United States Patent 7,691,997 (FUNCTIONAL AND HYPERFUNCTIONAL SIRNA) - sequence listing, part 20

SEQ ID NO: 796221 - RNA, 19 nt, Homo sapiens
agggaagagugaucuaugu

SEQ ID NO: 796222 - RNA, 19 nt, Homo sapiens
ccaguccuguccagcauca

SEQ ID NO: 796223 - RNA, 19 nt, Homo sapiens
gcugaacaaguaaagaaau

SEQ ID NO: 796224 - RNA, 19 nt, Homo sapiens
uugaaggcgucuacaacaa

SEQ ID NO: 796225 - RNA, 19 nt, Homo sapiens
caagacagaguccguaucg

SEQ ID NO: 796226 - RNA, 19 nt, Homo sapiens
caacuggaagaacugagaa

SEQ ID NO: 796227 - RNA, 19 nt, Homo sapiens
ggaucgccauggagaacga

SEQ ID NO: 796228 - RNA, 19 nt, Homo sapiens
agcagucuuucuucuuaua

SEQ ID NO: 796229 - RNA, 19 nt, Homo sapiens
uagcagucuuucuucuuau

SEQ ID NO: 796230 - RNA, 19 nt, Homo sapiens
gcauuuccuuacagcuguu

SEQ ID NO: 796231 - RNA, 19 nt, Homo sapiens
cuuccgaaauguugacuuc

SEQ ID NO: 796232 - RNA, 19 nt, Homo sapiens
gugaauaaauccaccagua

SEQ ID NO: 796233 - RNA, 19 nt, Homo sapiens
gaggauggcuggacaagga

SEQ ID NO: 796234 - RNA, 19 nt, Homo sapiens
gccaugaacucgaaaguga

SEQ ID NO: 796235 - RNA, 19 nt, Homo sapiens
ccaguuggcucgagagauu

SEQ ID NO: 796236 - RNA, 19 nt, Homo sapiens
gaaggcgucuacaacaauu

SEQ ID NO: 796237 - RNA, 19 nt, Homo sapiens
gaaaggagaaagagguuga

SEQ ID NO: 796238 - RNA, 19 nt, Homo sapiens
gaaagucccuggucuucag

SEQ ID NO: 796239 - RNA, 19 nt, Homo sapiens
gaggagaacuacgguguga

SEQ ID NO: 796240 - RNA, 19 nt, Homo sapiens
gggcuccacuugugaugua

SEQ ID NO: 796241 - RNA, 19 nt, Homo sapiens
gacggaagaucuuuuauuu

SEQ ID NO: 796242 - RNA, 19 nt, Homo sapiens
cgagguaaguucaaucuca

SEQ ID NO: 796243 - RNA, 19 nt, Homo sapiens
ccgacugucuccugacuua

SEQ ID NO: 796244 - RNA, 19 nt, Homo sapiens
gcaggcaccucagauguau

SEQ ID NO: 796245 - RNA, 19 nt, Homo sapiens
caccucagauguauccaua

SEQ ID NO: 796246 - RNA, 19 nt, Homo sapiens
caaagccucugcugucugu

SEQ ID NO: 796247 - RNA, 19 nt, Homo sapiens
uaaaagaacucucuaccaa

SEQ ID NO: 796248 - RNA, 19 nt, Homo sapiens
ggacaaggacuuuuacuuu

SEQ ID NO: 796249 - RNA, 19 nt, Homo sapiens
gaugacaggauucuaugua

SEQ ID NO: 796250 - RNA, 19 nt, Homo sapiens
auagcagucuuucuucuua

SEQ ID NO: 796251 - RNA, 19 nt, Homo sapiens
uaacuugagugaccugugu

SEQ ID NO: 796252 - RNA, 19 nt, Homo sapiens
aaagacaaguucaccgauu

SEQ ID NO: 796253 - RNA, 19 nt, Homo sapiens
ggaguucaauccuacaaag

SEQ ID NO: 796254 - RNA, 19 nt, Homo sapiens
gacaaggacuuuuacuuuu

SEQ ID NO: 796255 - RNA, 19 nt, Homo sapiens
gaacuacggugugaagacu

SEQ ID NO: 796256 - RNA, 19 nt, Homo sapiens
ucaagacgcuaagcucaaa

SEQ ID NO: 796257 - RNA, 19 nt, Homo sapiens
acuaugaccucgagucuga

SEQ ID NO: 796258 - RNA, 19 nt, Homo sapiens
agaacagccuggauccuuu

SEQ ID NO: 796259 - RNA, 19 nt, Homo sapiens
caacuaugcuacuaaagac

SEQ ID NO: 796260 - RNA, 19 nt, Homo sapiens
ggacagagcacaggaaagg

SEQ ID NO: 796261 - RNA, 19 nt, Homo sapiens
gcuccuggcucuguccuuu

SEQ ID NO: 796262 - RNA, 19 nt, Homo sapiens
gaaauguucaaguucaaug

SEQ ID NO: 796263 - RNA, 19 nt, Homo sapiens
guucaccgauucagccauu

SEQ ID NO: 796264 - RNA, 19 nt, Homo sapiens
cuacaacccucagcaguuc

SEQ ID NO: 796265 - RNA, 19 nt, Homo sapiens
caagggagaagacaaagau

SEQ ID NO: 796266 - RNA, 19 nt, Homo sapiens
ggagaaagagguugauggu

SEQ ID NO: 796267 - RNA, 19 nt, Homo sapiens
ccaaaggaaaggagaaaga

SEQ ID NO: 796268 - RNA, 19 nt, Homo sapiens
gagaacagccuggauccuu

SEQ ID NO: 796269 - RNA, 19 nt, Homo sapiens
ucccuggucuucagaauga

SEQ ID NO: 796270 - RNA, 19 nt, Homo sapiens
gugaagacuaccuaugaua

SEQ ID NO: 796271 - RNA, 19 nt, Homo sapiens
ucaacuaugcuacuaaaga

SEQ ID NO: 796272 - RNA, 19 nt, Homo sapiens
cggaagaucuuuuauuuuc

SEQ ID NO: 796273 - RNA, 19 nt, Homo sapiens
gagguaaguucaaucucau

SEQ ID NO: 796274 - RNA, 19 nt, Homo sapiens
caucaagggagaagacaaa

SEQ ID NO: 796275 - RNA, 19 nt, Homo sapiens
agaaugaacagaaacgauu

SEQ ID NO: 796276 - RNA, 19 nt, Homo sapiens
gcaacagcgacgacuauga

SEQ ID NO: 796277 - RNA, 19 nt, Homo sapiens
cuucaacuaugcuacuaaa

SEQ ID NO: 796278 - RNA, 19 nt, Homo sapiens
guucuuucuuucccauuaa

SEQ ID NO: 796279 - RNA, 19 nt, Homo sapiens
gcacugaagaggagaagca

SEQ ID NO: 796280 - RNA, 19 nt, Homo sapiens
uaugauagcagucuuucuu

SEQ ID NO: 796281 - RNA, 19 nt, Homo sapiens
uaagccaagugaugucaug

SEQ ID NO: 796282 - RNA, 19 nt, Homo sapiens
ccucagauguauccauauc

SEQ ID NO: 796283 - RNA, 19 nt, Homo sapiens
ccucugcugucugugaaua

SEQ ID NO: 796284 - RNA, 19 nt, Homo sapiens
caaggaaccugggagaacu

SEQ ID NO: 796285 - RNA, 19 nt, Homo sapiens
ggacgcugccaucauguug

SEQ ID NO: 796286 - RNA, 19 nt, Homo sapiens
gugugaagacuaccuauga

SEQ ID NO: 796287 - RNA, 19 nt, Homo sapiens
gccaagugaugucaugcuu

SEQ ID NO: 796288 - RNA, 19 nt, Homo sapiens
caguacaucuccuacauac

SEQ ID NO: 796289 - RNA, 19 nt, Homo sapiens
ccaguacaucuccuacaua

SEQ ID NO: 796290 - RNA, 19 nt, Homo sapiens
ugagggcccuguugcugaa

SEQ ID NO: 796291 - RNA, 19 nt, Homo sapiens
gauagcagucuuucuucuu

SEQ ID NO: 796292 - RNA, 19 nt, Homo sapiens
gacgcuaagcucaaaguuu

SEQ ID NO: 796293 - RNA, 19 nt, Homo sapiens
agagguugauggucuguug

SEQ ID NO: 796294 - RNA, 19 nt, Homo sapiens
ggagaacuacggugugaag

SEQ ID NO: 796295 - RNA, 19 nt, Homo sapiens
ccauugccaugaacucgaa

SEQ ID NO: 796296 - RNA, 19 nt, Homo sapiens
cuuguucacuuccgaaaug

SEQ ID NO: 796297 - RNA, 19 nt, Homo sapiens
ggagacggaagaucuuuua

SEQ ID NO: 796298 - RNA, 19 nt, Homo sapiens
gagggaagagugaucuaug

SEQ ID NO: 796299 - RNA, 19 nt, Homo sapiens
cauauccuguauccaauuc

SEQ ID NO: 796300 - RNA, 19 nt, Homo sapiens
agaacucucuaccaaggaa

SEQ ID NO: 796301 - RNA, 19 nt, Homo sapiens
ggacagccacagcagaauc

SEQ ID NO: 796302 - RNA, 19 nt, Homo sapiens
guacaucuccuacauaccu

SEQ ID NO: 796303 - RNA, 19 nt, Homo sapiens
ucggauagcugggaaaguc

SEQ ID NO: 796304 - RNA, 19 nt, Homo sapiens
cguccucgcucaguuguga

SEQ ID NO: 796305 - RNA, 19 nt, Homo sapiens
ccugugaccucaucagucu

SEQ ID NO: 796306 - RNA, 19 nt, Homo sapiens
cuuauacggugcccuuaga

SEQ ID NO: 796307 - RNA, 19 nt, Homo sapiens
aagacaaguucaccgauuc

SEQ ID NO: 796308 - RNA, 19 nt, Homo sapiens
gacuucaacuaugcuacua

SEQ ID NO: 796309 - RNA, 19 nt, Homo sapiens
uguucuuucuuucccauua

SEQ ID NO: 796310 - RNA, 19 nt, Homo sapiens
cccauccucucaucuauuc

SEQ ID NO: 796311 - RNA, 19 nt, Homo sapiens
gcccuauucuuccuacauc

SEQ ID NO: 796312 - RNA, 19 nt, Homo sapiens
uaaaggaggagcccaaagg

SEQ ID NO: 796313 - RNA, 19 nt, Homo sapiens
caacagcgacgacuaugac

SEQ ID NO: 796314 - RNA, 19 nt, Homo sapiens
cagcaacagcgacgacuau

SEQ ID NO: 796315 - RNA, 19 nt, Homo sapiens
ggaagagugaucuaugucu

SEQ ID NO: 796316 - RNA, 19 nt, Homo sapiens
ggagggaagagugaucuau

SEQ ID NO: 796317 - RNA, 19 nt, Homo sapiens
gauguauccauauccugua

SEQ ID NO: 796318 - RNA, 19 nt, Homo sapiens
uugauggucuguugacuuc

SEQ ID NO: 796319 - RNA, 19 nt, Homo sapiens
aggaggagcccaaaggaaa

SEQ ID NO: 796320 - RNA, 19 nt, Homo sapiens
ggaaagucccuggucuuca

SEQ ID NO: 796321 - RNA, 19 nt, Homo sapiens
guauaucccucugccucaa

SEQ ID NO: 796322 - RNA, 19 nt, Homo sapiens
cguugaacccuaaugcuaa

SEQ ID NO: 796323 - RNA, 19 nt, Homo sapiens
cugaacaaguaaagaaauc

SEQ ID NO: 796324 - RNA, 19 nt, Homo sapiens
ugucaugcuuguucacuuc

SEQ ID NO: 796325 - RNA, 19 nt, Homo sapiens
gggcccaguuuaagcuuca

SEQ ID NO: 796326 - RNA, 19 nt, Homo sapiens
agucugacauguccaaugg

SEQ ID NO: 796327 - RNA, 19 nt, Homo sapiens
agggaagagugaucuaugu

SEQ ID NO: 796328 - RNA, 19 nt, Homo sapiens
ccaguccuguccagcauca

SEQ ID NO: 796329 - RNA, 19 nt, Homo sapiens
gcugaacaaguaaagaaau

SEQ ID NO: 796330 - RNA, 19 nt, Homo sapiens
caagacagaguccguaucg

SEQ ID NO: 796331 - RNA, 19 nt, Homo sapiens
caacuggaagaacugagaa

SEQ ID NO: 796332 - RNA, 19 nt, Homo sapiens
gugaauaaauccaccagua

SEQ ID NO: 796333 - RNA, 19 nt, Homo sapiens
gaggauggcuggacaagga

SEQ ID NO: 796334 - RNA, 19 nt, Homo sapiens
gccaugaacucgaaaguga

SEQ ID NO: 796335 - RNA, 19 nt, Homo sapiens
ccaguuggcucgagagauu

SEQ ID NO: 796336 - RNA, 19 nt, Homo sapiens
gaaggcgucuacaacaauu

SEQ ID NO: 796337 - RNA, 19 nt, Homo sapiens
gaaaggagaaagagguuga

SEQ ID NO: 796338 - RNA, 19 nt, Homo sapiens
gaaagucccuggucuucag

SEQ ID NO: 796339 - RNA, 19 nt, Homo sapiens
gaggagaacuacgguguga

SEQ ID NO: 796340 - RNA, 19 nt, Homo sapiens
gggcuccacuugugaugua

SEQ ID NO: 796341 - RNA, 19 nt, Homo sapiens
gacggaagaucuuuuauuu

SEQ ID NO: 796342 - RNA, 19 nt, Homo sapiens
gcaggcaccucagauguau

SEQ ID NO: 796343 - RNA, 19 nt, Homo sapiens
caccucagauguauccaua

SEQ ID NO: 796344 - RNA, 19 nt, Homo sapiens
caaagccucugcugucugu

SEQ ID NO: 796345 - RNA, 19 nt, Homo sapiens
uaaaagaacucucuaccaa

SEQ ID NO: 796346 - RNA, 19 nt, Homo sapiens
ggacaaggacuuuuacuuu

SEQ ID NO: 796347 - RNA, 19 nt, Homo sapiens
auagcagucuuucuucuua

SEQ ID NO: 796348 - RNA, 19 nt, Homo sapiens
uaacuugagugaccugugu

SEQ ID NO: 796349 - RNA, 19 nt, Homo sapiens
aaagacaaguucaccgauu

SEQ ID NO: 796350 - RNA, 19 nt, Homo sapiens
ggaguucaauccuacaaag

SEQ ID NO: 796351 - RNA, 19 nt, Homo sapiens
gacaaggacuuuuacuuuu

SEQ ID NO: 796352 - RNA, 19 nt, Homo sapiens
gaacuacggugugaagacu

SEQ ID NO: 796353 - RNA, 19 nt, Homo sapiens
ucaagacgcuaagcucaaa

SEQ ID NO: 796354 - RNA, 19 nt, Homo sapiens
acuaugaccucgagucuga

SEQ ID NO: 796355 - RNA, 19 nt, Homo sapiens
agaacagccuggauccuuu

SEQ ID NO: 796356 - RNA, 19 nt, Homo sapiens
caacuaugcuacuaaagac

SEQ ID NO: 796357 - RNA, 19 nt, Homo sapiens
ggacagagcacaggaaagg

SEQ ID NO: 796358 - RNA, 19 nt, Homo sapiens
gaaauguucaaguucaaug

SEQ ID NO: 796359 - RNA, 19 nt, Homo sapiens
guucaccgauucagccauu

SEQ ID NO: 796360 - RNA, 19 nt, Homo sapiens
cuacaacccucagcaguuc

SEQ ID NO: 796361 - RNA, 19 nt, Homo sapiens
caagggagaagacaaagau

SEQ ID NO: 796362 - RNA, 19 nt, Homo sapiens
ggagaaagagguugauggu

SEQ ID NO: 796363 - RNA, 19 nt, Homo sapiens
ccaaaggaaaggagaaaga

SEQ ID NO: 796364 - RNA, 19 nt, Homo sapiens
gagaacagccuggauccuu

SEQ ID NO: 796365 - RNA, 19 nt, Homo sapiens
ucccuggucuucagaauga

SEQ ID NO: 796366 - RNA, 19 nt, Homo sapiens
gugaagacuaccuaugaua

SEQ ID NO: 796367 - RNA, 19 nt, Homo sapiens
ucaacuaugcuacuaaaga

SEQ ID NO: 796368 - RNA, 19 nt, Homo sapiens
cggaagaucuuuuauuuuc

SEQ ID NO: 796369 - RNA, 19 nt, Homo sapiens
caucaagggagaagacaaa

SEQ ID NO: 796370 - RNA, 19 nt, Homo sapiens
agaaugaacagaaacgauu

SEQ ID NO: 796371 - RNA, 19 nt, Homo sapiens
gcaacagcgacgacuauga

SEQ ID NO: 796372 - RNA, 19 nt, Homo sapiens
cuucaacuaugcuacuaaa

SEQ ID NO: 796373 - RNA, 19 nt, Homo sapiens
guucuuucuuucccauuaa

SEQ ID NO: 796374 - RNA, 19 nt, Homo sapiens
gcacugaagaggagaagca

SEQ ID NO: 796375 - RNA, 19 nt, Homo sapiens
uaugauagcagucuuucuu

SEQ ID NO: 796376 - RNA, 19 nt, Homo sapiens
uaagccaagugaugucaug

SEQ ID NO: 796377 - RNA, 19 nt, Homo sapiens
ccucagauguauccauauc

SEQ ID NO: 796378 - RNA, 19 nt, Homo sapiens
ccucugcugucugugaaua

SEQ ID NO: 796379 - RNA, 19 nt, Homo sapiens
caaggaaccugggagaacu

SEQ ID NO: 796380 - RNA, 19 nt, Homo sapiens
ggacgcugccaucauguug

SEQ ID NO: 796381 - RNA, 19 nt, Homo sapiens
gugugaagacuaccuauga

SEQ ID NO: 796382 - RNA, 19 nt, Homo sapiens
gccaagugaugucaugcuu

SEQ ID NO: 796383 - RNA, 19 nt, Homo sapiens
caguacaucuccuacauac

SEQ ID NO: 796384 - RNA, 19 nt, Homo sapiens
ccaguacaucuccuacaua

SEQ ID NO: 796385 - RNA, 19 nt, Homo sapiens
ugagggcccuguugcugaa

SEQ ID NO: 796386 - RNA, 19 nt, Homo sapiens
gauagcagucuuucuucuu

SEQ ID NO: 796387 - RNA, 19 nt, Homo sapiens
gacgcuaagcucaaaguuu

SEQ ID NO: 796388 - RNA, 19 nt, Homo sapiens
agagguugauggucuguug

SEQ ID NO: 796389 - RNA, 19 nt, Homo sapiens
ggagaacuacggugugaag

SEQ ID NO: 796390 - RNA, 19 nt, Homo sapiens
ccauugccaugaacucgaa

SEQ ID NO: 796391 - RNA, 19 nt, Homo sapiens
cuuguucacuuccgaaaug

SEQ ID NO: 796392 - RNA, 19 nt, Homo sapiens
ggagacggaagaucuuuua

SEQ ID NO: 796393 - RNA, 19 nt, Homo sapiens
gagggaagagugaucuaug

SEQ ID NO: 796394 - RNA, 19 nt, Homo sapiens
cauauccuguauccaauuc

SEQ ID NO: 796395 - RNA, 19 nt, Homo sapiens
agaacucucuaccaaggaa

SEQ ID NO: 796396 - RNA, 19 nt, Homo sapiens
ggacagccacagcagaauc

SEQ ID NO: 796397 - RNA, 19 nt, Homo sapiens
guacaucuccuacauaccu

SEQ ID NO: 796398 - RNA, 19 nt, Homo sapiens
ucggauagcugggaaaguc

SEQ ID NO: 796399 - RNA, 19 nt, Homo sapiens
ccugugaccucaucagucu

SEQ ID NO: 796400 - RNA, 19 nt, Homo sapiens
cuuauacggugcccuuaga

SEQ ID NO: 796401 - RNA, 19 nt, Homo sapiens
aagacaaguucaccgauuc

SEQ ID NO: 796402 - RNA, 19 nt, Homo sapiens
gacuucaacuaugcuacua

SEQ ID NO: 796403 - RNA, 19 nt, Homo sapiens
uguucuuucuuucccauua

SEQ ID NO: 796404 - RNA, 19 nt, Homo sapiens
cccauccucucaucuauuc

SEQ ID NO: 796405 - RNA, 19 nt, Homo sapiens
gcccuauucuuccuacauc

SEQ ID NO: 796406 - RNA, 19 nt, Homo sapiens
uaaaggaggagcccaaagg

SEQ ID NO: 796407 - RNA, 19 nt, Homo sapiens
caacagcgacgacuaugac

SEQ ID NO: 796408 - RNA, 19 nt, Homo sapiens
cagcaacagcgacgacuau

SEQ ID NO: 796409 - RNA, 19 nt, Homo sapiens
ggaagagugaucuaugucu

SEQ ID NO: 796410 - RNA, 19 nt, Homo sapiens
ggagggaagagugaucuau

SEQ ID NO: 796411 - RNA, 19 nt, Homo sapiens
gauguauccauauccugua

SEQ ID NO: 796412 - RNA, 19 nt, Homo sapiens
uugauggucuguugacuuc

SEQ ID NO: 796413 - RNA, 19 nt, Homo sapiens
aggaggagcccaaaggaaa

SEQ ID NO: 796414 - RNA, 19 nt, Homo sapiens
ggaaagucccuggucuuca

SEQ ID NO: 796415 - RNA, 19 nt, Homo sapiens
guauaucccucugccucaa

SEQ ID NO: 796416 - RNA, 19 nt, Homo sapiens
cguugaacccuaaugcuaa

SEQ ID NO: 796417 - RNA, 19 nt, Homo sapiens
cugaacaaguaaagaaauc

SEQ ID NO: 796418 - RNA, 19 nt, Homo sapiens
ugucaugcuuguucacuuc

SEQ ID NO: 796419 - RNA, 19 nt, Homo sapiens
gggcccaguuuaagcuuca

SEQ ID NO: 796420 - RNA, 19 nt, Homo sapiens
agucugacauguccaaugg

SEQ ID NO: 796421 - RNA, 19 nt, Homo sapiens
agggaagagugaucuaugu

SEQ ID NO: 796422 - RNA, 19 nt, Homo sapiens
ccaguccuguccagcauca

SEQ ID NO: 796423 - RNA, 19 nt, Homo sapiens
gcugaacaaguaaagaaau

SEQ ID NO: 796424 - RNA, 19 nt, Homo sapiens
uugaaggcgucuacaacaa

SEQ ID NO: 796425 - RNA, 19 nt, Homo sapiens
caagacagaguccguaucg

SEQ ID NO: 796426 - RNA, 19 nt, Homo sapiens
caacuggaagaacugagaa

SEQ ID NO: 796427 - RNA, 19 nt, Homo sapiens
ggaucgccauggagaacga

SEQ ID NO: 796428 - RNA, 19 nt, Homo sapiens
agcagucuuucuucuuaua

SEQ ID NO: 796429 - RNA, 19 nt, Homo sapiens
uagcagucuuucuucuuau

SEQ ID NO: 796430 - RNA, 19 nt, Homo sapiens
gcauuuccuuacagcuguu

SEQ ID NO: 796431 - RNA, 19 nt, Homo sapiens
cuuccgaaauguugacuuc

SEQ ID NO: 796432 - RNA, 19 nt, Homo sapiens
gugaauaaauccaccagua

SEQ ID NO: 796433 - RNA, 19 nt, Homo sapiens
gaggauggcuggacaagga

SEQ ID NO: 796434 - RNA, 19 nt, Homo sapiens
gccaugaacucgaaaguga

SEQ ID NO: 796435 - RNA, 19 nt, Homo sapiens
ccaguuggcucgagagauu

SEQ ID NO: 796436 - RNA, 19 nt, Homo sapiens
gaaggcgucuacaacaauu

SEQ ID NO: 796437 - RNA, 19 nt, Homo sapiens
gaaaggagaaagagguuga

SEQ ID NO: 796438 - RNA, 19 nt, Homo sapiens
gaaagucccuggucuucag

SEQ ID NO: 796439 - RNA, 19 nt, Homo sapiens
gaggagaacuacgguguga

SEQ ID NO: 796440 - RNA, 19 nt, Homo sapiens
gggcuccacuugugaugua

SEQ ID NO: 796441 - RNA, 19 nt, Homo sapiens
gacggaagaucuuuuauuu

SEQ ID NO: 796442 - RNA, 19 nt, Homo sapiens
gcaggcaccucagauguau

SEQ ID NO: 796443 - RNA, 19 nt, Homo sapiens
caccucagauguauccaua

SEQ ID NO: 796444 - RNA, 19 nt, Homo sapiens
caaagccucugcugucugu

SEQ ID NO: 796445 - RNA, 19 nt, Homo sapiens
uaaaagaacucucuaccaa

SEQ ID NO: 796446 - RNA, 19 nt, Homo sapiens
ggacaaggacuuuuacuuu

SEQ ID NO: 796447 - RNA, 19 nt, Homo sapiens
auagcagucuuucuucuua

SEQ ID NO: 796448 - RNA, 19 nt, Homo sapiens
uaacuugagugaccugugu

SEQ ID NO: 796449 - RNA, 19 nt, Homo sapiens
aaagacaaguucaccgauu

SEQ ID NO: 796450 - RNA, 19 nt, Homo sapiens
ggaguucaauccuacaaag

SEQ ID NO: 796451 - RNA, 19 nt, Homo sapiens
gacaaggacuuuuacuuuu

SEQ ID NO: 796452 - RNA, 19 nt, Homo sapiens
gaacuacggugugaagacu

SEQ ID NO: 796453 - RNA, 19 nt, Homo sapiens
ucaagacgcuaagcucaaa

SEQ ID NO: 796454 - RNA, 19 nt, Homo sapiens
acuaugaccucgagucuga

SEQ ID NO: 796455 - RNA, 19 nt, Homo sapiens
agaacagccuggauccuuu

SEQ ID NO: 796456 - RNA, 19 nt, Homo sapiens
caacuaugcuacuaaagac

SEQ ID NO: 796457 - RNA, 19 nt, Homo sapiens
ggacagagcacaggaaagg

SEQ ID NO: 796458 - RNA, 19 nt, Homo sapiens
gaaauguucaaguucaaug

SEQ ID NO: 796459 - RNA, 19 nt, Homo sapiens
guucaccgauucagccauu

SEQ ID NO: 796460 - RNA, 19 nt, Homo sapiens
cuacaacccucagcaguuc

SEQ ID NO: 796461 - RNA, 19 nt, Homo sapiens
caagggagaagacaaagau

SEQ ID NO: 796462 - RNA, 19 nt, Homo sapiens
ggagaaagagguugauggu

SEQ ID NO: 796463 - RNA, 19 nt, Homo sapiens
ccaaaggaaaggagaaaga

SEQ ID NO: 796464 - RNA, 19 nt, Homo sapiens
gagaacagccuggauccuu

SEQ ID NO: 796465 - RNA, 19 nt, Homo sapiens
ucccuggucuucagaauga

SEQ ID NO: 796466 - RNA, 19 nt, Homo sapiens
gugaagacuaccuaugaua

SEQ ID NO: 796467 - RNA, 19 nt, Homo sapiens
ucaacuaugcuacuaaaga

SEQ ID NO: 796468 - RNA, 19 nt, Homo sapiens
cggaagaucuuuuauuuuc

SEQ ID NO: 796469 - RNA, 19 nt, Homo sapiens
caucaagggagaagacaaa

SEQ ID NO: 796470 - RNA, 19 nt, Homo sapiens
agaaugaacagaaacgauu

SEQ ID NO: 796471 - RNA, 19 nt, Homo sapiens
gcaacagcgacgacuauga

SEQ ID NO: 796472 - RNA, 19 nt, Homo sapiens
cuucaacuaugcuacuaaa

SEQ ID NO: 796473 - RNA, 19 nt, Homo sapiens
guucuuucuuucccauuaa

SEQ ID NO: 796474 - RNA, 19 nt, Homo sapiens
gcacugaagaggagaagca

SEQ ID NO: 796475 - RNA, 19 nt, Homo sapiens
uaugauagcagucuuucuu

SEQ ID NO: 796476 - RNA, 19 nt, Homo sapiens
uaagccaagugaugucaug

SEQ ID NO: 796477 - RNA, 19 nt, Homo sapiens
ccucagauguauccauauc

SEQ ID NO: 796478 - RNA, 19 nt, Homo sapiens
ccucugcugucugugaaua

SEQ ID NO: 796479 - RNA, 19 nt, Homo sapiens
caaggaaccugggagaacu

SEQ ID NO: 796480 - RNA, 19 nt, Homo sapiens
ggacgcugccaucauguug

SEQ ID NO: 796481 - RNA, 19 nt, Homo sapiens
gugugaagacuaccuauga

SEQ ID NO: 796482 - RNA, 19 nt, Homo sapiens
gccaagugaugucaugcuu

SEQ ID NO: 796483 - RNA, 19 nt, Homo sapiens
caguacaucuccuacauac

SEQ ID NO: 796484 - RNA, 19 nt, Homo sapiens
ccaguacaucuccuacaua

SEQ ID NO: 796485 - RNA, 19 nt, Homo sapiens
ugagggcccuguugcugaa

SEQ ID NO: 796486 - RNA, 19 nt, Homo sapiens
gauagcagucuuucuucuu

SEQ ID NO: 796487 - RNA, 19 nt, Homo sapiens
gacgcuaagcucaaaguuu

SEQ ID NO: 796488 - RNA, 19 nt, Homo sapiens
agagguugauggucuguug

SEQ ID NO: 796489 - RNA, 19 nt, Homo sapiens
ggagaacuacggugugaag

SEQ ID NO: 796490 - RNA, 19 nt, Homo sapiens
ccauugccaugaacucgaa

SEQ ID NO: 796491 - RNA, 19 nt, Homo sapiens
cuuguucacuuccgaaaug

SEQ ID NO: 796492 - RNA, 19 nt, Homo sapiens
ggagacggaagaucuuuua

SEQ ID NO: 796493 - RNA, 19 nt, Homo sapiens
gagggaagagugaucuaug

SEQ ID NO: 796494 - RNA, 19 nt, Homo sapiens
cauauccuguauccaauuc

SEQ ID NO: 796495 - RNA, 19 nt, Homo sapiens
agaacucucuaccaaggaa

SEQ ID NO: 796496 - RNA, 19 nt, Homo sapiens
ggacagccacagcagaauc

SEQ ID NO: 796497 - RNA, 19 nt, Homo sapiens
guacaucuccuacauaccu

SEQ ID NO: 796498 - RNA, 19 nt, Homo sapiens
ucggauagcugggaaaguc

SEQ ID NO: 796499 - RNA, 19 nt, Homo sapiens
ccugugaccucaucagucu

SEQ ID NO: 796500 - RNA, 19 nt, Homo sapiens
cuuauacggugcccuuaga

SEQ ID NO: 796501 - RNA, 19 nt, Homo sapiens
aagacaaguucaccgauuc

SEQ ID NO: 796502 - RNA, 19 nt, Homo sapiens
gacuucaacuaugcuacua

SEQ ID NO: 796503 - RNA, 19 nt, Homo sapiens
uguucuuucuuucccauua

SEQ ID NO: 796504 - RNA, 19 nt, Homo sapiens
cccauccucucaucuauuc

SEQ ID NO: 796505 - RNA, 19 nt, Homo sapiens
gcccuauucuuccuacauc

SEQ ID NO: 796506 - RNA, 19 nt, Homo sapiens
uaaaggaggagcccaaagg

SEQ ID NO: 796507 - RNA, 19 nt, Homo sapiens
caacagcgacgacuaugac

SEQ ID NO: 796508 - RNA, 19 nt, Homo sapiens
cagcaacagcgacgacuau

SEQ ID NO: 796509 - RNA, 19 nt, Homo sapiens
ggaagagugaucuaugucu

SEQ ID NO: 796510 - RNA, 19 nt, Homo sapiens
ggagggaagagugaucuau

SEQ ID NO: 796511 - RNA, 19 nt, Homo sapiens
gauguauccauauccugua

SEQ ID NO: 796512 - RNA, 19 nt, Homo sapiens
uugauggucuguugacuuc

SEQ ID NO: 796513 - RNA, 19 nt, Homo sapiens
aggaggagcccaaaggaaa

SEQ ID NO: 796514 - RNA, 19 nt, Homo sapiens
ggaaagucccuggucuuca

SEQ ID NO: 796515 - RNA, 19 nt, Homo sapiens
guauaucccucugccucaa

SEQ ID NO: 796516 - RNA, 19 nt, Homo sapiens
cguugaacccuaaugcuaa

SEQ ID NO: 796517 - RNA, 19 nt, Homo sapiens
cugaacaaguaaagaaauc

SEQ ID NO: 796518 - RNA, 19 nt, Homo sapiens
ugucaugcuuguucacuuc

SEQ ID NO: 796519 - RNA, 19 nt, Homo sapiens
gggcccaguuuaagcuuca

SEQ ID NO: 796520 - RNA, 19 nt, Homo sapiens
agucugacauguccaaugg

SEQ ID NO: 796521 - RNA, 19 nt, Homo sapiens
agggaagagugaucuaugu

SEQ ID NO: 796522 - RNA, 19 nt, Homo sapiens
ccaguccuguccagcauca

SEQ ID NO: 796523 - RNA, 19 nt, Homo sapiens
gcugaacaaguaaagaaau

SEQ ID NO: 796524 - RNA, 19 nt, Homo sapiens
uugaaggcgucuacaacaa

SEQ ID NO: 796525 - RNA, 19 nt, Homo sapiens
caagacagaguccguaucg

SEQ ID NO: 796526 - RNA, 19 nt, Homo sapiens
caacuggaagaacugagaa

SEQ ID NO: 796527 - RNA, 19 nt, Homo sapiens
ggaucgccauggagaacga

SEQ ID NO: 796528 - RNA, 19 nt, Homo sapiens
agcagucuuucuucuuaua

SEQ ID NO: 796529 - RNA, 19 nt, Homo sapiens
uagcagucuuucuucuuau

SEQ ID NO: 796530 - RNA, 19 nt, Homo sapiens
gcauuuccuuacagcuguu

SEQ ID NO: 796531 - RNA, 19 nt, Homo sapiens
cuuccgaaauguugacuuc

SEQ ID NO: 796532 - RNA, 19 nt, Homo sapiens
ggacagaccugcugccuua

SEQ ID NO: 796533 - RNA, 19 nt, Homo sapiens
gagcaucucuucuccauaa

SEQ ID NO: 796534 - RNA, 19 nt, Homo sapiens
gacauuagcccuuuaguua

SEQ ID NO: 796535 - RNA, 19 nt, Homo sapiens
uaaacacggucaugaauaa

SEQ ID NO: 796536 - RNA, 19 nt, Homo sapiens
cugcauaucuucugguuua

SEQ ID NO: 796537 - RNA, 19 nt, Homo sapiens
gcauggcgcuugagagauu

SEQ ID NO: 796538 - RNA, 19 nt, Homo sapiens
gaagaagacagcaacauga

SEQ ID NO: 796539 - RNA, 19 nt, Homo sapiens
gcaagacauuagcccuuua

SEQ ID NO: 796540 - RNA, 19 nt, Homo sapiens
gaaccaacauuaauuccau

SEQ ID NO: 796541 - RNA, 19 nt, Homo sapiens
ggaaacaggucuugaagcu

SEQ ID NO: 796542 - RNA, 19 nt, Homo sapiens
gaagaagacccgugggaaa

SEQ ID NO: 796543 - RNA, 19 nt, Homo sapiens
ccauaugaaucaaguguuu

SEQ ID NO: 796544 - RNA, 19 nt, Homo sapiens
gaagacagcaacaugaaga

SEQ ID NO: 796545 - RNA, 19 nt, Homo sapiens
ggaauucacagacgagaaa

SEQ ID NO: 796546 - RNA, 19 nt, Homo sapiens
ggaagaagacagcaacaug

SEQ ID NO: 796547 - RNA, 19 nt, Homo sapiens
gaucuacggagucuucuaa

SEQ ID NO: 796548 - RNA, 19 nt, Homo sapiens
ucuugaagcugacccauuu

SEQ ID NO: 796549 - RNA, 19 nt, Homo sapiens
gaagauggagugcuaaugg

SEQ ID NO: 796550 - RNA, 19 nt, Homo sapiens
gggaagacauccaguguac

SEQ ID NO: 796551 - RNA, 19 nt, Homo sapiens
uccauaagauagugugaua

SEQ ID NO: 796552 - RNA, 19 nt, Homo sapiens
gauaaacacggucaugaau

SEQ ID NO: 796553 - RNA, 19 nt, Homo sapiens
cauuagcccuuuaguuaug

SEQ ID NO: 796554 - RNA, 19 nt, Homo sapiens
ggacuucaccaggauauug

SEQ ID NO: 796555 - RNA, 19 nt, Homo sapiens
acaugaagauggagugcua

SEQ ID NO: 796556 - RNA, 19 nt, Homo sapiens
cuacggaaauccuaacuac

SEQ ID NO: 796557 - RNA, 19 nt, Homo sapiens
ucuggaaccugauuaagga

SEQ ID NO: 796558 - RNA, 19 nt, Homo sapiens
ugaccagacuuguauacug

SEQ ID NO: 796559 - RNA, 19 nt, Homo sapiens
gagaagcauuguuuucaaa

SEQ ID NO: 796560 - RNA, 19 nt, Homo sapiens
ucaaugacuccaauauuug

SEQ ID NO: 796561 - RNA, 19 nt, Homo sapiens
caaugaagcgagagucuug

SEQ ID NO: 796562 - RNA, 19 nt, Homo sapiens
ugccuuaacuccuugauuc

SEQ ID NO: 796563 - RNA, 19 nt, Homo sapiens
ggagggcaguaugagcuuu

SEQ ID NO: 796564 - RNA, 19 nt, Homo sapiens
gcaacgugcccuuguuugu

SEQ ID NO: 796565 - RNA, 19 nt, Homo sapiens
caacugcugugaccagacu

SEQ ID NO: 796566 - RNA, 19 nt, Homo sapiens
gccagauccuuccaaugaa

SEQ ID NO: 796567 - RNA, 19 nt, Homo sapiens
ccagggaguuaucaagcaa

SEQ ID NO: 796568 - RNA, 19 nt, Homo sapiens
ucacugaugugcacuuggu

SEQ ID NO: 796569 - RNA, 19 nt, Homo sapiens
uuaaggaccagaucacuga

SEQ ID NO: 796570 - RNA, 19 nt, Homo sapiens
gcugugaccagacuuguau

SEQ ID NO: 796571 - RNA, 19 nt, Homo sapiens
ggaaaauggucuugcuuca

SEQ ID NO: 796572 - RNA, 19 nt, Homo sapiens
ggugcucgcugcugugcaa

SEQ ID NO: 796573 - RNA, 19 nt, Homo sapiens
ggagaagcauuguuuucaa

SEQ ID NO: 796574 - RNA, 19 nt, Homo sapiens
agagagagcagcccagaga

SEQ ID NO: 796575 - RNA, 19 nt, Homo sapiens
auaaacacggucaugaaua

SEQ ID NO: 796576 - RNA, 19 nt, Homo sapiens
agacuccggucauuacugu

SEQ ID NO: 796577 - RNA, 19 nt, Homo sapiens
agccagauccuuccaauga

SEQ ID NO: 796578 - RNA, 19 nt, Homo sapiens
ugugagaacugugggaaga

SEQ ID NO: 796579 - RNA, 19 nt, Homo sapiens
acagcaacaugaagagaga

SEQ ID NO: 796580 - RNA, 19 nt, Homo sapiens
gauggagugcuaauggaaa

SEQ ID NO: 796581 - RNA, 19 nt, Homo sapiens
ggaaacugcauaucuucug

SEQ ID NO: 796582 - RNA, 19 nt, Homo sapiens
ucuaagagauuuugcaaug

SEQ ID NO: 796583 - RNA, 19 nt, Homo sapiens
aaaauggucuugcuucaau

SEQ ID NO: 796584 - RNA, 19 nt, Homo sapiens
ugauaaacacggucaugaa

SEQ ID NO: 796585 - RNA, 19 nt, Homo sapiens
ugagaaccaacauuaauuc

SEQ ID NO: 796586 - RNA, 19 nt, Homo sapiens
cccaaaaccuucagagauu

SEQ ID NO: 796587 - RNA, 19 nt, Homo sapiens
gaagcgagagucuugugau

SEQ ID NO: 796588 - RNA, 19 nt, Homo sapiens
ugcaagacauuagcccuuu

SEQ ID NO: 796589 - RNA, 19 nt, Homo sapiens
gaagacauccaguguaccu

SEQ ID NO: 796590 - RNA, 19 nt, Homo sapiens
gcgagagucuugugaugcu

SEQ ID NO: 796591 - RNA, 19 nt, Homo sapiens
caacuguaccucaaacucu

SEQ ID NO: 796592 - RNA, 19 nt, Homo sapiens
cguaaugaauguggacuuc

SEQ ID NO: 796593 - RNA, 19 nt, Homo sapiens
ugauucagguguucguaau

SEQ ID NO: 796594 - RNA, 19 nt, Homo sapiens
caucgugccuggcucacau

SEQ ID NO: 796595 - RNA, 19 nt, Homo sapiens
caaaauauguaaccaugag

SEQ ID NO: 796596 - RNA, 19 nt, Homo sapiens
guaccuacggaaauccuaa

SEQ ID NO: 796597 - RNA, 19 nt, Homo sapiens
ggucauuacugugucuaca

SEQ ID NO: 796598 - RNA, 19 nt, Homo sapiens
uuggagugaucacgaauga

SEQ ID NO: 796599 - RNA, 19 nt, Homo sapiens
acacggucaugaauaaagu

SEQ ID NO: 796600 - RNA, 19 nt, Homo sapiens
gcucagucccgacguggaa

SEQ ID NO: 796601 - RNA, 19 nt, Homo sapiens
gaagucgugcuguccugaa

SEQ ID NO: 796602 - RNA, 19 nt, Homo sapiens
cauaucuucugguuuacau

SEQ ID NO: 796603 - RNA, 19 nt, Homo sapiens
aagcgagagucuugugaug

SEQ ID NO: 796604 - RNA, 19 nt, Homo sapiens
gugcaacgugcccuuguuu

SEQ ID NO: 796605 - RNA, 19 nt, Homo sapiens
gugauaaacacggucauga

SEQ ID NO: 796606 - RNA, 19 nt, Homo sapiens
agacauuagcccuuuaguu

SEQ ID NO: 796607 - RNA, 19 nt, Homo sapiens
cucauggccugguugguuu

SEQ ID NO: 796608 - RNA, 19 nt, Homo sapiens
gaagacccgugggaaacag

SEQ ID NO: 796609 - RNA, 19 nt, Homo sapiens
acuuugagaaccaacauua

SEQ ID NO: 796610 - RNA, 19 nt, Homo sapiens
cgaaugagcaaggcguuug

SEQ ID NO: 796611 - RNA, 19 nt, Homo sapiens
ucaccaggauauugaagag

SEQ ID NO: 796612 - RNA, 19 nt, Homo sapiens
aagauggagugcuaaugga

SEQ ID NO: 796613 - RNA, 19 nt, Homo sapiens
ucauuacugugucuacauc

SEQ ID NO: 796614 - RNA, 19 nt, Homo sapiens
aagaagacagcaacaugaa

SEQ ID NO: 796615 - RNA, 19 nt, Homo sapiens
ucagccagauccuuccaau

SEQ ID NO: 796616 - RNA, 19 nt, Homo sapiens
ucacagacgagaaagaucu

SEQ ID NO: 796617 - RNA, 19 nt, Homo sapiens
aaacucuggaaccugauua

SEQ ID NO: 796618 - RNA, 19 nt, Homo sapiens
uaucuucugguuuacauga

SEQ ID NO: 796619 - RNA, 19 nt, Homo sapiens
gugccuggcucacauaagc

SEQ ID NO: 796620 - RNA, 19 nt, Homo sapiens
cagucagaauggaugcuuu

SEQ ID NO: 796621 - RNA, 19 nt, Homo sapiens
uggcagacuccggucauua

SEQ ID NO: 796622 - RNA, 19 nt, Homo sapiens
caggacagccggcagaaag

SEQ ID NO: 796623 - RNA, 19 nt, Homo sapiens
gcaggacagccggcagaaa

SEQ ID NO: 796624 - RNA, 19 nt, Homo sapiens
auucagguguucguaauga

SEQ ID NO: 796625 - RNA, 19 nt, Homo sapiens
ccucauggccugguugguu

SEQ ID NO: 796626 - RNA, 19 nt, Homo sapiens
cuucaaugacuccaauauu

SEQ ID NO: 796627 - RNA, 19 nt, Homo sapiens
gugggaaacaggucuugaa

SEQ ID NO: 796628 - RNA, 19 nt, Homo sapiens
caagacauuagcccuuuag

SEQ ID NO: 796629 - RNA, 19 nt, Homo sapiens
gaucugccacucccuguac

SEQ ID NO: 796630 - RNA, 19 nt, Homo sapiens
caaacucuggaaccugauu

SEQ ID NO: 796631 - RNA, 19 nt, Homo sapiens
gacuucaccaggauauuga

SEQ ID NO: 796632 - RNA, 19 nt, Homo sapiens
gcaaagagaguuagaauaa

SEQ ID NO: 796633 - RNA, 19 nt, Homo sapiens
gaacaagugugcagcuuaa

SEQ ID NO: 796634 - RNA, 19 nt, Homo sapiens
gaagaagacuuguugugaa

SEQ ID NO: 796635 - RNA, 19 nt, Homo sapiens
gaaggaggaugaaguaaug

SEQ ID NO: 796636 - RNA, 19 nt, Homo sapiens
gaagguauuugaagcagua

SEQ ID NO: 796637 - RNA, 19 nt, Homo sapiens
ggaaugcuaugacuuuaaa

SEQ ID NO: 796638 - RNA, 19 nt, Homo sapiens
gaagacuuguugugaauuu

SEQ ID NO: 796639 - RNA, 19 nt, Homo sapiens
gauggaacauguacgguua

SEQ ID NO: 796640 - RNA, 19 nt, Homo sapiens
guacugaccuucugaacaa

SEQ ID NO: 796641 - RNA, 19 nt, Homo sapiens
ggaaauuucugcucauaga

SEQ ID NO: 796642 - RNA, 19 nt, Homo sapiens
ggagacagguugcagauau

SEQ ID NO: 796643 - RNA, 19 nt, Homo sapiens
gaauggaccugguguaaca

SEQ ID NO: 796644 - RNA, 19 nt, Homo sapiens
gaaguaauguguguucuug

SEQ ID NO: 796645 - RNA, 19 nt, Homo sapiens
gaauaugugugaugccaaa

SEQ ID NO: 796646 - RNA, 19 nt, Homo sapiens
gcacaguacuuugaauuau

SEQ ID NO: 796647 - RNA, 19 nt, Homo sapiens
gaacaaggccaacaccuau

SEQ ID NO: 796648 - RNA, 19 nt, Homo sapiens
gggauacacuguuugcuuu

SEQ ID NO: 796649 - RNA, 19 nt, Homo sapiens
ccaugaaccuucccaaauu

SEQ ID NO: 796650 - RNA, 19 nt, Homo sapiens
guaacacacuugaauaugu

SEQ ID NO: 796651 - RNA, 19 nt, Homo sapiens
aaacagccuucaacaagua

SEQ ID NO: 796652 - RNA, 19 nt, Homo sapiens
gaaacagccuucaacaagu

SEQ ID NO: 796653 - RNA, 19 nt, Homo sapiens
cuacauggcuggacuuguu

SEQ ID NO: 796654 - RNA, 19 nt, Homo sapiens
guagaaugcuauaaugcua

SEQ ID NO: 796655 - RNA, 19 nt, Homo sapiens
cagaagacauggaaauuuc

SEQ ID NO: 796656 - RNA, 19 nt, Homo sapiens
gaacauuacugcagguuuu

SEQ ID NO: 796657 - RNA, 19 nt, Homo sapiens
caacagagcagcguauauu

SEQ ID NO: 796658 - RNA, 19 nt, Homo sapiens
cagaagaaaugcaggaguu

SEQ ID NO: 796659 - RNA, 19 nt, Homo sapiens
acaaaugaguggaccuaua

SEQ ID NO: 796660 - RNA, 19 nt, Homo sapiens
uguaggagguuaugaugua

SEQ ID NO: 796661 - RNA, 19 nt, Homo sapiens
uuugggagcugcuguguua

SEQ ID NO: 796662 - RNA, 19 nt, Homo sapiens
cagcguauauuaaugaaga

SEQ ID NO: 796663 - RNA, 19 nt, Homo sapiens
gcaaagauuaccucauuga

SEQ ID NO: 796664 - RNA, 19 nt, Homo sapiens
gcagaagacauggaaauuu

SEQ ID NO: 796665 - RNA, 19 nt, Homo sapiens
gcaggaguuugugcaguua

SEQ ID NO: 796666 - RNA, 19 nt, Homo sapiens
gcuaugacuuuaaagaaga

SEQ ID NO: 796667 - RNA, 19 nt, Homo sapiens
gaacauguacgguuaccuu

SEQ ID NO: 796668 - RNA, 19 nt, Homo sapiens
gcauauaaaugugugucua

SEQ ID NO: 796669 - RNA, 19 nt, Homo sapiens
gcacaaagcagggucauca

SEQ ID NO: 796670 - RNA, 19 nt, Homo sapiens
ggaccuauauagcagaaau

SEQ ID NO: 796671 - RNA, 19 nt, Homo sapiens
caaaugaguggaccuauau

SEQ ID NO: 796672 - RNA, 19 nt, Homo sapiens
uugcaaagauuaccucauu

SEQ ID NO: 796673 - RNA, 19 nt, Homo sapiens
gauaugaacaugugcagaa

SEQ ID NO: 796674 - RNA, 19 nt, Homo sapiens
uauaugaucccaccacuaa

SEQ ID NO: 796675 - RNA, 19 nt, Homo sapiens
gagcagcguauauuaauga

SEQ ID NO: 796676 - RNA, 19 nt, Homo sapiens
uaacuuggcgucaguagaa

SEQ ID NO: 796677 - RNA, 19 nt, Homo sapiens
gaacaugugcagaagaaau

SEQ ID NO: 796678 - RNA, 19 nt, Homo sapiens
gcuauaaugcuacaacaaa

SEQ ID NO: 796679 - RNA, 19 nt, Homo sapiens
ucaaagucaugaacgaauu

SEQ ID NO: 796680 - RNA, 19 nt, Homo sapiens
gaauggugcuggcuguguu

SEQ ID NO: 796681 - RNA, 19 nt, Homo sapiens
ucagaagccucucgauuca

SEQ ID NO: 796682 - RNA, 19 nt, Homo sapiens
gagcugcuguguuaaaugg

SEQ ID NO: 796683 - RNA, 19 nt, Homo sapiens
gaagagaagguauuugaag

SEQ ID NO: 796684 - RNA, 19 nt, Homo sapiens
cagaagagaagguauuuga

SEQ ID NO: 796685 - RNA, 19 nt, Homo sapiens
gugacaaacuuaccauuuc

SEQ ID NO: 796686 - RNA, 19 nt, Homo sapiens
gugaauccuuggcauauga

SEQ ID NO: 796687 - RNA, 19 nt, Homo sapiens
guugagggauacacuguuu

SEQ ID NO: 796688 - RNA, 19 nt, Homo sapiens
uggcgucaguagaauauua

SEQ ID NO: 796689 - RNA, 19 nt, Homo sapiens
cagcuggucucuuacaguu

SEQ ID NO: 796690 - RNA, 19 nt, Homo sapiens
caaagucaugaacgaauua

SEQ ID NO: 796691 - RNA, 19 nt, Homo sapiens
acuuguagcugcacuuuaa

SEQ ID NO: 796692 - RNA, 19 nt, Homo sapiens
gaccagcguugcuaacaug

SEQ ID NO: 796693 - RNA, 19 nt, Homo sapiens
caacaccuaugcagagcaa

SEQ ID NO: 796694 - RNA, 19 nt, Homo sapiens
uaacagaagagagaacuuu

SEQ ID NO: 796695 - RNA, 19 nt, Homo sapiens
ugaagugacugagaaucua

SEQ ID NO: 796696 - RNA, 19 nt, Homo sapiens
agaagccucucgauucaaa

SEQ ID NO: 796697 - RNA, 19 nt, Homo sapiens
gcagugcuugcaaagauua

SEQ ID NO: 796698 - RNA, 19 nt, Homo sapiens
gcuauuaacagaagagaga

SEQ ID NO: 796699 - RNA, 19 nt, Homo sapiens
cugcaggacuuaaucugua

SEQ ID NO: 796700 - RNA, 19 nt, Homo sapiens
gagaaacagccuucaacaa

SEQ ID NO: 796701 - RNA, 19 nt, Homo sapiens
ugucaucuguggaagcaua

SEQ ID NO: 796702 - RNA, 19 nt, Homo sapiens
caugaaccuucccaaauug

SEQ ID NO: 796703 - RNA, 19 nt, Homo sapiens
gagcaaagagaguuagaau

SEQ ID NO: 796704 - RNA, 19 nt, Homo sapiens
caaaacaugucuuucuuga

SEQ ID NO: 796705 - RNA, 19 nt, Homo sapiens
aguaauguguguucuugua

SEQ ID NO: 796706 - RNA, 19 nt, Homo sapiens
gauacgaucgucugccuuu

SEQ ID NO: 796707 - RNA, 19 nt, Homo sapiens
guggaagcauacaacauaa

SEQ ID NO: 796708 - RNA, 19 nt, Homo sapiens
gcagcuuaaucucaaguga

SEQ ID NO: 796709 - RNA, 19 nt, Homo sapiens
aaauucagguuacagaaga

SEQ ID NO: 796710 - RNA, 19 nt, Homo sapiens
gaugaugguuccuguaacu

SEQ ID NO: 796711 - RNA, 19 nt, Homo sapiens
ggcacaguacuuugaauua

SEQ ID NO: 796712 - RNA, 19 nt, Homo sapiens
gggaugaugguuccuguaa

SEQ ID NO: 796713 - RNA, 19 nt, Homo sapiens
gagacagguugcagauaug

SEQ ID NO: 796714 - RNA, 19 nt, Homo sapiens
acaguagaaugcuauaaug

SEQ ID NO: 796715 - RNA, 19 nt, Homo sapiens
gcauacaacauaaagucua

SEQ ID NO: 796716 - RNA, 19 nt, Homo sapiens
ucagaggguugaagaggaa

SEQ ID NO: 796717 - RNA, 19 nt, Homo sapiens
cauguguguugaucagaua

SEQ ID NO: 796718 - RNA, 19 nt, Homo sapiens
uagcacuucuccacuugua

SEQ ID NO: 796719 - RNA, 19 nt, Homo sapiens
gaaggacauuuucagcaua

SEQ ID NO: 796720 - RNA, 19 nt, Homo sapiens
gaagaaaugcaggaguuug

SEQ ID NO: 796721 - RNA, 19 nt, Homo sapiens
guggaaugcuaugacuuua

SEQ ID NO: 796722 - RNA, 19 nt, Homo sapiens
gaugugaggcaagaguuua

SEQ ID NO: 796723 - RNA, 19 nt, Homo sapiens
ugaagaagacuuguuguga

SEQ ID NO: 796724 - RNA, 19 nt, Homo sapiens
uguggaagcauacaacaua

SEQ ID NO: 796725 - RNA, 19 nt, Homo sapiens
gaggaagcauuggucaaga

SEQ ID NO: 796726 - RNA, 19 nt, Homo sapiens
gaaauucagguuacagaag

SEQ ID NO: 796727 - RNA, 19 nt, Homo sapiens
caaagcagggucaucagaa

SEQ ID NO: 796728 - RNA, 19 nt, Homo sapiens
caacaaaugaguggaccua

SEQ ID NO: 796729 - RNA, 19 nt, Homo sapiens
caacauaaagucuaaugag

SEQ ID NO: 796730 - RNA, 19 nt, Homo sapiens
ggaccagcguugcuaacau

SEQ ID NO: 796731 - RNA, 19 nt, Homo sapiens
gcaccaaguagcagaguug

SEQ ID NO: 796732 - RNA, 19 nt, Homo sapiens
ggacaaauaugcuguguuu

SEQ ID NO: 796733 - RNA, 19 nt, Homo sapiens
gaacugacauuugaagaaa

SEQ ID NO: 796734 - RNA, 19 nt, Homo sapiens
gaaaggcaguggaaugaaa

SEQ ID NO: 796735 - RNA, 19 nt, Homo sapiens
cagcaaauuugacuucuua

SEQ ID NO: 796736 - RNA, 19 nt, Homo sapiens
ggaauugucuuugccauuu

SEQ ID NO: 796737 - RNA, 19 nt, Homo sapiens
gcccaaauccuguguauua

SEQ ID NO: 796738 - RNA, 19 nt, Homo sapiens
ggagaaagcuuugcagaau

SEQ ID NO: 796739 - RNA, 19 nt, Homo sapiens
gugaagaacugacauuuga

SEQ ID NO: 796740 - RNA, 19 nt, Homo sapiens
uaagaaguaucccaguuua

SEQ ID NO: 796741 - RNA, 19 nt, Homo sapiens
gaggagaucuuaagcaugu

SEQ ID NO: 796742 - RNA, 19 nt, Homo sapiens
gaaauccagugaagaaaug

SEQ ID NO: 796743 - RNA, 19 nt, Homo sapiens
gaacuuagcagaccuagau

SEQ ID NO: 796744 - RNA, 19 nt, Homo sapiens
ugacagggaccaauaaaua

SEQ ID NO: 796745 - RNA, 19 nt, Homo sapiens
caaauaugaugcccuuaaa

SEQ ID NO: 796746 - RNA, 19 nt, Homo sapiens
gaacagacagcagagaaua

SEQ ID NO: 796747 - RNA, 19 nt, Homo sapiens
ccaauacucugaaugagaa

SEQ ID NO: 796748 - RNA, 19 nt, Homo sapiens
gaguagagaugaugcuuug

SEQ ID NO: 796749 - RNA, 19 nt, Homo sapiens
gaauugucuuugccauuua

SEQ ID NO: 796750 - RNA, 19 nt, Homo sapiens
cagaaacaguacugaauuu

SEQ ID NO: 796751 - RNA, 19 nt, Homo sapiens
ggaaugaaaucucuuugca

SEQ ID NO: 796752 - RNA, 19 nt, Homo sapiens
gaaauaagccguucuucuc

SEQ ID NO: 796753 - RNA, 19 nt, Homo sapiens
uugaagaccugaaagauaa

SEQ ID NO: 796754 - RNA, 19 nt, Homo sapiens
gagaaagcuuugcagaauu

SEQ ID NO: 796755 - RNA, 19 nt, Homo sapiens
ccagaagcuugcucacuua

SEQ ID NO: 796756 - RNA, 19 nt, Homo sapiens
gggaaugccuuaccuagga

SEQ ID NO: 796757 - RNA, 19 nt, Homo sapiens
gcaguggccucucuccaaa

SEQ ID NO: 796758 - RNA, 19 nt, Homo sapiens
gcucacuuaucucuacuua

SEQ ID NO: 796759 - RNA, 19 nt, Homo sapiens
gaacaacuccucugugaag

SEQ ID NO: 796760 - RNA, 19 nt, Homo sapiens
caaguacgaugucuucaga

SEQ ID NO: 796761 - RNA, 19 nt, Homo sapiens
gaaauugcgauuaaacuga

SEQ ID NO: 796762 - RNA, 19 nt, Homo sapiens
ugauagcucuuuggauuua

SEQ ID NO: 796763 - RNA, 19 nt, Homo sapiens
ggaaacucuuggacagaua

SEQ ID NO: 796764 - RNA, 19 nt, Homo sapiens
ugacaucucucuccaaagu

SEQ ID NO: 796765 - RNA, 19 nt, Homo sapiens
ucugauagcucuuuggauu

SEQ ID NO: 796766 - RNA, 19 nt, Homo sapiens
gaagaaaauuguccagaaa

SEQ ID NO: 796767 - RNA, 19 nt, Homo sapiens
gaagcuugcucacuuaucu

SEQ ID NO: 796768 - RNA, 19 nt, Homo sapiens
aaagugagcuggcaaccuu

SEQ ID NO: 796769 - RNA, 19 nt, Homo sapiens
caaagaagacucugcauca

SEQ ID NO: 796770 - RNA, 19 nt, Homo sapiens
ggaagggucuggacuaggu

SEQ ID NO: 796771 - RNA, 19 nt, Homo sapiens
aagaggaaauugcgauuaa

SEQ ID NO: 796772 - RNA, 19 nt, Homo sapiens
gcagaaaacucucuccauu

SEQ ID NO: 796773 - RNA, 19 nt, Homo sapiens
ggaauauucuggucuagca

SEQ ID NO: 796774 - RNA, 19 nt, Homo sapiens
cagaaugccuccuuggauu

SEQ ID NO: 796775 - RNA, 19 nt, Homo sapiens
gaugaugguuucaccgauu

SEQ ID NO: 796776 - RNA, 19 nt, Homo sapiens
guucaaggaucacacaaga

SEQ ID NO: 796777 - RNA, 19 nt, Homo sapiens
uagcagaccuagauauguu

SEQ ID NO: 796778 - RNA, 19 nt, Homo sapiens
uaacgaccuuuguaaguga

SEQ ID NO: 796779 - RNA, 19 nt, Homo sapiens
ucaagaugcuucuaaguca

SEQ ID NO: 796780 - RNA, 19 nt, Homo sapiens
ggacagauaugggccuuag

SEQ ID NO: 796781 - RNA, 19 nt, Homo sapiens
agagaagccugcagaagaa

SEQ ID NO: 796782 - RNA, 19 nt, Homo sapiens
ugaaggacaucgauaaagu

SEQ ID NO: 796783 - RNA, 19 nt, Homo sapiens
caaaugauaccuuaaaugg

SEQ ID NO: 796784 - RNA, 19 nt, Homo sapiens
caugacaucucucuccaaa

SEQ ID NO: 796785 - RNA, 19 nt, Homo sapiens
gcgagaaaccauugucuuu

SEQ ID NO: 796786 - RNA, 19 nt, Homo sapiens
caaccuacccugcaaauca

SEQ ID NO: 796787 - RNA, 19 nt, Homo sapiens
guaagaaguaucccaguuu

SEQ ID NO: 796788 - RNA, 19 nt, Homo sapiens
ggaggcggcuucauguuuc

SEQ ID NO: 796789 - RNA, 19 nt, Homo sapiens
gcucaugcuuccuggagua

SEQ ID NO: 796790 - RNA, 19 nt, Homo sapiens
gaccaacacugccugacuu

SEQ ID NO: 796791 - RNA, 19 nt, Homo sapiens
ggaugacuuuggagaguuu

SEQ ID NO: 796792 - RNA, 19 nt, Homo sapiens
guaacgaccuuuguaagug

SEQ ID NO: 796793 - RNA, 19 nt, Homo sapiens
gaagaugcacucucuguuc

SEQ ID NO: 796794 - RNA, 19 nt, Homo sapiens
gcaaggaggacucugaaga

SEQ ID NO: 796795 - RNA, 19 nt, Homo sapiens
gaauucagaucugcaggaa

SEQ ID NO: 796796 - RNA, 19 nt, Homo sapiens
gcugacaaguccucugaaa

SEQ ID NO: 796797 - RNA, 19 nt, Homo sapiens
ccaaggaccuauugcuaug

SEQ ID NO: 796798 - RNA, 19 nt, Homo sapiens
gaucaaaaccugucaauug

SEQ ID NO: 796799 - RNA, 19 nt, Homo sapiens
gaccacggcuuucuugauc

SEQ ID NO: 796800 - RNA, 19 nt, Homo sapiens
caaagacugugaccaugga

SEQ ID NO: 796801 - RNA, 19 nt, Homo sapiens
gagccuuggugauaaagaa

SEQ ID NO: 796802 - RNA, 19 nt, Homo sapiens
cagcagagaauaaaccuuu

SEQ ID NO: 796803 - RNA, 19 nt, Homo sapiens
guagauggauguguaagug

SEQ ID NO: 796804 - RNA, 19 nt, Homo sapiens
gagugugccucuugaaugu

SEQ ID NO: 796805 - RNA, 19 nt, Homo sapiens
gcaaaugauaccuuaaaug

SEQ ID NO: 796806 - RNA, 19 nt, Homo sapiens
guugaagaccugaaagaua

SEQ ID NO: 796807 - RNA, 19 nt, Homo sapiens
ggauuuacaaugagaguuu

SEQ ID NO: 796808 - RNA, 19 nt, Homo sapiens
ucgauaaaguguggaauaa

SEQ ID NO: 796809 - RNA, 19 nt, Homo sapiens
ggaggacucugaagaugca

SEQ ID NO: 796810 - RNA, 19 nt, Homo sapiens
gaugaaaacucgcuggauu

SEQ ID NO: 796811 - RNA, 19 nt, Homo sapiens
gggaggagaucuuaagcau

SEQ ID NO: 796812 - RNA, 19 nt, Homo sapiens
ggugauaaauauagugcuu

SEQ ID NO: 796813 - RNA, 19 nt, Homo sapiens
aaugaguccugaugcuuua

SEQ ID NO: 796814 - RNA, 19 nt, Homo sapiens
uggaauagauacugccaaa

SEQ ID NO: 796815 - RNA, 19 nt, Homo sapiens
gaaugccuccuuggauuua

SEQ ID NO: 796816 - RNA, 19 nt, Homo sapiens
uuccaaagaugacugcaua

SEQ ID NO: 796817 - RNA, 19 nt, Homo sapiens
gcaguggaaugaaaucucu

SEQ ID NO: 796818 - RNA, 19 nt, Homo sapiens
cugaacaacuccucuguga

SEQ ID NO: 796819 - RNA, 19 nt, Homo sapiens
gaucaacugugucgaacca

SEQ ID NO: 796820 - RNA, 19 nt, Homo sapiens
gcauaugaauggcagagau

SEQ ID NO: 796821 - RNA, 19 nt, Homo sapiens
agaaagcuuugcagaauuc

SEQ ID NO: 796822 - RNA, 19 nt, Homo sapiens
gauaugggccuuagcuaau

SEQ ID NO: 796823 - RNA, 19 nt, Homo sapiens
ucgcuucccugaaucgaua

SEQ ID NO: 796824 - RNA, 19 nt, Homo sapiens
gagauccuggugauaaaua

SEQ ID NO: 796825 - RNA, 19 nt, Homo sapiens
aagaugacuuccaggauuu

SEQ ID NO: 796826 - RNA, 19 nt, Homo sapiens
gaauagauacugccaaacu

SEQ ID NO: 796827 - RNA, 19 nt, Homo sapiens
ccaguuuaauggccaguaa

SEQ ID NO: 796828 - RNA, 19 nt, Homo sapiens
gaaguaucccaguuuaaug

SEQ ID NO: 796829 - RNA, 19 nt, Homo sapiens
ggagagaagaguagagaug

SEQ ID NO: 796830 - RNA, 19 nt, Homo sapiens
caggaugacuuugcagauu

SEQ ID NO: 796831 - RNA, 19 nt, Homo sapiens
cagcuccuauuccaacuuu

SEQ ID NO: 796832 - RNA, 19 nt, Homo sapiens
ggacaaauaugcuguguuu

SEQ ID NO: 796833 - RNA, 19 nt, Homo sapiens
gaacugacauuugaagaaa

SEQ ID NO: 796834 - RNA, 19 nt, Homo sapiens
gaaaggcaguggaaugaaa

SEQ ID NO: 796835 - RNA, 19 nt, Homo sapiens
cagcaaauuugacuucuua

SEQ ID NO: 796836 - RNA, 19 nt, Homo sapiens
ggaauugucuuugccauuu

SEQ ID NO: 796837 - RNA, 19 nt, Homo sapiens
gcccaaauccuguguauua

SEQ ID NO: 796838 - RNA, 19 nt, Homo sapiens
ggagaaagcuuugcagaau

SEQ ID NO: 796839 - RNA, 19 nt, Homo sapiens
gugaagaacugacauuuga

SEQ ID NO: 796840 - RNA, 19 nt, Homo sapiens
uaagaaguaucccaguuua

SEQ ID NO: 796841 - RNA, 19 nt, Homo sapiens
gaggagaucuuaagcaugu

SEQ ID NO: 796842 - RNA, 19 nt, Homo sapiens
gaaauccagugaagaaaug

SEQ ID NO: 796843 - RNA, 19 nt, Homo sapiens
gaacuuagcagaccuagau

SEQ ID NO: 796844 - RNA, 19 nt, Homo sapiens
ugacagggaccaauaaaua

SEQ ID NO: 796845 - RNA, 19 nt, Homo sapiens
caaauaugaugcccuuaaa

SEQ ID NO: 796846 - RNA, 19 nt, Homo sapiens
gaacagacagcagagaaua

SEQ ID NO: 796847 - RNA, 19 nt, Homo sapiens
ccaauacucugaaugagaa

SEQ ID NO: 796848 - RNA, 19 nt, Homo sapiens
gaguagagaugaugcuuug

SEQ ID NO: 796849 - RNA, 19 nt, Homo sapiens
gaauugucuuugccauuua

SEQ ID NO: 796850 - RNA, 19 nt, Homo sapiens
cagaaacaguacugaauuu

SEQ ID NO: 796851 - RNA, 19 nt, Homo sapiens
ggaaugaaaucucuuugca

SEQ ID NO: 796852 - RNA, 19 nt, Homo sapiens
gaaauaagccguucuucuc

SEQ ID NO: 796853 - RNA, 19 nt, Homo sapiens
uugaagaccugaaagauaa

SEQ ID NO: 796854 - RNA, 19 nt, Homo sapiens
gagaaagcuuugcagaauu

SEQ ID NO: 796855 - RNA, 19 nt, Homo sapiens
ccagaagcuugcucacuua

SEQ ID NO: 796856 - RNA, 19 nt, Homo sapiens
gggaaugccuuaccuagga

SEQ ID NO: 796857 - RNA, 19 nt, Homo sapiens
gcaguggccucucuccaaa

SEQ ID NO: 796858 - RNA, 19 nt, Homo sapiens
gcucacuuaucucuacuua

SEQ ID NO: 796859 - RNA, 19 nt, Homo sapiens
gaacaacuccucugugaag

SEQ ID NO: 796860 - RNA, 19 nt, Homo sapiens
caaguacgaugucuucaga

SEQ ID NO: 796861 - RNA, 19 nt, Homo sapiens
gaaauugcgauuaaacuga

SEQ ID NO: 796862 - RNA, 19 nt, Homo sapiens
ugauagcucuuuggauuua

SEQ ID NO: 796863 - RNA, 19 nt, Homo sapiens
ggaaacucuuggacagaua

SEQ ID NO: 796864 - RNA, 19 nt, Homo sapiens
ugacaucucucuccaaagu

SEQ ID NO: 796865 - RNA, 19 nt, Homo sapiens
ucugauagcucuuuggauu

SEQ ID NO: 796866 - RNA, 19 nt, Homo sapiens
gaagaaaauuguccagaaa

SEQ ID NO: 796867 - RNA, 19 nt, Homo sapiens
gaagcuugcucacuuaucu

SEQ ID NO: 796868 - RNA, 19 nt, Homo sapiens
aaagugagcuggcaaccuu

SEQ ID NO: 796869 - RNA, 19 nt, Homo sapiens
caaagaagacucugcauca

SEQ ID NO: 796870 - RNA, 19 nt, Homo sapiens
ggaagggucuggacuaggu

SEQ ID NO: 796871 - RNA, 19 nt, Homo sapiens
aagaggaaauugcgauuaa

SEQ ID NO: 796872 - RNA, 19 nt, Homo sapiens
gcagaaaacucucuccauu

SEQ ID NO: 796873 - RNA, 19 nt, Homo sapiens
ggaauauucuggucuagca

SEQ ID NO: 796874 - RNA, 19 nt, Homo sapiens
cagaaugccuccuuggauu

SEQ ID NO: 796875 - RNA, 19 nt, Homo sapiens
gaugaugguuucaccgauu

SEQ ID NO: 796876 - RNA, 19 nt, Homo sapiens
guucaaggaucacacaaga

SEQ ID NO: 796877 - RNA, 19 nt, Homo sapiens
uagcagaccuagauauguu

SEQ ID NO: 796878 - RNA, 19 nt, Homo sapiens
uaacgaccuuuguaaguga

SEQ ID NO: 796879 - RNA, 19 nt, Homo sapiens
ucaagaugcuucuaaguca

SEQ ID NO: 796880 - RNA, 19 nt, Homo sapiens
ggacagauaugggccuuag

SEQ ID NO: 796881 - RNA, 19 nt, Homo sapiens
ugaaggacaucgauaaagu

SEQ ID NO: 796882 - RNA, 19 nt, Homo sapiens
caaaugauaccuuaaaugg

SEQ ID NO: 796883 - RNA, 19 nt, Homo sapiens
caugacaucucucuccaaa

SEQ ID NO: 796884 - RNA, 19 nt, Homo sapiens
gcgagaaaccauugucuuu

SEQ ID NO: 796885 - RNA, 19 nt, Homo sapiens
caaccuacccugcaaauca

SEQ ID NO: 796886 - RNA, 19 nt, Homo sapiens
guaagaaguaucccaguuu

SEQ ID NO: 796887 - RNA, 19 nt, Homo sapiens
ggaggcggcuucauguuuc

SEQ ID NO: 796888 - RNA, 19 nt, Homo sapiens
gcucaugcuuccuggagua

SEQ ID NO: 796889 - RNA, 19 nt, Homo sapiens
gaccaacacugccugacuu

SEQ ID NO: 796890 - RNA, 19 nt, Homo sapiens
ggaugacuuuggagaguuu

SEQ ID NO: 796891 - RNA, 19 nt, Homo sapiens
guaacgaccuuuguaagug

SEQ ID NO: 796892 - RNA, 19 nt, Homo sapiens
gaagaugcacucucuguuc

SEQ ID NO: 796893 - RNA, 19 nt, Homo sapiens
gcaaggaggacucugaaga

SEQ ID NO: 796894 - RNA, 19 nt, Homo sapiens
gaauucagaucugcaggaa

SEQ ID NO: 796895 - RNA, 19 nt, Homo sapiens
gcugacaaguccucugaaa

SEQ ID NO: 796896 - RNA, 19 nt, Homo sapiens
ccaaggaccuauugcuaug

SEQ ID NO: 796897 - RNA, 19 nt, Homo sapiens
gaucaaaaccugucaauug

SEQ ID NO: 796898 - RNA, 19 nt, Homo sapiens
gaccacggcuuucuugauc

SEQ ID NO: 796899 - RNA, 19 nt, Homo sapiens
caaagacugugaccaugga

SEQ ID NO: 796900 - RNA, 19 nt, Homo sapiens
gagccuuggugauaaagaa

SEQ ID NO: 796901 - RNA, 19 nt, Homo sapiens
cagcagagaauaaaccuuu

SEQ ID NO: 796902 - RNA, 19 nt, Homo sapiens
guagauggauguguaagug

SEQ ID NO: 796903 - RNA, 19 nt, Homo sapiens
gagugugccucuugaaugu

SEQ ID NO: 796904 - RNA, 19 nt, Homo sapiens
gcaaaugauaccuuaaaug

SEQ ID NO: 796905 - RNA, 19 nt, Homo sapiens
guugaagaccugaaagaua

SEQ ID NO: 796906 - RNA, 19 nt, Homo sapiens
ggauuuacaaugagaguuu

SEQ ID NO: 796907 - RNA, 19 nt, Homo sapiens
ucgauaaaguguggaauaa

SEQ ID NO: 796908 - RNA, 19 nt, Homo sapiens
ggaggacucugaagaugca

SEQ ID NO: 796909 - RNA, 19 nt, Homo sapiens
gaugaaaacucgcuggauu

SEQ ID NO: 796910 - RNA, 19 nt, Homo sapiens
gggaggagaucuuaagcau

SEQ ID NO: 796911 - RNA, 19 nt, Homo sapiens
ggugauaaauauagugcuu

SEQ ID NO: 796912 - RNA, 19 nt, Homo sapiens
aaugaguccugaugcuuua

SEQ ID NO: 796913 - RNA, 19 nt, Homo sapiens
uggaauagauacugccaaa

SEQ ID NO: 796914 - RNA, 19 nt, Homo sapiens
gaaugccuccuuggauuua

SEQ ID NO: 796915 - RNA, 19 nt, Homo sapiens
uuccaaagaugacugcaua

SEQ ID NO: 796916 - RNA, 19 nt, Homo sapiens
gcaguggaaugaaaucucu

SEQ ID NO: 796917 - RNA, 19 nt, Homo sapiens
cugaacaacuccucuguga

SEQ ID NO: 796918 - RNA, 19 nt, Homo sapiens
gaucaacugugucgaacca

SEQ ID NO: 796919 - RNA, 19 nt, Homo sapiens
gcauaugaauggcagagau

SEQ ID NO: 796920 - RNA, 19 nt, Homo sapiens
agaaagcuuugcagaauuc

SEQ ID NO: 796921 - RNA, 19 nt, Homo sapiens
gauaugggccuuagcuaau

SEQ ID NO: 796922 - RNA, 19 nt, Homo sapiens
ucgcuucccugaaucgaua

SEQ ID NO: 796923 - RNA, 19 nt, Homo sapiens
gagauccuggugauaaaua

SEQ ID NO: 796924 - RNA, 19 nt, Homo sapiens
aagaugacuuccaggauuu

SEQ ID NO: 796925 - RNA, 19 nt, Homo sapiens
gaauagauacugccaaacu

SEQ ID NO: 796926 - RNA, 19 nt, Homo sapiens
ccaguuuaauggccaguaa

SEQ ID NO: 796927 - RNA, 19 nt, Homo sapiens
gaaguaucccaguuuaaug

SEQ ID NO: 796928 - RNA, 19 nt, Homo sapiens
ggagagaagaguagagaug

SEQ ID NO: 796929 - RNA, 19 nt, Homo sapiens
caggaugacuuugcagauu

SEQ ID NO: 796930 - RNA, 19 nt, Homo sapiens
cagcuccuauuccaacuuu

SEQ ID NO: 796931 - RNA, 19 nt, Homo sapiens
ccagaaacaguacugaauu

SEQ ID NO: 796932 - RNA, 19 nt, Homo sapiens
ggacaaauaugcuguguuu

SEQ ID NO: 796933 - RNA, 19 nt, Homo sapiens
cagcaaauuugacuucuua

SEQ ID NO: 796934 - RNA, 19 nt, Homo sapiens
gagcacagauaaugucuuu

SEQ ID NO: 796935 - RNA, 19 nt, Homo sapiens
ggagaaagcuuugcagaau

SEQ ID NO: 796936 - RNA, 19 nt, Homo sapiens
gugaguagcuuccaaggua

SEQ ID NO: 796937 - RNA, 19 nt, Homo sapiens
gaggagaucuuaagcaugu

SEQ ID NO: 796938 - RNA, 19 nt, Homo sapiens
gugaaugccucaugacaua

SEQ ID NO: 796939 - RNA, 19 nt, Homo sapiens
gaaauccagugaagaaaug

SEQ ID NO: 796940 - RNA, 19 nt, Homo sapiens
gaacuuagcagaccuagau

SEQ ID NO: 796941 - RNA, 19 nt, Homo sapiens
caaauaugaugcccuuaaa

SEQ ID NO: 796942 - RNA, 19 nt, Homo sapiens
gaacagacagcagagaaua

SEQ ID NO: 796943 - RNA, 19 nt, Homo sapiens
gcaagaaucugucucaaaa

SEQ ID NO: 796944 - RNA, 19 nt, Homo sapiens
ccacugagauguuagaugu

SEQ ID NO: 796945 - RNA, 19 nt, Homo sapiens
gaaguaauugccaguauuu

SEQ ID NO: 796946 - RNA, 19 nt, Homo sapiens
ggaccacuauauacauuaa

SEQ ID NO: 796947 - RNA, 19 nt, Homo sapiens
uugaagaccugaaagauaa

SEQ ID NO: 796948 - RNA, 19 nt, Homo sapiens
gagaaagcuuugcagaauu

SEQ ID NO: 796949 - RNA, 19 nt, Homo sapiens
gcagauaacuugagaucag

SEQ ID NO: 796950 - RNA, 19 nt, Homo sapiens
gcucacaccuguaaucuca

SEQ ID NO: 796951 - RNA, 19 nt, Homo sapiens
gaagaugaccuccaggauu

SEQ ID NO: 796952 - RNA, 19 nt, Homo sapiens
gauguuagauguucuuaag

SEQ ID NO: 796953 - RNA, 19 nt, Homo sapiens
aagaugaccuccaggauuu

SEQ ID NO: 796954 - RNA, 19 nt, Homo sapiens
gaaaccguguaucuacuaa

SEQ ID NO: 796955 - RNA, 19 nt, Homo sapiens
caaguacgaugucuucaga

SEQ ID NO: 796956 - RNA, 19 nt, Homo sapiens
ccacacaacucuuacauac

SEQ ID NO: 796957 - RNA, 19 nt, Homo sapiens
ugauagcucuuuggauuua

SEQ ID NO: 796958 - RNA, 19 nt, Homo sapiens
ggaaacucuuggacagaua

SEQ ID NO: 796959 - RNA, 19 nt, Homo sapiens
ugacaucucucuccaaagu

SEQ ID NO: 796960 - RNA, 19 nt, Homo sapiens
ucugauagcucuuuggauu

SEQ ID NO: 796961 - RNA, 19 nt, Homo sapiens
gacauaagcaucugaagaa

SEQ ID NO: 796962 - RNA, 19 nt, Homo sapiens
aaagugagcuggcaaccuu

SEQ ID NO: 796963 - RNA, 19 nt, Homo sapiens
caaagaagacucugcauca

SEQ ID NO: 796964 - RNA, 19 nt, Homo sapiens
ggaagggucuggacuaggu

SEQ ID NO: 796965 - RNA, 19 nt, Homo sapiens
acauguagcuucccagaaa

SEQ ID NO: 796966 - RNA, 19 nt, Homo sapiens
uuagaggugugcuguguua

SEQ ID NO: 796967 - RNA, 19 nt, Homo sapiens
cagaaugccuccuuggauu

SEQ ID NO: 796968 - RNA, 19 nt, Homo sapiens
ggaauauucuggucuagca

SEQ ID NO: 796969 - RNA, 19 nt, Homo sapiens
cauaacaaaugacuggaaa

SEQ ID NO: 796970 - RNA, 19 nt, Homo sapiens
cauaauaucuggcacuagu

SEQ ID NO: 796971 - RNA, 19 nt, Homo sapiens
gaugaugguuucaccgauu

SEQ ID NO: 796972 - RNA, 19 nt, Homo sapiens
gcaggcagauaacuugaga

SEQ ID NO: 796973 - RNA, 19 nt, Homo sapiens
gaaggaacucgguuacaaa

SEQ ID NO: 796974 - RNA, 19 nt, Homo sapiens
cagcggaccuacuuaaguu

SEQ ID NO: 796975 - RNA, 19 nt, Homo sapiens
gcacagauaaugucuuuua

SEQ ID NO: 796976 - RNA, 19 nt, Homo sapiens
uagcagaccuagauauguu

SEQ ID NO: 796977 - RNA, 19 nt, Homo sapiens
cgaaguaauugccaguauu

SEQ ID NO: 796978 - RNA, 19 nt, Homo sapiens
uaacgaccuuuguaaguga

SEQ ID NO: 796979 - RNA, 19 nt, Homo sapiens
ucaagaugcuucuaaguca

SEQ ID NO: 796980 - RNA, 19 nt, Homo sapiens
ggacagauaugggccuuag

SEQ ID NO: 796981 - RNA, 19 nt, Homo sapiens
ccuguaaucucaacgcuuu

SEQ ID NO: 796982 - RNA, 19 nt, Homo sapiens
acacaacucuuacauacug

SEQ ID NO: 796983 - RNA, 19 nt, Homo sapiens
caugacaucucucuccaaa

SEQ ID NO: 796984 - RNA, 19 nt, Homo sapiens
gcgagaaaccauugucuuu

SEQ ID NO: 796985 - RNA, 19 nt, Homo sapiens
caaccuacccugcaaauca

SEQ ID NO: 796986 - RNA, 19 nt, Homo sapiens
ggaugacuuuggagaguuu

SEQ ID NO: 796987 - RNA, 19 nt, Homo sapiens
guaacgaccuuuguaagug

SEQ ID NO: 796988 - RNA, 19 nt, Homo sapiens
gaagaugcacucucuguuc

SEQ ID NO: 796989 - RNA, 19 nt, Homo sapiens
gcaaggaggacucugaaga

SEQ ID NO: 796990 - RNA, 19 nt, Homo sapiens
gaauucagaucugcaggaa

SEQ ID NO: 796991 - RNA, 19 nt, Homo sapiens
gcugacaaguccucugaaa

SEQ ID NO: 796992 - RNA, 19 nt, Homo sapiens
ugaaggaacucgguuacaa

SEQ ID NO: 796993 - RNA, 19 nt, Homo sapiens
gcaucuagccugcauauca

SEQ ID NO: 796994 - RNA, 19 nt, Homo sapiens
gaaaucagggucaauuaca

SEQ ID NO: 796995 - RNA, 19 nt, Homo sapiens
cagcagagaauaaaccuuu

SEQ ID NO: 796996 - RNA, 19 nt, Homo sapiens
uuacuugccuggucucuga

SEQ ID NO: 796997 - RNA, 19 nt, Homo sapiens
guugaagaccugaaagaua

SEQ ID NO: 796998 - RNA, 19 nt, Homo sapiens
ggauuuacaaugagaguuu

SEQ ID NO: 796999 - RNA, 19 nt, Homo sapiens
ggucuacagucccauaugu

SEQ ID NO: 797000 - RNA, 19 nt, Homo sapiens
ggaggacucugaagaugca

SEQ ID NO: 797001 - RNA, 19 nt, Homo sapiens
gaaugccuccuuggauuua

SEQ ID NO: 797002 - RNA, 19 nt, Homo sapiens
gggaggagaucuuaagcau

SEQ ID NO: 797003 - RNA, 19 nt, Homo sapiens
ggugauaaauauagugcuu

SEQ ID NO: 797004 - RNA, 19 nt, Homo sapiens
uggaauagauacugccaaa

SEQ ID NO: 797005 - RNA, 19 nt, Homo sapiens
aaugaguccugaugcuuua

SEQ ID NO: 797006 - RNA, 19 nt, Homo sapiens
gcacugagccgagaucaca

SEQ ID NO: 797007 - RNA, 19 nt, Homo sapiens
caagagagaacaguagaaa

SEQ ID NO: 797008 - RNA, 19 nt, Homo sapiens
aaauguugcucucugguuu

SEQ ID NO: 797009 - RNA, 19 nt, Homo sapiens
agaaagcuuugcagaauuc

SEQ ID NO: 797010 - RNA, 19 nt, Homo sapiens
gauaugggccuuagcuaau

SEQ ID NO: 797011 - RNA, 19 nt, Homo sapiens
gagauccuggugauaaaua

SEQ ID NO: 797012 - RNA, 19 nt, Homo sapiens
gaauagauacugccaaacu

SEQ ID NO: 797013 - RNA, 19 nt, Homo sapiens
ggaauguguuugugaaugc

SEQ ID NO: 797014 - RNA, 19 nt, Homo sapiens
augcagguauugcucauua

SEQ ID NO: 797015 - RNA, 19 nt, Homo sapiens
caggaugacuuugcagauu

SEQ ID NO: 797016 - RNA, 19 nt, Homo sapiens
cagcuccuauuccaacuuu

SEQ ID NO: 797017 - RNA, 19 nt, Homo sapiens
ugaggaauguguuugugaa

SEQ ID NO: 797018 - RNA, 19 nt, Homo sapiens
ggaacucgguuacaaaucc

SEQ ID NO: 797019 - RNA, 19 nt, Homo sapiens
uuaaguggcuuuucuauga

SEQ ID NO: 797020 - RNA, 19 nt, Homo sapiens
cucauuagcucguuugguu

SEQ ID NO: 797021 - RNA, 19 nt, Homo sapiens
ucccagcucuugccaguuu

SEQ ID NO: 797022 - RNA, 19 nt, Homo sapiens
gacaugaaauuggcugaug

SEQ ID NO: 797023 - RNA, 19 nt, Homo sapiens
ugccuucaauggacaaaua

SEQ ID NO: 797024 - RNA, 19 nt, Homo sapiens
gcagggaaaccgugcaaga

SEQ ID NO: 797025 - RNA, 19 nt, Homo sapiens
gagaagagucauguugaaa

SEQ ID NO: 797026 - RNA, 19 nt, Homo sapiens
agagaagagucauguugaa

SEQ ID NO: 797027 - RNA, 19 nt, Homo sapiens
cacauuagcuccgcucaug

SEQ ID NO: 797028 - RNA, 19 nt, Homo sapiens
acaaauaugaugcccuuaa

SEQ ID NO: 797029 - RNA, 19 nt, Homo sapiens
gggaaacucuuggacagau

SEQ ID NO: 797030 - RNA, 19 nt, Homo sapiens
aaacaacaaacacaaguga

SEQ ID NO: 797031 - RNA, 19 nt, Homo sapiens
ucagugauuuccaagaguu

SEQ ID NO: 797032 - RNA, 19 nt, Homo sapiens
gaacacggcccaaggaaga

SEQ ID NO: 797033 - RNA, 19 nt, Homo sapiens
aggaaaaucugacgaauaa

SEQ ID NO: 797034 - RNA, 19 nt, Homo sapiens
gaacuggcuggccuuguuu

SEQ ID NO: 797035 - RNA, 19 nt, Homo sapiens
gcacacggcugagggugau

SEQ ID NO: 797036 - RNA, 19 nt, Homo sapiens
agaacuggcuggccuuguu

SEQ ID NO: 797037 - RNA, 19 nt, Homo sapiens
gggaguaggccaagaagga

SEQ ID NO: 797038 - RNA, 19 nt, Homo sapiens
cagcaccacuccuuuccuu

SEQ ID NO: 797039 - RNA, 19 nt, Homo sapiens
gcgcaugggcgucaauguu

SEQ ID NO: 797040 - RNA, 19 nt, Homo sapiens
ggaaaccgauguggaagac

SEQ ID NO: 797041 - RNA, 19 nt, Homo sapiens
gcaccagcaccacuccuuu

SEQ ID NO: 797042 - RNA, 19 nt, Homo sapiens
ggaguaggccaagaaggaa

SEQ ID NO: 797043 - RNA, 19 nt, Homo sapiens
ccaagaccaucugcuguca

SEQ ID NO: 797044 - RNA, 19 nt, Homo sapiens
gguaacugaucugccuuga

SEQ ID NO: 797045 - RNA, 19 nt, Homo sapiens
gaaaaucugacgaauaaag

SEQ ID NO: 797046 - RNA, 19 nt, Homo sapiens
gaaggaaaaucugacgaau

SEQ ID NO: 797047 - RNA, 19 nt, Homo sapiens
caugcagacccucaucuuu

SEQ ID NO: 797048 - RNA, 19 nt, Homo sapiens
gccugucacugguaugaug

SEQ ID NO: 797049 - RNA, 19 nt, Homo sapiens
gcaccacuccuuuccuuac

SEQ ID NO: 797050 - RNA, 19 nt, Homo sapiens
uccgagggcuuccugaugu

SEQ ID NO: 797051 - RNA, 19 nt, Homo sapiens
ccacaaccaggaacacuag

SEQ ID NO: 797052 - RNA, 19 nt, Homo sapiens
cgcaugggcgucaauguuu

SEQ ID NO: 797053 - RNA, 19 nt, Homo sapiens
gcagugaccagcaggaacu

SEQ ID NO: 797054 - RNA, 19 nt, Homo sapiens
uccugagucugaucuguuu

SEQ ID NO: 797055 - RNA, 19 nt, Homo sapiens
ggaacugcccagagaacug

SEQ ID NO: 797056 - RNA, 19 nt, Homo sapiens
gcaugggcgucaauguuuu

SEQ ID NO: 797057 - RNA, 19 nt, Homo sapiens
gcagacagggcaggauugu

SEQ ID NO: 797058 - RNA, 19 nt, Homo sapiens
gugcuggucccacuaagga

SEQ ID NO: 797059 - RNA, 19 nt, Homo sapiens
ucagaacacggcccaagga

SEQ ID NO: 797060 - RNA, 19 nt, Homo sapiens
ggccugagaugugcuucug

SEQ ID NO: 797061 - RNA, 19 nt, Homo sapiens
gccacaaccaggaacacua

SEQ ID NO: 797062 - RNA, 19 nt, Homo sapiens
aagaccaucugcugucaca

SEQ ID NO: 797063 - RNA, 19 nt, Homo sapiens
gcaccaucaggcccaugua

SEQ ID NO: 797064 - RNA, 19 nt, Homo sapiens
gcuggucccacuaaggaaa

SEQ ID NO: 797065 - RNA, 19 nt, Homo sapiens
gaaugugcuggucccacua

SEQ ID NO: 797066 - RNA, 19 nt, Homo sapiens
gaguaggccaagaaggaaa

SEQ ID NO: 797067 - RNA, 19 nt, Homo sapiens
ugaagaggcagcccuggau

SEQ ID NO: 797068 - RNA, 19 nt, Homo sapiens
gcucagcagcagguacgua

SEQ ID NO: 797069 - RNA, 19 nt, Homo sapiens
gaaggccugagaugugcuu

SEQ ID NO: 797070 - RNA, 19 nt, Homo sapiens
cauccugaccuuggcagua

SEQ ID NO: 797071 - RNA, 19 nt, Homo sapiens
gagcagggguaccaaggau

SEQ ID NO: 797072 - RNA, 19 nt, Homo sapiens
cagaacacggcccaaggaa

SEQ ID NO: 797073 - RNA, 19 nt, Homo sapiens
ccaacuuccugccugaaaa

SEQ ID NO: 797074 - RNA, 19 nt, Homo sapiens
cugcacaccuggccacaac

SEQ ID NO: 797075 - RNA, 19 nt, Homo sapiens
gaccaucugcugucacaac

SEQ ID NO: 797076 - RNA, 19 nt, Homo sapiens
aggaaagccugggaaacug

SEQ ID NO: 797077 - RNA, 19 nt, Homo sapiens
cugaguggcugggauccuu

SEQ ID NO: 797078 - RNA, 19 nt, Homo sapiens
gagaaacuguuccaauuaa

SEQ ID NO: 797079 - RNA, 19 nt, Homo sapiens
gaacagagaagaucacauu

SEQ ID NO: 797080 - RNA, 19 nt, Homo sapiens
cagagaaacuguuccaauu

SEQ ID NO: 797081 - RNA, 19 nt, Homo sapiens
gauaugaccucagcccuaa

SEQ ID NO: 797082 - RNA, 19 nt, Homo sapiens
gaaaaggaauucuccaaaa

SEQ ID NO: 797083 - RNA, 19 nt, Homo sapiens
gaaaguaauggaagaagaa

SEQ ID NO: 797084 - RNA, 19 nt, Homo sapiens
gcacagaaccuggcauuca

SEQ ID NO: 797085 - RNA, 19 nt, Homo sapiens
ggaauccguucuagaggaa

SEQ ID NO: 797086 - RNA, 19 nt, Homo sapiens
ucugagaggugacuccaua

SEQ ID NO: 797087 - RNA, 19 nt, Homo sapiens
gaaaacacuuccugugauu

SEQ ID NO: 797088 - RNA, 19 nt, Homo sapiens
gaccacagguucuuaugau

SEQ ID NO: 797089 - RNA, 19 nt, Homo sapiens
guugacagcuggagacaga

SEQ ID NO: 797090 - RNA, 19 nt, Homo sapiens
gcacaauacaaagaacuua

SEQ ID NO: 797091 - RNA, 19 nt, Homo sapiens
uaagguccacagauuauua

SEQ ID NO: 797092 - RNA, 19 nt, Homo sapiens
ugauaaaccugcuccugaa

SEQ ID NO: 797093 - RNA, 19 nt, Homo sapiens
guuuaaagaugcagagaug

SEQ ID NO: 797094 - RNA, 19 nt, Homo sapiens
augcagagaugaaugaauu

SEQ ID NO: 797095 - RNA, 19 nt, Homo sapiens
agagaaacuguuccaauua

SEQ ID NO: 797096 - RNA, 19 nt, Homo sapiens
ccagugaacgagcaaauaa

SEQ ID NO: 797097 - RNA, 19 nt, Homo sapiens
ugaaaguaauggaagaaga

SEQ ID NO: 797098 - RNA, 19 nt, Homo sapiens
guccacagauuauuagaug

SEQ ID NO: 797099 - RNA, 19 nt, Homo sapiens
gagcagucgucucccuauu

SEQ ID NO: 797100 - RNA, 19 nt, Homo sapiens
gcagagaugaaugaauuaa

SEQ ID NO: 797101 - RNA, 19 nt, Homo sapiens
gcagucgucucccuauuac

SEQ ID NO: 797102 - RNA, 19 nt, Homo sapiens
ucauaagguccacagauua

SEQ ID NO: 797103 - RNA, 19 nt, Homo sapiens
ggaccacagguucuuauga

SEQ ID NO: 797104 - RNA, 19 nt, Homo sapiens
uaccuuggcuggaauguca

SEQ ID NO: 797105 - RNA, 19 nt, Homo sapiens
gaagcauguucuccacaau

SEQ ID NO: 797106 - RNA, 19 nt, Homo sapiens
gaaauuagccgaaaacacu

SEQ ID NO: 797107 - RNA, 19 nt, Homo sapiens
ccaccaggguuuggcagua

SEQ ID NO: 797108 - RNA, 19 nt, Homo sapiens
gaaacuguuccaauuaaag

SEQ ID NO: 797109 - RNA, 19 nt, Homo sapiens
cagcaccacuccuuuccuu

SEQ ID NO: 797110 - RNA, 19 nt, Homo sapiens
ggcaguaccuuggcuggaa

SEQ ID NO: 797111 - RNA, 19 nt, Homo sapiens
ggucaucccuaagccuuug

SEQ ID NO: 797112 - RNA, 19 nt, Homo sapiens
gaucauaagguccacagau

SEQ ID NO: 797113 - RNA, 19 nt, Homo sapiens
ggaaaccgauguggaagac

SEQ ID NO: 797114 - RNA, 19 nt, Homo sapiens
gcguggagguccugcauca

SEQ ID NO: 797115 - RNA, 19 nt, Homo sapiens
gcaccagcaccacuccuuu

SEQ ID NO: 797116 - RNA, 19 nt, Homo sapiens
gcuuagugauggagauaug

SEQ ID NO: 797117 - RNA, 19 nt, Homo sapiens
acaagaagaggcccagaaa

SEQ ID NO: 797118 - RNA, 19 nt, Homo sapiens
agagaugaaugaauuaagg

SEQ ID NO: 797119 - RNA, 19 nt, Homo sapiens
auuauuagauggcauguca

SEQ ID NO: 797120 - RNA, 19 nt, Homo sapiens
gcaguaccuuggcuggaau

SEQ ID NO: 797121 - RNA, 19 nt, Homo sapiens
ggacuuggcagcugcuaag

SEQ ID NO: 797122 - RNA, 19 nt, Homo sapiens
gaucacauuuucuucuuga

SEQ ID NO: 797123 - RNA, 19 nt, Homo sapiens
cagagaagaucacauuuuc

SEQ ID NO: 797124 - RNA, 19 nt, Homo sapiens
agcauguucuccacaauuu

SEQ ID NO: 797125 - RNA, 19 nt, Homo sapiens
ccaugucaguccuaggaaa

SEQ ID NO: 797126 - RNA, 19 nt, Homo sapiens
gaaucugguugcccggaau

SEQ ID NO: 797127 - RNA, 19 nt, Homo sapiens
cagaaaagcuuuguugaca

SEQ ID NO: 797128 - RNA, 19 nt, Homo sapiens
ggagguccugcaucaguuu

SEQ ID NO: 797129 - RNA, 19 nt, Homo sapiens
ggaacaagagguggucaga

SEQ ID NO: 797130 - RNA, 19 nt, Homo sapiens
cuuggcagcugcuaagaga

SEQ ID NO: 797131 - RNA, 19 nt, Homo sapiens
ggaaaaggaauucuccaaa

SEQ ID NO: 797132 - RNA, 19 nt, Homo sapiens
guccugacccagugccuua

SEQ ID NO: 797133 - RNA, 19 nt, Homo sapiens
ugacugcacuuagcauucu

SEQ ID NO: 797134 - RNA, 19 nt, Homo sapiens
uuaaagaugcagagaugaa

SEQ ID NO: 797135 - RNA, 19 nt, Homo sapiens
aucauaagguccacagauu

SEQ ID NO: 797136 - RNA, 19 nt, Homo sapiens
agaugaaaguaauggaaga

SEQ ID NO: 797137 - RNA, 19 nt, Homo sapiens
gaugaaaguaauggaagaa

SEQ ID NO: 797138 - RNA, 19 nt, Homo sapiens
gagaugaaugaauuaagga

SEQ ID NO: 797139 - RNA, 19 nt, Homo sapiens
gcacagacaguggcugaca

SEQ ID NO: 797140 - RNA, 19 nt, Homo sapiens
uccaagugcugccaaagug

SEQ ID NO: 797141 - RNA, 19 nt, Homo sapiens
aaacacuuccugugauuuc

SEQ ID NO: 797142 - RNA, 19 nt, Homo sapiens
gcaccacuccuuuccuuac

SEQ ID NO: 797143 - RNA, 19 nt, Homo sapiens
gggcagagaggauaguaag

SEQ ID NO: 797144 - RNA, 19 nt, Homo sapiens
uauaaagccagaagcaugu

SEQ ID NO: 797145 - RNA, 19 nt, Homo sapiens
uccgagggcuuccugaugu

SEQ ID NO: 797146 - RNA, 19 nt, Homo sapiens
gcagugaccagcaggaacu

SEQ ID NO: 797147 - RNA, 19 nt, Homo sapiens
cgaaaacacuuccugugau

SEQ ID NO: 797148 - RNA, 19 nt, Homo sapiens
ccuguuggcuuucucuucu

SEQ ID NO: 797149 - RNA, 19 nt, Homo sapiens
ggaacugcccagagaacug

SEQ ID NO: 797150 - RNA, 19 nt, Homo sapiens
gaguaguaguucugagucu

SEQ ID NO: 797151 - RNA, 19 nt, Homo sapiens
ugagaggugacuccauaaa

SEQ ID NO: 797152 - RNA, 19 nt, Homo sapiens
ugaacgagcaaauaaacug

SEQ ID NO: 797153 - RNA, 19 nt, Homo sapiens
caaagcuccagaccaguga

SEQ ID NO: 797154 - RNA, 19 nt, Homo sapiens
aguaauggaagaagaaguu

SEQ ID NO: 797155 - RNA, 19 nt, Homo sapiens
caucacggccugacagagu

SEQ ID NO: 797156 - RNA, 19 nt, Homo sapiens
gaugcuucuucaccuguug

SEQ ID NO: 797157 - RNA, 19 nt, Homo sapiens
gggacucaccgacacauuc

SEQ ID NO: 797158 - RNA, 19 nt, Homo sapiens
gccagacggagucaggaua

SEQ ID NO: 797159 - RNA, 19 nt, Homo sapiens
uauuagauggcaugucaaa

SEQ ID NO: 797160 - RNA, 19 nt, Homo sapiens
uaaagaugcagagaugaau

SEQ ID NO: 797161 - RNA, 19 nt, Homo sapiens
uggagguccugcaucaguu

SEQ ID NO: 797162 - RNA, 19 nt, Homo sapiens
ucagcucuguucccacuca

SEQ ID NO: 797163 - RNA, 19 nt, Homo sapiens
cgaauuagagguacuucag

SEQ ID NO: 797164 - RNA, 19 nt, Homo sapiens
guacuucaggcacaauaca

SEQ ID NO: 797165 - RNA, 19 nt, Homo sapiens
acccuucugugguuauaaa

SEQ ID NO: 797166 - RNA, 19 nt, Homo sapiens
agcagucgucucccuauua

SEQ ID NO: 797167 - RNA, 19 nt, Homo sapiens
ucaggcacaauacaaagaa

SEQ ID NO: 797168 - RNA, 19 nt, Homo sapiens
ugaagaggcagcccuggau

SEQ ID NO: 797169 - RNA, 19 nt, Homo sapiens
gcgugcugcuggcuguuga

SEQ ID NO: 797170 - RNA, 19 nt, Homo sapiens
ugccaccuccugaguagua

SEQ ID NO: 797171 - RNA, 19 nt, Homo sapiens
gagaucaaacacucaaggu

SEQ ID NO: 797172 - RNA, 19 nt, Homo sapiens
gagaggugacuccauaaaa

SEQ ID NO: 797173 - RNA, 19 nt, Homo sapiens
aagcauguucuccacaauu

SEQ ID NO: 797174 - RNA, 19 nt, Homo sapiens
aagaugcagagaugaauga

SEQ ID NO: 797175 - RNA, 19 nt, Homo sapiens
uugcgagacucacuacauc

SEQ ID NO: 797176 - RNA, 19 nt, Homo sapiens
gaccagugaacgagcaaau

SEQ ID NO: 797177 - RNA, 19 nt, Homo sapiens
cagcacccacuguugaaga

SEQ ID NO: 797178 - RNA, 19 nt, Homo sapiens
gagaaacuguuccaauuaa

SEQ ID NO: 797179 - RNA, 19 nt, Homo sapiens
gaacagagaagaucacauu

SEQ ID NO: 797180 - RNA, 19 nt, Homo sapiens
cagagaaacuguuccaauu

SEQ ID NO: 797181 - RNA, 19 nt, Homo sapiens
gaacacggcccaaggaaga

SEQ ID NO: 797182 - RNA, 19 nt, Homo sapiens
gaaaaggaauucuccaaaa

SEQ ID NO: 797183 - RNA, 19 nt, Homo sapiens
gaaaguaauggaagaagaa

SEQ ID NO: 797184 - RNA, 19 nt, Homo sapiens
gcacagaaccuggcauuca

SEQ ID NO: 797185 - RNA, 19 nt, Homo sapiens
ggaauccguucuagaggaa

SEQ ID NO: 797186 - RNA, 19 nt, Homo sapiens
ucugagaggugacuccaua

SEQ ID NO: 797187 - RNA, 19 nt, Homo sapiens
gcccagagccgcaagauug

SEQ ID NO: 797188 - RNA, 19 nt, Homo sapiens
gaaaacacuuccugugauu

SEQ ID NO: 797189 - RNA, 19 nt, Homo sapiens
gaccacagguucuuaugau

SEQ ID NO: 797190 - RNA, 19 nt, Homo sapiens
guugacagcuggagacaga

SEQ ID NO: 797191 - RNA, 19 nt, Homo sapiens
gcacaauacaaagaacuua

SEQ ID NO: 797192 - RNA, 19 nt, Homo sapiens
uaagguccacagauuauua

SEQ ID NO: 797193 - RNA, 19 nt, Homo sapiens
ccaaaggguuccagugugu

SEQ ID NO: 797194 - RNA, 19 nt, Homo sapiens
ugauaaaccugcuccugaa

SEQ ID NO: 797195 - RNA, 19 nt, Homo sapiens
guuuaaagaugcagagaug

SEQ ID NO: 797196 - RNA, 19 nt, Homo sapiens
augcagagaugaaugaauu

SEQ ID NO: 797197 - RNA, 19 nt, Homo sapiens
agagaaacuguuccaauua

SEQ ID NO: 797198 - RNA, 19 nt, Homo sapiens
ccagugaacgagcaaauaa

SEQ ID NO: 797199 - RNA, 19 nt, Homo sapiens
ugaaaguaauggaagaaga

SEQ ID NO: 797200 - RNA, 19 nt, Homo sapiens
guccacagauuauuagaug

SEQ ID NO: 797201 - RNA, 19 nt, Homo sapiens
aggaaaaucugacgaauaa

SEQ ID NO: 797202 - RNA, 19 nt, Homo sapiens
gaacuggcuggccuuguuu

SEQ ID NO: 797203 - RNA, 19 nt, Homo sapiens
gcagagaugaaugaauuaa

SEQ ID NO: 797204 - RNA, 19 nt, Homo sapiens
ucauaagguccacagauua

SEQ ID NO: 797205 - RNA, 19 nt, Homo sapiens
gcacacggcugagggugau

SEQ ID NO: 797206 - RNA, 19 nt, Homo sapiens
agaacuggcuggccuuguu

SEQ ID NO: 797207 - RNA, 19 nt, Homo sapiens
gggaguaggccaagaagga

SEQ ID NO: 797208 - RNA, 19 nt, Homo sapiens
ggaccacagguucuuauga

SEQ ID NO: 797209 - RNA, 19 nt, Homo sapiens
uaccuuggcuggaauguca

SEQ ID NO: 797210 - RNA, 19 nt, Homo sapiens
gaagcagccucaguugauc

SEQ ID NO: 797211 - RNA, 19 nt, Homo sapiens
gaagcauguucuccacaau

SEQ ID NO: 797212 - RNA, 19 nt, Homo sapiens
gaaauuagccgaaaacacu

SEQ ID NO: 797213 - RNA, 19 nt, Homo sapiens
ccaccaggguuuggcagua

SEQ ID NO: 797214 - RNA, 19 nt, Homo sapiens
gaaacuguuccaauuaaag

SEQ ID NO: 797215 - RNA, 19 nt, Homo sapiens
cagcaccacuccuuuccuu

SEQ ID NO: 797216 - RNA, 19 nt, Homo sapiens
ggcaguaccuuggcuggaa

SEQ ID NO: 797217 - RNA, 19 nt, Homo sapiens
ggucaucccuaagccuuug

SEQ ID NO: 797218 - RNA, 19 nt, Homo sapiens
gaucauaagguccacagau

SEQ ID NO: 797219 - RNA, 19 nt, Homo sapiens
gcgcaugggcgucaauguu

SEQ ID NO: 797220 - RNA, 19 nt, Homo sapiens
ggaaaccgauguggaagac

SEQ ID NO: 797221 - RNA, 19 nt, Homo sapiens
gcguggagguccugcauca

SEQ ID NO: 797222 - RNA, 19 nt, Homo sapiens
ccucagcacucuaccaaag

SEQ ID NO: 797223 - RNA, 19 nt, Homo sapiens
gcaccagcaccacuccuuu

SEQ ID NO: 797224 - RNA, 19 nt, Homo sapiens
acaagaagaggcccagaaa

SEQ ID NO: 797225 - RNA, 19 nt, Homo sapiens
agagaugaaugaauuaagg

SEQ ID NO: 797226 - RNA, 19 nt, Homo sapiens
gcaguaccuuggcuggaau

SEQ ID NO: 797227 - RNA, 19 nt, Homo sapiens
auuauuagauggcauguca

SEQ ID NO: 797228 - RNA, 19 nt, Homo sapiens
ggacuuggcagcugcuaag

SEQ ID NO: 797229 - RNA, 19 nt, Homo sapiens
gaucacauuuucuucuuga

SEQ ID NO: 797230 - RNA, 19 nt, Homo sapiens
cagagaagaucacauuuuc

SEQ ID NO: 797231 - RNA, 19 nt, Homo sapiens
ugaagcagccucaguugau

SEQ ID NO: 797232 - RNA, 19 nt, Homo sapiens
agcauguucuccacaauuu

SEQ ID NO: 797233 - RNA, 19 nt, Homo sapiens
ccaugucaguccuaggaaa

SEQ ID NO: 797234 - RNA, 19 nt, Homo sapiens
ggaguaggccaagaaggaa

SEQ ID NO: 797235 - RNA, 19 nt, Homo sapiens
ccaagaccaucugcuguca

SEQ ID NO: 797236 - RNA, 19 nt, Homo sapiens
gaaucugguugcccggaau

SEQ ID NO: 797237 - RNA, 19 nt, Homo sapiens
cagaaaagcuuuguugaca

SEQ ID NO: 797238 - RNA, 19 nt, Homo sapiens
ggagguccugcaucaguuu

SEQ ID NO: 797239 - RNA, 19 nt, Homo sapiens
cuuggcagcugcuaagaga

SEQ ID NO: 797240 - RNA, 19 nt, Homo sapiens
ggaaaaggaauucuccaaa

SEQ ID NO: 797241 - RNA, 19 nt, Homo sapiens
guccugacccagugccuua

SEQ ID NO: 797242 - RNA, 19 nt, Homo sapiens
uuaaagaugcagagaugaa

SEQ ID NO: 797243 - RNA, 19 nt, Homo sapiens
gguaacugaucugccuuga

SEQ ID NO: 797244 - RNA, 19 nt, Homo sapiens
ugguguggcuccuggcuaa

SEQ ID NO: 797245 - RNA, 19 nt, Homo sapiens
agaugaaaguaauggaaga

SEQ ID NO: 797246 - RNA, 19 nt, Homo sapiens
gaugaaaguaauggaagaa

SEQ ID NO: 797247 - RNA, 19 nt, Homo sapiens
gagaugaaugaauuaagga

SEQ ID NO: 797248 - RNA, 19 nt, Homo sapiens
aucauaagguccacagauu

SEQ ID NO: 797249 - RNA, 19 nt, Homo sapiens
gaaaaucugacgaauaaag

SEQ ID NO: 797250 - RNA, 19 nt, Homo sapiens
gcacagacaguggcugaca

SEQ ID NO: 797251 - RNA, 19 nt, Homo sapiens
uccaagugcugccaaagug

SEQ ID NO: 797252 - RNA, 19 nt, Homo sapiens
aaacacuuccugugauuuc

SEQ ID NO: 797253 - RNA, 19 nt, Homo sapiens
gaaggaaaaucugacgaau

SEQ ID NO: 797254 - RNA, 19 nt, Homo sapiens
caugcagacccucaucuuu

SEQ ID NO: 797255 - RNA, 19 nt, Homo sapiens
gccugucacugguaugaug

SEQ ID NO: 797256 - RNA, 19 nt, Homo sapiens
gcaccacuccuuuccuuac

SEQ ID NO: 797257 - RNA, 19 nt, Homo sapiens
gggcagagaggauaguaag

SEQ ID NO: 797258 - RNA, 19 nt, Homo sapiens
uauaaagccagaagcaugu

SEQ ID NO: 797259 - RNA, 19 nt, Homo sapiens
uccgagggcuuccugaugu

SEQ ID NO: 797260 - RNA, 19 nt, Homo sapiens
ccacaaccaggaacacuag

SEQ ID NO: 797261 - RNA, 19 nt, Homo sapiens
cgcaugggcgucaauguuu

SEQ ID NO: 797262 - RNA, 19 nt, Homo sapiens
gcagugaccagcaggaacu

SEQ ID NO: 797263 - RNA, 19 nt, Homo sapiens
cgaaaacacuuccugugau

SEQ ID NO: 797264 - RNA, 19 nt, Homo sapiens
uccugagucugaucuguuu

SEQ ID NO: 797265 - RNA, 19 nt, Homo sapiens
ggaacugcccagagaacug

SEQ ID NO: 797266 - RNA, 19 nt, Homo sapiens
gaguaguaguucugagucu

SEQ ID NO: 797267 - RNA, 19 nt, Homo sapiens
ugagaggugacuccauaaa

SEQ ID NO: 797268 - RNA, 19 nt, Homo sapiens
ugaacgagcaaauaaacug

SEQ ID NO: 797269 - RNA, 19 nt, Homo sapiens
caaagcuccagaccaguga

SEQ ID NO: 797270 - RNA, 19 nt, Homo sapiens
gcaugggcgucaauguuuu

SEQ ID NO: 797271 - RNA, 19 nt, Homo sapiens
caucacggccugacagagu

SEQ ID NO: 797272 - RNA, 19 nt, Homo sapiens
gggacucaccgacacauuc

SEQ ID NO: 797273 - RNA, 19 nt, Homo sapiens
aguaauggaagaagaaguu

SEQ ID NO: 797274 - RNA, 19 nt, Homo sapiens
gccagacggagucaggaua

SEQ ID NO: 797275 - RNA, 19 nt, Homo sapiens
ucagaacacggcccaagga

SEQ ID NO: 797276 - RNA, 19 nt, Homo sapiens
uauuagauggcaugucaaa

SEQ ID NO: 797277 - RNA, 19 nt, Homo sapiens
uaaagaugcagagaugaau

SEQ ID NO: 797278 - RNA, 19 nt, Homo sapiens
gauaugaccucagcccuaa

SEQ ID NO: 797279 - RNA, 19 nt, Homo sapiens
gaacacggcccaaggaaga

SEQ ID NO: 797280 - RNA, 19 nt, Homo sapiens
gcacagaaccuggcauuca

SEQ ID NO: 797281 - RNA, 19 nt, Homo sapiens
ucugagaggugacuccaua

SEQ ID NO: 797282 - RNA, 19 nt, Homo sapiens
gaaaacacuuccugugauu

SEQ ID NO: 797283 - RNA, 19 nt, Homo sapiens
gaccacagguucuuaugau

SEQ ID NO: 797284 - RNA, 19 nt, Homo sapiens
guugacagcuggagacaga

SEQ ID NO: 797285 - RNA, 19 nt, Homo sapiens
ugauaaaccugcuccugaa

SEQ ID NO: 797286 - RNA, 19 nt, Homo sapiens
guuuaaagaugcagagaug

SEQ ID NO: 797287 - RNA, 19 nt, Homo sapiens
augcagagaugaaugaauu

SEQ ID NO: 797288 - RNA, 19 nt, Homo sapiens
ccagugaacgagcaaauaa

SEQ ID NO: 797289 - RNA, 19 nt, Homo sapiens
aggaaaaucugacgaauaa

SEQ ID NO: 797290 - RNA, 19 nt, Homo sapiens
gaacuggcuggccuuguuu

SEQ ID NO: 797291 - RNA, 19 nt, Homo sapiens
gagcagucgucucccuauu

SEQ ID NO: 797292 - RNA, 19 nt, Homo sapiens
gcagagaugaaugaauuaa

SEQ ID NO: 797293 - RNA, 19 nt, Homo sapiens
gcagucgucucccuauuac

SEQ ID NO: 797294 - RNA, 19 nt, Homo sapiens
gcacacggcugagggugau

SEQ ID NO: 797295 - RNA, 19 nt, Homo sapiens
agaacuggcuggccuuguu

SEQ ID NO: 797296 - RNA, 19 nt, Homo sapiens
gggaguaggccaagaagga

SEQ ID NO: 797297 - RNA, 19 nt, Homo sapiens
ggaccacagguucuuauga

SEQ ID NO: 797298 - RNA, 19 nt, Homo sapiens
uaccuuggcuggaauguca

SEQ ID NO: 797299 - RNA, 19 nt, Homo sapiens
gaagcagccucaguugauc

SEQ ID NO: 797300 - RNA, 19 nt, Homo sapiens
gaagcauguucuccacaau

SEQ ID NO: 797301 - RNA, 19 nt, Homo sapiens
gaaauuagccgaaaacacu

SEQ ID NO: 797302 - RNA, 19 nt, Homo sapiens
ccaccaggguuuggcagua

SEQ ID NO: 797303 - RNA, 19 nt, Homo sapiens
cagcaccacuccuuuccuu

SEQ ID NO: 797304 - RNA, 19 nt, Homo sapiens
ggcaguaccuuggcuggaa

SEQ ID NO: 797305 - RNA, 19 nt, Homo sapiens
ggucaucccuaagccuuug

SEQ ID NO: 797306 - RNA, 19 nt, Homo sapiens
gcgcaugggcgucaauguu

SEQ ID NO: 797307 - RNA, 19 nt, Homo sapiens
ggaaaccgauguggaagac

SEQ ID NO: 797308 - RNA, 19 nt, Homo sapiens
gcguggagguccugcauca

SEQ ID NO: 797309 - RNA, 19 nt, Homo sapiens
gcaccagcaccacuccuuu

SEQ ID NO: 797310 - RNA, 19 nt, Homo sapiens
gcuuagugauggagauaug

SEQ ID NO: 797311 - RNA, 19 nt, Homo sapiens
agagaugaaugaauuaagg

SEQ ID NO: 797312 - RNA, 19 nt, Homo sapiens
acaagaagaggcccagaaa

SEQ ID NO: 797313 - RNA, 19 nt, Homo sapiens
gcaguaccuuggcuggaau

SEQ ID NO: 797314 - RNA, 19 nt, Homo sapiens
ggacuuggcagcugcuaag

SEQ ID NO: 797315 - RNA, 19 nt, Homo sapiens
ugaagcagccucaguugau

SEQ ID NO: 797316 - RNA, 19 nt, Homo sapiens
agcauguucuccacaauuu

SEQ ID NO: 797317 - RNA, 19 nt, Homo sapiens
ccaugucaguccuaggaaa

SEQ ID NO: 797318 - RNA, 19 nt, Homo sapiens
ggaguaggccaagaaggaa

SEQ ID NO: 797319 - RNA, 19 nt, Homo sapiens
ccaagaccaucugcuguca

SEQ ID NO: 797320 - RNA, 19 nt, Homo sapiens
gaaucugguugcccggaau

SEQ ID NO: 797321 - RNA, 19 nt, Homo sapiens
cagaaaagcuuuguugaca

SEQ ID NO: 797322 - RNA, 19 nt, Homo sapiens
ggagguccugcaucaguuu

SEQ ID NO: 797323 - RNA, 19 nt, Homo sapiens
cuuggcagcugcuaagaga

SEQ ID NO: 797324 - RNA, 19 nt, Homo sapiens
guccugacccagugccuua

SEQ ID NO: 797325 - RNA, 19 nt, Homo sapiens
ugacugcacuuagcauucu

SEQ ID NO: 797326 - RNA, 19 nt, Homo sapiens
uuaaagaugcagagaugaa

SEQ ID NO: 797327 - RNA, 19 nt, Homo sapiens
gagaugaaugaauuaagga

SEQ ID NO: 797328 - RNA, 19 nt, Homo sapiens
gguaacugaucugccuuga

SEQ ID NO: 797329 - RNA, 19 nt, Homo sapiens
ugguguggcuccuggcuaa

SEQ ID NO: 797330 - RNA, 19 nt, Homo sapiens
gaaaaucugacgaauaaag

SEQ ID NO: 797331 - RNA, 19 nt, Homo sapiens
gcacagacaguggcugaca

SEQ ID NO: 797332 - RNA, 19 nt, Homo sapiens
uccaagugcugccaaagug

SEQ ID NO: 797333 - RNA, 19 nt, Homo sapiens
aaacacuuccugugauuuc

SEQ ID NO: 797334 - RNA, 19 nt, Homo sapiens
gaaggaaaaucugacgaau

SEQ ID NO: 797335 - RNA, 19 nt, Homo sapiens
caugcagacccucaucuuu

SEQ ID NO: 797336 - RNA, 19 nt, Homo sapiens
gccugucacugguaugaug

SEQ ID NO: 797337 - RNA, 19 nt, Homo sapiens
gcaccacuccuuuccuuac

SEQ ID NO: 797338 - RNA, 19 nt, Homo sapiens
uauaaagccagaagcaugu

SEQ ID NO: 797339 - RNA, 19 nt, Homo sapiens
gggcagagaggauaguaag

SEQ ID NO: 797340 - RNA, 19 nt, Homo sapiens
uccgagggcuuccugaugu

SEQ ID NO: 797341 - RNA, 19 nt, Homo sapiens
ccacaaccaggaacacuag

SEQ ID NO: 797342 - RNA, 19 nt, Homo sapiens
cgcaugggcgucaauguuu

SEQ ID NO: 797343 - RNA, 19 nt, Homo sapiens
gcagugaccagcaggaacu

SEQ ID NO: 797344 - RNA, 19 nt, Homo sapiens
cgaaaacacuuccugugau

SEQ ID NO: 797345 - RNA, 19 nt, Homo sapiens
ccuguuggcuuucucuucu

SEQ ID NO: 797346 - RNA, 19 nt, Homo sapiens
uccugagucugaucuguuu

SEQ ID NO: 797347 - RNA, 19 nt, Homo sapiens
ggaacugcccagagaacug

SEQ ID NO: 797348 - RNA, 19 nt, Homo sapiens
ugaacgagcaaauaaacug

SEQ ID NO: 797349 - RNA, 19 nt, Homo sapiens
caaagcuccagaccaguga

SEQ ID NO: 797350 - RNA, 19 nt, Homo sapiens
gaguaguaguucugagucu

SEQ ID NO: 797351 - RNA, 19 nt, Homo sapiens
ugagaggugacuccauaaa

SEQ ID NO: 797352 - RNA, 19 nt, Homo sapiens
gcaugggcgucaauguuuu

SEQ ID NO: 797353 - RNA, 19 nt, Homo sapiens
gccagacggagucaggaua

SEQ ID NO: 797354 - RNA, 19 nt, Homo sapiens
caucacggccugacagagu

SEQ ID NO: 797355 - RNA, 19 nt, Homo sapiens
gaugcuucuucaccuguug

SEQ ID NO: 797356 - RNA, 19 nt, Homo sapiens
gggacucaccgacacauuc

SEQ ID NO: 797357 - RNA, 19 nt, Homo sapiens
ucagaacacggcccaagga

SEQ ID NO: 797358 - RNA, 19 nt, Homo sapiens
uaaagaugcagagaugaau

SEQ ID NO: 797359 - RNA, 19 nt, Homo sapiens
gccacaaccaggaacacua

SEQ ID NO: 797360 - RNA, 19 nt, Homo sapiens
uggagguccugcaucaguu

SEQ ID NO: 797361 - RNA, 19 nt, Homo sapiens
ucagcucuguucccacuca

SEQ ID NO: 797362 - RNA, 19 nt, Homo sapiens
acccuucugugguuauaaa

SEQ ID NO: 797363 - RNA, 19 nt, Homo sapiens
uugauccggucaucccuaa

SEQ ID NO: 797364 - RNA, 19 nt, Homo sapiens
aagaccaucugcugucaca

SEQ ID NO: 797365 - RNA, 19 nt, Homo sapiens
gcaccaucaggcccaugua

SEQ ID NO: 797366 - RNA, 19 nt, Homo sapiens
agcagucgucucccuauua

SEQ ID NO: 797367 - RNA, 19 nt, Homo sapiens
gaguaggccaagaaggaaa

SEQ ID NO: 797368 - RNA, 19 nt, Homo sapiens
aagaugcagagaugaauga

SEQ ID NO: 797369 - RNA, 19 nt, Homo sapiens
aagcauguucuccacaauu

SEQ ID NO: 797370 - RNA, 19 nt, Homo sapiens
ugaagaggcagcccuggau

SEQ ID NO: 797371 - RNA, 19 nt, Homo sapiens
gcgugcugcuggcuguuga

SEQ ID NO: 797372 - RNA, 19 nt, Homo sapiens
gagaggugacuccauaaaa

SEQ ID NO: 797373 - RNA, 19 nt, Homo sapiens
ugccaccuccugaguagua

SEQ ID NO: 797374 - RNA, 19 nt, Homo sapiens
gagaucaaacacucaaggu

SEQ ID NO: 797375 - RNA, 19 nt, Homo sapiens
gaccagugaacgagcaaau

SEQ ID NO: 797376 - RNA, 19 nt, Homo sapiens
gcucagcagcagguacgua

SEQ ID NO: 797377 - RNA, 19 nt, Homo sapiens
cagcacccacuguugaaga

SEQ ID NO: 797378 - RNA, 19 nt, Homo sapiens
gaacacggcccaaggaaga

SEQ ID NO: 797379 - RNA, 19 nt, Homo sapiens
aggaaaaucugacgaauaa

SEQ ID NO: 797380 - RNA, 19 nt, Homo sapiens
gaacuggcuggccuuguuu

SEQ ID NO: 797381 - RNA, 19 nt, Homo sapiens
gcacacggcugagggugau

SEQ ID NO: 797382 - RNA, 19 nt, Homo sapiens
agaacuggcuggccuuguu

SEQ ID NO: 797383 - RNA, 19 nt, Homo sapiens
gggaguaggccaagaagga

SEQ ID NO: 797384 - RNA, 19 nt, Homo sapiens
cagcaccacuccuuuccuu

SEQ ID NO: 797385 - RNA, 19 nt, Homo sapiens
gcgcaugggcgucaauguu

SEQ ID NO: 797386 - RNA, 19 nt, Homo sapiens
ggaaaccgauguggaagac

SEQ ID NO: 797387 - RNA, 19 nt, Homo sapiens
gcaccagcaccacuccuuu

SEQ ID NO: 797388 - RNA, 19 nt, Homo sapiens
ggaguaggccaagaaggaa

SEQ ID NO: 797389 - RNA, 19 nt, Homo sapiens
ccaagaccaucugcuguca

SEQ ID NO: 797390 - RNA, 19 nt, Homo sapiens
gguaacugaucugccuuga

SEQ ID NO: 797391 - RNA, 19 nt, Homo sapiens
gaaaaucugacgaauaaag

SEQ ID NO: 797392 - RNA, 19 nt, Homo sapiens
gaaggaaaaucugacgaau

SEQ ID NO: 797393 - RNA, 19 nt, Homo sapiens
caugcagacccucaucuuu

SEQ ID NO: 797394 - RNA, 19 nt, Homo sapiens
gccugucacugguaugaug

SEQ ID NO: 797395 - RNA, 19 nt, Homo sapiens
gcaccacuccuuuccuuac

SEQ ID NO: 797396 - RNA, 19 nt, Homo sapiens
uccgagggcuuccugaugu

SEQ ID NO: 797397 - RNA, 19 nt, Homo sapiens
ccacaaccaggaacacuag

SEQ ID NO: 797398 - RNA, 19 nt, Homo sapiens
cgcaugggcgucaauguuu

SEQ ID NO: 797399 - RNA, 19 nt, Homo sapiens
gcagugaccagcaggaacu

SEQ ID NO: 797400 - RNA, 19 nt, Homo sapiens
uccugagucugaucuguuu

SEQ ID NO: 797401 - RNA, 19 nt, Homo sapiens
ggaacugcccagagaacug

SEQ ID NO: 797402 - RNA, 19 nt, Homo sapiens
gcaugggcgucaauguuuu

SEQ ID NO: 797403 - RNA, 19 nt, Homo sapiens
ucagaacacggcccaagga

SEQ ID NO: 797404 - RNA, 19 nt, Homo sapiens
gccacaaccaggaacacua

SEQ ID NO: 797405 - RNA, 19 nt, Homo sapiens
aagaccaucugcugucaca

SEQ ID NO: 797406 - RNA, 19 nt, Homo sapiens
gcaccaucaggcccaugua

SEQ ID NO: 797407 - RNA, 19 nt, Homo sapiens
gaguaggccaagaaggaaa

SEQ ID NO: 797408 - RNA, 19 nt, Homo sapiens
ugaagaggcagcccuggau

SEQ ID NO: 797409 - RNA, 19 nt, Homo sapiens
gcucagcagcagguacgua

SEQ ID NO: 797410 - RNA, 19 nt, Homo sapiens
cauccugaccuuggcagua

SEQ ID NO: 797411 - RNA, 19 nt, Homo sapiens
gagcagggguaccaaggau

SEQ ID NO: 797412 - RNA, 19 nt, Homo sapiens
cagaacacggcccaaggaa

SEQ ID NO: 797413 - RNA, 19 nt, Homo sapiens
cugcacaccuggccacaac

SEQ ID NO: 797414 - RNA, 19 nt, Homo sapiens
gaccaucugcugucacaac

SEQ ID NO: 797415 - RNA, 19 nt, Homo sapiens
aggaaagccugggaaacug

SEQ ID NO: 797416 - RNA, 19 nt, Homo sapiens
cugaguggcugggauccuu

SEQ ID NO: 797417 - RNA, 19 nt, Homo sapiens
gagaaacuguuccaauuaa

SEQ ID NO: 797418 - RNA, 19 nt, Homo sapiens
gaacagagaagaucacauu

SEQ ID NO: 797419 - RNA, 19 nt, Homo sapiens
cagagaaacuguuccaauu

SEQ ID NO: 797420 - RNA, 19 nt, Homo sapiens
gauaugaccucagcccuaa

SEQ ID NO: 797421 - RNA, 19 nt, Homo sapiens
gaaaaggaauucuccaaaa

SEQ ID NO: 797422 - RNA, 19 nt, Homo sapiens
gaaaguaauggaagaagaa

SEQ ID NO: 797423 - RNA, 19 nt, Homo sapiens
gcacagaaccuggcauuca

SEQ ID NO: 797424 - RNA, 19 nt, Homo sapiens
ggaauccguucuagaggaa

SEQ ID NO: 797425 - RNA, 19 nt, Homo sapiens
ucugagaggugacuccaua

SEQ ID NO: 797426 - RNA, 19 nt, Homo sapiens
gaaaacacuuccugugauu

SEQ ID NO: 797427 - RNA, 19 nt, Homo sapiens
gaccacagguucuuaugau

SEQ ID NO: 797428 - RNA, 19 nt, Homo sapiens
guugacagcuggagacaga

SEQ ID NO: 797429 - RNA, 19 nt, Homo sapiens
gcacaauacaaagaacuua

SEQ ID NO: 797430 - RNA, 19 nt, Homo sapiens
uaagguccacagauuauua

SEQ ID NO: 797431 - RNA, 19 nt, Homo sapiens
ugauaaaccugcuccugaa

SEQ ID NO: 797432 - RNA, 19 nt, Homo sapiens
guuuaaagaugcagagaug

SEQ ID NO: 797433 - RNA, 19 nt, Homo sapiens
augcagagaugaaugaauu

SEQ ID NO: 797434 - RNA, 19 nt, Homo sapiens
agagaaacuguuccaauua

SEQ ID NO: 797435 - RNA, 19 nt, Homo sapiens
ccagugaacgagcaaauaa

SEQ ID NO: 797436 - RNA, 19 nt, Homo sapiens
ugaaaguaauggaagaaga

SEQ ID NO: 797437 - RNA, 19 nt, Homo sapiens
guccacagauuauuagaug

SEQ ID NO: 797438 - RNA, 19 nt, Homo sapiens
gagcagucgucucccuauu

SEQ ID NO: 797439 - RNA, 19 nt, Homo sapiens
gcagagaugaaugaauuaa

SEQ ID NO: 797440 - RNA, 19 nt, Homo sapiens
gcagucgucucccuauuac

SEQ ID NO: 797441 - RNA, 19 nt, Homo sapiens
ucauaagguccacagauua

SEQ ID NO: 797442 - RNA, 19 nt, Homo sapiens
ggaccacagguucuuauga

SEQ ID NO: 797443 - RNA, 19 nt, Homo sapiens
uaccuuggcuggaauguca

SEQ ID NO: 797444 - RNA, 19 nt, Homo sapiens
gaagcauguucuccacaau

SEQ ID NO: 797445 - RNA, 19 nt, Homo sapiens
gaaauuagccgaaaacacu

SEQ ID NO: 797446 - RNA, 19 nt, Homo sapiens
ccaccaggguuuggcagua

SEQ ID NO: 797447 - RNA, 19 nt, Homo sapiens
gaaacuguuccaauuaaag

SEQ ID NO: 797448 - RNA, 19 nt, Homo sapiens
cagcaccacuccuuuccuu

SEQ ID NO: 797449 - RNA, 19 nt, Homo sapiens
ggcaguaccuuggcuggaa

SEQ ID NO: 797450 - RNA, 19 nt, Homo sapiens
ggucaucccuaagccuuug

SEQ ID NO: 797451 - RNA, 19 nt, Homo sapiens
gaucauaagguccacagau

SEQ ID NO: 797452 - RNA, 19 nt, Homo sapiens
ggaaaccgauguggaagac

SEQ ID NO: 797453 - RNA, 19 nt, Homo sapiens
gcguggagguccugcauca

SEQ ID NO: 797454 - RNA, 19 nt, Homo sapiens
gcaccagcaccacuccuuu

SEQ ID NO: 797455 - RNA, 19 nt, Homo sapiens
gcuuagugauggagauaug

SEQ ID NO: 797456 - RNA, 19 nt, Homo sapiens
acaagaagaggcccagaaa

SEQ ID NO: 797457 - RNA, 19 nt, Homo sapiens
agagaugaaugaauuaagg

SEQ ID NO: 797458 - RNA, 19 nt, Homo sapiens
auuauuagauggcauguca

SEQ ID NO: 797459 - RNA, 19 nt, Homo sapiens
gcaguaccuuggcuggaau

SEQ ID NO: 797460 - RNA, 19 nt, Homo sapiens
ggacuuggcagcugcuaag

SEQ ID NO: 797461 - RNA, 19 nt, Homo sapiens
gaucacauuuucuucuuga

SEQ ID NO: 797462 - RNA, 19 nt, Homo sapiens
cagagaagaucacauuuuc

SEQ ID NO: 797463 - RNA, 19 nt, Homo sapiens
agcauguucuccacaauuu

SEQ ID NO: 797464 - RNA, 19 nt, Homo sapiens
ccaugucaguccuaggaaa

SEQ ID NO: 797465 - RNA, 19 nt, Homo sapiens
gaaucugguugcccggaau

SEQ ID NO: 797466 - RNA, 19 nt, Homo sapiens
cagaaaagcuuuguugaca

SEQ ID NO: 797467 - RNA, 19 nt, Homo sapiens
ggagguccugcaucaguuu

SEQ ID NO: 797468 - RNA, 19 nt, Homo sapiens
cuuggcagcugcuaagaga

SEQ ID NO: 797469 - RNA, 19 nt, Homo sapiens
ggaaaaggaauucuccaaa

SEQ ID NO: 797470 - RNA, 19 nt, Homo sapiens
guccugacccagugccuua

SEQ ID NO: 797471 - RNA, 19 nt, Homo sapiens
ugacugcacuuagcauucu

SEQ ID NO: 797472 - RNA, 19 nt, Homo sapiens
uuaaagaugcagagaugaa

SEQ ID NO: 797473 - RNA, 19 nt, Homo sapiens
aucauaagguccacagauu

SEQ ID NO: 797474 - RNA, 19 nt, Homo sapiens
ugguguggcuccuggcuaa

SEQ ID NO: 797475 - RNA, 19 nt, Homo sapiens
agaugaaaguaauggaaga

SEQ ID NO: 797476 - RNA, 19 nt, Homo sapiens
gagaugaaugaauuaagga

SEQ ID NO: 797477 - RNA, 19 nt, Homo sapiens
gaugaaaguaauggaagaa

SEQ ID NO: 797478 - RNA, 19 nt, Homo sapiens
gcacagacaguggcugaca

SEQ ID NO: 797479 - RNA, 19 nt, Homo sapiens
uccaagugcugccaaagug

SEQ ID NO: 797480 - RNA, 19 nt, Homo sapiens
aaacacuuccugugauuuc

SEQ ID NO: 797481 - RNA, 19 nt, Homo sapiens
gcaccacuccuuuccuuac

SEQ ID NO: 797482 - RNA, 19 nt, Homo sapiens
gggcagagaggauaguaag

SEQ ID NO: 797483 - RNA, 19 nt, Homo sapiens
uauaaagccagaagcaugu

SEQ ID NO: 797484 - RNA, 19 nt, Homo sapiens
uccgagggcuuccugaugu

SEQ ID NO: 797485 - RNA, 19 nt, Homo sapiens
gcagugaccagcaggaacu

SEQ ID NO: 797486 - RNA, 19 nt, Homo sapiens
cgaaaacacuuccugugau

SEQ ID NO: 797487 - RNA, 19 nt, Homo sapiens
ccuguuggcuuucucuucu

SEQ ID NO: 797488 - RNA, 19 nt, Homo sapiens
ggaacugcccagagaacug

SEQ ID NO: 797489 - RNA, 19 nt, Homo sapiens
gaguaguaguucugagucu

SEQ ID NO: 797490 - RNA, 19 nt, Homo sapiens
ugagaggugacuccauaaa

SEQ ID NO: 797491 - RNA, 19 nt, Homo sapiens
ugaacgagcaaauaaacug

SEQ ID NO: 797492 - RNA, 19 nt, Homo sapiens
caaagcuccagaccaguga

SEQ ID NO: 797493 - RNA, 19 nt, Homo sapiens
aguaauggaagaagaaguu

SEQ ID NO: 797494 - RNA, 19 nt, Homo sapiens
caucacggccugacagagu

SEQ ID NO: 797495 - RNA, 19 nt, Homo sapiens
gaugcuucuucaccuguug

SEQ ID NO: 797496 - RNA, 19 nt, Homo sapiens
gggacucaccgacacauuc

SEQ ID NO: 797497 - RNA, 19 nt, Homo sapiens
gccagacggagucaggaua

SEQ ID NO: 797498 - RNA, 19 nt, Homo sapiens
uauuagauggcaugucaaa

SEQ ID NO: 797499 - RNA, 19 nt, Homo sapiens
uaaagaugcagagaugaau

SEQ ID NO: 797500 - RNA, 19 nt, Homo sapiens
uggagguccugcaucaguu

SEQ ID NO: 797501 - RNA, 19 nt, Homo sapiens
ucagcucuguucccacuca

SEQ ID NO: 797502 - RNA, 19 nt, Homo sapiens
cgaauuagagguacuucag

SEQ ID NO: 797503 - RNA, 19 nt, Homo sapiens
guacuucaggcacaauaca

SEQ ID NO: 797504 - RNA, 19 nt, Homo sapiens
acccuucugugguuauaaa

SEQ ID NO: 797505 - RNA, 19 nt, Homo sapiens
agcagucgucucccuauua

SEQ ID NO: 797506 - RNA, 19 nt, Homo sapiens
ucaggcacaauacaaagaa

SEQ ID NO: 797507 - RNA, 19 nt, Homo sapiens
ugaagaggcagcccuggau

SEQ ID NO: 797508 - RNA, 19 nt, Homo sapiens
gcgugcugcuggcuguuga

SEQ ID NO: 797509 - RNA, 19 nt, Homo sapiens
ugccaccuccugaguagua

SEQ ID NO: 797510 - RNA, 19 nt, Homo sapiens
gagaucaaacacucaaggu

SEQ ID NO: 797511 - RNA, 19 nt, Homo sapiens
gagaggugacuccauaaaa

SEQ ID NO: 797512 - RNA, 19 nt, Homo sapiens
aagcauguucuccacaauu

SEQ ID NO: 797513 - RNA, 19 nt, Homo sapiens
aagaugcagagaugaauga

SEQ ID NO: 797514 - RNA, 19 nt, Homo sapiens
uugcgagacucacuacauc

SEQ ID NO: 797515 - RNA, 19 nt, Homo sapiens
gaccagugaacgagcaaau

SEQ ID NO: 797516 - RNA, 19 nt, Homo sapiens
cagcacccacuguugaaga

SEQ ID NO: 797517 - RNA, 19 nt, Homo sapiens
gaccaaaucucuuccuuua

SEQ ID NO: 797518 - RNA, 19 nt, Homo sapiens
gauagaagcuguauaaaca

SEQ ID NO: 797519 - RNA, 19 nt, Homo sapiens
gaaagugccugucaguaaa

SEQ ID NO: 797520 - RNA, 19 nt, Homo sapiens
gaaggauacugcaucuuua

SEQ ID NO: 797521 - RNA, 19 nt, Homo sapiens
ggacucacguuaccaauuu

SEQ ID NO: 797522 - RNA, 19 nt, Homo sapiens
ggauaaagaugcaguauuc

SEQ ID NO: 797523 - RNA, 19 nt, Homo sapiens
agacugagaugguaaguua

SEQ ID NO: 797524 - RNA, 19 nt, Homo sapiens
guucauggauguagaaaua

SEQ ID NO: 797525 - RNA, 19 nt, Homo sapiens
gaacagaccaccuuuaaga

SEQ ID NO: 797526 - RNA, 19 nt, Homo sapiens
gaugguaaguuaacugaua

SEQ ID NO: 797527 - RNA, 19 nt, Homo sapiens
gaauugagcugugaacuga

SEQ ID NO: 797528 - RNA, 19 nt, Homo sapiens
gaacacaaaucugaacauu

SEQ ID NO: 797529 - RNA, 19 nt, Homo sapiens
gaacacacauccaaucugu

SEQ ID NO: 797530 - RNA, 19 nt, Homo sapiens
gaaaccaccuucccagauu

SEQ ID NO: 797531 - RNA, 19 nt, Homo sapiens
gcagacaacugauuccaaa

SEQ ID NO: 797532 - RNA, 19 nt, Homo sapiens
agacugagauuucuaauga

SEQ ID NO: 797533 - RNA, 19 nt, Homo sapiens
ccaaugagauauuccuaua

SEQ ID NO: 797534 - RNA, 19 nt, Homo sapiens
caagggaguuacauuauuu

SEQ ID NO: 797535 - RNA, 19 nt, Homo sapiens
gcaacaaaguguacacaaa

SEQ ID NO: 797536 - RNA, 19 nt, Homo sapiens
gguagugacuguauuguuu

SEQ ID NO: 797537 - RNA, 19 nt, Homo sapiens
gcaauagacuaggcaauuu

SEQ ID NO: 797538 - RNA, 19 nt, Homo sapiens
guaagaagcuguccaacau

SEQ ID NO: 797539 - RNA, 19 nt, Homo sapiens
ccaguggacuugucaauaa

SEQ ID NO: 797540 - RNA, 19 nt, Homo sapiens
gaaguucgcucguucagau

SEQ ID NO: 797541 - RNA, 19 nt, Homo sapiens
ggaaagagagcuucuaguu

SEQ ID NO: 797542 - RNA, 19 nt, Homo sapiens
gaaagagagcuucuaguuu

SEQ ID NO: 797543 - RNA, 19 nt, Homo sapiens
ccagaaagccuuaauauuc

SEQ ID NO: 797544 - RNA, 19 nt, Homo sapiens
ggucugaucuuaaguuguu

SEQ ID NO: 797545 - RNA, 19 nt, Homo sapiens
gaaacaguauguaugauuc

SEQ ID NO: 797546 - RNA, 19 nt, Homo sapiens
caagugaaguguagauuug

SEQ ID NO: 797547 - RNA, 19 nt, Homo sapiens
gaagagacaggcauuguuu

SEQ ID NO: 797548 - RNA, 19 nt, Homo sapiens
gcaugaagguuaaauaaag

SEQ ID NO: 797549 - RNA, 19 nt, Homo sapiens
gcaaauguguugaguucuu

SEQ ID NO: 797550 - RNA, 19 nt, Homo sapiens
caaagcagguucaucaaga

SEQ ID NO: 797551 - RNA, 19 nt, Homo sapiens
gauuaaacauucaggcuuu

SEQ ID NO: 797552 - RNA, 19 nt, Homo sapiens
guauucaacuuuccuauga

SEQ ID NO: 797553 - RNA, 19 nt, Homo sapiens
gcagguaaauguauucuag

SEQ ID NO: 797554 - RNA, 19 nt, Homo sapiens
ggaaucaguucauuagaau

SEQ ID NO: 797555 - RNA, 19 nt, Homo sapiens
gaauaaaucucucagucau

SEQ ID NO: 797556 - RNA, 19 nt, Homo sapiens
gagaacagaccaccuuuaa

SEQ ID NO: 797557 - RNA, 19 nt, Homo sapiens
gcaaagauuguguucauuu

SEQ ID NO: 797558 - RNA, 19 nt, Homo sapiens
gaaauggaaugucuucagu

SEQ ID NO: 797559 - RNA, 19 nt, Homo sapiens
gcaaucgaaugaauaauca

SEQ ID NO: 797560 - RNA, 19 nt, Homo sapiens
ggacugugauuaaacauuc

SEQ ID NO: 797561 - RNA, 19 nt, Homo sapiens
gaaauaaugcgccucuuga

SEQ ID NO: 797562 - RNA, 19 nt, Homo sapiens
gaacaagggucuccaaacg

SEQ ID NO: 797563 - RNA, 19 nt, Homo sapiens
ccaauuaagugucaaagga

SEQ ID NO: 797564 - RNA, 19 nt, Homo sapiens
gagcacaaauucacccaaa

SEQ ID NO: 797565 - RNA, 19 nt, Homo sapiens
ucuaaugacuucaccauaa

SEQ ID NO: 797566 - RNA, 19 nt, Homo sapiens
gcacgugggugucccgaaa

SEQ ID NO: 797567 - RNA, 19 nt, Homo sapiens
cagaaagccuuaauauuca

SEQ ID NO: 797568 - RNA, 19 nt, Homo sapiens
ggacugugaucgcagcuuu

SEQ ID NO: 797569 - RNA, 19 nt, Homo sapiens
caaauguguugaguucuua

SEQ ID NO: 797570 - RNA, 19 nt, Homo sapiens
aaucaaaucuguucacaug

SEQ ID NO: 797571 - RNA, 19 nt, Homo sapiens
gcaacccuguuauaaguuu

SEQ ID NO: 797572 - RNA, 19 nt, Homo sapiens
gaaguaaggguuaauagga

SEQ ID NO: 797573 - RNA, 19 nt, Homo sapiens
ccagugggcuaacaaauau

SEQ ID NO: 797574 - RNA, 19 nt, Homo sapiens
ccaaaucucuuccuuuagu

SEQ ID NO: 797575 - RNA, 19 nt, Homo sapiens
gauaagugacucuccaaua

SEQ ID NO: 797576 - RNA, 19 nt, Homo sapiens
gagaaugcuucccauagaa

SEQ ID NO: 797577 - RNA, 19 nt, Homo sapiens
gcacugagguaaucuuucu

SEQ ID NO: 797578 - RNA, 19 nt, Homo sapiens
caaagucagugaacaugaa

SEQ ID NO: 797579 - RNA, 19 nt, Homo sapiens
caaggucucugacaguauu

SEQ ID NO: 797580 - RNA, 19 nt, Homo sapiens
gcaaaagacugaaggauau

SEQ ID NO: 797581 - RNA, 19 nt, Homo sapiens
guucagauaugccuuguau

SEQ ID NO: 797582 - RNA, 19 nt, Homo sapiens
aauguugccuguaaacuua

SEQ ID NO: 797583 - RNA, 19 nt, Homo sapiens
acagaaacauccuuuaguu

SEQ ID NO: 797584 - RNA, 19 nt, Homo sapiens
ucaaggcucuuuccuauca

SEQ ID NO: 797585 - RNA, 19 nt, Homo sapiens
caucuucccuuucugcuaa

SEQ ID NO: 797586 - RNA, 19 nt, Homo sapiens
ggaaacagucgccucagua

SEQ ID NO: 797587 - RNA, 19 nt, Homo sapiens
ccauggaacuagugauuaa

SEQ ID NO: 797588 - RNA, 19 nt, Homo sapiens
gaugaaguauguugggaaa

SEQ ID NO: 797589 - RNA, 19 nt, Homo sapiens
gaucuaagcacaauuaagu

SEQ ID NO: 797590 - RNA, 19 nt, Homo sapiens
gcaguucuagugauaaaua

SEQ ID NO: 797591 - RNA, 19 nt, Homo sapiens
caacgagcauucuuucaga

SEQ ID NO: 797592 - RNA, 19 nt, Homo sapiens
gcagguucaucaagacuuu

SEQ ID NO: 797593 - RNA, 19 nt, Homo sapiens
cagcaaaccaugaagauaa

SEQ ID NO: 797594 - RNA, 19 nt, Homo sapiens
uaacccauguccacugaua

SEQ ID NO: 797595 - RNA, 19 nt, Homo sapiens
ugagguaacucuuaugaau

SEQ ID NO: 797596 - RNA, 19 nt, Homo sapiens
gaagggaucuaagcacaau

SEQ ID NO: 797597 - RNA, 19 nt, Homo sapiens
agagaaaccuuacaagugu

SEQ ID NO: 797598 - RNA, 19 nt, Homo sapiens
ggauccaaaucuagugaua

SEQ ID NO: 797599 - RNA, 19 nt, Homo sapiens
aaagagagcuucuaguuuu

SEQ ID NO: 797600 - RNA, 19 nt, Homo sapiens
gaaagugguuugggacaga

SEQ ID NO: 797601 - RNA, 19 nt, Homo sapiens
gauaaaaccugucagcauu

SEQ ID NO: 797602 - RNA, 19 nt, Homo sapiens
gagagaaaccuuacaagug

SEQ ID NO: 797603 - RNA, 19 nt, Homo sapiens
aaggagagauaauggauaa

SEQ ID NO: 797604 - RNA, 19 nt, Homo sapiens
acacaugacuuaacaaugg

SEQ ID NO: 797605 - RNA, 19 nt, Homo sapiens
gaaaccggcuuauaauacu

SEQ ID NO: 797606 - RNA, 19 nt, Homo sapiens
aaacuuagcagguaaaugu

SEQ ID NO: 797607 - RNA, 19 nt, Homo sapiens
uggaauagcuuaugcaaag

SEQ ID NO: 797608 - RNA, 19 nt, Homo sapiens
gcaccuaguuggcaaguag

SEQ ID NO: 797609 - RNA, 19 nt, Homo sapiens
caaagcaaguguuccaugu

SEQ ID NO: 797610 - RNA, 19 nt, Homo sapiens
gagagauaauggauaauuc

SEQ ID NO: 797611 - RNA, 19 nt, Homo sapiens
ccacacugccuuccacuua

SEQ ID NO: 797612 - RNA, 19 nt, Homo sapiens
cauaugacauuucuacuca

SEQ ID NO: 797613 - RNA, 19 nt, Homo sapiens
gaaugugagguaacucuua

SEQ ID NO: 797614 - RNA, 19 nt, Homo sapiens
uaccaaagcugcaacugaa

SEQ ID NO: 797615 - RNA, 19 nt, Homo sapiens
ggaagagccuccauuucau

SEQ ID NO: 797616 - RNA, 19 nt, Homo sapiens
aagcagagauggaaauaau

SEQ ID NO: 797617 - RNA, 19 nt, Homo sapiens
ccaguggacuugucaauaa

SEQ ID NO: 797618 - RNA, 19 nt, Homo sapiens
gcaaaguauuguuaucuug

SEQ ID NO: 797619 - RNA, 19 nt, Homo sapiens
gaacaagggucuccaaacg

SEQ ID NO: 797620 - RNA, 19 nt, Homo sapiens
ggaaauucaugcuuugaug

SEQ ID NO: 797621 - RNA, 19 nt, Homo sapiens
gaccuuagauagcguuaau

SEQ ID NO: 797622 - RNA, 19 nt, Homo sapiens
gaaaugugaacaacacuau

SEQ ID NO: 797623 - RNA, 19 nt, Homo sapiens
ccaaaugugaccuuagaua

SEQ ID NO: 797624 - RNA, 19 nt, Homo sapiens
gaugaugaccugccaaaug

SEQ ID NO: 797625 - RNA, 19 nt, Homo sapiens
agggaaauauggcaaagua

SEQ ID NO: 797626 - RNA, 19 nt, Homo sapiens
ccaagguguucaauggaua

SEQ ID NO: 797627 - RNA, 19 nt, Homo sapiens
aaacagagcuuuuggaauc

SEQ ID NO: 797628 - RNA, 19 nt, Homo sapiens
gcacgaaugucagcagcuu

SEQ ID NO: 797629 - RNA, 19 nt, Homo sapiens
ccagagcaguacaagagua

SEQ ID NO: 797630 - RNA, 19 nt, Homo sapiens
ggcagagaauggaguguuu

SEQ ID NO: 797631 - RNA, 19 nt, Homo sapiens
uuucagcccucguuuauug

SEQ ID NO: 797632 - RNA, 19 nt, Homo sapiens
gaacaaauggaugaaugaa

SEQ ID NO: 797633 - RNA, 19 nt, Homo sapiens
caaugugacucuaagaaca

SEQ ID NO: 797634 - RNA, 19 nt, Homo sapiens
gaugagauauaagaccuau

SEQ ID NO: 797635 - RNA, 19 nt, Homo sapiens
gcugugaacuggcacgaau

SEQ ID NO: 797636 - RNA, 19 nt, Homo sapiens
ggaaauuacagaauagcuu

SEQ ID NO: 797637 - RNA, 19 nt, Homo sapiens
ggcaaaguauuguuaucuu

SEQ ID NO: 797638 - RNA, 19 nt, Homo sapiens
ccaugaauuuacagucuaa

SEQ ID NO: 797639 - RNA, 19 nt, Homo sapiens
ggaaaugugaacaacacua

SEQ ID NO: 797640 - RNA, 19 nt, Homo sapiens
ggaggacucguuaucugua

SEQ ID NO: 797641 - RNA, 19 nt, Homo sapiens
guagaucacuuccaaacac

SEQ ID NO: 797642 - RNA, 19 nt, Homo sapiens
aagaacaaauggaugaaug

SEQ ID NO: 797643 - RNA, 19 nt, Homo sapiens
gauuucagcccucguuuau

SEQ ID NO: 797644 - RNA, 19 nt, Homo sapiens
gagaggccauggcaaagca

SEQ ID NO: 797645 - RNA, 19 nt, Homo sapiens
uaccuagaauugaaccuaa

SEQ ID NO: 797646 - RNA, 19 nt, Homo sapiens
gguguucaauggauaaugg

SEQ ID NO: 797647 - RNA, 19 nt, Homo sapiens
caaaugugaccuuagauag

SEQ ID NO: 797648 - RNA, 19 nt, Homo sapiens
cuaacaaacugagucaugu

SEQ ID NO: 797649 - RNA, 19 nt, Homo sapiens
cagcuucuguucaggauca

SEQ ID NO: 797650 - RNA, 19 nt, Homo sapiens
cuccaaacguccacaacua

SEQ ID NO: 797651 - RNA, 19 nt, Homo sapiens
ggaccgcaggguuagauuu

SEQ ID NO: 797652 - RNA, 19 nt, Homo sapiens
ugagauauaagaccuaugu

SEQ ID NO: 797653 - RNA, 19 nt, Homo sapiens
caagucccaugaauuuaca

SEQ ID NO: 797654 - RNA, 19 nt, Homo sapiens
caacaccuuugagaacaga

SEQ ID NO: 797655 - RNA, 19 nt, Homo sapiens
caaagucaagggaaauaug

SEQ ID NO: 797656 - RNA, 19 nt, Homo sapiens
aagaguaaguaucacauuc

SEQ ID NO: 797657 - RNA, 19 nt, Homo sapiens
ugccaaaugugaccuuaga

SEQ ID NO: 797658 - RNA, 19 nt, Homo sapiens
gaucacuuccaaacacaaa

SEQ ID NO: 797659 - RNA, 19 nt, Homo sapiens
guuggaaauucaugcuuug

SEQ ID NO: 797660 - RNA, 19 nt, Homo sapiens
gccaagguguucaauggau

SEQ ID NO: 797661 - RNA, 19 nt, Homo sapiens
augaugaccugccaaaugu

SEQ ID NO: 797662 - RNA, 19 nt, Homo sapiens
gcaucugccuccucaccuu

SEQ ID NO: 797663 - RNA, 19 nt, Homo sapiens
caguggacuugucaauaaa

SEQ ID NO: 797664 - RNA, 19 nt, Homo sapiens
caagaguaaguaucacauu

SEQ ID NO: 797665 - RNA, 19 nt, Homo sapiens
gaugaccugccaaauguga

SEQ ID NO: 797666 - RNA, 19 nt, Homo sapiens
aaagugacagugaugauga

SEQ ID NO: 797667 - RNA, 19 nt, Homo sapiens
ggaucaaugugacucuaag

SEQ ID NO: 797668 - RNA, 19 nt, Homo sapiens
gagauuagggcagagaaug

SEQ ID NO: 797669 - RNA, 19 nt, Homo sapiens
ugaaugcucuuugggagau

SEQ ID NO: 797670 - RNA, 19 nt, Homo sapiens
ucuaagaacaaauggauga

SEQ ID NO: 797671 - RNA, 19 nt, Homo sapiens
caagguguucaauggauaa

SEQ ID NO: 797672 - RNA, 19 nt, Homo sapiens
guaccuagaauugaaccua

SEQ ID NO: 797673 - RNA, 19 nt, Homo sapiens
ccuuguaccuagaauugaa

SEQ ID NO: 797674 - RNA, 19 nt, Homo sapiens
gaauggaguguuuuaauga

SEQ ID NO: 797675 - RNA, 19 nt, Homo sapiens
aauggaaacugcagcaucu

SEQ ID NO: 797676 - RNA, 19 nt, Homo sapiens
uacacaaagucaagggaaa

SEQ ID NO: 797677 - RNA, 19 nt, Homo sapiens
gccaguggacuugucaaua

SEQ ID NO: 797678 - RNA, 19 nt, Homo sapiens
gaggacucguuaucuguag

SEQ ID NO: 797679 - RNA, 19 nt, Homo sapiens
caagggaaauauggcaaag

SEQ ID NO: 797680 - RNA, 19 nt, Homo sapiens
gcaguacaagaguaaguau

SEQ ID NO: 797681 - RNA, 19 nt, Homo sapiens
cagagcaguacaagaguaa

SEQ ID NO: 797682 - RNA, 19 nt, Homo sapiens
aagaauaucaacaccuuug

SEQ ID NO: 797683 - RNA, 19 nt, Homo sapiens
gcuuugaugagauauaaga

SEQ ID NO: 797684 - RNA, 19 nt, Homo sapiens
aguuggaaauucaugcuuu

SEQ ID NO: 797685 - RNA, 19 nt, Homo sapiens
gaucaaugugacucuaaga

SEQ ID NO: 797686 - RNA, 19 nt, Homo sapiens
ugacagugaugaugaugac

SEQ ID NO: 797687 - RNA, 19 nt, Homo sapiens
cacaaagucaagggaaaua

SEQ ID NO: 797688 - RNA, 19 nt, Homo sapiens
caggaucaaugugacucua

SEQ ID NO: 797689 - RNA, 19 nt, Homo sapiens
cccaugaauuuacagucua

SEQ ID NO: 797690 - RNA, 19 nt, Homo sapiens
acagaauguuaaugcuuga

SEQ ID NO: 797691 - RNA, 19 nt, Homo sapiens
gaucuacggcccuuuccau

SEQ ID NO: 797692 - RNA, 19 nt, Homo sapiens
uagauagcguuaaugaaac

SEQ ID NO: 797693 - RNA, 19 nt, Homo sapiens
ccuuagauagcguuaauga

SEQ ID NO: 797694 - RNA, 19 nt, Homo sapiens
uaucacaucaguaucuuca

SEQ ID NO: 797695 - RNA, 19 nt, Homo sapiens
gcacccuucuccugaacuc

SEQ ID NO: 797696 - RNA, 19 nt, Homo sapiens
agaacaaauggaugaauga

SEQ ID NO: 797697 - RNA, 19 nt, Homo sapiens
ugaacuggcacgaauguca

SEQ ID NO: 797698 - RNA, 19 nt, Homo sapiens
uuccauagccagagcagua

SEQ ID NO: 797699 - RNA, 19 nt, Homo sapiens
aaugugaacaacacuauug

SEQ ID NO: 797700 - RNA, 19 nt, Homo sapiens
gaccgcaggguuagauuuc

SEQ ID NO: 797701 - RNA, 19 nt, Homo sapiens
guucaauggauaauggaaa

SEQ ID NO: 797702 - RNA, 19 nt, Homo sapiens
gaauugccaagguguucaa

SEQ ID NO: 797703 - RNA, 19 nt, Homo sapiens
gagcaguacaagaguaagu

SEQ ID NO: 797704 - RNA, 19 nt, Homo sapiens
guuaucacaucaguaucuu

SEQ ID NO: 797705 - RNA, 19 nt, Homo sapiens
ccggaggacucguuaucug

SEQ ID NO: 797706 - RNA, 19 nt, Homo sapiens
ucaagggaaauauggcaaa

SEQ ID NO: 797707 - RNA, 19 nt, Homo sapiens
agaauggaguguuuuaaug

SEQ ID NO: 797708 - RNA, 19 nt, Homo sapiens
gggcagagaauggaguguu

SEQ ID NO: 797709 - RNA, 19 nt, Homo sapiens
ggagauuagggcagagaau

SEQ ID NO: 797710 - RNA, 19 nt, Homo sapiens
uagaucacuuccaaacaca

SEQ ID NO: 797711 - RNA, 19 nt, Homo sapiens
agagagaaagggagagaga

SEQ ID NO: 797712 - RNA, 19 nt, Homo sapiens
ucacaggaugaauuaagaa

SEQ ID NO: 797713 - RNA, 19 nt, Homo sapiens
aggccuaucucccagacaa

SEQ ID NO: 797714 - RNA, 19 nt, Homo sapiens
ucaagucccaugaauuuac

SEQ ID NO: 797715 - RNA, 19 nt, Homo sapiens
caaccuuguaccuagaauu

SEQ ID NO: 797716 - RNA, 19 nt, Homo sapiens
ucagucaaccuuguaccua

SEQ ID NO: 797717 - RNA, 19 nt, Homo sapiens
ggaaagagcauaacaagua

SEQ ID NO: 797718 - RNA, 19 nt, Homo sapiens
gagagaagccuuauaaaug

SEQ ID NO: 797719 - RNA, 19 nt, Homo sapiens
gaaauuugcucgcucagau

SEQ ID NO: 797720 - RNA, 19 nt, Homo sapiens
gaagacggauucaccaaug

SEQ ID NO: 797721 - RNA, 19 nt, Homo sapiens
cagcagaucuuacauguca

SEQ ID NO: 797722 - RNA, 19 nt, Homo sapiens
gagauagaauacagaagua

SEQ ID NO: 797723 - RNA, 19 nt, Homo sapiens
ggauuugguuucugaguuu

SEQ ID NO: 797724 - RNA, 19 nt, Homo sapiens
gaaagagcauaacaaguag

SEQ ID NO: 797725 - RNA, 19 nt, Homo sapiens
ggccggaacugaauuggua

SEQ ID NO: 797726 - RNA, 19 nt, Homo sapiens
acaaguaguugauugguaa

SEQ ID NO: 797727 - RNA, 19 nt, Homo sapiens
ggagagaagccuuauaaau

SEQ ID NO: 797728 - RNA, 19 nt, Homo sapiens
gaacaaacauacgcugcuu

SEQ ID NO: 797729 - RNA, 19 nt, Homo sapiens
cuagaacucuuauccauau

SEQ ID NO: 797730 - RNA, 19 nt, Homo sapiens
aagcugcgcugguaucuuu

SEQ ID NO: 797731 - RNA, 19 nt, Homo sapiens
gaucagcucaggaguauga

SEQ ID NO: 797732 - RNA, 19 nt, Homo sapiens
gaacucuuauccauauguu

SEQ ID NO: 797733 - RNA, 19 nt, Homo sapiens
aaacauacgcugcuuuauu

SEQ ID NO: 797734 - RNA, 19 nt, Homo sapiens
cagcaaacauuccuacugu

SEQ ID NO: 797735 - RNA, 19 nt, Homo sapiens
ggagaacccagcacuguuu

SEQ ID NO: 797736 - RNA, 19 nt, Homo sapiens
uagagaagcugcgcuggua

SEQ ID NO: 797737 - RNA, 19 nt, Homo sapiens
caaaagcucucaccugaaa

SEQ ID NO: 797738 - RNA, 19 nt, Homo sapiens
gcaagaaccagcagcaaug

SEQ ID NO: 797739 - RNA, 19 nt, Homo sapiens
cauaacaaguaguugauug

SEQ ID NO: 797740 - RNA, 19 nt, Homo sapiens
gcacaggucacacuagaga

SEQ ID NO: 797741 - RNA, 19 nt, Homo sapiens
caggagagaagccuuauaa

SEQ ID NO: 797742 - RNA, 19 nt, Homo sapiens
cagcgaacccacuuuauuu

SEQ ID NO: 797743 - RNA, 19 nt, Homo sapiens
gagcauaacaaguaguuga

SEQ ID NO: 797744 - RNA, 19 nt, Homo sapiens
uaauaugacuucuccaaca

SEQ ID NO: 797745 - RNA, 19 nt, Homo sapiens
gcgaucagcucaggaguau

SEQ ID NO: 797746 - RNA, 19 nt, Homo sapiens
guaguugauugguaagauu

SEQ ID NO: 797747 - RNA, 19 nt, Homo sapiens
gcagcaaaguguacaccaa

SEQ ID NO: 797748 - RNA, 19 nt, Homo sapiens
gcuacaagcuccaauacgu

SEQ ID NO: 797749 - RNA, 19 nt, Homo sapiens
aacauacgcugcuuuauuc

SEQ ID NO: 797750 - RNA, 19 nt, Homo sapiens
acaaacauacgcugcuuua

SEQ ID NO: 797751 - RNA, 19 nt, Homo sapiens
aaacaggaaucaaacucaa

SEQ ID NO: 797752 - RNA, 19 nt, Homo sapiens
gggauuugguuucugaguu

SEQ ID NO: 797753 - RNA, 19 nt, Homo sapiens
uaagauggguggccugaag

SEQ ID NO: 797754 - RNA, 19 nt, Homo sapiens
cuagugacauggucgauau

SEQ ID NO: 797755 - RNA, 19 nt, Homo sapiens
auacgcugcuuuauucuuu

SEQ ID NO: 797756 - RNA, 19 nt, Homo sapiens
cagucagucugccaaauaa

SEQ ID NO: 797757 - RNA, 19 nt, Homo sapiens
gcucaccgcagaauccaua

SEQ ID NO: 797758 - RNA, 19 nt, Homo sapiens
gagcuuuguuucccuuguu

SEQ ID NO: 797759 - RNA, 19 nt, Homo sapiens
acccagcacuguuuaauga

SEQ ID NO: 797760 - RNA, 19 nt, Homo sapiens
ucaaggcugugaacaaaca

SEQ ID NO: 797761 - RNA, 19 nt, Homo sapiens
gacuucagcuugcauaugg

SEQ ID NO: 797762 - RNA, 19 nt, Homo sapiens
agagaagccuuauaaaugc

SEQ ID NO: 797763 - RNA, 19 nt, Homo sapiens
acucaaggcugugaacaaa

SEQ ID NO: 797764 - RNA, 19 nt, Homo sapiens
gccagcagaucuuacaugu

SEQ ID NO: 797765 - RNA, 19 nt, Homo sapiens
gagaacccagcacuguuua

SEQ ID NO: 797766 - RNA, 19 nt, Homo sapiens
ggaaugaggaguucuuguc

SEQ ID NO: 797767 - RNA, 19 nt, Homo sapiens
ucagucagucugccaaaua

SEQ ID NO: 797768 - RNA, 19 nt, Homo sapiens
gaacggaggaccuuaagcu

SEQ ID NO: 797769 - RNA, 19 nt, Homo sapiens
acagggauuugguuucuga

SEQ ID NO: 797770 - RNA, 19 nt, Homo sapiens
cuaaauggaaagagcauaa

SEQ ID NO: 797771 - RNA, 19 nt, Homo sapiens
cagcagcaauggcccaaau

SEQ ID NO: 797772 - RNA, 19 nt, Homo sapiens
gaggagaguacaauugaga

SEQ ID NO: 797773 - RNA, 19 nt, Homo sapiens
gacaugagcacuucagcaa

SEQ ID NO: 797774 - RNA, 19 nt, Homo sapiens
caguugaccucuccuuuca

SEQ ID NO: 797775 - RNA, 19 nt, Homo sapiens
ugaggcacauucccaguga

SEQ ID NO: 797776 - RNA, 19 nt, Homo sapiens
ucgcuugacuugaagagaa

SEQ ID NO: 797777 - RNA, 19 nt, Homo sapiens
gaucuuacaugucauucac

SEQ ID NO: 797778 - RNA, 19 nt, Homo sapiens
gcagaucuuacaugucauu

SEQ ID NO: 797779 - RNA, 19 nt, Homo sapiens
ccagcgaacccacuuuauu

SEQ ID NO: 797780 - RNA, 19 nt, Homo sapiens
gaacccagcacuguuuaau

SEQ ID NO: 797781 - RNA, 19 nt, Homo sapiens
caugaguucuggacacuuc

SEQ ID NO: 797782 - RNA, 19 nt, Homo sapiens
gauggcugcuccuggaaau

SEQ ID NO: 797783 - RNA, 19 nt, Homo sapiens
gugaggagaguacaauuga

SEQ ID NO: 797784 - RNA, 19 nt, Homo sapiens
gcccagcgaacccacuuua

SEQ ID NO: 797785 - RNA, 19 nt, Homo sapiens
ccgcacaggucacacuaga

SEQ ID NO: 797786 - RNA, 19 nt, Homo sapiens
cuuaagcucuggccacuuc

SEQ ID NO: 797787 - RNA, 19 nt, Homo sapiens
uuacaugucauucacacua

SEQ ID NO: 797788 - RNA, 19 nt, Homo sapiens
caucugacaugagcacuuc

SEQ ID NO: 797789 - RNA, 19 nt, Homo sapiens
ccuucaggauuaaagauuu

SEQ ID NO: 797790 - RNA, 19 nt, Homo sapiens
gaugagcucacucgccauu

SEQ ID NO: 797791 - RNA, 19 nt, Homo sapiens
gagaagccuuauaaaugca

SEQ ID NO: 797792 - RNA, 19 nt, Homo sapiens
cagcaaaguguacaccaaa

SEQ ID NO: 797793 - RNA, 19 nt, Homo sapiens
gguccaacuuaauucagaa

SEQ ID NO: 797794 - RNA, 19 nt, Homo sapiens
gugcugagguugggacaau

SEQ ID NO: 797795 - RNA, 19 nt, Homo sapiens
caugagcacuucagcaaac

SEQ ID NO: 797796 - RNA, 19 nt, Homo sapiens
caaugcagguauucaagca

SEQ ID NO: 797797 - RNA, 19 nt, Homo sapiens
aacaaguaguugauuggua

SEQ ID NO: 797798 - RNA, 19 nt, Homo sapiens
guccucagcuagugacaug

SEQ ID NO: 797799 - RNA, 19 nt, Homo sapiens
gguugaagcagcccacuga

SEQ ID NO: 797800 - RNA, 19 nt, Homo sapiens
gagcacuucagcaaacauu

SEQ ID NO: 797801 - RNA, 19 nt, Homo sapiens
ugagauagaauacagaagu

SEQ ID NO: 797802 - RNA, 19 nt, Homo sapiens
gacauggucgauauggaua

SEQ ID NO: 797803 - RNA, 19 nt, Homo sapiens
ugagcucacucgccauuuc

SEQ ID NO: 797804 - RNA, 19 nt, Homo sapiens
agacagugcuggugcuucu

SEQ ID NO: 797805 - RNA, 19 nt, Homo sapiens
gaauaagcugagucccaua

SEQ ID NO: 797806 - RNA, 19 nt, Homo sapiens
gcaggaugcagcaaagugu

SEQ ID NO: 797807 - RNA, 19 nt, Homo sapiens
gcucaaugcagguauucaa

SEQ ID NO: 797808 - RNA, 19 nt, Homo sapiens
gcugagguugggacaauuu

SEQ ID NO: 797809 - RNA, 19 nt, Homo sapiens
caaugugacuuugcaggau

SEQ ID NO: 797810 - RNA, 19 nt, Homo sapiens
gagaagacggauucaccaa

SEQ ID NO: 797811 - RNA, 19 nt, Homo sapiens
ggagguccaacuuaauuca

SEQ ID NO: 797812 - RNA, 19 nt, Homo sapiens
ucaagggaaugaggaguuc

SEQ ID NO: 797813 - RNA, 19 nt, Homo sapiens
gcauaacaaguaguugauu

SEQ ID NO: 797814 - RNA, 19 nt, Homo sapiens
cauggucgauauggauaaa

SEQ ID NO: 797815 - RNA, 19 nt, Homo sapiens
ggaaauuugcucgcucaga

SEQ ID NO: 797816 - RNA, 19 nt, Homo sapiens
guuggaugcuugagagcuu

SEQ ID NO: 797817 - RNA, 19 nt, Homo sapiens
ggaaagaaauggaaacuua

SEQ ID NO: 797818 - RNA, 19 nt, Homo sapiens
gaauguagcugcagagaua

SEQ ID NO: 797819 - RNA, 19 nt, Homo sapiens
gaauagcgauugugucaua

SEQ ID NO: 797820 - RNA, 19 nt, Homo sapiens
ggaaagaggugcugcuauu

SEQ ID NO: 797821 - RNA, 19 nt, Homo sapiens
caauaaagcuuucuguuug

SEQ ID NO: 797822 - RNA, 19 nt, Homo sapiens
gcaaguaugugguuuauca

SEQ ID NO: 797823 - RNA, 19 nt, Homo sapiens
gagaagauguugaauauag

SEQ ID NO: 797824 - RNA, 19 nt, Homo sapiens
cgaaagaagucugauguua

SEQ ID NO: 797825 - RNA, 19 nt, Homo sapiens
gaagaugacuuugacauau

SEQ ID NO: 797826 - RNA, 19 nt, Homo sapiens
gaaacuccgucucuacuaa

SEQ ID NO: 797827 - RNA, 19 nt, Homo sapiens
gaaaguacaugaugaaggu

SEQ ID NO: 797828 - RNA, 19 nt, Homo sapiens
ggaacagacucaguuauaa

SEQ ID NO: 797829 - RNA, 19 nt, Homo sapiens
ggaggaagaugacguugaa

SEQ ID NO: 797830 - RNA, 19 nt, Homo sapiens
caacagacccugcguacua

SEQ ID NO: 797831 - RNA, 19 nt, Homo sapiens
cagaagaacagaagaaaua

SEQ ID NO: 797832 - RNA, 19 nt, Homo sapiens
gggagaagcuuuaucaaca

SEQ ID NO: 797833 - RNA, 19 nt, Homo sapiens
caucaacacugucuucuug

SEQ ID NO: 797834 - RNA, 19 nt, Homo sapiens
ccaaguaccucguguggaa

SEQ ID NO: 797835 - RNA, 19 nt, Homo sapiens
gaacagacucaguuauaaa

SEQ ID NO: 797836 - RNA, 19 nt, Homo sapiens
ggaagaugacguugaauuu

SEQ ID NO: 797837 - RNA, 19 nt, Homo sapiens
gcacugauauuugaagaug

SEQ ID NO: 797838 - RNA, 19 nt, Homo sapiens
guaaugaacuguguacuuc

SEQ ID NO: 797839 - RNA, 19 nt, Homo sapiens
gaaagccucuggaagacuu

SEQ ID NO: 797840 - RNA, 19 nt, Homo sapiens
ucgcaaagccaaauaaaua

SEQ ID NO: 797841 - RNA, 19 nt, Homo sapiens
gaaaauaugugggaaugua

SEQ ID NO: 797842 - RNA, 19 nt, Homo sapiens
gaaagaggugcugcuauua

SEQ ID NO: 797843 - RNA, 19 nt, Homo sapiens
cuucuacucuuucugauua

SEQ ID NO: 797844 - RNA, 19 nt, Homo sapiens
aagcaugccuuguucauuu

SEQ ID NO: 797845 - RNA, 19 nt, Homo sapiens
ggaguggauucaccaaauu

SEQ ID NO: 797846 - RNA, 19 nt, Homo sapiens
guuagaaugucucaucaaa

SEQ ID NO: 797847 - RNA, 19 nt, Homo sapiens
gacacacucuugagcauuu

SEQ ID NO: 797848 - RNA, 19 nt, Homo sapiens
ggucaucucuucugaucuu

SEQ ID NO: 797849 - RNA, 19 nt, Homo sapiens
cauccuacuuugucaguua

SEQ ID NO: 797850 - RNA, 19 nt, Homo sapiens
guacaaugauuucuaccuu

SEQ ID NO: 797851 - RNA, 19 nt, Homo sapiens
gaaugaaggugguggucaa

SEQ ID NO: 797852 - RNA, 19 nt, Homo sapiens
ccaauccucucaagaaguu

SEQ ID NO: 797853 - RNA, 19 nt, Homo sapiens
gcucagggucuucaaguua

SEQ ID NO: 797854 - RNA, 19 nt, Homo sapiens
gcgauugugucauauauuc

SEQ ID NO: 797855 - RNA, 19 nt, Homo sapiens
ugaaagcaaugauggaaga

SEQ ID NO: 797856 - RNA, 19 nt, Homo sapiens
guacauugcugugauuuua

SEQ ID NO: 797857 - RNA, 19 nt, Homo sapiens
ggaggagcuugguauacua

SEQ ID NO: 797858 - RNA, 19 nt, Homo sapiens
gccaauaaaugaauagcuu

SEQ ID NO: 797859 - RNA, 19 nt, Homo sapiens
gugcuucuuuccauuguua

SEQ ID NO: 797860 - RNA, 19 nt, Homo sapiens
gcaagaagcgaaugcauca

SEQ ID NO: 797861 - RNA, 19 nt, Homo sapiens
ccaaacgacugucccagaa

SEQ ID NO: 797862 - RNA, 19 nt, Homo sapiens
ucacuuacuucccuugaaa

SEQ ID NO: 797863 - RNA, 19 nt, Homo sapiens
ggaaucaccaucaaacuau

SEQ ID NO: 797864 - RNA, 19 nt, Homo sapiens
gacagaugcuacccaguaa

SEQ ID NO: 797865 - RNA, 19 nt, Homo sapiens
gaugacauauucaacuuca

SEQ ID NO: 797866 - RNA, 19 nt, Homo sapiens
uuuaagggcuggauggaua

SEQ ID NO: 797867 - RNA, 19 nt, Homo sapiens
gguggucaaugcucucaua

SEQ ID NO: 797868 - RNA, 19 nt, Homo sapiens
ggauggcuuuggaugguua

SEQ ID NO: 797869 - RNA, 19 nt, Homo sapiens
ugaagaagcuggucaacgu

SEQ ID NO: 797870 - RNA, 19 nt, Homo sapiens
gaaaugcauuaauggaaca

SEQ ID NO: 797871 - RNA, 19 nt, Homo sapiens
gagcauuucugucacaagu

SEQ ID NO: 797872 - RNA, 19 nt, Homo sapiens
ucaguaacccggaagcuua

SEQ ID NO: 797873 - RNA, 19 nt, Homo sapiens
gcaauucacucgguuacau

SEQ ID NO: 797874 - RNA, 19 nt, Homo sapiens
aaauugacauguucucuga

SEQ ID NO: 797875 - RNA, 19 nt, Homo sapiens
gaauauagggaauuugguu

SEQ ID NO: 797876 - RNA, 19 nt, Homo sapiens
ugagaacugugaugacuga

SEQ ID NO: 797877 - RNA, 19 nt, Homo sapiens
aaucagaaguuuagccauu

SEQ ID NO: 797878 - RNA, 19 nt, Homo sapiens
ggccucagcuugaccuaaa

SEQ ID NO: 797879 - RNA, 19 nt, Homo sapiens
ggucaaugcucucauaggu

SEQ ID NO: 797880 - RNA, 19 nt, Homo sapiens
gaaagaagucugauguuac

SEQ ID NO: 797881 - RNA, 19 nt, Homo sapiens
gcacaaagcaaagacauca

SEQ ID NO: 797882 - RNA, 19 nt, Homo sapiens
ugacugacccguuuacuga

SEQ ID NO: 797883 - RNA, 19 nt, Homo sapiens
gaaucaccaucaaacuauu

SEQ ID NO: 797884 - RNA, 19 nt, Homo sapiens
ugacagaugcuacccagua

SEQ ID NO: 797885 - RNA, 19 nt, Homo sapiens
gggaguggauucaccaaau

SEQ ID NO: 797886 - RNA, 19 nt, Homo sapiens
caacauuggucuucuacuc

SEQ ID NO: 797887 - RNA, 19 nt, Homo sapiens
gauguuaccaguauacuau

SEQ ID NO: 797888 - RNA, 19 nt, Homo sapiens
ccagaagcaacacaauuua

SEQ ID NO: 797889 - RNA, 19 nt, Homo sapiens
gaaaaccugcuaccaaaua

SEQ ID NO: 797890 - RNA, 19 nt, Homo sapiens
gagaagcuuuaucaacaga

SEQ ID NO: 797891 - RNA, 19 nt, Homo sapiens
caaauauucugcccuuucu

SEQ ID NO: 797892 - RNA, 19 nt, Homo sapiens
gaagcaacacaauuuauca

SEQ ID NO: 797893 - RNA, 19 nt, Homo sapiens
ggaauuuauuugacugugu

SEQ ID NO: 797894 - RNA, 19 nt, Homo sapiens
ggcaagagguuucauucug

SEQ ID NO: 797895 - RNA, 19 nt, Homo sapiens
caauacagccacugaagaa

SEQ ID NO: 797896 - RNA, 19 nt, Homo sapiens
caaagugaauccagagucu

SEQ ID NO: 797897 - RNA, 19 nt, Homo sapiens
gggaauggaucgaaaauau

SEQ ID NO: 797898 - RNA, 19 nt, Homo sapiens
cgccgaggcuggaacauuu

SEQ ID NO: 797899 - RNA, 19 nt, Homo sapiens
uaucaucuccuuucucauu

SEQ ID NO: 797900 - RNA, 19 nt, Homo sapiens
gaacaacagccagaguuug

SEQ ID NO: 797901 - RNA, 19 nt, Homo sapiens
gagaaaaccuggcauccaa

SEQ ID NO: 797902 - RNA, 19 nt, Homo sapiens
ggaaguugcccaagcucua

SEQ ID NO: 797903 - RNA, 19 nt, Homo sapiens
ugaagaugacuuugacaua

SEQ ID NO: 797904 - RNA, 19 nt, Homo sapiens
gcccgacagucucauguuu

SEQ ID NO: 797905 - RNA, 19 nt, Homo sapiens
cagcaucuuugcccuggua

SEQ ID NO: 797906 - RNA, 19 nt, Homo sapiens
gcaggagaaucgcuuaaac

SEQ ID NO: 797907 - RNA, 19 nt, Homo sapiens
gaccaagggugaccaaggu

SEQ ID NO: 797908 - RNA, 19 nt, Homo sapiens
aagaggugcugcuauuauu

SEQ ID NO: 797909 - RNA, 19 nt, Homo sapiens
ggcaauuucucuuggauca

SEQ ID NO: 797910 - RNA, 19 nt, Homo sapiens
ugaccacccucauuaacuu

SEQ ID NO: 797911 - RNA, 19 nt, Homo sapiens
gaaagaaauggaaacuuag

SEQ ID NO: 797912 - RNA, 19 nt, Homo sapiens
gagcagaacaagaauguag

SEQ ID NO: 797913 - RNA, 19 nt, Homo sapiens
caagcucuauggcgacauu

SEQ ID NO: 797914 - RNA, 19 nt, Homo sapiens
gaguggauucaccaaauua

SEQ ID NO: 797915 - RNA, 19 nt, Homo sapiens
caagagaaaggaagaggaa

SEQ ID NO: 797916 - RNA, 19 nt, Homo sapiens
uuagagaacuucaauacag

SEQ ID NO: 797917 - RNA, 19 nt, Homo sapiens
gaacacaauuaaacgcuua

SEQ ID NO: 797918 - RNA, 19 nt, Homo sapiens
ggacaaggcugcuacuuca

SEQ ID NO: 797919 - RNA, 19 nt, Homo sapiens
gaacuaugaccgagaagua

SEQ ID NO: 797920 - RNA, 19 nt, Homo sapiens
ggucacaggucaacuaguu

SEQ ID NO: 797921 - RNA, 19 nt, Homo sapiens
cugagaagcugaacuauga

SEQ ID NO: 797922 - RNA, 19 nt, Homo sapiens
gcaaaugagugcucuucuu

SEQ ID NO: 797923 - RNA, 19 nt, Homo sapiens
gcagaaaccuagucagucu

SEQ ID NO: 797924 - RNA, 19 nt, Homo sapiens
gaagaaaacuccuaaagag

SEQ ID NO: 797925 - RNA, 19 nt, Homo sapiens
gaucaucgccacagucauu

SEQ ID NO: 797926 - RNA, 19 nt, Homo sapiens
gauccucaaugcccacuuu

SEQ ID NO: 797927 - RNA, 19 nt, Homo sapiens
gcaaugcccucuccagucu

SEQ ID NO: 797928 - RNA, 19 nt, Homo sapiens
gccaugagcuccauagcaa

SEQ ID NO: 797929 - RNA, 19 nt, Homo sapiens
caacauggcgggacagcua

SEQ ID NO: 797930 - RNA, 19 nt, Homo sapiens
aagaggaaguggcaaauga

SEQ ID NO: 797931 - RNA, 19 nt, Homo sapiens
caacaacaacaacaacaaa

SEQ ID NO: 797932 - RNA, 19 nt, Homo sapiens
aaugauagcuggacaaguc

SEQ ID NO: 797933 - RNA, 19 nt, Homo sapiens
gaagcaaaauucacagaaa

SEQ ID NO: 797934 - RNA, 19 nt, Homo sapiens
uagaggaaacccagcauua

SEQ ID NO: 797935 - RNA, 19 nt, Homo sapiens
cagcgaaucucaccaacau

SEQ ID NO: 797936 - RNA, 19 nt, Homo sapiens
gaguuugguucugcaauaa

SEQ ID NO: 797937 - RNA, 19 nt, Homo sapiens
agaguuugguucugcaaua

SEQ ID NO: 797938 - RNA, 19 nt, Homo sapiens
gaggagauccgagaauuug

SEQ ID NO: 797939 - RNA, 19 nt, Homo sapiens
gcugaacuaugaccgagaa

SEQ ID NO: 797940 - RNA, 19 nt, Homo sapiens
ggaggagauccgagaauuu

SEQ ID NO: 797941 - RNA, 19 nt, Homo sapiens
aaagagaugcccacccaua

SEQ ID NO: 797942 - RNA, 19 nt, Homo sapiens
ugaccgaaauugcugagaa

SEQ ID NO: 797943 - RNA, 19 nt, Homo sapiens
cucuacagcugguuaauaa

SEQ ID NO: 797944 - RNA, 19 nt, Homo sapiens
ugaaaugaaugcggaguug

SEQ ID NO: 797945 - RNA, 19 nt, Homo sapiens
ucacaggccuuuggcaaug

SEQ ID NO: 797946 - RNA, 19 nt, Homo sapiens
caaaugagugcucuucuuc

SEQ ID NO: 797947 - RNA, 19 nt, Homo sapiens
gagaaguaguuagaguuug

SEQ ID NO: 797948 - RNA, 19 nt, Homo sapiens
ggcaggaaaugaccgaaau

SEQ ID NO: 797949 - RNA, 19 nt, Homo sapiens
ggacaggcucucagugcua

SEQ ID NO: 797950 - RNA, 19 nt, Homo sapiens
gcccugaagaacacaauua

SEQ ID NO: 797951 - RNA, 19 nt, Homo sapiens
cgagaaguaguuagaguuu

SEQ ID NO: 797952 - RNA, 19 nt, Homo sapiens
ggaaaugaccgaaauugcu

SEQ ID NO: 797953 - RNA, 19 nt, Homo sapiens
gcacagcaguuagcuucug

SEQ ID NO: 797954 - RNA, 19 nt, Homo sapiens
ccauuccacugaugccuaa

SEQ ID NO: 797955 - RNA, 19 nt, Homo sapiens
gcacaaggacagauuaucg

SEQ ID NO: 797956 - RNA, 19 nt, Homo sapiens
caacagcgaaucucaccaa

SEQ ID NO: 797957 - RNA, 19 nt, Homo sapiens
ggaagaaaacuccuaaaga

SEQ ID NO: 797958 - RNA, 19 nt, Homo sapiens
gaggaaacccagcauuauc

SEQ ID NO: 797959 - RNA, 19 nt, Homo sapiens
gaaaugaaugcggaguuga

SEQ ID NO: 797960 - RNA, 19 nt, Homo sapiens
gaaaacuccuaaagagaug

SEQ ID NO: 797961 - RNA, 19 nt, Homo sapiens
gaccgaaauugcugagaag

SEQ ID NO: 797962 - RNA, 19 nt, Homo sapiens
gcaggaaaugaccgaaauu

SEQ ID NO: 797963 - RNA, 19 nt, Homo sapiens
uggaggagauccgagaauu

SEQ ID NO: 797964 - RNA, 19 nt, Homo sapiens
ccacggcagucccuuugga

SEQ ID NO: 797965 - RNA, 19 nt, Homo sapiens
gagaugcccacccauaauc

SEQ ID NO: 797966 - RNA, 19 nt, Homo sapiens
cagauuaucgggaccauuc

SEQ ID NO: 797967 - RNA, 19 nt, Homo sapiens
ggacauggccugccuucac

SEQ ID NO: 797968 - RNA, 19 nt, Homo sapiens
agaaguaguuagaguuugg

SEQ ID NO: 797969 - RNA, 19 nt, Homo sapiens
gaaccugaccgaguuuauc

SEQ ID NO: 797970 - RNA, 19 nt, Homo sapiens
ugcagaaccugaccgaguu

SEQ ID NO: 797971 - RNA, 19 nt, Homo sapiens
gcugagaagcugaacuaug

SEQ ID NO: 797972 - RNA, 19 nt, Homo sapiens
ggacaucaccccuaaaagu

SEQ ID NO: 797973 - RNA, 19 nt, Homo sapiens
ugccaaagcuuuuaaaauc

SEQ ID NO: 797974 - RNA, 19 nt, Homo sapiens
gcacucagggcuugcaagu

SEQ ID NO: 797975 - RNA, 19 nt, Homo sapiens
aagagaugcccacccauaa

SEQ ID NO: 797976 - RNA, 19 nt, Homo sapiens
guuugguucugcaauaaga

SEQ ID NO: 797977 - RNA, 19 nt, Homo sapiens
gcauccaugucucaaaguc

SEQ ID NO: 797978 - RNA, 19 nt, Homo sapiens
ucuucaggauccaaugaua

SEQ ID NO: 797979 - RNA, 19 nt, Homo sapiens
gcagaaccugaccgaguuu

SEQ ID NO: 797980 - RNA, 19 nt, Homo sapiens
guuaauaauccacuagcaa

SEQ ID NO: 797981 - RNA, 19 nt, Homo sapiens
aagcauccaugucucaaag

SEQ ID NO: 797982 - RNA, 19 nt, Homo sapiens
gcaaggacugguucucaca

SEQ ID NO: 797983 - RNA, 19 nt, Homo sapiens
guugagaggugaggacaag

SEQ ID NO: 797984 - RNA, 19 nt, Homo sapiens
gaaacccagcauuaucaga

SEQ ID NO: 797985 - RNA, 19 nt, Homo sapiens
ugaccgagaaguaguuaga

SEQ ID NO: 797986 - RNA, 19 nt, Homo sapiens
gcugguuaauaauccacua

SEQ ID NO: 797987 - RNA, 19 nt, Homo sapiens
gcagccggaggcauuauga

SEQ ID NO: 797988 - RNA, 19 nt, Homo sapiens
caaccagccaauccucauu

SEQ ID NO: 797989 - RNA, 19 nt, Homo sapiens
ggcaagcccugaagaacac

SEQ ID NO: 797990 - RNA, 19 nt, Homo sapiens
guaguuagaguuugguucu

SEQ ID NO: 797991 - RNA, 19 nt, Homo sapiens
gggcaggaaaugaccgaaa

SEQ ID NO: 797992 - RNA, 19 nt, Homo sapiens
cuacagcugguuaauaauc

SEQ ID NO: 797993 - RNA, 19 nt, Homo sapiens
ccucuacagcugguuaaua

SEQ ID NO: 797994 - RNA, 19 nt, Homo sapiens
gcuaggaggccagcaagga

SEQ ID NO: 797995 - RNA, 19 nt, Homo sapiens
caggaaaugaccgaaauug

SEQ ID NO: 797996 - RNA, 19 nt, Homo sapiens
gaaucucaccaacauccaa

SEQ ID NO: 797997 - RNA, 19 nt, Homo sapiens
caacaccaggccagucaga

SEQ ID NO: 797998 - RNA, 19 nt, Homo sapiens
uagcuggacaagucaguaa

SEQ ID NO: 797999 - RNA, 19 nt, Homo sapiens
uauaaugauccaagaggaa

SEQ ID NO: 798000 - RNA, 19 nt, Homo sapiens
gguuaauaauccacuagca

SEQ ID NO: 798001 - RNA, 19 nt, Homo sapiens
caagaggaaguggcaaaug

SEQ ID NO: 798002 - RNA, 19 nt, Homo sapiens
gcgaggacacucccagcaa

SEQ ID NO: 798003 - RNA, 19 nt, Homo sapiens
ccuugggacuccacaacaa

SEQ ID NO: 798004 - RNA, 19 nt, Homo sapiens
guaagcccuugcugucagu

SEQ ID NO: 798005 - RNA, 19 nt, Homo sapiens
auaauccacuagcaaguca

SEQ ID NO: 798006 - RNA, 19 nt, Homo sapiens
cuacaucucagcugcaaca

SEQ ID NO: 798007 - RNA, 19 nt, Homo sapiens
agaggaaacccagcauuau

SEQ ID NO: 798008 - RNA, 19 nt, Homo sapiens
caagcauccaugucucaaa

SEQ ID NO: 798009 - RNA, 19 nt, Homo sapiens
cugcugcgcugagagaaug

SEQ ID NO: 798010 - RNA, 19 nt, Homo sapiens
ggacuccacaacaacaaca

SEQ ID NO: 798011 - RNA, 19 nt, Homo sapiens
cugaagaacacaauuaaac

SEQ ID NO: 798012 - RNA, 19 nt, Homo sapiens
cagaucaucgccacaguca

SEQ ID NO: 798013 - RNA, 19 nt, Homo sapiens
cagcaaggacugguucuca

SEQ ID NO: 798014 - RNA, 19 nt, Homo sapiens
ccucauucccuucaacaug

SEQ ID NO: 798015 - RNA, 19 nt, Homo sapiens
gcaaaauucacagaaacua

SEQ ID NO: 798016 - RNA, 19 nt, Homo sapiens
ccuguggaaucaaaugaca

SEQ ID NO: 798017 - RNA, 19 nt, Homo sapiens
gcacgagccugaagacaua

SEQ ID NO: 798018 - RNA, 19 nt, Homo sapiens
gagcgugacuuguaauaaa

SEQ ID NO: 798019 - RNA, 19 nt, Homo sapiens
ucacguaaguccacauaua

SEQ ID NO: 798020 - RNA, 19 nt, Homo sapiens
cagcugggcuucauuggua

SEQ ID NO: 798021 - RNA, 19 nt, Homo sapiens
ccaaacagaaccucgauua

SEQ ID NO: 798022 - RNA, 19 nt, Homo sapiens
uauaagagcgugacuugua

SEQ ID NO: 798023 - RNA, 19 nt, Homo sapiens
gauuacugcuuccucauga

SEQ ID NO: 798024 - RNA, 19 nt, Homo sapiens
ggaaugcauauacuacuuu

SEQ ID NO: 798025 - RNA, 19 nt, Homo sapiens
gaccugagccugauuguag

SEQ ID NO: 798026 - RNA, 19 nt, Homo sapiens
gagaugaggcuccgcaaug

SEQ ID NO: 798027 - RNA, 19 nt, Homo sapiens
gcacuucacccuggagaaa

SEQ ID NO: 798028 - RNA, 19 nt, Homo sapiens
auaagagcgugacuuguaa

SEQ ID NO: 798029 - RNA, 19 nt, Homo sapiens
ggcaagauccagaaacuga

SEQ ID NO: 798030 - RNA, 19 nt, Homo sapiens
ccaaaggcaucuacuacgu

SEQ ID NO: 798031 - RNA, 19 nt, Homo sapiens
caagagggccgugucagaa

SEQ ID NO: 798032 - RNA, 19 nt, Homo sapiens
gcacucagcggccagaaag

SEQ ID NO: 798033 - RNA, 19 nt, Homo sapiens
gaacacuggaaugcauaua

SEQ ID NO: 798034 - RNA, 19 nt, Homo sapiens
ugagcgagaucuuccugaa

SEQ ID NO: 798035 - RNA, 19 nt, Homo sapiens
gggcuucauugguaagaug

SEQ ID NO: 798036 - RNA, 19 nt, Homo sapiens
uacuuuaugugcuguguuu

SEQ ID NO: 798037 - RNA, 19 nt, Homo sapiens
ccagaaaggcgacguugug

SEQ ID NO: 798038 - RNA, 19 nt, Homo sapiens
gagccugauuguagaguuc

SEQ ID NO: 798039 - RNA, 19 nt, Homo sapiens
gagcgagaucuuccugaaa

SEQ ID NO: 798040 - RNA, 19 nt, Homo sapiens
gaucggcuccuucuacaag

SEQ ID NO: 798041 - RNA, 19 nt, Homo sapiens
aacagaaccucgauuacug

SEQ ID NO: 798042 - RNA, 19 nt, Homo sapiens
uccagaaacugaaggacaa

SEQ ID NO: 798043 - RNA, 19 nt, Homo sapiens
gcaagauccagaaacugaa

SEQ ID NO: 798044 - RNA, 19 nt, Homo sapiens
gacuuguaauaaaggguua

SEQ ID NO: 798045 - RNA, 19 nt, Homo sapiens
cagaucggcuccuucuaca

SEQ ID NO: 798046 - RNA, 19 nt, Homo sapiens
uggaaugcauauacuacuu

SEQ ID NO: 798047 - RNA, 19 nt, Homo sapiens
gcgaacacuggaaugcaua

SEQ ID NO: 798048 - RNA, 19 nt, Homo sapiens
gcacugugaccggcagaaa

SEQ ID NO: 798049 - RNA, 19 nt, Homo sapiens
gaucaagagggccguguca

SEQ ID NO: 798050 - RNA, 19 nt, Homo sapiens
uagaguucauucucauguu

SEQ ID NO: 798051 - RNA, 19 nt, Homo sapiens
ggaccugagccugauugua

SEQ ID NO: 798052 - RNA, 19 nt, Homo sapiens
gcagugacagagaacauca

SEQ ID NO: 798053 - RNA, 19 nt, Homo sapiens
ucaagagggccgugucaga

SEQ ID NO: 798054 - RNA, 19 nt, Homo sapiens
gaggacaagcucuucaaca

SEQ ID NO: 798055 - RNA, 19 nt, Homo sapiens
guagaguucauucucaugu

SEQ ID NO: 798056 - RNA, 19 nt, Homo sapiens
ccacuucuacccugacuuc

SEQ ID NO: 798057 - RNA, 19 nt, Homo sapiens
gaaggaggacucggucauc

SEQ ID NO: 798058 - RNA, 19 nt, Homo sapiens
ucuauaagagcgugacuug

SEQ ID NO: 798059 - RNA, 19 nt, Homo sapiens
ugagcaccaugaagaacuu

SEQ ID NO: 798060 - RNA, 19 nt, Homo sapiens
ccaacuaccugagcaccau

SEQ ID NO: 798061 - RNA, 19 nt, Homo sapiens
aaacagaaccucgauuacu

SEQ ID NO: 798062 - RNA, 19 nt, Homo sapiens
gguggaggaccaaacagaa

SEQ ID NO: 798063 - RNA, 19 nt, Homo sapiens
agaguucauucucauguuc

SEQ ID NO: 798064 - RNA, 19 nt, Homo sapiens
uaccugagcaccaugaaga

SEQ ID NO: 798065 - RNA, 19 nt, Homo sapiens
ccagaucggcuccuucuac

SEQ ID NO: 798066 - RNA, 19 nt, Homo sapiens
uugguaagauguucaaguc

SEQ ID NO: 798067 - RNA, 19 nt, Homo sapiens
gauguacgcgcaguccaaa

SEQ ID NO: 798068 - RNA, 19 nt, Homo sapiens
acacuggaaugcauauacu

SEQ ID NO: 798069 - RNA, 19 nt, Homo sapiens
acgugcagcuggaggauga

SEQ ID NO: 798070 - RNA, 19 nt, Homo sapiens
gaaacugaaggacaaagac

SEQ ID NO: 798071 - RNA, 19 nt, Homo sapiens
ugacgcugcugcucuucug

SEQ ID NO: 798072 - RNA, 19 nt, Homo sapiens
gcccugaagcccacauuuc

SEQ ID NO: 798073 - RNA, 19 nt, Homo sapiens
caaacagaaccucgauuac

SEQ ID NO: 798074 - RNA, 19 nt, Homo sapiens
cuucaaaccgucccucuuc

SEQ ID NO: 798075 - RNA, 19 nt, Homo sapiens
gacuggagcgguucuucuu

SEQ ID NO: 798076 - RNA, 19 nt, Homo sapiens
cauauucugugggugaaag

SEQ ID NO: 798077 - RNA, 19 nt, Homo sapiens
cuucggcagugacagagaa

SEQ ID NO: 798078 - RNA, 19 nt, Homo sapiens
aagagcgugacuuguaaua

SEQ ID NO: 798079 - RNA, 19 nt, Homo sapiens
agaaacugaaggacaaaga

SEQ ID NO: 798080 - RNA, 19 nt, Homo sapiens
agaugaggcuccgcaaugg

SEQ ID NO: 798081 - RNA, 19 nt, Homo sapiens
gaaggaugcgaagcacugu

SEQ ID NO: 798082 - RNA, 19 nt, Homo sapiens
gaccaaacagaaccucgau

SEQ ID NO: 798083 - RNA, 19 nt, Homo sapiens
acucugcacucgcucaucu

SEQ ID NO: 798084 - RNA, 19 nt, Homo sapiens
cgacggcuaccuccagauc

SEQ ID NO: 798085 - RNA, 19 nt, Homo sapiens
ucgacaacccucagucaga

SEQ ID NO: 798086 - RNA, 19 nt, Homo sapiens
aggacaagcucuucaacac

SEQ ID NO: 798087 - RNA, 19 nt, Homo sapiens
aagagggccgugucagaaa

SEQ ID NO: 798088 - RNA, 19 nt, Homo sapiens
ugagccugauuguagaguu

SEQ ID NO: 798089 - RNA, 19 nt, Homo sapiens
caagauccagaaacugaag

SEQ ID NO: 798090 - RNA, 19 nt, Homo sapiens
gauuguagaguucauucuc

SEQ ID NO: 798091 - RNA, 19 nt, Homo sapiens
guccaaaggcaucuacuac

SEQ ID NO: 798092 - RNA, 19 nt, Homo sapiens
gcacgagccugaagacaua

SEQ ID NO: 798093 - RNA, 19 nt, Homo sapiens
gagcgugacuuguaauaaa

SEQ ID NO: 798094 - RNA, 19 nt, Homo sapiens
ucacguaaguccacauaua

SEQ ID NO: 798095 - RNA, 19 nt, Homo sapiens
cagcugggcuucauuggua

SEQ ID NO: 798096 - RNA, 19 nt, Homo sapiens
ccaaacagaaccucgauua

SEQ ID NO: 798097 - RNA, 19 nt, Homo sapiens
uauaagagcgugacuugua

SEQ ID NO: 798098 - RNA, 19 nt, Homo sapiens
gagcauuagugucagugua

SEQ ID NO: 798099 - RNA, 19 nt, Homo sapiens
gauuacugcuuccucauga

SEQ ID NO: 798100 - RNA, 19 nt, Homo sapiens
caaggacagugaagagcua

SEQ ID NO: 798101 - RNA, 19 nt, Homo sapiens
ggagguuguugaucucauu

SEQ ID NO: 798102 - RNA, 19 nt, Homo sapiens
ggaaugcauauacuacuuu

SEQ ID NO: 798103 - RNA, 19 nt, Homo sapiens
gaccugagccugauuguag

SEQ ID NO: 798104 - RNA, 19 nt, Homo sapiens
caagaacagaugucaauga

SEQ ID NO: 798105 - RNA, 19 nt, Homo sapiens
gcacuucacccuggagaaa

SEQ ID NO: 798106 - RNA, 19 nt, Homo sapiens
auaagagcgugacuuguaa

SEQ ID NO: 798107 - RNA, 19 nt, Homo sapiens
ggcaagauccagaaacuga

SEQ ID NO: 798108 - RNA, 19 nt, Homo sapiens
ccaaaggcaucuacuacgu

SEQ ID NO: 798109 - RNA, 19 nt, Homo sapiens
gguggugccucucuacugu

SEQ ID NO: 798110 - RNA, 19 nt, Homo sapiens
caagagggccgugucagaa

SEQ ID NO: 798111 - RNA, 19 nt, Homo sapiens
gaggugggcuccuggaacu

SEQ ID NO: 798112 - RNA, 19 nt, Homo sapiens
gaacacuggaaugcauaua

SEQ ID NO: 798113 - RNA, 19 nt, Homo sapiens
ugagcgagaucuuccugaa

SEQ ID NO: 798114 - RNA, 19 nt, Homo sapiens
gggcuucauugguaagaug

SEQ ID NO: 798115 - RNA, 19 nt, Homo sapiens
uacuuuaugugcuguguuu

SEQ ID NO: 798116 - RNA, 19 nt, Homo sapiens
gagccugauuguagaguuc

SEQ ID NO: 798117 - RNA, 19 nt, Homo sapiens
gagcgagaucuuccugaaa

SEQ ID NO: 798118 - RNA, 19 nt, Homo sapiens
gaucggcuccuucuacaag

SEQ ID NO: 798119 - RNA, 19 nt, Homo sapiens
aacagaaccucgauuacug

SEQ ID NO: 798120 - RNA, 19 nt, Homo sapiens
gcacaagaacagaugucaa

SEQ ID NO: 798121 - RNA, 19 nt, Homo sapiens
uccagaaacugaaggacaa

SEQ ID NO: 798122 - RNA, 19 nt, Homo sapiens
gcaagauccagaaacugaa

SEQ ID NO: 798123 - RNA, 19 nt, Homo sapiens
aagaacagaugucaaugag

SEQ ID NO: 798124 - RNA, 19 nt, Homo sapiens
cacaagaacagaugucaau

SEQ ID NO: 798125 - RNA, 19 nt, Homo sapiens
cuaccuaggucuggaaauc

SEQ ID NO: 798126 - RNA, 19 nt, Homo sapiens
gacuuguaauaaaggguua

SEQ ID NO: 798127 - RNA, 19 nt, Homo sapiens
cagaucggcuccuucuaca

SEQ ID NO: 798128 - RNA, 19 nt, Homo sapiens
uggaaugcauauacuacuu

SEQ ID NO: 798129 - RNA, 19 nt, Homo sapiens
gcgaacacuggaaugcaua

SEQ ID NO: 798130 - RNA, 19 nt, Homo sapiens
gcacugugaccggcagaaa

SEQ ID NO: 798131 - RNA, 19 nt, Homo sapiens
gcuguugacuguccuugag

SEQ ID NO: 798132 - RNA, 19 nt, Homo sapiens
uagaguucauucucauguu

SEQ ID NO: 798133 - RNA, 19 nt, Homo sapiens
ggaccugagccugauugua

SEQ ID NO: 798134 - RNA, 19 nt, Homo sapiens
gcagugacagagaacauca

SEQ ID NO: 798135 - RNA, 19 nt, Homo sapiens
gaucaagagggccguguca

SEQ ID NO: 798136 - RNA, 19 nt, Homo sapiens
gaggacaagcucuucaaca

SEQ ID NO: 798137 - RNA, 19 nt, Homo sapiens
guagaguucauucucaugu

SEQ ID NO: 798138 - RNA, 19 nt, Homo sapiens
ccacuucuacccugacuuc

SEQ ID NO: 798139 - RNA, 19 nt, Homo sapiens
gaaggaggacucggucauc

SEQ ID NO: 798140 - RNA, 19 nt, Homo sapiens
ucaagagggccgugucaga

SEQ ID NO: 798141 - RNA, 19 nt, Homo sapiens
ucuauaagagcgugacuug

SEQ ID NO: 798142 - RNA, 19 nt, Homo sapiens
ugagcaccaugaagaacuu

SEQ ID NO: 798143 - RNA, 19 nt, Homo sapiens
ccaacuaccugagcaccau

SEQ ID NO: 798144 - RNA, 19 nt, Homo sapiens
aaacagaaccucgauuacu

SEQ ID NO: 798145 - RNA, 19 nt, Homo sapiens
gguggaggaccaaacagaa

SEQ ID NO: 798146 - RNA, 19 nt, Homo sapiens
agaguucauucucauguuc

SEQ ID NO: 798147 - RNA, 19 nt, Homo sapiens
uaccugagcaccaugaaga

SEQ ID NO: 798148 - RNA, 19 nt, Homo sapiens
gcaggcacaagaacagaug

SEQ ID NO: 798149 - RNA, 19 nt, Homo sapiens
caacggauggagcggauuc

SEQ ID NO: 798150 - RNA, 19 nt, Homo sapiens
gguuguugaucucauucuu

SEQ ID NO: 798151 - RNA, 19 nt, Homo sapiens
ccagaucggcuccuucuac

SEQ ID NO: 798152 - RNA, 19 nt, Homo sapiens
uugguaagauguucaaguc

SEQ ID NO: 798153 - RNA, 19 nt, Homo sapiens
gauguacgcgcaguccaaa

SEQ ID NO: 798154 - RNA, 19 nt, Homo sapiens
acacuggaaugcauauacu

SEQ ID NO: 798155 - RNA, 19 nt, Homo sapiens
acgugcagcuggaggauga

SEQ ID NO: 798156 - RNA, 19 nt, Homo sapiens
cccaugagcauuaguguca

SEQ ID NO: 798157 - RNA, 19 nt, Homo sapiens
gaugccuucucagaggaua

SEQ ID NO: 798158 - RNA, 19 nt, Homo sapiens
gaaacugaaggacaaagac

SEQ ID NO: 798159 - RNA, 19 nt, Homo sapiens
gcccugaagcccacauuuc

SEQ ID NO: 798160 - RNA, 19 nt, Homo sapiens
ccucgcugcuguugacugu

SEQ ID NO: 798161 - RNA, 19 nt, Homo sapiens
caaacagaaccucgauuac

SEQ ID NO: 798162 - RNA, 19 nt, Homo sapiens
cuucagaugccuucucaga

SEQ ID NO: 798163 - RNA, 19 nt, Homo sapiens
uuccagcccuugcuuagga

SEQ ID NO: 798164 - RNA, 19 nt, Homo sapiens
cuucaaaccgucccucuuc

SEQ ID NO: 798165 - RNA, 19 nt, Homo sapiens
cacuucagaugccuucuca

SEQ ID NO: 798166 - RNA, 19 nt, Homo sapiens
gacuggagcgguucuucuu

SEQ ID NO: 798167 - RNA, 19 nt, Homo sapiens
cauauucugugggugaaag

SEQ ID NO: 798168 - RNA, 19 nt, Homo sapiens
cuucggcagugacagagaa

SEQ ID NO: 798169 - RNA, 19 nt, Homo sapiens
aagagcgugacuuguaaua

SEQ ID NO: 798170 - RNA, 19 nt, Homo sapiens
ccaggagguuguugaucuc

SEQ ID NO: 798171 - RNA, 19 nt, Homo sapiens
cgugacggcuugccuacca

SEQ ID NO: 798172 - RNA, 19 nt, Homo sapiens
gagggagcgugugcugcaa

SEQ ID NO: 798173 - RNA, 19 nt, Homo sapiens
cuacaaggacagugaagag

SEQ ID NO: 798174 - RNA, 19 nt, Homo sapiens
agaaacugaaggacaaaga

SEQ ID NO: 798175 - RNA, 19 nt, Homo sapiens
ggacagugaagagcuagca

SEQ ID NO: 798176 - RNA, 19 nt, Homo sapiens
gaaggaugcgaagcacugu

SEQ ID NO: 798177 - RNA, 19 nt, Homo sapiens
accaggagguuguugaucu

SEQ ID NO: 798178 - RNA, 19 nt, Homo sapiens
gaccaaacagaaccucgau

SEQ ID NO: 798179 - RNA, 19 nt, Homo sapiens
caccugagcaaugaaguga

SEQ ID NO: 798180 - RNA, 19 nt, Homo sapiens
gacugguggugccucucua

SEQ ID NO: 798181 - RNA, 19 nt, Homo sapiens
cgacggcuaccuccagauc

SEQ ID NO: 798182 - RNA, 19 nt, Homo sapiens
ucgacaacccucagucaga

SEQ ID NO: 798183 - RNA, 19 nt, Homo sapiens
aggacaagcucuucaacac

SEQ ID NO: 798184 - RNA, 19 nt, Homo sapiens
ugagccugauuguagaguu

SEQ ID NO: 798185 - RNA, 19 nt, Homo sapiens
acucugcacucgcucaucu

SEQ ID NO: 798186 - RNA, 19 nt, Homo sapiens
aagagggccgugucagaaa

SEQ ID NO: 798187 - RNA, 19 nt, Homo sapiens
gcuacaaggacagugaaga

SEQ ID NO: 798188 - RNA, 19 nt, Homo sapiens
caagauccagaaacugaag

SEQ ID NO: 798189 - RNA, 19 nt, Homo sapiens
gauuguagaguucauucuc

SEQ ID NO: 798190 - RNA, 19 nt, Homo sapiens
guccaaaggcaucuacuac

SEQ ID NO: 798191 - RNA, 19 nt, Homo sapiens
caugagcauuagugucagu

SEQ ID NO: 798192 - RNA, 19 nt, Homo sapiens
guaaagaguugucagauga

SEQ ID NO: 798193 - RNA, 19 nt, Homo sapiens
gagcagaagcugacacuuu

SEQ ID NO: 798194 - RNA, 19 nt, Homo sapiens
gagcacaucagccuuauga

SEQ ID NO: 798195 - RNA, 19 nt, Homo sapiens
gguaaagaguugucagaug

SEQ ID NO: 798196 - RNA, 19 nt, Homo sapiens
gaaaugcaucuucagcuuu

SEQ ID NO: 798197 - RNA, 19 nt, Homo sapiens
gaugggcucuuguuaagug

SEQ ID NO: 798198 - RNA, 19 nt, Homo sapiens
ggacauagucuucuacaag

SEQ ID NO: 798199 - RNA, 19 nt, Homo sapiens
ccaaagggaaugucuguaa

SEQ ID NO: 798200 - RNA, 19 nt, Homo sapiens
gaaacggaauaaccaguuc

SEQ ID NO: 798201 - RNA, 19 nt, Homo sapiens
gaagcccagugaauauauu

SEQ ID NO: 798202 - RNA, 19 nt, Homo sapiens
ggagaagcccagugaauau

SEQ ID NO: 798203 - RNA, 19 nt, Homo sapiens
gcaccugucuggauguguu

SEQ ID NO: 798204 - RNA, 19 nt, Homo sapiens
gggaugggcucuuguuaag

SEQ ID NO: 798205 - RNA, 19 nt, Homo sapiens
ggagcucagugcccuugua

SEQ ID NO: 798206 - RNA, 19 nt, Homo sapiens
gagaagcccagugaauaua

SEQ ID NO: 798207 - RNA, 19 nt, Homo sapiens
ggaccuaugccuucuauca

SEQ ID NO: 798208 - RNA, 19 nt, Homo sapiens
gaagcccuauauaaagauu

SEQ ID NO: 798209 - RNA, 19 nt, Homo sapiens
gaaggaccgugagccuaaa

SEQ ID NO: 798210 - RNA, 19 nt, Homo sapiens
acaaggacauagucuucua

SEQ ID NO: 798211 - RNA, 19 nt, Homo sapiens
gcaggacgccggagauugu

SEQ ID NO: 798212 - RNA, 19 nt, Homo sapiens
gcagugacccacccaccua

SEQ ID NO: 798213 - RNA, 19 nt, Homo sapiens
aaaugcaucuucagcuuug

SEQ ID NO: 798214 - RNA, 19 nt, Homo sapiens
agaaaugcaucuucagcuu

SEQ ID NO: 798215 - RNA, 19 nt, Homo sapiens
gcacccagaauaccaagaa

SEQ ID NO: 798216 - RNA, 19 nt, Homo sapiens
cugaagcccuauauaaaga

SEQ ID NO: 798217 - RNA, 19 nt, Homo sapiens
ugaaggaccgugagccuaa

SEQ ID NO: 798218 - RNA, 19 nt, Homo sapiens
gugcacgacuucacagaug

SEQ ID NO: 798219 - RNA, 19 nt, Homo sapiens
uuucagauuuccgguaaua

SEQ ID NO: 798220 - RNA, 19 nt, Homo sapiens
gcugacacuuucauguuug

SEQ ID NO: 798221 - RNA, 19 nt, Homo sapiens
cagcaagagugcaaacauc

SEQ ID NO: 798222 - RNA, 19 nt, Homo sapiens
ucagugcccuuguagugaa

SEQ ID NO: 798223 - RNA, 19 nt, Homo sapiens
gcagacuggugcacgacuu

SEQ ID NO: 798224 - RNA, 19 nt, Homo sapiens
cguccgaucugucaucaau

SEQ ID NO: 798225 - RNA, 19 nt, Homo sapiens
ucagauuuccgguaauaaa

SEQ ID NO: 798226 - RNA, 19 nt, Homo sapiens
gaagcugacacuuucaugu

SEQ ID NO: 798227 - RNA, 19 nt, Homo sapiens
gcucagugcccuuguagug

SEQ ID NO: 798228 - RNA, 19 nt, Homo sapiens
caaagggaaugucuguaac

SEQ ID NO: 798229 - RNA, 19 nt, Homo sapiens
cagaugccauuacagacaa

SEQ ID NO: 798230 - RNA, 19 nt, Homo sapiens
ggacauaagagcagaagcu

SEQ ID NO: 798231 - RNA, 19 nt, Homo sapiens
ucacucccaucaucaacuu

SEQ ID NO: 798232 - RNA, 19 nt, Homo sapiens
ucaccuaccuuugcaccaa

SEQ ID NO: 798233 - RNA, 19 nt, Homo sapiens
ggacuuuggcugcgaguag

SEQ ID NO: 798234 - RNA, 19 nt, Homo sapiens
aggagaagcccagugaaua

SEQ ID NO: 798235 - RNA, 19 nt, Homo sapiens
agcagaagcugacacuuuc

SEQ ID NO: 798236 - RNA, 19 nt, Homo sapiens
uggacagucugcagaaaug

SEQ ID NO: 798237 - RNA, 19 nt, Homo sapiens
gggcucuuguuaaguguug

SEQ ID NO: 798238 - RNA, 19 nt, Homo sapiens
ccucagaugccauuacaga

SEQ ID NO: 798239 - RNA, 19 nt, Homo sapiens
caagagugcaaacaucaug

SEQ ID NO: 798240 - RNA, 19 nt, Homo sapiens
gaauauauuacugcgauca

SEQ ID NO: 798241 - RNA, 19 nt, Homo sapiens
ucuguaacaucaacaucuu

SEQ ID NO: 798242 - RNA, 19 nt, Homo sapiens
ucgcgaggcacccagaaua

SEQ ID NO: 798243 - RNA, 19 nt, Homo sapiens
ugaaacggaauaaccaguu

SEQ ID NO: 798244 - RNA, 19 nt, Homo sapiens
gggcagcaccugucuggau

SEQ ID NO: 798245 - RNA, 19 nt, Homo sapiens
ccaggguguugaugacuuc

SEQ ID NO: 798246 - RNA, 19 nt, Homo sapiens
gccaggguguugaugacuu

SEQ ID NO: 798247 - RNA, 19 nt, Homo sapiens
uaccucagaugccauuaca

SEQ ID NO: 798248 - RNA, 19 nt, Homo sapiens
guuaaguguuggugacaag

SEQ ID NO: 798249 - RNA, 19 nt, Homo sapiens
gacuuuggcugcgaguaga

SEQ ID NO: 798250 - RNA, 19 nt, Homo sapiens
caacaucuucgcaauccau

SEQ ID NO: 798251 - RNA, 19 nt, Homo sapiens
gaccgugagccuaaagaga

SEQ ID NO: 798252 - RNA, 19 nt, Homo sapiens
ucuccugggucuuguacaa

SEQ ID NO: 798253 - RNA, 19 nt, Homo sapiens
caggagaagcccagugaau

SEQ ID NO: 798254 - RNA, 19 nt, Homo sapiens
ugacgccugccuuccauuu

SEQ ID NO: 798255 - RNA, 19 nt, Homo sapiens
caauaccucagaugccauu

SEQ ID NO: 798256 - RNA, 19 nt, Homo sapiens
aagcugacacuuucauguu

SEQ ID NO: 798257 - RNA, 19 nt, Homo sapiens
ccugaagcccuauauaaag

SEQ ID NO: 798258 - RNA, 19 nt, Homo sapiens
agacuuuggacuuuauuga

SEQ ID NO: 798259 - RNA, 19 nt, Homo sapiens
cauccugaagcccuauaua

SEQ ID NO: 798260 - RNA, 19 nt, Homo sapiens
gcugacgccugccuuccau

SEQ ID NO: 798261 - RNA, 19 nt, Homo sapiens
ccgugagccuaaagagauu

SEQ ID NO: 798262 - RNA, 19 nt, Homo sapiens
agcugacacuuucauguuu

SEQ ID NO: 798263 - RNA, 19 nt, Homo sapiens
acuuuggacuuuauugaug

SEQ ID NO: 798264 - RNA, 19 nt, Homo sapiens
ucagaugccauuacagaca

SEQ ID NO: 798265 - RNA, 19 nt, Homo sapiens
gcaagagugcaaacaucau

SEQ ID NO: 798266 - RNA, 19 nt, Homo sapiens
ccacccaccuaccuuugca

SEQ ID NO: 798267 - RNA, 19 nt, Homo sapiens
ggucaccuauggcuuuuau

SEQ ID NO: 798268 - RNA, 19 nt, Homo sapiens
gagccuaaagagauugaau

SEQ ID NO: 798269 - RNA, 19 nt, Homo sapiens
ccuaugccuucuaucacaa

SEQ ID NO: 798270 - RNA, 19 nt, Homo sapiens
uccugaagcccuauauaaa

SEQ ID NO: 798271 - RNA, 19 nt, Homo sapiens
cccagagucuaaguaaaga

SEQ ID NO: 798272 - RNA, 19 nt, Homo sapiens
gacccacccaccuaccuuu

SEQ ID NO: 798273 - RNA, 19 nt, Homo sapiens
cauuacagacaaggacaua

SEQ ID NO: 798274 - RNA, 19 nt, Homo sapiens
gagcucagugcccuuguag

SEQ ID NO: 798275 - RNA, 19 nt, Homo sapiens
aagcccagugaauauauua

SEQ ID NO: 798276 - RNA, 19 nt, Homo sapiens
gucaggagaagcccaguga

SEQ ID NO: 798277 - RNA, 19 nt, Homo sapiens
ugucaucaauaccucagau

SEQ ID NO: 798278 - RNA, 19 nt, Homo sapiens
uuugagcacaucagccuua

SEQ ID NO: 798279 - RNA, 19 nt, Homo sapiens
uuacagacaaggacauagu

SEQ ID NO: 798280 - RNA, 19 nt, Homo sapiens
gcaggaggugcaagagcuu

SEQ ID NO: 798281 - RNA, 19 nt, Homo sapiens
gcagaagcugacacuuuca

SEQ ID NO: 798282 - RNA, 19 nt, Homo sapiens
caucaacaucuucgcaauc

SEQ ID NO: 798283 - RNA, 19 nt, Homo sapiens
acaucaacaucuucgcaau

SEQ ID NO: 798284 - RNA, 19 nt, Homo sapiens
aaagggaaugucuguaaca

SEQ ID NO: 798285 - RNA, 19 nt, Homo sapiens
gaggugcaagagcuucuga

SEQ ID NO: 798286 - RNA, 19 nt, Homo sapiens
gacuuuggacuuuauugau

SEQ ID NO: 798287 - RNA, 19 nt, Homo sapiens
agaagcccagugaauauau

SEQ ID NO: 798288 - RNA, 19 nt, Homo sapiens
acgccugccuuccauuuca

SEQ ID NO: 798289 - RNA, 19 nt, Homo sapiens
auccugaagcccuauauaa

SEQ ID NO: 798290 - RNA, 19 nt, Homo sapiens
ucucccagagucuaaguaa

SEQ ID NO: 798291 - RNA, 19 nt, Homo sapiens
uccgaucugucaucaauac

SEQ ID NO: 798292 - RNA, 19 nt, Homo sapiens
ugaaacagcugggaguuaa

SEQ ID NO: 798293 - RNA, 19 nt, Homo sapiens
gcuacaagcuggugaucuu

SEQ ID NO: 798294 - RNA, 19 nt, Homo sapiens
caagguggcuggcuuugau

SEQ ID NO: 798295 - RNA, 19 nt, Homo sapiens
ggaaacgggucgccaucga

SEQ ID NO: 798296 - RNA, 19 nt, Homo sapiens
gaccggaagugcuccagaa

SEQ ID NO: 798297 - RNA, 19 nt, Homo sapiens
gaggaguucuuucucaagu

SEQ ID NO: 798298 - RNA, 19 nt, Homo sapiens
augcugagcugccgaagaa

SEQ ID NO: 798299 - RNA, 19 nt, Homo sapiens
gaaguccaccuuucucaag

SEQ ID NO: 798300 - RNA, 19 nt, Homo sapiens
gagaucccguuccggcuau

SEQ ID NO: 798301 - RNA, 19 nt, Homo sapiens
caaccgguuucgagagaug

SEQ ID NO: 798302 - RNA, 19 nt, Homo sapiens
ggacaguggcagugaaaca

SEQ ID NO: 798303 - RNA, 19 nt, Homo sapiens
gugaaacagcugggaguua

SEQ ID NO: 798304 - RNA, 19 nt, Homo sapiens
gaagugcuccagaacucaa

SEQ ID NO: 798305 - RNA, 19 nt, Homo sapiens
ccagaaucccagccagaua

SEQ ID NO: 798306 - RNA, 19 nt, Homo sapiens
ccggauauguccacgugaa

SEQ ID NO: 798307 - RNA, 19 nt, Homo sapiens
ggaaguccaccuuucucaa

SEQ ID NO: 798308 - RNA, 19 nt, Homo sapiens
uggagaaguugcuaguguu

SEQ ID NO: 798309 - RNA, 19 nt, Homo sapiens
gggacacacuguauuuggu

SEQ ID NO: 798310 - RNA, 19 nt, Homo sapiens
gcaagguggcuggcuuuga

SEQ ID NO: 798311 - RNA, 19 nt, Homo sapiens
ggagaaguugcuaguguuc

SEQ ID NO: 798312 - RNA, 19 nt, Homo sapiens
ugacggacuccucucauau

SEQ ID NO: 798313 - RNA, 19 nt, Homo sapiens
cggaagugcuccagaacuc

SEQ ID NO: 798314 - RNA, 19 nt, Homo sapiens
gcugggagaacuuggagaa

SEQ ID NO: 798315 - RNA, 19 nt, Homo sapiens
caacgacggcacgcccaua

SEQ ID NO: 798316 - RNA, 19 nt, Homo sapiens
gggcaagguggcuggcuuu

SEQ ID NO: 798317 - RNA, 19 nt, Homo sapiens
ccucuggugucccaagaug

SEQ ID NO: 798318 - RNA, 19 nt, Homo sapiens
aacaaccgguuucgagaga

SEQ ID NO: 798319 - RNA, 19 nt, Homo sapiens
cugcgccgaucgccuguuu

SEQ ID NO: 798320 - RNA, 19 nt, Homo sapiens
uuggagaaguugcuagugu

SEQ ID NO: 798321 - RNA, 19 nt, Homo sapiens
gccgggaaguccaccuuuc

SEQ ID NO: 798322 - RNA, 19 nt, Homo sapiens
caagaugagaagagagaug

SEQ ID NO: 798323 - RNA, 19 nt, Homo sapiens
gggaaguccaccuuucuca

SEQ ID NO: 798324 - RNA, 19 nt, Homo sapiens
gucccaagaugagaagaga

SEQ ID NO: 798325 - RNA, 19 nt, Homo sapiens
ugagacagcccugaagcaa

SEQ ID NO: 798326 - RNA, 19 nt, Homo sapiens
uggaggcugugguggagaa

SEQ ID NO: 798327 - RNA, 19 nt, Homo sapiens
gcugugugaccacguguga

SEQ ID NO: 798328 - RNA, 19 nt, Homo sapiens
ggaagugcuccagaacuca

SEQ ID NO: 798329 - RNA, 19 nt, Homo sapiens
gacggacuccucucauauc

SEQ ID NO: 798330 - RNA, 19 nt, Homo sapiens
gugacuggaggaucuugua

SEQ ID NO: 798331 - RNA, 19 nt, Homo sapiens
cagaaucccagccagauac

SEQ ID NO: 798332 - RNA, 19 nt, Homo sapiens
gagacccgcacaccagaau

SEQ ID NO: 798333 - RNA, 19 nt, Homo sapiens
ggauauguccacgugaaca

SEQ ID NO: 798334 - RNA, 19 nt, Homo sapiens
aaguccaccuuucucaaga

SEQ ID NO: 798335 - RNA, 19 nt, Homo sapiens
gcuggauucuuaagugaua

SEQ ID NO: 798336 - RNA, 19 nt, Homo sapiens
gaaacuagaaugcuggauu

SEQ ID NO: 798337 - RNA, 19 nt, Homo sapiens
caacagcacggacuacauu

SEQ ID NO: 798338 - RNA, 19 nt, Homo sapiens
gaaugugggccuaguguug

SEQ ID NO: 798339 - RNA, 19 nt, Homo sapiens
gggcagcgcucaucaacgu

SEQ ID NO: 798340 - RNA, 19 nt, Homo sapiens
ggaccaagacagcaagcua

SEQ ID NO: 798341 - RNA, 19 nt, Homo sapiens
gcacuguccucaacaucau

SEQ ID NO: 798342 - RNA, 19 nt, Homo sapiens
ggagcuggacuauggcuuu

SEQ ID NO: 798343 - RNA, 19 nt, Homo sapiens
guaccuacaggccauauug

SEQ ID NO: 798344 - RNA, 19 nt, Homo sapiens
acgaggagcuggacuaugg

SEQ ID NO: 798345 - RNA, 19 nt, Homo sapiens
ggacgcugcuugccaugca

SEQ ID NO: 798346 - RNA, 19 nt, Homo sapiens
ugagcuggauggacaguga

SEQ ID NO: 798347 - RNA, 19 nt, Homo sapiens
caacuggguacaagacauu

SEQ ID NO: 798348 - RNA, 19 nt, Homo sapiens
acagcaagcuacgcaauug

SEQ ID NO: 798349 - RNA, 19 nt, Homo sapiens
cuuaagugauaucuucuga

SEQ ID NO: 798350 - RNA, 19 nt, Homo sapiens
ccaugcagcuggcguaggu

SEQ ID NO: 798351 - RNA, 19 nt, Homo sapiens
gaagauccggcaccacauc

SEQ ID NO: 798352 - RNA, 19 nt, Homo sapiens
gacagcaagcuacgcaauu

SEQ ID NO: 798353 - RNA, 19 nt, Homo sapiens
ggaguggccaggaccaaga

SEQ ID NO: 798354 - RNA, 19 nt, Homo sapiens
gagcuggacuauggcuuuc

SEQ ID NO: 798355 - RNA, 19 nt, Homo sapiens
gaacaggacaaccucucau

SEQ ID NO: 798356 - RNA, 19 nt, Homo sapiens
gcagcaacagcacggacua

SEQ ID NO: 798357 - RNA, 19 nt, Homo sapiens
gccugaacacugugaagua

SEQ ID NO: 798358 - RNA, 19 nt, Homo sapiens
gcgaggacgacgaguucua

SEQ ID NO: 798359 - RNA, 19 nt, Homo sapiens
caacgaggagcuggacuau

SEQ ID NO: 798360 - RNA, 19 nt, Homo sapiens
ggaaugugggccuaguguu

SEQ ID NO: 798361 - RNA, 19 nt, Homo sapiens
aaucacaacuggguacaag

SEQ ID NO: 798362 - RNA, 19 nt, Homo sapiens
ucaacgaggagcuggacua

SEQ ID NO: 798363 - RNA, 19 nt, Homo sapiens
aaugcuggauucuuaagug

SEQ ID NO: 798364 - RNA, 19 nt, Homo sapiens
ggccuaguguugccagauc

SEQ ID NO: 798365 - RNA, 19 nt, Homo sapiens
caugcacagugaucagaga

SEQ ID NO: 798366 - RNA, 19 nt, Homo sapiens
gcauccugcugcucuccaa

SEQ ID NO: 798367 - RNA, 19 nt, Homo sapiens
gcaacagcacggacuacau

SEQ ID NO: 798368 - RNA, 19 nt, Homo sapiens
ugaacacugugaaguacca

SEQ ID NO: 798369 - RNA, 19 nt, Homo sapiens
agggaggccugaacacugu

SEQ ID NO: 798370 - RNA, 19 nt, Homo sapiens
gagagaggcuggggugugu

SEQ ID NO: 798371 - RNA, 19 nt, Homo sapiens
ccugaacacugugaaguac

SEQ ID NO: 798372 - RNA, 19 nt, Homo sapiens
cgaaagaaacuagaaugcu

SEQ ID NO: 798373 - RNA, 19 nt, Homo sapiens
ggagggaggccugaacacu

SEQ ID NO: 798374 - RNA, 19 nt, Homo sapiens
gaaucacaacuggguacaa

SEQ ID NO: 798375 - RNA, 19 nt, Homo sapiens
gugaggaagccuguaccua

SEQ ID NO: 798376 - RNA, 19 nt, Homo sapiens
cggacuacauugccaugca

SEQ ID NO: 798377 - RNA, 19 nt, Homo sapiens
gcucagcucuguguaauga

SEQ ID NO: 798378 - RNA, 19 nt, Homo sapiens
aaacacaccuggaggcaaa

SEQ ID NO: 798379 - RNA, 19 nt, Homo sapiens
uaagaggagugaagaaaga

SEQ ID NO: 798380 - RNA, 19 nt, Homo sapiens
ggaagaagccagaggauuc

SEQ ID NO: 798381 - RNA, 19 nt, Homo sapiens
ccacuaaauugcuguguga

SEQ ID NO: 798382 - RNA, 19 nt, Homo sapiens
gcaccaaaccugacuguga

SEQ ID NO: 798383 - RNA, 19 nt, Homo sapiens
ggagaggguuugcuaaucu

SEQ ID NO: 798384 - RNA, 19 nt, Homo sapiens
ggccaaguguguuccauaa

SEQ ID NO: 798385 - RNA, 19 nt, Homo sapiens
gcaaggacucucccucuaa

SEQ ID NO: 798386 - RNA, 19 nt, Homo sapiens
ccaaggaaaugcccaagga

SEQ ID NO: 798387 - RNA, 19 nt, Homo sapiens
guugguaucuguaaauguu

SEQ ID NO: 798388 - RNA, 19 nt, Homo sapiens
aaagggagguacagaaguu

SEQ ID NO: 798389 - RNA, 19 nt, Homo sapiens
gggcugaguuugagcaaga

SEQ ID NO: 798390 - RNA, 19 nt, Homo sapiens
cgaaaggucuuagcaguca

SEQ ID NO: 798391 - RNA, 19 nt, Homo sapiens
aaagucuccuucaacaaua

SEQ ID NO: 798392 - RNA, 19 nt, Homo sapiens
caaagucuccuucaacaau

SEQ ID NO: 798393 - RNA, 19 nt, Homo sapiens
auaaugaccugcuccgaaa

SEQ ID NO: 798394 - RNA, 19 nt, Homo sapiens
gaagaaagaagacaagacu

SEQ ID NO: 798395 - RNA, 19 nt, Homo sapiens
gaagcaggauggccuaguc

SEQ ID NO: 798396 - RNA, 19 nt, Homo sapiens
guacagaaguuccaauucc

SEQ ID NO: 798397 - RNA, 19 nt, Homo sapiens
gcaguguggauaauguuua

SEQ ID NO: 798398 - RNA, 19 nt, Homo sapiens
uaucugagcauguaucuau

SEQ ID NO: 798399 - RNA, 19 nt, Homo sapiens
ggcaaggacucucccucua

SEQ ID NO: 798400 - RNA, 19 nt, Homo sapiens
uaucuggccugguuauuuc

SEQ ID NO: 798401 - RNA, 19 nt, Homo sapiens
gccaagauuucacacaugu

SEQ ID NO: 798402 - RNA, 19 nt, Homo sapiens
gagacuuucccacaugaua

SEQ ID NO: 798403 - RNA, 19 nt, Homo sapiens
agacaaacacuuggagaua

SEQ ID NO: 798404 - RNA, 19 nt, Homo sapiens
gagcaagacucccuaaccu

SEQ ID NO: 798405 - RNA, 19 nt, Homo sapiens
agacauugauccucucuca

SEQ ID NO: 798406 - RNA, 19 nt, Homo sapiens
ccacacacccuccuucaug

SEQ ID NO: 798407 - RNA, 19 nt, Homo sapiens
gcacucguguggaauacau

SEQ ID NO: 798408 - RNA, 19 nt, Homo sapiens
gacaaacacuuggagauac

SEQ ID NO: 798409 - RNA, 19 nt, Homo sapiens
gauagcaaagugagccaua

SEQ ID NO: 798410 - RNA, 19 nt, Homo sapiens
ggccauuucuggagcaaga

SEQ ID NO: 798411 - RNA, 19 nt, Homo sapiens
caccaaaccugacugugau

SEQ ID NO: 798412 - RNA, 19 nt, Homo sapiens
caaggacucucccucuaag

SEQ ID NO: 798413 - RNA, 19 nt, Homo sapiens
ggaauuauagauacagcuu

SEQ ID NO: 798414 - RNA, 19 nt, Homo sapiens
gccaagaauuucaaagucu

SEQ ID NO: 798415 - RNA, 19 nt, Homo sapiens
agucuuaucuggccugguu

SEQ ID NO: 798416 - RNA, 19 nt, Homo sapiens
cuaaauugcugugugacuu

SEQ ID NO: 798417 - RNA, 19 nt, Homo sapiens
cagcagccuuuaagaagug

SEQ ID NO: 798418 - RNA, 19 nt, Homo sapiens
ggucugcacucgccuggau

SEQ ID NO: 798419 - RNA, 19 nt, Homo sapiens
gauccucucucagccuuug

SEQ ID NO: 798420 - RNA, 19 nt, Homo sapiens
ccaccuuccugcccaaguu

SEQ ID NO: 798421 - RNA, 19 nt, Homo sapiens
gccagggcuuugagacuuu

SEQ ID NO: 798422 - RNA, 19 nt, Homo sapiens
uuuaagaagugucccuuug

SEQ ID NO: 798423 - RNA, 19 nt, Homo sapiens
gucugucgcuacuacaaua

SEQ ID NO: 798424 - RNA, 19 nt, Homo sapiens
gggaggagaggguuugcua

SEQ ID NO: 798425 - RNA, 19 nt, Homo sapiens
ucacugauuccuacacauu

SEQ ID NO: 798426 - RNA, 19 nt, Homo sapiens
gaggagaggguuugcuaau

SEQ ID NO: 798427 - RNA, 19 nt, Homo sapiens
gcucgugucuuaugaucca

SEQ ID NO: 798428 - RNA, 19 nt, Homo sapiens
ccagggagacaaacacuug

SEQ ID NO: 798429 - RNA, 19 nt, Homo sapiens
ggaggagaggguuugcuaa

SEQ ID NO: 798430 - RNA, 19 nt, Homo sapiens
ggauaauguuuaguucugu

SEQ ID NO: 798431 - RNA, 19 nt, Homo sapiens
ccugugaccuuugugacua

SEQ ID NO: 798432 - RNA, 19 nt, Homo sapiens
caagagcccuguguuccau

SEQ ID NO: 798433 - RNA, 19 nt, Homo sapiens
ggaaaccaaagccacaaug

SEQ ID NO: 798434 - RNA, 19 nt, Homo sapiens
caagucugauguccugugu

SEQ ID NO: 798435 - RNA, 19 nt, Homo sapiens
ccagcagccuuuaagaagu

SEQ ID NO: 798436 - RNA, 19 nt, Homo sapiens
gcccuaggauagcaaagug

SEQ ID NO: 798437 - RNA, 19 nt, Homo sapiens
cauucuggcuccuccacua

SEQ ID NO: 798438 - RNA, 19 nt, Homo sapiens
gaucugcuucgccuuaguu

SEQ ID NO: 798439 - RNA, 19 nt, Homo sapiens
caugaucuccggcuaccua

SEQ ID NO: 798440 - RNA, 19 nt, Homo sapiens
gaaaccaaagccacaaugg

SEQ ID NO: 798441 - RNA, 19 nt, Homo sapiens
ccagguaccagacaaggaa

SEQ ID NO: 798442 - RNA, 19 nt, Homo sapiens
gagaggguuugcuaaucug

SEQ ID NO: 798443 - RNA, 19 nt, Homo sapiens
uguaaugagugaugcuaug

SEQ ID NO: 798444 - RNA, 19 nt, Homo sapiens
caacuccagcagccuuuaa

SEQ ID NO: 798445 - RNA, 19 nt, Homo sapiens
ccagaggauucccgagugu

SEQ ID NO: 798446 - RNA, 19 nt, Homo sapiens
ggaacacagccuugauugu

SEQ ID NO: 798447 - RNA, 19 nt, Homo sapiens
gggaacacagccuugauug

SEQ ID NO: 798448 - RNA, 19 nt, Homo sapiens
gcucccagcccaaccuauu

SEQ ID NO: 798449 - RNA, 19 nt, Homo sapiens
caucagcccuuguuuuguu

SEQ ID NO: 798450 - RNA, 19 nt, Homo sapiens
guccugagauugaauuagg

SEQ ID NO: 798451 - RNA, 19 nt, Homo sapiens
ugaggcagcaggacaaaga

SEQ ID NO: 798452 - RNA, 19 nt, Homo sapiens
gagacaaacacuuggagau

SEQ ID NO: 798453 - RNA, 19 nt, Homo sapiens
ccucuuguuucccagguuu

SEQ ID NO: 798454 - RNA, 19 nt, Homo sapiens
uggauaauguuuaguucug

SEQ ID NO: 798455 - RNA, 19 nt, Homo sapiens
cuacacauugccaagauuu

SEQ ID NO: 798456 - RNA, 19 nt, Homo sapiens
guucagcuaugaccaucug

SEQ ID NO: 798457 - RNA, 19 nt, Homo sapiens
ccagcacucguguggaaua

SEQ ID NO: 798458 - RNA, 19 nt, Homo sapiens
gcugguugguaucuguaaa

SEQ ID NO: 798459 - RNA, 19 nt, Homo sapiens
acacuuggguauuuucuaa

SEQ ID NO: 798460 - RNA, 19 nt, Homo sapiens
gggaagaagccagaggauu

SEQ ID NO: 798461 - RNA, 19 nt, Homo sapiens
ccaguucauuaaagucuuc

SEQ ID NO: 798462 - RNA, 19 nt, Homo sapiens
ccaaagucccugugaccuu

SEQ ID NO: 798463 - RNA, 19 nt, Homo sapiens
agacucaggcccacacuug

SEQ ID NO: 798464 - RNA, 19 nt, Homo sapiens
ucucagccuuugcuugcua

SEQ ID NO: 798465 - RNA, 19 nt, Homo sapiens
guucaucggccuccaguuc

SEQ ID NO: 798466 - RNA, 19 nt, Homo sapiens
gaggagugaagaaagaaga

SEQ ID NO: 798467 - RNA, 19 nt, Homo sapiens
gccugccgcucuucuuuau

SEQ ID NO: 798468 - RNA, 19 nt, Homo sapiens
gugauccaguucauuaaag

SEQ ID NO: 798469 - RNA, 19 nt, Homo sapiens
gggauccuguuugcaguga

SEQ ID NO: 798470 - RNA, 19 nt, Homo sapiens
caccagcccugaggauaug

SEQ ID NO: 798471 - RNA, 19 nt, Homo sapiens
gaucuccggcuaccuaaag

SEQ ID NO: 798472 - RNA, 19 nt, Homo sapiens
cuaucaacgccaagaauuu

SEQ ID NO: 798473 - RNA, 19 nt, Homo sapiens
agacuuucccacaugauaa

SEQ ID NO: 798474 - RNA, 19 nt, Homo sapiens
caaagaggcaaggaccaaa

SEQ ID NO: 798475 - RNA, 19 nt, Homo sapiens
ccuaagaggagugaagaaa

SEQ ID NO: 798476 - RNA, 19 nt, Homo sapiens
gcaccgaccccgaaugauu

SEQ ID NO: 798477 - RNA, 19 nt, Homo sapiens
uaaagaaucucauggaaga

SEQ ID NO: 798478 - RNA, 19 nt, Homo sapiens
gaagaagugucccaugauu

SEQ ID NO: 798479 - RNA, 19 nt, Homo sapiens
caaaggagaauguggauua

SEQ ID NO: 798480 - RNA, 19 nt, Homo sapiens
gggaaucaguaaagacuua

SEQ ID NO: 798481 - RNA, 19 nt, Homo sapiens
gaaaguacuucucauggau

SEQ ID NO: 798482 - RNA, 19 nt, Homo sapiens
gaaggaaguguaccucuuu

SEQ ID NO: 798483 - RNA, 19 nt, Homo sapiens
ggaauaaagguguuucuga

SEQ ID NO: 798484 - RNA, 19 nt, Homo sapiens
ggugaugcuuuaugcuuua

SEQ ID NO: 798485 - RNA, 19 nt, Homo sapiens
ggauugaucuuuccagagu

SEQ ID NO: 798486 - RNA, 19 nt, Homo sapiens
gaacuggccugucaaaaug

SEQ ID NO: 798487 - RNA, 19 nt, Homo sapiens
guuaucagcucucaucaga

SEQ ID NO: 798488 - RNA, 19 nt, Homo sapiens
gggcacagcuuccucucuu

SEQ ID NO: 798489 - RNA, 19 nt, Homo sapiens
ugauggaccucaggaauaa

SEQ ID NO: 798490 - RNA, 19 nt, Homo sapiens
ugaaacaccugaaggcaau

SEQ ID NO: 798491 - RNA, 19 nt, Homo sapiens
gcucgugucugcaguuguu

SEQ ID NO: 798492 - RNA, 19 nt, Homo sapiens
cuagugcucuccagaauau

SEQ ID NO: 798493 - RNA, 19 nt, Homo sapiens
guaggguacuugucaauuc

SEQ ID NO: 798494 - RNA, 19 nt, Homo sapiens
gaucaucucaucaaaggaa

SEQ ID NO: 798495 - RNA, 19 nt, Homo sapiens
ggaaucugcuggagguuuc

SEQ ID NO: 798496 - RNA, 19 nt, Homo sapiens
gaacuuugcugagauuggu

SEQ ID NO: 798497 - RNA, 19 nt, Homo sapiens
gcuuacagcucuccuuuua

SEQ ID NO: 798498 - RNA, 19 nt, Homo sapiens
gcacugagaaaccauguau

SEQ ID NO: 798499 - RNA, 19 nt, Homo sapiens
gagcgacacagcagcaaua

SEQ ID NO: 798500 - RNA, 19 nt, Homo sapiens
cugcacaacucauuucuga

SEQ ID NO: 798501 - RNA, 19 nt, Homo sapiens
ggauaucauuguguuugua

SEQ ID NO: 798502 - RNA, 19 nt, Homo sapiens
gcaucaaccuuuccuacau

SEQ ID NO: 798503 - RNA, 19 nt, Homo sapiens
uaagagaagugguccuauc

SEQ ID NO: 798504 - RNA, 19 nt, Homo sapiens
gaacuacuaggcauaaaca

SEQ ID NO: 798505 - RNA, 19 nt, Homo sapiens
ugaaaguacuucucaugga

SEQ ID NO: 798506 - RNA, 19 nt, Homo sapiens
ggaaguguaccucuuugaa

SEQ ID NO: 798507 - RNA, 19 nt, Homo sapiens
ugucugcaguuguugaaua

SEQ ID NO: 798508 - RNA, 19 nt, Homo sapiens
ugaaggcguuuguugagaa

SEQ ID NO: 798509 - RNA, 19 nt, Homo sapiens
cugaagaagugucccauga

SEQ ID NO: 798510 - RNA, 19 nt, Homo sapiens
aggagaauguggauuauau

SEQ ID NO: 798511 - RNA, 19 nt, Homo sapiens
ucucuucccuuaacccuuu

SEQ ID NO: 798512 - RNA, 19 nt, Homo sapiens
ccaaagaugcuguggcuau

SEQ ID NO: 798513 - RNA, 19 nt, Homo sapiens
ggacauaucaggccauggu

SEQ ID NO: 798514 - RNA, 19 nt, Homo sapiens
gugauuacauugcugugaa

SEQ ID NO: 798515 - RNA, 19 nt, Homo sapiens
caaaggaaggcuuaaggaa

SEQ ID NO: 798516 - RNA, 19 nt, Homo sapiens
uuucagagguugagcaaga

SEQ ID NO: 798517 - RNA, 19 nt, Homo sapiens
gaaggcguuuguugagaau

SEQ ID NO: 798518 - RNA, 19 nt, Homo sapiens
gcccagcuaucuagaacaa

SEQ ID NO: 798519 - RNA, 19 nt, Homo sapiens
ucaguaaugugaucagcaa

SEQ ID NO: 798520 - RNA, 19 nt, Homo sapiens
agacagaccucaggauauc

SEQ ID NO: 798521 - RNA, 19 nt, Homo sapiens
aaaggaaggcuuaaggaaa

SEQ ID NO: 798522 - RNA, 19 nt, Homo sapiens
gaaaaugucugggacuguu

SEQ ID NO: 798523 - RNA, 19 nt, Homo sapiens
guuccuccauugcuccuua

SEQ ID NO: 798524 - RNA, 19 nt, Homo sapiens
aaccuaccauguuucuuua

SEQ ID NO: 798525 - RNA, 19 nt, Homo sapiens
ccuuaacccuuucugcuuu

SEQ ID NO: 798526 - RNA, 19 nt, Homo sapiens
cgacuggcauagugaguau

SEQ ID NO: 798527 - RNA, 19 nt, Homo sapiens
aggcguuuguugagaauua

SEQ ID NO: 798528 - RNA, 19 nt, Homo sapiens
caucaaccuuuccuacaug

SEQ ID NO: 798529 - RNA, 19 nt, Homo sapiens
ccaaacaauuccucaaagg

SEQ ID NO: 798530 - RNA, 19 nt, Homo sapiens
ggacugaagggaguagaaa

SEQ ID NO: 798531 - RNA, 19 nt, Homo sapiens
uuagaucgcugugaugaug

SEQ ID NO: 798532 - RNA, 19 nt, Homo sapiens
ccauguaugaccacaauaa

SEQ ID NO: 798533 - RNA, 19 nt, Homo sapiens
ccacauuccugcacaacuc

SEQ ID NO: 798534 - RNA, 19 nt, Homo sapiens
gagacagaccucaggauau

SEQ ID NO: 798535 - RNA, 19 nt, Homo sapiens
ugaauauggugguaaacga

SEQ ID NO: 798536 - RNA, 19 nt, Homo sapiens
caguaaagacuuaagagaa

SEQ ID NO: 798537 - RNA, 19 nt, Homo sapiens
ggagaauguggauuauauu

SEQ ID NO: 798538 - RNA, 19 nt, Homo sapiens
gagagcagcuuuggguucu

SEQ ID NO: 798539 - RNA, 19 nt, Homo sapiens
auacacagcaucaaccuuu

SEQ ID NO: 798540 - RNA, 19 nt, Homo sapiens
uaaagagacgacuggcaua

SEQ ID NO: 798541 - RNA, 19 nt, Homo sapiens
agagacagaccucaggaua

SEQ ID NO: 798542 - RNA, 19 nt, Homo sapiens
guaccucuuugaacgcauu

SEQ ID NO: 798543 - RNA, 19 nt, Homo sapiens
caaagaugcuguggcuauc

SEQ ID NO: 798544 - RNA, 19 nt, Homo sapiens
gguaaacgagucagaggaa

SEQ ID NO: 798545 - RNA, 19 nt, Homo sapiens
caagaacuggccugucaaa

SEQ ID NO: 798546 - RNA, 19 nt, Homo sapiens
gcucucaagucacaucaag

SEQ ID NO: 798547 - RNA, 19 nt, Homo sapiens
ugagaauuauccacaguuc

SEQ ID NO: 798548 - RNA, 19 nt, Homo sapiens
aguaaagacuuaagagaag

SEQ ID NO: 798549 - RNA, 19 nt, Homo sapiens
gaagggcuguaggguacuu

SEQ ID NO: 798550 - RNA, 19 nt, Homo sapiens
ccacagugcacaacacgaa

SEQ ID NO: 798551 - RNA, 19 nt, Homo sapiens
gcuggagguuucagagguu

SEQ ID NO: 798552 - RNA, 19 nt, Homo sapiens
gcugugaagcaguacauuu

SEQ ID NO: 798553 - RNA, 19 nt, Homo sapiens
agaaggaaguguaccucuu

SEQ ID NO: 798554 - RNA, 19 nt, Homo sapiens
cacaaucacuucaguuacu

SEQ ID NO: 798555 - RNA, 19 nt, Homo sapiens
agagacgacuggcauagug

SEQ ID NO: 798556 - RNA, 19 nt, Homo sapiens
gacaugaaggcguuuguug

SEQ ID NO: 798557 - RNA, 19 nt, Homo sapiens
gguaugaaaguacuucuca

SEQ ID NO: 798558 - RNA, 19 nt, Homo sapiens
cagcaagagugacgugaag

SEQ ID NO: 798559 - RNA, 19 nt, Homo sapiens
agacccaaauacacuauau

SEQ ID NO: 798560 - RNA, 19 nt, Homo sapiens
ccagguagcccacggauac

SEQ ID NO: 798561 - RNA, 19 nt, Homo sapiens
guucugugcugguuguuag

SEQ ID NO: 798562 - RNA, 19 nt, Homo sapiens
gagcagcuuuggguucugu

SEQ ID NO: 798563 - RNA, 19 nt, Homo sapiens
gaggagccaccuaugaaga

SEQ ID NO: 798564 - RNA, 19 nt, Homo sapiens
agcaagaacuggccuguca

SEQ ID NO: 798565 - RNA, 19 nt, Homo sapiens
uaccugaacuuugcugaga

SEQ ID NO: 798566 - RNA, 19 nt, Homo sapiens
ccacgaacuacuaggcaua

SEQ ID NO: 798567 - RNA, 19 nt, Homo sapiens
gcaagugauaacuaaagaa

SEQ ID NO: 798568 - RNA, 19 nt, Homo sapiens
gggcuuacagcucuccuuu

SEQ ID NO: 798569 - RNA, 19 nt, Homo sapiens
ugaagcugaugaacaggaa

SEQ ID NO: 798570 - RNA, 19 nt, Homo sapiens
gaagacccaaauacacuau

SEQ ID NO: 798571 - RNA, 19 nt, Homo sapiens
aaaggagaauguggauuau

SEQ ID NO: 798572 - RNA, 19 nt, Homo sapiens
uagaacucaucuccaggua

SEQ ID NO: 798573 - RNA, 19 nt, Homo sapiens
gaagggaguagaaaaugua

SEQ ID NO: 798574 - RNA, 19 nt, Homo sapiens
caccaaacaauuccucaaa

SEQ ID NO: 798575 - RNA, 19 nt, Homo sapiens
gaagcaguacauuuccaaa

SEQ ID NO: 798576 - RNA, 19 nt, Homo sapiens
gguccuaucugcugaaaau

SEQ ID NO: 798577 - RNA, 19 nt, Homo sapiens
ggacgaggcuggcaucaag

SEQ ID NO: 798578 - RNA, 19 nt, Homo sapiens
gugaggagguggagccuuu

SEQ ID NO: 798579 - RNA, 19 nt, Homo sapiens
ggaguugugucucgucuuc

SEQ ID NO: 798580 - RNA, 19 nt, Homo sapiens
gugaaggaauuucuugaga

SEQ ID NO: 798581 - RNA, 19 nt, Homo sapiens
gauggcagcugugaaggaa

SEQ ID NO: 798582 - RNA, 19 nt, Homo sapiens
gcugcugccuccugucuaa

SEQ ID NO: 798583 - RNA, 19 nt, Homo sapiens
gcugcuuucuuauccauuu

SEQ ID NO: 798584 - RNA, 19 nt, Homo sapiens
ccaaggaccuggccauacu

SEQ ID NO: 798585 - RNA, 19 nt, Homo sapiens
ggccuucccucagcuguuu

SEQ ID NO: 798586 - RNA, 19 nt, Homo sapiens
ggagauggcagcugugaag

SEQ ID NO: 798587 - RNA, 19 nt, Homo sapiens
gugaugcccuccugguuug

SEQ ID NO: 798588 - RNA, 19 nt, Homo sapiens
ggugaugcccuccugguuu

SEQ ID NO: 798589 - RNA, 19 nt, Homo sapiens
agaaauugcuuccucaaaa

SEQ ID NO: 798590 - RNA, 19 nt, Homo sapiens
uggcagcugugaaggaauu

SEQ ID NO: 798591 - RNA, 19 nt, Homo sapiens
ggguccaguucaagacaua

SEQ ID NO: 798592 - RNA, 19 nt, Homo sapiens
ugauugagcaugaaaugaa

SEQ ID NO: 798593 - RNA, 19 nt, Homo sapiens
ggagccgugugguguaugu

SEQ ID NO: 798594 - RNA, 19 nt, Homo sapiens
ucaagaaggcagcagagaa

SEQ ID NO: 798595 - RNA, 19 nt, Homo sapiens
uguccuggauuccgauaaa

SEQ ID NO: 798596 - RNA, 19 nt, Homo sapiens
cucaggaccucacucacua

SEQ ID NO: 798597 - RNA, 19 nt, Homo sapiens
acaggcagcuggagaaagg

SEQ ID NO: 798598 - RNA, 19 nt, Homo sapiens
gauugagcaugaaaugaag

SEQ ID NO: 798599 - RNA, 19 nt, Homo sapiens
gaaggcagcagagaacauc

SEQ ID NO: 798600 - RNA, 19 nt, Homo sapiens
ccugugacccucaacauga

SEQ ID NO: 798601 - RNA, 19 nt, Homo sapiens
caagaaggcagcagagaac

SEQ ID NO: 798602 - RNA, 19 nt, Homo sapiens
ggcaccaucuuggaucuga

SEQ ID NO: 798603 - RNA, 19 nt, Homo sapiens
gaacgggaucccugccaau

SEQ ID NO: 798604 - RNA, 19 nt, Homo sapiens
gagugugucugcgggagaa

SEQ ID NO: 798605 - RNA, 19 nt, Homo sapiens
gcgccuaggaucccuguga

SEQ ID NO: 798606 - RNA, 19 nt, Homo sapiens
gcuucucagucaugaaugu

SEQ ID NO: 798607 - RNA, 19 nt, Homo sapiens
gcugccuccugucuaacua

SEQ ID NO: 798608 - RNA, 19 nt, Homo sapiens
cauggugcccguacgguuu

SEQ ID NO: 798609 - RNA, 19 nt, Homo sapiens
gcuacaggcagcuggagaa

SEQ ID NO: 798610 - RNA, 19 nt, Homo sapiens
cgucuucugucuccaugug

SEQ ID NO: 798611 - RNA, 19 nt, Homo sapiens
gcugugaaggaauuucuug

SEQ ID NO: 798612 - RNA, 19 nt, Homo sapiens
cgggaucccugccaaucga

SEQ ID NO: 798613 - RNA, 19 nt, Homo sapiens
aagaaauugcuuccucaaa

SEQ ID NO: 798614 - RNA, 19 nt, Homo sapiens
ucacucaggaccucacuca

SEQ ID NO: 798615 - RNA, 19 nt, Homo sapiens
guggagccgugugguguau

SEQ ID NO: 798616 - RNA, 19 nt, Homo sapiens
caacaugaagauggugaug

SEQ ID NO: 798617 - RNA, 19 nt, Homo sapiens
ucacgucaaguacaucugu

SEQ ID NO: 798618 - RNA, 19 nt, Homo sapiens
aaagaaauugcuuccucaa

SEQ ID NO: 798619 - RNA, 19 nt, Homo sapiens
ugugguguaugugugguaa

SEQ ID NO: 798620 - RNA, 19 nt, Homo sapiens
gggagaaagaggagaaucg

SEQ ID NO: 798621 - RNA, 19 nt, Homo sapiens
cugugacccucaacaugaa

SEQ ID NO: 798622 - RNA, 19 nt, Homo sapiens
ccgcugacccacucacuca

SEQ ID NO: 798623 - RNA, 19 nt, Homo sapiens
gcaagcguggcaccaucuu

SEQ ID NO: 798624 - RNA, 19 nt, Homo sapiens
gccaggguccaguucaaga

SEQ ID NO: 798625 - RNA, 19 nt, Homo sapiens
ggccuugauugagcaugaa

SEQ ID NO: 798626 - RNA, 19 nt, Homo sapiens
aggccuugauugagcauga

SEQ ID NO: 798627 - RNA, 19 nt, Homo sapiens
gaacugcgacgaucacuua

SEQ ID NO: 798628 - RNA, 19 nt, Homo sapiens
gaaauagguuguggaagua

SEQ ID NO: 798629 - RNA, 19 nt, Homo sapiens
caacacacccucuugcuaa

SEQ ID NO: 798630 - RNA, 19 nt, Homo sapiens
ugaaauagguuguggaagu

SEQ ID NO: 798631 - RNA, 19 nt, Homo sapiens
ucuguuggcucaugaaaua

SEQ ID NO: 798632 - RNA, 19 nt, Homo sapiens
ugaaggagauacugaagga

SEQ ID NO: 798633 - RNA, 19 nt, Homo sapiens
gaaacaggccguuaggaau

SEQ ID NO: 798634 - RNA, 19 nt, Homo sapiens
aaacagggcauuuagcaaa

SEQ ID NO: 798635 - RNA, 19 nt, Homo sapiens
uaaaggagcagaggaaaug

SEQ ID NO: 798636 - RNA, 19 nt, Homo sapiens
caaaagagcucuggucauc

SEQ ID NO: 798637 - RNA, 19 nt, Homo sapiens
guuaauguguucagaaguc

SEQ ID NO: 798638 - RNA, 19 nt, Homo sapiens
gccgugauguggucauuug

SEQ ID NO: 798639 - RNA, 19 nt, Homo sapiens
gaagucacaacuacacaga

SEQ ID NO: 798640 - RNA, 19 nt, Homo sapiens
ucgcuguccuuacuacuuu

SEQ ID NO: 798641 - RNA, 19 nt, Homo sapiens
gguuguggaaguaaaguua

SEQ ID NO: 798642 - RNA, 19 nt, Homo sapiens
guauggaagucacaacuac

SEQ ID NO: 798643 - RNA, 19 nt, Homo sapiens
acaaaacagugguagguua

SEQ ID NO: 798644 - RNA, 19 nt, Homo sapiens
aaacagugguagguuaaug

SEQ ID NO: 798645 - RNA, 19 nt, Homo sapiens
aaagagggaccauaugaug

SEQ ID NO: 798646 - RNA, 19 nt, Homo sapiens
agaagucgcuguccuuacu

SEQ ID NO: 798647 - RNA, 19 nt, Homo sapiens
gggaccagcuucgaguuug

SEQ ID NO: 798648 - RNA, 19 nt, Homo sapiens
agaaacaggccguuaggaa

SEQ ID NO: 798649 - RNA, 19 nt, Homo sapiens
gaggcgagcugggauuaag

SEQ ID NO: 798650 - RNA, 19 nt, Homo sapiens
cauuacaccuacucugaga

SEQ ID NO: 798651 - RNA, 19 nt, Homo sapiens
cagaauaaacagggcauuu

SEQ ID NO: 798652 - RNA, 19 nt, Homo sapiens
uuucucagccuacaaauug

SEQ ID NO: 798653 - RNA, 19 nt, Homo sapiens
ucacaacuacacagagauu

SEQ ID NO: 798654 - RNA, 19 nt, Homo sapiens
ucacuguguucgcucuaaa

SEQ ID NO: 798655 - RNA, 19 nt, Homo sapiens
ccugauagccgccaucugu

SEQ ID NO: 798656 - RNA, 19 nt, Homo sapiens
cauaugauguggugguucu

SEQ ID NO: 798657 - RNA, 19 nt, Homo sapiens
agucacaacuacacagaga

SEQ ID NO: 798658 - RNA, 19 nt, Homo sapiens
ucagaagucgcuguccuua

SEQ ID NO: 798659 - RNA, 19 nt, Homo sapiens
gcgacgaucacuuagagaa

SEQ ID NO: 798660 - RNA, 19 nt, Homo sapiens
aaacaggccguuaggaauc

SEQ ID NO: 798661 - RNA, 19 nt, Homo sapiens
gguggcggcucaagugaag

SEQ ID NO: 798662 - RNA, 19 nt, Homo sapiens
caugaaauagguuguggaa

SEQ ID NO: 798663 - RNA, 19 nt, Homo sapiens
gaagucgcuguccuuacua

SEQ ID NO: 798664 - RNA, 19 nt, Homo sapiens
agugguagguuaauguguu

SEQ ID NO: 798665 - RNA, 19 nt, Homo sapiens
cgacgaucacuuagagaaa

SEQ ID NO: 798666 - RNA, 19 nt, Homo sapiens
aagccuuguuugcagaaua

SEQ ID NO: 798667 - RNA, 19 nt, Homo sapiens
uugcaggccuggcuggaaa

SEQ ID NO: 798668 - RNA, 19 nt, Homo sapiens
gacgaucacuuagagaaac

SEQ ID NO: 798669 - RNA, 19 nt, Homo sapiens
gucauuacaccuacucuga

SEQ ID NO: 798670 - RNA, 19 nt, Homo sapiens
guagguuaauguguucaga

SEQ ID NO: 798671 - RNA, 19 nt, Homo sapiens
cagggcauuuagcaaacua

SEQ ID NO: 798672 - RNA, 19 nt, Homo sapiens
agccuuguuugcagaauaa

SEQ ID NO: 798673 - RNA, 19 nt, Homo sapiens
ggagacggucaucccugua

SEQ ID NO: 798674 - RNA, 19 nt, Homo sapiens
gcuaaaggagcagaggaaa

SEQ ID NO: 798675 - RNA, 19 nt, Homo sapiens
aauagguuguggaaguaaa

SEQ ID NO: 798676 - RNA, 19 nt, Homo sapiens
ggaccagcuucgaguuugc

SEQ ID NO: 798677 - RNA, 19 nt, Homo sapiens
acaacacacccucuugcua

SEQ ID NO: 798678 - RNA, 19 nt, Homo sapiens
aaagagcucuggucauccu

SEQ ID NO: 798679 - RNA, 19 nt, Homo sapiens
caaaacagugguagguuaa

SEQ ID NO: 798680 - RNA, 19 nt, Homo sapiens
aaaccggaagggccugaua

SEQ ID NO: 798681 - RNA, 19 nt, Homo sapiens
ggaaauggagacggucauc

SEQ ID NO: 798682 - RNA, 19 nt, Homo sapiens
ggaaguauggaagucacaa

SEQ ID NO: 798683 - RNA, 19 nt, Homo sapiens
gugguagguuaauguguuc

SEQ ID NO: 798684 - RNA, 19 nt, Homo sapiens
gaugccagccuugaagaug

SEQ ID NO: 798685 - RNA, 19 nt, Homo sapiens
aacacacccucuugcuaaa

SEQ ID NO: 798686 - RNA, 19 nt, Homo sapiens
caacuacacagagauuucu

SEQ ID NO: 798687 - RNA, 19 nt, Homo sapiens
gagaaacaggccguuagga

SEQ ID NO: 798688 - RNA, 19 nt, Homo sapiens
uuagagaaacaggccguua

SEQ ID NO: 798689 - RNA, 19 nt, Homo sapiens
gcugugaaggagauacuga

SEQ ID NO: 798690 - RNA, 19 nt, Homo sapiens
ugagucugcugcugugaag

SEQ ID NO: 798691 - RNA, 19 nt, Homo sapiens
gagacggucaucccuguag

SEQ ID NO: 798692 - RNA, 19 nt, Homo sapiens
guggucauuuguccugaug

SEQ ID NO: 798693 - RNA, 19 nt, Homo sapiens
gagguggcggcucaaguga

SEQ ID NO: 798694 - RNA, 19 nt, Homo sapiens
cuaaaggagcagaggaaau

SEQ ID NO: 798695 - RNA, 19 nt, Homo sapiens
cugcgacgaucacuuagag

SEQ ID NO: 798696 - RNA, 19 nt, Homo sapiens
uagagaaacaggccguuag

SEQ ID NO: 798697 - RNA, 19 nt, Homo sapiens
ggcuaaaggagcagaggaa

SEQ ID NO: 798698 - RNA, 19 nt, Homo sapiens
agacggucaucccuguaga

SEQ ID NO: 798699 - RNA, 19 nt, Homo sapiens
agauuucucagccuacaaa

SEQ ID NO: 798700 - RNA, 19 nt, Homo sapiens
aauccauucucacuguguu

SEQ ID NO: 798701 - RNA, 19 nt, Homo sapiens
agagggaccauaugaugug

SEQ ID NO: 798702 - RNA, 19 nt, Homo sapiens
gcuaaagacaaaaugauga

SEQ ID NO: 798703 - RNA, 19 nt, Homo sapiens
gcucuguuggcucaugaaa

SEQ ID NO: 798704 - RNA, 19 nt, Homo sapiens
gcagaauaaacagggcauu

SEQ ID NO: 798705 - RNA, 19 nt, Homo sapiens
guuacaacacacccucuug

SEQ ID NO: 798706 - RNA, 19 nt, Homo sapiens
ggaaggagcugaagagaau

SEQ ID NO: 798707 - RNA, 19 nt, Homo sapiens
ccaaggagaacgacuuuga

SEQ ID NO: 798708 - RNA, 19 nt, Homo sapiens
aagaggagcuggugagaag

SEQ ID NO: 798709 - RNA, 19 nt, Homo sapiens
agagggacgucuuccugua

SEQ ID NO: 798710 - RNA, 19 nt, Homo sapiens
gaagaggagcuggugagaa

SEQ ID NO: 798711 - RNA, 19 nt, Homo sapiens
ggagguagacgagcuguuc

SEQ ID NO: 798712 - RNA, 19 nt, Homo sapiens
gacgagcuguucgacguaa

SEQ ID NO: 798713 - RNA, 19 nt, Homo sapiens
gagcuggaccgagagauga

SEQ ID NO: 798714 - RNA, 19 nt, Homo sapiens
gcgcauguuugcugacuac

SEQ ID NO: 798715 - RNA, 19 nt, Homo sapiens
ccccaucuguuaauaaaua

SEQ ID NO: 798716 - RNA, 19 nt, Homo sapiens
gugagaagacagcgaaaug

SEQ ID NO: 798717 - RNA, 19 nt, Homo sapiens
gcaggaggcgcuagacaag

SEQ ID NO: 798718 - RNA, 19 nt, Homo sapiens
agggacgucuuccuguaua

SEQ ID NO: 798719 - RNA, 19 nt, Homo sapiens
ggaagaggagcuggugaga

SEQ ID NO: 798720 - RNA, 19 nt, Homo sapiens
gagggacgucuuccuguau

SEQ ID NO: 798721 - RNA, 19 nt, Homo sapiens
ggccaaggagaacgacuuu

SEQ ID NO: 798722 - RNA, 19 nt, Homo sapiens
ggagugcacagccaugaca

SEQ ID NO: 798723 - RNA, 19 nt, Homo sapiens
uccaggagauggcugacaa

SEQ ID NO: 798724 - RNA, 19 nt, Homo sapiens
acaggcuggugcuacagua

SEQ ID NO: 798725 - RNA, 19 nt, Homo sapiens
aggaggcgcuagacaagga

SEQ ID NO: 798726 - RNA, 19 nt, Homo sapiens
ggacgucuuccuguauaga

SEQ ID NO: 798727 - RNA, 19 nt, Homo sapiens
gcugcaggaugccuacuac

SEQ ID NO: 798728 - RNA, 19 nt, Homo sapiens
gcuaccagcagugcauaaa

SEQ ID NO: 798729 - RNA, 19 nt, Homo sapiens
ggucccaucccuucaucaa

SEQ ID NO: 798730 - RNA, 19 nt, Homo sapiens
cggaaggagcugaagagaa

SEQ ID NO: 798731 - RNA, 19 nt, Homo sapiens
gguccuggaugagaucaag

SEQ ID NO: 798732 - RNA, 19 nt, Homo sapiens
gcagcuaccagcagugcau

SEQ ID NO: 798733 - RNA, 19 nt, Homo sapiens
ccacccugcugcugcucaa

SEQ ID NO: 798734 - RNA, 19 nt, Homo sapiens
ucggugugguccuggauga

SEQ ID NO: 798735 - RNA, 19 nt, Homo sapiens
gggacgucuuccuguauag

SEQ ID NO: 798736 - RNA, 19 nt, Homo sapiens
gaacagggcucugcuuaac

SEQ ID NO: 798737 - RNA, 19 nt, Homo sapiens
cagagaagguggugcaauu

SEQ ID NO: 798738 - RNA, 19 nt, Homo sapiens
cagaaaccauguacaggua

SEQ ID NO: 798739 - RNA, 19 nt, Homo sapiens
gcucaaaggucucccucuu

SEQ ID NO: 798740 - RNA, 19 nt, Homo sapiens
ucaaaggucucccucuuca

SEQ ID NO: 798741 - RNA, 19 nt, Homo sapiens
aaacaccgaucugugcaua

SEQ ID NO: 798742 - RNA, 19 nt, Homo sapiens
gagcacaccaccauucuga

SEQ ID NO: 798743 - RNA, 19 nt, Homo sapiens
gcgaacagggcucugcuua

SEQ ID NO: 798744 - RNA, 19 nt, Homo sapiens
gaucauccguaaaguagca

SEQ ID NO: 798745 - RNA, 19 nt, Homo sapiens
gagcauccaucaggaguuc

SEQ ID NO: 798746 - RNA, 19 nt, Homo sapiens
caagugugcauuccaguuu

SEQ ID NO: 798747 - RNA, 19 nt, Homo sapiens
gaauucggcugcgccaaga

SEQ ID NO: 798748 - RNA, 19 nt, Homo sapiens
ccagaaaucauacggaaau

SEQ ID NO: 798749 - RNA, 19 nt, Homo sapiens
agacgcagaagcugaauuu

SEQ ID NO: 798750 - RNA, 19 nt, Homo sapiens
gcaccaacuuccaccucuu

SEQ ID NO: 798751 - RNA, 19 nt, Homo sapiens
gaagaagcagucgcugaaa

SEQ ID NO: 798752 - RNA, 19 nt, Homo sapiens
ucgaagcccucgcagaaga

SEQ ID NO: 798753 - RNA, 19 nt, Homo sapiens
cgcagaagcugaauuucga

SEQ ID NO: 798754 - RNA, 19 nt, Homo sapiens
caagguggcccagaaauca

SEQ ID NO: 798755 - RNA, 19 nt, Homo sapiens
ccaagacccuguacaucuc

SEQ ID NO: 798756 - RNA, 19 nt, Homo sapiens
gcaacagugugaacagacu

SEQ ID NO: 798757 - RNA, 19 nt, Homo sapiens
agaagguggugcaauuuca

SEQ ID NO: 798758 - RNA, 19 nt, Homo sapiens
gagaagguggugcaauuuc

SEQ ID NO: 798759 - RNA, 19 nt, Homo sapiens
caugaucauccguaaagua

SEQ ID NO: 798760 - RNA, 19 nt, Homo sapiens
cagcaacagugugaacaga

SEQ ID NO: 798761 - RNA, 19 nt, Homo sapiens
cgaacagggcucugcuuaa

SEQ ID NO: 798762 - RNA, 19 nt, Homo sapiens
agaagaagcagucgcugaa

SEQ ID NO: 798763 - RNA, 19 nt, Homo sapiens
caacuuccaccucuucauc

SEQ ID NO: 798764 - RNA, 19 nt, Homo sapiens
ccuagugccuucuccuuca

SEQ ID NO: 798765 - RNA, 19 nt, Homo sapiens
gccaagacccuguacaucu

SEQ ID NO: 798766 - RNA, 19 nt, Homo sapiens
acagggcucugcuuaacga

SEQ ID NO: 798767 - RNA, 19 nt, Homo sapiens
cacacuaccucccaugauc

SEQ ID NO: 798768 - RNA, 19 nt, Homo sapiens
ucucgaagcccucgcagaa

SEQ ID NO: 798769 - RNA, 19 nt, Homo sapiens
uuaucaaggucaucucgaa

SEQ ID NO: 798770 - RNA, 19 nt, Homo sapiens
ucucccagcugcacaagug

SEQ ID NO: 798771 - RNA, 19 nt, Homo sapiens
ccagagcacaccaccauuc

SEQ ID NO: 798772 - RNA, 19 nt, Homo sapiens
gacaagaggaagcacuuuc

SEQ ID NO: 798773 - RNA, 19 nt, Homo sapiens
acaccgaucugugcauauc

SEQ ID NO: 798774 - RNA, 19 nt, Homo sapiens
gcaggacagaucagagaug

SEQ ID NO: 798775 - RNA, 19 nt, Homo sapiens
agugugcgcuccuugaugu

SEQ ID NO: 798776 - RNA, 19 nt, Homo sapiens
ccacugagacgcagaagcu

SEQ ID NO: 798777 - RNA, 19 nt, Homo sapiens
cagaaaucauacggaaaug

SEQ ID NO: 798778 - RNA, 19 nt, Homo sapiens
ggucaccggcaucacacua

SEQ ID NO: 798779 - RNA, 19 nt, Homo sapiens
ccacagccgccuuaucaag

SEQ ID NO: 798780 - RNA, 19 nt, Homo sapiens
cagccggacuccagggaau

SEQ ID NO: 798781 - RNA, 19 nt, Homo sapiens
acuuaugccuugccacaga

SEQ ID NO: 798782 - RNA, 19 nt, Homo sapiens
ccaagguggcccagaaauc

SEQ ID NO: 798783 - RNA, 19 nt, Homo sapiens
gggcucuucuacccuagug

SEQ ID NO: 798784 - RNA, 19 nt, Homo sapiens
gcgccaagacccuguacau

SEQ ID NO: 798785 - RNA, 19 nt, Homo sapiens
uaaaguagcaaaacagugu

SEQ ID NO: 798786 - RNA, 19 nt, Homo sapiens
agagaagguggugcaauuu

SEQ ID NO: 798787 - RNA, 19 nt, Homo sapiens
gcauauccuccggcucaaa

SEQ ID NO: 798788 - RNA, 19 nt, Homo sapiens
ggaggcagaaaccauguac

SEQ ID NO: 798789 - RNA, 19 nt, Homo sapiens
aagaagcagucgcugaaaa

SEQ ID NO: 798790 - RNA, 19 nt, Homo sapiens
uuccacagccgccuuauca

SEQ ID NO: 798791 - RNA, 19 nt, Homo sapiens
cagacaagaggaagcacuu

SEQ ID NO: 798792 - RNA, 19 nt, Homo sapiens
gggcucaaggugugguuug

SEQ ID NO: 798793 - RNA, 19 nt, Homo sapiens
gaagguggugcaauuucag

SEQ ID NO: 798794 - RNA, 19 nt, Homo sapiens
gcacaccauuugcuuccaa

SEQ ID NO: 798795 - RNA, 19 nt, Homo sapiens
gcacaugcgccuccucuuc

SEQ ID NO: 798796 - RNA, 19 nt, Homo sapiens
ccgcuucacucacuacuuc

SEQ ID NO: 798797 - RNA, 19 nt, Homo sapiens
gggcagggcugaugaaccu

SEQ ID NO: 798798 - RNA, 19 nt, Homo sapiens
ccagugaccuuggagagau

SEQ ID NO: 798799 - RNA, 19 nt, Homo sapiens
gcccuucccucucaucaca

SEQ ID NO: 798800 - RNA, 19 nt, Homo sapiens
gagaaccuccuggugauau

SEQ ID NO: 798801 - RNA, 19 nt, Homo sapiens
uggcugcccuaucauguga

SEQ ID NO: 798802 - RNA, 19 nt, Homo sapiens
gagcccaugugccucuuca

SEQ ID NO: 798803 - RNA, 19 nt, Homo sapiens
ccgcagugccuaccaguga

SEQ ID NO: 798804 - RNA, 19 nt, Homo sapiens
gcuccugaaugcuguaguc

SEQ ID NO: 798805 - RNA, 19 nt, Homo sapiens
ugugcuggcugcccuauca

SEQ ID NO: 798806 - RNA, 19 nt, Homo sapiens
ucaaccacacuuugucuga

SEQ ID NO: 798807 - RNA, 19 nt, Homo sapiens
guaguccauuaccuuccua

SEQ ID NO: 798808 - RNA, 19 nt, Homo sapiens
ucaucacagucuucaaugu

SEQ ID NO: 798809 - RNA, 19 nt, Homo sapiens
ccugaaugcuguaguccau

SEQ ID NO: 798810 - RNA, 19 nt, Homo sapiens
caacuggaccgagcugcuu

SEQ ID NO: 798811 - RNA, 19 nt, Homo sapiens
gcuuucaggcacaccauuu

SEQ ID NO: 798812 - RNA, 19 nt, Homo sapiens
cugcugcccuucccucuca

SEQ ID NO: 798813 - RNA, 19 nt, Homo sapiens
ucuacuuugucaacaugua

SEQ ID NO: 798814 - RNA, 19 nt, Homo sapiens
acucacuacuucuacuuug

SEQ ID NO: 798815 - RNA, 19 nt, Homo sapiens
ugguugggcugguggagaa

SEQ ID NO: 798816 - RNA, 19 nt, Homo sapiens
cagcauuccaucaucauca

SEQ ID NO: 798817 - RNA, 19 nt, Homo sapiens
cuacguggccgucuuuguc

SEQ ID NO: 798818 - RNA, 19 nt, Homo sapiens
caagcgcgugguccucuuu

SEQ ID NO: 798819 - RNA, 19 nt, Homo sapiens
ucgcggaccugggcauugu

SEQ ID NO: 798820 - RNA, 19 nt, Homo sapiens
ucucaucacagucuucaau

SEQ ID NO: 798821 - RNA, 19 nt, Homo sapiens
guauagcagcaucuucuuc

SEQ ID NO: 798822 - RNA, 19 nt, Homo sapiens
cuucuacuuugucaacaug

SEQ ID NO: 798823 - RNA, 19 nt, Homo sapiens
ggcgugugcuggucccaau

SEQ ID NO: 798824 - RNA, 19 nt, Homo sapiens
ucuccaugcugcacugugu

SEQ ID NO: 798825 - RNA, 19 nt, Homo sapiens
cgagcugcuugaccucuuc

SEQ ID NO: 798826 - RNA, 19 nt, Homo sapiens
gaaccucuacauccucaac

SEQ ID NO: 798827 - RNA, 19 nt, Homo sapiens
ccaagcgcgugguccucuu

SEQ ID NO: 798828 - RNA, 19 nt, Homo sapiens
agaaccuccuggugauaug

SEQ ID NO: 798829 - RNA, 19 nt, Homo sapiens
gcucuacuucuucuaugau

SEQ ID NO: 798830 - RNA, 19 nt, Homo sapiens
ccacaagcauugaauauaa

SEQ ID NO: 798831 - RNA, 19 nt, Homo sapiens
gcaggaagcuguuggcaaa

SEQ ID NO: 798832 - RNA, 19 nt, Homo sapiens
ggacucagauaaacauaaa

SEQ ID NO: 798833 - RNA, 19 nt, Homo sapiens
uagaagaccuuaagaaaga

SEQ ID NO: 798834 - RNA, 19 nt, Homo sapiens
aauagaagcugcugacuuu

SEQ ID NO: 798835 - RNA, 19 nt, Homo sapiens
gaggaugaaugguuuauug

SEQ ID NO: 798836 - RNA, 19 nt, Homo sapiens
gaucacagaccaacaagua

SEQ ID NO: 798837 - RNA, 19 nt, Homo sapiens
gagcagaacuaugacuuaa

SEQ ID NO: 798838 - RNA, 19 nt, Homo sapiens
gaaaggaacacuugauaau

SEQ ID NO: 798839 - RNA, 19 nt, Homo sapiens
gggauaacauugaggauga

SEQ ID NO: 798840 - RNA, 19 nt, Homo sapiens
gaaguacauugagagaaua

SEQ ID NO: 798841 - RNA, 19 nt, Homo sapiens
gaaccuguaucccagacua

SEQ ID NO: 798842 - RNA, 19 nt, Homo sapiens
uaaagcagaucacaaagga

SEQ ID NO: 798843 - RNA, 19 nt, Homo sapiens
guaccgagcccaugaauug

SEQ ID NO: 798844 - RNA, 19 nt, Homo sapiens
gauggugaauucuuguuaa

SEQ ID NO: 798845 - RNA, 19 nt, Homo sapiens
gaugaagacuuugaauguu

SEQ ID NO: 798846 - RNA, 19 nt, Homo sapiens
gagaggcccuagaaccuuu

SEQ ID NO: 798847 - RNA, 19 nt, Homo sapiens
ggaccugcuuccaaucuuu

SEQ ID NO: 798848 - RNA, 19 nt, Homo sapiens
aaucagccuuucaaucuua

SEQ ID NO: 798849 - RNA, 19 nt, Homo sapiens
gcagaacuaugacuuaacu

SEQ ID NO: 798850 - RNA, 19 nt, Homo sapiens
ggugaauucuuguuaauag

SEQ ID NO: 798851 - RNA, 19 nt, Homo sapiens
agaaggagcagaacuauga

SEQ ID NO: 798852 - RNA, 19 nt, Homo sapiens
gaugaugacuuggacuuug

SEQ ID NO: 798853 - RNA, 19 nt, Homo sapiens
ggagcagaacuaugacuua

SEQ ID NO: 798854 - RNA, 19 nt, Homo sapiens
gaucuuaugcuccaaaugu

SEQ ID NO: 798855 - RNA, 19 nt, Homo sapiens
gaacuaugacuuaacugaa

SEQ ID NO: 798856 - RNA, 19 nt, Homo sapiens
agacaaugauggugaauuc

SEQ ID NO: 798857 - RNA, 19 nt, Homo sapiens
gaaucagccuuucaaucuu

SEQ ID NO: 798858 - RNA, 19 nt, Homo sapiens
gcacauuuagcuucucuuu

SEQ ID NO: 798859 - RNA, 19 nt, Homo sapiens
cugaugaucuggaugauga

SEQ ID NO: 798860 - RNA, 19 nt, Homo sapiens
uauacgagcugcugugaau

SEQ ID NO: 798861 - RNA, 19 nt, Homo sapiens
agaaguacauugagagaau

SEQ ID NO: 798862 - RNA, 19 nt, Homo sapiens
ccaugaagcuugcuacgau

SEQ ID NO: 798863 - RNA, 19 nt, Homo sapiens
caacaaguaagccaacaaa

SEQ ID NO: 798864 - RNA, 19 nt, Homo sapiens
ugaguggguuucagacuuu

SEQ ID NO: 798865 - RNA, 19 nt, Homo sapiens
uaugagcccuggugaagaa

SEQ ID NO: 798866 - RNA, 19 nt, Homo sapiens
caaagaagaauggaagaaa

SEQ ID NO: 798867 - RNA, 19 nt, Homo sapiens
gaaccaaguggaaccugua

SEQ ID NO: 798868 - RNA, 19 nt, Homo sapiens
cagagagcaugaaagcuuu

SEQ ID NO: 798869 - RNA, 19 nt, Homo sapiens
caaugauggugaauucuug

SEQ ID NO: 798870 - RNA, 19 nt, Homo sapiens
uagcaaggauugaagacaa

SEQ ID NO: 798871 - RNA, 19 nt, Homo sapiens
gcagaucacaaaggaauuu

SEQ ID NO: 798872 - RNA, 19 nt, Homo sapiens
uagaaauggcagagaauua

SEQ ID NO: 798873 - RNA, 19 nt, Homo sapiens
gagaauaaucacucgguuu

SEQ ID NO: 798874 - RNA, 19 nt, Homo sapiens
cagacaauaccauuugaua

SEQ ID NO: 798875 - RNA, 19 nt, Homo sapiens
gagugcagcugccugacaa

SEQ ID NO: 798876 - RNA, 19 nt, Homo sapiens
ugaaaggaacacuugauaa

SEQ ID NO: 798877 - RNA, 19 nt, Homo sapiens
ucauggauuugagaucuua

SEQ ID NO: 798878 - RNA, 19 nt, Homo sapiens
ugacaacaccgaucacaga

SEQ ID NO: 798879 - RNA, 19 nt, Homo sapiens
cgaaggagaggcccuagaa

SEQ ID NO: 798880 - RNA, 19 nt, Homo sapiens
ccugaaacacgaauaauga

SEQ ID NO: 798881 - RNA, 19 nt, Homo sapiens
ugaagacaaugauggugaa

SEQ ID NO: 798882 - RNA, 19 nt, Homo sapiens
acacgaaccuggcgaagag

SEQ ID NO: 798883 - RNA, 19 nt, Homo sapiens
gccaaggccuaaugaguca

SEQ ID NO: 798884 - RNA, 19 nt, Homo sapiens
caacaauuccacaagcauu

SEQ ID NO: 798885 - RNA, 19 nt, Homo sapiens
aaggaacacuugauaaucu

SEQ ID NO: 798886 - RNA, 19 nt, Homo sapiens
ucagagagcaugaaagcuu

SEQ ID NO: 798887 - RNA, 19 nt, Homo sapiens
uaacaauucagaugaggaa

SEQ ID NO: 798888 - RNA, 19 nt, Homo sapiens
gaagcuugcuacgauggaa

SEQ ID NO: 798889 - RNA, 19 nt, Homo sapiens
uaagaaagaagcagcuaau

SEQ ID NO: 798890 - RNA, 19 nt, Homo sapiens
gaaaguucucuugcuauga

SEQ ID NO: 798891 - RNA, 19 nt, Homo sapiens
ggaagaaaccaugaagcuu

SEQ ID NO: 798892 - RNA, 19 nt, Homo sapiens
ggcuagaaauggcagagaa

SEQ ID NO: 798893 - RNA, 19 nt, Homo sapiens
caucagaggguacccagaa

SEQ ID NO: 798894 - RNA, 19 nt, Homo sapiens
uauuaucccugcaccaaga

SEQ ID NO: 798895 - RNA, 19 nt, Homo sapiens
cauggggaauuguguauua

SEQ ID NO: 798896 - RNA, 19 nt, Homo sapiens
guaauaaagcagaucacaa

SEQ ID NO: 798897 - RNA, 19 nt, Homo sapiens
ggaugaaugguuuauuguu

SEQ ID NO: 798898 - RNA, 19 nt, Homo sapiens
ggauaacauugaggaugaa

SEQ ID NO: 798899 - RNA, 19 nt, Homo sapiens
agaaucagccuuucaaucu

SEQ ID NO: 798900 - RNA, 19 nt, Homo sapiens
caauucagaugaggaagau

SEQ ID NO: 798901 - RNA, 19 nt, Homo sapiens
aaagaagaauggaagaaac

SEQ ID NO: 798902 - RNA, 19 nt, Homo sapiens
ugacuuggacuuugaaaca

SEQ ID NO: 798903 - RNA, 19 nt, Homo sapiens
agauagugaugaugacuug

SEQ ID NO: 798904 - RNA, 19 nt, Homo sapiens
ugaugaagacuuugaaugu

SEQ ID NO: 798905 - RNA, 19 nt, Homo sapiens
uuacagacaauaccauuug

SEQ ID NO: 798906 - RNA, 19 nt, Homo sapiens
aaaguucucuugcuaugag

SEQ ID NO: 798907 - RNA, 19 nt, Homo sapiens
gauaaucucaagucauaca

SEQ ID NO: 798908 - RNA, 19 nt, Homo sapiens
ggagaaggagcagaacuau

SEQ ID NO: 798909 - RNA, 19 nt, Homo sapiens
gaaacacgaauaaugacau

SEQ ID NO: 798910 - RNA, 19 nt, Homo sapiens
agaauaaucacucgguuug

SEQ ID NO: 798911 - RNA, 19 nt, Homo sapiens
gagaucuuaugcuccaaau

SEQ ID NO: 798912 - RNA, 19 nt, Homo sapiens
ugaaauuggcucauggauu

SEQ ID NO: 798913 - RNA, 19 nt, Homo sapiens
aaacacgaauaaugacauc

SEQ ID NO: 798914 - RNA, 19 nt, Homo sapiens
guacugccuguuccugaua

SEQ ID NO: 798915 - RNA, 19 nt, Homo sapiens
gcaaaaguuucaccacuag

SEQ ID NO: 798916 - RNA, 19 nt, Homo sapiens
gauauagaagaccuuaaga

SEQ ID NO: 798917 - RNA, 19 nt, Homo sapiens
aaucacagcacauucagaa

SEQ ID NO: 798918 - RNA, 19 nt, Homo sapiens
gguacgggagaaucuguua

SEQ ID NO: 798919 - RNA, 19 nt, Homo sapiens
ccagauggaccaggaacua

SEQ ID NO: 798920 - RNA, 19 nt, Homo sapiens
cugaaaggaacacuugaua

SEQ ID NO: 798921 - RNA, 19 nt, Homo sapiens
ucuggaugaugaagacuuu

SEQ ID NO: 798922 - RNA, 19 nt, Homo sapiens
ggagaggcggcuaaggaaa

SEQ ID NO: 798923 - RNA, 19 nt, Homo sapiens
gucaagggacucagauaaa

SEQ ID NO: 798924 - RNA, 19 nt, Homo sapiens
gaugaggaagauucuggua

SEQ ID NO: 798925 - RNA, 19 nt, Homo sapiens
gaaaccaugaagcuugcua

SEQ ID NO: 798926 - RNA, 19 nt, Homo sapiens
ucaagggacucagauaaac

SEQ ID NO: 798927 - RNA, 19 nt, Homo sapiens
cagacuuucucucaggauu

SEQ ID NO: 798928 - RNA, 19 nt, Homo sapiens
gaugcagauucuuuucuua

SEQ ID NO: 798929 - RNA, 19 nt, Homo sapiens
ccugcgagcuugucguguu

SEQ ID NO: 798930 - RNA, 19 nt, Homo sapiens
gaaccucucuuauugauuu

SEQ ID NO: 798931 - RNA, 19 nt, Homo sapiens
gaaagugaaucucccauaa

SEQ ID NO: 798932 - RNA, 19 nt, Homo sapiens
gaagauggcuauuucagaa

SEQ ID NO: 798933 - RNA, 19 nt, Homo sapiens
aaacuaagcuguccucaga

SEQ ID NO: 798934 - RNA, 19 nt, Homo sapiens
gagacuacaucuuguuuaa

SEQ ID NO: 798935 - RNA, 19 nt, Homo sapiens
gaaguuggacuguguuaua

SEQ ID NO: 798936 - RNA, 19 nt, Homo sapiens
gaacaggaguuucaauagu

SEQ ID NO: 798937 - RNA, 19 nt, Homo sapiens
gagugaagguuuggaaaua

SEQ ID NO: 798938 - RNA, 19 nt, Homo sapiens
gaaagcaaaucugcgaauu

SEQ ID NO: 798939 - RNA, 19 nt, Homo sapiens
guaaggaugcguugaauaa

SEQ ID NO: 798940 - RNA, 19 nt, Homo sapiens
cagcugggcuucauuggua

SEQ ID NO: 798941 - RNA, 19 nt, Homo sapiens
gagaauuccuugcuuugaa

SEQ ID NO: 798942 - RNA, 19 nt, Homo sapiens
gaagagagaaguuaaaucu

SEQ ID NO: 798943 - RNA, 19 nt, Homo sapiens
ucacagcgcucuucugaau

SEQ ID NO: 798944 - RNA, 19 nt, Homo sapiens
ucgaauagcugaacacaga

SEQ ID NO: 798945 - RNA, 19 nt, Homo sapiens
caaagaaaccaaagacaaa

SEQ ID NO: 798946 - RNA, 19 nt, Homo sapiens
caacugaucaucugagaaa

SEQ ID NO: 798947 - RNA, 19 nt, Homo sapiens
gcaaagaaaccaaagacaa

SEQ ID NO: 798948 - RNA, 19 nt, Homo sapiens
cgaauucgcuucagaccuu

SEQ ID NO: 798949 - RNA, 19 nt, Homo sapiens
acagcgcucuucugaauua

SEQ ID NO: 798950 - RNA, 19 nt, Homo sapiens
aagugaaucucccauaaua

SEQ ID NO: 798951 - RNA, 19 nt, Homo sapiens
ggucugcacucaucacuau

SEQ ID NO: 798952 - RNA, 19 nt, Homo sapiens
uaaauacgauugugcaaca

SEQ ID NO: 798953 - RNA, 19 nt, Homo sapiens
gagagacagauauugauua

SEQ ID NO: 798954 - RNA, 19 nt, Homo sapiens
gaaguaaggaugcguugaa

SEQ ID NO: 798955 - RNA, 19 nt, Homo sapiens
ucauuugccucauuuauug

SEQ ID NO: 798956 - RNA, 19 nt, Homo sapiens
ggaaagugaaucucccaua

SEQ ID NO: 798957 - RNA, 19 nt, Homo sapiens
gacaaacgauuagaagaug

SEQ ID NO: 798958 - RNA, 19 nt, Homo sapiens
agaguaagauggagaacaa

SEQ ID NO: 798959 - RNA, 19 nt, Homo sapiens
uaaaggaguuaacaagcaa

SEQ ID NO: 798960 - RNA, 19 nt, Homo sapiens
caacgagaauuccuugcuu

SEQ ID NO: 798961 - RNA, 19 nt, Homo sapiens
gauaagacgauugucauuu

SEQ ID NO: 798962 - RNA, 19 nt, Homo sapiens
ucacuuccuuccuuacuuu

SEQ ID NO: 798963 - RNA, 19 nt, Homo sapiens
gaaagaguaagauggagaa

SEQ ID NO: 798964 - RNA, 19 nt, Homo sapiens
ggagauauucugcuaaaca

SEQ ID NO: 798965 - RNA, 19 nt, Homo sapiens
uagccaaccuggagaaaga

SEQ ID NO: 798966 - RNA, 19 nt, Homo sapiens
guuggacuguguuauagua

SEQ ID NO: 798967 - RNA, 19 nt, Homo sapiens
gaaucucccauaauaauug

SEQ ID NO: 798968 - RNA, 19 nt, Homo sapiens
ccaagaacauccuggagau

SEQ ID NO: 798969 - RNA, 19 nt, Homo sapiens
ggagagacagauauugauu

SEQ ID NO: 798970 - RNA, 19 nt, Homo sapiens
ggagacuacaucuuguuua

SEQ ID NO: 798971 - RNA, 19 nt, Homo sapiens
gaaacucuucauucccuua

SEQ ID NO: 798972 - RNA, 19 nt, Homo sapiens
gaacuguagccacugcuuu

SEQ ID NO: 798973 - RNA, 19 nt, Homo sapiens
gagaugaggcuccgcaaug

SEQ ID NO: 798974 - RNA, 19 nt, Homo sapiens
gaacacuaccucuugugaa

SEQ ID NO: 798975 - RNA, 19 nt, Homo sapiens
aaccaaagacaaacgauua

SEQ ID NO: 798976 - RNA, 19 nt, Homo sapiens
ggagaaacccauugauugg

SEQ ID NO: 798977 - RNA, 19 nt, Homo sapiens
gggcauauauuacauucag

SEQ ID NO: 798978 - RNA, 19 nt, Homo sapiens
gagagaaguuaaaucuuac

SEQ ID NO: 798979 - RNA, 19 nt, Homo sapiens
caaagacaaacgauuagaa

SEQ ID NO: 798980 - RNA, 19 nt, Homo sapiens
cccuaaagcuguuaaagga

SEQ ID NO: 798981 - RNA, 19 nt, Homo sapiens
gcagaaacaaauggaagua

SEQ ID NO: 798982 - RNA, 19 nt, Homo sapiens
gaaauaagcaaagaaacca

SEQ ID NO: 798983 - RNA, 19 nt, Homo sapiens
cagucaauguagaaaguua

SEQ ID NO: 798984 - RNA, 19 nt, Homo sapiens
ugauaaaccagucaaugua

SEQ ID NO: 798985 - RNA, 19 nt, Homo sapiens
ccagugugauggugaaaug

SEQ ID NO: 798986 - RNA, 19 nt, Homo sapiens
caaccuggagaaagaauuu

SEQ ID NO: 798987 - RNA, 19 nt, Homo sapiens
gaaugguguugcagaagga

SEQ ID NO: 798988 - RNA, 19 nt, Homo sapiens
ugagaaugguguugcagaa

SEQ ID NO: 798989 - RNA, 19 nt, Homo sapiens
gcgcucuucugaauuaaau

SEQ ID NO: 798990 - RNA, 19 nt, Homo sapiens
agaauuccuugcuuugaaa

SEQ ID NO: 798991 - RNA, 19 nt, Homo sapiens
auaagacgauugucauuuc

SEQ ID NO: 798992 - RNA, 19 nt, Homo sapiens
gaaaagggcauauauuaca

SEQ ID NO: 798993 - RNA, 19 nt, Homo sapiens
aaugauguaugcucaagaa

SEQ ID NO: 798994 - RNA, 19 nt, Homo sapiens
gaacaaagcaaaaccuaga

SEQ ID NO: 798995 - RNA, 19 nt, Homo sapiens
aagaacaggaguuucaaua

SEQ ID NO: 798996 - RNA, 19 nt, Homo sapiens
guagauaagacgauuguca

SEQ ID NO: 798997 - RNA, 19 nt, Homo sapiens
gauuagaagauggcuauuu

SEQ ID NO: 798998 - RNA, 19 nt, Homo sapiens
gagaaguuggacuguguua

SEQ ID NO: 798999 - RNA, 19 nt, Homo sapiens
cauagaaacucuucauucc

SEQ ID NO: 799000 - RNA, 19 nt, Homo sapiens
gugaaucucccauaauaau

SEQ ID NO: 799001 - RNA, 19 nt, Homo sapiens
gaacauccuggagauauuc

SEQ ID NO: 799002 - RNA, 19 nt, Homo sapiens
gaucuuacucugauuguag

SEQ ID NO: 799003 - RNA, 19 nt, Homo sapiens
aaagaaagaguaagaugga

SEQ ID NO: 799004 - RNA, 19 nt, Homo sapiens
aaucuuaccucauagaaac

SEQ ID NO: 799005 - RNA, 19 nt, Homo sapiens
ucaaccugcuguacagauu

SEQ ID NO: 799006 - RNA, 19 nt, Homo sapiens
ccaagucucaaucccauuu

SEQ ID NO: 799007 - RNA, 19 nt, Homo sapiens
gauauucugcuaaacacaa

SEQ ID NO: 799008 - RNA, 19 nt, Homo sapiens
gauaaaccagucaauguag

SEQ ID NO: 799009 - RNA, 19 nt, Homo sapiens
ucaacuuucuucugaggaa

SEQ ID NO: 799010 - RNA, 19 nt, Homo sapiens
gcuccgcaauggaacugua

SEQ ID NO: 799011 - RNA, 19 nt, Homo sapiens
gaaagucugcaacccugaa

SEQ ID NO: 799012 - RNA, 19 nt, Homo sapiens
ggaucuuacucugauugua

SEQ ID NO: 799013 - RNA, 19 nt, Homo sapiens
gaagaacaggaguuucaau

SEQ ID NO: 799014 - RNA, 19 nt, Homo sapiens
gacuuucaguuauucagaa

SEQ ID NO: 799015 - RNA, 19 nt, Homo sapiens
cuggagauauucugcuaaa

SEQ ID NO: 799016 - RNA, 19 nt, Homo sapiens
agaacauccuggagauauu

SEQ ID NO: 799017 - RNA, 19 nt, Homo sapiens
cacuucaacuuucuucuga

SEQ ID NO: 799018 - RNA, 19 nt, Homo sapiens
ccaaagaaagaguaagaug

SEQ ID NO: 799019 - RNA, 19 nt, Homo sapiens
aagagaaguuggacugugu

SEQ ID NO: 799020 - RNA, 19 nt, Homo sapiens
agaaacaaauggaaguaag

SEQ ID NO: 799021 - RNA, 19 nt, Homo sapiens
acuaagcuguccucagauu

SEQ ID NO: 799022 - RNA, 19 nt, Homo sapiens
gccuuucgacuuucaguua

SEQ ID NO: 799023 - RNA, 19 nt, Homo sapiens
gagauauucugcuaaacac

SEQ ID NO: 799024 - RNA, 19 nt, Homo sapiens
caagaacauccuggagaua

SEQ ID NO: 799025 - RNA, 19 nt, Homo sapiens
uaggagagacagauauuga

SEQ ID NO: 799026 - RNA, 19 nt, Homo sapiens
caagugccaaguauuuauu

SEQ ID NO: 799027 - RNA, 19 nt, Homo sapiens
auuagaagauggcuauuuc

SEQ ID NO: 799028 - RNA, 19 nt, Homo sapiens
acucaucacuaucaggaaa

SEQ ID NO: 799029 - RNA, 19 nt, Homo sapiens
gcacuucaacuuucuucug

SEQ ID NO: 799030 - RNA, 19 nt, Homo sapiens
ccucagaucucuauuauua

SEQ ID NO: 799031 - RNA, 19 nt, Homo sapiens
ccaaauauguguugauuga

SEQ ID NO: 799032 - RNA, 19 nt, Homo sapiens
guaaguugcccuucuauua

SEQ ID NO: 799033 - RNA, 19 nt, Homo sapiens
gcacaauacuggaagagaa

SEQ ID NO: 799034 - RNA, 19 nt, Homo sapiens
ggcaagacaugauuaauga

SEQ ID NO: 799035 - RNA, 19 nt, Homo sapiens
gaaacaauauggacuugga

SEQ ID NO: 799036 - RNA, 19 nt, Homo sapiens
ugacacaccuggacagauu

SEQ ID NO: 799037 - RNA, 19 nt, Homo sapiens
aagaaucgauggcacaaua

SEQ ID NO: 799038 - RNA, 19 nt, Homo sapiens
uggauuagaugaacucuuu

SEQ ID NO: 799039 - RNA, 19 nt, Homo sapiens
agagaaaucuugugacuca

SEQ ID NO: 799040 - RNA, 19 nt, Homo sapiens
gaaauaugccucacacugu

SEQ ID NO: 799041 - RNA, 19 nt, Homo sapiens
caacguugcuaugaaauau

SEQ ID NO: 799042 - RNA, 19 nt, Homo sapiens
ccacagaguuacagaggaa

SEQ ID NO: 799043 - RNA, 19 nt, Homo sapiens
gggaguaucguccugaaua

SEQ ID NO: 799044 - RNA, 19 nt, Homo sapiens
uggaauggaugcaggauuu

SEQ ID NO: 799045 - RNA, 19 nt, Homo sapiens
cccagaacauguccaaaua

SEQ ID NO: 799046 - RNA, 19 nt, Homo sapiens
gcugaggaauggaaucaaa

SEQ ID NO: 799047 - RNA, 19 nt, Homo sapiens
gcagagagaacaacuggaa

SEQ ID NO: 799048 - RNA, 19 nt, Homo sapiens
ggaguaucguccugaauau

SEQ ID NO: 799049 - RNA, 19 nt, Homo sapiens
aaauaugccucacacugua

SEQ ID NO: 799050 - RNA, 19 nt, Homo sapiens
ucagaauccuguuucauug

SEQ ID NO: 799051 - RNA, 19 nt, Homo sapiens
uaaccugacucguucaaug

SEQ ID NO: 799052 - RNA, 19 nt, Homo sapiens
aacaugagcuuauccagaa

SEQ ID NO: 799053 - RNA, 19 nt, Homo sapiens
gacauugaccacagaguua

SEQ ID NO: 799054 - RNA, 19 nt, Homo sapiens
cagaacauguccaaauaug

SEQ ID NO: 799055 - RNA, 19 nt, Homo sapiens
ccaaggcacuccaccguau

SEQ ID NO: 799056 - RNA, 19 nt, Homo sapiens
guagcaaaguuucucuuau

SEQ ID NO: 799057 - RNA, 19 nt, Homo sapiens
acacuucacuuguuucuag

SEQ ID NO: 799058 - RNA, 19 nt, Homo sapiens
uagcacacuucacuuguuu

SEQ ID NO: 799059 - RNA, 19 nt, Homo sapiens
caaugagccugguguuaga

SEQ ID NO: 799060 - RNA, 19 nt, Homo sapiens
gaaaagauauggguucugu

SEQ ID NO: 799061 - RNA, 19 nt, Homo sapiens
aaaccaagcugccuuucau

SEQ ID NO: 799062 - RNA, 19 nt, Homo sapiens
gaaucagaauccuguuuca

SEQ ID NO: 799063 - RNA, 19 nt, Homo sapiens
gcaaggaaggauauacuga

SEQ ID NO: 799064 - RNA, 19 nt, Homo sapiens
ggaccuccaugugaaagaa

SEQ ID NO: 799065 - RNA, 19 nt, Homo sapiens
cagcgauacugaugacauu

SEQ ID NO: 799066 - RNA, 19 nt, Homo sapiens
gggcaagacaugauuaaug

SEQ ID NO: 799067 - RNA, 19 nt, Homo sapiens
caccucagaucucuauuau

SEQ ID NO: 799068 - RNA, 19 nt, Homo sapiens
gaggaaccuuggaugaaga

SEQ ID NO: 799069 - RNA, 19 nt, Homo sapiens
ccaccucagaucucuauua

SEQ ID NO: 799070 - RNA, 19 nt, Homo sapiens
gcagacagcgauacugaug

SEQ ID NO: 799071 - RNA, 19 nt, Homo sapiens
gagacuacauacgucagua

SEQ ID NO: 799072 - RNA, 19 nt, Homo sapiens
guccaaauauguguugauu

SEQ ID NO: 799073 - RNA, 19 nt, Homo sapiens
caagcugccuuucauugug

SEQ ID NO: 799074 - RNA, 19 nt, Homo sapiens
gcugcacccuucugauuug

SEQ ID NO: 799075 - RNA, 19 nt, Homo sapiens
uaccagugcugccgaagaa

SEQ ID NO: 799076 - RNA, 19 nt, Homo sapiens
ucucuuugcuaccagauuu

SEQ ID NO: 799077 - RNA, 19 nt, Homo sapiens
ugaaucaagagacuacaua

SEQ ID NO: 799078 - RNA, 19 nt, Homo sapiens
guaauggacacaucgagaa

SEQ ID NO: 799079 - RNA, 19 nt, Homo sapiens
gauauucgugauacuguaa

SEQ ID NO: 799080 - RNA, 19 nt, Homo sapiens
cacacuguauagcucauua

SEQ ID NO: 799081 - RNA, 19 nt, Homo sapiens
ggaugaagaggaugaggaa

SEQ ID NO: 799082 - RNA, 19 nt, Homo sapiens
guauucaccuggucagcuu

SEQ ID NO: 799083 - RNA, 19 nt, Homo sapiens
gagaaggcccagaacaugu

SEQ ID NO: 799084 - RNA, 19 nt, Homo sapiens
ccaacguugcuaugaaaua

SEQ ID NO: 799085 - RNA, 19 nt, Homo sapiens
aaccaacguugcuaugaaa

SEQ ID NO: 799086 - RNA, 19 nt, Homo sapiens
gccuuucccuuguauuuau

SEQ ID NO: 799087 - RNA, 19 nt, Homo sapiens
gcaaaguuucucuuauuag

SEQ ID NO: 799088 - RNA, 19 nt, Homo sapiens
ccucagaguagcaaaguuu

SEQ ID NO: 799089 - RNA, 19 nt, Homo sapiens
uaaguugcccuucuauuag

SEQ ID NO: 799090 - RNA, 19 nt, Homo sapiens
gcacccuucugauuugauc

SEQ ID NO: 799091 - RNA, 19 nt, Homo sapiens
caacuggaacgccuucgaa

SEQ ID NO: 799092 - RNA, 19 nt, Homo sapiens
ccagugcugccgaagaaua

SEQ ID NO: 799093 - RNA, 19 nt, Homo sapiens
ucagaucucuauuauuagg

SEQ ID NO: 799094 - RNA, 19 nt, Homo sapiens
cgaggaaccuuggaugaag

SEQ ID NO: 799095 - RNA, 19 nt, Homo sapiens
caucauugaccacagcuuu

SEQ ID NO: 799096 - RNA, 19 nt, Homo sapiens
acaguugucaucuauguaa

SEQ ID NO: 799097 - RNA, 19 nt, Homo sapiens
gaugaagucagggauagaa

SEQ ID NO: 799098 - RNA, 19 nt, Homo sapiens
ugauauucgugauacugua

SEQ ID NO: 799099 - RNA, 19 nt, Homo sapiens
gcccagaacauguccaaau

SEQ ID NO: 799100 - RNA, 19 nt, Homo sapiens
ugaccucacucaaucucuu

SEQ ID NO: 799101 - RNA, 19 nt, Homo sapiens
cagaugaagucagggauag

SEQ ID NO: 799102 - RNA, 19 nt, Homo sapiens
gcccuugcauccucauuuc

SEQ ID NO: 799103 - RNA, 19 nt, Homo sapiens
ucuugacccugcacuguaa

SEQ ID NO: 799104 - RNA, 19 nt, Homo sapiens
uuagagaaaucuugugacu

SEQ ID NO: 799105 - RNA, 19 nt, Homo sapiens
ugacauugaccacagaguu

SEQ ID NO: 799106 - RNA, 19 nt, Homo sapiens
cuggacagauugagguauu

SEQ ID NO: 799107 - RNA, 19 nt, Homo sapiens
gccgucagguuuguugaaa

SEQ ID NO: 799108 - RNA, 19 nt, Homo sapiens
guacaugaaguucccuuuc

SEQ ID NO: 799109 - RNA, 19 nt, Homo sapiens
aaagauauggguucuguag

SEQ ID NO: 799110 - RNA, 19 nt, Homo sapiens
guaucguccugaauaugaa

SEQ ID NO: 799111 - RNA, 19 nt, Homo sapiens
cauuauaggccgucagguu

SEQ ID NO: 799112 - RNA, 19 nt, Homo sapiens
ucagaugaagucagggaua

SEQ ID NO: 799113 - RNA, 19 nt, Homo sapiens
uuagcacacuucacuuguu

SEQ ID NO: 799114 - RNA, 19 nt, Homo sapiens
ugaagaggaugaggaagca

SEQ ID NO: 799115 - RNA, 19 nt, Homo sapiens
gaauaugaacgucugaaaa

SEQ ID NO: 799116 - RNA, 19 nt, Homo sapiens
ucaaugagccugguguuag

SEQ ID NO: 799117 - RNA, 19 nt, Homo sapiens
ggauccagcaguacaugaa

SEQ ID NO: 799118 - RNA, 19 nt, Homo sapiens
ggccuuucccuuguauuua

SEQ ID NO: 799119 - RNA, 19 nt, Homo sapiens
gcaagaaucgauggcacaa

SEQ ID NO: 799120 - RNA, 19 nt, Homo sapiens
gcgauacugaugacauuga

SEQ ID NO: 799121 - RNA, 19 nt, Homo sapiens
ccagaacauguccaaauau

SEQ ID NO: 799122 - RNA, 19 nt, Homo sapiens
gcacccagugugucuguug

SEQ ID NO: 799123 - RNA, 19 nt, Homo sapiens
gcaagacaugauuaaugaa

SEQ ID NO: 799124 - RNA, 19 nt, Homo sapiens
aaagggaaacaugagcuua

SEQ ID NO: 799125 - RNA, 19 nt, Homo sapiens
ugaauaugaacgucugaaa

SEQ ID NO: 799126 - RNA, 19 nt, Homo sapiens
agaaguaccaacccaguga

SEQ ID NO: 799127 - RNA, 19 nt, Homo sapiens
auggacacaucgagaagua

SEQ ID NO: 799128 - RNA, 19 nt, Homo sapiens
gcacuccaccguaugugau

SEQ ID NO: 799129 - RNA, 19 nt, Homo sapiens
acuguaaguugcccuucua

SEQ ID NO: 799130 - RNA, 19 nt, Homo sapiens
gaacugguguggaggauua

SEQ ID NO: 799131 - RNA, 19 nt, Homo sapiens
ggaggaaggugaaguagga

SEQ ID NO: 799132 - RNA, 19 nt, Homo sapiens
ggcgugagcuucuuuauca

SEQ ID NO: 799133 - RNA, 19 nt, Homo sapiens
cagcauggcucacucuuuc

SEQ ID NO: 799134 - RNA, 19 nt, Homo sapiens
ucaagacccugcuggcuuu

SEQ ID NO: 799135 - RNA, 19 nt, Homo sapiens
gaaaacaccuucuuugucu

SEQ ID NO: 799136 - RNA, 19 nt, Homo sapiens
gcucacagaugaacaggau

SEQ ID NO: 799137 - RNA, 19 nt, Homo sapiens
gggacucuauuuauucuga

SEQ ID NO: 799138 - RNA, 19 nt, Homo sapiens
ucaacaagcuucacuccau

SEQ ID NO: 799139 - RNA, 19 nt, Homo sapiens
gcaaugagggugaggacaa

SEQ ID NO: 799140 - RNA, 19 nt, Homo sapiens
ggacaaggaagacaguuuc

SEQ ID NO: 799141 - RNA, 19 nt, Homo sapiens
ggaauguccuggagcugau

SEQ ID NO: 799142 - RNA, 19 nt, Homo sapiens
caaugagggugaggacaaa

SEQ ID NO: 799143 - RNA, 19 nt, Homo sapiens
ucaaggagcagaucagcaa

SEQ ID NO: 799144 - RNA, 19 nt, Homo sapiens
gccugggacucuauuuauu

SEQ ID NO: 799145 - RNA, 19 nt, Homo sapiens
uggcuggccucacacauga

SEQ ID NO: 799146 - RNA, 19 nt, Homo sapiens
ggcggaagccggaguuuga

SEQ ID NO: 799147 - RNA, 19 nt, Homo sapiens
gcugguggccuucaucaug

SEQ ID NO: 799148 - RNA, 19 nt, Homo sapiens
ggacaaaaucuucuuaauc

SEQ ID NO: 799149 - RNA, 19 nt, Homo sapiens
gaagccggaguuugacauu

SEQ ID NO: 799150 - RNA, 19 nt, Homo sapiens
ccagcgugcucuccuacuu

SEQ ID NO: 799151 - RNA, 19 nt, Homo sapiens
cagccgaggugccaucauc

SEQ ID NO: 799152 - RNA, 19 nt, Homo sapiens
gaauuccugugccgaagag

SEQ ID NO: 799153 - RNA, 19 nt, Homo sapiens
gcuccagcgugcucuccua

SEQ ID NO: 799154 - RNA, 19 nt, Homo sapiens
guacuacggccacuacagu

SEQ ID NO: 799155 - RNA, 19 nt, Homo sapiens
gcucuccuacuuccucuuu

SEQ ID NO: 799156 - RNA, 19 nt, Homo sapiens
gccgugaucuaccucaaca

SEQ ID NO: 799157 - RNA, 19 nt, Homo sapiens
acuacaaggugacgcagaa

SEQ ID NO: 799158 - RNA, 19 nt, Homo sapiens
aggagcagaucagcaauga

SEQ ID NO: 799159 - RNA, 19 nt, Homo sapiens
ggaggaagcggaggaaggu

SEQ ID NO: 799160 - RNA, 19 nt, Homo sapiens
uggccuaccucuccacugu

SEQ ID NO: 799161 - RNA, 19 nt, Homo sapiens
ggacucuauuuauucugau

SEQ ID NO: 799162 - RNA, 19 nt, Homo sapiens
ggugaaguaggaccgaauu

SEQ ID NO: 799163 - RNA, 19 nt, Homo sapiens
gaaguagccagcagacacu

SEQ ID NO: 799164 - RNA, 19 nt, Homo sapiens
ggaagcggaggaaggugaa

SEQ ID NO: 799165 - RNA, 19 nt, Homo sapiens
uuaaagggguuuugcaaau

SEQ ID NO: 799166 - RNA, 19 nt, Homo sapiens
ucaucugccugcucaagga

SEQ ID NO: 799167 - RNA, 19 nt, Homo sapiens
ggaaaacaccuucuuuguc

SEQ ID NO: 799168 - RNA, 19 nt, Homo sapiens
ucaagcugcugcucgucuu

SEQ ID NO: 799169 - RNA, 19 nt, Homo sapiens
uccuggagcugauuuaugg

SEQ ID NO: 799170 - RNA, 19 nt, Homo sapiens
gcgaagugcacgacuccuu

SEQ ID NO: 799171 - RNA, 19 nt, Homo sapiens
gugccaucaucucccagua

SEQ ID NO: 799172 - RNA, 19 nt, Homo sapiens
ggcauuggccagagacaug

SEQ ID NO: 799173 - RNA, 19 nt, Homo sapiens
aaacaccuucuuugucuuc

SEQ ID NO: 799174 - RNA, 19 nt, Homo sapiens
cugcucgucuucuauguca

SEQ ID NO: 799175 - RNA, 19 nt, Homo sapiens
ucacccacaccgucaugua

SEQ ID NO: 799176 - RNA, 19 nt, Homo sapiens
gagcgggaggugacaggaa

SEQ ID NO: 799177 - RNA, 19 nt, Homo sapiens
uaaagggguuuugcaaaug

SEQ ID NO: 799178 - RNA, 19 nt, Homo sapiens
uggguggccugcccuacaa

SEQ ID NO: 799179 - RNA, 19 nt, Homo sapiens
cccacaccgucauguacua

SEQ ID NO: 799180 - RNA, 19 nt, Homo sapiens
gccaucaucucccaguacu

SEQ ID NO: 799181 - RNA, 19 nt, Homo sapiens
ggacccuggacaccaugua

SEQ ID NO: 799182 - RNA, 19 nt, Homo sapiens
ugaucuaccucaacaucca

SEQ ID NO: 799183 - RNA, 19 nt, Homo sapiens
gauggaaaacaccuucuuu

SEQ ID NO: 799184 - RNA, 19 nt, Homo sapiens
gcaccgguaccugauggaa

SEQ ID NO: 799185 - RNA, 19 nt, Homo sapiens
gggcgugagcuucuuuauc

SEQ ID NO: 799186 - RNA, 19 nt, Homo sapiens
ggaagccggaguuugacau

SEQ ID NO: 799187 - RNA, 19 nt, Homo sapiens
caucaucucccaguacuac

SEQ ID NO: 799188 - RNA, 19 nt, Homo sapiens
ccugggacucuauuuauuc

SEQ ID NO: 799189 - RNA, 19 nt, Homo sapiens
cugccugggacucuauuua

SEQ ID NO: 799190 - RNA, 19 nt, Homo sapiens
agacccugcuggcuuucaa

SEQ ID NO: 799191 - RNA, 19 nt, Homo sapiens
gacaccaggacaaggaaga

SEQ ID NO: 799192 - RNA, 19 nt, Homo sapiens
ggaaguagcuuugcucauu

SEQ ID NO: 799193 - RNA, 19 nt, Homo sapiens
gaacauggaucgaggaaau

SEQ ID NO: 799194 - RNA, 19 nt, Homo sapiens
gaagggagaugucugauuc

SEQ ID NO: 799195 - RNA, 19 nt, Homo sapiens
ggaagacaaucuagaauau

SEQ ID NO: 799196 - RNA, 19 nt, Homo sapiens
ggagaugucugauucuaaa

SEQ ID NO: 799197 - RNA, 19 nt, Homo sapiens
gaaagcagcagccgucaua

SEQ ID NO: 799198 - RNA, 19 nt, Homo sapiens
uaagacagcugacggcuuu

SEQ ID NO: 799199 - RNA, 19 nt, Homo sapiens
gaaaucaguuguccuuaau

SEQ ID NO: 799200 - RNA, 19 nt, Homo sapiens
gagaugguauugcuaaauu

SEQ ID NO: 799201 - RNA, 19 nt, Homo sapiens
caacacagcuucagggaau

SEQ ID NO: 799202 - RNA, 19 nt, Homo sapiens
gaaguagcuuugcucauuu

SEQ ID NO: 799203 - RNA, 19 nt, Homo sapiens
ggaguuggcuucugcaaau

SEQ ID NO: 799204 - RNA, 19 nt, Homo sapiens
cugaagagcuagcgaauaa

SEQ ID NO: 799205 - RNA, 19 nt, Homo sapiens
ugaagcagaucgaauguuu

SEQ ID NO: 799206 - RNA, 19 nt, Homo sapiens
gcagggagcuugaauucug

SEQ ID NO: 799207 - RNA, 19 nt, Homo sapiens
ggaagaagauugaaaaguu

SEQ ID NO: 799208 - RNA, 19 nt, Homo sapiens
gcaaguggguggacuagug

SEQ ID NO: 799209 - RNA, 19 nt, Homo sapiens
guaccaaguucgauccaua

SEQ ID NO: 799210 - RNA, 19 nt, Homo sapiens
gcagauccaugcagaaugu

SEQ ID NO: 799211 - RNA, 19 nt, Homo sapiens
uaauagaucuccggcauaa

SEQ ID NO: 799212 - RNA, 19 nt, Homo sapiens
ugaaaucaguuguccuuaa

SEQ ID NO: 799213 - RNA, 19 nt, Homo sapiens
ggacauuccuucaauuaag

SEQ ID NO: 799214 - RNA, 19 nt, Homo sapiens
guagagacaugauugguau

SEQ ID NO: 799215 - RNA, 19 nt, Homo sapiens
ugaauucuguuccaacuaa

SEQ ID NO: 799216 - RNA, 19 nt, Homo sapiens
caaugagcaugaagagaua

SEQ ID NO: 799217 - RNA, 19 nt, Homo sapiens
caaggucauuucagacuuu

SEQ ID NO: 799218 - RNA, 19 nt, Homo sapiens
ucucuuaccuuguguuuga

SEQ ID NO: 799219 - RNA, 19 nt, Homo sapiens
agaggaagaugaccaagaa

SEQ ID NO: 799220 - RNA, 19 nt, Homo sapiens
caaguucgauccauagcaa

SEQ ID NO: 799221 - RNA, 19 nt, Homo sapiens
gauugacuauccaccauuu

SEQ ID NO: 799222 - RNA, 19 nt, Homo sapiens
caggcagacucucuuauuu

SEQ ID NO: 799223 - RNA, 19 nt, Homo sapiens
ccacagcaguuaauagauc

SEQ ID NO: 799224 - RNA, 19 nt, Homo sapiens
gcagcaagauggacaaggu

SEQ ID NO: 799225 - RNA, 19 nt, Homo sapiens
agagagagauauacugaga

SEQ ID NO: 799226 - RNA, 19 nt, Homo sapiens
ccaaucaacacguuucuaa

SEQ ID NO: 799227 - RNA, 19 nt, Homo sapiens
gcaauuugguaguuguaga

SEQ ID NO: 799228 - RNA, 19 nt, Homo sapiens
gacauuccuucaauuaaga

SEQ ID NO: 799229 - RNA, 19 nt, Homo sapiens
ggaagaggaagacaaucua

SEQ ID NO: 799230 - RNA, 19 nt, Homo sapiens
uaaaggguauucgagauga

SEQ ID NO: 799231 - RNA, 19 nt, Homo sapiens
gcaauuaugaggccuacaa

SEQ ID NO: 799232 - RNA, 19 nt, Homo sapiens
gaagaagauugaaaaguug

SEQ ID NO: 799233 - RNA, 19 nt, Homo sapiens
gaauguaagcgguuuggaa

SEQ ID NO: 799234 - RNA, 19 nt, Homo sapiens
gcagccaguuuaaguaauc

SEQ ID NO: 799235 - RNA, 19 nt, Homo sapiens
gcuaaagcgugaaaucagu

SEQ ID NO: 799236 - RNA, 19 nt, Homo sapiens
cagacucucuuauuuagug

SEQ ID NO: 799237 - RNA, 19 nt, Homo sapiens
ggcagacucucuuauuuag

SEQ ID NO: 799238 - RNA, 19 nt, Homo sapiens
ugaagaggcuugaagaaaa

SEQ ID NO: 799239 - RNA, 19 nt, Homo sapiens
cauauaaucuucgaucagu

SEQ ID NO: 799240 - RNA, 19 nt, Homo sapiens
caggauugcuccagguuug

SEQ ID NO: 799241 - RNA, 19 nt, Homo sapiens
ugagaaagguguggccuau

SEQ ID NO: 799242 - RNA, 19 nt, Homo sapiens
ggaggaagaggaagacaau

SEQ ID NO: 799243 - RNA, 19 nt, Homo sapiens
gacccaggcucugaagauu

SEQ ID NO: 799244 - RNA, 19 nt, Homo sapiens
aaagagagagauauacuga

SEQ ID NO: 799245 - RNA, 19 nt, Homo sapiens
ucgaggaaauaacaaugua

SEQ ID NO: 799246 - RNA, 19 nt, Homo sapiens
ccagagacauccugaucga

SEQ ID NO: 799247 - RNA, 19 nt, Homo sapiens
gguagagacaugauuggua

SEQ ID NO: 799248 - RNA, 19 nt, Homo sapiens
ucggaaaucugaauacaca

SEQ ID NO: 799249 - RNA, 19 nt, Homo sapiens
ggaagggagaugucugauu

SEQ ID NO: 799250 - RNA, 19 nt, Homo sapiens
gagagaaacaaggucauuu

SEQ ID NO: 799251 - RNA, 19 nt, Homo sapiens
ccaagaagcuuauuuucga

SEQ ID NO: 799252 - RNA, 19 nt, Homo sapiens
ucaggcagcuagagacaug

SEQ ID NO: 799253 - RNA, 19 nt, Homo sapiens
ggaaaagcauauaaucuuc

SEQ ID NO: 799254 - RNA, 19 nt, Homo sapiens
caacuuaugcaccagauuc

SEQ ID NO: 799255 - RNA, 19 nt, Homo sapiens
gagauugacuauccaccau

SEQ ID NO: 799256 - RNA, 19 nt, Homo sapiens
ggagcaauuugguaguugu

SEQ ID NO: 799257 - RNA, 19 nt, Homo sapiens
gcacaacagggccauaaca

SEQ ID NO: 799258 - RNA, 19 nt, Homo sapiens
agaaagguguggccuauac

SEQ ID NO: 799259 - RNA, 19 nt, Homo sapiens
gcagaucgaauguuugaca

SEQ ID NO: 799260 - RNA, 19 nt, Homo sapiens
ugacggaaauccaauugca

SEQ ID NO: 799261 - RNA, 19 nt, Homo sapiens
gguaacuguuccaggauug

SEQ ID NO: 799262 - RNA, 19 nt, Homo sapiens
ucaacacguuucuaaggaa

SEQ ID NO: 799263 - RNA, 19 nt, Homo sapiens
ggauuugaguaccaaguuc

SEQ ID NO: 799264 - RNA, 19 nt, Homo sapiens
caagauggaacccaaagug

SEQ ID NO: 799265 - RNA, 19 nt, Homo sapiens
ggaaggagccaaucaacac

SEQ ID NO: 799266 - RNA, 19 nt, Homo sapiens
gaagagcgggugagaaagg

SEQ ID NO: 799267 - RNA, 19 nt, Homo sapiens
gcuagcgaauaaccuuaaa

SEQ ID NO: 799268 - RNA, 19 nt, Homo sapiens
caaaacagguagugggaaa

SEQ ID NO: 799269 - RNA, 19 nt, Homo sapiens
gaagacaaucuagaauaug

SEQ ID NO: 799270 - RNA, 19 nt, Homo sapiens
gagcuagcgaauaaccuua

SEQ ID NO: 799271 - RNA, 19 nt, Homo sapiens
aggcagacucucuuauuua

SEQ ID NO: 799272 - RNA, 19 nt, Homo sapiens
ugacaggcagacucucuua

SEQ ID NO: 799273 - RNA, 19 nt, Homo sapiens
ggaaauccaauugcaccua

SEQ ID NO: 799274 - RNA, 19 nt, Homo sapiens
ccagaagccacaaggauug

SEQ ID NO: 799275 - RNA, 19 nt, Homo sapiens
gaugucugauucuaaaugg

SEQ ID NO: 799276 - RNA, 19 nt, Homo sapiens
guaaguugagguuaucuug

SEQ ID NO: 799277 - RNA, 19 nt, Homo sapiens
caagauggagcccaagaug

SEQ ID NO: 799278 - RNA, 19 nt, Homo sapiens
gcaaaugauggucggaaug

SEQ ID NO: 799279 - RNA, 19 nt, Homo sapiens
guaaaggguauucgagaug

SEQ ID NO: 799280 - RNA, 19 nt, Homo sapiens
gaucagagugagagaaaca

SEQ ID NO: 799281 - RNA, 19 nt, Homo sapiens
gaagaugaccaagaagcuu

SEQ ID NO: 799282 - RNA, 19 nt, Homo sapiens
gagcuugaauucuguucca

SEQ ID NO: 799283 - RNA, 19 nt, Homo sapiens
gagaucgacuaacggcaau

SEQ ID NO: 799284 - RNA, 19 nt, Homo sapiens
gauagugacggaaauccaa

SEQ ID NO: 799285 - RNA, 19 nt, Homo sapiens
gaagaggaagacaaucuag

SEQ ID NO: 799286 - RNA, 19 nt, Homo sapiens
guggacagcaagacagaua

SEQ ID NO: 799287 - RNA, 19 nt, Homo sapiens
gagacuggcaaucggcaua

SEQ ID NO: 799288 - RNA, 19 nt, Homo sapiens
gggaauaacagccgagaag

SEQ ID NO: 799289 - RNA, 19 nt, Homo sapiens
gaucaguggccguauaugg

SEQ ID NO: 799290 - RNA, 19 nt, Homo sapiens
aggaagacaaucuagaaua

SEQ ID NO: 799291 - RNA, 19 nt, Homo sapiens
gcagugauuguguguccua

SEQ ID NO: 799292 - RNA, 19 nt, Homo sapiens
gccaggaucugcugacaua

SEQ ID NO: 799293 - RNA, 19 nt, Homo sapiens
ggaaagagccugccugucu

SEQ ID NO: 799294 - RNA, 19 nt, Homo sapiens
gaucauuucucuuucuuca

SEQ ID NO: 799295 - RNA, 19 nt, Homo sapiens
gcaggaggcuggaagaaag

SEQ ID NO: 799296 - RNA, 19 nt, Homo sapiens
ggacacaguuccucuggau

SEQ ID NO: 799297 - RNA, 19 nt, Homo sapiens
gaagaugcccauagcacua

SEQ ID NO: 799298 - RNA, 19 nt, Homo sapiens
gcucugggcccuucuagua

SEQ ID NO: 799299 - RNA, 19 nt, Homo sapiens
ggacaggaguaccagauca

SEQ ID NO: 799300 - RNA, 19 nt, Homo sapiens
gguauaagcaacagacuaa

SEQ ID NO: 799301 - RNA, 19 nt, Homo sapiens
ggaagaaaggacagaagua

SEQ ID NO: 799302 - RNA, 19 nt, Homo sapiens
caaagacuccucaaagcua

SEQ ID NO: 799303 - RNA, 19 nt, Homo sapiens
gaagacaucccaacaagag

SEQ ID NO: 799304 - RNA, 19 nt, Homo sapiens
ccagacagcuuuuaauuga

SEQ ID NO: 799305 - RNA, 19 nt, Homo sapiens
gcucagaggaccagcuaua

SEQ ID NO: 799306 - RNA, 19 nt, Homo sapiens
ugacauggauggcuaccuu

SEQ ID NO: 799307 - RNA, 19 nt, Homo sapiens
gcaaccaagucgugagaga

SEQ ID NO: 799308 - RNA, 19 nt, Homo sapiens
acacaguuccucuggauua

SEQ ID NO: 799309 - RNA, 19 nt, Homo sapiens
cuaccucucuuccuggaua

SEQ ID NO: 799310 - RNA, 19 nt, Homo sapiens
gcaaaagugucuguuaaaa

SEQ ID NO: 799311 - RNA, 19 nt, Homo sapiens
aaagcaacaucuacaguga

SEQ ID NO: 799312 - RNA, 19 nt, Homo sapiens
ccaggaacccaucaaagua

SEQ ID NO: 799313 - RNA, 19 nt, Homo sapiens
gaagaaaggacagaaguag

SEQ ID NO: 799314 - RNA, 19 nt, Homo sapiens
caaaguagcaacccuaagu

SEQ ID NO: 799315 - RNA, 19 nt, Homo sapiens
ggcaacaacuacucugaug

SEQ ID NO: 799316 - RNA, 19 nt, Homo sapiens
gggcaaaagugucuguuaa

SEQ ID NO: 799317 - RNA, 19 nt, Homo sapiens
ggucaaagacuccucaaag

SEQ ID NO: 799318 - RNA, 19 nt, Homo sapiens
gaaugaggauuagccuuca

SEQ ID NO: 799319 - RNA, 19 nt, Homo sapiens
ccacaagguuccaggagau

SEQ ID NO: 799320 - RNA, 19 nt, Homo sapiens
caaagcuacucaagaccaa

SEQ ID NO: 799321 - RNA, 19 nt, Homo sapiens
ccucaaagcuacucaagac

SEQ ID NO: 799322 - RNA, 19 nt, Homo sapiens
guucuccucccaucaguua

SEQ ID NO: 799323 - RNA, 19 nt, Homo sapiens
ugagagauaagauuacuga

SEQ ID NO: 799324 - RNA, 19 nt, Homo sapiens
gaagugccagagaguguaa

SEQ ID NO: 799325 - RNA, 19 nt, Homo sapiens
caaaguguccgccuaccaa

SEQ ID NO: 799326 - RNA, 19 nt, Homo sapiens
acaagagcaugucuacgaa

SEQ ID NO: 799327 - RNA, 19 nt, Homo sapiens
ggacuggaccacugacaug

SEQ ID NO: 799328 - RNA, 19 nt, Homo sapiens
caguuccucuggauuauga

SEQ ID NO: 799329 - RNA, 19 nt, Homo sapiens
ccagaucaauggcaacuac

SEQ ID NO: 799330 - RNA, 19 nt, Homo sapiens
caacgacucuggagaaacc

SEQ ID NO: 799331 - RNA, 19 nt, Homo sapiens
cuucaagccugcggugaua

SEQ ID NO: 799332 - RNA, 19 nt, Homo sapiens
cacuauaagucuaauguuc

SEQ ID NO: 799333 - RNA, 19 nt, Homo sapiens
gcaacaacuacucugauga

SEQ ID NO: 799334 - RNA, 19 nt, Homo sapiens
guucugcuccuccacuaua

SEQ ID NO: 799335 - RNA, 19 nt, Homo sapiens
ggaagacaucccaacaaga

SEQ ID NO: 799336 - RNA, 19 nt, Homo sapiens
acagcgacauugugaaguu

SEQ ID NO: 799337 - RNA, 19 nt, Homo sapiens
gcccauagcacuaggacuu

SEQ ID NO: 799338 - RNA, 19 nt, Homo sapiens
cggaagacaucccaacaag

SEQ ID NO: 799339 - RNA, 19 nt, Homo sapiens
gauguaucccuccaauuga

SEQ ID NO: 799340 - RNA, 19 nt, Homo sapiens
agauguaucccuccaauug

SEQ ID NO: 799341 - RNA, 19 nt, Homo sapiens
cagacacuauucaacuuug

SEQ ID NO: 799342 - RNA, 19 nt, Homo sapiens
gagggaagaugcccauagc

SEQ ID NO: 799343 - RNA, 19 nt, Homo sapiens
gagccaacuucccagaauc

SEQ ID NO: 799344 - RNA, 19 nt, Homo sapiens
gccaacgacucuggagaaa

SEQ ID NO: 799345 - RNA, 19 nt, Homo sapiens
cgacucaggcuccuauuuc

SEQ ID NO: 799346 - RNA, 19 nt, Homo sapiens
aggaucugcugacauaauu

SEQ ID NO: 799347 - RNA, 19 nt, Homo sapiens
ggaagugccagagagugua

SEQ ID NO: 799348 - RNA, 19 nt, Homo sapiens
uccuggugcucaauaaaua

SEQ ID NO: 799349 - RNA, 19 nt, Homo sapiens
gcucagacccugucaccau

SEQ ID NO: 799350 - RNA, 19 nt, Homo sapiens
ugguacuccucucuaaaua

SEQ ID NO: 799351 - RNA, 19 nt, Homo sapiens
caacaacuacucugaugag

SEQ ID NO: 799352 - RNA, 19 nt, Homo sapiens
cagcgacauugugaaguuu

SEQ ID NO: 799353 - RNA, 19 nt, Homo sapiens
gagcagcacagcgacauug

SEQ ID NO: 799354 - RNA, 19 nt, Homo sapiens
gaaaggggaugugaaucuu

SEQ ID NO: 799355 - RNA, 19 nt, Homo sapiens
uacagacacuauucaacuu

SEQ ID NO: 799356 - RNA, 19 nt, Homo sapiens
ugagccaacuucccagaau

SEQ ID NO: 799357 - RNA, 19 nt, Homo sapiens
caacaucuacagugaagca

SEQ ID NO: 799358 - RNA, 19 nt, Homo sapiens
aaaguagcaacccuaagua

SEQ ID NO: 799359 - RNA, 19 nt, Homo sapiens
uaaccaggaacccaucaaa

SEQ ID NO: 799360 - RNA, 19 nt, Homo sapiens
ggugcucaauaaauaucua

SEQ ID NO: 799361 - RNA, 19 nt, Homo sapiens
gcacuaggacuuggucauc

SEQ ID NO: 799362 - RNA, 19 nt, Homo sapiens
aaucuucccugcaccuaug

SEQ ID NO: 799363 - RNA, 19 nt, Homo sapiens
caccuacaaccaugacaua

SEQ ID NO: 799364 - RNA, 19 nt, Homo sapiens
caagguuccaggagaugua

SEQ ID NO: 799365 - RNA, 19 nt, Homo sapiens
caucaugccuacagacacu

SEQ ID NO: 799366 - RNA, 19 nt, Homo sapiens
cuaaauaccagagggaaga

SEQ ID NO: 799367 - RNA, 19 nt, Homo sapiens
ggccaacgacucuggagaa

SEQ ID NO: 799368 - RNA, 19 nt, Homo sapiens
gaucuuacugggccugcua

SEQ ID NO: 799369 - RNA, 19 nt, Homo sapiens
ccucccaucaguuauauuu

SEQ ID NO: 799370 - RNA, 19 nt, Homo sapiens
gucgugagagauaagauua

SEQ ID NO: 799371 - RNA, 19 nt, Homo sapiens
ugagcuccguguccagaaa

SEQ ID NO: 799372 - RNA, 19 nt, Homo sapiens
aaccaagucgugagagaua

SEQ ID NO: 799373 - RNA, 19 nt, Homo sapiens
gaaguagcucuggcuguga

SEQ ID NO: 799374 - RNA, 19 nt, Homo sapiens
gucaaagacuccucaaagc

SEQ ID NO: 799375 - RNA, 19 nt, Homo sapiens
ccaugaggguggccaucuu

SEQ ID NO: 799376 - RNA, 19 nt, Homo sapiens
cuauaagucuaauguucug

SEQ ID NO: 799377 - RNA, 19 nt, Homo sapiens
cuacagacacuauucaacu

SEQ ID NO: 799378 - RNA, 19 nt, Homo sapiens
guacuccucucuaaauacc

SEQ ID NO: 799379 - RNA, 19 nt, Homo sapiens
ugacaacuggcagcgguua

SEQ ID NO: 799380 - RNA, 19 nt, Homo sapiens
caggaucauuucucuuucu

SEQ ID NO: 799381 - RNA, 19 nt, Homo sapiens
aacaagagcaugucuacga

SEQ ID NO: 799382 - RNA, 19 nt, Homo sapiens
guaacaggaccuuggaaag

SEQ ID NO: 799383 - RNA, 19 nt, Homo sapiens
gcgacauugugaaguuugu

SEQ ID NO: 799384 - RNA, 19 nt, Homo sapiens
gacucaggcuccuauuucu

SEQ ID NO: 799385 - RNA, 19 nt, Homo sapiens
uagcaacccuaaguaccuu

SEQ ID NO: 799386 - RNA, 19 nt, Homo sapiens
ccacuacacgugugaaguc

SEQ ID NO: 799387 - RNA, 19 nt, Homo sapiens
ugagcacccuggagaugga

SEQ ID NO: 799388 - RNA, 19 nt, Homo sapiens
gagauguaucccuccaauu

SEQ ID NO: 799389 - RNA, 19 nt, Homo sapiens
gcaaggcuacacccaaguc

SEQ ID NO: 799390 - RNA, 19 nt, Homo sapiens
acagacacuauucaacuuu

SEQ ID NO: 799391 - RNA, 19 nt, Homo sapiens
gaaucuucccugcaccuau

SEQ ID NO: 799392 - RNA, 19 nt, Homo sapiens
gaaacucgcuccuggcuuu

SEQ ID NO: 799393 - RNA, 19 nt, Homo sapiens
ggucacagcugaggaauuu

SEQ ID NO: 799394 - RNA, 19 nt, Homo sapiens
ggaauauucugucauaaga

SEQ ID NO: 799395 - RNA, 19 nt, Homo sapiens
caaacaggaugaacucuaa

SEQ ID NO: 799396 - RNA, 19 nt, Homo sapiens
guucagagaugacacauga

SEQ ID NO: 799397 - RNA, 19 nt, Homo sapiens
guaggugggucacauagua

SEQ ID NO: 799398 - RNA, 19 nt, Homo sapiens
ccacauggcuaccuucuau

SEQ ID NO: 799399 - RNA, 19 nt, Homo sapiens
gaugacacaugacaacaaa

SEQ ID NO: 799400 - RNA, 19 nt, Homo sapiens
ccacauaagucaucugcuu

SEQ ID NO: 799401 - RNA, 19 nt, Homo sapiens
gagaaacacugcccaagag

SEQ ID NO: 799402 - RNA, 19 nt, Homo sapiens
gagaaguccuccuggaaga

SEQ ID NO: 799403 - RNA, 19 nt, Homo sapiens
caggguaucuauauaaaga

SEQ ID NO: 799404 - RNA, 19 nt, Homo sapiens
guguauaucuuggagguua

SEQ ID NO: 799405 - RNA, 19 nt, Homo sapiens
uggaagaguucucagagua

SEQ ID NO: 799406 - RNA, 19 nt, Homo sapiens
ccaaagccaucccugaguu

SEQ ID NO: 799407 - RNA, 19 nt, Homo sapiens
ugacugaguucuggaauau

SEQ ID NO: 799408 - RNA, 19 nt, Homo sapiens
ucuggaauauucugucaua

SEQ ID NO: 799409 - RNA, 19 nt, Homo sapiens
gagcugauugugaagaaua

SEQ ID NO: 799410 - RNA, 19 nt, Homo sapiens
gcccugagguaguucauga

SEQ ID NO: 799411 - RNA, 19 nt, Homo sapiens
gaugugcguuggcgagaaa

SEQ ID NO: 799412 - RNA, 19 nt, Homo sapiens
gcacugccaaccaugauuu

SEQ ID NO: 799413 - RNA, 19 nt, Homo sapiens
gaauaaauguuggaaagcu

SEQ ID NO: 799414 - RNA, 19 nt, Homo sapiens
gaucgccagugauaguaaa

SEQ ID NO: 799415 - RNA, 19 nt, Homo sapiens
gaaggucacagcugaggaa

SEQ ID NO: 799416 - RNA, 19 nt, Homo sapiens
gaagaguucucagaguaca

SEQ ID NO: 799417 - RNA, 19 nt, Homo sapiens
caugggauguguccaguau

SEQ ID NO: 799418 - RNA, 19 nt, Homo sapiens
ugacacaugacaacaaauu

SEQ ID NO: 799419 - RNA, 19 nt, Homo sapiens
ugaagaaauugacaaggau

SEQ ID NO: 799420 - RNA, 19 nt, Homo sapiens
uggaauaaauguuggaaag

SEQ ID NO: 799421 - RNA, 19 nt, Homo sapiens
ucacagcugaggaauuuaa

SEQ ID NO: 799422 - RNA, 19 nt, Homo sapiens
uugaagaaauugacaagga

SEQ ID NO: 799423 - RNA, 19 nt, Homo sapiens
caaauggugguggcacuua

SEQ ID NO: 799424 - RNA, 19 nt, Homo sapiens
gaaacggacagugaucauu

SEQ ID NO: 799425 - RNA, 19 nt, Homo sapiens
gugcaaauucugaugauga

SEQ ID NO: 799426 - RNA, 19 nt, Homo sapiens
gagaugggcaggagaguca

SEQ ID NO: 799427 - RNA, 19 nt, Homo sapiens
ucacauaguaccuggugua

SEQ ID NO: 799428 - RNA, 19 nt, Homo sapiens
gcagugccguauuaguguu

SEQ ID NO: 799429 - RNA, 19 nt, Homo sapiens
caucuuggaggaaccauaa

SEQ ID NO: 799430 - RNA, 19 nt, Homo sapiens
ccaaacaggaugaacucua

SEQ ID NO: 799431 - RNA, 19 nt, Homo sapiens
aagaaugagugguguguuc

SEQ ID NO: 799432 - RNA, 19 nt, Homo sapiens
ccagcagccugugcaaauu

SEQ ID NO: 799433 - RNA, 19 nt, Homo sapiens
ugggauguguccaguauug

SEQ ID NO: 799434 - RNA, 19 nt, Homo sapiens
guauuaguguuugacauug

SEQ ID NO: 799435 - RNA, 19 nt, Homo sapiens
ggccuaccauuaauagugu

SEQ ID NO: 799436 - RNA, 19 nt, Homo sapiens
caucucagaccacaaauag

SEQ ID NO: 799437 - RNA, 19 nt, Homo sapiens
uguccaggguaucuauaua

SEQ ID NO: 799438 - RNA, 19 nt, Homo sapiens
ugagugguguguucagaga

SEQ ID NO: 799439 - RNA, 19 nt, Homo sapiens
guaguaggugggucacaua

SEQ ID NO: 799440 - RNA, 19 nt, Homo sapiens
cagguggaauuuaggcaaa

SEQ ID NO: 799441 - RNA, 19 nt, Homo sapiens
caagagagaagaaagaaaa

SEQ ID NO: 799442 - RNA, 19 nt, Homo sapiens
gcaucucagaccacaaaua

SEQ ID NO: 799443 - RNA, 19 nt, Homo sapiens
augcugagcugauugugaa

SEQ ID NO: 799444 - RNA, 19 nt, Homo sapiens
guuccuggaugacugaguu

SEQ ID NO: 799445 - RNA, 19 nt, Homo sapiens
ugccaaccaugauuuguga

SEQ ID NO: 799446 - RNA, 19 nt, Homo sapiens
ggguacauguucauaugga

SEQ ID NO: 799447 - RNA, 19 nt, Homo sapiens
gaaacaugcguuccuggau

SEQ ID NO: 799448 - RNA, 19 nt, Homo sapiens
aaacacugcccaagagaga

SEQ ID NO: 799449 - RNA, 19 nt, Homo sapiens
uauccucuguucccaaaug

SEQ ID NO: 799450 - RNA, 19 nt, Homo sapiens
guccaggguaucuauauaa

SEQ ID NO: 799451 - RNA, 19 nt, Homo sapiens
ggauguguccaguauugaa

SEQ ID NO: 799452 - RNA, 19 nt, Homo sapiens
caaagaccaggaagccaaa

SEQ ID NO: 799453 - RNA, 19 nt, Homo sapiens
gguacauguucauauggaa

SEQ ID NO: 799454 - RNA, 19 nt, Homo sapiens
caaggaggaagaagaaaca

SEQ ID NO: 799455 - RNA, 19 nt, Homo sapiens
gauguguccaguauugaaa

SEQ ID NO: 799456 - RNA, 19 nt, Homo sapiens
aaacggacagugaucauuc

SEQ ID NO: 799457 - RNA, 19 nt, Homo sapiens
guucuggaauauucuguca

SEQ ID NO: 799458 - RNA, 19 nt, Homo sapiens
ucuauccucuguucccaaa

SEQ ID NO: 799459 - RNA, 19 nt, Homo sapiens
gggccuaccauuaauagug

SEQ ID NO: 799460 - RNA, 19 nt, Homo sapiens
uccaggguaucuauauaaa

SEQ ID NO: 799461 - RNA, 19 nt, Homo sapiens
ccaggaagccaaacaggau

SEQ ID NO: 799462 - RNA, 19 nt, Homo sapiens
cguauuaguguuugacauu

SEQ ID NO: 799463 - RNA, 19 nt, Homo sapiens
ggcgagaaacggacaguga

SEQ ID NO: 799464 - RNA, 19 nt, Homo sapiens
gaucugggcaaguuguguu

SEQ ID NO: 799465 - RNA, 19 nt, Homo sapiens
acugaguucuggaauauuc

SEQ ID NO: 799466 - RNA, 19 nt, Homo sapiens
gaaguuuugucccaauaga

SEQ ID NO: 799467 - RNA, 19 nt, Homo sapiens
agagaaacacugcccaaga

SEQ ID NO: 799468 - RNA, 19 nt, Homo sapiens
gagaaacggacagugauca

SEQ ID NO: 799469 - RNA, 19 nt, Homo sapiens
ggaauuuaggcaaaacuua

SEQ ID NO: 799470 - RNA, 19 nt, Homo sapiens
ucauaagacuuugcaacug

SEQ ID NO: 799471 - RNA, 19 nt, Homo sapiens
uggcguggauggagaagug

SEQ ID NO: 799472 - RNA, 19 nt, Homo sapiens
ggaagaguucucagaguac

SEQ ID NO: 799473 - RNA, 19 nt, Homo sapiens
ucugggaucugggcaaguu

SEQ ID NO: 799474 - RNA, 19 nt, Homo sapiens
ugagguaguucaugaaaau

SEQ ID NO: 799475 - RNA, 19 nt, Homo sapiens
uaccuucuauccucuguuc

SEQ ID NO: 799476 - RNA, 19 nt, Homo sapiens
gcaagacagcaaugacagu

SEQ ID NO: 799477 - RNA, 19 nt, Homo sapiens
gaugcugagcugauuguga

SEQ ID NO: 799478 - RNA, 19 nt, Homo sapiens
aggcaaaacuuacaguauu

SEQ ID NO: 799479 - RNA, 19 nt, Homo sapiens
aacaugcguuccuggauga

SEQ ID NO: 799480 - RNA, 19 nt, Homo sapiens
aagcgauucuccugucuca

SEQ ID NO: 799481 - RNA, 19 nt, Homo sapiens
ccaagagagaagaaagaaa

SEQ ID NO: 799482 - RNA, 19 nt, Homo sapiens
ggcaaaacuuacaguauug

SEQ ID NO: 799483 - RNA, 19 nt, Homo sapiens
gcccaagagagaagaaaga

SEQ ID NO: 799484 - RNA, 19 nt, Homo sapiens
gcacacgcacaucaugcuu

SEQ ID NO: 799485 - RNA, 19 nt, Homo sapiens
gcugaucgccagugauagu

SEQ ID NO: 799486 - RNA, 19 nt, Homo sapiens
ccucccagguggaauuuag

SEQ ID NO: 799487 - RNA, 19 nt, Homo sapiens
ucccugaguuggcuuuguu

SEQ ID NO: 799488 - RNA, 19 nt, Homo sapiens
caaagccaucccugaguug

SEQ ID NO: 799489 - RNA, 19 nt, Homo sapiens
aaauggugguggcacuuau

SEQ ID NO: 799490 - RNA, 19 nt, Homo sapiens
guacauguucauauggaau

SEQ ID NO: 799491 - RNA, 19 nt, Homo sapiens
gacacaugacaacaaauug

SEQ ID NO: 799492 - RNA, 19 nt, Homo sapiens
gaaaguauguccuagcuua

SEQ ID NO: 799493 - RNA, 19 nt, Homo sapiens
gagcagaguucuuuguaua

SEQ ID NO: 799494 - RNA, 19 nt, Homo sapiens
ggaugaaggugauguguuu

SEQ ID NO: 799495 - RNA, 19 nt, Homo sapiens
agagagaccugcugcaaua

SEQ ID NO: 799496 - RNA, 19 nt, Homo sapiens
caaagugccuucuguuuca

SEQ ID NO: 799497 - RNA, 19 nt, Homo sapiens
gugaugaacuggaaagaaa

SEQ ID NO: 799498 - RNA, 19 nt, Homo sapiens
guacuaagauaaagacugu

SEQ ID NO: 799499 - RNA, 19 nt, Homo sapiens
gcaauaccuuccuacauga

SEQ ID NO: 799500 - RNA, 19 nt, Homo sapiens
ggcaauaccuuccuacaug

SEQ ID NO: 799501 - RNA, 19 nt, Homo sapiens
gcagaaaccuggaaaagaa

SEQ ID NO: 799502 - RNA, 19 nt, Homo sapiens
ggacauguguaugcaauga

SEQ ID NO: 799503 - RNA, 19 nt, Homo sapiens
ccucagcgcucgcgucuuu

SEQ ID NO: 799504 - RNA, 19 nt, Homo sapiens
gcaccuaugugggaacuuu

SEQ ID NO: 799505 - RNA, 19 nt, Homo sapiens
ccaaguauuuccuuuauag

SEQ ID NO: 799506 - RNA, 19 nt, Homo sapiens
ggaaguaaaugagauucuu

SEQ ID NO: 799507 - RNA, 19 nt, Homo sapiens
ccaaugggaacucaauuua

SEQ ID NO: 799508 - RNA, 19 nt, Homo sapiens
uaaagacugucaauccauu

SEQ ID NO: 799509 - RNA, 19 nt, Homo sapiens
gaaggaaccagcccaauag

SEQ ID NO: 799510 - RNA, 19 nt, Homo sapiens
gauaaagacugucaaucca

SEQ ID NO: 799511 - RNA, 19 nt, Homo sapiens
caacaguggccacaaguaa

SEQ ID NO: 799512 - RNA, 19 nt, Homo sapiens
gaacgagaaaugagacaaa

SEQ ID NO: 799513 - RNA, 19 nt, Homo sapiens
guaaucauccugagacuga

SEQ ID NO: 799514 - RNA, 19 nt, Homo sapiens
aaacagcuauccugcuuug

SEQ ID NO: 799515 - RNA, 19 nt, Homo sapiens
guacagagccagcugacaa

SEQ ID NO: 799516 - RNA, 19 nt, Homo sapiens
gaaagccaaggaucuaauu

SEQ ID NO: 799517 - RNA, 19 nt, Homo sapiens
ggacagaauuuuauaggaa

SEQ ID NO: 799518 - RNA, 19 nt, Homo sapiens
gaagaaagauacgggacau

SEQ ID NO: 799519 - RNA, 19 nt, Homo sapiens
ggagcagaguucuuuguau

SEQ ID NO: 799520 - RNA, 19 nt, Homo sapiens
acaacaagcucugugauug

SEQ ID NO: 799521 - RNA, 19 nt, Homo sapiens
ugaaggaaccagcccaaua

SEQ ID NO: 799522 - RNA, 19 nt, Homo sapiens
gaaacaguauuagccauag

SEQ ID NO: 799523 - RNA, 19 nt, Homo sapiens
aaacaaagacaaccauuuc

SEQ ID NO: 799524 - RNA, 19 nt, Homo sapiens
aguaaagucuccugaaaug

SEQ ID NO: 799525 - RNA, 19 nt, Homo sapiens
caccaaguauuuccuuuau

SEQ ID NO: 799526 - RNA, 19 nt, Homo sapiens
cuaaaccucuaccuaauca

SEQ ID NO: 799527 - RNA, 19 nt, Homo sapiens
agaaggaacugcgguguug

SEQ ID NO: 799528 - RNA, 19 nt, Homo sapiens
gaguuacaguugucaguga

SEQ ID NO: 799529 - RNA, 19 nt, Homo sapiens
aaacagccaucauccaaca

SEQ ID NO: 799530 - RNA, 19 nt, Homo sapiens
gaaagcagaaaccuggaaa

SEQ ID NO: 799531 - RNA, 19 nt, Homo sapiens
gugaaacuacuuuggauuu

SEQ ID NO: 799532 - RNA, 19 nt, Homo sapiens
ccauaguacuaaggaaaua

SEQ ID NO: 799533 - RNA, 19 nt, Homo sapiens
gacugggucuucaucaauu

SEQ ID NO: 799534 - RNA, 19 nt, Homo sapiens
gaacaugaauuccaaaagg

SEQ ID NO: 799535 - RNA, 19 nt, Homo sapiens
gaagaaggccuaaaagaug

SEQ ID NO: 799536 - RNA, 19 nt, Homo sapiens
gauucuggcugaaggaaau

SEQ ID NO: 799537 - RNA, 19 nt, Homo sapiens
guauagucaucgaauauca

SEQ ID NO: 799538 - RNA, 19 nt, Homo sapiens
uuauugagauugucgugua

SEQ ID NO: 799539 - RNA, 19 nt, Homo sapiens
ccaccaaguauuuccuuua

SEQ ID NO: 799540 - RNA, 19 nt, Homo sapiens
cagccaucauccaacauua

SEQ ID NO: 799541 - RNA, 19 nt, Homo sapiens
gaaugggaacauagaauug

SEQ ID NO: 799542 - RNA, 19 nt, Homo sapiens
ccuuaucgcucaacaugaa

SEQ ID NO: 799543 - RNA, 19 nt, Homo sapiens
gcaagaaugugugguaagc

SEQ ID NO: 799544 - RNA, 19 nt, Homo sapiens
gguguugacuccugugugu

SEQ ID NO: 799545 - RNA, 19 nt, Homo sapiens
gaauaucagaguuacaguu

SEQ ID NO: 799546 - RNA, 19 nt, Homo sapiens
uuucuucucucccaacuuu

SEQ ID NO: 799547 - RNA, 19 nt, Homo sapiens
auaguaaagucuccugaaa

SEQ ID NO: 799548 - RNA, 19 nt, Homo sapiens
auaagaaggugaugaacug

SEQ ID NO: 799549 - RNA, 19 nt, Homo sapiens
agacuuggauuggaagauu

SEQ ID NO: 799550 - RNA, 19 nt, Homo sapiens
ggaaccagcccaauagaag

SEQ ID NO: 799551 - RNA, 19 nt, Homo sapiens
auaaacagcuauccugcuu

SEQ ID NO: 799552 - RNA, 19 nt, Homo sapiens
augaugaccuuguugauga

SEQ ID NO: 799553 - RNA, 19 nt, Homo sapiens
aagcuaaaccucuaccuaa

SEQ ID NO: 799554 - RNA, 19 nt, Homo sapiens
gcacaugcucggaaggaaa

SEQ ID NO: 799555 - RNA, 19 nt, Homo sapiens
uaaagucuccugaaaugug

SEQ ID NO: 799556 - RNA, 19 nt, Homo sapiens
cagcaagggccaugugaaa

SEQ ID NO: 799557 - RNA, 19 nt, Homo sapiens
aggauaagcuaaaccucua

SEQ ID NO: 799558 - RNA, 19 nt, Homo sapiens
ggaagaagaaggccuaaaa

SEQ ID NO: 799559 - RNA, 19 nt, Homo sapiens
caacaugaagaacgagaaa

SEQ ID NO: 799560 - RNA, 19 nt, Homo sapiens
aagggucgccugcaacuua

SEQ ID NO: 799561 - RNA, 19 nt, Homo sapiens
ugucuucucucuugguauu

SEQ ID NO: 799562 - RNA, 19 nt, Homo sapiens
agacaaccauuucuacuac

SEQ ID NO: 799563 - RNA, 19 nt, Homo sapiens
gagacugacuacaagaaca

SEQ ID NO: 799564 - RNA, 19 nt, Homo sapiens
gcuguggcguucucucuug

SEQ ID NO: 799565 - RNA, 19 nt, Homo sapiens
cuaaggugcuguuccuguu

SEQ ID NO: 799566 - RNA, 19 nt, Homo sapiens
ccaagcccaccaaguauuu

SEQ ID NO: 799567 - RNA, 19 nt, Homo sapiens
ucagccaguuccuguaauu

SEQ ID NO: 799568 - RNA, 19 nt, Homo sapiens
cagcuauccugcuuuggaa

SEQ ID NO: 799569 - RNA, 19 nt, Homo sapiens
ggcguugacugggaacaua

SEQ ID NO: 799570 - RNA, 19 nt, Homo sapiens
cauauaagaaggugaugaa

SEQ ID NO: 799571 - RNA, 19 nt, Homo sapiens
ccaccuuucuguucugaga

SEQ ID NO: 799572 - RNA, 19 nt, Homo sapiens
caaaggaaagggugacaau

SEQ ID NO: 799573 - RNA, 19 nt, Homo sapiens
gagaaacgacuccggagau

SEQ ID NO: 799574 - RNA, 19 nt, Homo sapiens
uuagaggaauuucgucaga

SEQ ID NO: 799575 - RNA, 19 nt, Homo sapiens
caucgaauaucagccaguu

SEQ ID NO: 799576 - RNA, 19 nt, Homo sapiens
cauccaacauuauugagau

SEQ ID NO: 799577 - RNA, 19 nt, Homo sapiens
acaaagacaaccauuucua

SEQ ID NO: 799578 - RNA, 19 nt, Homo sapiens
ugauggaacccaccaauau

SEQ ID NO: 799579 - RNA, 19 nt, Homo sapiens
ugaaugggaacauagaauu

SEQ ID NO: 799580 - RNA, 19 nt, Homo sapiens
gagaaagccaaggaucuaa

SEQ ID NO: 799581 - RNA, 19 nt, Homo sapiens
cagaagaggagacucaguu

SEQ ID NO: 799582 - RNA, 19 nt, Homo sapiens
gcccacauuuuaacuuuua

SEQ ID NO: 799583 - RNA, 19 nt, Homo sapiens
ucucagucuuucauucaua

SEQ ID NO: 799584 - RNA, 19 nt, Homo sapiens
gccaaugggaacucaauuu

SEQ ID NO: 799585 - RNA, 19 nt, Homo sapiens
gaagcaucaugagccaauu

SEQ ID NO: 799586 - RNA, 19 nt, Homo sapiens
gauggaacccaccaauaug

SEQ ID NO: 799587 - RNA, 19 nt, Homo sapiens
gcagaguucuuuguauaac

SEQ ID NO: 799588 - RNA, 19 nt, Homo sapiens
agaaggugaugaacuggaa

SEQ ID NO: 799589 - RNA, 19 nt, Homo sapiens
gcacauaggacagaauuuu

SEQ ID NO: 799590 - RNA, 19 nt, Homo sapiens
gaaagauacgggacaugug

SEQ ID NO: 799591 - RNA, 19 nt, Homo sapiens
uagaaaaggugauggaaga

SEQ ID NO: 799592 - RNA, 19 nt, Homo sapiens
gaagaaggaucccuguuug

SEQ ID NO: 799593 - RNA, 19 nt, Homo sapiens
gcaagaagccgguagucua

SEQ ID NO: 799594 - RNA, 19 nt, Homo sapiens
cgaagaaggaucccuguuu

SEQ ID NO: 799595 - RNA, 19 nt, Homo sapiens
ggagguggaagacgaagaa

SEQ ID NO: 799596 - RNA, 19 nt, Homo sapiens
gcagaucucccuccaguac

SEQ ID NO: 799597 - RNA, 19 nt, Homo sapiens
gguggaagacgaagaagga

SEQ ID NO: 799598 - RNA, 19 nt, Homo sapiens
gccacgugcuccaggauug

SEQ ID NO: 799599 - RNA, 19 nt, Homo sapiens
ggcgggacuuugauugcua

SEQ ID NO: 799600 - RNA, 19 nt, Homo sapiens
uccaguaccucaagaacga

SEQ ID NO: 799601 - RNA, 19 nt, Homo sapiens
caacagcaauaaacuuccu

SEQ ID NO: 799602 - RNA, 19 nt, Homo sapiens
gauggaaugcccuccuguu

SEQ ID NO: 799603 - RNA, 19 nt, Homo sapiens
augcagcugugauuuguug

SEQ ID NO: 799604 - RNA, 19 nt, Homo sapiens
ucgacuggaucaacgagaa

SEQ ID NO: 799605 - RNA, 19 nt, Homo sapiens
aacgacacguggaggcaua

SEQ ID NO: 799606 - RNA, 19 nt, Homo sapiens
caucaagcuugcagagcau

SEQ ID NO: 799607 - RNA, 19 nt, Homo sapiens
cgacuggaucaacgagaaa

SEQ ID NO: 799608 - RNA, 19 nt, Homo sapiens
uguccucgcugcgcucuug

SEQ ID NO: 799609 - RNA, 19 nt, Homo sapiens
gcccuccuguugcgcaaug

SEQ ID NO: 799610 - RNA, 19 nt, Homo sapiens
agaaggaucccuguuugug

SEQ ID NO: 799611 - RNA, 19 nt, Homo sapiens
ccgccuacaucgacuggau

SEQ ID NO: 799612 - RNA, 19 nt, Homo sapiens
gcacagagccaucuucuuc

SEQ ID NO: 799613 - RNA, 19 nt, Homo sapiens
gaucagacauggcccagaa

SEQ ID NO: 799614 - RNA, 19 nt, Homo sapiens
gagaagcacugagcaagaa

SEQ ID NO: 799615 - RNA, 19 nt, Homo sapiens
caucaaacuucgcaagauu

SEQ ID NO: 799616 - RNA, 19 nt, Homo sapiens
gcacggcccugaagcuguu

SEQ ID NO: 799617 - RNA, 19 nt, Homo sapiens
caagaacccuggcuacauc

SEQ ID NO: 799618 - RNA, 19 nt, Homo sapiens
caucaaggguaagaaauga

SEQ ID NO: 799619 - RNA, 19 nt, Homo sapiens
ccaaagaccuacagauggu

SEQ ID NO: 799620 - RNA, 19 nt, Homo sapiens
gggaggagauaaacaccaa

SEQ ID NO: 799621 - RNA, 19 nt, Homo sapiens
ucucacagcugacaaccuu

SEQ ID NO: 799622 - RNA, 19 nt, Homo sapiens
ccaagacgaucgccacauc

SEQ ID NO: 799623 - RNA, 19 nt, Homo sapiens
gaaccuacaggaugaaagu

SEQ ID NO: 799624 - RNA, 19 nt, Homo sapiens
ggaagugacagccucauca

SEQ ID NO: 799625 - RNA, 19 nt, Homo sapiens
ggagaagcacugagcaaga

SEQ ID NO: 799626 - RNA, 19 nt, Homo sapiens
gaacagcggcagaaaauug

SEQ ID NO: 799627 - RNA, 19 nt, Homo sapiens
acccaggaauucucaauaa

SEQ ID NO: 799628 - RNA, 19 nt, Homo sapiens
ggaucugcuucuccaguuu

SEQ ID NO: 799629 - RNA, 19 nt, Homo sapiens
gaagugacagccucaucaa

SEQ ID NO: 799630 - RNA, 19 nt, Homo sapiens
ccacaucacagaaucguau

SEQ ID NO: 799631 - RNA, 19 nt, Homo sapiens
gcaagaacccuggcuacau

SEQ ID NO: 799632 - RNA, 19 nt, Homo sapiens
ucaacgaggugcucaagag

SEQ ID NO: 799633 - RNA, 19 nt, Homo sapiens
uaagaaaugagccuaguca

SEQ ID NO: 799634 - RNA, 19 nt, Homo sapiens
gaacccuggcuacaucaaa

SEQ ID NO: 799635 - RNA, 19 nt, Homo sapiens
ugacagagagggccaagga

SEQ ID NO: 799636 - RNA, 19 nt, Homo sapiens
gguaagaaaugagccuagu

SEQ ID NO: 799637 - RNA, 19 nt, Homo sapiens
agacauggcccagaacuug

SEQ ID NO: 799638 - RNA, 19 nt, Homo sapiens
ccaggaauucucaauaaau

SEQ ID NO: 799639 - RNA, 19 nt, Homo sapiens
cccaggaauucucaauaaa

SEQ ID NO: 799640 - RNA, 19 nt, Homo sapiens
gugauuuccuacaguguug

SEQ ID NO: 799641 - RNA, 19 nt, Homo sapiens
aaacaccaacccaggaauu

SEQ ID NO: 799642 - RNA, 19 nt, Homo sapiens
acagagccaucuucuucaa

SEQ ID NO: 799643 - RNA, 19 nt, Homo sapiens
gccuagggcuggacuacga

SEQ ID NO: 799644 - RNA, 19 nt, Homo sapiens
uguagaagccaaacaagug

SEQ ID NO: 799645 - RNA, 19 nt, Homo sapiens
agagugugguggccaaguu

SEQ ID NO: 799646 - RNA, 19 nt, Homo sapiens
gcaggaacagcggcagaaa

SEQ ID NO: 799647 - RNA, 19 nt, Homo sapiens
agagccaucuucuucaauc

SEQ ID NO: 799648 - RNA, 19 nt, Homo sapiens
aaaugagccuagucaccaa

SEQ ID NO: 799649 - RNA, 19 nt, Homo sapiens
gacauggcccagaacuuga

SEQ ID NO: 799650 - RNA, 19 nt, Homo sapiens
cagaaucguaucuaucuca

SEQ ID NO: 799651 - RNA, 19 nt, Homo sapiens
ucacagaaucguaucuauc

SEQ ID NO: 799652 - RNA, 19 nt, Homo sapiens
cccauuaucuaugacauuc

SEQ ID NO: 799653 - RNA, 19 nt, Homo sapiens
cugaaccccucuuggauua

SEQ ID NO: 799654 - RNA, 19 nt, Homo sapiens
cacagaaucguaucuaucu

SEQ ID NO: 799655 - RNA, 19 nt, Homo sapiens
caucacagaaucguaucua

SEQ ID NO: 799656 - RNA, 19 nt, Homo sapiens
gaucgccacaucacagaau

SEQ ID NO: 799657 - RNA, 19 nt, Homo sapiens
cuacgaggaacgaguguug

SEQ ID NO: 799658 - RNA, 19 nt, Homo sapiens
ccucaucaaggguaagaaa

SEQ ID NO: 799659 - RNA, 19 nt, Homo sapiens
ggagcuuccuagcauguac

SEQ ID NO: 799660 - RNA, 19 nt, Homo sapiens
accuacagauggugaauau

SEQ ID NO: 799661 - RNA, 19 nt, Homo sapiens
gaccuacagauggugaaua

SEQ ID NO: 799662 - RNA, 19 nt, Homo sapiens
gagcagcccagaauaucuc

SEQ ID NO: 799663 - RNA, 19 nt, Homo sapiens
acgaggugcucaagagugu

SEQ ID NO: 799664 - RNA, 19 nt, Homo sapiens
gccgagggccuucacuuca

SEQ ID NO: 799665 - RNA, 19 nt, Homo sapiens
ucaucaaggguaagaaaug

SEQ ID NO: 799666 - RNA, 19 nt, Homo sapiens
gcccagaauaucuccaaga

SEQ ID NO: 799667 - RNA, 19 nt, Homo sapiens
gaguguugccguccauugu

SEQ ID NO: 799668 - RNA, 19 nt, Homo sapiens
cuccaaagaccuacagaug

SEQ ID NO: 799669 - RNA, 19 nt, Homo sapiens
caacccaggaauucucaau

SEQ ID NO: 799670 - RNA, 19 nt, Homo sapiens
acaucaaacuucgcaagau

SEQ ID NO: 799671 - RNA, 19 nt, Homo sapiens
caacgaggugcucaagagu

SEQ ID NO: 799672 - RNA, 19 nt, Homo sapiens
cagagagggccaaggacuu

SEQ ID NO: 799673 - RNA, 19 nt, Homo sapiens
ucaaggcugggaggagaua

SEQ ID NO: 799674 - RNA, 19 nt, Homo sapiens
ugcugaaccuacaggauga

SEQ ID NO: 799675 - RNA, 19 nt, Homo sapiens
caagacgaucgccacauca

SEQ ID NO: 799676 - RNA, 19 nt, Homo sapiens
cccagaacuugaaggacuu

SEQ ID NO: 799677 - RNA, 19 nt, Homo sapiens
cccagaauaucuccaagac

SEQ ID NO: 799678 - RNA, 19 nt, Homo sapiens
guaagaaaugagccuaguc

SEQ ID NO: 799679 - RNA, 19 nt, Homo sapiens
guguugccguccauuguca

SEQ ID NO: 799680 - RNA, 19 nt, Homo sapiens
gaagaagcgcuuugaggaa

SEQ ID NO: 799681 - RNA, 19 nt, Homo sapiens
gcaauaaguccauggagau

SEQ ID NO: 799682 - RNA, 19 nt, Homo sapiens
gcagaaacccucgggaaug

SEQ ID NO: 799683 - RNA, 19 nt, Homo sapiens
gagagcugguguugucuga

SEQ ID NO: 799684 - RNA, 19 nt, Homo sapiens
ugaagaauguggacaaggu

SEQ ID NO: 799685 - RNA, 19 nt, Homo sapiens
ggcgguaccugcagaugaa

SEQ ID NO: 799686 - RNA, 19 nt, Homo sapiens
cgagcacgcuguaggguau

SEQ ID NO: 799687 - RNA, 19 nt, Homo sapiens
gagcugguguugucugaag

SEQ ID NO: 799688 - RNA, 19 nt, Homo sapiens
ccauggagaucgagguguu

SEQ ID NO: 799689 - RNA, 19 nt, Homo sapiens
acacaccaaagcuuuauuu

SEQ ID NO: 799690 - RNA, 19 nt, Homo sapiens
cugcaaaccuacacaccaa

SEQ ID NO: 799691 - RNA, 19 nt, Homo sapiens
ccagugccuucuucaccua

SEQ ID NO: 799692 - RNA, 19 nt, Homo sapiens
gcgcggagaucaccuacac

SEQ ID NO: 799693 - RNA, 19 nt, Homo sapiens
agcagcagcuuuauuagug

SEQ ID NO: 799694 - RNA, 19 nt, Homo sapiens
gggaggcguugggcagaaa

SEQ ID NO: 799695 - RNA, 19 nt, Homo sapiens
guguuaaccuguacucucu

SEQ ID NO: 799696 - RNA, 19 nt, Homo sapiens
cagaaacccucgggaaugc

SEQ ID NO: 799697 - RNA, 19 nt, Homo sapiens
gcaugaccuucacgagcaa

SEQ ID NO: 799698 - RNA, 19 nt, Homo sapiens
gaaacccucgggaaugcuu

SEQ ID NO: 799699 - RNA, 19 nt, Homo sapiens
ccuguacucucuccugcaa

SEQ ID NO: 799700 - RNA, 19 nt, Homo sapiens
gggcgguaccugcagauga

SEQ ID NO: 799701 - RNA, 19 nt, Homo sapiens
cacaccaaagcuuuauuua

SEQ ID NO: 799702 - RNA, 19 nt, Homo sapiens
ccuacacaccaaagcuuua

SEQ ID NO: 799703 - RNA, 19 nt, Homo sapiens
gcaaaccuacacaccaaag

SEQ ID NO: 799704 - RNA, 19 nt, Homo sapiens
auugagagcugguguuguc

SEQ ID NO: 799705 - RNA, 19 nt, Homo sapiens
cccugucgcugaagaaugu

SEQ ID NO: 799706 - RNA, 19 nt, Homo sapiens
ucggugagguggcgcaugu

SEQ ID NO: 799707 - RNA, 19 nt, Homo sapiens
ggcagaaacccucgggaau

SEQ ID NO: 799708 - RNA, 19 nt, Homo sapiens
gcugaagaauguggacaag

SEQ ID NO: 799709 - RNA, 19 nt, Homo sapiens
gcuguaggguaugggaaga

SEQ ID NO: 799710 - RNA, 19 nt, Homo sapiens
gguguugucugaaguuuuc

SEQ ID NO: 799711 - RNA, 19 nt, Homo sapiens
agaccgaggacgagaagaa

SEQ ID NO: 799712 - RNA, 19 nt, Homo sapiens
gaggcaggcgccaucauca

SEQ ID NO: 799713 - RNA, 19 nt, Homo sapiens
agaaaaggcugcgucauca

SEQ ID NO: 799714 - RNA, 19 nt, Homo sapiens
ccacuggugccucgaguag

SEQ ID NO: 799715 - RNA, 19 nt, Homo sapiens
cagaugaaggcgacgauca

SEQ ID NO: 799716 - RNA, 19 nt, Homo sapiens
acccagagccgaacacugu

SEQ ID NO: 799717 - RNA, 19 nt, Homo sapiens
ggacgagaagaagcgcuuu

SEQ ID NO: 799718 - RNA, 19 nt, Homo sapiens
ggugccuccuguuguguau

SEQ ID NO: 799719 - RNA, 19 nt, Homo sapiens
auaaguccauggagaucga

SEQ ID NO: 799720 - RNA, 19 nt, Homo sapiens
acggaggugugaccaugaa

SEQ ID NO: 799721 - RNA, 19 nt, Homo sapiens
gguaugaagcccagaagcu

SEQ ID NO: 799722 - RNA, 19 nt, Homo sapiens
gcugcugcuuggcuggaaa

SEQ ID NO: 799723 - RNA, 19 nt, Homo sapiens
gcgcaccgacuuccugucu

SEQ ID NO: 799724 - RNA, 19 nt, Homo sapiens
cuacacaccaaagcuuuau

SEQ ID NO: 799725 - RNA, 19 nt, Homo sapiens
gacgagaagaagcgcuuug

SEQ ID NO: 799726 - RNA, 19 nt, Homo sapiens
gaagaaaucucuagacuca

SEQ ID NO: 799727 - RNA, 19 nt, Homo sapiens
ggacagcauuucauaugua

SEQ ID NO: 799728 - RNA, 19 nt, Homo sapiens
gaagaugacuaccagcaaa

SEQ ID NO: 799729 - RNA, 19 nt, Homo sapiens
gagaagagauugagaagca

SEQ ID NO: 799730 - RNA, 19 nt, Homo sapiens
gaaggaagaggaaaggaaa

SEQ ID NO: 799731 - RNA, 19 nt, Homo sapiens
gacagcauuucauauguaa

SEQ ID NO: 799732 - RNA, 19 nt, Homo sapiens
agaaaucucuagacucaga

SEQ ID NO: 799733 - RNA, 19 nt, Homo sapiens
gagagaacgagaagagauu

SEQ ID NO: 799734 - RNA, 19 nt, Homo sapiens
caaaagagcguuacaugaa

SEQ ID NO: 799735 - RNA, 19 nt, Homo sapiens
gagugaggaugaagaagau

SEQ ID NO: 799736 - RNA, 19 nt, Homo sapiens
gcagaaggccagggaagaa

SEQ ID NO: 799737 - RNA, 19 nt, Homo sapiens
gaagaggaaaggaaagcaa

SEQ ID NO: 799738 - RNA, 19 nt, Homo sapiens
cagucacucucccugaaua

SEQ ID NO: 799739 - RNA, 19 nt, Homo sapiens
gaacgagaagagauugaga

SEQ ID NO: 799740 - RNA, 19 nt, Homo sapiens
cagaugagagugaggauga

SEQ ID NO: 799741 - RNA, 19 nt, Homo sapiens
ggagagaacgagaagagau

SEQ ID NO: 799742 - RNA, 19 nt, Homo sapiens
gaugccacauugucaggaa

SEQ ID NO: 799743 - RNA, 19 nt, Homo sapiens
ggaagaaggaagaggaaag

SEQ ID NO: 799744 - RNA, 19 nt, Homo sapiens
gcaaaagagcguuacauga

SEQ ID NO: 799745 - RNA, 19 nt, Homo sapiens
caggacagcauuucauaug

SEQ ID NO: 799746 - RNA, 19 nt, Homo sapiens
gcaggacagcauuucauau

SEQ ID NO: 799747 - RNA, 19 nt, Homo sapiens
caucuuggcacagaaauug

SEQ ID NO: 799748 - RNA, 19 nt, Homo sapiens
aaaagacgaugccacauug

SEQ ID NO: 799749 - RNA, 19 nt, Homo sapiens
cacucucccugaauaagua

SEQ ID NO: 799750 - RNA, 19 nt, Homo sapiens
gaggagagaacgagaagag

SEQ ID NO: 799751 - RNA, 19 nt, Homo sapiens
gccaggaccucugcugugu

SEQ ID NO: 799752 - RNA, 19 nt, Homo sapiens
gaagaaagggaggccacaa

SEQ ID NO: 799753 - RNA, 19 nt, Homo sapiens
aaaagagcguuacaugaaa

SEQ ID NO: 799754 - RNA, 19 nt, Homo sapiens
ggaugaagaagaugacuac

SEQ ID NO: 799755 - RNA, 19 nt, Homo sapiens
gaaagggaggccacaaagg

SEQ ID NO: 799756 - RNA, 19 nt, Homo sapiens
gaagaaggaagaggaaagg

SEQ ID NO: 799757 - RNA, 19 nt, Homo sapiens
caaaagacgaugccacauu

SEQ ID NO: 799758 - RNA, 19 nt, Homo sapiens
gaaaacgaaugcagucacu

SEQ ID NO: 799759 - RNA, 19 nt, Homo sapiens
gagaacgagaagagauuga

SEQ ID NO: 799760 - RNA, 19 nt, Homo sapiens
uugaagggcucaucgacau

SEQ ID NO: 799761 - RNA, 19 nt, Homo sapiens
agagugaggaugaagaaga

SEQ ID NO: 799762 - RNA, 19 nt, Homo sapiens
caggaccucugcugugucu

SEQ ID NO: 799763 - RNA, 19 nt, Homo sapiens
aagaaagggaggccacaaa

SEQ ID NO: 799764 - RNA, 19 nt, Homo sapiens
ugagagugaggaugaagaa

SEQ ID NO: 799765 - RNA, 19 nt, Homo sapiens
agaaggaagaggaaaggaa

SEQ ID NO: 799766 - RNA, 19 nt, Homo sapiens
gggcgaggcaguauacaag

SEQ ID NO: 799767 - RNA, 19 nt, Homo sapiens
gcagucacucucccugaau

SEQ ID NO: 799768 - RNA, 19 nt, Homo sapiens
gcgccucaaugccuaaagg

SEQ ID NO: 799769 - RNA, 19 nt, Homo sapiens
aaagagcguuacaugaaaa

SEQ ID NO: 799770 - RNA, 19 nt, Homo sapiens
uugagaagcagaaggcaaa

SEQ ID NO: 799771 - RNA, 19 nt, Homo sapiens
gaucuggacgggccaaagg

SEQ ID NO: 799772 - RNA, 19 nt, Homo sapiens
gugaggaugaagaagauga

SEQ ID NO: 799773 - RNA, 19 nt, Homo sapiens
aggacagcauuucauaugu

SEQ ID NO: 799774 - RNA, 19 nt, Homo sapiens
ugcaggacagcauuucaua

SEQ ID NO: 799775 - RNA, 19 nt, Homo sapiens
uacaagcccugaggagauc

SEQ ID NO: 799776 - RNA, 19 nt, Homo sapiens
ugcagucacucucccugaa

SEQ ID NO: 799777 - RNA, 19 nt, Homo sapiens
aaacgaaugcagucacucu

SEQ ID NO: 799778 - RNA, 19 nt, Homo sapiens
aagaggaaaggaaagcaaa

SEQ ID NO: 799779 - RNA, 19 nt, Homo sapiens
auacaagcccugaggagau

SEQ ID NO: 799780 - RNA, 19 nt, Homo sapiens
agacgaugccacauuguca

SEQ ID NO: 799781 - RNA, 19 nt, Homo sapiens
gggaagaagaggagcaaaa

SEQ ID NO: 799782 - RNA, 19 nt, Homo sapiens
agaaagggaggccacaaag

SEQ ID NO: 799783 - RNA, 19 nt, Homo sapiens
ggaagaggaaaggaaagca

SEQ ID NO: 799784 - RNA, 19 nt, Homo sapiens
ggaagacuguuguguuauu

SEQ ID NO: 799785 - RNA, 19 nt, Homo sapiens
uaggaagacuguuguguua

SEQ ID NO: 799786 - RNA, 19 nt, Homo sapiens
ucagauggauggacaguuu

SEQ ID NO: 799787 - RNA, 19 nt, Homo sapiens
gaagacuguuguguuauuu

SEQ ID NO: 799788 - RNA, 19 nt, Homo sapiens
gcucugugcuucuauaaug

SEQ ID NO: 799789 - RNA, 19 nt, Homo sapiens
ccacaacccugaauaaacu

SEQ ID NO: 799790 - RNA, 19 nt, Homo sapiens
cgaccuaccugccauuugu

SEQ ID NO: 799791 - RNA, 19 nt, Homo sapiens
cuacagcacuuuacaagca

SEQ ID NO: 799792 - RNA, 19 nt, Homo sapiens
ggaucuggcucacgaguuc

SEQ ID NO: 799793 - RNA, 19 nt, Homo sapiens
gcucuauguucuaugauga

SEQ ID NO: 799794 - RNA, 19 nt, Homo sapiens
gaacuuccuuuccuucacu

SEQ ID NO: 799795 - RNA, 19 nt, Homo sapiens
acaguuugcuggcuauuga

SEQ ID NO: 799796 - RNA, 19 nt, Homo sapiens
gcuagaggcuacagcacuu

SEQ ID NO: 799797 - RNA, 19 nt, Homo sapiens
gaaggcuaauggcagaguu

SEQ ID NO: 799798 - RNA, 19 nt, Homo sapiens
agacaaucgucaccaagaa

SEQ ID NO: 799799 - RNA, 19 nt, Homo sapiens
gcggcucuauguucuauga

SEQ ID NO: 799800 - RNA, 19 nt, Homo sapiens
gaaugcccguuaccugguu

SEQ ID NO: 799801 - RNA, 19 nt, Homo sapiens
caggaucagucaagggaaa

SEQ ID NO: 799802 - RNA, 19 nt, Homo sapiens
gcauauaccagucaggaau

SEQ ID NO: 799803 - RNA, 19 nt, Homo sapiens
uaaacucuguuggcccaua

SEQ ID NO: 799804 - RNA, 19 nt, Homo sapiens
cuuauaaugugaagguuug

SEQ ID NO: 799805 - RNA, 19 nt, Homo sapiens
gcacuuuacaagcaaggua

SEQ ID NO: 799806 - RNA, 19 nt, Homo sapiens
aaacucuguuggcccauaa

SEQ ID NO: 799807 - RNA, 19 nt, Homo sapiens
gagacaaucgucaccaaga

SEQ ID NO: 799808 - RNA, 19 nt, Homo sapiens
gaggauggccccuagcuua

SEQ ID NO: 799809 - RNA, 19 nt, Homo sapiens
gguggguggugaaggcuaa

SEQ ID NO: 799810 - RNA, 19 nt, Homo sapiens
ugugaagguuuguaaauag

SEQ ID NO: 799811 - RNA, 19 nt, Homo sapiens
caacccaccuauucugucu

SEQ ID NO: 799812 - RNA, 19 nt, Homo sapiens
gaaacucccaggcucaauc

SEQ ID NO: 799813 - RNA, 19 nt, Homo sapiens
gggccacaacccugaauaa

SEQ ID NO: 799814 - RNA, 19 nt, Homo sapiens
gugaagguuuguaaauagu

SEQ ID NO: 799815 - RNA, 19 nt, Homo sapiens
gcauuucagccguuugcua

SEQ ID NO: 799816 - RNA, 19 nt, Homo sapiens
ugaggcgagugcauaagaa

SEQ ID NO: 799817 - RNA, 19 nt, Homo sapiens
agacuguuguguuauuugu

SEQ ID NO: 799818 - RNA, 19 nt, Homo sapiens
gagucugauuucuauauag

SEQ ID NO: 799819 - RNA, 19 nt, Homo sapiens
caccuauucugucuaaucu

SEQ ID NO: 799820 - RNA, 19 nt, Homo sapiens
ggccacaacccugaauaaa

SEQ ID NO: 799821 - RNA, 19 nt, Homo sapiens
gggaaagaaaggagggaaa

SEQ ID NO: 799822 - RNA, 19 nt, Homo sapiens
ggucugcuuucuuccaagu

SEQ ID NO: 799823 - RNA, 19 nt, Homo sapiens
caagguguggcuuccauug

SEQ ID NO: 799824 - RNA, 19 nt, Homo sapiens
guugaggaguugagagagu

SEQ ID NO: 799825 - RNA, 19 nt, Homo sapiens
ucccugugauccucuauga

SEQ ID NO: 799826 - RNA, 19 nt, Homo sapiens
ucaagggaaagcacuagaa

SEQ ID NO: 799827 - RNA, 19 nt, Homo sapiens
ucugcuuucuuccaaguuu

SEQ ID NO: 799828 - RNA, 19 nt, Homo sapiens
ccauaaccuucagcuguga

SEQ ID NO: 799829 - RNA, 19 nt, Homo sapiens
uagcuuaggaagacuguug

SEQ ID NO: 799830 - RNA, 19 nt, Homo sapiens
ucuauaaugugggaaaugg

SEQ ID NO: 799831 - RNA, 19 nt, Homo sapiens
ccaccuauucugucuaauc

SEQ ID NO: 799832 - RNA, 19 nt, Homo sapiens
acccaccuauucugucuaa

SEQ ID NO: 799833 - RNA, 19 nt, Homo sapiens
gccguuugcuaccucgauu

SEQ ID NO: 799834 - RNA, 19 nt, Homo sapiens
cagagcauuucagccguuu

SEQ ID NO: 799835 - RNA, 19 nt, Homo sapiens
uagaggcuacagcacuuua

SEQ ID NO: 799836 - RNA, 19 nt, Homo sapiens
uauguucuaugaugaggau

SEQ ID NO: 799837 - RNA, 19 nt, Homo sapiens
ggucggucccacaguauug

SEQ ID NO: 799838 - RNA, 19 nt, Homo sapiens
uuaggaagacuguuguguu

SEQ ID NO: 799839 - RNA, 19 nt, Homo sapiens
ggacuguucaccaccuugu

SEQ ID NO: 799840 - RNA, 19 nt, Homo sapiens
ugccuggucugcuuucuuc

SEQ ID NO: 799841 - RNA, 19 nt, Homo sapiens
ggaaagaaaggagggaaaa

SEQ ID NO: 799842 - RNA, 19 nt, Homo sapiens
ggcucuauguucuaugaug

SEQ ID NO: 799843 - RNA, 19 nt, Homo sapiens
caagguaugcuuucuucca

SEQ ID NO: 799844 - RNA, 19 nt, Homo sapiens
aagcugaggcgagugcaua

SEQ ID NO: 799845 - RNA, 19 nt, Homo sapiens
acuguuguguuauuuguuc

SEQ ID NO: 799846 - RNA, 19 nt, Homo sapiens
cgaguucuaugaggagaca

SEQ ID NO: 799847 - RNA, 19 nt, Homo sapiens
gcacuguauacaaguagga

SEQ ID NO: 799848 - RNA, 19 nt, Homo sapiens
caguauugguuggguguug

SEQ ID NO: 799849 - RNA, 19 nt, Homo sapiens
gccugauucuuccgaccua

SEQ ID NO: 799850 - RNA, 19 nt, Homo sapiens
ugugggcacuguauacaag

SEQ ID NO: 799851 - RNA, 19 nt, Homo sapiens
cacguggauuucccuguga

SEQ ID NO: 799852 - RNA, 19 nt, Homo sapiens
gccacaacccugaauaaac

SEQ ID NO: 799853 - RNA, 19 nt, Homo sapiens
ugggcacuguauacaagua

SEQ ID NO: 799854 - RNA, 19 nt, Homo sapiens
caagggaaagcacuagaac

SEQ ID NO: 799855 - RNA, 19 nt, Homo sapiens
cuccauggcuuugcaccaa

SEQ ID NO: 799856 - RNA, 19 nt, Homo sapiens
gaggcgagugcauaagaau

SEQ ID NO: 799857 - RNA, 19 nt, Homo sapiens
cauauaccagucaggaaug

SEQ ID NO: 799858 - RNA, 19 nt, Homo sapiens
gcagggcauauaccaguca

SEQ ID NO: 799859 - RNA, 19 nt, Homo sapiens
guucccgccuucagaugga

SEQ ID NO: 799860 - RNA, 19 nt, Homo sapiens
uugguuggguguugguuug

SEQ ID NO: 799861 - RNA, 19 nt, Homo sapiens
caguugaggaguugagaga

SEQ ID NO: 799862 - RNA, 19 nt, Homo sapiens
cucgauuccuccuguguug

SEQ ID NO: 799863 - RNA, 19 nt, Homo sapiens
gagcauuucagccguuugc

SEQ ID NO: 799864 - RNA, 19 nt, Homo sapiens
uuccuucacuucccuuuua

SEQ ID NO: 799865 - RNA, 19 nt, Homo sapiens
uacagcacuuuacaagcaa

SEQ ID NO: 799866 - RNA, 19 nt, Homo sapiens
gauaaucccuucaaguuaa

SEQ ID NO: 799867 - RNA, 19 nt, Homo sapiens
ucagaaagcuggcaaagaa

SEQ ID NO: 799868 - RNA, 19 nt, Homo sapiens
gaauugauguuucucauga

SEQ ID NO: 799869 - RNA, 19 nt, Homo sapiens
gaaguguccucaaauugua

SEQ ID NO: 799870 - RNA, 19 nt, Homo sapiens
ggugaacagugguuaauaa

SEQ ID NO: 799871 - RNA, 19 nt, Homo sapiens
gacaaaugcuaguguguuu

SEQ ID NO: 799872 - RNA, 19 nt, Homo sapiens
gagauaaucccuucaaguu

SEQ ID NO: 799873 - RNA, 19 nt, Homo sapiens
ccauagcacugguuacuuu

SEQ ID NO: 799874 - RNA, 19 nt, Homo sapiens
ggcagagccugaagaauuu

SEQ ID NO: 799875 - RNA, 19 nt, Homo sapiens
cguaauagcucuucaaguc

SEQ ID NO: 799876 - RNA, 19 nt, Homo sapiens
uaaggaccauucuagauuu

SEQ ID NO: 799877 - RNA, 19 nt, Homo sapiens
ugaggaaacuagacaaaug

SEQ ID NO: 799878 - RNA, 19 nt, Homo sapiens
ggaccauucuagauuuauu

SEQ ID NO: 799879 - RNA, 19 nt, Homo sapiens
agacagcaguggagaauug

SEQ ID NO: 799880 - RNA, 19 nt, Homo sapiens
uuuaggaccugcugucaua

SEQ ID NO: 799881 - RNA, 19 nt, Homo sapiens
gaacagcuuuucuaaaugu

SEQ ID NO: 799882 - RNA, 19 nt, Homo sapiens
uaugaaguguccucaaauu

SEQ ID NO: 799883 - RNA, 19 nt, Homo sapiens
cgaaagaggcaaauaugaa

SEQ ID NO: 799884 - RNA, 19 nt, Homo sapiens
aauaugaaguguccucaaa

SEQ ID NO: 799885 - RNA, 19 nt, Homo sapiens
ugacaaaccaagaggauuu

SEQ ID NO: 799886 - RNA, 19 nt, Homo sapiens
caugaugaauggaauaugu

SEQ ID NO: 799887 - RNA, 19 nt, Homo sapiens
aaccauacauuucaaguga

SEQ ID NO: 799888 - RNA, 19 nt, Homo sapiens
gaaaguagcguuggaagag

SEQ ID NO: 799889 - RNA, 19 nt, Homo sapiens
gacagcaaaucaaagaaga

SEQ ID NO: 799890 - RNA, 19 nt, Homo sapiens
gaccugcugucauaaaugu

SEQ ID NO: 799891 - RNA, 19 nt, Homo sapiens
gaaagaggcaaauaugaag

SEQ ID NO: 799892 - RNA, 19 nt, Homo sapiens
ugaagaauuugucguggaa

SEQ ID NO: 799893 - RNA, 19 nt, Homo sapiens
gaagaugaagcucaauaau

SEQ ID NO: 799894 - RNA, 19 nt, Homo sapiens
caacaaaacuacauugcaa

SEQ ID NO: 799895 - RNA, 19 nt, Homo sapiens
gaugacagcaaaucaaaga

SEQ ID NO: 799896 - RNA, 19 nt, Homo sapiens
ugaguuugcuuuacugguu

SEQ ID NO: 799897 - RNA, 19 nt, Homo sapiens
guaguugcuuccuuuauca

SEQ ID NO: 799898 - RNA, 19 nt, Homo sapiens
gcucauagaaaccuaauca

SEQ ID NO: 799899 - RNA, 19 nt, Homo sapiens
uuucugagaugccauuauu

SEQ ID NO: 799900 - RNA, 19 nt, Homo sapiens
aaacagaauggaaagagua

SEQ ID NO: 799901 - RNA, 19 nt, Homo sapiens
auagaaaccuaaucagaug

SEQ ID NO: 799902 - RNA, 19 nt, Homo sapiens
gcagugguuuauuugcaaa

SEQ ID NO: 799903 - RNA, 19 nt, Homo sapiens
gaacguaauagcucuucaa

SEQ ID NO: 799904 - RNA, 19 nt, Homo sapiens
gcgaaagaggcaaauauga

SEQ ID NO: 799905 - RNA, 19 nt, Homo sapiens
aagagaugcugcugacaaa

SEQ ID NO: 799906 - RNA, 19 nt, Homo sapiens
uggaagggauuuacagaug

SEQ ID NO: 799907 - RNA, 19 nt, Homo sapiens
gaaucccuguugcuacauu

SEQ ID NO: 799908 - RNA, 19 nt, Homo sapiens
cuaaggaccauucuagauu

SEQ ID NO: 799909 - RNA, 19 nt, Homo sapiens
gaaauggaaagauucagau

SEQ ID NO: 799910 - RNA, 19 nt, Homo sapiens
agaauugauugaagcguuu

SEQ ID NO: 799911 - RNA, 19 nt, Homo sapiens
agacuuggcucauagaaac

SEQ ID NO: 799912 - RNA, 19 nt, Homo sapiens
cagaagaugaagcucaaua

SEQ ID NO: 799913 - RNA, 19 nt, Homo sapiens
gagacuaacuuggcauucu

SEQ ID NO: 799914 - RNA, 19 nt, Homo sapiens
uagagguguuggcaguuua

SEQ ID NO: 799915 - RNA, 19 nt, Homo sapiens
cauagaaaccuaaucagau

SEQ ID NO: 799916 - RNA, 19 nt, Homo sapiens
gguauaucauuuccucuuc

SEQ ID NO: 799917 - RNA, 19 nt, Homo sapiens
ccuauugaccugcauguuu

SEQ ID NO: 799918 - RNA, 19 nt, Homo sapiens
gaugaggaaacuagacaaa

SEQ ID NO: 799919 - RNA, 19 nt, Homo sapiens
agauaaucccuucaaguua

SEQ ID NO: 799920 - RNA, 19 nt, Homo sapiens
aaggaccauucuagauuua

SEQ ID NO: 799921 - RNA, 19 nt, Homo sapiens
gcucuucaagucugcaaua

SEQ ID NO: 799922 - RNA, 19 nt, Homo sapiens
uuuguaaccuaaccuauug

SEQ ID NO: 799923 - RNA, 19 nt, Homo sapiens
aaaauggccuccaacaaaa

SEQ ID NO: 799924 - RNA, 19 nt, Homo sapiens
gauccugaaagaauaauug

SEQ ID NO: 799925 - RNA, 19 nt, Homo sapiens
augggaaaguggaauauuu

SEQ ID NO: 799926 - RNA, 19 nt, Homo sapiens
ugaaugggaaaguggaaua

SEQ ID NO: 799927 - RNA, 19 nt, Homo sapiens
ugaaguguccucaaauugu

SEQ ID NO: 799928 - RNA, 19 nt, Homo sapiens
ugaaucugaugacagcaaa

SEQ ID NO: 799929 - RNA, 19 nt, Homo sapiens
guauaucauuuccucuuca

SEQ ID NO: 799930 - RNA, 19 nt, Homo sapiens
agacuaacuuggcauucuu

SEQ ID NO: 799931 - RNA, 19 nt, Homo sapiens
cucaugaaauggaaagauu

SEQ ID NO: 799932 - RNA, 19 nt, Homo sapiens
uaagagauaaucccuucaa

SEQ ID NO: 799933 - RNA, 19 nt, Homo sapiens
agaagaugaagcucaauaa

SEQ ID NO: 799934 - RNA, 19 nt, Homo sapiens
aguacuagaucgacgugua

SEQ ID NO: 799935 - RNA, 19 nt, Homo sapiens
uuagagguguuggcaguuu

SEQ ID NO: 799936 - RNA, 19 nt, Homo sapiens
ucauagaaaccuaaucaga

SEQ ID NO: 799937 - RNA, 19 nt, Homo sapiens
uguaagacuuggcucauag

SEQ ID NO: 799938 - RNA, 19 nt, Homo sapiens
aaacuuguguucucaugag

SEQ ID NO: 799939 - RNA, 19 nt, Homo sapiens
uagcacugguuacuuugaa

SEQ ID NO: 799940 - RNA, 19 nt, Homo sapiens
uuacagaugcugacaauac

SEQ ID NO: 799941 - RNA, 19 nt, Homo sapiens
caaaugcuaguguguuuua

SEQ ID NO: 799942 - RNA, 19 nt, Homo sapiens
ggaaacuagacaaaugcua

SEQ ID NO: 799943 - RNA, 19 nt, Homo sapiens
gaagggauuuacagaugcu

SEQ ID NO: 799944 - RNA, 19 nt, Homo sapiens
aaagagaugcugcugacaa

SEQ ID NO: 799945 - RNA, 19 nt, Homo sapiens
cagcaaaucaaagaagaaa

SEQ ID NO: 799946 - RNA, 19 nt, Homo sapiens
gugaacagugguuaauaaa

SEQ ID NO: 799947 - RNA, 19 nt, Homo sapiens
guguguguguguauccaua

SEQ ID NO: 799948 - RNA, 19 nt, Homo sapiens
gaaguggaagggauuuaca

SEQ ID NO: 799949 - RNA, 19 nt, Homo sapiens
cuucaagucugcaauaaaa

SEQ ID NO: 799950 - RNA, 19 nt, Homo sapiens
ugauugaagcguuucuuaa

SEQ ID NO: 799951 - RNA, 19 nt, Homo sapiens
uguaguugcuuccuuuauc

SEQ ID NO: 799952 - RNA, 19 nt, Homo sapiens
aagcguuucuuaacucuca

SEQ ID NO: 799953 - RNA, 19 nt, Homo sapiens
ugucauaaaugugugaaca

SEQ ID NO: 799954 - RNA, 19 nt, Homo sapiens
gaacauuugauaccauggu

SEQ ID NO: 799955 - RNA, 19 nt, Homo sapiens
gagagacuaacuuggcauu

SEQ ID NO: 799956 - RNA, 19 nt, Homo sapiens
uaucugacagugaaucuga

SEQ ID NO: 799957 - RNA, 19 nt, Homo sapiens
guuauccaacuguauauug

SEQ ID NO: 799958 - RNA, 19 nt, Homo sapiens
ucagaugguuagagguguu

SEQ ID NO: 799959 - RNA, 19 nt, Homo sapiens
uggaaucccuguugcuaca

SEQ ID NO: 799960 - RNA, 19 nt, Homo sapiens
cacagcagguuuccucauc

SEQ ID NO: 799961 - RNA, 19 nt, Homo sapiens
ccaacuguauauuguuuac

SEQ ID NO: 799962 - RNA, 19 nt, Homo sapiens
gaaugggaaaguggaauau

SEQ ID NO: 799963 - RNA, 19 nt, Homo sapiens
cauuuccucuucauuaaag

SEQ ID NO: 799964 - RNA, 19 nt, Homo sapiens
gcauccauagcacugguua

SEQ ID NO: 799965 - RNA, 19 nt, Homo sapiens
ggcgaaagaggcaaauaug

SEQ ID NO: 799966 - RNA, 19 nt, Homo sapiens
gauaaucccuucaaguuaa

SEQ ID NO: 799967 - RNA, 19 nt, Homo sapiens
ucagaaagcuggcaaagaa

SEQ ID NO: 799968 - RNA, 19 nt, Homo sapiens
gaauugauguuucucauga

SEQ ID NO: 799969 - RNA, 19 nt, Homo sapiens
gaaguguccucaaauugua

SEQ ID NO: 799970 - RNA, 19 nt, Homo sapiens
ggugaacagugguuaauaa

SEQ ID NO: 799971 - RNA, 19 nt, Homo sapiens
gacaaaugcuaguguguuu

SEQ ID NO: 799972 - RNA, 19 nt, Homo sapiens
gagauaaucccuucaaguu

SEQ ID NO: 799973 - RNA, 19 nt, Homo sapiens
ggauguggcuugagcugua

SEQ ID NO: 799974 - RNA, 19 nt, Homo sapiens
ccauagcacugguuacuuu

SEQ ID NO: 799975 - RNA, 19 nt, Homo sapiens
ggcagagccugaagaauuu

SEQ ID NO: 799976 - RNA, 19 nt, Homo sapiens
aauaauagcucuucaaguc

SEQ ID NO: 799977 - RNA, 19 nt, Homo sapiens
uaaggaccauucuagauuu

SEQ ID NO: 799978 - RNA, 19 nt, Homo sapiens
gcucggaggcggugaauaa

SEQ ID NO: 799979 - RNA, 19 nt, Homo sapiens
ugaggaaacuagacaaaug

SEQ ID NO: 799980 - RNA, 19 nt, Homo sapiens
ggaccauucuagauuuauu

SEQ ID NO: 799981 - RNA, 19 nt, Homo sapiens
agacagcaguggagaauug

SEQ ID NO: 799982 - RNA, 19 nt, Homo sapiens
uuuaggaccugcugucaua

SEQ ID NO: 799983 - RNA, 19 nt, Homo sapiens
gaacagcuuuucuaaaugu

SEQ ID NO: 799984 - RNA, 19 nt, Homo sapiens
uaugaaguguccucaaauu

SEQ ID NO: 799985 - RNA, 19 nt, Homo sapiens
cgaaagaggcaaauaugaa

SEQ ID NO: 799986 - RNA, 19 nt, Homo sapiens
aauaugaaguguccucaaa

SEQ ID NO: 799987 - RNA, 19 nt, Homo sapiens
ugacaaaccaagaggauuu

SEQ ID NO: 799988 - RNA, 19 nt, Homo sapiens
caugaugaauggaauaugu

SEQ ID NO: 799989 - RNA, 19 nt, Homo sapiens
aaccauacauuucaaguga

SEQ ID NO: 799990 - RNA, 19 nt, Homo sapiens
gaaaguagcguuggaagag

SEQ ID NO: 799991 - RNA, 19 nt, Homo sapiens
gacagcaaaucaaagaaga

SEQ ID NO: 799992 - RNA, 19 nt, Homo sapiens
gaccugcugucauaaaugu

SEQ ID NO: 799993 - RNA, 19 nt, Homo sapiens
gaaagaggcaaauaugaag

SEQ ID NO: 799994 - RNA, 19 nt, Homo sapiens
ugaagaauuugucguggaa

SEQ ID NO: 799995 - RNA, 19 nt, Homo sapiens
gaagaugaagcucaauaau

SEQ ID NO: 799996 - RNA, 19 nt, Homo sapiens
gaugacagcaaaucaaaga

SEQ ID NO: 799997 - RNA, 19 nt, Homo sapiens
caacaaaacuacauugcaa

SEQ ID NO: 799998 - RNA, 19 nt, Homo sapiens
ugaguuugcuuuacugguu

SEQ ID NO: 799999 - RNA, 19 nt, Homo sapiens
guaguugcuuccuuuauca

SEQ ID NO: 800000 - RNA, 19 nt, Homo sapiens
gcucauagaaaccuaauca

SEQ ID NO: 800001 - RNA, 19 nt, Homo sapiens
uuucugagaugccauuauu

SEQ ID NO: 800002 - RNA, 19 nt, Homo sapiens
aaacagaauggaaagagua

SEQ ID NO: 800003 - RNA, 19 nt, Homo sapiens
auagaaaccuaaucagaug

SEQ ID NO: 800004 - RNA, 19 nt, Homo sapiens
gcagugguuuauuugcaaa

SEQ ID NO: 800005 - RNA, 19 nt, Homo sapiens
gcgaaagaggcaaauauga

SEQ ID NO: 800006 - RNA, 19 nt, Homo sapiens
aagagaugcugcugacaaa

SEQ ID NO: 800007 - RNA, 19 nt, Homo sapiens
uggaagggauuuacagaug

SEQ ID NO: 800008 - RNA, 19 nt, Homo sapiens
gaaucccuguugcuacauu

SEQ ID NO: 800009 - RNA, 19 nt, Homo sapiens
cuaaggaccauucuagauu

SEQ ID NO: 800010 - RNA, 19 nt, Homo sapiens
gaaauggaaagauucagau

SEQ ID NO: 800011 - RNA, 19 nt, Homo sapiens
agaauugauugaagcguuu

SEQ ID NO: 800012 - RNA, 19 nt, Homo sapiens
agacuuggcucauagaaac

SEQ ID NO: 800013 - RNA, 19 nt, Homo sapiens
cagaagaugaagcucaaua

SEQ ID NO: 800014 - RNA, 19 nt, Homo sapiens
gagacuaacuuggcauucu

SEQ ID NO: 800015 - RNA, 19 nt, Homo sapiens
uagagguguuggcaguuua

SEQ ID NO: 800016 - RNA, 19 nt, Homo sapiens
cauagaaaccuaaucagau

SEQ ID NO: 800017 - RNA, 19 nt, Homo sapiens
gguauaucauuuccucuuc

SEQ ID NO: 800018 - RNA, 19 nt, Homo sapiens
cggaggcggugaauaauag

SEQ ID NO: 800019 - RNA, 19 nt, Homo sapiens
ccuauugaccugcauguuu

SEQ ID NO: 800020 - RNA, 19 nt, Homo sapiens
gaugaggaaacuagacaaa

SEQ ID NO: 800021 - RNA, 19 nt, Homo sapiens
agauaaucccuucaaguua

SEQ ID NO: 800022 - RNA, 19 nt, Homo sapiens
aaggaccauucuagauuua

SEQ ID NO: 800023 - RNA, 19 nt, Homo sapiens
gcucuucaagucugcaaua

SEQ ID NO: 800024 - RNA, 19 nt, Homo sapiens
uuuguaaccuaaccuauug

SEQ ID NO: 800025 - RNA, 19 nt, Homo sapiens
aaaauggccuccaacaaaa

SEQ ID NO: 800026 - RNA, 19 nt, Homo sapiens
gauccugaaagaauaauug

SEQ ID NO: 800027 - RNA, 19 nt, Homo sapiens
augggaaaguggaauauuu

SEQ ID NO: 800028 - RNA, 19 nt, Homo sapiens
ugaaguguccucaaauugu

SEQ ID NO: 800029 - RNA, 19 nt, Homo sapiens
ugaaugggaaaguggaaua

SEQ ID NO: 800030 - RNA, 19 nt, Homo sapiens
ugaaucugaugacagcaaa

SEQ ID NO: 800031 - RNA, 19 nt, Homo sapiens
guauaucauuuccucuuca

SEQ ID NO: 800032 - RNA, 19 nt, Homo sapiens
agacuaacuuggcauucuu

SEQ ID NO: 800033 - RNA, 19 nt, Homo sapiens
cucaugaaauggaaagauu

SEQ ID NO: 800034 - RNA, 19 nt, Homo sapiens
uaagagauaaucccuucaa

SEQ ID NO: 800035 - RNA, 19 nt, Homo sapiens
agaagaugaagcucaauaa

SEQ ID NO: 800036 - RNA, 19 nt, Homo sapiens
aguacuagaucgacgugua

SEQ ID NO: 800037 - RNA, 19 nt, Homo sapiens
uuagagguguuggcaguuu

SEQ ID NO: 800038 - RNA, 19 nt, Homo sapiens
ucauagaaaccuaaucaga

SEQ ID NO: 800039 - RNA, 19 nt, Homo sapiens
uguaagacuuggcucauag

SEQ ID NO: 800040 - RNA, 19 nt, Homo sapiens
aaacuuguguucucaugag

SEQ ID NO: 800041 - RNA, 19 nt, Homo sapiens
uagcacugguuacuuugaa

SEQ ID NO: 800042 - RNA, 19 nt, Homo sapiens
gaagggauuuacagaugcu

SEQ ID NO: 800043 - RNA, 19 nt, Homo sapiens
caaaugcuaguguguuuua

SEQ ID NO: 800044 - RNA, 19 nt, Homo sapiens
ggaaacuagacaaaugcua

SEQ ID NO: 800045 - RNA, 19 nt, Homo sapiens
uuacagaugcugacaauac

SEQ ID NO: 800046 - RNA, 19 nt, Homo sapiens
aaagagaugcugcugacaa

SEQ ID NO: 800047 - RNA, 19 nt, Homo sapiens
cagcaaaucaaagaagaaa

SEQ ID NO: 800048 - RNA, 19 nt, Homo sapiens
gugaacagugguuaauaaa

SEQ ID NO: 800049 - RNA, 19 nt, Homo sapiens
cuucaagucugcaauaaaa

SEQ ID NO: 800050 - RNA, 19 nt, Homo sapiens
gaaguggaagggauuuaca

SEQ ID NO: 800051 - RNA, 19 nt, Homo sapiens
guguguguguguauccaua

SEQ ID NO: 800052 - RNA, 19 nt, Homo sapiens
ugauugaagcguuucuuaa

SEQ ID NO: 800053 - RNA, 19 nt, Homo sapiens
gaauaauagcucuucaagu

SEQ ID NO: 800054 - RNA, 19 nt, Homo sapiens
uguaguugcuuccuuuauc

SEQ ID NO: 800055 - RNA, 19 nt, Homo sapiens
aagcguuucuuaacucuca

SEQ ID NO: 800056 - RNA, 19 nt, Homo sapiens
ugucauaaaugugugaaca

SEQ ID NO: 800057 - RNA, 19 nt, Homo sapiens
gaacauuugauaccauggu

SEQ ID NO: 800058 - RNA, 19 nt, Homo sapiens
gagagacuaacuuggcauu

SEQ ID NO: 800059 - RNA, 19 nt, Homo sapiens
uaucugacagugaaucuga

SEQ ID NO: 800060 - RNA, 19 nt, Homo sapiens
guuauccaacuguauauug

SEQ ID NO: 800061 - RNA, 19 nt, Homo sapiens
ucagaugguuagagguguu

SEQ ID NO: 800062 - RNA, 19 nt, Homo sapiens
uggaaucccuguugcuaca

SEQ ID NO: 800063 - RNA, 19 nt, Homo sapiens
cacagcagguuuccucauc

SEQ ID NO: 800064 - RNA, 19 nt, Homo sapiens
ccaacuguauauuguuuac

SEQ ID NO: 800065 - RNA, 19 nt, Homo sapiens
cauuuccucuucauuaaag

SEQ ID NO: 800066 - RNA, 19 nt, Homo sapiens
ggaaagcgcuggagacaga

SEQ ID NO: 800067 - RNA, 19 nt, Homo sapiens
ggaaguacguccuggauga

SEQ ID NO: 800068 - RNA, 19 nt, Homo sapiens
guacugagaugaugaggaa

SEQ ID NO: 800069 - RNA, 19 nt, Homo sapiens
gaacagaaucuucaaguug

SEQ ID NO: 800070 - RNA, 19 nt, Homo sapiens
gcagaugaauucuuuccua

SEQ ID NO: 800071 - RNA, 19 nt, Homo sapiens
ucaaguugcugcucagaua

SEQ ID NO: 800072 - RNA, 19 nt, Homo sapiens
gggaagacguggacggaua

SEQ ID NO: 800073 - RNA, 19 nt, Homo sapiens
ucagauaagugaagauuug

SEQ ID NO: 800074 - RNA, 19 nt, Homo sapiens
uuaaacaccuacacaagua

SEQ ID NO: 800075 - RNA, 19 nt, Homo sapiens
gucaaacgcuguagacauu

SEQ ID NO: 800076 - RNA, 19 nt, Homo sapiens
ggaagacuauuucaacgau

SEQ ID NO: 800077 - RNA, 19 nt, Homo sapiens
uggccaagcugcucaagua

SEQ ID NO: 800078 - RNA, 19 nt, Homo sapiens
cagaugaauucuuuccuaa

SEQ ID NO: 800079 - RNA, 19 nt, Homo sapiens
aagcgcagcuguauaaaga

SEQ ID NO: 800080 - RNA, 19 nt, Homo sapiens
gaagagcaccugaggaauc

SEQ ID NO: 800081 - RNA, 19 nt, Homo sapiens
ugaaugaauugaugacgaa

SEQ ID NO: 800082 - RNA, 19 nt, Homo sapiens
caagaaagacugggucaaa

SEQ ID NO: 800083 - RNA, 19 nt, Homo sapiens
gcgcauacuugaccggaaa

SEQ ID NO: 800084 - RNA, 19 nt, Homo sapiens
ccucauccauggcuacuuu

SEQ ID NO: 800085 - RNA, 19 nt, Homo sapiens
gaagacuauuucaacgauu

SEQ ID NO: 800086 - RNA, 19 nt, Homo sapiens
gcaaggagggugccgagaa

SEQ ID NO: 800087 - RNA, 19 nt, Homo sapiens
uuaagaaccuccugaacau

SEQ ID NO: 800088 - RNA, 19 nt, Homo sapiens
cuaagcagauauaaagaug

SEQ ID NO: 800089 - RNA, 19 nt, Homo sapiens
caaacgcuguagacauuau

SEQ ID NO: 800090 - RNA, 19 nt, Homo sapiens
ggagcaacaucugaaugaa

SEQ ID NO: 800091 - RNA, 19 nt, Homo sapiens
gccauugucuuccagaugu

SEQ ID NO: 800092 - RNA, 19 nt, Homo sapiens
agcaacaucugaaugaauu

SEQ ID NO: 800093 - RNA, 19 nt, Homo sapiens
gaugaauucuuuccuaagc

SEQ ID NO: 800094 - RNA, 19 nt, Homo sapiens
ggagagaagcgcggaagaa

SEQ ID NO: 800095 - RNA, 19 nt, Homo sapiens
uguccacgcucacuucaaa

SEQ ID NO: 800096 - RNA, 19 nt, Homo sapiens
gggacgggcugauguacga

SEQ ID NO: 800097 - RNA, 19 nt, Homo sapiens
ugaaugacgucaaagacau

SEQ ID NO: 800098 - RNA, 19 nt, Homo sapiens
uggacaagguggagcagua

SEQ ID NO: 800099 - RNA, 19 nt, Homo sapiens
cagcaaguauccagacauc

SEQ ID NO: 800100 - RNA, 19 nt, Homo sapiens
ggaauccauagucaguuua

SEQ ID NO: 800101 - RNA, 19 nt, Homo sapiens
caaggagggugccgagaag

SEQ ID NO: 800102 - RNA, 19 nt, Homo sapiens
gaauccauagucaguuuaa

SEQ ID NO: 800103 - RNA, 19 nt, Homo sapiens
cuacacaaguacugagaug

SEQ ID NO: 800104 - RNA, 19 nt, Homo sapiens
cugaugagcuggcuaagca

SEQ ID NO: 800105 - RNA, 19 nt, Homo sapiens
gaaaacaaagguacuaguu

SEQ ID NO: 800106 - RNA, 19 nt, Homo sapiens
aagaagagcaccugaggaa

SEQ ID NO: 800107 - RNA, 19 nt, Homo sapiens
uggagaaccucaagaacau

SEQ ID NO: 800108 - RNA, 19 nt, Homo sapiens
ccacucuggucagcaagua

SEQ ID NO: 800109 - RNA, 19 nt, Homo sapiens
gacgaagaaguggcuauua

SEQ ID NO: 800110 - RNA, 19 nt, Homo sapiens
gagcaacaucugaaugaau

SEQ ID NO: 800111 - RNA, 19 nt, Homo sapiens
gagaaaauguucaccaucu

SEQ ID NO: 800112 - RNA, 19 nt, Homo sapiens
ggagacccaggaccuaauu

SEQ ID NO: 800113 - RNA, 19 nt, Homo sapiens
acgaagaaguggcuauuag

SEQ ID NO: 800114 - RNA, 19 nt, Homo sapiens
aggaauccauagucaguuu

SEQ ID NO: 800115 - RNA, 19 nt, Homo sapiens
gaugaagcgcagcuguaua

SEQ ID NO: 800116 - RNA, 19 nt, Homo sapiens
gaaagacugggucaaagag

SEQ ID NO: 800117 - RNA, 19 nt, Homo sapiens
ccguagaggugcacagaga

SEQ ID NO: 800118 - RNA, 19 nt, Homo sapiens
ggacugugaccaccagaau

SEQ ID NO: 800119 - RNA, 19 nt, Homo sapiens
caaggaauccauagucagu

SEQ ID NO: 800120 - RNA, 19 nt, Homo sapiens
gcgcagcuguauaaagaag

SEQ ID NO: 800121 - RNA, 19 nt, Homo sapiens
gcucagauaagugaagauu

SEQ ID NO: 800122 - RNA, 19 nt, Homo sapiens
ucucuugggugcuuguuug

SEQ ID NO: 800123 - RNA, 19 nt, Homo sapiens
agaggucacuggucacugu

SEQ ID NO: 800124 - RNA, 19 nt, Homo sapiens
gcaaguauccagacaucag

SEQ ID NO: 800125 - RNA, 19 nt, Homo sapiens
gaauugaugacgaagaagu

SEQ ID NO: 800126 - RNA, 19 nt, Homo sapiens
uaaagaaugaaguggaaga

SEQ ID NO: 800127 - RNA, 19 nt, Homo sapiens
gaagcuggcguccgguuuc

SEQ ID NO: 800128 - RNA, 19 nt, Homo sapiens
gaagcgcagcuguauaaag

SEQ ID NO: 800129 - RNA, 19 nt, Homo sapiens
ggacaagguggagcaguau

SEQ ID NO: 800130 - RNA, 19 nt, Homo sapiens
ccaccuugcuggucucagu

SEQ ID NO: 800131 - RNA, 19 nt, Homo sapiens
ggaagcuggcguccgguuu

SEQ ID NO: 800132 - RNA, 19 nt, Homo sapiens
augaagcgcagcuguauaa

SEQ ID NO: 800133 - RNA, 19 nt, Homo sapiens
caaguugcugcucagauaa

SEQ ID NO: 800134 - RNA, 19 nt, Homo sapiens
caacaucugaaugaauuga

SEQ ID NO: 800135 - RNA, 19 nt, Homo sapiens
gcagcuguauaaagaagag

SEQ ID NO: 800136 - RNA, 19 nt, Homo sapiens
gagaacaccccuagcauga

SEQ ID NO: 800137 - RNA, 19 nt, Homo sapiens
guggagaaccucaagaaca

SEQ ID NO: 800138 - RNA, 19 nt, Homo sapiens
ggucaaacgcuguagacau

SEQ ID NO: 800139 - RNA, 19 nt, Homo sapiens
augaauugaugacgaagaa

SEQ ID NO: 800140 - RNA, 19 nt, Homo sapiens
agaaagacugggucaaaga

SEQ ID NO: 800141 - RNA, 19 nt, Homo sapiens
gcuggagacagacaagaaa

SEQ ID NO: 800142 - RNA, 19 nt, Homo sapiens
agaaccuccugaacaugua

SEQ ID NO: 800143 - RNA, 19 nt, Homo sapiens
caugaacagugugaggauu

SEQ ID NO: 800144 - RNA, 19 nt, Homo sapiens
cuugggugcuuguuuguug

SEQ ID NO: 800145 - RNA, 19 nt, Homo sapiens
caaagagacagagccagaa

SEQ ID NO: 800146 - RNA, 19 nt, Homo sapiens
gagagaagcgcggaagaag

SEQ ID NO: 800147 - RNA, 19 nt, Homo sapiens
ugacgugggucuuaaacac

SEQ ID NO: 800148 - RNA, 19 nt, Homo sapiens
ucaguugucaggaucauug

SEQ ID NO: 800149 - RNA, 19 nt, Homo sapiens
gcagagcaucaacaccauu

SEQ ID NO: 800150 - RNA, 19 nt, Homo sapiens
cugagcugcuugacacgua

SEQ ID NO: 800151 - RNA, 19 nt, Homo sapiens
cacaaguacugagaugaug

SEQ ID NO: 800152 - RNA, 19 nt, Homo sapiens
gaaaauguucaccaucuug

SEQ ID NO: 800153 - RNA, 19 nt, Homo sapiens
gacaugaagcagaccauca

SEQ ID NO: 800154 - RNA, 19 nt, Homo sapiens
uggagcaacaucugaauga

SEQ ID NO: 800155 - RNA, 19 nt, Homo sapiens
caaagguacuaguuuuaug

SEQ ID NO: 800156 - RNA, 19 nt, Homo sapiens
aagaaagacugggucaaag

SEQ ID NO: 800157 - RNA, 19 nt, Homo sapiens
gacccaggaccuaauugaa

SEQ ID NO: 800158 - RNA, 19 nt, Homo sapiens
ugaccucauugucgccaaa

SEQ ID NO: 800159 - RNA, 19 nt, Homo sapiens
cccaggaccuaauugaaca

SEQ ID NO: 800160 - RNA, 19 nt, Homo sapiens
gaaagggaagagaaaauug

SEQ ID NO: 800161 - RNA, 19 nt, Homo sapiens
cuaagcagcuguggauggu

SEQ ID NO: 800162 - RNA, 19 nt, Homo sapiens
cgucaccuaauuaaaguuu

SEQ ID NO: 800163 - RNA, 19 nt, Homo sapiens
gaaccccgucaccuaauua

SEQ ID NO: 800164 - RNA, 19 nt, Homo sapiens
ggaaccccgucaccuaauu

SEQ ID NO: 800165 - RNA, 19 nt, Homo sapiens
cuguagacauuaucugugu

SEQ ID NO: 800166 - RNA, 19 nt, Homo sapiens
gcacaucaauaaagaggaa

SEQ ID NO: 800167 - RNA, 19 nt, Homo sapiens
ggaagggacugaaauugug

SEQ ID NO: 800168 - RNA, 19 nt, Homo sapiens
ggaggcacaucaauaaaga

SEQ ID NO: 800169 - RNA, 19 nt, Homo sapiens
gagaagauccgaaagaaau

SEQ ID NO: 800170 - RNA, 19 nt, Homo sapiens
guaggaggcacaucaauaa

SEQ ID NO: 800171 - RNA, 19 nt, Homo sapiens
ggaugaaguucguguacaa

SEQ ID NO: 800172 - RNA, 19 nt, Homo sapiens
gaccggcacuucuuaaugu

SEQ ID NO: 800173 - RNA, 19 nt, Homo sapiens
gcgagaagauccgaaagaa

SEQ ID NO: 800174 - RNA, 19 nt, Homo sapiens
gaaagugucuacggucugu

SEQ ID NO: 800175 - RNA, 19 nt, Homo sapiens
gguaggaggcacaucaaua

SEQ ID NO: 800176 - RNA, 19 nt, Homo sapiens
uaacucuccuuucuccuuu

SEQ ID NO: 800177 - RNA, 19 nt, Homo sapiens
gaagguaggaggcacauca

SEQ ID NO: 800178 - RNA, 19 nt, Homo sapiens
ucaaacaccaccucccuua

SEQ ID NO: 800179 - RNA, 19 nt, Homo sapiens
gaaguucguguacaaagaa

SEQ ID NO: 800180 - RNA, 19 nt, Homo sapiens
ggucaguucuacuucuuga

SEQ ID NO: 800181 - RNA, 19 nt, Homo sapiens
gauaggagaccuggacaaa

SEQ ID NO: 800182 - RNA, 19 nt, Homo sapiens
ugaaguucguguacaaaga

SEQ ID NO: 800183 - RNA, 19 nt, Homo sapiens
aaacaccaccucccuuauu

SEQ ID NO: 800184 - RNA, 19 nt, Homo sapiens
agacuucuuucucuacauu

SEQ ID NO: 800185 - RNA, 19 nt, Homo sapiens
gagcugaggaugccuuguu

SEQ ID NO: 800186 - RNA, 19 nt, Homo sapiens
ccaggaacaccaugaagaa

SEQ ID NO: 800187 - RNA, 19 nt, Homo sapiens
ggaccggcacuucuuaaug

SEQ ID NO: 800188 - RNA, 19 nt, Homo sapiens
ggaacaccaugaagaagac

SEQ ID NO: 800189 - RNA, 19 nt, Homo sapiens
ucccaaagcucggauagga

SEQ ID NO: 800190 - RNA, 19 nt, Homo sapiens
ucucacaguuggucaguuc

SEQ ID NO: 800191 - RNA, 19 nt, Homo sapiens
guaacucuccuuucuccuu

SEQ ID NO: 800192 - RNA, 19 nt, Homo sapiens
cggcacuucuuaauguuug

SEQ ID NO: 800193 - RNA, 19 nt, Homo sapiens
cgagaagauccgaaagaaa

SEQ ID NO: 800194 - RNA, 19 nt, Homo sapiens
agaagauccgaaagaaaua

SEQ ID NO: 800195 - RNA, 19 nt, Homo sapiens
ggaggaugaaguucgugua

SEQ ID NO: 800196 - RNA, 19 nt, Homo sapiens
ucaggaccggcacuucuua

SEQ ID NO: 800197 - RNA, 19 nt, Homo sapiens
gcucugagggcgagaagau

SEQ ID NO: 800198 - RNA, 19 nt, Homo sapiens
ccacaaugggucagcugua

SEQ ID NO: 800199 - RNA, 19 nt, Homo sapiens
gcaaucccuuccuuucacu

SEQ ID NO: 800200 - RNA, 19 nt, Homo sapiens
cagcaaucccuuccuuuca

SEQ ID NO: 800201 - RNA, 19 nt, Homo sapiens
gaugaaguucguguacaaa

SEQ ID NO: 800202 - RNA, 19 nt, Homo sapiens
guuggaagggacugaaauu

SEQ ID NO: 800203 - RNA, 19 nt, Homo sapiens
caaacaccaccucccuuau

SEQ ID NO: 800204 - RNA, 19 nt, Homo sapiens
guaccaggaacaccaugaa

SEQ ID NO: 800205 - RNA, 19 nt, Homo sapiens
ccagcaaucccuuccuuuc

SEQ ID NO: 800206 - RNA, 19 nt, Homo sapiens
ucuccagccucucuuagga

SEQ ID NO: 800207 - RNA, 19 nt, Homo sapiens
aacaccaccucccuuauuc

SEQ ID NO: 800208 - RNA, 19 nt, Homo sapiens
aagaagagcauccguucga

SEQ ID NO: 800209 - RNA, 19 nt, Homo sapiens
ggcgagaagauccgaaaga

SEQ ID NO: 800210 - RNA, 19 nt, Homo sapiens
gaagauccgaaagaaauac

SEQ ID NO: 800211 - RNA, 19 nt, Homo sapiens
uggaagggacugaaauugu

SEQ ID NO: 800212 - RNA, 19 nt, Homo sapiens
gggucucauucuacaaaga

SEQ ID NO: 800213 - RNA, 19 nt, Homo sapiens
cacaaugggucagcuguac

SEQ ID NO: 800214 - RNA, 19 nt, Homo sapiens
aagagcauccguucgagaa

SEQ ID NO: 800215 - RNA, 19 nt, Homo sapiens
ucuuaauguuuguggcuuu

SEQ ID NO: 800216 - RNA, 19 nt, Homo sapiens
uuugguuucuguucccuuu

SEQ ID NO: 800217 - RNA, 19 nt, Homo sapiens
gaggaugaaguucguguac

SEQ ID NO: 800218 - RNA, 19 nt, Homo sapiens
ggauaggagaccuggacaa

SEQ ID NO: 800219 - RNA, 19 nt, Homo sapiens
ucacaguuggucaguucua

SEQ ID NO: 800220 - RNA, 19 nt, Homo sapiens
uccuuucacuaccuucuuu

SEQ ID NO: 800221 - RNA, 19 nt, Homo sapiens
ucuccuuucuccuuucuuc

SEQ ID NO: 800222 - RNA, 19 nt, Homo sapiens
uaggaggcacaucaauaaa

SEQ ID NO: 800223 - RNA, 19 nt, Homo sapiens
gggugccggugauaguaga

SEQ ID NO: 800224 - RNA, 19 nt, Homo sapiens
agaaaaggcucccaaagcu

SEQ ID NO: 800225 - RNA, 19 nt, Homo sapiens
ucaguucuacuucuugauc

SEQ ID NO: 800226 - RNA, 19 nt, Homo sapiens
gcucagaaccccagcaauc

SEQ ID NO: 800227 - RNA, 19 nt, Homo sapiens
caggaccggcacuucuuaa

SEQ ID NO: 800228 - RNA, 19 nt, Homo sapiens
aggaacaccaugaagaaga

SEQ ID NO: 800229 - RNA, 19 nt, Homo sapiens
ucaaagagcugcugacauc

SEQ ID NO: 800230 - RNA, 19 nt, Homo sapiens
agaagaagguccguaaaua

SEQ ID NO: 800231 - RNA, 19 nt, Homo sapiens
ccaacuaccugaacgauga

SEQ ID NO: 800232 - RNA, 19 nt, Homo sapiens
ggaguucaccucuguguuu

SEQ ID NO: 800233 - RNA, 19 nt, Homo sapiens
ggacaagaauuuugccuuu

SEQ ID NO: 800234 - RNA, 19 nt, Homo sapiens
ggagcacgguggacugauu

SEQ ID NO: 800235 - RNA, 19 nt, Homo sapiens
gaagaagguccguaaauac

SEQ ID NO: 800236 - RNA, 19 nt, Homo sapiens
gaagaagaagguccguaaa

SEQ ID NO: 800237 - RNA, 19 nt, Homo sapiens
caacuggaauggcagcaau

SEQ ID NO: 800238 - RNA, 19 nt, Homo sapiens
caacgagaauaaacaagag

SEQ ID NO: 800239 - RNA, 19 nt, Homo sapiens
ggagccagaugaccagaca

SEQ ID NO: 800240 - RNA, 19 nt, Homo sapiens
gugaguacguggacaucaa

SEQ ID NO: 800241 - RNA, 19 nt, Homo sapiens
agaagaagaagguccguaa

SEQ ID NO: 800242 - RNA, 19 nt, Homo sapiens
caugauggauuucuucaac

SEQ ID NO: 800243 - RNA, 19 nt, Homo sapiens
gaccagaggcgcuaaagag

SEQ ID NO: 800244 - RNA, 19 nt, Homo sapiens
gcacacagccccacacaga

SEQ ID NO: 800245 - RNA, 19 nt, Homo sapiens
gcaagcugcgggucagauu

SEQ ID NO: 800246 - RNA, 19 nt, Homo sapiens
gaguucaccucuguguuug

SEQ ID NO: 800247 - RNA, 19 nt, Homo sapiens
ucaacgagaauaaacaaga

SEQ ID NO: 800248 - RNA, 19 nt, Homo sapiens
gcucaacgagaauaaacaa

SEQ ID NO: 800249 - RNA, 19 nt, Homo sapiens
uuaaccaggacaagaauuu

SEQ ID NO: 800250 - RNA, 19 nt, Homo sapiens
cgacgacgcagcaaaccuu

SEQ ID NO: 800251 - RNA, 19 nt, Homo sapiens
ggaauggcagcaauuaagg

SEQ ID NO: 800252 - RNA, 19 nt, Homo sapiens
cagggccagucacuaaaga

SEQ ID NO: 800253 - RNA, 19 nt, Homo sapiens
aacaagagcgggacaagga

SEQ ID NO: 800254 - RNA, 19 nt, Homo sapiens
aagaagaagguccguaaau

SEQ ID NO: 800255 - RNA, 19 nt, Homo sapiens
gacaagaauuuugccuuuu

SEQ ID NO: 800256 - RNA, 19 nt, Homo sapiens
agauuaaccaggacaagaa

SEQ ID NO: 800257 - RNA, 19 nt, Homo sapiens
gccacgagaagaagaagaa

SEQ ID NO: 800258 - RNA, 19 nt, Homo sapiens
gagcugcugacauccuuug

SEQ ID NO: 800259 - RNA, 19 nt, Homo sapiens
gaggagcacgguggacuga

SEQ ID NO: 800260 - RNA, 19 nt, Homo sapiens
uguuggcugugcagauuaa

SEQ ID NO: 800261 - RNA, 19 nt, Homo sapiens
aguguuggcugugcagauu

SEQ ID NO: 800262 - RNA, 19 nt, Homo sapiens
gcagcucaacgagaauaaa

SEQ ID NO: 800263 - RNA, 19 nt, Homo sapiens
gcuacgccuucugugagua

SEQ ID NO: 800264 - RNA, 19 nt, Homo sapiens
cagauuaaccaggacaaga

SEQ ID NO: 800265 - RNA, 19 nt, Homo sapiens
gcaaguucgccaacagagu

SEQ ID NO: 800266 - RNA, 19 nt, Homo sapiens
gcaguacaaggccaugcaa

SEQ ID NO: 800267 - RNA, 19 nt, Homo sapiens
ggacgagugcagcaaguac

SEQ ID NO: 800268 - RNA, 19 nt, Homo sapiens
gauuaaccaggacaagaau

SEQ ID NO: 800269 - RNA, 19 nt, Homo sapiens
ucacugaggaggccaugau

SEQ ID NO: 800270 - RNA, 19 nt, Homo sapiens
gagcacgguggacugauuc

SEQ ID NO: 800271 - RNA, 19 nt, Homo sapiens
guguuugacugccagaaag

SEQ ID NO: 800272 - RNA, 19 nt, Homo sapiens
cgucacggaucaggccauu

SEQ ID NO: 800273 - RNA, 19 nt, Homo sapiens
cgaggaguaugaggagauc

SEQ ID NO: 800274 - RNA, 19 nt, Homo sapiens
acaucaacgucacggauca

SEQ ID NO: 800275 - RNA, 19 nt, Homo sapiens
aagagcugcugacauccuu

SEQ ID NO: 800276 - RNA, 19 nt, Homo sapiens
uggaauggcagcaauuaag

SEQ ID NO: 800277 - RNA, 19 nt, Homo sapiens
gggacgagugcagcaagua

SEQ ID NO: 800278 - RNA, 19 nt, Homo sapiens
guacaaggccaugcaagcu

SEQ ID NO: 800279 - RNA, 19 nt, Homo sapiens
agcggcagcucaacgagaa

SEQ ID NO: 800280 - RNA, 19 nt, Homo sapiens
uuccagggccagucacuaa

SEQ ID NO: 800281 - RNA, 19 nt, Homo sapiens
gagacuacccaggcuaugg

SEQ ID NO: 800282 - RNA, 19 nt, Homo sapiens
gaucuaaaguugcaugguu

SEQ ID NO: 800283 - RNA, 19 nt, Homo sapiens
uaaugaagauucugaguga

SEQ ID NO: 800284 - RNA, 19 nt, Homo sapiens
uaccaaagcuugaguguca

SEQ ID NO: 800285 - RNA, 19 nt, Homo sapiens
gaguugggcuuaauguuga

SEQ ID NO: 800286 - RNA, 19 nt, Homo sapiens
gaaaaugucuuugacugua

SEQ ID NO: 800287 - RNA, 19 nt, Homo sapiens
gaugagagacuaaggauuc

SEQ ID NO: 800288 - RNA, 19 nt, Homo sapiens
gcacugagagggcgauuga

SEQ ID NO: 800289 - RNA, 19 nt, Homo sapiens
caacaacaggugcugcuua

SEQ ID NO: 800290 - RNA, 19 nt, Homo sapiens
uugcagagcugaaagagaa

SEQ ID NO: 800291 - RNA, 19 nt, Homo sapiens
aaacugauccuguaccaaa

SEQ ID NO: 800292 - RNA, 19 nt, Homo sapiens
gagcaguuguuaugaauac

SEQ ID NO: 800293 - RNA, 19 nt, Homo sapiens
gaaaauagaguugggcuua

SEQ ID NO: 800294 - RNA, 19 nt, Homo sapiens
aagauuggcuucaagaaug

SEQ ID NO: 800295 - RNA, 19 nt, Homo sapiens
gaagaugagagacuaagga

SEQ ID NO: 800296 - RNA, 19 nt, Homo sapiens
gcauggagcaguuguuaug

SEQ ID NO: 800297 - RNA, 19 nt, Homo sapiens
ccagaaaacugauccugua

SEQ ID NO: 800298 - RNA, 19 nt, Homo sapiens
agaggucacuucugccuuu

SEQ ID NO: 800299 - RNA, 19 nt, Homo sapiens
gaaagagaagauagugcua

SEQ ID NO: 800300 - RNA, 19 nt, Homo sapiens
cggcaucgcucacguugug

SEQ ID NO: 800301 - RNA, 19 nt, Homo sapiens
ucuccagaguuacaaauaa

SEQ ID NO: 800302 - RNA, 19 nt, Homo sapiens
guggucuucuccagaguua

SEQ ID NO: 800303 - RNA, 19 nt, Homo sapiens
cuauuugccuuaagaacuu

SEQ ID NO: 800304 - RNA, 19 nt, Homo sapiens
acuaaggauucuucucuuu

SEQ ID NO: 800305 - RNA, 19 nt, Homo sapiens
gcaguuguuaugaauacua

SEQ ID NO: 800306 - RNA, 19 nt, Homo sapiens
ggcuuaauguugacuucua

SEQ ID NO: 800307 - RNA, 19 nt, Homo sapiens
ggcaguacuuacaaccuuu

SEQ ID NO: 800308 - RNA, 19 nt, Homo sapiens
gcuuaauguugacuucuau

SEQ ID NO: 800309 - RNA, 19 nt, Homo sapiens
caacaggugcugcuuaguc

SEQ ID NO: 800310 - RNA, 19 nt, Homo sapiens
gacuaaggauucuucucuu

SEQ ID NO: 800311 - RNA, 19 nt, Homo sapiens
aaauguuccucuaucagaa

SEQ ID NO: 800312 - RNA, 19 nt, Homo sapiens
aaauagaguugggcuuaau

SEQ ID NO: 800313 - RNA, 19 nt, Homo sapiens
ggagcaguuguuaugaaua

SEQ ID NO: 800314 - RNA, 19 nt, Homo sapiens
cauguguccucugaucuaa

SEQ ID NO: 800315 - RNA, 19 nt, Homo sapiens
gcuaacgcacaaucgcuua

SEQ ID NO: 800316 - RNA, 19 nt, Homo sapiens
caaaggcaguacuuacaac

SEQ ID NO: 800317 - RNA, 19 nt, Homo sapiens
uugcaugguuggucugaaa

SEQ ID NO: 800318 - RNA, 19 nt, Homo sapiens
uuuagaagaugagagacua

SEQ ID NO: 800319 - RNA, 19 nt, Homo sapiens
ggccuggcguguauucgaa

SEQ ID NO: 800320 - RNA, 19 nt, Homo sapiens
ucacuaaugaagauucuga

SEQ ID NO: 800321 - RNA, 19 nt, Homo sapiens
ucagagauggauauucaaa

SEQ ID NO: 800322 - RNA, 19 nt, Homo sapiens
ccucugaucuaaaguugca

SEQ ID NO: 800323 - RNA, 19 nt, Homo sapiens
gaugcagagucccaugugu

SEQ ID NO: 800324 - RNA, 19 nt, Homo sapiens
cgauugaccaagcuucuuu

SEQ ID NO: 800325 - RNA, 19 nt, Homo sapiens
gagagacuaaggauucuuc

SEQ ID NO: 800326 - RNA, 19 nt, Homo sapiens
aaagagaagauagugcuaa

SEQ ID NO: 800327 - RNA, 19 nt, Homo sapiens
aauggugugcuaucucuua

SEQ ID NO: 800328 - RNA, 19 nt, Homo sapiens
ucaaaggcaguacuuacaa

SEQ ID NO: 800329 - RNA, 19 nt, Homo sapiens
agaguugggcuuaauguug

SEQ ID NO: 800330 - RNA, 19 nt, Homo sapiens
aaagauuggcuucaagaau

SEQ ID NO: 800331 - RNA, 19 nt, Homo sapiens
gagcugaaagagaagauag

SEQ ID NO: 800332 - RNA, 19 nt, Homo sapiens
ggugugcuaucucuuaaaa

SEQ ID NO: 800333 - RNA, 19 nt, Homo sapiens
uggagcaguuguuaugaau

SEQ ID NO: 800334 - RNA, 19 nt, Homo sapiens
gggauacgcagguggugaa

SEQ ID NO: 800335 - RNA, 19 nt, Homo sapiens
ccauguguccucugaucua

SEQ ID NO: 800336 - RNA, 19 nt, Homo sapiens
gcugcuuagucauuucuug

SEQ ID NO: 800337 - RNA, 19 nt, Homo sapiens
agugucagguucaggcuuu

SEQ ID NO: 800338 - RNA, 19 nt, Homo sapiens
gaaaacugauccuguacca

SEQ ID NO: 800339 - RNA, 19 nt, Homo sapiens
ccugagaggugcgcugugu

SEQ ID NO: 800340 - RNA, 19 nt, Homo sapiens
auagcuauuugccuuaaga

SEQ ID NO: 800341 - RNA, 19 nt, Homo sapiens
cuuccuaguuggcauugaa

SEQ ID NO: 800342 - RNA, 19 nt, Homo sapiens
gcaguuucuauuuaccuuu

SEQ ID NO: 800343 - RNA, 19 nt, Homo sapiens
aacaggugcugcuuaguca

SEQ ID NO: 800344 - RNA, 19 nt, Homo sapiens
aacaacaggugcugcuuag

SEQ ID NO: 800345 - RNA, 19 nt, Homo sapiens
ugaagauucugagugaagu

SEQ ID NO: 800346 - RNA, 19 nt, Homo sapiens
aaagauugcagagcugaaa

SEQ ID NO: 800347 - RNA, 19 nt, Homo sapiens
guccucugaucuaaaguug

SEQ ID NO: 800348 - RNA, 19 nt, Homo sapiens
gcuauuugccuuaagaacu

SEQ ID NO: 800349 - RNA, 19 nt, Homo sapiens
uuauugcugucuucaacaa

SEQ ID NO: 800350 - RNA, 19 nt, Homo sapiens
gcacaaucgcuuaaaauca

SEQ ID NO: 800351 - RNA, 19 nt, Homo sapiens
ucaaaauguuccucuauca

SEQ ID NO: 800352 - RNA, 19 nt, Homo sapiens
aggcaguacuuacaaccuu

SEQ ID NO: 800353 - RNA, 19 nt, Homo sapiens
agacuaaggauucuucucu

SEQ ID NO: 800354 - RNA, 19 nt, Homo sapiens
caaaagccauaguaaaugc

SEQ ID NO: 800355 - RNA, 19 nt, Homo sapiens
uaacgcacaaucgcuuaaa

SEQ ID NO: 800356 - RNA, 19 nt, Homo sapiens
ggucuucuccagaguuaca

SEQ ID NO: 800357 - RNA, 19 nt, Homo sapiens
caggugcugcuuagucauu

SEQ ID NO: 800358 - RNA, 19 nt, Homo sapiens
ggucacuucugccuuucca

SEQ ID NO: 800359 - RNA, 19 nt, Homo sapiens
ucacucaaaggcaguacuu

SEQ ID NO: 800360 - RNA, 19 nt, Homo sapiens
ggauucuucucuuuuauag

SEQ ID NO: 800361 - RNA, 19 nt, Homo sapiens
gaccaguccaagccagaaa

SEQ ID NO: 800362 - RNA, 19 nt, Homo sapiens
gaagauucugagugaagug

SEQ ID NO: 800363 - RNA, 19 nt, Homo sapiens
aagagaagauagugcuaac

SEQ ID NO: 800364 - RNA, 19 nt, Homo sapiens
gcugaaagagaagauagug

SEQ ID NO: 800365 - RNA, 19 nt, Homo sapiens
ugagaggugcgcuguguuc

SEQ ID NO: 800366 - RNA, 19 nt, Homo sapiens
aaaauagaguugggcuuaa

SEQ ID NO: 800367 - RNA, 19 nt, Homo sapiens
uguguccucugaucuaaag

SEQ ID NO: 800368 - RNA, 19 nt, Homo sapiens
ugagagggcgauugaccaa

SEQ ID NO: 800369 - RNA, 19 nt, Homo sapiens
ugcccuggcugccuugaga

SEQ ID NO: 800370 - RNA, 19 nt, Homo sapiens
guuuccaucuguauucuac

SEQ ID NO: 800371 - RNA, 19 nt, Homo sapiens
auggagcaguuguuaugaa

SEQ ID NO: 800372 - RNA, 19 nt, Homo sapiens
caugguuggucugaaaaua

SEQ ID NO: 800373 - RNA, 19 nt, Homo sapiens
agucccauguguccucuga

SEQ ID NO: 800374 - RNA, 19 nt, Homo sapiens
gcagagcugaaagagaaga

SEQ ID NO: 800375 - RNA, 19 nt, Homo sapiens
gaggucacuucugccuuuc

SEQ ID NO: 800376 - RNA, 19 nt, Homo sapiens
ggaacaaacugaacacuuc

SEQ ID NO: 800377 - RNA, 19 nt, Homo sapiens
gaacaccauuccugauuuc

SEQ ID NO: 800378 - RNA, 19 nt, Homo sapiens
caaaucgccucucuugcua

SEQ ID NO: 800379 - RNA, 19 nt, Homo sapiens
gagaacaccauuccugauu

SEQ ID NO: 800380 - RNA, 19 nt, Homo sapiens
gggaagggaugugagauga

SEQ ID NO: 800381 - RNA, 19 nt, Homo sapiens
gaagggaugugagaugauc

SEQ ID NO: 800382 - RNA, 19 nt, Homo sapiens
ucacaacugucacaaccuu

SEQ ID NO: 800383 - RNA, 19 nt, Homo sapiens
ucccugagguucuuguaua

SEQ ID NO: 800384 - RNA, 19 nt, Homo sapiens
gacaaguaaaucuguguua

SEQ ID NO: 800385 - RNA, 19 nt, Homo sapiens
agaacaccauuccugauuu

SEQ ID NO: 800386 - RNA, 19 nt, Homo sapiens
uagcugaccugacacagau

SEQ ID NO: 800387 - RNA, 19 nt, Homo sapiens
aaaucacgcuguguucuuu

SEQ ID NO: 800388 - RNA, 19 nt, Homo sapiens
cuaguuauuucccucugua

SEQ ID NO: 800389 - RNA, 19 nt, Homo sapiens
guucuuguauagacuaguu

SEQ ID NO: 800390 - RNA, 19 nt, Homo sapiens
aggaguagcugaccugaca

SEQ ID NO: 800391 - RNA, 19 nt, Homo sapiens
gaagcauccucugccaaga

SEQ ID NO: 800392 - RNA, 19 nt, Homo sapiens
ccagugagugugagcauuu

SEQ ID NO: 800393 - RNA, 19 nt, Homo sapiens
guucucgccugguuuggaa

SEQ ID NO: 800394 - RNA, 19 nt, Homo sapiens
ugaaacugaugguacuugu

SEQ ID NO: 800395 - RNA, 19 nt, Homo sapiens
cagugagugugagcauuua

SEQ ID NO: 800396 - RNA, 19 nt, Homo sapiens
acugaacacuuccaaagga

SEQ ID NO: 800397 - RNA, 19 nt, Homo sapiens
aaacugaacacuuccaaag

SEQ ID NO: 800398 - RNA, 19 nt, Homo sapiens
ccucagguuuuauguuuua

SEQ ID NO: 800399 - RNA, 19 nt, Homo sapiens
uugcaacaaucaaugagaa

SEQ ID NO: 800400 - RNA, 19 nt, Homo sapiens
gaaacugaugguacuuguu

SEQ ID NO: 800401 - RNA, 19 nt, Homo sapiens
aaaugaaacugaugguacu

SEQ ID NO: 800402 - RNA, 19 nt, Homo sapiens
cugcauuucuaguuucuau

SEQ ID NO: 800403 - RNA, 19 nt, Homo sapiens
ggagaacaccauuccugau

SEQ ID NO: 800404 - RNA, 19 nt, Homo sapiens
cgugauuccuugcaacaau

SEQ ID NO: 800405 - RNA, 19 nt, Homo sapiens
uaaaagaucacaacuguca

SEQ ID NO: 800406 - RNA, 19 nt, Homo sapiens
gcaauagagcauagauucu

SEQ ID NO: 800407 - RNA, 19 nt, Homo sapiens
caacaaucaaugagaaucu

SEQ ID NO: 800408 - RNA, 19 nt, Homo sapiens
gccaaaagccaaaaugaaa

SEQ ID NO: 800409 - RNA, 19 nt, Homo sapiens
gagcagcgagucugucgau

SEQ ID NO: 800410 - RNA, 19 nt, Homo sapiens
gaugggaagggaugugaga

SEQ ID NO: 800411 - RNA, 19 nt, Homo sapiens
guacuuguuuucaccauug

SEQ ID NO: 800412 - RNA, 19 nt, Homo sapiens
gaucuguuacugcaacuuc

SEQ ID NO: 800413 - RNA, 19 nt, Homo sapiens
uuauuucccucuguaaaga

SEQ ID NO: 800414 - RNA, 19 nt, Homo sapiens
cugcaaaucgccucucuug

SEQ ID NO: 800415 - RNA, 19 nt, Homo sapiens
agacaaggcagacaaaggu

SEQ ID NO: 800416 - RNA, 19 nt, Homo sapiens
gaccugacacagauugaug

SEQ ID NO: 800417 - RNA, 19 nt, Homo sapiens
guagcugaccugacacaga

SEQ ID NO: 800418 - RNA, 19 nt, Homo sapiens
caaacugaacacuuccaaa

SEQ ID NO: 800419 - RNA, 19 nt, Homo sapiens
ccacaaacugcacuacauc

SEQ ID NO: 800420 - RNA, 19 nt, Homo sapiens
ggcagacaaagguucauuu

SEQ ID NO: 800421 - RNA, 19 nt, Homo sapiens
ucgccucucuugcuacaga

SEQ ID NO: 800422 - RNA, 19 nt, Homo sapiens
gcaacaaucaaugagaauc

SEQ ID NO: 800423 - RNA, 19 nt, Homo sapiens
ccagagacaaggcagacaa

SEQ ID NO: 800424 - RNA, 19 nt, Homo sapiens
cccacaaacugcacuacau

SEQ ID NO: 800425 - RNA, 19 nt, Homo sapiens
acuaaaagaucacaacugu

SEQ ID NO: 800426 - RNA, 19 nt, Homo sapiens
caaggcagacaaagguuca

SEQ ID NO: 800427 - RNA, 19 nt, Homo sapiens
gagacaaggcagacaaagg

SEQ ID NO: 800428 - RNA, 19 nt, Homo sapiens
ugcaauagagcauagauuc

SEQ ID NO: 800429 - RNA, 19 nt, Homo sapiens
gagguucuuguauagacua

SEQ ID NO: 800430 - RNA, 19 nt, Homo sapiens
gagugugagcauuuaagaa

SEQ ID NO: 800431 - RNA, 19 nt, Homo sapiens
caccuccucucuucuccuu

SEQ ID NO: 800432 - RNA, 19 nt, Homo sapiens
gcacuacaucaguauaacu

SEQ ID NO: 800433 - RNA, 19 nt, Homo sapiens
uccagcaccuccucucuuc

SEQ ID NO: 800434 - RNA, 19 nt, Homo sapiens
cagagacaaggcagacaaa

SEQ ID NO: 800435 - RNA, 19 nt, Homo sapiens
cuaagacaaguaaaucugu

SEQ ID NO: 800436 - RNA, 19 nt, Homo sapiens
ggaagggaugugagaugau

SEQ ID NO: 800437 - RNA, 19 nt, Homo sapiens
ugaugucaauguccaggau

SEQ ID NO: 800438 - RNA, 19 nt, Homo sapiens
gcuacagaaagauacuaaa

SEQ ID NO: 800439 - RNA, 19 nt, Homo sapiens
guucaagccaugccugcaa

SEQ ID NO: 800440 - RNA, 19 nt, Homo sapiens
ugggcuaacuuugcugcua

SEQ ID NO: 800441 - RNA, 19 nt, Homo sapiens
guuauuucccucuguaaag

SEQ ID NO: 800442 - RNA, 19 nt, Homo sapiens
ugagugugagcauuuaaga

SEQ ID NO: 800443 - RNA, 19 nt, Homo sapiens
gcuguguucuuuuaaaauc

SEQ ID NO: 800444 - RNA, 19 nt, Homo sapiens
gugcaauagagcauagauu

SEQ ID NO: 800445 - RNA, 19 nt, Homo sapiens
cugcacuacaucaguauaa

SEQ ID NO: 800446 - RNA, 19 nt, Homo sapiens
gggaugggaagggauguga

SEQ ID NO: 800447 - RNA, 19 nt, Homo sapiens
aaagaucacaacugucaca

SEQ ID NO: 800448 - RNA, 19 nt, Homo sapiens
ccauugggcuaacuuugcu

SEQ ID NO: 800449 - RNA, 19 nt, Homo sapiens
gacaaggcagacaaagguu

SEQ ID NO: 800450 - RNA, 19 nt, Homo sapiens
ccaaaaggaaagaagaaaa

SEQ ID NO: 800451 - RNA, 19 nt, Homo sapiens
caaaaugaaacugauggua

SEQ ID NO: 800452 - RNA, 19 nt, Homo sapiens
ugugagcauuuaagaagca

SEQ ID NO: 800453 - RNA, 19 nt, Homo sapiens
caguauagcuugcaauuaa

SEQ ID NO: 800454 - RNA, 19 nt, Homo sapiens
gaaacuuccuguacauaaa

SEQ ID NO: 800455 - RNA, 19 nt, Homo sapiens
gacagaaucuucagacuau

SEQ ID NO: 800456 - RNA, 19 nt, Homo sapiens
agaggaaacuguucaagua

SEQ ID NO: 800457 - RNA, 19 nt, Homo sapiens
gaaaggagaugaguaugau

SEQ ID NO: 800458 - RNA, 19 nt, Homo sapiens
gaaacagacuucguaaaga

SEQ ID NO: 800459 - RNA, 19 nt, Homo sapiens
uaaggguucuguaguguua

SEQ ID NO: 800460 - RNA, 19 nt, Homo sapiens
ggaaacuguucaaguauug

SEQ ID NO: 800461 - RNA, 19 nt, Homo sapiens
guaugaagauggagacaaa

SEQ ID NO: 800462 - RNA, 19 nt, Homo sapiens
cuaauucucugaaagauga

SEQ ID NO: 800463 - RNA, 19 nt, Homo sapiens
gaaugaaaguauagccaaa

SEQ ID NO: 800464 - RNA, 19 nt, Homo sapiens
ugaacgggauuacaacaua

SEQ ID NO: 800465 - RNA, 19 nt, Homo sapiens
gugcagauuucaacacuuu

SEQ ID NO: 800466 - RNA, 19 nt, Homo sapiens
gaacauaccccuuuacuga

SEQ ID NO: 800467 - RNA, 19 nt, Homo sapiens
guauuuaucugccaagaau

SEQ ID NO: 800468 - RNA, 19 nt, Homo sapiens
gaacaugacagaaucuuca

SEQ ID NO: 800469 - RNA, 19 nt, Homo sapiens
cuaauucccuuccuuauca

SEQ ID NO: 800470 - RNA, 19 nt, Homo sapiens
aaacagacuucguaaagau

SEQ ID NO: 800471 - RNA, 19 nt, Homo sapiens
gggcaucugucucaucuug

SEQ ID NO: 800472 - RNA, 19 nt, Homo sapiens
cauagugccuccaccagua

SEQ ID NO: 800473 - RNA, 19 nt, Homo sapiens
uguagaaaguguagacuaa

SEQ ID NO: 800474 - RNA, 19 nt, Homo sapiens
ggaauauguucuggcauuu

SEQ ID NO: 800475 - RNA, 19 nt, Homo sapiens
caagaaaggagaugaguau

SEQ ID NO: 800476 - RNA, 19 nt, Homo sapiens
ugaccucccugcaagauuu

SEQ ID NO: 800477 - RNA, 19 nt, Homo sapiens
aaaguuaccuagaguuguu

SEQ ID NO: 800478 - RNA, 19 nt, Homo sapiens
gaaugccugugaacccaua

SEQ ID NO: 800479 - RNA, 19 nt, Homo sapiens
gaaaguguagacuaaugua

SEQ ID NO: 800480 - RNA, 19 nt, Homo sapiens
gaggggaguuugaauguua

SEQ ID NO: 800481 - RNA, 19 nt, Homo sapiens
gcuaauguuucugaacuuu

SEQ ID NO: 800482 - RNA, 19 nt, Homo sapiens
gaacgggauuacaacauag

SEQ ID NO: 800483 - RNA, 19 nt, Homo sapiens
gcacuuucaucguguuaau

SEQ ID NO: 800484 - RNA, 19 nt, Homo sapiens
gaagcacucaugcaacuuu

SEQ ID NO: 800485 - RNA, 19 nt, Homo sapiens
cagcaacuguuaauacuca

SEQ ID NO: 800486 - RNA, 19 nt, Homo sapiens
gaauauguucuggcauuua

SEQ ID NO: 800487 - RNA, 19 nt, Homo sapiens
gaaucccgcucacaucaga

SEQ ID NO: 800488 - RNA, 19 nt, Homo sapiens
gcaauuaagaccuagauca

SEQ ID NO: 800489 - RNA, 19 nt, Homo sapiens
ggauagacauagagcuaga

SEQ ID NO: 800490 - RNA, 19 nt, Homo sapiens
uaaacuauguacagaggaa

SEQ ID NO: 800491 - RNA, 19 nt, Homo sapiens
agaccuagaucacaguauu

SEQ ID NO: 800492 - RNA, 19 nt, Homo sapiens
cuucaaagauuucuguaga

SEQ ID NO: 800493 - RNA, 19 nt, Homo sapiens
guaacuauguagaaagugu

SEQ ID NO: 800494 - RNA, 19 nt, Homo sapiens
ggagaugaguaugauguau

SEQ ID NO: 800495 - RNA, 19 nt, Homo sapiens
uaagaaacuuccuguacau

SEQ ID NO: 800496 - RNA, 19 nt, Homo sapiens
agacauagagcuagaagaa

SEQ ID NO: 800497 - RNA, 19 nt, Homo sapiens
ccagcucuuugcauucuua

SEQ ID NO: 800498 - RNA, 19 nt, Homo sapiens
uggaauauguucuggcauu

SEQ ID NO: 800499 - RNA, 19 nt, Homo sapiens
cagaacuaaugauguauug

SEQ ID NO: 800500 - RNA, 19 nt, Homo sapiens
caacgacauugagguacua

SEQ ID NO: 800501 - RNA, 19 nt, Homo sapiens
auaauagacuggugcugua

SEQ ID NO: 800502 - RNA, 19 nt, Homo sapiens
uuaagaaacuuccuguaca

SEQ ID NO: 800503 - RNA, 19 nt, Homo sapiens
caauucaucuggcacuuuc

SEQ ID NO: 800504 - RNA, 19 nt, Homo sapiens
uagaaaguguagacuaaug

SEQ ID NO: 800505 - RNA, 19 nt, Homo sapiens
cagaucauauaccucuuaa

SEQ ID NO: 800506 - RNA, 19 nt, Homo sapiens
gagcagcuaauguuucuga

SEQ ID NO: 800507 - RNA, 19 nt, Homo sapiens
gugcggauauucagucaug

SEQ ID NO: 800508 - RNA, 19 nt, Homo sapiens
agacaguagucaagaagaa

SEQ ID NO: 800509 - RNA, 19 nt, Homo sapiens
ggagcggucuauacuagug

SEQ ID NO: 800510 - RNA, 19 nt, Homo sapiens
gaagacgacaaugaagaua

SEQ ID NO: 800511 - RNA, 19 nt, Homo sapiens
guagacccuuggcuaacua

SEQ ID NO: 800512 - RNA, 19 nt, Homo sapiens
guaguguuaucaaagcaaa

SEQ ID NO: 800513 - RNA, 19 nt, Homo sapiens
ggaagacgacaaugaagau

SEQ ID NO: 800514 - RNA, 19 nt, Homo sapiens
ggaugaguaugaagaugga

SEQ ID NO: 800515 - RNA, 19 nt, Homo sapiens
acauugagguacuaaagaa

SEQ ID NO: 800516 - RNA, 19 nt, Homo sapiens
caggagcggucuauacuag

SEQ ID NO: 800517 - RNA, 19 nt, Homo sapiens
ugacaguagugaugcagaa

SEQ ID NO: 800518 - RNA, 19 nt, Homo sapiens
ugacagaaucuucagacua

SEQ ID NO: 800519 - RNA, 19 nt, Homo sapiens
caucagaacaugacagaau

SEQ ID NO: 800520 - RNA, 19 nt, Homo sapiens
aaauugacauuccaucugu

SEQ ID NO: 800521 - RNA, 19 nt, Homo sapiens
caauucagcucuucuuuug

SEQ ID NO: 800522 - RNA, 19 nt, Homo sapiens
gaauuuagucuuccuuugg

SEQ ID NO: 800523 - RNA, 19 nt, Homo sapiens
gaucacaguauuuaagugu

SEQ ID NO: 800524 - RNA, 19 nt, Homo sapiens
uaugauguaugugccauuu

SEQ ID NO: 800525 - RNA, 19 nt, Homo sapiens
ugucucaucuugauaguca

SEQ ID NO: 800526 - RNA, 19 nt, Homo sapiens
ccugcaagauuugguuaua

SEQ ID NO: 800527 - RNA, 19 nt, Homo sapiens
ccacacaagucuacaccau

SEQ ID NO: 800528 - RNA, 19 nt, Homo sapiens
guucuguaguguuaucaaa

SEQ ID NO: 800529 - RNA, 19 nt, Homo sapiens
gcacaaagaaacucaaagc

SEQ ID NO: 800530 - RNA, 19 nt, Homo sapiens
ucaaggcgauucagacucu

SEQ ID NO: 800531 - RNA, 19 nt, Homo sapiens
ccauuuguuuggaugagua

SEQ ID NO: 800532 - RNA, 19 nt, Homo sapiens
gcaucugucucaucuugau

SEQ ID NO: 800533 - RNA, 19 nt, Homo sapiens
uggcaagacuguuuguguu

SEQ ID NO: 800534 - RNA, 19 nt, Homo sapiens
gaaaaugcaucucagacau

SEQ ID NO: 800535 - RNA, 19 nt, Homo sapiens
ucagaucauauaccucuua

SEQ ID NO: 800536 - RNA, 19 nt, Homo sapiens
caaacuucagcaacuguua

SEQ ID NO: 800537 - RNA, 19 nt, Homo sapiens
uucagaagaugauugguuu

SEQ ID NO: 800538 - RNA, 19 nt, Homo sapiens
ggugaaucaucagcuaauu

SEQ ID NO: 800539 - RNA, 19 nt, Homo sapiens
gcacagagagcaggauaca

SEQ ID NO: 800540 - RNA, 19 nt, Homo sapiens
gaggaaacuguucaaguau

SEQ ID NO: 800541 - RNA, 19 nt, Homo sapiens
ggacuucaagagagaaaga

SEQ ID NO: 800542 - RNA, 19 nt, Homo sapiens
ugaggaagacgacaaugaa

SEQ ID NO: 800543 - RNA, 19 nt, Homo sapiens
agaaacuuccuguacauaa

SEQ ID NO: 800544 - RNA, 19 nt, Homo sapiens
cagcuaauguuucugaacu

SEQ ID NO: 800545 - RNA, 19 nt, Homo sapiens
ugauguaugugccauuugu

SEQ ID NO: 800546 - RNA, 19 nt, Homo sapiens
agaaaggagaugaguauga

SEQ ID NO: 800547 - RNA, 19 nt, Homo sapiens
agaaacagacuucguaaag

SEQ ID NO: 800548 - RNA, 19 nt, Homo sapiens
caggauagacauagagcua

SEQ ID NO: 800549 - RNA, 19 nt, Homo sapiens
acacaagucuacaccaucu

SEQ ID NO: 800550 - RNA, 19 nt, Homo sapiens
cauuccaucugucuuuauu

SEQ ID NO: 800551 - RNA, 19 nt, Homo sapiens
gcagacauuuuagcauaua

SEQ ID NO: 800552 - RNA, 19 nt, Homo sapiens
ccauaaaguuaccuagagu

SEQ ID NO: 800553 - RNA, 19 nt, Homo sapiens
ggacaagacucucaagauu

SEQ ID NO: 800554 - RNA, 19 nt, Homo sapiens
agacagaggucgacauuua

SEQ ID NO: 800555 - RNA, 19 nt, Homo sapiens
acaagacucucaagauuua

SEQ ID NO: 800556 - RNA, 19 nt, Homo sapiens
ggagcuaguuucccaguuu

SEQ ID NO: 800557 - RNA, 19 nt, Homo sapiens
gugaugacaugaacuagua

SEQ ID NO: 800558 - RNA, 19 nt, Homo sapiens
gaaggugccuaccauguuc

SEQ ID NO: 800559 - RNA, 19 nt, Homo sapiens
cgaaagugcucaaccuugu

SEQ ID NO: 800560 - RNA, 19 nt, Homo sapiens
gacaagacucucaagauuu

SEQ ID NO: 800561 - RNA, 19 nt, Homo sapiens
ccaaggcccucaucuuugu

SEQ ID NO: 800562 - RNA, 19 nt, Homo sapiens
ccaacuccgucuuccauga

SEQ ID NO: 800563 - RNA, 19 nt, Homo sapiens
gcacaguggccgcuaugaa

SEQ ID NO: 800564 - RNA, 19 nt, Homo sapiens
gggccuaccugcucaugga

SEQ ID NO: 800565 - RNA, 19 nt, Homo sapiens
ggucgacauuuauaacuca

SEQ ID NO: 800566 - RNA, 19 nt, Homo sapiens
uaagacagaggucgacauu

SEQ ID NO: 800567 - RNA, 19 nt, Homo sapiens
gcaaacgccagcacauaau

SEQ ID NO: 800568 - RNA, 19 nt, Homo sapiens
ucucagauauggcuugcaa

SEQ ID NO: 800569 - RNA, 19 nt, Homo sapiens
gagcuaguuucccaguuuc

SEQ ID NO: 800570 - RNA, 19 nt, Homo sapiens
ugagggaacagcccgauuu

SEQ ID NO: 800571 - RNA, 19 nt, Homo sapiens
aaagugaugacaugaacua

SEQ ID NO: 800572 - RNA, 19 nt, Homo sapiens
gaaaagugaugacaugaac

SEQ ID NO: 800573 - RNA, 19 nt, Homo sapiens
ccagcggcauuuccgauga

SEQ ID NO: 800574 - RNA, 19 nt, Homo sapiens
acagaggucgacauuuaua

SEQ ID NO: 800575 - RNA, 19 nt, Homo sapiens
ugaaggugccuaccauguu

SEQ ID NO: 800576 - RNA, 19 nt, Homo sapiens
gacagaggucgacauuuau

SEQ ID NO: 800577 - RNA, 19 nt, Homo sapiens
gaugguagugucugacuuc

SEQ ID NO: 800578 - RNA, 19 nt, Homo sapiens
gagggaacagcccgauuug

SEQ ID NO: 800579 - RNA, 19 nt, Homo sapiens
caacuccgucuuccaugaa

SEQ ID NO: 800580 - RNA, 19 nt, Homo sapiens
gggauguguugcagcaugu

SEQ ID NO: 800581 - RNA, 19 nt, Homo sapiens
ucuccaggcugucgugguu

SEQ ID NO: 800582 - RNA, 19 nt, Homo sapiens
cuagcgauuuguuuaggaa

SEQ ID NO: 800583 - RNA, 19 nt, Homo sapiens
gaaagugcucaaccuugug

SEQ ID NO: 800584 - RNA, 19 nt, Homo sapiens
ggaugguagugucugacuu

SEQ ID NO: 800585 - RNA, 19 nt, Homo sapiens
acccaaggcccucaucuuu

SEQ ID NO: 800586 - RNA, 19 nt, Homo sapiens
ugcaaacgccagcacauaa

SEQ ID NO: 800587 - RNA, 19 nt, Homo sapiens
cgucuuccaugaaauaaac

SEQ ID NO: 800588 - RNA, 19 nt, Homo sapiens
gccaagagccaggacaaga

SEQ ID NO: 800589 - RNA, 19 nt, Homo sapiens
caaacgccagcacauaaug

SEQ ID NO: 800590 - RNA, 19 nt, Homo sapiens
gagacgcacaggaagcaaa

SEQ ID NO: 800591 - RNA, 19 nt, Homo sapiens
cagaggucgacauuuauaa

SEQ ID NO: 800592 - RNA, 19 nt, Homo sapiens
agcgugcucucucggaaua

SEQ ID NO: 800593 - RNA, 19 nt, Homo sapiens
gugucugacuuccacguuu

SEQ ID NO: 800594 - RNA, 19 nt, Homo sapiens
cgauuugccugguucugau

SEQ ID NO: 800595 - RNA, 19 nt, Homo sapiens
gguccuugcugcgaaagug

SEQ ID NO: 800596 - RNA, 19 nt, Homo sapiens
agaggaugguagugucuga

SEQ ID NO: 800597 - RNA, 19 nt, Homo sapiens
ggcuggaccugcugguguu

SEQ ID NO: 800598 - RNA, 19 nt, Homo sapiens
ucucaagauuuaugaaggu

SEQ ID NO: 800599 - RNA, 19 nt, Homo sapiens
gaaucugcaacaacuuuca

SEQ ID NO: 800600 - RNA, 19 nt, Homo sapiens
ggaaaagugaugacaugaa

SEQ ID NO: 800601 - RNA, 19 nt, Homo sapiens
ugucggagacgcacaggaa

SEQ ID NO: 800602 - RNA, 19 nt, Homo sapiens
gagcacaguggccgcuaug

SEQ ID NO: 800603 - RNA, 19 nt, Homo sapiens
gauggcuucucagauaugg

SEQ ID NO: 800604 - RNA, 19 nt, Homo sapiens
uuaugaaggugccuaccau

SEQ ID NO: 800605 - RNA, 19 nt, Homo sapiens
cugaaucugcaacaacuuu

SEQ ID NO: 800606 - RNA, 19 nt, Homo sapiens
uaggaaaagugaugacaug

SEQ ID NO: 800607 - RNA, 19 nt, Homo sapiens
acaugugggucucucaaag

SEQ ID NO: 800608 - RNA, 19 nt, Homo sapiens
ccuaccugcucauggaguu

SEQ ID NO: 800609 - RNA, 19 nt, Homo sapiens
agacggacaguaccucuuc

SEQ ID NO: 800610 - RNA, 19 nt, Homo sapiens
caaugcagacggacaguac

SEQ ID NO: 800611 - RNA, 19 nt, Homo sapiens
aaacaugugggucucucaa

SEQ ID NO: 800612 - RNA, 19 nt, Homo sapiens
ccuaccauguucuccacaa

SEQ ID NO: 800613 - RNA, 19 nt, Homo sapiens
cccaaggcccucaucuuug

SEQ ID NO: 800614 - RNA, 19 nt, Homo sapiens
gccuugggcacccgcauuu

SEQ ID NO: 800615 - RNA, 19 nt, Homo sapiens
ucauggaguuagccaagag

SEQ ID NO: 800616 - RNA, 19 nt, Homo sapiens
ggugugcgcggagcuaguu

SEQ ID NO: 800617 - RNA, 19 nt, Homo sapiens
cacaguggccgcuaugaag

SEQ ID NO: 800618 - RNA, 19 nt, Homo sapiens
ggagaggaugguagugucu

SEQ ID NO: 800619 - RNA, 19 nt, Homo sapiens
gguguucgcccacgaccau

SEQ ID NO: 800620 - RNA, 19 nt, Homo sapiens
cgccagcacauaauggaaa

SEQ ID NO: 800621 - RNA, 19 nt, Homo sapiens
cggaagagcugaaggaauu

SEQ ID NO: 800622 - RNA, 19 nt, Homo sapiens
gcacagcccagaaaccuuu

SEQ ID NO: 800623 - RNA, 19 nt, Homo sapiens
agagagagcuccagcagau

SEQ ID NO: 800624 - RNA, 19 nt, Homo sapiens
acacagagcccacggaugu

SEQ ID NO: 800625 - RNA, 19 nt, Homo sapiens
uuaacgaggugaagacaga

SEQ ID NO: 800626 - RNA, 19 nt, Homo sapiens
agaugaagcuggaccuaga

SEQ ID NO: 800627 - RNA, 19 nt, Homo sapiens
gcugggaucaggacuauga

SEQ ID NO: 800628 - RNA, 19 nt, Homo sapiens
ugaaggaugaccucucuuu

SEQ ID NO: 800629 - RNA, 19 nt, Homo sapiens
ggguacaagugcagcauca

SEQ ID NO: 800630 - RNA, 19 nt, Homo sapiens
uccagcagcucaagcagaa

SEQ ID NO: 800631 - RNA, 19 nt, Homo sapiens
gagcugaaggaauucuuug

SEQ ID NO: 800632 - RNA, 19 nt, Homo sapiens
augguugaaugcuguauuu

SEQ ID NO: 800633 - RNA, 19 nt, Homo sapiens
cagcagauccgcauuaacg

SEQ ID NO: 800634 - RNA, 19 nt, Homo sapiens
ccaccgggcuggcauuuug

SEQ ID NO: 800635 - RNA, 19 nt, Homo sapiens
ggagaucgccaagaaaauu

SEQ ID NO: 800636 - RNA, 19 nt, Homo sapiens
ccacggaagagcugaagga

SEQ ID NO: 800637 - RNA, 19 nt, Homo sapiens
ccuugagucuguaguguuc

SEQ ID NO: 800638 - RNA, 19 nt, Homo sapiens
ucuacaagcacacccauga

SEQ ID NO: 800639 - RNA, 19 nt, Homo sapiens
gcuaccacuucuuccucua

SEQ ID NO: 800640 - RNA, 19 nt, Homo sapiens
gagguggccacaucaagga

SEQ ID NO: 800641 - RNA, 19 nt, Homo sapiens
guuuggagguggccacauc

SEQ ID NO: 800642 - RNA, 19 nt, Homo sapiens
ccgcugggaucaggacuau

SEQ ID NO: 800643 - RNA, 19 nt, Homo sapiens
ccaagcaacacgccuucaa

SEQ ID NO: 800644 - RNA, 19 nt, Homo sapiens
guacaagugcagcaucaag

SEQ ID NO: 800645 - RNA, 19 nt, Homo sapiens
uccagcagauccgcauuaa

SEQ ID NO: 800646 - RNA, 19 nt, Homo sapiens
gaaggaugaccucucuuuu

SEQ ID NO: 800647 - RNA, 19 nt, Homo sapiens
ugugaaggaugaccucucu

SEQ ID NO: 800648 - RNA, 19 nt, Homo sapiens
ucgggacugugaaggauga

SEQ ID NO: 800649 - RNA, 19 nt, Homo sapiens
gaugguugaaugcuguauu

SEQ ID NO: 800650 - RNA, 19 nt, Homo sapiens
gaaaauggucaacuacauc

SEQ ID NO: 800651 - RNA, 19 nt, Homo sapiens
acagagaucaguguggaaa

SEQ ID NO: 800652 - RNA, 19 nt, Homo sapiens
cagaaaccuuuggccacaa

SEQ ID NO: 800653 - RNA, 19 nt, Homo sapiens
gagcucuucgggacuguga

SEQ ID NO: 800654 - RNA, 19 nt, Homo sapiens
caagcaacacgccuucaag

SEQ ID NO: 800655 - RNA, 19 nt, Homo sapiens
ugaccucggcugagagaga

SEQ ID NO: 800656 - RNA, 19 nt, Homo sapiens
gcucuaccgccucgacuca

SEQ ID NO: 800657 - RNA, 19 nt, Homo sapiens
ggagcaggacuuccaucug

SEQ ID NO: 800658 - RNA, 19 nt, Homo sapiens
cgccucgacucacagaaug

SEQ ID NO: 800659 - RNA, 19 nt, Homo sapiens
agaaaccuuuggccacaag

SEQ ID NO: 800660 - RNA, 19 nt, Homo sapiens
agucuguaguguucaucua

SEQ ID NO: 800661 - RNA, 19 nt, Homo sapiens
cuagagcgggaaaccauug

SEQ ID NO: 800662 - RNA, 19 nt, Homo sapiens
ugaagacagagaucagugu

SEQ ID NO: 800663 - RNA, 19 nt, Homo sapiens
gcucugugcggcucaucaa

SEQ ID NO: 800664 - RNA, 19 nt, Homo sapiens
gaggugaagacagagauca

SEQ ID NO: 800665 - RNA, 19 nt, Homo sapiens
ggacugagcuaauuuguuc

SEQ ID NO: 800666 - RNA, 19 nt, Homo sapiens
ggaaggugaugcauuuauu

SEQ ID NO: 800667 - RNA, 19 nt, Homo sapiens
ugagguaggugcgguauua

SEQ ID NO: 800668 - RNA, 19 nt, Homo sapiens
ggauccagcuuccuucuga

SEQ ID NO: 800669 - RNA, 19 nt, Homo sapiens
gguuaugcuugaaguguua

SEQ ID NO: 800670 - RNA, 19 nt, Homo sapiens
caccguaacugcuugugua

SEQ ID NO: 800671 - RNA, 19 nt, Homo sapiens
aagggaaggugaugcauuu

SEQ ID NO: 800672 - RNA, 19 nt, Homo sapiens
cagaaccucuucacauaga

SEQ ID NO: 800673 - RNA, 19 nt, Homo sapiens
accagaaccucuucacaua

SEQ ID NO: 800674 - RNA, 19 nt, Homo sapiens
gagcuaauuuguuccucuu

SEQ ID NO: 800675 - RNA, 19 nt, Homo sapiens
cagaacacuugcuucacua

SEQ ID NO: 800676 - RNA, 19 nt, Homo sapiens
ugggacagcuuuacgagaa

SEQ ID NO: 800677 - RNA, 19 nt, Homo sapiens
aaacuuguccuucuggaaa

SEQ ID NO: 800678 - RNA, 19 nt, Homo sapiens
cgacaggguuccggugauu

SEQ ID NO: 800679 - RNA, 19 nt, Homo sapiens
gcuaauuuguuccucuuuc

SEQ ID NO: 800680 - RNA, 19 nt, Homo sapiens
gcucucagauuguugacau

SEQ ID NO: 800681 - RNA, 19 nt, Homo sapiens
gaaggugaugcauuuauuc

SEQ ID NO: 800682 - RNA, 19 nt, Homo sapiens
gcuuguguaucuuguaaau

SEQ ID NO: 800683 - RNA, 19 nt, Homo sapiens
guacuugguuccaucugau

SEQ ID NO: 800684 - RNA, 19 nt, Homo sapiens
ggucucaggcucucagauu

SEQ ID NO: 800685 - RNA, 19 nt, Homo sapiens
ucagaacacuugcuucacu

SEQ ID NO: 800686 - RNA, 19 nt, Homo sapiens
ccuauuagugcauuuguaa

SEQ ID NO: 800687 - RNA, 19 nt, Homo sapiens
ucauguggaucaucaggaa

SEQ ID NO: 800688 - RNA, 19 nt, Homo sapiens
gaacacuugcuucacuaga

SEQ ID NO: 800689 - RNA, 19 nt, Homo sapiens
gcauuuguaacuggauuua

SEQ ID NO: 800690 - RNA, 19 nt, Homo sapiens
gaaacuuguccuucuggaa

SEQ ID NO: 800691 - RNA, 19 nt, Homo sapiens
ccacaguccagccuaacua

SEQ ID NO: 800692 - RNA, 19 nt, Homo sapiens
gauaagacagucccacagu

SEQ ID NO: 800693 - RNA, 19 nt, Homo sapiens
cguaacugcuuguguaucu

SEQ ID NO: 800694 - RNA, 19 nt, Homo sapiens
uaacuaugggacagcuuua

SEQ ID NO: 800695 - RNA, 19 nt, Homo sapiens
ggguuaugcuugaaguguu

SEQ ID NO: 800696 - RNA, 19 nt, Homo sapiens
gggaaggugaugcauuuau

SEQ ID NO: 800697 - RNA, 19 nt, Homo sapiens
gcagucagaacacuugcuu

SEQ ID NO: 800698 - RNA, 19 nt, Homo sapiens
augcauuuauucuggguua

SEQ ID NO: 800699 - RNA, 19 nt, Homo sapiens
cugcuuguguaucuuguaa

SEQ ID NO: 800700 - RNA, 19 nt, Homo sapiens
gaacacuuuuggcuucuga

SEQ ID NO: 800701 - RNA, 19 nt, Homo sapiens
acacuugcuucacuagaau

SEQ ID NO: 800702 - RNA, 19 nt, Homo sapiens
aaggcgaucuuccuguuug

SEQ ID NO: 800703 - RNA, 19 nt, Homo sapiens
gauccagcuuccuucugaa

SEQ ID NO: 800704 - RNA, 19 nt, Homo sapiens
gaauaugccaacugccaau

SEQ ID NO: 800705 - RNA, 19 nt, Homo sapiens
aacacuugcuucacuagaa

SEQ ID NO: 800706 - RNA, 19 nt, Homo sapiens
gugcauuuguaacuggauu

SEQ ID NO: 800707 - RNA, 19 nt, Homo sapiens
uaacugcuuguguaucuug

SEQ ID NO: 800708 - RNA, 19 nt, Homo sapiens
ugggcuaggugcaccguaa

SEQ ID NO: 800709 - RNA, 19 nt, Homo sapiens
uaggugcgguauuaaagug

SEQ ID NO: 800710 - RNA, 19 nt, Homo sapiens
ggugcgguauuaaagugaa

SEQ ID NO: 800711 - RNA, 19 nt, Homo sapiens
gcucaguucauguggauca

SEQ ID NO: 800712 - RNA, 19 nt, Homo sapiens
gguaggugcgguauuaaag

SEQ ID NO: 800713 - RNA, 19 nt, Homo sapiens
caguucauguggaucauca

SEQ ID NO: 800714 - RNA, 19 nt, Homo sapiens
caaacggaaguacuugguu

SEQ ID NO: 800715 - RNA, 19 nt, Homo sapiens
cuaauuuguuccucuuucu

SEQ ID NO: 800716 - RNA, 19 nt, Homo sapiens
aaagggaaggugaugcauu

SEQ ID NO: 800717 - RNA, 19 nt, Homo sapiens
cuggaaaucauauugaaug

SEQ ID NO: 800718 - RNA, 19 nt, Homo sapiens
gucucaggcucucagauug

SEQ ID NO: 800719 - RNA, 19 nt, Homo sapiens
cuaacuaugggacagcuuu

SEQ ID NO: 800720 - RNA, 19 nt, Homo sapiens
uauucuggguuaugcuuga

SEQ ID NO: 800721 - RNA, 19 nt, Homo sapiens
gcauuuauucuggguuaug

SEQ ID NO: 800722 - RNA, 19 nt, Homo sapiens
gaaguacuugguuccaucu

SEQ ID NO: 800723 - RNA, 19 nt, Homo sapiens
ggccauugcugggcuaggu

SEQ ID NO: 800724 - RNA, 19 nt, Homo sapiens
aaaaggcgaucuuccuguu

SEQ ID NO: 800725 - RNA, 19 nt, Homo sapiens
ugacaaacggaaguacuug

SEQ ID NO: 800726 - RNA, 19 nt, Homo sapiens
ccaaauuaaauccuuagca

SEQ ID NO: 800727 - RNA, 19 nt, Homo sapiens
gagguaggugcgguauuaa

SEQ ID NO: 800728 - RNA, 19 nt, Homo sapiens
ccagaaccucuucacauag

SEQ ID NO: 800729 - RNA, 19 nt, Homo sapiens
uaccagaaccucuucacau

SEQ ID NO: 800730 - RNA, 19 nt, Homo sapiens
guaacugcuuguguaucuu

SEQ ID NO: 800731 - RNA, 19 nt, Homo sapiens
gugcgguauuaaagugaaa

SEQ ID NO: 800732 - RNA, 19 nt, Homo sapiens
guaggugcgguauuaaagu

SEQ ID NO: 800733 - RNA, 19 nt, Homo sapiens
gcaccguaacugcuugugu

SEQ ID NO: 800734 - RNA, 19 nt, Homo sapiens
gucccacaguccagccuaa

SEQ ID NO: 800735 - RNA, 19 nt, Homo sapiens
aguacuugguuccaucuga

SEQ ID NO: 800736 - RNA, 19 nt, Homo sapiens
ugaaagggaaggugaugca

SEQ ID NO: 800737 - RNA, 19 nt, Homo sapiens
ggaggaccacucgcuggaa

SEQ ID NO: 800738 - RNA, 19 nt, Homo sapiens
agucagaacacuugcuuca

SEQ ID NO: 800739 - RNA, 19 nt, Homo sapiens
gaaagggaaggugaugcau

SEQ ID NO: 800740 - RNA, 19 nt, Homo sapiens
uggcucaguucauguggau

SEQ ID NO: 800741 - RNA, 19 nt, Homo sapiens
gggacagcuuuacgagaag

SEQ ID NO: 800742 - RNA, 19 nt, Homo sapiens
aaaggcgaucuuccuguuu

SEQ ID NO: 800743 - RNA, 19 nt, Homo sapiens
cauguuggacugagcuaau

SEQ ID NO: 800744 - RNA, 19 nt, Homo sapiens
gguuccaucugauaucacu

SEQ ID NO: 800745 - RNA, 19 nt, Homo sapiens
agccagccauuuucaguua

SEQ ID NO: 800746 - RNA, 19 nt, Homo sapiens
ggacugagcuaauuuguuc

SEQ ID NO: 800747 - RNA, 19 nt, Homo sapiens
ggaaggugaugcauuuauu

SEQ ID NO: 800748 - RNA, 19 nt, Homo sapiens
ugagguaggugcgguauua

SEQ ID NO: 800749 - RNA, 19 nt, Homo sapiens
ggauccagcuuccuucuga

SEQ ID NO: 800750 - RNA, 19 nt, Homo sapiens
gguuaugcuugaaguguua

SEQ ID NO: 800751 - RNA, 19 nt, Homo sapiens
caccguaacugcuugugua

SEQ ID NO: 800752 - RNA, 19 nt, Homo sapiens
aagggaaggugaugcauuu

SEQ ID NO: 800753 - RNA, 19 nt, Homo sapiens
cagaaccucuucacauaga

SEQ ID NO: 800754 - RNA, 19 nt, Homo sapiens
accagaaccucuucacaua

SEQ ID NO: 800755 - RNA, 19 nt, Homo sapiens
gagcuaauuuguuccucuu

SEQ ID NO: 800756 - RNA, 19 nt, Homo sapiens
cagaacacuugcuucacua

SEQ ID NO: 800757 - RNA, 19 nt, Homo sapiens
ugggacagcuuuacgagaa

SEQ ID NO: 800758 - RNA, 19 nt, Homo sapiens
aaacuuguccuucuggaaa

SEQ ID NO: 800759 - RNA, 19 nt, Homo sapiens
cgacaggguuccggugauu

SEQ ID NO: 800760 - RNA, 19 nt, Homo sapiens
gcuaauuuguuccucuuuc

SEQ ID NO: 800761 - RNA, 19 nt, Homo sapiens
gcucucagauuguugacau

SEQ ID NO: 800762 - RNA, 19 nt, Homo sapiens
gaaggugaugcauuuauuc

SEQ ID NO: 800763 - RNA, 19 nt, Homo sapiens
gcuuguguaucuuguaaau

SEQ ID NO: 800764 - RNA, 19 nt, Homo sapiens
guacuugguuccaucugau

SEQ ID NO: 800765 - RNA, 19 nt, Homo sapiens
ggucucaggcucucagauu

SEQ ID NO: 800766 - RNA, 19 nt, Homo sapiens
ucagaacacuugcuucacu

SEQ ID NO: 800767 - RNA, 19 nt, Homo sapiens
ccuauuagugcauuuguaa

SEQ ID NO: 800768 - RNA, 19 nt, Homo sapiens
ucauguggaucaucaggaa

SEQ ID NO: 800769 - RNA, 19 nt, Homo sapiens
gaacacuugcuucacuaga

SEQ ID NO: 800770 - RNA, 19 nt, Homo sapiens
gcauuuguaacuggauuua

SEQ ID NO: 800771 - RNA, 19 nt, Homo sapiens
gaaacuuguccuucuggaa

SEQ ID NO: 800772 - RNA, 19 nt, Homo sapiens
ccacaguccagccuaacua

SEQ ID NO: 800773 - RNA, 19 nt, Homo sapiens
gauaagacagucccacagu

SEQ ID NO: 800774 - RNA, 19 nt, Homo sapiens
cguaacugcuuguguaucu

SEQ ID NO: 800775 - RNA, 19 nt, Homo sapiens
uaacuaugggacagcuuua

SEQ ID NO: 800776 - RNA, 19 nt, Homo sapiens
ggguuaugcuugaaguguu

SEQ ID NO: 800777 - RNA, 19 nt, Homo sapiens
gggaaggugaugcauuuau

SEQ ID NO: 800778 - RNA, 19 nt, Homo sapiens
gcagucagaacacuugcuu

SEQ ID NO: 800779 - RNA, 19 nt, Homo sapiens
augcauuuauucuggguua

SEQ ID NO: 800780 - RNA, 19 nt, Homo sapiens
cugcuuguguaucuuguaa

SEQ ID NO: 800781 - RNA, 19 nt, Homo sapiens
gaacacuuuuggcuucuga

SEQ ID NO: 800782 - RNA, 19 nt, Homo sapiens
acacuugcuucacuagaau

SEQ ID NO: 800783 - RNA, 19 nt, Homo sapiens
aaggcgaucuuccuguuug

SEQ ID NO: 800784 - RNA, 19 nt, Homo sapiens
gauccagcuuccuucugaa

SEQ ID NO: 800785 - RNA, 19 nt, Homo sapiens
gaauaugccaacugccaau

SEQ ID NO: 800786 - RNA, 19 nt, Homo sapiens
aacacuugcuucacuagaa

SEQ ID NO: 800787 - RNA, 19 nt, Homo sapiens
gugcauuuguaacuggauu

SEQ ID NO: 800788 - RNA, 19 nt, Homo sapiens
uaacugcuuguguaucuug

SEQ ID NO: 800789 - RNA, 19 nt, Homo sapiens
ugggcuaggugcaccguaa

SEQ ID NO: 800790 - RNA, 19 nt, Homo sapiens
uaggugcgguauuaaagug

SEQ ID NO: 800791 - RNA, 19 nt, Homo sapiens
ggugcgguauuaaagugaa

SEQ ID NO: 800792 - RNA, 19 nt, Homo sapiens
gcucaguucauguggauca

SEQ ID NO: 800793 - RNA, 19 nt, Homo sapiens
gguaggugcgguauuaaag

SEQ ID NO: 800794 - RNA, 19 nt, Homo sapiens
caguucauguggaucauca

SEQ ID NO: 800795 - RNA, 19 nt, Homo sapiens
caaacggaaguacuugguu

SEQ ID NO: 800796 - RNA, 19 nt, Homo sapiens
cuaauuuguuccucuuucu

SEQ ID NO: 800797 - RNA, 19 nt, Homo sapiens
aaagggaaggugaugcauu

SEQ ID NO: 800798 - RNA, 19 nt, Homo sapiens
cuggaaaucauauugaaug

SEQ ID NO: 800799 - RNA, 19 nt, Homo sapiens
gucucaggcucucagauug

SEQ ID NO: 800800 - RNA, 19 nt, Homo sapiens
cuaacuaugggacagcuuu

SEQ ID NO: 800801 - RNA, 19 nt, Homo sapiens
uauucuggguuaugcuuga

SEQ ID NO: 800802 - RNA, 19 nt, Homo sapiens
gcauuuauucuggguuaug

SEQ ID NO: 800803 - RNA, 19 nt, Homo sapiens
gaaguacuugguuccaucu

SEQ ID NO: 800804 - RNA, 19 nt, Homo sapiens
ggccauugcugggcuaggu

SEQ ID NO: 800805 - RNA, 19 nt, Homo sapiens
aaaaggcgaucuuccuguu

SEQ ID NO: 800806 - RNA, 19 nt, Homo sapiens
ugacaaacggaaguacuug

SEQ ID NO: 800807 - RNA, 19 nt, Homo sapiens
ccaaauuaaauccuuagca

SEQ ID NO: 800808 - RNA, 19 nt, Homo sapiens
gagguaggugcgguauuaa

SEQ ID NO: 800809 - RNA, 19 nt, Homo sapiens
ccagaaccucuucacauag

SEQ ID NO: 800810 - RNA, 19 nt, Homo sapiens
uaccagaaccucuucacau

SEQ ID NO: 800811 - RNA, 19 nt, Homo sapiens
guaacugcuuguguaucuu

SEQ ID NO: 800812 - RNA, 19 nt, Homo sapiens
gugcgguauuaaagugaaa

SEQ ID NO: 800813 - RNA, 19 nt, Homo sapiens
guaggugcgguauuaaagu

SEQ ID NO: 800814 - RNA, 19 nt, Homo sapiens
gcaccguaacugcuugugu

SEQ ID NO: 800815 - RNA, 19 nt, Homo sapiens
gucccacaguccagccuaa

SEQ ID NO: 800816 - RNA, 19 nt, Homo sapiens
aguacuugguuccaucuga

SEQ ID NO: 800817 - RNA, 19 nt, Homo sapiens
ugaaagggaaggugaugca

SEQ ID NO: 800818 - RNA, 19 nt, Homo sapiens
ggaggaccacucgcuggaa

SEQ ID NO: 800819 - RNA, 19 nt, Homo sapiens
agucagaacacuugcuuca

SEQ ID NO: 800820 - RNA, 19 nt, Homo sapiens
gaaagggaaggugaugcau

SEQ ID NO: 800821 - RNA, 19 nt, Homo sapiens
uggcucaguucauguggau

SEQ ID NO: 800822 - RNA, 19 nt, Homo sapiens
gggacagcuuuacgagaag

SEQ ID NO: 800823 - RNA, 19 nt, Homo sapiens
aaaggcgaucuuccuguuu

SEQ ID NO: 800824 - RNA, 19 nt, Homo sapiens
cauguuggacugagcuaau

SEQ ID NO: 800825 - RNA, 19 nt, Homo sapiens
gguuccaucugauaucacu

SEQ ID NO: 800826 - RNA, 19 nt, Homo sapiens
agccagccauuuucaguua

SEQ ID NO: 800827 - RNA, 19 nt, Homo sapiens
gcaaauccauguuuacuuu

SEQ ID NO: 800828 - RNA, 19 nt, Homo sapiens
ccacagagccugccacuuu

SEQ ID NO: 800829 - RNA, 19 nt, Homo sapiens
gcagcacacuccuaauuga

SEQ ID NO: 800830 - RNA, 19 nt, Homo sapiens
ccaccaaggucuacaguga

SEQ ID NO: 800831 - RNA, 19 nt, Homo sapiens
agucacggauggagaaaua

SEQ ID NO: 800832 - RNA, 19 nt, Homo sapiens
ccaccgaugucaaucagaa

SEQ ID NO: 800833 - RNA, 19 nt, Homo sapiens
gcacacuccuaauugacaa

SEQ ID NO: 800834 - RNA, 19 nt, Homo sapiens
uggagaagguggccaguga

SEQ ID NO: 800835 - RNA, 19 nt, Homo sapiens
ccaccaagcagccgccaua

SEQ ID NO: 800836 - RNA, 19 nt, Homo sapiens
ccagcucccugcucauuga

SEQ ID NO: 800837 - RNA, 19 nt, Homo sapiens
gccaaggucucaccaagag

SEQ ID NO: 800838 - RNA, 19 nt, Homo sapiens
gcccaacucccaucuaaug

SEQ ID NO: 800839 - RNA, 19 nt, Homo sapiens
ucaaggagccugccaaggu

SEQ ID NO: 800840 - RNA, 19 nt, Homo sapiens
cagagaagcuacgcucauc

SEQ ID NO: 800841 - RNA, 19 nt, Homo sapiens
gucagcagaucaagagaug

SEQ ID NO: 800842 - RNA, 19 nt, Homo sapiens
gaacccaccggcaacuguu

SEQ ID NO: 800843 - RNA, 19 nt, Homo sapiens
ggucuccucccucauauuc

SEQ ID NO: 800844 - RNA, 19 nt, Homo sapiens
ucaccacaccaacuucuaa

SEQ ID NO: 800845 - RNA, 19 nt, Homo sapiens
gggcugcaccugucccaaa

SEQ ID NO: 800846 - RNA, 19 nt, Homo sapiens
aggcccaacucccaucuaa

SEQ ID NO: 800847 - RNA, 19 nt, Homo sapiens
guacagacagcggaugaga

SEQ ID NO: 800848 - RNA, 19 nt, Homo sapiens
agccgcaaauccauguuua

SEQ ID NO: 800849 - RNA, 19 nt, Homo sapiens
ccucauauucuguccugua

SEQ ID NO: 800850 - RNA, 19 nt, Homo sapiens
cacagagccugccacuuuc

SEQ ID NO: 800851 - RNA, 19 nt, Homo sapiens
ccaagcagccgccauacca

SEQ ID NO: 800852 - RNA, 19 nt, Homo sapiens
acuccuaauugacaaggua

SEQ ID NO: 800853 - RNA, 19 nt, Homo sapiens
gagaugcagcacacuccua

SEQ ID NO: 800854 - RNA, 19 nt, Homo sapiens
gaaauaugucaucgagucu

SEQ ID NO: 800855 - RNA, 19 nt, Homo sapiens
cauauucuguccuguaucc

SEQ ID NO: 800856 - RNA, 19 nt, Homo sapiens
cccaggcccuccuucucua

SEQ ID NO: 800857 - RNA, 19 nt, Homo sapiens
aauaugucaucgagucuuc

SEQ ID NO: 800858 - RNA, 19 nt, Homo sapiens
ccaccuacacugagaccuu

SEQ ID NO: 800859 - RNA, 19 nt, Homo sapiens
cugcagaugucaaccaaaa

SEQ ID NO: 800860 - RNA, 19 nt, Homo sapiens
ccaagucuucucaucugaa

SEQ ID NO: 800861 - RNA, 19 nt, Homo sapiens
cucauauucuguccuguau

SEQ ID NO: 800862 - RNA, 19 nt, Homo sapiens
agaugcagcacacuccuaa

SEQ ID NO: 800863 - RNA, 19 nt, Homo sapiens
ucuagcauccaacagaauu

SEQ ID NO: 800864 - RNA, 19 nt, Homo sapiens
ucacggauggagaaauaug

SEQ ID NO: 800865 - RNA, 19 nt, Homo sapiens
cuagagagacgacauuuug

SEQ ID NO: 800866 - RNA, 19 nt, Homo sapiens
ucuaacagcagccacaauc

SEQ ID NO: 800867 - RNA, 19 nt, Homo sapiens
ggugucagcagaucaagag

SEQ ID NO: 800868 - RNA, 19 nt, Homo sapiens
gcccaucaccuaccauguc

SEQ ID NO: 800869 - RNA, 19 nt, Homo sapiens
acagacagcggaugagaag

SEQ ID NO: 800870 - RNA, 19 nt, Homo sapiens
cccaagucuucucaucuga

SEQ ID NO: 800871 - RNA, 19 nt, Homo sapiens
cagcagaucaagagauguc

SEQ ID NO: 800872 - RNA, 19 nt, Homo sapiens
gccagucacggauggagaa

SEQ ID NO: 800873 - RNA, 19 nt, Homo sapiens
uuuguccucucaccuauca

SEQ ID NO: 800874 - RNA, 19 nt, Homo sapiens
cagccgcaaauccauguuu

SEQ ID NO: 800875 - RNA, 19 nt, Homo sapiens
gcucccugcucauugacau

SEQ ID NO: 800876 - RNA, 19 nt, Homo sapiens
gcccaaacccaaccagaac

SEQ ID NO: 800877 - RNA, 19 nt, Homo sapiens
caaauccauguuuacuuuc

SEQ ID NO: 800878 - RNA, 19 nt, Homo sapiens
ccagagaagcuacgcucau

SEQ ID NO: 800879 - RNA, 19 nt, Homo sapiens
augcagcacacuccuaauu

SEQ ID NO: 800880 - RNA, 19 nt, Homo sapiens
cggcugaggaggugagaug

SEQ ID NO: 800881 - RNA, 19 nt, Homo sapiens
ggaaauaacuaagagauuc

SEQ ID NO: 800882 - RNA, 19 nt, Homo sapiens
ggcaagggcuccuaucuuu

SEQ ID NO: 800883 - RNA, 19 nt, Homo sapiens
gagaggcacuuaaucugua

SEQ ID NO: 800884 - RNA, 19 nt, Homo sapiens
ggacauuuauuaacaggaa

SEQ ID NO: 800885 - RNA, 19 nt, Homo sapiens
gguaggagcccuucucuuu

SEQ ID NO: 800886 - RNA, 19 nt, Homo sapiens
gacauucgcucagcucaua

SEQ ID NO: 800887 - RNA, 19 nt, Homo sapiens
ccaaggacauuuauuaaca

SEQ ID NO: 800888 - RNA, 19 nt, Homo sapiens
ccaccaaggacauuuauua

SEQ ID NO: 800889 - RNA, 19 nt, Homo sapiens
gaagaauccagcauacaua

SEQ ID NO: 800890 - RNA, 19 nt, Homo sapiens
caucaaaccucgaagaauc

SEQ ID NO: 800891 - RNA, 19 nt, Homo sapiens
aaauacagcuggcuaucua

SEQ ID NO: 800892 - RNA, 19 nt, Homo sapiens
aagaagaacucgaaccaaa

SEQ ID NO: 800893 - RNA, 19 nt, Homo sapiens
ucauugcucuuuaugguua

SEQ ID NO: 800894 - RNA, 19 nt, Homo sapiens
gcauuuggaugaugaugaa

SEQ ID NO: 800895 - RNA, 19 nt, Homo sapiens
caucuucacucuucacuug

SEQ ID NO: 800896 - RNA, 19 nt, Homo sapiens
uguauucccuuaacucuaa

SEQ ID NO: 800897 - RNA, 19 nt, Homo sapiens
ccucaucuguauccuaaua

SEQ ID NO: 800898 - RNA, 19 nt, Homo sapiens
ggagggacauuacuaugau

SEQ ID NO: 800899 - RNA, 19 nt, Homo sapiens
gagugaagauggcauugaa

SEQ ID NO: 800900 - RNA, 19 nt, Homo sapiens
ugaagaaggugaauacagu

SEQ ID NO: 800901 - RNA, 19 nt, Homo sapiens
ugaaacaagucuagucuuc

SEQ ID NO: 800902 - RNA, 19 nt, Homo sapiens
ggaccaaugcaucucuuua

SEQ ID NO: 800903 - RNA, 19 nt, Homo sapiens
gaggagugaccuacuauaa

SEQ ID NO: 800904 - RNA, 19 nt, Homo sapiens
gcacagagggucccauugu

SEQ ID NO: 800905 - RNA, 19 nt, Homo sapiens
gaagagauuccuauuacug

SEQ ID NO: 800906 - RNA, 19 nt, Homo sapiens
gaccaaugcaucucuuuaa

SEQ ID NO: 800907 - RNA, 19 nt, Homo sapiens
gaagagaagggagaagaaa

SEQ ID NO: 800908 - RNA, 19 nt, Homo sapiens
ccaaggaggaaauaacuaa

SEQ ID NO: 800909 - RNA, 19 nt, Homo sapiens
ugagguaaguggaauuaga

SEQ ID NO: 800910 - RNA, 19 nt, Homo sapiens
uaggagcccuucucuuuga

SEQ ID NO: 800911 - RNA, 19 nt, Homo sapiens
guucuucacuucugggaaa

SEQ ID NO: 800912 - RNA, 19 nt, Homo sapiens
gugagagccuuugccuuua

SEQ ID NO: 800913 - RNA, 19 nt, Homo sapiens
aucaauaccuguacuauga

SEQ ID NO: 800914 - RNA, 19 nt, Homo sapiens
ggaccuccaccucaguuua

SEQ ID NO: 800915 - RNA, 19 nt, Homo sapiens
ugaauacagugaagaggaa

SEQ ID NO: 800916 - RNA, 19 nt, Homo sapiens
gcucauugcucuuuauggu

SEQ ID NO: 800917 - RNA, 19 nt, Homo sapiens
ggaagaauccagcauacau

SEQ ID NO: 800918 - RNA, 19 nt, Homo sapiens
gaaggugaauacagugaag

SEQ ID NO: 800919 - RNA, 19 nt, Homo sapiens
caaugcaucucuuuaaagg

SEQ ID NO: 800920 - RNA, 19 nt, Homo sapiens
gugagacuguuaagcauga

SEQ ID NO: 800921 - RNA, 19 nt, Homo sapiens
gcccuaagcauuuggauga

SEQ ID NO: 800922 - RNA, 19 nt, Homo sapiens
aaacaagucuagucuucug

SEQ ID NO: 800923 - RNA, 19 nt, Homo sapiens
gcccaugucuucugcuguu

SEQ ID NO: 800924 - RNA, 19 nt, Homo sapiens
gaagaacucgaaccaaagu

SEQ ID NO: 800925 - RNA, 19 nt, Homo sapiens
guuauccucuuguauacuu

SEQ ID NO: 800926 - RNA, 19 nt, Homo sapiens
cuaaugaugcuguuaauuc

SEQ ID NO: 800927 - RNA, 19 nt, Homo sapiens
gguccacuguguuuaguug

SEQ ID NO: 800928 - RNA, 19 nt, Homo sapiens
gcugggagcaugacaaguu

SEQ ID NO: 800929 - RNA, 19 nt, Homo sapiens
cuaagcauuuggaugauga

SEQ ID NO: 800930 - RNA, 19 nt, Homo sapiens
gcuguucccuuugccuuaa

SEQ ID NO: 800931 - RNA, 19 nt, Homo sapiens
ggagaggcacuuaaucugu

SEQ ID NO: 800932 - RNA, 19 nt, Homo sapiens
gaacucagaagagaaauac

SEQ ID NO: 800933 - RNA, 19 nt, Homo sapiens
ggagugaccuacuauaacc

SEQ ID NO: 800934 - RNA, 19 nt, Homo sapiens
ucuagcagcuggccuaauc

SEQ ID NO: 800935 - RNA, 19 nt, Homo sapiens
ggccuugcuucucuucuuu

SEQ ID NO: 800936 - RNA, 19 nt, Homo sapiens
agaccuggccuuucacuuu

SEQ ID NO: 800937 - RNA, 19 nt, Homo sapiens
cgccucaucuguauccuaa

SEQ ID NO: 800938 - RNA, 19 nt, Homo sapiens
gcaagaagaacucgaacca

SEQ ID NO: 800939 - RNA, 19 nt, Homo sapiens
uuuaaagggugcccauuug

SEQ ID NO: 800940 - RNA, 19 nt, Homo sapiens
gaccuccaccucaguuuaa

SEQ ID NO: 800941 - RNA, 19 nt, Homo sapiens
caccaaggacauuuauuaa

SEQ ID NO: 800942 - RNA, 19 nt, Homo sapiens
cauugugacuuggagauaa

SEQ ID NO: 800943 - RNA, 19 nt, Homo sapiens
ggaggagugaccuacuaua

SEQ ID NO: 800944 - RNA, 19 nt, Homo sapiens
gucaugaacuuugguaauc

SEQ ID NO: 800945 - RNA, 19 nt, Homo sapiens
gggaagcuccgguggauuc

SEQ ID NO: 800946 - RNA, 19 nt, Homo sapiens
agugagagccuuugccuuu

SEQ ID NO: 800947 - RNA, 19 nt, Homo sapiens
gaaauacagcuggcuaucu

SEQ ID NO: 800948 - RNA, 19 nt, Homo sapiens
ggauccaucuccagaagca

SEQ ID NO: 800949 - RNA, 19 nt, Homo sapiens
cauugaaggugaugcuguu

SEQ ID NO: 800950 - RNA, 19 nt, Homo sapiens
uuuguaggcuguucccuuu

SEQ ID NO: 800951 - RNA, 19 nt, Homo sapiens
gaggaaauaacuaagagau

SEQ ID NO: 800952 - RNA, 19 nt, Homo sapiens
gcaaagaugguggcugugu

SEQ ID NO: 800953 - RNA, 19 nt, Homo sapiens
ccacgggaacuucgaggua

SEQ ID NO: 800954 - RNA, 19 nt, Homo sapiens
gacaucaaaccucgaagaa

SEQ ID NO: 800955 - RNA, 19 nt, Homo sapiens
ugaaaucagaagcuaauga

SEQ ID NO: 800956 - RNA, 19 nt, Homo sapiens
uuaagacacugugagaguu

SEQ ID NO: 800957 - RNA, 19 nt, Homo sapiens
guaggagcccuucucuuug

SEQ ID NO: 800958 - RNA, 19 nt, Homo sapiens
gcccaaccauauacacaug

SEQ ID NO: 800959 - RNA, 19 nt, Homo sapiens
gaagcuaaugaugcuguua

SEQ ID NO: 800960 - RNA, 19 nt, Homo sapiens
gcuguucucucggauuaug

SEQ ID NO: 800961 - RNA, 19 nt, Homo sapiens
aaagggugcccauuuguga

SEQ ID NO: 800962 - RNA, 19 nt, Homo sapiens
guguuuaguugcaaggauu

SEQ ID NO: 800963 - RNA, 19 nt, Homo sapiens
gggccuugcuucucuucuu

SEQ ID NO: 800964 - RNA, 19 nt, Homo sapiens
caauaccuguacuaugaug

SEQ ID NO: 800965 - RNA, 19 nt, Homo sapiens
augcuguucucucggauua

SEQ ID NO: 800966 - RNA, 19 nt, Homo sapiens
gagaaauacagcuggcuau

SEQ ID NO: 800967 - RNA, 19 nt, Homo sapiens
caaaguggagcugaaauca

SEQ ID NO: 800968 - RNA, 19 nt, Homo sapiens
gaaccugagggcaaagaug

SEQ ID NO: 800969 - RNA, 19 nt, Homo sapiens
caucccagauaauggagaa

SEQ ID NO: 800970 - RNA, 19 nt, Homo sapiens
ccauugagaagaaauccua

SEQ ID NO: 800971 - RNA, 19 nt, Homo sapiens
ugucugcacccaggaauua

SEQ ID NO: 800972 - RNA, 19 nt, Homo sapiens
caaggacauuuauuaacag

SEQ ID NO: 800973 - RNA, 19 nt, Homo sapiens
gcacacacacacacacaca

SEQ ID NO: 800974 - RNA, 19 nt, Homo sapiens
ccuuaaaccugaagauguc

SEQ ID NO: 800975 - RNA, 19 nt, Homo sapiens
accaaugcaucucuuuaaa

SEQ ID NO: 800976 - RNA, 19 nt, Homo sapiens
gaccuggccuuucacuuuu

SEQ ID NO: 800977 - RNA, 19 nt, Homo sapiens
gagccaaacgcuauucauc

SEQ ID NO: 800978 - RNA, 19 nt, Homo sapiens
ugaugaagaucggaagaau

SEQ ID NO: 800979 - RNA, 19 nt, Homo sapiens
gcauugugacuuggagaua

SEQ ID NO: 800980 - RNA, 19 nt, Homo sapiens
uacagaaccugagggcaaa

SEQ ID NO: 800981 - RNA, 19 nt, Homo sapiens
gcugauaccucaaucuuua

SEQ ID NO: 800982 - RNA, 19 nt, Homo sapiens
gaaaguaaguacaguaaug

SEQ ID NO: 800983 - RNA, 19 nt, Homo sapiens
ggaaaggaccaauuauuua

SEQ ID NO: 800984 - RNA, 19 nt, Homo sapiens
ggaggaagcugaauaccuu

SEQ ID NO: 800985 - RNA, 19 nt, Homo sapiens
gaagaauucugaucaauac

SEQ ID NO: 800986 - RNA, 19 nt, Homo sapiens
gcacaugugaucaauauaa

SEQ ID NO: 800987 - RNA, 19 nt, Homo sapiens
cgggagagcugaacacuuu

SEQ ID NO: 800988 - RNA, 19 nt, Homo sapiens
gaggagggaugguguugua

SEQ ID NO: 800989 - RNA, 19 nt, Homo sapiens
acaaggagcuguaccacua

SEQ ID NO: 800990 - RNA, 19 nt, Homo sapiens
gggaaaggaccaauuauuu

SEQ ID NO: 800991 - RNA, 19 nt, Homo sapiens
gcacugauguagaugaaug

SEQ ID NO: 800992 - RNA, 19 nt, Homo sapiens
gauaagcccugaaggacuu

SEQ ID NO: 800993 - RNA, 19 nt, Homo sapiens
guagaugaaugcucagaaa

SEQ ID NO: 800994 - RNA, 19 nt, Homo sapiens
gaagaaagagugcuuagau

SEQ ID NO: 800995 - RNA, 19 nt, Homo sapiens
gaaagagugcuuagauuug

SEQ ID NO: 800996 - RNA, 19 nt, Homo sapiens
gaagaaaguaaguacagua

SEQ ID NO: 800997 - RNA, 19 nt, Homo sapiens
gcuacgcccucuuucuuua

SEQ ID NO: 800998 - RNA, 19 nt, Homo sapiens
gaugggaaaggaccaauua

SEQ ID NO: 800999 - RNA, 19 nt, Homo sapiens
cuacagcccuggaaaguga

SEQ ID NO: 801000 - RNA, 19 nt, Homo sapiens
gaacacaaccacagacaau

SEQ ID NO: 801001 - RNA, 19 nt, Homo sapiens
gaaccuggacccuaaagaa

SEQ ID NO: 801002 - RNA, 19 nt, Homo sapiens
gaauagagaagcuccuaaa

SEQ ID NO: 801003 - RNA, 19 nt, Homo sapiens
guuaugaguuugcagauga

SEQ ID NO: 801004 - RNA, 19 nt, Homo sapiens
gagaacuaccugagcauua

SEQ ID NO: 801005 - RNA, 19 nt, Homo sapiens
gaaauuguucuucgaaguu

SEQ ID NO: 801006 - RNA, 19 nt, Homo sapiens
gcaggaaggcgacgacgua

SEQ ID NO: 801007 - RNA, 19 nt, Homo sapiens
gagcagagccugagacgau

SEQ ID NO: 801008 - RNA, 19 nt, Homo sapiens
gguguuguaucaguaaaua

SEQ ID NO: 801009 - RNA, 19 nt, Homo sapiens
caucagugcauuucuauuu

SEQ ID NO: 801010 - RNA, 19 nt, Homo sapiens
ccacaucucucccuacaag

SEQ ID NO: 801011 - RNA, 19 nt, Homo sapiens
gcaaaggcaaagaaaguaa

SEQ ID NO: 801012 - RNA, 19 nt, Homo sapiens
gaaguacccacagaaagua

SEQ ID NO: 801013 - RNA, 19 nt, Homo sapiens
uagagaagcuccuaaaauu

SEQ ID NO: 801014 - RNA, 19 nt, Homo sapiens
acaccgaggucuucacgua

SEQ ID NO: 801015 - RNA, 19 nt, Homo sapiens
aagcacaugugaucaauau

SEQ ID NO: 801016 - RNA, 19 nt, Homo sapiens
gcagaugaccggcauacuu

SEQ ID NO: 801017 - RNA, 19 nt, Homo sapiens
agaacuaccugagcauuaa

SEQ ID NO: 801018 - RNA, 19 nt, Homo sapiens
gugcuuagauuugcuguga

SEQ ID NO: 801019 - RNA, 19 nt, Homo sapiens
gaagucagaaggaccauau

SEQ ID NO: 801020 - RNA, 19 nt, Homo sapiens
gcauuaagaccaacauuca

SEQ ID NO: 801021 - RNA, 19 nt, Homo sapiens
cccaauggcuuaaccuuug

SEQ ID NO: 801022 - RNA, 19 nt, Homo sapiens
agaaagagugcuuagauuu

SEQ ID NO: 801023 - RNA, 19 nt, Homo sapiens
aagaaagagugcuuagauu

SEQ ID NO: 801024 - RNA, 19 nt, Homo sapiens
gcaacuucuuguaaacauu

SEQ ID NO: 801025 - RNA, 19 nt, Homo sapiens
ggaugguguuguaucagua

SEQ ID NO: 801026 - RNA, 19 nt, Homo sapiens
gagggaugguguuguauca

SEQ ID NO: 801027 - RNA, 19 nt, Homo sapiens
gagaggagacgguucguau

SEQ ID NO: 801028 - RNA, 19 nt, Homo sapiens
ggacagacuggaauagaga

SEQ ID NO: 801029 - RNA, 19 nt, Homo sapiens
ggauggauuucagugcaua

SEQ ID NO: 801030 - RNA, 19 nt, Homo sapiens
caauuuggauuacuacgau

SEQ ID NO: 801031 - RNA, 19 nt, Homo sapiens
aaggaagacuuggaguuua

SEQ ID NO: 801032 - RNA, 19 nt, Homo sapiens
ggaagaaaguaaguacagu

SEQ ID NO: 801033 - RNA, 19 nt, Homo sapiens
acacagaucuggugaaucc

SEQ ID NO: 801034 - RNA, 19 nt, Homo sapiens
ccagcagauuggcuacuua

SEQ ID NO: 801035 - RNA, 19 nt, Homo sapiens
gcaccuuccugcucuauac

SEQ ID NO: 801036 - RNA, 19 nt, Homo sapiens
gugccugccugccugguua

SEQ ID NO: 801037 - RNA, 19 nt, Homo sapiens
cgcaguauguggacuauga

SEQ ID NO: 801038 - RNA, 19 nt, Homo sapiens
ggaaggcgacgacguaaag

SEQ ID NO: 801039 - RNA, 19 nt, Homo sapiens
guauaaugcugccaacaag

SEQ ID NO: 801040 - RNA, 19 nt, Homo sapiens
caccagagguagacagaga

SEQ ID NO: 801041 - RNA, 19 nt, Homo sapiens
cacagaaaguaaaguauca

SEQ ID NO: 801042 - RNA, 19 nt, Homo sapiens
cuagauuacuccaauaaag

SEQ ID NO: 801043 - RNA, 19 nt, Homo sapiens
gggagaggaugguguacug

SEQ ID NO: 801044 - RNA, 19 nt, Homo sapiens
gcugguguguggacaaaga

SEQ ID NO: 801045 - RNA, 19 nt, Homo sapiens
aaaggaagacuuggaguuu

SEQ ID NO: 801046 - RNA, 19 nt, Homo sapiens
ggacggcgugucauucaaa

SEQ ID NO: 801047 - RNA, 19 nt, Homo sapiens
gaccacauccgcagaacaa

SEQ ID NO: 801048 - RNA, 19 nt, Homo sapiens
cggcauacuugcaucuuga

SEQ ID NO: 801049 - RNA, 19 nt, Homo sapiens
ccggagugguuaugaguuu

SEQ ID NO: 801050 - RNA, 19 nt, Homo sapiens
gaaaugggaagcacugucu

SEQ ID NO: 801051 - RNA, 19 nt, Homo sapiens
augcagaacugaugggaaa

SEQ ID NO: 801052 - RNA, 19 nt, Homo sapiens
gggagcagguaggcgcuua

SEQ ID NO: 801053 - RNA, 19 nt, Homo sapiens
gaauuggccauuagacguu

SEQ ID NO: 801054 - RNA, 19 nt, Homo sapiens
ccaauggcuuaaccuuuga

SEQ ID NO: 801055 - RNA, 19 nt, Homo sapiens
cuacacagaucuggugaau

SEQ ID NO: 801056 - RNA, 19 nt, Homo sapiens
acugugaccucuacaaguu

SEQ ID NO: 801057 - RNA, 19 nt, Homo sapiens
acauggaaguuacauucua

SEQ ID NO: 801058 - RNA, 19 nt, Homo sapiens
cgggauaacugcagucuac

SEQ ID NO: 801059 - RNA, 19 nt, Homo sapiens
ggagaaaacagaagaauuc

SEQ ID NO: 801060 - RNA, 19 nt, Homo sapiens
cugaaggacuugccauaga

SEQ ID NO: 801061 - RNA, 19 nt, Homo sapiens
ugugagcgcuggagggaaa

SEQ ID NO: 801062 - RNA, 19 nt, Homo sapiens
uguaucaacuugccuggaa

SEQ ID NO: 801063 - RNA, 19 nt, Homo sapiens
gaggagacgguucguauca

SEQ ID NO: 801064 - RNA, 19 nt, Homo sapiens
ggaaagugacuauaaugag

SEQ ID NO: 801065 - RNA, 19 nt, Homo sapiens
gaagguuguuauugcaagu

SEQ ID NO: 801066 - RNA, 19 nt, Homo sapiens
caaaggcaaagaaaguaaa

SEQ ID NO: 801067 - RNA, 19 nt, Homo sapiens
uaaaggaagacuuggaguu

SEQ ID NO: 801068 - RNA, 19 nt, Homo sapiens
acaguaauguaaaggaaga

SEQ ID NO: 801069 - RNA, 19 nt, Homo sapiens
ggucaugaaguuccuggua

SEQ ID NO: 801070 - RNA, 19 nt, Homo sapiens
aaaugaagguuguuauugc

SEQ ID NO: 801071 - RNA, 19 nt, Homo sapiens
gacuuggaguuuacaauca

SEQ ID NO: 801072 - RNA, 19 nt, Homo sapiens
acaacgaucucaccucuac

SEQ ID NO: 801073 - RNA, 19 nt, Homo sapiens
gcuuaaccuuugacccuuu

SEQ ID NO: 801074 - RNA, 19 nt, Homo sapiens
gagaagcuccuaaaauuga

SEQ ID NO: 801075 - RNA, 19 nt, Homo sapiens
ggaauagagaagcuccuaa

SEQ ID NO: 801076 - RNA, 19 nt, Homo sapiens
gcgaugaccugggccacuu

SEQ ID NO: 801077 - RNA, 19 nt, Homo sapiens
cagaugaccggcauacuug

SEQ ID NO: 801078 - RNA, 19 nt, Homo sapiens
gugaauccuugcuaugaug

SEQ ID NO: 801079 - RNA, 19 nt, Homo sapiens
ggugaauccuugcuaugau

SEQ ID NO: 801080 - RNA, 19 nt, Homo sapiens
ugacauggaaguuacauuc

SEQ ID NO: 801081 - RNA, 19 nt, Homo sapiens
gaaaugcccuucucugaaa

SEQ ID NO: 801082 - RNA, 19 nt, Homo sapiens
gcacucagcucguguaugu

SEQ ID NO: 801083 - RNA, 19 nt, Homo sapiens
ggaaugaugucuuguauag

SEQ ID NO: 801084 - RNA, 19 nt, Homo sapiens
uggaagagcugauuucuaa

SEQ ID NO: 801085 - RNA, 19 nt, Homo sapiens
gcaauacuguuccuggaua

SEQ ID NO: 801086 - RNA, 19 nt, Homo sapiens
gaacgaaugucuaaacaag

SEQ ID NO: 801087 - RNA, 19 nt, Homo sapiens
uaucacagcuucaauaaga

SEQ ID NO: 801088 - RNA, 19 nt, Homo sapiens
gaacuugccuguuuauuuu

SEQ ID NO: 801089 - RNA, 19 nt, Homo sapiens
ccagaacucuuggaaauaa

SEQ ID NO: 801090 - RNA, 19 nt, Homo sapiens
guacaaggauuagaagaaa

SEQ ID NO: 801091 - RNA, 19 nt, Homo sapiens
gaaggaagauuucgauguc

SEQ ID NO: 801092 - RNA, 19 nt, Homo sapiens
caacaaggauuaugcagau

SEQ ID NO: 801093 - RNA, 19 nt, Homo sapiens
gagaugaccuggagcucua

SEQ ID NO: 801094 - RNA, 19 nt, Homo sapiens
agaaauagcgggauccuua

SEQ ID NO: 801095 - RNA, 19 nt, Homo sapiens
ggaacuugccuguuuauuu

SEQ ID NO: 801096 - RNA, 19 nt, Homo sapiens
ccacagaauuuaaucaguu

SEQ ID NO: 801097 - RNA, 19 nt, Homo sapiens
guaauggaaugaugucuug

SEQ ID NO: 801098 - RNA, 19 nt, Homo sapiens
ggagagaauugccacagaa

SEQ ID NO: 801099 - RNA, 19 nt, Homo sapiens
gagguuagauucuuaagca

SEQ ID NO: 801100 - RNA, 19 nt, Homo sapiens
gaaaugauuggcuuuaaga

SEQ ID NO: 801101 - RNA, 19 nt, Homo sapiens
acuggaaggucuccuauua

SEQ ID NO: 801102 - RNA, 19 nt, Homo sapiens
uaaagaaaccucugcacua

SEQ ID NO: 801103 - RNA, 19 nt, Homo sapiens
gaagagguucugagccuua

SEQ ID NO: 801104 - RNA, 19 nt, Homo sapiens
gaaagugacucuguucucu

SEQ ID NO: 801105 - RNA, 19 nt, Homo sapiens
ggacuuacgccacgauuga

SEQ ID NO: 801106 - RNA, 19 nt, Homo sapiens
ugaaagcacucauaaguac

SEQ ID NO: 801107 - RNA, 19 nt, Homo sapiens
gcucaaacaagcaauaauu

SEQ ID NO: 801108 - RNA, 19 nt, Homo sapiens
caagaaaccuuugguaacu

SEQ ID NO: 801109 - RNA, 19 nt, Homo sapiens
gcguauagcuggcauuaca

SEQ ID NO: 801110 - RNA, 19 nt, Homo sapiens
agaaaccucugcacuagaa

SEQ ID NO: 801111 - RNA, 19 nt, Homo sapiens
gcaguuggcccuagauguu

SEQ ID NO: 801112 - RNA, 19 nt, Homo sapiens
uuacagauguccuggaaga

SEQ ID NO: 801113 - RNA, 19 nt, Homo sapiens
caacagcagagcagccuua

SEQ ID NO: 801114 - RNA, 19 nt, Homo sapiens
guauuaaacucugugaaga

SEQ ID NO: 801115 - RNA, 19 nt, Homo sapiens
gaucaagaaaccuuuggua

SEQ ID NO: 801116 - RNA, 19 nt, Homo sapiens
aaagaaaccucugcacuag

SEQ ID NO: 801117 - RNA, 19 nt, Homo sapiens
gaacucaucaacaaggauu

SEQ ID NO: 801118 - RNA, 19 nt, Homo sapiens
gccuucaggucauguauaa

SEQ ID NO: 801119 - RNA, 19 nt, Homo sapiens
uggaagaacugagagauga

SEQ ID NO: 801120 - RNA, 19 nt, Homo sapiens
gaacuccugggcuuucuaa

SEQ ID NO: 801121 - RNA, 19 nt, Homo sapiens
aagugacucuguucucuua

SEQ ID NO: 801122 - RNA, 19 nt, Homo sapiens
gggagaaagugacucuguu

SEQ ID NO: 801123 - RNA, 19 nt, Homo sapiens
gcacgauacucuguguuug

SEQ ID NO: 801124 - RNA, 19 nt, Homo sapiens
gaaggucuccuauuagaag

SEQ ID NO: 801125 - RNA, 19 nt, Homo sapiens
gaggugccaucuccaguga

SEQ ID NO: 801126 - RNA, 19 nt, Homo sapiens
gaaagaccuccuuccuaaa

SEQ ID NO: 801127 - RNA, 19 nt, Homo sapiens
cagcaucacuccagcaaca

SEQ ID NO: 801128 - RNA, 19 nt, Homo sapiens
gugaaagcacucauaagua

SEQ ID NO: 801129 - RNA, 19 nt, Homo sapiens
gagacucacucugcagauu

SEQ ID NO: 801130 - RNA, 19 nt, Homo sapiens
uagacgaggugauuauaga

SEQ ID NO: 801131 - RNA, 19 nt, Homo sapiens
gcccuucucugaaauaaag

SEQ ID NO: 801132 - RNA, 19 nt, Homo sapiens
uggaaggucuccuauuaga

SEQ ID NO: 801133 - RNA, 19 nt, Homo sapiens
uaaacucugugaagaagau

SEQ ID NO: 801134 - RNA, 19 nt, Homo sapiens
ggaaacaaagccugugguu

SEQ ID NO: 801135 - RNA, 19 nt, Homo sapiens
gagauguucuugccauuac

SEQ ID NO: 801136 - RNA, 19 nt, Homo sapiens
aagcagcacuuacagaugu

SEQ ID NO: 801137 - RNA, 19 nt, Homo sapiens
ggaagugacgacuguaaug

SEQ ID NO: 801138 - RNA, 19 nt, Homo sapiens
gaaaccgugucagauguau

SEQ ID NO: 801139 - RNA, 19 nt, Homo sapiens
agaccuccuuccuaaauaa

SEQ ID NO: 801140 - RNA, 19 nt, Homo sapiens
gcaaagaaccuuccaucac

SEQ ID NO: 801141 - RNA, 19 nt, Homo sapiens
ggugccaucuccagugaaa

SEQ ID NO: 801142 - RNA, 19 nt, Homo sapiens
cuucaggucauguauaaua

SEQ ID NO: 801143 - RNA, 19 nt, Homo sapiens
accuggagcucuacuauaa

SEQ ID NO: 801144 - RNA, 19 nt, Homo sapiens
gcaaccgucuguagcaaag

SEQ ID NO: 801145 - RNA, 19 nt, Homo sapiens
acacaaggauaagcucaaa

SEQ ID NO: 801146 - RNA, 19 nt, Homo sapiens
ccaaggagaucaagaaacc

SEQ ID NO: 801147 - RNA, 19 nt, Homo sapiens
aaaguaagaccgcguauag

SEQ ID NO: 801148 - RNA, 19 nt, Homo sapiens
aaccacagcuuccuccuau

SEQ ID NO: 801149 - RNA, 19 nt, Homo sapiens
gguaacugguagcaaagaa

SEQ ID NO: 801150 - RNA, 19 nt, Homo sapiens
gaucacaggcuaguguaaa

SEQ ID NO: 801151 - RNA, 19 nt, Homo sapiens
caaguuauucggucaguug

SEQ ID NO: 801152 - RNA, 19 nt, Homo sapiens
cgacuguaauggaaugaug

SEQ ID NO: 801153 - RNA, 19 nt, Homo sapiens
gcuuggaucuuggcacuga

SEQ ID NO: 801154 - RNA, 19 nt, Homo sapiens
ugaaaugauuggcuuuaag

SEQ ID NO: 801155 - RNA, 19 nt, Homo sapiens
gagcucuacuauaaacuuc

SEQ ID NO: 801156 - RNA, 19 nt, Homo sapiens
ggucauguauaauaaacuc

SEQ ID NO: 801157 - RNA, 19 nt, Homo sapiens
caaaguaagaccgcguaua

SEQ ID NO: 801158 - RNA, 19 nt, Homo sapiens
gcucuacuauaaacuucuu

SEQ ID NO: 801159 - RNA, 19 nt, Homo sapiens
gcccaugcgucuucucuca

SEQ ID NO: 801160 - RNA, 19 nt, Homo sapiens
ggagaaagugacucuguuc

SEQ ID NO: 801161 - RNA, 19 nt, Homo sapiens
guacuugggagagcagaua

SEQ ID NO: 801162 - RNA, 19 nt, Homo sapiens
gauacucuguguuugucaa

SEQ ID NO: 801163 - RNA, 19 nt, Homo sapiens
gaagagcugauuucuaaaa

SEQ ID NO: 801164 - RNA, 19 nt, Homo sapiens
ccacaaauaguacaaggau

SEQ ID NO: 801165 - RNA, 19 nt, Homo sapiens
gaaggaauucgggcaguug

SEQ ID NO: 801166 - RNA, 19 nt, Homo sapiens
ugacgacuguaauggaaug

SEQ ID NO: 801167 - RNA, 19 nt, Homo sapiens
gaccuggagcucuacuaua

SEQ ID NO: 801168 - RNA, 19 nt, Homo sapiens
caagagaagaguuggacuu

SEQ ID NO: 801169 - RNA, 19 nt, Homo sapiens
gagagcagauacaaaaguu

SEQ ID NO: 801170 - RNA, 19 nt, Homo sapiens
gauggaagagagccugaaa

SEQ ID NO: 801171 - RNA, 19 nt, Homo sapiens
aaccgugucagauguauua

SEQ ID NO: 801172 - RNA, 19 nt, Homo sapiens
gauaagcucaaacaagcaa

SEQ ID NO: 801173 - RNA, 19 nt, Homo sapiens
ugugugcccuccuugagua

SEQ ID NO: 801174 - RNA, 19 nt, Homo sapiens
ucacucaggcccauuucua

SEQ ID NO: 801175 - RNA, 19 nt, Homo sapiens
cagcugaaaguccguauug

SEQ ID NO: 801176 - RNA, 19 nt, Homo sapiens
gaagcagcacuuacagaug

SEQ ID NO: 801177 - RNA, 19 nt, Homo sapiens
gaaauagcgggauccuuag

SEQ ID NO: 801178 - RNA, 19 nt, Homo sapiens
gagcccauccugccuauca

SEQ ID NO: 801179 - RNA, 19 nt, Homo sapiens
aagaccuccuuccuaaaua

SEQ ID NO: 801180 - RNA, 19 nt, Homo sapiens
aaagaccuccuuccuaaau

SEQ ID NO: 801181 - RNA, 19 nt, Homo sapiens
gaagagggauuauaauuug

SEQ ID NO: 801182 - RNA, 19 nt, Homo sapiens
gaaagaagaagaagguaua

SEQ ID NO: 801183 - RNA, 19 nt, Homo sapiens
gaaagaagaugacaaugca

SEQ ID NO: 801184 - RNA, 19 nt, Homo sapiens
gaaauaaacagacccaauu

SEQ ID NO: 801185 - RNA, 19 nt, Homo sapiens
gaaaagagguacagcauaa

SEQ ID NO: 801186 - RNA, 19 nt, Homo sapiens
caaagaacauuaucuggaa

SEQ ID NO: 801187 - RNA, 19 nt, Homo sapiens
gcaauuaugcucuguguuu

SEQ ID NO: 801188 - RNA, 19 nt, Homo sapiens
ggaagagggauuauaauuu

SEQ ID NO: 801189 - RNA, 19 nt, Homo sapiens
gaaaggcaaaucuacaaua

SEQ ID NO: 801190 - RNA, 19 nt, Homo sapiens
gaacaaaggaaccauucua

SEQ ID NO: 801191 - RNA, 19 nt, Homo sapiens
gaaagaggaacaaagauug

SEQ ID NO: 801192 - RNA, 19 nt, Homo sapiens
gaaucaagaucaacauauc

SEQ ID NO: 801193 - RNA, 19 nt, Homo sapiens
gaaagcaguaggagaagua

SEQ ID NO: 801194 - RNA, 19 nt, Homo sapiens
gacacaaucucuccauuug

SEQ ID NO: 801195 - RNA, 19 nt, Homo sapiens
gauaugcgcuggaacaaag

SEQ ID NO: 801196 - RNA, 19 nt, Homo sapiens
acacaacucuggacaguga

SEQ ID NO: 801197 - RNA, 19 nt, Homo sapiens
gaacacagacagaagaaau

SEQ ID NO: 801198 - RNA, 19 nt, Homo sapiens
gcaacuuggugguguacua

SEQ ID NO: 801199 - RNA, 19 nt, Homo sapiens
gaacaaggaauuucaccaa

SEQ ID NO: 801200 - RNA, 19 nt, Homo sapiens
gauagaagcaacagaagaa

SEQ ID NO: 801201 - RNA, 19 nt, Homo sapiens
acaaacagucucuuaguua

SEQ ID NO: 801202 - RNA, 19 nt, Homo sapiens
ggaauguguuguucaugaa

SEQ ID NO: 801203 - RNA, 19 nt, Homo sapiens
acagagagcccgagaauug

SEQ ID NO: 801204 - RNA, 19 nt, Homo sapiens
cgacugaaauauacaaaca

SEQ ID NO: 801205 - RNA, 19 nt, Homo sapiens
gcucugugaucaagcuaua

SEQ ID NO: 801206 - RNA, 19 nt, Homo sapiens
gagaugacaacacugauaa

SEQ ID NO: 801207 - RNA, 19 nt, Homo sapiens
ugucauacuucacagauuu

SEQ ID NO: 801208 - RNA, 19 nt, Homo sapiens
cagcacaccuggaaaguuc

SEQ ID NO: 801209 - RNA, 19 nt, Homo sapiens
gggaagagggauuauaauu

SEQ ID NO: 801210 - RNA, 19 nt, Homo sapiens
agaugauggugaugaauua

SEQ ID NO: 801211 - RNA, 19 nt, Homo sapiens
gaucaucaauccaacucuu

SEQ ID NO: 801212 - RNA, 19 nt, Homo sapiens
caaauccacuuaaauucug

SEQ ID NO: 801213 - RNA, 19 nt, Homo sapiens
aaagaaagcaguaggagaa

SEQ ID NO: 801214 - RNA, 19 nt, Homo sapiens
guauagcggugaacaagga

SEQ ID NO: 801215 - RNA, 19 nt, Homo sapiens
gagcuuggcacucuuauuc

SEQ ID NO: 801216 - RNA, 19 nt, Homo sapiens
guuacuagcuauugggaaa

SEQ ID NO: 801217 - RNA, 19 nt, Homo sapiens
ggacguuauugaggauaua

SEQ ID NO: 801218 - RNA, 19 nt, Homo sapiens
caacagagagcccgagaau

SEQ ID NO: 801219 - RNA, 19 nt, Homo sapiens
caucuucucuucaacuuuc

SEQ ID NO: 801220 - RNA, 19 nt, Homo sapiens
aaacagacccaauucauca

SEQ ID NO: 801221 - RNA, 19 nt, Homo sapiens
ggacaaccacaaccucauu

SEQ ID NO: 801222 - RNA, 19 nt, Homo sapiens
ggaaucaagaucaacauau

SEQ ID NO: 801223 - RNA, 19 nt, Homo sapiens
gcagcaacuugguggugua

SEQ ID NO: 801224 - RNA, 19 nt, Homo sapiens
agaauucaguagacuauug

SEQ ID NO: 801225 - RNA, 19 nt, Homo sapiens
gguauggaaucaaguuuua

SEQ ID NO: 801226 - RNA, 19 nt, Homo sapiens
gcccagagacagaaaguaa

SEQ ID NO: 801227 - RNA, 19 nt, Homo sapiens
caaacagucucuuaguuac

SEQ ID NO: 801228 - RNA, 19 nt, Homo sapiens
ugaucaagcuauagccuuu

SEQ ID NO: 801229 - RNA, 19 nt, Homo sapiens
gauauaaucgguauggaau

SEQ ID NO: 801230 - RNA, 19 nt, Homo sapiens
ggaaagaagaugacaaugc

SEQ ID NO: 801231 - RNA, 19 nt, Homo sapiens
guccaaauccacuuaaauu

SEQ ID NO: 801232 - RNA, 19 nt, Homo sapiens
ugaaagaggaacaaagauu

SEQ ID NO: 801233 - RNA, 19 nt, Homo sapiens
guagagaugacaacacuga

SEQ ID NO: 801234 - RNA, 19 nt, Homo sapiens
gaaauuacagaaacugaca

SEQ ID NO: 801235 - RNA, 19 nt, Homo sapiens
uacaaacagucucuuaguu

SEQ ID NO: 801236 - RNA, 19 nt, Homo sapiens
gcccugagcucugugauca

SEQ ID NO: 801237 - RNA, 19 nt, Homo sapiens
caaccucauugaaagaaga

SEQ ID NO: 801238 - RNA, 19 nt, Homo sapiens
gcagaauucaguagacuau

SEQ ID NO: 801239 - RNA, 19 nt, Homo sapiens
gcauauggaggacguuauu

SEQ ID NO: 801240 - RNA, 19 nt, Homo sapiens
uacagaaacugacacuaga

SEQ ID NO: 801241 - RNA, 19 nt, Homo sapiens
ggauauaaucgguauggaa

SEQ ID NO: 801242 - RNA, 19 nt, Homo sapiens
caauccaacucuuaaaugg

SEQ ID NO: 801243 - RNA, 19 nt, Homo sapiens
gaacuaaugacugcaaagu

SEQ ID NO: 801244 - RNA, 19 nt, Homo sapiens
aagauuggauggcaugcua

SEQ ID NO: 801245 - RNA, 19 nt, Homo sapiens
acacagacagaagaaauua

SEQ ID NO: 801246 - RNA, 19 nt, Homo sapiens
ugacacaaucucuccauuu

SEQ ID NO: 801247 - RNA, 19 nt, Homo sapiens
uuucugauccuuugucaua

SEQ ID NO: 801248 - RNA, 19 nt, Homo sapiens
caaaggaaccauucuaaaa

SEQ ID NO: 801249 - RNA, 19 nt, Homo sapiens
gaaacugacacuagagcuu

SEQ ID NO: 801250 - RNA, 19 nt, Homo sapiens
gaugcuggccucacagaaa

SEQ ID NO: 801251 - RNA, 19 nt, Homo sapiens
acuaaugacugcaaagugu

SEQ ID NO: 801252 - RNA, 19 nt, Homo sapiens
gaagaauucgcaggaagaa

SEQ ID NO: 801253 - RNA, 19 nt, Homo sapiens
aggaauguguuguucauga

SEQ ID NO: 801254 - RNA, 19 nt, Homo sapiens
caucagaucaucaauccaa

SEQ ID NO: 801255 - RNA, 19 nt, Homo sapiens
gucauugccuuucuccauu

SEQ ID NO: 801256 - RNA, 19 nt, Homo sapiens
gcucuguguuucauauguu

SEQ ID NO: 801257 - RNA, 19 nt, Homo sapiens
ugacaacacugauaaaauc

SEQ ID NO: 801258 - RNA, 19 nt, Homo sapiens
uauaaucgguauggaauca

SEQ ID NO: 801259 - RNA, 19 nt, Homo sapiens
gaguccaaauccacuuaaa

SEQ ID NO: 801260 - RNA, 19 nt, Homo sapiens
caacuggaaagcaauucua

SEQ ID NO: 801261 - RNA, 19 nt, Homo sapiens
gcacucuuauuccaaaguc

SEQ ID NO: 801262 - RNA, 19 nt, Homo sapiens
gagaaauuacagaaacuga

SEQ ID NO: 801263 - RNA, 19 nt, Homo sapiens
gaacauuaucuggaaguau

SEQ ID NO: 801264 - RNA, 19 nt, Homo sapiens
caacauaucagguggucau

SEQ ID NO: 801265 - RNA, 19 nt, Homo sapiens
ccacuuaaauucuguuuuc

SEQ ID NO: 801266 - RNA, 19 nt, Homo sapiens
aaaggaauguguuguucau

SEQ ID NO: 801267 - RNA, 19 nt, Homo sapiens
uaaugacugcaaaguguua

SEQ ID NO: 801268 - RNA, 19 nt, Homo sapiens
guacuacuggaacuaauga

SEQ ID NO: 801269 - RNA, 19 nt, Homo sapiens
ggaggacguuauugaggau

SEQ ID NO: 801270 - RNA, 19 nt, Homo sapiens
uacaucaaguggcuacaaa

SEQ ID NO: 801271 - RNA, 19 nt, Homo sapiens
ucaccaaguuacuagcuau

SEQ ID NO: 801272 - RNA, 19 nt, Homo sapiens
ccaaauccacuuaaauucu

SEQ ID NO: 801273 - RNA, 19 nt, Homo sapiens
gaauguguuguucaugaaa

SEQ ID NO: 801274 - RNA, 19 nt, Homo sapiens
uuaaaggaauguguuguuc

SEQ ID NO: 801275 - RNA, 19 nt, Homo sapiens
cagaugauggugaugaauu

SEQ ID NO: 801276 - RNA, 19 nt, Homo sapiens
acaaaggaaccauucuaaa

SEQ ID NO: 801277 - RNA, 19 nt, Homo sapiens
aaacugacacuagagcuuu

SEQ ID NO: 801278 - RNA, 19 nt, Homo sapiens
guguuaaacgacugaaaua

SEQ ID NO: 801279 - RNA, 19 nt, Homo sapiens
gagcagaauucaguagacu

SEQ ID NO: 801280 - RNA, 19 nt, Homo sapiens
gugcucaugucaccaaaca

SEQ ID NO: 801281 - RNA, 19 nt, Homo sapiens
ggaagaaggacaacaguua

SEQ ID NO: 801282 - RNA, 19 nt, Homo sapiens
gaauguagaucaagcuuuc

SEQ ID NO: 801283 - RNA, 19 nt, Homo sapiens
gaaccaacacggaaagaaa

SEQ ID NO: 801284 - RNA, 19 nt, Homo sapiens
ccagacaaauuuaaaggaa

SEQ ID NO: 801285 - RNA, 19 nt, Homo sapiens
cagcaaagauuaggaugaa

SEQ ID NO: 801286 - RNA, 19 nt, Homo sapiens
gaacuuguccggguuauca

SEQ ID NO: 801287 - RNA, 19 nt, Homo sapiens
gaagcuggcuaguccuuuc

SEQ ID NO: 801288 - RNA, 19 nt, Homo sapiens
gacaaaugaucaccauguu

SEQ ID NO: 801289 - RNA, 19 nt, Homo sapiens
uagaaucccuucaguuuua

SEQ ID NO: 801290 - RNA, 19 nt, Homo sapiens
caagaaaggcugccauugu

SEQ ID NO: 801291 - RNA, 19 nt, Homo sapiens
gaugaguucccaaugauuu

SEQ ID NO: 801292 - RNA, 19 nt, Homo sapiens
ggauacagcaggacaagaa

SEQ ID NO: 801293 - RNA, 19 nt, Homo sapiens
uaaggcugcuucaaagauu

SEQ ID NO: 801294 - RNA, 19 nt, Homo sapiens
gcaaagauuaggaugaaug

SEQ ID NO: 801295 - RNA, 19 nt, Homo sapiens
gcacggcagcuuaagguaa

SEQ ID NO: 801296 - RNA, 19 nt, Homo sapiens
uaaaggaucgugaugaguu

SEQ ID NO: 801297 - RNA, 19 nt, Homo sapiens
aaagacagauucucagagu

SEQ ID NO: 801298 - RNA, 19 nt, Homo sapiens
gcuacagguugugaaauaa

SEQ ID NO: 801299 - RNA, 19 nt, Homo sapiens
gaucaucaaagacagguaa

SEQ ID NO: 801300 - RNA, 19 nt, Homo sapiens
gaagcuacagguugugaaa

SEQ ID NO: 801301 - RNA, 19 nt, Homo sapiens
aagaaaggcugccauugug

SEQ ID NO: 801302 - RNA, 19 nt, Homo sapiens
acacuaaggcugcuucaaa

SEQ ID NO: 801303 - RNA, 19 nt, Homo sapiens
caaaugaucaccauguuag

SEQ ID NO: 801304 - RNA, 19 nt, Homo sapiens
agacagauucucagaguaa

SEQ ID NO: 801305 - RNA, 19 nt, Homo sapiens
ucuagaaucccuucaguuu

SEQ ID NO: 801306 - RNA, 19 nt, Homo sapiens
ggaggcaucagcaaagauu

SEQ ID NO: 801307 - RNA, 19 nt, Homo sapiens
gaagaaggacaacaguuag

SEQ ID NO: 801308 - RNA, 19 nt, Homo sapiens
cgugaugaguucccaauga

SEQ ID NO: 801309 - RNA, 19 nt, Homo sapiens
agaucaagcuuuccaugaa

SEQ ID NO: 801310 - RNA, 19 nt, Homo sapiens
gaaucauacugccuacugu

SEQ ID NO: 801311 - RNA, 19 nt, Homo sapiens
uaauaaagcagaucuggau

SEQ ID NO: 801312 - RNA, 19 nt, Homo sapiens
gaaaagcccucaucuucuc

SEQ ID NO: 801313 - RNA, 19 nt, Homo sapiens
ugaaccaucucagaccuuu

SEQ ID NO: 801314 - RNA, 19 nt, Homo sapiens
acaaaugaucaccauguua

SEQ ID NO: 801315 - RNA, 19 nt, Homo sapiens
gaucaagcuuuccaugaac

SEQ ID NO: 801316 - RNA, 19 nt, Homo sapiens
ggaaucauacugccuacug

SEQ ID NO: 801317 - RNA, 19 nt, Homo sapiens
gaucaccauguuagccuua

SEQ ID NO: 801318 - RNA, 19 nt, Homo sapiens
gugaugaguucccaaugau

SEQ ID NO: 801319 - RNA, 19 nt, Homo sapiens
agcuacagguugugaaaua

SEQ ID NO: 801320 - RNA, 19 nt, Homo sapiens
gauccaaccauugaagauu

SEQ ID NO: 801321 - RNA, 19 nt, Homo sapiens
gacaagaaaggcugccauu

SEQ ID NO: 801322 - RNA, 19 nt, Homo sapiens
gacagauucucagaguaaa

SEQ ID NO: 801323 - RNA, 19 nt, Homo sapiens
gaccuuuacugauacuaca

SEQ ID NO: 801324 - RNA, 19 nt, Homo sapiens
gcccucaucuucucuuucu

SEQ ID NO: 801325 - RNA, 19 nt, Homo sapiens
uaggaugaauguagaucaa

SEQ ID NO: 801326 - RNA, 19 nt, Homo sapiens
caaugucagccuuuguuaa

SEQ ID NO: 801327 - RNA, 19 nt, Homo sapiens
ucaaugucagccuuuguua

SEQ ID NO: 801328 - RNA, 19 nt, Homo sapiens
caaagcagugugugauaga

SEQ ID NO: 801329 - RNA, 19 nt, Homo sapiens
ccuguuguauuuauggauu

SEQ ID NO: 801330 - RNA, 19 nt, Homo sapiens
gaaccaucucagaccuuua

SEQ ID NO: 801331 - RNA, 19 nt, Homo sapiens
gaguaaaggaucgugauga

SEQ ID NO: 801332 - RNA, 19 nt, Homo sapiens
acacugaauugaaucuaca

SEQ ID NO: 801333 - RNA, 19 nt, Homo sapiens
gccaugagagaacaguaua

SEQ ID NO: 801334 - RNA, 19 nt, Homo sapiens
acaaagcagugugugauag

SEQ ID NO: 801335 - RNA, 19 nt, Homo sapiens
agauuaggaugaauguaga

SEQ ID NO: 801336 - RNA, 19 nt, Homo sapiens
caaagauuaggaugaaugu

SEQ ID NO: 801337 - RNA, 19 nt, Homo sapiens
ucaaagacagauucucaga

SEQ ID NO: 801338 - RNA, 19 nt, Homo sapiens
aaggcugcuucaaagauua

SEQ ID NO: 801339 - RNA, 19 nt, Homo sapiens
cacuaaggcugcuucaaag

SEQ ID NO: 801340 - RNA, 19 nt, Homo sapiens
agacaaaugaucaccaugu

SEQ ID NO: 801341 - RNA, 19 nt, Homo sapiens
gauuaugauccaaccauug

SEQ ID NO: 801342 - RNA, 19 nt, Homo sapiens
gcaagucggcgcucaccau

SEQ ID NO: 801343 - RNA, 19 nt, Homo sapiens
cugugaagcuaauacaaug

SEQ ID NO: 801344 - RNA, 19 nt, Homo sapiens
gguaacacaggaagaagga

SEQ ID NO: 801345 - RNA, 19 nt, Homo sapiens
gcuaguccuuucugugaag

SEQ ID NO: 801346 - RNA, 19 nt, Homo sapiens
uagaucaagcuuuccauga

SEQ ID NO: 801347 - RNA, 19 nt, Homo sapiens
aaaggaucgugaugaguuc

SEQ ID NO: 801348 - RNA, 19 nt, Homo sapiens
gaaauuucaagagcaggaa

SEQ ID NO: 801349 - RNA, 19 nt, Homo sapiens
ucacagauagaggcaguuu

SEQ ID NO: 801350 - RNA, 19 nt, Homo sapiens
caacuuuuguuuucugaug

SEQ ID NO: 801351 - RNA, 19 nt, Homo sapiens
ccuuaaauacacugaauug

SEQ ID NO: 801352 - RNA, 19 nt, Homo sapiens
uuuggaaucuaagcuguuu

SEQ ID NO: 801353 - RNA, 19 nt, Homo sapiens
uggcuaguccuuucuguga

SEQ ID NO: 801354 - RNA, 19 nt, Homo sapiens
aggcugccauugugucauu

SEQ ID NO: 801355 - RNA, 19 nt, Homo sapiens
gaggcaucagcaaagauua

SEQ ID NO: 801356 - RNA, 19 nt, Homo sapiens
aagacagauucucagagua

SEQ ID NO: 801357 - RNA, 19 nt, Homo sapiens
ugagagaacaguauaugag

SEQ ID NO: 801358 - RNA, 19 nt, Homo sapiens
uuagacaaaugaucaccau

SEQ ID NO: 801359 - RNA, 19 nt, Homo sapiens
aagauuaggaugaauguag

SEQ ID NO: 801360 - RNA, 19 nt, Homo sapiens
caugaacuuguccggguua

SEQ ID NO: 801361 - RNA, 19 nt, Homo sapiens
caugagagaacaguauaug

SEQ ID NO: 801362 - RNA, 19 nt, Homo sapiens
aguaaaggaucgugaugag

SEQ ID NO: 801363 - RNA, 19 nt, Homo sapiens
cuacaaaagugaaccaucu

SEQ ID NO: 801364 - RNA, 19 nt, Homo sapiens
ugccuacuguuacucuaaa

SEQ ID NO: 801365 - RNA, 19 nt, Homo sapiens
caguuuacaucuuguuggu

SEQ ID NO: 801366 - RNA, 19 nt, Homo sapiens
cuccucaguuuacaucuug

SEQ ID NO: 801367 - RNA, 19 nt, Homo sapiens
ucagcaaagauuaggauga

SEQ ID NO: 801368 - RNA, 19 nt, Homo sapiens
cagcaggacaagaagaguu

SEQ ID NO: 801369 - RNA, 19 nt, Homo sapiens
cuacuguuacucuaaauag

SEQ ID NO: 801370 - RNA, 19 nt, Homo sapiens
agcagugugugauagauga

SEQ ID NO: 801371 - RNA, 19 nt, Homo sapiens
ggcuaguccuuucugugaa

SEQ ID NO: 801372 - RNA, 19 nt, Homo sapiens
cucuuucucuccucaguuu

SEQ ID NO: 801373 - RNA, 19 nt, Homo sapiens
cagcuuaagguaacauaca

SEQ ID NO: 801374 - RNA, 19 nt, Homo sapiens
uuucaaagacagauucuca

SEQ ID NO: 801375 - RNA, 19 nt, Homo sapiens
auacacagacaugcucuuu

SEQ ID NO: 801376 - RNA, 19 nt, Homo sapiens
cuaaggcugcuucaaagau

SEQ ID NO: 801377 - RNA, 19 nt, Homo sapiens
gaagaguuuggagccauga

SEQ ID NO: 801378 - RNA, 19 nt, Homo sapiens
cggguuaucaggaaauuuc

SEQ ID NO: 801379 - RNA, 19 nt, Homo sapiens
ugaauguagaucaagcuuu

SEQ ID NO: 801380 - RNA, 19 nt, Homo sapiens
caguuagcacggcagcuua

SEQ ID NO: 801381 - RNA, 19 nt, Homo sapiens
gcagauaggcucuuacuuu

SEQ ID NO: 801382 - RNA, 19 nt, Homo sapiens
gaagaaagacucugagaug

SEQ ID NO: 801383 - RNA, 19 nt, Homo sapiens
ucaaauacaucgccaguga

SEQ ID NO: 801384 - RNA, 19 nt, Homo sapiens
gcgaagauguggugcauga

SEQ ID NO: 801385 - RNA, 19 nt, Homo sapiens
gaccuuuacugucguauuu

SEQ ID NO: 801386 - RNA, 19 nt, Homo sapiens
gagacaacguaacaagaua

SEQ ID NO: 801387 - RNA, 19 nt, Homo sapiens
ccaagaaggugaugauugu

SEQ ID NO: 801388 - RNA, 19 nt, Homo sapiens
gaauggagcugugcuaaag

SEQ ID NO: 801389 - RNA, 19 nt, Homo sapiens
gacaagcacuucuucaaug

SEQ ID NO: 801390 - RNA, 19 nt, Homo sapiens
agacagaaccgguuuguuu

SEQ ID NO: 801391 - RNA, 19 nt, Homo sapiens
cagauaggcucuuacuuug

SEQ ID NO: 801392 - RNA, 19 nt, Homo sapiens
ggaaugcacugaauaaagc

SEQ ID NO: 801393 - RNA, 19 nt, Homo sapiens
ggaagacuguaaauacgaa

SEQ ID NO: 801394 - RNA, 19 nt, Homo sapiens
gcaaauccaucuuccuaca

SEQ ID NO: 801395 - RNA, 19 nt, Homo sapiens
gaagacaccuaagcagaga

SEQ ID NO: 801396 - RNA, 19 nt, Homo sapiens
gacagaaccgguuuguuua

SEQ ID NO: 801397 - RNA, 19 nt, Homo sapiens
ccacgugcauucacauuga

SEQ ID NO: 801398 - RNA, 19 nt, Homo sapiens
gcuaaaggauucacacagu

SEQ ID NO: 801399 - RNA, 19 nt, Homo sapiens
ccagaaggguggaaggaaa

SEQ ID NO: 801400 - RNA, 19 nt, Homo sapiens
ggaggaagacuguaaauac

SEQ ID NO: 801401 - RNA, 19 nt, Homo sapiens
gaacacguccuguaacauc

SEQ ID NO: 801402 - RNA, 19 nt, Homo sapiens
cuaccggccuccaguauuu

SEQ ID NO: 801403 - RNA, 19 nt, Homo sapiens
uaaaggauucacacaguua

SEQ ID NO: 801404 - RNA, 19 nt, Homo sapiens
cagaaccgguuuguuuaua

SEQ ID NO: 801405 - RNA, 19 nt, Homo sapiens
guacaaguguccagugauc

SEQ ID NO: 801406 - RNA, 19 nt, Homo sapiens
guucagcacuuccucauca

SEQ ID NO: 801407 - RNA, 19 nt, Homo sapiens
uggaguaauuuaugccuua

SEQ ID NO: 801408 - RNA, 19 nt, Homo sapiens
gaccgcaacucacacauuc

SEQ ID NO: 801409 - RNA, 19 nt, Homo sapiens
ccagaaggauccaagacaa

SEQ ID NO: 801410 - RNA, 19 nt, Homo sapiens
caagguggcuuuccgucuu

SEQ ID NO: 801411 - RNA, 19 nt, Homo sapiens
gcucagaggcuuuccagaa

SEQ ID NO: 801412 - RNA, 19 nt, Homo sapiens
gaucugaauucugcccuuu

SEQ ID NO: 801413 - RNA, 19 nt, Homo sapiens
ggacucagacgguagcauu

SEQ ID NO: 801414 - RNA, 19 nt, Homo sapiens
cuacuaaggugcuaggaau

SEQ ID NO: 801415 - RNA, 19 nt, Homo sapiens
gcgaacacguccuguaaca

SEQ ID NO: 801416 - RNA, 19 nt, Homo sapiens
gaggcaagguguacgucua

SEQ ID NO: 801417 - RNA, 19 nt, Homo sapiens
uaaaagcacucaaguacaa

SEQ ID NO: 801418 - RNA, 19 nt, Homo sapiens
cgaaagagacaacguaaca

SEQ ID NO: 801419 - RNA, 19 nt, Homo sapiens
gaggagacuuugaguugau

SEQ ID NO: 801420 - RNA, 19 nt, Homo sapiens
caagaaccauggugcauac

SEQ ID NO: 801421 - RNA, 19 nt, Homo sapiens
cagaggagacuuugaguug

SEQ ID NO: 801422 - RNA, 19 nt, Homo sapiens
cagcaaauccaucuuccua

SEQ ID NO: 801423 - RNA, 19 nt, Homo sapiens
cgacaucaguggcaauaag

SEQ ID NO: 801424 - RNA, 19 nt, Homo sapiens
gugcauaguacgaccuuua

SEQ ID NO: 801425 - RNA, 19 nt, Homo sapiens
agaaccgguuuguuuauaa

SEQ ID NO: 801426 - RNA, 19 nt, Homo sapiens
ggaauggagcugugcuaaa

SEQ ID NO: 801427 - RNA, 19 nt, Homo sapiens
ggacggcauuuggcauuga

SEQ ID NO: 801428 - RNA, 19 nt, Homo sapiens
cgauuuggguccuccauug

SEQ ID NO: 801429 - RNA, 19 nt, Homo sapiens
ucuaugagcugagacagaa

SEQ ID NO: 801430 - RNA, 19 nt, Homo sapiens
gaaggaaaggagccaagaa

SEQ ID NO: 801431 - RNA, 19 nt, Homo sapiens
gaccucaucucccgagcaa

SEQ ID NO: 801432 - RNA, 19 nt, Homo sapiens
ucacacaguuaccagaaug

SEQ ID NO: 801433 - RNA, 19 nt, Homo sapiens
cuaaaggauucacacaguu

SEQ ID NO: 801434 - RNA, 19 nt, Homo sapiens
ucugagauguggagacuga

SEQ ID NO: 801435 - RNA, 19 nt, Homo sapiens
gaggaagacuguaaauacg

SEQ ID NO: 801436 - RNA, 19 nt, Homo sapiens
gccagcagauaggcucuua

SEQ ID NO: 801437 - RNA, 19 nt, Homo sapiens
gaaccgguuuguuuauaac

SEQ ID NO: 801438 - RNA, 19 nt, Homo sapiens
gcucuuacuuugggaguga

SEQ ID NO: 801439 - RNA, 19 nt, Homo sapiens
gggaggaagacuguaaaua

SEQ ID NO: 801440 - RNA, 19 nt, Homo sapiens
guacgucuaugagcugaga

SEQ ID NO: 801441 - RNA, 19 nt, Homo sapiens
ccgaggagcucaagaacca

SEQ ID NO: 801442 - RNA, 19 nt, Homo sapiens
ggaaaggagccaagaaggu

SEQ ID NO: 801443 - RNA, 19 nt, Homo sapiens
acagcacgguccuaaauau

SEQ ID NO: 801444 - RNA, 19 nt, Homo sapiens
ccacagucuucaucauaga

SEQ ID NO: 801445 - RNA, 19 nt, Homo sapiens
ggaugaagaaagacucuga

SEQ ID NO: 801446 - RNA, 19 nt, Homo sapiens
gagacugggacaccuuuaa

SEQ ID NO: 801447 - RNA, 19 nt, Homo sapiens
ccagcuggcuuugcacuug

SEQ ID NO: 801448 - RNA, 19 nt, Homo sapiens
gcagcagccugagccacua

SEQ ID NO: 801449 - RNA, 19 nt, Homo sapiens
caccacagucuucaucaua

SEQ ID NO: 801450 - RNA, 19 nt, Homo sapiens
gaucaacaucuuccacaga

SEQ ID NO: 801451 - RNA, 19 nt, Homo sapiens
gcaagguguacgucuauga

SEQ ID NO: 801452 - RNA, 19 nt, Homo sapiens
gaacugcaccaaacucaac

SEQ ID NO: 801453 - RNA, 19 nt, Homo sapiens
caaguacaaauccaugaaa

SEQ ID NO: 801454 - RNA, 19 nt, Homo sapiens
uagcgaacacguccuguaa

SEQ ID NO: 801455 - RNA, 19 nt, Homo sapiens
gccagagggugcugaggaa

SEQ ID NO: 801456 - RNA, 19 nt, Homo sapiens
uuaccagaaugcccgauuu

SEQ ID NO: 801457 - RNA, 19 nt, Homo sapiens
uaacggaacgcuaaaggau

SEQ ID NO: 801458 - RNA, 19 nt, Homo sapiens
gaaagagacaacguaacaa

SEQ ID NO: 801459 - RNA, 19 nt, Homo sapiens
cgucagcuaucccuucuuc

SEQ ID NO: 801460 - RNA, 19 nt, Homo sapiens
ccucuggucucaugagugu

SEQ ID NO: 801461 - RNA, 19 nt, Homo sapiens
caagaacgagaccuccuuu

SEQ ID NO: 801462 - RNA, 19 nt, Homo sapiens
acaagcacuucuucaaugu

SEQ ID NO: 801463 - RNA, 19 nt, Homo sapiens
gcauuuggcauugaauuug

SEQ ID NO: 801464 - RNA, 19 nt, Homo sapiens
cagccuugguggcaaauau

SEQ ID NO: 801465 - RNA, 19 nt, Homo sapiens
agaaugaacccaagagcaa

SEQ ID NO: 801466 - RNA, 19 nt, Homo sapiens
gcuaggaauucguaaucau

SEQ ID NO: 801467 - RNA, 19 nt, Homo sapiens
gcacucaaguacaaaucca

SEQ ID NO: 801468 - RNA, 19 nt, Homo sapiens
cgggagacguguacaagug

SEQ ID NO: 801469 - RNA, 19 nt, Homo sapiens
ucaagaaccauggugcaua

SEQ ID NO: 801470 - RNA, 19 nt, Homo sapiens
gagaaggugauccagcaaa

SEQ ID NO: 801471 - RNA, 19 nt, Homo sapiens
gaagauguggugcaugagu

SEQ ID NO: 801472 - RNA, 19 nt, Homo sapiens
cuacauggacaucgucauu

SEQ ID NO: 801473 - RNA, 19 nt, Homo sapiens
gguaugaccagugauaaug

SEQ ID NO: 801474 - RNA, 19 nt, Homo sapiens
aagaaagacucugagaugu

SEQ ID NO: 801475 - RNA, 19 nt, Homo sapiens
gcgcacccauguacuucaa

SEQ ID NO: 801476 - RNA, 19 nt, Homo sapiens
ccagugacccugaugacaa

SEQ ID NO: 801477 - RNA, 19 nt, Homo sapiens
gccaagaaggugaugauug

SEQ ID NO: 801478 - RNA, 19 nt, Homo sapiens
ggguggagguucagcacuu

SEQ ID NO: 801479 - RNA, 19 nt, Homo sapiens
guaaauacgaacccaaucu

SEQ ID NO: 801480 - RNA, 19 nt, Homo sapiens
ccagggaggaagacuguaa

SEQ ID NO: 801481 - RNA, 19 nt, Homo sapiens
ggaggcagcugucuuagua

SEQ ID NO: 801482 - RNA, 19 nt, Homo sapiens
gggaagagcugcugaugaa

SEQ ID NO: 801483 - RNA, 19 nt, Homo sapiens
ggaaagcuuugcauuuaaa

SEQ ID NO: 801484 - RNA, 19 nt, Homo sapiens
gaauagagccgcguacaua

SEQ ID NO: 801485 - RNA, 19 nt, Homo sapiens
aaggaaagcuuugcauuua

SEQ ID NO: 801486 - RNA, 19 nt, Homo sapiens
gcucuuacaucaggaaaua

SEQ ID NO: 801487 - RNA, 19 nt, Homo sapiens
gcagguaucucugguagaa

SEQ ID NO: 801488 - RNA, 19 nt, Homo sapiens
gaauggacauacagaaguu

SEQ ID NO: 801489 - RNA, 19 nt, Homo sapiens
caacaaaacuguauggaaa

SEQ ID NO: 801490 - RNA, 19 nt, Homo sapiens
gauugggucuguuguaauu

SEQ ID NO: 801491 - RNA, 19 nt, Homo sapiens
ucaaagaauugugugcuua

SEQ ID NO: 801492 - RNA, 19 nt, Homo sapiens
cuacugaucugucaccaaa

SEQ ID NO: 801493 - RNA, 19 nt, Homo sapiens
ggauuaacacugaauagua

SEQ ID NO: 801494 - RNA, 19 nt, Homo sapiens
caucugcucuggaauuaaa

SEQ ID NO: 801495 - RNA, 19 nt, Homo sapiens
caaggaggcagcugucuua

SEQ ID NO: 801496 - RNA, 19 nt, Homo sapiens
gagccaaugugacugcuuu

SEQ ID NO: 801497 - RNA, 19 nt, Homo sapiens
caaggaaagcuuugcauuu

SEQ ID NO: 801498 - RNA, 19 nt, Homo sapiens
gcucgaaaguaagggauua

SEQ ID NO: 801499 - RNA, 19 nt, Homo sapiens
ccacauauuuauugccauu

SEQ ID NO: 801500 - RNA, 19 nt, Homo sapiens
gccaagaccugaaauugau

SEQ ID NO: 801501 - RNA, 19 nt, Homo sapiens
ugucaauucuuuccugaua

SEQ ID NO: 801502 - RNA, 19 nt, Homo sapiens
gcaaaguauugauucuguu

SEQ ID NO: 801503 - RNA, 19 nt, Homo sapiens
ggacagcaccaggagauaa

SEQ ID NO: 801504 - RNA, 19 nt, Homo sapiens
auacugaucucucccagaa

SEQ ID NO: 801505 - RNA, 19 nt, Homo sapiens
uaauagagaugagcaagau

SEQ ID NO: 801506 - RNA, 19 nt, Homo sapiens
aaacacucauggauaugua

SEQ ID NO: 801507 - RNA, 19 nt, Homo sapiens
aguaagggauuaacacuga

SEQ ID NO: 801508 - RNA, 19 nt, Homo sapiens
ggauaacacugcaaguucu

SEQ ID NO: 801509 - RNA, 19 nt, Homo sapiens
ccaagcaguucacagaaug

SEQ ID NO: 801510 - RNA, 19 nt, Homo sapiens
guaaaggagagcaaauaaa

SEQ ID NO: 801511 - RNA, 19 nt, Homo sapiens
gaauaaggacguaaacagu

SEQ ID NO: 801512 - RNA, 19 nt, Homo sapiens
agagaaaggcgaauacauu

SEQ ID NO: 801513 - RNA, 19 nt, Homo sapiens
gugauugggucuguuguaa

SEQ ID NO: 801514 - RNA, 19 nt, Homo sapiens
caagaaugauggagucuac

SEQ ID NO: 801515 - RNA, 19 nt, Homo sapiens
gucaaauacuuccuucauu

SEQ ID NO: 801516 - RNA, 19 nt, Homo sapiens
agucauaauucuggaguua

SEQ ID NO: 801517 - RNA, 19 nt, Homo sapiens
gcaacccacauauuuauug

SEQ ID NO: 801518 - RNA, 19 nt, Homo sapiens
gaggccaacuccaaggaaa

SEQ ID NO: 801519 - RNA, 19 nt, Homo sapiens
ccacaguucaugaggauaa

SEQ ID NO: 801520 - RNA, 19 nt, Homo sapiens
acaaggauauguaccuguu

SEQ ID NO: 801521 - RNA, 19 nt, Homo sapiens
aggaauaacuagagaggaa

SEQ ID NO: 801522 - RNA, 19 nt, Homo sapiens
gaaugaaucaagcagcaaa

SEQ ID NO: 801523 - RNA, 19 nt, Homo sapiens
caugggaggugauuagcaa

SEQ ID NO: 801524 - RNA, 19 nt, Homo sapiens
gaaauagugaugaacaaag

SEQ ID NO: 801525 - RNA, 19 nt, Homo sapiens
ggaucccaguggaacaaua

SEQ ID NO: 801526 - RNA, 19 nt, Homo sapiens
caagauaacaggaggaagu

SEQ ID NO: 801527 - RNA, 19 nt, Homo sapiens
gagaugaaccauacaccaa

SEQ ID NO: 801528 - RNA, 19 nt, Homo sapiens
gagagcaaauaaacaacau

SEQ ID NO: 801529 - RNA, 19 nt, Homo sapiens
gaggauaacacugcaaguu

SEQ ID NO: 801530 - RNA, 19 nt, Homo sapiens
gcucuggaauuaaauaugc

SEQ ID NO: 801531 - RNA, 19 nt, Homo sapiens
gguaaggaccgccuaaauc

SEQ ID NO: 801532 - RNA, 19 nt, Homo sapiens
agaauugugugcuuaguuc

SEQ ID NO: 801533 - RNA, 19 nt, Homo sapiens
gaacaaauagaggauaugg

SEQ ID NO: 801534 - RNA, 19 nt, Homo sapiens
gcaaacacugccaggcuaa

SEQ ID NO: 801535 - RNA, 19 nt, Homo sapiens
uaaaggagagcaaauaaac

SEQ ID NO: 801536 - RNA, 19 nt, Homo sapiens
ggucuguuguaauuguuaa

SEQ ID NO: 801537 - RNA, 19 nt, Homo sapiens
gcugaauaauaauggcuuu

SEQ ID NO: 801538 - RNA, 19 nt, Homo sapiens
gaucccaguggaacaauaa

SEQ ID NO: 801539 - RNA, 19 nt, Homo sapiens
gaugaaagaaacacacuca

SEQ ID NO: 801540 - RNA, 19 nt, Homo sapiens
guacugccacuauuguaaa

SEQ ID NO: 801541 - RNA, 19 nt, Homo sapiens
gauuagcaauucugaggau

SEQ ID NO: 801542 - RNA, 19 nt, Homo sapiens
caaugaagaucagccuuuc

SEQ ID NO: 801543 - RNA, 19 nt, Homo sapiens
ggaaaauccucaguacaaa

SEQ ID NO: 801544 - RNA, 19 nt, Homo sapiens
aggaaagcuuugcauuuaa

SEQ ID NO: 801545 - RNA, 19 nt, Homo sapiens
guucaugaggauaagauua

SEQ ID NO: 801546 - RNA, 19 nt, Homo sapiens
ggaggugcauuugugguau

SEQ ID NO: 801547 - RNA, 19 nt, Homo sapiens
guuuaucccucaagcaaau

SEQ ID NO: 801548 - RNA, 19 nt, Homo sapiens
caacauugcacaaguaacu

SEQ ID NO: 801549 - RNA, 19 nt, Homo sapiens
gcacuugggcauacaaucu

SEQ ID NO: 801550 - RNA, 19 nt, Homo sapiens
guacaugggaggugauuag

SEQ ID NO: 801551 - RNA, 19 nt, Homo sapiens
cagaaaauaucucagaaga

SEQ ID NO: 801552 - RNA, 19 nt, Homo sapiens
ggagauaauuuugauguug

SEQ ID NO: 801553 - RNA, 19 nt, Homo sapiens
gaaauucuacaaggauaug

SEQ ID NO: 801554 - RNA, 19 nt, Homo sapiens
gaaaguaagggauuaacac

SEQ ID NO: 801555 - RNA, 19 nt, Homo sapiens
cccuucagcucgaaaguaa

SEQ ID NO: 801556 - RNA, 19 nt, Homo sapiens
ugaaagaaacacacucaug

SEQ ID NO: 801557 - RNA, 19 nt, Homo sapiens
caaaguauugauucuguug

SEQ ID NO: 801558 - RNA, 19 nt, Homo sapiens
ugacuacagcuucuacgua

SEQ ID NO: 801559 - RNA, 19 nt, Homo sapiens
ucaaaaguauccaacauug

SEQ ID NO: 801560 - RNA, 19 nt, Homo sapiens
ggaugcaacuuccaaaaug

SEQ ID NO: 801561 - RNA, 19 nt, Homo sapiens
agaugaagcucagaacaau

SEQ ID NO: 801562 - RNA, 19 nt, Homo sapiens
ccugagaauuggaaggaaa

SEQ ID NO: 801563 - RNA, 19 nt, Homo sapiens
caucccaugugugaucaua

SEQ ID NO: 801564 - RNA, 19 nt, Homo sapiens
ucaaguagaccuagaagag

SEQ ID NO: 801565 - RNA, 19 nt, Homo sapiens
uaccaccauuugaaccuua

SEQ ID NO: 801566 - RNA, 19 nt, Homo sapiens
uaauauuucuacgcuggua

SEQ ID NO: 801567 - RNA, 19 nt, Homo sapiens
ccaaggaaagcuuugcauu

SEQ ID NO: 801568 - RNA, 19 nt, Homo sapiens
gacacguucuuucucauca

SEQ ID NO: 801569 - RNA, 19 nt, Homo sapiens
gggaggugauuagcaauuc

SEQ ID NO: 801570 - RNA, 19 nt, Homo sapiens
gucaauucuuuccugauaa

SEQ ID NO: 801571 - RNA, 19 nt, Homo sapiens
uagaggauauggugacuac

SEQ ID NO: 801572 - RNA, 19 nt, Homo sapiens
ggagagcaaauaaacaaca

SEQ ID NO: 801573 - RNA, 19 nt, Homo sapiens
ucccaugugugaucauaaa

SEQ ID NO: 801574 - RNA, 19 nt, Homo sapiens
gugcaggcgcugauucuuu

SEQ ID NO: 801575 - RNA, 19 nt, Homo sapiens
gagcagcaaauucuucugu

SEQ ID NO: 801576 - RNA, 19 nt, Homo sapiens
cugcaaaggugggcacuug

SEQ ID NO: 801577 - RNA, 19 nt, Homo sapiens
guaagggauuaacacugaa

SEQ ID NO: 801578 - RNA, 19 nt, Homo sapiens
gaugaagcaguaauagaga

SEQ ID NO: 801579 - RNA, 19 nt, Homo sapiens
guucuuguauugaugaagu

SEQ ID NO: 801580 - RNA, 19 nt, Homo sapiens
uuaaguaccaccauuugaa

SEQ ID NO: 801581 - RNA, 19 nt, Homo sapiens
gaaccgaacuuuaccauua

SEQ ID NO: 801582 - RNA, 19 nt, Homo sapiens
uuacauagcugaucguuua

SEQ ID NO: 801583 - RNA, 19 nt, Homo sapiens
gaagugguauuauccauuu

SEQ ID NO: 801584 - RNA, 19 nt, Homo sapiens
gaaaugaggaugcagaaua

SEQ ID NO: 801585 - RNA, 19 nt, Homo sapiens
ggacuuugcuggguucuua

SEQ ID NO: 801586 - RNA, 19 nt, Homo sapiens
gaacaaauuugauguggau

SEQ ID NO: 801587 - RNA, 19 nt, Homo sapiens
gaaagagaaugaagagaga

SEQ ID NO: 801588 - RNA, 19 nt, Homo sapiens
cuaaaugccuucgcuauua

SEQ ID NO: 801589 - RNA, 19 nt, Homo sapiens
gcaauugaccguuugguua

SEQ ID NO: 801590 - RNA, 19 nt, Homo sapiens
ggaugcagcugaugagaaa

SEQ ID NO: 801591 - RNA, 19 nt, Homo sapiens
gacaugaggucaaagauug

SEQ ID NO: 801592 - RNA, 19 nt, Homo sapiens
gagaagaauucaaaccaaa

SEQ ID NO: 801593 - RNA, 19 nt, Homo sapiens
gaacugaauucauggacaa

SEQ ID NO: 801594 - RNA, 19 nt, Homo sapiens
gcacaagaauuagguuuga

SEQ ID NO: 801595 - RNA, 19 nt, Homo sapiens
ggaaaguugugcagucgua

SEQ ID NO: 801596 - RNA, 19 nt, Homo sapiens
guacuugucuuacagaaau

SEQ ID NO: 801597 - RNA, 19 nt, Homo sapiens
gaacuggcauuuacagcaa

SEQ ID NO: 801598 - RNA, 19 nt, Homo sapiens
gcuacgagcugcccuagaa

SEQ ID NO: 801599 - RNA, 19 nt, Homo sapiens
cagaauaacucuaguccuu

SEQ ID NO: 801600 - RNA, 19 nt, Homo sapiens
gaagagaccagaagaaaca

SEQ ID NO: 801601 - RNA, 19 nt, Homo sapiens
ggaaagagaacucacaaug

SEQ ID NO: 801602 - RNA, 19 nt, Homo sapiens
ggucaaagauugugaaggu

SEQ ID NO: 801603 - RNA, 19 nt, Homo sapiens
gauccugauucuaguauaa

SEQ ID NO: 801604 - RNA, 19 nt, Homo sapiens
aaaugaggaugcagaauaa

SEQ ID NO: 801605 - RNA, 19 nt, Homo sapiens
gcugaucguuuaaauaaug

SEQ ID NO: 801606 - RNA, 19 nt, Homo sapiens
gggaagaaauauuggcaaa

SEQ ID NO: 801607 - RNA, 19 nt, Homo sapiens
ggcggaagcucaugaguga

SEQ ID NO: 801608 - RNA, 19 nt, Homo sapiens
gcuggguucuuagauauua

SEQ ID NO: 801609 - RNA, 19 nt, Homo sapiens
gaggugaugucuuauuugu

SEQ ID NO: 801610 - RNA, 19 nt, Homo sapiens
gaguacagaugaucauguu

SEQ ID NO: 801611 - RNA, 19 nt, Homo sapiens
ggaauaggaguacugguuu

SEQ ID NO: 801612 - RNA, 19 nt, Homo sapiens
caguggaucugaauuuauu

SEQ ID NO: 801613 - RNA, 19 nt, Homo sapiens
ccuuggaggugaugucuua

SEQ ID NO: 801614 - RNA, 19 nt, Homo sapiens
gggaaagcaugaugaacuu

SEQ ID NO: 801615 - RNA, 19 nt, Homo sapiens
ggaguuugauaaucuguau

SEQ ID NO: 801616 - RNA, 19 nt, Homo sapiens
ccaaauccuuucaucauuc

SEQ ID NO: 801617 - RNA, 19 nt, Homo sapiens
ggaagcagcgguacuacaa

SEQ ID NO: 801618 - RNA, 19 nt, Homo sapiens
ggacaugaggucaaagauu

SEQ ID NO: 801619 - RNA, 19 nt, Homo sapiens
ucagcaaacuagaguauau

SEQ ID NO: 801620 - RNA, 19 nt, Homo sapiens
gaaagagaacucacaaugg

SEQ ID NO: 801621 - RNA, 19 nt, Homo sapiens
guaaucaguuuggacauga

SEQ ID NO: 801622 - RNA, 19 nt, Homo sapiens
gcucccgucucuuugguua

SEQ ID NO: 801623 - RNA, 19 nt, Homo sapiens
guguaaagauuccaguuga

SEQ ID NO: 801624 - RNA, 19 nt, Homo sapiens
gaagggaaagcaugaugaa

SEQ ID NO: 801625 - RNA, 19 nt, Homo sapiens
caaguacccguccaucaua

SEQ ID NO: 801626 - RNA, 19 nt, Homo sapiens
ggaaucauccaucccugua

SEQ ID NO: 801627 - RNA, 19 nt, Homo sapiens
ccaguaaaccuaauccaaa

SEQ ID NO: 801628 - RNA, 19 nt, Homo sapiens
gaauuagguuugaacucuu

SEQ ID NO: 801629 - RNA, 19 nt, Homo sapiens
uacaguggaucugaauuua

SEQ ID NO: 801630 - RNA, 19 nt, Homo sapiens
ucaagaaauucaccagguu

SEQ ID NO: 801631 - RNA, 19 nt, Homo sapiens
ugaacuaugucaugggauu

SEQ ID NO: 801632 - RNA, 19 nt, Homo sapiens
acacaugaaccgaacuuua

SEQ ID NO: 801633 - RNA, 19 nt, Homo sapiens
gaaagugguuaugucaauc

SEQ ID NO: 801634 - RNA, 19 nt, Homo sapiens
gagcccagccuaaccauga

SEQ ID NO: 801635 - RNA, 19 nt, Homo sapiens
uggacaaucuugcuaaaug

SEQ ID NO: 801636 - RNA, 19 nt, Homo sapiens
uggaggugaugucuuauuu

SEQ ID NO: 801637 - RNA, 19 nt, Homo sapiens
acaagcagccuaugaaaug

SEQ ID NO: 801638 - RNA, 19 nt, Homo sapiens
gagacaagcagccuaugaa

SEQ ID NO: 801639 - RNA, 19 nt, Homo sapiens
gaaguugaggauagcauuu

SEQ ID NO: 801640 - RNA, 19 nt, Homo sapiens
agaaagugguuaugucaau

SEQ ID NO: 801641 - RNA, 19 nt, Homo sapiens
caauugaccguuugguuaa

SEQ ID NO: 801642 - RNA, 19 nt, Homo sapiens
gaacuugccgauagucuuc

SEQ ID NO: 801643 - RNA, 19 nt, Homo sapiens
guaaaccuaauccaaauga

SEQ ID NO: 801644 - RNA, 19 nt, Homo sapiens
ggacaagcccagauuccaa

SEQ ID NO: 801645 - RNA, 19 nt, Homo sapiens
uaacucuaguccuucgaua

SEQ ID NO: 801646 - RNA, 19 nt, Homo sapiens
gcaaguacccguccaucau

SEQ ID NO: 801647 - RNA, 19 nt, Homo sapiens
gcuaaaugccuucgcuauu

SEQ ID NO: 801648 - RNA, 19 nt, Homo sapiens
caguaaaccuaauccaaau

SEQ ID NO: 801649 - RNA, 19 nt, Homo sapiens
gcucaggaacuggcauuua

SEQ ID NO: 801650 - RNA, 19 nt, Homo sapiens
guuagcaguuggugaaguu

SEQ ID NO: 801651 - RNA, 19 nt, Homo sapiens
ggacaaucuugcuaaaugc

SEQ ID NO: 801652 - RNA, 19 nt, Homo sapiens
ucaggaagauacaauugga

SEQ ID NO: 801653 - RNA, 19 nt, Homo sapiens
gcaauggacggcaguggaa

SEQ ID NO: 801654 - RNA, 19 nt, Homo sapiens
cagaagagaccagaagaaa

SEQ ID NO: 801655 - RNA, 19 nt, Homo sapiens
caagcagccuaugaaauga

SEQ ID NO: 801656 - RNA, 19 nt, Homo sapiens
gugaguauuuggaaagaga

SEQ ID NO: 801657 - RNA, 19 nt, Homo sapiens
gaagaaauauuggcaaaag

SEQ ID NO: 801658 - RNA, 19 nt, Homo sapiens
ccaagaggcucaggaacug

SEQ ID NO: 801659 - RNA, 19 nt, Homo sapiens
ggaagugguauuauccauu

SEQ ID NO: 801660 - RNA, 19 nt, Homo sapiens
ccuucgauaucuccuaaua

SEQ ID NO: 801661 - RNA, 19 nt, Homo sapiens
guucucaaguagccaguaa

SEQ ID NO: 801662 - RNA, 19 nt, Homo sapiens
gaaauucaccagguucuca

SEQ ID NO: 801663 - RNA, 19 nt, Homo sapiens
caaccagcuuucacuccua

SEQ ID NO: 801664 - RNA, 19 nt, Homo sapiens
gcgagucagggaagaaaua

SEQ ID NO: 801665 - RNA, 19 nt, Homo sapiens
guacucauccugaagacaa

SEQ ID NO: 801666 - RNA, 19 nt, Homo sapiens
uaagauccaugcugauuuu

SEQ ID NO: 801667 - RNA, 19 nt, Homo sapiens
aaacuacaguacuuugugu

SEQ ID NO: 801668 - RNA, 19 nt, Homo sapiens
cccaaauccuuucaucauu

SEQ ID NO: 801669 - RNA, 19 nt, Homo sapiens
caccaccaccugugacuua

SEQ ID NO: 801670 - RNA, 19 nt, Homo sapiens
agaggauaaugucagguua

SEQ ID NO: 801671 - RNA, 19 nt, Homo sapiens
ucaaagauugugaagguuu

SEQ ID NO: 801672 - RNA, 19 nt, Homo sapiens
gaagaauucaaaccaaaca

SEQ ID NO: 801673 - RNA, 19 nt, Homo sapiens
ggaagcagcagucgagaag

SEQ ID NO: 801674 - RNA, 19 nt, Homo sapiens
gagaggacaagcccagauu

SEQ ID NO: 801675 - RNA, 19 nt, Homo sapiens
gguacuacaagaacaaauu

SEQ ID NO: 801676 - RNA, 19 nt, Homo sapiens
uaggaggaauuaagcgaaa

SEQ ID NO: 801677 - RNA, 19 nt, Homo sapiens
guacagaugaucauguuag

SEQ ID NO: 801678 - RNA, 19 nt, Homo sapiens
cauguggucuuuguaauca

SEQ ID NO: 801679 - RNA, 19 nt, Homo sapiens
agagaagaauucaaaccaa

SEQ ID NO: 801680 - RNA, 19 nt, Homo sapiens
gcaaagagcccagccuaac

SEQ ID NO: 801681 - RNA, 19 nt, Homo sapiens
caaugaagaugaagacaua

SEQ ID NO: 801682 - RNA, 19 nt, Homo sapiens
gaaagagagugagcucaua

SEQ ID NO: 801683 - RNA, 19 nt, Homo sapiens
gaucuaaucucccuaaucu

SEQ ID NO: 801684 - RNA, 19 nt, Homo sapiens
ugaaagagcucucguacug

SEQ ID NO: 801685 - RNA, 19 nt, Homo sapiens
ggagaaacccuacaaaugu

SEQ ID NO: 801686 - RNA, 19 nt, Homo sapiens
caaguuacauguaugagaa

SEQ ID NO: 801687 - RNA, 19 nt, Homo sapiens
ucgcaggucuagcauauua

SEQ ID NO: 801688 - RNA, 19 nt, Homo sapiens
caaugaaagugaaagauga

SEQ ID NO: 801689 - RNA, 19 nt, Homo sapiens
ugaaaucccuuacagcuau

SEQ ID NO: 801690 - RNA, 19 nt, Homo sapiens
cauaggagaugauucaaug

SEQ ID NO: 801691 - RNA, 19 nt, Homo sapiens
gaacgcccauuccagugua

SEQ ID NO: 801692 - RNA, 19 nt, Homo sapiens
ugaaagagaugagaauguu

SEQ ID NO: 801693 - RNA, 19 nt, Homo sapiens
gcugaaggguuaagaucua

SEQ ID NO: 801694 - RNA, 19 nt, Homo sapiens
gagcgugccuucugagaga

SEQ ID NO: 801695 - RNA, 19 nt, Homo sapiens
aaccaaaucucaugaaaug

SEQ ID NO: 801696 - RNA, 19 nt, Homo sapiens
gaaauucauuggugagaag

SEQ ID NO: 801697 - RNA, 19 nt, Homo sapiens
gcagcgacauggaagauau

SEQ ID NO: 801698 - RNA, 19 nt, Homo sapiens
gagaaacccuacaaaugug

SEQ ID NO: 801699 - RNA, 19 nt, Homo sapiens
cauguugucucauucgaua

SEQ ID NO: 801700 - RNA, 19 nt, Homo sapiens
ggagaugugcuauaugaaa

SEQ ID NO: 801701 - RNA, 19 nt, Homo sapiens
gcucaaugccucagaaauu

SEQ ID NO: 801702 - RNA, 19 nt, Homo sapiens
gaaauuauucgcaggucua

SEQ ID NO: 801703 - RNA, 19 nt, Homo sapiens
gaaacacugucuuccuuca

SEQ ID NO: 801704 - RNA, 19 nt, Homo sapiens
ggagaugguuccaguuauc

SEQ ID NO: 801705 - RNA, 19 nt, Homo sapiens
ccggagaugugcuauauga

SEQ ID NO: 801706 - RNA, 19 nt, Homo sapiens
gaagaacgccagaaucaca

SEQ ID NO: 801707 - RNA, 19 nt, Homo sapiens
gcagagaugggaagugaaa

SEQ ID NO: 801708 - RNA, 19 nt, Homo sapiens
gcagagaaguucccuugag

SEQ ID NO: 801709 - RNA, 19 nt, Homo sapiens
ucacauagccagaggagaa

SEQ ID NO: 801710 - RNA, 19 nt, Homo sapiens
gagaaggcccagccaauga

SEQ ID NO: 801711 - RNA, 19 nt, Homo sapiens
ugacuacaguuuaaccaaa

SEQ ID NO: 801712 - RNA, 19 nt, Homo sapiens
ucaaagugaucgacaagga

SEQ ID NO: 801713 - RNA, 19 nt, Homo sapiens
gcaaugggaugccacuucu

SEQ ID NO: 801714 - RNA, 19 nt, Homo sapiens
cagcuucaaugucuuaaug

SEQ ID NO: 801715 - RNA, 19 nt, Homo sapiens
ugaauucucgucucacaua

SEQ ID NO: 801716 - RNA, 19 nt, Homo sapiens
gguaugaauucucgucuca

SEQ ID NO: 801717 - RNA, 19 nt, Homo sapiens
cucaagagcuggaaaggaa

SEQ ID NO: 801718 - RNA, 19 nt, Homo sapiens
uuacagcuauucaagagaa

SEQ ID NO: 801719 - RNA, 19 nt, Homo sapiens
gaaagugaaagaugaauac

SEQ ID NO: 801720 - RNA, 19 nt, Homo sapiens
gaagccugcugaagugaau

SEQ ID NO: 801721 - RNA, 19 nt, Homo sapiens
uaacauguguggagaucga

SEQ ID NO: 801722 - RNA, 19 nt, Homo sapiens
guucauaagcgaagccaua

SEQ ID NO: 801723 - RNA, 19 nt, Homo sapiens
gaaaucccuuacagcuauu

SEQ ID NO: 801724 - RNA, 19 nt, Homo sapiens
gaaagagaugagaauguuu

SEQ ID NO: 801725 - RNA, 19 nt, Homo sapiens
ucuaaucucccuaaucuaa

SEQ ID NO: 801726 - RNA, 19 nt, Homo sapiens
gcaaauccacaaagaggaa

SEQ ID NO: 801727 - RNA, 19 nt, Homo sapiens
ggauugcuccuauguauuc

SEQ ID NO: 801728 - RNA, 19 nt, Homo sapiens
aagcagagaugggaaguga

SEQ ID NO: 801729 - RNA, 19 nt, Homo sapiens
caacuaugcaugccaaaga

SEQ ID NO: 801730 - RNA, 19 nt, Homo sapiens
cauggaagauauacaaaca

SEQ ID NO: 801731 - RNA, 19 nt, Homo sapiens
aaaugacagucuaagagua

SEQ ID NO: 801732 - RNA, 19 nt, Homo sapiens
aaucacaucuaucagcaaa

SEQ ID NO: 801733 - RNA, 19 nt, Homo sapiens
caaaucucaugaaauggaa

SEQ ID NO: 801734 - RNA, 19 nt, Homo sapiens
gguauuuggucauuaucuu

SEQ ID NO: 801735 - RNA, 19 nt, Homo sapiens
ggacuugaauuuuauggaa

SEQ ID NO: 801736 - RNA, 19 nt, Homo sapiens
acagaagccugcugaagug

SEQ ID NO: 801737 - RNA, 19 nt, Homo sapiens
gggaggugauggaugugua

SEQ ID NO: 801738 - RNA, 19 nt, Homo sapiens
gaaagaugaauacagugaa

SEQ ID NO: 801739 - RNA, 19 nt, Homo sapiens
cgacauggaagauauacaa

SEQ ID NO: 801740 - RNA, 19 nt, Homo sapiens
aaacaaaugcggaacugaa

SEQ ID NO: 801741 - RNA, 19 nt, Homo sapiens
gaagacauaggagaugauu

SEQ ID NO: 801742 - RNA, 19 nt, Homo sapiens
ggagaaggcccagccaaug

SEQ ID NO: 801743 - RNA, 19 nt, Homo sapiens
gagaugugcuauaugaaac

SEQ ID NO: 801744 - RNA, 19 nt, Homo sapiens
ugacagcaaccaugaagaa

SEQ ID NO: 801745 - RNA, 19 nt, Homo sapiens
ugaauacagugaaagagau

SEQ ID NO: 801746 - RNA, 19 nt, Homo sapiens
ccaaaucucaugaaaugga

SEQ ID NO: 801747 - RNA, 19 nt, Homo sapiens
gcaggucuagcauauuauu

SEQ ID NO: 801748 - RNA, 19 nt, Homo sapiens
ugucuuccuucagaaauua

SEQ ID NO: 801749 - RNA, 19 nt, Homo sapiens
ucaauaacgccaucagcua

SEQ ID NO: 801750 - RNA, 19 nt, Homo sapiens
gacuacaguuuaaccaaau

SEQ ID NO: 801751 - RNA, 19 nt, Homo sapiens
gaccucgccuaacagauug

SEQ ID NO: 801752 - RNA, 19 nt, Homo sapiens
ugaccucgccuaacagauu

SEQ ID NO: 801753 - RNA, 19 nt, Homo sapiens
gccaugaucgguaugaauu

SEQ ID NO: 801754 - RNA, 19 nt, Homo sapiens
caucagcuucaaugucuua

SEQ ID NO: 801755 - RNA, 19 nt, Homo sapiens
ugaaagaugaauacaguga

SEQ ID NO: 801756 - RNA, 19 nt, Homo sapiens
agacauaggagaugauuca

SEQ ID NO: 801757 - RNA, 19 nt, Homo sapiens
ccuaacagauugcucucaa

SEQ ID NO: 801758 - RNA, 19 nt, Homo sapiens
ucucagggauugcuccuau

SEQ ID NO: 801759 - RNA, 19 nt, Homo sapiens
caauaacgccaucagcuau

SEQ ID NO: 801760 - RNA, 19 nt, Homo sapiens
ggacagauuagcaagcaau

SEQ ID NO: 801761 - RNA, 19 nt, Homo sapiens
gauaguagcaggccaacca

SEQ ID NO: 801762 - RNA, 19 nt, Homo sapiens
caguugaccucgccuaaca

SEQ ID NO: 801763 - RNA, 19 nt, Homo sapiens
gccagaaucacaucuauca

SEQ ID NO: 801764 - RNA, 19 nt, Homo sapiens
gcagaaagugcagcgguuu

SEQ ID NO: 801765 - RNA, 19 nt, Homo sapiens
ggaccaagccaucaauaac

SEQ ID NO: 801766 - RNA, 19 nt, Homo sapiens
cuacagcaguggaaugagu

SEQ ID NO: 801767 - RNA, 19 nt, Homo sapiens
gcacucaggagcagucugu

SEQ ID NO: 801768 - RNA, 19 nt, Homo sapiens
uaucuggucucagggauug

SEQ ID NO: 801769 - RNA, 19 nt, Homo sapiens
gagagugagcucauacaga

SEQ ID NO: 801770 - RNA, 19 nt, Homo sapiens
gugcagcgguuuugaauga

SEQ ID NO: 801771 - RNA, 19 nt, Homo sapiens
agugaaagaugaauacagu

SEQ ID NO: 801772 - RNA, 19 nt, Homo sapiens
ggaggcaagacacaucaaa

SEQ ID NO: 801773 - RNA, 19 nt, Homo sapiens
uggagaaacccuacaaaug

SEQ ID NO: 801774 - RNA, 19 nt, Homo sapiens
gcgaagccauacuggugaa

SEQ ID NO: 801775 - RNA, 19 nt, Homo sapiens
aaacauacucaguuccaaa

SEQ ID NO: 801776 - RNA, 19 nt, Homo sapiens
ggagcgcugccguacauuu

SEQ ID NO: 801777 - RNA, 19 nt, Homo sapiens
ucaaugaaagugaaagaug

SEQ ID NO: 801778 - RNA, 19 nt, Homo sapiens
caaagugaucgacaaggaa

SEQ ID NO: 801779 - RNA, 19 nt, Homo sapiens
guacuggacagauuagcaa

SEQ ID NO: 801780 - RNA, 19 nt, Homo sapiens
aagaugaacugcgaugugu

SEQ ID NO: 801781 - RNA, 19 nt, Homo sapiens
guaaagaacugcacaugaa

SEQ ID NO: 801782 - RNA, 19 nt, Homo sapiens
ugagagaccugcugucaua

SEQ ID NO: 801783 - RNA, 19 nt, Homo sapiens
ucaccuggcuuguuuauuu

SEQ ID NO: 801784 - RNA, 19 nt, Homo sapiens
gagagaagccguucaaaug

SEQ ID NO: 801785 - RNA, 19 nt, Homo sapiens
ccuaagagauucugauuug

SEQ ID NO: 801786 - RNA, 19 nt, Homo sapiens
cgacagagcuggaaaugca

SEQ ID NO: 801787 - RNA, 19 nt, Homo sapiens
cauuugcucugccuaauua

SEQ ID NO: 801788 - RNA, 19 nt, Homo sapiens
gcgggaauauuguuucuuu

SEQ ID NO: 801789 - RNA, 19 nt, Homo sapiens
gcaggacuuuggugguuua

SEQ ID NO: 801790 - RNA, 19 nt, Homo sapiens
gaaggaggcugagcugaug

SEQ ID NO: 801791 - RNA, 19 nt, Homo sapiens
gaacuuaacauaugagaag

SEQ ID NO: 801792 - RNA, 19 nt, Homo sapiens
ggagaaggagaacagauua

SEQ ID NO: 801793 - RNA, 19 nt, Homo sapiens
gcugagaucucccgacaga

SEQ ID NO: 801794 - RNA, 19 nt, Homo sapiens
ggaagaaacagaagagaga

SEQ ID NO: 801795 - RNA, 19 nt, Homo sapiens
gaacaagagccuauuaugg

SEQ ID NO: 801796 - RNA, 19 nt, Homo sapiens
uaagagcaguccauuucua

SEQ ID NO: 801797 - RNA, 19 nt, Homo sapiens
cgauucagcuacccagaua

SEQ ID NO: 801798 - RNA, 19 nt, Homo sapiens
gcagagugaugaagagugu

SEQ ID NO: 801799 - RNA, 19 nt, Homo sapiens
gaacugcacaugaagaaau

SEQ ID NO: 801800 - RNA, 19 nt, Homo sapiens
acaacuaucuccagaaugu

SEQ ID NO: 801801 - RNA, 19 nt, Homo sapiens
ccacaacuaucuccagaau

SEQ ID NO: 801802 - RNA, 19 nt, Homo sapiens
guucaaauguccuuucugu

SEQ ID NO: 801803 - RNA, 19 nt, Homo sapiens
cauaaagauucaccuaaga

SEQ ID NO: 801804 - RNA, 19 nt, Homo sapiens
ccaggaccguuaugaguuu

SEQ ID NO: 801805 - RNA, 19 nt, Homo sapiens
gaaggaggaugucaaagcu

SEQ ID NO: 801806 - RNA, 19 nt, Homo sapiens
gggaaaagcucaugcgauu

SEQ ID NO: 801807 - RNA, 19 nt, Homo sapiens
ggaaacagacgcuauugau

SEQ ID NO: 801808 - RNA, 19 nt, Homo sapiens
uauggaagauuguaaggaa

SEQ ID NO: 801809 - RNA, 19 nt, Homo sapiens
gagcugaugcagucucaua

SEQ ID NO: 801810 - RNA, 19 nt, Homo sapiens
ggaccaagccaucaacaau

SEQ ID NO: 801811 - RNA, 19 nt, Homo sapiens
ggagagaagccguucaaau

SEQ ID NO: 801812 - RNA, 19 nt, Homo sapiens
guuguggguucuauguuua

SEQ ID NO: 801813 - RNA, 19 nt, Homo sapiens
ggacuuuggugguuuaaaa

SEQ ID NO: 801814 - RNA, 19 nt, Homo sapiens
gaugcagucucauaugaug

SEQ ID NO: 801815 - RNA, 19 nt, Homo sapiens
caaauucaguaaagcuaga

SEQ ID NO: 801816 - RNA, 19 nt, Homo sapiens
aagaggagcugaguuguug

SEQ ID NO: 801817 - RNA, 19 nt, Homo sapiens
gaagaaauaccgcacuuac

SEQ ID NO: 801818 - RNA, 19 nt, Homo sapiens
ggaaacugcugauagucau

SEQ ID NO: 801819 - RNA, 19 nt, Homo sapiens
gaaacagacgcuauugaug

SEQ ID NO: 801820 - RNA, 19 nt, Homo sapiens
caucugagguccugugauc

SEQ ID NO: 801821 - RNA, 19 nt, Homo sapiens
ggaacaagagccuauuaug

SEQ ID NO: 801822 - RNA, 19 nt, Homo sapiens
gagaagccguucaaauguc

SEQ ID NO: 801823 - RNA, 19 nt, Homo sapiens
ccagauauucacuuugaua

SEQ ID NO: 801824 - RNA, 19 nt, Homo sapiens
agcaauagcugccuggauu

SEQ ID NO: 801825 - RNA, 19 nt, Homo sapiens
cuacccagauauucacuuu

SEQ ID NO: 801826 - RNA, 19 nt, Homo sapiens
ugaagagugugacaggaaa

SEQ ID NO: 801827 - RNA, 19 nt, Homo sapiens
gggcaggacuuuggugguu

SEQ ID NO: 801828 - RNA, 19 nt, Homo sapiens
gaaauaccgcacuuacaau

SEQ ID NO: 801829 - RNA, 19 nt, Homo sapiens
ugaaggacaucuacaaggu

SEQ ID NO: 801830 - RNA, 19 nt, Homo sapiens
gaccugcugucauagagaa

SEQ ID NO: 801831 - RNA, 19 nt, Homo sapiens
ucaaauguccuuucuguag

SEQ ID NO: 801832 - RNA, 19 nt, Homo sapiens
ccaaugugcuuaugguaca

SEQ ID NO: 801833 - RNA, 19 nt, Homo sapiens
gaauccggcuuccgaaugg

SEQ ID NO: 801834 - RNA, 19 nt, Homo sapiens
cagcaugccucaccaaguc

SEQ ID NO: 801835 - RNA, 19 nt, Homo sapiens
gagguccugugaucuuauu

SEQ ID NO: 801836 - RNA, 19 nt, Homo sapiens
agaaauaccgcacuuacaa

SEQ ID NO: 801837 - RNA, 19 nt, Homo sapiens
ucagaaagcagccaugaug

SEQ ID NO: 801838 - RNA, 19 nt, Homo sapiens
ucauaaagauucaccuaag

SEQ ID NO: 801839 - RNA, 19 nt, Homo sapiens
uuuaucaccuggcuuguuu

SEQ ID NO: 801840 - RNA, 19 nt, Homo sapiens
cuucagagaucauggaaca

SEQ ID NO: 801841 - RNA, 19 nt, Homo sapiens
gauuagggccuucaagugu

SEQ ID NO: 801842 - RNA, 19 nt, Homo sapiens
gacaagcacaaauucagua

SEQ ID NO: 801843 - RNA, 19 nt, Homo sapiens
cagggaaacugcugauagu

SEQ ID NO: 801844 - RNA, 19 nt, Homo sapiens
gaacgccccuuccacugua

SEQ ID NO: 801845 - RNA, 19 nt, Homo sapiens
ucagaauuaugauggaaga

SEQ ID NO: 801846 - RNA, 19 nt, Homo sapiens
caguaaagcuagaaaugca

SEQ ID NO: 801847 - RNA, 19 nt, Homo sapiens
gcuauugauggcuauauaa

SEQ ID NO: 801848 - RNA, 19 nt, Homo sapiens
gcauugcacuuugacuaug

SEQ ID NO: 801849 - RNA, 19 nt, Homo sapiens
gcacuuacaaucccaccuu

SEQ ID NO: 801850 - RNA, 19 nt, Homo sapiens
acccagauauucacuuuga

SEQ ID NO: 801851 - RNA, 19 nt, Homo sapiens
ggacaccucaggacccauu

SEQ ID NO: 801852 - RNA, 19 nt, Homo sapiens
gcacuccaauauggcaauu

SEQ ID NO: 801853 - RNA, 19 nt, Homo sapiens
ugacgucuguggcaugguu

SEQ ID NO: 801854 - RNA, 19 nt, Homo sapiens
aagcacaaauucaguaaag

SEQ ID NO: 801855 - RNA, 19 nt, Homo sapiens
gaagaaacagaagagagaa

SEQ ID NO: 801856 - RNA, 19 nt, Homo sapiens
caccuuuccucaaauguug

SEQ ID NO: 801857 - RNA, 19 nt, Homo sapiens
aggaggaugucaaagcuuu

SEQ ID NO: 801858 - RNA, 19 nt, Homo sapiens
ucugagacacauaaaguua

SEQ ID NO: 801859 - RNA, 19 nt, Homo sapiens
gaagaaccccuaauugaga

SEQ ID NO: 801860 - RNA, 19 nt, Homo sapiens
aaucccaccuuuccucaaa

SEQ ID NO: 801861 - RNA, 19 nt, Homo sapiens
ccacuggaaugcaacaucu

SEQ ID NO: 801862 - RNA, 19 nt, Homo sapiens
uauauaacgugugacaaug

SEQ ID NO: 801863 - RNA, 19 nt, Homo sapiens
cugaugcagucucauauga

SEQ ID NO: 801864 - RNA, 19 nt, Homo sapiens
augguaaacugaaauguga

SEQ ID NO: 801865 - RNA, 19 nt, Homo sapiens
cgggaauauuguuucuuua

SEQ ID NO: 801866 - RNA, 19 nt, Homo sapiens
ucaggucuaucauccaaau

SEQ ID NO: 801867 - RNA, 19 nt, Homo sapiens
guaaggaacaagagccuau

SEQ ID NO: 801868 - RNA, 19 nt, Homo sapiens
gaccaagccaucaacaaug

SEQ ID NO: 801869 - RNA, 19 nt, Homo sapiens
aacaagagccuauuaugga

SEQ ID NO: 801870 - RNA, 19 nt, Homo sapiens
ggaacgcugccacaacuau

SEQ ID NO: 801871 - RNA, 19 nt, Homo sapiens
uuaagggccaccuacaaua

SEQ ID NO: 801872 - RNA, 19 nt, Homo sapiens
uguuguggguucuauguuu

SEQ ID NO: 801873 - RNA, 19 nt, Homo sapiens
ccuaagaggagcugaguug

SEQ ID NO: 801874 - RNA, 19 nt, Homo sapiens
acagaagccaggaccguua

SEQ ID NO: 801875 - RNA, 19 nt, Homo sapiens
gggaaacugcugauaguca

SEQ ID NO: 801876 - RNA, 19 nt, Homo sapiens
gaaaagcucaugcgauuca

SEQ ID NO: 801877 - RNA, 19 nt, Homo sapiens
uaagaggagcugaguuguu

SEQ ID NO: 801878 - RNA, 19 nt, Homo sapiens
aagauucaccuaagagauu

SEQ ID NO: 801879 - RNA, 19 nt, Homo sapiens
ucuacaaggucuucaaugg

SEQ ID NO: 801880 - RNA, 19 nt, Homo sapiens
ccaccuacaauacaucuga

SEQ ID NO: 801881 - RNA, 19 nt, Homo sapiens
uaacugcacugaaaccauu

SEQ ID NO: 801882 - RNA, 19 nt, Homo sapiens
ccaccuaacugcacugaaa

SEQ ID NO: 801883 - RNA, 19 nt, Homo sapiens
gaaaagaaauggcgaccaa

SEQ ID NO: 801884 - RNA, 19 nt, Homo sapiens
ccaacaaggucgauuugau

SEQ ID NO: 801885 - RNA, 19 nt, Homo sapiens
guaauuaggcaacagauuc

SEQ ID NO: 801886 - RNA, 19 nt, Homo sapiens
caacaaggucgauuugaug

SEQ ID NO: 801887 - RNA, 19 nt, Homo sapiens
gguuggguguuguugguua

SEQ ID NO: 801888 - RNA, 19 nt, Homo sapiens
gcaggaagcagcaucaagu

SEQ ID NO: 801889 - RNA, 19 nt, Homo sapiens
ggacccaccucucaauguc

SEQ ID NO: 801890 - RNA, 19 nt, Homo sapiens
guuguugguuauuugguua

SEQ ID NO: 801891 - RNA, 19 nt, Homo sapiens
ugaaacauacggagauuga

SEQ ID NO: 801892 - RNA, 19 nt, Homo sapiens
ugaagacuccuaccugaaa

SEQ ID NO: 801893 - RNA, 19 nt, Homo sapiens
ucaaagacagggagucauu

SEQ ID NO: 801894 - RNA, 19 nt, Homo sapiens
cgacaaagccuuccaugac

SEQ ID NO: 801895 - RNA, 19 nt, Homo sapiens
gggaaggccaccuguuaaa

SEQ ID NO: 801896 - RNA, 19 nt, Homo sapiens
ugaccucguuagaguaauu

SEQ ID NO: 801897 - RNA, 19 nt, Homo sapiens
aagggaaggccaccuguua

SEQ ID NO: 801898 - RNA, 19 nt, Homo sapiens
gccagaagaagaagaagaa

SEQ ID NO: 801899 - RNA, 19 nt, Homo sapiens
gaaauggcgaccaaacaca

SEQ ID NO: 801900 - RNA, 19 nt, Homo sapiens
caauauuccguacauagaa

SEQ ID NO: 801901 - RNA, 19 nt, Homo sapiens
acacaauauuccguacaua

SEQ ID NO: 801902 - RNA, 19 nt, Homo sapiens
gaagacuccuaccugaaac

SEQ ID NO: 801903 - RNA, 19 nt, Homo sapiens
gaagaucaccagggagcaa

SEQ ID NO: 801904 - RNA, 19 nt, Homo sapiens
cagcugggcaggaggaauu

SEQ ID NO: 801905 - RNA, 19 nt, Homo sapiens
gugacaaccuccccacaua

SEQ ID NO: 801906 - RNA, 19 nt, Homo sapiens
ggcaacagauuccggaaaa

SEQ ID NO: 801907 - RNA, 19 nt, Homo sapiens
caugaccucguuagaguaa

SEQ ID NO: 801908 - RNA, 19 nt, Homo sapiens
uugaugcacuugaggaaga

SEQ ID NO: 801909 - RNA, 19 nt, Homo sapiens
gaaggccaccuguuaaagc

SEQ ID NO: 801910 - RNA, 19 nt, Homo sapiens
gcaaugugugaucuuguga

SEQ ID NO: 801911 - RNA, 19 nt, Homo sapiens
gccaaggacccaccucuca

SEQ ID NO: 801912 - RNA, 19 nt, Homo sapiens
ccugaaacauacggagauu

SEQ ID NO: 801913 - RNA, 19 nt, Homo sapiens
ggguguuguugguuauuug

SEQ ID NO: 801914 - RNA, 19 nt, Homo sapiens
uccaugaccucguuagagu

SEQ ID NO: 801915 - RNA, 19 nt, Homo sapiens
caaggacccaccucucaau

SEQ ID NO: 801916 - RNA, 19 nt, Homo sapiens
acaauauuccguacauaga

SEQ ID NO: 801917 - RNA, 19 nt, Homo sapiens
gcgccaugcgggagcaaua

SEQ ID NO: 801918 - RNA, 19 nt, Homo sapiens
cauguuguuuggauuucaa

SEQ ID NO: 801919 - RNA, 19 nt, Homo sapiens
ggaaggccaccuguuaaag

SEQ ID NO: 801920 - RNA, 19 nt, Homo sapiens
aaacugcaaugugugaucu

SEQ ID NO: 801921 - RNA, 19 nt, Homo sapiens
aaacauacggagauugaca

SEQ ID NO: 801922 - RNA, 19 nt, Homo sapiens
ggccacaggcacccacaaa

SEQ ID NO: 801923 - RNA, 19 nt, Homo sapiens
aaagugcccucaccaucca

SEQ ID NO: 801924 - RNA, 19 nt, Homo sapiens
acuccuaccugaaacauac

SEQ ID NO: 801925 - RNA, 19 nt, Homo sapiens
ccaaggacccaccucucaa

SEQ ID NO: 801926 - RNA, 19 nt, Homo sapiens
cacaauauuccguacauag

SEQ ID NO: 801927 - RNA, 19 nt, Homo sapiens
gaucuuugugccugacuau

SEQ ID NO: 801928 - RNA, 19 nt, Homo sapiens
ugacaaggccagcuuugag

SEQ ID NO: 801929 - RNA, 19 nt, Homo sapiens
aaagccagaagaagaagaa

SEQ ID NO: 801930 - RNA, 19 nt, Homo sapiens
ggccaacaaggucgauuug

SEQ ID NO: 801931 - RNA, 19 nt, Homo sapiens
caagggaaggccaccuguu

SEQ ID NO: 801932 - RNA, 19 nt, Homo sapiens
ccacaggcacccacaaacu

SEQ ID NO: 801933 - RNA, 19 nt, Homo sapiens
gaccucguuagaguaauua

SEQ ID NO: 801934 - RNA, 19 nt, Homo sapiens
caggaagcagcaucaaguu

SEQ ID NO: 801935 - RNA, 19 nt, Homo sapiens
ugcaaugugugaucuugug

SEQ ID NO: 801936 - RNA, 19 nt, Homo sapiens
gcgaccaaacacaauauuc

SEQ ID NO: 801937 - RNA, 19 nt, Homo sapiens
caaagacagggagucauuc

SEQ ID NO: 801938 - RNA, 19 nt, Homo sapiens
gaccgcuuccaccagcuua

SEQ ID NO: 801939 - RNA, 19 nt, Homo sapiens
uggguguuguugguuauuu

SEQ ID NO: 801940 - RNA, 19 nt, Homo sapiens
caaacugcaaugugugauc

SEQ ID NO: 801941 - RNA, 19 nt, Homo sapiens
gaagaagaagaaaaccaaa

SEQ ID NO: 801942 - RNA, 19 nt, Homo sapiens
guuggguguuguugguuau

SEQ ID NO: 801943 - RNA, 19 nt, Homo sapiens
ccaugaccucguuagagua

SEQ ID NO: 801944 - RNA, 19 nt, Homo sapiens
uagaaaccagugccaagga

SEQ ID NO: 801945 - RNA, 19 nt, Homo sapiens
aacacaauauuccguacau

SEQ ID NO: 801946 - RNA, 19 nt, Homo sapiens
ucacugacaaggccagcuu

SEQ ID NO: 801947 - RNA, 19 nt, Homo sapiens
agggaaggccaccuguuaa

SEQ ID NO: 801948 - RNA, 19 nt, Homo sapiens
aaugugugaucuugugaca

SEQ ID NO: 801949 - RNA, 19 nt, Homo sapiens
gcacccacaaacugcaaug

SEQ ID NO: 801950 - RNA, 19 nt, Homo sapiens
ucgacaaagccuuccauga

SEQ ID NO: 801951 - RNA, 19 nt, Homo sapiens
aaauggcgaccaaacacaa

SEQ ID NO: 801952 - RNA, 19 nt, Homo sapiens
aagaaauggcgaccaaaca

SEQ ID NO: 801953 - RNA, 19 nt, Homo sapiens
aaagaaauggcgaccaaac

SEQ ID NO: 801954 - RNA, 19 nt, Homo sapiens
ggauagagcugaaggacua

SEQ ID NO: 801955 - RNA, 19 nt, Homo sapiens
caacuccucucuacucuua

SEQ ID NO: 801956 - RNA, 19 nt, Homo sapiens
ucaccucucuugcguauuu

SEQ ID NO: 801957 - RNA, 19 nt, Homo sapiens
caugaaauguuuggccuua

SEQ ID NO: 801958 - RNA, 19 nt, Homo sapiens
agaaggagcuggaacagau

SEQ ID NO: 801959 - RNA, 19 nt, Homo sapiens
aaccuggucucuugaauuu

SEQ ID NO: 801960 - RNA, 19 nt, Homo sapiens
ugacugagcgaguugauuu

SEQ ID NO: 801961 - RNA, 19 nt, Homo sapiens
gaaggacuaugcaaaugag

SEQ ID NO: 801962 - RNA, 19 nt, Homo sapiens
gggcagggcuguaguuggu

SEQ ID NO: 801963 - RNA, 19 nt, Homo sapiens
gaaaccuggucucuugaau

SEQ ID NO: 801964 - RNA, 19 nt, Homo sapiens
gaagagagaccagaacaag

SEQ ID NO: 801965 - RNA, 19 nt, Homo sapiens
ucaaggaccugcucaucga

SEQ ID NO: 801966 - RNA, 19 nt, Homo sapiens
gcucguagacuaugggaaa

SEQ ID NO: 801967 - RNA, 19 nt, Homo sapiens
ugggauggcucguagacua

SEQ ID NO: 801968 - RNA, 19 nt, Homo sapiens
caccugaccuggaagcuau

SEQ ID NO: 801969 - RNA, 19 nt, Homo sapiens
ggugauggcuucucugacu

SEQ ID NO: 801970 - RNA, 19 nt, Homo sapiens
gcucccaccuucuuucuuc

SEQ ID NO: 801971 - RNA, 19 nt, Homo sapiens
caaaugaggaaguaaguca

SEQ ID NO: 801972 - RNA, 19 nt, Homo sapiens
uauccucugucucugcuua

SEQ ID NO: 801973 - RNA, 19 nt, Homo sapiens
uuggaaaccuggucucuug

SEQ ID NO: 801974 - RNA, 19 nt, Homo sapiens
uaucaccucucuugcguau

SEQ ID NO: 801975 - RNA, 19 nt, Homo sapiens
gcuaagggagggaggcuaa

SEQ ID NO: 801976 - RNA, 19 nt, Homo sapiens
ggacuaugcaaaugaggaa

SEQ ID NO: 801977 - RNA, 19 nt, Homo sapiens
uggaacagauggaagacuu

SEQ ID NO: 801978 - RNA, 19 nt, Homo sapiens
ggugcagccucuccuguug

SEQ ID NO: 801979 - RNA, 19 nt, Homo sapiens
ugaaauguuuggccuuagu

SEQ ID NO: 801980 - RNA, 19 nt, Homo sapiens
ugaaggacuaugcaaauga

SEQ ID NO: 801981 - RNA, 19 nt, Homo sapiens
gcugaaggacuaugcaaau

SEQ ID NO: 801982 - RNA, 19 nt, Homo sapiens
ggaucacagucucuucuca

SEQ ID NO: 801983 - RNA, 19 nt, Homo sapiens
ggaaaccuggucucuugaa

SEQ ID NO: 801984 - RNA, 19 nt, Homo sapiens
guccaaaucaugaaauguu

SEQ ID NO: 801985 - RNA, 19 nt, Homo sapiens
ccacccaacuccucucuac

SEQ ID NO: 801986 - RNA, 19 nt, Homo sapiens
gacccugucucuauuaaaa

SEQ ID NO: 801987 - RNA, 19 nt, Homo sapiens
caaggcaggaggaucguuu

SEQ ID NO: 801988 - RNA, 19 nt, Homo sapiens
gcaguggcuuaugcuugua

SEQ ID NO: 801989 - RNA, 19 nt, Homo sapiens
ggaucuccuucccuccuuu

SEQ ID NO: 801990 - RNA, 19 nt, Homo sapiens
cacagucucuucucacuac

SEQ ID NO: 801991 - RNA, 19 nt, Homo sapiens
cuaugcaaaugaggaagua

SEQ ID NO: 801992 - RNA, 19 nt, Homo sapiens
ugagcgaguugauuucaca

SEQ ID NO: 801993 - RNA, 19 nt, Homo sapiens
gaaggggacccauauccua

SEQ ID NO: 801994 - RNA, 19 nt, Homo sapiens
aaaccuggucucuugaauu

SEQ ID NO: 801995 - RNA, 19 nt, Homo sapiens
gcagggcagggcuguaguu

SEQ ID NO: 801996 - RNA, 19 nt, Homo sapiens
gcgacaggauagagcugaa

SEQ ID NO: 801997 - RNA, 19 nt, Homo sapiens
ccucuaccuucauuccaaa

SEQ ID NO: 801998 - RNA, 19 nt, Homo sapiens
gcucaucgagguuuacaag

SEQ ID NO: 801999 - RNA, 19 nt, Homo sapiens
uggccucccuccucaagaa

SEQ ID NO: 802000 - RNA, 19 nt, Homo sapiens
gaaggagcuggaacagaug

SEQ ID NO: 802001 - RNA, 19 nt, Homo sapiens
ucaagaaggagcuggaaca

SEQ ID NO: 802002 - RNA, 19 nt, Homo sapiens
cugaaggacuaugcaaaug

SEQ ID NO: 802003 - RNA, 19 nt, Homo sapiens
ugcaguggcuuaugcuugu

SEQ ID NO: 802004 - RNA, 19 nt, Homo sapiens
cagccugggcaacauagua

SEQ ID NO: 802005 - RNA, 19 nt, Homo sapiens
gccucuaccuucauuccaa

SEQ ID NO: 802006 - RNA, 19 nt, Homo sapiens
gcugggagcuuggaaaccu

SEQ ID NO: 802007 - RNA, 19 nt, Homo sapiens
cugcagccauggagucuuc

SEQ ID NO: 802008 - RNA, 19 nt, Homo sapiens
agagagaccagaacaaguc

SEQ ID NO: 802009 - RNA, 19 nt, Homo sapiens
uggacuugcuggccaucua

SEQ ID NO: 802010 - RNA, 19 nt, Homo sapiens
uuugggagguuaugagcaa

SEQ ID NO: 802011 - RNA, 19 nt, Homo sapiens
gagcugaaggacuaugcaa

SEQ ID NO: 802012 - RNA, 19 nt, Homo sapiens
ggaaucgcgagcugaagga

SEQ ID NO: 802013 - RNA, 19 nt, Homo sapiens
gaaauguuuggccuuaguc

SEQ ID NO: 802014 - RNA, 19 nt, Homo sapiens
cugcuuaucaccucucuug

SEQ ID NO: 802015 - RNA, 19 nt, Homo sapiens
ucucuacucuuauccuuuu

SEQ ID NO: 802016 - RNA, 19 nt, Homo sapiens
gugacuggguguucauuuu

SEQ ID NO: 802017 - RNA, 19 nt, Homo sapiens
ggugacuggguguucauuu

SEQ ID NO: 802018 - RNA, 19 nt, Homo sapiens
caggugauggcuucucuga

SEQ ID NO: 802019 - RNA, 19 nt, Homo sapiens
guggaguggcgacaggaua

SEQ ID NO: 802020 - RNA, 19 nt, Homo sapiens
gggauggcucguagacuau

SEQ ID NO: 802021 - RNA, 19 nt, Homo sapiens
gcaaaugaggaaguaaguc

SEQ ID NO: 802022 - RNA, 19 nt, Homo sapiens
ucacagucucuucucacua

SEQ ID NO: 802023 - RNA, 19 nt, Homo sapiens
ccuccuuucucguccaaau

SEQ ID NO: 802024 - RNA, 19 nt, Homo sapiens
ccucucuacucuuauccuu

SEQ ID NO: 802025 - RNA, 19 nt, Homo sapiens
cuuguaaucccagcacuuu

SEQ ID NO: 802026 - RNA, 19 nt, Homo sapiens
ggcaggugauggcuucucu

SEQ ID NO: 802027 - RNA, 19 nt, Homo sapiens
ccaccugaccuggaagcua

SEQ ID NO: 802028 - RNA, 19 nt, Homo sapiens
ugacuggguguucauuuua

SEQ ID NO: 802029 - RNA, 19 nt, Homo sapiens
cuggaugacugagcgaguu

SEQ ID NO: 802030 - RNA, 19 nt, Homo sapiens
guuggugacuggguguuca

SEQ ID NO: 802031 - RNA, 19 nt, Homo sapiens
gaagagauguuacccagua

SEQ ID NO: 802032 - RNA, 19 nt, Homo sapiens
ccuaugaggugcucuguua

SEQ ID NO: 802033 - RNA, 19 nt, Homo sapiens
gcacaaacacacucaauga

SEQ ID NO: 802034 - RNA, 19 nt, Homo sapiens
caacuccucuugaaucuau

SEQ ID NO: 802035 - RNA, 19 nt, Homo sapiens
ucaauaagaugaucagcaa

SEQ ID NO: 802036 - RNA, 19 nt, Homo sapiens
gaggguggcuuugaguaua

SEQ ID NO: 802037 - RNA, 19 nt, Homo sapiens
ggaaagggacauuguaaau

SEQ ID NO: 802038 - RNA, 19 nt, Homo sapiens
gagcagagaacagaaagua

SEQ ID NO: 802039 - RNA, 19 nt, Homo sapiens
ucagaaauauccucgcaaa

SEQ ID NO: 802040 - RNA, 19 nt, Homo sapiens
ugaagaaauucgacaagaa

SEQ ID NO: 802041 - RNA, 19 nt, Homo sapiens
ccaccaaucccucaaagua

SEQ ID NO: 802042 - RNA, 19 nt, Homo sapiens
ccacuauguugaagaaauu

SEQ ID NO: 802043 - RNA, 19 nt, Homo sapiens
gaccagaccuuggagaaug

SEQ ID NO: 802044 - RNA, 19 nt, Homo sapiens
ccaggaggcccguguauuu

SEQ ID NO: 802045 - RNA, 19 nt, Homo sapiens
ggaaugcacccuugugaga

SEQ ID NO: 802046 - RNA, 19 nt, Homo sapiens
gaggaaacguucaccuugu

SEQ ID NO: 802047 - RNA, 19 nt, Homo sapiens
cagacaaagugccggauaa

SEQ ID NO: 802048 - RNA, 19 nt, Homo sapiens
uaaauguccuggagcagaa

SEQ ID NO: 802049 - RNA, 19 nt, Homo sapiens
ugucagaaaucucggauga

SEQ ID NO: 802050 - RNA, 19 nt, Homo sapiens
gcagaucuccuccuucaug

SEQ ID NO: 802051 - RNA, 19 nt, Homo sapiens
gcaccaugcugcaggcuau

SEQ ID NO: 802052 - RNA, 19 nt, Homo sapiens
gcaguacacucuagaacca

SEQ ID NO: 802053 - RNA, 19 nt, Homo sapiens
ccaagcuucuguauugaaa

SEQ ID NO: 802054 - RNA, 19 nt, Homo sapiens
gggaugaauuugagaagga

SEQ ID NO: 802055 - RNA, 19 nt, Homo sapiens
ucagaaaucucggaugaau

SEQ ID NO: 802056 - RNA, 19 nt, Homo sapiens
ucaacaagguggccaugaa

SEQ ID NO: 802057 - RNA, 19 nt, Homo sapiens
agacaugacugggaaagaa

SEQ ID NO: 802058 - RNA, 19 nt, Homo sapiens
caagaaggaugaggaguca

SEQ ID NO: 802059 - RNA, 19 nt, Homo sapiens
gaagaaauucgacaagaag

SEQ ID NO: 802060 - RNA, 19 nt, Homo sapiens
ucaaacagccugagaaagu

SEQ ID NO: 802061 - RNA, 19 nt, Homo sapiens
gcauugcguugcugcauug

SEQ ID NO: 802062 - RNA, 19 nt, Homo sapiens
ggaagaggguggcuuugag

SEQ ID NO: 802063 - RNA, 19 nt, Homo sapiens
gaaauauccucgcaaacac

SEQ ID NO: 802064 - RNA, 19 nt, Homo sapiens
gaggcagcauccagugaua

SEQ ID NO: 802065 - RNA, 19 nt, Homo sapiens
ggaaguuacuguagcugau

SEQ ID NO: 802066 - RNA, 19 nt, Homo sapiens
gcuggaagaucuggaaguu

SEQ ID NO: 802067 - RNA, 19 nt, Homo sapiens
acauucagcugcaugauga

SEQ ID NO: 802068 - RNA, 19 nt, Homo sapiens
gauggaugaugacaaugaa

SEQ ID NO: 802069 - RNA, 19 nt, Homo sapiens
gcccguguauuuaaugaaa

SEQ ID NO: 802070 - RNA, 19 nt, Homo sapiens
gaagaggugugugauggau

SEQ ID NO: 802071 - RNA, 19 nt, Homo sapiens
gauguuacccaguaucuug

SEQ ID NO: 802072 - RNA, 19 nt, Homo sapiens
ugagugcucuggcgaaguu

SEQ ID NO: 802073 - RNA, 19 nt, Homo sapiens
uacauccgcuucaucuaua

SEQ ID NO: 802074 - RNA, 19 nt, Homo sapiens
guacauccgcuucaucuau

SEQ ID NO: 802075 - RNA, 19 nt, Homo sapiens
gcucugcccucgugucuuc

SEQ ID NO: 802076 - RNA, 19 nt, Homo sapiens
gcuccuggcugguguguuc

SEQ ID NO: 802077 - RNA, 19 nt, Homo sapiens
cgagccaccuucuaccuaa

SEQ ID NO: 802078 - RNA, 19 nt, Homo sapiens
aagcagaucuccuccuuca

SEQ ID NO: 802079 - RNA, 19 nt, Homo sapiens
caucaacccucggaaaugu

SEQ ID NO: 802080 - RNA, 19 nt, Homo sapiens
uacuguagcugaucacauu

SEQ ID NO: 802081 - RNA, 19 nt, Homo sapiens
gcaaacacgccguccuuau

SEQ ID NO: 802082 - RNA, 19 nt, Homo sapiens
aaggagaugucuugcauug

SEQ ID NO: 802083 - RNA, 19 nt, Homo sapiens
gaagaggcuguggguaaua

SEQ ID NO: 802084 - RNA, 19 nt, Homo sapiens
caaacagccugagaaagug

SEQ ID NO: 802085 - RNA, 19 nt, Homo sapiens
caaacacgccguccuuaug

SEQ ID NO: 802086 - RNA, 19 nt, Homo sapiens
ugaagcagaucuccuccuu

SEQ ID NO: 802087 - RNA, 19 nt, Homo sapiens
gcuaugaggaugaguaugu

SEQ ID NO: 802088 - RNA, 19 nt, Homo sapiens
gcagagcagagaacagaaa

SEQ ID NO: 802089 - RNA, 19 nt, Homo sapiens
ggugugugauggaugauga

SEQ ID NO: 802090 - RNA, 19 nt, Homo sapiens
uggagaaccuggucacaga

SEQ ID NO: 802091 - RNA, 19 nt, Homo sapiens
ggccuuaagucucccuuug

SEQ ID NO: 802092 - RNA, 19 nt, Homo sapiens
uggaggagcugccaguaga

SEQ ID NO: 802093 - RNA, 19 nt, Homo sapiens
uaaugaaacucccaucaac

SEQ ID NO: 802094 - RNA, 19 nt, Homo sapiens
uggguaauauugugaaguu

SEQ ID NO: 802095 - RNA, 19 nt, Homo sapiens
ggaggcccguguauuuaau

SEQ ID NO: 802096 - RNA, 19 nt, Homo sapiens
aaacacgccguccuuauga

SEQ ID NO: 802097 - RNA, 19 nt, Homo sapiens
agaaaucucggaugaauuc

SEQ ID NO: 802098 - RNA, 19 nt, Homo sapiens
uucccaagcuucuguauug

SEQ ID NO: 802099 - RNA, 19 nt, Homo sapiens
uggaagaucuggaaguuac

SEQ ID NO: 802100 - RNA, 19 nt, Homo sapiens
cgucggaugugcuacuuga

SEQ ID NO: 802101 - RNA, 19 nt, Homo sapiens
caggaaagggacauuguaa

SEQ ID NO: 802102 - RNA, 19 nt, Homo sapiens
gaaacugaacuucgaagca

SEQ ID NO: 802103 - RNA, 19 nt, Homo sapiens
ucaugaaacugaacuucga

SEQ ID NO: 802104 - RNA, 19 nt, Homo sapiens
caaaguacauccgcuucau

SEQ ID NO: 802105 - RNA, 19 nt, Homo sapiens
gagagcugcuugcgcaaca

SEQ ID NO: 802106 - RNA, 19 nt, Homo sapiens
uagcuuguccuaaaucuug

SEQ ID NO: 802107 - RNA, 19 nt, Homo sapiens
ugaagaggcuguggguaau

SEQ ID NO: 802108 - RNA, 19 nt, Homo sapiens
ggaugaugacaaugaagua

SEQ ID NO: 802109 - RNA, 19 nt, Homo sapiens
caggaggcccguguauuua

SEQ ID NO: 802110 - RNA, 19 nt, Homo sapiens
acaaagugccggauaacaa

SEQ ID NO: 802111 - RNA, 19 nt, Homo sapiens
ggaccgagccaccuucuac

SEQ ID NO: 802112 - RNA, 19 nt, Homo sapiens
gaugaugacaaugaaguaa

SEQ ID NO: 802113 - RNA, 19 nt, Homo sapiens
agaggugugugauggauga

SEQ ID NO: 802114 - RNA, 19 nt, Homo sapiens
agaaauauccucgcaaaca

SEQ ID NO: 802115 - RNA, 19 nt, Homo sapiens
gcaacaagcacgagauggu

SEQ ID NO: 802116 - RNA, 19 nt, Homo sapiens
gagccaccuucuaccuaaa

SEQ ID NO: 802117 - RNA, 19 nt, Homo sapiens
ugugauggaugaugacaau

SEQ ID NO: 802118 - RNA, 19 nt, Homo sapiens
gaucuccuccuucauguca

SEQ ID NO: 802119 - RNA, 19 nt, Homo sapiens
gauucaaaccgcagcauug

SEQ ID NO: 802120 - RNA, 19 nt, Homo sapiens
gcuauugagcgcuacauga

SEQ ID NO: 802121 - RNA, 19 nt, Homo sapiens
ccaggaaagggacauugua

SEQ ID NO: 802122 - RNA, 19 nt, Homo sapiens
ggugacagccagaaguuug

SEQ ID NO: 802123 - RNA, 19 nt, Homo sapiens
ccagaaugaagagauguua

SEQ ID NO: 802124 - RNA, 19 nt, Homo sapiens
gaaauucgacaagaaggau

SEQ ID NO: 802125 - RNA, 19 nt, Homo sapiens
gccaguagacaucaucuug

SEQ ID NO: 802126 - RNA, 19 nt, Homo sapiens
gaaacguucaccuugucua

SEQ ID NO: 802127 - RNA, 19 nt, Homo sapiens
ggaugaguaugugcuggaa

SEQ ID NO: 802128 - RNA, 19 nt, Homo sapiens
ucagcugcaugaugaaguu

SEQ ID NO: 802129 - RNA, 19 nt, Homo sapiens
gggaagaggguggcuuuga

SEQ ID NO: 802130 - RNA, 19 nt, Homo sapiens
ugugacagcuuguaaucug

SEQ ID NO: 802131 - RNA, 19 nt, Homo sapiens
caagaucggugaagccaaa

SEQ ID NO: 802132 - RNA, 19 nt, Homo sapiens
ccaguucgaugaaguguuu

SEQ ID NO: 802133 - RNA, 19 nt, Homo sapiens
gcaaagaagacgaaaguga

SEQ ID NO: 802134 - RNA, 19 nt, Homo sapiens
gaaacucacuggcguccaa

SEQ ID NO: 802135 - RNA, 19 nt, Homo sapiens
gaacuaaggaucccguuga

SEQ ID NO: 802136 - RNA, 19 nt, Homo sapiens
gacaagagcuuccagaacu

SEQ ID NO: 802137 - RNA, 19 nt, Homo sapiens
gcuuugggaugaagaauuu

SEQ ID NO: 802138 - RNA, 19 nt, Homo sapiens
gagaaaaccuugaaaacaa

SEQ ID NO: 802139 - RNA, 19 nt, Homo sapiens
aagaagagaugguuucguu

SEQ ID NO: 802140 - RNA, 19 nt, Homo sapiens
gaagagaugguuucguuug

SEQ ID NO: 802141 - RNA, 19 nt, Homo sapiens
aaagaaggguucaugauca

SEQ ID NO: 802142 - RNA, 19 nt, Homo sapiens
caaagaagacgaaagugaa

SEQ ID NO: 802143 - RNA, 19 nt, Homo sapiens
ccggagggauuccaucaua

SEQ ID NO: 802144 - RNA, 19 nt, Homo sapiens
ccaguaaccugaaguuugg

SEQ ID NO: 802145 - RNA, 19 nt, Homo sapiens
gaauuuaccuaccacaaaa

SEQ ID NO: 802146 - RNA, 19 nt, Homo sapiens
ugagcaagcuggagaagau

SEQ ID NO: 802147 - RNA, 19 nt, Homo sapiens
agacgaaagugaagaggaa

SEQ ID NO: 802148 - RNA, 19 nt, Homo sapiens
gaucgacauucucaccaaa

SEQ ID NO: 802149 - RNA, 19 nt, Homo sapiens
gagcaaaucuguguaugac

SEQ ID NO: 802150 - RNA, 19 nt, Homo sapiens
gaacuucuuggaucugauu

SEQ ID NO: 802151 - RNA, 19 nt, Homo sapiens
cggaagcgcuuugggauga

SEQ ID NO: 802152 - RNA, 19 nt, Homo sapiens
ccaggacgcugacauugau

SEQ ID NO: 802153 - RNA, 19 nt, Homo sapiens
gagaagacuuuuacuguga

SEQ ID NO: 802154 - RNA, 19 nt, Homo sapiens
ggaccaaaauuguggaaaa

SEQ ID NO: 802155 - RNA, 19 nt, Homo sapiens
ggaggagucuuucaaaaug

SEQ ID NO: 802156 - RNA, 19 nt, Homo sapiens
gaccuccacucauuccauu

SEQ ID NO: 802157 - RNA, 19 nt, Homo sapiens
ucaagaagacgaaauaugg

SEQ ID NO: 802158 - RNA, 19 nt, Homo sapiens
ggagcaaaucuguguauga

SEQ ID NO: 802159 - RNA, 19 nt, Homo sapiens
ggaggaggagucuuucaaa

SEQ ID NO: 802160 - RNA, 19 nt, Homo sapiens
gaaguuuggagaugaauuc

SEQ ID NO: 802161 - RNA, 19 nt, Homo sapiens
ggacaagcucgaaaucaga

SEQ ID NO: 802162 - RNA, 19 nt, Homo sapiens
ugaaauuccucggagcuuu

SEQ ID NO: 802163 - RNA, 19 nt, Homo sapiens
caccuguccuucuacauuu

SEQ ID NO: 802164 - RNA, 19 nt, Homo sapiens
gcagugagcagcuucaucu

SEQ ID NO: 802165 - RNA, 19 nt, Homo sapiens
uaaagaaggguucaugauc

SEQ ID NO: 802166 - RNA, 19 nt, Homo sapiens
ugagcgaggucaucacaga

SEQ ID NO: 802167 - RNA, 19 nt, Homo sapiens
acaagagcuuccagaacua

SEQ ID NO: 802168 - RNA, 19 nt, Homo sapiens
ggaucgacauucucaccaa

SEQ ID NO: 802169 - RNA, 19 nt, Homo sapiens
cgagcaagaugagggauug

SEQ ID NO: 802170 - RNA, 19 nt, Homo sapiens
ucaaugagcagaaauaugc

SEQ ID NO: 802171 - RNA, 19 nt, Homo sapiens
gaaguugaaagacggagaa

SEQ ID NO: 802172 - RNA, 19 nt, Homo sapiens
acaagacgcuaaagcaagu

SEQ ID NO: 802173 - RNA, 19 nt, Homo sapiens
gaaggguucaugaucaaga

SEQ ID NO: 802174 - RNA, 19 nt, Homo sapiens
gaagguggccauccagaag

SEQ ID NO: 802175 - RNA, 19 nt, Homo sapiens
uccgagaccuccacucauu

SEQ ID NO: 802176 - RNA, 19 nt, Homo sapiens
gagcacgcccaguauaaga

SEQ ID NO: 802177 - RNA, 19 nt, Homo sapiens
ugaauuuaccuaccacaaa

SEQ ID NO: 802178 - RNA, 19 nt, Homo sapiens
gaagagaccccaagagugu

SEQ ID NO: 802179 - RNA, 19 nt, Homo sapiens
gccaguaaccugaaguuug

SEQ ID NO: 802180 - RNA, 19 nt, Homo sapiens
gagacaagagcuuccagaa

SEQ ID NO: 802181 - RNA, 19 nt, Homo sapiens
cuacauggcuacauuuuau

SEQ ID NO: 802182 - RNA, 19 nt, Homo sapiens
gcaggacccuucagaucag

SEQ ID NO: 802183 - RNA, 19 nt, Homo sapiens
ggaagguggccauccagaa

SEQ ID NO: 802184 - RNA, 19 nt, Homo sapiens
aagagaugguuucguuuga

SEQ ID NO: 802185 - RNA, 19 nt, Homo sapiens
gcccgaccgucauguguga

SEQ ID NO: 802186 - RNA, 19 nt, Homo sapiens
gaggaggagucuuucaaaa

SEQ ID NO: 802187 - RNA, 19 nt, Homo sapiens
gaagaggaagaccaacaau

SEQ ID NO: 802188 - RNA, 19 nt, Homo sapiens
aagaaggguucaugaucaa

SEQ ID NO: 802189 - RNA, 19 nt, Homo sapiens
ugacauugaucuccaagac

SEQ ID NO: 802190 - RNA, 19 nt, Homo sapiens
ucaccuguccuucuacauu

SEQ ID NO: 802191 - RNA, 19 nt, Homo sapiens
ccaagcgcuuccaggauga

SEQ ID NO: 802192 - RNA, 19 nt, Homo sapiens
caagaagacgaaauaugga

SEQ ID NO: 802193 - RNA, 19 nt, Homo sapiens
gcaggagcacgcccaguau

SEQ ID NO: 802194 - RNA, 19 nt, Homo sapiens
ggaaugccaguaaccugaa

SEQ ID NO: 802195 - RNA, 19 nt, Homo sapiens
ggcaggacccuucagauca

SEQ ID NO: 802196 - RNA, 19 nt, Homo sapiens
ggaagugcagggcaaagug

SEQ ID NO: 802197 - RNA, 19 nt, Homo sapiens
ccuccacucauuccauuua

SEQ ID NO: 802198 - RNA, 19 nt, Homo sapiens
gaucaagagggcccaagga

SEQ ID NO: 802199 - RNA, 19 nt, Homo sapiens
aaucgacccugugaaguug

SEQ ID NO: 802200 - RNA, 19 nt, Homo sapiens
gaaaucgacccugugaagu

SEQ ID NO: 802201 - RNA, 19 nt, Homo sapiens
ugaaaucgacccugugaag

SEQ ID NO: 802202 - RNA, 19 nt, Homo sapiens
cuaaggaucccguugaaag

SEQ ID NO: 802203 - RNA, 19 nt, Homo sapiens
gaguugaccucuggaaugc

SEQ ID NO: 802204 - RNA, 19 nt, Homo sapiens
gggacaaguucaagaagac

SEQ ID NO: 802205 - RNA, 19 nt, Homo sapiens
uggagaaccuacggcagua

SEQ ID NO: 802206 - RNA, 19 nt, Homo sapiens
gcaggguggugccauucau

SEQ ID NO: 802207 - RNA, 19 nt, Homo sapiens
gaucagaagcaaagaagac

SEQ ID NO: 802208 - RNA, 19 nt, Homo sapiens
agaagcgccucaccgucua

SEQ ID NO: 802209 - RNA, 19 nt, Homo sapiens
ggaagcgcuuugggaugaa

SEQ ID NO: 802210 - RNA, 19 nt, Homo sapiens
cugaugcggugaagaacuu

SEQ ID NO: 802211 - RNA, 19 nt, Homo sapiens
gcauugacgagaccaugaa

SEQ ID NO: 802212 - RNA, 19 nt, Homo sapiens
caucgugaaugggcaaugu

SEQ ID NO: 802213 - RNA, 19 nt, Homo sapiens
agaaggaggacuugcagaa

SEQ ID NO: 802214 - RNA, 19 nt, Homo sapiens
caggagcacgcccaguaua

SEQ ID NO: 802215 - RNA, 19 nt, Homo sapiens
cuacaagacgcuaaagcaa

SEQ ID NO: 802216 - RNA, 19 nt, Homo sapiens
ucuacucccucuucaacuu

SEQ ID NO: 802217 - RNA, 19 nt, Homo sapiens
cagccucucuacagcauuc

SEQ ID NO: 802218 - RNA, 19 nt, Homo sapiens
aguccuacauggcuacauu

SEQ ID NO: 802219 - RNA, 19 nt, Homo sapiens
aaaucgacccugugaaguu

SEQ ID NO: 802220 - RNA, 19 nt, Homo sapiens
aagcaaagaagacgaaagu

SEQ ID NO: 802221 - RNA, 19 nt, Homo sapiens
gaaggaggacuugcagaag

SEQ ID NO: 802222 - RNA, 19 nt, Homo sapiens
ggagaaaaccuugaaaaca

SEQ ID NO: 802223 - RNA, 19 nt, Homo sapiens
ggaggaagacguggacaag

SEQ ID NO: 802224 - RNA, 19 nt, Homo sapiens
ugaagaggaagaccaacaa

SEQ ID NO: 802225 - RNA, 19 nt, Homo sapiens
gggagcaaaucuguguaug

SEQ ID NO: 802226 - RNA, 19 nt, Homo sapiens
gcauucccaucgagaacau

SEQ ID NO: 802227 - RNA, 19 nt, Homo sapiens
ccugaaguuuggagaugaa

SEQ ID NO: 802228 - RNA, 19 nt, Homo sapiens
ggaggccugugggagcaaa

SEQ ID NO: 802229 - RNA, 19 nt, Homo sapiens
gcccaucgugcuuaaagaa

SEQ ID NO: 802230 - RNA, 19 nt, Homo sapiens
gauaugccagagccacaaa

SEQ ID NO: 802231 - RNA, 19 nt, Homo sapiens
gaacugcacuucuccaaca

SEQ ID NO: 802232 - RNA, 19 nt, Homo sapiens
gcaaggagaucgacuuucg

SEQ ID NO: 802233 - RNA, 19 nt, Homo sapiens
gaggaagggcugcugcuua

SEQ ID NO: 802234 - RNA, 19 nt, Homo sapiens
ggaggaugcuggagaguag

SEQ ID NO: 802235 - RNA, 19 nt, Homo sapiens
gcaagggcaaguacaugua

SEQ ID NO: 802236 - RNA, 19 nt, Homo sapiens
ucaaggaacugcacuucuc

SEQ ID NO: 802237 - RNA, 19 nt, Homo sapiens
gagaguagcggcugcaaag

SEQ ID NO: 802238 - RNA, 19 nt, Homo sapiens
aggaagggcugcugcuuau

SEQ ID NO: 802239 - RNA, 19 nt, Homo sapiens
gggcaaggagaucgacuuu

SEQ ID NO: 802240 - RNA, 19 nt, Homo sapiens
ugaagaccguggacugugu

SEQ ID NO: 802241 - RNA, 19 nt, Homo sapiens
ucagugagcgcucgcaaga

SEQ ID NO: 802242 - RNA, 19 nt, Homo sapiens
ggccagugcccuucaguga

SEQ ID NO: 802243 - RNA, 19 nt, Homo sapiens
ggaaaggccccaaguuaau

SEQ ID NO: 802244 - RNA, 19 nt, Homo sapiens
ggaacgagcgcggaagcaa

SEQ ID NO: 802245 - RNA, 19 nt, Homo sapiens
ggagaguagcggcugcaaa

SEQ ID NO: 802246 - RNA, 19 nt, Homo sapiens
gggaggaugcuggagagua

SEQ ID NO: 802247 - RNA, 19 nt, Homo sapiens
cugcacuucuccaacauga

SEQ ID NO: 802248 - RNA, 19 nt, Homo sapiens
ggguagaggagaggaguuu

SEQ ID NO: 802249 - RNA, 19 nt, Homo sapiens
gaagggcugcugcuuaucc

SEQ ID NO: 802250 - RNA, 19 nt, Homo sapiens
uguugcagcucuggaagaa

SEQ ID NO: 802251 - RNA, 19 nt, Homo sapiens
ccacauccacacucucauc

SEQ ID NO: 802252 - RNA, 19 nt, Homo sapiens
gauggugcaguacaagaau

SEQ ID NO: 802253 - RNA, 19 nt, Homo sapiens
gcucaaggaacugcacuuc

SEQ ID NO: 802254 - RNA, 19 nt, Homo sapiens
cuccaacucugccugaaag

SEQ ID NO: 802255 - RNA, 19 nt, Homo sapiens
gaaaggccccaaguuaaug

SEQ ID NO: 802256 - RNA, 19 nt, Homo sapiens
ucaaauccacgcggcagaa

SEQ ID NO: 802257 - RNA, 19 nt, Homo sapiens
gcgcaagggcaaguacaug

SEQ ID NO: 802258 - RNA, 19 nt, Homo sapiens
gcugcaaagcgcugaagga

SEQ ID NO: 802259 - RNA, 19 nt, Homo sapiens
cgagaucacgcugcagaug

SEQ ID NO: 802260 - RNA, 19 nt, Homo sapiens
gaaauggucuguacaauau

SEQ ID NO: 802261 - RNA, 19 nt, Homo sapiens
gaaagaaccugaaggaaca

SEQ ID NO: 802262 - RNA, 19 nt, Homo sapiens
ggauuuaccuuguucuaua

SEQ ID NO: 802263 - RNA, 19 nt, Homo sapiens
aaacagagcugcuucauca

SEQ ID NO: 802264 - RNA, 19 nt, Homo sapiens
guagauagcacaaguauuu

SEQ ID NO: 802265 - RNA, 19 nt, Homo sapiens
guagauagcacaaguauuu

SEQ ID NO: 802266 - RNA, 19 nt, Homo sapiens
gaagagcacuccagacuca

SEQ ID NO: 802267 - RNA, 19 nt, Homo sapiens
gaaggaacaucucaugaau

SEQ ID NO: 802268 - RNA, 19 nt, Homo sapiens
ccucaaacgucuaccauua

SEQ ID NO: 802269 - RNA, 19 nt, Homo sapiens
ggaaauggucuguacaaua

SEQ ID NO: 802270 - RNA, 19 nt, Homo sapiens
gaaacuaccucgucuagca

SEQ ID NO: 802271 - RNA, 19 nt, Homo sapiens
gcacaaguauuuggagaaa

SEQ ID NO: 802272 - RNA, 19 nt, Homo sapiens
gcacaaguauuuggagaaa

SEQ ID NO: 802273 - RNA, 19 nt, Homo sapiens
ccaaggauaucaucaguug

SEQ ID NO: 802274 - RNA, 19 nt, Homo sapiens
gaagaagaagcauuuguuu

SEQ ID NO: 802275 - RNA, 19 nt, Homo sapiens
ccaaugaaaugguuauaug

SEQ ID NO: 802276 - RNA, 19 nt, Homo sapiens
aggaacaucucaugaauuu

SEQ ID NO: 802277 - RNA, 19 nt, Homo sapiens
gcaaagaagauuaucaguu

SEQ ID NO: 802278 - RNA, 19 nt, Homo sapiens
guaauucacugguccacaa

SEQ ID NO: 802279 - RNA, 19 nt, Homo sapiens
ggaaucaauuucagagaau

SEQ ID NO: 802280 - RNA, 19 nt, Homo sapiens
aagcagacauuacccuaua

SEQ ID NO: 802281 - RNA, 19 nt, Homo sapiens
ggaaguaagcaauggcaua

SEQ ID NO: 802282 - RNA, 19 nt, Homo sapiens
gaaaggaccaaaugccaaa

SEQ ID NO: 802283 - RNA, 19 nt, Homo sapiens
gauacuagccuuaacaugu

SEQ ID NO: 802284 - RNA, 19 nt, Homo sapiens
cuaaagaacuccauuacca

SEQ ID NO: 802285 - RNA, 19 nt, Homo sapiens
uauaaugccuacugaaaga

SEQ ID NO: 802286 - RNA, 19 nt, Homo sapiens
ucacacaccucauauugau

SEQ ID NO: 802287 - RNA, 19 nt, Homo sapiens
ugaccaagcugucuuuaca

SEQ ID NO: 802288 - RNA, 19 nt, Homo sapiens
auacuagccuuaacaugua

SEQ ID NO: 802289 - RNA, 19 nt, Homo sapiens
ugaaagauaugagcauguu

SEQ ID NO: 802290 - RNA, 19 nt, Homo sapiens
ugagggaacugcacauuca

SEQ ID NO: 802291 - RNA, 19 nt, Homo sapiens
gcacaccuaugccuuuaca

SEQ ID NO: 802292 - RNA, 19 nt, Homo sapiens
acucagaacucagaaauug

SEQ ID NO: 802293 - RNA, 19 nt, Homo sapiens
gaacugcacauucauccaa

SEQ ID NO: 802294 - RNA, 19 nt, Homo sapiens
agaaaggcauccaaaccua

SEQ ID NO: 802295 - RNA, 19 nt, Homo sapiens
ggaaaggugcaguaucuug

SEQ ID NO: 802296 - RNA, 19 nt, Homo sapiens
gaagugggcuguguuugag

SEQ ID NO: 802297 - RNA, 19 nt, Homo sapiens
ggauggacauaaagccaaa

SEQ ID NO: 802298 - RNA, 19 nt, Homo sapiens
gcaugguguuagacaauuu

SEQ ID NO: 802299 - RNA, 19 nt, Homo sapiens
gguuauaugugacaagugu

SEQ ID NO: 802300 - RNA, 19 nt, Homo sapiens
gaagugaccgaaugagaga

SEQ ID NO: 802301 - RNA, 19 nt, Homo sapiens
gcaacugcauccugacugu

SEQ ID NO: 802302 - RNA, 19 nt, Homo sapiens
caaccuaaguguuauucau

SEQ ID NO: 802303 - RNA, 19 nt, Homo sapiens
ugacaaguguggccaagga

SEQ ID NO: 802304 - RNA, 19 nt, Homo sapiens
cagaacagagacuuaauuu

SEQ ID NO: 802305 - RNA, 19 nt, Homo sapiens
gauaaggaaucaauuucag

SEQ ID NO: 802306 - RNA, 19 nt, Homo sapiens
uagcacaccuaugccuuua

SEQ ID NO: 802307 - RNA, 19 nt, Homo sapiens
gcaaauguaagcagugguu

SEQ ID NO: 802308 - RNA, 19 nt, Homo sapiens
caucauauuugaagacagu

SEQ ID NO: 802309 - RNA, 19 nt, Homo sapiens
uauguucacugcacucuga

SEQ ID NO: 802310 - RNA, 19 nt, Homo sapiens
aaagccagcauguaaauuu

SEQ ID NO: 802311 - RNA, 19 nt, Homo sapiens
gaaaggugcaguaucuugu

SEQ ID NO: 802312 - RNA, 19 nt, Homo sapiens
cauccaaaccuauaucuga

SEQ ID NO: 802313 - RNA, 19 nt, Homo sapiens
ggagacugguauuugaaga

SEQ ID NO: 802314 - RNA, 19 nt, Homo sapiens
gaagacaguucuaaauccu

SEQ ID NO: 802315 - RNA, 19 nt, Homo sapiens
gcacgucgggugacacuug

SEQ ID NO: 802316 - RNA, 19 nt, Homo sapiens
caucuaaagaacuccauua

SEQ ID NO: 802317 - RNA, 19 nt, Homo sapiens
gaacucaacacagagauuc

SEQ ID NO: 802318 - RNA, 19 nt, Homo sapiens
ucagaacucagaaauugua

SEQ ID NO: 802319 - RNA, 19 nt, Homo sapiens
gaaaggcauccaaaccuau

SEQ ID NO: 802320 - RNA, 19 nt, Homo sapiens
ccaauguccagcaguguua

SEQ ID NO: 802321 - RNA, 19 nt, Homo sapiens
ccacaagcggucuccuuua

SEQ ID NO: 802322 - RNA, 19 nt, Homo sapiens
cauauugauuccaguguga

SEQ ID NO: 802323 - RNA, 19 nt, Homo sapiens
ucaagaagaguauucagaa

SEQ ID NO: 802324 - RNA, 19 nt, Homo sapiens
ccaaggaccucgguuugug

SEQ ID NO: 802325 - RNA, 19 nt, Homo sapiens
ccaaaccuauaucugauuc

SEQ ID NO: 802326 - RNA, 19 nt, Homo sapiens
caccaaauguggcuuucaa

SEQ ID NO: 802327 - RNA, 19 nt, Homo sapiens
gccaaagcauugcaaguca

SEQ ID NO: 802328 - RNA, 19 nt, Homo sapiens
caagaagaguauucagaag

SEQ ID NO: 802329 - RNA, 19 nt, Homo sapiens
cagagcugcuucaucauau

SEQ ID NO: 802330 - RNA, 19 nt, Homo sapiens
cuuagcagaucaggaguua

SEQ ID NO: 802331 - RNA, 19 nt, Homo sapiens
gaucuuggccugcugcaau

SEQ ID NO: 802332 - RNA, 19 nt, Homo sapiens
ggauaaggaaucaauuuca

SEQ ID NO: 802333 - RNA, 19 nt, Homo sapiens
gaaguaagcaauggcauag

SEQ ID NO: 802334 - RNA, 19 nt, Homo sapiens
gauuacaagaccauguuua

SEQ ID NO: 802335 - RNA, 19 nt, Homo sapiens
gaacuugagcuuaugacau

SEQ ID NO: 802336 - RNA, 19 nt, Homo sapiens
ccagugugauugauucaga

SEQ ID NO: 802337 - RNA, 19 nt, Homo sapiens
gauaucaucaguuguguca

SEQ ID NO: 802338 - RNA, 19 nt, Homo sapiens
ugaauaacuuagcagauca

SEQ ID NO: 802339 - RNA, 19 nt, Homo sapiens
ugaaggaacaucucaugaa

SEQ ID NO: 802340 - RNA, 19 nt, Homo sapiens
ccuggagacugguauuuga

SEQ ID NO: 802341 - RNA, 19 nt, Homo sapiens
gagcugcuucaucauauuu

SEQ ID NO: 802342 - RNA, 19 nt, Homo sapiens
auauugagccuguaaauug

SEQ ID NO: 802343 - RNA, 19 nt, Homo sapiens
gggugacacuugauggaaa

SEQ ID NO: 802344 - RNA, 19 nt, Homo sapiens
caauaugucaagaagagua

SEQ ID NO: 802345 - RNA, 19 nt, Homo sapiens
gauuuaccuuguucuauag

SEQ ID NO: 802346 - RNA, 19 nt, Homo sapiens
aguaagcaauggcauagaa

SEQ ID NO: 802347 - RNA, 19 nt, Homo sapiens
ugaagugggcuguguuuga

SEQ ID NO: 802348 - RNA, 19 nt, Homo sapiens
uacaauaugucaagaagag

SEQ ID NO: 802349 - RNA, 19 nt, Homo sapiens
cuagcuagauggucagaug

SEQ ID NO: 802350 - RNA, 19 nt, Homo sapiens
uaucagagcaaacaucaug

SEQ ID NO: 802351 - RNA, 19 nt, Homo sapiens
uaucagagcaaacaucaug

SEQ ID NO: 802352 - RNA, 19 nt, Homo sapiens
ugcaguaucuuguggaaug

SEQ ID NO: 802353 - RNA, 19 nt, Homo sapiens
ucaaucaucuaaagaacuc

SEQ ID NO: 802354 - RNA, 19 nt, Homo sapiens
cagagaauccuacuuugga

SEQ ID NO: 802355 - RNA, 19 nt, Homo sapiens
ucaaacgucuaccauuaca

SEQ ID NO: 802356 - RNA, 19 nt, Homo sapiens
ucaugaggcuugugugcaa

SEQ ID NO: 802357 - RNA, 19 nt, Homo sapiens
cagaagcucccaaugaaau

SEQ ID NO: 802358 - RNA, 19 nt, Homo sapiens
gcacauucauccaauaccu

SEQ ID NO: 802359 - RNA, 19 nt, Homo sapiens
ccaccuggcccauauacaa

SEQ ID NO: 802360 - RNA, 19 nt, Homo sapiens
caaaggaacuggauaauuu

SEQ ID NO: 802361 - RNA, 19 nt, Homo sapiens
gcaacagucuaccuuauuu

SEQ ID NO: 802362 - RNA, 19 nt, Homo sapiens
ggaacaagcuaacuuacaa

SEQ ID NO: 802363 - RNA, 19 nt, Homo sapiens
gaaacaaggaugaaagaua

SEQ ID NO: 802364 - RNA, 19 nt, Homo sapiens
aaagacagcucacagcaua

SEQ ID NO: 802365 - RNA, 19 nt, Homo sapiens
gaacuuugaugaggcuuua

SEQ ID NO: 802366 - RNA, 19 nt, Homo sapiens
agacauaaguaccacauua

SEQ ID NO: 802367 - RNA, 19 nt, Homo sapiens
gauagaagcuuauagaaac

SEQ ID NO: 802368 - RNA, 19 nt, Homo sapiens
ggauaaaccucaauuccuu

SEQ ID NO: 802369 - RNA, 19 nt, Homo sapiens
ugaguuggcugaauaguaa

SEQ ID NO: 802370 - RNA, 19 nt, Homo sapiens
ggaccaaccuaaacaaguu

SEQ ID NO: 802371 - RNA, 19 nt, Homo sapiens
caucagaucuuccauugaa

SEQ ID NO: 802372 - RNA, 19 nt, Homo sapiens
aaucuaagcuuuccggaua

SEQ ID NO: 802373 - RNA, 19 nt, Homo sapiens
gaaggaaccauuugaacua

SEQ ID NO: 802374 - RNA, 19 nt, Homo sapiens
gcaaagagccagauaguca

SEQ ID NO: 802375 - RNA, 19 nt, Homo sapiens
gaucaugcaagauaaguua

SEQ ID NO: 802376 - RNA, 19 nt, Homo sapiens
ggugauaguuccaaaguga

SEQ ID NO: 802377 - RNA, 19 nt, Homo sapiens
gaucuuccauugaacauug

SEQ ID NO: 802378 - RNA, 19 nt, Homo sapiens
ggaucaggcuucccuauga

SEQ ID NO: 802379 - RNA, 19 nt, Homo sapiens
ggaagaugaucaugcaaga

SEQ ID NO: 802380 - RNA, 19 nt, Homo sapiens
ugaaagugauagaagcuua

SEQ ID NO: 802381 - RNA, 19 nt, Homo sapiens
uaacauccauggaaucuuc

SEQ ID NO: 802382 - RNA, 19 nt, Homo sapiens
gaguggaacugaaacuaaa

SEQ ID NO: 802383 - RNA, 19 nt, Homo sapiens
gcagguugaucaagaagaa

SEQ ID NO: 802384 - RNA, 19 nt, Homo sapiens
ggacagaguggaacugaaa

SEQ ID NO: 802385 - RNA, 19 nt, Homo sapiens
ugaaugaccuugauguuuc

SEQ ID NO: 802386 - RNA, 19 nt, Homo sapiens
cauacaggauggauacaua

SEQ ID NO: 802387 - RNA, 19 nt, Homo sapiens
ggauaagcuucaagaacua

SEQ ID NO: 802388 - RNA, 19 nt, Homo sapiens
gcaaaugcaucagaucuuc

SEQ ID NO: 802389 - RNA, 19 nt, Homo sapiens
cgaauuagauuuacaagac

SEQ ID NO: 802390 - RNA, 19 nt, Homo sapiens
gaaugccguugaagaauau

SEQ ID NO: 802391 - RNA, 19 nt, Homo sapiens
agaaugccguugaagaaua

SEQ ID NO: 802392 - RNA, 19 nt, Homo sapiens
gaaaugaugcuaagaaugc

SEQ ID NO: 802393 - RNA, 19 nt, Homo sapiens
gcacuggcguauggaauuu

SEQ ID NO: 802394 - RNA, 19 nt, Homo sapiens
gcagaagcauagauuuaau

SEQ ID NO: 802395 - RNA, 19 nt, Homo sapiens
gauccaacuugucaugaaa

SEQ ID NO: 802396 - RNA, 19 nt, Homo sapiens
caaacaagaccgauuaaau

SEQ ID NO: 802397 - RNA, 19 nt, Homo sapiens
ggaaccauuugaacuagaa

SEQ ID NO: 802398 - RNA, 19 nt, Homo sapiens
ugaugaagcuguugcaaga

SEQ ID NO: 802399 - RNA, 19 nt, Homo sapiens
gaugagaaaccaagaaaug

SEQ ID NO: 802400 - RNA, 19 nt, Homo sapiens
ggaacuggauaauuucugu

SEQ ID NO: 802401 - RNA, 19 nt, Homo sapiens
agacaaacaagaccgauua

SEQ ID NO: 802402 - RNA, 19 nt, Homo sapiens
gaagaggaaauugaucaua

SEQ ID NO: 802403 - RNA, 19 nt, Homo sapiens
gaaaauugaugggguuuaa

SEQ ID NO: 802404 - RNA, 19 nt, Homo sapiens
ggagacagaaacuucauuu

SEQ ID NO: 802405 - RNA, 19 nt, Homo sapiens
gaucaggcuucccuaugaa

SEQ ID NO: 802406 - RNA, 19 nt, Homo sapiens
acaagacaaucuaagcuuu

SEQ ID NO: 802407 - RNA, 19 nt, Homo sapiens
ccagaagacuugaguaaac

SEQ ID NO: 802408 - RNA, 19 nt, Homo sapiens
uaagaaugccguugaagaa

SEQ ID NO: 802409 - RNA, 19 nt, Homo sapiens
caagauaaguuagagaaag

SEQ ID NO: 802410 - RNA, 19 nt, Homo sapiens
gcacagaacaaacuaaguc

SEQ ID NO: 802411 - RNA, 19 nt, Homo sapiens
gugaagacauuaguaguau

SEQ ID NO: 802412 - RNA, 19 nt, Homo sapiens
caaacuaagucucacucaa

SEQ ID NO: 802413 - RNA, 19 nt, Homo sapiens
gaaaccaagaaauguagua

SEQ ID NO: 802414 - RNA, 19 nt, Homo sapiens
guacuuagaggaagagaga

SEQ ID NO: 802415 - RNA, 19 nt, Homo sapiens
caacagucuaccuuauuua

SEQ ID NO: 802416 - RNA, 19 nt, Homo sapiens
caggauggauacauaguug

SEQ ID NO: 802417 - RNA, 19 nt, Homo sapiens
ucauuuccauugcugcuua

SEQ ID NO: 802418 - RNA, 19 nt, Homo sapiens
gcucacagcauacuaaauc

SEQ ID NO: 802419 - RNA, 19 nt, Homo sapiens
agaaguuccugaagacaaa

SEQ ID NO: 802420 - RNA, 19 nt, Homo sapiens
aagcagaaguuccugaaga

SEQ ID NO: 802421 - RNA, 19 nt, Homo sapiens
gccaagaucuucucaacag

SEQ ID NO: 802422 - RNA, 19 nt, Homo sapiens
gagacagaaacuucauuua

SEQ ID NO: 802423 - RNA, 19 nt, Homo sapiens
gcgcaucaguaauugagaa

SEQ ID NO: 802424 - RNA, 19 nt, Homo sapiens
guuccaaagugaagguuaa

SEQ ID NO: 802425 - RNA, 19 nt, Homo sapiens
gacauaaguaccacauuaa

SEQ ID NO: 802426 - RNA, 19 nt, Homo sapiens
guuuaagguugaugaauga

SEQ ID NO: 802427 - RNA, 19 nt, Homo sapiens
gaagacauuaguaguauag

SEQ ID NO: 802428 - RNA, 19 nt, Homo sapiens
gaaaaugccuaauggaagu

SEQ ID NO: 802429 - RNA, 19 nt, Homo sapiens
uaaagcuucuacugggaua

SEQ ID NO: 802430 - RNA, 19 nt, Homo sapiens
gcugggcacugucuaugaa

SEQ ID NO: 802431 - RNA, 19 nt, Homo sapiens
agaaagaaaugaugcuaag

SEQ ID NO: 802432 - RNA, 19 nt, Homo sapiens
ccacaagaaggaaccauuu

SEQ ID NO: 802433 - RNA, 19 nt, Homo sapiens
cuacuaccuuugauccaua

SEQ ID NO: 802434 - RNA, 19 nt, Homo sapiens
gcacuucuguucauuucca

SEQ ID NO: 802435 - RNA, 19 nt, Homo sapiens
aagaugaucaugcaagaua

SEQ ID NO: 802436 - RNA, 19 nt, Homo sapiens
caaagugaagguuaaaguu

SEQ ID NO: 802437 - RNA, 19 nt, Homo sapiens
gaagugccuuauccugaug

SEQ ID NO: 802438 - RNA, 19 nt, Homo sapiens
uaauggaagugcaggaguu

SEQ ID NO: 802439 - RNA, 19 nt, Homo sapiens
gaacucgagccauuggaaa

SEQ ID NO: 802440 - RNA, 19 nt, Homo sapiens
caagaaggaaccauuugaa

SEQ ID NO: 802441 - RNA, 19 nt, Homo sapiens
ugagaaaccaagaaaugua

SEQ ID NO: 802442 - RNA, 19 nt, Homo sapiens
gagaaagaaagaaaugaug

SEQ ID NO: 802443 - RNA, 19 nt, Homo sapiens
caacgugaagacauuagua

SEQ ID NO: 802444 - RNA, 19 nt, Homo sapiens
gauuucaauuccuagcuuu

SEQ ID NO: 802445 - RNA, 19 nt, Homo sapiens
aaaugcagguugaucaaga

SEQ ID NO: 802446 - RNA, 19 nt, Homo sapiens
gaauugggagcuucacuau

SEQ ID NO: 802447 - RNA, 19 nt, Homo sapiens
gugaugaguucaagaccaa

SEQ ID NO: 802448 - RNA, 19 nt, Homo sapiens
guugcaggcuuaaauuguu

SEQ ID NO: 802449 - RNA, 19 nt, Homo sapiens
gaaauaguagcaaagucaa

SEQ ID NO: 802450 - RNA, 19 nt, Homo sapiens
uggauaagcuucaagaacu

SEQ ID NO: 802451 - RNA, 19 nt, Homo sapiens
gcaagauaaguuagagaaa

SEQ ID NO: 802452 - RNA, 19 nt, Homo sapiens
guagacaacuaggccaaga

SEQ ID NO: 802453 - RNA, 19 nt, Homo sapiens
cauuugaacuagaagcauu

SEQ ID NO: 802454 - RNA, 19 nt, Homo sapiens
cuacuucugugaugaguuc

SEQ ID NO: 802455 - RNA, 19 nt, Homo sapiens
cuuaaagucuuggcuacua

SEQ ID NO: 802456 - RNA, 19 nt, Homo sapiens
gauaaaccucaauuccuuu

SEQ ID NO: 802457 - RNA, 19 nt, Homo sapiens
uaagcuuuccggauaauuu

SEQ ID NO: 802458 - RNA, 19 nt, Homo sapiens
gaaagugauagaagcuuau

SEQ ID NO: 802459 - RNA, 19 nt, Homo sapiens
caagaagaagggcaucaaa

SEQ ID NO: 802460 - RNA, 19 nt, Homo sapiens
ggacaaagcuuacaaguug

SEQ ID NO: 802461 - RNA, 19 nt, Homo sapiens
uugcagagcuggaaauuaa

SEQ ID NO: 802462 - RNA, 19 nt, Homo sapiens
ccaaagagaugcaugaaag

SEQ ID NO: 802463 - RNA, 19 nt, Homo sapiens
gaauugugaugguuagaaa

SEQ ID NO: 802464 - RNA, 19 nt, Homo sapiens
gaagagggcccuggaugua

SEQ ID NO: 802465 - RNA, 19 nt, Homo sapiens
gaagagagacucgguucua

SEQ ID NO: 802466 - RNA, 19 nt, Homo sapiens
guuagaaacuucguggaua

SEQ ID NO: 802467 - RNA, 19 nt, Homo sapiens
ggaaagagaguggcagaaa

SEQ ID NO: 802468 - RNA, 19 nt, Homo sapiens
gagagaagccaaagagaug

SEQ ID NO: 802469 - RNA, 19 nt, Homo sapiens
gagacucgguucuaacuuc

SEQ ID NO: 802470 - RNA, 19 nt, Homo sapiens
gaaagagaguggcagaaaa

SEQ ID NO: 802471 - RNA, 19 nt, Homo sapiens
gauagauccugaaguuaca

SEQ ID NO: 802472 - RNA, 19 nt, Homo sapiens
gaacaaccaguauuagaag

SEQ ID NO: 802473 - RNA, 19 nt, Homo sapiens
ccuagaacaaccaguauua

SEQ ID NO: 802474 - RNA, 19 nt, Homo sapiens
acagugaggugaaacaaau

SEQ ID NO: 802475 - RNA, 19 nt, Homo sapiens
gaaagagagagaagccaaa

SEQ ID NO: 802476 - RNA, 19 nt, Homo sapiens
aaagagguuucggcaguua

SEQ ID NO: 802477 - RNA, 19 nt, Homo sapiens
guggauaguuuguggaaau

SEQ ID NO: 802478 - RNA, 19 nt, Homo sapiens
gaaggaaaaccuacaauug

SEQ ID NO: 802479 - RNA, 19 nt, Homo sapiens
agagaugcaugaaaggaaa

SEQ ID NO: 802480 - RNA, 19 nt, Homo sapiens
guucaaacaagcuguauau

SEQ ID NO: 802481 - RNA, 19 nt, Homo sapiens
ucaagaugaugcugacaga

SEQ ID NO: 802482 - RNA, 19 nt, Homo sapiens
gauaagacagggaacacuu

SEQ ID NO: 802483 - RNA, 19 nt, Homo sapiens
gaaaugaggggcuugguuu

SEQ ID NO: 802484 - RNA, 19 nt, Homo sapiens
aagagagacucgguucuaa

SEQ ID NO: 802485 - RNA, 19 nt, Homo sapiens
ucgaaggacucauucuuuc

SEQ ID NO: 802486 - RNA, 19 nt, Homo sapiens
ggacagcuggcgaaacuuc

SEQ ID NO: 802487 - RNA, 19 nt, Homo sapiens
gaaguuacagaugaagaaa

SEQ ID NO: 802488 - RNA, 19 nt, Homo sapiens
ugaaacaaauagagaagag

SEQ ID NO: 802489 - RNA, 19 nt, Homo sapiens
cacccaaaccuuucacuuu

SEQ ID NO: 802490 - RNA, 19 nt, Homo sapiens
gcaccgaggaagcauuuau

SEQ ID NO: 802491 - RNA, 19 nt, Homo sapiens
acaaagggaagaagagauu

SEQ ID NO: 802492 - RNA, 19 nt, Homo sapiens
guggacagcuggcgaaacu

SEQ ID NO: 802493 - RNA, 19 nt, Homo sapiens
acaaguugcuacuggauca

SEQ ID NO: 802494 - RNA, 19 nt, Homo sapiens
cauuugagguucuucagau

SEQ ID NO: 802495 - RNA, 19 nt, Homo sapiens
uagccugucugcauuuguu

SEQ ID NO: 802496 - RNA, 19 nt, Homo sapiens
uuagaaacuucguggauag

SEQ ID NO: 802497 - RNA, 19 nt, Homo sapiens
agaacaaccaguauuagaa

SEQ ID NO: 802498 - RNA, 19 nt, Homo sapiens
aagcauuuaugaccuucua

SEQ ID NO: 802499 - RNA, 19 nt, Homo sapiens
ggagagagcgggacuucag

SEQ ID NO: 802500 - RNA, 19 nt, Homo sapiens
gaggugaaacaaauagaga

SEQ ID NO: 802501 - RNA, 19 nt, Homo sapiens
guccuagccugucugcauu

SEQ ID NO: 802502 - RNA, 19 nt, Homo sapiens
acccaaaccuuucacuuuc

SEQ ID NO: 802503 - RNA, 19 nt, Homo sapiens
agacagggaacacuuguga

SEQ ID NO: 802504 - RNA, 19 nt, Homo sapiens
gauaguuuguggaaaucau

SEQ ID NO: 802505 - RNA, 19 nt, Homo sapiens
caugaaaggaaacgacaaa

SEQ ID NO: 802506 - RNA, 19 nt, Homo sapiens
ccacgccacccaaaccuuu

SEQ ID NO: 802507 - RNA, 19 nt, Homo sapiens
agacugacccguccugguu

SEQ ID NO: 802508 - RNA, 19 nt, Homo sapiens
gaaacaaauagagaagaga

SEQ ID NO: 802509 - RNA, 19 nt, Homo sapiens
uagaacaaccaguauuaga

SEQ ID NO: 802510 - RNA, 19 nt, Homo sapiens
aaacagacaaugaaacucu

SEQ ID NO: 802511 - RNA, 19 nt, Homo sapiens
caaggucacaggcacagaa

SEQ ID NO: 802512 - RNA, 19 nt, Homo sapiens
ggaagaagagauugaagcu

SEQ ID NO: 802513 - RNA, 19 nt, Homo sapiens
gaaacgacaaagggaagaa

SEQ ID NO: 802514 - RNA, 19 nt, Homo sapiens
cagcaccgaggaagcauuu

SEQ ID NO: 802515 - RNA, 19 nt, Homo sapiens
ugaaguuacagaugaagaa

SEQ ID NO: 802516 - RNA, 19 nt, Homo sapiens
ucgaucagaguaauucuuu

SEQ ID NO: 802517 - RNA, 19 nt, Homo sapiens
ucacaggcacagaaccuuu

SEQ ID NO: 802518 - RNA, 19 nt, Homo sapiens
gagagagaagccaaagaga

SEQ ID NO: 802519 - RNA, 19 nt, Homo sapiens
ggaaggaaaaccuacaauu

SEQ ID NO: 802520 - RNA, 19 nt, Homo sapiens
gcauuuguuagugguaaua

SEQ ID NO: 802521 - RNA, 19 nt, Homo sapiens
cugaugcccugugguguuu

SEQ ID NO: 802522 - RNA, 19 nt, Homo sapiens
ccaacauagaguaguauuu

SEQ ID NO: 802523 - RNA, 19 nt, Homo sapiens
ugagaccaccgaaaguaaa

SEQ ID NO: 802524 - RNA, 19 nt, Homo sapiens
ugaggaaagucgagauggu

SEQ ID NO: 802525 - RNA, 19 nt, Homo sapiens
cagauagauccugaaguua

SEQ ID NO: 802526 - RNA, 19 nt, Homo sapiens
cgacaaagggaagaagaga

SEQ ID NO: 802527 - RNA, 19 nt, Homo sapiens
gccaaagagaugcaugaaa

SEQ ID NO: 802528 - RNA, 19 nt, Homo sapiens
gagagacucgguucuaacu

SEQ ID NO: 802529 - RNA, 19 nt, Homo sapiens
agagggcccuggauguaau

SEQ ID NO: 802530 - RNA, 19 nt, Homo sapiens
ccugagaccaccgaaagua

SEQ ID NO: 802531 - RNA, 19 nt, Homo sapiens
ggaaacgacaaagggaaga

SEQ ID NO: 802532 - RNA, 19 nt, Homo sapiens
gcuacuggaucaggagcaa

SEQ ID NO: 802533 - RNA, 19 nt, Homo sapiens
cgaaggcccagauaagaca

SEQ ID NO: 802534 - RNA, 19 nt, Homo sapiens
aaagggaagaagagauuga

SEQ ID NO: 802535 - RNA, 19 nt, Homo sapiens
gaaaagaauacguggaaca

SEQ ID NO: 802536 - RNA, 19 nt, Homo sapiens
auccugaaguuacagauga

SEQ ID NO: 802537 - RNA, 19 nt, Homo sapiens
gguuagaaacuucguggau

SEQ ID NO: 802538 - RNA, 19 nt, Homo sapiens
ugugaugguuagaaacuuc

SEQ ID NO: 802539 - RNA, 19 nt, Homo sapiens
agagagaagccaaagagau

SEQ ID NO: 802540 - RNA, 19 nt, Homo sapiens
gauccugaaguuacagaug

SEQ ID NO: 802541 - RNA, 19 nt, Homo sapiens
ccaaaccuuucacuuucca

SEQ ID NO: 802542 - RNA, 19 nt, Homo sapiens
gcugugacuucagagacaa

SEQ ID NO: 802543 - RNA, 19 nt, Homo sapiens
gaucagaguaauucuuuug

SEQ ID NO: 802544 - RNA, 19 nt, Homo sapiens
gcauuuaugaccuucuaca

SEQ ID NO: 802545 - RNA, 19 nt, Homo sapiens
cuuggugcauccugacaaa

SEQ ID NO: 802546 - RNA, 19 nt, Homo sapiens
uuaugaccuucuacaguga

SEQ ID NO: 802547 - RNA, 19 nt, Homo sapiens
uugagguucuucagauaga

SEQ ID NO: 802548 - RNA, 19 nt, Homo sapiens
guguugcugugacuucaga

SEQ ID NO: 802549 - RNA, 19 nt, Homo sapiens
aaagagaugcaugaaagga

SEQ ID NO: 802550 - RNA, 19 nt, Homo sapiens
ccugucuacugaccaauca

SEQ ID NO: 802551 - RNA, 19 nt, Homo sapiens
agauagauccugaaguuac

SEQ ID NO: 802552 - RNA, 19 nt, Homo sapiens
agagagagaagccaaagag

SEQ ID NO: 802553 - RNA, 19 nt, Homo sapiens
agaagagggcccuggaugu

SEQ ID NO: 802554 - RNA, 19 nt, Homo sapiens
uggacaaagcuuacaaguu

SEQ ID NO: 802555 - RNA, 19 nt, Homo sapiens
cugcauuuguuagugguaa

SEQ ID NO: 802556 - RNA, 19 nt, Homo sapiens
cuucuacagugaggugaaa

SEQ ID NO: 802557 - RNA, 19 nt, Homo sapiens
aggaagcauuuaugaccuu

SEQ ID NO: 802558 - RNA, 19 nt, Homo sapiens
ugaauugugaugguuagaa

SEQ ID NO: 802559 - RNA, 19 nt, Homo sapiens
gcgaaacuuccaagccaau

SEQ ID NO: 802560 - RNA, 19 nt, Homo sapiens
ggaggaggaugcagaaauc

SEQ ID NO: 802561 - RNA, 19 nt, Homo sapiens
gaucacagcucaggaagca

SEQ ID NO: 802562 - RNA, 19 nt, Homo sapiens
gggcagacccagcaacaua

SEQ ID NO: 802563 - RNA, 19 nt, Homo sapiens
ggaagaagaggagcuguuu

SEQ ID NO: 802564 - RNA, 19 nt, Homo sapiens
gcaggagucuacagugaug

SEQ ID NO: 802565 - RNA, 19 nt, Homo sapiens
caagaucuuuguggaguuu

SEQ ID NO: 802566 - RNA, 19 nt, Homo sapiens
gcagaaaucauugucaaga

SEQ ID NO: 802567 - RNA, 19 nt, Homo sapiens
gcacagacuccaucaagau

SEQ ID NO: 802568 - RNA, 19 nt, Homo sapiens
gcaaggugguggcugaagu

SEQ ID NO: 802569 - RNA, 19 nt, Homo sapiens
ggaggaugcagaaaucauu

SEQ ID NO: 802570 - RNA, 19 nt, Homo sapiens
gaugcugugucuuccauga

SEQ ID NO: 802571 - RNA, 19 nt, Homo sapiens
ggugguggcugaaguguac

SEQ ID NO: 802572 - RNA, 19 nt, Homo sapiens
aagcaggagucuacaguga

SEQ ID NO: 802573 - RNA, 19 nt, Homo sapiens
caucaucuaccaagagaaa

SEQ ID NO: 802574 - RNA, 19 nt, Homo sapiens
ccaagaaggagaaggaaga

SEQ ID NO: 802575 - RNA, 19 nt, Homo sapiens
caagaucacagcucaggaa

SEQ ID NO: 802576 - RNA, 19 nt, Homo sapiens
cagaaaucauugucaagau

SEQ ID NO: 802577 - RNA, 19 nt, Homo sapiens
gcuacggcuucauugagua

SEQ ID NO: 802578 - RNA, 19 nt, Homo sapiens
agaaaucauugucaagauc

SEQ ID NO: 802579 - RNA, 19 nt, Homo sapiens
gcaucuacguggccucugu

SEQ ID NO: 802580 - RNA, 19 nt, Homo sapiens
ucaagagugugcuggugaa

SEQ ID NO: 802581 - RNA, 19 nt, Homo sapiens
gagcguguuugaggccuuu

SEQ ID NO: 802582 - RNA, 19 nt, Homo sapiens
ggcacagacuccaucaaga

SEQ ID NO: 802583 - RNA, 19 nt, Homo sapiens
ccauagcucuccaggucaa

SEQ ID NO: 802584 - RNA, 19 nt, Homo sapiens
gaaaucauugucaagaucu

SEQ ID NO: 802585 - RNA, 19 nt, Homo sapiens
caagggcuacggcuucauu

SEQ ID NO: 802586 - RNA, 19 nt, Homo sapiens
cugcacagcuggccuugga

SEQ ID NO: 802587 - RNA, 19 nt, Homo sapiens
gcaagcaggagucuacagu

SEQ ID NO: 802588 - RNA, 19 nt, Homo sapiens
gacacauggugaugcagaa

SEQ ID NO: 802589 - RNA, 19 nt, Homo sapiens
agaaggagaaggaagaaga

SEQ ID NO: 802590 - RNA, 19 nt, Homo sapiens
ggauaaaggugcggaugcu

SEQ ID NO: 802591 - RNA, 19 nt, Homo sapiens
gucaucaucuaccaagaga

SEQ ID NO: 802592 - RNA, 19 nt, Homo sapiens
ggagcuguuucccgaguca

SEQ ID NO: 802593 - RNA, 19 nt, Homo sapiens
gggacuccgucaccaugaa

SEQ ID NO: 802594 - RNA, 19 nt, Homo sapiens
ggaugcugcuggcccugaa

SEQ ID NO: 802595 - RNA, 19 nt, Homo sapiens
gguggcagcgggagacaaa

SEQ ID NO: 802596 - RNA, 19 nt, Homo sapiens
ccaggucaauggccagcaa

SEQ ID NO: 802597 - RNA, 19 nt, Homo sapiens
ugacaucaagagcguguuu

SEQ ID NO: 802598 - RNA, 19 nt, Homo sapiens
gaagaagaggagcuguuuc

SEQ ID NO: 802599 - RNA, 19 nt, Homo sapiens
gcagaugaacucggugaug

SEQ ID NO: 802600 - RNA, 19 nt, Homo sapiens
gggcacagacuccaucaag

SEQ ID NO: 802601 - RNA, 19 nt, Homo sapiens
ucaagagcaucgacauguc

SEQ ID NO: 802602 - RNA, 19 nt, Homo sapiens
ucaagaucuuuguggaguu

SEQ ID NO: 802603 - RNA, 19 nt, Homo sapiens
gaggaugcagaaaucauug

SEQ ID NO: 802604 - RNA, 19 nt, Homo sapiens
gaaggagaaggaagaagag

SEQ ID NO: 802605 - RNA, 19 nt, Homo sapiens
gcaggcccagcccaucaua

SEQ ID NO: 802606 - RNA, 19 nt, Homo sapiens
gcuuugccuucguggagua

SEQ ID NO: 802607 - RNA, 19 nt, Homo sapiens
cgugggcucuaucuacuau

SEQ ID NO: 802608 - RNA, 19 nt, Homo sapiens
ugaaccgcgucaucaucua

SEQ ID NO: 802609 - RNA, 19 nt, Homo sapiens
agaggaguguggcaaguuc

SEQ ID NO: 802610 - RNA, 19 nt, Homo sapiens
caagaaggagaaggaagaa

SEQ ID NO: 802611 - RNA, 19 nt, Homo sapiens
ggacuugcacuuguuccuu

SEQ ID NO: 802612 - RNA, 19 nt, Homo sapiens
cagccuacagugcggauaa

SEQ ID NO: 802613 - RNA, 19 nt, Homo sapiens
ugauaacagugaccucucu

SEQ ID NO: 802614 - RNA, 19 nt, Homo sapiens
gcccagucgucccaagaug

SEQ ID NO: 802615 - RNA, 19 nt, Homo sapiens
ggcuacggcuucauugagu

SEQ ID NO: 802616 - RNA, 19 nt, Homo sapiens
uucagaaggccaagaagua

SEQ ID NO: 802617 - RNA, 19 nt, Homo sapiens
ugggcucuaucuacuauga

SEQ ID NO: 802618 - RNA, 19 nt, Homo sapiens
ccaagaaguacgccaugga

SEQ ID NO: 802619 - RNA, 19 nt, Homo sapiens
augcagaaaucauugucaa

SEQ ID NO: 802620 - RNA, 19 nt, Homo sapiens
ccacaacuggcaagcacaa

SEQ ID NO: 802621 - RNA, 19 nt, Homo sapiens
gaccaggagcguuuugaua

SEQ ID NO: 802622 - RNA, 19 nt, Homo sapiens
gaaccgcgucaucaucuac

SEQ ID NO: 802623 - RNA, 19 nt, Homo sapiens
gucccaagaugcugugucu

SEQ ID NO: 802624 - RNA, 19 nt, Homo sapiens
cacaagggcuacggcuuca

SEQ ID NO: 802625 - RNA, 19 nt, Homo sapiens
uugcacuuguuccuuguuu

SEQ ID NO: 802626 - RNA, 19 nt, Homo sapiens
ccucaauggccgcugguuu

SEQ ID NO: 802627 - RNA, 19 nt, Homo sapiens
cgaggaggaggaugcagaa

SEQ ID NO: 802628 - RNA, 19 nt, Homo sapiens
caucaagagcaucgacaug

SEQ ID NO: 802629 - RNA, 19 nt, Homo sapiens
cuacagugcggauaaaggu

SEQ ID NO: 802630 - RNA, 19 nt, Homo sapiens
caaggugguggcugaagug

SEQ ID NO: 802631 - RNA, 19 nt, Homo sapiens
ggaggugacagaggagugu

SEQ ID NO: 802632 - RNA, 19 nt, Homo sapiens
cuacgugggcucuaucuac

SEQ ID NO: 802633 - RNA, 19 nt, Homo sapiens
cucaauggccgcugguuug

SEQ ID NO: 802634 - RNA, 19 nt, Homo sapiens
gaugcagaaaucauuguca

SEQ ID NO: 802635 - RNA, 19 nt, Homo sapiens
ggucaauggccagcaagga

SEQ ID NO: 802636 - RNA, 19 nt, Homo sapiens
agucagagcggccagagau

SEQ ID NO: 802637 - RNA, 19 nt, Homo sapiens
ugucuuccaugaaccucuu

SEQ ID NO: 802638 - RNA, 19 nt, Homo sapiens
gggcuacggcuucauugag

SEQ ID NO: 802639 - RNA, 19 nt, Homo sapiens
ggaggaggaugcagaaauc

SEQ ID NO: 802640 - RNA, 19 nt, Homo sapiens
gaucacagcucaggaagca

SEQ ID NO: 802641 - RNA, 19 nt, Homo sapiens
gggcagacccagcaacaua

SEQ ID NO: 802642 - RNA, 19 nt, Homo sapiens
ggaagaagaggagcuguuu

SEQ ID NO: 802643 - RNA, 19 nt, Homo sapiens
gcaggagucuacagugaug

SEQ ID NO: 802644 - RNA, 19 nt, Homo sapiens
caagaucuuuguggaguuu

SEQ ID NO: 802645 - RNA, 19 nt, Homo sapiens
gcagaaaucauugucaaga

SEQ ID NO: 802646 - RNA, 19 nt, Homo sapiens
gcacagacuccaucaagau

SEQ ID NO: 802647 - RNA, 19 nt, Homo sapiens
gcaaggugguggcugaagu

SEQ ID NO: 802648 - RNA, 19 nt, Homo sapiens
ggaggaugcagaaaucauu

SEQ ID NO: 802649 - RNA, 19 nt, Homo sapiens
gaugcugugucuuccauga

SEQ ID NO: 802650 - RNA, 19 nt, Homo sapiens
ggugguggcugaaguguac

SEQ ID NO: 802651 - RNA, 19 nt, Homo sapiens
aagcaggagucuacaguga

SEQ ID NO: 802652 - RNA, 19 nt, Homo sapiens
gcagauggcagcagugaca

SEQ ID NO: 802653 - RNA, 19 nt, Homo sapiens
caucaucuaccaagagaaa

SEQ ID NO: 802654 - RNA, 19 nt, Homo sapiens
ccaagaaggagaaggaaga

SEQ ID NO: 802655 - RNA, 19 nt, Homo sapiens
caagaucacagcucaggaa

SEQ ID NO: 802656 - RNA, 19 nt, Homo sapiens
cagaaaucauugucaagau

SEQ ID NO: 802657 - RNA, 19 nt, Homo sapiens
gcuacggcuucauugagua

SEQ ID NO: 802658 - RNA, 19 nt, Homo sapiens
agaaaucauugucaagauc

SEQ ID NO: 802659 - RNA, 19 nt, Homo sapiens
gcaucuacguggccucugu

SEQ ID NO: 802660 - RNA, 19 nt, Homo sapiens
ucaagagugugcuggugaa

SEQ ID NO: 802661 - RNA, 19 nt, Homo sapiens
gagcguguuugaggccuuu

SEQ ID NO: 802662 - RNA, 19 nt, Homo sapiens
gauccucucucaccuuugc

SEQ ID NO: 802663 - RNA, 19 nt, Homo sapiens
acaaugggcuuuggagauc

SEQ ID NO: 802664 - RNA, 19 nt, Homo sapiens
ggcacagacuccaucaaga

SEQ ID NO: 802665 - RNA, 19 nt, Homo sapiens
ccauagcucuccaggucaa

SEQ ID NO: 802666 - RNA, 19 nt, Homo sapiens
gaaaucauugucaagaucu

SEQ ID NO: 802667 - RNA, 19 nt, Homo sapiens
caagggcuacggcuucauu

SEQ ID NO: 802668 - RNA, 19 nt, Homo sapiens
cugcacagcuggccuugga

SEQ ID NO: 802669 - RNA, 19 nt, Homo sapiens
gcaagcaggagucuacagu

SEQ ID NO: 802670 - RNA, 19 nt, Homo sapiens
gacacauggugaugcagaa

SEQ ID NO: 802671 - RNA, 19 nt, Homo sapiens
gacaaugggcuuuggagau

SEQ ID NO: 802672 - RNA, 19 nt, Homo sapiens
agaaggagaaggaagaaga

SEQ ID NO: 802673 - RNA, 19 nt, Homo sapiens
ggauaaaggugcggaugcu

SEQ ID NO: 802674 - RNA, 19 nt, Homo sapiens
gucaucaucuaccaagaga

SEQ ID NO: 802675 - RNA, 19 nt, Homo sapiens
ggagcuguuucccgaguca

SEQ ID NO: 802676 - RNA, 19 nt, Homo sapiens
gggacuccgucaccaugaa

SEQ ID NO: 802677 - RNA, 19 nt, Homo sapiens
ggaugcugcuggcccugaa

SEQ ID NO: 802678 - RNA, 19 nt, Homo sapiens
gguggcagcgggagacaaa

SEQ ID NO: 802679 - RNA, 19 nt, Homo sapiens
ccaggucaauggccagcaa

SEQ ID NO: 802680 - RNA, 19 nt, Homo sapiens
ugacaucaagagcguguuu

SEQ ID NO: 802681 - RNA, 19 nt, Homo sapiens
gggcacagacuccaucaag

SEQ ID NO: 802682 - RNA, 19 nt, Homo sapiens
gaagaagaggagcuguuuc

SEQ ID NO: 802683 - RNA, 19 nt, Homo sapiens
gcagaugaacucggugaug

SEQ ID NO: 802684 - RNA, 19 nt, Homo sapiens
ucaagagcaucgacauguc

SEQ ID NO: 802685 - RNA, 19 nt, Homo sapiens
ucaagaucuuuguggaguu

SEQ ID NO: 802686 - RNA, 19 nt, Homo sapiens
gaggaugcagaaaucauug

SEQ ID NO: 802687 - RNA, 19 nt, Homo sapiens
gaaggagaaggaagaagag

SEQ ID NO: 802688 - RNA, 19 nt, Homo sapiens
gcaggcccagcccaucaua

SEQ ID NO: 802689 - RNA, 19 nt, Homo sapiens
gcuuugccuucguggagua

SEQ ID NO: 802690 - RNA, 19 nt, Homo sapiens
cgugggcucuaucuacuau

SEQ ID NO: 802691 - RNA, 19 nt, Homo sapiens
ugaaccgcgucaucaucua

SEQ ID NO: 802692 - RNA, 19 nt, Homo sapiens
agaggaguguggcaaguuc

SEQ ID NO: 802693 - RNA, 19 nt, Homo sapiens
caagaaggagaaggaagaa

SEQ ID NO: 802694 - RNA, 19 nt, Homo sapiens
ggacuugcacuuguuccuu

SEQ ID NO: 802695 - RNA, 19 nt, Homo sapiens
cagccuacagugcggauaa

SEQ ID NO: 802696 - RNA, 19 nt, Homo sapiens
ugauaacagugaccucucu

SEQ ID NO: 802697 - RNA, 19 nt, Homo sapiens
uucagaaggccaagaagua

SEQ ID NO: 802698 - RNA, 19 nt, Homo sapiens
gcccagucgucccaagaug

SEQ ID NO: 802699 - RNA, 19 nt, Homo sapiens
ggcuacggcuucauugagu

SEQ ID NO: 802700 - RNA, 19 nt, Homo sapiens
ugggcucuaucuacuauga

SEQ ID NO: 802701 - RNA, 19 nt, Homo sapiens
ccaagaaguacgccaugga

SEQ ID NO: 802702 - RNA, 19 nt, Homo sapiens
gcagugacaaugggcuuug

SEQ ID NO: 802703 - RNA, 19 nt, Homo sapiens
augcagaaaucauugucaa

SEQ ID NO: 802704 - RNA, 19 nt, Homo sapiens
gauggcagcagugacaaug

SEQ ID NO: 802705 - RNA, 19 nt, Homo sapiens
ccacaacuggcaagcacaa

SEQ ID NO: 802706 - RNA, 19 nt, Homo sapiens
gaccaggagcguuuugaua

SEQ ID NO: 802707 - RNA, 19 nt, Homo sapiens
gaaccgcgucaucaucuac

SEQ ID NO: 802708 - RNA, 19 nt, Homo sapiens
gucccaagaugcugugucu

SEQ ID NO: 802709 - RNA, 19 nt, Homo sapiens
cacaagggcuacggcuuca

SEQ ID NO: 802710 - RNA, 19 nt, Homo sapiens
uugcacuuguuccuuguuu

SEQ ID NO: 802711 - RNA, 19 nt, Homo sapiens
ccucaauggccgcugguuu

SEQ ID NO: 802712 - RNA, 19 nt, Homo sapiens
cgaggaggaggaugcagaa

SEQ ID NO: 802713 - RNA, 19 nt, Homo sapiens
caucaagagcaucgacaug

SEQ ID NO: 802714 - RNA, 19 nt, Homo sapiens
cuacagugcggauaaaggu

SEQ ID NO: 802715 - RNA, 19 nt, Homo sapiens
caaggugguggcugaagug

SEQ ID NO: 802716 - RNA, 19 nt, Homo sapiens
ggaggugacagaggagugu

SEQ ID NO: 802717 - RNA, 19 nt, Homo sapiens
cuacgugggcucuaucuac

SEQ ID NO: 802718 - RNA, 19 nt, Homo sapiens
cucaauggccgcugguuug

SEQ ID NO: 802719 - RNA, 19 nt, Homo sapiens
gaugcagaaaucauuguca

SEQ ID NO: 802720 - RNA, 19 nt, Homo sapiens
ggucaauggccagcaagga

SEQ ID NO: 802721 - RNA, 19 nt, Homo sapiens
agucagagcggccagagau

SEQ ID NO: 802722 - RNA, 19 nt, Homo sapiens
ugucuuccaugaaccucuu

SEQ ID NO: 802723 - RNA, 19 nt, Homo sapiens
gggcuacggcuucauugag

SEQ ID NO: 802724 - RNA, 19 nt, Homo sapiens
gcacccagauuuaguaaua

SEQ ID NO: 802725 - RNA, 19 nt, Homo sapiens
gaccauaguuguucacuuu

SEQ ID NO: 802726 - RNA, 19 nt, Homo sapiens
gcagagaaaugaauggaaa

SEQ ID NO: 802727 - RNA, 19 nt, Homo sapiens
caucaaagcuauuaaguuc

SEQ ID NO: 802728 - RNA, 19 nt, Homo sapiens
gaccaaauguaucaaguaa

SEQ ID NO: 802729 - RNA, 19 nt, Homo sapiens
ugacacaguugcugauaua

SEQ ID NO: 802730 - RNA, 19 nt, Homo sapiens
gaaaggagagccagagaaa

SEQ ID NO: 802731 - RNA, 19 nt, Homo sapiens
gggauuaccuccaauuaga

SEQ ID NO: 802732 - RNA, 19 nt, Homo sapiens
aaacugacaucuucaaaug

SEQ ID NO: 802733 - RNA, 19 nt, Homo sapiens
gggccaagauucccuuuaa

SEQ ID NO: 802734 - RNA, 19 nt, Homo sapiens
ucaaauaguucuggacuuu

SEQ ID NO: 802735 - RNA, 19 nt, Homo sapiens
uaaccaaccuguuugaaga

SEQ ID NO: 802736 - RNA, 19 nt, Homo sapiens
gcucagaucuugcaaaguc

SEQ ID NO: 802737 - RNA, 19 nt, Homo sapiens
uaagauugcuugggcuuua

SEQ ID NO: 802738 - RNA, 19 nt, Homo sapiens
gacaagaaguucacagaga

SEQ ID NO: 802739 - RNA, 19 nt, Homo sapiens
gcucagaaccuguuaaaga

SEQ ID NO: 802740 - RNA, 19 nt, Homo sapiens
ggaaggagauagagauuac

SEQ ID NO: 802741 - RNA, 19 nt, Homo sapiens
ugugaaagauguuggauuu

SEQ ID NO: 802742 - RNA, 19 nt, Homo sapiens
ggagaaagaacgacagaaa

SEQ ID NO: 802743 - RNA, 19 nt, Homo sapiens
ggagaagagugacacaguu

SEQ ID NO: 802744 - RNA, 19 nt, Homo sapiens
gaaugauccugaacuuuau

SEQ ID NO: 802745 - RNA, 19 nt, Homo sapiens
agaaugauccugaacuuua

SEQ ID NO: 802746 - RNA, 19 nt, Homo sapiens
gauaaugugccucagguua

SEQ ID NO: 802747 - RNA, 19 nt, Homo sapiens
guaccuggacuuuauguua

SEQ ID NO: 802748 - RNA, 19 nt, Homo sapiens
gccagcagcuucaacaauu

SEQ ID NO: 802749 - RNA, 19 nt, Homo sapiens
aauaacagcuugucagaga

SEQ ID NO: 802750 - RNA, 19 nt, Homo sapiens
gaauggaaaucgucuugga

SEQ ID NO: 802751 - RNA, 19 nt, Homo sapiens
gaaaccagggaaagcauua

SEQ ID NO: 802752 - RNA, 19 nt, Homo sapiens
gaucuuggaguuacauaua

SEQ ID NO: 802753 - RNA, 19 nt, Homo sapiens
gaagaccuccuguagauau

SEQ ID NO: 802754 - RNA, 19 nt, Homo sapiens
ucagauagcagaacaacua

SEQ ID NO: 802755 - RNA, 19 nt, Homo sapiens
gcacuuuccagaauuuaua

SEQ ID NO: 802756 - RNA, 19 nt, Homo sapiens
agauagagauuaccgguuu

SEQ ID NO: 802757 - RNA, 19 nt, Homo sapiens
gaacaacuacaacagcaaa

SEQ ID NO: 802758 - RNA, 19 nt, Homo sapiens
gaacaugguagguaaacuu

SEQ ID NO: 802759 - RNA, 19 nt, Homo sapiens
ggacgagacagaauucaaa

SEQ ID NO: 802760 - RNA, 19 nt, Homo sapiens
caaccuguuugaagaguuu

SEQ ID NO: 802761 - RNA, 19 nt, Homo sapiens
cuaaguguauguaguacua

SEQ ID NO: 802762 - RNA, 19 nt, Homo sapiens
caacugacuuguauagaca

SEQ ID NO: 802763 - RNA, 19 nt, Homo sapiens
gaagucaauuuggaugauu

SEQ ID NO: 802764 - RNA, 19 nt, Homo sapiens
ggauaccacuugggaauga

SEQ ID NO: 802765 - RNA, 19 nt, Homo sapiens
gccaagauucccuuuaaua

SEQ ID NO: 802766 - RNA, 19 nt, Homo sapiens
ggacagccgccaaauguga

SEQ ID NO: 802767 - RNA, 19 nt, Homo sapiens
ggauguggaucuuggaguu

SEQ ID NO: 802768 - RNA, 19 nt, Homo sapiens
ccagcagcuucaacaauua

SEQ ID NO: 802769 - RNA, 19 nt, Homo sapiens
guugagaaguuuauucaga

SEQ ID NO: 802770 - RNA, 19 nt, Homo sapiens
gguccaaggucauuaagau

SEQ ID NO: 802771 - RNA, 19 nt, Homo sapiens
ucacaacuuucucacguuu

SEQ ID NO: 802772 - RNA, 19 nt, Homo sapiens
aacaagaaguugauggaua

SEQ ID NO: 802773 - RNA, 19 nt, Homo sapiens
cauguucaccuuucucuua

SEQ ID NO: 802774 - RNA, 19 nt, Homo sapiens
ggauagggaugacagagau

SEQ ID NO: 802775 - RNA, 19 nt, Homo sapiens
gcucuuacggcacaacuua

SEQ ID NO: 802776 - RNA, 19 nt, Homo sapiens
auacaaaccuuacagauac

SEQ ID NO: 802777 - RNA, 19 nt, Homo sapiens
aaaguacguuucaauguug

SEQ ID NO: 802778 - RNA, 19 nt, Homo sapiens
caaguggugguauaucuua

SEQ ID NO: 802779 - RNA, 19 nt, Homo sapiens
caucuaauguuuccaguag

SEQ ID NO: 802780 - RNA, 19 nt, Homo sapiens
gaggacagccgccaaaugu

SEQ ID NO: 802781 - RNA, 19 nt, Homo sapiens
ggaguagucagcagcauuu

SEQ ID NO: 802782 - RNA, 19 nt, Homo sapiens
ucagaaauguaaaccagaa

SEQ ID NO: 802783 - RNA, 19 nt, Homo sapiens
gaaauaaacaaggagaaga

SEQ ID NO: 802784 - RNA, 19 nt, Homo sapiens
ccaaagaccaaauguauca

SEQ ID NO: 802785 - RNA, 19 nt, Homo sapiens
cacaguugcugauauagaa

SEQ ID NO: 802786 - RNA, 19 nt, Homo sapiens
gcagaaggaggcaugauug

SEQ ID NO: 802787 - RNA, 19 nt, Homo sapiens
ggaagacucugagcauagu

SEQ ID NO: 802788 - RNA, 19 nt, Homo sapiens
uggaagaccuccuguagau

SEQ ID NO: 802789 - RNA, 19 nt, Homo sapiens
gccuauagauccaagagaa

SEQ ID NO: 802790 - RNA, 19 nt, Homo sapiens
caccaaauguuccaaauac

SEQ ID NO: 802791 - RNA, 19 nt, Homo sapiens
gaaagauguuggauuuggu

SEQ ID NO: 802792 - RNA, 19 nt, Homo sapiens
gaucaggagacuguaaaua

SEQ ID NO: 802793 - RNA, 19 nt, Homo sapiens
gaaggaggcaugauugauc

SEQ ID NO: 802794 - RNA, 19 nt, Homo sapiens
gaacaagaagcuaagaaag

SEQ ID NO: 802795 - RNA, 19 nt, Homo sapiens
acaagaaguugauggauag

SEQ ID NO: 802796 - RNA, 19 nt, Homo sapiens
aaucaucacucaguaggua

SEQ ID NO: 802797 - RNA, 19 nt, Homo sapiens
gacaaagcguagacaaugu

SEQ ID NO: 802798 - RNA, 19 nt, Homo sapiens
ggaguuacauauauaccau

SEQ ID NO: 802799 - RNA, 19 nt, Homo sapiens
gcgguucgcucaagaucaa

SEQ ID NO: 802800 - RNA, 19 nt, Homo sapiens
acaagaagcuaagaaagug

SEQ ID NO: 802801 - RNA, 19 nt, Homo sapiens
ugacagagauuuugauuuc

SEQ ID NO: 802802 - RNA, 19 nt, Homo sapiens
gaaccgaggauuuggacaa

SEQ ID NO: 802803 - RNA, 19 nt, Homo sapiens
gauuaccgguuuccuccua

SEQ ID NO: 802804 - RNA, 19 nt, Homo sapiens
gaauacagccacccagugu

SEQ ID NO: 802805 - RNA, 19 nt, Homo sapiens
agacuuaaccaaccuguuu

SEQ ID NO: 802806 - RNA, 19 nt, Homo sapiens
ccauagauauucagcaaca

SEQ ID NO: 802807 - RNA, 19 nt, Homo sapiens
ugaagaaagagguagauuu

SEQ ID NO: 802808 - RNA, 19 nt, Homo sapiens
uaaacaaggagaagaguga

SEQ ID NO: 802809 - RNA, 19 nt, Homo sapiens
ggauuugguagccuuguua

SEQ ID NO: 802810 - RNA, 19 nt, Homo sapiens
ugaagaguuuggacagauu

SEQ ID NO: 802811 - RNA, 19 nt, Homo sapiens
gaaagaaagaggaaaucau

SEQ ID NO: 802812 - RNA, 19 nt, Homo sapiens
caacacucuuacucccuua

SEQ ID NO: 802813 - RNA, 19 nt, Homo sapiens
gguuggauaugguaauaga

SEQ ID NO: 802814 - RNA, 19 nt, Homo sapiens
ucaaggaaaugaauaacag

SEQ ID NO: 802815 - RNA, 19 nt, Homo sapiens
gacuauaaaccacccauuu

SEQ ID NO: 802816 - RNA, 19 nt, Homo sapiens
gaaaacaccagaucaguga

SEQ ID NO: 802817 - RNA, 19 nt, Homo sapiens
guaaaguugucaucucucu

SEQ ID NO: 802818 - RNA, 19 nt, Homo sapiens
agagaccacuuuggcuuua

SEQ ID NO: 802819 - RNA, 19 nt, Homo sapiens
guccaaggcuuaccugauc

SEQ ID NO: 802820 - RNA, 19 nt, Homo sapiens
aauagcaaguggugguaua

SEQ ID NO: 802821 - RNA, 19 nt, Homo sapiens
gagaagagugacacaguug

SEQ ID NO: 802822 - RNA, 19 nt, Homo sapiens
acaagaaguucacagagau

SEQ ID NO: 802823 - RNA, 19 nt, Homo sapiens
gaagacaaagcguagacaa

SEQ ID NO: 802824 - RNA, 19 nt, Homo sapiens
ccacagagcucuucaguug

SEQ ID NO: 802825 - RNA, 19 nt, Homo sapiens
ggauuuggcugaugaagua

SEQ ID NO: 802826 - RNA, 19 nt, Homo sapiens
caaauaggcucuccaugaa

SEQ ID NO: 802827 - RNA, 19 nt, Homo sapiens
gaaccaacauaaagagaaa

SEQ ID NO: 802828 - RNA, 19 nt, Homo sapiens
gauaccaaguucauucaua

SEQ ID NO: 802829 - RNA, 19 nt, Homo sapiens
gaacuuagcacacaugaag

SEQ ID NO: 802830 - RNA, 19 nt, Homo sapiens
ggauuuaucugaucaccaa

SEQ ID NO: 802831 - RNA, 19 nt, Homo sapiens
cgaauuaagugucaccauu

SEQ ID NO: 802832 - RNA, 19 nt, Homo sapiens
gaagaguuccuguuaaaug

SEQ ID NO: 802833 - RNA, 19 nt, Homo sapiens
gaccagcucuaucugcaua

SEQ ID NO: 802834 - RNA, 19 nt, Homo sapiens
gagaaaugcagacgauaua

SEQ ID NO: 802835 - RNA, 19 nt, Homo sapiens
caaagaaucagcagagaaa

SEQ ID NO: 802836 - RNA, 19 nt, Homo sapiens
gcaagguugugcuuucaaa

SEQ ID NO: 802837 - RNA, 19 nt, Homo sapiens
caaguacacucggauauug

SEQ ID NO: 802838 - RNA, 19 nt, Homo sapiens
gaaauccaauguuaaaugc

SEQ ID NO: 802839 - RNA, 19 nt, Homo sapiens
aaagaagaguuccuguuaa

SEQ ID NO: 802840 - RNA, 19 nt, Homo sapiens
gaaagaaggaaaugcagaa

SEQ ID NO: 802841 - RNA, 19 nt, Homo sapiens
acagagcucuucaguugua

SEQ ID NO: 802842 - RNA, 19 nt, Homo sapiens
uagaaugucugaagaacaa

SEQ ID NO: 802843 - RNA, 19 nt, Homo sapiens
aagaagaguuccuguuaaa

SEQ ID NO: 802844 - RNA, 19 nt, Homo sapiens
caacaugacagucuuguga

SEQ ID NO: 802845 - RNA, 19 nt, Homo sapiens
gaucaugucucugcagaug

SEQ ID NO: 802846 - RNA, 19 nt, Homo sapiens
caaaugauaucacucacau

SEQ ID NO: 802847 - RNA, 19 nt, Homo sapiens
gaaguggccugguccaagu

SEQ ID NO: 802848 - RNA, 19 nt, Homo sapiens
ugaacgagauauuccagua

SEQ ID NO: 802849 - RNA, 19 nt, Homo sapiens
caucuuacaugauaucuca

SEQ ID NO: 802850 - RNA, 19 nt, Homo sapiens
caggaaaguuuguaguauu

SEQ ID NO: 802851 - RNA, 19 nt, Homo sapiens
ggauggcucuucuuaagug

SEQ ID NO: 802852 - RNA, 19 nt, Homo sapiens
ccagggacacuuaauauuu

SEQ ID NO: 802853 - RNA, 19 nt, Homo sapiens
ccaugaaacugcaaaggaa

SEQ ID NO: 802854 - RNA, 19 nt, Homo sapiens
gaucugaacuuagcacaca

SEQ ID NO: 802855 - RNA, 19 nt, Homo sapiens
caaauccuguugcuuaugu

SEQ ID NO: 802856 - RNA, 19 nt, Homo sapiens
ugaaguaccugcucagcuu

SEQ ID NO: 802857 - RNA, 19 nt, Homo sapiens
cgaauugacugugcagaaa

SEQ ID NO: 802858 - RNA, 19 nt, Homo sapiens
ggacaaaacaguacaaauu

SEQ ID NO: 802859 - RNA, 19 nt, Homo sapiens
ccacggacaugguagaaug

SEQ ID NO: 802860 - RNA, 19 nt, Homo sapiens
uaacuaccgucugggaaua

SEQ ID NO: 802861 - RNA, 19 nt, Homo sapiens
acaaauaggcucuccauga

SEQ ID NO: 802862 - RNA, 19 nt, Homo sapiens
uuaaaugccucuacuaaag

SEQ ID NO: 802863 - RNA, 19 nt, Homo sapiens
gcaccuagucccuuaugua

SEQ ID NO: 802864 - RNA, 19 nt, Homo sapiens
acacaacuguccucauuga

SEQ ID NO: 802865 - RNA, 19 nt, Homo sapiens
cagcagacccuucucauug

SEQ ID NO: 802866 - RNA, 19 nt, Homo sapiens
agaaacaccacaaaugaua

SEQ ID NO: 802867 - RNA, 19 nt, Homo sapiens
ccaaguucauucauacaaa

SEQ ID NO: 802868 - RNA, 19 nt, Homo sapiens
aggaauaugugaugucaaa

SEQ ID NO: 802869 - RNA, 19 nt, Homo sapiens
ggagggaaccgguaacaug

SEQ ID NO: 802870 - RNA, 19 nt, Homo sapiens
uaggauaucuucacugaca

SEQ ID NO: 802871 - RNA, 19 nt, Homo sapiens
gcucuucaguuguaauuuc

SEQ ID NO: 802872 - RNA, 19 nt, Homo sapiens
ccuagucccuuauguauca

SEQ ID NO: 802873 - RNA, 19 nt, Homo sapiens
aaacaaagacaugggauuu

SEQ ID NO: 802874 - RNA, 19 nt, Homo sapiens
gaauuaagugucaccauug

SEQ ID NO: 802875 - RNA, 19 nt, Homo sapiens
guaagaagccuguuauggu

SEQ ID NO: 802876 - RNA, 19 nt, Homo sapiens
aaagagaaaugcagacgau

SEQ ID NO: 802877 - RNA, 19 nt, Homo sapiens
gaauaugugaugucaaaug

SEQ ID NO: 802878 - RNA, 19 nt, Homo sapiens
caauggauggcucuucuua

SEQ ID NO: 802879 - RNA, 19 nt, Homo sapiens
gggaaccgguaacaugauu

SEQ ID NO: 802880 - RNA, 19 nt, Homo sapiens
cagacgauauaaccaguaa

SEQ ID NO: 802881 - RNA, 19 nt, Homo sapiens
aagaguuccuguuaaauga

SEQ ID NO: 802882 - RNA, 19 nt, Homo sapiens
gaauauauuugggaagagu

SEQ ID NO: 802883 - RNA, 19 nt, Homo sapiens
caaguccuguucuguaguu

SEQ ID NO: 802884 - RNA, 19 nt, Homo sapiens
gcugugagcucaaacaaaa

SEQ ID NO: 802885 - RNA, 19 nt, Homo sapiens
ccaaacaccaucaccauga

SEQ ID NO: 802886 - RNA, 19 nt, Homo sapiens
gacaagacacugaauggaa

SEQ ID NO: 802887 - RNA, 19 nt, Homo sapiens
gcuaaggaaccaacauaaa

SEQ ID NO: 802888 - RNA, 19 nt, Homo sapiens
agagaaacaccacaaauga

SEQ ID NO: 802889 - RNA, 19 nt, Homo sapiens
gacaagaggcgccaugaga

SEQ ID NO: 802890 - RNA, 19 nt, Homo sapiens
cuacuucuaugccuucuau

SEQ ID NO: 802891 - RNA, 19 nt, Homo sapiens
ccaagaaacaguagccaaa

SEQ ID NO: 802892 - RNA, 19 nt, Homo sapiens
gaaguaccugcucagcuua

SEQ ID NO: 802893 - RNA, 19 nt, Homo sapiens
guaggaauaugugauguca

SEQ ID NO: 802894 - RNA, 19 nt, Homo sapiens
gagauauuccaguauguuu

SEQ ID NO: 802895 - RNA, 19 nt, Homo sapiens
gcacaacuugaacgagaua

SEQ ID NO: 802896 - RNA, 19 nt, Homo sapiens
gccagacacauauguauaa

SEQ ID NO: 802897 - RNA, 19 nt, Homo sapiens
gaauucaaguaucuguuca

SEQ ID NO: 802898 - RNA, 19 nt, Homo sapiens
gacacugaauggaauuuau

SEQ ID NO: 802899 - RNA, 19 nt, Homo sapiens
gcucagccagggacacuua

SEQ ID NO: 802900 - RNA, 19 nt, Homo sapiens
ucaaggaacuguguguuuc

SEQ ID NO: 802901 - RNA, 19 nt, Homo sapiens
gaacgaagagaucaugucu

SEQ ID NO: 802902 - RNA, 19 nt, Homo sapiens
gaaacaccacaaaugauau

SEQ ID NO: 802903 - RNA, 19 nt, Homo sapiens
gagggaaccgguaacauga

SEQ ID NO: 802904 - RNA, 19 nt, Homo sapiens
uccauacacucaaacuaua

SEQ ID NO: 802905 - RNA, 19 nt, Homo sapiens
guugguggcucuugcauuc

SEQ ID NO: 802906 - RNA, 19 nt, Homo sapiens
gauuaaaggaagacaugua

SEQ ID NO: 802907 - RNA, 19 nt, Homo sapiens
uaugugaugucaaauggaa

SEQ ID NO: 802908 - RNA, 19 nt, Homo sapiens
ccacaaaugauaucacuca

SEQ ID NO: 802909 - RNA, 19 nt, Homo sapiens
gaacgagauauuccaguau

SEQ ID NO: 802910 - RNA, 19 nt, Homo sapiens
ccaaagaccagcucuaucu

SEQ ID NO: 802911 - RNA, 19 nt, Homo sapiens
ccaaguauaaucccaaaga

SEQ ID NO: 802912 - RNA, 19 nt, Homo sapiens
ggaaccaacauaaagagaa

SEQ ID NO: 802913 - RNA, 19 nt, Homo sapiens
ugagguggauugaggagaa

SEQ ID NO: 802914 - RNA, 19 nt, Homo sapiens
gaaccgguaacaugauuga

SEQ ID NO: 802915 - RNA, 19 nt, Homo sapiens
gaucuauaaucaggcaauu

SEQ ID NO: 802916 - RNA, 19 nt, Homo sapiens
gcacacaugaagcaacauu

SEQ ID NO: 802917 - RNA, 19 nt, Homo sapiens
acaagacacugaauggaau

SEQ ID NO: 802918 - RNA, 19 nt, Homo sapiens
gaaaccaaacgagauuauu

SEQ ID NO: 802919 - RNA, 19 nt, Homo sapiens
ucaggaaaguuuguaguau

SEQ ID NO: 802920 - RNA, 19 nt, Homo sapiens
uaacggcgaugcaggucuu

SEQ ID NO: 802921 - RNA, 19 nt, Homo sapiens
guucuugcccuuugaauau

SEQ ID NO: 802922 - RNA, 19 nt, Homo sapiens
agacaaauaaggagaaaga

SEQ ID NO: 802923 - RNA, 19 nt, Homo sapiens
caacuguccucauugaaac

SEQ ID NO: 802924 - RNA, 19 nt, Homo sapiens
gacagaaacuggacucuua

SEQ ID NO: 802925 - RNA, 19 nt, Homo sapiens
gaacaagacagaacaauug

SEQ ID NO: 802926 - RNA, 19 nt, Homo sapiens
gcuaguuccucuucaauua

SEQ ID NO: 802927 - RNA, 19 nt, Homo sapiens
gaaacuggacucuuaauaa

SEQ ID NO: 802928 - RNA, 19 nt, Homo sapiens
caaauucugucccaugaua

SEQ ID NO: 802929 - RNA, 19 nt, Homo sapiens
caacagaccucuuccagau

SEQ ID NO: 802930 - RNA, 19 nt, Homo sapiens
gagcaaaacugauuaaaga

SEQ ID NO: 802931 - RNA, 19 nt, Homo sapiens
gaagagggccagacaaaga

SEQ ID NO: 802932 - RNA, 19 nt, Homo sapiens
agacaaacaucucccguaa

SEQ ID NO: 802933 - RNA, 19 nt, Homo sapiens
gcaaggcccucauaagcuu

SEQ ID NO: 802934 - RNA, 19 nt, Homo sapiens
gagaagacacgacaggaua

SEQ ID NO: 802935 - RNA, 19 nt, Homo sapiens
gaagcucucugcuacaaau

SEQ ID NO: 802936 - RNA, 19 nt, Homo sapiens
ggaaagacacaccaagaaa

SEQ ID NO: 802937 - RNA, 19 nt, Homo sapiens
gcaacuggcacuacaagua

SEQ ID NO: 802938 - RNA, 19 nt, Homo sapiens
ucaccuaucuacugaguuu

SEQ ID NO: 802939 - RNA, 19 nt, Homo sapiens
gaauagcacaguuaagaaa

SEQ ID NO: 802940 - RNA, 19 nt, Homo sapiens
gagaucugcucauauucua

SEQ ID NO: 802941 - RNA, 19 nt, Homo sapiens
gaaaacagccaaaucuaua

SEQ ID NO: 802942 - RNA, 19 nt, Homo sapiens
aaacuggacuacaauaugu

SEQ ID NO: 802943 - RNA, 19 nt, Homo sapiens
gaacuugagggaaagauga

SEQ ID NO: 802944 - RNA, 19 nt, Homo sapiens
cuacaacuguggcuacaaa

SEQ ID NO: 802945 - RNA, 19 nt, Homo sapiens
ggaaagaugaauaaaggaa

SEQ ID NO: 802946 - RNA, 19 nt, Homo sapiens
ggagacagcaggaacuuga

SEQ ID NO: 802947 - RNA, 19 nt, Homo sapiens
ucuguuagcuggagaguug

SEQ ID NO: 802948 - RNA, 19 nt, Homo sapiens
aggaugagcuggcuucuga

SEQ ID NO: 802949 - RNA, 19 nt, Homo sapiens
ugacuuauuucacucagaa

SEQ ID NO: 802950 - RNA, 19 nt, Homo sapiens
ugacaaacaugcucagaag

SEQ ID NO: 802951 - RNA, 19 nt, Homo sapiens
gagcugugguguuuauuca

SEQ ID NO: 802952 - RNA, 19 nt, Homo sapiens
acaaagagccuaagaccaa

SEQ ID NO: 802953 - RNA, 19 nt, Homo sapiens
gaacuccuguuaccaaagg

SEQ ID NO: 802954 - RNA, 19 nt, Homo sapiens
gggccuggcuuuacugaga

SEQ ID NO: 802955 - RNA, 19 nt, Homo sapiens
caacaucugugacuuugag

SEQ ID NO: 802956 - RNA, 19 nt, Homo sapiens
ucacgcaacuccugcaaga

SEQ ID NO: 802957 - RNA, 19 nt, Homo sapiens
gcuaccagcuggcuccaaa

SEQ ID NO: 802958 - RNA, 19 nt, Homo sapiens
aagcugaaguaaugccuua

SEQ ID NO: 802959 - RNA, 19 nt, Homo sapiens
ggaaccauuucacagagaa

SEQ ID NO: 802960 - RNA, 19 nt, Homo sapiens
gacaacagcagcacaguga

SEQ ID NO: 802961 - RNA, 19 nt, Homo sapiens
gaggcugggucugcuauaa

SEQ ID NO: 802962 - RNA, 19 nt, Homo sapiens
gcacagagggagaugauag

SEQ ID NO: 802963 - RNA, 19 nt, Homo sapiens
cagaauagcacaguuaaga

SEQ ID NO: 802964 - RNA, 19 nt, Homo sapiens
acaaacaugcucagaagua

SEQ ID NO: 802965 - RNA, 19 nt, Homo sapiens
caaagagccuaagaccaaa

SEQ ID NO: 802966 - RNA, 19 nt, Homo sapiens
agaccaaccuggccaaugu

SEQ ID NO: 802967 - RNA, 19 nt, Homo sapiens
gaucugcucauauucuaaa

SEQ ID NO: 802968 - RNA, 19 nt, Homo sapiens
gcacuuccgcccucuuuga

SEQ ID NO: 802969 - RNA, 19 nt, Homo sapiens
gcugagggcaggagaauug

SEQ ID NO: 802970 - RNA, 19 nt, Homo sapiens
gaaguguggcugagaaugu

SEQ ID NO: 802971 - RNA, 19 nt, Homo sapiens
gagaagcacaugcagaaug

SEQ ID NO: 802972 - RNA, 19 nt, Homo sapiens
gggaaagacacaccaagaa

SEQ ID NO: 802973 - RNA, 19 nt, Homo sapiens
gauaggauagguaagagaa

SEQ ID NO: 802974 - RNA, 19 nt, Homo sapiens
uaaaggaauugugcugaga

SEQ ID NO: 802975 - RNA, 19 nt, Homo sapiens
ugagaaagaugcccagaac

SEQ ID NO: 802976 - RNA, 19 nt, Homo sapiens
gcauccauaugaccucuga

SEQ ID NO: 802977 - RNA, 19 nt, Homo sapiens
gcagaaguccaggcccuua

SEQ ID NO: 802978 - RNA, 19 nt, Homo sapiens
uauaaugccuuccuaucug

SEQ ID NO: 802979 - RNA, 19 nt, Homo sapiens
aaagaggaaucaacacauc

SEQ ID NO: 802980 - RNA, 19 nt, Homo sapiens
ccucacagcucuccaaacu

SEQ ID NO: 802981 - RNA, 19 nt, Homo sapiens
caaagaaucgccaguagca

SEQ ID NO: 802982 - RNA, 19 nt, Homo sapiens
caaacuggacuacaauaug

SEQ ID NO: 802983 - RNA, 19 nt, Homo sapiens
ggaauugugcugagaguag

SEQ ID NO: 802984 - RNA, 19 nt, Homo sapiens
ucuaaaggcagacguaauu

SEQ ID NO: 802985 - RNA, 19 nt, Homo sapiens
gaccugaccauccuacuga

SEQ ID NO: 802986 - RNA, 19 nt, Homo sapiens
ucuccuaccugcugauuga

SEQ ID NO: 802987 - RNA, 19 nt, Homo sapiens
ggcccuaccaguucuaaua

SEQ ID NO: 802988 - RNA, 19 nt, Homo sapiens
ccucaagacugacaaacau

SEQ ID NO: 802989 - RNA, 19 nt, Homo sapiens
gcaggaggaggaagaagaa

SEQ ID NO: 802990 - RNA, 19 nt, Homo sapiens
gcugugacgucugcaacua

SEQ ID NO: 802991 - RNA, 19 nt, Homo sapiens
gcagugaacuccuguuacc

SEQ ID NO: 802992 - RNA, 19 nt, Homo sapiens
aaagaaggagugcaaggua

SEQ ID NO: 802993 - RNA, 19 nt, Homo sapiens
cagcaaagacugggaaaga

SEQ ID NO: 802994 - RNA, 19 nt, Homo sapiens
caaugucugugcucaagga

SEQ ID NO: 802995 - RNA, 19 nt, Homo sapiens
gcaggagaauugcuugaac

SEQ ID NO: 802996 - RNA, 19 nt, Homo sapiens
acugcaagcugaaguaaug

SEQ ID NO: 802997 - RNA, 19 nt, Homo sapiens
uagcucuucugaccaaauu

SEQ ID NO: 802998 - RNA, 19 nt, Homo sapiens
gagccgagaucacgucacu

SEQ ID NO: 802999 - RNA, 19 nt, Homo sapiens
gaaagacacaccaagaaaa

SEQ ID NO: 803000 - RNA, 19 nt, Homo sapiens
gcaaagacugggaaagaca

SEQ ID NO: 803001 - RNA, 19 nt, Homo sapiens
gguaagagaagaaaacuaa

SEQ ID NO: 803002 - RNA, 19 nt, Homo sapiens
gacaggauaggauagguaa

SEQ ID NO: 803003 - RNA, 19 nt, Homo sapiens
gcaccaaccaaaugauuca

SEQ ID NO: 803004 - RNA, 19 nt, Homo sapiens
agaaagaugcccagaacaa

SEQ ID NO: 803005 - RNA, 19 nt, Homo sapiens
gccaaagaaucgccaguag

SEQ ID NO: 803006 - RNA, 19 nt, Homo sapiens
gaaagaugcccagaacaag

SEQ ID NO: 803007 - RNA, 19 nt, Homo sapiens
gcagcacagugaacaugga

SEQ ID NO: 803008 - RNA, 19 nt, Homo sapiens
gcucuuuaucccuuaguua

SEQ ID NO: 803009 - RNA, 19 nt, Homo sapiens
gcucaaggccaacuuccaa

SEQ ID NO: 803010 - RNA, 19 nt, Homo sapiens
caagagaagcacccugaga

SEQ ID NO: 803011 - RNA, 19 nt, Homo sapiens
ccuccuggaugaagaaguu

SEQ ID NO: 803012 - RNA, 19 nt, Homo sapiens
gugaacuccuguuaccaaa

SEQ ID NO: 803013 - RNA, 19 nt, Homo sapiens
cagggugaaucaauggaaa

SEQ ID NO: 803014 - RNA, 19 nt, Homo sapiens
gcuaggugcguuaagauga

SEQ ID NO: 803015 - RNA, 19 nt, Homo sapiens
ccaacucccuacccuggaa

SEQ ID NO: 803016 - RNA, 19 nt, Homo sapiens
agaaacuggacucuuaaua

SEQ ID NO: 803017 - RNA, 19 nt, Homo sapiens
ggacagaaacuggacucuu

SEQ ID NO: 803018 - RNA, 19 nt, Homo sapiens
gaagaaaacagccaaaucu

SEQ ID NO: 803019 - RNA, 19 nt, Homo sapiens
cgccgugaauuuauuuauu

SEQ ID NO: 803020 - RNA, 19 nt, Homo sapiens
gcucuaccacugcagcaua

SEQ ID NO: 803021 - RNA, 19 nt, Homo sapiens
gaacucuuccaguacuuug

SEQ ID NO: 803022 - RNA, 19 nt, Homo sapiens
uaagcuuucuggagccaaa

SEQ ID NO: 803023 - RNA, 19 nt, Homo sapiens
uaggauagguaagagaaga

SEQ ID NO: 803024 - RNA, 19 nt, Homo sapiens
caaaguagcugaacuaaau

SEQ ID NO: 803025 - RNA, 19 nt, Homo sapiens
gaugaaaccuaucagaaua

SEQ ID NO: 803026 - RNA, 19 nt, Homo sapiens
gaacuagacucaauauuag

SEQ ID NO: 803027 - RNA, 19 nt, Homo sapiens
aaacaaaggugguuacauu

SEQ ID NO: 803028 - RNA, 19 nt, Homo sapiens
gagaagggcucacuuguau

SEQ ID NO: 803029 - RNA, 19 nt, Homo sapiens
gcacagaacuagacucaau

SEQ ID NO: 803030 - RNA, 19 nt, Homo sapiens
gaauugggcuucuagugua

SEQ ID NO: 803031 - RNA, 19 nt, Homo sapiens
uuaaugagcugcagaguaa

SEQ ID NO: 803032 - RNA, 19 nt, Homo sapiens
caacaugacucucccagaa

SEQ ID NO: 803033 - RNA, 19 nt, Homo sapiens
gaacaaggagaagaaauua

SEQ ID NO: 803034 - RNA, 19 nt, Homo sapiens
gagaaaggcuugacaucuu

SEQ ID NO: 803035 - RNA, 19 nt, Homo sapiens
caccagagaugaaacauuu

SEQ ID NO: 803036 - RNA, 19 nt, Homo sapiens
ggaacaggcucaugcuaaa

SEQ ID NO: 803037 - RNA, 19 nt, Homo sapiens
ccaaagaucagauugcuua

SEQ ID NO: 803038 - RNA, 19 nt, Homo sapiens
gcaaacacaccaaguagua

SEQ ID NO: 803039 - RNA, 19 nt, Homo sapiens
uaacauggguguauugaau

SEQ ID NO: 803040 - RNA, 19 nt, Homo sapiens
cgaaauagacguucuuaaa

SEQ ID NO: 803041 - RNA, 19 nt, Homo sapiens
aaacagcuguccacaagua

SEQ ID NO: 803042 - RNA, 19 nt, Homo sapiens
gagcgaauguuuaaggaaa

SEQ ID NO: 803043 - RNA, 19 nt, Homo sapiens
caaagagaauuccaaauca

SEQ ID NO: 803044 - RNA, 19 nt, Homo sapiens
ccacauacuuucacugauu

SEQ ID NO: 803045 - RNA, 19 nt, Homo sapiens
gaaaggucauccucaagaa

SEQ ID NO: 803046 - RNA, 19 nt, Homo sapiens
gaacauacuccgccacauu

SEQ ID NO: 803047 - RNA, 19 nt, Homo sapiens
gagaaugaaucgaaacaug

SEQ ID NO: 803048 - RNA, 19 nt, Homo sapiens
ugaaguaacugccacagaa

SEQ ID NO: 803049 - RNA, 19 nt, Homo sapiens
gaagaugaacccaaauauu

SEQ ID NO: 803050 - RNA, 19 nt, Homo sapiens
agaaugaacugaagaugaa

SEQ ID NO: 803051 - RNA, 19 nt, Homo sapiens
guaaacagguaccauacaa

SEQ ID NO: 803052 - RNA, 19 nt, Homo sapiens
gaaccucucucuuaaguac

SEQ ID NO: 803053 - RNA, 19 nt, Homo sapiens
gaacaggaacuucaacaga

SEQ ID NO: 803054 - RNA, 19 nt, Homo sapiens
gaaacugauuccuguauuc

SEQ ID NO: 803055 - RNA, 19 nt, Homo sapiens
gaagaggagucugcugaaa

SEQ ID NO: 803056 - RNA, 19 nt, Homo sapiens
aggcagagcuuucagauga

SEQ ID NO: 803057 - RNA, 19 nt, Homo sapiens
ucuguuaucuccaucuuua

SEQ ID NO: 803058 - RNA, 19 nt, Homo sapiens
cagaagaacauguugauaa

SEQ ID NO: 803059 - RNA, 19 nt, Homo sapiens
aaacaucucuacuauggaa

SEQ ID NO: 803060 - RNA, 19 nt, Homo sapiens
gaaaugagacaugcacaaa

SEQ ID NO: 803061 - RNA, 19 nt, Homo sapiens
gaagauggaugggauugug

SEQ ID NO: 803062 - RNA, 19 nt, Homo sapiens
ugaaugcaccagaguauua

SEQ ID NO: 803063 - RNA, 19 nt, Homo sapiens
uagcugaacuaaaucguaa

SEQ ID NO: 803064 - RNA, 19 nt, Homo sapiens
gaaaacagcuguccacaag

SEQ ID NO: 803065 - RNA, 19 nt, Homo sapiens
gaucuggagcgacaaguua

SEQ ID NO: 803066 - RNA, 19 nt, Homo sapiens
ucaaggauaucaacaggaa

SEQ ID NO: 803067 - RNA, 19 nt, Homo sapiens
ugaauuagacgucaagaaa

SEQ ID NO: 803068 - RNA, 19 nt, Homo sapiens
gggcaaagaugaagaugca

SEQ ID NO: 803069 - RNA, 19 nt, Homo sapiens
uuacagaucucaacuuagu

SEQ ID NO: 803070 - RNA, 19 nt, Homo sapiens
caacagauaauacagcaaa

SEQ ID NO: 803071 - RNA, 19 nt, Homo sapiens
gaaaucagucgucugcaaa

SEQ ID NO: 803072 - RNA, 19 nt, Homo sapiens
ggauaaaccagcucacaaa

SEQ ID NO: 803073 - RNA, 19 nt, Homo sapiens
ccucauuccucaaagauuu

SEQ ID NO: 803074 - RNA, 19 nt, Homo sapiens
gcacucaaguaaaggaaau

SEQ ID NO: 803075 - RNA, 19 nt, Homo sapiens
gaaauggaagggauucuga

SEQ ID NO: 803076 - RNA, 19 nt, Homo sapiens
ucauauagcccauucauug

SEQ ID NO: 803077 - RNA, 19 nt, Homo sapiens
gagcuagaaggauuaauuu

SEQ ID NO: 803078 - RNA, 19 nt, Homo sapiens
aaacuggcaugcuugcuaa

SEQ ID NO: 803079 - RNA, 19 nt, Homo sapiens
ugacaucuuccauugauua

SEQ ID NO: 803080 - RNA, 19 nt, Homo sapiens
aauagcaacucaagaggua

SEQ ID NO: 803081 - RNA, 19 nt, Homo sapiens
gaaauagacguucuuaaac

SEQ ID NO: 803082 - RNA, 19 nt, Homo sapiens
caucaagcuuauugucaua

SEQ ID NO: 803083 - RNA, 19 nt, Homo sapiens
agaacuaacugaugacgaa

SEQ ID NO: 803084 - RNA, 19 nt, Homo sapiens
caucuuccauugauuauuc

SEQ ID NO: 803085 - RNA, 19 nt, Homo sapiens
agaugaagaugcaaagaaa

SEQ ID NO: 803086 - RNA, 19 nt, Homo sapiens
ugagguagcuuccuuaaaa

SEQ ID NO: 803087 - RNA, 19 nt, Homo sapiens
acaaguaacugaaguaacu

SEQ ID NO: 803088 - RNA, 19 nt, Homo sapiens
gaaaguggccgaaagaaaa

SEQ ID NO: 803089 - RNA, 19 nt, Homo sapiens
ccaaagagaauuccaaauc

SEQ ID NO: 803090 - RNA, 19 nt, Homo sapiens
acaggaacuucaacagaua

SEQ ID NO: 803091 - RNA, 19 nt, Homo sapiens
ugagaagggucaaggaaga

SEQ ID NO: 803092 - RNA, 19 nt, Homo sapiens
gaauuaaagcccuagagaa

SEQ ID NO: 803093 - RNA, 19 nt, Homo sapiens
gaagaaacacauaaacaag

SEQ ID NO: 803094 - RNA, 19 nt, Homo sapiens
guaacacaguggaagauau

SEQ ID NO: 803095 - RNA, 19 nt, Homo sapiens
gaaaugacugagaaugaaa

SEQ ID NO: 803096 - RNA, 19 nt, Homo sapiens
gagaugaagaagaaagaua

SEQ ID NO: 803097 - RNA, 19 nt, Homo sapiens
ccaugaauuugcuauugua

SEQ ID NO: 803098 - RNA, 19 nt, Homo sapiens
ggaauugggcuucuagugu

SEQ ID NO: 803099 - RNA, 19 nt, Homo sapiens
uggagaggcuucagaaaga

SEQ ID NO: 803100 - RNA, 19 nt, Homo sapiens
gcaaagaugaagaugcaaa

SEQ ID NO: 803101 - RNA, 19 nt, Homo sapiens
guggauaacugaagaugau

SEQ ID NO: 803102 - RNA, 19 nt, Homo sapiens
ggagaaaaguugaagcaaa

SEQ ID NO: 803103 - RNA, 19 nt, Homo sapiens
gcaccagaguauuaauaga

SEQ ID NO: 803104 - RNA, 19 nt, Homo sapiens
gaaauagagaaacuccuuu

SEQ ID NO: 803105 - RNA, 19 nt, Homo sapiens
cagaaagacagaagaauga

SEQ ID NO: 803106 - RNA, 19 nt, Homo sapiens
caaggaagcccaucagauc

SEQ ID NO: 803107 - RNA, 19 nt, Homo sapiens
aagagaagauaucccaauu

SEQ ID NO: 803108 - RNA, 19 nt, Homo sapiens
gaagagaagauaucccaau

SEQ ID NO: 803109 - RNA, 19 nt, Homo sapiens
uaaaagaucuccaagaaca

SEQ ID NO: 803110 - RNA, 19 nt, Homo sapiens
agacacuucuucaaggaua

SEQ ID NO: 803111 - RNA, 19 nt, Homo sapiens
uggaagaacuaaagaaaca

SEQ ID NO: 803112 - RNA, 19 nt, Homo sapiens
gcagagcuuucagaugauu

SEQ ID NO: 803113 - RNA, 19 nt, Homo sapiens
acuuacagaucucaacuua

SEQ ID NO: 803114 - RNA, 19 nt, Homo sapiens
agaaaugacugagaaugaa

SEQ ID NO: 803115 - RNA, 19 nt, Homo sapiens
gcaaacaaccaaagcaaca

SEQ ID NO: 803116 - RNA, 19 nt, Homo sapiens
aaugagacaugcacaaaga

SEQ ID NO: 803117 - RNA, 19 nt, Homo sapiens
uaagacauuuccaaaguca

SEQ ID NO: 803118 - RNA, 19 nt, Homo sapiens
gauguuaucuacugaacuc

SEQ ID NO: 803119 - RNA, 19 nt, Homo sapiens
gcagagaagggcucacuug

SEQ ID NO: 803120 - RNA, 19 nt, Homo sapiens
gaacuucaacagauaauac

SEQ ID NO: 803121 - RNA, 19 nt, Homo sapiens
caaaugaggaaauugagaa

SEQ ID NO: 803122 - RNA, 19 nt, Homo sapiens
ucagauugcuuaugucaca

SEQ ID NO: 803123 - RNA, 19 nt, Homo sapiens
uguaauggguaaacaggua

SEQ ID NO: 803124 - RNA, 19 nt, Homo sapiens
ggucaagccuguaguauua

SEQ ID NO: 803125 - RNA, 19 nt, Homo sapiens
ggaauuguguugauguuua

SEQ ID NO: 803126 - RNA, 19 nt, Homo sapiens
gcaaauaccaccauccuua

SEQ ID NO: 803127 - RNA, 19 nt, Homo sapiens
gaagacaaauugguuauga

SEQ ID NO: 803128 - RNA, 19 nt, Homo sapiens
cacaguauaucaagcauua

SEQ ID NO: 803129 - RNA, 19 nt, Homo sapiens
cagaagggcuaguguauug

SEQ ID NO: 803130 - RNA, 19 nt, Homo sapiens
gauaguggcugagaaauuc

SEQ ID NO: 803131 - RNA, 19 nt, Homo sapiens
gaacagaagggcuagugua

SEQ ID NO: 803132 - RNA, 19 nt, Homo sapiens
gagaagcacaugaacguua

SEQ ID NO: 803133 - RNA, 19 nt, Homo sapiens
guuaauuccuugcauauga

SEQ ID NO: 803134 - RNA, 19 nt, Homo sapiens
cuaaugagcucugugguaa

SEQ ID NO: 803135 - RNA, 19 nt, Homo sapiens
gagagaagcccuuuagaug

SEQ ID NO: 803136 - RNA, 19 nt, Homo sapiens
cagaagaacagccauauuu

SEQ ID NO: 803137 - RNA, 19 nt, Homo sapiens
gaugagguaugcuugcuuu

SEQ ID NO: 803138 - RNA, 19 nt, Homo sapiens
cagagggacugucaucuaa

SEQ ID NO: 803139 - RNA, 19 nt, Homo sapiens
gaaaauaucugcuauacag

SEQ ID NO: 803140 - RNA, 19 nt, Homo sapiens
gugcuuaguuaauugguua

SEQ ID NO: 803141 - RNA, 19 nt, Homo sapiens
gaguugagcuggccauguu

SEQ ID NO: 803142 - RNA, 19 nt, Homo sapiens
cagcuacgcucccacauga

SEQ ID NO: 803143 - RNA, 19 nt, Homo sapiens
gcaugcagauuugugauaa

SEQ ID NO: 803144 - RNA, 19 nt, Homo sapiens
caagagaggcucccuaaug

SEQ ID NO: 803145 - RNA, 19 nt, Homo sapiens
gaacugugacgaaagguuu

SEQ ID NO: 803146 - RNA, 19 nt, Homo sapiens
ccaagggaaugaacaagaa

SEQ ID NO: 803147 - RNA, 19 nt, Homo sapiens
gcaaaccgcaucuccauga

SEQ ID NO: 803148 - RNA, 19 nt, Homo sapiens
uguaauaccagcauucuua

SEQ ID NO: 803149 - RNA, 19 nt, Homo sapiens
cgggaaggcugugagauua

SEQ ID NO: 803150 - RNA, 19 nt, Homo sapiens
aaagugagcugucccuuca

SEQ ID NO: 803151 - RNA, 19 nt, Homo sapiens
ggagaauucugaugacaca

SEQ ID NO: 803152 - RNA, 19 nt, Homo sapiens
ggaaugaacaagaagacua

SEQ ID NO: 803153 - RNA, 19 nt, Homo sapiens
guagagaaagucagcguua

SEQ ID NO: 803154 - RNA, 19 nt, Homo sapiens
gaagaacagccauauuuca

SEQ ID NO: 803155 - RNA, 19 nt, Homo sapiens
uguauagacuucuuuggua

SEQ ID NO: 803156 - RNA, 19 nt, Homo sapiens
ggauaggccugguuuccuu

SEQ ID NO: 803157 - RNA, 19 nt, Homo sapiens
ggaacaauuuagaaacuuc

SEQ ID NO: 803158 - RNA, 19 nt, Homo sapiens
guucagcacagcaucauua

SEQ ID NO: 803159 - RNA, 19 nt, Homo sapiens
gagaagcccuauccaugug

SEQ ID NO: 803160 - RNA, 19 nt, Homo sapiens
ccgaguagcuggaauuaca

SEQ ID NO: 803161 - RNA, 19 nt, Homo sapiens
ggcauuccaugacaaguuu

SEQ ID NO: 803162 - RNA, 19 nt, Homo sapiens
gaaaguuaauuccuugcau

SEQ ID NO: 803163 - RNA, 19 nt, Homo sapiens
ucacaaccuugagcuauuu

SEQ ID NO: 803164 - RNA, 19 nt, Homo sapiens
ucaaagcuauucuuacauc

SEQ ID NO: 803165 - RNA, 19 nt, Homo sapiens
gcucugcucuugccauaau

SEQ ID NO: 803166 - RNA, 19 nt, Homo sapiens
ggagagaaacccuuuaucu

SEQ ID NO: 803167 - RNA, 19 nt, Homo sapiens
caagaaguuuguccuggaa

SEQ ID NO: 803168 - RNA, 19 nt, Homo sapiens
ccagaaagcuaagugugaa

SEQ ID NO: 803169 - RNA, 19 nt, Homo sapiens
caaauaccaccauccuuaa

SEQ ID NO: 803170 - RNA, 19 nt, Homo sapiens
gggcagcaauucuggauuc

SEQ ID NO: 803171 - RNA, 19 nt, Homo sapiens
caaccaggagcuuauuaua

SEQ ID NO: 803172 - RNA, 19 nt, Homo sapiens
guuagugcauuacaugaaa

SEQ ID NO: 803173 - RNA, 19 nt, Homo sapiens
gggaaccacugaacuaaag

SEQ ID NO: 803174 - RNA, 19 nt, Homo sapiens
ggagagaagcccuuuagau

SEQ ID NO: 803175 - RNA, 19 nt, Homo sapiens
aaacugugcugugcaugua

SEQ ID NO: 803176 - RNA, 19 nt, Homo sapiens
caauugagauuaaguccau

SEQ ID NO: 803177 - RNA, 19 nt, Homo sapiens
uagcugaaccuauguugua

SEQ ID NO: 803178 - RNA, 19 nt, Homo sapiens
uaacauccgucuccuuagu

SEQ ID NO: 803179 - RNA, 19 nt, Homo sapiens
agagugagccuuuaaauca

SEQ ID NO: 803180 - RNA, 19 nt, Homo sapiens
gaaagucagcguuacacaa

SEQ ID NO: 803181 - RNA, 19 nt, Homo sapiens
gaagaauugcacacaguuu

SEQ ID NO: 803182 - RNA, 19 nt, Homo sapiens
cagaugagaagacaaauug

SEQ ID NO: 803183 - RNA, 19 nt, Homo sapiens
aagagaggcucccuaaugu

SEQ ID NO: 803184 - RNA, 19 nt, Homo sapiens
gaacuaaagcccaauuugc

SEQ ID NO: 803185 - RNA, 19 nt, Homo sapiens
ccucaucaguaucauauug

SEQ ID NO: 803186 - RNA, 19 nt, Homo sapiens
ccaccauccuuaacagaaa

SEQ ID NO: 803187 - RNA, 19 nt, Homo sapiens
gauguaaacugugcuuagu

SEQ ID NO: 803188 - RNA, 19 nt, Homo sapiens
ggccauguuucacaguaua

SEQ ID NO: 803189 - RNA, 19 nt, Homo sapiens
ggaaggcugugagauuaau

SEQ ID NO: 803190 - RNA, 19 nt, Homo sapiens
cugcaacacuggaagaauu

SEQ ID NO: 803191 - RNA, 19 nt, Homo sapiens
aaacaugacauugcugaua

SEQ ID NO: 803192 - RNA, 19 nt, Homo sapiens
accuaaagcuugcauguuu

SEQ ID NO: 803193 - RNA, 19 nt, Homo sapiens
caaagcaccaguccagaaa

SEQ ID NO: 803194 - RNA, 19 nt, Homo sapiens
ugacagcaaugacuaugga

SEQ ID NO: 803195 - RNA, 19 nt, Homo sapiens
uaauaaauugggccacuua

SEQ ID NO: 803196 - RNA, 19 nt, Homo sapiens
cagcaauucuggauucuag

SEQ ID NO: 803197 - RNA, 19 nt, Homo sapiens
gauaagaugcucccaaguc

SEQ ID NO: 803198 - RNA, 19 nt, Homo sapiens
gcacuuuucuaacuaauga

SEQ ID NO: 803199 - RNA, 19 nt, Homo sapiens
auucacaggugcaguuaua

SEQ ID NO: 803200 - RNA, 19 nt, Homo sapiens
gaaguaguggagaucauuu

SEQ ID NO: 803201 - RNA, 19 nt, Homo sapiens
cguaaauacuugguaguuu

SEQ ID NO: 803202 - RNA, 19 nt, Homo sapiens
ggugagcauuuccuuaguu

SEQ ID NO: 803203 - RNA, 19 nt, Homo sapiens
ggcaaggauuucaacauga

SEQ ID NO: 803204 - RNA, 19 nt, Homo sapiens
guacaauucuuagugaagu

SEQ ID NO: 803205 - RNA, 19 nt, Homo sapiens
acaguacaauucuuaguga

SEQ ID NO: 803206 - RNA, 19 nt, Homo sapiens
cagcaccucuaguaccuuu

SEQ ID NO: 803207 - RNA, 19 nt, Homo sapiens
ccagacuucuccucaaaga

SEQ ID NO: 803208 - RNA, 19 nt, Homo sapiens
gagagaaacccuuuaucug

SEQ ID NO: 803209 - RNA, 19 nt, Homo sapiens
gcugguaccuggagaagca

SEQ ID NO: 803210 - RNA, 19 nt, Homo sapiens
ggaaguccuuauucugugu

SEQ ID NO: 803211 - RNA, 19 nt, Homo sapiens
ucaugagguuguacuguaa

SEQ ID NO: 803212 - RNA, 19 nt, Homo sapiens
gcagaaaaguauaucaaga

SEQ ID NO: 803213 - RNA, 19 nt, Homo sapiens
ggaaugaggcagaaaagua

SEQ ID NO: 803214 - RNA, 19 nt, Homo sapiens
aaacaucacguucucuauu

SEQ ID NO: 803215 - RNA, 19 nt, Homo sapiens
uuuaugggaugacaaauug

SEQ ID NO: 803216 - RNA, 19 nt, Homo sapiens
ccagggaagucaccuaaag

SEQ ID NO: 803217 - RNA, 19 nt, Homo sapiens
caguguagcugaaccuaug

SEQ ID NO: 803218 - RNA, 19 nt, Homo sapiens
uggcaaggauuucaacaug

SEQ ID NO: 803219 - RNA, 19 nt, Homo sapiens
caagaucguccauggauau

SEQ ID NO: 803220 - RNA, 19 nt, Homo sapiens
ucaagaucguccauggaua

SEQ ID NO: 803221 - RNA, 19 nt, Homo sapiens
cauaggcgcaugcagauuu

SEQ ID NO: 803222 - RNA, 19 nt, Homo sapiens
acacuggaauauucaggua

SEQ ID NO: 803223 - RNA, 19 nt, Homo sapiens
gaucauauuuauccagacu

SEQ ID NO: 803224 - RNA, 19 nt, Homo sapiens
guacagagaugugauauua

SEQ ID NO: 803225 - RNA, 19 nt, Homo sapiens
gaaaugaacuuaucucagu

SEQ ID NO: 803226 - RNA, 19 nt, Homo sapiens
ggaaagaucuucacaugug

SEQ ID NO: 803227 - RNA, 19 nt, Homo sapiens
gacuagaccuguacuaaua

SEQ ID NO: 803228 - RNA, 19 nt, Homo sapiens
gagaaacccuuuaagugua

SEQ ID NO: 803229 - RNA, 19 nt, Homo sapiens
gggaaugccugaacucaua

SEQ ID NO: 803230 - RNA, 19 nt, Homo sapiens
gaagauggacucuagauuu

SEQ ID NO: 803231 - RNA, 19 nt, Homo sapiens
gauaauagcauugugguua

SEQ ID NO: 803232 - RNA, 19 nt, Homo sapiens
caacuuacuuuccaucaaa

SEQ ID NO: 803233 - RNA, 19 nt, Homo sapiens
agagaaaccuuaugaaugu

SEQ ID NO: 803234 - RNA, 19 nt, Homo sapiens
acaagauucugaagacuua

SEQ ID NO: 803235 - RNA, 19 nt, Homo sapiens
agacaacauucacaucuua

SEQ ID NO: 803236 - RNA, 19 nt, Homo sapiens
ucacaucucuuccucugua

SEQ ID NO: 803237 - RNA, 19 nt, Homo sapiens
gaaacuuuguuauguguga

SEQ ID NO: 803238 - RNA, 19 nt, Homo sapiens
gcuaaugaaugcagaaaga

SEQ ID NO: 803239 - RNA, 19 nt, Homo sapiens
gaggaugaauaacaaguuu

SEQ ID NO: 803240 - RNA, 19 nt, Homo sapiens
uuacuuagaucaugaguug

SEQ ID NO: 803241 - RNA, 19 nt, Homo sapiens
ggaauggaagaguaaauua

SEQ ID NO: 803242 - RNA, 19 nt, Homo sapiens
ggucaggccuuucugugua

SEQ ID NO: 803243 - RNA, 19 nt, Homo sapiens
auauguagcucacguauuu

SEQ ID NO: 803244 - RNA, 19 nt, Homo sapiens
guugugaacuuuauaguga

SEQ ID NO: 803245 - RNA, 19 nt, Homo sapiens
gagaaacccuaugaaugua

SEQ ID NO: 803246 - RNA, 19 nt, Homo sapiens
gagaaacccuaugaaugua

SEQ ID NO: 803247 - RNA, 19 nt, Homo sapiens
gggaaccacuucauucuga

SEQ ID NO: 803248 - RNA, 19 nt, Homo sapiens
gaugauauaucuggaaugu

SEQ ID NO: 803249 - RNA, 19 nt, Homo sapiens
gaaguacauucuagaggaa

SEQ ID NO: 803250 - RNA, 19 nt, Homo sapiens
caacuuacccaacaucaaa

SEQ ID NO: 803251 - RNA, 19 nt, Homo sapiens
gagagaaaccuuaugaaug

SEQ ID NO: 803252 - RNA, 19 nt, Homo sapiens
gagaauacauacuggugaa

SEQ ID NO: 803253 - RNA, 19 nt, Homo sapiens
gauaauguauucaggaagu

SEQ ID NO: 803254 - RNA, 19 nt, Homo sapiens
ugccaaagcucuacacauu

SEQ ID NO: 803255 - RNA, 19 nt, Homo sapiens
gaaacccuaugaauguaaa

SEQ ID NO: 803256 - RNA, 19 nt, Homo sapiens
gaaacccuaugaauguaaa

SEQ ID NO: 803257 - RNA, 19 nt, Homo sapiens
caucagagaauucauauug

SEQ ID NO: 803258 - RNA, 19 nt, Homo sapiens
gcgcuggcauaaacaauaa

SEQ ID NO: 803259 - RNA, 19 nt, Homo sapiens
guugagcacuugaaauuga

SEQ ID NO: 803260 - RNA, 19 nt, Homo sapiens
guacaucagagaauucaua

SEQ ID NO: 803261 - RNA, 19 nt, Homo sapiens
ugaaguacaugaaccuuga

SEQ ID NO: 803262 - RNA, 19 nt, Homo sapiens
gaugguaaccuaagucuug

SEQ ID NO: 803263 - RNA, 19 nt, Homo sapiens
gacaaacucuaugaaugua

SEQ ID NO: 803264 - RNA, 19 nt, Homo sapiens
gagccgagaucacgccauu

SEQ ID NO: 803265 - RNA, 19 nt, Homo sapiens
caagaggaaucaccugguu

SEQ ID NO: 803266 - RNA, 19 nt, Homo sapiens
agacugcuuucacaacuua

SEQ ID NO: 803267 - RNA, 19 nt, Homo sapiens
ggagagaaaccuuaugaau

SEQ ID NO: 803268 - RNA, 19 nt, Homo sapiens
guggaaagaucuucacaug

SEQ ID NO: 803269 - RNA, 19 nt, Homo sapiens
gcucucacuucauauguuu

SEQ ID NO: 803270 - RNA, 19 nt, Homo sapiens
gugagaagccuuaugauug

SEQ ID NO: 803271 - RNA, 19 nt, Homo sapiens
gagagaaacccuacgaaug

SEQ ID NO: 803272 - RNA, 19 nt, Homo sapiens
ugagaagccuuaugauugu

SEQ ID NO: 803273 - RNA, 19 nt, Homo sapiens
caacuuaaucuccaucaaa

SEQ ID NO: 803274 - RNA, 19 nt, Homo sapiens
gaacaagaaaguccucaug

SEQ ID NO: 803275 - RNA, 19 nt, Homo sapiens
acagagaugugauauuaga

SEQ ID NO: 803276 - RNA, 19 nt, Homo sapiens
ggaagguaauggaaagaau

SEQ ID NO: 803277 - RNA, 19 nt, Homo sapiens
gaacucauaucagaggaau

SEQ ID NO: 803278 - RNA, 19 nt, Homo sapiens
agauguggcuguagacuuu

SEQ ID NO: 803279 - RNA, 19 nt, Homo sapiens
agaaggcgcuugagaagga

SEQ ID NO: 803280 - RNA, 19 nt, Homo sapiens
gaaaggaaagucauuuagu

SEQ ID NO: 803281 - RNA, 19 nt, Homo sapiens
gaaaagcccuaugaaugua

SEQ ID NO: 803282 - RNA, 19 nt, Homo sapiens
gagaagugcuaugagugua

SEQ ID NO: 803283 - RNA, 19 nt, Homo sapiens
ugagaaacccuaugaaugu

SEQ ID NO: 803284 - RNA, 19 nt, Homo sapiens
ugagaaacccuaugaaugu

SEQ ID NO: 803285 - RNA, 19 nt, Homo sapiens
gaagguaauggaaagaauu

SEQ ID NO: 803286 - RNA, 19 nt, Homo sapiens
gcaggauguucuauuucua

SEQ ID NO: 803287 - RNA, 19 nt, Homo sapiens
uauuagaacucuuccuuug

SEQ ID NO: 803288 - RNA, 19 nt, Homo sapiens
caacaucagagaauucauu

SEQ ID NO: 803289 - RNA, 19 nt, Homo sapiens
caacaucagaguauucauu

SEQ ID NO: 803290 - RNA, 19 nt, Homo sapiens
cgacaucagagaauucaua

SEQ ID NO: 803291 - RNA, 19 nt, Homo sapiens
guucagagauguggcugua

SEQ ID NO: 803292 - RNA, 19 nt, Homo sapiens
ucacguauuucuauuguca

SEQ ID NO: 803293 - RNA, 19 nt, Homo sapiens
cauugggauuggaauauua

SEQ ID NO: 803294 - RNA, 19 nt, Homo sapiens
gaucaugaguugaacaaac

SEQ ID NO: 803295 - RNA, 19 nt, Homo sapiens
ggaauguggucaggccuuu

SEQ ID NO: 803296 - RNA, 19 nt, Homo sapiens
gagaagccguaugaaugua

SEQ ID NO: 803297 - RNA, 19 nt, Homo sapiens
gagaugugauauuagagaa

SEQ ID NO: 803298 - RNA, 19 nt, Homo sapiens
ucagucaaaugcaaugaaa

SEQ ID NO: 803299 - RNA, 19 nt, Homo sapiens
gaagccguaugaauguaaa

SEQ ID NO: 803300 - RNA, 19 nt, Homo sapiens
gaauucauauuggugagaa

SEQ ID NO: 803301 - RNA, 19 nt, Homo sapiens
ugaccucucuaucucuaua

SEQ ID NO: 803302 - RNA, 19 nt, Homo sapiens
gcaaaaugaugguaaccua

SEQ ID NO: 803303 - RNA, 19 nt, Homo sapiens
cuaaugugcuacaguaaga

SEQ ID NO: 803304 - RNA, 19 nt, Homo sapiens
aagauggacucuagauuug

SEQ ID NO: 803305 - RNA, 19 nt, Homo sapiens
ggacuagaccuguacuaau

SEQ ID NO: 803306 - RNA, 19 nt, Homo sapiens
gaaaccucaucuccgcuaa

SEQ ID NO: 803307 - RNA, 19 nt, Homo sapiens
aaaggaaagucauuuaguc

SEQ ID NO: 803308 - RNA, 19 nt, Homo sapiens
agaaacccuuuaaguguaa

SEQ ID NO: 803309 - RNA, 19 nt, Homo sapiens
gagaaaccuuaugaaugua

SEQ ID NO: 803310 - RNA, 19 nt, Homo sapiens
acucagaacuuauuucaca

SEQ ID NO: 803311 - RNA, 19 nt, Homo sapiens
ugagaaaccauacaaaugu

SEQ ID NO: 803312 - RNA, 19 nt, Homo sapiens
ugagaaacccuuuaagugu

SEQ ID NO: 803313 - RNA, 19 nt, Homo sapiens
ucucacagcuuacucaaca

SEQ ID NO: 803314 - RNA, 19 nt, Homo sapiens
gacaacaacuuacuuucca

SEQ ID NO: 803315 - RNA, 19 nt, Homo sapiens
gaaagagcccuggaugguu

SEQ ID NO: 803316 - RNA, 19 nt, Homo sapiens
gcucacguauuucuauugu

SEQ ID NO: 803317 - RNA, 19 nt, Homo sapiens
gagcaaaacucuaucucaa

SEQ ID NO: 803318 - RNA, 19 nt, Homo sapiens
uaaccuaagucuuggauac

SEQ ID NO: 803319 - RNA, 19 nt, Homo sapiens
gagaauggaauauugacaa

SEQ ID NO: 803320 - RNA, 19 nt, Homo sapiens
ggaaauucauccuagaaaa

SEQ ID NO: 803321 - RNA, 19 nt, Homo sapiens
gagcauaggaaguacauuc

SEQ ID NO: 803322 - RNA, 19 nt, Homo sapiens
ggugagaagccuuaugauu

SEQ ID NO: 803323 - RNA, 19 nt, Homo sapiens
gcugagaagugcuaugagu

SEQ ID NO: 803324 - RNA, 19 nt, Homo sapiens
gaaguuggcucaagaauuu

SEQ ID NO: 803325 - RNA, 19 nt, Homo sapiens
ggagaaauguguuguguug

SEQ ID NO: 803326 - RNA, 19 nt, Homo sapiens
gaaaugucguugcuuagua

SEQ ID NO: 803327 - RNA, 19 nt, Homo sapiens
aaacagagauacugcauuu

SEQ ID NO: 803328 - RNA, 19 nt, Homo sapiens
ggaagaaguugaaagauuc

SEQ ID NO: 803329 - RNA, 19 nt, Homo sapiens
guaagucacuacuggaaua

SEQ ID NO: 803330 - RNA, 19 nt, Homo sapiens
gcucuaauauuacacagua

SEQ ID NO: 803331 - RNA, 19 nt, Homo sapiens
caaccuggcuacuucauuu

SEQ ID NO: 803332 - RNA, 19 nt, Homo sapiens
guaauuacauggaagcaaa

SEQ ID NO: 803333 - RNA, 19 nt, Homo sapiens
guauaaagauguucacaga

SEQ ID NO: 803334 - RNA, 19 nt, Homo sapiens
ccacuuaguucucaauuga

SEQ ID NO: 803335 - RNA, 19 nt, Homo sapiens
gucaaagacuuguuacaua

SEQ ID NO: 803336 - RNA, 19 nt, Homo sapiens
gcaugaaucuugugcucua

SEQ ID NO: 803337 - RNA, 19 nt, Homo sapiens
caacguuaaugacaaguuu

SEQ ID NO: 803338 - RNA, 19 nt, Homo sapiens
ggacgucaguggcuuaaau

SEQ ID NO: 803339 - RNA, 19 nt, Homo sapiens
gcugaagcgucacauuaua

SEQ ID NO: 803340 - RNA, 19 nt, Homo sapiens
gaggaguguuggaguauuu

SEQ ID NO: 803341 - RNA, 19 nt, Homo sapiens
ggacauauuugacagugau

SEQ ID NO: 803342 - RNA, 19 nt, Homo sapiens
uaccaacacugccaaagua

SEQ ID NO: 803343 - RNA, 19 nt, Homo sapiens
gaagauaucaggaagaagu

SEQ ID NO: 803344 - RNA, 19 nt, Homo sapiens
agagggagcuguguuagua

SEQ ID NO: 803345 - RNA, 19 nt, Homo sapiens
gaggacagacugauaguuu

SEQ ID NO: 803346 - RNA, 19 nt, Homo sapiens
ccggaaaugucguugcuua

SEQ ID NO: 803347 - RNA, 19 nt, Homo sapiens
gggaagaauuggaagaaga

SEQ ID NO: 803348 - RNA, 19 nt, Homo sapiens
guacacuucucgaaaucua

SEQ ID NO: 803349 - RNA, 19 nt, Homo sapiens
ucacaaaccuagacaugga

SEQ ID NO: 803350 - RNA, 19 nt, Homo sapiens
gaagagaacauagugaaga

SEQ ID NO: 803351 - RNA, 19 nt, Homo sapiens
cagcauaaccauuuguaua

SEQ ID NO: 803352 - RNA, 19 nt, Homo sapiens
cgagaaaguuaaaugcauu

SEQ ID NO: 803353 - RNA, 19 nt, Homo sapiens
ucaaagacuuguuacauag

SEQ ID NO: 803354 - RNA, 19 nt, Homo sapiens
gauaaagaguagcaugaau

SEQ ID NO: 803355 - RNA, 19 nt, Homo sapiens
ugggaaauauccuauguuu

SEQ ID NO: 803356 - RNA, 19 nt, Homo sapiens
cacaguaaguucaaagaaa

SEQ ID NO: 803357 - RNA, 19 nt, Homo sapiens
gcaaagaguguccugauuc

SEQ ID NO: 803358 - RNA, 19 nt, Homo sapiens
gauguugucuucgaaauuc

SEQ ID NO: 803359 - RNA, 19 nt, Homo sapiens
gauagaggacagacugaua

SEQ ID NO: 803360 - RNA, 19 nt, Homo sapiens
gaaaggauguaagucaaag

SEQ ID NO: 803361 - RNA, 19 nt, Homo sapiens
gcacagggcccacacuuag

SEQ ID NO: 803362 - RNA, 19 nt, Homo sapiens
gcagggaacuggcauccau

SEQ ID NO: 803363 - RNA, 19 nt, Homo sapiens
ugugagcuguucaucauua

SEQ ID NO: 803364 - RNA, 19 nt, Homo sapiens
ccucuucuguucuuguuua

SEQ ID NO: 803365 - RNA, 19 nt, Homo sapiens
auaaagauguucacagaga

SEQ ID NO: 803366 - RNA, 19 nt, Homo sapiens
ugaaucuugugcucuaaua

SEQ ID NO: 803367 - RNA, 19 nt, Homo sapiens
uucaaggacugcaagauua

SEQ ID NO: 803368 - RNA, 19 nt, Homo sapiens
guucaaggcucugcuauag

SEQ ID NO: 803369 - RNA, 19 nt, Homo sapiens
ggaaagauuaauugccuaa

SEQ ID NO: 803370 - RNA, 19 nt, Homo sapiens
gugaucaaauacaacguua

SEQ ID NO: 803371 - RNA, 19 nt, Homo sapiens
aggaagaaguugaaagauu

SEQ ID NO: 803372 - RNA, 19 nt, Homo sapiens
ccuuaaagauguccuguug

SEQ ID NO: 803373 - RNA, 19 nt, Homo sapiens
caaauguaaucgagaaagu

SEQ ID NO: 803374 - RNA, 19 nt, Homo sapiens
caacuccuuucauggaauu

SEQ ID NO: 803375 - RNA, 19 nt, Homo sapiens
gaagggauccaacuugcaa

SEQ ID NO: 803376 - RNA, 19 nt, Homo sapiens
cauaucacauguauagaga

SEQ ID NO: 803377 - RNA, 19 nt, Homo sapiens
caaacaccuuucucucuga

SEQ ID NO: 803378 - RNA, 19 nt, Homo sapiens
aaaugucguugcuuaguaa

SEQ ID NO: 803379 - RNA, 19 nt, Homo sapiens
uaaagauguucacagagaa

SEQ ID NO: 803380 - RNA, 19 nt, Homo sapiens
cuaaccagccuaacuuuaa

SEQ ID NO: 803381 - RNA, 19 nt, Homo sapiens
aagauguccuguugcuuua

SEQ ID NO: 803382 - RNA, 19 nt, Homo sapiens
gaagagucccacugacauu

SEQ ID NO: 803383 - RNA, 19 nt, Homo sapiens
gagcaacuccuuucaugga

SEQ ID NO: 803384 - RNA, 19 nt, Homo sapiens
uaaaucagaagacaaguga

SEQ ID NO: 803385 - RNA, 19 nt, Homo sapiens
cgucgaauauguacuugaa

SEQ ID NO: 803386 - RNA, 19 nt, Homo sapiens
ccaugaaccuugauauagu

SEQ ID NO: 803387 - RNA, 19 nt, Homo sapiens
ggaauuagaccaccucaac

SEQ ID NO: 803388 - RNA, 19 nt, Homo sapiens
agaauuugcuaccgaaguu

SEQ ID NO: 803389 - RNA, 19 nt, Homo sapiens
acagauggccgucgaauau

SEQ ID NO: 803390 - RNA, 19 nt, Homo sapiens
uaccucaucuucagucaaa

SEQ ID NO: 803391 - RNA, 19 nt, Homo sapiens
aagaagauaucaggaagaa

SEQ ID NO: 803392 - RNA, 19 nt, Homo sapiens
uaaauaacuugcuguucug

SEQ ID NO: 803393 - RNA, 19 nt, Homo sapiens
uaaccagccuaacuuuaau

SEQ ID NO: 803394 - RNA, 19 nt, Homo sapiens
uauauucacucccggaaau

SEQ ID NO: 803395 - RNA, 19 nt, Homo sapiens
caugaaccuugauauaguu

SEQ ID NO: 803396 - RNA, 19 nt, Homo sapiens
ccacagccuugaugacuuc

SEQ ID NO: 803397 - RNA, 19 nt, Homo sapiens
aaugaagaguuaccuugua

SEQ ID NO: 803398 - RNA, 19 nt, Homo sapiens
ggugggaaauauccuaugu

SEQ ID NO: 803399 - RNA, 19 nt, Homo sapiens
gaagaacgcaguuuuguug

SEQ ID NO: 803400 - RNA, 19 nt, Homo sapiens
gauuugagaucauguccau

SEQ ID NO: 803401 - RNA, 19 nt, Homo sapiens
agacauccuucgcuucauu

SEQ ID NO: 803402 - RNA, 19 nt, Homo sapiens
aaagaaaggauguaaguca

SEQ ID NO: 803403 - RNA, 19 nt, Homo sapiens
gucaguggcuuaaauucuu

SEQ ID NO: 803404 - RNA, 19 nt, Homo sapiens
gcggaaauucuuaauaaug

SEQ ID NO: 803405 - RNA, 19 nt, Homo sapiens
ccauuacgagucauuguua

SEQ ID NO: 803406 - RNA, 19 nt, Homo sapiens
gggaagagaacauagugaa

SEQ ID NO: 803407 - RNA, 19 nt, Homo sapiens
cuacuucauuucauugcua

SEQ ID NO: 803408 - RNA, 19 nt, Homo sapiens
gaagaagauaucaggaaga

SEQ ID NO: 803409 - RNA, 19 nt, Homo sapiens
gaacuccacagccuugaug

SEQ ID NO: 803410 - RNA, 19 nt, Homo sapiens
cagacaaaaugaagaguua

SEQ ID NO: 803411 - RNA, 19 nt, Homo sapiens
gagaacauagugaagauuc

SEQ ID NO: 803412 - RNA, 19 nt, Homo sapiens
gcguguaacuuguguagca

SEQ ID NO: 803413 - RNA, 19 nt, Homo sapiens
gaacgcaguuuuguugaaa

SEQ ID NO: 803414 - RNA, 19 nt, Homo sapiens
ugauauaguugaccugcuu

SEQ ID NO: 803415 - RNA, 19 nt, Homo sapiens
caacuugaacaaccagaaa

SEQ ID NO: 803416 - RNA, 19 nt, Homo sapiens
ggaggaguguuggaguauu

SEQ ID NO: 803417 - RNA, 19 nt, Homo sapiens
ggacugcaagauuauuuga

SEQ ID NO: 803418 - RNA, 19 nt, Homo sapiens
gaaauguguuguguugucu

SEQ ID NO: 803419 - RNA, 19 nt, Homo sapiens
caauugagccacuuuaucu

SEQ ID NO: 803420 - RNA, 19 nt, Homo sapiens
gacaguguuugaaucauca

SEQ ID NO: 803421 - RNA, 19 nt, Homo sapiens
ggaagaauuggaagaagau

SEQ ID NO: 803422 - RNA, 19 nt, Homo sapiens
gaugacuucuacauaggaa

SEQ ID NO: 803423 - RNA, 19 nt, Homo sapiens
ggagcaaccuaucuugaac

SEQ ID NO: 803424 - RNA, 19 nt, Homo sapiens
gaaagaaacugccauccaa

SEQ ID NO: 803425 - RNA, 19 nt, Homo sapiens
gaagguaguugacaguaua

SEQ ID NO: 803426 - RNA, 19 nt, Homo sapiens
gaacagaauucccaaauac

SEQ ID NO: 803427 - RNA, 19 nt, Homo sapiens
gaaaauaacucugcacaua

SEQ ID NO: 803428 - RNA, 19 nt, Homo sapiens
gaacagaaccacauuaaau

SEQ ID NO: 803429 - RNA, 19 nt, Homo sapiens
guaaauaccucaagggaau

SEQ ID NO: 803430 - RNA, 19 nt, Homo sapiens
gcaaauguauauucagaug

SEQ ID NO: 803431 - RNA, 19 nt, Homo sapiens
gaacagaugcgacagaguu

SEQ ID NO: 803432 - RNA, 19 nt, Homo sapiens
gaaauuacacgagaguaua

SEQ ID NO: 803433 - RNA, 19 nt, Homo sapiens
gcaggagccucuugacuug

SEQ ID NO: 803434 - RNA, 19 nt, Homo sapiens
gaauuuguguuguggcuuu

SEQ ID NO: 803435 - RNA, 19 nt, Homo sapiens
gcacuucacuuccacuuca

SEQ ID NO: 803436 - RNA, 19 nt, Homo sapiens
gcagggaauucaucuuuga

SEQ ID NO: 803437 - RNA, 19 nt, Homo sapiens
ugaauaugcugcuuuagaa

SEQ ID NO: 803438 - RNA, 19 nt, Homo sapiens
cagaaaccauagaguauaa

SEQ ID NO: 803439 - RNA, 19 nt, Homo sapiens
gaacacagaagacaauaug

SEQ ID NO: 803440 - RNA, 19 nt, Homo sapiens
ggaaacaccaagaucauaa

SEQ ID NO: 803441 - RNA, 19 nt, Homo sapiens
ugaacagaauucccaaaua

SEQ ID NO: 803442 - RNA, 19 nt, Homo sapiens
gaagacucauucuguaaau

SEQ ID NO: 803443 - RNA, 19 nt, Homo sapiens
cagaccaacuucauacuaa

SEQ ID NO: 803444 - RNA, 19 nt, Homo sapiens
aaauuggcaugacuacuua

SEQ ID NO: 803445 - RNA, 19 nt, Homo sapiens
ggagaggccugcuucuugu

SEQ ID NO: 803446 - RNA, 19 nt, Homo sapiens
gggagaggcugcugccaaa

SEQ ID NO: 803447 - RNA, 19 nt, Homo sapiens
ucuagcagcuucaucagua

SEQ ID NO: 803448 - RNA, 19 nt, Homo sapiens
gaagaaaaguuaccagaau

SEQ ID NO: 803449 - RNA, 19 nt, Homo sapiens
caugauagauaaagacguu

SEQ ID NO: 803450 - RNA, 19 nt, Homo sapiens
agacuugccuuguguauuc

SEQ ID NO: 803451 - RNA, 19 nt, Homo sapiens
ucaaggcacccuaauuaua

SEQ ID NO: 803452 - RNA, 19 nt, Homo sapiens
gcuauaaguuacaaggaaa

SEQ ID NO: 803453 - RNA, 19 nt, Homo sapiens
ggaaaccucugucuuugag

SEQ ID NO: 803454 - RNA, 19 nt, Homo sapiens
caacacucaugcuuaaguu

SEQ ID NO: 803455 - RNA, 19 nt, Homo sapiens
cauaucaacucaacacuca

SEQ ID NO: 803456 - RNA, 19 nt, Homo sapiens
gcaguaaaccuaugaugga

SEQ ID NO: 803457 - RNA, 19 nt, Homo sapiens
uaaagacguugaacucuca

SEQ ID NO: 803458 - RNA, 19 nt, Homo sapiens
ucucuacaauggugacuua

SEQ ID NO: 803459 - RNA, 19 nt, Homo sapiens
cagagaguccugccaaaua

SEQ ID NO: 803460 - RNA, 19 nt, Homo sapiens
ggacuaagagaauuauaug

SEQ ID NO: 803461 - RNA, 19 nt, Homo sapiens
ggaagacucauucuguaaa

SEQ ID NO: 803462 - RNA, 19 nt, Homo sapiens
caaauauacugaugucucu

SEQ ID NO: 803463 - RNA, 19 nt, Homo sapiens
gacaaaagaugcagcaauu

SEQ ID NO: 803464 - RNA, 19 nt, Homo sapiens
caacauugauauggaaguu

SEQ ID NO: 803465 - RNA, 19 nt, Homo sapiens
aagcacagauggacaagaa

SEQ ID NO: 803466 - RNA, 19 nt, Homo sapiens
gcugauauauugugacagu

SEQ ID NO: 803467 - RNA, 19 nt, Homo sapiens
ggucacagucuuucaguaa

SEQ ID NO: 803468 - RNA, 19 nt, Homo sapiens
gguguucugucccuacuuu

SEQ ID NO: 803469 - RNA, 19 nt, Homo sapiens
ccagaagccuuaaacaucu

SEQ ID NO: 803470 - RNA, 19 nt, Homo sapiens
ugaaagacuugccuugugu

SEQ ID NO: 803471 - RNA, 19 nt, Homo sapiens
gcacauaaugaacagaauu

SEQ ID NO: 803472 - RNA, 19 nt, Homo sapiens
gcagacucuuucucccuua

SEQ ID NO: 803473 - RNA, 19 nt, Homo sapiens
gagaguaucgggucacuau

SEQ ID NO: 803474 - RNA, 19 nt, Homo sapiens
agucaaggcacccuaauua

SEQ ID NO: 803475 - RNA, 19 nt, Homo sapiens
gugcaaacuucaaauaaca

SEQ ID NO: 803476 - RNA, 19 nt, Homo sapiens
cacaaaaucugaagacuuu

SEQ ID NO: 803477 - RNA, 19 nt, Homo sapiens
acucaacacucaugcuuaa

SEQ ID NO: 803478 - RNA, 19 nt, Homo sapiens
guaaaccuaugauggacuu

SEQ ID NO: 803479 - RNA, 19 nt, Homo sapiens
gaaagacuggcaaucagaa

SEQ ID NO: 803480 - RNA, 19 nt, Homo sapiens
ugaagugccuaaaguugaa

SEQ ID NO: 803481 - RNA, 19 nt, Homo sapiens
ucauugacaucuggaauaa

SEQ ID NO: 803482 - RNA, 19 nt, Homo sapiens
gggaauucaucuuugagaa

SEQ ID NO: 803483 - RNA, 19 nt, Homo sapiens
gggcugaaagaaugauuua

SEQ ID NO: 803484 - RNA, 19 nt, Homo sapiens
ggucaagacucagccauuc

SEQ ID NO: 803485 - RNA, 19 nt, Homo sapiens
aaacugccauccaaacaga

SEQ ID NO: 803486 - RNA, 19 nt, Homo sapiens
uggcaugacuacuuauaaa

SEQ ID NO: 803487 - RNA, 19 nt, Homo sapiens
gauuauagccuugaagaga

SEQ ID NO: 803488 - RNA, 19 nt, Homo sapiens
gugaaagacuugccuugug

SEQ ID NO: 803489 - RNA, 19 nt, Homo sapiens
uguagaagguguugccaaa

SEQ ID NO: 803490 - RNA, 19 nt, Homo sapiens
agagaguccugccaaauau

SEQ ID NO: 803491 - RNA, 19 nt, Homo sapiens
gcugaaagaaugauuuaga

SEQ ID NO: 803492 - RNA, 19 nt, Homo sapiens
ucugaaaccugcucccaaa

SEQ ID NO: 803493 - RNA, 19 nt, Homo sapiens
cagaagagccacugccaaa

SEQ ID NO: 803494 - RNA, 19 nt, Homo sapiens
gaauuacccacuuuauaga

SEQ ID NO: 803495 - RNA, 19 nt, Homo sapiens
ugaaacugauacugcuaua

SEQ ID NO: 803496 - RNA, 19 nt, Homo sapiens
ccacgaccauacucaaguu

SEQ ID NO: 803497 - RNA, 19 nt, Homo sapiens
aaucagaaaccauagagua

SEQ ID NO: 803498 - RNA, 19 nt, Homo sapiens
cagcaugucugcagggaau

SEQ ID NO: 803499 - RNA, 19 nt, Homo sapiens
gucccuacuuuaagaauuu

SEQ ID NO: 803500 - RNA, 19 nt, Homo sapiens
gagaggcugcugccaaauu

SEQ ID NO: 803501 - RNA, 19 nt, Homo sapiens
gagaacagagcaucaagug

SEQ ID NO: 803502 - RNA, 19 nt, Homo sapiens
guaguugacaguauaagaa

SEQ ID NO: 803503 - RNA, 19 nt, Homo sapiens
ucuccgaagucacaagaua

SEQ ID NO: 803504 - RNA, 19 nt, Homo sapiens
gaccaaauauacugauguc

SEQ ID NO: 803505 - RNA, 19 nt, Homo sapiens
gaggccugcuucuuguaua

SEQ ID NO: 803506 - RNA, 19 nt, Homo sapiens
ccacaugcaucgcuucaag

SEQ ID NO: 803507 - RNA, 19 nt, Homo sapiens
gaaagacuugccuugugua

SEQ ID NO: 803508 - RNA, 19 nt, Homo sapiens
caacuaggacaaacauaga

SEQ ID NO: 803509 - RNA, 19 nt, Homo sapiens
gggaagacucauucuguaa

SEQ ID NO: 803510 - RNA, 19 nt, Homo sapiens
agaaaucaauguagaaggu

SEQ ID NO: 803511 - RNA, 19 nt, Homo sapiens
ugagugaagugccuaaagu

SEQ ID NO: 803512 - RNA, 19 nt, Homo sapiens
gauaagagucccugugaag

SEQ ID NO: 803513 - RNA, 19 nt, Homo sapiens
uggcaaauguauauucaga

SEQ ID NO: 803514 - RNA, 19 nt, Homo sapiens
gggaaacaccaagaucaua

SEQ ID NO: 803515 - RNA, 19 nt, Homo sapiens
guucauggcaguaaaccua

SEQ ID NO: 803516 - RNA, 19 nt, Homo sapiens
gcacugcgcccaaacugau

SEQ ID NO: 803517 - RNA, 19 nt, Homo sapiens
cgauggaugucaacagaga

SEQ ID NO: 803518 - RNA, 19 nt, Homo sapiens
ccaaacacaccaauaggaa

SEQ ID NO: 803519 - RNA, 19 nt, Homo sapiens
gccagaagccuuaaacauc

SEQ ID NO: 803520 - RNA, 19 nt, Homo sapiens
uacaauaucugugaaugga

SEQ ID NO: 803521 - RNA, 19 nt, Homo sapiens
ccaaaagaacugacaaaua

SEQ ID NO: 803522 - RNA, 19 nt, Homo sapiens
gagccacugccaaaccuua

SEQ ID NO: 803523 - RNA, 19 nt, Homo sapiens
ucagaaaccauagaguaua

SEQ ID NO: 803524 - RNA, 19 nt, Homo sapiens
gaaacaggcucacagauug

SEQ ID NO: 803525 - RNA, 19 nt, Homo sapiens
ggaaacaggcucacagauu

SEQ ID NO: 803526 - RNA, 19 nt, Homo sapiens
ccaaguagugcaaucauua

SEQ ID NO: 803527 - RNA, 19 nt, Homo sapiens
ucagagggauauucacuaa

SEQ ID NO: 803528 - RNA, 19 nt, Homo sapiens
ggugacguuucuauauuua

SEQ ID NO: 803529 - RNA, 19 nt, Homo sapiens
gcaauaagccccugcauuu

SEQ ID NO: 803530 - RNA, 19 nt, Homo sapiens
gcgccuguguucuguguua

SEQ ID NO: 803531 - RNA, 19 nt, Homo sapiens
cccaaagucuuacuguaua

SEQ ID NO: 803532 - RNA, 19 nt, Homo sapiens
ggucugugcucagcugaua

SEQ ID NO: 803533 - RNA, 19 nt, Homo sapiens
gaugccauguuaccaauga

SEQ ID NO: 803534 - RNA, 19 nt, Homo sapiens
ugcuauagaugccauguua

SEQ ID NO: 803535 - RNA, 19 nt, Homo sapiens
ggcgggagcucuuaaagga

SEQ ID NO: 803536 - RNA, 19 nt, Homo sapiens
caggugacguuucuauauu

SEQ ID NO: 803537 - RNA, 19 nt, Homo sapiens
gggaaacacagcauuuaaa

SEQ ID NO: 803538 - RNA, 19 nt, Homo sapiens
ccaaguguguugacaagug

SEQ ID NO: 803539 - RNA, 19 nt, Homo sapiens
ggauucacauugguuugua

SEQ ID NO: 803540 - RNA, 19 nt, Homo sapiens
gcgaggagucccugcaaua

SEQ ID NO: 803541 - RNA, 19 nt, Homo sapiens
gccauuguuuacucucuua

SEQ ID NO: 803542 - RNA, 19 nt, Homo sapiens
cugaagcucuggaaacuug

SEQ ID NO: 803543 - RNA, 19 nt, Homo sapiens
aaaugaaaguugcuaguuc

SEQ ID NO: 803544 - RNA, 19 nt, Homo sapiens
ccaaagucuuacuguauau

SEQ ID NO: 803545 - RNA, 19 nt, Homo sapiens
uggagaacccaaagucuua

SEQ ID NO: 803546 - RNA, 19 nt, Homo sapiens
gcagagcccguucaugguu

SEQ ID NO: 803547 - RNA, 19 nt, Homo sapiens
ccauguauguauuugagaa

SEQ ID NO: 803548 - RNA, 19 nt, Homo sapiens
gaaggucucaugcucugaa

SEQ ID NO: 803549 - RNA, 19 nt, Homo sapiens
caacaauuacuuaggaugu

SEQ ID NO: 803550 - RNA, 19 nt, Homo sapiens
uaacugccaugcacuguac

SEQ ID NO: 803551 - RNA, 19 nt, Homo sapiens
uuacuuaggauguuuguga

SEQ ID NO: 803552 - RNA, 19 nt, Homo sapiens
aagcuuaaaugugugguuu

SEQ ID NO: 803553 - RNA, 19 nt, Homo sapiens
gccauauucucacaugaug

SEQ ID NO: 803554 - RNA, 19 nt, Homo sapiens
ggaaacacagcauuuaaaa

SEQ ID NO: 803555 - RNA, 19 nt, Homo sapiens
ccaggugacguuucuauau

SEQ ID NO: 803556 - RNA, 19 nt, Homo sapiens
ccaauccuuucuuguccua

SEQ ID NO: 803557 - RNA, 19 nt, Homo sapiens
ccgccgaccuugcuauaga

SEQ ID NO: 803558 - RNA, 19 nt, Homo sapiens
cgaggagucccugcaauaa

SEQ ID NO: 803559 - RNA, 19 nt, Homo sapiens
cacauugguuuguagcauu

SEQ ID NO: 803560 - RNA, 19 nt, Homo sapiens
gaacccaaagucuuacugu

SEQ ID NO: 803561 - RNA, 19 nt, Homo sapiens
cagcagugauuccaacaag

SEQ ID NO: 803562 - RNA, 19 nt, Homo sapiens
aauccuuucuuguccuaua

SEQ ID NO: 803563 - RNA, 19 nt, Homo sapiens
ggauguggauauuuaagac

SEQ ID NO: 803564 - RNA, 19 nt, Homo sapiens
gcaccauccugggucagaa

SEQ ID NO: 803565 - RNA, 19 nt, Homo sapiens
ggucucaugcucugaaaug

SEQ ID NO: 803566 - RNA, 19 nt, Homo sapiens
caaguagugcaaucauuau

SEQ ID NO: 803567 - RNA, 19 nt, Homo sapiens
acauugguuuguagcauuu

SEQ ID NO: 803568 - RNA, 19 nt, Homo sapiens
gcagcugccugugcccuau

SEQ ID NO: 803569 - RNA, 19 nt, Homo sapiens
gcagugauuccaacaagca

SEQ ID NO: 803570 - RNA, 19 nt, Homo sapiens
ccugaucccuguccuccaa

SEQ ID NO: 803571 - RNA, 19 nt, Homo sapiens
caaagacucccucccuagu

SEQ ID NO: 803572 - RNA, 19 nt, Homo sapiens
gggagaacccugccugaag

SEQ ID NO: 803573 - RNA, 19 nt, Homo sapiens
caccaaagcagacauagag

SEQ ID NO: 803574 - RNA, 19 nt, Homo sapiens
uagaugccauguuaccaau

SEQ ID NO: 803575 - RNA, 19 nt, Homo sapiens
aggugacguuucuauauuu

SEQ ID NO: 803576 - RNA, 19 nt, Homo sapiens
gggauguggauauuuaaga

SEQ ID NO: 803577 - RNA, 19 nt, Homo sapiens
uggaugauguggagaugga

SEQ ID NO: 803578 - RNA, 19 nt, Homo sapiens
caccaaguguguugacaag

SEQ ID NO: 803579 - RNA, 19 nt, Homo sapiens
aaugaaaguugcuaguucu

SEQ ID NO: 803580 - RNA, 19 nt, Homo sapiens
aacccaaagucuuacugua

SEQ ID NO: 803581 - RNA, 19 nt, Homo sapiens
agacugagcacccagagau

SEQ ID NO: 803582 - RNA, 19 nt, Homo sapiens
ucucuuauuuaccaacuuc

SEQ ID NO: 803583 - RNA, 19 nt, Homo sapiens
gccauguuaccaaugauuu

SEQ ID NO: 803584 - RNA, 19 nt, Homo sapiens
gcggaaacaggcucacaga

SEQ ID NO: 803585 - RNA, 19 nt, Homo sapiens
gagcuucccacccacuuuc

SEQ ID NO: 803586 - RNA, 19 nt, Homo sapiens
ccagacccgugcccaaucu

SEQ ID NO: 803587 - RNA, 19 nt, Homo sapiens
cguccuagaucgggaacaa

SEQ ID NO: 803588 - RNA, 19 nt, Homo sapiens
ccagcuuccugcccuacuu

SEQ ID NO: 803589 - RNA, 19 nt, Homo sapiens
gauuucagagggauauuca

SEQ ID NO: 803590 - RNA, 19 nt, Homo sapiens
ucacauugguuuguagcau

SEQ ID NO: 803591 - RNA, 19 nt, Homo sapiens
gaccugucccucuguccua

SEQ ID NO: 803592 - RNA, 19 nt, Homo sapiens
auguggagauggagaacua

SEQ ID NO: 803593 - RNA, 19 nt, Homo sapiens
gacugagcacccagagaua

SEQ ID NO: 803594 - RNA, 19 nt, Homo sapiens
gauucacauugguuuguag

SEQ ID NO: 803595 - RNA, 19 nt, Homo sapiens
cagcgccuguguucugugu

SEQ ID NO: 803596 - RNA, 19 nt, Homo sapiens
aaucuccucucccucuguu

SEQ ID NO: 803597 - RNA, 19 nt, Homo sapiens
gaggagucccugcaauaag

SEQ ID NO: 803598 - RNA, 19 nt, Homo sapiens
gcaugacagugggcaccuu

SEQ ID NO: 803599 - RNA, 19 nt, Homo sapiens
gcuccugccugcauuucca

SEQ ID NO: 803600 - RNA, 19 nt, Homo sapiens
ggagauggagaacuaugag

SEQ ID NO: 803601 - RNA, 19 nt, Homo sapiens
ccuuuggugugccauauuc

SEQ ID NO: 803602 - RNA, 19 nt, Homo sapiens
gcagcagugauuccaacaa

SEQ ID NO: 803603 - RNA, 19 nt, Homo sapiens
acccucaggucccuccuuu

SEQ ID NO: 803604 - RNA, 19 nt, Homo sapiens
gccugaagcucuggaaacu

SEQ ID NO: 803605 - RNA, 19 nt, Homo sapiens
accaaguagugcaaucauu

SEQ ID NO: 803606 - RNA, 19 nt, Homo sapiens
acccaaagucuuacuguau

SEQ ID NO: 803607 - RNA, 19 nt, Homo sapiens
ucaccaaagcagacauaga

SEQ ID NO: 803608 - RNA, 19 nt, Homo sapiens
ccagcaugcuccgugaugu

SEQ ID NO: 803609 - RNA, 19 nt, Homo sapiens
cccuguuccuugcacauuu

SEQ ID NO: 803610 - RNA, 19 nt, Homo sapiens
cagcaugcuccgugauguu

SEQ ID NO: 803611 - RNA, 19 nt, Homo sapiens
caguuuggccguccuagau

SEQ ID NO: 803612 - RNA, 19 nt, Homo sapiens
ucucgaugcugccaauguc

SEQ ID NO: 803613 - RNA, 19 nt, Homo sapiens
gugccauauucucacauga

SEQ ID NO: 803614 - RNA, 19 nt, Homo sapiens
gggauucacauugguuugu

SEQ ID NO: 803615 - RNA, 19 nt, Homo sapiens
gauaacugccaugcacugu

SEQ ID NO: 803616 - RNA, 19 nt, Homo sapiens
uuggggauguggauauuua

SEQ ID NO: 803617 - RNA, 19 nt, Homo sapiens
uugccaagcuccaaagacu

SEQ ID NO: 803618 - RNA, 19 nt, Homo sapiens
ucucaccaaagcagacaua

SEQ ID NO: 803619 - RNA, 19 nt, Homo sapiens
ccuacacggucaccacagu

SEQ ID NO: 803620 - RNA, 19 nt, Homo sapiens
caaugucaccaacagcaau

SEQ ID NO: 803621 - RNA, 19 nt, Homo sapiens
uccaugggauucacauugg

SEQ ID NO: 803622 - RNA, 19 nt, Homo sapiens
ggggaaacacagcauuuaa

SEQ ID NO: 803623 - RNA, 19 nt, Homo sapiens
aaacaggcucacagauugu

SEQ ID NO: 803624 - RNA, 19 nt, Homo sapiens
gaacaaccucucugaagaa

SEQ ID NO: 803625 - RNA, 19 nt, Homo sapiens
uacaagggcucacaauuug

SEQ ID NO: 803626 - RNA, 19 nt, Homo sapiens
gccaaugacucaagcugua

SEQ ID NO: 803627 - RNA, 19 nt, Homo sapiens
caaagaagccagccaaauc

SEQ ID NO: 803628 - RNA, 19 nt, Homo sapiens
gagcuccgaugacaacuug

SEQ ID NO: 803629 - RNA, 19 nt, Homo sapiens
cagacagcaucgagauuua

SEQ ID NO: 803630 - RNA, 19 nt, Homo sapiens
gcagacagcaucgagauuu

SEQ ID NO: 803631 - RNA, 19 nt, Homo sapiens
ugagccaacuuucaaauug

SEQ ID NO: 803632 - RNA, 19 nt, Homo sapiens
guagcucccugguuggaua

SEQ ID NO: 803633 - RNA, 19 nt, Homo sapiens
aaaggaaacugucaucgau

SEQ ID NO: 803634 - RNA, 19 nt, Homo sapiens
ggaggcgggugugugaaua

SEQ ID NO: 803635 - RNA, 19 nt, Homo sapiens
caaccucucugaagaaguc

SEQ ID NO: 803636 - RNA, 19 nt, Homo sapiens
agaacaaccucucugaaga

SEQ ID NO: 803637 - RNA, 19 nt, Homo sapiens
ccaaagcgaucgaugugau

SEQ ID NO: 803638 - RNA, 19 nt, Homo sapiens
caagagaggacuagaagga

SEQ ID NO: 803639 - RNA, 19 nt, Homo sapiens
ucaacuuccuccucuguaa

SEQ ID NO: 803640 - RNA, 19 nt, Homo sapiens
gaccuuagaguguauaguu

SEQ ID NO: 803641 - RNA, 19 nt, Homo sapiens
auacaagggcucacaauuu

SEQ ID NO: 803642 - RNA, 19 nt, Homo sapiens
cuacugaugucccagaaau

SEQ ID NO: 803643 - RNA, 19 nt, Homo sapiens
gagaauaaaugagguaacg

SEQ ID NO: 803644 - RNA, 19 nt, Homo sapiens
acauagaccuuagagugua

SEQ ID NO: 803645 - RNA, 19 nt, Homo sapiens
gccaagugcucacacacaa

SEQ ID NO: 803646 - RNA, 19 nt, Homo sapiens
ccaagaacaacacuacuga

SEQ ID NO: 803647 - RNA, 19 nt, Homo sapiens
gaacucacacuagcuuguu

SEQ ID NO: 803648 - RNA, 19 nt, Homo sapiens
gaggauaucagcaugaagu

SEQ ID NO: 803649 - RNA, 19 nt, Homo sapiens
acaaggagaccaaagagaa

SEQ ID NO: 803650 - RNA, 19 nt, Homo sapiens
aaacugucaucgauaggaa

SEQ ID NO: 803651 - RNA, 19 nt, Homo sapiens
cuucagcacccuccaauuu

SEQ ID NO: 803652 - RNA, 19 nt, Homo sapiens
gcucugaccuugauuuuca

SEQ ID NO: 803653 - RNA, 19 nt, Homo sapiens
ggacagagagauggacaug

SEQ ID NO: 803654 - RNA, 19 nt, Homo sapiens
ccucccagcuuuagguuau

SEQ ID NO: 803655 - RNA, 19 nt, Homo sapiens
caaagccguucaucucagu

SEQ ID NO: 803656 - RNA, 19 nt, Homo sapiens
gaagaggaaggaagagaag

SEQ ID NO: 803657 - RNA, 19 nt, Homo sapiens
gaaacugucaucgauagga

SEQ ID NO: 803658 - RNA, 19 nt, Homo sapiens
gcacugacaccaacuacgu

SEQ ID NO: 803659 - RNA, 19 nt, Homo sapiens
cggcaccucugaucaagug

SEQ ID NO: 803660 - RNA, 19 nt, Homo sapiens
ggaauacaagagaggacua

SEQ ID NO: 803661 - RNA, 19 nt, Homo sapiens
gauggcacccuccucagaa

SEQ ID NO: 803662 - RNA, 19 nt, Homo sapiens
caacuuccuccucuguaaa

SEQ ID NO: 803663 - RNA, 19 nt, Homo sapiens
caauuauccuucucucucu

SEQ ID NO: 803664 - RNA, 19 nt, Homo sapiens
gcugccagauggacaagga

SEQ ID NO: 803665 - RNA, 19 nt, Homo sapiens
ggaggacaacggacccaaa

SEQ ID NO: 803666 - RNA, 19 nt, Homo sapiens
cccaagcccucacccaaga

SEQ ID NO: 803667 - RNA, 19 nt, Homo sapiens
gcugcucuaugcuguguau

SEQ ID NO: 803668 - RNA, 19 nt, Homo sapiens
gagacgaagccacaguuau

SEQ ID NO: 803669 - RNA, 19 nt, Homo sapiens
ucacgaaacuagaaaacuu

SEQ ID NO: 803670 - RNA, 19 nt, Homo sapiens
gaggaaggaagagaagaaa

SEQ ID NO: 803671 - RNA, 19 nt, Homo sapiens
ggacaaggagaccaaagag

SEQ ID NO: 803672 - RNA, 19 nt, Homo sapiens
ccucagccaccuuggauaa

SEQ ID NO: 803673 - RNA, 19 nt, Homo sapiens
cuagguguguguacaagug

SEQ ID NO: 803674 - RNA, 19 nt, Homo sapiens
cauacaagggcucacaauu

SEQ ID NO: 803675 - RNA, 19 nt, Homo sapiens
ccaaagaagccagccaaau

SEQ ID NO: 803676 - RNA, 19 nt, Homo sapiens
gagaagaggaaggaagaga

SEQ ID NO: 803677 - RNA, 19 nt, Homo sapiens
gacggcuacugguuccuaa

SEQ ID NO: 803678 - RNA, 19 nt, Homo sapiens
cgagucagccugcagugaa

SEQ ID NO: 803679 - RNA, 19 nt, Homo sapiens
gcaagaaggguggcaugga

SEQ ID NO: 803680 - RNA, 19 nt, Homo sapiens
cauagaccuuagaguguau

SEQ ID NO: 803681 - RNA, 19 nt, Homo sapiens
ggcggugucuguauguaug

SEQ ID NO: 803682 - RNA, 19 nt, Homo sapiens
agacgaagccacaguuauc

SEQ ID NO: 803683 - RNA, 19 nt, Homo sapiens
ugagacgaagccacaguua

SEQ ID NO: 803684 - RNA, 19 nt, Homo sapiens
ccagacuccugcccuuuua

SEQ ID NO: 803685 - RNA, 19 nt, Homo sapiens
gugguggacuagauagaug

SEQ ID NO: 803686 - RNA, 19 nt, Homo sapiens
ucagccaccuuggauaaga

SEQ ID NO: 803687 - RNA, 19 nt, Homo sapiens
ccucugggcugaugauacu

SEQ ID NO: 803688 - RNA, 19 nt, Homo sapiens
agaagcagcugcccaucca

SEQ ID NO: 803689 - RNA, 19 nt, Homo sapiens
acaggcauguugugagaau

SEQ ID NO: 803690 - RNA, 19 nt, Homo sapiens
ccacuacaacucccacuuc

SEQ ID NO: 803691 - RNA, 19 nt, Homo sapiens
aggaaacugucaucgauag

SEQ ID NO: 803692 - RNA, 19 nt, Homo sapiens
ggacagccaggaccacaag

SEQ ID NO: 803693 - RNA, 19 nt, Homo sapiens
cggcagagacgcuugacuu

SEQ ID NO: 803694 - RNA, 19 nt, Homo sapiens
gugugugaauagcauauau

SEQ ID NO: 803695 - RNA, 19 nt, Homo sapiens
cccgacagcuugccguguu

SEQ ID NO: 803696 - RNA, 19 nt, Homo sapiens
caagaugacgacaguccaa

SEQ ID NO: 803697 - RNA, 19 nt, Homo sapiens
gggcucacaauuuggcuuu

SEQ ID NO: 803698 - RNA, 19 nt, Homo sapiens
gacaaggagaccaaagaga

SEQ ID NO: 803699 - RNA, 19 nt, Homo sapiens
gggcugcucuaugcugugu

SEQ ID NO: 803700 - RNA, 19 nt, Homo sapiens
ccaaugacucaagcuguaa

SEQ ID NO: 803701 - RNA, 19 nt, Homo sapiens
ccagagcaguacugagucu

SEQ ID NO: 803702 - RNA, 19 nt, Homo sapiens
cuaguggcguauaagaaga

SEQ ID NO: 803703 - RNA, 19 nt, Homo sapiens
cauccgagacauccucuug

SEQ ID NO: 803704 - RNA, 19 nt, Homo sapiens
accuuagaguguauaguua

SEQ ID NO: 803705 - RNA, 19 nt, Homo sapiens
gcauacaagggcucacaau

SEQ ID NO: 803706 - RNA, 19 nt, Homo sapiens
gaggaaagaaacgauuuua

SEQ ID NO: 803707 - RNA, 19 nt, Homo sapiens
cagcaugaaguucgaugaa

SEQ ID NO: 803708 - RNA, 19 nt, Homo sapiens
ucgaggauaucagcaugaa

SEQ ID NO: 803709 - RNA, 19 nt, Homo sapiens
ggcauguugugagaauaaa

SEQ ID NO: 803710 - RNA, 19 nt, Homo sapiens
cccagaaauuccagcaguu

SEQ ID NO: 803711 - RNA, 19 nt, Homo sapiens
caagauugcccagaucaag

SEQ ID NO: 803712 - RNA, 19 nt, Homo sapiens
caagcuguaagucaucuga

SEQ ID NO: 803713 - RNA, 19 nt, Homo sapiens
gaggacaacggacccaaag

SEQ ID NO: 803714 - RNA, 19 nt, Homo sapiens
guccagagcaguacugagu

SEQ ID NO: 803715 - RNA, 19 nt, Homo sapiens
cacauagaccuuagagugu

SEQ ID NO: 803716 - RNA, 19 nt, Homo sapiens
gcgcagacagcaucgagau

SEQ ID NO: 803717 - RNA, 19 nt, Homo sapiens
agaagaggaaggaagagaa

SEQ ID NO: 803718 - RNA, 19 nt, Homo sapiens
ccgagaagaggaaggaaga

SEQ ID NO: 803719 - RNA, 19 nt, Homo sapiens
ggcagagacgcuugacuug

SEQ ID NO: 803720 - RNA, 19 nt, Homo sapiens
gagucagccugcagugaag

SEQ ID NO: 803721 - RNA, 19 nt, Homo sapiens
agagcugagugaccaguau

SEQ ID NO: 803722 - RNA, 19 nt, Homo sapiens
caacacuacugagcugacu

SEQ ID NO: 803723 - RNA, 19 nt, Homo sapiens
ccuuagaguguauaguuaa

SEQ ID NO: 803724 - RNA, 19 nt, Homo sapiens
gcacagauguagaacuuua

SEQ ID NO: 803725 - RNA, 19 nt, Homo sapiens
gaagggugcuuauucuuua

SEQ ID NO: 803726 - RNA, 19 nt, Homo sapiens
aaagugagcugcuauauau

SEQ ID NO: 803727 - RNA, 19 nt, Homo sapiens
gaaagagacuacacuauca

SEQ ID NO: 803728 - RNA, 19 nt, Homo sapiens
gaaccaaccugacagcauu

SEQ ID NO: 803729 - RNA, 19 nt, Homo sapiens
ccaaagaucugaagccaaa

SEQ ID NO: 803730 - RNA, 19 nt, Homo sapiens
ggagaaaguuagccuguuu

SEQ ID NO: 803731 - RNA, 19 nt, Homo sapiens
uaaaugcucucauaacuug

SEQ ID NO: 803732 - RNA, 19 nt, Homo sapiens
gaauacugcucguuauaaa

SEQ ID NO: 803733 - RNA, 19 nt, Homo sapiens
caggaaagcuggcaaauuc

SEQ ID NO: 803734 - RNA, 19 nt, Homo sapiens
aggcuuagcuuuauucaua

SEQ ID NO: 803735 - RNA, 19 nt, Homo sapiens
gcucguauuuguaaacuaa

SEQ ID NO: 803736 - RNA, 19 nt, Homo sapiens
gaagaaacgcccaguauuc

SEQ ID NO: 803737 - RNA, 19 nt, Homo sapiens
ggucauaucuuagaauugu

SEQ ID NO: 803738 - RNA, 19 nt, Homo sapiens
ggaugaaggugaauugugu

SEQ ID NO: 803739 - RNA, 19 nt, Homo sapiens
aaaguuaggcuaccaauuu

SEQ ID NO: 803740 - RNA, 19 nt, Homo sapiens
ggacaaagagagagaaaga

SEQ ID NO: 803741 - RNA, 19 nt, Homo sapiens
gaaccaagaugucaguuuu

SEQ ID NO: 803742 - RNA, 19 nt, Homo sapiens
aaaguuagccuguuugaaa

SEQ ID NO: 803743 - RNA, 19 nt, Homo sapiens
uauguaaucugaugcauga

SEQ ID NO: 803744 - RNA, 19 nt, Homo sapiens
ggaagggugcuuauucuuu

SEQ ID NO: 803745 - RNA, 19 nt, Homo sapiens
caaagugagcugcuauaua

SEQ ID NO: 803746 - RNA, 19 nt, Homo sapiens
auucagggcuucaaauaua

SEQ ID NO: 803747 - RNA, 19 nt, Homo sapiens
gaaauaagggaaaggauca

SEQ ID NO: 803748 - RNA, 19 nt, Homo sapiens
gagcugcuauauauuauuc

SEQ ID NO: 803749 - RNA, 19 nt, Homo sapiens
gggcagaagugcaaaguag

SEQ ID NO: 803750 - RNA, 19 nt, Homo sapiens
uugauugccucuaaaguua

SEQ ID NO: 803751 - RNA, 19 nt, Homo sapiens
ggaauacugcucguuauaa

SEQ ID NO: 803752 - RNA, 19 nt, Homo sapiens
ggaagaaacgcccaguauu

SEQ ID NO: 803753 - RNA, 19 nt, Homo sapiens
ccacacagaagaacauuaa

SEQ ID NO: 803754 - RNA, 19 nt, Homo sapiens
ucucaaaucuccacacaga

SEQ ID NO: 803755 - RNA, 19 nt, Homo sapiens
ccaguuagauuccuuugga

SEQ ID NO: 803756 - RNA, 19 nt, Homo sapiens
guacucauaugucuuguag

SEQ ID NO: 803757 - RNA, 19 nt, Homo sapiens
cuacugucaugguuuguua

SEQ ID NO: 803758 - RNA, 19 nt, Homo sapiens
cagaagaacauuaagcuuu

SEQ ID NO: 803759 - RNA, 19 nt, Homo sapiens
gaccuugguuucaaaguga

SEQ ID NO: 803760 - RNA, 19 nt, Homo sapiens
ggacagcagcaugaauuua

SEQ ID NO: 803761 - RNA, 19 nt, Homo sapiens
gaagaacauuaagcuuuga

SEQ ID NO: 803762 - RNA, 19 nt, Homo sapiens
agaagaacauuaagcuuug

SEQ ID NO: 803763 - RNA, 19 nt, Homo sapiens
gaaaguggaagucucaaau

SEQ ID NO: 803764 - RNA, 19 nt, Homo sapiens
ggaggccucuuucgagcua

SEQ ID NO: 803765 - RNA, 19 nt, Homo sapiens
gaauggaaaccuaaguaaa

SEQ ID NO: 803766 - RNA, 19 nt, Homo sapiens
auaccagggucauaucuua

SEQ ID NO: 803767 - RNA, 19 nt, Homo sapiens
gcuaaucuucugcuuauuu

SEQ ID NO: 803768 - RNA, 19 nt, Homo sapiens
caaauauaaugccaucuuc

SEQ ID NO: 803769 - RNA, 19 nt, Homo sapiens
guugaagucuaauacauga

SEQ ID NO: 803770 - RNA, 19 nt, Homo sapiens
ggccaaauuugcuguuuau

SEQ ID NO: 803771 - RNA, 19 nt, Homo sapiens
cgagcuaccuggauugcua

SEQ ID NO: 803772 - RNA, 19 nt, Homo sapiens
caccuuagcuaauuaaucu

SEQ ID NO: 803773 - RNA, 19 nt, Homo sapiens
ucacuuguguguaugugua

SEQ ID NO: 803774 - RNA, 19 nt, Homo sapiens
guaauaaaccucaaagucu

SEQ ID NO: 803775 - RNA, 19 nt, Homo sapiens
cauccacccuuuaagaauu

SEQ ID NO: 803776 - RNA, 19 nt, Homo sapiens
gaaauucugcaugccuuua

SEQ ID NO: 803777 - RNA, 19 nt, Homo sapiens
gugaugaucucaaguccuu

SEQ ID NO: 803778 - RNA, 19 nt, Homo sapiens
gaagaaagcagcgaaacau

SEQ ID NO: 803779 - RNA, 19 nt, Homo sapiens
gauggaacauuuucugaua

SEQ ID NO: 803780 - RNA, 19 nt, Homo sapiens
gagauaaaggucaauauuc

SEQ ID NO: 803781 - RNA, 19 nt, Homo sapiens
caauuuaccuuggauuugu

SEQ ID NO: 803782 - RNA, 19 nt, Homo sapiens
gcacaguacacuagauuau

SEQ ID NO: 803783 - RNA, 19 nt, Homo sapiens
gcccugagccugccuguuu

SEQ ID NO: 803784 - RNA, 19 nt, Homo sapiens
ggaccuugguuucaaagug

SEQ ID NO: 803785 - RNA, 19 nt, Homo sapiens
ugaaaucaccuaaugcauu

SEQ ID NO: 803786 - RNA, 19 nt, Homo sapiens
ggacaaacaaagaaggaaa

SEQ ID NO: 803787 - RNA, 19 nt, Homo sapiens
caaucucaaugacaucuuu

SEQ ID NO: 803788 - RNA, 19 nt, Homo sapiens
ucagggaaguccagagaaa

SEQ ID NO: 803789 - RNA, 19 nt, Homo sapiens
gagaguaucuaugucuuuc

SEQ ID NO: 803790 - RNA, 19 nt, Homo sapiens
agacuacacuaucagguuu

SEQ ID NO: 803791 - RNA, 19 nt, Homo sapiens
uacaggagcuggugaaaca

SEQ ID NO: 803792 - RNA, 19 nt, Homo sapiens
ugauagcccuugugacuug

SEQ ID NO: 803793 - RNA, 19 nt, Homo sapiens
aagacuccauugaaaguua

SEQ ID NO: 803794 - RNA, 19 nt, Homo sapiens
gcuaccaauuucuugauuu

SEQ ID NO: 803795 - RNA, 19 nt, Homo sapiens
ggcaaauucucuaacaguu

SEQ ID NO: 803796 - RNA, 19 nt, Homo sapiens
ugaauuguguuucggaaga

SEQ ID NO: 803797 - RNA, 19 nt, Homo sapiens
cagaugaaauccaaaccaa

SEQ ID NO: 803798 - RNA, 19 nt, Homo sapiens
gcauauauuuagcggguau

SEQ ID NO: 803799 - RNA, 19 nt, Homo sapiens
caguggaguugaagucuaa

SEQ ID NO: 803800 - RNA, 19 nt, Homo sapiens
gguuucagguuacauaaau

SEQ ID NO: 803801 - RNA, 19 nt, Homo sapiens
gcccagaaauaucuucaga

SEQ ID NO: 803802 - RNA, 19 nt, Homo sapiens
gacuugaaaucaccuaaug

SEQ ID NO: 803803 - RNA, 19 nt, Homo sapiens
gaaggugaauuguguuucg

SEQ ID NO: 803804 - RNA, 19 nt, Homo sapiens
caugagugauuugguuaua

SEQ ID NO: 803805 - RNA, 19 nt, Homo sapiens
ucucagaaaucaguuugua

SEQ ID NO: 803806 - RNA, 19 nt, Homo sapiens
gcaaugaagaccucaggaa

SEQ ID NO: 803807 - RNA, 19 nt, Homo sapiens
cugauaaacuuaacaaugg

SEQ ID NO: 803808 - RNA, 19 nt, Homo sapiens
uaauccagaugcaaucauu

SEQ ID NO: 803809 - RNA, 19 nt, Homo sapiens
gaaaauucauguccauaug

SEQ ID NO: 803810 - RNA, 19 nt, Homo sapiens
gaagaauuaggcuugguuu

SEQ ID NO: 803811 - RNA, 19 nt, Homo sapiens
ucaggaauacugcucguua

SEQ ID NO: 803812 - RNA, 19 nt, Homo sapiens
acugaaggcuggcaccaua

SEQ ID NO: 803813 - RNA, 19 nt, Homo sapiens
cuaccuggauugcuaauuc

SEQ ID NO: 803814 - RNA, 19 nt, Homo sapiens
gcugcuauguucugcauug

SEQ ID NO: 803815 - RNA, 19 nt, Homo sapiens
ccucaagauucuguaauaa

SEQ ID NO: 803816 - RNA, 19 nt, Homo sapiens
gccaagcucguauuuguaa

SEQ ID NO: 803817 - RNA, 19 nt, Homo sapiens
ccacauccacccuuuaaga

SEQ ID NO: 803818 - RNA, 19 nt, Homo sapiens
aaaugugugugcucuauug

SEQ ID NO: 803819 - RNA, 19 nt, Homo sapiens
gaaaaugugugugcucuau

SEQ ID NO: 803820 - RNA, 19 nt, Homo sapiens
ugccauaggcccagaaaua

SEQ ID NO: 803821 - RNA, 19 nt, Homo sapiens
gaucugauagcccuuguga

SEQ ID NO: 803822 - RNA, 19 nt, Homo sapiens
gcagaucuagaaaugcaua

SEQ ID NO: 803823 - RNA, 19 nt, Homo sapiens
gaguugaagucuaauacau

SEQ ID NO: 803824 - RNA, 19 nt, Homo sapiens
gcaaauagcuuaaaugucu

SEQ ID NO: 803825 - RNA, 19 nt, Homo sapiens
gaaggaggcugaaaguauu

SEQ ID NO: 803826 - RNA, 19 nt, Homo sapiens
gcaaaggcauguacuacua

SEQ ID NO: 803827 - RNA, 19 nt, Homo sapiens
caacugaagucauuacaaa

SEQ ID NO: 803828 - RNA, 19 nt, Homo sapiens
guagagacuuucaguauuu

SEQ ID NO: 803829 - RNA, 19 nt, Homo sapiens
ggucugaugugccuaauuu

SEQ ID NO: 803830 - RNA, 19 nt, Homo sapiens
gccauuagcucucuacaaa

SEQ ID NO: 803831 - RNA, 19 nt, Homo sapiens
gaagagaaauaggauaaga

SEQ ID NO: 803832 - RNA, 19 nt, Homo sapiens
gaacauaagccauauaucu

SEQ ID NO: 803833 - RNA, 19 nt, Homo sapiens
gcaaagaauucucuaugga

SEQ ID NO: 803834 - RNA, 19 nt, Homo sapiens
gggccaagcuguugaacua

SEQ ID NO: 803835 - RNA, 19 nt, Homo sapiens
acagaugacuggcauauuu

SEQ ID NO: 803836 - RNA, 19 nt, Homo sapiens
cagaaagacucaugauauu

SEQ ID NO: 803837 - RNA, 19 nt, Homo sapiens
guucuacacucaauccuua

SEQ ID NO: 803838 - RNA, 19 nt, Homo sapiens
ucagaaagauuuacggauu

SEQ ID NO: 803839 - RNA, 19 nt, Homo sapiens
aguggaagcuuucaaguua

SEQ ID NO: 803840 - RNA, 19 nt, Homo sapiens
cagcagcucuacaaauaua

SEQ ID NO: 803841 - RNA, 19 nt, Homo sapiens
ggaaacggauggcacagaa

SEQ ID NO: 803842 - RNA, 19 nt, Homo sapiens
uaaguaacccucuaacuaa

SEQ ID NO: 803843 - RNA, 19 nt, Homo sapiens
ccacugagaaugcagauua

SEQ ID NO: 803844 - RNA, 19 nt, Homo sapiens
caaauacacuauagaguca

SEQ ID NO: 803845 - RNA, 19 nt, Homo sapiens
gaaauaggauaagaaguuc

SEQ ID NO: 803846 - RNA, 19 nt, Homo sapiens
aaacacagacccaucuuua

SEQ ID NO: 803847 - RNA, 19 nt, Homo sapiens
ggaagaacaagcuuacuuu

SEQ ID NO: 803848 - RNA, 19 nt, Homo sapiens
ugagugauccuucauauuu

SEQ ID NO: 803849 - RNA, 19 nt, Homo sapiens
caacaugcguauuuauaga

SEQ ID NO: 803850 - RNA, 19 nt, Homo sapiens
gaguagaugcugcuauuua

SEQ ID NO: 803851 - RNA, 19 nt, Homo sapiens
gggaguagaugcugcuauu

SEQ ID NO: 803852 - RNA, 19 nt, Homo sapiens
caaaugguaugguguugaa

SEQ ID NO: 803853 - RNA, 19 nt, Homo sapiens
ggagucagucccuaauuua

SEQ ID NO: 803854 - RNA, 19 nt, Homo sapiens
gaaaugcaguguucucucu

SEQ ID NO: 803855 - RNA, 19 nt, Homo sapiens
caaugaaagugguaaauca

SEQ ID NO: 803856 - RNA, 19 nt, Homo sapiens
gcccgaaccugaacuggua

SEQ ID NO: 803857 - RNA, 19 nt, Homo sapiens
gauauacaguguugaaauc

SEQ ID NO: 803858 - RNA, 19 nt, Homo sapiens
gaugcugggucaagugaua

SEQ ID NO: 803859 - RNA, 19 nt, Homo sapiens
ggaagugggaagagaaaua

SEQ ID NO: 803860 - RNA, 19 nt, Homo sapiens
uggcacagauucagguuua

SEQ ID NO: 803861 - RNA, 19 nt, Homo sapiens
ugcagcagcucuacaaaua

SEQ ID NO: 803862 - RNA, 19 nt, Homo sapiens
ggacaaaugcccacucuuc

SEQ ID NO: 803863 - RNA, 19 nt, Homo sapiens
cagaaagauuuacggauuu

SEQ ID NO: 803864 - RNA, 19 nt, Homo sapiens
ucaagagccuucccacaaa

SEQ ID NO: 803865 - RNA, 19 nt, Homo sapiens
uaacauuucucugcaaaga

SEQ ID NO: 803866 - RNA, 19 nt, Homo sapiens
ggacuaaaaucucugaauu

SEQ ID NO: 803867 - RNA, 19 nt, Homo sapiens
guugaaaucuggucugaug

SEQ ID NO: 803868 - RNA, 19 nt, Homo sapiens
gagcuugucuccugucugu

SEQ ID NO: 803869 - RNA, 19 nt, Homo sapiens
uuacaaaucugcucuacau

SEQ ID NO: 803870 - RNA, 19 nt, Homo sapiens
uaaagaggauggguagaaa

SEQ ID NO: 803871 - RNA, 19 nt, Homo sapiens
ggugaaaguucuacacuca

SEQ ID NO: 803872 - RNA, 19 nt, Homo sapiens
caaagugcuuagcgaagua

SEQ ID NO: 803873 - RNA, 19 nt, Homo sapiens
gaucuuccuuggagcuaua

SEQ ID NO: 803874 - RNA, 19 nt, Homo sapiens
gauaaggcuuugugggaaa

SEQ ID NO: 803875 - RNA, 19 nt, Homo sapiens
gcaacaaugucaaugucaa

SEQ ID NO: 803876 - RNA, 19 nt, Homo sapiens
auggauggcucaauucuua

SEQ ID NO: 803877 - RNA, 19 nt, Homo sapiens
caaguucaguguuuacaga

SEQ ID NO: 803878 - RNA, 19 nt, Homo sapiens
gcaauaaguaacccucuaa

SEQ ID NO: 803879 - RNA, 19 nt, Homo sapiens
guaguuagguaccauuugu

SEQ ID NO: 803880 - RNA, 19 nt, Homo sapiens
uaaagaggguaaagggaaa

SEQ ID NO: 803881 - RNA, 19 nt, Homo sapiens
caaauccugugcccuuauu

SEQ ID NO: 803882 - RNA, 19 nt, Homo sapiens
gaaaguauugucuaaagug

SEQ ID NO: 803883 - RNA, 19 nt, Homo sapiens
ccaagguagugaaguaauu

SEQ ID NO: 803884 - RNA, 19 nt, Homo sapiens
gggaagagaaauaggauaa

SEQ ID NO: 803885 - RNA, 19 nt, Homo sapiens
gagcagauauacagaaugc

SEQ ID NO: 803886 - RNA, 19 nt, Homo sapiens
cagguaagguguauguuga

SEQ ID NO: 803887 - RNA, 19 nt, Homo sapiens
guucaguguuuacagauaa

SEQ ID NO: 803888 - RNA, 19 nt, Homo sapiens
gguauagucugugaauuau

SEQ ID NO: 803889 - RNA, 19 nt, Homo sapiens
ccaggucuguuuaguugua

SEQ ID NO: 803890 - RNA, 19 nt, Homo sapiens
ucagaaagacucaugauau

SEQ ID NO: 803891 - RNA, 19 nt, Homo sapiens
gaguggugcuggagaguuu

SEQ ID NO: 803892 - RNA, 19 nt, Homo sapiens
gaacugggacaaacacaga

SEQ ID NO: 803893 - RNA, 19 nt, Homo sapiens
cagcuucacuuuagcaaug

SEQ ID NO: 803894 - RNA, 19 nt, Homo sapiens
gagaugaugucagguacaa

SEQ ID NO: 803895 - RNA, 19 nt, Homo sapiens
ucaaagaaguggcacagau

SEQ ID NO: 803896 - RNA, 19 nt, Homo sapiens
caugguugcccacaaauua

SEQ ID NO: 803897 - RNA, 19 nt, Homo sapiens
guaguucccuucaguucaa

SEQ ID NO: 803898 - RNA, 19 nt, Homo sapiens
ugagugcucucgcuaagaa

SEQ ID NO: 803899 - RNA, 19 nt, Homo sapiens
aaagaaguauuggcaguuu

SEQ ID NO: 803900 - RNA, 19 nt, Homo sapiens
gguagaaacacauauguau

SEQ ID NO: 803901 - RNA, 19 nt, Homo sapiens
guucacaacaugcguauuu

SEQ ID NO: 803902 - RNA, 19 nt, Homo sapiens
ucacgaaugucuuaguguu

SEQ ID NO: 803903 - RNA, 19 nt, Homo sapiens
cagcaugguugcccacaaa

SEQ ID NO: 803904 - RNA, 19 nt, Homo sapiens
gaagaacaagcuuacuuug

SEQ ID NO: 803905 - RNA, 19 nt, Homo sapiens
gcacuagccuguccucacu

SEQ ID NO: 803906 - RNA, 19 nt, Homo sapiens
ggacaugaacaaagcugua

SEQ ID NO: 803907 - RNA, 19 nt, Homo sapiens
gaccgaagacuaccucauu

SEQ ID NO: 803908 - RNA, 19 nt, Homo sapiens
aaacaaaggcagcagacua

SEQ ID NO: 803909 - RNA, 19 nt, Homo sapiens
caaacuaucagauucauuc

SEQ ID NO: 803910 - RNA, 19 nt, Homo sapiens
caaagaaguggcacagauu

SEQ ID NO: 803911 - RNA, 19 nt, Homo sapiens
ccauucaccuccacguuaa

SEQ ID NO: 803912 - RNA, 19 nt, Homo sapiens
gcgaaugaagugaauaauu

SEQ ID NO: 803913 - RNA, 19 nt, Homo sapiens
cauaacauuucucugcaaa

SEQ ID NO: 803914 - RNA, 19 nt, Homo sapiens
caaggacaauggcaacaau

SEQ ID NO: 803915 - RNA, 19 nt, Homo sapiens
gauauaugcugcucuuggu

SEQ ID NO: 803916 - RNA, 19 nt, Homo sapiens
gacaacaaacuaucagauu

SEQ ID NO: 803917 - RNA, 19 nt, Homo sapiens
guaauuggaagacacauga

SEQ ID NO: 803918 - RNA, 19 nt, Homo sapiens
ugaaggaggcugaaaguau

SEQ ID NO: 803919 - RNA, 19 nt, Homo sapiens
gaagcuuucaaguuaguua

SEQ ID NO: 803920 - RNA, 19 nt, Homo sapiens
gauauuccaugcccagauc

SEQ ID NO: 803921 - RNA, 19 nt, Homo sapiens
agaacaagcuuacuuugca

SEQ ID NO: 803922 - RNA, 19 nt, Homo sapiens
auagggaacuccagacuga

SEQ ID NO: 803923 - RNA, 19 nt, Homo sapiens
gcuuaaaugucucuugcaa

SEQ ID NO: 803924 - RNA, 19 nt, Homo sapiens
gaccaaagcuuucaaguuu

SEQ ID NO: 803925 - RNA, 19 nt, Homo sapiens
caaauaaacugcugcuuaa

SEQ ID NO: 803926 - RNA, 19 nt, Homo sapiens
gcagaucacucauaaagga

SEQ ID NO: 803927 - RNA, 19 nt, Homo sapiens
gaaagcacauagaauagaa

SEQ ID NO: 803928 - RNA, 19 nt, Homo sapiens
ggacaacuaucucuggaaa

SEQ ID NO: 803929 - RNA, 19 nt, Homo sapiens
gccauuagcuuccacauga

SEQ ID NO: 803930 - RNA, 19 nt, Homo sapiens
gccacaagcuugcagaaua

SEQ ID NO: 803931 - RNA, 19 nt, Homo sapiens
guaauucucugcuguguau

SEQ ID NO: 803932 - RNA, 19 nt, Homo sapiens
gaugguggcucccaggaua

SEQ ID NO: 803933 - RNA, 19 nt, Homo sapiens
gaaagagacagagaaguua

SEQ ID NO: 803934 - RNA, 19 nt, Homo sapiens
ggaaagagacagagaaguu

SEQ ID NO: 803935 - RNA, 19 nt, Homo sapiens
ccacaagcuugcagaauaa

SEQ ID NO: 803936 - RNA, 19 nt, Homo sapiens
ucaaauaaacugcugcuua

SEQ ID NO: 803937 - RNA, 19 nt, Homo sapiens
gcaaagacaucaagaaagc

SEQ ID NO: 803938 - RNA, 19 nt, Homo sapiens
gauagagaauccuacauug

SEQ ID NO: 803939 - RNA, 19 nt, Homo sapiens
ucggagaacucaagacaua

SEQ ID NO: 803940 - RNA, 19 nt, Homo sapiens
gacuauggauuucacauuu

SEQ ID NO: 803941 - RNA, 19 nt, Homo sapiens
gcacauagaauagaacaaa

SEQ ID NO: 803942 - RNA, 19 nt, Homo sapiens
gagagaagcgggauugaaa

SEQ ID NO: 803943 - RNA, 19 nt, Homo sapiens
cgacagaagcaacuuauuu

SEQ ID NO: 803944 - RNA, 19 nt, Homo sapiens
ggaagagucugagaaagug

SEQ ID NO: 803945 - RNA, 19 nt, Homo sapiens
caagacauaugguggaaga

SEQ ID NO: 803946 - RNA, 19 nt, Homo sapiens
gggaauagagaacuuuaua

SEQ ID NO: 803947 - RNA, 19 nt, Homo sapiens
ggaacgagcagucgauauu

SEQ ID NO: 803948 - RNA, 19 nt, Homo sapiens
gaaagugagcgucgucaaa

SEQ ID NO: 803949 - RNA, 19 nt, Homo sapiens
gcgcuuugcuguagaaaug

SEQ ID NO: 803950 - RNA, 19 nt, Homo sapiens
gaagagagccagacugaag

SEQ ID NO: 803951 - RNA, 19 nt, Homo sapiens
gagaugagccuagaaguga

SEQ ID NO: 803952 - RNA, 19 nt, Homo sapiens
gagaagagagccagacuga

SEQ ID NO: 803953 - RNA, 19 nt, Homo sapiens
ggugaugugucaaauaaug

SEQ ID NO: 803954 - RNA, 19 nt, Homo sapiens
ggacacagccaggguaauu

SEQ ID NO: 803955 - RNA, 19 nt, Homo sapiens
uaaccucccuuucuuuaga

SEQ ID NO: 803956 - RNA, 19 nt, Homo sapiens
ucacagacucuugauauua

SEQ ID NO: 803957 - RNA, 19 nt, Homo sapiens
gccauucgcuuccggauug

SEQ ID NO: 803958 - RNA, 19 nt, Homo sapiens
ccaacgugcucaagcuaua

SEQ ID NO: 803959 - RNA, 19 nt, Homo sapiens
cgggugaugugucaaauaa

SEQ ID NO: 803960 - RNA, 19 nt, Homo sapiens
ggaagaggaugacuuagac

SEQ ID NO: 803961 - RNA, 19 nt, Homo sapiens
gaccuagccugccugauug

SEQ ID NO: 803962 - RNA, 19 nt, Homo sapiens
cagagaaguuacaaacaaa

SEQ ID NO: 803963 - RNA, 19 nt, Homo sapiens
acagagaaguuacaaacaa

SEQ ID NO: 803964 - RNA, 19 nt, Homo sapiens
caguaaagauagacaaaga

SEQ ID NO: 803965 - RNA, 19 nt, Homo sapiens
ccaaagaaccaaccauaga

SEQ ID NO: 803966 - RNA, 19 nt, Homo sapiens
ucccaaaucuuaccucuau

SEQ ID NO: 803967 - RNA, 19 nt, Homo sapiens
uaaagagaauucugguguu

SEQ ID NO: 803968 - RNA, 19 nt, Homo sapiens
ccagcuacguuuaaauuau

SEQ ID NO: 803969 - RNA, 19 nt, Homo sapiens
gagcagaucccaccacauc

SEQ ID NO: 803970 - RNA, 19 nt, Homo sapiens
gagaacagccugccuugug

SEQ ID NO: 803971 - RNA, 19 nt, Homo sapiens
gaagagcaguacagcaucu

SEQ ID NO: 803972 - RNA, 19 nt, Homo sapiens
ucucgagugucuucuauuu

SEQ ID NO: 803973 - RNA, 19 nt, Homo sapiens
gaagaaggcuaugaaucca

SEQ ID NO: 803974 - RNA, 19 nt, Homo sapiens
gcaaacaucagccguguag

SEQ ID NO: 803975 - RNA, 19 nt, Homo sapiens
guacaccuaccaucaguuu

SEQ ID NO: 803976 - RNA, 19 nt, Homo sapiens
ggauuuagacccugauuuc

SEQ ID NO: 803977 - RNA, 19 nt, Homo sapiens
ccaaauacacagagccuuu

SEQ ID NO: 803978 - RNA, 19 nt, Homo sapiens
ggcaaggccuucccaaauc

SEQ ID NO: 803979 - RNA, 19 nt, Homo sapiens
ccggguaucugcagaagaa

SEQ ID NO: 803980 - RNA, 19 nt, Homo sapiens
caucagccguguagagcua

SEQ ID NO: 803981 - RNA, 19 nt, Homo sapiens
gaagaggaaccagaauuug

SEQ ID NO: 803982 - RNA, 19 nt, Homo sapiens
ugaagaggaaccagaauuu

SEQ ID NO: 803983 - RNA, 19 nt, Homo sapiens
gaacaaaugguggcaagau

SEQ ID NO: 803984 - RNA, 19 nt, Homo sapiens
acaaugagccugcugaaga

SEQ ID NO: 803985 - RNA, 19 nt, Homo sapiens
gaauaaauccaggagagaa

SEQ ID NO: 803986 - RNA, 19 nt, Homo sapiens
ggaaagcacauagaauaga

SEQ ID NO: 803987 - RNA, 19 nt, Homo sapiens
gauccucacuuagaaacuu

SEQ ID NO: 803988 - RNA, 19 nt, Homo sapiens
uuuagacccugauuucuuu

SEQ ID NO: 803989 - RNA, 19 nt, Homo sapiens
acaacuaucucuggaaaga

SEQ ID NO: 803990 - RNA, 19 nt, Homo sapiens
gcaaggccuucccaaaucu

SEQ ID NO: 803991 - RNA, 19 nt, Homo sapiens
ccucuggccuggaaacaaa

SEQ ID NO: 803992 - RNA, 19 nt, Homo sapiens
guguagagcuaacggaaga

SEQ ID NO: 803993 - RNA, 19 nt, Homo sapiens
ggagccaaguaugggauua

SEQ ID NO: 803994 - RNA, 19 nt, Homo sapiens
gcacgaagaggaacucauc

SEQ ID NO: 803995 - RNA, 19 nt, Homo sapiens
gagccagacugaagaccaa

SEQ ID NO: 803996 - RNA, 19 nt, Homo sapiens
uagcuucuaucccuacaaa

SEQ ID NO: 803997 - RNA, 19 nt, Homo sapiens
ggggaggggugaagaaaua

SEQ ID NO: 803998 - RNA, 19 nt, Homo sapiens
ggacuauggauuucacauu

SEQ ID NO: 803999 - RNA, 19 nt, Homo sapiens
ggaagaagacagggacuug

SEQ ID NO: 804000 - RNA, 19 nt, Homo sapiens
aaagagaauucugguguug

SEQ ID NO: 804001 - RNA, 19 nt, Homo sapiens
cuacauugcccuucuaguu

SEQ ID NO: 804002 - RNA, 19 nt, Homo sapiens
uaaaguugcugcagcugau

SEQ ID NO: 804003 - RNA, 19 nt, Homo sapiens
gaacaaugagccugcugaa

SEQ ID NO: 804004 - RNA, 19 nt, Homo sapiens
uauagaggcugcuaaaucg

SEQ ID NO: 804005 - RNA, 19 nt, Homo sapiens
aaucuuaccucuaucucaa

SEQ ID NO: 804006 - RNA, 19 nt, Homo sapiens
ugacuuugcugcuggaauc

SEQ ID NO: 804007 - RNA, 19 nt, Homo sapiens
acggaaagcacauagaaua

SEQ ID NO: 804008 - RNA, 19 nt, Homo sapiens
cacagacucuugauauuag

SEQ ID NO: 804009 - RNA, 19 nt, Homo sapiens
gccuagaagugaugaaugu

SEQ ID NO: 804010 - RNA, 19 nt, Homo sapiens
gcacugagacagcugaaag

SEQ ID NO: 804011 - RNA, 19 nt, Homo sapiens
acacagagccuuuguuguc

SEQ ID NO: 804012 - RNA, 19 nt, Homo sapiens
gacagaagcaacuuauuuc

SEQ ID NO: 804013 - RNA, 19 nt, Homo sapiens
ggagcgcuuugcuguagaa

SEQ ID NO: 804014 - RNA, 19 nt, Homo sapiens
cagaugaggaauacuauga

SEQ ID NO: 804015 - RNA, 19 nt, Homo sapiens
gaggauggcagcucagaug

SEQ ID NO: 804016 - RNA, 19 nt, Homo sapiens
agaccuagccugccugauu

SEQ ID NO: 804017 - RNA, 19 nt, Homo sapiens
cagcuacguuuaaauuauc

SEQ ID NO: 804018 - RNA, 19 nt, Homo sapiens
gcccagcuacguuuaaauu

SEQ ID NO: 804019 - RNA, 19 nt, Homo sapiens
gcgacacacaguaaagaua

SEQ ID NO: 804020 - RNA, 19 nt, Homo sapiens
ggagaacucaagacauaug

SEQ ID NO: 804021 - RNA, 19 nt, Homo sapiens
ggacagaccaaagcuuuca

SEQ ID NO: 804022 - RNA, 19 nt, Homo sapiens
gaaggugcacuuugcugaa

SEQ ID NO: 804023 - RNA, 19 nt, Homo sapiens
aaacugcugcuuaaucuug

SEQ ID NO: 804024 - RNA, 19 nt, Homo sapiens
gcucugaucuuaaucuuug

SEQ ID NO: 804025 - RNA, 19 nt, Homo sapiens
gaccaugacaucuauauuu

SEQ ID NO: 804026 - RNA, 19 nt, Homo sapiens
gagauccgcuggccuggaa

SEQ ID NO: 804027 - RNA, 19 nt, Homo sapiens
gcugauggccuagcuguua

SEQ ID NO: 804028 - RNA, 19 nt, Homo sapiens
gaagagccaaggugugaaa

SEQ ID NO: 804029 - RNA, 19 nt, Homo sapiens
gcucuggcuucuucaguuu

SEQ ID NO: 804030 - RNA, 19 nt, Homo sapiens
gggcuuggcuggagguguu

SEQ ID NO: 804031 - RNA, 19 nt, Homo sapiens
cuggagguguuaucauuua

SEQ ID NO: 804032 - RNA, 19 nt, Homo sapiens
caucccagguaucaucuuu

SEQ ID NO: 804033 - RNA, 19 nt, Homo sapiens
ggagguguuaucauuuaua

SEQ ID NO: 804034 - RNA, 19 nt, Homo sapiens
gauagacaaucuccuucug

SEQ ID NO: 804035 - RNA, 19 nt, Homo sapiens
gaucuucguuuaucucaac

SEQ ID NO: 804036 - RNA, 19 nt, Homo sapiens
ggcuggagguguuaucauu

SEQ ID NO: 804037 - RNA, 19 nt, Homo sapiens
gugaggcacugcugguauu

SEQ ID NO: 804038 - RNA, 19 nt, Homo sapiens
ggucaugccuuugcuugga

SEQ ID NO: 804039 - RNA, 19 nt, Homo sapiens
cuacaguuaugcuuggauu

SEQ ID NO: 804040 - RNA, 19 nt, Homo sapiens
gcaugucucuucccaucug

SEQ ID NO: 804041 - RNA, 19 nt, Homo sapiens
cgcaaacaguggccuauug

SEQ ID NO: 804042 - RNA, 19 nt, Homo sapiens
caccaucgcccgaaaguau

SEQ ID NO: 804043 - RNA, 19 nt, Homo sapiens
ucaacaugauccugcugua

SEQ ID NO: 804044 - RNA, 19 nt, Homo sapiens
gaucuuaaucuuugacagu

SEQ ID NO: 804045 - RNA, 19 nt, Homo sapiens
ccgcuggccuggaaccaaa

SEQ ID NO: 804046 - RNA, 19 nt, Homo sapiens
ggaguggaccuaaacuaca

SEQ ID NO: 804047 - RNA, 19 nt, Homo sapiens
accaugacaucuauauuug

SEQ ID NO: 804048 - RNA, 19 nt, Homo sapiens
ggaccaugacaucuauauu

SEQ ID NO: 804049 - RNA, 19 nt, Homo sapiens
agcauacacuacacagaua

SEQ ID NO: 804050 - RNA, 19 nt, Homo sapiens
cuauguagccgccacugua

SEQ ID NO: 804051 - RNA, 19 nt, Homo sapiens
ucccagguaucaucuuuga

SEQ ID NO: 804052 - RNA, 19 nt, Homo sapiens
uucuguagcucugaucuua

SEQ ID NO: 804053 - RNA, 19 nt, Homo sapiens
gugaaaagcagauuugauu

SEQ ID NO: 804054 - RNA, 19 nt, Homo sapiens
gaguggaccuaaacuacag

SEQ ID NO: 804055 - RNA, 19 nt, Homo sapiens
gaagcauacacuacacaga

SEQ ID NO: 804056 - RNA, 19 nt, Homo sapiens
acaguggaguggaccuaaa

SEQ ID NO: 804057 - RNA, 19 nt, Homo sapiens
ggucucugcuggccaccuu

SEQ ID NO: 804058 - RNA, 19 nt, Homo sapiens
gguauuggguggcauuagc

SEQ ID NO: 804059 - RNA, 19 nt, Homo sapiens
gcacucuguuugucuucau

SEQ ID NO: 804060 - RNA, 19 nt, Homo sapiens
gcauuagcuuuguccucaa

SEQ ID NO: 804061 - RNA, 19 nt, Homo sapiens
gcuggagguguuaucauuu

SEQ ID NO: 804062 - RNA, 19 nt, Homo sapiens
ggcaguggcccucuucuca

SEQ ID NO: 804063 - RNA, 19 nt, Homo sapiens
gagccuuggugugguccua

SEQ ID NO: 804064 - RNA, 19 nt, Homo sapiens
ucguuuaucucaacaugau

SEQ ID NO: 804065 - RNA, 19 nt, Homo sapiens
cuucugaucuucguuuauc

SEQ ID NO: 804066 - RNA, 19 nt, Homo sapiens
ggugaucgaaguccuggaa

SEQ ID NO: 804067 - RNA, 19 nt, Homo sapiens
gacagcuacuugggcauga

SEQ ID NO: 804068 - RNA, 19 nt, Homo sapiens
cccagacccugcacacaga

SEQ ID NO: 804069 - RNA, 19 nt, Homo sapiens
ucagcacucuguuugucuu

SEQ ID NO: 804070 - RNA, 19 nt, Homo sapiens
gcagaguggcgacgucuac

SEQ ID NO: 804071 - RNA, 19 nt, Homo sapiens
gcauggcaguggcccucuu

SEQ ID NO: 804072 - RNA, 19 nt, Homo sapiens
cuguagcucugaucuuaau

SEQ ID NO: 804073 - RNA, 19 nt, Homo sapiens
gaccacucauucugacaca

SEQ ID NO: 804074 - RNA, 19 nt, Homo sapiens
cuacaucccagguaucauc

SEQ ID NO: 804075 - RNA, 19 nt, Homo sapiens
aagcauacacuacacagau

SEQ ID NO: 804076 - RNA, 19 nt, Homo sapiens
caagauggcgaggcccaaa

SEQ ID NO: 804077 - RNA, 19 nt, Homo sapiens
gccuuugggucacacucua

SEQ ID NO: 804078 - RNA, 19 nt, Homo sapiens
agacagacacccgcaucua

SEQ ID NO: 804079 - RNA, 19 nt, Homo sapiens
ggacccaguggacuucuuc

SEQ ID NO: 804080 - RNA, 19 nt, Homo sapiens
gaucgaaguccuggaaguc

SEQ ID NO: 804081 - RNA, 19 nt, Homo sapiens
ccucuucucaucaguguug

SEQ ID NO: 804082 - RNA, 19 nt, Homo sapiens
uagcucugaucuuaaucuu

SEQ ID NO: 804083 - RNA, 19 nt, Homo sapiens
caagugggaccggcugcua

SEQ ID NO: 804084 - RNA, 19 nt, Homo sapiens
gggaccaugacaucuauau

SEQ ID NO: 804085 - RNA, 19 nt, Homo sapiens
gacagacacccgcaucuac

SEQ ID NO: 804086 - RNA, 19 nt, Homo sapiens
agaggcggcaguaguguuu

SEQ ID NO: 804087 - RNA, 19 nt, Homo sapiens
acacuacacagauagacaa

SEQ ID NO: 804088 - RNA, 19 nt, Homo sapiens
ucaucuuccuggaguaugu

SEQ ID NO: 804089 - RNA, 19 nt, Homo sapiens
gcccucuucucaucagugu

SEQ ID NO: 804090 - RNA, 19 nt, Homo sapiens
caguggcccucuucucauc

SEQ ID NO: 804091 - RNA, 19 nt, Homo sapiens
ggagcuuccugucccuuuu

SEQ ID NO: 804092 - RNA, 19 nt, Homo sapiens
gagaacggagggagaaggu

SEQ ID NO: 804093 - RNA, 19 nt, Homo sapiens
ggugaggcacugcugguau

SEQ ID NO: 804094 - RNA, 19 nt, Homo sapiens
gcaguggcccucuucucau

SEQ ID NO: 804095 - RNA, 19 nt, Homo sapiens
ccgaauguccgcaaacagu

SEQ ID NO: 804096 - RNA, 19 nt, Homo sapiens
gcauacacuacacagauag

SEQ ID NO: 804097 - RNA, 19 nt, Homo sapiens
gacaguggaguggaccuaa

SEQ ID NO: 804098 - RNA, 19 nt, Homo sapiens
ggucaucuuccgaguccaa

SEQ ID NO: 804099 - RNA, 19 nt, Homo sapiens
caucaagcgcucucugaca

SEQ ID NO: 804100 - RNA, 19 nt, Homo sapiens
cguucuacguccaauacaa

SEQ ID NO: 804101 - RNA, 19 nt, Homo sapiens
gugauacuguggccuccau

SEQ ID NO: 804102 - RNA, 19 nt, Homo sapiens
guggaguggaccuaaacua

SEQ ID NO: 804103 - RNA, 19 nt, Homo sapiens
uauauuugcgcagaucauu

SEQ ID NO: 804104 - RNA, 19 nt, Homo sapiens
ccaucgcccgaaaguauuu

SEQ ID NO: 804105 - RNA, 19 nt, Homo sapiens
ggugguaguagggauggua

SEQ ID NO: 804106 - RNA, 19 nt, Homo sapiens
cuucguuuaucucaacaug

SEQ ID NO: 804107 - RNA, 19 nt, Homo sapiens
ugaucgaaguccuggaagu

SEQ ID NO: 804108 - RNA, 19 nt, Homo sapiens
cacagcagacagcuacuug

SEQ ID NO: 804109 - RNA, 19 nt, Homo sapiens
ccacucauucugacacaca

SEQ ID NO: 804110 - RNA, 19 nt, Homo sapiens
gccuggcggucuucaucuu

SEQ ID NO: 804111 - RNA, 19 nt, Homo sapiens
caacaugauccugcuguac

SEQ ID NO: 804112 - RNA, 19 nt, Homo sapiens
uggagguguuaucauuuau

SEQ ID NO: 804113 - RNA, 19 nt, Homo sapiens
gcaagaggcugcaggaaga

SEQ ID NO: 804114 - RNA, 19 nt, Homo sapiens
caucaaaucugacaagaga

SEQ ID NO: 804115 - RNA, 19 nt, Homo sapiens
ggacacaguucuuugaaau

SEQ ID NO: 804116 - RNA, 19 nt, Homo sapiens
ucagagagcugcaguacaa

SEQ ID NO: 804117 - RNA, 19 nt, Homo sapiens
gagcagaacuaggguugua

SEQ ID NO: 804118 - RNA, 19 nt, Homo sapiens
ccaaggaaaugaccaaaga

SEQ ID NO: 804119 - RNA, 19 nt, Homo sapiens
ccacagaccugcccaagau

SEQ ID NO: 804120 - RNA, 19 nt, Homo sapiens
ggaaggaccucugggcaaa

SEQ ID NO: 804121 - RNA, 19 nt, Homo sapiens
ggaaacacguggccaagau

SEQ ID NO: 804122 - RNA, 19 nt, Homo sapiens
ggagacggauggugccuuu

SEQ ID NO: 804123 - RNA, 19 nt, Homo sapiens
gcgaggaccugauguacaa

SEQ ID NO: 804124 - RNA, 19 nt, Homo sapiens
ggaguugggugcaucuuau

SEQ ID NO: 804125 - RNA, 19 nt, Homo sapiens
gaauuuaccucaccaacag

SEQ ID NO: 804126 - RNA, 19 nt, Homo sapiens
gcaaguccaucaguauuga

SEQ ID NO: 804127 - RNA, 19 nt, Homo sapiens
gagaugaccauuaagguuu

SEQ ID NO: 804128 - RNA, 19 nt, Homo sapiens
gagacgagauggcuguuug

SEQ ID NO: 804129 - RNA, 19 nt, Homo sapiens
guagaaagguagaaaggau

SEQ ID NO: 804130 - RNA, 19 nt, Homo sapiens
gccacgcccugauuucuua

SEQ ID NO: 804131 - RNA, 19 nt, Homo sapiens
guagaaaggauucagauug

SEQ ID NO: 804132 - RNA, 19 nt, Homo sapiens
acaaggaggugcagguaaa

SEQ ID NO: 804133 - RNA, 19 nt, Homo sapiens
gaacagccgcagugaaaga

SEQ ID NO: 804134 - RNA, 19 nt, Homo sapiens
uagaaaggauucagauugu

SEQ ID NO: 804135 - RNA, 19 nt, Homo sapiens
gaaggccagugcuuaacaa

SEQ ID NO: 804136 - RNA, 19 nt, Homo sapiens
gcacucuggccauguguua

SEQ ID NO: 804137 - RNA, 19 nt, Homo sapiens
ccaaauggaucugcugaug

SEQ ID NO: 804138 - RNA, 19 nt, Homo sapiens
ggccagugcuuaacaaauc

SEQ ID NO: 804139 - RNA, 19 nt, Homo sapiens
gagcagagagagccaagaa

SEQ ID NO: 804140 - RNA, 19 nt, Homo sapiens
gcagagaggcagggacuuu

SEQ ID NO: 804141 - RNA, 19 nt, Homo sapiens
ggagaaaacagcaaaauga

SEQ ID NO: 804142 - RNA, 19 nt, Homo sapiens
gggaaaggauguggaaaca

SEQ ID NO: 804143 - RNA, 19 nt, Homo sapiens
cuuaggagguuccaacuug

SEQ ID NO: 804144 - RNA, 19 nt, Homo sapiens
gggacacaguucuuugaaa

SEQ ID NO: 804145 - RNA, 19 nt, Homo sapiens
gacccuaauucaccuuauu

SEQ ID NO: 804146 - RNA, 19 nt, Homo sapiens
gacuauggcuaccugaaga

SEQ ID NO: 804147 - RNA, 19 nt, Homo sapiens
gagggaaacugcugguucu

SEQ ID NO: 804148 - RNA, 19 nt, Homo sapiens
agagagccuuccugucaua

SEQ ID NO: 804149 - RNA, 19 nt, Homo sapiens
gaaaucaagaccagacuag

SEQ ID NO: 804150 - RNA, 19 nt, Homo sapiens
cuagaggccguuaguauuu

SEQ ID NO: 804151 - RNA, 19 nt, Homo sapiens
gcagagagagccaagaagu

SEQ ID NO: 804152 - RNA, 19 nt, Homo sapiens
ggagaaguccaccaagaug

SEQ ID NO: 804153 - RNA, 19 nt, Homo sapiens
aaaugcuggugaucacuua

SEQ ID NO: 804154 - RNA, 19 nt, Homo sapiens
gagcaaacggugagaagga

SEQ ID NO: 804155 - RNA, 19 nt, Homo sapiens
gagaugaggagccagaaga

SEQ ID NO: 804156 - RNA, 19 nt, Homo sapiens
caaggugaguucaagaaag

SEQ ID NO: 804157 - RNA, 19 nt, Homo sapiens
gaggaugccuaaccuaacu

SEQ ID NO: 804158 - RNA, 19 nt, Homo sapiens
gggaggaugccuaaccuaa

SEQ ID NO: 804159 - RNA, 19 nt, Homo sapiens
gggaugccuuugcugauga

SEQ ID NO: 804160 - RNA, 19 nt, Homo sapiens
caaaagaggaugccaguuu

SEQ ID NO: 804161 - RNA, 19 nt, Homo sapiens
ggaaaucaagaccagacua

SEQ ID NO: 804162 - RNA, 19 nt, Homo sapiens
cuggauggcugcaguguug

SEQ ID NO: 804163 - RNA, 19 nt, Homo sapiens
guaguguggucuccauguu

SEQ ID NO: 804164 - RNA, 19 nt, Homo sapiens
caacaaggaggugcaggua

SEQ ID NO: 804165 - RNA, 19 nt, Homo sapiens
ccaaagaggcccugccaau

SEQ ID NO: 804166 - RNA, 19 nt, Homo sapiens
ccagaggccugugugaaug

SEQ ID NO: 804167 - RNA, 19 nt, Homo sapiens
gggccuggcugaugugauc

SEQ ID NO: 804168 - RNA, 19 nt, Homo sapiens
ucaggcugcuugaggagua

SEQ ID NO: 804169 - RNA, 19 nt, Homo sapiens
ugauggaccuggccaagga

SEQ ID NO: 804170 - RNA, 19 nt, Homo sapiens
ucaaggaguccgucucauu

SEQ ID NO: 804171 - RNA, 19 nt, Homo sapiens
gagaggaugcggagagguu

SEQ ID NO: 804172 - RNA, 19 nt, Homo sapiens
gcuggcacgugcucaagaa

SEQ ID NO: 804173 - RNA, 19 nt, Homo sapiens
ggaauuuaccucaccaaca

SEQ ID NO: 804174 - RNA, 19 nt, Homo sapiens
caaggaguccgucucauuc

SEQ ID NO: 804175 - RNA, 19 nt, Homo sapiens
gggaugugaugauaaagca

SEQ ID NO: 804176 - RNA, 19 nt, Homo sapiens
gguaucaccucaucucacu

SEQ ID NO: 804177 - RNA, 19 nt, Homo sapiens
ccaaggaccggaagaagga

SEQ ID NO: 804178 - RNA, 19 nt, Homo sapiens
gacaugcggcucaagauug

SEQ ID NO: 804179 - RNA, 19 nt, Homo sapiens
aaagaggcccugccaauca

SEQ ID NO: 804180 - RNA, 19 nt, Homo sapiens
gaaccucagcccagagaga

SEQ ID NO: 804181 - RNA, 19 nt, Homo sapiens
caaggccucugcauauucu

SEQ ID NO: 804182 - RNA, 19 nt, Homo sapiens
gauggugccuuugaagcaa

SEQ ID NO: 804183 - RNA, 19 nt, Homo sapiens
cagaggcccuuugcaguug

SEQ ID NO: 804184 - RNA, 19 nt, Homo sapiens
ggccugccuuccauucuuu

SEQ ID NO: 804185 - RNA, 19 nt, Homo sapiens
gggaguugggugcaucuua

SEQ ID NO: 804186 - RNA, 19 nt, Homo sapiens
gagaccagcacaggacaua

SEQ ID NO: 804187 - RNA, 19 nt, Homo sapiens
gagcugcaguacaaucaca

SEQ ID NO: 804188 - RNA, 19 nt, Homo sapiens
auagagagccuuccuguca

SEQ ID NO: 804189 - RNA, 19 nt, Homo sapiens
ugugacggcugccaaguug

SEQ ID NO: 804190 - RNA, 19 nt, Homo sapiens
ccagaggcccuuugcaguu

SEQ ID NO: 804191 - RNA, 19 nt, Homo sapiens
guagcaaaguccuguuucu

SEQ ID NO: 804192 - RNA, 19 nt, Homo sapiens
uggcugcaguguuguacua

SEQ ID NO: 804193 - RNA, 19 nt, Homo sapiens
cuugggaugugaugauaaa

SEQ ID NO: 804194 - RNA, 19 nt, Homo sapiens
gaacuacuuccgccacauc

SEQ ID NO: 804195 - RNA, 19 nt, Homo sapiens
ucauuccuguugucacuuu

SEQ ID NO: 804196 - RNA, 19 nt, Homo sapiens
aaauggaucugcugauggu

SEQ ID NO: 804197 - RNA, 19 nt, Homo sapiens
cgacaugcggcucaagauu

SEQ ID NO: 804198 - RNA, 19 nt, Homo sapiens
gaaugugugcaccugcuuu

SEQ ID NO: 804199 - RNA, 19 nt, Homo sapiens
ggaaggccagugcuuaaca

SEQ ID NO: 804200 - RNA, 19 nt, Homo sapiens
gccgugauccugggaauuu

SEQ ID NO: 804201 - RNA, 19 nt, Homo sapiens
gaugaggccaccugggaaa

SEQ ID NO: 804202 - RNA, 19 nt, Homo sapiens
gcagggcccaacaugauga

SEQ ID NO: 804203 - RNA, 19 nt, Homo sapiens
ggacccuaauucaccuuau

SEQ ID NO: 804204 - RNA, 19 nt, Homo sapiens
cugcucagcuguucuuaca

SEQ ID NO: 804205 - RNA, 19 nt, Homo sapiens
acaaggaagagcagaacua

SEQ ID NO: 804206 - RNA, 19 nt, Homo sapiens
gguagaaaggauucagauu

SEQ ID NO: 804207 - RNA, 19 nt, Homo sapiens
cuugaggaguaauggguua

SEQ ID NO: 804208 - RNA, 19 nt, Homo sapiens
ccuagaggccguuaguauu

SEQ ID NO: 804209 - RNA, 19 nt, Homo sapiens
aggaacagccgcagugaaa

SEQ ID NO: 804210 - RNA, 19 nt, Homo sapiens
uggagcagaucgaguggaa

SEQ ID NO: 804211 - RNA, 19 nt, Homo sapiens
caaagaggcccugccaauc

SEQ ID NO: 804212 - RNA, 19 nt, Homo sapiens
ggaccuggccaaggaaaug

SEQ ID NO: 804213 - RNA, 19 nt, Homo sapiens
ucaaauggcugcauacuua

SEQ ID NO: 804214 - RNA, 19 nt, Homo sapiens
gaaacaaugugguggaaua

SEQ ID NO: 804215 - RNA, 19 nt, Homo sapiens
gaacgaggcugauggguau

SEQ ID NO: 804216 - RNA, 19 nt, Homo sapiens
gcaaguagauaguacauug

SEQ ID NO: 804217 - RNA, 19 nt, Homo sapiens
ggaaauugaugaacaaaga

SEQ ID NO: 804218 - RNA, 19 nt, Homo sapiens
gaccauaaaucccuaauga

SEQ ID NO: 804219 - RNA, 19 nt, Homo sapiens
gagaagcccuagauaguaa

SEQ ID NO: 804220 - RNA, 19 nt, Homo sapiens
uauaagagcugcagaguug

SEQ ID NO: 804221 - RNA, 19 nt, Homo sapiens
ccaagggacuguauuaauu

SEQ ID NO: 804222 - RNA, 19 nt, Homo sapiens
ccagauaccuugucaauag

SEQ ID NO: 804223 - RNA, 19 nt, Homo sapiens
gcaacacacucucuugaaa

SEQ ID NO: 804224 - RNA, 19 nt, Homo sapiens
gaacagagcuuuugcagau

SEQ ID NO: 804225 - RNA, 19 nt, Homo sapiens
ccaagaauuuccagugaua

SEQ ID NO: 804226 - RNA, 19 nt, Homo sapiens
ggaaggcuaugucuuauca

SEQ ID NO: 804227 - RNA, 19 nt, Homo sapiens
gcugauaaauguacuguug

SEQ ID NO: 804228 - RNA, 19 nt, Homo sapiens
caacagcgauacaaguuug

SEQ ID NO: 804229 - RNA, 19 nt, Homo sapiens
ggaaacaguugcuugaagu

SEQ ID NO: 804230 - RNA, 19 nt, Homo sapiens
gaaagaggaguacaccuaa

SEQ ID NO: 804231 - RNA, 19 nt, Homo sapiens
gaaaguaucaucaguccuu

SEQ ID NO: 804232 - RNA, 19 nt, Homo sapiens
gaacaggaagcuauacuga

SEQ ID NO: 804233 - RNA, 19 nt, Homo sapiens
gaagaaaguagcaguguug

SEQ ID NO: 804234 - RNA, 19 nt, Homo sapiens
gaacagugccauuuauaau

SEQ ID NO: 804235 - RNA, 19 nt, Homo sapiens
guucuagcauuuccaauuu

SEQ ID NO: 804236 - RNA, 19 nt, Homo sapiens
ugagcuagauacuguguua

SEQ ID NO: 804237 - RNA, 19 nt, Homo sapiens
ccagaaagcauaacugauu

SEQ ID NO: 804238 - RNA, 19 nt, Homo sapiens
ccaggaagguaucuaugua

SEQ ID NO: 804239 - RNA, 19 nt, Homo sapiens
gaagaaaugcuagaaguga

SEQ ID NO: 804240 - RNA, 19 nt, Homo sapiens
gcucacaaauaagguaaua

SEQ ID NO: 804241 - RNA, 19 nt, Homo sapiens
ccaagaacuuugugagauu

SEQ ID NO: 804242 - RNA, 19 nt, Homo sapiens
gagcuuccaugcuugcuuu

SEQ ID NO: 804243 - RNA, 19 nt, Homo sapiens
ggaacagugccauuuauaa

SEQ ID NO: 804244 - RNA, 19 nt, Homo sapiens
ggagagaggugggcaagga

SEQ ID NO: 804245 - RNA, 19 nt, Homo sapiens
uaacuagucuuaaccaaag

SEQ ID NO: 804246 - RNA, 19 nt, Homo sapiens
ggaagaaaguagcaguguu

SEQ ID NO: 804247 - RNA, 19 nt, Homo sapiens
gggauucagucuaaacaaa

SEQ ID NO: 804248 - RNA, 19 nt, Homo sapiens
gauccaagggacuguauua

SEQ ID NO: 804249 - RNA, 19 nt, Homo sapiens
gaacaguuaucaucuucau

SEQ ID NO: 804250 - RNA, 19 nt, Homo sapiens
gcugagaugucacaaacaa

SEQ ID NO: 804251 - RNA, 19 nt, Homo sapiens
ccacuuaacagccauguaa

SEQ ID NO: 804252 - RNA, 19 nt, Homo sapiens
aagcauaacugauucuaga

SEQ ID NO: 804253 - RNA, 19 nt, Homo sapiens
guacaugaagcguugaaua

SEQ ID NO: 804254 - RNA, 19 nt, Homo sapiens
gcugugagguucuagcauu

SEQ ID NO: 804255 - RNA, 19 nt, Homo sapiens
aauaaccacuucagacuuu

SEQ ID NO: 804256 - RNA, 19 nt, Homo sapiens
ccauaaaucccuaaugaaa

SEQ ID NO: 804257 - RNA, 19 nt, Homo sapiens
gagugaaucugaucucugu

SEQ ID NO: 804258 - RNA, 19 nt, Homo sapiens
ugaaagaguugcaggacaa

SEQ ID NO: 804259 - RNA, 19 nt, Homo sapiens
caugaacacugaaauggaa

SEQ ID NO: 804260 - RNA, 19 nt, Homo sapiens
gaacugaguauccacaaug

SEQ ID NO: 804261 - RNA, 19 nt, Homo sapiens
uaaaccagauccauuaauc

SEQ ID NO: 804262 - RNA, 19 nt, Homo sapiens
ggaauugauuugaaagaca

SEQ ID NO: 804263 - RNA, 19 nt, Homo sapiens
ugaaugaagcagaugauua

SEQ ID NO: 804264 - RNA, 19 nt, Homo sapiens
cuggauggguacuuuauua

SEQ ID NO: 804265 - RNA, 19 nt, Homo sapiens
ugaaugaccaugacaauga

SEQ ID NO: 804266 - RNA, 19 nt, Homo sapiens
ugaagcagaugauuacuag

SEQ ID NO: 804267 - RNA, 19 nt, Homo sapiens
aaaaugaugucgccacuua

SEQ ID NO: 804268 - RNA, 19 nt, Homo sapiens
ucggagagcugcauauuca

SEQ ID NO: 804269 - RNA, 19 nt, Homo sapiens
ggaagguaucuauguauuu

SEQ ID NO: 804270 - RNA, 19 nt, Homo sapiens
gagacagccuuaucagugu

SEQ ID NO: 804271 - RNA, 19 nt, Homo sapiens
auaaaggccuggcuacuga

SEQ ID NO: 804272 - RNA, 19 nt, Homo sapiens
caagggacuguauuaauuu

SEQ ID NO: 804273 - RNA, 19 nt, Homo sapiens
gaaugaagcagaugauuac

SEQ ID NO: 804274 - RNA, 19 nt, Homo sapiens
caauagcaacuucuaauga

SEQ ID NO: 804275 - RNA, 19 nt, Homo sapiens
gcgaaggaauggaugaugu

SEQ ID NO: 804276 - RNA, 19 nt, Homo sapiens
uaauaucaguguuggaaga

SEQ ID NO: 804277 - RNA, 19 nt, Homo sapiens
ucagauggauuaacuaguc

SEQ ID NO: 804278 - RNA, 19 nt, Homo sapiens
cucauucugugcuauauua

SEQ ID NO: 804279 - RNA, 19 nt, Homo sapiens
gaaacaguugcuugaagua

SEQ ID NO: 804280 - RNA, 19 nt, Homo sapiens
aaauagagccgcaagcaaa

SEQ ID NO: 804281 - RNA, 19 nt, Homo sapiens
gaaaggaugaaguaaauac

SEQ ID NO: 804282 - RNA, 19 nt, Homo sapiens
caaccgaguuucugguaau

SEQ ID NO: 804283 - RNA, 19 nt, Homo sapiens
ccuauauucuccuccauuu

SEQ ID NO: 804284 - RNA, 19 nt, Homo sapiens
gaaugaccaugacaaugau

SEQ ID NO: 804285 - RNA, 19 nt, Homo sapiens
gcugugaucuuauucuuac

SEQ ID NO: 804286 - RNA, 19 nt, Homo sapiens
ggagagagugaacugagua

SEQ ID NO: 804287 - RNA, 19 nt, Homo sapiens
cuaaugaaaggaugaagua

SEQ ID NO: 804288 - RNA, 19 nt, Homo sapiens
gaaauuucaguguggguuu

SEQ ID NO: 804289 - RNA, 19 nt, Homo sapiens
aagcaaacauuucaaacug

SEQ ID NO: 804290 - RNA, 19 nt, Homo sapiens
agaaacgacuacagaguga

SEQ ID NO: 804291 - RNA, 19 nt, Homo sapiens
cagcucacuuaaauugaua

SEQ ID NO: 804292 - RNA, 19 nt, Homo sapiens
aaguaugacugccagauuu

SEQ ID NO: 804293 - RNA, 19 nt, Homo sapiens
gcccuuaguugucaugguu

SEQ ID NO: 804294 - RNA, 19 nt, Homo sapiens
aggaauggaugauguuuau

SEQ ID NO: 804295 - RNA, 19 nt, Homo sapiens
gacaaucuacagacucaua

SEQ ID NO: 804296 - RNA, 19 nt, Homo sapiens
gaauccaacucagugaaga

SEQ ID NO: 804297 - RNA, 19 nt, Homo sapiens
uagggcauguuucagcuua

SEQ ID NO: 804298 - RNA, 19 nt, Homo sapiens
guagauggcugagcuaaaa

SEQ ID NO: 804299 - RNA, 19 nt, Homo sapiens
guucagcucacuuaaauug

SEQ ID NO: 804300 - RNA, 19 nt, Homo sapiens
cagcacagucuuccagaua

SEQ ID NO: 804301 - RNA, 19 nt, Homo sapiens
caacaagggcuacaucaag

SEQ ID NO: 804302 - RNA, 19 nt, Homo sapiens
ggacaaauucugagucucu

SEQ ID NO: 804303 - RNA, 19 nt, Homo sapiens
ugacaaugaugccaauauc

SEQ ID NO: 804304 - RNA, 19 nt, Homo sapiens
aagggaaggcuaugucuua

SEQ ID NO: 804305 - RNA, 19 nt, Homo sapiens
gggcugagaugucacaaac

SEQ ID NO: 804306 - RNA, 19 nt, Homo sapiens
uagaagggcugagauguca

SEQ ID NO: 804307 - RNA, 19 nt, Homo sapiens
aaacuaaaccagauccauu

SEQ ID NO: 804308 - RNA, 19 nt, Homo sapiens
gaauuacucagcccuguug

SEQ ID NO: 804309 - RNA, 19 nt, Homo sapiens
gggaauagacagcuuagug

SEQ ID NO: 804310 - RNA, 19 nt, Homo sapiens
ugccacauccggagaauua

SEQ ID NO: 804311 - RNA, 19 nt, Homo sapiens
ggaggaaaugguaugcaua

SEQ ID NO: 804312 - RNA, 19 nt, Homo sapiens
guaaguuucuaucaucauc

SEQ ID NO: 804313 - RNA, 19 nt, Homo sapiens
gacaugcacugccuaauua

SEQ ID NO: 804314 - RNA, 19 nt, Homo sapiens
ggaggaauguggaaaguuu

SEQ ID NO: 804315 - RNA, 19 nt, Homo sapiens
guacagaacucucccauuc

SEQ ID NO: 804316 - RNA, 19 nt, Homo sapiens
gauggaaacuucacaauuc

SEQ ID NO: 804317 - RNA, 19 nt, Homo sapiens
gaugaaaugugccuugaaa

SEQ ID NO: 804318 - RNA, 19 nt, Homo sapiens
gaagguggauuugcuauug

SEQ ID NO: 804319 - RNA, 19 nt, Homo sapiens
caaacaggcuuuacagaga

SEQ ID NO: 804320 - RNA, 19 nt, Homo sapiens
gauaauuucuccaaacuca

SEQ ID NO: 804321 - RNA, 19 nt, Homo sapiens
guggaucucuuaugaauga

SEQ ID NO: 804322 - RNA, 19 nt, Homo sapiens
ggugaaaucugagaagaaa

SEQ ID NO: 804323 - RNA, 19 nt, Homo sapiens
caagagagaaauccagaua

SEQ ID NO: 804324 - RNA, 19 nt, Homo sapiens
gaguggaucucuuaugaau

SEQ ID NO: 804325 - RNA, 19 nt, Homo sapiens
caagaaagagugcccaauu

SEQ ID NO: 804326 - RNA, 19 nt, Homo sapiens
cauuuaagcuacucaagaa

SEQ ID NO: 804327 - RNA, 19 nt, Homo sapiens
gaaugaagugcuccagaua

SEQ ID NO: 804328 - RNA, 19 nt, Homo sapiens
caucaucucuguuucuuca

SEQ ID NO: 804329 - RNA, 19 nt, Homo sapiens
ggacucaaaucuccugaca

SEQ ID NO: 804330 - RNA, 19 nt, Homo sapiens
ccucggaccucucaacaaa

SEQ ID NO: 804331 - RNA, 19 nt, Homo sapiens
cugaagaacugcuaaacaa

SEQ ID NO: 804332 - RNA, 19 nt, Homo sapiens
ccaaggcuauuuaaucuca

SEQ ID NO: 804333 - RNA, 19 nt, Homo sapiens
ccacagcccugcaucaaca

SEQ ID NO: 804334 - RNA, 19 nt, Homo sapiens
aaagucagguggcaauuug

SEQ ID NO: 804335 - RNA, 19 nt, Homo sapiens
cuacuucacuuugccauuu

SEQ ID NO: 804336 - RNA, 19 nt, Homo sapiens
gaaagucagguggcaauuu

SEQ ID NO: 804337 - RNA, 19 nt, Homo sapiens
gggagucaaugcaguagaa

SEQ ID NO: 804338 - RNA, 19 nt, Homo sapiens
guaaagucaucaucucugu

SEQ ID NO: 804339 - RNA, 19 nt, Homo sapiens
cagaaauggucaaccugua

SEQ ID NO: 804340 - RNA, 19 nt, Homo sapiens
agagaaauccagauaauga

SEQ ID NO: 804341 - RNA, 19 nt, Homo sapiens
aaacaggcuuuacagagaa

SEQ ID NO: 804342 - RNA, 19 nt, Homo sapiens
agagagaaauccagauaau

SEQ ID NO: 804343 - RNA, 19 nt, Homo sapiens
ucacuuguaucacuccaaa

SEQ ID NO: 804344 - RNA, 19 nt, Homo sapiens
aaugacaaguaccuaguua

SEQ ID NO: 804345 - RNA, 19 nt, Homo sapiens
gcacaggcguauucucagu

SEQ ID NO: 804346 - RNA, 19 nt, Homo sapiens
acacaacgcuguccuaucg

SEQ ID NO: 804347 - RNA, 19 nt, Homo sapiens
ggaaccagacccugacaaa

SEQ ID NO: 804348 - RNA, 19 nt, Homo sapiens
gcucuuggauguuuguugu

SEQ ID NO: 804349 - RNA, 19 nt, Homo sapiens
gacaagcaaugggaugaaa

SEQ ID NO: 804350 - RNA, 19 nt, Homo sapiens
gaagcgccaccaacaaauu

SEQ ID NO: 804351 - RNA, 19 nt, Homo sapiens
gaguagcggugauguaugg

SEQ ID NO: 804352 - RNA, 19 nt, Homo sapiens
ggagauuucuagaguggau

SEQ ID NO: 804353 - RNA, 19 nt, Homo sapiens
uuucauuccucuucaagua

SEQ ID NO: 804354 - RNA, 19 nt, Homo sapiens
aacaacagcugaugacuca

SEQ ID NO: 804355 - RNA, 19 nt, Homo sapiens
ugacacgcauauuccuaua

SEQ ID NO: 804356 - RNA, 19 nt, Homo sapiens
ccugauaauucucgauauu

SEQ ID NO: 804357 - RNA, 19 nt, Homo sapiens
ucaaugcaguagaagauga

SEQ ID NO: 804358 - RNA, 19 nt, Homo sapiens
gaggugaaaucugagaaga

SEQ ID NO: 804359 - RNA, 19 nt, Homo sapiens
ucaaaucuccugacacuuc

SEQ ID NO: 804360 - RNA, 19 nt, Homo sapiens
cgagccgucucaaguuuaa

SEQ ID NO: 804361 - RNA, 19 nt, Homo sapiens
gcagacauuugggcucuug

SEQ ID NO: 804362 - RNA, 19 nt, Homo sapiens
gggaagugcucauucugau

SEQ ID NO: 804363 - RNA, 19 nt, Homo sapiens
acaaaaggccggauauuua

SEQ ID NO: 804364 - RNA, 19 nt, Homo sapiens
gccgagccgucucaaguuu

SEQ ID NO: 804365 - RNA, 19 nt, Homo sapiens
ccugaccucuugccuauga

SEQ ID NO: 804366 - RNA, 19 nt, Homo sapiens
aagaaagagugcccaauuc

SEQ ID NO: 804367 - RNA, 19 nt, Homo sapiens
gggaugaaaugugccuuga

SEQ ID NO: 804368 - RNA, 19 nt, Homo sapiens
gcaaacaucccgagaagcu

SEQ ID NO: 804369 - RNA, 19 nt, Homo sapiens
cuagaaaccaucgguauuu

SEQ ID NO: 804370 - RNA, 19 nt, Homo sapiens
aaagucaucaucucuguuu

SEQ ID NO: 804371 - RNA, 19 nt, Homo sapiens
ucuccgaggugaaaucuga

SEQ ID NO: 804372 - RNA, 19 nt, Homo sapiens
gccacuauguccuguguga

SEQ ID NO: 804373 - RNA, 19 nt, Homo sapiens
gaaauuuagcagauucuuc

SEQ ID NO: 804374 - RNA, 19 nt, Homo sapiens
uaacuagacuaccuuuacu

SEQ ID NO: 804375 - RNA, 19 nt, Homo sapiens
caaacucacagcugaagaa

SEQ ID NO: 804376 - RNA, 19 nt, Homo sapiens
ugacgauaauuucuccaaa

SEQ ID NO: 804377 - RNA, 19 nt, Homo sapiens
ggaagagggccacuguuca

SEQ ID NO: 804378 - RNA, 19 nt, Homo sapiens
ccacagagacuucaauugc

SEQ ID NO: 804379 - RNA, 19 nt, Homo sapiens
agacaugcacugccuaauu

SEQ ID NO: 804380 - RNA, 19 nt, Homo sapiens
caaaugaaguguuuuccuu

SEQ ID NO: 804381 - RNA, 19 nt, Homo sapiens
gaaugacaaguaccuaguu

SEQ ID NO: 804382 - RNA, 19 nt, Homo sapiens
gaucccaggcuuucaauca

SEQ ID NO: 804383 - RNA, 19 nt, Homo sapiens
acucacagcugaagaacug

SEQ ID NO: 804384 - RNA, 19 nt, Homo sapiens
agaaugaagugcuccagau

SEQ ID NO: 804385 - RNA, 19 nt, Homo sapiens
gauaaugagggaucuuuca

SEQ ID NO: 804386 - RNA, 19 nt, Homo sapiens
acaaguaccuaguuaacca

SEQ ID NO: 804387 - RNA, 19 nt, Homo sapiens
cauuugggcucuuggaugu

SEQ ID NO: 804388 - RNA, 19 nt, Homo sapiens
gaauauuguggguuacauu

SEQ ID NO: 804389 - RNA, 19 nt, Homo sapiens
gggcacaggcguauucuca

SEQ ID NO: 804390 - RNA, 19 nt, Homo sapiens
uguccuacuucucauuuaa

SEQ ID NO: 804391 - RNA, 19 nt, Homo sapiens
gcaaaaucaucacuacgaa

SEQ ID NO: 804392 - RNA, 19 nt, Homo sapiens
gaggaggaauguggaaagu

SEQ ID NO: 804393 - RNA, 19 nt, Homo sapiens
uuaagcuacucaagaaaga

SEQ ID NO: 804394 - RNA, 19 nt, Homo sapiens
caagacaugcacugccuaa

SEQ ID NO: 804395 - RNA, 19 nt, Homo sapiens
gcgauugacacgcauauuc

SEQ ID NO: 804396 - RNA, 19 nt, Homo sapiens
gacaacagccaaagguuca

SEQ ID NO: 804397 - RNA, 19 nt, Homo sapiens
gcaguagaagaugagauua

SEQ ID NO: 804398 - RNA, 19 nt, Homo sapiens
ggaagguggauuugcuauu

SEQ ID NO: 804399 - RNA, 19 nt, Homo sapiens
ccuuggaucucuuuucuua

SEQ ID NO: 804400 - RNA, 19 nt, Homo sapiens
gacgauaauuucuccaaac

SEQ ID NO: 804401 - RNA, 19 nt, Homo sapiens
cuacuucucauuuaagcua

SEQ ID NO: 804402 - RNA, 19 nt, Homo sapiens
cuacgaaggcagacauuug

SEQ ID NO: 804403 - RNA, 19 nt, Homo sapiens
augaagugcuccagauauu

SEQ ID NO: 804404 - RNA, 19 nt, Homo sapiens
gagagaaauccagauaaug

SEQ ID NO: 804405 - RNA, 19 nt, Homo sapiens
gcuauuuaaucucacuugu

SEQ ID NO: 804406 - RNA, 19 nt, Homo sapiens
gugccuguuucaagaauga

SEQ ID NO: 804407 - RNA, 19 nt, Homo sapiens
caaggacuuugccaagcuu

SEQ ID NO: 804408 - RNA, 19 nt, Homo sapiens
cguggaaucccuuugauga

SEQ ID NO: 804409 - RNA, 19 nt, Homo sapiens
caaucagccuggccuuuua

SEQ ID NO: 804410 - RNA, 19 nt, Homo sapiens
gaagagggccacuguucag

SEQ ID NO: 804411 - RNA, 19 nt, Homo sapiens
gaaauggucaaccuguaca

SEQ ID NO: 804412 - RNA, 19 nt, Homo sapiens
caguagaagaugagauuaa

SEQ ID NO: 804413 - RNA, 19 nt, Homo sapiens
gaacggagaucagaauaga

SEQ ID NO: 804414 - RNA, 19 nt, Homo sapiens
gugagaaacuaacuacuua

SEQ ID NO: 804415 - RNA, 19 nt, Homo sapiens
gauaaggacugaucaugaa

SEQ ID NO: 804416 - RNA, 19 nt, Homo sapiens
gagauaaguugucagauug

SEQ ID NO: 804417 - RNA, 19 nt, Homo sapiens
ucaccugucugcaguauua

SEQ ID NO: 804418 - RNA, 19 nt, Homo sapiens
ggaaaucugugcauucguu

SEQ ID NO: 804419 - RNA, 19 nt, Homo sapiens
ggacaagacuuaccaaagg

SEQ ID NO: 804420 - RNA, 19 nt, Homo sapiens
gcauaaagcuaaagugaag

SEQ ID NO: 804421 - RNA, 19 nt, Homo sapiens
gaugguagaugaaguacuu

SEQ ID NO: 804422 - RNA, 19 nt, Homo sapiens
ugaagaaguuagagcuuua

SEQ ID NO: 804423 - RNA, 19 nt, Homo sapiens
gauaugacacugcagaaua

SEQ ID NO: 804424 - RNA, 19 nt, Homo sapiens
gggacaaucugacuggaua

SEQ ID NO: 804425 - RNA, 19 nt, Homo sapiens
uuacauagcuucagaccuu

SEQ ID NO: 804426 - RNA, 19 nt, Homo sapiens
gagaacuccuuaauggaua

SEQ ID NO: 804427 - RNA, 19 nt, Homo sapiens
uaacagauggguaacuuua

SEQ ID NO: 804428 - RNA, 19 nt, Homo sapiens
guacugauuugcacuuuga

SEQ ID NO: 804429 - RNA, 19 nt, Homo sapiens
gggaagagcccauaacaga

SEQ ID NO: 804430 - RNA, 19 nt, Homo sapiens
aaccuaaccucgacuauuu

SEQ ID NO: 804431 - RNA, 19 nt, Homo sapiens
ggaagauuguacagcauaa

SEQ ID NO: 804432 - RNA, 19 nt, Homo sapiens
gaucauaucuaaccuacag

SEQ ID NO: 804433 - RNA, 19 nt, Homo sapiens
gacaugaucuuuugcaaua

SEQ ID NO: 804434 - RNA, 19 nt, Homo sapiens
agagauaaguugucagauu

SEQ ID NO: 804435 - RNA, 19 nt, Homo sapiens
gcggugcucuguuauauau

SEQ ID NO: 804436 - RNA, 19 nt, Homo sapiens
gaaaaugcuugguuaugua

SEQ ID NO: 804437 - RNA, 19 nt, Homo sapiens
gaggaaagcucaguacaag

SEQ ID NO: 804438 - RNA, 19 nt, Homo sapiens
ugagaucacugccagcuuu

SEQ ID NO: 804439 - RNA, 19 nt, Homo sapiens
ggaccaugcucuuccagaa

SEQ ID NO: 804440 - RNA, 19 nt, Homo sapiens
ucagaaagcuucgguggaa

SEQ ID NO: 804441 - RNA, 19 nt, Homo sapiens
gaacucaguguccaguaua

SEQ ID NO: 804442 - RNA, 19 nt, Homo sapiens
guacaagcuuugauagaug

SEQ ID NO: 804443 - RNA, 19 nt, Homo sapiens
guucugaccugcaacuuga

SEQ ID NO: 804444 - RNA, 19 nt, Homo sapiens
gaaaauaagccuuuaguug

SEQ ID NO: 804445 - RNA, 19 nt, Homo sapiens
gcacuuugauucacaccuu

SEQ ID NO: 804446 - RNA, 19 nt, Homo sapiens
guaaagugauuggaaaugu

SEQ ID NO: 804447 - RNA, 19 nt, Homo sapiens
gaaaugcaaagcuuuaugu

SEQ ID NO: 804448 - RNA, 19 nt, Homo sapiens
gguggaaggucacuauuuc

SEQ ID NO: 804449 - RNA, 19 nt, Homo sapiens
gcaggaugauuuacugaug

SEQ ID NO: 804450 - RNA, 19 nt, Homo sapiens
acacaugagcucuuaguua

SEQ ID NO: 804451 - RNA, 19 nt, Homo sapiens
uaaauggaaugcucugaau

SEQ ID NO: 804452 - RNA, 19 nt, Homo sapiens
guuuggaccucucguagua

SEQ ID NO: 804453 - RNA, 19 nt, Homo sapiens
uuucauaucuggucaaugu

SEQ ID NO: 804454 - RNA, 19 nt, Homo sapiens
cuacagaaaucuaccuaau

SEQ ID NO: 804455 - RNA, 19 nt, Homo sapiens
gaagagcccauaacagaau

SEQ ID NO: 804456 - RNA, 19 nt, Homo sapiens
gcuaggauaucaauuaaac

SEQ ID NO: 804457 - RNA, 19 nt, Homo sapiens
gcaauacuguuuguacugu

SEQ ID NO: 804458 - RNA, 19 nt, Homo sapiens
uaaucaaccugaaagaaga

SEQ ID NO: 804459 - RNA, 19 nt, Homo sapiens
gaacuggagcaugcacuua

SEQ ID NO: 804460 - RNA, 19 nt, Homo sapiens
ugacaaacggguugaagua

SEQ ID NO: 804461 - RNA, 19 nt, Homo sapiens
ggacaagccagugcaaauu

SEQ ID NO: 804462 - RNA, 19 nt, Homo sapiens
ccaggaacagauaauauua

SEQ ID NO: 804463 - RNA, 19 nt, Homo sapiens
uaagaaaguuguguaaugg

SEQ ID NO: 804464 - RNA, 19 nt, Homo sapiens
guagaaugguacugauuug

SEQ ID NO: 804465 - RNA, 19 nt, Homo sapiens
acaaaccgcuggugaagga

SEQ ID NO: 804466 - RNA, 19 nt, Homo sapiens
gcacuuaacagucgaucuu

SEQ ID NO: 804467 - RNA, 19 nt, Homo sapiens
uguauuaacuugcugaugu

SEQ ID NO: 804468 - RNA, 19 nt, Homo sapiens
gggagggacuuucauaucu

SEQ ID NO: 804469 - RNA, 19 nt, Homo sapiens
caauaguaauguagccuuu

SEQ ID NO: 804470 - RNA, 19 nt, Homo sapiens
ugaccaggauugugaaaga

SEQ ID NO: 804471 - RNA, 19 nt, Homo sapiens
uaucuaaccuacagaaauc

SEQ ID NO: 804472 - RNA, 19 nt, Homo sapiens
caucuuagcuuacaaacac

SEQ ID NO: 804473 - RNA, 19 nt, Homo sapiens
caacaauucagcaaucauu

SEQ ID NO: 804474 - RNA, 19 nt, Homo sapiens
gaacgcuacucuagaaagg

SEQ ID NO: 804475 - RNA, 19 nt, Homo sapiens
cuaaagaaaugucuguaca

SEQ ID NO: 804476 - RNA, 19 nt, Homo sapiens
cuucagaccuuguccagaa

SEQ ID NO: 804477 - RNA, 19 nt, Homo sapiens
gauagaugccugccuagaa

SEQ ID NO: 804478 - RNA, 19 nt, Homo sapiens
acagauggguaacuuuauu

SEQ ID NO: 804479 - RNA, 19 nt, Homo sapiens
ucacaacaauucagcaauc

SEQ ID NO: 804480 - RNA, 19 nt, Homo sapiens
ccucagggcuuacaguguu

SEQ ID NO: 804481 - RNA, 19 nt, Homo sapiens
cauaugugcuggaugauca

SEQ ID NO: 804482 - RNA, 19 nt, Homo sapiens
acaaacggguugaaguaaa

SEQ ID NO: 804483 - RNA, 19 nt, Homo sapiens
gcugaaagcaagucuuauu

SEQ ID NO: 804484 - RNA, 19 nt, Homo sapiens
ucuggucaaugucauaaua

SEQ ID NO: 804485 - RNA, 19 nt, Homo sapiens
gugaauagaugguggaaac

SEQ ID NO: 804486 - RNA, 19 nt, Homo sapiens
gcugaaaguugugaauaga

SEQ ID NO: 804487 - RNA, 19 nt, Homo sapiens
caggcuaggauaucaauua

SEQ ID NO: 804488 - RNA, 19 nt, Homo sapiens
ggauaacccuucaugaaaa

SEQ ID NO: 804489 - RNA, 19 nt, Homo sapiens
gugaguagguggcagaugu

SEQ ID NO: 804490 - RNA, 19 nt, Homo sapiens
ccaguauaaugcagaauug

SEQ ID NO: 804491 - RNA, 19 nt, Homo sapiens
cagucgaucuucucucuuu

SEQ ID NO: 804492 - RNA, 19 nt, Homo sapiens
ccucgacuauuuguuguua

SEQ ID NO: 804493 - RNA, 19 nt, Homo sapiens
cgacugaccaggauuguga

SEQ ID NO: 804494 - RNA, 19 nt, Homo sapiens
gaauagaugguggaaacua

SEQ ID NO: 804495 - RNA, 19 nt, Homo sapiens
ugaaaguugugaauagaug

SEQ ID NO: 804496 - RNA, 19 nt, Homo sapiens
ggugcucuguuauauauug

SEQ ID NO: 804497 - RNA, 19 nt, Homo sapiens
cauaacagaaugaccuaua

SEQ ID NO: 804498 - RNA, 19 nt, Homo sapiens
ggaagagcccauaacagaa

SEQ ID NO: 804499 - RNA, 19 nt, Homo sapiens
gugcauucguucucgauuu

SEQ ID NO: 804500 - RNA, 19 nt, Homo sapiens
aaagagaggguccuucaaa

SEQ ID NO: 804501 - RNA, 19 nt, Homo sapiens
gauuuaagucgcuguguuu

SEQ ID NO: 804502 - RNA, 19 nt, Homo sapiens
gcacuagcguggacauuuu

SEQ ID NO: 804503 - RNA, 19 nt, Homo sapiens
caaacggguugaaguaaag

SEQ ID NO: 804504 - RNA, 19 nt, Homo sapiens
gggauaaauuuccaucauc

SEQ ID NO: 804505 - RNA, 19 nt, Homo sapiens
gauuggaaauguaauggau

SEQ ID NO: 804506 - RNA, 19 nt, Homo sapiens
cuuguacugucuuaaguua

SEQ ID NO: 804507 - RNA, 19 nt, Homo sapiens
cuguuaagcuugaguagaa

SEQ ID NO: 804508 - RNA, 19 nt, Homo sapiens
cuacuuaauucccuggauu

SEQ ID NO: 804509 - RNA, 19 nt, Homo sapiens
uaauggugaugcuaaagaa

SEQ ID NO: 804510 - RNA, 19 nt, Homo sapiens
cacaugagcucuuaguuac

SEQ ID NO: 804511 - RNA, 19 nt, Homo sapiens
guaguagacuggccucaca

SEQ ID NO: 804512 - RNA, 19 nt, Homo sapiens
cagcauaaagcuaaaguga

SEQ ID NO: 804513 - RNA, 19 nt, Homo sapiens
gcucauacaucaagaguua

SEQ ID NO: 804514 - RNA, 19 nt, Homo sapiens
caacagagguuuucaauua

SEQ ID NO: 804515 - RNA, 19 nt, Homo sapiens
ggacgaggcucuucagauu

SEQ ID NO: 804516 - RNA, 19 nt, Homo sapiens
gaaacuaaaucaucuagga

SEQ ID NO: 804517 - RNA, 19 nt, Homo sapiens
caaaggugcuuacuucauu

SEQ ID NO: 804518 - RNA, 19 nt, Homo sapiens
ggagcgaugugauaaguuu

SEQ ID NO: 804519 - RNA, 19 nt, Homo sapiens
gaaaccauauccuaguaaa

SEQ ID NO: 804520 - RNA, 19 nt, Homo sapiens
gaagguauauuugcaugaa

SEQ ID NO: 804521 - RNA, 19 nt, Homo sapiens
cuacaaaggugcuuacuuc

SEQ ID NO: 804522 - RNA, 19 nt, Homo sapiens
acagagauuuggagaauaa

SEQ ID NO: 804523 - RNA, 19 nt, Homo sapiens
gcaaggaguuacugaagga

SEQ ID NO: 804524 - RNA, 19 nt, Homo sapiens
ccuaugagcugcauuugaa

SEQ ID NO: 804525 - RNA, 19 nt, Homo sapiens
ggacuggacucuugaagca

SEQ ID NO: 804526 - RNA, 19 nt, Homo sapiens
ucacaagccuucuguacuu

SEQ ID NO: 804527 - RNA, 19 nt, Homo sapiens
gaaagaaagugagauaucg

SEQ ID NO: 804528 - RNA, 19 nt, Homo sapiens
gaaguugccuauggauuau

SEQ ID NO: 804529 - RNA, 19 nt, Homo sapiens
gaacagagggaccuauugu

SEQ ID NO: 804530 - RNA, 19 nt, Homo sapiens
agaauaagcuuagaucugu

SEQ ID NO: 804531 - RNA, 19 nt, Homo sapiens
agaaguugccuauggauua

SEQ ID NO: 804532 - RNA, 19 nt, Homo sapiens
ggaagaagaaguugccuau

SEQ ID NO: 804533 - RNA, 19 nt, Homo sapiens
ccuaagaacugaggaaaug

SEQ ID NO: 804534 - RNA, 19 nt, Homo sapiens
gaacuacacagugaauauu

SEQ ID NO: 804535 - RNA, 19 nt, Homo sapiens
caaaccaggugcucaaaca

SEQ ID NO: 804536 - RNA, 19 nt, Homo sapiens
aaagugagauaucgaacaa

SEQ ID NO: 804537 - RNA, 19 nt, Homo sapiens
aagcuuagaucugugauuu

SEQ ID NO: 804538 - RNA, 19 nt, Homo sapiens
ggaaagaaagugagauauc

SEQ ID NO: 804539 - RNA, 19 nt, Homo sapiens
guaagugcuuggucucuga

SEQ ID NO: 804540 - RNA, 19 nt, Homo sapiens
uaaaguggaugagagagaa

SEQ ID NO: 804541 - RNA, 19 nt, Homo sapiens
guccagaacuacacaguga

SEQ ID NO: 804542 - RNA, 19 nt, Homo sapiens
aaauugauguggcuucauu

SEQ ID NO: 804543 - RNA, 19 nt, Homo sapiens
cauaagaaaccauauccua

SEQ ID NO: 804544 - RNA, 19 nt, Homo sapiens
guccaagucuggugagaaa

SEQ ID NO: 804545 - RNA, 19 nt, Homo sapiens
ggugaaagguauucuugug

SEQ ID NO: 804546 - RNA, 19 nt, Homo sapiens
gaacaccaccuuccugaca

SEQ ID NO: 804547 - RNA, 19 nt, Homo sapiens
acacagagauuuggagaau

SEQ ID NO: 804548 - RNA, 19 nt, Homo sapiens
caucagacauacacagaga

SEQ ID NO: 804549 - RNA, 19 nt, Homo sapiens
aagaaaccauauccuagua

SEQ ID NO: 804550 - RNA, 19 nt, Homo sapiens
guuguggccucuguaaaua

SEQ ID NO: 804551 - RNA, 19 nt, Homo sapiens
ugacgaguguugugccuuu

SEQ ID NO: 804552 - RNA, 19 nt, Homo sapiens
gaacuguuguccucacucu

SEQ ID NO: 804553 - RNA, 19 nt, Homo sapiens
aaacgcacauugcuccaaa

SEQ ID NO: 804554 - RNA, 19 nt, Homo sapiens
gcuuagaucugugauuuca

SEQ ID NO: 804555 - RNA, 19 nt, Homo sapiens
gaaagguauucuuguggau

SEQ ID NO: 804556 - RNA, 19 nt, Homo sapiens
ggaagccaguaguuauuuc

SEQ ID NO: 804557 - RNA, 19 nt, Homo sapiens
aagaugaaauugaccaaga

SEQ ID NO: 804558 - RNA, 19 nt, Homo sapiens
ucagagacguggguacaaa

SEQ ID NO: 804559 - RNA, 19 nt, Homo sapiens
ugaaggccguucuuaugaa

SEQ ID NO: 804560 - RNA, 19 nt, Homo sapiens
guggugaagugaugcauga

SEQ ID NO: 804561 - RNA, 19 nt, Homo sapiens
caauaagucuguuggaacu

SEQ ID NO: 804562 - RNA, 19 nt, Homo sapiens
gagaauaagcuuagaucug

SEQ ID NO: 804563 - RNA, 19 nt, Homo sapiens
gauacuguuucuauagaga

SEQ ID NO: 804564 - RNA, 19 nt, Homo sapiens
gaaggccguucuuaugaag

SEQ ID NO: 804565 - RNA, 19 nt, Homo sapiens
aagaagaaguugccuaugg

SEQ ID NO: 804566 - RNA, 19 nt, Homo sapiens
caaacccugugauguaugu

SEQ ID NO: 804567 - RNA, 19 nt, Homo sapiens
gugaagugaugcaugauuc

SEQ ID NO: 804568 - RNA, 19 nt, Homo sapiens
agaagaaguugccuaugga

SEQ ID NO: 804569 - RNA, 19 nt, Homo sapiens
gugcuuacuucauucaaga

SEQ ID NO: 804570 - RNA, 19 nt, Homo sapiens
gauuauagcaacagagguu

SEQ ID NO: 804571 - RNA, 19 nt, Homo sapiens
ucagagcacagcaggaaua

SEQ ID NO: 804572 - RNA, 19 nt, Homo sapiens
caccuuccaugauaucaaa

SEQ ID NO: 804573 - RNA, 19 nt, Homo sapiens
ugcgaugucugucuuguaa

SEQ ID NO: 804574 - RNA, 19 nt, Homo sapiens
guaaauacucuacaaaggu

SEQ ID NO: 804575 - RNA, 19 nt, Homo sapiens
gaaagugagauaucgaaca

SEQ ID NO: 804576 - RNA, 19 nt, Homo sapiens
acauggagguagcgcauaa

SEQ ID NO: 804577 - RNA, 19 nt, Homo sapiens
gaaacaagugaaugggauu

SEQ ID NO: 804578 - RNA, 19 nt, Homo sapiens
gcaaauggcagugcuccaa

SEQ ID NO: 804579 - RNA, 19 nt, Homo sapiens
gcagaagugcucccaagga

SEQ ID NO: 804580 - RNA, 19 nt, Homo sapiens
uaacuuacgcugacuucuu

SEQ ID NO: 804581 - RNA, 19 nt, Homo sapiens
ggagaggcaccacaucaug

SEQ ID NO: 804582 - RNA, 19 nt, Homo sapiens
ccaggaagccaguaguuau

SEQ ID NO: 804583 - RNA, 19 nt, Homo sapiens
aacuuacgcugacuucuuu

SEQ ID NO: 804584 - RNA, 19 nt, Homo sapiens
ggaaugaaagcagaacaga

SEQ ID NO: 804585 - RNA, 19 nt, Homo sapiens
ccuggaagccucacucauu

SEQ ID NO: 804586 - RNA, 19 nt, Homo sapiens
agacauacacagagauuug

SEQ ID NO: 804587 - RNA, 19 nt, Homo sapiens
gccaggaugcguuaaugua

SEQ ID NO: 804588 - RNA, 19 nt, Homo sapiens
gaauuugacaucugguaug

SEQ ID NO: 804589 - RNA, 19 nt, Homo sapiens
gagcagccucccauccuaa

SEQ ID NO: 804590 - RNA, 19 nt, Homo sapiens
ugacaacugaggccuauga

SEQ ID NO: 804591 - RNA, 19 nt, Homo sapiens
gcacagcgaguccaagucu

SEQ ID NO: 804592 - RNA, 19 nt, Homo sapiens
gucaauaagucuguuggaa

SEQ ID NO: 804593 - RNA, 19 nt, Homo sapiens
uacgcugacuucuuuguaa

SEQ ID NO: 804594 - RNA, 19 nt, Homo sapiens
gaacuuugaauaugaacca

SEQ ID NO: 804595 - RNA, 19 nt, Homo sapiens
uaagaaaccauauccuagu

SEQ ID NO: 804596 - RNA, 19 nt, Homo sapiens
uaugaaggccguucuuaug

SEQ ID NO: 804597 - RNA, 19 nt, Homo sapiens
gcacauugcuccaaaacca

SEQ ID NO: 804598 - RNA, 19 nt, Homo sapiens
caccaccugacaaauauua

SEQ ID NO: 804599 - RNA, 19 nt, Homo sapiens
ccugacaaauauuacugua

SEQ ID NO: 804600 - RNA, 19 nt, Homo sapiens
ggugaucccuugcccaaac

SEQ ID NO: 804601 - RNA, 19 nt, Homo sapiens
cagaaaaggugacgagugu

SEQ ID NO: 804602 - RNA, 19 nt, Homo sapiens
ggcagcgugugcaccauuu

SEQ ID NO: 804603 - RNA, 19 nt, Homo sapiens
ccucagcccgucuuucuuu

SEQ ID NO: 804604 - RNA, 19 nt, Homo sapiens
ccuccuugcuuccaucuug

SEQ ID NO: 804605 - RNA, 19 nt, Homo sapiens
caucugguaugcugguaug

SEQ ID NO: 804606 - RNA, 19 nt, Homo sapiens
aaaguagacugaauuugac

SEQ ID NO: 804607 - RNA, 19 nt, Homo sapiens
ccaacauucugccugugaa

SEQ ID NO: 804608 - RNA, 19 nt, Homo sapiens
gauaucgaacaaagccaua

SEQ ID NO: 804609 - RNA, 19 nt, Homo sapiens
cagcagccaggaugcguua

SEQ ID NO: 804610 - RNA, 19 nt, Homo sapiens
ccaugaagaugaaauugac

SEQ ID NO: 804611 - RNA, 19 nt, Homo sapiens
gaaaauugauguggcuuca

SEQ ID NO: 804612 - RNA, 19 nt, Homo sapiens
uaaaccagggugugaauuc

SEQ ID NO: 804613 - RNA, 19 nt, Homo sapiens
gaaauuaggucaaaucaga

SEQ ID NO: 804614 - RNA, 19 nt, Homo sapiens
gaaagaaguugaagugaaa

SEQ ID NO: 804615 - RNA, 19 nt, Homo sapiens
caacaaggcugacaauaaa

SEQ ID NO: 804616 - RNA, 19 nt, Homo sapiens
gaagagaaaugugcaacua

SEQ ID NO: 804617 - RNA, 19 nt, Homo sapiens
ggaaagaaguugaagugaa

SEQ ID NO: 804618 - RNA, 19 nt, Homo sapiens
ggaaagcagucaccaacua

SEQ ID NO: 804619 - RNA, 19 nt, Homo sapiens
caaagaagcugcugcugaa

SEQ ID NO: 804620 - RNA, 19 nt, Homo sapiens
gaggaaacauuaacacaaa

SEQ ID NO: 804621 - RNA, 19 nt, Homo sapiens
ggaaguaucagcaaacaua

SEQ ID NO: 804622 - RNA, 19 nt, Homo sapiens
gaaguauguugauccuuua

SEQ ID NO: 804623 - RNA, 19 nt, Homo sapiens
gaaaggauaccuaaacauu

SEQ ID NO: 804624 - RNA, 19 nt, Homo sapiens
gagaagacagugauuaaua

SEQ ID NO: 804625 - RNA, 19 nt, Homo sapiens
caaacaauaucccaguaua

SEQ ID NO: 804626 - RNA, 19 nt, Homo sapiens
ggaauggaguguaaagauu

SEQ ID NO: 804627 - RNA, 19 nt, Homo sapiens
gaaagauucuguuccaaau

SEQ ID NO: 804628 - RNA, 19 nt, Homo sapiens
ggaagaaauugcuaugcua

SEQ ID NO: 804629 - RNA, 19 nt, Homo sapiens
gaaguugaaucauaccauu

SEQ ID NO: 804630 - RNA, 19 nt, Homo sapiens
gaacugugcucuuugagau

SEQ ID NO: 804631 - RNA, 19 nt, Homo sapiens
ggaaauagaacuuuguuug

SEQ ID NO: 804632 - RNA, 19 nt, Homo sapiens
gaaggaaggccuacuaaga

SEQ ID NO: 804633 - RNA, 19 nt, Homo sapiens
aagaauggcuugaacgaua

SEQ ID NO: 804634 - RNA, 19 nt, Homo sapiens
gaaagacaguaucaauaug

SEQ ID NO: 804635 - RNA, 19 nt, Homo sapiens
gaaauugaguuccaucaca

SEQ ID NO: 804636 - RNA, 19 nt, Homo sapiens
aagcagaaguugaaucaua

SEQ ID NO: 804637 - RNA, 19 nt, Homo sapiens
gaagaaaugcugauacguu

SEQ ID NO: 804638 - RNA, 19 nt, Homo sapiens
caacacugcucuucacuau

SEQ ID NO: 804639 - RNA, 19 nt, Homo sapiens
ccacgggcuucaaauaaua

SEQ ID NO: 804640 - RNA, 19 nt, Homo sapiens
caagaggaguuguuaucua

SEQ ID NO: 804641 - RNA, 19 nt, Homo sapiens
gaagagaagagaagaaaug

SEQ ID NO: 804642 - RNA, 19 nt, Homo sapiens
uagauuggcugcugcuaua

SEQ ID NO: 804643 - RNA, 19 nt, Homo sapiens
ugagagauaucuucacuug

SEQ ID NO: 804644 - RNA, 19 nt, Homo sapiens
ggauagagauuccgauagu

SEQ ID NO: 804645 - RNA, 19 nt, Homo sapiens
gaagucauauagaaaggaa

SEQ ID NO: 804646 - RNA, 19 nt, Homo sapiens
ggaugauguugaugacuua

SEQ ID NO: 804647 - RNA, 19 nt, Homo sapiens
ugaaauagaugaggaugaa

SEQ ID NO: 804648 - RNA, 19 nt, Homo sapiens
aaacggaccucgaaagaau

SEQ ID NO: 804649 - RNA, 19 nt, Homo sapiens
gaugaaggcuguacaaugc

SEQ ID NO: 804650 - RNA, 19 nt, Homo sapiens
gaaagcaucaagagaauau

SEQ ID NO: 804651 - RNA, 19 nt, Homo sapiens
gaagaaauugcuaugcuaa

SEQ ID NO: 804652 - RNA, 19 nt, Homo sapiens
ggaugcagcucuuucaugu

SEQ ID NO: 804653 - RNA, 19 nt, Homo sapiens
gaacuuuguuugaggauag

SEQ ID NO: 804654 - RNA, 19 nt, Homo sapiens
guuuagaucucaacagaaa

SEQ ID NO: 804655 - RNA, 19 nt, Homo sapiens
gaggaguuguuaucuauga

SEQ ID NO: 804656 - RNA, 19 nt, Homo sapiens
aaagagagauaacuggauu

SEQ ID NO: 804657 - RNA, 19 nt, Homo sapiens
gaaaugaacaagcagaaga

SEQ ID NO: 804658 - RNA, 19 nt, Homo sapiens
agaaguauguugauccuuu

SEQ ID NO: 804659 - RNA, 19 nt, Homo sapiens
ccaaucaccuuuccaaaca

SEQ ID NO: 804660 - RNA, 19 nt, Homo sapiens
ugagacaacuucaacaaga

SEQ ID NO: 804661 - RNA, 19 nt, Homo sapiens
gaacagaaugccagaaugu

SEQ ID NO: 804662 - RNA, 19 nt, Homo sapiens
gaaaugcugauacguugua

SEQ ID NO: 804663 - RNA, 19 nt, Homo sapiens
gaacaggaaauagaacuuu

SEQ ID NO: 804664 - RNA, 19 nt, Homo sapiens
gaaagcagucaccaacuaa

SEQ ID NO: 804665 - RNA, 19 nt, Homo sapiens
ggacauaucaguagcaaca

SEQ ID NO: 804666 - RNA, 19 nt, Homo sapiens
gaaguaaagagcacugaaa

SEQ ID NO: 804667 - RNA, 19 nt, Homo sapiens
gagacaacuucaacaagaa

SEQ ID NO: 804668 - RNA, 19 nt, Homo sapiens
gaagagcaauauaggaaag

SEQ ID NO: 804669 - RNA, 19 nt, Homo sapiens
gguccugccuugcaaauga

SEQ ID NO: 804670 - RNA, 19 nt, Homo sapiens
gaagaaaggauaccuaaac

SEQ ID NO: 804671 - RNA, 19 nt, Homo sapiens
gacagcaguuuaagugaaa

SEQ ID NO: 804672 - RNA, 19 nt, Homo sapiens
cagauggaacucagaauua

SEQ ID NO: 804673 - RNA, 19 nt, Homo sapiens
ugaaauggcucaaaagaaa

SEQ ID NO: 804674 - RNA, 19 nt, Homo sapiens
cgagaacugugcucuuuga

SEQ ID NO: 804675 - RNA, 19 nt, Homo sapiens
gaugaugacagcaguuuaa

SEQ ID NO: 804676 - RNA, 19 nt, Homo sapiens
uaagauggcuaaacuagag

SEQ ID NO: 804677 - RNA, 19 nt, Homo sapiens
aaacaaggaugaccucaca

SEQ ID NO: 804678 - RNA, 19 nt, Homo sapiens
gaacucagaauuaaagauc

SEQ ID NO: 804679 - RNA, 19 nt, Homo sapiens
agagauaacuggauuuaag

SEQ ID NO: 804680 - RNA, 19 nt, Homo sapiens
caacaagaacuagcugaua

SEQ ID NO: 804681 - RNA, 19 nt, Homo sapiens
gagaaugcaaugcuaaauu

SEQ ID NO: 804682 - RNA, 19 nt, Homo sapiens
gauguccgcauuaggauua

SEQ ID NO: 804683 - RNA, 19 nt, Homo sapiens
ccugagaagucauauagaa

SEQ ID NO: 804684 - RNA, 19 nt, Homo sapiens
caagaccaguuucaugcua

SEQ ID NO: 804685 - RNA, 19 nt, Homo sapiens
agaugaauguucucguuua

SEQ ID NO: 804686 - RNA, 19 nt, Homo sapiens
gggcugacuuguuauguug

SEQ ID NO: 804687 - RNA, 19 nt, Homo sapiens
ugaugaugaugauggauua

SEQ ID NO: 804688 - RNA, 19 nt, Homo sapiens
gaaaugaaagauucuguuc

SEQ ID NO: 804689 - RNA, 19 nt, Homo sapiens
gaugaaagcucugaagacu

SEQ ID NO: 804690 - RNA, 19 nt, Homo sapiens
ucacuaugcugucuauaau

SEQ ID NO: 804691 - RNA, 19 nt, Homo sapiens
agagaaaugugcaacuauu

SEQ ID NO: 804692 - RNA, 19 nt, Homo sapiens
uagcagaggucaacaccaa

SEQ ID NO: 804693 - RNA, 19 nt, Homo sapiens
gaagaaauuaggucaaauc

SEQ ID NO: 804694 - RNA, 19 nt, Homo sapiens
ggaagcagaaguugaauca

SEQ ID NO: 804695 - RNA, 19 nt, Homo sapiens
agacaagguuaauguacua

SEQ ID NO: 804696 - RNA, 19 nt, Homo sapiens
ggaagacaagguuaaugua

SEQ ID NO: 804697 - RNA, 19 nt, Homo sapiens
caaagcagcugaacaugac

SEQ ID NO: 804698 - RNA, 19 nt, Homo sapiens
gaaucuggaucaauagcuu

SEQ ID NO: 804699 - RNA, 19 nt, Homo sapiens
gcaaauuugucugaagaug

SEQ ID NO: 804700 - RNA, 19 nt, Homo sapiens
gaugcaagaucacaagcaa

SEQ ID NO: 804701 - RNA, 19 nt, Homo sapiens
ggucaaaucagaaaucaau

SEQ ID NO: 804702 - RNA, 19 nt, Homo sapiens
acaacaaggcugacaauaa

SEQ ID NO: 804703 - RNA, 19 nt, Homo sapiens
caggacggcucuacauuug

SEQ ID NO: 804704 - RNA, 19 nt, Homo sapiens
gaaagggaagggagugaaa

SEQ ID NO: 804705 - RNA, 19 nt, Homo sapiens
gaagugaucaaccugagaa

SEQ ID NO: 804706 - RNA, 19 nt, Homo sapiens
gggaaggccaguuuacuaa

SEQ ID NO: 804707 - RNA, 19 nt, Homo sapiens
agaaguagcaucagaagaa

SEQ ID NO: 804708 - RNA, 19 nt, Homo sapiens
agaggaagauauagaauca

SEQ ID NO: 804709 - RNA, 19 nt, Homo sapiens
caccugaccuucuuccaaa

SEQ ID NO: 804710 - RNA, 19 nt, Homo sapiens
caaauaauagcauggagaa

SEQ ID NO: 804711 - RNA, 19 nt, Homo sapiens
ggagcuaucugaaacaaaa

SEQ ID NO: 804712 - RNA, 19 nt, Homo sapiens
ugacagcaguuuaagugaa

SEQ ID NO: 804713 - RNA, 19 nt, Homo sapiens
ggaaauggcugguuuggaa

SEQ ID NO: 804714 - RNA, 19 nt, Homo sapiens
gaaauucucucaacugaug

SEQ ID NO: 804715 - RNA, 19 nt, Homo sapiens
gcaaagaacacauaaauga

SEQ ID NO: 804716 - RNA, 19 nt, Homo sapiens
gcagaggucuucacacuuu

SEQ ID NO: 804717 - RNA, 19 nt, Homo sapiens
uaaaugaucuucagacaga

SEQ ID NO: 804718 - RNA, 19 nt, Homo sapiens
gaaagugacucuguucuug

SEQ ID NO: 804719 - RNA, 19 nt, Homo sapiens
gagcagcccuacucugaua

SEQ ID NO: 804720 - RNA, 19 nt, Homo sapiens
cgaagaaggugguggcuuu

SEQ ID NO: 804721 - RNA, 19 nt, Homo sapiens
gaugaggacuucuuccaaa

SEQ ID NO: 804722 - RNA, 19 nt, Homo sapiens
caaggaggauuauauugaa

SEQ ID NO: 804723 - RNA, 19 nt, Homo sapiens
uagaugguaugaagucuua

SEQ ID NO: 804724 - RNA, 19 nt, Homo sapiens
gguaugaagucuuacaguu

SEQ ID NO: 804725 - RNA, 19 nt, Homo sapiens
caacuuagauguccucaac

SEQ ID NO: 804726 - RNA, 19 nt, Homo sapiens
gcagguacaaggaggauua

SEQ ID NO: 804727 - RNA, 19 nt, Homo sapiens
caaauauucuucagugugu

SEQ ID NO: 804728 - RNA, 19 nt, Homo sapiens
agacagaacuuaagaaugc

SEQ ID NO: 804729 - RNA, 19 nt, Homo sapiens
gaaagagccagccagauga

SEQ ID NO: 804730 - RNA, 19 nt, Homo sapiens
gaaacucuuuagauacuga

SEQ ID NO: 804731 - RNA, 19 nt, Homo sapiens
cgacuauuauauccaguua

SEQ ID NO: 804732 - RNA, 19 nt, Homo sapiens
guucaagaauugucagaaa

SEQ ID NO: 804733 - RNA, 19 nt, Homo sapiens
gaaaagccccguaagauuu

SEQ ID NO: 804734 - RNA, 19 nt, Homo sapiens
guaaccagcuuucaagaca

SEQ ID NO: 804735 - RNA, 19 nt, Homo sapiens
uuagaaacgucauguagaa

SEQ ID NO: 804736 - RNA, 19 nt, Homo sapiens
guacaaggaggauuauauu

SEQ ID NO: 804737 - RNA, 19 nt, Homo sapiens
gaaccuuacuacauucuuc

SEQ ID NO: 804738 - RNA, 19 nt, Homo sapiens
uggagaaccuuacuacauu

SEQ ID NO: 804739 - RNA, 19 nt, Homo sapiens
cgagagcccuuucaacaau

SEQ ID NO: 804740 - RNA, 19 nt, Homo sapiens
ggacucagaggucgacuuu

SEQ ID NO: 804741 - RNA, 19 nt, Homo sapiens
gagagcccuuucaacaaua

SEQ ID NO: 804742 - RNA, 19 nt, Homo sapiens
ggaauuaaacggaguucaa

SEQ ID NO: 804743 - RNA, 19 nt, Homo sapiens
ggaccgagguuuggcagaa

SEQ ID NO: 804744 - RNA, 19 nt, Homo sapiens
acucagaggucgacuuuga

SEQ ID NO: 804745 - RNA, 19 nt, Homo sapiens
gcagaucagacuaaguaua

SEQ ID NO: 804746 - RNA, 19 nt, Homo sapiens
gcacaaagggugacgauac

SEQ ID NO: 804747 - RNA, 19 nt, Homo sapiens
ggaagaauccagaggugaa

SEQ ID NO: 804748 - RNA, 19 nt, Homo sapiens
gacaugagauugggaggaa

SEQ ID NO: 804749 - RNA, 19 nt, Homo sapiens
gcagaaguuuccucaucuu

SEQ ID NO: 804750 - RNA, 19 nt, Homo sapiens
guaguaacuuggagcuuga

SEQ ID NO: 804751 - RNA, 19 nt, Homo sapiens
gcucuuagcugcguucaag

SEQ ID NO: 804752 - RNA, 19 nt, Homo sapiens
cagcaaagaacacauaaau

SEQ ID NO: 804753 - RNA, 19 nt, Homo sapiens
uuaaugauguggacaaauc

SEQ ID NO: 804754 - RNA, 19 nt, Homo sapiens
agugggagauuacggaaua

SEQ ID NO: 804755 - RNA, 19 nt, Homo sapiens
gacauccacucgccauuug

SEQ ID NO: 804756 - RNA, 19 nt, Homo sapiens
ggagaaccuuacuacauuc

SEQ ID NO: 804757 - RNA, 19 nt, Homo sapiens
guaaggacccagaaauaga

SEQ ID NO: 804758 - RNA, 19 nt, Homo sapiens
aaagaaggcagucacguuu

SEQ ID NO: 804759 - RNA, 19 nt, Homo sapiens
gaggagacccugcgacuca

SEQ ID NO: 804760 - RNA, 19 nt, Homo sapiens
gaacccacagccuggauaa

SEQ ID NO: 804761 - RNA, 19 nt, Homo sapiens
caaagacucuagcuuacca

SEQ ID NO: 804762 - RNA, 19 nt, Homo sapiens
gaacuugaggaguccagua

SEQ ID NO: 804763 - RNA, 19 nt, Homo sapiens
agaaaggacuggcccugaa

SEQ ID NO: 804764 - RNA, 19 nt, Homo sapiens
gacgaaggcuuguccuaca

SEQ ID NO: 804765 - RNA, 19 nt, Homo sapiens
caagagucaucgugaagga

SEQ ID NO: 804766 - RNA, 19 nt, Homo sapiens
gccauuugcugacaugaga

SEQ ID NO: 804767 - RNA, 19 nt, Homo sapiens
uagaggcuguggagacuuu

SEQ ID NO: 804768 - RNA, 19 nt, Homo sapiens
cauaaaugaucuucagaca

SEQ ID NO: 804769 - RNA, 19 nt, Homo sapiens
uaacaggccacuuugagaa

SEQ ID NO: 804770 - RNA, 19 nt, Homo sapiens
ugcacaggcugcugacuua

SEQ ID NO: 804771 - RNA, 19 nt, Homo sapiens
gaaguuuccucaucuuuug

SEQ ID NO: 804772 - RNA, 19 nt, Homo sapiens
caaagagucagucauaaca

SEQ ID NO: 804773 - RNA, 19 nt, Homo sapiens
auucaaaccuuuccaacuu

SEQ ID NO: 804774 - RNA, 19 nt, Homo sapiens
ccgcacagccguauucaaa

SEQ ID NO: 804775 - RNA, 19 nt, Homo sapiens
cagcagaggucuucacacu

SEQ ID NO: 804776 - RNA, 19 nt, Homo sapiens
ugagugggaugaugacuuc

SEQ ID NO: 804777 - RNA, 19 nt, Homo sapiens
gaaggagccggacaucgaa

SEQ ID NO: 804778 - RNA, 19 nt, Homo sapiens
gaaacgucauguagaaacu

SEQ ID NO: 804779 - RNA, 19 nt, Homo sapiens
gcagagacuccuccaacaa

SEQ ID NO: 804780 - RNA, 19 nt, Homo sapiens
acaaggaggauuauauuga

SEQ ID NO: 804781 - RNA, 19 nt, Homo sapiens
ggucuucacacuuucagua

SEQ ID NO: 804782 - RNA, 19 nt, Homo sapiens
agaaagagccagccagaug

SEQ ID NO: 804783 - RNA, 19 nt, Homo sapiens
cuacuggacucuuuaggau

SEQ ID NO: 804784 - RNA, 19 nt, Homo sapiens
gcaccucauugcagucuuc

SEQ ID NO: 804785 - RNA, 19 nt, Homo sapiens
gaucuucagacagaacuua

SEQ ID NO: 804786 - RNA, 19 nt, Homo sapiens
guaacuuggagcuugauua

SEQ ID NO: 804787 - RNA, 19 nt, Homo sapiens
guuggaagcgacuauuaua

SEQ ID NO: 804788 - RNA, 19 nt, Homo sapiens
uaacugcagaucagacuaa

SEQ ID NO: 804789 - RNA, 19 nt, Homo sapiens
gguacaaggaggauuauau

SEQ ID NO: 804790 - RNA, 19 nt, Homo sapiens
ggacccagaaauagacuuu

SEQ ID NO: 804791 - RNA, 19 nt, Homo sapiens
cugcagaucagacuaagua

SEQ ID NO: 804792 - RNA, 19 nt, Homo sapiens
ggaggauuauauugaaaca

SEQ ID NO: 804793 - RNA, 19 nt, Homo sapiens
gcacuagcguagcaagagu

SEQ ID NO: 804794 - RNA, 19 nt, Homo sapiens
gcaauuccagccuucugua

SEQ ID NO: 804795 - RNA, 19 nt, Homo sapiens
gaagacacucccucuguuc

SEQ ID NO: 804796 - RNA, 19 nt, Homo sapiens
gaaggcaccugcggagucu

SEQ ID NO: 804797 - RNA, 19 nt, Homo sapiens
ggaagaccaucacagucau

SEQ ID NO: 804798 - RNA, 19 nt, Homo sapiens
ccuccuaccuccuucgaaa

SEQ ID NO: 804799 - RNA, 19 nt, Homo sapiens
caagacagacugcuaacug

SEQ ID NO: 804800 - RNA, 19 nt, Homo sapiens
agaagacacucccucuguu

SEQ ID NO: 804801 - RNA, 19 nt, Homo sapiens
gaaauggcugguuuggaaa

SEQ ID NO: 804802 - RNA, 19 nt, Homo sapiens
gaagcuauguuagaaacgu

SEQ ID NO: 804803 - RNA, 19 nt, Homo sapiens
acacauaaaugaucuucag

SEQ ID NO: 804804 - RNA, 19 nt, Homo sapiens
ucacaaccgacauggauaa

SEQ ID NO: 804805 - RNA, 19 nt, Homo sapiens
ggaagcgacuauuauaucc

SEQ ID NO: 804806 - RNA, 19 nt, Homo sapiens
ggccugagcuucgaguaug

SEQ ID NO: 804807 - RNA, 19 nt, Homo sapiens
ucugauagaugguaugaag

SEQ ID NO: 804808 - RNA, 19 nt, Homo sapiens
ucaaccaagucauuagaga

SEQ ID NO: 804809 - RNA, 19 nt, Homo sapiens
gaagugcagguaccuccua

SEQ ID NO: 804810 - RNA, 19 nt, Homo sapiens
acccagaaauagacuuuaa

SEQ ID NO: 804811 - RNA, 19 nt, Homo sapiens
guacagaugaggacuucuu

SEQ ID NO: 804812 - RNA, 19 nt, Homo sapiens
cagaucagacuaaguauag

SEQ ID NO: 804813 - RNA, 19 nt, Homo sapiens
gaacacagauaaagugauu

SEQ ID NO: 804814 - RNA, 19 nt, Homo sapiens
gcaauacucugauaauuug

SEQ ID NO: 804815 - RNA, 19 nt, Homo sapiens
acaaauagguuucccauaa

SEQ ID NO: 804816 - RNA, 19 nt, Homo sapiens
ccaagaagauuacaaagaa

SEQ ID NO: 804817 - RNA, 19 nt, Homo sapiens
aaaggaagcuguuuggaua

SEQ ID NO: 804818 - RNA, 19 nt, Homo sapiens
ggaaaugcaagaagaauua

SEQ ID NO: 804819 - RNA, 19 nt, Homo sapiens
gaauaggccuggacacuga

SEQ ID NO: 804820 - RNA, 19 nt, Homo sapiens
gaagcuguuuggauauuua

SEQ ID NO: 804821 - RNA, 19 nt, Homo sapiens
ucacauccauuuagagaua

SEQ ID NO: 804822 - RNA, 19 nt, Homo sapiens
ccaagaaacucagagauuu

SEQ ID NO: 804823 - RNA, 19 nt, Homo sapiens
gaagcaagcugacacagau

SEQ ID NO: 804824 - RNA, 19 nt, Homo sapiens
gaacauggcagcccuauca

SEQ ID NO: 804825 - RNA, 19 nt, Homo sapiens
gcacagaucuggugagaac

SEQ ID NO: 804826 - RNA, 19 nt, Homo sapiens
gaacauggcagugcuauga

SEQ ID NO: 804827 - RNA, 19 nt, Homo sapiens
caaauugaacucucucuua

SEQ ID NO: 804828 - RNA, 19 nt, Homo sapiens
gaagacaucccuccacauu

SEQ ID NO: 804829 - RNA, 19 nt, Homo sapiens
gcagucaggugucccaauu

SEQ ID NO: 804830 - RNA, 19 nt, Homo sapiens
gaugaucuaugucuucuug

SEQ ID NO: 804831 - RNA, 19 nt, Homo sapiens
cacaauaucuuaacucuuc

SEQ ID NO: 804832 - RNA, 19 nt, Homo sapiens
ggaccucgccuacgcaaua

SEQ ID NO: 804833 - RNA, 19 nt, Homo sapiens
gggcaagaauucacacgua

SEQ ID NO: 804834 - RNA, 19 nt, Homo sapiens
ggaaauauuuguagaugag

SEQ ID NO: 804835 - RNA, 19 nt, Homo sapiens
guccauuucugauguaaua

SEQ ID NO: 804836 - RNA, 19 nt, Homo sapiens
gcauuugccuaacuguaua

SEQ ID NO: 804837 - RNA, 19 nt, Homo sapiens
gcaaauuugugaucaguag

SEQ ID NO: 804838 - RNA, 19 nt, Homo sapiens
gaggucccaucuucauuua

SEQ ID NO: 804839 - RNA, 19 nt, Homo sapiens
caaauagguuucccauaau

SEQ ID NO: 804840 - RNA, 19 nt, Homo sapiens
gcuguugucuaucuauuaa

SEQ ID NO: 804841 - RNA, 19 nt, Homo sapiens
guaaauagaaguaguguuc

SEQ ID NO: 804842 - RNA, 19 nt, Homo sapiens
ccuggacacugauuuguua

SEQ ID NO: 804843 - RNA, 19 nt, Homo sapiens
cgaggaaggugcaagugua

SEQ ID NO: 804844 - RNA, 19 nt, Homo sapiens
ccaccaaaguccucaauau

SEQ ID NO: 804845 - RNA, 19 nt, Homo sapiens
agaaauggauggauggaaa

SEQ ID NO: 804846 - RNA, 19 nt, Homo sapiens
cuacuuagcuuugaguuug

SEQ ID NO: 804847 - RNA, 19 nt, Homo sapiens
gcaauuccuuagauaauca

SEQ ID NO: 804848 - RNA, 19 nt, Homo sapiens
gugcauaacuccaugaaca

SEQ ID NO: 804849 - RNA, 19 nt, Homo sapiens
ggucccaucuucauuuaaa

SEQ ID NO: 804850 - RNA, 19 nt, Homo sapiens
ggagugagaguacuagaaa

SEQ ID NO: 804851 - RNA, 19 nt, Homo sapiens
gaaacaggcaaauuuguga

SEQ ID NO: 804852 - RNA, 19 nt, Homo sapiens
acacagugauuaaagguuu

SEQ ID NO: 804853 - RNA, 19 nt, Homo sapiens
cagcauagcucaaggaaaa

SEQ ID NO: 804854 - RNA, 19 nt, Homo sapiens
caauauggcuucccucuac

SEQ ID NO: 804855 - RNA, 19 nt, Homo sapiens
caagauuccugucgauuca

SEQ ID NO: 804856 - RNA, 19 nt, Homo sapiens
cgauguagauuauugaugu

SEQ ID NO: 804857 - RNA, 19 nt, Homo sapiens
gaaaggaugcuucguugug

SEQ ID NO: 804858 - RNA, 19 nt, Homo sapiens
gaauacgcacaauaucuua

SEQ ID NO: 804859 - RNA, 19 nt, Homo sapiens
ucacugaucuuuugcauuu

SEQ ID NO: 804860 - RNA, 19 nt, Homo sapiens
guaguccuauuuauccaua

SEQ ID NO: 804861 - RNA, 19 nt, Homo sapiens
ccacggacaugacaaaaua

SEQ ID NO: 804862 - RNA, 19 nt, Homo sapiens
ccaagccucuccagguuaa

SEQ ID NO: 804863 - RNA, 19 nt, Homo sapiens
ggaagcuguuuggauauuu

SEQ ID NO: 804864 - RNA, 19 nt, Homo sapiens
ccaagcaauugaagagaaa

SEQ ID NO: 804865 - RNA, 19 nt, Homo sapiens
gcaaguuguuaacgccuaa

SEQ ID NO: 804866 - RNA, 19 nt, Homo sapiens
gaaggaaucaaugacuaua

SEQ ID NO: 804867 - RNA, 19 nt, Homo sapiens
agucaggugucccaauuua

SEQ ID NO: 804868 - RNA, 19 nt, Homo sapiens
gcaacuuccugcuucuuau

SEQ ID NO: 804869 - RNA, 19 nt, Homo sapiens
gcagggugaucgcagugua

SEQ ID NO: 804870 - RNA, 19 nt, Homo sapiens
gaaaaugcccaguaacuuu

SEQ ID NO: 804871 - RNA, 19 nt, Homo sapiens
ccaaagaaggaaucaauga

SEQ ID NO: 804872 - RNA, 19 nt, Homo sapiens
caaacgugauuguaucuuc

SEQ ID NO: 804873 - RNA, 19 nt, Homo sapiens
ggugaucgcaguguaaaua

SEQ ID NO: 804874 - RNA, 19 nt, Homo sapiens
gggaaauauuuguagauga

SEQ ID NO: 804875 - RNA, 19 nt, Homo sapiens
caacaggguauacaacaaa

SEQ ID NO: 804876 - RNA, 19 nt, Homo sapiens
gaagggaaaguuugggauu

SEQ ID NO: 804877 - RNA, 19 nt, Homo sapiens
caccaaaguccucaauaua

SEQ ID NO: 804878 - RNA, 19 nt, Homo sapiens
cuucuaggcugcuuuaaug

SEQ ID NO: 804879 - RNA, 19 nt, Homo sapiens
guauuaagguucaaaugca

SEQ ID NO: 804880 - RNA, 19 nt, Homo sapiens
caacaucacacaugacuag

SEQ ID NO: 804881 - RNA, 19 nt, Homo sapiens
uuucaggccuugacaauug

SEQ ID NO: 804882 - RNA, 19 nt, Homo sapiens
ucaggugucccaauuuaua

SEQ ID NO: 804883 - RNA, 19 nt, Homo sapiens
ccauugagcuaacagacaa

SEQ ID NO: 804884 - RNA, 19 nt, Homo sapiens
uguguaagacucagauuua

SEQ ID NO: 804885 - RNA, 19 nt, Homo sapiens
ccaucgcuuugcuaaauua

SEQ ID NO: 804886 - RNA, 19 nt, Homo sapiens
aagaaggaaucaaugacua

SEQ ID NO: 804887 - RNA, 19 nt, Homo sapiens
gcuuugaguuugauauaga

SEQ ID NO: 804888 - RNA, 19 nt, Homo sapiens
agaagucucucgauuaugg

SEQ ID NO: 804889 - RNA, 19 nt, Homo sapiens
gaggaucacucaggguuau

SEQ ID NO: 804890 - RNA, 19 nt, Homo sapiens
augacuagcuuaccuguuu

SEQ ID NO: 804891 - RNA, 19 nt, Homo sapiens
gagugucaguuguauguug

SEQ ID NO: 804892 - RNA, 19 nt, Homo sapiens
aaauugaacucucucuuag

SEQ ID NO: 804893 - RNA, 19 nt, Homo sapiens
gcaaccaacaaacaaauug

SEQ ID NO: 804894 - RNA, 19 nt, Homo sapiens
ucacagaccugaggauaag

SEQ ID NO: 804895 - RNA, 19 nt, Homo sapiens
gcuaacagacaacauaguu

SEQ ID NO: 804896 - RNA, 19 nt, Homo sapiens
gaaguaguguucacaucca

SEQ ID NO: 804897 - RNA, 19 nt, Homo sapiens
ggagagaauuuucacugua

SEQ ID NO: 804898 - RNA, 19 nt, Homo sapiens
caaacaaauugaacucucu

SEQ ID NO: 804899 - RNA, 19 nt, Homo sapiens
acucagagauuucuuuaca

SEQ ID NO: 804900 - RNA, 19 nt, Homo sapiens
gaaaauuggccacuuugua

SEQ ID NO: 804901 - RNA, 19 nt, Homo sapiens
aagggaaaguuugggauua

SEQ ID NO: 804902 - RNA, 19 nt, Homo sapiens
gcuuugaggucccaucuuc

SEQ ID NO: 804903 - RNA, 19 nt, Homo sapiens
aaggauacuugacuuagaa

SEQ ID NO: 804904 - RNA, 19 nt, Homo sapiens
gaaagauaccauuauagca

SEQ ID NO: 804905 - RNA, 19 nt, Homo sapiens
caucacacaugacuagcuu

SEQ ID NO: 804906 - RNA, 19 nt, Homo sapiens
uacuugagcuugugaauag

SEQ ID NO: 804907 - RNA, 19 nt, Homo sapiens
caacuuccugcuucuuaua

SEQ ID NO: 804908 - RNA, 19 nt, Homo sapiens
agagauuucuuuacaguca

SEQ ID NO: 804909 - RNA, 19 nt, Homo sapiens
uuggagcccuaauaaauuu

SEQ ID NO: 804910 - RNA, 19 nt, Homo sapiens
ucagagauuucuuuacagu

SEQ ID NO: 804911 - RNA, 19 nt, Homo sapiens
gaggaaggugcaaguguaa

SEQ ID NO: 804912 - RNA, 19 nt, Homo sapiens
acacuuggcacgcuacuuu

SEQ ID NO: 804913 - RNA, 19 nt, Homo sapiens
gaucaaaugugccuuaaua

SEQ ID NO: 804914 - RNA, 19 nt, Homo sapiens
gauaauagcuguuucauca

SEQ ID NO: 804915 - RNA, 19 nt, Homo sapiens
gaacauuccugcaaaguau

SEQ ID NO: 804916 - RNA, 19 nt, Homo sapiens
ggacaaguaugaaugguuu

SEQ ID NO: 804917 - RNA, 19 nt, Homo sapiens
ucaccaagcuaucacauua

SEQ ID NO: 804918 - RNA, 19 nt, Homo sapiens
ugacacaucuguaccaauu

SEQ ID NO: 804919 - RNA, 19 nt, Homo sapiens
caagaaggauuuggcauuu

SEQ ID NO: 804920 - RNA, 19 nt, Homo sapiens
guaaaccgaucuccaaaga

SEQ ID NO: 804921 - RNA, 19 nt, Homo sapiens
aaauagaccuggcauuaaa

SEQ ID NO: 804922 - RNA, 19 nt, Homo sapiens
acaaagaacccaaagauaa

SEQ ID NO: 804923 - RNA, 19 nt, Homo sapiens
gaugacagauuaccgcauu

SEQ ID NO: 804924 - RNA, 19 nt, Homo sapiens
caaagaacccaaagauaaa

SEQ ID NO: 804925 - RNA, 19 nt, Homo sapiens
cuaaauagaccuggcauua

SEQ ID NO: 804926 - RNA, 19 nt, Homo sapiens
gcacaaagaacccaaagau

SEQ ID NO: 804927 - RNA, 19 nt, Homo sapiens
guaggauccucccaguuua

SEQ ID NO: 804928 - RNA, 19 nt, Homo sapiens
gaucaguguuugccuuuga

SEQ ID NO: 804929 - RNA, 19 nt, Homo sapiens
gaacaugguccaagacaau

SEQ ID NO: 804930 - RNA, 19 nt, Homo sapiens
ggagagcuuuccagaguug

SEQ ID NO: 804931 - RNA, 19 nt, Homo sapiens
gcaaauacagcaacacaga

SEQ ID NO: 804932 - RNA, 19 nt, Homo sapiens
ggcaucacguguauuuaua

SEQ ID NO: 804933 - RNA, 19 nt, Homo sapiens
ggacaaaagugaaaugaau

SEQ ID NO: 804934 - RNA, 19 nt, Homo sapiens
gagcuaagccggaggaugu

SEQ ID NO: 804935 - RNA, 19 nt, Homo sapiens
caggagagcuuuccagagu

SEQ ID NO: 804936 - RNA, 19 nt, Homo sapiens
aaauguaccugaugaacaa

SEQ ID NO: 804937 - RNA, 19 nt, Homo sapiens
cagauuaccgcauuaagua

SEQ ID NO: 804938 - RNA, 19 nt, Homo sapiens
gcacaagaguuggccaaga

SEQ ID NO: 804939 - RNA, 19 nt, Homo sapiens
acaagaaggugaucagugu

SEQ ID NO: 804940 - RNA, 19 nt, Homo sapiens
gcugagauguggcuggaaa

SEQ ID NO: 804941 - RNA, 19 nt, Homo sapiens
caauaaaucugauguacac

SEQ ID NO: 804942 - RNA, 19 nt, Homo sapiens
cgacauguuugugagauuu

SEQ ID NO: 804943 - RNA, 19 nt, Homo sapiens
gcaguaaaccgaucuccaa

SEQ ID NO: 804944 - RNA, 19 nt, Homo sapiens
caaugaaucuuugcucuuc

SEQ ID NO: 804945 - RNA, 19 nt, Homo sapiens
gaagagugagcacaaagaa

SEQ ID NO: 804946 - RNA, 19 nt, Homo sapiens
ggaaugcaguggcgcaauc

SEQ ID NO: 804947 - RNA, 19 nt, Homo sapiens
uaaauagaccuggcauuaa

SEQ ID NO: 804948 - RNA, 19 nt, Homo sapiens
gaaauguaccugaugaaca

SEQ ID NO: 804949 - RNA, 19 nt, Homo sapiens
ugacaaggccaaacaaguu

SEQ ID NO: 804950 - RNA, 19 nt, Homo sapiens
gaccuggcauuaaauuuca

SEQ ID NO: 804951 - RNA, 19 nt, Homo sapiens
uuaaagccauuucauguuc

SEQ ID NO: 804952 - RNA, 19 nt, Homo sapiens
gagaaucaaucaggaaucu

SEQ ID NO: 804953 - RNA, 19 nt, Homo sapiens
gagcagaugaugacgugua

SEQ ID NO: 804954 - RNA, 19 nt, Homo sapiens
acccaaagauuguuuauag

SEQ ID NO: 804955 - RNA, 19 nt, Homo sapiens
gcuccgccaucgcacaaua

SEQ ID NO: 804956 - RNA, 19 nt, Homo sapiens
agauugagcuuucugaaca

SEQ ID NO: 804957 - RNA, 19 nt, Homo sapiens
guggguggcuuugauguuu

SEQ ID NO: 804958 - RNA, 19 nt, Homo sapiens
ggcauuaaauuucaagaag

SEQ ID NO: 804959 - RNA, 19 nt, Homo sapiens
guucaguucuucucaagug

SEQ ID NO: 804960 - RNA, 19 nt, Homo sapiens
gaaccauuuugucucauua

SEQ ID NO: 804961 - RNA, 19 nt, Homo sapiens
ggagggcugcguauuugua

SEQ ID NO: 804962 - RNA, 19 nt, Homo sapiens
gaccagagggcgcaucauu

SEQ ID NO: 804963 - RNA, 19 nt, Homo sapiens
gaagguguguccggagguu

SEQ ID NO: 804964 - RNA, 19 nt, Homo sapiens
uaaauagccugaugcucau

SEQ ID NO: 804965 - RNA, 19 nt, Homo sapiens
gggaguguguuuagucugu

SEQ ID NO: 804966 - RNA, 19 nt, Homo sapiens
gaguaccuguuaguuagua

SEQ ID NO: 804967 - RNA, 19 nt, Homo sapiens
gcuuaacuuugacuugaaa

SEQ ID NO: 804968 - RNA, 19 nt, Homo sapiens
ccagagggcgcaucauuga

SEQ ID NO: 804969 - RNA, 19 nt, Homo sapiens
gguaaauguucuguuguga

SEQ ID NO: 804970 - RNA, 19 nt, Homo sapiens
gaacgucaagcucgugguu

SEQ ID NO: 804971 - RNA, 19 nt, Homo sapiens
ugaggaggcacgcguauuu

SEQ ID NO: 804972 - RNA, 19 nt, Homo sapiens
uugaacugaugacagauua

SEQ ID NO: 804973 - RNA, 19 nt, Homo sapiens
cacaaagaacccaaagaua

SEQ ID NO: 804974 - RNA, 19 nt, Homo sapiens
gaggaggcacgcguauuua

SEQ ID NO: 804975 - RNA, 19 nt, Homo sapiens
uuagagaucuccauaacag

SEQ ID NO: 804976 - RNA, 19 nt, Homo sapiens
ccaaagauuguuuauagug

SEQ ID NO: 804977 - RNA, 19 nt, Homo sapiens
ucaagaaggauuuggcauu

SEQ ID NO: 804978 - RNA, 19 nt, Homo sapiens
gauucuaccuuuuguguuu

SEQ ID NO: 804979 - RNA, 19 nt, Homo sapiens
guucuguugugauuguuaa

SEQ ID NO: 804980 - RNA, 19 nt, Homo sapiens
ucugguaaauguucuguug

SEQ ID NO: 804981 - RNA, 19 nt, Homo sapiens
caaacucccugaagaagcu

SEQ ID NO: 804982 - RNA, 19 nt, Homo sapiens
ggagcuggaugcacaagag

SEQ ID NO: 804983 - RNA, 19 nt, Homo sapiens
gcaacacagaaauucauaa

SEQ ID NO: 804984 - RNA, 19 nt, Homo sapiens
cagaucaaaugugccuuaa

SEQ ID NO: 804985 - RNA, 19 nt, Homo sapiens
ucagaucaaaugugccuua

SEQ ID NO: 804986 - RNA, 19 nt, Homo sapiens
gaaaguucaguucuucuca

SEQ ID NO: 804987 - RNA, 19 nt, Homo sapiens
gcaucacguguauuuauaa

SEQ ID NO: 804988 - RNA, 19 nt, Homo sapiens
guucugggccaacaaauau

SEQ ID NO: 804989 - RNA, 19 nt, Homo sapiens
ccucccaguuuaacaauga

SEQ ID NO: 804990 - RNA, 19 nt, Homo sapiens
cgacaggaacuuucucuuc

SEQ ID NO: 804991 - RNA, 19 nt, Homo sapiens
gagcaaauacagcaacaca

SEQ ID NO: 804992 - RNA, 19 nt, Homo sapiens
ugucuggucuuaugagaug

SEQ ID NO: 804993 - RNA, 19 nt, Homo sapiens
gagaugguuuucauucuuu

SEQ ID NO: 804994 - RNA, 19 nt, Homo sapiens
guuguaagauaaggaaaug

SEQ ID NO: 804995 - RNA, 19 nt, Homo sapiens
cagaccugcuuaacuuuga

SEQ ID NO: 804996 - RNA, 19 nt, Homo sapiens
gaguguguuuagucuguuu

SEQ ID NO: 804997 - RNA, 19 nt, Homo sapiens
gcucugccauuucuugagu

SEQ ID NO: 804998 - RNA, 19 nt, Homo sapiens
uacagaacaugguccaaga

SEQ ID NO: 804999 - RNA, 19 nt, Homo sapiens
ucuugacccuucucuuuaa

SEQ ID NO: 805000 - RNA, 19 nt, Homo sapiens
caagugguuuucuuacaua

SEQ ID NO: 805001 - RNA, 19 nt, Homo sapiens
ugaaguccguauacaagga

SEQ ID NO: 805002 - RNA, 19 nt, Homo sapiens
caagagaaucaaucaggaa

SEQ ID NO: 805003 - RNA, 19 nt, Homo sapiens
cauuagagaucuccauaac

SEQ ID NO: 805004 - RNA, 19 nt, Homo sapiens
ugauagacuugccauuuua

SEQ ID NO: 805005 - RNA, 19 nt, Homo sapiens
ccgaguagcugggauuaca

SEQ ID NO: 805006 - RNA, 19 nt, Homo sapiens
gcaaucuuggcucacuuua

SEQ ID NO: 805007 - RNA, 19 nt, Homo sapiens
ugaacauuccugcaaagua

SEQ ID NO: 805008 - RNA, 19 nt, Homo sapiens
caaauacagcaacacagaa

SEQ ID NO: 805009 - RNA, 19 nt, Homo sapiens
gagaucuccauaacaguaa

SEQ ID NO: 805010 - RNA, 19 nt, Homo sapiens
agagaucuccauaacagua

SEQ ID NO: 805011 - RNA, 19 nt, Homo sapiens
gaauuacgagcagaacaaa

SEQ ID NO: 805012 - RNA, 19 nt, Homo sapiens
gugauagacuugccauuuu

SEQ ID NO: 805013 - RNA, 19 nt, Homo sapiens
gcaagacccuucugaaaua

SEQ ID NO: 805014 - RNA, 19 nt, Homo sapiens
guacagggcuccagaagua

SEQ ID NO: 805015 - RNA, 19 nt, Homo sapiens
gaugaguccuuuacuauaa

SEQ ID NO: 805016 - RNA, 19 nt, Homo sapiens
caagacaacacaagaauua

SEQ ID NO: 805017 - RNA, 19 nt, Homo sapiens
gaaaucaaguuguaugugu

SEQ ID NO: 805018 - RNA, 19 nt, Homo sapiens
gaacuaagacaugucaaua

SEQ ID NO: 805019 - RNA, 19 nt, Homo sapiens
gaaagcagguuuuaaauug

SEQ ID NO: 805020 - RNA, 19 nt, Homo sapiens
gaagcacucucgauacuug

SEQ ID NO: 805021 - RNA, 19 nt, Homo sapiens
gaugaaagaacucuaagua

SEQ ID NO: 805022 - RNA, 19 nt, Homo sapiens
caacaaaggauucagauga

SEQ ID NO: 805023 - RNA, 19 nt, Homo sapiens
gaaaugagacagaaauuca

SEQ ID NO: 805024 - RNA, 19 nt, Homo sapiens
ggagaguaauuuaugcuuu

SEQ ID NO: 805025 - RNA, 19 nt, Homo sapiens
guucaagccuccugaguaa

SEQ ID NO: 805026 - RNA, 19 nt, Homo sapiens
gaaacuaugucccuuccuu

SEQ ID NO: 805027 - RNA, 19 nt, Homo sapiens
uaaaugaccugcaucaagu

SEQ ID NO: 805028 - RNA, 19 nt, Homo sapiens
aaaccuaguuaccugauua

SEQ ID NO: 805029 - RNA, 19 nt, Homo sapiens
ugauauaccuguaacugua

SEQ ID NO: 805030 - RNA, 19 nt, Homo sapiens
gaaauggcauacucucgaa

SEQ ID NO: 805031 - RNA, 19 nt, Homo sapiens
gaaauucagugacgaaggu

SEQ ID NO: 805032 - RNA, 19 nt, Homo sapiens
gcaauuagucagcugauuu

SEQ ID NO: 805033 - RNA, 19 nt, Homo sapiens
aaauguaucucuugccuaa

SEQ ID NO: 805034 - RNA, 19 nt, Homo sapiens
gagaguaauuuaugcuuug

SEQ ID NO: 805035 - RNA, 19 nt, Homo sapiens
aaacuacucucuauugguu

SEQ ID NO: 805036 - RNA, 19 nt, Homo sapiens
gcucaaccaugccaaugua

SEQ ID NO: 805037 - RNA, 19 nt, Homo sapiens
ccaaagggcccuaaccuaa

SEQ ID NO: 805038 - RNA, 19 nt, Homo sapiens
ugacuaauguucuguccua

SEQ ID NO: 805039 - RNA, 19 nt, Homo sapiens
gagauaaagccaaagagua

SEQ ID NO: 805040 - RNA, 19 nt, Homo sapiens
gggagaagcaggauacuuu

SEQ ID NO: 805041 - RNA, 19 nt, Homo sapiens
caacaggggugcaauuuaa

SEQ ID NO: 805042 - RNA, 19 nt, Homo sapiens
caaaguaaauucaguuggu

SEQ ID NO: 805043 - RNA, 19 nt, Homo sapiens
gaaaaccacuuaagcaaga

SEQ ID NO: 805044 - RNA, 19 nt, Homo sapiens
uuagucagcugauuugauu

SEQ ID NO: 805045 - RNA, 19 nt, Homo sapiens
caacagaaaugauauaccu

SEQ ID NO: 805046 - RNA, 19 nt, Homo sapiens
gaugaaaccaagcuuaauu

SEQ ID NO: 805047 - RNA, 19 nt, Homo sapiens
aaacacggcuucuuucauc

SEQ ID NO: 805048 - RNA, 19 nt, Homo sapiens
gaaaugauauaccuguaac

SEQ ID NO: 805049 - RNA, 19 nt, Homo sapiens
gagcaaauggauuguuuaa

SEQ ID NO: 805050 - RNA, 19 nt, Homo sapiens
ccuaaugacuugguaaauu

SEQ ID NO: 805051 - RNA, 19 nt, Homo sapiens
gcaaugcaaucucaacagu

SEQ ID NO: 805052 - RNA, 19 nt, Homo sapiens
ggcagaggcuguuccauug

SEQ ID NO: 805053 - RNA, 19 nt, Homo sapiens
ccugaaggcuaucaacuuu

SEQ ID NO: 805054 - RNA, 19 nt, Homo sapiens
ucacaaacacggcuucuuu

SEQ ID NO: 805055 - RNA, 19 nt, Homo sapiens
ucagauaacucaguacaga

SEQ ID NO: 805056 - RNA, 19 nt, Homo sapiens
ggaguaaccgacaauauau

SEQ ID NO: 805057 - RNA, 19 nt, Homo sapiens
cugcagccauuucuuguua

SEQ ID NO: 805058 - RNA, 19 nt, Homo sapiens
cagcaaagcuucagaaaau

SEQ ID NO: 805059 - RNA, 19 nt, Homo sapiens
gauagaggguuauuuacuc

SEQ ID NO: 805060 - RNA, 19 nt, Homo sapiens
gcaaaucaacacuuuauag

SEQ ID NO: 805061 - RNA, 19 nt, Homo sapiens
gagaugaguccuuuacuau

SEQ ID NO: 805062 - RNA, 19 nt, Homo sapiens
uaacugagauggaauuuug

SEQ ID NO: 805063 - RNA, 19 nt, Homo sapiens
aaacuacucuugacaugau

SEQ ID NO: 805064 - RNA, 19 nt, Homo sapiens
ggugaugaaucucuuccua

SEQ ID NO: 805065 - RNA, 19 nt, Homo sapiens
gaaguacuccugaggucua

SEQ ID NO: 805066 - RNA, 19 nt, Homo sapiens
agagaugaguccuuuacua

SEQ ID NO: 805067 - RNA, 19 nt, Homo sapiens
gugagaacuuuauuuguug

SEQ ID NO: 805068 - RNA, 19 nt, Homo sapiens
ccacucaucuacaaaguca

SEQ ID NO: 805069 - RNA, 19 nt, Homo sapiens
cuuaguaggucauugguuu

SEQ ID NO: 805070 - RNA, 19 nt, Homo sapiens
gugcagauauuuaugaagu

SEQ ID NO: 805071 - RNA, 19 nt, Homo sapiens
gaccagaacuugugaaaau

SEQ ID NO: 805072 - RNA, 19 nt, Homo sapiens
ggaauaucauguaucagau

SEQ ID NO: 805073 - RNA, 19 nt, Homo sapiens
caagacccuucugaaauaa

SEQ ID NO: 805074 - RNA, 19 nt, Homo sapiens
gccaaacacauauucauaa

SEQ ID NO: 805075 - RNA, 19 nt, Homo sapiens
gcucucaacaugaagguua

SEQ ID NO: 805076 - RNA, 19 nt, Homo sapiens
ucaguaaucagcaaaguaa

SEQ ID NO: 805077 - RNA, 19 nt, Homo sapiens
cagccaagcagcacuauuu

SEQ ID NO: 805078 - RNA, 19 nt, Homo sapiens
cuaaaggacuauauacauc

SEQ ID NO: 805079 - RNA, 19 nt, Homo sapiens
ugaaauggguaaaggacaa

SEQ ID NO: 805080 - RNA, 19 nt, Homo sapiens
caaaugcugugaauuacuc

SEQ ID NO: 805081 - RNA, 19 nt, Homo sapiens
caaagggcccuaaccuaaa

SEQ ID NO: 805082 - RNA, 19 nt, Homo sapiens
uauagacacuuucauaugg

SEQ ID NO: 805083 - RNA, 19 nt, Homo sapiens
uauaguaacugagauggaa

SEQ ID NO: 805084 - RNA, 19 nt, Homo sapiens
ggacucgcauuuauucaca

SEQ ID NO: 805085 - RNA, 19 nt, Homo sapiens
uacaaggacucgcauuuau

SEQ ID NO: 805086 - RNA, 19 nt, Homo sapiens
uggaguaaccgacaauaua

SEQ ID NO: 805087 - RNA, 19 nt, Homo sapiens
guaggaagaaacuugauuu

SEQ ID NO: 805088 - RNA, 19 nt, Homo sapiens
ggauuuauguaggaagaaa

SEQ ID NO: 805089 - RNA, 19 nt, Homo sapiens
guugcauucugaacaaaua

SEQ ID NO: 805090 - RNA, 19 nt, Homo sapiens
ccaggauaaugacaaauug

SEQ ID NO: 805091 - RNA, 19 nt, Homo sapiens
gggcagaggcuguuccauu

SEQ ID NO: 805092 - RNA, 19 nt, Homo sapiens
guaggucauugguuugauu

SEQ ID NO: 805093 - RNA, 19 nt, Homo sapiens
ugugauagaggguuauuua

SEQ ID NO: 805094 - RNA, 19 nt, Homo sapiens
acagucaacuuuguaauga

SEQ ID NO: 805095 - RNA, 19 nt, Homo sapiens
ccuaauccauggucuaguu

SEQ ID NO: 805096 - RNA, 19 nt, Homo sapiens
cagaaaugauauaccugua

SEQ ID NO: 805097 - RNA, 19 nt, Homo sapiens
gaagcugaauucauuucug

SEQ ID NO: 805098 - RNA, 19 nt, Homo sapiens
ggcacaccaugaauagaua

SEQ ID NO: 805099 - RNA, 19 nt, Homo sapiens
gggagcugaucgcuauuaa

SEQ ID NO: 805100 - RNA, 19 nt, Homo sapiens
gcacuucgauauccuuacu

SEQ ID NO: 805101 - RNA, 19 nt, Homo sapiens
cagcugauuugauuacaau

SEQ ID NO: 805102 - RNA, 19 nt, Homo sapiens
cauagacacugugcuaaug

SEQ ID NO: 805103 - RNA, 19 nt, Homo sapiens
gaauagauacacaacaauc

SEQ ID NO: 805104 - RNA, 19 nt, Homo sapiens
uauaagaaauggcauacuc

SEQ ID NO: 805105 - RNA, 19 nt, Homo sapiens
gcccaugugugauaggauu

SEQ ID NO: 805106 - RNA, 19 nt, Homo sapiens
uuacugggaugucaggaaa

SEQ ID NO: 805107 - RNA, 19 nt, Homo sapiens
gacuauaccucauuuacag

SEQ ID NO: 805108 - RNA, 19 nt, Homo sapiens
gggagacagucacguccua

SEQ ID NO: 805109 - RNA, 19 nt, Homo sapiens
ucuauugguuccaggauaa

SEQ ID NO: 805110 - RNA, 19 nt, Homo sapiens
acagucacaugccacauuu

SEQ ID NO: 805111 - RNA, 19 nt, Homo sapiens
gguuccagcucuacaaguu

SEQ ID NO: 805112 - RNA, 19 nt, Homo sapiens
ccaagcagcacuauuugaa

SEQ ID NO: 805113 - RNA, 19 nt, Homo sapiens
gcaagacccuucugaaaua

SEQ ID NO: 805114 - RNA, 19 nt, Homo sapiens
guacagggcuccagaagua

SEQ ID NO: 805115 - RNA, 19 nt, Homo sapiens
gaugaguccuuuacuauaa

SEQ ID NO: 805116 - RNA, 19 nt, Homo sapiens
caagacaacacaagaauua

SEQ ID NO: 805117 - RNA, 19 nt, Homo sapiens
gaaaucaaguuguaugugu

SEQ ID NO: 805118 - RNA, 19 nt, Homo sapiens
gaacuaagacaugucaaua

SEQ ID NO: 805119 - RNA, 19 nt, Homo sapiens
gaaagcagguuuuaaauug

SEQ ID NO: 805120 - RNA, 19 nt, Homo sapiens
gaagcacucucgauacuug

SEQ ID NO: 805121 - RNA, 19 nt, Homo sapiens
gaugaaagaacucuaagua

SEQ ID NO: 805122 - RNA, 19 nt, Homo sapiens
caacaaaggauucagauga

SEQ ID NO: 805123 - RNA, 19 nt, Homo sapiens
gaaaugagacagaaauuca

SEQ ID NO: 805124 - RNA, 19 nt, Homo sapiens
ggagaguaauuuaugcuuu

SEQ ID NO: 805125 - RNA, 19 nt, Homo sapiens
guucaagccuccugaguaa

SEQ ID NO: 805126 - RNA, 19 nt, Homo sapiens
gaaacuaugucccuuccuu

SEQ ID NO: 805127 - RNA, 19 nt, Homo sapiens
uaaaugaccugcaucaagu

SEQ ID NO: 805128 - RNA, 19 nt, Homo sapiens
aaaccuaguuaccugauua

SEQ ID NO: 805129 - RNA, 19 nt, Homo sapiens
ugauauaccuguaacugua

SEQ ID NO: 805130 - RNA, 19 nt, Homo sapiens
gaaauggcauacucucgaa

SEQ ID NO: 805131 - RNA, 19 nt, Homo sapiens
gaaauucagugacgaaggu

SEQ ID NO: 805132 - RNA, 19 nt, Homo sapiens
gcaauuagucagcugauuu

SEQ ID NO: 805133 - RNA, 19 nt, Homo sapiens
aaauguaucucuugccuaa

SEQ ID NO: 805134 - RNA, 19 nt, Homo sapiens
gagaguaauuuaugcuuug

SEQ ID NO: 805135 - RNA, 19 nt, Homo sapiens
aaacuacucucuauugguu

SEQ ID NO: 805136 - RNA, 19 nt, Homo sapiens
gcucaaccaugccaaugua

SEQ ID NO: 805137 - RNA, 19 nt, Homo sapiens
ccaaagggcccuaaccuaa

SEQ ID NO: 805138 - RNA, 19 nt, Homo sapiens
ugacuaauguucuguccua

SEQ ID NO: 805139 - RNA, 19 nt, Homo sapiens
gagauaaagccaaagagua

SEQ ID NO: 805140 - RNA, 19 nt, Homo sapiens
gggagaagcaggauacuuu

SEQ ID NO: 805141 - RNA, 19 nt, Homo sapiens
caacaggggugcaauuuaa

SEQ ID NO: 805142 - RNA, 19 nt, Homo sapiens
caaaguaaauucaguuggu

SEQ ID NO: 805143 - RNA, 19 nt, Homo sapiens
gaaaaccacuuaagcaaga

SEQ ID NO: 805144 - RNA, 19 nt, Homo sapiens
uuagucagcugauuugauu

SEQ ID NO: 805145 - RNA, 19 nt, Homo sapiens
caacagaaaugauauaccu

SEQ ID NO: 805146 - RNA, 19 nt, Homo sapiens
gaugaaaccaagcuuaauu

SEQ ID NO: 805147 - RNA, 19 nt, Homo sapiens
aaacacggcuucuuucauc

SEQ ID NO: 805148 - RNA, 19 nt, Homo sapiens
gaaaugauauaccuguaac

SEQ ID NO: 805149 - RNA, 19 nt, Homo sapiens
gagcaaauggauuguuuaa

SEQ ID NO: 805150 - RNA, 19 nt, Homo sapiens
ccuaaugacuugguaaauu

SEQ ID NO: 805151 - RNA, 19 nt, Homo sapiens
gcaaugcaaucucaacagu

SEQ ID NO: 805152 - RNA, 19 nt, Homo sapiens
ggcagaggcuguuccauug

SEQ ID NO: 805153 - RNA, 19 nt, Homo sapiens
ccugaaggcuaucaacuuu

SEQ ID NO: 805154 - RNA, 19 nt, Homo sapiens
ucacaaacacggcuucuuu

SEQ ID NO: 805155 - RNA, 19 nt, Homo sapiens
ucagauaacucaguacaga

SEQ ID NO: 805156 - RNA, 19 nt, Homo sapiens
ggaguaaccgacaauauau

SEQ ID NO: 805157 - RNA, 19 nt, Homo sapiens
cugcagccauuucuuguua

SEQ ID NO: 805158 - RNA, 19 nt, Homo sapiens
cagcaaagcuucagaaaau

SEQ ID NO: 805159 - RNA, 19 nt, Homo sapiens
gauagaggguuauuuacuc

SEQ ID NO: 805160 - RNA, 19 nt, Homo sapiens
gcaaaucaacacuuuauag

SEQ ID NO: 805161 - RNA, 19 nt, Homo sapiens
gagaugaguccuuuacuau

SEQ ID NO: 805162 - RNA, 19 nt, Homo sapiens
uaacugagauggaauuuug

SEQ ID NO: 805163 - RNA, 19 nt, Homo sapiens
aaacuacucuugacaugau

SEQ ID NO: 805164 - RNA, 19 nt, Homo sapiens
ggugaugaaucucuuccua

SEQ ID NO: 805165 - RNA, 19 nt, Homo sapiens
gaaguacuccugaggucua

SEQ ID NO: 805166 - RNA, 19 nt, Homo sapiens
agagaugaguccuuuacua

SEQ ID NO: 805167 - RNA, 19 nt, Homo sapiens
gugagaacuuuauuuguug

SEQ ID NO: 805168 - RNA, 19 nt, Homo sapiens
ccacucaucuacaaaguca

SEQ ID NO: 805169 - RNA, 19 nt, Homo sapiens
cuuaguaggucauugguuu

SEQ ID NO: 805170 - RNA, 19 nt, Homo sapiens
gugcagauauuuaugaagu

SEQ ID NO: 805171 - RNA, 19 nt, Homo sapiens
gaccagaacuugugaaaau

SEQ ID NO: 805172 - RNA, 19 nt, Homo sapiens
ggaauaucauguaucagau

SEQ ID NO: 805173 - RNA, 19 nt, Homo sapiens
caagacccuucugaaauaa

SEQ ID NO: 805174 - RNA, 19 nt, Homo sapiens
gccaaacacauauucauaa

SEQ ID NO: 805175 - RNA, 19 nt, Homo sapiens
gcucucaacaugaagguua

SEQ ID NO: 805176 - RNA, 19 nt, Homo sapiens
ucaguaaucagcaaaguaa

SEQ ID NO: 805177 - RNA, 19 nt, Homo sapiens
cagccaagcagcacuauuu

SEQ ID NO: 805178 - RNA, 19 nt, Homo sapiens
cuaaaggacuauauacauc

SEQ ID NO: 805179 - RNA, 19 nt, Homo sapiens
ugaaauggguaaaggacaa

SEQ ID NO: 805180 - RNA, 19 nt, Homo sapiens
caaaugcugugaauuacuc

SEQ ID NO: 805181 - RNA, 19 nt, Homo sapiens
caaagggcccuaaccuaaa

SEQ ID NO: 805182 - RNA, 19 nt, Homo sapiens
uauagacacuuucauaugg

SEQ ID NO: 805183 - RNA, 19 nt, Homo sapiens
uauaguaacugagauggaa

SEQ ID NO: 805184 - RNA, 19 nt, Homo sapiens
ggacucgcauuuauucaca

SEQ ID NO: 805185 - RNA, 19 nt, Homo sapiens
uacaaggacucgcauuuau

SEQ ID NO: 805186 - RNA, 19 nt, Homo sapiens
uggaguaaccgacaauaua

SEQ ID NO: 805187 - RNA, 19 nt, Homo sapiens
guaggaagaaacuugauuu

SEQ ID NO: 805188 - RNA, 19 nt, Homo sapiens
ggauuuauguaggaagaaa

SEQ ID NO: 805189 - RNA, 19 nt, Homo sapiens
guugcauucugaacaaaua

SEQ ID NO: 805190 - RNA, 19 nt, Homo sapiens
ccaggauaaugacaaauug

SEQ ID NO: 805191 - RNA, 19 nt, Homo sapiens
gggcagaggcuguuccauu

SEQ ID NO: 805192 - RNA, 19 nt, Homo sapiens
guaggucauugguuugauu

SEQ ID NO: 805193 - RNA, 19 nt, Homo sapiens
ugugauagaggguuauuua

SEQ ID NO: 805194 - RNA, 19 nt, Homo sapiens
acagucaacuuuguaauga

SEQ ID NO: 805195 - RNA, 19 nt, Homo sapiens
ccuaauccauggucuaguu

SEQ ID NO: 805196 - RNA, 19 nt, Homo sapiens
cagaaaugauauaccugua

SEQ ID NO: 805197 - RNA, 19 nt, Homo sapiens
ggcacaccaugaauagaua

SEQ ID NO: 805198 - RNA, 19 nt, Homo sapiens
gaagcugaauucauuucug

SEQ ID NO: 805199 - RNA, 19 nt, Homo sapiens
gggagcugaucgcuauuaa

SEQ ID NO: 805200 - RNA, 19 nt, Homo sapiens
gcacuucgauauccuuacu

SEQ ID NO: 805201 - RNA, 19 nt, Homo sapiens
cagcugauuugauuacaau

SEQ ID NO: 805202 - RNA, 19 nt, Homo sapiens
cauagacacugugcuaaug

SEQ ID NO: 805203 - RNA, 19 nt, Homo sapiens
gaauagauacacaacaauc

SEQ ID NO: 805204 - RNA, 19 nt, Homo sapiens
uauaagaaauggcauacuc

SEQ ID NO: 805205 - RNA, 19 nt, Homo sapiens
gggagacagucacguccua

SEQ ID NO: 805206 - RNA, 19 nt, Homo sapiens
gcccaugugugauaggauu

SEQ ID NO: 805207 - RNA, 19 nt, Homo sapiens
uuacugggaugucaggaaa

SEQ ID NO: 805208 - RNA, 19 nt, Homo sapiens
gacuauaccucauuuacag

SEQ ID NO: 805209 - RNA, 19 nt, Homo sapiens
ucuauugguuccaggauaa

SEQ ID NO: 805210 - RNA, 19 nt, Homo sapiens
acagucacaugccacauuu

SEQ ID NO: 805211 - RNA, 19 nt, Homo sapiens
gguuccagcucuacaaguu

SEQ ID NO: 805212 - RNA, 19 nt, Homo sapiens
ccaagcagcacuauuugaa

SEQ ID NO: 805213 - RNA, 19 nt, Homo sapiens
guacagggcuccagaagua

SEQ ID NO: 805214 - RNA, 19 nt, Homo sapiens
gaaaggcaacuucauauua

SEQ ID NO: 805215 - RNA, 19 nt, Homo sapiens
gaguauuccuuuccacuua

SEQ ID NO: 805216 - RNA, 19 nt, Homo sapiens
gauaguaacugcacuuagu

SEQ ID NO: 805217 - RNA, 19 nt, Homo sapiens
gcacaggaaauauuuagua

SEQ ID NO: 805218 - RNA, 19 nt, Homo sapiens
gcucaaccaugccaaugua

SEQ ID NO: 805219 - RNA, 19 nt, Homo sapiens
agaaggauauugacggaua

SEQ ID NO: 805220 - RNA, 19 nt, Homo sapiens
gaaacuuacuggguauaaa

SEQ ID NO: 805221 - RNA, 19 nt, Homo sapiens
gagauugacagaugagaua

SEQ ID NO: 805222 - RNA, 19 nt, Homo sapiens
aaacacggcuucuuucauc

SEQ ID NO: 805223 - RNA, 19 nt, Homo sapiens
ccugaaggcuaucaacuuu

SEQ ID NO: 805224 - RNA, 19 nt, Homo sapiens
ucacaaacacggcuucuuu

SEQ ID NO: 805225 - RNA, 19 nt, Homo sapiens
uaacugcacuuaguauuuc

SEQ ID NO: 805226 - RNA, 19 nt, Homo sapiens
caauaaagacuccaugaga

SEQ ID NO: 805227 - RNA, 19 nt, Homo sapiens
ggugagaaauaguacagaa

SEQ ID NO: 805228 - RNA, 19 nt, Homo sapiens
gaaguacuccugaggucua

SEQ ID NO: 805229 - RNA, 19 nt, Homo sapiens
guaacugcacuuaguauuu

SEQ ID NO: 805230 - RNA, 19 nt, Homo sapiens
gaauugcacaggaaauauu

SEQ ID NO: 805231 - RNA, 19 nt, Homo sapiens
gaccagaacuugugaaaau

SEQ ID NO: 805232 - RNA, 19 nt, Homo sapiens
ggaauaucauguaucagau

SEQ ID NO: 805233 - RNA, 19 nt, Homo sapiens
cugaagagauugacagaug

SEQ ID NO: 805234 - RNA, 19 nt, Homo sapiens
ggacucgcauuuauucaca

SEQ ID NO: 805235 - RNA, 19 nt, Homo sapiens
uacaaggacucgcauuuau

SEQ ID NO: 805236 - RNA, 19 nt, Homo sapiens
ccacuaaugguguacuaua

SEQ ID NO: 805237 - RNA, 19 nt, Homo sapiens
acacuaacauuaaggacuu

SEQ ID NO: 805238 - RNA, 19 nt, Homo sapiens
ugacggauauuccagaaca

SEQ ID NO: 805239 - RNA, 19 nt, Homo sapiens
ugaagagauugacagauga

SEQ ID NO: 805240 - RNA, 19 nt, Homo sapiens
agauagaccuaggauagua

SEQ ID NO: 805241 - RNA, 19 nt, Homo sapiens
guacagaauaccacuaaug

SEQ ID NO: 805242 - RNA, 19 nt, Homo sapiens
gggagcugaucgcuauuaa

SEQ ID NO: 805243 - RNA, 19 nt, Homo sapiens
ggcacaccaugaauagaua

SEQ ID NO: 805244 - RNA, 19 nt, Homo sapiens
gugcaaaugcuugaauaua

SEQ ID NO: 805245 - RNA, 19 nt, Homo sapiens
gagaaauaguacagaauac

SEQ ID NO: 805246 - RNA, 19 nt, Homo sapiens
gaauagauacacaacaauc

SEQ ID NO: 805247 - RNA, 19 nt, Homo sapiens
cagagaagaguauuccuuu

SEQ ID NO: 805248 - RNA, 19 nt, Homo sapiens
uuacaaggacucgcauuua

SEQ ID NO: 805249 - RNA, 19 nt, Homo sapiens
gggagacagucacguccua

SEQ ID NO: 805250 - RNA, 19 nt, Homo sapiens
gugcuaggcugagggaauu

SEQ ID NO: 805251 - RNA, 19 nt, Homo sapiens
cucauaaccugaagagauu

SEQ ID NO: 805252 - RNA, 19 nt, Homo sapiens
ugagggaauuccacacuga

SEQ ID NO: 805253 - RNA, 19 nt, Homo sapiens
gcagagaagaguauuccuu

SEQ ID NO: 805254 - RNA, 19 nt, Homo sapiens
ugagauagaccuaggauag

SEQ ID NO: 805255 - RNA, 19 nt, Homo sapiens
gacuuugacacuaacauua

SEQ ID NO: 805256 - RNA, 19 nt, Homo sapiens
ccaauaacuuaaagaccuu

SEQ ID NO: 805257 - RNA, 19 nt, Homo sapiens
caaggacucgcauuuauuc

SEQ ID NO: 805258 - RNA, 19 nt, Homo sapiens
cugcagaacugaaccacuu

SEQ ID NO: 805259 - RNA, 19 nt, Homo sapiens
uaaggcagaagacugauuu

SEQ ID NO: 805260 - RNA, 19 nt, Homo sapiens
gugugcaaaugcuugaaua

SEQ ID NO: 805261 - RNA, 19 nt, Homo sapiens
guguguacccaauaacuua

SEQ ID NO: 805262 - RNA, 19 nt, Homo sapiens
aaaccuccauauacagauu

SEQ ID NO: 805263 - RNA, 19 nt, Homo sapiens
gccaauguagucaaauuaa

SEQ ID NO: 805264 - RNA, 19 nt, Homo sapiens
cuucuuucaucgagacuua

SEQ ID NO: 805265 - RNA, 19 nt, Homo sapiens
gauagaccuaggauaguaa

SEQ ID NO: 805266 - RNA, 19 nt, Homo sapiens
gaaauaguacagaauacca

SEQ ID NO: 805267 - RNA, 19 nt, Homo sapiens
gagcugaucgcuauuaaaa

SEQ ID NO: 805268 - RNA, 19 nt, Homo sapiens
gcaggcacaccaugaauag

SEQ ID NO: 805269 - RNA, 19 nt, Homo sapiens
gaucaaaaccuccauauac

SEQ ID NO: 805270 - RNA, 19 nt, Homo sapiens
gacagucacguccuauuga

SEQ ID NO: 805271 - RNA, 19 nt, Homo sapiens
ccuuuccacuuacaacuaa

SEQ ID NO: 805272 - RNA, 19 nt, Homo sapiens
gguguacuauauaagguau

SEQ ID NO: 805273 - RNA, 19 nt, Homo sapiens
cacuaaugguguacuauau

SEQ ID NO: 805274 - RNA, 19 nt, Homo sapiens
gcuauaaggaauaucaugu

SEQ ID NO: 805275 - RNA, 19 nt, Homo sapiens
ucuaugaauugcacaggaa

SEQ ID NO: 805276 - RNA, 19 nt, Homo sapiens
gggaaaaugaucaucuuua

SEQ ID NO: 805277 - RNA, 19 nt, Homo sapiens
gauauuccagaacaacuga

SEQ ID NO: 805278 - RNA, 19 nt, Homo sapiens
aagaaacgaccaacagcua

SEQ ID NO: 805279 - RNA, 19 nt, Homo sapiens
caucauggcagaaguuuac

SEQ ID NO: 805280 - RNA, 19 nt, Homo sapiens
ccaugccaauguagucaaa

SEQ ID NO: 805281 - RNA, 19 nt, Homo sapiens
acagucacguccuauugaa

SEQ ID NO: 805282 - RNA, 19 nt, Homo sapiens
ugguuuggcccgagaaaua

SEQ ID NO: 805283 - RNA, 19 nt, Homo sapiens
uucgggagguuaagucuuu

SEQ ID NO: 805284 - RNA, 19 nt, Homo sapiens
ccacuucggccgugagaug

SEQ ID NO: 805285 - RNA, 19 nt, Homo sapiens
acaaggacucgcauuuauu

SEQ ID NO: 805286 - RNA, 19 nt, Homo sapiens
aggaauaucauguaucaga

SEQ ID NO: 805287 - RNA, 19 nt, Homo sapiens
aaucuuuaccagcucauua

SEQ ID NO: 805288 - RNA, 19 nt, Homo sapiens
gcacuuaguauuucauagc

SEQ ID NO: 805289 - RNA, 19 nt, Homo sapiens
gaaacgaccaacagcuagu

SEQ ID NO: 805290 - RNA, 19 nt, Homo sapiens
uuacaagcgggauggauuu

SEQ ID NO: 805291 - RNA, 19 nt, Homo sapiens
gggauggauuucucuaagg

SEQ ID NO: 805292 - RNA, 19 nt, Homo sapiens
ucgcauuuauucacaaaca

SEQ ID NO: 805293 - RNA, 19 nt, Homo sapiens
uaaguuguuuccugagucu

SEQ ID NO: 805294 - RNA, 19 nt, Homo sapiens
ggagcugaucgcuauuaaa

SEQ ID NO: 805295 - RNA, 19 nt, Homo sapiens
gguacugguuguugaaagg

SEQ ID NO: 805296 - RNA, 19 nt, Homo sapiens
accaacagcuagucagguu

SEQ ID NO: 805297 - RNA, 19 nt, Homo sapiens
caguccagcuccugagaga

SEQ ID NO: 805298 - RNA, 19 nt, Homo sapiens
gagacagucacguccuauu

SEQ ID NO: 805299 - RNA, 19 nt, Homo sapiens
agacagucacguccuauug

SEQ ID NO: 805300 - RNA, 19 nt, Homo sapiens
gagcaggcacaccaugaau

SEQ ID NO: 805301 - RNA, 19 nt, Homo sapiens
ugacuuugacacuaacauu

SEQ ID NO: 805302 - RNA, 19 nt, Homo sapiens
agagaagaguauuccuuuc

SEQ ID NO: 805303 - RNA, 19 nt, Homo sapiens
ggagaauguuuucaaaucu

SEQ ID NO: 805304 - RNA, 19 nt, Homo sapiens
gaaguuaucagggaaaaug

SEQ ID NO: 805305 - RNA, 19 nt, Homo sapiens
gaagcucaaccaugccaau

SEQ ID NO: 805306 - RNA, 19 nt, Homo sapiens
caccaugaauagauacaca

SEQ ID NO: 805307 - RNA, 19 nt, Homo sapiens
aguuugacuuugacacuaa

SEQ ID NO: 805308 - RNA, 19 nt, Homo sapiens
gagauagaccuaggauagu

SEQ ID NO: 805309 - RNA, 19 nt, Homo sapiens
caagcgggauggauuucuc

SEQ ID NO: 805310 - RNA, 19 nt, Homo sapiens
acucauaaccugaagagau

SEQ ID NO: 805311 - RNA, 19 nt, Homo sapiens
ugaaacuuacuggguauaa

SEQ ID NO: 805312 - RNA, 19 nt, Homo sapiens
gcaucauggcagaaguuua

SEQ ID NO: 805313 - RNA, 19 nt, Homo sapiens
gaaaugagggcuuuaguuu

SEQ ID NO: 805314 - RNA, 19 nt, Homo sapiens
ggugguggcuggugguuua

SEQ ID NO: 805315 - RNA, 19 nt, Homo sapiens
gaagggaaaugagggcuuu

SEQ ID NO: 805316 - RNA, 19 nt, Homo sapiens
gcaacaccauccacaagaa

SEQ ID NO: 805317 - RNA, 19 nt, Homo sapiens
gagagaacuuguaaggauu

SEQ ID NO: 805318 - RNA, 19 nt, Homo sapiens
gcagugcucuggaaucugu

SEQ ID NO: 805319 - RNA, 19 nt, Homo sapiens
caacuucgcugugcucaug

SEQ ID NO: 805320 - RNA, 19 nt, Homo sapiens
ggucaaaguugucuucauc

SEQ ID NO: 805321 - RNA, 19 nt, Homo sapiens
gggccagucuccuucguua

SEQ ID NO: 805322 - RNA, 19 nt, Homo sapiens
ggcaagaacuacaacaaga

SEQ ID NO: 805323 - RNA, 19 nt, Homo sapiens
gcaacaucgucaaguauga

SEQ ID NO: 805324 - RNA, 19 nt, Homo sapiens
ggaaugacacugugaggaa

SEQ ID NO: 805325 - RNA, 19 nt, Homo sapiens
agaagaaggugcacaagga

SEQ ID NO: 805326 - RNA, 19 nt, Homo sapiens
gaaugacacugugaggaaa

SEQ ID NO: 805327 - RNA, 19 nt, Homo sapiens
ggaaaugagggcuuuaguu

SEQ ID NO: 805328 - RNA, 19 nt, Homo sapiens
gcacgugggagacggguua

SEQ ID NO: 805329 - RNA, 19 nt, Homo sapiens
ucucagagcuggugcacaa

SEQ ID NO: 805330 - RNA, 19 nt, Homo sapiens
ggaaccaccugcugaccaa

SEQ ID NO: 805331 - RNA, 19 nt, Homo sapiens
agagagaacuuguaaggau

SEQ ID NO: 805332 - RNA, 19 nt, Homo sapiens
ggucauggccuaucucuuc

SEQ ID NO: 805333 - RNA, 19 nt, Homo sapiens
ggacaagaaccacuucaau

SEQ ID NO: 805334 - RNA, 19 nt, Homo sapiens
gcagccaccucaccaacuu

SEQ ID NO: 805335 - RNA, 19 nt, Homo sapiens
ucacaguccugaacacaga

SEQ ID NO: 805336 - RNA, 19 nt, Homo sapiens
gcggaaagaccgacauuga

SEQ ID NO: 805337 - RNA, 19 nt, Homo sapiens
gcacggacgacaagauuug

SEQ ID NO: 805338 - RNA, 19 nt, Homo sapiens
cagcauccaucaacaagga

SEQ ID NO: 805339 - RNA, 19 nt, Homo sapiens
gggagacggucaucaauac

SEQ ID NO: 805340 - RNA, 19 nt, Homo sapiens
gacaagaaccacuucaaug

SEQ ID NO: 805341 - RNA, 19 nt, Homo sapiens
ggagacggguuacgacaag

SEQ ID NO: 805342 - RNA, 19 nt, Homo sapiens
gcacggacacacugacuga

SEQ ID NO: 805343 - RNA, 19 nt, Homo sapiens
caggacagauggacagguu

SEQ ID NO: 805344 - RNA, 19 nt, Homo sapiens
aagaaccacuucaaugcua

SEQ ID NO: 805345 - RNA, 19 nt, Homo sapiens
guccugggcuuggaucuuu

SEQ ID NO: 805346 - RNA, 19 nt, Homo sapiens
cggacacacugacugagua

SEQ ID NO: 805347 - RNA, 19 nt, Homo sapiens
acaagaaccugugcaucaa

SEQ ID NO: 805348 - RNA, 19 nt, Homo sapiens
cauggacccugucaucuuc

SEQ ID NO: 805349 - RNA, 19 nt, Homo sapiens
gcaagaacuacaacaagau

SEQ ID NO: 805350 - RNA, 19 nt, Homo sapiens
acacgcaccagcucuauuu

SEQ ID NO: 805351 - RNA, 19 nt, Homo sapiens
gaacggcaacuucaauaac

SEQ ID NO: 805352 - RNA, 19 nt, Homo sapiens
gaagcaacacccgcuacua

SEQ ID NO: 805353 - RNA, 19 nt, Homo sapiens
uggagaaugugcagugcua

SEQ ID NO: 805354 - RNA, 19 nt, Homo sapiens
gaggaguacccgagaaaga

SEQ ID NO: 805355 - RNA, 19 nt, Homo sapiens
gcaaugggguggucaaagu

SEQ ID NO: 805356 - RNA, 19 nt, Homo sapiens
ucaaccagguggcccagaa

SEQ ID NO: 805357 - RNA, 19 nt, Homo sapiens
gauugaacuucucuauaag

SEQ ID NO: 805358 - RNA, 19 nt, Homo sapiens
ggucuucaucuucgucuuu

SEQ ID NO: 805359 - RNA, 19 nt, Homo sapiens
caagaacuacaacaagaug

SEQ ID NO: 805360 - RNA, 19 nt, Homo sapiens
cuacaacccucgcgacaac

SEQ ID NO: 805361 - RNA, 19 nt, Homo sapiens
gcgcacggacgacaagauu

SEQ ID NO: 805362 - RNA, 19 nt, Homo sapiens
gggccgagauugaacuucu

SEQ ID NO: 805363 - RNA, 19 nt, Homo sapiens
agagaacuuguaaggauua

SEQ ID NO: 805364 - RNA, 19 nt, Homo sapiens
caaggggacucgaggaauu

SEQ ID NO: 805365 - RNA, 19 nt, Homo sapiens
gcagcgacgucaucauggu

SEQ ID NO: 805366 - RNA, 19 nt, Homo sapiens
ccuacaaaguggagcagaa

SEQ ID NO: 805367 - RNA, 19 nt, Homo sapiens
ucgacaagacucaguauga

SEQ ID NO: 805368 - RNA, 19 nt, Homo sapiens
agaaccacuucaaugcuaa

SEQ ID NO: 805369 - RNA, 19 nt, Homo sapiens
ccaaaaccaucaagcagaa

SEQ ID NO: 805370 - RNA, 19 nt, Homo sapiens
cggaggauguggaaugaca

SEQ ID NO: 805371 - RNA, 19 nt, Homo sapiens
ucacugcgccuuacagaag

SEQ ID NO: 805372 - RNA, 19 nt, Homo sapiens
ggagaaugccacagugaag

SEQ ID NO: 805373 - RNA, 19 nt, Homo sapiens
cgagagagaacuuguaagg

SEQ ID NO: 805374 - RNA, 19 nt, Homo sapiens
ccauugcuguaaauauuuc

SEQ ID NO: 805375 - RNA, 19 nt, Homo sapiens
ggaucgacaagacucagua

SEQ ID NO: 805376 - RNA, 19 nt, Homo sapiens
gcgcaacaucgucaaguau

SEQ ID NO: 805377 - RNA, 19 nt, Homo sapiens
cuacgauggugccgucuuc

SEQ ID NO: 805378 - RNA, 19 nt, Homo sapiens
ggacacacugacugaguau

SEQ ID NO: 805379 - RNA, 19 nt, Homo sapiens
ucaacgaaauggaaaagaa

SEQ ID NO: 805380 - RNA, 19 nt, Homo sapiens
ggccauauuugggcaguuc

SEQ ID NO: 805381 - RNA, 19 nt, Homo sapiens
gcaccucuaccugcuacua

SEQ ID NO: 805382 - RNA, 19 nt, Homo sapiens
ccguguacguggaugauga

SEQ ID NO: 805383 - RNA, 19 nt, Homo sapiens
gaauucggaggauguggaa

SEQ ID NO: 805384 - RNA, 19 nt, Homo sapiens
agaaggugcacaaggagua

SEQ ID NO: 805385 - RNA, 19 nt, Homo sapiens
gagaacuuguaaggauuau

SEQ ID NO: 805386 - RNA, 19 nt, Homo sapiens
gacgucuccuccucuguga

SEQ ID NO: 805387 - RNA, 19 nt, Homo sapiens
gacaagcgcucggcaucca

SEQ ID NO: 805388 - RNA, 19 nt, Homo sapiens
cgcgcaacaucgucaagua

SEQ ID NO: 805389 - RNA, 19 nt, Homo sapiens
cuucugagguugccaaagg

SEQ ID NO: 805390 - RNA, 19 nt, Homo sapiens
ggccuccucuucaucaaca

SEQ ID NO: 805391 - RNA, 19 nt, Homo sapiens
cuacaaaguggagcagaaa

SEQ ID NO: 805392 - RNA, 19 nt, Homo sapiens
caacacccgcuacuacaca

SEQ ID NO: 805393 - RNA, 19 nt, Homo sapiens
ggcuccgaguggacaauua

SEQ ID NO: 805394 - RNA, 19 nt, Homo sapiens
gcgccucucuaguggugaa

SEQ ID NO: 805395 - RNA, 19 nt, Homo sapiens
ccggacgccuucaagauca

SEQ ID NO: 805396 - RNA, 19 nt, Homo sapiens
gguggagaaugccaacuac

SEQ ID NO: 805397 - RNA, 19 nt, Homo sapiens
gagagagaacuuguaagga

SEQ ID NO: 805398 - RNA, 19 nt, Homo sapiens
gcaaccgcguggacuaugc

SEQ ID NO: 805399 - RNA, 19 nt, Homo sapiens
gaggagggagaacuuggaa

SEQ ID NO: 805400 - RNA, 19 nt, Homo sapiens
ggagagggagacagaugga

SEQ ID NO: 805401 - RNA, 19 nt, Homo sapiens
ggauguggaaugacacugu

SEQ ID NO: 805402 - RNA, 19 nt, Homo sapiens
gcaucgcggcugccauuga

SEQ ID NO: 805403 - RNA, 19 nt, Homo sapiens
ccggccugcugcacuauuu

SEQ ID NO: 805404 - RNA, 19 nt, Homo sapiens
ccacggagaaugccacagu

SEQ ID NO: 805405 - RNA, 19 nt, Homo sapiens
aagcagaacagccgcaaug

SEQ ID NO: 805406 - RNA, 19 nt, Homo sapiens
caggaggaguacccgagaa

SEQ ID NO: 805407 - RNA, 19 nt, Homo sapiens
cuacggacgcgcaucaaga

SEQ ID NO: 805408 - RNA, 19 nt, Homo sapiens
aaugagggcuuuaguuucc

SEQ ID NO: 805409 - RNA, 19 nt, Homo sapiens
cagagcuggugcacaacaa

SEQ ID NO: 805410 - RNA, 19 nt, Homo sapiens
aacggcaacuucaauaaca

SEQ ID NO: 805411 - RNA, 19 nt, Homo sapiens
acucacggaucccucaaga

SEQ ID NO: 805412 - RNA, 19 nt, Homo sapiens
gaucgacaagacucaguau

SEQ ID NO: 805413 - RNA, 19 nt, Homo sapiens
gaaggaaguuuauucagaa

SEQ ID NO: 805414 - RNA, 19 nt, Homo sapiens
gaaggaauauuucuacaga

SEQ ID NO: 805415 - RNA, 19 nt, Homo sapiens
gaacuuugaugaugccuuu

SEQ ID NO: 805416 - RNA, 19 nt, Homo sapiens
ggaaggaaguuuauucaga

SEQ ID NO: 805417 - RNA, 19 nt, Homo sapiens
gaugaaacgucaggaauuu

SEQ ID NO: 805418 - RNA, 19 nt, Homo sapiens
ggacgccgcuggagagaaa

SEQ ID NO: 805419 - RNA, 19 nt, Homo sapiens
gcuagaagcauauggaaua

SEQ ID NO: 805420 - RNA, 19 nt, Homo sapiens
ggaauuuacuacacagaaa

SEQ ID NO: 805421 - RNA, 19 nt, Homo sapiens
caacacgggucucugcuuu

SEQ ID NO: 805422 - RNA, 19 nt, Homo sapiens
ccaaauggcccacuuuaaa

SEQ ID NO: 805423 - RNA, 19 nt, Homo sapiens
gaugaaaggcaagcaauua

SEQ ID NO: 805424 - RNA, 19 nt, Homo sapiens
gagaaucgaggacauuuaa

SEQ ID NO: 805425 - RNA, 19 nt, Homo sapiens
aagagaagcuggccugauu

SEQ ID NO: 805426 - RNA, 19 nt, Homo sapiens
gaaaugggcauguguguag

SEQ ID NO: 805427 - RNA, 19 nt, Homo sapiens
gagguaaacauucuaauug

SEQ ID NO: 805428 - RNA, 19 nt, Homo sapiens
ccaagaaccucgcauaguc

SEQ ID NO: 805429 - RNA, 19 nt, Homo sapiens
gaaguuaccuacuccaaaa

SEQ ID NO: 805430 - RNA, 19 nt, Homo sapiens
uggaauacauggccuguuu

SEQ ID NO: 805431 - RNA, 19 nt, Homo sapiens
gaagcuggccugauuaugu

SEQ ID NO: 805432 - RNA, 19 nt, Homo sapiens
ccaagugacugcuccauuc

SEQ ID NO: 805433 - RNA, 19 nt, Homo sapiens
gagauugaauucugugugu

SEQ ID NO: 805434 - RNA, 19 nt, Homo sapiens
ugagguaguugacaaagaa

SEQ ID NO: 805435 - RNA, 19 nt, Homo sapiens
gaaccucauuccuucuuug

SEQ ID NO: 805436 - RNA, 19 nt, Homo sapiens
gaaucgaggacauuuaauu

SEQ ID NO: 805437 - RNA, 19 nt, Homo sapiens
gcaagcaauuagagccuuu

SEQ ID NO: 805438 - RNA, 19 nt, Homo sapiens
cuacagauauuucacagau

SEQ ID NO: 805439 - RNA, 19 nt, Homo sapiens
acacaucccuguuccaaau

SEQ ID NO: 805440 - RNA, 19 nt, Homo sapiens
acagauauuucacagauga

SEQ ID NO: 805441 - RNA, 19 nt, Homo sapiens
cuagcaggcuuuccaguuu

SEQ ID NO: 805442 - RNA, 19 nt, Homo sapiens
agcaagaucuucccaauug

SEQ ID NO: 805443 - RNA, 19 nt, Homo sapiens
gaccuggccucugugcuua

SEQ ID NO: 805444 - RNA, 19 nt, Homo sapiens
cagcaugucuucuacuuca

SEQ ID NO: 805445 - RNA, 19 nt, Homo sapiens
gugcaaagauggacucuac

SEQ ID NO: 805446 - RNA, 19 nt, Homo sapiens
ggagcugcaucacauaguu

SEQ ID NO: 805447 - RNA, 19 nt, Homo sapiens
gcaccucccucacuuugug

SEQ ID NO: 805448 - RNA, 19 nt, Homo sapiens
ugaaggagcuggaccuaag

SEQ ID NO: 805449 - RNA, 19 nt, Homo sapiens
gggcauguguguagaaaca

SEQ ID NO: 805450 - RNA, 19 nt, Homo sapiens
ucgcugagcucaucggaaa

SEQ ID NO: 805451 - RNA, 19 nt, Homo sapiens
gcacuaaaguaauggaacu

SEQ ID NO: 805452 - RNA, 19 nt, Homo sapiens
gaccggaagugcaaagaug

SEQ ID NO: 805453 - RNA, 19 nt, Homo sapiens
aaacagacauggagcucuu

SEQ ID NO: 805454 - RNA, 19 nt, Homo sapiens
ucacacagcugcuacuucu

SEQ ID NO: 805455 - RNA, 19 nt, Homo sapiens
gaaaucagagaaagagaga

SEQ ID NO: 805456 - RNA, 19 nt, Homo sapiens
ccuaucagcugacuucuuc

SEQ ID NO: 805457 - RNA, 19 nt, Homo sapiens
cagcacagaucaacaugga

SEQ ID NO: 805458 - RNA, 19 nt, Homo sapiens
ggagaaucgaggacauuua

SEQ ID NO: 805459 - RNA, 19 nt, Homo sapiens
gagcaagccaacagaguaa

SEQ ID NO: 805460 - RNA, 19 nt, Homo sapiens
ugaaagacaagaaagauga

SEQ ID NO: 805461 - RNA, 19 nt, Homo sapiens
gcaagugaaagacaagaaa

SEQ ID NO: 805462 - RNA, 19 nt, Homo sapiens
gcaauuagagccuuuaggu

SEQ ID NO: 805463 - RNA, 19 nt, Homo sapiens
ggaugaaacgucaggaauu

SEQ ID NO: 805464 - RNA, 19 nt, Homo sapiens
uaauggaacuuugaugaug

SEQ ID NO: 805465 - RNA, 19 nt, Homo sapiens
gcuguggccucacgucuga

SEQ ID NO: 805466 - RNA, 19 nt, Homo sapiens
ggaagaaucugaggaacac

SEQ ID NO: 805467 - RNA, 19 nt, Homo sapiens
ggaucaggcugcaagugaa

SEQ ID NO: 805468 - RNA, 19 nt, Homo sapiens
agagagagauggagaacau

SEQ ID NO: 805469 - RNA, 19 nt, Homo sapiens
ucacagcucuuuuagaauu

SEQ ID NO: 805470 - RNA, 19 nt, Homo sapiens
uaucacagcucuuuuagaa

SEQ ID NO: 805471 - RNA, 19 nt, Homo sapiens
ugacaucgguggagguugu

SEQ ID NO: 805472 - RNA, 19 nt, Homo sapiens
cgaguucacuucccuguag

SEQ ID NO: 805473 - RNA, 19 nt, Homo sapiens
ggagagguaaacauucuaa

SEQ ID NO: 805474 - RNA, 19 nt, Homo sapiens
gcaggaaggaauauuucua

SEQ ID NO: 805475 - RNA, 19 nt, Homo sapiens
ggagaggucugaagaaacc

SEQ ID NO: 805476 - RNA, 19 nt, Homo sapiens
ccucugugguguugcuuua

SEQ ID NO: 805477 - RNA, 19 nt, Homo sapiens
gaggaacacagaacaguga

SEQ ID NO: 805478 - RNA, 19 nt, Homo sapiens
aggaggagcugaaggaguu

SEQ ID NO: 805479 - RNA, 19 nt, Homo sapiens
gaacaaccuggaugacguu

SEQ ID NO: 805480 - RNA, 19 nt, Homo sapiens
gagcuggaccuaaguggaa

SEQ ID NO: 805481 - RNA, 19 nt, Homo sapiens
gcagcaauguccuaugucu

SEQ ID NO: 805482 - RNA, 19 nt, Homo sapiens
gcugauagcccgagugaca

SEQ ID NO: 805483 - RNA, 19 nt, Homo sapiens
gaaaccaggagaucucaug

SEQ ID NO: 805484 - RNA, 19 nt, Homo sapiens
gagcaagaucuucccaauu

SEQ ID NO: 805485 - RNA, 19 nt, Homo sapiens
ccaauggccucuggaugaa

SEQ ID NO: 805486 - RNA, 19 nt, Homo sapiens
guaggugcccugggauuua

SEQ ID NO: 805487 - RNA, 19 nt, Homo sapiens
ugagaucagagacuuauuu

SEQ ID NO: 805488 - RNA, 19 nt, Homo sapiens
ggacacaucccuguuccaa

SEQ ID NO: 805489 - RNA, 19 nt, Homo sapiens
ggagagaugaguaauagca

SEQ ID NO: 805490 - RNA, 19 nt, Homo sapiens
aaaagacgcuagaagcaua

SEQ ID NO: 805491 - RNA, 19 nt, Homo sapiens
cagaaaaccccuauaaauu

SEQ ID NO: 805492 - RNA, 19 nt, Homo sapiens
acaggaagaucuacaagag

SEQ ID NO: 805493 - RNA, 19 nt, Homo sapiens
gcauguguguagaaacaga

SEQ ID NO: 805494 - RNA, 19 nt, Homo sapiens
aaccacacguuuccuauug

SEQ ID NO: 805495 - RNA, 19 nt, Homo sapiens
aauaagaaguuaccuacuc

SEQ ID NO: 805496 - RNA, 19 nt, Homo sapiens
guucuacguuggccacuug

SEQ ID NO: 805497 - RNA, 19 nt, Homo sapiens
ggaaagcuccccagaggua

SEQ ID NO: 805498 - RNA, 19 nt, Homo sapiens
cgggagagaugaguaauag

SEQ ID NO: 805499 - RNA, 19 nt, Homo sapiens
ggaccuggccucugugcuu

SEQ ID NO: 805500 - RNA, 19 nt, Homo sapiens
gggcaucaaccacacguuu

SEQ ID NO: 805501 - RNA, 19 nt, Homo sapiens
gguaaacauucuaauugca

SEQ ID NO: 805502 - RNA, 19 nt, Homo sapiens
uaauugagaucagagacuu

SEQ ID NO: 805503 - RNA, 19 nt, Homo sapiens
cgaggacauuuaauugaga

SEQ ID NO: 805504 - RNA, 19 nt, Homo sapiens
gcugcuacuucuacaaaga

SEQ ID NO: 805505 - RNA, 19 nt, Homo sapiens
gagagagaaaucagagaaa

SEQ ID NO: 805506 - RNA, 19 nt, Homo sapiens
agaaagagagagagagaaa

SEQ ID NO: 805507 - RNA, 19 nt, Homo sapiens
ggagaucucaugccugcaa

SEQ ID NO: 805508 - RNA, 19 nt, Homo sapiens
gggaucaggcugcaaguga

SEQ ID NO: 805509 - RNA, 19 nt, Homo sapiens
caaauggcccacuuuaaag

SEQ ID NO: 805510 - RNA, 19 nt, Homo sapiens
ggucucugcuuugugauga

SEQ ID NO: 805511 - RNA, 19 nt, Homo sapiens
gagggaagaaucugaggaa

SEQ ID NO: 805512 - RNA, 19 nt, Homo sapiens
ggccugcacuugccugaug

SEQ ID NO: 805513 - RNA, 19 nt, Homo sapiens
gaaaugaaauuccaguuug

SEQ ID NO: 805514 - RNA, 19 nt, Homo sapiens
gaaggaaguuuauucagaa

SEQ ID NO: 805515 - RNA, 19 nt, Homo sapiens
gaaggaauauuucuacaga

SEQ ID NO: 805516 - RNA, 19 nt, Homo sapiens
gaacuuugaugaugccuuu

SEQ ID NO: 805517 - RNA, 19 nt, Homo sapiens
ggaaggaaguuuauucaga

SEQ ID NO: 805518 - RNA, 19 nt, Homo sapiens
gaugaaacgucaggaauuu

SEQ ID NO: 805519 - RNA, 19 nt, Homo sapiens
ggacgccgcuggagagaaa

SEQ ID NO: 805520 - RNA, 19 nt, Homo sapiens
gcuagaagcauauggaaua

SEQ ID NO: 805521 - RNA, 19 nt, Homo sapiens
ggaauuuacuacacagaaa

SEQ ID NO: 805522 - RNA, 19 nt, Homo sapiens
caacacgggucucugcuuu

SEQ ID NO: 805523 - RNA, 19 nt, Homo sapiens
ccaaauggcccacuuuaaa

SEQ ID NO: 805524 - RNA, 19 nt, Homo sapiens
gaugaaaggcaagcaauua

SEQ ID NO: 805525 - RNA, 19 nt, Homo sapiens
gagaaucgaggacauuuaa

SEQ ID NO: 805526 - RNA, 19 nt, Homo sapiens
aagagaagcuggccugauu

SEQ ID NO: 805527 - RNA, 19 nt, Homo sapiens
gaaaugggcauguguguag

SEQ ID NO: 805528 - RNA, 19 nt, Homo sapiens
gagguaaacauucuaauug

SEQ ID NO: 805529 - RNA, 19 nt, Homo sapiens
ccaagaaccucgcauaguc

SEQ ID NO: 805530 - RNA, 19 nt, Homo sapiens
gaaguuaccuacuccaaaa

SEQ ID NO: 805531 - RNA, 19 nt, Homo sapiens
uggaauacauggccuguuu

SEQ ID NO: 805532 - RNA, 19 nt, Homo sapiens
gaagcuggccugauuaugu

SEQ ID NO: 805533 - RNA, 19 nt, Homo sapiens
ccaagugacugcuccauuc

SEQ ID NO: 805534 - RNA, 19 nt, Homo sapiens
gagauugaauucugugugu

SEQ ID NO: 805535 - RNA, 19 nt, Homo sapiens
ugagguaguugacaaagaa

SEQ ID NO: 805536 - RNA, 19 nt, Homo sapiens
gaaccucauuccuucuuug

SEQ ID NO: 805537 - RNA, 19 nt, Homo sapiens
gaaucgaggacauuuaauu

SEQ ID NO: 805538 - RNA, 19 nt, Homo sapiens
gcaagcaauuagagccuuu

SEQ ID NO: 805539 - RNA, 19 nt, Homo sapiens
cuacagauauuucacagau

SEQ ID NO: 805540 - RNA, 19 nt, Homo sapiens
acacaucccuguuccaaau

SEQ ID NO: 805541 - RNA, 19 nt, Homo sapiens
acagauauuucacagauga

SEQ ID NO: 805542 - RNA, 19 nt, Homo sapiens
cuagcaggcuuuccaguuu

SEQ ID NO: 805543 - RNA, 19 nt, Homo sapiens
agcaagaucuucccaauug

SEQ ID NO: 805544 - RNA, 19 nt, Homo sapiens
gaccuggccucugugcuua

SEQ ID NO: 805545 - RNA, 19 nt, Homo sapiens
cagcaugucuucuacuuca

SEQ ID NO: 805546 - RNA, 19 nt, Homo sapiens
gugcaaagauggacucuac

SEQ ID NO: 805547 - RNA, 19 nt, Homo sapiens
ggagcugcaucacauaguu

SEQ ID NO: 805548 - RNA, 19 nt, Homo sapiens
gcaccucccucacuuugug

SEQ ID NO: 805549 - RNA, 19 nt, Homo sapiens
ugaaggagcuggaccuaag

SEQ ID NO: 805550 - RNA, 19 nt, Homo sapiens
gggcauguguguagaaaca

SEQ ID NO: 805551 - RNA, 19 nt, Homo sapiens
ucgcugagcucaucggaaa

SEQ ID NO: 805552 - RNA, 19 nt, Homo sapiens
gcacuaaaguaauggaacu

SEQ ID NO: 805553 - RNA, 19 nt, Homo sapiens
gaccggaagugcaaagaug

SEQ ID NO: 805554 - RNA, 19 nt, Homo sapiens
aaacagacauggagcucuu

SEQ ID NO: 805555 - RNA, 19 nt, Homo sapiens
ucacacagcugcuacuucu

SEQ ID NO: 805556 - RNA, 19 nt, Homo sapiens
gaaaucagagaaagagaga

SEQ ID NO: 805557 - RNA, 19 nt, Homo sapiens
cagcacagaucaacaugga

SEQ ID NO: 805558 - RNA, 19 nt, Homo sapiens
ggagaaucgaggacauuua

SEQ ID NO: 805559 - RNA, 19 nt, Homo sapiens
gagcaagccaacagaguaa

SEQ ID NO: 805560 - RNA, 19 nt, Homo sapiens
ugaaagacaagaaagauga

SEQ ID NO: 805561 - RNA, 19 nt, Homo sapiens
gcaagugaaagacaagaaa

SEQ ID NO: 805562 - RNA, 19 nt, Homo sapiens
gcaauuagagccuuuaggu

SEQ ID NO: 805563 - RNA, 19 nt, Homo sapiens
ggaugaaacgucaggaauu

SEQ ID NO: 805564 - RNA, 19 nt, Homo sapiens
uaauggaacuuugaugaug

SEQ ID NO: 805565 - RNA, 19 nt, Homo sapiens
guucagggaugcuggaaau

SEQ ID NO: 805566 - RNA, 19 nt, Homo sapiens
gcuguggccucacgucuga

SEQ ID NO: 805567 - RNA, 19 nt, Homo sapiens
ggaucaggcugcaagugaa

SEQ ID NO: 805568 - RNA, 19 nt, Homo sapiens
agagagagauggagaacau

SEQ ID NO: 805569 - RNA, 19 nt, Homo sapiens
ucacagcucuuuuagaauu

SEQ ID NO: 805570 - RNA, 19 nt, Homo sapiens
uaucacagcucuuuuagaa

SEQ ID NO: 805571 - RNA, 19 nt, Homo sapiens
ugacaucgguggagguugu

SEQ ID NO: 805572 - RNA, 19 nt, Homo sapiens
uauaugggcugucguuaca

SEQ ID NO: 805573 - RNA, 19 nt, Homo sapiens
cgaguucacuucccuguag

SEQ ID NO: 805574 - RNA, 19 nt, Homo sapiens
ggagagguaaacauucuaa

SEQ ID NO: 805575 - RNA, 19 nt, Homo sapiens
gcaggaaggaauauuucua

SEQ ID NO: 805576 - RNA, 19 nt, Homo sapiens
ccucugugguguugcuuua

SEQ ID NO: 805577 - RNA, 19 nt, Homo sapiens
aggaggagcugaaggaguu

SEQ ID NO: 805578 - RNA, 19 nt, Homo sapiens
gaacaaccuggaugacguu

SEQ ID NO: 805579 - RNA, 19 nt, Homo sapiens
gagcuggaccuaaguggaa

SEQ ID NO: 805580 - RNA, 19 nt, Homo sapiens
gcagcaauguccuaugucu

SEQ ID NO: 805581 - RNA, 19 nt, Homo sapiens
gcugauagcccgagugaca

SEQ ID NO: 805582 - RNA, 19 nt, Homo sapiens
gaaaccaggagaucucaug

SEQ ID NO: 805583 - RNA, 19 nt, Homo sapiens
gagcaagaucuucccaauu

SEQ ID NO: 805584 - RNA, 19 nt, Homo sapiens
ccaauggccucuggaugaa

SEQ ID NO: 805585 - RNA, 19 nt, Homo sapiens
ugagaucagagacuuauuu

SEQ ID NO: 805586 - RNA, 19 nt, Homo sapiens
ggacacaucccuguuccaa

SEQ ID NO: 805587 - RNA, 19 nt, Homo sapiens
ggagagaugaguaauagca

SEQ ID NO: 805588 - RNA, 19 nt, Homo sapiens
aaaagacgcuagaagcaua

SEQ ID NO: 805589 - RNA, 19 nt, Homo sapiens
cagaaaaccccuauaaauu

SEQ ID NO: 805590 - RNA, 19 nt, Homo sapiens
acaggaagaucuacaagag

SEQ ID NO: 805591 - RNA, 19 nt, Homo sapiens
gcauguguguagaaacaga

SEQ ID NO: 805592 - RNA, 19 nt, Homo sapiens
aaccacacguuuccuauug

SEQ ID NO: 805593 - RNA, 19 nt, Homo sapiens
aauaagaaguuaccuacuc

SEQ ID NO: 805594 - RNA, 19 nt, Homo sapiens
guucuacguuggccacuug

SEQ ID NO: 805595 - RNA, 19 nt, Homo sapiens
ggaaagcuccccagaggua

SEQ ID NO: 805596 - RNA, 19 nt, Homo sapiens
cgggagagaugaguaauag

SEQ ID NO: 805597 - RNA, 19 nt, Homo sapiens
ggaccuggccucugugcuu

SEQ ID NO: 805598 - RNA, 19 nt, Homo sapiens
gggcaucaaccacacguuu

SEQ ID NO: 805599 - RNA, 19 nt, Homo sapiens
gguaaacauucuaauugca

SEQ ID NO: 805600 - RNA, 19 nt, Homo sapiens
uaauugagaucagagacuu

SEQ ID NO: 805601 - RNA, 19 nt, Homo sapiens
cgaggacauuuaauugaga

SEQ ID NO: 805602 - RNA, 19 nt, Homo sapiens
gcugcuacuucuacaaaga

SEQ ID NO: 805603 - RNA, 19 nt, Homo sapiens
gagagagaaaucagagaaa

SEQ ID NO: 805604 - RNA, 19 nt, Homo sapiens
agaaagagagagagagaaa

SEQ ID NO: 805605 - RNA, 19 nt, Homo sapiens
ggagaucucaugccugcaa

SEQ ID NO: 805606 - RNA, 19 nt, Homo sapiens
gggaucaggcugcaaguga

SEQ ID NO: 805607 - RNA, 19 nt, Homo sapiens
caaauggcccacuuuaaag

SEQ ID NO: 805608 - RNA, 19 nt, Homo sapiens
ggucucugcuuugugauga

SEQ ID NO: 805609 - RNA, 19 nt, Homo sapiens
ggccugcacuugccugaug

SEQ ID NO: 805610 - RNA, 19 nt, Homo sapiens
gaaaggcaagcaauuagag

SEQ ID NO: 805611 - RNA, 19 nt, Homo sapiens
gagaucagagacuuauuug

SEQ ID NO: 805612 - RNA, 19 nt, Homo sapiens
gaggccacguggauucuug

SEQ ID NO: 805613 - RNA, 19 nt, Homo sapiens
gaaggaaguuuauucagaa

SEQ ID NO: 805614 - RNA, 19 nt, Homo sapiens
gaaggaauauuucuacaga

SEQ ID NO: 805615 - RNA, 19 nt, Homo sapiens
gaacuuugaugaugccuuu

SEQ ID NO: 805616 - RNA, 19 nt, Homo sapiens
ggaaggaaguuuauucaga

SEQ ID NO: 805617 - RNA, 19 nt, Homo sapiens
gaugaaacgucaggaauuu

SEQ ID NO: 805618 - RNA, 19 nt, Homo sapiens
ggacgccgcuggagagaaa

SEQ ID NO: 805619 - RNA, 19 nt, Homo sapiens
gcuagaagcauauggaaua

SEQ ID NO: 805620 - RNA, 19 nt, Homo sapiens
ggaauuuacuacacagaaa

SEQ ID NO: 805621 - RNA, 19 nt, Homo sapiens
caacacgggucucugcuuu

SEQ ID NO: 805622 - RNA, 19 nt, Homo sapiens
ccaaauggcccacuuuaaa

SEQ ID NO: 805623 - RNA, 19 nt, Homo sapiens
gaugaaaggcaagcaauua

SEQ ID NO: 805624 - RNA, 19 nt, Homo sapiens
gagaaucgaggacauuuaa

SEQ ID NO: 805625 - RNA, 19 nt, Homo sapiens
aagagaagcuggccugauu

SEQ ID NO: 805626 - RNA, 19 nt, Homo sapiens
gaaaugggcauguguguag

SEQ ID NO: 805627 - RNA, 19 nt, Homo sapiens
gagguaaacauucuaauug

SEQ ID NO: 805628 - RNA, 19 nt, Homo sapiens
ccaagaaccucgcauaguc

SEQ ID NO: 805629 - RNA, 19 nt, Homo sapiens
gaaguuaccuacuccaaaa

SEQ ID NO: 805630 - RNA, 19 nt, Homo sapiens
uggaauacauggccuguuu

SEQ ID NO: 805631 - RNA, 19 nt, Homo sapiens
gaagcuggccugauuaugu

SEQ ID NO: 805632 - RNA, 19 nt, Homo sapiens
ccaagugacugcuccauuc

SEQ ID NO: 805633 - RNA, 19 nt, Homo sapiens
gagauugaauucugugugu

SEQ ID NO: 805634 - RNA, 19 nt, Homo sapiens
ugagguaguugacaaagaa

SEQ ID NO: 805635 - RNA, 19 nt, Homo sapiens
gaaccucauuccuucuuug

SEQ ID NO: 805636 - RNA, 19 nt, Homo sapiens
gaaucgaggacauuuaauu

SEQ ID NO: 805637 - RNA, 19 nt, Homo sapiens
gcaagcaauuagagccuuu

SEQ ID NO: 805638 - RNA, 19 nt, Homo sapiens
cuacagauauuucacagau

SEQ ID NO: 805639 - RNA, 19 nt, Homo sapiens
acacaucccuguuccaaau

SEQ ID NO: 805640 - RNA, 19 nt, Homo sapiens
acagauauuucacagauga

SEQ ID NO: 805641 - RNA, 19 nt, Homo sapiens
cuagcaggcuuuccaguuu

SEQ ID NO: 805642 - RNA, 19 nt, Homo sapiens
agcaagaucuucccaauug

SEQ ID NO: 805643 - RNA, 19 nt, Homo sapiens
gaccuggccucugugcuua

SEQ ID NO: 805644 - RNA, 19 nt, Homo sapiens
cagcaugucuucuacuuca

SEQ ID NO: 805645 - RNA, 19 nt, Homo sapiens
gugcaaagauggacucuac

SEQ ID NO: 805646 - RNA, 19 nt, Homo sapiens
ggagcugcaucacauaguu

SEQ ID NO: 805647 - RNA, 19 nt, Homo sapiens
gcaccucccucacuuugug

SEQ ID NO: 805648 - RNA, 19 nt, Homo sapiens
ugaaggagcuggaccuaag

SEQ ID NO: 805649 - RNA, 19 nt, Homo sapiens
gggcauguguguagaaaca

SEQ ID NO: 805650 - RNA, 19 nt, Homo sapiens
ucgcugagcucaucggaaa

SEQ ID NO: 805651 - RNA, 19 nt, Homo sapiens
gcacuaaaguaauggaacu

SEQ ID NO: 805652 - RNA, 19 nt, Homo sapiens
gaccggaagugcaaagaug

SEQ ID NO: 805653 - RNA, 19 nt, Homo sapiens
aaacagacauggagcucuu

SEQ ID NO: 805654 - RNA, 19 nt, Homo sapiens
ucacacagcugcuacuucu

SEQ ID NO: 805655 - RNA, 19 nt, Homo sapiens
gaaaucagagaaagagaga

SEQ ID NO: 805656 - RNA, 19 nt, Homo sapiens
cagcacagaucaacaugga

SEQ ID NO: 805657 - RNA, 19 nt, Homo sapiens
ggagaaucgaggacauuua

SEQ ID NO: 805658 - RNA, 19 nt, Homo sapiens
gagcaagccaacagaguaa

SEQ ID NO: 805659 - RNA, 19 nt, Homo sapiens
ugaaagacaagaaagauga

SEQ ID NO: 805660 - RNA, 19 nt, Homo sapiens
gcaagugaaagacaagaaa

SEQ ID NO: 805661 - RNA, 19 nt, Homo sapiens
gcaauuagagccuuuaggu

SEQ ID NO: 805662 - RNA, 19 nt, Homo sapiens
ggaugaaacgucaggaauu

SEQ ID NO: 805663 - RNA, 19 nt, Homo sapiens
uaauggaacuuugaugaug

SEQ ID NO: 805664 - RNA, 19 nt, Homo sapiens
gcuguggccucacgucuga

SEQ ID NO: 805665 - RNA, 19 nt, Homo sapiens
ggaagaaucugaggaacac

SEQ ID NO: 805666 - RNA, 19 nt, Homo sapiens
ggaucaggcugcaagugaa

SEQ ID NO: 805667 - RNA, 19 nt, Homo sapiens
agagagagauggagaacau

SEQ ID NO: 805668 - RNA, 19 nt, Homo sapiens
ucacagcucuuuuagaauu

SEQ ID NO: 805669 - RNA, 19 nt, Homo sapiens
uaucacagcucuuuuagaa

SEQ ID NO: 805670 - RNA, 19 nt, Homo sapiens
ugacaucgguggagguugu

SEQ ID NO: 805671 - RNA, 19 nt, Homo sapiens
cgaguucacuucccuguag

SEQ ID NO: 805672 - RNA, 19 nt, Homo sapiens
ggagagguaaacauucuaa

SEQ ID NO: 805673 - RNA, 19 nt, Homo sapiens
gcaggaaggaauauuucua

SEQ ID NO: 805674 - RNA, 19 nt, Homo sapiens
ggagaggucugaagaaacc

SEQ ID NO: 805675 - RNA, 19 nt, Homo sapiens
aggaggagcugaaggaguu

SEQ ID NO: 805676 - RNA, 19 nt, Homo sapiens
ccucugugguguugcuuua

SEQ ID NO: 805677 - RNA, 19 nt, Homo sapiens
gaacaaccuggaugacguu

SEQ ID NO: 805678 - RNA, 19 nt, Homo sapiens
gagcuggaccuaaguggaa

SEQ ID NO: 805679 - RNA, 19 nt, Homo sapiens
gcagcaauguccuaugucu

SEQ ID NO: 805680 - RNA, 19 nt, Homo sapiens
gcugauagcccgagugaca

SEQ ID NO: 805681 - RNA, 19 nt, Homo sapiens
gaaaccaggagaucucaug

SEQ ID NO: 805682 - RNA, 19 nt, Homo sapiens
gagcaagaucuucccaauu

SEQ ID NO: 805683 - RNA, 19 nt, Homo sapiens
ccaauggccucuggaugaa

SEQ ID NO: 805684 - RNA, 19 nt, Homo sapiens
ugagaucagagacuuauuu

SEQ ID NO: 805685 - RNA, 19 nt, Homo sapiens
ggacacaucccuguuccaa

SEQ ID NO: 805686 - RNA, 19 nt, Homo sapiens
ggagagaugaguaauagca

SEQ ID NO: 805687 - RNA, 19 nt, Homo sapiens
aaaagacgcuagaagcaua

SEQ ID NO: 805688 - RNA, 19 nt, Homo sapiens
cagaaaaccccuauaaauu

SEQ ID NO: 805689 - RNA, 19 nt, Homo sapiens
acaggaagaucuacaagag

SEQ ID NO: 805690 - RNA, 19 nt, Homo sapiens
gcauguguguagaaacaga

SEQ ID NO: 805691 - RNA, 19 nt, Homo sapiens
aaccacacguuuccuauug

SEQ ID NO: 805692 - RNA, 19 nt, Homo sapiens
aauaagaaguuaccuacuc

SEQ ID NO: 805693 - RNA, 19 nt, Homo sapiens
guucuacguuggccacuug

SEQ ID NO: 805694 - RNA, 19 nt, Homo sapiens
ggaaagcuccccagaggua

SEQ ID NO: 805695 - RNA, 19 nt, Homo sapiens
cgggagagaugaguaauag

SEQ ID NO: 805696 - RNA, 19 nt, Homo sapiens
ggaccuggccucugugcuu

SEQ ID NO: 805697 - RNA, 19 nt, Homo sapiens
gggcaucaaccacacguuu

SEQ ID NO: 805698 - RNA, 19 nt, Homo sapiens
gguaaacauucuaauugca

SEQ ID NO: 805699 - RNA, 19 nt, Homo sapiens
uaauugagaucagagacuu

SEQ ID NO: 805700 - RNA, 19 nt, Homo sapiens
cgaggacauuuaauugaga

SEQ ID NO: 805701 - RNA, 19 nt, Homo sapiens
gcugcuacuucuacaaaga

SEQ ID NO: 805702 - RNA, 19 nt, Homo sapiens
gagagagaaaucagagaaa

SEQ ID NO: 805703 - RNA, 19 nt, Homo sapiens
agaaagagagagagagaaa

SEQ ID NO: 805704 - RNA, 19 nt, Homo sapiens
ggagaucucaugccugcaa

SEQ ID NO: 805705 - RNA, 19 nt, Homo sapiens
gggaucaggcugcaaguga

SEQ ID NO: 805706 - RNA, 19 nt, Homo sapiens
caaauggcccacuuuaaag

SEQ ID NO: 805707 - RNA, 19 nt, Homo sapiens
ggucucugcuuugugauga

SEQ ID NO: 805708 - RNA, 19 nt, Homo sapiens
gagggaagaaucugaggaa

SEQ ID NO: 805709 - RNA, 19 nt, Homo sapiens
ggccugcacuugccugaug

SEQ ID NO: 805710 - RNA, 19 nt, Homo sapiens
gaaaggcaagcaauuagag

SEQ ID NO: 805711 - RNA, 19 nt, Homo sapiens
gagaucagagacuuauuug

SEQ ID NO: 805712 - RNA, 19 nt, Homo sapiens
gaggccacguggauucuug

SEQ ID NO: 805713 - RNA, 19 nt, Homo sapiens
gaaaugaaauuccaguuug

SEQ ID NO: 805714 - RNA, 19 nt, Homo sapiens
gaaggaauauuucuacaga

SEQ ID NO: 805715 - RNA, 19 nt, Homo sapiens
gaugaaacgucaggaauuu

SEQ ID NO: 805716 - RNA, 19 nt, Homo sapiens
ggacgccgcuggagagaaa

SEQ ID NO: 805717 - RNA, 19 nt, Homo sapiens
gcuagaagcauauggaaua

SEQ ID NO: 805718 - RNA, 19 nt, Homo sapiens
ggaauuuacuacacagaaa

SEQ ID NO: 805719 - RNA, 19 nt, Homo sapiens
caacacgggucucugcuuu

SEQ ID NO: 805720 - RNA, 19 nt, Homo sapiens
ccaaauggcccacuuuaaa

SEQ ID NO: 805721 - RNA, 19 nt, Homo sapiens
gaugaaaggcaagcaauua

SEQ ID NO: 805722 - RNA, 19 nt, Homo sapiens
gagaaucgaggacauuuaa

SEQ ID NO: 805723 - RNA, 19 nt, Homo sapiens
aagagaagcuggccugauu

SEQ ID NO: 805724 - RNA, 19 nt, Homo sapiens
gaaaugggcauguguguag

SEQ ID NO: 805725 - RNA, 19 nt, Homo sapiens
gagguaaacauucuaauug

SEQ ID NO: 805726 - RNA, 19 nt, Homo sapiens
ccaagaaccucgcauaguc

SEQ ID NO: 805727 - RNA, 19 nt, Homo sapiens
uggaauacauggccuguuu

SEQ ID NO: 805728 - RNA, 19 nt, Homo sapiens
gaagcuggccugauuaugu

SEQ ID NO: 805729 - RNA, 19 nt, Homo sapiens
ccaagugacugcuccauuc

SEQ ID NO: 805730 - RNA, 19 nt, Homo sapiens
gagauugaauucugugugu

SEQ ID NO: 805731 - RNA, 19 nt, Homo sapiens
ugagguaguugacaaagaa

SEQ ID NO: 805732 - RNA, 19 nt, Homo sapiens
gaaccucauuccuucuuug

SEQ ID NO: 805733 - RNA, 19 nt, Homo sapiens
gaaucgaggacauuuaauu

SEQ ID NO: 805734 - RNA, 19 nt, Homo sapiens
gcaagcaauuagagccuuu

SEQ ID NO: 805735 - RNA, 19 nt, Homo sapiens
cuacagauauuucacagau

SEQ ID NO: 805736 - RNA, 19 nt, Homo sapiens
acacaucccuguuccaaau

SEQ ID NO: 805737 - RNA, 19 nt, Homo sapiens
acagauauuucacagauga

SEQ ID NO: 805738 - RNA, 19 nt, Homo sapiens
agcaagaucuucccaauug

SEQ ID NO: 805739 - RNA, 19 nt, Homo sapiens
gaccuggccucugugcuua

SEQ ID NO: 805740 - RNA, 19 nt, Homo sapiens
cagcaugucuucuacuuca

SEQ ID NO: 805741 - RNA, 19 nt, Homo sapiens
gugcaaagauggacucuac

SEQ ID NO: 805742 - RNA, 19 nt, Homo sapiens
ggagcugcaucacauaguu

SEQ ID NO: 805743 - RNA, 19 nt, Homo sapiens
gcaccucccucacuuugug

SEQ ID NO: 805744 - RNA, 19 nt, Homo sapiens
ugaaggagcuggaccuaag

SEQ ID NO: 805745 - RNA, 19 nt, Homo sapiens
gggcauguguguagaaaca

SEQ ID NO: 805746 - RNA, 19 nt, Homo sapiens
ucgcugagcucaucggaaa

SEQ ID NO: 805747 - RNA, 19 nt, Homo sapiens
gaccggaagugcaaagaug

SEQ ID NO: 805748 - RNA, 19 nt, Homo sapiens
aaacagacauggagcucuu

SEQ ID NO: 805749 - RNA, 19 nt, Homo sapiens
ucacacagcugcuacuucu

SEQ ID NO: 805750 - RNA, 19 nt, Homo sapiens
gaaaucagagaaagagaga

SEQ ID NO: 805751 - RNA, 19 nt, Homo sapiens
cagcacagaucaacaugga

SEQ ID NO: 805752 - RNA, 19 nt, Homo sapiens
ggagaaucgaggacauuua

SEQ ID NO: 805753 - RNA, 19 nt, Homo sapiens
ugaaagacaagaaagauga

SEQ ID NO: 805754 - RNA, 19 nt, Homo sapiens
gcaagugaaagacaagaaa

SEQ ID NO: 805755 - RNA, 19 nt, Homo sapiens
gcaauuagagccuuuaggu

SEQ ID NO: 805756 - RNA, 19 nt, Homo sapiens
ggaugaaacgucaggaauu

SEQ ID NO: 805757 - RNA, 19 nt, Homo sapiens
guucagggaugcuggaaau

SEQ ID NO: 805758 - RNA, 19 nt, Homo sapiens
gcuguggccucacgucuga

SEQ ID NO: 805759 - RNA, 19 nt, Homo sapiens
ggaucaggcugcaagugaa

SEQ ID NO: 805760 - RNA, 19 nt, Homo sapiens
agagagagauggagaacau

SEQ ID NO: 805761 - RNA, 19 nt, Homo sapiens
ugacaucgguggagguugu

SEQ ID NO: 805762 - RNA, 19 nt, Homo sapiens
uauaugggcugucguuaca

SEQ ID NO: 805763 - RNA, 19 nt, Homo sapiens
cgaguucacuucccuguag

SEQ ID NO: 805764 - RNA, 19 nt, Homo sapiens
ggagagguaaacauucuaa

SEQ ID NO: 805765 - RNA, 19 nt, Homo sapiens
gcaggaaggaauauuucua

SEQ ID NO: 805766 - RNA, 19 nt, Homo sapiens
ccucugugguguugcuuua

SEQ ID NO: 805767 - RNA, 19 nt, Homo sapiens
aggaggagcugaaggaguu

SEQ ID NO: 805768 - RNA, 19 nt, Homo sapiens
gaacaaccuggaugacguu

SEQ ID NO: 805769 - RNA, 19 nt, Homo sapiens
gagcuggaccuaaguggaa

SEQ ID NO: 805770 - RNA, 19 nt, Homo sapiens
gcagcaauguccuaugucu

SEQ ID NO: 805771 - RNA, 19 nt, Homo sapiens
gcugauagcccgagugaca

SEQ ID NO: 805772 - RNA, 19 nt, Homo sapiens
gaaaccaggagaucucaug

SEQ ID NO: 805773 - RNA, 19 nt, Homo sapiens
gagcaagaucuucccaauu

SEQ ID NO: 805774 - RNA, 19 nt, Homo sapiens
ccaauggccucuggaugaa

SEQ ID NO: 805775 - RNA, 19 nt, Homo sapiens
ugagaucagagacuuauuu

SEQ ID NO: 805776 - RNA, 19 nt, Homo sapiens
ggacacaucccuguuccaa

SEQ ID NO: 805777 - RNA, 19 nt, Homo sapiens
ggagagaugaguaauagca

SEQ ID NO: 805778 - RNA, 19 nt, Homo sapiens
aaaagacgcuagaagcaua

SEQ ID NO: 805779 - RNA, 19 nt, Homo sapiens
gcauguguguagaaacaga

SEQ ID NO: 805780 - RNA, 19 nt, Homo sapiens
aaccacacguuuccuauug

SEQ ID NO: 805781 - RNA, 19 nt, Homo sapiens
guucuacguuggccacuug

SEQ ID NO: 805782 - RNA, 19 nt, Homo sapiens
ggaaagcuccccagaggua

SEQ ID NO: 805783 - RNA, 19 nt, Homo sapiens
cgggagagaugaguaauag

SEQ ID NO: 805784 - RNA, 19 nt, Homo sapiens
ggaccuggccucugugcuu

SEQ ID NO: 805785 - RNA, 19 nt, Homo sapiens
gggcaucaaccacacguuu

SEQ ID NO: 805786 - RNA, 19 nt, Homo sapiens
gguaaacauucuaauugca

SEQ ID NO: 805787 - RNA, 19 nt, Homo sapiens
uaauugagaucagagacuu

SEQ ID NO: 805788 - RNA, 19 nt, Homo sapiens
cgaggacauuuaauugaga

SEQ ID NO: 805789 - RNA, 19 nt, Homo sapiens
gcugcuacuucuacaaaga

SEQ ID NO: 805790 - RNA, 19 nt, Homo sapiens
gagagagaaaucagagaaa

SEQ ID NO: 805791 - RNA, 19 nt, Homo sapiens
agaaagagagagagagaaa

SEQ ID NO: 805792 - RNA, 19 nt, Homo sapiens
ggagaucucaugccugcaa

SEQ ID NO: 805793 - RNA, 19 nt, Homo sapiens
gggaucaggcugcaaguga

SEQ ID NO: 805794 - RNA, 19 nt, Homo sapiens
caaauggcccacuuuaaag

SEQ ID NO: 805795 - RNA, 19 nt, Homo sapiens
ggucucugcuuugugauga

SEQ ID NO: 805796 - RNA, 19 nt, Homo sapiens
ggccugcacuugccugaug

SEQ ID NO: 805797 - RNA, 19 nt, Homo sapiens
gaaaggcaagcaauuagag

SEQ ID NO: 805798 - RNA, 19 nt, Homo sapiens
gagaucagagacuuauuug

SEQ ID NO: 805799 - RNA, 19 nt, Homo sapiens
gcacuuucugcauuaaauu

SEQ ID NO: 805800 - RNA, 19 nt, Homo sapiens
gagaagcuggccugauuau

SEQ ID NO: 805801 - RNA, 19 nt, Homo sapiens
gacccauccucaccucauu

SEQ ID NO: 805802 - RNA, 19 nt, Homo sapiens
ccgcauagccguaccuuca

SEQ ID NO: 805803 - RNA, 19 nt, Homo sapiens
gaacuggagcucugcuauc

SEQ ID NO: 805804 - RNA, 19 nt, Homo sapiens
ugagcaagaucuucccaau

SEQ ID NO: 805805 - RNA, 19 nt, Homo sapiens
cauccugccugcaaacuca

SEQ ID NO: 805806 - RNA, 19 nt, Homo sapiens
aaacguuccugacacaagu

SEQ ID NO: 805807 - RNA, 19 nt, Homo sapiens
uauugggccuguuaaguga

SEQ ID NO: 805808 - RNA, 19 nt, Homo sapiens
caucaucuccaccuucuug

SEQ ID NO: 805809 - RNA, 19 nt, Homo sapiens
acaacccucugucuacauu

SEQ ID NO: 805810 - RNA, 19 nt, Homo sapiens
ccacaacccucugucuaca

SEQ ID NO: 805811 - RNA, 19 nt, Homo sapiens
uuagguuggucaaaucaaa

SEQ ID NO: 805812 - RNA, 19 nt, Homo sapiens
ccacagcucugcagaaccu

SEQ ID NO: 805813 - RNA, 19 nt, Homo sapiens
gaaggaauauuucuacaga

SEQ ID NO: 805814 - RNA, 19 nt, Homo sapiens
gaugaaacgucaggaauuu

SEQ ID NO: 805815 - RNA, 19 nt, Homo sapiens
ggacgccgcuggagagaaa

SEQ ID NO: 805816 - RNA, 19 nt, Homo sapiens
gcuagaagcauauggaaua

SEQ ID NO: 805817 - RNA, 19 nt, Homo sapiens
ggaauuuacuacacagaaa

SEQ ID NO: 805818 - RNA, 19 nt, Homo sapiens
caacacgggucucugcuuu

SEQ ID NO: 805819 - RNA, 19 nt, Homo sapiens
ccaaauggcccacuuuaaa

SEQ ID NO: 805820 - RNA, 19 nt, Homo sapiens
gaugaaaggcaagcaauua

SEQ ID NO: 805821 - RNA, 19 nt, Homo sapiens
gagaaucgaggacauuuaa

SEQ ID NO: 805822 - RNA, 19 nt, Homo sapiens
aagagaagcuggccugauu

SEQ ID NO: 805823 - RNA, 19 nt, Homo sapiens
gaaaugggcauguguguag

SEQ ID NO: 805824 - RNA, 19 nt, Homo sapiens
gagguaaacauucuaauug

SEQ ID NO: 805825 - RNA, 19 nt, Homo sapiens
ccaagaaccucgcauaguc

SEQ ID NO: 805826 - RNA, 19 nt, Homo sapiens
uggaauacauggccuguuu

SEQ ID NO: 805827 - RNA, 19 nt, Homo sapiens
gaagcuggccugauuaugu

SEQ ID NO: 805828 - RNA, 19 nt, Homo sapiens
ccaagugacugcuccauuc

SEQ ID NO: 805829 - RNA, 19 nt, Homo sapiens
gagauugaauucugugugu

SEQ ID NO: 805830 - RNA, 19 nt, Homo sapiens
ugagguaguugacaaagaa

SEQ ID NO: 805831 - RNA, 19 nt, Homo sapiens
gaaccucauuccuucuuug

SEQ ID NO: 805832 - RNA, 19 nt, Homo sapiens
gaaucgaggacauuuaauu

SEQ ID NO: 805833 - RNA, 19 nt, Homo sapiens
gcaagcaauuagagccuuu

SEQ ID NO: 805834 - RNA, 19 nt, Homo sapiens
cuacagauauuucacagau

SEQ ID NO: 805835 - RNA, 19 nt, Homo sapiens
acacaucccuguuccaaau

SEQ ID NO: 805836 - RNA, 19 nt, Homo sapiens
acagauauuucacagauga

SEQ ID NO: 805837 - RNA, 19 nt, Homo sapiens
agcaagaucuucccaauug

SEQ ID NO: 805838 - RNA, 19 nt, Homo sapiens
gaccuggccucugugcuua

SEQ ID NO: 805839 - RNA, 19 nt, Homo sapiens
cagcaugucuucuacuuca

SEQ ID NO: 805840 - RNA, 19 nt, Homo sapiens
gugcaaagauggacucuac

SEQ ID NO: 805841 - RNA, 19 nt, Homo sapiens
ggagcugcaucacauaguu

SEQ ID NO: 805842 - RNA, 19 nt, Homo sapiens
gcaccucccucacuuugug

SEQ ID NO: 805843 - RNA, 19 nt, Homo sapiens
ugaaggagcuggaccuaag

SEQ ID NO: 805844 - RNA, 19 nt, Homo sapiens
gggcauguguguagaaaca

SEQ ID NO: 805845 - RNA, 19 nt, Homo sapiens
ucgcugagcucaucggaaa

SEQ ID NO: 805846 - RNA, 19 nt, Homo sapiens
gaccggaagugcaaagaug

SEQ ID NO: 805847 - RNA, 19 nt, Homo sapiens
aaacagacauggagcucuu

SEQ ID NO: 805848 - RNA, 19 nt, Homo sapiens
ucacacagcugcuacuucu

SEQ ID NO: 805849 - RNA, 19 nt, Homo sapiens
gaaaucagagaaagagaga

SEQ ID NO: 805850 - RNA, 19 nt, Homo sapiens
cagcacagaucaacaugga

SEQ ID NO: 805851 - RNA, 19 nt, Homo sapiens
ggagaaucgaggacauuua

SEQ ID NO: 805852 - RNA, 19 nt, Homo sapiens
ugaaagacaagaaagauga

SEQ ID NO: 805853 - RNA, 19 nt, Homo sapiens
gcaagugaaagacaagaaa

SEQ ID NO: 805854 - RNA, 19 nt, Homo sapiens
gcaauuagagccuuuaggu

SEQ ID NO: 805855 - RNA, 19 nt, Homo sapiens
ggaugaaacgucaggaauu

SEQ ID NO: 805856 - RNA, 19 nt, Homo sapiens
gcuguggccucacgucuga

SEQ ID NO: 805857 - RNA, 19 nt, Homo sapiens
ggaucaggcugcaagugaa

SEQ ID NO: 805858 - RNA, 19 nt, Homo sapiens
agagagagauggagaacau

SEQ ID NO: 805859 - RNA, 19 nt, Homo sapiens
ugacaucgguggagguugu

SEQ ID NO: 805860 - RNA, 19 nt, Homo sapiens
cgaguucacuucccuguag

SEQ ID NO: 805861 - RNA, 19 nt, Homo sapiens
ggagagguaaacauucuaa

SEQ ID NO: 805862 - RNA, 19 nt, Homo sapiens
gcaggaaggaauauuucua

SEQ ID NO: 805863 - RNA, 19 nt, Homo sapiens
ccucugugguguugcuuua

SEQ ID NO: 805864 - RNA, 19 nt, Homo sapiens
aggaggagcugaaggaguu

SEQ ID NO: 805865 - RNA, 19 nt, Homo sapiens
gaacaaccuggaugacguu

SEQ ID NO: 805866 - RNA, 19 nt, Homo sapiens
gagcuggaccuaaguggaa

SEQ ID NO: 805867 - RNA, 19 nt, Homo sapiens
gcagcaauguccuaugucu

SEQ ID NO: 805868 - RNA, 19 nt, Homo sapiens
gcugauagcccgagugaca

SEQ ID NO: 805869 - RNA, 19 nt, Homo sapiens
gaaaccaggagaucucaug

SEQ ID NO: 805870 - RNA, 19 nt, Homo sapiens
gagcaagaucuucccaauu

SEQ ID NO: 805871 - RNA, 19 nt, Homo sapiens
ccaauggccucuggaugaa

SEQ ID NO: 805872 - RNA, 19 nt, Homo sapiens
ugagaucagagacuuauuu

SEQ ID NO: 805873 - RNA, 19 nt, Homo sapiens
ggacacaucccuguuccaa

SEQ ID NO: 805874 - RNA, 19 nt, Homo sapiens
ggagagaugaguaauagca

SEQ ID NO: 805875 - RNA, 19 nt, Homo sapiens
aaaagacgcuagaagcaua

SEQ ID NO: 805876 - RNA, 19 nt, Homo sapiens
gcauguguguagaaacaga

SEQ ID NO: 805877 - RNA, 19 nt, Homo sapiens
aaccacacguuuccuauug

SEQ ID NO: 805878 - RNA, 19 nt, Homo sapiens
guucuacguuggccacuug

SEQ ID NO: 805879 - RNA, 19 nt, Homo sapiens
ggaaagcuccccagaggua

SEQ ID NO: 805880 - RNA, 19 nt, Homo sapiens
cgggagagaugaguaauag

SEQ ID NO: 805881 - RNA, 19 nt, Homo sapiens
ggaccuggccucugugcuu

SEQ ID NO: 805882 - RNA, 19 nt, Homo sapiens
gggcaucaaccacacguuu

SEQ ID NO: 805883 - RNA, 19 nt, Homo sapiens
gguaaacauucuaauugca

SEQ ID NO: 805884 - RNA, 19 nt, Homo sapiens
uaauugagaucagagacuu

SEQ ID NO: 805885 - RNA, 19 nt, Homo sapiens
cgaggacauuuaauugaga

SEQ ID NO: 805886 - RNA, 19 nt, Homo sapiens
gcugcuacuucuacaaaga

SEQ ID NO: 805887 - RNA, 19 nt, Homo sapiens
gagagagaaaucagagaaa

SEQ ID NO: 805888 - RNA, 19 nt, Homo sapiens
agaaagagagagagagaaa

SEQ ID NO: 805889 - RNA, 19 nt, Homo sapiens
ggagaucucaugccugcaa

SEQ ID NO: 805890 - RNA, 19 nt, Homo sapiens
gggaucaggcugcaaguga

SEQ ID NO: 805891 - RNA, 19 nt, Homo sapiens
caaauggcccacuuuaaag

SEQ ID NO: 805892 - RNA, 19 nt, Homo sapiens
ggucucugcuuugugauga

SEQ ID NO: 805893 - RNA, 19 nt, Homo sapiens
ggccugcacuugccugaug

SEQ ID NO: 805894 - RNA, 19 nt, Homo sapiens
gaaaggcaagcaauuagag

SEQ ID NO: 805895 - RNA, 19 nt, Homo sapiens
gagaucagagacuuauuug

SEQ ID NO: 805896 - RNA, 19 nt, Homo sapiens
gcacuuucugcauuaaauu

SEQ ID NO: 805897 - RNA, 19 nt, Homo sapiens
gagaagcuggccugauuau

SEQ ID NO: 805898 - RNA, 19 nt, Homo sapiens
gacccauccucaccucauu

SEQ ID NO: 805899 - RNA, 19 nt, Homo sapiens
ccgcauagccguaccuuca

SEQ ID NO: 805900 - RNA, 19 nt, Homo sapiens
gaacuggagcucugcuauc

SEQ ID NO: 805901 - RNA, 19 nt, Homo sapiens
ugagcaagaucuucccaau

SEQ ID NO: 805902 - RNA, 19 nt, Homo sapiens
cauccugccugcaaacuca

SEQ ID NO: 805903 - RNA, 19 nt, Homo sapiens
aaacguuccugacacaagu

SEQ ID NO: 805904 - RNA, 19 nt, Homo sapiens
uauugggccuguuaaguga

SEQ ID NO: 805905 - RNA, 19 nt, Homo sapiens
caucaucuccaccuucuug

SEQ ID NO: 805906 - RNA, 19 nt, Homo sapiens
acaacccucugucuacauu

SEQ ID NO: 805907 - RNA, 19 nt, Homo sapiens
ccacaacccucugucuaca

SEQ ID NO: 805908 - RNA, 19 nt, Homo sapiens
uuagguuggucaaaucaaa

SEQ ID NO: 805909 - RNA, 19 nt, Homo sapiens
ccacagcucugcagaaccu

SEQ ID NO: 805910 - RNA, 19 nt, Homo sapiens
ggaggagaaucgaggacau

SEQ ID NO: 805911 - RNA, 19 nt, Homo sapiens
acacagaaaucagagaaag

SEQ ID NO: 805912 - RNA, 19 nt, Homo sapiens
ggguggagcugcaucacau

SEQ ID NO: 805913 - RNA, 19 nt, Homo sapiens
gaacggaguuuauuucuau

SEQ ID NO: 805914 - RNA, 19 nt, Homo sapiens
ggacagaaauacugaauga

SEQ ID NO: 805915 - RNA, 19 nt, Homo sapiens
gaacaaagagguuaaagug

SEQ ID NO: 805916 - RNA, 19 nt, Homo sapiens
ggacacagcuuugcucaga

SEQ ID NO: 805917 - RNA, 19 nt, Homo sapiens
gaugaggauugaacaguua

SEQ ID NO: 805918 - RNA, 19 nt, Homo sapiens
ugaagaaacugaaugcaaa

SEQ ID NO: 805919 - RNA, 19 nt, Homo sapiens
cugaaugacuuuacacuua

SEQ ID NO: 805920 - RNA, 19 nt, Homo sapiens
gagaugaagcuaaagaaua

SEQ ID NO: 805921 - RNA, 19 nt, Homo sapiens
gcaauaaugucuagagagu

SEQ ID NO: 805922 - RNA, 19 nt, Homo sapiens
gcucaugccuguaauccua

SEQ ID NO: 805923 - RNA, 19 nt, Homo sapiens
caacucagcuggucaacau

SEQ ID NO: 805924 - RNA, 19 nt, Homo sapiens
acaaagagguuaaaguguu

SEQ ID NO: 805925 - RNA, 19 nt, Homo sapiens
gcagaugugucuucagaga

SEQ ID NO: 805926 - RNA, 19 nt, Homo sapiens
gagcucaccucugucauuu

SEQ ID NO: 805927 - RNA, 19 nt, Homo sapiens
ccagguagauaaucauauu

SEQ ID NO: 805928 - RNA, 19 nt, Homo sapiens
ccgaguagcugggauuaua

SEQ ID NO: 805929 - RNA, 19 nt, Homo sapiens
gaccaacguuugugauauu

SEQ ID NO: 805930 - RNA, 19 nt, Homo sapiens
gcaccaaacaggcugcuua

SEQ ID NO: 805931 - RNA, 19 nt, Homo sapiens
gugcucagcuucaugauug

SEQ ID NO: 805932 - RNA, 19 nt, Homo sapiens
ggacuacucugccuacuac

SEQ ID NO: 805933 - RNA, 19 nt, Homo sapiens
caugauagcaccucugaua

SEQ ID NO: 805934 - RNA, 19 nt, Homo sapiens
ggaaagcacaauauaaaga

SEQ ID NO: 805935 - RNA, 19 nt, Homo sapiens
gagccgagauugugccauu

SEQ ID NO: 805936 - RNA, 19 nt, Homo sapiens
ggacccacauccauaaaug

SEQ ID NO: 805937 - RNA, 19 nt, Homo sapiens
caaggaagcaguugauuug

SEQ ID NO: 805938 - RNA, 19 nt, Homo sapiens
caaagagguuaaaguguug

SEQ ID NO: 805939 - RNA, 19 nt, Homo sapiens
ggacgggacucauguaagg

SEQ ID NO: 805940 - RNA, 19 nt, Homo sapiens
agaguugucuagcuacuua

SEQ ID NO: 805941 - RNA, 19 nt, Homo sapiens
gauaaaucauucagagguu

SEQ ID NO: 805942 - RNA, 19 nt, Homo sapiens
gauagcaccucugauaaau

SEQ ID NO: 805943 - RNA, 19 nt, Homo sapiens
gaaaauaagucaugaaggu

SEQ ID NO: 805944 - RNA, 19 nt, Homo sapiens
gauagugucuggaacaaag

SEQ ID NO: 805945 - RNA, 19 nt, Homo sapiens
gaaaguucuucucccacua

SEQ ID NO: 805946 - RNA, 19 nt, Homo sapiens
uaccaaaucugcaucaaga

SEQ ID NO: 805947 - RNA, 19 nt, Homo sapiens
gaaguaggcuuuucucguu

SEQ ID NO: 805948 - RNA, 19 nt, Homo sapiens
gaggcauuauguacaaaua

SEQ ID NO: 805949 - RNA, 19 nt, Homo sapiens
ccaccgcacuggccuaauu

SEQ ID NO: 805950 - RNA, 19 nt, Homo sapiens
ggcuuacacugcugaaaua

SEQ ID NO: 805951 - RNA, 19 nt, Homo sapiens
caaacuuggugaccuggua

SEQ ID NO: 805952 - RNA, 19 nt, Homo sapiens
gaagauaggaaaguuagaa

SEQ ID NO: 805953 - RNA, 19 nt, Homo sapiens
ugugggaacuuuauggaua

SEQ ID NO: 805954 - RNA, 19 nt, Homo sapiens
gaagaaauccuggcugcaa

SEQ ID NO: 805955 - RNA, 19 nt, Homo sapiens
gaaaugaagaaauggagaa

SEQ ID NO: 805956 - RNA, 19 nt, Homo sapiens
gcuauaacauaaggucuuu

SEQ ID NO: 805957 - RNA, 19 nt, Homo sapiens
gaugcaggcuguaguguuc

SEQ ID NO: 805958 - RNA, 19 nt, Homo sapiens
gacaccagcauuagcauua

SEQ ID NO: 805959 - RNA, 19 nt, Homo sapiens
gcacuggccuaauuucucu

SEQ ID NO: 805960 - RNA, 19 nt, Homo sapiens
uguaagaguugucuagcua

SEQ ID NO: 805961 - RNA, 19 nt, Homo sapiens
gggaaaagccacuuaguua

SEQ ID NO: 805962 - RNA, 19 nt, Homo sapiens
ucgacgaucccauauauua

SEQ ID NO: 805963 - RNA, 19 nt, Homo sapiens
ggaaagggaaauguagaua

SEQ ID NO: 805964 - RNA, 19 nt, Homo sapiens
gcacaacagucaugguuuu

SEQ ID NO: 805965 - RNA, 19 nt, Homo sapiens
gagugaagaugguagacuu

SEQ ID NO: 805966 - RNA, 19 nt, Homo sapiens
caucaugcccagcuaauuu

SEQ ID NO: 805967 - RNA, 19 nt, Homo sapiens
gaaccagcaggcaauuuaa

SEQ ID NO: 805968 - RNA, 19 nt, Homo sapiens
ucggugaccuccugguuua

SEQ ID NO: 805969 - RNA, 19 nt, Homo sapiens
gaucccagguagauaauca

SEQ ID NO: 805970 - RNA, 19 nt, Homo sapiens
agaugaagcuaaagaauag

SEQ ID NO: 805971 - RNA, 19 nt, Homo sapiens
uaacaggcauuauuaccau

SEQ ID NO: 805972 - RNA, 19 nt, Homo sapiens
gcucacgugucuugucauu

SEQ ID NO: 805973 - RNA, 19 nt, Homo sapiens
cuaauuugguccuuugauu

SEQ ID NO: 805974 - RNA, 19 nt, Homo sapiens
cauaagagaccaacguuug

SEQ ID NO: 805975 - RNA, 19 nt, Homo sapiens
gcagggaaagggaaaugua

SEQ ID NO: 805976 - RNA, 19 nt, Homo sapiens
cagaaauacugaaugacuu

SEQ ID NO: 805977 - RNA, 19 nt, Homo sapiens
gagaagauucagaggcaua

SEQ ID NO: 805978 - RNA, 19 nt, Homo sapiens
gagaccaacguuugugaua

SEQ ID NO: 805979 - RNA, 19 nt, Homo sapiens
ggucauguuuuccauuuua

SEQ ID NO: 805980 - RNA, 19 nt, Homo sapiens
acaccaacauacuggcuua

SEQ ID NO: 805981 - RNA, 19 nt, Homo sapiens
gcagaacggaguuuauuuc

SEQ ID NO: 805982 - RNA, 19 nt, Homo sapiens
ccgcagaugugucuucaga

SEQ ID NO: 805983 - RNA, 19 nt, Homo sapiens
gcacaacggcaccaagaga

SEQ ID NO: 805984 - RNA, 19 nt, Homo sapiens
ccauagaacuuggucaugu

SEQ ID NO: 805985 - RNA, 19 nt, Homo sapiens
ccaaggaagcaguugauuu

SEQ ID NO: 805986 - RNA, 19 nt, Homo sapiens
caaacaggcugcuuaaaau

SEQ ID NO: 805987 - RNA, 19 nt, Homo sapiens
cauagaacuuggucauguu

SEQ ID NO: 805988 - RNA, 19 nt, Homo sapiens
gcugagagaugcacaacag

SEQ ID NO: 805989 - RNA, 19 nt, Homo sapiens
gagcuuagucucacgaguu

SEQ ID NO: 805990 - RNA, 19 nt, Homo sapiens
acacagcuuugcucagaaa

SEQ ID NO: 805991 - RNA, 19 nt, Homo sapiens
gguguccacuuucuuucua

SEQ ID NO: 805992 - RNA, 19 nt, Homo sapiens
uaaguggccucuggucauu

SEQ ID NO: 805993 - RNA, 19 nt, Homo sapiens
aauccuggcugcaauaaug

SEQ ID NO: 805994 - RNA, 19 nt, Homo sapiens
gacuguuccugacacuuua

SEQ ID NO: 805995 - RNA, 19 nt, Homo sapiens
gcagggagacaaacauuuc

SEQ ID NO: 805996 - RNA, 19 nt, Homo sapiens
gaacuuuauggauaggaua

SEQ ID NO: 805997 - RNA, 19 nt, Homo sapiens
caaauuccuuggcucuaug

SEQ ID NO: 805998 - RNA, 19 nt, Homo sapiens
guccuaacaggcauuauua

SEQ ID NO: 805999 - RNA, 19 nt, Homo sapiens
ggcauuauguacaaauaug

SEQ ID NO: 806000 - RNA, 19 nt, Homo sapiens
gggaaaccauccuacuugu

SEQ ID NO: 806001 - RNA, 19 nt, Homo sapiens
gaaauccuggcugcaauaa

SEQ ID NO: 806002 - RNA, 19 nt, Homo sapiens
agaaccagcaggcaauuua

SEQ ID NO: 806003 - RNA, 19 nt, Homo sapiens
ugauguaaaucuucccaaa

SEQ ID NO: 806004 - RNA, 19 nt, Homo sapiens
caacggagacaccagcauu

SEQ ID NO: 806005 - RNA, 19 nt, Homo sapiens
gaucacaaacucaucuaga

SEQ ID NO: 806006 - RNA, 19 nt, Homo sapiens
ucacgugucuugucauucu

SEQ ID NO: 806007 - RNA, 19 nt, Homo sapiens
gagguugguugaaucacaa

SEQ ID NO: 806008 - RNA, 19 nt, Homo sapiens
ggagacaaacauuucuauu

SEQ ID NO: 806009 - RNA, 19 nt, Homo sapiens
ucaacauucugucucauau

SEQ ID NO: 806010 - RNA, 19 nt, Homo sapiens
gcugaaauauuuuggguuu

SEQ ID NO: 806011 - RNA, 19 nt, Homo sapiens
agagaggcauuauguacaa

SEQ ID NO: 806012 - RNA, 19 nt, Homo sapiens
uaggaaaguuagaagcaaa

SEQ ID NO: 806013 - RNA, 19 nt, Homo sapiens
gaauacaaguccucaaaua

SEQ ID NO: 806014 - RNA, 19 nt, Homo sapiens
ggaaggauguuguggauaa

SEQ ID NO: 806015 - RNA, 19 nt, Homo sapiens
gaacaucugcacuuucuua

SEQ ID NO: 806016 - RNA, 19 nt, Homo sapiens
gaacagugcccaaauuaaa

SEQ ID NO: 806017 - RNA, 19 nt, Homo sapiens
guagaggccuggugguuua

SEQ ID NO: 806018 - RNA, 19 nt, Homo sapiens
ugguauagcuuuccuaaua

SEQ ID NO: 806019 - RNA, 19 nt, Homo sapiens
caaacuagaugucuucaga

SEQ ID NO: 806020 - RNA, 19 nt, Homo sapiens
ggagguggcuguuucauca

SEQ ID NO: 806021 - RNA, 19 nt, Homo sapiens
gagaaugcauggccaacua

SEQ ID NO: 806022 - RNA, 19 nt, Homo sapiens
ggaaaggaccuacgagaaa

SEQ ID NO: 806023 - RNA, 19 nt, Homo sapiens
caucugcacuuucuuauau

SEQ ID NO: 806024 - RNA, 19 nt, Homo sapiens
gaaaggaccuacgagaaau

SEQ ID NO: 806025 - RNA, 19 nt, Homo sapiens
gagcgaggauuuaauaaca

SEQ ID NO: 806026 - RNA, 19 nt, Homo sapiens
gcaaagagcgaggauuuaa

SEQ ID NO: 806027 - RNA, 19 nt, Homo sapiens
caacuaagccuuccucaau

SEQ ID NO: 806028 - RNA, 19 nt, Homo sapiens
gguauagcuuuccuaauaa

SEQ ID NO: 806029 - RNA, 19 nt, Homo sapiens
ccacauucgucaucaagua

SEQ ID NO: 806030 - RNA, 19 nt, Homo sapiens
gaacaaucguauuuccuau

SEQ ID NO: 806031 - RNA, 19 nt, Homo sapiens
gaacuguacaugugaaauu

SEQ ID NO: 806032 - RNA, 19 nt, Homo sapiens
gagacuauaucuacaugaa

SEQ ID NO: 806033 - RNA, 19 nt, Homo sapiens
cuagaugucuucagaaaug

SEQ ID NO: 806034 - RNA, 19 nt, Homo sapiens
guacauguauuaacaaugc

SEQ ID NO: 806035 - RNA, 19 nt, Homo sapiens
gaugaaaccuuccauagcu

SEQ ID NO: 806036 - RNA, 19 nt, Homo sapiens
aaagagcgaggauuuaaua

SEQ ID NO: 806037 - RNA, 19 nt, Homo sapiens
ccaaggagaaccauaguaa

SEQ ID NO: 806038 - RNA, 19 nt, Homo sapiens
gaaguucuuugcccagaga

SEQ ID NO: 806039 - RNA, 19 nt, Homo sapiens
guaauuugcacaucaauga

SEQ ID NO: 806040 - RNA, 19 nt, Homo sapiens
cgaauguucucacucacua

SEQ ID NO: 806041 - RNA, 19 nt, Homo sapiens
gcucgaauguucucacuca

SEQ ID NO: 806042 - RNA, 19 nt, Homo sapiens
caugauaacuagagaauac

SEQ ID NO: 806043 - RNA, 19 nt, Homo sapiens
gaaauuguacaacugaaga

SEQ ID NO: 806044 - RNA, 19 nt, Homo sapiens
gaggaaggauguuguggau

SEQ ID NO: 806045 - RNA, 19 nt, Homo sapiens
caacauacagguucuaaca

SEQ ID NO: 806046 - RNA, 19 nt, Homo sapiens
gcgaggauuuaauaacauu

SEQ ID NO: 806047 - RNA, 19 nt, Homo sapiens
gaaauagguuaaagguucu

SEQ ID NO: 806048 - RNA, 19 nt, Homo sapiens
gggccaaacuucaaaccaa

SEQ ID NO: 806049 - RNA, 19 nt, Homo sapiens
ggaacagugcccaaauuaa

SEQ ID NO: 806050 - RNA, 19 nt, Homo sapiens
gcaggcagauuacaauguc

SEQ ID NO: 806051 - RNA, 19 nt, Homo sapiens
gugauuaccucgaguuaag

SEQ ID NO: 806052 - RNA, 19 nt, Homo sapiens
gauuaugccucugguauag

SEQ ID NO: 806053 - RNA, 19 nt, Homo sapiens
ggaagcacuuuuaauguuu

SEQ ID NO: 806054 - RNA, 19 nt, Homo sapiens
gcucacagcaucucuccua

SEQ ID NO: 806055 - RNA, 19 nt, Homo sapiens
uacugaaacuugagacuuu

SEQ ID NO: 806056 - RNA, 19 nt, Homo sapiens
gaaagugccuucgcagacu

SEQ ID NO: 806057 - RNA, 19 nt, Homo sapiens
gaggagacguuguuuugua

SEQ ID NO: 806058 - RNA, 19 nt, Homo sapiens
gccaagaaacuguaucuga

SEQ ID NO: 806059 - RNA, 19 nt, Homo sapiens
ucaaugcuauccucuguuc

SEQ ID NO: 806060 - RNA, 19 nt, Homo sapiens
ugaauaaugcugugucuau

SEQ ID NO: 806061 - RNA, 19 nt, Homo sapiens
ggacucagaggaaauagau

SEQ ID NO: 806062 - RNA, 19 nt, Homo sapiens
gaagggccauacucagauc

SEQ ID NO: 806063 - RNA, 19 nt, Homo sapiens
ggaccuuacuggcauccaa

SEQ ID NO: 806064 - RNA, 19 nt, Homo sapiens
ugcaucaccuuaugaguuu

SEQ ID NO: 806065 - RNA, 19 nt, Homo sapiens
gaaaccaucagcucaguca

SEQ ID NO: 806066 - RNA, 19 nt, Homo sapiens
aagaaacuguaucugagua

SEQ ID NO: 806067 - RNA, 19 nt, Homo sapiens
ggccauacucagaucauua

SEQ ID NO: 806068 - RNA, 19 nt, Homo sapiens
cagcuuaacaccauaguga

SEQ ID NO: 806069 - RNA, 19 nt, Homo sapiens
auuuaaggcugucucuuua

SEQ ID NO: 806070 - RNA, 19 nt, Homo sapiens
gggaugagcacccucuuug

SEQ ID NO: 806071 - RNA, 19 nt, Homo sapiens
guucggguuugauccauuu

SEQ ID NO: 806072 - RNA, 19 nt, Homo sapiens
guauggauccuaauuaagu

SEQ ID NO: 806073 - RNA, 19 nt, Homo sapiens
acauacagguucuaacaga

SEQ ID NO: 806074 - RNA, 19 nt, Homo sapiens
gaacuacuuccucuaucuu

SEQ ID NO: 806075 - RNA, 19 nt, Homo sapiens
ugggagacauuaccuguga

SEQ ID NO: 806076 - RNA, 19 nt, Homo sapiens
gcccugcguuuccuauauu

SEQ ID NO: 806077 - RNA, 19 nt, Homo sapiens
ggaggaagggccauacuca

SEQ ID NO: 806078 - RNA, 19 nt, Homo sapiens
uaccggaccuugcuggaaa

SEQ ID NO: 806079 - RNA, 19 nt, Homo sapiens
ucauauacauugugacagu

SEQ ID NO: 806080 - RNA, 19 nt, Homo sapiens
cuaccacccuucacugcua

SEQ ID NO: 806081 - RNA, 19 nt, Homo sapiens
ccuaggaagugagcaguuu

SEQ ID NO: 806082 - RNA, 19 nt, Homo sapiens
gggugaggcucuccuagga

SEQ ID NO: 806083 - RNA, 19 nt, Homo sapiens
gaacgcauuccuuauacug

SEQ ID NO: 806084 - RNA, 19 nt, Homo sapiens
cuuggaaagucuagaauau

SEQ ID NO: 806085 - RNA, 19 nt, Homo sapiens
acuaacagcuuuguaggaa

SEQ ID NO: 806086 - RNA, 19 nt, Homo sapiens
caugcaauacccagacuua

SEQ ID NO: 806087 - RNA, 19 nt, Homo sapiens
gaaggauguuguggauaau

SEQ ID NO: 806088 - RNA, 19 nt, Homo sapiens
gacuggagcuuucaauggu

SEQ ID NO: 806089 - RNA, 19 nt, Homo sapiens
gccauacucagaucauuaa

SEQ ID NO: 806090 - RNA, 19 nt, Homo sapiens
uggaacagugcccaaauua

SEQ ID NO: 806091 - RNA, 19 nt, Homo sapiens
ggacacaaccaccgggaau

SEQ ID NO: 806092 - RNA, 19 nt, Homo sapiens
gugcaucaccuuaugaguu

SEQ ID NO: 806093 - RNA, 19 nt, Homo sapiens
gcaacgauauagagaagcu

SEQ ID NO: 806094 - RNA, 19 nt, Homo sapiens
caacuugcccaacuuaaag

SEQ ID NO: 806095 - RNA, 19 nt, Homo sapiens
acaaucguauuuccuaugu

SEQ ID NO: 806096 - RNA, 19 nt, Homo sapiens
gaggcuaguuugggaauuc

SEQ ID NO: 806097 - RNA, 19 nt, Homo sapiens
gaaaacccuuggaacugua

SEQ ID NO: 806098 - RNA, 19 nt, Homo sapiens
gaggaaugcuagaucacau

SEQ ID NO: 806099 - RNA, 19 nt, Homo sapiens
uaaauugaggguucugauu

SEQ ID NO: 806100 - RNA, 19 nt, Homo sapiens
uuagucagauuaccgaguu

SEQ ID NO: 806101 - RNA, 19 nt, Homo sapiens
gcauuucggaaccuaagua

SEQ ID NO: 806102 - RNA, 19 nt, Homo sapiens
aaaagcaacuggguauaua

SEQ ID NO: 806103 - RNA, 19 nt, Homo sapiens
uggagaacaucugcacuuu

SEQ ID NO: 806104 - RNA, 19 nt, Homo sapiens
gaugagcacccucuuugug

SEQ ID NO: 806105 - RNA, 19 nt, Homo sapiens
caagccggauuaccucgaa

SEQ ID NO: 806106 - RNA, 19 nt, Homo sapiens
gcucccagcuuaacaccau

SEQ ID NO: 806107 - RNA, 19 nt, Homo sapiens
caaccagugcaucaccuua

SEQ ID NO: 806108 - RNA, 19 nt, Homo sapiens
uauuuaaggcugucucuuu

SEQ ID NO: 806109 - RNA, 19 nt, Homo sapiens
uggaaagucuagaauaucu

SEQ ID NO: 806110 - RNA, 19 nt, Homo sapiens
cuauuaaucuugggaacaa

SEQ ID NO: 806111 - RNA, 19 nt, Homo sapiens
gaggaauucuaugaggaaa

SEQ ID NO: 806112 - RNA, 19 nt, Homo sapiens
cauauacauugugacagua

SEQ ID NO: 806113 - RNA, 19 nt, Homo sapiens
caaacuagcuucagauauu

SEQ ID NO: 806114 - RNA, 19 nt, Homo sapiens
gaagagagauaguagaaga

SEQ ID NO: 806115 - RNA, 19 nt, Homo sapiens
caaauaagaugaagagaga

SEQ ID NO: 806116 - RNA, 19 nt, Homo sapiens
gaaauuuccuuuaguugga

SEQ ID NO: 806117 - RNA, 19 nt, Homo sapiens
caagugguguugccucuua

SEQ ID NO: 806118 - RNA, 19 nt, Homo sapiens
gcagaaagagagaggauua

SEQ ID NO: 806119 - RNA, 19 nt, Homo sapiens
gaauacauguuucagagaa

SEQ ID NO: 806120 - RNA, 19 nt, Homo sapiens
aaacaaagguccuauagca

SEQ ID NO: 806121 - RNA, 19 nt, Homo sapiens
gauaugaacagguggcuua

SEQ ID NO: 806122 - RNA, 19 nt, Homo sapiens
aaagauugcucaagaagaa

SEQ ID NO: 806123 - RNA, 19 nt, Homo sapiens
gaucaaagccaaucaagau

SEQ ID NO: 806124 - RNA, 19 nt, Homo sapiens
agaaagaugcgaagaguua

SEQ ID NO: 806125 - RNA, 19 nt, Homo sapiens
gaucaggaauaucgaaaga

SEQ ID NO: 806126 - RNA, 19 nt, Homo sapiens
aauccuaacuuucuccuua

SEQ ID NO: 806127 - RNA, 19 nt, Homo sapiens
gcgaagggcuggguaugua

SEQ ID NO: 806128 - RNA, 19 nt, Homo sapiens
gagaaggaguggccauuau

SEQ ID NO: 806129 - RNA, 19 nt, Homo sapiens
gaugugaaauuuccuuuag

SEQ ID NO: 806130 - RNA, 19 nt, Homo sapiens
caagauuacuggagugaga

SEQ ID NO: 806131 - RNA, 19 nt, Homo sapiens
ggcaagguauacacaauuu

SEQ ID NO: 806132 - RNA, 19 nt, Homo sapiens
gcacaaaucaaagaagaaa

SEQ ID NO: 806133 - RNA, 19 nt, Homo sapiens
acaaauggaugcacugaga

SEQ ID NO: 806134 - RNA, 19 nt, Homo sapiens
gggaucagcuucaauaacu

SEQ ID NO: 806135 - RNA, 19 nt, Homo sapiens
gugacagacuauucaguua

SEQ ID NO: 806136 - RNA, 19 nt, Homo sapiens
aagcagagaaagcaaauua

SEQ ID NO: 806137 - RNA, 19 nt, Homo sapiens
gaacagguggcuuaacaga

SEQ ID NO: 806138 - RNA, 19 nt, Homo sapiens
cagcacaaaucaaagaaga

SEQ ID NO: 806139 - RNA, 19 nt, Homo sapiens
aaaggaagaucaaguaguc

SEQ ID NO: 806140 - RNA, 19 nt, Homo sapiens
ggaucugaaucaccaaauu

SEQ ID NO: 806141 - RNA, 19 nt, Homo sapiens
ggauuguacuguauaugaa

SEQ ID NO: 806142 - RNA, 19 nt, Homo sapiens
ggacuagcauaagaucaaa

SEQ ID NO: 806143 - RNA, 19 nt, Homo sapiens
gaagaauacauguuucaga

SEQ ID NO: 806144 - RNA, 19 nt, Homo sapiens
ggagaaggaguggccauua

SEQ ID NO: 806145 - RNA, 19 nt, Homo sapiens
gcagagaaagcaaauuaug

SEQ ID NO: 806146 - RNA, 19 nt, Homo sapiens
gaaagggcucuguguggua

SEQ ID NO: 806147 - RNA, 19 nt, Homo sapiens
ggauuaagcaggaacaaga

SEQ ID NO: 806148 - RNA, 19 nt, Homo sapiens
gaugaaaggucuugaugac

SEQ ID NO: 806149 - RNA, 19 nt, Homo sapiens
cccuauggcucaaucaaua

SEQ ID NO: 806150 - RNA, 19 nt, Homo sapiens
aagcuuagaucaucaagug

SEQ ID NO: 806151 - RNA, 19 nt, Homo sapiens
gaagauccaaauaagauga

SEQ ID NO: 806152 - RNA, 19 nt, Homo sapiens
ucaggaauaucgaaagaga

SEQ ID NO: 806153 - RNA, 19 nt, Homo sapiens
gggcuggguauguauauua

SEQ ID NO: 806154 - RNA, 19 nt, Homo sapiens
gaaggaguggccauuauga

SEQ ID NO: 806155 - RNA, 19 nt, Homo sapiens
gaaaggucuugaugacugu

SEQ ID NO: 806156 - RNA, 19 nt, Homo sapiens
caaagccugucauccuaaa

SEQ ID NO: 806157 - RNA, 19 nt, Homo sapiens
gcagaucggugcaagaaaa

SEQ ID NO: 806158 - RNA, 19 nt, Homo sapiens
uaagaagaaugcgagcuuu

SEQ ID NO: 806159 - RNA, 19 nt, Homo sapiens
ccauuggacucacagauug

SEQ ID NO: 806160 - RNA, 19 nt, Homo sapiens
aaagaagggugauaagagu

SEQ ID NO: 806161 - RNA, 19 nt, Homo sapiens
caagaagaauacauguuuc

SEQ ID NO: 806162 - RNA, 19 nt, Homo sapiens
gcaaauggucuccgaguca

SEQ ID NO: 806163 - RNA, 19 nt, Homo sapiens
gcaaagcagagaaagcaaa

SEQ ID NO: 806164 - RNA, 19 nt, Homo sapiens
uguaguggaugugaaauuu

SEQ ID NO: 806165 - RNA, 19 nt, Homo sapiens
cuggaugucuuucaaacua

SEQ ID NO: 806166 - RNA, 19 nt, Homo sapiens
acagguggcuuaacagaau

SEQ ID NO: 806167 - RNA, 19 nt, Homo sapiens
gaagggcuggguauguaua

SEQ ID NO: 806168 - RNA, 19 nt, Homo sapiens
gagcuauucuuuucuguaa

SEQ ID NO: 806169 - RNA, 19 nt, Homo sapiens
ggagugagagugacaagga

SEQ ID NO: 806170 - RNA, 19 nt, Homo sapiens
guaguggacuggaugaaag

SEQ ID NO: 806171 - RNA, 19 nt, Homo sapiens
gcuguuuaauggacucuuu

SEQ ID NO: 806172 - RNA, 19 nt, Homo sapiens
cagcuucaauaacuagaaa

SEQ ID NO: 806173 - RNA, 19 nt, Homo sapiens
uagccugccugaauuuaaa

SEQ ID NO: 806174 - RNA, 19 nt, Homo sapiens
aaagaaagaugcgaagagu

SEQ ID NO: 806175 - RNA, 19 nt, Homo sapiens
ggaugugaaauuuccuuua

SEQ ID NO: 806176 - RNA, 19 nt, Homo sapiens
caaagccaaucaagaugga

SEQ ID NO: 806177 - RNA, 19 nt, Homo sapiens
gcaggccacucuuaagaag

SEQ ID NO: 806178 - RNA, 19 nt, Homo sapiens
cgaccucccucgaugaguu

SEQ ID NO: 806179 - RNA, 19 nt, Homo sapiens
ucauuagccugccugaauu

SEQ ID NO: 806180 - RNA, 19 nt, Homo sapiens
ucauaucccugucgucaga

SEQ ID NO: 806181 - RNA, 19 nt, Homo sapiens
ggaucagcuucaauaacua

SEQ ID NO: 806182 - RNA, 19 nt, Homo sapiens
caacaucaaccucuugcaa

SEQ ID NO: 806183 - RNA, 19 nt, Homo sapiens
ggaugcaagugcuaaaugg

SEQ ID NO: 806184 - RNA, 19 nt, Homo sapiens
ggaggauucugucuucucu

SEQ ID NO: 806185 - RNA, 19 nt, Homo sapiens
augcaucccuuuauuggua

SEQ ID NO: 806186 - RNA, 19 nt, Homo sapiens
gcuacgaccuauaucuaug

SEQ ID NO: 806187 - RNA, 19 nt, Homo sapiens
gcauaagggaucugaauca

SEQ ID NO: 806188 - RNA, 19 nt, Homo sapiens
ccacgacuccugcacguuu

SEQ ID NO: 806189 - RNA, 19 nt, Homo sapiens
caaaucggauccacuucug

SEQ ID NO: 806190 - RNA, 19 nt, Homo sapiens
guaauagcccaacucacua

SEQ ID NO: 806191 - RNA, 19 nt, Homo sapiens
cccgagugguguuaucuua

SEQ ID NO: 806192 - RNA, 19 nt, Homo sapiens
gguauugcauaaugugaau

SEQ ID NO: 806193 - RNA, 19 nt, Homo sapiens
cagcuaaaauccuaacuuu

SEQ ID NO: 806194 - RNA, 19 nt, Homo sapiens
agagggaucagcuucaaua

SEQ ID NO: 806195 - RNA, 19 nt, Homo sapiens
aaagggcucugugugguaa

SEQ ID NO: 806196 - RNA, 19 nt, Homo sapiens
gauacuccaucaacaccaa

SEQ ID NO: 806197 - RNA, 19 nt, Homo sapiens
caaauggucuccgagucaa

SEQ ID NO: 806198 - RNA, 19 nt, Homo sapiens
cuaccuaguuuacaaaugg

SEQ ID NO: 806199 - RNA, 19 nt, Homo sapiens
gacagacuauucaguuaca

SEQ ID NO: 806200 - RNA, 19 nt, Homo sapiens
ggaugaaaggucuugauga

SEQ ID NO: 806201 - RNA, 19 nt, Homo sapiens
gggcaggcaugagcuauuc

SEQ ID NO: 806202 - RNA, 19 nt, Homo sapiens
gagcacaggcggcagucua

SEQ ID NO: 806203 - RNA, 19 nt, Homo sapiens
gacgugcuguauuguacua

SEQ ID NO: 806204 - RNA, 19 nt, Homo sapiens
guccuuauguggaagcaaa

SEQ ID NO: 806205 - RNA, 19 nt, Homo sapiens
gagaccacacuauaccaua

SEQ ID NO: 806206 - RNA, 19 nt, Homo sapiens
gcacugagacaagacauca

SEQ ID NO: 806207 - RNA, 19 nt, Homo sapiens
gagagauaguagaagagaa

SEQ ID NO: 806208 - RNA, 19 nt, Homo sapiens
gggcaggccacucuuaaga

SEQ ID NO: 806209 - RNA, 19 nt, Homo sapiens
cuaauacacugcgagaguu

SEQ ID NO: 806210 - RNA, 19 nt, Homo sapiens
gggcaagccucgaaguuuu

SEQ ID NO: 806211 - RNA, 19 nt, Homo sapiens
gauacugucuuauauugcu

SEQ ID NO: 806212 - RNA, 19 nt, Homo sapiens
agaagcagauacuccauca

SEQ ID NO: 806213 - RNA, 19 nt, Homo sapiens
gaccaaagcucaccuguuu

SEQ ID NO: 806214 - RNA, 19 nt, Homo sapiens
ggaaggauuuggaauauuu

SEQ ID NO: 806215 - RNA, 19 nt, Homo sapiens
gauaauagccuuacacuga

SEQ ID NO: 806216 - RNA, 19 nt, Homo sapiens
gaacuuacuugaauggauu

SEQ ID NO: 806217 - RNA, 19 nt, Homo sapiens
ggaaaugugugcuuuauag

SEQ ID NO: 806218 - RNA, 19 nt, Homo sapiens
gaacugaggaucauuugua

SEQ ID NO: 806219 - RNA, 19 nt, Homo sapiens
aaacugggcucaaacaauu

SEQ ID NO: 806220 - RNA, 19 nt, Homo sapiens
gagauugaacucugaauua

SEQ ID NO: 806221 - RNA, 19 nt, Homo sapiens
gaaagugauuguaccugua

SEQ ID NO: 806222 - RNA, 19 nt, Homo sapiens
gauccaagcaguucuauaa

SEQ ID NO: 806223 - RNA, 19 nt, Homo sapiens
caaacuugcuuaugauuga

SEQ ID NO: 806224 - RNA, 19 nt, Homo sapiens
gaagagaguucagaagaug

SEQ ID NO: 806225 - RNA, 19 nt, Homo sapiens
gagauugcauagaagaaua

SEQ ID NO: 806226 - RNA, 19 nt, Homo sapiens
uaacaucgguggcucaguu

SEQ ID NO: 806227 - RNA, 19 nt, Homo sapiens
cauuaucccucccugauua

SEQ ID NO: 806228 - RNA, 19 nt, Homo sapiens
gaauguuucugaaggcuuu

SEQ ID NO: 806229 - RNA, 19 nt, Homo sapiens
gugaagaugugaucauuug

SEQ ID NO: 806230 - RNA, 19 nt, Homo sapiens
ccacaaugcugauauaucu

SEQ ID NO: 806231 - RNA, 19 nt, Homo sapiens
uuagguagguaacaucuua

SEQ ID NO: 806232 - RNA, 19 nt, Homo sapiens
gaggaaggauuuggaauau

SEQ ID NO: 806233 - RNA, 19 nt, Homo sapiens
gaaggaaauacuacucaua

SEQ ID NO: 806234 - RNA, 19 nt, Homo sapiens
gagaaacugugccuguuga

SEQ ID NO: 806235 - RNA, 19 nt, Homo sapiens
gcuacacuauuucuguuua

SEQ ID NO: 806236 - RNA, 19 nt, Homo sapiens
guguaucacuuucacuuua

SEQ ID NO: 806237 - RNA, 19 nt, Homo sapiens
guaaugaggcagaauauug

SEQ ID NO: 806238 - RNA, 19 nt, Homo sapiens
ggacuagcuuaccugauuu

SEQ ID NO: 806239 - RNA, 19 nt, Homo sapiens
ccacuguacuguaauaaug

SEQ ID NO: 806240 - RNA, 19 nt, Homo sapiens
ccaagcaguucuauaauca

SEQ ID NO: 806241 - RNA, 19 nt, Homo sapiens
gagaaccuauugaaaggaa

SEQ ID NO: 806242 - RNA, 19 nt, Homo sapiens
gaguagugauuagcauuua

SEQ ID NO: 806243 - RNA, 19 nt, Homo sapiens
gcaauggagucuuaaagca

SEQ ID NO: 806244 - RNA, 19 nt, Homo sapiens
gagagaaccuauugaaagg

SEQ ID NO: 806245 - RNA, 19 nt, Homo sapiens
ggaugaagguuaucaguac

SEQ ID NO: 806246 - RNA, 19 nt, Homo sapiens
ugaagagaaugcauauuug

SEQ ID NO: 806247 - RNA, 19 nt, Homo sapiens
ggaagaagugcuugaaaga

SEQ ID NO: 806248 - RNA, 19 nt, Homo sapiens
gcaaugccuuagucauaaa

SEQ ID NO: 806249 - RNA, 19 nt, Homo sapiens
ugaaagucauggacaauug

SEQ ID NO: 806250 - RNA, 19 nt, Homo sapiens
uuagugaccucuggaauaa

SEQ ID NO: 806251 - RNA, 19 nt, Homo sapiens
acucuuagguggaauguuu

SEQ ID NO: 806252 - RNA, 19 nt, Homo sapiens
acucauaucuucauuguca

SEQ ID NO: 806253 - RNA, 19 nt, Homo sapiens
guuaaggaaugagaagaua

SEQ ID NO: 806254 - RNA, 19 nt, Homo sapiens
guugucaccuucuuaacua

SEQ ID NO: 806255 - RNA, 19 nt, Homo sapiens
gagagaaacugugccuguu

SEQ ID NO: 806256 - RNA, 19 nt, Homo sapiens
gcagaguccugacauugga

SEQ ID NO: 806257 - RNA, 19 nt, Homo sapiens
gaagucgggaugaagguua

SEQ ID NO: 806258 - RNA, 19 nt, Homo sapiens
cuaaugcacugacagauuc

SEQ ID NO: 806259 - RNA, 19 nt, Homo sapiens
ggguugaacuuacuugaau

SEQ ID NO: 806260 - RNA, 19 nt, Homo sapiens
ccugugaacugcaaacuug

SEQ ID NO: 806261 - RNA, 19 nt, Homo sapiens
ucaggaaguuugagugcua

SEQ ID NO: 806262 - RNA, 19 nt, Homo sapiens
ugucagggcuggaacuauu

SEQ ID NO: 806263 - RNA, 19 nt, Homo sapiens
ugacagguuucuagaguug

SEQ ID NO: 806264 - RNA, 19 nt, Homo sapiens
gcaauguuguauauaguuc

SEQ ID NO: 806265 - RNA, 19 nt, Homo sapiens
gaugguuguugccgaagua

SEQ ID NO: 806266 - RNA, 19 nt, Homo sapiens
aggcugaucuugaaucuga

SEQ ID NO: 806267 - RNA, 19 nt, Homo sapiens
gauguuaacuggccugcau

SEQ ID NO: 806268 - RNA, 19 nt, Homo sapiens
aagaagugcuugaaagaga

SEQ ID NO: 806269 - RNA, 19 nt, Homo sapiens
uagaauaguuguugaaggu

SEQ ID NO: 806270 - RNA, 19 nt, Homo sapiens
gaaugcaggucuggcuaaa

SEQ ID NO: 806271 - RNA, 19 nt, Homo sapiens
uaagcaagguccacucuag

SEQ ID NO: 806272 - RNA, 19 nt, Homo sapiens
agaccacaaugcugauaua

SEQ ID NO: 806273 - RNA, 19 nt, Homo sapiens
ucucaaaucuucaacucuu

SEQ ID NO: 806274 - RNA, 19 nt, Homo sapiens
ggaaauacuacucauaucu

SEQ ID NO: 806275 - RNA, 19 nt, Homo sapiens
uuaauuaccuaacgucugu

SEQ ID NO: 806276 - RNA, 19 nt, Homo sapiens
cagaaacucuuagguggaa

SEQ ID NO: 806277 - RNA, 19 nt, Homo sapiens
gaagcaagugugagcagua

SEQ ID NO: 806278 - RNA, 19 nt, Homo sapiens
cugaagagaaugcauauuu

SEQ ID NO: 806279 - RNA, 19 nt, Homo sapiens
gagaauagaggcaaaagua

SEQ ID NO: 806280 - RNA, 19 nt, Homo sapiens
gaggucaaacuaaggauaa

SEQ ID NO: 806281 - RNA, 19 nt, Homo sapiens
aggacuagcuuaccugauu

SEQ ID NO: 806282 - RNA, 19 nt, Homo sapiens
cgaaagaaauguagaugcu

SEQ ID NO: 806283 - RNA, 19 nt, Homo sapiens
cucaauaucugucaaacuu

SEQ ID NO: 806284 - RNA, 19 nt, Homo sapiens
uaaagauugugguucaguu

SEQ ID NO: 806285 - RNA, 19 nt, Homo sapiens
uaguguagcugaagagaau

SEQ ID NO: 806286 - RNA, 19 nt, Homo sapiens
ggaaggaaauacuacucau

SEQ ID NO: 806287 - RNA, 19 nt, Homo sapiens
uaaugccacuuuaacacua

SEQ ID NO: 806288 - RNA, 19 nt, Homo sapiens
aaacaauucucagccuaaa

SEQ ID NO: 806289 - RNA, 19 nt, Homo sapiens
guagaugaguuuccagaag

SEQ ID NO: 806290 - RNA, 19 nt, Homo sapiens
ggagauugaacucugaauu

SEQ ID NO: 806291 - RNA, 19 nt, Homo sapiens
gcacugacagauucuaaau

SEQ ID NO: 806292 - RNA, 19 nt, Homo sapiens
gaaagaaauguagaugcua

SEQ ID NO: 806293 - RNA, 19 nt, Homo sapiens
ccuaguacuuguagauuga

SEQ ID NO: 806294 - RNA, 19 nt, Homo sapiens
ugaaaggaauuuguuguca

SEQ ID NO: 806295 - RNA, 19 nt, Homo sapiens
aaucgccacuguacuguaa

SEQ ID NO: 806296 - RNA, 19 nt, Homo sapiens
aguaggaaauccaaugaaa

SEQ ID NO: 806297 - RNA, 19 nt, Homo sapiens
ccacucagauucuaaacag

SEQ ID NO: 806298 - RNA, 19 nt, Homo sapiens
gaaaggcagauacggcauu

SEQ ID NO: 806299 - RNA, 19 nt, Homo sapiens
uauugcaccuccuuucuuu

SEQ ID NO: 806300 - RNA, 19 nt, Homo sapiens
uuaccaggcugaucuugaa

SEQ ID NO: 806301 - RNA, 19 nt, Homo sapiens
gaagaugugaucauuugug

SEQ ID NO: 806302 - RNA, 19 nt, Homo sapiens
cuacucauaucuucauugu

SEQ ID NO: 806303 - RNA, 19 nt, Homo sapiens
gauaaccuaugggaauguu

SEQ ID NO: 806304 - RNA, 19 nt, Homo sapiens
caaacaauucucagccuaa

SEQ ID NO: 806305 - RNA, 19 nt, Homo sapiens
gggaugaagguuaucagua

SEQ ID NO: 806306 - RNA, 19 nt, Homo sapiens
ccaguaaugaggcagaaua

SEQ ID NO: 806307 - RNA, 19 nt, Homo sapiens
agcaagcaauggagucuua

SEQ ID NO: 806308 - RNA, 19 nt, Homo sapiens
gaagagaaugcauauuugg

SEQ ID NO: 806309 - RNA, 19 nt, Homo sapiens
agaggaaggauuuggaaua

SEQ ID NO: 806310 - RNA, 19 nt, Homo sapiens
gagguucccuuugcauguu

SEQ ID NO: 806311 - RNA, 19 nt, Homo sapiens
gucauaaacugggcucaaa

SEQ ID NO: 806312 - RNA, 19 nt, Homo sapiens
gcagcguguuguuuccuuu

SEQ ID NO: 806313 - RNA, 19 nt, Homo sapiens
gaacuuguaucuucuguua

SEQ ID NO: 806314 - RNA, 19 nt, Homo sapiens
ggagaaauaugaugcuaua

SEQ ID NO: 806315 - RNA, 19 nt, Homo sapiens
gaauugagcuaucugcuaa

SEQ ID NO: 806316 - RNA, 19 nt, Homo sapiens
gaacaagaaugcagcaaga

SEQ ID NO: 806317 - RNA, 19 nt, Homo sapiens
gaaugcaucuagcuuauuu

SEQ ID NO: 806318 - RNA, 19 nt, Homo sapiens
gcaucuagcuuauuucuug

SEQ ID NO: 806319 - RNA, 19 nt, Homo sapiens
gaagagcauuuacuauuug

SEQ ID NO: 806320 - RNA, 19 nt, Homo sapiens
ggaaugagugcuuuaguua

SEQ ID NO: 806321 - RNA, 19 nt, Homo sapiens
gcaaagaccuccaguacca

SEQ ID NO: 806322 - RNA, 19 nt, Homo sapiens
uaaaucagauguuggcuuu

SEQ ID NO: 806323 - RNA, 19 nt, Homo sapiens
gaugauauguguaagaaga

SEQ ID NO: 806324 - RNA, 19 nt, Homo sapiens
guaggaaccuuacaaauac

SEQ ID NO: 806325 - RNA, 19 nt, Homo sapiens
gaaaucagcacuacacaga

SEQ ID NO: 806326 - RNA, 19 nt, Homo sapiens
uaacaggaaucaagugcua

SEQ ID NO: 806327 - RNA, 19 nt, Homo sapiens
gagcugccaucgucacaua

SEQ ID NO: 806328 - RNA, 19 nt, Homo sapiens
uaacagcccuuagaauuga

SEQ ID NO: 806329 - RNA, 19 nt, Homo sapiens
guaaggugguccuagauaa

SEQ ID NO: 806330 - RNA, 19 nt, Homo sapiens
ggaauugucagcauuauug

SEQ ID NO: 806331 - RNA, 19 nt, Homo sapiens
gagaugauauguguaagaa

SEQ ID NO: 806332 - RNA, 19 nt, Homo sapiens
gcaguaaggugguccuaga

SEQ ID NO: 806333 - RNA, 19 nt, Homo sapiens
cuacagauauucaaagguu

SEQ ID NO: 806334 - RNA, 19 nt, Homo sapiens
gguauuauuuacaccguua

SEQ ID NO: 806335 - RNA, 19 nt, Homo sapiens
ccaggaaucuugugguuga

SEQ ID NO: 806336 - RNA, 19 nt, Homo sapiens
gaaauaugaugcuauacca

SEQ ID NO: 806337 - RNA, 19 nt, Homo sapiens
gcucacacauuacaaauag

SEQ ID NO: 806338 - RNA, 19 nt, Homo sapiens
ccaagaucaugcaguauaa

SEQ ID NO: 806339 - RNA, 19 nt, Homo sapiens
uaauggaccuguuuaugaa

SEQ ID NO: 806340 - RNA, 19 nt, Homo sapiens
gagauaugccuuucaguuu

SEQ ID NO: 806341 - RNA, 19 nt, Homo sapiens
caaugagugugaugagaua

SEQ ID NO: 806342 - RNA, 19 nt, Homo sapiens
ucaaugcaguguagacuuu

SEQ ID NO: 806343 - RNA, 19 nt, Homo sapiens
uuaccucaguucacuauua

SEQ ID NO: 806344 - RNA, 19 nt, Homo sapiens
ggaagaugcagucacauuu

SEQ ID NO: 806345 - RNA, 19 nt, Homo sapiens
ggacacacacacacacaua

SEQ ID NO: 806346 - RNA, 19 nt, Homo sapiens
gcaguaaggauauaaaugu

SEQ ID NO: 806347 - RNA, 19 nt, Homo sapiens
cuuacaagcugcauacuuu

SEQ ID NO: 806348 - RNA, 19 nt, Homo sapiens
cuagugcucugacugguua

SEQ ID NO: 806349 - RNA, 19 nt, Homo sapiens
uaggagacaugcauuugua

SEQ ID NO: 806350 - RNA, 19 nt, Homo sapiens
caugagaagugaagaaugu

SEQ ID NO: 806351 - RNA, 19 nt, Homo sapiens
gaacauaugaugagagaag

SEQ ID NO: 806352 - RNA, 19 nt, Homo sapiens
gcaaagcacacaauaaagu

SEQ ID NO: 806353 - RNA, 19 nt, Homo sapiens
gauggaagaugcagucaca

SEQ ID NO: 806354 - RNA, 19 nt, Homo sapiens
cuacaguauuggucauuua

SEQ ID NO: 806355 - RNA, 19 nt, Homo sapiens
ucaauguacuccuuagaaa

SEQ ID NO: 806356 - RNA, 19 nt, Homo sapiens
ucaaucaugucuacaaaug

SEQ ID NO: 806357 - RNA, 19 nt, Homo sapiens
guggagagcucaacuugga

SEQ ID NO: 806358 - RNA, 19 nt, Homo sapiens
ccaguaaacuuaguauuuc

SEQ ID NO: 806359 - RNA, 19 nt, Homo sapiens
uaagaugacuccuuucucu

SEQ ID NO: 806360 - RNA, 19 nt, Homo sapiens
aaagggaacugagagguaa

SEQ ID NO: 806361 - RNA, 19 nt, Homo sapiens
acacauguuugaaguacua

SEQ ID NO: 806362 - RNA, 19 nt, Homo sapiens
aaucagcucugugaacaua

SEQ ID NO: 806363 - RNA, 19 nt, Homo sapiens
cauucaaacuggaacauuu

SEQ ID NO: 806364 - RNA, 19 nt, Homo sapiens
ucaacaagcagaacuauga

SEQ ID NO: 806365 - RNA, 19 nt, Homo sapiens
agauuaagaugacuccuuu

SEQ ID NO: 806366 - RNA, 19 nt, Homo sapiens
guuggaaucuaucuaaaug

SEQ ID NO: 806367 - RNA, 19 nt, Homo sapiens
aaaguagccuuguauagug

SEQ ID NO: 806368 - RNA, 19 nt, Homo sapiens
gauauucaaagguugcuua

SEQ ID NO: 806369 - RNA, 19 nt, Homo sapiens
ggauacaacuucugcuaca

SEQ ID NO: 806370 - RNA, 19 nt, Homo sapiens
gaugaugaauugaagaaag

SEQ ID NO: 806371 - RNA, 19 nt, Homo sapiens
ggaauugagcuaucugcua

SEQ ID NO: 806372 - RNA, 19 nt, Homo sapiens
aguaggaaccuuacaaaua

SEQ ID NO: 806373 - RNA, 19 nt, Homo sapiens
gcacuugccacacaauuau

SEQ ID NO: 806374 - RNA, 19 nt, Homo sapiens
agaggaaacuggagaugaa

SEQ ID NO: 806375 - RNA, 19 nt, Homo sapiens
gugaugaaguguauuggaa

SEQ ID NO: 806376 - RNA, 19 nt, Homo sapiens
gaacuaugaggcuauguug

SEQ ID NO: 806377 - RNA, 19 nt, Homo sapiens
acaggaauaucaaggauug

SEQ ID NO: 806378 - RNA, 19 nt, Homo sapiens
uaaaagaagugaaggacua

SEQ ID NO: 806379 - RNA, 19 nt, Homo sapiens
gaucagaaaucagcacuac

SEQ ID NO: 806380 - RNA, 19 nt, Homo sapiens
gagcauuuacuauuuggua

SEQ ID NO: 806381 - RNA, 19 nt, Homo sapiens
gagaacauccugccucuuc

SEQ ID NO: 806382 - RNA, 19 nt, Homo sapiens
caaagguugcuuacauaua

SEQ ID NO: 806383 - RNA, 19 nt, Homo sapiens
gcaacuauuucacagcaau

SEQ ID NO: 806384 - RNA, 19 nt, Homo sapiens
gauuacguguggacuauug

SEQ ID NO: 806385 - RNA, 19 nt, Homo sapiens
cauuccaagucuucuauua

SEQ ID NO: 806386 - RNA, 19 nt, Homo sapiens
gcccaucccucuucauuca

SEQ ID NO: 806387 - RNA, 19 nt, Homo sapiens
gccaagaucaugcaguaua

SEQ ID NO: 806388 - RNA, 19 nt, Homo sapiens
gugaacauaugaugagaga

SEQ ID NO: 806389 - RNA, 19 nt, Homo sapiens
gaccagaagcgcuuugaaa

SEQ ID NO: 806390 - RNA, 19 nt, Homo sapiens
gcgcccacauuuccuagua

SEQ ID NO: 806391 - RNA, 19 nt, Homo sapiens
guaauucccugagugaugu

SEQ ID NO: 806392 - RNA, 19 nt, Homo sapiens
gaacagccucuucugaugu

SEQ ID NO: 806393 - RNA, 19 nt, Homo sapiens
ccagaucugcuuauuguuu

SEQ ID NO: 806394 - RNA, 19 nt, Homo sapiens
guaacuguguauaauguug

SEQ ID NO: 806395 - RNA, 19 nt, Homo sapiens
gagagguaacuguguauaa

SEQ ID NO: 806396 - RNA, 19 nt, Homo sapiens
aauuacaccuuccacauuu

SEQ ID NO: 806397 - RNA, 19 nt, Homo sapiens
ggugaaggcaguaaggaua

SEQ ID NO: 806398 - RNA, 19 nt, Homo sapiens
gaauggacacuaacaggaa

SEQ ID NO: 806399 - RNA, 19 nt, Homo sapiens
gaaaucagaauggacacua

SEQ ID NO: 806400 - RNA, 19 nt, Homo sapiens
aagccaagaucaugcagua

SEQ ID NO: 806401 - RNA, 19 nt, Homo sapiens
ugacguugguuucauguug

SEQ ID NO: 806402 - RNA, 19 nt, Homo sapiens
guacauuaguuucaacaag

SEQ ID NO: 806403 - RNA, 19 nt, Homo sapiens
gagcucaacuuggaaaucu

SEQ ID NO: 806404 - RNA, 19 nt, Homo sapiens
aaucagcacuacacagaaa

SEQ ID NO: 806405 - RNA, 19 nt, Homo sapiens
cuucugauguuucuaggua

SEQ ID NO: 806406 - RNA, 19 nt, Homo sapiens
guagggauccaagcucuua

SEQ ID NO: 806407 - RNA, 19 nt, Homo sapiens
acacacacacacauaaaua

SEQ ID NO: 806408 - RNA, 19 nt, Homo sapiens
ugacaacuuugaagccauu

SEQ ID NO: 806409 - RNA, 19 nt, Homo sapiens
cuuauuggaugcaguauau

SEQ ID NO: 806410 - RNA, 19 nt, Homo sapiens
caagucaguugucaaugga

SEQ ID NO: 806411 - RNA, 19 nt, Homo sapiens
uagagcacauugaagcuaa

SEQ ID NO: 806412 - RNA, 19 nt, Homo sapiens
uuaauggaccuguuuauga

SEQ ID NO: 806413 - RNA, 19 nt, Homo sapiens
gaagugaauuugcaaagua

SEQ ID NO: 806414 - RNA, 19 nt, Homo sapiens
gaacauaucucaggcauca

SEQ ID NO: 806415 - RNA, 19 nt, Homo sapiens
caaaguugcuggcuuagua

SEQ ID NO: 806416 - RNA, 19 nt, Homo sapiens
gaagagaacccauugguaa

SEQ ID NO: 806417 - RNA, 19 nt, Homo sapiens
guagagcccucaauucaua

SEQ ID NO: 806418 - RNA, 19 nt, Homo sapiens
ggaaagcaauccuuaguga

SEQ ID NO: 806419 - RNA, 19 nt, Homo sapiens
ucaaacagcugucauagaa

SEQ ID NO: 806420 - RNA, 19 nt, Homo sapiens
ggagaaaucuuaugaaugc

SEQ ID NO: 806421 - RNA, 19 nt, Homo sapiens
gaaaggacaucucauucaa

SEQ ID NO: 806422 - RNA, 19 nt, Homo sapiens
uaagagacuucccuaauaa

SEQ ID NO: 806423 - RNA, 19 nt, Homo sapiens
gaagaaauuuguccggaaa

SEQ ID NO: 806424 - RNA, 19 nt, Homo sapiens
caugaaagcucucaauuau

SEQ ID NO: 806425 - RNA, 19 nt, Homo sapiens
gaaaucaaaccucagaaua

SEQ ID NO: 806426 - RNA, 19 nt, Homo sapiens
gaagggaaauaauguauca

SEQ ID NO: 806427 - RNA, 19 nt, Homo sapiens
gaaaccagaugaagaugaa

SEQ ID NO: 806428 - RNA, 19 nt, Homo sapiens
gaagaugaaugcaggaaga

SEQ ID NO: 806429 - RNA, 19 nt, Homo sapiens
ccaaacagaugcagaagaa

SEQ ID NO: 806430 - RNA, 19 nt, Homo sapiens
gagcauuccuuguaguuaa

SEQ ID NO: 806431 - RNA, 19 nt, Homo sapiens
ggacgugacuauagaauuc

SEQ ID NO: 806432 - RNA, 19 nt, Homo sapiens
ggagaaacauccucuaaag

SEQ ID NO: 806433 - RNA, 19 nt, Homo sapiens
guaauucgcauaagucaua

SEQ ID NO: 806434 - RNA, 19 nt, Homo sapiens
gaaagaaaccagaugaaga

SEQ ID NO: 806435 - RNA, 19 nt, Homo sapiens
gaagacagucccagaagua

SEQ ID NO: 806436 - RNA, 19 nt, Homo sapiens
ggaaagagcacgaggaugu

SEQ ID NO: 806437 - RNA, 19 nt, Homo sapiens
gagcauuucuggcauguug

SEQ ID NO: 806438 - RNA, 19 nt, Homo sapiens
auaagagacuucccuaaua

SEQ ID NO: 806439 - RNA, 19 nt, Homo sapiens
gaagucaaaccucagaaua

SEQ ID NO: 806440 - RNA, 19 nt, Homo sapiens
gaugaaacccuauaaaugu

SEQ ID NO: 806441 - RNA, 19 nt, Homo sapiens
agaaacaccugcaucuuaa

SEQ ID NO: 806442 - RNA, 19 nt, Homo sapiens
gaacacagacuuggguuaa

SEQ ID NO: 806443 - RNA, 19 nt, Homo sapiens
ccgaagaacugcucucuga

SEQ ID NO: 806444 - RNA, 19 nt, Homo sapiens
caacagcucugaucauuuu

SEQ ID NO: 806445 - RNA, 19 nt, Homo sapiens
ggacuacuguauucuguug

SEQ ID NO: 806446 - RNA, 19 nt, Homo sapiens
gaaaauagguugcgguaau

SEQ ID NO: 806447 - RNA, 19 nt, Homo sapiens
gaaaggagcaggucuugau

SEQ ID NO: 806448 - RNA, 19 nt, Homo sapiens
ucaaguagaugcccauaau

SEQ ID NO: 806449 - RNA, 19 nt, Homo sapiens
ucaaggagaaccucaaaua

SEQ ID NO: 806450 - RNA, 19 nt, Homo sapiens
gaagucaacuguggaggaa

SEQ ID NO: 806451 - RNA, 19 nt, Homo sapiens
gaaaguguaguagggauua

SEQ ID NO: 806452 - RNA, 19 nt, Homo sapiens
ggauguccaugauguauau

SEQ ID NO: 806453 - RNA, 19 nt, Homo sapiens
agaagucacucaaugauga

SEQ ID NO: 806454 - RNA, 19 nt, Homo sapiens
aaaagcagcuguuaguuua

SEQ ID NO: 806455 - RNA, 19 nt, Homo sapiens
guacaggacaccuagauuu

SEQ ID NO: 806456 - RNA, 19 nt, Homo sapiens
gaaaggcacaccucacuga

SEQ ID NO: 806457 - RNA, 19 nt, Homo sapiens
aggagaaccucaaauauga

SEQ ID NO: 806458 - RNA, 19 nt, Homo sapiens
gcaagagauuaaacuauca

SEQ ID NO: 806459 - RNA, 19 nt, Homo sapiens
ccucagagaucaucacaga

SEQ ID NO: 806460 - RNA, 19 nt, Homo sapiens
aaacagcugucauagaaga

SEQ ID NO: 806461 - RNA, 19 nt, Homo sapiens
ggaaauccuuugagaaguc

SEQ ID NO: 806462 - RNA, 19 nt, Homo sapiens
ggaaggcaaacaaauuuaa

SEQ ID NO: 806463 - RNA, 19 nt, Homo sapiens
ggcaacaucuuacuaguuc

SEQ ID NO: 806464 - RNA, 19 nt, Homo sapiens
gagaacccauugguaagua

SEQ ID NO: 806465 - RNA, 19 nt, Homo sapiens
ucgcauaagucauagaauu

SEQ ID NO: 806466 - RNA, 19 nt, Homo sapiens
ugacagugcuuguauucaa

SEQ ID NO: 806467 - RNA, 19 nt, Homo sapiens
ggagagaaaccauucaaau

SEQ ID NO: 806468 - RNA, 19 nt, Homo sapiens
ggagagaaaccauuugaau

SEQ ID NO: 806469 - RNA, 19 nt, Homo sapiens
caucuggguugcucaagua

SEQ ID NO: 806470 - RNA, 19 nt, Homo sapiens
gauguggccuagauauuug

SEQ ID NO: 806471 - RNA, 19 nt, Homo sapiens
gguagaggguucugaccua

SEQ ID NO: 806472 - RNA, 19 nt, Homo sapiens
ccucaaauaugaucagaga

SEQ ID NO: 806473 - RNA, 19 nt, Homo sapiens
uguaagaagucuacccuaa

SEQ ID NO: 806474 - RNA, 19 nt, Homo sapiens
gguuaaauccucugaauau

SEQ ID NO: 806475 - RNA, 19 nt, Homo sapiens
ggauguggccuagauauuu

SEQ ID NO: 806476 - RNA, 19 nt, Homo sapiens
ggauaggccugaaugaagu

SEQ ID NO: 806477 - RNA, 19 nt, Homo sapiens
gaagucuacccuaagcuua

SEQ ID NO: 806478 - RNA, 19 nt, Homo sapiens
ggagaaaacuuaccagugu

SEQ ID NO: 806479 - RNA, 19 nt, Homo sapiens
gguaauguaugugagaauu

SEQ ID NO: 806480 - RNA, 19 nt, Homo sapiens
ucaaggacgugacuauaga

SEQ ID NO: 806481 - RNA, 19 nt, Homo sapiens
ccaauacuccauuucauaa

SEQ ID NO: 806482 - RNA, 19 nt, Homo sapiens
agucauacccuauuagaua

SEQ ID NO: 806483 - RNA, 19 nt, Homo sapiens
cagaguguaucaaagaauu

SEQ ID NO: 806484 - RNA, 19 nt, Homo sapiens
cagaagccaucacagauug

SEQ ID NO: 806485 - RNA, 19 nt, Homo sapiens
cuaccuggauccaucauuu

SEQ ID NO: 806486 - RNA, 19 nt, Homo sapiens
gguugaaacuucuggcaaa

SEQ ID NO: 806487 - RNA, 19 nt, Homo sapiens
guagugggaugaagucuca

SEQ ID NO: 806488 - RNA, 19 nt, Homo sapiens
gguagugaauguaagaaga

SEQ ID NO: 806489 - RNA, 19 nt, Homo sapiens
ucagagggcacaaaccuua

SEQ ID NO: 806490 - RNA, 19 nt, Homo sapiens
gcuuuaauguggcauggua

SEQ ID NO: 806491 - RNA, 19 nt, Homo sapiens
caacuguggaggaauauaa

SEQ ID NO: 806492 - RNA, 19 nt, Homo sapiens
ggagcaagcuuuugaaugu

SEQ ID NO: 806493 - RNA, 19 nt, Homo sapiens
ggaagugaauuugcaaagu

SEQ ID NO: 806494 - RNA, 19 nt, Homo sapiens
gagaugugaugcuggagaa

SEQ ID NO: 806495 - RNA, 19 nt, Homo sapiens
gacacugggugacauggua

SEQ ID NO: 806496 - RNA, 19 nt, Homo sapiens
gaagucauacccuauuaga

SEQ ID NO: 806497 - RNA, 19 nt, Homo sapiens
cagagugcaucaaagaauu

SEQ ID NO: 806498 - RNA, 19 nt, Homo sapiens
ggacaucucauucaacauc

SEQ ID NO: 806499 - RNA, 19 nt, Homo sapiens
ggacucaacaacuaacaaa

SEQ ID NO: 806500 - RNA, 19 nt, Homo sapiens
gaaaagcagcuguuaguuu

SEQ ID NO: 806501 - RNA, 19 nt, Homo sapiens
ucagagaauucacauagga

SEQ ID NO: 806502 - RNA, 19 nt, Homo sapiens
gaagaagucacucaaugau

SEQ ID NO: 806503 - RNA, 19 nt, Homo sapiens
gccaauacuccauuucaua

SEQ ID NO: 806504 - RNA, 19 nt, Homo sapiens
ccgaagaagucacucaaug

SEQ ID NO: 806505 - RNA, 19 nt, Homo sapiens
guagaugcccauaauaaga

SEQ ID NO: 806506 - RNA, 19 nt, Homo sapiens
gauaucauuucuaggacaa

SEQ ID NO: 806507 - RNA, 19 nt, Homo sapiens
acaugaaagcucucaauua

SEQ ID NO: 806508 - RNA, 19 nt, Homo sapiens
guagaggguucugaccuaa

SEQ ID NO: 806509 - RNA, 19 nt, Homo sapiens
ggagggacucagauuuaua

SEQ ID NO: 806510 - RNA, 19 nt, Homo sapiens
gcuagagagucaaggagaa

SEQ ID NO: 806511 - RNA, 19 nt, Homo sapiens
uaaauuaggcacagcaaga

SEQ ID NO: 806512 - RNA, 19 nt, Homo sapiens
uuagauagcucccacacau

SEQ ID NO: 806513 - RNA, 19 nt, Homo sapiens
gagcuucuauuucauauug

SEQ ID NO: 806514 - RNA, 19 nt, Homo sapiens
gaauaaagauacagagagu

SEQ ID NO: 806515 - RNA, 19 nt, Homo sapiens
ggagagagagaaacauaua

SEQ ID NO: 806516 - RNA, 19 nt, Homo sapiens
gaacgaccguguacagugu

SEQ ID NO: 806517 - RNA, 19 nt, Homo sapiens
cuucugaccucaagugaua

SEQ ID NO: 806518 - RNA, 19 nt, Homo sapiens
ggcaggauguugucaauug

SEQ ID NO: 806519 - RNA, 19 nt, Homo sapiens
gcacugagaagagaaguuu

SEQ ID NO: 806520 - RNA, 19 nt, Homo sapiens
gaggugagguuggaaguug

SEQ ID NO: 806521 - RNA, 19 nt, Homo sapiens
gugccgagcuucuauuuca

SEQ ID NO: 806522 - RNA, 19 nt, Homo sapiens
gggcagcucuugucuugga

SEQ ID NO: 806523 - RNA, 19 nt, Homo sapiens
gcaaaagggaugaguguua

SEQ ID NO: 806524 - RNA, 19 nt, Homo sapiens
ccaaaacccuguugugaaa

SEQ ID NO: 806525 - RNA, 19 nt, Homo sapiens
gagaauggagagagagaaa

SEQ ID NO: 806526 - RNA, 19 nt, Homo sapiens
gaacgcaccuuuugacaag

SEQ ID NO: 806527 - RNA, 19 nt, Homo sapiens
ccucacgccuccuccgaua

SEQ ID NO: 806528 - RNA, 19 nt, Homo sapiens
gggagcagaugauccaagu

SEQ ID NO: 806529 - RNA, 19 nt, Homo sapiens
ggaagaggaggacgaggaa

SEQ ID NO: 806530 - RNA, 19 nt, Homo sapiens
gaggcaggauguugucaau

SEQ ID NO: 806531 - RNA, 19 nt, Homo sapiens
ggagucugauggagaagau

SEQ ID NO: 806532 - RNA, 19 nt, Homo sapiens
gcaguuugaugaugaugag

SEQ ID NO: 806533 - RNA, 19 nt, Homo sapiens
ggagagcgagagagaguga

SEQ ID NO: 806534 - RNA, 19 nt, Homo sapiens
gaauggagagagagaaaca

SEQ ID NO: 806535 - RNA, 19 nt, Homo sapiens
uagagagaauggagagaga

SEQ ID NO: 806536 - RNA, 19 nt, Homo sapiens
gagcguugccuccuagaau

SEQ ID NO: 806537 - RNA, 19 nt, Homo sapiens
cagaccagcucguguccuu

SEQ ID NO: 806538 - RNA, 19 nt, Homo sapiens
ggaggagaacgaccgugua

SEQ ID NO: 806539 - RNA, 19 nt, Homo sapiens
gaccucuucuuccauuaug

SEQ ID NO: 806540 - RNA, 19 nt, Homo sapiens
gagagagagaaacauauau

SEQ ID NO: 806541 - RNA, 19 nt, Homo sapiens
auacagagagucaaauaga

SEQ ID NO: 806542 - RNA, 19 nt, Homo sapiens
gacaagacagccaacauca

SEQ ID NO: 806543 - RNA, 19 nt, Homo sapiens
gcaggauguugucaauugg

SEQ ID NO: 806544 - RNA, 19 nt, Homo sapiens
aaagauacagagagucaaa

SEQ ID NO: 806545 - RNA, 19 nt, Homo sapiens
uccauuaugucuucaacaa

SEQ ID NO: 806546 - RNA, 19 nt, Homo sapiens
gaggagagcgagagagagu

SEQ ID NO: 806547 - RNA, 19 nt, Homo sapiens
ggagaacgaccguguacag

SEQ ID NO: 806548 - RNA, 19 nt, Homo sapiens
ggaccucuucuuccauuau

SEQ ID NO: 806549 - RNA, 19 nt, Homo sapiens
gacaggguuucgccauguu

SEQ ID NO: 806550 - RNA, 19 nt, Homo sapiens
gcccagacccugcacuuuc

SEQ ID NO: 806551 - RNA, 19 nt, Homo sapiens
gggaggagagcgagagaga

SEQ ID NO: 806552 - RNA, 19 nt, Homo sapiens
agauacagagagucaaaua

SEQ ID NO: 806553 - RNA, 19 nt, Homo sapiens
ccaaccuacuugagauaug

SEQ ID NO: 806554 - RNA, 19 nt, Homo sapiens
cuucaaugaugaggaguuu

SEQ ID NO: 806555 - RNA, 19 nt, Homo sapiens
cauuaugucuucaacaacu

SEQ ID NO: 806556 - RNA, 19 nt, Homo sapiens
gcccugagcgccaaugaug

SEQ ID NO: 806557 - RNA, 19 nt, Homo sapiens
gcucuuaagcaacauguuc

SEQ ID NO: 806558 - RNA, 19 nt, Homo sapiens
gagaagcaggagacgauug

SEQ ID NO: 806559 - RNA, 19 nt, Homo sapiens
gccgagcuucuauuucaua

SEQ ID NO: 806560 - RNA, 19 nt, Homo sapiens
gagagaauggagagagaga

SEQ ID NO: 806561 - RNA, 19 nt, Homo sapiens
agcguugccuccuagaaua

SEQ ID NO: 806562 - RNA, 19 nt, Homo sapiens
ccacuucggcuucaaugau

SEQ ID NO: 806563 - RNA, 19 nt, Homo sapiens
uggcggagaccaacaagaa

SEQ ID NO: 806564 - RNA, 19 nt, Homo sapiens
ggaggcaggaggugagguu

SEQ ID NO: 806565 - RNA, 19 nt, Homo sapiens
acagaaggcagcaaaguca

SEQ ID NO: 806566 - RNA, 19 nt, Homo sapiens
caaccuacuugagauaugc

SEQ ID NO: 806567 - RNA, 19 nt, Homo sapiens
gagcaggaggagaguguga

SEQ ID NO: 806568 - RNA, 19 nt, Homo sapiens
gcggagaccaacaagaaga

SEQ ID NO: 806569 - RNA, 19 nt, Homo sapiens
gcccagagccugaccaacu

SEQ ID NO: 806570 - RNA, 19 nt, Homo sapiens
cgucgaaggaugagaauca

SEQ ID NO: 806571 - RNA, 19 nt, Homo sapiens
ggcaggaggugagguugga

SEQ ID NO: 806572 - RNA, 19 nt, Homo sapiens
ggaagacgaggagggcauu

SEQ ID NO: 806573 - RNA, 19 nt, Homo sapiens
ugacaagacagccaacauc

SEQ ID NO: 806574 - RNA, 19 nt, Homo sapiens
cuucuuccauuaugucuuc

SEQ ID NO: 806575 - RNA, 19 nt, Homo sapiens
cgaaggaugagaaucaaca

SEQ ID NO: 806576 - RNA, 19 nt, Homo sapiens
cagcucguguccuuucuuc

SEQ ID NO: 806577 - RNA, 19 nt, Homo sapiens
gauacagagagucaaauag

SEQ ID NO: 806578 - RNA, 19 nt, Homo sapiens
uccagcaguuugaugauga

SEQ ID NO: 806579 - RNA, 19 nt, Homo sapiens
cccagacccugcacuuuca

SEQ ID NO: 806580 - RNA, 19 nt, Homo sapiens
acagagagucaaauagaga

SEQ ID NO: 806581 - RNA, 19 nt, Homo sapiens
ggacgaggaggaggaggaa

SEQ ID NO: 806582 - RNA, 19 nt, Homo sapiens
agacaggguuucgccaugu

SEQ ID NO: 806583 - RNA, 19 nt, Homo sapiens
agaagcaggagacgauuga

SEQ ID NO: 806584 - RNA, 19 nt, Homo sapiens
aaauaaaggaaggcaguuu

SEQ ID NO: 806585 - RNA, 19 nt, Homo sapiens
agagucaaauagagagaau

SEQ ID NO: 806586 - RNA, 19 nt, Homo sapiens
guuagcugcugugggauug

SEQ ID NO: 806587 - RNA, 19 nt, Homo sapiens
caaaagggaugaguguuag

SEQ ID NO: 806588 - RNA, 19 nt, Homo sapiens
gaccagcucguguccuuuc

SEQ ID NO: 806589 - RNA, 19 nt, Homo sapiens
auaaagauacagagaguca

SEQ ID NO: 806590 - RNA, 19 nt, Homo sapiens
cauuugcacugagaagaga

SEQ ID NO: 806591 - RNA, 19 nt, Homo sapiens
gaggagaacgaccguguac

SEQ ID NO: 806592 - RNA, 19 nt, Homo sapiens
caguguggccugcgagauu

SEQ ID NO: 806593 - RNA, 19 nt, Homo sapiens
gagguuggaaguugagcaa

SEQ ID NO: 806594 - RNA, 19 nt, Homo sapiens
cgucaggcaccgugugaaa

SEQ ID NO: 806595 - RNA, 19 nt, Homo sapiens
agacagugaggacgaagaa

SEQ ID NO: 806596 - RNA, 19 nt, Homo sapiens
guuugaugaugaugaggaa

SEQ ID NO: 806597 - RNA, 19 nt, Homo sapiens
cacuucggcuucaaugaug

SEQ ID NO: 806598 - RNA, 19 nt, Homo sapiens
gaacacccaccaccuacac

SEQ ID NO: 806599 - RNA, 19 nt, Homo sapiens
ggucaugggcauccucauc

SEQ ID NO: 806600 - RNA, 19 nt, Homo sapiens
gcguugccuccuagaauaa

SEQ ID NO: 806601 - RNA, 19 nt, Homo sapiens
acagugaggacgaagaaga

SEQ ID NO: 806602 - RNA, 19 nt, Homo sapiens
ggugugggcccuuguuucu

SEQ ID NO: 806603 - RNA, 19 nt, Homo sapiens
gaccgcauccagcaguuug

SEQ ID NO: 806604 - RNA, 19 nt, Homo sapiens
ugaccucugccuucauuga

SEQ ID NO: 806605 - RNA, 19 nt, Homo sapiens
ggagaagcaggagacgauu

SEQ ID NO: 806606 - RNA, 19 nt, Homo sapiens
ccgagcuucuauuucauau

SEQ ID NO: 806607 - RNA, 19 nt, Homo sapiens
gagagucaaauagagagaa

SEQ ID NO: 806608 - RNA, 19 nt, Homo sapiens
ccacagaaggcagcaaagu

SEQ ID NO: 806609 - RNA, 19 nt, Homo sapiens
ggaccgcauccagcaguuu

SEQ ID NO: 806610 - RNA, 19 nt, Homo sapiens
gaaggaugagaaucaacau

SEQ ID NO: 806611 - RNA, 19 nt, Homo sapiens
uaaauaaaggaaggcaguu

SEQ ID NO: 806612 - RNA, 19 nt, Homo sapiens
uacagagagucaaauagag

SEQ ID NO: 806613 - RNA, 19 nt, Homo sapiens
gaagaagccuuacaaagaa

SEQ ID NO: 806614 - RNA, 19 nt, Homo sapiens
ggagauaucugcugucuga

SEQ ID NO: 806615 - RNA, 19 nt, Homo sapiens
ggaagguacuggaaauuua

SEQ ID NO: 806616 - RNA, 19 nt, Homo sapiens
caaaugagauggacuuaaa

SEQ ID NO: 806617 - RNA, 19 nt, Homo sapiens
gcaacagucuuucaugaua

SEQ ID NO: 806618 - RNA, 19 nt, Homo sapiens
gagcacauccugauaaaua

SEQ ID NO: 806619 - RNA, 19 nt, Homo sapiens
ggaauuagcuauuaaaggu

SEQ ID NO: 806620 - RNA, 19 nt, Homo sapiens
ucacagaccuuuccaaaug

SEQ ID NO: 806621 - RNA, 19 nt, Homo sapiens
agaaggaacucaauaauga

SEQ ID NO: 806622 - RNA, 19 nt, Homo sapiens
gauauggucugauaaauag

SEQ ID NO: 806623 - RNA, 19 nt, Homo sapiens
gaaaucaugucccuccaaa

SEQ ID NO: 806624 - RNA, 19 nt, Homo sapiens
ccacucaaguuccaaauuu

SEQ ID NO: 806625 - RNA, 19 nt, Homo sapiens
gaagacugccuauauuuaa

SEQ ID NO: 806626 - RNA, 19 nt, Homo sapiens
caaacuaacugcaguaaca

SEQ ID NO: 806627 - RNA, 19 nt, Homo sapiens
gaccagauauucccagaaa

SEQ ID NO: 806628 - RNA, 19 nt, Homo sapiens
cauaagugcugucaguaua

SEQ ID NO: 806629 - RNA, 19 nt, Homo sapiens
ggaggaauauuaugugaau

SEQ ID NO: 806630 - RNA, 19 nt, Homo sapiens
gacacgaaauucauucaua

SEQ ID NO: 806631 - RNA, 19 nt, Homo sapiens
ggaaagauaagagggauua

SEQ ID NO: 806632 - RNA, 19 nt, Homo sapiens
ugaagaugcugcuccaaua

SEQ ID NO: 806633 - RNA, 19 nt, Homo sapiens
ggaaagaacuaugucugaa

SEQ ID NO: 806634 - RNA, 19 nt, Homo sapiens
guucugaguucuuugauuu

SEQ ID NO: 806635 - RNA, 19 nt, Homo sapiens
cagcggaucuucacucaaa

SEQ ID NO: 806636 - RNA, 19 nt, Homo sapiens
gauauaauguuaggaguga

SEQ ID NO: 806637 - RNA, 19 nt, Homo sapiens
ggauauggucugauaaaua

SEQ ID NO: 806638 - RNA, 19 nt, Homo sapiens
uaagagggauuaagaagga

SEQ ID NO: 806639 - RNA, 19 nt, Homo sapiens
gauugauggugauguaaua

SEQ ID NO: 806640 - RNA, 19 nt, Homo sapiens
cgaugugcaugauaauuua

SEQ ID NO: 806641 - RNA, 19 nt, Homo sapiens
gagacgagguucccuaugu

SEQ ID NO: 806642 - RNA, 19 nt, Homo sapiens
gagcgaagacugccuauau

SEQ ID NO: 806643 - RNA, 19 nt, Homo sapiens
ccagacaacuagacaacua

SEQ ID NO: 806644 - RNA, 19 nt, Homo sapiens
gaagcuuccuccaucaauu

SEQ ID NO: 806645 - RNA, 19 nt, Homo sapiens
gcaauuguucugaaugaua

SEQ ID NO: 806646 - RNA, 19 nt, Homo sapiens
gaagaucuuucagagcuuu

SEQ ID NO: 806647 - RNA, 19 nt, Homo sapiens
aauaggauauggucugaua

SEQ ID NO: 806648 - RNA, 19 nt, Homo sapiens
gaagaacaaagaaacauga

SEQ ID NO: 806649 - RNA, 19 nt, Homo sapiens
gaaagaacuaugucugaaa

SEQ ID NO: 806650 - RNA, 19 nt, Homo sapiens
gauuggcccuacagaguua

SEQ ID NO: 806651 - RNA, 19 nt, Homo sapiens
gucaacaucuggaggauuu

SEQ ID NO: 806652 - RNA, 19 nt, Homo sapiens
gaacauuacagagccaaua

SEQ ID NO: 806653 - RNA, 19 nt, Homo sapiens
agaagaagccuuacaaaga

SEQ ID NO: 806654 - RNA, 19 nt, Homo sapiens
aaacaugacugucucaaag

SEQ ID NO: 806655 - RNA, 19 nt, Homo sapiens
ggaauuuacucacgcaauc

SEQ ID NO: 806656 - RNA, 19 nt, Homo sapiens
gguacaccauuaucacaua

SEQ ID NO: 806657 - RNA, 19 nt, Homo sapiens
agagaaaucugcagucaau

SEQ ID NO: 806658 - RNA, 19 nt, Homo sapiens
cgaagacugccuauauuua

SEQ ID NO: 806659 - RNA, 19 nt, Homo sapiens
gcagcuaacuggauuugau

SEQ ID NO: 806660 - RNA, 19 nt, Homo sapiens
ccaguggaaugucagauaa

SEQ ID NO: 806661 - RNA, 19 nt, Homo sapiens
gaagauuccuuggcuuuca

SEQ ID NO: 806662 - RNA, 19 nt, Homo sapiens
gaagcacacugauuuggau

SEQ ID NO: 806663 - RNA, 19 nt, Homo sapiens
caaagaacuuguugaccaa

SEQ ID NO: 806664 - RNA, 19 nt, Homo sapiens
aaaguugguugcaauguuu

SEQ ID NO: 806665 - RNA, 19 nt, Homo sapiens
gcacguggccaaauuaugu

SEQ ID NO: 806666 - RNA, 19 nt, Homo sapiens
gaaccaacuuuguacaucu

SEQ ID NO: 806667 - RNA, 19 nt, Homo sapiens
gguacaggaucuauaaguu

SEQ ID NO: 806668 - RNA, 19 nt, Homo sapiens
gauauagaccugcagcuaa

SEQ ID NO: 806669 - RNA, 19 nt, Homo sapiens
aaaggcaagucucaucuaa

SEQ ID NO: 806670 - RNA, 19 nt, Homo sapiens
gaagacauauagguaacuu

SEQ ID NO: 806671 - RNA, 19 nt, Homo sapiens
caacagucuuucaugauau

SEQ ID NO: 806672 - RNA, 19 nt, Homo sapiens
ucuauaaguugcuguguuu

SEQ ID NO: 806673 - RNA, 19 nt, Homo sapiens
gauaagaggagacaugaug

SEQ ID NO: 806674 - RNA, 19 nt, Homo sapiens
caguauaccucuacaacaa

SEQ ID NO: 806675 - RNA, 19 nt, Homo sapiens
gauaucugcugucugaaga

SEQ ID NO: 806676 - RNA, 19 nt, Homo sapiens
cguauuaccacucugauua

SEQ ID NO: 806677 - RNA, 19 nt, Homo sapiens
gaaguagcauggaccagau

SEQ ID NO: 806678 - RNA, 19 nt, Homo sapiens
gaaacaugacugucucaaa

SEQ ID NO: 806679 - RNA, 19 nt, Homo sapiens
ggugaaguguguccaaaga

SEQ ID NO: 806680 - RNA, 19 nt, Homo sapiens
ucacauaagugcugucagu

SEQ ID NO: 806681 - RNA, 19 nt, Homo sapiens
gcugaaauuugccaguaaa

SEQ ID NO: 806682 - RNA, 19 nt, Homo sapiens
caacuaaagugccaucaac

SEQ ID NO: 806683 - RNA, 19 nt, Homo sapiens
guaaugacauacuggacaa

SEQ ID NO: 806684 - RNA, 19 nt, Homo sapiens
gagaaaccauuaaguucau

SEQ ID NO: 806685 - RNA, 19 nt, Homo sapiens
ggauaaaggaaacuggaua

SEQ ID NO: 806686 - RNA, 19 nt, Homo sapiens
ugacauacuggacaaauuu

SEQ ID NO: 806687 - RNA, 19 nt, Homo sapiens
gagagaaaccauuaaguuc

SEQ ID NO: 806688 - RNA, 19 nt, Homo sapiens
ggugaauacucgcugauau

SEQ ID NO: 806689 - RNA, 19 nt, Homo sapiens
cacaguaguuucaauauag

SEQ ID NO: 806690 - RNA, 19 nt, Homo sapiens
agauagcgaugaugguaua

SEQ ID NO: 806691 - RNA, 19 nt, Homo sapiens
guaagaaaucggagguaua

SEQ ID NO: 806692 - RNA, 19 nt, Homo sapiens
ucucucaccuguacuauau

SEQ ID NO: 806693 - RNA, 19 nt, Homo sapiens
caaaugaagcacacugauu

SEQ ID NO: 806694 - RNA, 19 nt, Homo sapiens
gaccaacuuuaucuccaua

SEQ ID NO: 806695 - RNA, 19 nt, Homo sapiens
gguaaccguuggagcaauu

SEQ ID NO: 806696 - RNA, 19 nt, Homo sapiens
gcuuuaagauggacuagug

SEQ ID NO: 806697 - RNA, 19 nt, Homo sapiens
gcgaagacugccuauauuu

SEQ ID NO: 806698 - RNA, 19 nt, Homo sapiens
ucaauuugcuccugugugu

SEQ ID NO: 806699 - RNA, 19 nt, Homo sapiens
ccacacugcuaauauggaa

SEQ ID NO: 806700 - RNA, 19 nt, Homo sapiens
ccuacaagacuuacuauuu

SEQ ID NO: 806701 - RNA, 19 nt, Homo sapiens
gaagguacuggaaauuuau

SEQ ID NO: 806702 - RNA, 19 nt, Homo sapiens
uaacuuggaugugguuuca

SEQ ID NO: 806703 - RNA, 19 nt, Homo sapiens
ccugugugguuuacuaaua

SEQ ID NO: 806704 - RNA, 19 nt, Homo sapiens
cgaaauucauucauaccaa

SEQ ID NO: 806705 - RNA, 19 nt, Homo sapiens
agacauuacuggcuuuguu

SEQ ID NO: 806706 - RNA, 19 nt, Homo sapiens
ugagagaaaccauuaaguu

SEQ ID NO: 806707 - RNA, 19 nt, Homo sapiens
caugguggcucauauaugg

SEQ ID NO: 806708 - RNA, 19 nt, Homo sapiens
uaagaaaucggagguauau

SEQ ID NO: 806709 - RNA, 19 nt, Homo sapiens
ugaaaucaaugggagauau

SEQ ID NO: 806710 - RNA, 19 nt, Homo sapiens
aggcaagucucaucuaaga

SEQ ID NO: 806711 - RNA, 19 nt, Homo sapiens
gauuagaccagucagguuu

SEQ ID NO: 806712 - RNA, 19 nt, Homo sapiens
ggaaccaacuuuguacauc

SEQ ID NO: 806713 - RNA, 19 nt, Homo sapiens
gcaauuggaugcaacauuu

SEQ ID NO: 806714 - RNA, 19 nt, Homo sapiens
ggacauugaugguuuaauu

SEQ ID NO: 806715 - RNA, 19 nt, Homo sapiens
uaaagacucugaccaagua

SEQ ID NO: 806716 - RNA, 19 nt, Homo sapiens
gcaugucucugcuauauuu

SEQ ID NO: 806717 - RNA, 19 nt, Homo sapiens
caggagagguguuauauga

SEQ ID NO: 806718 - RNA, 19 nt, Homo sapiens
gaagauaucagcugcauug

SEQ ID NO: 806719 - RNA, 19 nt, Homo sapiens
gaacccuggugcuuuauuu

SEQ ID NO: 806720 - RNA, 19 nt, Homo sapiens
gaaacaaguugacaagcuu

SEQ ID NO: 806721 - RNA, 19 nt, Homo sapiens
gaugugggaucuucgauuu

SEQ ID NO: 806722 - RNA, 19 nt, Homo sapiens
ucagaacccuggugcuuua

SEQ ID NO: 806723 - RNA, 19 nt, Homo sapiens
ggaaugacccuccagcuuu

SEQ ID NO: 806724 - RNA, 19 nt, Homo sapiens
gaaccaggcuugaaaauga

SEQ ID NO: 806725 - RNA, 19 nt, Homo sapiens
ggaggaacauuuaauaucu

SEQ ID NO: 806726 - RNA, 19 nt, Homo sapiens
gaacagacacuuucaccaa

SEQ ID NO: 806727 - RNA, 19 nt, Homo sapiens
gaacagguccucagaaugg

SEQ ID NO: 806728 - RNA, 19 nt, Homo sapiens
caagaaaccuauuccagau

SEQ ID NO: 806729 - RNA, 19 nt, Homo sapiens
gaaauaccuuccagcaugu

SEQ ID NO: 806730 - RNA, 19 nt, Homo sapiens
ccaauaagcugggugucua

SEQ ID NO: 806731 - RNA, 19 nt, Homo sapiens
gaaugacccuccagcuuug

SEQ ID NO: 806732 - RNA, 19 nt, Homo sapiens
ccgaaauccugcugucuua

SEQ ID NO: 806733 - RNA, 19 nt, Homo sapiens
ggcagauccugaauuguua

SEQ ID NO: 806734 - RNA, 19 nt, Homo sapiens
caacagacccucaaaccaa

SEQ ID NO: 806735 - RNA, 19 nt, Homo sapiens
ggacaugaaucaccuaaaa

SEQ ID NO: 806736 - RNA, 19 nt, Homo sapiens
gacuaaagcucaagaugga

SEQ ID NO: 806737 - RNA, 19 nt, Homo sapiens
ggcuuuagcugcaguauug

SEQ ID NO: 806738 - RNA, 19 nt, Homo sapiens
gaaaauaccuugaacuucu

SEQ ID NO: 806739 - RNA, 19 nt, Homo sapiens
ggagagcccugcugcugaa

SEQ ID NO: 806740 - RNA, 19 nt, Homo sapiens
gaccaugcauacccacaua

SEQ ID NO: 806741 - RNA, 19 nt, Homo sapiens
gaccuuuguuuacaugaua

SEQ ID NO: 806742 - RNA, 19 nt, Homo sapiens
gauccugaauuguuacuga

SEQ ID NO: 806743 - RNA, 19 nt, Homo sapiens
gaugaccgguuaccaguga

SEQ ID NO: 806744 - RNA, 19 nt, Homo sapiens
gaaagagauuguugagucu

SEQ ID NO: 806745 - RNA, 19 nt, Homo sapiens
gaggcaaacugguuacguu

SEQ ID NO: 806746 - RNA, 19 nt, Homo sapiens
caagagcauuuacacuauu

SEQ ID NO: 806747 - RNA, 19 nt, Homo sapiens
caaaguggauggagccaau

SEQ ID NO: 806748 - RNA, 19 nt, Homo sapiens
aagcacagaugguuuaaga

SEQ ID NO: 806749 - RNA, 19 nt, Homo sapiens
cauaaugcauggaaauguu

SEQ ID NO: 806750 - RNA, 19 nt, Homo sapiens
cauagcagguggacaagaa

SEQ ID NO: 806751 - RNA, 19 nt, Homo sapiens
ucaagagcauuuacacuau

SEQ ID NO: 806752 - RNA, 19 nt, Homo sapiens
uauaugaacuucccaccaa

SEQ ID NO: 806753 - RNA, 19 nt, Homo sapiens
cauggcagauccugaauug

SEQ ID NO: 806754 - RNA, 19 nt, Homo sapiens
gaaguuaaaggaaguagau

SEQ ID NO: 806755 - RNA, 19 nt, Homo sapiens
uagcugcaguauugacuua

SEQ ID NO: 806756 - RNA, 19 nt, Homo sapiens
gaagaucuaggaaagaaga

SEQ ID NO: 806757 - RNA, 19 nt, Homo sapiens
acacaguggugcuucgaua

SEQ ID NO: 806758 - RNA, 19 nt, Homo sapiens
gaagguaaacuuugaggau

SEQ ID NO: 806759 - RNA, 19 nt, Homo sapiens
aaacacagccgccagaaga

SEQ ID NO: 806760 - RNA, 19 nt, Homo sapiens
uuacauaucuucugcuucu

SEQ ID NO: 806761 - RNA, 19 nt, Homo sapiens
gcacagaugguuuaagaca

SEQ ID NO: 806762 - RNA, 19 nt, Homo sapiens
cuuaucagcugcuucguuu

SEQ ID NO: 806763 - RNA, 19 nt, Homo sapiens
ggagagguguuauaugaac

SEQ ID NO: 806764 - RNA, 19 nt, Homo sapiens
uauaagacauggacuaguc

SEQ ID NO: 806765 - RNA, 19 nt, Homo sapiens
cagggaauguagagaaauu

SEQ ID NO: 806766 - RNA, 19 nt, Homo sapiens
ccagcaggaugaaguuaaa

SEQ ID NO: 806767 - RNA, 19 nt, Homo sapiens
uaguguauuuccuggauua

SEQ ID NO: 806768 - RNA, 19 nt, Homo sapiens
agaaaccuauuccagauga

SEQ ID NO: 806769 - RNA, 19 nt, Homo sapiens
agaaauuaguugcauguug

SEQ ID NO: 806770 - RNA, 19 nt, Homo sapiens
guuuggaguuucuguauga

SEQ ID NO: 806771 - RNA, 19 nt, Homo sapiens
gaagaacuggaaagagauu

SEQ ID NO: 806772 - RNA, 19 nt, Homo sapiens
aagaagaucuaggaaagaa

SEQ ID NO: 806773 - RNA, 19 nt, Homo sapiens
ccugaaguauucugauaaa

SEQ ID NO: 806774 - RNA, 19 nt, Homo sapiens
uggaguuucuguaugauaa

SEQ ID NO: 806775 - RNA, 19 nt, Homo sapiens
caccaggccucuucaccua

SEQ ID NO: 806776 - RNA, 19 nt, Homo sapiens
gaggaugauucucguggaa

SEQ ID NO: 806777 - RNA, 19 nt, Homo sapiens
gaugcaacauuuaguacga

SEQ ID NO: 806778 - RNA, 19 nt, Homo sapiens
gucaagagcauuuacacua

SEQ ID NO: 806779 - RNA, 19 nt, Homo sapiens
gagcaccucauucuaaaga

SEQ ID NO: 806780 - RNA, 19 nt, Homo sapiens
guacgaaugcuucccuuga

SEQ ID NO: 806781 - RNA, 19 nt, Homo sapiens
guauagugcugccucugaa

SEQ ID NO: 806782 - RNA, 19 nt, Homo sapiens
gagcauggcagauccugaa

SEQ ID NO: 806783 - RNA, 19 nt, Homo sapiens
acagacaaguucagcauau

SEQ ID NO: 806784 - RNA, 19 nt, Homo sapiens
gaaugcuucccuugagaua

SEQ ID NO: 806785 - RNA, 19 nt, Homo sapiens
ucauuagcauguuugcaua

SEQ ID NO: 806786 - RNA, 19 nt, Homo sapiens
gcuagaugaugccagcaaa

SEQ ID NO: 806787 - RNA, 19 nt, Homo sapiens
cacuauuucugcugauaua

SEQ ID NO: 806788 - RNA, 19 nt, Homo sapiens
ugagaccucugcuuucaug

SEQ ID NO: 806789 - RNA, 19 nt, Homo sapiens
augaagaacuggaaagaga

SEQ ID NO: 806790 - RNA, 19 nt, Homo sapiens
ugagagugcuguugaccuu

SEQ ID NO: 806791 - RNA, 19 nt, Homo sapiens
acagaugguuuaagacaga

SEQ ID NO: 806792 - RNA, 19 nt, Homo sapiens
gcuaaugaaucugaaaucu

SEQ ID NO: 806793 - RNA, 19 nt, Homo sapiens
gaaaaggagcaucugguua

SEQ ID NO: 806794 - RNA, 19 nt, Homo sapiens
gaauuagaccucucugauc

SEQ ID NO: 806795 - RNA, 19 nt, Homo sapiens
ggaugaaguuaaaggaagu

SEQ ID NO: 806796 - RNA, 19 nt, Homo sapiens
aagaacagguccucagaau

SEQ ID NO: 806797 - RNA, 19 nt, Homo sapiens
gaaaagaagaucuaggaaa

SEQ ID NO: 806798 - RNA, 19 nt, Homo sapiens
aauuauagcuggagacaag

SEQ ID NO: 806799 - RNA, 19 nt, Homo sapiens
ucagugagaccucugcuuu

SEQ ID NO: 806800 - RNA, 19 nt, Homo sapiens
caaagaacagguccucaga

SEQ ID NO: 806801 - RNA, 19 nt, Homo sapiens
ggacacuaguacuguagga

SEQ ID NO: 806802 - RNA, 19 nt, Homo sapiens
guagagaaauuaguugcau

SEQ ID NO: 806803 - RNA, 19 nt, Homo sapiens
gacaagcuuucaucaucuu

SEQ ID NO: 806804 - RNA, 19 nt, Homo sapiens
ggaggaagcacagaugguu

SEQ ID NO: 806805 - RNA, 19 nt, Homo sapiens
cauaguaacagaaugcauu

SEQ ID NO: 806806 - RNA, 19 nt, Homo sapiens
aaacuacucagaaggauug

SEQ ID NO: 806807 - RNA, 19 nt, Homo sapiens
gaaacuacucagaaggauu

SEQ ID NO: 806808 - RNA, 19 nt, Homo sapiens
ggaaauguuaauccaaaug

SEQ ID NO: 806809 - RNA, 19 nt, Homo sapiens
gauggaagccacccuuugu

SEQ ID NO: 806810 - RNA, 19 nt, Homo sapiens
cuacauaugggaucuaaau

SEQ ID NO: 806811 - RNA, 19 nt, Homo sapiens
gcauugaaacucgaaacua

SEQ ID NO: 806812 - RNA, 19 nt, Homo sapiens
cauggacacuaguacugua

SEQ ID NO: 806813 - RNA, 19 nt, Homo sapiens
gcaauuggaugcaacauuu

SEQ ID NO: 806814 - RNA, 19 nt, Homo sapiens
ggacauugaugguuuaauu

SEQ ID NO: 806815 - RNA, 19 nt, Homo sapiens
gaaagaagcacauuaaaga

SEQ ID NO: 806816 - RNA, 19 nt, Homo sapiens
gcaugucucugcuauauuu

SEQ ID NO: 806817 - RNA, 19 nt, Homo sapiens
caggagagguguuauauga

SEQ ID NO: 806818 - RNA, 19 nt, Homo sapiens
gaagauaucagcugcauug

SEQ ID NO: 806819 - RNA, 19 nt, Homo sapiens
gaacccuggugcuuuauuu

SEQ ID NO: 806820 - RNA, 19 nt, Homo sapiens
gaaacaaguugacaagcuu

SEQ ID NO: 806821 - RNA, 19 nt, Homo sapiens
gaugugggaucuucgauuu

SEQ ID NO: 806822 - RNA, 19 nt, Homo sapiens
ucagaacccuggugcuuua

SEQ ID NO: 806823 - RNA, 19 nt, Homo sapiens
ggaaugacccuccagcuuu

SEQ ID NO: 806824 - RNA, 19 nt, Homo sapiens
gaaccaggcuugaaaauga

SEQ ID NO: 806825 - RNA, 19 nt, Homo sapiens
ggaggaacauuuaauaucu

SEQ ID NO: 806826 - RNA, 19 nt, Homo sapiens
gaacagacacuuucaccaa

SEQ ID NO: 806827 - RNA, 19 nt, Homo sapiens
gaacagguccucagaaugg

SEQ ID NO: 806828 - RNA, 19 nt, Homo sapiens
caagaaaccuauuccagau

SEQ ID NO: 806829 - RNA, 19 nt, Homo sapiens
gaaauaccuuccagcaugu

SEQ ID NO: 806830 - RNA, 19 nt, Homo sapiens
ccaauaagcugggugucua

SEQ ID NO: 806831 - RNA, 19 nt, Homo sapiens
gaaugacccuccagcuuug

SEQ ID NO: 806832 - RNA, 19 nt, Homo sapiens
ccgaaauccugcugucuua

SEQ ID NO: 806833 - RNA, 19 nt, Homo sapiens
ggcagauccugaauuguua

SEQ ID NO: 806834 - RNA, 19 nt, Homo sapiens
caacagacccucaaaccaa

SEQ ID NO: 806835 - RNA, 19 nt, Homo sapiens
ggacaugaaucaccuaaaa

SEQ ID NO: 806836 - RNA, 19 nt, Homo sapiens
gacuaaagcucaagaugga

SEQ ID NO: 806837 - RNA, 19 nt, Homo sapiens
ggcuuuagcugcaguauug

SEQ ID NO: 806838 - RNA, 19 nt, Homo sapiens
gaaaauaccuugaacuucu

SEQ ID NO: 806839 - RNA, 19 nt, Homo sapiens
gaccaugcauacccacaua

SEQ ID NO: 806840 - RNA, 19 nt, Homo sapiens
gaccuuuguuuacaugaua

SEQ ID NO: 806841 - RNA, 19 nt, Homo sapiens
gauccugaauuguuacuga

SEQ ID NO: 806842 - RNA, 19 nt, Homo sapiens
gaugaccgguuaccaguga

SEQ ID NO: 806843 - RNA, 19 nt, Homo sapiens
gaaagagauuguugagucu

SEQ ID NO: 806844 - RNA, 19 nt, Homo sapiens
gaggcaaacugguuacguu

SEQ ID NO: 806845 - RNA, 19 nt, Homo sapiens
caagagcauuuacacuauu

SEQ ID NO: 806846 - RNA, 19 nt, Homo sapiens
aagcacagaugguuuaaga

SEQ ID NO: 806847 - RNA, 19 nt, Homo sapiens
cauaaugcauggaaauguu

SEQ ID NO: 806848 - RNA, 19 nt, Homo sapiens
cauagcagguggacaagaa

SEQ ID NO: 806849 - RNA, 19 nt, Homo sapiens
ggaaagaagcacauuaaag

SEQ ID NO: 806850 - RNA, 19 nt, Homo sapiens
ucaagagcauuuacacuau

SEQ ID NO: 806851 - RNA, 19 nt, Homo sapiens
uauaugaacuucccaccaa

SEQ ID NO: 806852 - RNA, 19 nt, Homo sapiens
cauggcagauccugaauug

SEQ ID NO: 806853 - RNA, 19 nt, Homo sapiens
gaaguuaaaggaaguagau

SEQ ID NO: 806854 - RNA, 19 nt, Homo sapiens
uagcugcaguauugacuua

SEQ ID NO: 806855 - RNA, 19 nt, Homo sapiens
acacaguggugcuucgaua

SEQ ID NO: 806856 - RNA, 19 nt, Homo sapiens
gaagguaaacuuugaggau

SEQ ID NO: 806857 - RNA, 19 nt, Homo sapiens
aaacacagccgccagaaga

SEQ ID NO: 806858 - RNA, 19 nt, Homo sapiens
uuacauaucuucugcuucu

SEQ ID NO: 806859 - RNA, 19 nt, Homo sapiens
gcacagaugguuuaagaca

SEQ ID NO: 806860 - RNA, 19 nt, Homo sapiens
cuuaucagcugcuucguuu

SEQ ID NO: 806861 - RNA, 19 nt, Homo sapiens
ggagagguguuauaugaac

SEQ ID NO: 806862 - RNA, 19 nt, Homo sapiens
uauaagacauggacuaguc

SEQ ID NO: 806863 - RNA, 19 nt, Homo sapiens
cagggaauguagagaaauu

SEQ ID NO: 806864 - RNA, 19 nt, Homo sapiens
ccagcaggaugaaguuaaa

SEQ ID NO: 806865 - RNA, 19 nt, Homo sapiens
uaguguauuuccuggauua

SEQ ID NO: 806866 - RNA, 19 nt, Homo sapiens
agaaaccuauuccagauga

SEQ ID NO: 806867 - RNA, 19 nt, Homo sapiens
agaaauuaguugcauguug

SEQ ID NO: 806868 - RNA, 19 nt, Homo sapiens
guuuggaguuucuguauga

SEQ ID NO: 806869 - RNA, 19 nt, Homo sapiens
gaagaacuggaaagagauu

SEQ ID NO: 806870 - RNA, 19 nt, Homo sapiens
aagaagaucuaggaaagaa

SEQ ID NO: 806871 - RNA, 19 nt, Homo sapiens
ccugaaguauucugauaaa

SEQ ID NO: 806872 - RNA, 19 nt, Homo sapiens
uggaguuucuguaugauaa

SEQ ID NO: 806873 - RNA, 19 nt, Homo sapiens
gaugcaacauuuaguacga

SEQ ID NO: 806874 - RNA, 19 nt, Homo sapiens
caccaggccucuucaccua

SEQ ID NO: 806875 - RNA, 19 nt, Homo sapiens
gaggaugauucucguggaa

SEQ ID NO: 806876 - RNA, 19 nt, Homo sapiens
gucaagagcauuuacacua

SEQ ID NO: 806877 - RNA, 19 nt, Homo sapiens
gagcaccucauucuaaaga

SEQ ID NO: 806878 - RNA, 19 nt, Homo sapiens
guacgaaugcuucccuuga

SEQ ID NO: 806879 - RNA, 19 nt, Homo sapiens
uaggaaagaagcacauuaa

SEQ ID NO: 806880 - RNA, 19 nt, Homo sapiens
guauagugcugccucugaa

SEQ ID NO: 806881 - RNA, 19 nt, Homo sapiens
gagcauggcagauccugaa

SEQ ID NO: 806882 - RNA, 19 nt, Homo sapiens
acagacaaguucagcauau

SEQ ID NO: 806883 - RNA, 19 nt, Homo sapiens
ucauuagcauguuugcaua

SEQ ID NO: 806884 - RNA, 19 nt, Homo sapiens
gcuagaugaugccagcaaa

SEQ ID NO: 806885 - RNA, 19 nt, Homo sapiens
gaaugcuucccuugagaua

SEQ ID NO: 806886 - RNA, 19 nt, Homo sapiens
cacuauuucugcugauaua

SEQ ID NO: 806887 - RNA, 19 nt, Homo sapiens
ugagaccucugcuuucaug

SEQ ID NO: 806888 - RNA, 19 nt, Homo sapiens
augaagaacuggaaagaga

SEQ ID NO: 806889 - RNA, 19 nt, Homo sapiens
ugagagugcuguugaccuu

SEQ ID NO: 806890 - RNA, 19 nt, Homo sapiens
acagaugguuuaagacaga

SEQ ID NO: 806891 - RNA, 19 nt, Homo sapiens
gcuaaugaaucugaaaucu

SEQ ID NO: 806892 - RNA, 19 nt, Homo sapiens
gaaaaggagcaucugguua

SEQ ID NO: 806893 - RNA, 19 nt, Homo sapiens
gaauuagaccucucugauc

SEQ ID NO: 806894 - RNA, 19 nt, Homo sapiens
ggaugaaguuaaaggaagu

SEQ ID NO: 806895 - RNA, 19 nt, Homo sapiens
aagaacagguccucagaau

SEQ ID NO: 806896 - RNA, 19 nt, Homo sapiens
gaagcacauuaaagaggaa

SEQ ID NO: 806897 - RNA, 19 nt, Homo sapiens
gaaaagaagaucuaggaaa

SEQ ID NO: 806898 - RNA, 19 nt, Homo sapiens
aauuauagcuggagacaag

SEQ ID NO: 806899 - RNA, 19 nt, Homo sapiens
ucagugagaccucugcuuu

SEQ ID NO: 806900 - RNA, 19 nt, Homo sapiens
caaagaacagguccucaga

SEQ ID NO: 806901 - RNA, 19 nt, Homo sapiens
ggacacuaguacuguagga

SEQ ID NO: 806902 - RNA, 19 nt, Homo sapiens
guagagaaauuaguugcau

SEQ ID NO: 806903 - RNA, 19 nt, Homo sapiens
gacaagcuuucaucaucuu

SEQ ID NO: 806904 - RNA, 19 nt, Homo sapiens
ggaggaagcacagaugguu

SEQ ID NO: 806905 - RNA, 19 nt, Homo sapiens
cauaguaacagaaugcauu

SEQ ID NO: 806906 - RNA, 19 nt, Homo sapiens
aaacuacucagaaggauug

SEQ ID NO: 806907 - RNA, 19 nt, Homo sapiens
gaaacuacucagaaggauu

SEQ ID NO: 806908 - RNA, 19 nt, Homo sapiens
ggaaauguuaauccaaaug

SEQ ID NO: 806909 - RNA, 19 nt, Homo sapiens
gauggaagccacccuuugu

SEQ ID NO: 806910 - RNA, 19 nt, Homo sapiens
uguaugggaucuuagagaa

SEQ ID NO: 806911 - RNA, 19 nt, Homo sapiens
cuacauaugggaucuaaau

SEQ ID NO: 806912 - RNA, 19 nt, Homo sapiens
gcauugaaacucgaaacua

SEQ ID NO: 806913 - RNA, 19 nt, Homo sapiens
gaaagguacucuaguguua

SEQ ID NO: 806914 - RNA, 19 nt, Homo sapiens
gaaacuaguugaugaaaug

SEQ ID NO: 806915 - RNA, 19 nt, Homo sapiens
gcaagaagcugcucaccaa

SEQ ID NO: 806916 - RNA, 19 nt, Homo sapiens
ggaaagcuuugaagaguaa

SEQ ID NO: 806917 - RNA, 19 nt, Homo sapiens
gaacaauggucucuuuaau

SEQ ID NO: 806918 - RNA, 19 nt, Homo sapiens
gaacaaugguggagcagaa

SEQ ID NO: 806919 - RNA, 19 nt, Homo sapiens
gaaccucaaugauagauga

SEQ ID NO: 806920 - RNA, 19 nt, Homo sapiens
gaacuaaugucccugagau

SEQ ID NO: 806921 - RNA, 19 nt, Homo sapiens
ggagugagaucgucguauu

SEQ ID NO: 806922 - RNA, 19 nt, Homo sapiens
ucaaggagauguuuaugaa

SEQ ID NO: 806923 - RNA, 19 nt, Homo sapiens
gcacuacucucuucagauc

SEQ ID NO: 806924 - RNA, 19 nt, Homo sapiens
gaaccaagcuuuucuacaa

SEQ ID NO: 806925 - RNA, 19 nt, Homo sapiens
cagaaagucuucaacuauu

SEQ ID NO: 806926 - RNA, 19 nt, Homo sapiens
gagaauuccuugaacauca

SEQ ID NO: 806927 - RNA, 19 nt, Homo sapiens
gcacauacuggaaccaaua

SEQ ID NO: 806928 - RNA, 19 nt, Homo sapiens
gaauauagcuagguccaau

SEQ ID NO: 806929 - RNA, 19 nt, Homo sapiens
ucaagacgcucaaggaaga

SEQ ID NO: 806930 - RNA, 19 nt, Homo sapiens
gaacaucaagucagcugua

SEQ ID NO: 806931 - RNA, 19 nt, Homo sapiens
ggaguacauuugucacauu

SEQ ID NO: 806932 - RNA, 19 nt, Homo sapiens
ucacaguguuucaguaauu

SEQ ID NO: 806933 - RNA, 19 nt, Homo sapiens
gaauaucaacugucagaaa

SEQ ID NO: 806934 - RNA, 19 nt, Homo sapiens
gaagaauucagcauuagaa

SEQ ID NO: 806935 - RNA, 19 nt, Homo sapiens
ucagaucagugcaguguuu

SEQ ID NO: 806936 - RNA, 19 nt, Homo sapiens
caagucagcuguaaaauug

SEQ ID NO: 806937 - RNA, 19 nt, Homo sapiens
acacagagacugauucaaa

SEQ ID NO: 806938 - RNA, 19 nt, Homo sapiens
gaugaagacugggacauau

SEQ ID NO: 806939 - RNA, 19 nt, Homo sapiens
gcagauauacguggcauuu

SEQ ID NO: 806940 - RNA, 19 nt, Homo sapiens
agaaugagcugauuauaac

SEQ ID NO: 806941 - RNA, 19 nt, Homo sapiens
cagaaugagcugauuauaa

SEQ ID NO: 806942 - RNA, 19 nt, Homo sapiens
gcagaucaaguccaacaua

SEQ ID NO: 806943 - RNA, 19 nt, Homo sapiens
auagcuagguccaauguua

SEQ ID NO: 806944 - RNA, 19 nt, Homo sapiens
ggacauaucaucccuagag

SEQ ID NO: 806945 - RNA, 19 nt, Homo sapiens
gcacacgaguuuaaagaag

SEQ ID NO: 806946 - RNA, 19 nt, Homo sapiens
acaagucgcugcuagaaau

SEQ ID NO: 806947 - RNA, 19 nt, Homo sapiens
ucagaaagguacucuagug

SEQ ID NO: 806948 - RNA, 19 nt, Homo sapiens
guaauuugccuccaugauu

SEQ ID NO: 806949 - RNA, 19 nt, Homo sapiens
gaagaccguucuccauauc

SEQ ID NO: 806950 - RNA, 19 nt, Homo sapiens
ucaaauggauacccuuuca

SEQ ID NO: 806951 - RNA, 19 nt, Homo sapiens
gagcagaaugagcugauua

SEQ ID NO: 806952 - RNA, 19 nt, Homo sapiens
ucaguaaagcccucuguua

SEQ ID NO: 806953 - RNA, 19 nt, Homo sapiens
gauacaacuuccuuccaaa

SEQ ID NO: 806954 - RNA, 19 nt, Homo sapiens
caagaaagagaaauaccua

SEQ ID NO: 806955 - RNA, 19 nt, Homo sapiens
gacagcagauuaaagacuu

SEQ ID NO: 806956 - RNA, 19 nt, Homo sapiens
ccagaagccagcaguauuu

SEQ ID NO: 806957 - RNA, 19 nt, Homo sapiens
acaauggucucuuuaaugg

SEQ ID NO: 806958 - RNA, 19 nt, Homo sapiens
gagaacaucaugaacauca

SEQ ID NO: 806959 - RNA, 19 nt, Homo sapiens
uaauuugccuccaugauuc

SEQ ID NO: 806960 - RNA, 19 nt, Homo sapiens
ggaugaagacugggacaua

SEQ ID NO: 806961 - RNA, 19 nt, Homo sapiens
ccagaaagucuucaacuau

SEQ ID NO: 806962 - RNA, 19 nt, Homo sapiens
ggucggcuccugucacaua

SEQ ID NO: 806963 - RNA, 19 nt, Homo sapiens
gagaagcuccggagugaga

SEQ ID NO: 806964 - RNA, 19 nt, Homo sapiens
ccacaugucagaagauuau

SEQ ID NO: 806965 - RNA, 19 nt, Homo sapiens
uaaugucccugagauguuu

SEQ ID NO: 806966 - RNA, 19 nt, Homo sapiens
agaaagcacuacucucuuc

SEQ ID NO: 806967 - RNA, 19 nt, Homo sapiens
cagaagacccauagaaaug

SEQ ID NO: 806968 - RNA, 19 nt, Homo sapiens
aaucagaucaucaacagua

SEQ ID NO: 806969 - RNA, 19 nt, Homo sapiens
gugcggauguggaggauga

SEQ ID NO: 806970 - RNA, 19 nt, Homo sapiens
gauaggacaucuguuccaa

SEQ ID NO: 806971 - RNA, 19 nt, Homo sapiens
caacauaggcacauuaaaa

SEQ ID NO: 806972 - RNA, 19 nt, Homo sapiens
gaaauccagaaguccaaua

SEQ ID NO: 806973 - RNA, 19 nt, Homo sapiens
gaucaagacgcucaaggaa

SEQ ID NO: 806974 - RNA, 19 nt, Homo sapiens
uaucguaggcguuuauauu

SEQ ID NO: 806975 - RNA, 19 nt, Homo sapiens
agaaagacauaagcaagaa

SEQ ID NO: 806976 - RNA, 19 nt, Homo sapiens
uacccaacauguauuauga

SEQ ID NO: 806977 - RNA, 19 nt, Homo sapiens
uaucaucccuagaggaaga

SEQ ID NO: 806978 - RNA, 19 nt, Homo sapiens
acagacaacugauuagaca

SEQ ID NO: 806979 - RNA, 19 nt, Homo sapiens
aaacuucgaaccucaauga

SEQ ID NO: 806980 - RNA, 19 nt, Homo sapiens
ggaccugggcgcugcuaua

SEQ ID NO: 806981 - RNA, 19 nt, Homo sapiens
cccagaaagucuucaacua

SEQ ID NO: 806982 - RNA, 19 nt, Homo sapiens
ccuuucaacuggagaagua

SEQ ID NO: 806983 - RNA, 19 nt, Homo sapiens
agaagaacuuucagaggaa

SEQ ID NO: 806984 - RNA, 19 nt, Homo sapiens
ucaugcagcuucuugauag

SEQ ID NO: 806985 - RNA, 19 nt, Homo sapiens
aaagcuguuucuacugaua

SEQ ID NO: 806986 - RNA, 19 nt, Homo sapiens
ugauacaacuuccuuccaa

SEQ ID NO: 806987 - RNA, 19 nt, Homo sapiens
gacauaagcaagaaagaga

SEQ ID NO: 806988 - RNA, 19 nt, Homo sapiens
gaaccaauagaagaacuuu

SEQ ID NO: 806989 - RNA, 19 nt, Homo sapiens
acucagagacagcagauua

SEQ ID NO: 806990 - RNA, 19 nt, Homo sapiens
ggagaaacuaguugaugaa

SEQ ID NO: 806991 - RNA, 19 nt, Homo sapiens
aggagaaacuaguugauga

SEQ ID NO: 806992 - RNA, 19 nt, Homo sapiens
gcuagaggcugcacaccau

SEQ ID NO: 806993 - RNA, 19 nt, Homo sapiens
guaucacaguguuucagua

SEQ ID NO: 806994 - RNA, 19 nt, Homo sapiens
gaaaaugaaucaagcacau

SEQ ID NO: 806995 - RNA, 19 nt, Homo sapiens
caagugaucaguugcauag

SEQ ID NO: 806996 - RNA, 19 nt, Homo sapiens
uaaaucaagucugccaaug

SEQ ID NO: 806997 - RNA, 19 nt, Homo sapiens
gcagaaugagcugauuaua

SEQ ID NO: 806998 - RNA, 19 nt, Homo sapiens
ggauuuccauaaugucaug

SEQ ID NO: 806999 - RNA, 19 nt, Homo sapiens
gcauuagaauaucaacugu

SEQ ID NO: 807000 - RNA, 19 nt, Homo sapiens
ggccugaggucuacaaguc

SEQ ID NO: 807001 - RNA, 19 nt, Homo sapiens
gcauguuacuauuaaaugg

SEQ ID NO: 807002 - RNA, 19 nt, Homo sapiens
gaguacauuugucacauuc

SEQ ID NO: 807003 - RNA, 19 nt, Homo sapiens
gaaagacauaagcaagaaa

SEQ ID NO: 807004 - RNA, 19 nt, Homo sapiens
uggagaaacuggaaaccuu

SEQ ID NO: 807005 - RNA, 19 nt, Homo sapiens
agagacagcagauuaaaga

SEQ ID NO: 807006 - RNA, 19 nt, Homo sapiens
cuucgaaccucaaugauag

SEQ ID NO: 807007 - RNA, 19 nt, Homo sapiens
ccaaguaaccuuuuaacua

SEQ ID NO: 807008 - RNA, 19 nt, Homo sapiens
gacuuccgcugcugcuuaa

SEQ ID NO: 807009 - RNA, 19 nt, Homo sapiens
cagaucaucaacaguauuu

SEQ ID NO: 807010 - RNA, 19 nt, Homo sapiens
gugcaguguuucucaaaug

SEQ ID NO: 807011 - RNA, 19 nt, Homo sapiens
gaaagagaaauaccuaacu

SEQ ID NO: 807012 - RNA, 19 nt, Homo sapiens
ucaguugcauagaguacua

SEQ ID NO: 807013 - RNA, 19 nt, Homo sapiens
gcaggcagcucucaacaaa

SEQ ID NO: 807014 - RNA, 19 nt, Homo sapiens
gagaaggacuugucuuaug

SEQ ID NO: 807015 - RNA, 19 nt, Homo sapiens
ccggagagaugacugauua

SEQ ID NO: 807016 - RNA, 19 nt, Homo sapiens
gaaagagccuccggugaaa

SEQ ID NO: 807017 - RNA, 19 nt, Homo sapiens
gagagaaggacuugucuua

SEQ ID NO: 807018 - RNA, 19 nt, Homo sapiens
cagauaagcugcugggaaa

SEQ ID NO: 807019 - RNA, 19 nt, Homo sapiens
caagaacaccuacuaauuc

SEQ ID NO: 807020 - RNA, 19 nt, Homo sapiens
ggccagaagucaagaaaga

SEQ ID NO: 807021 - RNA, 19 nt, Homo sapiens
ggaagcagcaggacacauu

SEQ ID NO: 807022 - RNA, 19 nt, Homo sapiens
gcaccauccucauuaaugu

SEQ ID NO: 807023 - RNA, 19 nt, Homo sapiens
ggagcaccauccucauuaa

SEQ ID NO: 807024 - RNA, 19 nt, Homo sapiens
ccaagaacaccuacuaauu

SEQ ID NO: 807025 - RNA, 19 nt, Homo sapiens
gcacagcuuucccgucuca

SEQ ID NO: 807026 - RNA, 19 nt, Homo sapiens
ggaaggagggaaacugaaa

SEQ ID NO: 807027 - RNA, 19 nt, Homo sapiens
gcuaggcgcucucaugauc

SEQ ID NO: 807028 - RNA, 19 nt, Homo sapiens
gaaaggggauaucagauug

SEQ ID NO: 807029 - RNA, 19 nt, Homo sapiens
gcucuccacuccagacaaa

SEQ ID NO: 807030 - RNA, 19 nt, Homo sapiens
gggagcaccauccucauua

SEQ ID NO: 807031 - RNA, 19 nt, Homo sapiens
gcagagagaaggccugaga

SEQ ID NO: 807032 - RNA, 19 nt, Homo sapiens
ccagugggcucaccaaugg

SEQ ID NO: 807033 - RNA, 19 nt, Homo sapiens
agaaggacuugucuuaugu

SEQ ID NO: 807034 - RNA, 19 nt, Homo sapiens
agagaugacugauuagauc

SEQ ID NO: 807035 - RNA, 19 nt, Homo sapiens
agaaagagccuccggugaa

SEQ ID NO: 807036 - RNA, 19 nt, Homo sapiens
agagagagauccucagagu

SEQ ID NO: 807037 - RNA, 19 nt, Homo sapiens
agaagaagguggagaggau

SEQ ID NO: 807038 - RNA, 19 nt, Homo sapiens
ccaacgagcccaaggcaaa

SEQ ID NO: 807039 - RNA, 19 nt, Homo sapiens
gaaggacuugucuuaugua

SEQ ID NO: 807040 - RNA, 19 nt, Homo sapiens
ggaaggagggagauggaaa

SEQ ID NO: 807041 - RNA, 19 nt, Homo sapiens
gcagagagagagagacaga

SEQ ID NO: 807042 - RNA, 19 nt, Homo sapiens
caaaaucgcccacugauga

SEQ ID NO: 807043 - RNA, 19 nt, Homo sapiens
ugaaggagaagcagaagaa

SEQ ID NO: 807044 - RNA, 19 nt, Homo sapiens
aaacagcaccauagaguau

SEQ ID NO: 807045 - RNA, 19 nt, Homo sapiens
cuauaaagaugagaaggaa

SEQ ID NO: 807046 - RNA, 19 nt, Homo sapiens
ccacccaccuggagacgaa

SEQ ID NO: 807047 - RNA, 19 nt, Homo sapiens
caaacagcaccauagagua

SEQ ID NO: 807048 - RNA, 19 nt, Homo sapiens
gggacagccuccacaccua

SEQ ID NO: 807049 - RNA, 19 nt, Homo sapiens
ugaaagacggaacacauuu

SEQ ID NO: 807050 - RNA, 19 nt, Homo sapiens
gaggaaggagggaaacuga

SEQ ID NO: 807051 - RNA, 19 nt, Homo sapiens
ggccuuaccuacccaguuc

SEQ ID NO: 807052 - RNA, 19 nt, Homo sapiens
gaaaagcugcgacacaaaa

SEQ ID NO: 807053 - RNA, 19 nt, Homo sapiens
ggcagccagucuauuauga

SEQ ID NO: 807054 - RNA, 19 nt, Homo sapiens
aagacaaggugaugagaga

SEQ ID NO: 807055 - RNA, 19 nt, Homo sapiens
gacaugccgugguggagaa

SEQ ID NO: 807056 - RNA, 19 nt, Homo sapiens
gcaaguaaagaugacaauu

SEQ ID NO: 807057 - RNA, 19 nt, Homo sapiens
gcagagagaaggacuuguc

SEQ ID NO: 807058 - RNA, 19 nt, Homo sapiens
gcaggucugugcagugucu

SEQ ID NO: 807059 - RNA, 19 nt, Homo sapiens
agaaccagcucaucaacau

SEQ ID NO: 807060 - RNA, 19 nt, Homo sapiens
agacgaauguagccagaga

SEQ ID NO: 807061 - RNA, 19 nt, Homo sapiens
ucagaagccgccacaauga

SEQ ID NO: 807062 - RNA, 19 nt, Homo sapiens
caggagaagcggauugaaa

SEQ ID NO: 807063 - RNA, 19 nt, Homo sapiens
caucagcagugguaagaag

SEQ ID NO: 807064 - RNA, 19 nt, Homo sapiens
ucucugcccugcacgauga

SEQ ID NO: 807065 - RNA, 19 nt, Homo sapiens
ccuccacaccuacaaguua

SEQ ID NO: 807066 - RNA, 19 nt, Homo sapiens
cuacagccgugcccgcauu

SEQ ID NO: 807067 - RNA, 19 nt, Homo sapiens
gauauuucuugcccuguuc

SEQ ID NO: 807068 - RNA, 19 nt, Homo sapiens
gagaggaucaagacacuca

SEQ ID NO: 807069 - RNA, 19 nt, Homo sapiens
caaggcaaacuaugaacaa

SEQ ID NO: 807070 - RNA, 19 nt, Homo sapiens
ugacaaacagcaccauaga

SEQ ID NO: 807071 - RNA, 19 nt, Homo sapiens
uaaacgagcaagacacaga

SEQ ID NO: 807072 - RNA, 19 nt, Homo sapiens
ggagagaugacugauuaga

SEQ ID NO: 807073 - RNA, 19 nt, Homo sapiens
cagcaggucugugcagugu

SEQ ID NO: 807074 - RNA, 19 nt, Homo sapiens
ccaguuccaugauauuucu

SEQ ID NO: 807075 - RNA, 19 nt, Homo sapiens
cuacccaguuccaugauau

SEQ ID NO: 807076 - RNA, 19 nt, Homo sapiens
ccaaauccaguaugcagaa

SEQ ID NO: 807077 - RNA, 19 nt, Homo sapiens
gagagaugacugauuagau

SEQ ID NO: 807078 - RNA, 19 nt, Homo sapiens
ggagcagauugaccgaaug

SEQ ID NO: 807079 - RNA, 19 nt, Homo sapiens
ccacggcccugacaaacag

SEQ ID NO: 807080 - RNA, 19 nt, Homo sapiens
gcagugaggacaucuaugc

SEQ ID NO: 807081 - RNA, 19 nt, Homo sapiens
aggcagcucucaacaaagu

SEQ ID NO: 807082 - RNA, 19 nt, Homo sapiens
cagccagucuauuaugaug

SEQ ID NO: 807083 - RNA, 19 nt, Homo sapiens
caccaacccugacaaaauu

SEQ ID NO: 807084 - RNA, 19 nt, Homo sapiens
gcaguaaccacaacagcau

SEQ ID NO: 807085 - RNA, 19 nt, Homo sapiens
ggaaaggggauaucagauu

SEQ ID NO: 807086 - RNA, 19 nt, Homo sapiens
gaaggagggagauggaaag

SEQ ID NO: 807087 - RNA, 19 nt, Homo sapiens
ccacccugcuugagccaaa

SEQ ID NO: 807088 - RNA, 19 nt, Homo sapiens
ggagccagccugacaccaa

SEQ ID NO: 807089 - RNA, 19 nt, Homo sapiens
ccagagacaucagccuugu

SEQ ID NO: 807090 - RNA, 19 nt, Homo sapiens
gagaaggagagccuggaaa

SEQ ID NO: 807091 - RNA, 19 nt, Homo sapiens
ccaaugcaccugucaccaa

SEQ ID NO: 807092 - RNA, 19 nt, Homo sapiens
cuucauggcugggacaguu

SEQ ID NO: 807093 - RNA, 19 nt, Homo sapiens
gaagcagcaggacacauug

SEQ ID NO: 807094 - RNA, 19 nt, Homo sapiens
uaucuuaugugaggacuag

SEQ ID NO: 807095 - RNA, 19 nt, Homo sapiens
cugaggaguugaaggagaa

SEQ ID NO: 807096 - RNA, 19 nt, Homo sapiens
ggacaccgccaagcacaga

SEQ ID NO: 807097 - RNA, 19 nt, Homo sapiens
cgccaugccuuccgcaaug

SEQ ID NO: 807098 - RNA, 19 nt, Homo sapiens
gagaaaagcaaacacauuc

SEQ ID NO: 807099 - RNA, 19 nt, Homo sapiens
ugauauuucuugcccuguu

SEQ ID NO: 807100 - RNA, 19 nt, Homo sapiens
aaagagagagagagagaga

SEQ ID NO: 807101 - RNA, 19 nt, Homo sapiens
agaaagagagagagagaga

SEQ ID NO: 807102 - RNA, 19 nt, Homo sapiens
agagagagacagaaagaga

SEQ ID NO: 807103 - RNA, 19 nt, Homo sapiens
ggcaaacuaugaacaaagc

SEQ ID NO: 807104 - RNA, 19 nt, Homo sapiens
ccuggaaagugccuugaug

SEQ ID NO: 807105 - RNA, 19 nt, Homo sapiens
guggaucgcugccucuucu

SEQ ID NO: 807106 - RNA, 19 nt, Homo sapiens
cauaugcaaguaaagauga

SEQ ID NO: 807107 - RNA, 19 nt, Homo sapiens
gggaugaggccuuaaucug

SEQ ID NO: 807108 - RNA, 19 nt, Homo sapiens
gacacaaacccagugcuuu

SEQ ID NO: 807109 - RNA, 19 nt, Homo sapiens
ggacaaaaucgcccacuga

SEQ ID NO: 807110 - RNA, 19 nt, Homo sapiens
acaaacagcaccauagagu

SEQ ID NO: 807111 - RNA, 19 nt, Homo sapiens
cuccacaccuacaaguuaa

SEQ ID NO: 807112 - RNA, 19 nt, Homo sapiens
ccuacccaguuccaugaua

SEQ ID NO: 807113 - RNA, 19 nt, Homo sapiens
gaacagagguuuauaacaa

SEQ ID NO: 807114 - RNA, 19 nt, Homo sapiens
gaaauaaucccucuguuua

SEQ ID NO: 807115 - RNA, 19 nt, Homo sapiens
aaacuagccuuucacauua

SEQ ID NO: 807116 - RNA, 19 nt, Homo sapiens
gaugaaggcuggacaauug

SEQ ID NO: 807117 - RNA, 19 nt, Homo sapiens
gaaacuagguugugacaga

SEQ ID NO: 807118 - RNA, 19 nt, Homo sapiens
gaaaugcucugugauggua

SEQ ID NO: 807119 - RNA, 19 nt, Homo sapiens
gcacacagaucucaggaaa

SEQ ID NO: 807120 - RNA, 19 nt, Homo sapiens
ggacaauugugcuaaauga

SEQ ID NO: 807121 - RNA, 19 nt, Homo sapiens
ggucauaaguuaacuguau

SEQ ID NO: 807122 - RNA, 19 nt, Homo sapiens
caagaaccauucaucagua

SEQ ID NO: 807123 - RNA, 19 nt, Homo sapiens
gguaggaaaucauuaggua

SEQ ID NO: 807124 - RNA, 19 nt, Homo sapiens
ggaauggcauaagaauuua

SEQ ID NO: 807125 - RNA, 19 nt, Homo sapiens
caaauagcauugacacauu

SEQ ID NO: 807126 - RNA, 19 nt, Homo sapiens
gcucugugaugguaaauaa

SEQ ID NO: 807127 - RNA, 19 nt, Homo sapiens
caacagaaaucuuuaugca

SEQ ID NO: 807128 - RNA, 19 nt, Homo sapiens
gccauugacuccuuuagua

SEQ ID NO: 807129 - RNA, 19 nt, Homo sapiens
gaacugucauccugccuuu

SEQ ID NO: 807130 - RNA, 19 nt, Homo sapiens
gauaauucuuugccuagua

SEQ ID NO: 807131 - RNA, 19 nt, Homo sapiens
caagugcucuucucucuau

SEQ ID NO: 807132 - RNA, 19 nt, Homo sapiens
gaagaaagccauggcauug

SEQ ID NO: 807133 - RNA, 19 nt, Homo sapiens
gaagguauguccugucagu

SEQ ID NO: 807134 - RNA, 19 nt, Homo sapiens
gacaagcaguuaauaguau

SEQ ID NO: 807135 - RNA, 19 nt, Homo sapiens
ucacaccauucauauguua

SEQ ID NO: 807136 - RNA, 19 nt, Homo sapiens
gguaggaaaugcucuguga

SEQ ID NO: 807137 - RNA, 19 nt, Homo sapiens
uaacaucaauccuaacuag

SEQ ID NO: 807138 - RNA, 19 nt, Homo sapiens
gcuaacaugccucauaaua

SEQ ID NO: 807139 - RNA, 19 nt, Homo sapiens
ccaaaccacuacaguauug

SEQ ID NO: 807140 - RNA, 19 nt, Homo sapiens
uaacuaacaugcugcucua

SEQ ID NO: 807141 - RNA, 19 nt, Homo sapiens
gaagccaucgcgauuguua

SEQ ID NO: 807142 - RNA, 19 nt, Homo sapiens
cuaacaugcugcucuauuu

SEQ ID NO: 807143 - RNA, 19 nt, Homo sapiens
cacaaaggcuacaagcaua

SEQ ID NO: 807144 - RNA, 19 nt, Homo sapiens
uaaauaugcagcccaguua

SEQ ID NO: 807145 - RNA, 19 nt, Homo sapiens
uauguuaaguggcagaaua

SEQ ID NO: 807146 - RNA, 19 nt, Homo sapiens
gauaccaucucuuccuauu

SEQ ID NO: 807147 - RNA, 19 nt, Homo sapiens
cugauuaucugaagaacua

SEQ ID NO: 807148 - RNA, 19 nt, Homo sapiens
gucaguaucuuaacccuuu

SEQ ID NO: 807149 - RNA, 19 nt, Homo sapiens
gaucgaaacagaauaauag

SEQ ID NO: 807150 - RNA, 19 nt, Homo sapiens
gcccucauaugaauguuua

SEQ ID NO: 807151 - RNA, 19 nt, Homo sapiens
auacggaccugaagauaaa

SEQ ID NO: 807152 - RNA, 19 nt, Homo sapiens
gaauacauccaaagaauag

SEQ ID NO: 807153 - RNA, 19 nt, Homo sapiens
cgaauucagcccauuauuu

SEQ ID NO: 807154 - RNA, 19 nt, Homo sapiens
agacauuccuaacagauuu

SEQ ID NO: 807155 - RNA, 19 nt, Homo sapiens
gcaauucuucugguaaaua

SEQ ID NO: 807156 - RNA, 19 nt, Homo sapiens
caacaagacauuuaccuau

SEQ ID NO: 807157 - RNA, 19 nt, Homo sapiens
caagacauuuaccuauuug

SEQ ID NO: 807158 - RNA, 19 nt, Homo sapiens
gguauuugcugccuauugu

SEQ ID NO: 807159 - RNA, 19 nt, Homo sapiens
gauuaucugugaugguaaa

SEQ ID NO: 807160 - RNA, 19 nt, Homo sapiens
ugaagaaacuagguuguga

SEQ ID NO: 807161 - RNA, 19 nt, Homo sapiens
gcucuucucucuaucuaug

SEQ ID NO: 807162 - RNA, 19 nt, Homo sapiens
gaaagacaaagaacuuaga

SEQ ID NO: 807163 - RNA, 19 nt, Homo sapiens
acaagaagaugaugaugau

SEQ ID NO: 807164 - RNA, 19 nt, Homo sapiens
gaucgaauucagcccauua

SEQ ID NO: 807165 - RNA, 19 nt, Homo sapiens
gauuggugguuaugaguuu

SEQ ID NO: 807166 - RNA, 19 nt, Homo sapiens
gcagcccaguuaaauauug

SEQ ID NO: 807167 - RNA, 19 nt, Homo sapiens
caucaauccuaacuagaaa

SEQ ID NO: 807168 - RNA, 19 nt, Homo sapiens
gcugguaccuucuaguaau

SEQ ID NO: 807169 - RNA, 19 nt, Homo sapiens
ucauuuaacucucucaugu

SEQ ID NO: 807170 - RNA, 19 nt, Homo sapiens
uagguaacaucuuguggua

SEQ ID NO: 807171 - RNA, 19 nt, Homo sapiens
ggaaugaggcaguaccuau

SEQ ID NO: 807172 - RNA, 19 nt, Homo sapiens
gcaaauagcauugacacau

SEQ ID NO: 807173 - RNA, 19 nt, Homo sapiens
ccaccuaaguuacuacuag

SEQ ID NO: 807174 - RNA, 19 nt, Homo sapiens
ucaaagaagacauuccuaa

SEQ ID NO: 807175 - RNA, 19 nt, Homo sapiens
gaacccaccagucaccuuu

SEQ ID NO: 807176 - RNA, 19 nt, Homo sapiens
ccaaucagcuucaggaaaa

SEQ ID NO: 807177 - RNA, 19 nt, Homo sapiens
agaaauaaucccucuguuu

SEQ ID NO: 807178 - RNA, 19 nt, Homo sapiens
gcuuaaugccuuuauguaa

SEQ ID NO: 807179 - RNA, 19 nt, Homo sapiens
gacaagugcucuucucucu

SEQ ID NO: 807180 - RNA, 19 nt, Homo sapiens
agacaaagaacuuagacua

SEQ ID NO: 807181 - RNA, 19 nt, Homo sapiens
gaugaugauccuuuaauug

SEQ ID NO: 807182 - RNA, 19 nt, Homo sapiens
cuacaagcauagcacaauu

SEQ ID NO: 807183 - RNA, 19 nt, Homo sapiens
gaagaacuaugaauuuccu

SEQ ID NO: 807184 - RNA, 19 nt, Homo sapiens
gaaugaggcaguaccuauu

SEQ ID NO: 807185 - RNA, 19 nt, Homo sapiens
guucagagccaaggguuua

SEQ ID NO: 807186 - RNA, 19 nt, Homo sapiens
uaagauaacgcugaccaua

SEQ ID NO: 807187 - RNA, 19 nt, Homo sapiens
ggaagaaccagaugcaagu

SEQ ID NO: 807188 - RNA, 19 nt, Homo sapiens
aggaauggcauaagaauuu

SEQ ID NO: 807189 - RNA, 19 nt, Homo sapiens
cuaacaugccucauaauaa

SEQ ID NO: 807190 - RNA, 19 nt, Homo sapiens
gaauucagcccauuauuuu

SEQ ID NO: 807191 - RNA, 19 nt, Homo sapiens
guucugcugcuguuauuua

SEQ ID NO: 807192 - RNA, 19 nt, Homo sapiens
guuaauaguugaucgaaac

SEQ ID NO: 807193 - RNA, 19 nt, Homo sapiens
uaucugugaugguaaagaa

SEQ ID NO: 807194 - RNA, 19 nt, Homo sapiens
gcaucgaucauucauacua

SEQ ID NO: 807195 - RNA, 19 nt, Homo sapiens
ccaaagacucaagauguua

SEQ ID NO: 807196 - RNA, 19 nt, Homo sapiens
ugacaggcuuguaugaaga

SEQ ID NO: 807197 - RNA, 19 nt, Homo sapiens
uaaauaauccaugcuguug

SEQ ID NO: 807198 - RNA, 19 nt, Homo sapiens
gugacagacuagauuauau

SEQ ID NO: 807199 - RNA, 19 nt, Homo sapiens
guauuuaucuuugggacuu

SEQ ID NO: 807200 - RNA, 19 nt, Homo sapiens
cuacuaguauccuuugaug

SEQ ID NO: 807201 - RNA, 19 nt, Homo sapiens
ggaccugcauuucacaaag

SEQ ID NO: 807202 - RNA, 19 nt, Homo sapiens
caacauaaugaucgaauuc

SEQ ID NO: 807203 - RNA, 19 nt, Homo sapiens
agacaagcaguuaauagua

SEQ ID NO: 807204 - RNA, 19 nt, Homo sapiens
gaauagacuuucuguaccu

SEQ ID NO: 807205 - RNA, 19 nt, Homo sapiens
aagcauagcacaauuaaca

SEQ ID NO: 807206 - RNA, 19 nt, Homo sapiens
gauguacccauucacgaua

SEQ ID NO: 807207 - RNA, 19 nt, Homo sapiens
gcugcuauguggccuggua

SEQ ID NO: 807208 - RNA, 19 nt, Homo sapiens
ccuauugagucacugcuaa

SEQ ID NO: 807209 - RNA, 19 nt, Homo sapiens
aaacauacagugcguccua

SEQ ID NO: 807210 - RNA, 19 nt, Homo sapiens
cauuaugucuuaagcuguu

SEQ ID NO: 807211 - RNA, 19 nt, Homo sapiens
gcauagcacaauuaacauu

SEQ ID NO: 807212 - RNA, 19 nt, Homo sapiens
ccaacauaaugaucgaauu

SEQ ID NO: 807213 - RNA, 19 nt, Homo sapiens
gcagcuagcuaacucauua

SEQ ID NO: 807214 - RNA, 19 nt, Homo sapiens
gcacuuugcuuauuugaaa

SEQ ID NO: 807215 - RNA, 19 nt, Homo sapiens
gaaaucaaaugaccaauca

SEQ ID NO: 807216 - RNA, 19 nt, Homo sapiens
ggacaugucuucagauaau

SEQ ID NO: 807217 - RNA, 19 nt, Homo sapiens
gauauuaccucaaccgauu

SEQ ID NO: 807218 - RNA, 19 nt, Homo sapiens
caugaggucuguaaaguua

SEQ ID NO: 807219 - RNA, 19 nt, Homo sapiens
ggaaugcgcuauaaacgaa

SEQ ID NO: 807220 - RNA, 19 nt, Homo sapiens
gaagguugaugaccgauuu

SEQ ID NO: 807221 - RNA, 19 nt, Homo sapiens
gaaugaaguuugagaaugu

SEQ ID NO: 807222 - RNA, 19 nt, Homo sapiens
gcaauuagaugucucucuu

SEQ ID NO: 807223 - RNA, 19 nt, Homo sapiens
gaagaacaacugaacauuu

SEQ ID NO: 807224 - RNA, 19 nt, Homo sapiens
uaacagaugccauuuauga

SEQ ID NO: 807225 - RNA, 19 nt, Homo sapiens
gaucuuccaugguggcuua

SEQ ID NO: 807226 - RNA, 19 nt, Homo sapiens
gaacaugaagcuuugcaua

SEQ ID NO: 807227 - RNA, 19 nt, Homo sapiens
ccaauuauguggagacuga

SEQ ID NO: 807228 - RNA, 19 nt, Homo sapiens
ggauauaaccugaaccuuu

SEQ ID NO: 807229 - RNA, 19 nt, Homo sapiens
ggagauuacuugaagaguu

SEQ ID NO: 807230 - RNA, 19 nt, Homo sapiens
ccaagccuauggauauuua

SEQ ID NO: 807231 - RNA, 19 nt, Homo sapiens
gaaguuagcaggaguuaug

SEQ ID NO: 807232 - RNA, 19 nt, Homo sapiens
gagcaggaaugcgcuauaa

SEQ ID NO: 807233 - RNA, 19 nt, Homo sapiens
gagauuacuugaagaguug

SEQ ID NO: 807234 - RNA, 19 nt, Homo sapiens
caaauucuguucauuggaa

SEQ ID NO: 807235 - RNA, 19 nt, Homo sapiens
gaaaucagauaguagucuu

SEQ ID NO: 807236 - RNA, 19 nt, Homo sapiens
ggaaugaaguuugagaaug

SEQ ID NO: 807237 - RNA, 19 nt, Homo sapiens
gagaggagauuacuugaag

SEQ ID NO: 807238 - RNA, 19 nt, Homo sapiens
ucacuuacguuucguuuga

SEQ ID NO: 807239 - RNA, 19 nt, Homo sapiens
gcaggaagagagaagauua

SEQ ID NO: 807240 - RNA, 19 nt, Homo sapiens
agaagaaacuugagaggaa

SEQ ID NO: 807241 - RNA, 19 nt, Homo sapiens
guaaagagaaggagaaguu

SEQ ID NO: 807242 - RNA, 19 nt, Homo sapiens
ggcaagcuguuauagauuu

SEQ ID NO: 807243 - RNA, 19 nt, Homo sapiens
gaacucagcaaacagauau

SEQ ID NO: 807244 - RNA, 19 nt, Homo sapiens
cugaagaccuuuacgcaua

SEQ ID NO: 807245 - RNA, 19 nt, Homo sapiens
caaaugaccaaucaaguuu

SEQ ID NO: 807246 - RNA, 19 nt, Homo sapiens
gccaauagauuacguucuu

SEQ ID NO: 807247 - RNA, 19 nt, Homo sapiens
acacaggagugauggauaa

SEQ ID NO: 807248 - RNA, 19 nt, Homo sapiens
ccuacuacguggccuauua

SEQ ID NO: 807249 - RNA, 19 nt, Homo sapiens
gauauaaccugaaccuuuu

SEQ ID NO: 807250 - RNA, 19 nt, Homo sapiens
cugaguagcuuauacacua

SEQ ID NO: 807251 - RNA, 19 nt, Homo sapiens
cagaagaucuuuauuccau

SEQ ID NO: 807252 - RNA, 19 nt, Homo sapiens
aaaggaaacuguugccuau

SEQ ID NO: 807253 - RNA, 19 nt, Homo sapiens
cuacagaagugcaucauuc

SEQ ID NO: 807254 - RNA, 19 nt, Homo sapiens
gcaguaaaccucacgaaga

SEQ ID NO: 807255 - RNA, 19 nt, Homo sapiens
gaagagagaagauuauugg

SEQ ID NO: 807256 - RNA, 19 nt, Homo sapiens
guucuuaccucuacaaagu

SEQ ID NO: 807257 - RNA, 19 nt, Homo sapiens
gauaaacuuugcaguguca

SEQ ID NO: 807258 - RNA, 19 nt, Homo sapiens
uugaagaacuugugguuaa

SEQ ID NO: 807259 - RNA, 19 nt, Homo sapiens
ccuaugaccugaccaauuc

SEQ ID NO: 807260 - RNA, 19 nt, Homo sapiens
gaacaaagugacccaccua

SEQ ID NO: 807261 - RNA, 19 nt, Homo sapiens
gauguggacuuuuggauua

SEQ ID NO: 807262 - RNA, 19 nt, Homo sapiens
gggaucggauuuacccaua

SEQ ID NO: 807263 - RNA, 19 nt, Homo sapiens
gaugugcuguuacugcuuu

SEQ ID NO: 807264 - RNA, 19 nt, Homo sapiens
gaaauguaaucgcaucuac

SEQ ID NO: 807265 - RNA, 19 nt, Homo sapiens
ggacagaagugaaaaggaa

SEQ ID NO: 807266 - RNA, 19 nt, Homo sapiens
auggaaauguugccaauua

SEQ ID NO: 807267 - RNA, 19 nt, Homo sapiens
gaccaaauccaauguaaau

SEQ ID NO: 807268 - RNA, 19 nt, Homo sapiens
agacguggaugugcuguua

SEQ ID NO: 807269 - RNA, 19 nt, Homo sapiens
cagauaaugugggccaaua

SEQ ID NO: 807270 - RNA, 19 nt, Homo sapiens
caaagugacccaccuauca

SEQ ID NO: 807271 - RNA, 19 nt, Homo sapiens
aaacagauauuaccucaac

SEQ ID NO: 807272 - RNA, 19 nt, Homo sapiens
gaucacaaauucuguucau

SEQ ID NO: 807273 - RNA, 19 nt, Homo sapiens
gggauaaacuuugcagugu

SEQ ID NO: 807274 - RNA, 19 nt, Homo sapiens
gaagacaggcagcuagcua

SEQ ID NO: 807275 - RNA, 19 nt, Homo sapiens
uagcaggaguuaugaaaga

SEQ ID NO: 807276 - RNA, 19 nt, Homo sapiens
gaaauguugccaauuaugu

SEQ ID NO: 807277 - RNA, 19 nt, Homo sapiens
ccuauaaucccaacacuuu

SEQ ID NO: 807278 - RNA, 19 nt, Homo sapiens
gaagacaucauugguauca

SEQ ID NO: 807279 - RNA, 19 nt, Homo sapiens
cauauuggcuacuggaaau

SEQ ID NO: 807280 - RNA, 19 nt, Homo sapiens
aggaaacuguugccuauuu

SEQ ID NO: 807281 - RNA, 19 nt, Homo sapiens
gauauuuacugccacagau

SEQ ID NO: 807282 - RNA, 19 nt, Homo sapiens
cagaccaaauccaauguaa

SEQ ID NO: 807283 - RNA, 19 nt, Homo sapiens
gcacuacagauacaaagaa

SEQ ID NO: 807284 - RNA, 19 nt, Homo sapiens
cagguuggguaucgauaua

SEQ ID NO: 807285 - RNA, 19 nt, Homo sapiens
gaaguuggagaggagauua

SEQ ID NO: 807286 - RNA, 19 nt, Homo sapiens
gaaaguaauucagcaacag

SEQ ID NO: 807287 - RNA, 19 nt, Homo sapiens
ucacaaauucuguucauug

SEQ ID NO: 807288 - RNA, 19 nt, Homo sapiens
gagacagggcuucauguaa

SEQ ID NO: 807289 - RNA, 19 nt, Homo sapiens
aaucauacccugucauuug

SEQ ID NO: 807290 - RNA, 19 nt, Homo sapiens
gauauucacccacgauuuc

SEQ ID NO: 807291 - RNA, 19 nt, Homo sapiens
gggcauccucgacaucuua

SEQ ID NO: 807292 - RNA, 19 nt, Homo sapiens
uccagaaccugaaaucauu

SEQ ID NO: 807293 - RNA, 19 nt, Homo sapiens
ucaaaugaccaaucaaguu

SEQ ID NO: 807294 - RNA, 19 nt, Homo sapiens
caaagaagcgaguggcuau

SEQ ID NO: 807295 - RNA, 19 nt, Homo sapiens
ugacagaagaucuuuauuc

SEQ ID NO: 807296 - RNA, 19 nt, Homo sapiens
gguaauauguaagcaggaa

SEQ ID NO: 807297 - RNA, 19 nt, Homo sapiens
ccugaggaguugaggguua

SEQ ID NO: 807298 - RNA, 19 nt, Homo sapiens
ucucuuagcagcacagaua

SEQ ID NO: 807299 - RNA, 19 nt, Homo sapiens
caaauucuaagucugauga

SEQ ID NO: 807300 - RNA, 19 nt, Homo sapiens
gaucggauuuacccauaau

SEQ ID NO: 807301 - RNA, 19 nt, Homo sapiens
uaggcaagcuguuauagau

SEQ ID NO: 807302 - RNA, 19 nt, Homo sapiens
acuaacagaugccauuuau

SEQ ID NO: 807303 - RNA, 19 nt, Homo sapiens
caugguggcuuauucuaau

SEQ ID NO: 807304 - RNA, 19 nt, Homo sapiens
uaagacuugucacacagua

SEQ ID NO: 807305 - RNA, 19 nt, Homo sapiens
caugagcacugccgaggaa

SEQ ID NO: 807306 - RNA, 19 nt, Homo sapiens
ggaagagagaagauuauug

SEQ ID NO: 807307 - RNA, 19 nt, Homo sapiens
ucuaguggcucucauuuca

SEQ ID NO: 807308 - RNA, 19 nt, Homo sapiens
uguaagaacacccauauug

SEQ ID NO: 807309 - RNA, 19 nt, Homo sapiens
gcuaggaaacuuuaccaaa

SEQ ID NO: 807310 - RNA, 19 nt, Homo sapiens
ggaucggauuuacccauaa

SEQ ID NO: 807311 - RNA, 19 nt, Homo sapiens
aaaccaguaucaacgacua

SEQ ID NO: 807312 - RNA, 19 nt, Homo sapiens
gcaaggcauuccagugaca

SEQ ID NO: 807313 - RNA, 19 nt, Homo sapiens
caagaacucuccuaaauca

SEQ ID NO: 807314 - RNA, 19 nt, Homo sapiens
gaccaacccuggcaacaua

SEQ ID NO: 807315 - RNA, 19 nt, Homo sapiens
ggagaugcaugucuuugua

SEQ ID NO: 807316 - RNA, 19 nt, Homo sapiens
gccaagaacucuccuaaau

SEQ ID NO: 807317 - RNA, 19 nt, Homo sapiens
ggagaguccuagcugcuua

SEQ ID NO: 807318 - RNA, 19 nt, Homo sapiens
gggcuucuauucaggcuua

SEQ ID NO: 807319 - RNA, 19 nt, Homo sapiens
gaacaacugcucagggaaa

SEQ ID NO: 807320 - RNA, 19 nt, Homo sapiens
cuaaagaaccggcagauga

SEQ ID NO: 807321 - RNA, 19 nt, Homo sapiens
gaagagagaagggauguug

SEQ ID NO: 807322 - RNA, 19 nt, Homo sapiens
ggacaguucucggaccaaa

SEQ ID NO: 807323 - RNA, 19 nt, Homo sapiens
gaaguuugcuggagucaac

SEQ ID NO: 807324 - RNA, 19 nt, Homo sapiens
ggacugaggacccguuuau

SEQ ID NO: 807325 - RNA, 19 nt, Homo sapiens
ggacuugggcuucuauuca

SEQ ID NO: 807326 - RNA, 19 nt, Homo sapiens
cuacuucugugccuuugua

SEQ ID NO: 807327 - RNA, 19 nt, Homo sapiens
ccaguuugaucacaugaaa

SEQ ID NO: 807328 - RNA, 19 nt, Homo sapiens
gaaguucuagugucugaaa

SEQ ID NO: 807329 - RNA, 19 nt, Homo sapiens
gaacacacaggaccagaau

SEQ ID NO: 807330 - RNA, 19 nt, Homo sapiens
gcagaagacuguggaguac

SEQ ID NO: 807331 - RNA, 19 nt, Homo sapiens
gcaguuggaaggcgucuuu

SEQ ID NO: 807332 - RNA, 19 nt, Homo sapiens
uaaagaaccggcagaugaa

SEQ ID NO: 807333 - RNA, 19 nt, Homo sapiens
ggaugagcaugaaggcauu

SEQ ID NO: 807334 - RNA, 19 nt, Homo sapiens
aaauguggcugcacuaaag

SEQ ID NO: 807335 - RNA, 19 nt, Homo sapiens
ggcugaagcugaaggauca

SEQ ID NO: 807336 - RNA, 19 nt, Homo sapiens
uaacagacuccauccuuga

SEQ ID NO: 807337 - RNA, 19 nt, Homo sapiens
guacguguuuacaggcuuu

SEQ ID NO: 807338 - RNA, 19 nt, Homo sapiens
gaaggcgucuuucuuucuc

SEQ ID NO: 807339 - RNA, 19 nt, Homo sapiens
ggagauauuucuguaacuc

SEQ ID NO: 807340 - RNA, 19 nt, Homo sapiens
gagccaagaacucuccuaa

SEQ ID NO: 807341 - RNA, 19 nt, Homo sapiens
gaaagacauguuugacgaa

SEQ ID NO: 807342 - RNA, 19 nt, Homo sapiens
gaucagacagcaaagaauc

SEQ ID NO: 807343 - RNA, 19 nt, Homo sapiens
gggcugguccuuggaauuu

SEQ ID NO: 807344 - RNA, 19 nt, Homo sapiens
ucuagugucugaaagauca

SEQ ID NO: 807345 - RNA, 19 nt, Homo sapiens
aauuggaaguucuggauuu

SEQ ID NO: 807346 - RNA, 19 nt, Homo sapiens
gcagcauccuggugacaga

SEQ ID NO: 807347 - RNA, 19 nt, Homo sapiens
cagacaugauuguuucuug

SEQ ID NO: 807348 - RNA, 19 nt, Homo sapiens
gauuguuucuuguucuaga

SEQ ID NO: 807349 - RNA, 19 nt, Homo sapiens
ggaagaacccaccgugucu

SEQ ID NO: 807350 - RNA, 19 nt, Homo sapiens
aauagugccugcucccaaa

SEQ ID NO: 807351 - RNA, 19 nt, Homo sapiens
gaacaucugaggccacucu

SEQ ID NO: 807352 - RNA, 19 nt, Homo sapiens
uuucgaaucuugccugaug

SEQ ID NO: 807353 - RNA, 19 nt, Homo sapiens
gguaacagacuccauccuu

SEQ ID NO: 807354 - RNA, 19 nt, Homo sapiens
agacauguuugacgaauac

SEQ ID NO: 807355 - RNA, 19 nt, Homo sapiens
ucaacagccucaucuccaa

SEQ ID NO: 807356 - RNA, 19 nt, Homo sapiens
gcacccagcccuuguggau

SEQ ID NO: 807357 - RNA, 19 nt, Homo sapiens
ggcaagagauugggagagu

SEQ ID NO: 807358 - RNA, 19 nt, Homo sapiens
aaaaggcgcuucaacauca

SEQ ID NO: 807359 - RNA, 19 nt, Homo sapiens
gagcuuagaacccugaagu

SEQ ID NO: 807360 - RNA, 19 nt, Homo sapiens
ggaacacacaggaccagaa

SEQ ID NO: 807361 - RNA, 19 nt, Homo sapiens
ggaccuugcagaauuggaa

SEQ ID NO: 807362 - RNA, 19 nt, Homo sapiens
ccacaagcggugaucauga

SEQ ID NO: 807363 - RNA, 19 nt, Homo sapiens
gaagcugaaggaucacuug

SEQ ID NO: 807364 - RNA, 19 nt, Homo sapiens
agacaugauuguuucuugu

SEQ ID NO: 807365 - RNA, 19 nt, Homo sapiens
cugcagacaugauuguuuc

SEQ ID NO: 807366 - RNA, 19 nt, Homo sapiens
ccaccuccauccucacaga

SEQ ID NO: 807367 - RNA, 19 nt, Homo sapiens
ccaagaacucuccuaaauc

SEQ ID NO: 807368 - RNA, 19 nt, Homo sapiens
ggauggacuugggcuucua

SEQ ID NO: 807369 - RNA, 19 nt, Homo sapiens
cuagaaaggaauugucuga

SEQ ID NO: 807370 - RNA, 19 nt, Homo sapiens
ccaaggcugucaccaggau

SEQ ID NO: 807371 - RNA, 19 nt, Homo sapiens
gaauuggaaguucuggauu

SEQ ID NO: 807372 - RNA, 19 nt, Homo sapiens
uuacaggcuuuccagauca

SEQ ID NO: 807373 - RNA, 19 nt, Homo sapiens
ggaaggcgucuuucuuucu

SEQ ID NO: 807374 - RNA, 19 nt, Homo sapiens
acccggaccuugcagaauu

SEQ ID NO: 807375 - RNA, 19 nt, Homo sapiens
cacuugagcucaggaguug

SEQ ID NO: 807376 - RNA, 19 nt, Homo sapiens
gcuccugccugugauccua

SEQ ID NO: 807377 - RNA, 19 nt, Homo sapiens
ccacccagaguacguguuu

SEQ ID NO: 807378 - RNA, 19 nt, Homo sapiens
ugucagccuugucaucuug

SEQ ID NO: 807379 - RNA, 19 nt, Homo sapiens
aagacauguuugacgaaua

SEQ ID NO: 807380 - RNA, 19 nt, Homo sapiens
gaaucuugccugaugaauc

SEQ ID NO: 807381 - RNA, 19 nt, Homo sapiens
gacuuaaugucgugauucu

SEQ ID NO: 807382 - RNA, 19 nt, Homo sapiens
cagaucagacagcaaagaa

SEQ ID NO: 807383 - RNA, 19 nt, Homo sapiens
ucucagaucagacagcaaa

SEQ ID NO: 807384 - RNA, 19 nt, Homo sapiens
aaagacauguuugacgaau

SEQ ID NO: 807385 - RNA, 19 nt, Homo sapiens
cuaaaucaguggcuuucuc

SEQ ID NO: 807386 - RNA, 19 nt, Homo sapiens
cugaaguucuagugucuga

SEQ ID NO: 807387 - RNA, 19 nt, Homo sapiens
gugcagaaacgguggaugu

SEQ ID NO: 807388 - RNA, 19 nt, Homo sapiens
agaagacuguggaguacau

SEQ ID NO: 807389 - RNA, 19 nt, Homo sapiens
agccucaucuccaacaauu

SEQ ID NO: 807390 - RNA, 19 nt, Homo sapiens
gcugcagacaugauuguuu

SEQ ID NO: 807391 - RNA, 19 nt, Homo sapiens
gagaugcaugucuuuguau

SEQ ID NO: 807392 - RNA, 19 nt, Homo sapiens
gagccugcagugagaguuu

SEQ ID NO: 807393 - RNA, 19 nt, Homo sapiens
acacaggaccagaauggaa

SEQ ID NO: 807394 - RNA, 19 nt, Homo sapiens
cuuccuggcuccuuucuuc

SEQ ID NO: 807395 - RNA, 19 nt, Homo sapiens
gacaugauuguuucuuguu

SEQ ID NO: 807396 - RNA, 19 nt, Homo sapiens
agaugcaugucuuuguauu

SEQ ID NO: 807397 - RNA, 19 nt, Homo sapiens
caccaggauuggcaagaga

SEQ ID NO: 807398 - RNA, 19 nt, Homo sapiens
cacaggaugggcuuuguuu

SEQ ID NO: 807399 - RNA, 19 nt, Homo sapiens
uggaaggcgucuuucuuuc

SEQ ID NO: 807400 - RNA, 19 nt, Homo sapiens
ggagaucgaggagcucaau

SEQ ID NO: 807401 - RNA, 19 nt, Homo sapiens
ugcagaagacuguggagua

SEQ ID NO: 807402 - RNA, 19 nt, Homo sapiens
ccugugauccuagcacuuu

SEQ ID NO: 807403 - RNA, 19 nt, Homo sapiens
gccuagauuugaccucugu

SEQ ID NO: 807404 - RNA, 19 nt, Homo sapiens
gaugcaugucuuuguauug

SEQ ID NO: 807405 - RNA, 19 nt, Homo sapiens
gagccugggagccauguga

SEQ ID NO: 807406 - RNA, 19 nt, Homo sapiens
gcgccaguuugaucacaug

SEQ ID NO: 807407 - RNA, 19 nt, Homo sapiens
gaaaaggcgcuucaacauc

SEQ ID NO: 807408 - RNA, 19 nt, Homo sapiens
ucacuugagcucaggaguu

SEQ ID NO: 807409 - RNA, 19 nt, Homo sapiens
uauuuaaggcuguuagguu

SEQ ID NO: 807410 - RNA, 19 nt, Homo sapiens
ugaaggcauugucccaaag

SEQ ID NO: 807411 - RNA, 19 nt, Homo sapiens
guucuagugucugaaagau

SEQ ID NO: 807412 - RNA, 19 nt, Homo sapiens
gcucaaugccaccaucauc

SEQ ID NO: 807413 - RNA, 19 nt, Homo sapiens
gaaaggaaauacuggaaua

SEQ ID NO: 807414 - RNA, 19 nt, Homo sapiens
aaagauggcuuaccaaaua

SEQ ID NO: 807415 - RNA, 19 nt, Homo sapiens
guacugaaauccacaauaa

SEQ ID NO: 807416 - RNA, 19 nt, Homo sapiens
gaaguucuauagaguguua

SEQ ID NO: 807417 - RNA, 19 nt, Homo sapiens
gcacauugcuuuauaaaca

SEQ ID NO: 807418 - RNA, 19 nt, Homo sapiens
agagauaucugcaagaaua

SEQ ID NO: 807419 - RNA, 19 nt, Homo sapiens
gaagauggcccuuguacua

SEQ ID NO: 807420 - RNA, 19 nt, Homo sapiens
aaacaaagaugccaaacuu

SEQ ID NO: 807421 - RNA, 19 nt, Homo sapiens
gaaaauggcugacuuaugu

SEQ ID NO: 807422 - RNA, 19 nt, Homo sapiens
gauugaagguuguuucuaa

SEQ ID NO: 807423 - RNA, 19 nt, Homo sapiens
acagagagcugaaucaauu

SEQ ID NO: 807424 - RNA, 19 nt, Homo sapiens
gauuggagcugaaguuauu

SEQ ID NO: 807425 - RNA, 19 nt, Homo sapiens
ggaccaaguuacaguguuu

SEQ ID NO: 807426 - RNA, 19 nt, Homo sapiens
ggccauauccugcucauua

SEQ ID NO: 807427 - RNA, 19 nt, Homo sapiens
gcagugagguagauuugaa

SEQ ID NO: 807428 - RNA, 19 nt, Homo sapiens
gaagguguccaugaaauua

SEQ ID NO: 807429 - RNA, 19 nt, Homo sapiens
guacagcacucauaucauc

SEQ ID NO: 807430 - RNA, 19 nt, Homo sapiens
gauaucaucuuuggaaaug

SEQ ID NO: 807431 - RNA, 19 nt, Homo sapiens
gugcaaguaucaaguagua

SEQ ID NO: 807432 - RNA, 19 nt, Homo sapiens
ggaaaaggcuggucucuug

SEQ ID NO: 807433 - RNA, 19 nt, Homo sapiens
gcagaaggauuaguagcua

SEQ ID NO: 807434 - RNA, 19 nt, Homo sapiens
gcaauaagaugugagaaag

SEQ ID NO: 807435 - RNA, 19 nt, Homo sapiens
gcaauuaaacgaucagcua

SEQ ID NO: 807436 - RNA, 19 nt, Homo sapiens
gaaccacuauuuagcaugu

SEQ ID NO: 807437 - RNA, 19 nt, Homo sapiens
gcaauaugcuagucuuugu

SEQ ID NO: 807438 - RNA, 19 nt, Homo sapiens
ugaagaagguguccaugaa

SEQ ID NO: 807439 - RNA, 19 nt, Homo sapiens
gagcauuaaugaccugaaa

SEQ ID NO: 807440 - RNA, 19 nt, Homo sapiens
guccagaguucuuuacuuu

SEQ ID NO: 807441 - RNA, 19 nt, Homo sapiens
gauagaauucgacaguuua

SEQ ID NO: 807442 - RNA, 19 nt, Homo sapiens
gaacucaggguugcuauuu

SEQ ID NO: 807443 - RNA, 19 nt, Homo sapiens
caugagagauccuaauaau

SEQ ID NO: 807444 - RNA, 19 nt, Homo sapiens
gcacucauaucaucagcuu

SEQ ID NO: 807445 - RNA, 19 nt, Homo sapiens
gagguguucuuuauacauu

SEQ ID NO: 807446 - RNA, 19 nt, Homo sapiens
cagaggaucacauuaauuu

SEQ ID NO: 807447 - RNA, 19 nt, Homo sapiens
ggacugagaauacuuaaca

SEQ ID NO: 807448 - RNA, 19 nt, Homo sapiens
gagguagauuugaauauug

SEQ ID NO: 807449 - RNA, 19 nt, Homo sapiens
acaagcagcuacucaugua

SEQ ID NO: 807450 - RNA, 19 nt, Homo sapiens
auacagcaauucagacaua

SEQ ID NO: 807451 - RNA, 19 nt, Homo sapiens
gcuuacaguugcuaucaua

SEQ ID NO: 807452 - RNA, 19 nt, Homo sapiens
caggguugcuauuuacuua

SEQ ID NO: 807453 - RNA, 19 nt, Homo sapiens
cauagagucuucauauuuc

SEQ ID NO: 807454 - RNA, 19 nt, Homo sapiens
uuauggagguugauugaua

SEQ ID NO: 807455 - RNA, 19 nt, Homo sapiens
ugauguagaugucauaguu

SEQ ID NO: 807456 - RNA, 19 nt, Homo sapiens
gaagacaguaaacagcuua

SEQ ID NO: 807457 - RNA, 19 nt, Homo sapiens
ggcugcagcucuccuaaua

SEQ ID NO: 807458 - RNA, 19 nt, Homo sapiens
ugagagauccuaauaauca

SEQ ID NO: 807459 - RNA, 19 nt, Homo sapiens
gaaguuucauccuaaagau

SEQ ID NO: 807460 - RNA, 19 nt, Homo sapiens
gaaagauguguguugcuua

SEQ ID NO: 807461 - RNA, 19 nt, Homo sapiens
gaauucagcacaacaguga

SEQ ID NO: 807462 - RNA, 19 nt, Homo sapiens
ggucauagagucuucauau

SEQ ID NO: 807463 - RNA, 19 nt, Homo sapiens
gaaacaagucagcagaauu

SEQ ID NO: 807464 - RNA, 19 nt, Homo sapiens
uaggguauuugccaaguua

SEQ ID NO: 807465 - RNA, 19 nt, Homo sapiens
gaagaagguguccaugaaa

SEQ ID NO: 807466 - RNA, 19 nt, Homo sapiens
gguguuggcugaaagaugu

SEQ ID NO: 807467 - RNA, 19 nt, Homo sapiens
ugauagaauucgacaguuu

SEQ ID NO: 807468 - RNA, 19 nt, Homo sapiens
guaaacagcuuauuuugga

SEQ ID NO: 807469 - RNA, 19 nt, Homo sapiens
uaaacaaucugcugcucaa

SEQ ID NO: 807470 - RNA, 19 nt, Homo sapiens
gaacagagagcugaaucaa

SEQ ID NO: 807471 - RNA, 19 nt, Homo sapiens
gacaguaaacagcuuauuu

SEQ ID NO: 807472 - RNA, 19 nt, Homo sapiens
cagaagaaaugccacuguu

SEQ ID NO: 807473 - RNA, 19 nt, Homo sapiens
ggaguuguuuauaaucuug

SEQ ID NO: 807474 - RNA, 19 nt, Homo sapiens
gaaaggauaaugaagaagu

SEQ ID NO: 807475 - RNA, 19 nt, Homo sapiens
gaacaguuacucagauaau

SEQ ID NO: 807476 - RNA, 19 nt, Homo sapiens
gucaagccaugcaaguuua

SEQ ID NO: 807477 - RNA, 19 nt, Homo sapiens
uuacauggauacagcaauu

SEQ ID NO: 807478 - RNA, 19 nt, Homo sapiens
gaacagauaccagauccuu

SEQ ID NO: 807479 - RNA, 19 nt, Homo sapiens
caaguuaucggaccaaguu

SEQ ID NO: 807480 - RNA, 19 nt, Homo sapiens
gagcagcuuucuagucuca

SEQ ID NO: 807481 - RNA, 19 nt, Homo sapiens
caccagaaauggaacuauu

SEQ ID NO: 807482 - RNA, 19 nt, Homo sapiens
gucagcaaauguccacuua

SEQ ID NO: 807483 - RNA, 19 nt, Homo sapiens
gaauguaagucagcuguca

SEQ ID NO: 807484 - RNA, 19 nt, Homo sapiens
gagguugauugauaucuga

SEQ ID NO: 807485 - RNA, 19 nt, Homo sapiens
caucaucaguaauguguga

SEQ ID NO: 807486 - RNA, 19 nt, Homo sapiens
gccacugucugcagaagua

SEQ ID NO: 807487 - RNA, 19 nt, Homo sapiens
ggaagacaguaaacagcuu

SEQ ID NO: 807488 - RNA, 19 nt, Homo sapiens
caaguuguuucugugguua

SEQ ID NO: 807489 - RNA, 19 nt, Homo sapiens
gcaguaagcaacauuguca

SEQ ID NO: 807490 - RNA, 19 nt, Homo sapiens
gaucagcuaauaucaagaa

SEQ ID NO: 807491 - RNA, 19 nt, Homo sapiens
gauggcccuuguacuauaa

SEQ ID NO: 807492 - RNA, 19 nt, Homo sapiens
ugugacaacuuggaaauuu

SEQ ID NO: 807493 - RNA, 19 nt, Homo sapiens
ggaaauggcagcagugucu

SEQ ID NO: 807494 - RNA, 19 nt, Homo sapiens
gcaguaaaguuccagaaaa

SEQ ID NO: 807495 - RNA, 19 nt, Homo sapiens
gagcugaaucaauuuauga

SEQ ID NO: 807496 - RNA, 19 nt, Homo sapiens
gcacaacagugauuauucc

SEQ ID NO: 807497 - RNA, 19 nt, Homo sapiens
caaguuacaguguuugaaa

SEQ ID NO: 807498 - RNA, 19 nt, Homo sapiens
ggacaaacacaguauaaac

SEQ ID NO: 807499 - RNA, 19 nt, Homo sapiens
ccacauagugcaaguauca

SEQ ID NO: 807500 - RNA, 19 nt, Homo sapiens
gagggaagcaggauuuaga

SEQ ID NO: 807501 - RNA, 19 nt, Homo sapiens
ggaaguuucauccuaaaga

SEQ ID NO: 807502 - RNA, 19 nt, Homo sapiens
gggcuuuccucagagaaua

SEQ ID NO: 807503 - RNA, 19 nt, Homo sapiens
aagaucugcuucaucguua

SEQ ID NO: 807504 - RNA, 19 nt, Homo sapiens
gcaaagcacguuggacuga

SEQ ID NO: 807505 - RNA, 19 nt, Homo sapiens
aaacaagucagcagaauuc

SEQ ID NO: 807506 - RNA, 19 nt, Homo sapiens
uagcaaacacuggaaguua

SEQ ID NO: 807507 - RNA, 19 nt, Homo sapiens
gaugcuaccucugugugua

SEQ ID NO: 807508 - RNA, 19 nt, Homo sapiens
uggaaaggauaaugaagaa

SEQ ID NO: 807509 - RNA, 19 nt, Homo sapiens
guacuccuguuaagccauu

SEQ ID NO: 807510 - RNA, 19 nt, Homo sapiens
caaacacaguauaaacuuc

SEQ ID NO: 807511 - RNA, 19 nt, Homo sapiens
gaaggcauacguuguggaa

SEQ ID NO: 807512 - RNA, 19 nt, Homo sapiens
guuaaggaauuccacauag

SEQ ID NO: 807513 - RNA, 19 nt, Homo sapiens
gaaacaccaucucuacuaa

SEQ ID NO: 807514 - RNA, 19 nt, Homo sapiens
gcacaguggagauaaauua

SEQ ID NO: 807515 - RNA, 19 nt, Homo sapiens
ggaccaagcugcccauaau

SEQ ID NO: 807516 - RNA, 19 nt, Homo sapiens
gaaauuguauuccauccaa

SEQ ID NO: 807517 - RNA, 19 nt, Homo sapiens
uaacacauaugacacuuug

SEQ ID NO: 807518 - RNA, 19 nt, Homo sapiens
guacgaaagucuucaaaca

SEQ ID NO: 807519 - RNA, 19 nt, Homo sapiens
gcaguaggcggucgacuua

SEQ ID NO: 807520 - RNA, 19 nt, Homo sapiens
gagaauagucccacaugua

SEQ ID NO: 807521 - RNA, 19 nt, Homo sapiens
acacuuugauggacucuua

SEQ ID NO: 807522 - RNA, 19 nt, Homo sapiens
gaaaguaaacaacauguag

SEQ ID NO: 807523 - RNA, 19 nt, Homo sapiens
gaaaccucgucucuacuaa

SEQ ID NO: 807524 - RNA, 19 nt, Homo sapiens
gguauugacuugaaugaca

SEQ ID NO: 807525 - RNA, 19 nt, Homo sapiens
agagcugacuccugauuua

SEQ ID NO: 807526 - RNA, 19 nt, Homo sapiens
ccacuuggaugaugcucua

SEQ ID NO: 807527 - RNA, 19 nt, Homo sapiens
ggacuggccugaggguauu

SEQ ID NO: 807528 - RNA, 19 nt, Homo sapiens
acgaaagucuucaaacaaa

SEQ ID NO: 807529 - RNA, 19 nt, Homo sapiens
aaacagacucgaacuauug

SEQ ID NO: 807530 - RNA, 19 nt, Homo sapiens
ggagcaaccaccuuuguuu

SEQ ID NO: 807531 - RNA, 19 nt, Homo sapiens
gaccggcucuucauucguu

SEQ ID NO: 807532 - RNA, 19 nt, Homo sapiens
caacuguaguguauacguu

SEQ ID NO: 807533 - RNA, 19 nt, Homo sapiens
ugaaacaccaucucuacua

SEQ ID NO: 807534 - RNA, 19 nt, Homo sapiens
uaacaguaauucccagugu

SEQ ID NO: 807535 - RNA, 19 nt, Homo sapiens
uaacaggcauauucuuauc

SEQ ID NO: 807536 - RNA, 19 nt, Homo sapiens
gagaugcacuuagccucua

SEQ ID NO: 807537 - RNA, 19 nt, Homo sapiens
ucacuggacucugauaguu

SEQ ID NO: 807538 - RNA, 19 nt, Homo sapiens
gcagugagccgagaucaug

SEQ ID NO: 807539 - RNA, 19 nt, Homo sapiens
uaaguaacccucucucaug

SEQ ID NO: 807540 - RNA, 19 nt, Homo sapiens
aaacagggaugugcagaug

SEQ ID NO: 807541 - RNA, 19 nt, Homo sapiens
guauguguguguguauaua

SEQ ID NO: 807542 - RNA, 19 nt, Homo sapiens
gcugaaaccucugaaugug

SEQ ID NO: 807543 - RNA, 19 nt, Homo sapiens
guaaacaacauguaguuca

SEQ ID NO: 807544 - RNA, 19 nt, Homo sapiens
gaugaggauuuguaaacga

SEQ ID NO: 807545 - RNA, 19 nt, Homo sapiens
ccuagacacuuggaaauug

SEQ ID NO: 807546 - RNA, 19 nt, Homo sapiens
ugaggaagcuagagaaggu

SEQ ID NO: 807547 - RNA, 19 nt, Homo sapiens
cauaaaaggccuaaaagua

SEQ ID NO: 807548 - RNA, 19 nt, Homo sapiens
ggugcaaucuugguaguga

SEQ ID NO: 807549 - RNA, 19 nt, Homo sapiens
aguaggcggucgacuuaua

SEQ ID NO: 807550 - RNA, 19 nt, Homo sapiens
guaagacccacaaggauau

SEQ ID NO: 807551 - RNA, 19 nt, Homo sapiens
cgaaaccucgucucuacua

SEQ ID NO: 807552 - RNA, 19 nt, Homo sapiens
ggcgaaaccucgucucuac

SEQ ID NO: 807553 - RNA, 19 nt, Homo sapiens
gagccgagaucaugucacu

SEQ ID NO: 807554 - RNA, 19 nt, Homo sapiens
guauguaugugugugugua

SEQ ID NO: 807555 - RNA, 19 nt, Homo sapiens
gcacacaguggcugaaauc

SEQ ID NO: 807556 - RNA, 19 nt, Homo sapiens
cugcuaacauuaaugagaa

SEQ ID NO: 807557 - RNA, 19 nt, Homo sapiens
aaaguaagacccacaagga

SEQ ID NO: 807558 - RNA, 19 nt, Homo sapiens
gcaggagaaucacuugaac

SEQ ID NO: 807559 - RNA, 19 nt, Homo sapiens
gggcugcacuccuuucucu

SEQ ID NO: 807560 - RNA, 19 nt, Homo sapiens
gcuggcugcugcuaacauu

SEQ ID NO: 807561 - RNA, 19 nt, Homo sapiens
gcgggcagaucacgagguu

SEQ ID NO: 807562 - RNA, 19 nt, Homo sapiens
gcagaaaggagggaggauu

SEQ ID NO: 807563 - RNA, 19 nt, Homo sapiens
gagcugacuccugauuuaa

SEQ ID NO: 807564 - RNA, 19 nt, Homo sapiens
aaguaacccucucucauga

SEQ ID NO: 807565 - RNA, 19 nt, Homo sapiens
gugaaacagagauaaguaa

SEQ ID NO: 807566 - RNA, 19 nt, Homo sapiens
aaucgcagcuacucaggaa

SEQ ID NO: 807567 - RNA, 19 nt, Homo sapiens
gagauuaacuuuugucaac

SEQ ID NO: 807568 - RNA, 19 nt, Homo sapiens
caguggagauaaauuaaca

SEQ ID NO: 807569 - RNA, 19 nt, Homo sapiens
gcccuuguuuguggaguua

SEQ ID NO: 807570 - RNA, 19 nt, Homo sapiens
ccucaagguuguagcaugu

SEQ ID NO: 807571 - RNA, 19 nt, Homo sapiens
guaggcggucgacuuauaa

SEQ ID NO: 807572 - RNA, 19 nt, Homo sapiens
uaaacaacauguaguucag

SEQ ID NO: 807573 - RNA, 19 nt, Homo sapiens
gaaaacagacucgaacuau

SEQ ID NO: 807574 - RNA, 19 nt, Homo sapiens
uuucacaccuaacacauau

SEQ ID NO: 807575 - RNA, 19 nt, Homo sapiens
aacaacauguaguucagua

SEQ ID NO: 807576 - RNA, 19 nt, Homo sapiens
ugaggaggcugaagguagu

SEQ ID NO: 807577 - RNA, 19 nt, Homo sapiens
cauaggagaugcacuuagc

SEQ ID NO: 807578 - RNA, 19 nt, Homo sapiens
ucaccgagauuaacuuuug

SEQ ID NO: 807579 - RNA, 19 nt, Homo sapiens
ucagcacaguggagauaaa

SEQ ID NO: 807580 - RNA, 19 nt, Homo sapiens
gaggauucgucccauuaca

SEQ ID NO: 807581 - RNA, 19 nt, Homo sapiens
gauaaguaacccucucuca

SEQ ID NO: 807582 - RNA, 19 nt, Homo sapiens
ucacaccuaacacauauga

SEQ ID NO: 807583 - RNA, 19 nt, Homo sapiens
aguaagacccacaaggaua

SEQ ID NO: 807584 - RNA, 19 nt, Homo sapiens
gggcagaucacgagguuag

SEQ ID NO: 807585 - RNA, 19 nt, Homo sapiens
cuagacacuuggaaauugu

SEQ ID NO: 807586 - RNA, 19 nt, Homo sapiens
guguauacguuguugaaag

SEQ ID NO: 807587 - RNA, 19 nt, Homo sapiens
gcugggagcaaccaccuuu

SEQ ID NO: 807588 - RNA, 19 nt, Homo sapiens
cuuguucacuggacucuga

SEQ ID NO: 807589 - RNA, 19 nt, Homo sapiens
gaccaaggcaggugcaauc

SEQ ID NO: 807590 - RNA, 19 nt, Homo sapiens
cauaugacacuuugaugga

SEQ ID NO: 807591 - RNA, 19 nt, Homo sapiens
ugagaauagucccacaugu

SEQ ID NO: 807592 - RNA, 19 nt, Homo sapiens
acagggaugugcagaugga

SEQ ID NO: 807593 - RNA, 19 nt, Homo sapiens
uguauacguuguugaaagu

SEQ ID NO: 807594 - RNA, 19 nt, Homo sapiens
guucagcacaguggagaua

SEQ ID NO: 807595 - RNA, 19 nt, Homo sapiens
uuacauaggagaugcacuu

SEQ ID NO: 807596 - RNA, 19 nt, Homo sapiens
gauauuccuuugcccuucu

SEQ ID NO: 807597 - RNA, 19 nt, Homo sapiens
ggaggaccggcucuucauu

SEQ ID NO: 807598 - RNA, 19 nt, Homo sapiens
gaggaggaccggcucuuca

SEQ ID NO: 807599 - RNA, 19 nt, Homo sapiens
ucuuaaaccuccuaaucga

SEQ ID NO: 807600 - RNA, 19 nt, Homo sapiens
uuugucaacuguaguguau

SEQ ID NO: 807601 - RNA, 19 nt, Homo sapiens
agaauagucccacauguag

SEQ ID NO: 807602 - RNA, 19 nt, Homo sapiens
gcugcuaacauuaaugaga

SEQ ID NO: 807603 - RNA, 19 nt, Homo sapiens
ugucucaucuccuccacuu

SEQ ID NO: 807604 - RNA, 19 nt, Homo sapiens
gucauugucucccuaagca

SEQ ID NO: 807605 - RNA, 19 nt, Homo sapiens
ugucuacccuggaaaugug

SEQ ID NO: 807606 - RNA, 19 nt, Homo sapiens
gaggaccggcucuucauuc

SEQ ID NO: 807607 - RNA, 19 nt, Homo sapiens
cagcugaccugcaguugcu

SEQ ID NO: 807608 - RNA, 19 nt, Homo sapiens
ggcaggagaaucacuugaa

SEQ ID NO: 807609 - RNA, 19 nt, Homo sapiens
ugaccgcccugguguccuu

SEQ ID NO: 807610 - RNA, 19 nt, Homo sapiens
ggauucgucccauuacaau

SEQ ID NO: 807611 - RNA, 19 nt, Homo sapiens
cacaagacaagcagccuaa

SEQ ID NO: 807612 - RNA, 19 nt, Homo sapiens
guaacccucucucaugaac

SEQ ID NO: 807613 - RNA, 19 nt, Homo sapiens
agacagaacucaucuauaa

SEQ ID NO: 807614 - RNA, 19 nt, Homo sapiens
gaauucagaugagcuaaua

SEQ ID NO: 807615 - RNA, 19 nt, Homo sapiens
gcacacaaauucguaagua

SEQ ID NO: 807616 - RNA, 19 nt, Homo sapiens
gaacauuggugaucaucuu

SEQ ID NO: 807617 - RNA, 19 nt, Homo sapiens
aagcagaccugaagaaauu

SEQ ID NO: 807618 - RNA, 19 nt, Homo sapiens
caagagagcucagaaagau

SEQ ID NO: 807619 - RNA, 19 nt, Homo sapiens
gaagaaagcagagcacgua

SEQ ID NO: 807620 - RNA, 19 nt, Homo sapiens
gagaaccacucacgaauuc

SEQ ID NO: 807621 - RNA, 19 nt, Homo sapiens
gacauaaucucaaauccaa

SEQ ID NO: 807622 - RNA, 19 nt, Homo sapiens
ugaaaugugucacuggaua

SEQ ID NO: 807623 - RNA, 19 nt, Homo sapiens
ugacauaguuccuuccaaa

SEQ ID NO: 807624 - RNA, 19 nt, Homo sapiens
gaagugaugacccaguuua

SEQ ID NO: 807625 - RNA, 19 nt, Homo sapiens
gcagauugcucacauccaa

SEQ ID NO: 807626 - RNA, 19 nt, Homo sapiens
gguggaaggugaaguuuga

SEQ ID NO: 807627 - RNA, 19 nt, Homo sapiens
agaaacaacugacagagaa

SEQ ID NO: 807628 - RNA, 19 nt, Homo sapiens
guagagaaauuugccauug

SEQ ID NO: 807629 - RNA, 19 nt, Homo sapiens
ggaagaaguugaggaggaa

SEQ ID NO: 807630 - RNA, 19 nt, Homo sapiens
uaucgcaacuuaaugcuaa

SEQ ID NO: 807631 - RNA, 19 nt, Homo sapiens
cgaggaggauuuaugcuuu

SEQ ID NO: 807632 - RNA, 19 nt, Homo sapiens
gugaaauacuuguugcuaa

SEQ ID NO: 807633 - RNA, 19 nt, Homo sapiens
gaauugagcuaucgcaacu

SEQ ID NO: 807634 - RNA, 19 nt, Homo sapiens
uugaauaucugcacacaaa

SEQ ID NO: 807635 - RNA, 19 nt, Homo sapiens
ggacauagacaucaacaca

SEQ ID NO: 807636 - RNA, 19 nt, Homo sapiens
gcaacugucaccaucuuua

SEQ ID NO: 807637 - RNA, 19 nt, Homo sapiens
ggaagaaggcauugaugaa

SEQ ID NO: 807638 - RNA, 19 nt, Homo sapiens
ugacaacuuucaagaagaa

SEQ ID NO: 807639 - RNA, 19 nt, Homo sapiens
uuggauagcuacuagguua

SEQ ID NO: 807640 - RNA, 19 nt, Homo sapiens
gcagauuuguugugaagga

SEQ ID NO: 807641 - RNA, 19 nt, Homo sapiens
gcaaagcucggacauuaga

SEQ ID NO: 807642 - RNA, 19 nt, Homo sapiens
gaacucaucuauaaguacu

SEQ ID NO: 807643 - RNA, 19 nt, Homo sapiens
ggacucggcugaccucaag

SEQ ID NO: 807644 - RNA, 19 nt, Homo sapiens
gcagcgagcacuuaaagaa

SEQ ID NO: 807645 - RNA, 19 nt, Homo sapiens
ccagugagcugcguuacaa

SEQ ID NO: 807646 - RNA, 19 nt, Homo sapiens
uugcugaacugguugauaa

SEQ ID NO: 807647 - RNA, 19 nt, Homo sapiens
gaauaucugcacacaaauu

SEQ ID NO: 807648 - RNA, 19 nt, Homo sapiens
ucauggcuuucacaaauua

SEQ ID NO: 807649 - RNA, 19 nt, Homo sapiens
gaaguucaccuuucuugga

SEQ ID NO: 807650 - RNA, 19 nt, Homo sapiens
aaacaggacuuugcugaug

SEQ ID NO: 807651 - RNA, 19 nt, Homo sapiens
uugcucacauccaauauua

SEQ ID NO: 807652 - RNA, 19 nt, Homo sapiens
guaacucguuccuugauau

SEQ ID NO: 807653 - RNA, 19 nt, Homo sapiens
gaacuagacauaaucucaa

SEQ ID NO: 807654 - RNA, 19 nt, Homo sapiens
gugaucaucuucaaucuca

SEQ ID NO: 807655 - RNA, 19 nt, Homo sapiens
cagaacucaucuauaagua

SEQ ID NO: 807656 - RNA, 19 nt, Homo sapiens
cagacuuacugaagcuuua

SEQ ID NO: 807657 - RNA, 19 nt, Homo sapiens
gaaauugcccuuggaagug

SEQ ID NO: 807658 - RNA, 19 nt, Homo sapiens
gaagaaauugcccuuggaa

SEQ ID NO: 807659 - RNA, 19 nt, Homo sapiens
cagacaauguagagaaauu

SEQ ID NO: 807660 - RNA, 19 nt, Homo sapiens
ugagaucagugaaauacuu

SEQ ID NO: 807661 - RNA, 19 nt, Homo sapiens
gaaauuugccauugagaca

SEQ ID NO: 807662 - RNA, 19 nt, Homo sapiens
uagagaaauuugccauuga

SEQ ID NO: 807663 - RNA, 19 nt, Homo sapiens
gaaaggcagugaggaugug

SEQ ID NO: 807664 - RNA, 19 nt, Homo sapiens
gaagcggagugucgcaguu

SEQ ID NO: 807665 - RNA, 19 nt, Homo sapiens
gaggaggauuuaugcuuug

SEQ ID NO: 807666 - RNA, 19 nt, Homo sapiens
agucauggcuuucacaaau

SEQ ID NO: 807667 - RNA, 19 nt, Homo sapiens
gaagugaccaccagaccuu

SEQ ID NO: 807668 - RNA, 19 nt, Homo sapiens
gaaccuaaggaacugaauu

SEQ ID NO: 807669 - RNA, 19 nt, Homo sapiens
ccgaaaggcuccugucauc

SEQ ID NO: 807670 - RNA, 19 nt, Homo sapiens
uaaagaaccuaaggaacug

SEQ ID NO: 807671 - RNA, 19 nt, Homo sapiens
ccgcugugcucuauauuga

SEQ ID NO: 807672 - RNA, 19 nt, Homo sapiens
aggcauugaugaagugaua

SEQ ID NO: 807673 - RNA, 19 nt, Homo sapiens
guucaugguucuugaguuc

SEQ ID NO: 807674 - RNA, 19 nt, Homo sapiens
gggcagauuuguugugaag

SEQ ID NO: 807675 - RNA, 19 nt, Homo sapiens
acaacguccuaaacaguua

SEQ ID NO: 807676 - RNA, 19 nt, Homo sapiens
caugaacccugauccugaa

SEQ ID NO: 807677 - RNA, 19 nt, Homo sapiens
gcgcaguauuggaaggaua

SEQ ID NO: 807678 - RNA, 19 nt, Homo sapiens
gcacagacuuacugaagcu

SEQ ID NO: 807679 - RNA, 19 nt, Homo sapiens
gugaugacccaguuuauga

SEQ ID NO: 807680 - RNA, 19 nt, Homo sapiens
cagcuaaccuuugaauauc

SEQ ID NO: 807681 - RNA, 19 nt, Homo sapiens
ucagcuaaccuuugaauau

SEQ ID NO: 807682 - RNA, 19 nt, Homo sapiens
acauagacaucaacacaga

SEQ ID NO: 807683 - RNA, 19 nt, Homo sapiens
gaaagcagagcacguagca

SEQ ID NO: 807684 - RNA, 19 nt, Homo sapiens
gaagaaggcauugaugaag

SEQ ID NO: 807685 - RNA, 19 nt, Homo sapiens
gcaguacgggaauggguua

SEQ ID NO: 807686 - RNA, 19 nt, Homo sapiens
aggaguacuucaagcaaua

SEQ ID NO: 807687 - RNA, 19 nt, Homo sapiens
gcagcugagugcuaugaau

SEQ ID NO: 807688 - RNA, 19 nt, Homo sapiens
gagcacagacuuacugaag

SEQ ID NO: 807689 - RNA, 19 nt, Homo sapiens
ggaucuggauggcauguuc

SEQ ID NO: 807690 - RNA, 19 nt, Homo sapiens
cacagacaauguagagaaa

SEQ ID NO: 807691 - RNA, 19 nt, Homo sapiens
ugagugcuaugaauucaga

SEQ ID NO: 807692 - RNA, 19 nt, Homo sapiens
ggagaaaggcagugaggau

SEQ ID NO: 807693 - RNA, 19 nt, Homo sapiens
gagaagccgaugucaagaa

SEQ ID NO: 807694 - RNA, 19 nt, Homo sapiens
gagacagaacucaucuaua

SEQ ID NO: 807695 - RNA, 19 nt, Homo sapiens
gaggauuuaugcuuugcuu

SEQ ID NO: 807696 - RNA, 19 nt, Homo sapiens
ugggaaaucgauaucauua

SEQ ID NO: 807697 - RNA, 19 nt, Homo sapiens
ggaaggugaaguuugacua

SEQ ID NO: 807698 - RNA, 19 nt, Homo sapiens
ugaagaaauugcccuugga

SEQ ID NO: 807699 - RNA, 19 nt, Homo sapiens
gcuggaggcccuucagaaa

SEQ ID NO: 807700 - RNA, 19 nt, Homo sapiens
gaucaucuucaaucucaaa

SEQ ID NO: 807701 - RNA, 19 nt, Homo sapiens
gcuaaaagcuccuuaaagc

SEQ ID NO: 807702 - RNA, 19 nt, Homo sapiens
gaaccacucacgaauucuu

SEQ ID NO: 807703 - RNA, 19 nt, Homo sapiens
gaaaugugucacuggauau

SEQ ID NO: 807704 - RNA, 19 nt, Homo sapiens
cauaguuccuuccaaaaua

SEQ ID NO: 807705 - RNA, 19 nt, Homo sapiens
gagcuggacgccuacauug

SEQ ID NO: 807706 - RNA, 19 nt, Homo sapiens
agagagcucagaaagauaa

SEQ ID NO: 807707 - RNA, 19 nt, Homo sapiens
cagcaacugucaccaucuu

SEQ ID NO: 807708 - RNA, 19 nt, Homo sapiens
gaaacaacugacagagaaa

SEQ ID NO: 807709 - RNA, 19 nt, Homo sapiens
gaagagaagcagaaacaac

SEQ ID NO: 807710 - RNA, 19 nt, Homo sapiens
gcagagaagccgaugucaa

SEQ ID NO: 807711 - RNA, 19 nt, Homo sapiens
ucacagacaauguagagaa

SEQ ID NO: 807712 - RNA, 19 nt, Homo sapiens
gaugccaccagaauagaua

SEQ ID NO: 807713 - RNA, 19 nt, Homo sapiens
gauauaaggucucaugaua

SEQ ID NO: 807714 - RNA, 19 nt, Homo sapiens
gaaauuaaauccugaguuc

SEQ ID NO: 807715 - RNA, 19 nt, Homo sapiens
gaagauggcauauucauaa

SEQ ID NO: 807716 - RNA, 19 nt, Homo sapiens
ggaagagacuacagaagaa

SEQ ID NO: 807717 - RNA, 19 nt, Homo sapiens
ggagucaacuauuguauau

SEQ ID NO: 807718 - RNA, 19 nt, Homo sapiens
ggauaucacuaaccucuuu

SEQ ID NO: 807719 - RNA, 19 nt, Homo sapiens
gaggaaauaugaaaggauu

SEQ ID NO: 807720 - RNA, 19 nt, Homo sapiens
gcagauacgaccauuguua

SEQ ID NO: 807721 - RNA, 19 nt, Homo sapiens
uaacagcucuggaaacaau

SEQ ID NO: 807722 - RNA, 19 nt, Homo sapiens
ucaacaagcuggagaauca

SEQ ID NO: 807723 - RNA, 19 nt, Homo sapiens
gaaacuggacgauguguaa

SEQ ID NO: 807724 - RNA, 19 nt, Homo sapiens
caacaucuauuaagaccaa

SEQ ID NO: 807725 - RNA, 19 nt, Homo sapiens
ggacuagggugcagaagga

SEQ ID NO: 807726 - RNA, 19 nt, Homo sapiens
ccaagaaacuggacgaugu

SEQ ID NO: 807727 - RNA, 19 nt, Homo sapiens
gaacucaaguagucauuca

SEQ ID NO: 807728 - RNA, 19 nt, Homo sapiens
guagauauaugucacuguu

SEQ ID NO: 807729 - RNA, 19 nt, Homo sapiens
acaaugagaucaaaugaga

SEQ ID NO: 807730 - RNA, 19 nt, Homo sapiens
cauguuaugugucuucuaa

SEQ ID NO: 807731 - RNA, 19 nt, Homo sapiens
ccaaagagaagaaaugauu

SEQ ID NO: 807732 - RNA, 19 nt, Homo sapiens
ucugagaugugcuaaauaa

SEQ ID NO: 807733 - RNA, 19 nt, Homo sapiens
uagaggcacuuucucauuu

SEQ ID NO: 807734 - RNA, 19 nt, Homo sapiens
ccagaagacuuuacuuugu

SEQ ID NO: 807735 - RNA, 19 nt, Homo sapiens
ccagauacauguuuccuau

SEQ ID NO: 807736 - RNA, 19 nt, Homo sapiens
gauggcauauucauaaaga

SEQ ID NO: 807737 - RNA, 19 nt, Homo sapiens
cguaucagcucuacacauu

SEQ ID NO: 807738 - RNA, 19 nt, Homo sapiens
gaaccugcaugcucauaau

SEQ ID NO: 807739 - RNA, 19 nt, Homo sapiens
gcaggcagcuaauauugug

SEQ ID NO: 807740 - RNA, 19 nt, Homo sapiens
gaaacaaugagaucaaaug

SEQ ID NO: 807741 - RNA, 19 nt, Homo sapiens
uauaaucacuuguccauca

SEQ ID NO: 807742 - RNA, 19 nt, Homo sapiens
gcuaacagcucuggaaaca

SEQ ID NO: 807743 - RNA, 19 nt, Homo sapiens
cagcaaauguuguuucauc

SEQ ID NO: 807744 - RNA, 19 nt, Homo sapiens
cagaagacuuuacuuuguu

SEQ ID NO: 807745 - RNA, 19 nt, Homo sapiens
guuagugcauuauugagua

SEQ ID NO: 807746 - RNA, 19 nt, Homo sapiens
gggaagagacuacagaaga

SEQ ID NO: 807747 - RNA, 19 nt, Homo sapiens
gagcuugucuuguucucaa

SEQ ID NO: 807748 - RNA, 19 nt, Homo sapiens
gaauuugugucucuuccaa

SEQ ID NO: 807749 - RNA, 19 nt, Homo sapiens
ggaggucugucguagaaga

SEQ ID NO: 807750 - RNA, 19 nt, Homo sapiens
gaagcaggcagcuaauauu

SEQ ID NO: 807751 - RNA, 19 nt, Homo sapiens
ucaaacaggauaucacuaa

SEQ ID NO: 807752 - RNA, 19 nt, Homo sapiens
gaucaaaugagaaagauuc

SEQ ID NO: 807753 - RNA, 19 nt, Homo sapiens
caagauaaggcuacauuga

SEQ ID NO: 807754 - RNA, 19 nt, Homo sapiens
ggaauacagccuugcauga

SEQ ID NO: 807755 - RNA, 19 nt, Homo sapiens
gaggaaugcugaaaacuaa

SEQ ID NO: 807756 - RNA, 19 nt, Homo sapiens
gucacaagauccaauauau

SEQ ID NO: 807757 - RNA, 19 nt, Homo sapiens
cuacagguguggaccaauu

SEQ ID NO: 807758 - RNA, 19 nt, Homo sapiens
gaagguggccaaaaucuua

SEQ ID NO: 807759 - RNA, 19 nt, Homo sapiens
gaauacagccuugcaugaa

SEQ ID NO: 807760 - RNA, 19 nt, Homo sapiens
gcagguccaguguauauuu

SEQ ID NO: 807761 - RNA, 19 nt, Homo sapiens
caaauguuguuucaucugu

SEQ ID NO: 807762 - RNA, 19 nt, Homo sapiens
agagaaaggucccgaagau

SEQ ID NO: 807763 - RNA, 19 nt, Homo sapiens
gacaauccauagauauaga

SEQ ID NO: 807764 - RNA, 19 nt, Homo sapiens
gaagcauccuggcaugguu

SEQ ID NO: 807765 - RNA, 19 nt, Homo sapiens
acauggaucuugucucuug

SEQ ID NO: 807766 - RNA, 19 nt, Homo sapiens
gcauggauauguugaaacu

SEQ ID NO: 807767 - RNA, 19 nt, Homo sapiens
gaacuugccaaacuaagga

SEQ ID NO: 807768 - RNA, 19 nt, Homo sapiens
gagcagauacgaccauugu

SEQ ID NO: 807769 - RNA, 19 nt, Homo sapiens
cagcuaauauugugaacug

SEQ ID NO: 807770 - RNA, 19 nt, Homo sapiens
gagaguaccuucaguuuuc

SEQ ID NO: 807771 - RNA, 19 nt, Homo sapiens
gacuuuacuuuguuccaua

SEQ ID NO: 807772 - RNA, 19 nt, Homo sapiens
caaacccaauuauaucaga

SEQ ID NO: 807773 - RNA, 19 nt, Homo sapiens
gcaacugcauaauagcuau

SEQ ID NO: 807774 - RNA, 19 nt, Homo sapiens
gaugugaaccucuaaucaa

SEQ ID NO: 807775 - RNA, 19 nt, Homo sapiens
ucucguagcugcguacaaa

SEQ ID NO: 807776 - RNA, 19 nt, Homo sapiens
cuacauggaucuugucucu

SEQ ID NO: 807777 - RNA, 19 nt, Homo sapiens
gccuaauacucaagaaauu

SEQ ID NO: 807778 - RNA, 19 nt, Homo sapiens
uaaacccucuuucucaaau

SEQ ID NO: 807779 - RNA, 19 nt, Homo sapiens
cagaaagcccagcaagaua

SEQ ID NO: 807780 - RNA, 19 nt, Homo sapiens
gcacguugcugcgcgcuau

SEQ ID NO: 807781 - RNA, 19 nt, Homo sapiens
gagaucaaaugagaaagau

SEQ ID NO: 807782 - RNA, 19 nt, Homo sapiens
cgucugaacucaaguaguc

SEQ ID NO: 807783 - RNA, 19 nt, Homo sapiens
gcccucaacuccacugcua

SEQ ID NO: 807784 - RNA, 19 nt, Homo sapiens
uggacaagcugaugguuga

SEQ ID NO: 807785 - RNA, 19 nt, Homo sapiens
aaucacuuguccaucauua

SEQ ID NO: 807786 - RNA, 19 nt, Homo sapiens
ucaaaucaaggcugaaauu

SEQ ID NO: 807787 - RNA, 19 nt, Homo sapiens
uaucaagucuagaccauag

SEQ ID NO: 807788 - RNA, 19 nt, Homo sapiens
aaaguagcauggauauguu

SEQ ID NO: 807789 - RNA, 19 nt, Homo sapiens
gaauaccuuucugaauuug

SEQ ID NO: 807790 - RNA, 19 nt, Homo sapiens
aaauaaacccucuuucuca

SEQ ID NO: 807791 - RNA, 19 nt, Homo sapiens
uaauagcuaugcccaagga

SEQ ID NO: 807792 - RNA, 19 nt, Homo sapiens
agaaagcccagcaagauaa

SEQ ID NO: 807793 - RNA, 19 nt, Homo sapiens
ggacagacaagacaaggau

SEQ ID NO: 807794 - RNA, 19 nt, Homo sapiens
caacuuauagccugucaug

SEQ ID NO: 807795 - RNA, 19 nt, Homo sapiens
gaagaagaaacaaauagag

SEQ ID NO: 807796 - RNA, 19 nt, Homo sapiens
gagaacugccuaauacuca

SEQ ID NO: 807797 - RNA, 19 nt, Homo sapiens
ggagugcaguggcaugauc

SEQ ID NO: 807798 - RNA, 19 nt, Homo sapiens
gaagcuuucuggagauucu

SEQ ID NO: 807799 - RNA, 19 nt, Homo sapiens
gggcaaggaugggaaagug

SEQ ID NO: 807800 - RNA, 19 nt, Homo sapiens
uaucagcucuacacauugu

SEQ ID NO: 807801 - RNA, 19 nt, Homo sapiens
caggucauguuucaaauca

SEQ ID NO: 807802 - RNA, 19 nt, Homo sapiens
aaauagaggugaugaagac

SEQ ID NO: 807803 - RNA, 19 nt, Homo sapiens
gugacaauccauagauaua

SEQ ID NO: 807804 - RNA, 19 nt, Homo sapiens
ggccagaagacuuuacuuu

SEQ ID NO: 807805 - RNA, 19 nt, Homo sapiens
cccaaggagucaacuauug

SEQ ID NO: 807806 - RNA, 19 nt, Homo sapiens
agaggaacuugccaaacua

SEQ ID NO: 807807 - RNA, 19 nt, Homo sapiens
gguaugaaaggaagauuga

SEQ ID NO: 807808 - RNA, 19 nt, Homo sapiens
caacagaggcacucaaacu

SEQ ID NO: 807809 - RNA, 19 nt, Homo sapiens
cagauacgaccauuguuaa

SEQ ID NO: 807810 - RNA, 19 nt, Homo sapiens
ggucauguuucaaaucaag

SEQ ID NO: 807811 - RNA, 19 nt, Homo sapiens
aaacagagaaugugguuca

SEQ ID NO: 807812 - RNA, 19 nt, Homo sapiens
cccagagacucauuagauu

SEQ ID NO: 807813 - RNA, 19 nt, Homo sapiens
gcagguggcugacuucuuu

SEQ ID NO: 807814 - RNA, 19 nt, Homo sapiens
caugauaucuacuggauuu

SEQ ID NO: 807815 - RNA, 19 nt, Homo sapiens
gaaccgauuuguacaaugu

SEQ ID NO: 807816 - RNA, 19 nt, Homo sapiens
ccaagaaggugcccaagaa

SEQ ID NO: 807817 - RNA, 19 nt, Homo sapiens
gcucaaagccucaccauga

SEQ ID NO: 807818 - RNA, 19 nt, Homo sapiens
aaagguagguugaaauuug

SEQ ID NO: 807819 - RNA, 19 nt, Homo sapiens
gcgaaucccuugccaaaga

SEQ ID NO: 807820 - RNA, 19 nt, Homo sapiens
gaucaacucuuucaacaag

SEQ ID NO: 807821 - RNA, 19 nt, Homo sapiens
gcacuaccauuguaagguu

SEQ ID NO: 807822 - RNA, 19 nt, Homo sapiens
gaacagaugcuugcugaaa

SEQ ID NO: 807823 - RNA, 19 nt, Homo sapiens
gaauguaacuucacaacca

SEQ ID NO: 807824 - RNA, 19 nt, Homo sapiens
cggcagaucuuccaaauca

SEQ ID NO: 807825 - RNA, 19 nt, Homo sapiens
gaacugcugugcugaucaa

SEQ ID NO: 807826 - RNA, 19 nt, Homo sapiens
guacagcugccaccaaaua

SEQ ID NO: 807827 - RNA, 19 nt, Homo sapiens
ugaaguggauggagcagua

SEQ ID NO: 807828 - RNA, 19 nt, Homo sapiens
ggagcgagaucaagaagug

SEQ ID NO: 807829 - RNA, 19 nt, Homo sapiens
ccacgaugaucaacucuuu

SEQ ID NO: 807830 - RNA, 19 nt, Homo sapiens
gcucuccggugcccaguua

SEQ ID NO: 807831 - RNA, 19 nt, Homo sapiens
caaggucccugucccacua

SEQ ID NO: 807832 - RNA, 19 nt, Homo sapiens
gcuaggaaguuugaauaaa

SEQ ID NO: 807833 - RNA, 19 nt, Homo sapiens
ucaaauuccuuuccaguuc

SEQ ID NO: 807834 - RNA, 19 nt, Homo sapiens
gcccucaccucuugcuaua

SEQ ID NO: 807835 - RNA, 19 nt, Homo sapiens
uaaucaaacugucuuggaa

SEQ ID NO: 807836 - RNA, 19 nt, Homo sapiens
agacauaucugguguacgu

SEQ ID NO: 807837 - RNA, 19 nt, Homo sapiens
uagcauuagugccaugaua

SEQ ID NO: 807838 - RNA, 19 nt, Homo sapiens
gaagacaaaggagcagaua

SEQ ID NO: 807839 - RNA, 19 nt, Homo sapiens
gagcaacacgggaccgaua

SEQ ID NO: 807840 - RNA, 19 nt, Homo sapiens
acaauaagaucuuccuauc

SEQ ID NO: 807841 - RNA, 19 nt, Homo sapiens
caacaacaauaagaucuuc

SEQ ID NO: 807842 - RNA, 19 nt, Homo sapiens
ucaguacuauugugacauu

SEQ ID NO: 807843 - RNA, 19 nt, Homo sapiens
gaucaguacuauugugaca

SEQ ID NO: 807844 - RNA, 19 nt, Homo sapiens
gcagaucuuccaaaucaaa

SEQ ID NO: 807845 - RNA, 19 nt, Homo sapiens
gaugcuuccugguguguuu

SEQ ID NO: 807846 - RNA, 19 nt, Homo sapiens
acacaaggcuuucugaacu

SEQ ID NO: 807847 - RNA, 19 nt, Homo sapiens
cagcauggcuagcaaacga

SEQ ID NO: 807848 - RNA, 19 nt, Homo sapiens
gcucauuuguuguaacuca

SEQ ID NO: 807849 - RNA, 19 nt, Homo sapiens
ggaucuggcuucucaacug

SEQ ID NO: 807850 - RNA, 19 nt, Homo sapiens
gugcugaaaucauucugaa

SEQ ID NO: 807851 - RNA, 19 nt, Homo sapiens
caaaucaaauuccuuucca

SEQ ID NO: 807852 - RNA, 19 nt, Homo sapiens
aaacacagggucagguuaa

SEQ ID NO: 807853 - RNA, 19 nt, Homo sapiens
ccaagaagcccgaggagau

SEQ ID NO: 807854 - RNA, 19 nt, Homo sapiens
caaagaaaacgaagugaua

SEQ ID NO: 807855 - RNA, 19 nt, Homo sapiens
gggcuaaccaccuugcuuu

SEQ ID NO: 807856 - RNA, 19 nt, Homo sapiens
gcgaagaggacuuggagaa

SEQ ID NO: 807857 - RNA, 19 nt, Homo sapiens
ccaggaguacgaccaguua

SEQ ID NO: 807858 - RNA, 19 nt, Homo sapiens
caccaaauaucaaccuugu

SEQ ID NO: 807859 - RNA, 19 nt, Homo sapiens
gguagcagguggcugacuu

SEQ ID NO: 807860 - RNA, 19 nt, Homo sapiens
agucgagcguuguggauua

SEQ ID NO: 807861 - RNA, 19 nt, Homo sapiens
gcaauaaucaaacugucuu

SEQ ID NO: 807862 - RNA, 19 nt, Homo sapiens
agacagggccaaagagaaa

SEQ ID NO: 807863 - RNA, 19 nt, Homo sapiens
ggacaucacaaguaguaga

SEQ ID NO: 807864 - RNA, 19 nt, Homo sapiens
guucggacaucacaaguag

SEQ ID NO: 807865 - RNA, 19 nt, Homo sapiens
gacggcagaucuuccaaau

SEQ ID NO: 807866 - RNA, 19 nt, Homo sapiens
cuacgugugugcagaaugu

SEQ ID NO: 807867 - RNA, 19 nt, Homo sapiens
guacgccgcacaagucaaa

SEQ ID NO: 807868 - RNA, 19 nt, Homo sapiens
uaugaacucugguugcaau

SEQ ID NO: 807869 - RNA, 19 nt, Homo sapiens
caaagccucaccaugaauu

SEQ ID NO: 807870 - RNA, 19 nt, Homo sapiens
gccaugauaucuacuggau

SEQ ID NO: 807871 - RNA, 19 nt, Homo sapiens
cagcgaaucccuugccaaa

SEQ ID NO: 807872 - RNA, 19 nt, Homo sapiens
ggucaacaaccgucucuug

SEQ ID NO: 807873 - RNA, 19 nt, Homo sapiens
cagcgcaggucuggaugua

SEQ ID NO: 807874 - RNA, 19 nt, Homo sapiens
ggaaccgauuuguacaaug

SEQ ID NO: 807875 - RNA, 19 nt, Homo sapiens
gaagagacccuuggugacu

SEQ ID NO: 807876 - RNA, 19 nt, Homo sapiens
ggaaguagacagggccaaa

SEQ ID NO: 807877 - RNA, 19 nt, Homo sapiens
cagaggagcacaucagaau

SEQ ID NO: 807878 - RNA, 19 nt, Homo sapiens
gaggagcacguuugcaaga

SEQ ID NO: 807879 - RNA, 19 nt, Homo sapiens
ucaagaagugguucaguga

SEQ ID NO: 807880 - RNA, 19 nt, Homo sapiens
acucugcccuggauacaaa

SEQ ID NO: 807881 - RNA, 19 nt, Homo sapiens
gcacacaaggaaagccaaa

SEQ ID NO: 807882 - RNA, 19 nt, Homo sapiens
ucuguuagcaugaucagua

SEQ ID NO: 807883 - RNA, 19 nt, Homo sapiens
caaauuccuuuccaguucu

SEQ ID NO: 807884 - RNA, 19 nt, Homo sapiens
ugucggaacuggcugaauc

SEQ ID NO: 807885 - RNA, 19 nt, Homo sapiens
cccagaaguucaaagagaa

SEQ ID NO: 807886 - RNA, 19 nt, Homo sapiens
ucugaaaacucaaacagua

SEQ ID NO: 807887 - RNA, 19 nt, Homo sapiens
caucacaaguaguagaaca

SEQ ID NO: 807888 - RNA, 19 nt, Homo sapiens
ucagauagaucagauagcu

SEQ ID NO: 807889 - RNA, 19 nt, Homo sapiens
caaaugccacgaugaucaa

SEQ ID NO: 807890 - RNA, 19 nt, Homo sapiens
auacaacucugcccuggau

SEQ ID NO: 807891 - RNA, 19 nt, Homo sapiens
ccaccuugcuuuucucuuu

SEQ ID NO: 807892 - RNA, 19 nt, Homo sapiens
caacacgggaccgauauga

SEQ ID NO: 807893 - RNA, 19 nt, Homo sapiens
gguccgaacugagauugug

SEQ ID NO: 807894 - RNA, 19 nt, Homo sapiens
gagaucgacuccugguucu

SEQ ID NO: 807895 - RNA, 19 nt, Homo sapiens
guagacagggccaaagaga

SEQ ID NO: 807896 - RNA, 19 nt, Homo sapiens
guaacucaauaaagcaaag

SEQ ID NO: 807897 - RNA, 19 nt, Homo sapiens
ucuaacuuguugcucauuu

SEQ ID NO: 807898 - RNA, 19 nt, Homo sapiens
ugugguauuugacaagauu

SEQ ID NO: 807899 - RNA, 19 nt, Homo sapiens
cuaaauaccagcagaagag

SEQ ID NO: 807900 - RNA, 19 nt, Homo sapiens
gcagaacuggaucggcuaa

SEQ ID NO: 807901 - RNA, 19 nt, Homo sapiens
caacggcaccauccaguca

SEQ ID NO: 807902 - RNA, 19 nt, Homo sapiens
gcuccuccaagacacauua

SEQ ID NO: 807903 - RNA, 19 nt, Homo sapiens
ucuuuaagcaccuuucuaa

SEQ ID NO: 807904 - RNA, 19 nt, Homo sapiens
gaucuuccaaaucaaauuc

SEQ ID NO: 807905 - RNA, 19 nt, Homo sapiens
gcuuuucucuuuucucuuu

SEQ ID NO: 807906 - RNA, 19 nt, Homo sapiens
ggugggaauuguucauagu

SEQ ID NO: 807907 - RNA, 19 nt, Homo sapiens
gaggagcacaucagaaucu

SEQ ID NO: 807908 - RNA, 19 nt, Homo sapiens
ucugggaucucggugagua

SEQ ID NO: 807909 - RNA, 19 nt, Homo sapiens
gaggggaucuggcuucuca

SEQ ID NO: 807910 - RNA, 19 nt, Homo sapiens
aaggaaagccaaagccauu

SEQ ID NO: 807911 - RNA, 19 nt, Homo sapiens
gaucagauagcuggaguca

SEQ ID NO: 807912 - RNA, 19 nt, Homo sapiens
gucccugucccacuaaaua

SEQ ID NO: 807913 - RNA, 19 nt, Homo sapiens
ggacuggaauguaaaguga

SEQ ID NO: 807914 - RNA, 19 nt, Homo sapiens
gaaauuaaacuacgggaaa

SEQ ID NO: 807915 - RNA, 19 nt, Homo sapiens
ccgagcagcuucugaauuu

SEQ ID NO: 807916 - RNA, 19 nt, Homo sapiens
gcagaaagacuauucauuc

SEQ ID NO: 807917 - RNA, 19 nt, Homo sapiens
ggugagauuuguggauuua

SEQ ID NO: 807918 - RNA, 19 nt, Homo sapiens
caaacuagugcauguauaa

SEQ ID NO: 807919 - RNA, 19 nt, Homo sapiens
gcacuuugcucuuaguuac

SEQ ID NO: 807920 - RNA, 19 nt, Homo sapiens
aagagaaacuggacuguga

SEQ ID NO: 807921 - RNA, 19 nt, Homo sapiens
gcagauguguauacucaug

SEQ ID NO: 807922 - RNA, 19 nt, Homo sapiens
gguacuguguagaugauua

SEQ ID NO: 807923 - RNA, 19 nt, Homo sapiens
ugaacgacgugaaugagua

SEQ ID NO: 807924 - RNA, 19 nt, Homo sapiens
caauaaaguucugguucua

SEQ ID NO: 807925 - RNA, 19 nt, Homo sapiens
gcuagaaaccagccacaua

SEQ ID NO: 807926 - RNA, 19 nt, Homo sapiens
acaacaggauugaguauga

SEQ ID NO: 807927 - RNA, 19 nt, Homo sapiens
cagaaagacuauucauuca

SEQ ID NO: 807928 - RNA, 19 nt, Homo sapiens
auacagaccugcagaguuc

SEQ ID NO: 807929 - RNA, 19 nt, Homo sapiens
gaacugggcaugaccuuca

SEQ ID NO: 807930 - RNA, 19 nt, Homo sapiens
ccaccucgguuucugcuuu

SEQ ID NO: 807931 - RNA, 19 nt, Homo sapiens
ccgggaaacucgcggauaa

SEQ ID NO: 807932 - RNA, 19 nt, Homo sapiens
aaacugagccugugacugu

SEQ ID NO: 807933 - RNA, 19 nt, Homo sapiens
gaacaacaggauugaguau

SEQ ID NO: 807934 - RNA, 19 nt, Homo sapiens
ccaaacuagugcauguaua

SEQ ID NO: 807935 - RNA, 19 nt, Homo sapiens
ggaacaacaggauugagua

SEQ ID NO: 807936 - RNA, 19 nt, Homo sapiens
gacgugcccuuuacuguug

SEQ ID NO: 807937 - RNA, 19 nt, Homo sapiens
gaaguugaaucaggucugu

SEQ ID NO: 807938 - RNA, 19 nt, Homo sapiens
gaaaagagccacagaagau

SEQ ID NO: 807939 - RNA, 19 nt, Homo sapiens
gggaaagaacaucaauaua

SEQ ID NO: 807940 - RNA, 19 nt, Homo sapiens
gugaucgacugucuguaua

SEQ ID NO: 807941 - RNA, 19 nt, Homo sapiens
ccaaagagccguucaccau

SEQ ID NO: 807942 - RNA, 19 nt, Homo sapiens
cgagacaccuacucagaga

SEQ ID NO: 807943 - RNA, 19 nt, Homo sapiens
ccacugaucgcgcuggaua

SEQ ID NO: 807944 - RNA, 19 nt, Homo sapiens
caugauaggucagaaagug

SEQ ID NO: 807945 - RNA, 19 nt, Homo sapiens
cagcugggcucguugacaa

SEQ ID NO: 807946 - RNA, 19 nt, Homo sapiens
ccagcacaaucaaguguuu

SEQ ID NO: 807947 - RNA, 19 nt, Homo sapiens
acugugagcugcagaaaga

SEQ ID NO: 807948 - RNA, 19 nt, Homo sapiens
ggaggaagaggaagaggaa

SEQ ID NO: 807949 - RNA, 19 nt, Homo sapiens
ggaaggagaacgagaugga

SEQ ID NO: 807950 - RNA, 19 nt, Homo sapiens
gucauucgcuccaaagaga

SEQ ID NO: 807951 - RNA, 19 nt, Homo sapiens
gaaacucgcggauaagaag

SEQ ID NO: 807952 - RNA, 19 nt, Homo sapiens
gcccuuuacuguugacaaa

SEQ ID NO: 807953 - RNA, 19 nt, Homo sapiens
ucgcagauguguauacuca

SEQ ID NO: 807954 - RNA, 19 nt, Homo sapiens
gagcagcuucugaauuuga

SEQ ID NO: 807955 - RNA, 19 nt, Homo sapiens
cccuguagcugcucuguuu

SEQ ID NO: 807956 - RNA, 19 nt, Homo sapiens
cauccaagauagaaacuca

SEQ ID NO: 807957 - RNA, 19 nt, Homo sapiens
gcaggaagaaggagacaau

SEQ ID NO: 807958 - RNA, 19 nt, Homo sapiens
gauucuaccuguuccuaau

SEQ ID NO: 807959 - RNA, 19 nt, Homo sapiens
cuacaucagcaacgaauuu

SEQ ID NO: 807960 - RNA, 19 nt, Homo sapiens
gagaagaccucggggaauu

SEQ ID NO: 807961 - RNA, 19 nt, Homo sapiens
cacgagcccuucucuguga

SEQ ID NO: 807962 - RNA, 19 nt, Homo sapiens
gcgaccagguguuugaguu

SEQ ID NO: 807963 - RNA, 19 nt, Homo sapiens
gguccacgauguacaaagu

SEQ ID NO: 807964 - RNA, 19 nt, Homo sapiens
gcagaagggcauugaagug

SEQ ID NO: 807965 - RNA, 19 nt, Homo sapiens
guagaauucccgaguguga

SEQ ID NO: 807966 - RNA, 19 nt, Homo sapiens
aagcaacuguucauauuca

SEQ ID NO: 807967 - RNA, 19 nt, Homo sapiens
ugaucgcgcuggauaaaga

SEQ ID NO: 807968 - RNA, 19 nt, Homo sapiens
ccacuacguccucaaugua

SEQ ID NO: 807969 - RNA, 19 nt, Homo sapiens
cgacagcgaccagguguuu

SEQ ID NO: 807970 - RNA, 19 nt, Homo sapiens
gugcauguauaaauaaugg

SEQ ID NO: 807971 - RNA, 19 nt, Homo sapiens
ggaacacgccaaccacaug

SEQ ID NO: 807972 - RNA, 19 nt, Homo sapiens
ggugaucgacugucuguau

SEQ ID NO: 807973 - RNA, 19 nt, Homo sapiens
uagcugcucuguuuagaca

SEQ ID NO: 807974 - RNA, 19 nt, Homo sapiens
uaacgaggccaccugcauu

SEQ ID NO: 807975 - RNA, 19 nt, Homo sapiens
ggaaacucgcggauaagaa

SEQ ID NO: 807976 - RNA, 19 nt, Homo sapiens
gagcaaacaaacagucaug

SEQ ID NO: 807977 - RNA, 19 nt, Homo sapiens
gaucgucgcugugcuuggu

SEQ ID NO: 807978 - RNA, 19 nt, Homo sapiens
cgggaaagaacaucaauau

SEQ ID NO: 807979 - RNA, 19 nt, Homo sapiens
acaauaaaguucugguucu

SEQ ID NO: 807980 - RNA, 19 nt, Homo sapiens
gccuugugguuuaugcuua

SEQ ID NO: 807981 - RNA, 19 nt, Homo sapiens
guagaugauuaacugacuu

SEQ ID NO: 807982 - RNA, 19 nt, Homo sapiens
ggaauucgcagacucaaaa

SEQ ID NO: 807983 - RNA, 19 nt, Homo sapiens
gcacaucucguaccugaac

SEQ ID NO: 807984 - RNA, 19 nt, Homo sapiens
caaucuggcuggcuuaacu

SEQ ID NO: 807985 - RNA, 19 nt, Homo sapiens
ggauggaacaacaggauug

SEQ ID NO: 807986 - RNA, 19 nt, Homo sapiens
guacuguguagaugauuaa

SEQ ID NO: 807987 - RNA, 19 nt, Homo sapiens
ucaggucugugaugaggaa

SEQ ID NO: 807988 - RNA, 19 nt, Homo sapiens
gcaccacuacucccucuau

SEQ ID NO: 807989 - RNA, 19 nt, Homo sapiens
agacaauucuuugcaguuc

SEQ ID NO: 807990 - RNA, 19 nt, Homo sapiens
gaagcaguacgacagcauu

SEQ ID NO: 807991 - RNA, 19 nt, Homo sapiens
aaacaggugggcaaucauu

SEQ ID NO: 807992 - RNA, 19 nt, Homo sapiens
ugugcagccuugugguuua

SEQ ID NO: 807993 - RNA, 19 nt, Homo sapiens
ucaaagugcuggaauuuuc

SEQ ID NO: 807994 - RNA, 19 nt, Homo sapiens
ggaggaggaggaagaggaa

SEQ ID NO: 807995 - RNA, 19 nt, Homo sapiens
uuccugguguucaugauua

SEQ ID NO: 807996 - RNA, 19 nt, Homo sapiens
cagaagggcauugaaguga

SEQ ID NO: 807997 - RNA, 19 nt, Homo sapiens
gcagaggcgugcagaucca

SEQ ID NO: 807998 - RNA, 19 nt, Homo sapiens
uggcaaggauggaacaaca

SEQ ID NO: 807999 - RNA, 19 nt, Homo sapiens
aaacagucauggucuaaaa

SEQ ID NO: 808000 - RNA, 19 nt, Homo sapiens
gagacaauucuuugcaguu

SEQ ID NO: 808001 - RNA, 19 nt, Homo sapiens
aaagagccguucaccaucu

SEQ ID NO: 808002 - RNA, 19 nt, Homo sapiens
uaaaacaggugggcaauca

SEQ ID NO: 808003 - RNA, 19 nt, Homo sapiens
ccaugcagcacaucucgua

SEQ ID NO: 808004 - RNA, 19 nt, Homo sapiens
cauaaagcaacuguucaua

SEQ ID NO: 808005 - RNA, 19 nt, Homo sapiens
gggcaggagagcaaacaaa

SEQ ID NO: 808006 - RNA, 19 nt, Homo sapiens
gaagucaaagugcuggaau

SEQ ID NO: 808007 - RNA, 19 nt, Homo sapiens
acccgggacuggaauguaa

SEQ ID NO: 808008 - RNA, 19 nt, Homo sapiens
cguccucaauguagaauuc

SEQ ID NO: 808009 - RNA, 19 nt, Homo sapiens
gaccagguguuugaguuca

SEQ ID NO: 808010 - RNA, 19 nt, Homo sapiens
uggugaagaucagcauuaa

SEQ ID NO: 808011 - RNA, 19 nt, Homo sapiens
uuugaauacuguucuguga

SEQ ID NO: 808012 - RNA, 19 nt, Homo sapiens
gcaaacaaacagucauggu

SEQ ID NO: 808013 - RNA, 19 nt, Homo sapiens
ggacaaacagcaaauauuu

SEQ ID NO: 808014 - RNA, 19 nt, Homo sapiens
ggaagugccuagucaagua

SEQ ID NO: 808015 - RNA, 19 nt, Homo sapiens
caacaucccugcauugcua

SEQ ID NO: 808016 - RNA, 19 nt, Homo sapiens
gguguaggcucuccacuua

SEQ ID NO: 808017 - RNA, 19 nt, Homo sapiens
caagugagacuguuugaua

SEQ ID NO: 808018 - RNA, 19 nt, Homo sapiens
caaaugacuuguccacuga

SEQ ID NO: 808019 - RNA, 19 nt, Homo sapiens
gcugauguguccagaauuu

SEQ ID NO: 808020 - RNA, 19 nt, Homo sapiens
ccaaggagcuucgaaucua

SEQ ID NO: 808021 - RNA, 19 nt, Homo sapiens
ggacgggacugccaagaga

SEQ ID NO: 808022 - RNA, 19 nt, Homo sapiens
gaaguaaugcccacagaaa

SEQ ID NO: 808023 - RNA, 19 nt, Homo sapiens
gaaaaugugugguuacuga

SEQ ID NO: 808024 - RNA, 19 nt, Homo sapiens
gcaaauagccaaaucaaac

SEQ ID NO: 808025 - RNA, 19 nt, Homo sapiens
gcccuuaguuucacuguuu

SEQ ID NO: 808026 - RNA, 19 nt, Homo sapiens
caggauugcuccaggauuu

SEQ ID NO: 808027 - RNA, 19 nt, Homo sapiens
aagauugucuccagcuuua

SEQ ID NO: 808028 - RNA, 19 nt, Homo sapiens
gcacacagagcccaguuaa

SEQ ID NO: 808029 - RNA, 19 nt, Homo sapiens
caaggagcuucgaaucuaa

SEQ ID NO: 808030 - RNA, 19 nt, Homo sapiens
ccacugacaucccucaaga

SEQ ID NO: 808031 - RNA, 19 nt, Homo sapiens
gaaaucgacacucuuaaug

SEQ ID NO: 808032 - RNA, 19 nt, Homo sapiens
gaucaggagucacagacaa

SEQ ID NO: 808033 - RNA, 19 nt, Homo sapiens
acacagagcccaguuaauu

SEQ ID NO: 808034 - RNA, 19 nt, Homo sapiens
gcacggacucugccauuaa

SEQ ID NO: 808035 - RNA, 19 nt, Homo sapiens
guuauugggagucuuauua

SEQ ID NO: 808036 - RNA, 19 nt, Homo sapiens
gaagaauccuauguaaauc

SEQ ID NO: 808037 - RNA, 19 nt, Homo sapiens
uuacaguucugcaaaggua

SEQ ID NO: 808038 - RNA, 19 nt, Homo sapiens
caugaaauguacagagaaa

SEQ ID NO: 808039 - RNA, 19 nt, Homo sapiens
ugacugcacuguucugaga

SEQ ID NO: 808040 - RNA, 19 nt, Homo sapiens
ccugguaucuguacguuaa

SEQ ID NO: 808041 - RNA, 19 nt, Homo sapiens
guuuauagcuggaauacug

SEQ ID NO: 808042 - RNA, 19 nt, Homo sapiens
guggcuaaauuaagucaua

SEQ ID NO: 808043 - RNA, 19 nt, Homo sapiens
aaacuggacuccugcaugu

SEQ ID NO: 808044 - RNA, 19 nt, Homo sapiens
acgaugagcuagaaauuga

SEQ ID NO: 808045 - RNA, 19 nt, Homo sapiens
gcucaucaguuucuguaga

SEQ ID NO: 808046 - RNA, 19 nt, Homo sapiens
guucuugccuucuuggaaa

SEQ ID NO: 808047 - RNA, 19 nt, Homo sapiens
gagaucagacugcucauau

SEQ ID NO: 808048 - RNA, 19 nt, Homo sapiens
aaauguccauguuccauaa

SEQ ID NO: 808049 - RNA, 19 nt, Homo sapiens
cacgugaucucgucugaaa

SEQ ID NO: 808050 - RNA, 19 nt, Homo sapiens
gaaugacccugaaaugacu

SEQ ID NO: 808051 - RNA, 19 nt, Homo sapiens
agaaauguguggucguauu

SEQ ID NO: 808052 - RNA, 19 nt, Homo sapiens
gugcccagcuugcaugaaa

SEQ ID NO: 808053 - RNA, 19 nt, Homo sapiens
guacguaucugccuuugcu

SEQ ID NO: 808054 - RNA, 19 nt, Homo sapiens
gcaguacacuucuggaacu

SEQ ID NO: 808055 - RNA, 19 nt, Homo sapiens
ucugaagaauccuauguaa

SEQ ID NO: 808056 - RNA, 19 nt, Homo sapiens
gcacguguguguggcuaaa

SEQ ID NO: 808057 - RNA, 19 nt, Homo sapiens
ccucggaguuuaauuugaa

SEQ ID NO: 808058 - RNA, 19 nt, Homo sapiens
ggugaacaguagggcauua

SEQ ID NO: 808059 - RNA, 19 nt, Homo sapiens
agagaaauguguggucgua

SEQ ID NO: 808060 - RNA, 19 nt, Homo sapiens
aaucgacacucuuaaugaa

SEQ ID NO: 808061 - RNA, 19 nt, Homo sapiens
guacacuucuggaacuguu

SEQ ID NO: 808062 - RNA, 19 nt, Homo sapiens
gacacuaccuccuagaagu

SEQ ID NO: 808063 - RNA, 19 nt, Homo sapiens
acacaggaagguaauauuu

SEQ ID NO: 808064 - RNA, 19 nt, Homo sapiens
gagagacacaggaagguaa

SEQ ID NO: 808065 - RNA, 19 nt, Homo sapiens
gcaagauugucuccagcuu

SEQ ID NO: 808066 - RNA, 19 nt, Homo sapiens
cacaggaagguaauauuua

SEQ ID NO: 808067 - RNA, 19 nt, Homo sapiens
ccacagaaagcgcaaguug

SEQ ID NO: 808068 - RNA, 19 nt, Homo sapiens
agaauuacguagagaaauc

SEQ ID NO: 808069 - RNA, 19 nt, Homo sapiens
ggagcacuuugguuuauag

SEQ ID NO: 808070 - RNA, 19 nt, Homo sapiens
ccagccagcucucccagaa

SEQ ID NO: 808071 - RNA, 19 nt, Homo sapiens
gaugaugguuaggaacauu

SEQ ID NO: 808072 - RNA, 19 nt, Homo sapiens
ugagcgaacuugccugaug

SEQ ID NO: 808073 - RNA, 19 nt, Homo sapiens
cagcaaauauuucagucau

SEQ ID NO: 808074 - RNA, 19 nt, Homo sapiens
gcauuacauuugugugaau

SEQ ID NO: 808075 - RNA, 19 nt, Homo sapiens
uguccauguuccauaauua

SEQ ID NO: 808076 - RNA, 19 nt, Homo sapiens
cauaagagccaugcuguug

SEQ ID NO: 808077 - RNA, 19 nt, Homo sapiens
ccuggaggcucaccacuug

SEQ ID NO: 808078 - RNA, 19 nt, Homo sapiens
gaaauguacagagaaaugu

SEQ ID NO: 808079 - RNA, 19 nt, Homo sapiens
acagaaagcgcaaguuguu

SEQ ID NO: 808080 - RNA, 19 nt, Homo sapiens
cagaagcgcaaaucccaua

SEQ ID NO: 808081 - RNA, 19 nt, Homo sapiens
gggacaaacagcaaauauu

SEQ ID NO: 808082 - RNA, 19 nt, Homo sapiens
uaauguuucuugcugaguu

SEQ ID NO: 808083 - RNA, 19 nt, Homo sapiens
cgacagggccacaggagaa

SEQ ID NO: 808084 - RNA, 19 nt, Homo sapiens
gagacuguuugauauguca

SEQ ID NO: 808085 - RNA, 19 nt, Homo sapiens
ugucuuaggaugaugguua

SEQ ID NO: 808086 - RNA, 19 nt, Homo sapiens
ggagagacacaggaaggua

SEQ ID NO: 808087 - RNA, 19 nt, Homo sapiens
caugacaaccgacaaguga

SEQ ID NO: 808088 - RNA, 19 nt, Homo sapiens
ggagaucagacugcucaua

SEQ ID NO: 808089 - RNA, 19 nt, Homo sapiens
cacgugggcucaguaaauu

SEQ ID NO: 808090 - RNA, 19 nt, Homo sapiens
uagaaugacccugaaauga

SEQ ID NO: 808091 - RNA, 19 nt, Homo sapiens
ccacgugggcucaguaaau

SEQ ID NO: 808092 - RNA, 19 nt, Homo sapiens
gagcuucgaaucuaaguca

SEQ ID NO: 808093 - RNA, 19 nt, Homo sapiens
gaaggacaagcgauugaug

SEQ ID NO: 808094 - RNA, 19 nt, Homo sapiens
cgacugcucgccaaacaaa

SEQ ID NO: 808095 - RNA, 19 nt, Homo sapiens
caucuagaaugacccugaa

SEQ ID NO: 808096 - RNA, 19 nt, Homo sapiens
gagugagccugguguucuu

SEQ ID NO: 808097 - RNA, 19 nt, Homo sapiens
gacguguccugaaggugua

SEQ ID NO: 808098 - RNA, 19 nt, Homo sapiens
gcuggagcacuuugguuua

SEQ ID NO: 808099 - RNA, 19 nt, Homo sapiens
gggcauuacauuuguguga

SEQ ID NO: 808100 - RNA, 19 nt, Homo sapiens
ugaaauguacagagaaaug

SEQ ID NO: 808101 - RNA, 19 nt, Homo sapiens
caagauugucuccagcuuu

SEQ ID NO: 808102 - RNA, 19 nt, Homo sapiens
ggaccaaggcggagcaaag

SEQ ID NO: 808103 - RNA, 19 nt, Homo sapiens
gccauugguuggaacauca

SEQ ID NO: 808104 - RNA, 19 nt, Homo sapiens
gagaaaucgacacucuuaa

SEQ ID NO: 808105 - RNA, 19 nt, Homo sapiens
gcaaaucccauagccuuuc

SEQ ID NO: 808106 - RNA, 19 nt, Homo sapiens
uggaguaacuguacguauc

SEQ ID NO: 808107 - RNA, 19 nt, Homo sapiens
cuugugaguuguugacauu

SEQ ID NO: 808108 - RNA, 19 nt, Homo sapiens
acagggaagugccuaguca

SEQ ID NO: 808109 - RNA, 19 nt, Homo sapiens
aguguugacugucuucauu

SEQ ID NO: 808110 - RNA, 19 nt, Homo sapiens
ucacuugaccuugauaaga

SEQ ID NO: 808111 - RNA, 19 nt, Homo sapiens
agcaugggauguuggauuu

SEQ ID NO: 808112 - RNA, 19 nt, Homo sapiens
gaacaguagggcauuacau

SEQ ID NO: 808113 - RNA, 19 nt, Homo sapiens
gagaagaaguuaaagcaua

SEQ ID NO: 808114 - RNA, 19 nt, Homo sapiens
gcaaagacaucaccaugaa

SEQ ID NO: 808115 - RNA, 19 nt, Homo sapiens
ggaaugaacugaagaagca

SEQ ID NO: 808116 - RNA, 19 nt, Homo sapiens
uaaagaaggugccugaaga

SEQ ID NO: 808117 - RNA, 19 nt, Homo sapiens
gcgcagaccucuuccacua

SEQ ID NO: 808118 - RNA, 19 nt, Homo sapiens
gcgcuaaaguggauaauga

SEQ ID NO: 808119 - RNA, 19 nt, Homo sapiens
gcacacagcuggcuaugag

SEQ ID NO: 808120 - RNA, 19 nt, Homo sapiens
gaaagugugcgugauguua

SEQ ID NO: 808121 - RNA, 19 nt, Homo sapiens
gaaggugccugaagaaguc

SEQ ID NO: 808122 - RNA, 19 nt, Homo sapiens
aaacaucuguccuaacuug

SEQ ID NO: 808123 - RNA, 19 nt, Homo sapiens
gaagaggaaugaacugaag

SEQ ID NO: 808124 - RNA, 19 nt, Homo sapiens
ggagagauguggcuaugga

SEQ ID NO: 808125 - RNA, 19 nt, Homo sapiens
gaagaguggcugcuuauga

SEQ ID NO: 808126 - RNA, 19 nt, Homo sapiens
gaggaaggaugaagaagug

SEQ ID NO: 808127 - RNA, 19 nt, Homo sapiens
gagagucgcugggaacauu

SEQ ID NO: 808128 - RNA, 19 nt, Homo sapiens
gcaguaagcccaucaagau

SEQ ID NO: 808129 - RNA, 19 nt, Homo sapiens
ggaccaggauucaugaaau

SEQ ID NO: 808130 - RNA, 19 nt, Homo sapiens
ucacuuuccugacccuuua

SEQ ID NO: 808131 - RNA, 19 nt, Homo sapiens
gaucuacccuuaugaacug

SEQ ID NO: 808132 - RNA, 19 nt, Homo sapiens
cgacuaccaugcccaguuu

SEQ ID NO: 808133 - RNA, 19 nt, Homo sapiens
caccagagcuccaacugaa

SEQ ID NO: 808134 - RNA, 19 nt, Homo sapiens
gaaaccgacugcccaagga

SEQ ID NO: 808135 - RNA, 19 nt, Homo sapiens
gaggagaggaggaugauuu

SEQ ID NO: 808136 - RNA, 19 nt, Homo sapiens
gaagaacggaagauuuaaa

SEQ ID NO: 808137 - RNA, 19 nt, Homo sapiens
cauggaaguugccuuauug

SEQ ID NO: 808138 - RNA, 19 nt, Homo sapiens
gccgagaggugaugaguga

SEQ ID NO: 808139 - RNA, 19 nt, Homo sapiens
ggaaguugccuuauuguca

SEQ ID NO: 808140 - RNA, 19 nt, Homo sapiens
gaacugacuuaaauugaac

SEQ ID NO: 808141 - RNA, 19 nt, Homo sapiens
guccaacucucuuuccuaa

SEQ ID NO: 808142 - RNA, 19 nt, Homo sapiens
ucgaagaacggaagauuua

SEQ ID NO: 808143 - RNA, 19 nt, Homo sapiens
gauugcagcuuguauucuu

SEQ ID NO: 808144 - RNA, 19 nt, Homo sapiens
ugaaacaucuguccuaacu

SEQ ID NO: 808145 - RNA, 19 nt, Homo sapiens
gggcagagaagaaguuaaa

SEQ ID NO: 808146 - RNA, 19 nt, Homo sapiens
gaaagguucuuggucuaug

SEQ ID NO: 808147 - RNA, 19 nt, Homo sapiens
gaagaguucuaccaagucu

SEQ ID NO: 808148 - RNA, 19 nt, Homo sapiens
gauugcaucugaggaaauu

SEQ ID NO: 808149 - RNA, 19 nt, Homo sapiens
gagaaggaaugagaaagug

SEQ ID NO: 808150 - RNA, 19 nt, Homo sapiens
aguacaagaucuacccuua

SEQ ID NO: 808151 - RNA, 19 nt, Homo sapiens
uaaaguggauaaugagauc

SEQ ID NO: 808152 - RNA, 19 nt, Homo sapiens
ucaagaggcuggcgaugug

SEQ ID NO: 808153 - RNA, 19 nt, Homo sapiens
gaacaggggagaaagcuua

SEQ ID NO: 808154 - RNA, 19 nt, Homo sapiens
gaaaauaggccgugucuca

SEQ ID NO: 808155 - RNA, 19 nt, Homo sapiens
auaauccucucuugucuaa

SEQ ID NO: 808156 - RNA, 19 nt, Homo sapiens
gaaagacccagugcaaaga

SEQ ID NO: 808157 - RNA, 19 nt, Homo sapiens
gaagucugcuguguucuca

SEQ ID NO: 808158 - RNA, 19 nt, Homo sapiens
gauguaaggcagaaaguga

SEQ ID NO: 808159 - RNA, 19 nt, Homo sapiens
guagaacugacuuaaauug

SEQ ID NO: 808160 - RNA, 19 nt, Homo sapiens
acacuagcauuccuuauca

SEQ ID NO: 808161 - RNA, 19 nt, Homo sapiens
gaucggagaaggaaugaga

SEQ ID NO: 808162 - RNA, 19 nt, Homo sapiens
gaaggaugaagaagugaaa

SEQ ID NO: 808163 - RNA, 19 nt, Homo sapiens
gcaugaccaucucugaguu

SEQ ID NO: 808164 - RNA, 19 nt, Homo sapiens
uacaagaucuacccuuaug

SEQ ID NO: 808165 - RNA, 19 nt, Homo sapiens
gaacuuggcgagauugaag

SEQ ID NO: 808166 - RNA, 19 nt, Homo sapiens
ucauggaaguugccuuauu

SEQ ID NO: 808167 - RNA, 19 nt, Homo sapiens
caggaaggaucuuuguaga

SEQ ID NO: 808168 - RNA, 19 nt, Homo sapiens
gagaaagugugcgugaugu

SEQ ID NO: 808169 - RNA, 19 nt, Homo sapiens
gaaagugaucggagaagga

SEQ ID NO: 808170 - RNA, 19 nt, Homo sapiens
gcagggcaaccauaccaua

SEQ ID NO: 808171 - RNA, 19 nt, Homo sapiens
cuucugcccuggauuguaa

SEQ ID NO: 808172 - RNA, 19 nt, Homo sapiens
ccucaaaucuagucauuac

SEQ ID NO: 808173 - RNA, 19 nt, Homo sapiens
uuaagaacuuggcgagauu

SEQ ID NO: 808174 - RNA, 19 nt, Homo sapiens
gccaaugucuuuucacuuu

SEQ ID NO: 808175 - RNA, 19 nt, Homo sapiens
ggagaaggaaugagaaagu

SEQ ID NO: 808176 - RNA, 19 nt, Homo sapiens
caagaucuacccuuaugaa

SEQ ID NO: 808177 - RNA, 19 nt, Homo sapiens
gcaaggaggagaucaagca

SEQ ID NO: 808178 - RNA, 19 nt, Homo sapiens
gcagaauccuuacaaucca

SEQ ID NO: 808179 - RNA, 19 nt, Homo sapiens
guuaagaacuuggcgagau

SEQ ID NO: 808180 - RNA, 19 nt, Homo sapiens
gagcaccucugauguugag

SEQ ID NO: 808181 - RNA, 19 nt, Homo sapiens
acagacaacucucaucauc

SEQ ID NO: 808182 - RNA, 19 nt, Homo sapiens
gggaguauaucagcaagga

SEQ ID NO: 808183 - RNA, 19 nt, Homo sapiens
ggaagaggaaugaacugaa

SEQ ID NO: 808184 - RNA, 19 nt, Homo sapiens
agaagaaguuaaagcauag

SEQ ID NO: 808185 - RNA, 19 nt, Homo sapiens
uauugucacugguuaagaa

SEQ ID NO: 808186 - RNA, 19 nt, Homo sapiens
ucacugagcaccucugaug

SEQ ID NO: 808187 - RNA, 19 nt, Homo sapiens
ccaaugucauccagugcua

SEQ ID NO: 808188 - RNA, 19 nt, Homo sapiens
uaacggauguaaggcagaa

SEQ ID NO: 808189 - RNA, 19 nt, Homo sapiens
cguaaggcauguacccaaa

SEQ ID NO: 808190 - RNA, 19 nt, Homo sapiens
ggacucggucucagggaua

SEQ ID NO: 808191 - RNA, 19 nt, Homo sapiens
caaauguagaacugacuua

SEQ ID NO: 808192 - RNA, 19 nt, Homo sapiens
uguaaaaucucucuacuga

SEQ ID NO: 808193 - RNA, 19 nt, Homo sapiens
gaacugcugcuggugacua

SEQ ID NO: 808194 - RNA, 19 nt, Homo sapiens
ugacagugauccucucauc

SEQ ID NO: 808195 - RNA, 19 nt, Homo sapiens
ggacuaccagcaacucuau

SEQ ID NO: 808196 - RNA, 19 nt, Homo sapiens
aaucauggaaguugccuua

SEQ ID NO: 808197 - RNA, 19 nt, Homo sapiens
gcugaauacugagcacuga

SEQ ID NO: 808198 - RNA, 19 nt, Homo sapiens
aauccucucuugucuaaug

SEQ ID NO: 808199 - RNA, 19 nt, Homo sapiens
caaguacagucccaucuac

SEQ ID NO: 808200 - RNA, 19 nt, Homo sapiens
caucugcgcuaaaguggau

SEQ ID NO: 808201 - RNA, 19 nt, Homo sapiens
caacaaccacuuccacauc

SEQ ID NO: 808202 - RNA, 19 nt, Homo sapiens
gcuguguucucauguagga

SEQ ID NO: 808203 - RNA, 19 nt, Homo sapiens
gcagaaagugaucggagaa

SEQ ID NO: 808204 - RNA, 19 nt, Homo sapiens
gggauaugccuaccaauag

SEQ ID NO: 808205 - RNA, 19 nt, Homo sapiens
ucagggauaugccuaccaa

SEQ ID NO: 808206 - RNA, 19 nt, Homo sapiens
cuuguauucuuuagccuua

SEQ ID NO: 808207 - RNA, 19 nt, Homo sapiens
cuacugaagcucgguauaa

SEQ ID NO: 808208 - RNA, 19 nt, Homo sapiens
uaaaaucucucuacugaag

SEQ ID NO: 808209 - RNA, 19 nt, Homo sapiens
gggccuccguauugaauga

SEQ ID NO: 808210 - RNA, 19 nt, Homo sapiens
ggaggaaggaugaagaagu

SEQ ID NO: 808211 - RNA, 19 nt, Homo sapiens
cugcaaaguuggccauguu

SEQ ID NO: 808212 - RNA, 19 nt, Homo sapiens
caacacaccgcagggcuaa

SEQ ID NO: 808213 - RNA, 19 nt, Homo sapiens
aaagaaagcugucgaauug

SEQ ID NO: 808214 - RNA, 19 nt, Homo sapiens
ggaauggaguguauuauuu

SEQ ID NO: 808215 - RNA, 19 nt, Homo sapiens
gaacugauaugcaugaaug

SEQ ID NO: 808216 - RNA, 19 nt, Homo sapiens
gaacaucccuucugaaucu

SEQ ID NO: 808217 - RNA, 19 nt, Homo sapiens
gauccaaaguuuaguauga

SEQ ID NO: 808218 - RNA, 19 nt, Homo sapiens
gaucuuuguucuucucuua

SEQ ID NO: 808219 - RNA, 19 nt, Homo sapiens
gugauaacuucccauauua

SEQ ID NO: 808220 - RNA, 19 nt, Homo sapiens
guaggaaacugaaaggaaa

SEQ ID NO: 808221 - RNA, 19 nt, Homo sapiens
ugaaagcacagaacuauua

SEQ ID NO: 808222 - RNA, 19 nt, Homo sapiens
gcuaaucacuuuaccaaug

SEQ ID NO: 808223 - RNA, 19 nt, Homo sapiens
ggaaaccuccauacaguua

SEQ ID NO: 808224 - RNA, 19 nt, Homo sapiens
gcauauaucucuugaguac

SEQ ID NO: 808225 - RNA, 19 nt, Homo sapiens
gguaagggcuggugagguu

SEQ ID NO: 808226 - RNA, 19 nt, Homo sapiens
gaccuagucugccuucuuu

SEQ ID NO: 808227 - RNA, 19 nt, Homo sapiens
ggagaaaugugucugaaag

SEQ ID NO: 808228 - RNA, 19 nt, Homo sapiens
caaacuugcuaaucacuuu

SEQ ID NO: 808229 - RNA, 19 nt, Homo sapiens
gcaagacaguaccuuuaaa

SEQ ID NO: 808230 - RNA, 19 nt, Homo sapiens
gcuccuaacuguuguguga

SEQ ID NO: 808231 - RNA, 19 nt, Homo sapiens
gaagagggcacgaucugua

SEQ ID NO: 808232 - RNA, 19 nt, Homo sapiens
gaagcgaauuucccauuug

SEQ ID NO: 808233 - RNA, 19 nt, Homo sapiens
guagcaaugugcacuuuaa

SEQ ID NO: 808234 - RNA, 19 nt, Homo sapiens
caacaagguuugaugaaca

SEQ ID NO: 808235 - RNA, 19 nt, Homo sapiens
gaacggcaaccauuauuug

SEQ ID NO: 808236 - RNA, 19 nt, Homo sapiens
gauacaaccugcucucugu

SEQ ID NO: 808237 - RNA, 19 nt, Homo sapiens
guacaaccuuccagaaaga

SEQ ID NO: 808238 - RNA, 19 nt, Homo sapiens
gaaauaagaaccuacagau

SEQ ID NO: 808239 - RNA, 19 nt, Homo sapiens
ugugagagauccaaaguuu

SEQ ID NO: 808240 - RNA, 19 nt, Homo sapiens
aaacuggccuuauacauuc

SEQ ID NO: 808241 - RNA, 19 nt, Homo sapiens
gcacauggaacaggaauuu

SEQ ID NO: 808242 - RNA, 19 nt, Homo sapiens
gguaagaaauugggcauug

SEQ ID NO: 808243 - RNA, 19 nt, Homo sapiens
caaacuggccuuauacauu

SEQ ID NO: 808244 - RNA, 19 nt, Homo sapiens
gaacgggccucaacuccau

SEQ ID NO: 808245 - RNA, 19 nt, Homo sapiens
cggcaaccauuauuuguaa

SEQ ID NO: 808246 - RNA, 19 nt, Homo sapiens
ggacugauuaucuuaguuu

SEQ ID NO: 808247 - RNA, 19 nt, Homo sapiens
ugugauaacuucccauauu

SEQ ID NO: 808248 - RNA, 19 nt, Homo sapiens
gaauagauuucucugucuu

SEQ ID NO: 808249 - RNA, 19 nt, Homo sapiens
gggcauugcuuggcucuuu

SEQ ID NO: 808250 - RNA, 19 nt, Homo sapiens
gauaagacacucagagaga

SEQ ID NO: 808251 - RNA, 19 nt, Homo sapiens
augaagaacugaccaaauu

SEQ ID NO: 808252 - RNA, 19 nt, Homo sapiens
gaaauguggguaaugaauu

SEQ ID NO: 808253 - RNA, 19 nt, Homo sapiens
gacaagccauccagaauca

SEQ ID NO: 808254 - RNA, 19 nt, Homo sapiens
ggaagugugcauaguuaua

SEQ ID NO: 808255 - RNA, 19 nt, Homo sapiens
gggaaagguuuaagagaau

SEQ ID NO: 808256 - RNA, 19 nt, Homo sapiens
cgaauugccagcaguguua

SEQ ID NO: 808257 - RNA, 19 nt, Homo sapiens
aggaagagcuuuauguuuc

SEQ ID NO: 808258 - RNA, 19 nt, Homo sapiens
caucagugcuuccacauuc

SEQ ID NO: 808259 - RNA, 19 nt, Homo sapiens
uacacaaacuggccuuaua

SEQ ID NO: 808260 - RNA, 19 nt, Homo sapiens
guucuucucuuaaucaguu

SEQ ID NO: 808261 - RNA, 19 nt, Homo sapiens
ggaagugccucuccaacuc

SEQ ID NO: 808262 - RNA, 19 nt, Homo sapiens
uagcauagauucagauucu

SEQ ID NO: 808263 - RNA, 19 nt, Homo sapiens
gcucagauguccuuugaag

SEQ ID NO: 808264 - RNA, 19 nt, Homo sapiens
gauuugcagugaugaauau

SEQ ID NO: 808265 - RNA, 19 nt, Homo sapiens
caaggaaaccagaauuuga

SEQ ID NO: 808266 - RNA, 19 nt, Homo sapiens
cuggauaacuuacugcuuu

SEQ ID NO: 808267 - RNA, 19 nt, Homo sapiens
gaagcaagacaguaccuuu

SEQ ID NO: 808268 - RNA, 19 nt, Homo sapiens
cagcauauaucucuugagu

SEQ ID NO: 808269 - RNA, 19 nt, Homo sapiens
gaaccacugaugaugauuu

SEQ ID NO: 808270 - RNA, 19 nt, Homo sapiens
caucagacguuaacacauc

SEQ ID NO: 808271 - RNA, 19 nt, Homo sapiens
uaacgucuauggacugguu

SEQ ID NO: 808272 - RNA, 19 nt, Homo sapiens
aauaagaaccuacagauga

SEQ ID NO: 808273 - RNA, 19 nt, Homo sapiens
gaauggccauggaggcaaa

SEQ ID NO: 808274 - RNA, 19 nt, Homo sapiens
caucuagguugucuugaaa

SEQ ID NO: 808275 - RNA, 19 nt, Homo sapiens
ugaagcgaauuucccauuu

SEQ ID NO: 808276 - RNA, 19 nt, Homo sapiens
uaucagccaugcuaaauca

SEQ ID NO: 808277 - RNA, 19 nt, Homo sapiens
gcaagacaccagacccuaa

SEQ ID NO: 808278 - RNA, 19 nt, Homo sapiens
gcacucagcacuccaggaa

SEQ ID NO: 808279 - RNA, 19 nt, Homo sapiens
gcacaaagaugggaaaccu

SEQ ID NO: 808280 - RNA, 19 nt, Homo sapiens
gcuauugcacgauuucaua

SEQ ID NO: 808281 - RNA, 19 nt, Homo sapiens
aguaauaacugcucacuag

SEQ ID NO: 808282 - RNA, 19 nt, Homo sapiens
uuagaaauguggguaauga

SEQ ID NO: 808283 - RNA, 19 nt, Homo sapiens
cuauguagcuccuaacugu

SEQ ID NO: 808284 - RNA, 19 nt, Homo sapiens
gaacaggaaauuuguacau

SEQ ID NO: 808285 - RNA, 19 nt, Homo sapiens
gcaguagccuuaacaacag

SEQ ID NO: 808286 - RNA, 19 nt, Homo sapiens
guauaacacugaucaggau

SEQ ID NO: 808287 - RNA, 19 nt, Homo sapiens
gggcuuaaauugacugaag

SEQ ID NO: 808288 - RNA, 19 nt, Homo sapiens
uaaauugugugaagcgaau

SEQ ID NO: 808289 - RNA, 19 nt, Homo sapiens
gugauucugugguugagua

SEQ ID NO: 808290 - RNA, 19 nt, Homo sapiens
caggaaauuuguacauaga

SEQ ID NO: 808291 - RNA, 19 nt, Homo sapiens
uaagaagaaugcacuccuu

SEQ ID NO: 808292 - RNA, 19 nt, Homo sapiens
gagagcagccuaacgucua

SEQ ID NO: 808293 - RNA, 19 nt, Homo sapiens
gaacuggagagcagccuaa

SEQ ID NO: 808294 - RNA, 19 nt, Homo sapiens
gguaguugcuaaugcagaa

SEQ ID NO: 808295 - RNA, 19 nt, Homo sapiens
gcaaugugcacuuuaaaca

SEQ ID NO: 808296 - RNA, 19 nt, Homo sapiens
ggaagagcuuuauguuucu

SEQ ID NO: 808297 - RNA, 19 nt, Homo sapiens
gaguauuuaugucugcuuu

SEQ ID NO: 808298 - RNA, 19 nt, Homo sapiens
gcauauuugugucaguuug

SEQ ID NO: 808299 - RNA, 19 nt, Homo sapiens
gcauagauucagauucuuu

SEQ ID NO: 808300 - RNA, 19 nt, Homo sapiens
cauaaucugucauugaaca

SEQ ID NO: 808301 - RNA, 19 nt, Homo sapiens
ggaacaggaauuucuaaga

SEQ ID NO: 808302 - RNA, 19 nt, Homo sapiens
gauggagucuugcccuguu

SEQ ID NO: 808303 - RNA, 19 nt, Homo sapiens
caaagcagccuguccaaca

SEQ ID NO: 808304 - RNA, 19 nt, Homo sapiens
gggaauggaguguauuauu

SEQ ID NO: 808305 - RNA, 19 nt, Homo sapiens
uaaagugccucgaucuaag

SEQ ID NO: 808306 - RNA, 19 nt, Homo sapiens
uagcaucucuggucuuauc

SEQ ID NO: 808307 - RNA, 19 nt, Homo sapiens
gaaagcacagaacuauuau

SEQ ID NO: 808308 - RNA, 19 nt, Homo sapiens
uaccuucugugaaugcuua

SEQ ID NO: 808309 - RNA, 19 nt, Homo sapiens
gcagugaagggaaagguuu

SEQ ID NO: 808310 - RNA, 19 nt, Homo sapiens
guagaaccacugaugauga

SEQ ID NO: 808311 - RNA, 19 nt, Homo sapiens
caacuugcgccucuuagaa

SEQ ID NO: 808312 - RNA, 19 nt, Homo sapiens
ggauagagccacuuacagu

SEQ ID NO: 808313 - RNA, 19 nt, Homo sapiens
ccacaaagaugguaauaaa

SEQ ID NO: 808314 - RNA, 19 nt, Homo sapiens
ucacaaagcuuggaaauug

SEQ ID NO: 808315 - RNA, 19 nt, Homo sapiens
gaacgucacuggccuggaa

SEQ ID NO: 808316 - RNA, 19 nt, Homo sapiens
ccacaaagauggcuucaga

SEQ ID NO: 808317 - RNA, 19 nt, Homo sapiens
ggacagaguauuucauuaa

SEQ ID NO: 808318 - RNA, 19 nt, Homo sapiens
gacaguaacuuugguguaa

SEQ ID NO: 808319 - RNA, 19 nt, Homo sapiens
gcacauuccuuuccuuuag

SEQ ID NO: 808320 - RNA, 19 nt, Homo sapiens
gggcaguggugcaaucaua

SEQ ID NO: 808321 - RNA, 19 nt, Homo sapiens
ggaaggaacagccuaaaga

SEQ ID NO: 808322 - RNA, 19 nt, Homo sapiens
ucacuggccuggaaaugua

SEQ ID NO: 808323 - RNA, 19 nt, Homo sapiens
ucacuacccuugccagaaa

SEQ ID NO: 808324 - RNA, 19 nt, Homo sapiens
gagcagaagcugucacaaa

SEQ ID NO: 808325 - RNA, 19 nt, Homo sapiens
guacacaucugccucaucu

SEQ ID NO: 808326 - RNA, 19 nt, Homo sapiens
ucagagagguggucacaug

SEQ ID NO: 808327 - RNA, 19 nt, Homo sapiens
cacaagcccuuuggucuua

SEQ ID NO: 808328 - RNA, 19 nt, Homo sapiens
guggaaaucuguaggauca

SEQ ID NO: 808329 - RNA, 19 nt, Homo sapiens
gaaaggacacaaacuggaa

SEQ ID NO: 808330 - RNA, 19 nt, Homo sapiens
gagcccagccugacacaua

SEQ ID NO: 808331 - RNA, 19 nt, Homo sapiens
agaauucacugcaacaaga

SEQ ID NO: 808332 - RNA, 19 nt, Homo sapiens
ccagguagcaggaacuaua

SEQ ID NO: 808333 - RNA, 19 nt, Homo sapiens
aaagagaagucaugguuuc

SEQ ID NO: 808334 - RNA, 19 nt, Homo sapiens
gugcucagcuggcuucaga

SEQ ID NO: 808335 - RNA, 19 nt, Homo sapiens
gaccaagaauucacugcaa

SEQ ID NO: 808336 - RNA, 19 nt, Homo sapiens
caagguggguggaucacuu

SEQ ID NO: 808337 - RNA, 19 nt, Homo sapiens
uagaaaaucucaucucuga

SEQ ID NO: 808338 - RNA, 19 nt, Homo sapiens
gaaggaacagccuaaagau

SEQ ID NO: 808339 - RNA, 19 nt, Homo sapiens
uuuauaggcugcauccuuu

SEQ ID NO: 808340 - RNA, 19 nt, Homo sapiens
caggagcucuggaauaaag

SEQ ID NO: 808341 - RNA, 19 nt, Homo sapiens
ucuccagaaucuugucuua

SEQ ID NO: 808342 - RNA, 19 nt, Homo sapiens
gaagauagagcaggcugaa

SEQ ID NO: 808343 - RNA, 19 nt, Homo sapiens
gaagcuggccgagaucauu

SEQ ID NO: 808344 - RNA, 19 nt, Homo sapiens
caaagagaagucaugguuu

SEQ ID NO: 808345 - RNA, 19 nt, Homo sapiens
gaaugugccuccugcaaaa

SEQ ID NO: 808346 - RNA, 19 nt, Homo sapiens
acaguuucauuucccuuua

SEQ ID NO: 808347 - RNA, 19 nt, Homo sapiens
gacagaguauuucauuaag

SEQ ID NO: 808348 - RNA, 19 nt, Homo sapiens
cugaagaucucacaaagag

SEQ ID NO: 808349 - RNA, 19 nt, Homo sapiens
gagagguggucacaugcuu

SEQ ID NO: 808350 - RNA, 19 nt, Homo sapiens
ggagagcacagacggcauu

SEQ ID NO: 808351 - RNA, 19 nt, Homo sapiens
acaaagagaagucaugguu

SEQ ID NO: 808352 - RNA, 19 nt, Homo sapiens
caagacugcucugguggaa

SEQ ID NO: 808353 - RNA, 19 nt, Homo sapiens
caccaugcccagcuaauuu

SEQ ID NO: 808354 - RNA, 19 nt, Homo sapiens
ggcaaagucuuacugaaaa

SEQ ID NO: 808355 - RNA, 19 nt, Homo sapiens
aaaugaaagccaccaauga

SEQ ID NO: 808356 - RNA, 19 nt, Homo sapiens
ggaugugccugaggaguuc

SEQ ID NO: 808357 - RNA, 19 nt, Homo sapiens
cgaaugugccuccugcaaa

SEQ ID NO: 808358 - RNA, 19 nt, Homo sapiens
caagagggagcaacacuuc

SEQ ID NO: 808359 - RNA, 19 nt, Homo sapiens
ccacugggcucuguuucug

SEQ ID NO: 808360 - RNA, 19 nt, Homo sapiens
ccuauuaucccagcacuuu

SEQ ID NO: 808361 - RNA, 19 nt, Homo sapiens
cuccugggcucaagcgaua

SEQ ID NO: 808362 - RNA, 19 nt, Homo sapiens
guccacacccaauacuuua

SEQ ID NO: 808363 - RNA, 19 nt, Homo sapiens
gauauccucucagccacaa

SEQ ID NO: 808364 - RNA, 19 nt, Homo sapiens
guguaaaugcuuccuguuu

SEQ ID NO: 808365 - RNA, 19 nt, Homo sapiens
gaucccuucuuccauuguu

SEQ ID NO: 808366 - RNA, 19 nt, Homo sapiens
ccacaguucagaccaagaa

SEQ ID NO: 808367 - RNA, 19 nt, Homo sapiens
gcaccacugggcucuguuu

SEQ ID NO: 808368 - RNA, 19 nt, Homo sapiens
ggaaaucuguaggaucaac

SEQ ID NO: 808369 - RNA, 19 nt, Homo sapiens
caguuucauuucccuuuaa

SEQ ID NO: 808370 - RNA, 19 nt, Homo sapiens
ugaugcagccuucacauga

SEQ ID NO: 808371 - RNA, 19 nt, Homo sapiens
ggugcaaucauaacucauu

SEQ ID NO: 808372 - RNA, 19 nt, Homo sapiens
ccgacucgcagccuuaaua

SEQ ID NO: 808373 - RNA, 19 nt, Homo sapiens
gcccagaucucaggagucu

SEQ ID NO: 808374 - RNA, 19 nt, Homo sapiens
gcagugaucccuucuucca

SEQ ID NO: 808375 - RNA, 19 nt, Homo sapiens
ggaucuguaucacccaugu

SEQ ID NO: 808376 - RNA, 19 nt, Homo sapiens
caggacagaguauuucauu

SEQ ID NO: 808377 - RNA, 19 nt, Homo sapiens
uuaauaaagcgaugguuga

SEQ ID NO: 808378 - RNA, 19 nt, Homo sapiens
cgacucgcagccuuaauaa

SEQ ID NO: 808379 - RNA, 19 nt, Homo sapiens
ccacaagcccuuuggucuu

SEQ ID NO: 808380 - RNA, 19 nt, Homo sapiens
agugaucccuucuuccauu

SEQ ID NO: 808381 - RNA, 19 nt, Homo sapiens
ggcgguaucccuuguauca

SEQ ID NO: 808382 - RNA, 19 nt, Homo sapiens
gaccccaucucuacuaaaa

SEQ ID NO: 808383 - RNA, 19 nt, Homo sapiens
acaaagauggcuucagaga

SEQ ID NO: 808384 - RNA, 19 nt, Homo sapiens
agcccaacauuuagcuuua

SEQ ID NO: 808385 - RNA, 19 nt, Homo sapiens
ucagcuggcuucagaaacu

SEQ ID NO: 808386 - RNA, 19 nt, Homo sapiens
gcucagcuggcuucagaaa

SEQ ID NO: 808387 - RNA, 19 nt, Homo sapiens
caguaacuuugguguaaau

SEQ ID NO: 808388 - RNA, 19 nt, Homo sapiens
ucuguaggaucaacauaga

SEQ ID NO: 808389 - RNA, 19 nt, Homo sapiens
aggacagaguauuucauua

SEQ ID NO: 808390 - RNA, 19 nt, Homo sapiens
gacacaaacuggaauuuuc

SEQ ID NO: 808391 - RNA, 19 nt, Homo sapiens
uaacuuugguguaaaugcu

SEQ ID NO: 808392 - RNA, 19 nt, Homo sapiens
aggcaaagucuuacugaaa

SEQ ID NO: 808393 - RNA, 19 nt, Homo sapiens
guggugcaaucauaacuca

SEQ ID NO: 808394 - RNA, 19 nt, Homo sapiens
gaaaaucucaucucugaag

SEQ ID NO: 808395 - RNA, 19 nt, Homo sapiens
ggaacagccuaaagaugcu

SEQ ID NO: 808396 - RNA, 19 nt, Homo sapiens
caacauuuagcuuuaugga

SEQ ID NO: 808397 - RNA, 19 nt, Homo sapiens
gcccaacauuuagcuuuau

SEQ ID NO: 808398 - RNA, 19 nt, Homo sapiens
guaggcaaagucuuacuga

SEQ ID NO: 808399 - RNA, 19 nt, Homo sapiens
cuugguaggcaaagucuua

SEQ ID NO: 808400 - RNA, 19 nt, Homo sapiens
agcagaagcugucacaaag

SEQ ID NO: 808401 - RNA, 19 nt, Homo sapiens
ccuuuggucuuacccacua

SEQ ID NO: 808402 - RNA, 19 nt, Homo sapiens
ugcagaagcuggccgagau

SEQ ID NO: 808403 - RNA, 19 nt, Homo sapiens
agcagagugucuuggaaua

SEQ ID NO: 808404 - RNA, 19 nt, Homo sapiens
gacaguuucauuucccuuu

SEQ ID NO: 808405 - RNA, 19 nt, Homo sapiens
gcauguagcaaaagcauuu

SEQ ID NO: 808406 - RNA, 19 nt, Homo sapiens
gaugcagccuucacaugag

SEQ ID NO: 808407 - RNA, 19 nt, Homo sapiens
ggacacaaacuggaauuuu

SEQ ID NO: 808408 - RNA, 19 nt, Homo sapiens
ugacgucugcuguggguuu

SEQ ID NO: 808409 - RNA, 19 nt, Homo sapiens
uucaucaccucacgguaua

SEQ ID NO: 808410 - RNA, 19 nt, Homo sapiens
gaaguguaaccgcagugaa

SEQ ID NO: 808411 - RNA, 19 nt, Homo sapiens
gagguggucacaugcuuug

SEQ ID NO: 808412 - RNA, 19 nt, Homo sapiens
ggcacauuccuuuccuuua

SEQ ID NO: 808413 - RNA, 19 nt, Homo sapiens
aaacagagccuuacuauuu

SEQ ID NO: 808414 - RNA, 19 nt, Homo sapiens
gaaaucccaucucuacuaa

SEQ ID NO: 808415 - RNA, 19 nt, Homo sapiens
ggucagaacucaucacaga

SEQ ID NO: 808416 - RNA, 19 nt, Homo sapiens
gaaaugugcuuguccaaca

SEQ ID NO: 808417 - RNA, 19 nt, Homo sapiens
ggugguagcugaaguagaa

SEQ ID NO: 808418 - RNA, 19 nt, Homo sapiens
gccaccagcuguuucauua

SEQ ID NO: 808419 - RNA, 19 nt, Homo sapiens
ccaagaagcuuugugagaa

SEQ ID NO: 808420 - RNA, 19 nt, Homo sapiens
gcaaaggccuaacuagcaa

SEQ ID NO: 808421 - RNA, 19 nt, Homo sapiens
cagaggagcuaccagauga

SEQ ID NO: 808422 - RNA, 19 nt, Homo sapiens
acacaacccucugcuauaa

SEQ ID NO: 808423 - RNA, 19 nt, Homo sapiens
uaauacugcuguaccuuua

SEQ ID NO: 808424 - RNA, 19 nt, Homo sapiens
gaaauacaguggucucucu

SEQ ID NO: 808425 - RNA, 19 nt, Homo sapiens
uagcaucagugaauaguaa

SEQ ID NO: 808426 - RNA, 19 nt, Homo sapiens
gcaagacuccaucucauaa

SEQ ID NO: 808427 - RNA, 19 nt, Homo sapiens
ggaaccaucuggaccuuug

SEQ ID NO: 808428 - RNA, 19 nt, Homo sapiens
gaucguccauuauaucuuc

SEQ ID NO: 808429 - RNA, 19 nt, Homo sapiens
aacagagccuuacuauuua

SEQ ID NO: 808430 - RNA, 19 nt, Homo sapiens
ccacagggcuggaguuugg

SEQ ID NO: 808431 - RNA, 19 nt, Homo sapiens
ggucaguaauggucaguuu

SEQ ID NO: 808432 - RNA, 19 nt, Homo sapiens
gacgagaucagccgacuua

SEQ ID NO: 808433 - RNA, 19 nt, Homo sapiens
gagacucacuugcuaacuu

SEQ ID NO: 808434 - RNA, 19 nt, Homo sapiens
gcugaauacucuagauuug

SEQ ID NO: 808435 - RNA, 19 nt, Homo sapiens
gacuccaucucauaaauaa

SEQ ID NO: 808436 - RNA, 19 nt, Homo sapiens
cgugugaucuucaacguuu

SEQ ID NO: 808437 - RNA, 19 nt, Homo sapiens
caaccaacguguaucuaga

SEQ ID NO: 808438 - RNA, 19 nt, Homo sapiens
caacaaagcauccuaacag

SEQ ID NO: 808439 - RNA, 19 nt, Homo sapiens
ucacagaaaugaaauacag

SEQ ID NO: 808440 - RNA, 19 nt, Homo sapiens
ccaccagccuuuccaguga

SEQ ID NO: 808441 - RNA, 19 nt, Homo sapiens
gaucgaagccagcaaguuc

SEQ ID NO: 808442 - RNA, 19 nt, Homo sapiens
gcacagaagagacgauuca

SEQ ID NO: 808443 - RNA, 19 nt, Homo sapiens
ugaaacaggugccaaaguc

SEQ ID NO: 808444 - RNA, 19 nt, Homo sapiens
ggagguucaugacaacuga

SEQ ID NO: 808445 - RNA, 19 nt, Homo sapiens
gagaucagccgacuuagug

SEQ ID NO: 808446 - RNA, 19 nt, Homo sapiens
gaacauggaggucauaaaa

SEQ ID NO: 808447 - RNA, 19 nt, Homo sapiens
aaucuggacugcuuggaua

SEQ ID NO: 808448 - RNA, 19 nt, Homo sapiens
cgagggagguucaugacaa

SEQ ID NO: 808449 - RNA, 19 nt, Homo sapiens
uaacagggucguucccaua

SEQ ID NO: 808450 - RNA, 19 nt, Homo sapiens
caagaagcuuugugagaau

SEQ ID NO: 808451 - RNA, 19 nt, Homo sapiens
ggacuuaaugacugaaauu

SEQ ID NO: 808452 - RNA, 19 nt, Homo sapiens
agagguacaugggauauuu

SEQ ID NO: 808453 - RNA, 19 nt, Homo sapiens
gaaaagaguuagucgacuu

SEQ ID NO: 808454 - RNA, 19 nt, Homo sapiens
gagcaagacuccaucucau

SEQ ID NO: 808455 - RNA, 19 nt, Homo sapiens
ugaaaucccaucucuacua

SEQ ID NO: 808456 - RNA, 19 nt, Homo sapiens
gguccaggcugcuccuauu

SEQ ID NO: 808457 - RNA, 19 nt, Homo sapiens
ccaauauccuucaucacaa

SEQ ID NO: 808458 - RNA, 19 nt, Homo sapiens
guacaggcuucuccaguca

SEQ ID NO: 808459 - RNA, 19 nt, Homo sapiens
ccaggaauaguuugagaua

SEQ ID NO: 808460 - RNA, 19 nt, Homo sapiens
gagcuagucugcugaacca

SEQ ID NO: 808461 - RNA, 19 nt, Homo sapiens
agaguuagucgacuuauuu

SEQ ID NO: 808462 - RNA, 19 nt, Homo sapiens
ugacucuucuuagcaauaa

SEQ ID NO: 808463 - RNA, 19 nt, Homo sapiens
agacucacuugcuaacuuu

SEQ ID NO: 808464 - RNA, 19 nt, Homo sapiens
ccaacacaauacccgauaa

SEQ ID NO: 808465 - RNA, 19 nt, Homo sapiens
gauuuggcuugguggcuua

SEQ ID NO: 808466 - RNA, 19 nt, Homo sapiens
ugaauacucuagauuugug

SEQ ID NO: 808467 - RNA, 19 nt, Homo sapiens
guaaaccggaucaaagaaa

SEQ ID NO: 808468 - RNA, 19 nt, Homo sapiens
gcaggcuggcuuuguauaa

SEQ ID NO: 808469 - RNA, 19 nt, Homo sapiens
gcaugcauuugauuuaaca

SEQ ID NO: 808470 - RNA, 19 nt, Homo sapiens
accaggaggucaucugaua

SEQ ID NO: 808471 - RNA, 19 nt, Homo sapiens
uaaaccggaucaaagaaau

SEQ ID NO: 808472 - RNA, 19 nt, Homo sapiens
gcaguggcauagaaucugu

SEQ ID NO: 808473 - RNA, 19 nt, Homo sapiens
caccacagcugcuccuuca

SEQ ID NO: 808474 - RNA, 19 nt, Homo sapiens
cagaacugguugcagcuaa

SEQ ID NO: 808475 - RNA, 19 nt, Homo sapiens
uaacucuauuggucaguaa

SEQ ID NO: 808476 - RNA, 19 nt, Homo sapiens
agugguaggucauuucaaa

SEQ ID NO: 808477 - RNA, 19 nt, Homo sapiens
gauguucauucagguguuu

SEQ ID NO: 808478 - RNA, 19 nt, Homo sapiens
guuuguggcuguuaggaaa

SEQ ID NO: 808479 - RNA, 19 nt, Homo sapiens
gcagugagccaagaucaga

SEQ ID NO: 808480 - RNA, 19 nt, Homo sapiens
agucagggaugcauuaugu

SEQ ID NO: 808481 - RNA, 19 nt, Homo sapiens
auacauagcaucagugaau

SEQ ID NO: 808482 - RNA, 19 nt, Homo sapiens
aauccaaccucuauaaucu

SEQ ID NO: 808483 - RNA, 19 nt, Homo sapiens
ggaggaacauggaggucau

SEQ ID NO: 808484 - RNA, 19 nt, Homo sapiens
gcaggagaaucacuugaac

SEQ ID NO: 808485 - RNA, 19 nt, Homo sapiens
ucagaacucaucacagaaa

SEQ ID NO: 808486 - RNA, 19 nt, Homo sapiens
gagccuuacuauuuauuag

SEQ ID NO: 808487 - RNA, 19 nt, Homo sapiens
uggcauagaaucuguuaaa

SEQ ID NO: 808488 - RNA, 19 nt, Homo sapiens
cgagagagagagagagaaa

SEQ ID NO: 808489 - RNA, 19 nt, Homo sapiens
ucaguugucuccagcuguu

SEQ ID NO: 808490 - RNA, 19 nt, Homo sapiens
uagauuauccagccaagaa

SEQ ID NO: 808491 - RNA, 19 nt, Homo sapiens
gaaauaucagcccucaaga

SEQ ID NO: 808492 - RNA, 19 nt, Homo sapiens
gaacaugcuguacccacuu

SEQ ID NO: 808493 - RNA, 19 nt, Homo sapiens
caggcuggcuuuguauaaa

SEQ ID NO: 808494 - RNA, 19 nt, Homo sapiens
uuuaacaguuggugaaaug

SEQ ID NO: 808495 - RNA, 19 nt, Homo sapiens
ugaaauaucagcccucaag

SEQ ID NO: 808496 - RNA, 19 nt, Homo sapiens
gaaaccccgucucuacuaa

SEQ ID NO: 808497 - RNA, 19 nt, Homo sapiens
gcaggagaaucgcuucaac

SEQ ID NO: 808498 - RNA, 19 nt, Homo sapiens
aaacagaguccgaugaaag

SEQ ID NO: 808499 - RNA, 19 nt, Homo sapiens
gcaaguuccucaggcaaag

SEQ ID NO: 808500 - RNA, 19 nt, Homo sapiens
gaaaccaacucagaaugcu

SEQ ID NO: 808501 - RNA, 19 nt, Homo sapiens
gccaagaagcuuugugaga

SEQ ID NO: 808502 - RNA, 19 nt, Homo sapiens
gcugaaccaggaauaguuu

SEQ ID NO: 808503 - RNA, 19 nt, Homo sapiens
acaaacagagccuuacuau

SEQ ID NO: 808504 - RNA, 19 nt, Homo sapiens
ggaaacaguggaacagagu

SEQ ID NO: 808505 - RNA, 19 nt, Homo sapiens
cuggauggcucccuaggaa

SEQ ID NO: 808506 - RNA, 19 nt, Homo sapiens
cuaaacaacagaugccauu

SEQ ID NO: 808507 - RNA, 19 nt, Homo sapiens
guguccaacuaaccacuua

SEQ ID NO: 808508 - RNA, 19 nt, Homo sapiens
ggauucacauuugcugaug

SEQ ID NO: 808509 - RNA, 19 nt, Homo sapiens
gagaucacaccacugcauu

SEQ ID NO: 808510 - RNA, 19 nt, Homo sapiens
ccaagaagaugaaaacuac

SEQ ID NO: 808511 - RNA, 19 nt, Homo sapiens
ucugguggauucacauuug

SEQ ID NO: 808512 - RNA, 19 nt, Homo sapiens
ugaauaguaaugaguggua

SEQ ID NO: 808513 - RNA, 19 nt, Homo sapiens
gcacagagauuuauaguau

SEQ ID NO: 808514 - RNA, 19 nt, Homo sapiens
ggacaaucauuaccagaua

SEQ ID NO: 808515 - RNA, 19 nt, Homo sapiens
ccacaaaucagacacauua

SEQ ID NO: 808516 - RNA, 19 nt, Homo sapiens
gaacagaaaugguauuacu

SEQ ID NO: 808517 - RNA, 19 nt, Homo sapiens
ugaagaagaugucagcaua

SEQ ID NO: 808518 - RNA, 19 nt, Homo sapiens
cauggugacucuaauauuu

SEQ ID NO: 808519 - RNA, 19 nt, Homo sapiens
cugcagaccucuaaacaua

SEQ ID NO: 808520 - RNA, 19 nt, Homo sapiens
cuucucagcuuucaaauuu

SEQ ID NO: 808521 - RNA, 19 nt, Homo sapiens
gaaugaaacucccuuuuaa

SEQ ID NO: 808522 - RNA, 19 nt, Homo sapiens
gagaaagaguuaauugcaa

SEQ ID NO: 808523 - RNA, 19 nt, Homo sapiens
gugcagaaguuacaucauu

SEQ ID NO: 808524 - RNA, 19 nt, Homo sapiens
caacagcaguccaguacaa

SEQ ID NO: 808525 - RNA, 19 nt, Homo sapiens
ccugucaucucauuacuua

SEQ ID NO: 808526 - RNA, 19 nt, Homo sapiens
gauacuauguugaagaaga

SEQ ID NO: 808527 - RNA, 19 nt, Homo sapiens
cagaagauauuccuacaga

SEQ ID NO: 808528 - RNA, 19 nt, Homo sapiens
cacaagaucuuaccauaga

SEQ ID NO: 808529 - RNA, 19 nt, Homo sapiens
ugagagaucugaauuugga

SEQ ID NO: 808530 - RNA, 19 nt, Homo sapiens
gaugagcaguccgaaauaa

SEQ ID NO: 808531 - RNA, 19 nt, Homo sapiens
ugaaagaggugguuuagag

SEQ ID NO: 808532 - RNA, 19 nt, Homo sapiens
gagccaaguucaacgguaa

SEQ ID NO: 808533 - RNA, 19 nt, Homo sapiens
caauguuccugacuguuua

SEQ ID NO: 808534 - RNA, 19 nt, Homo sapiens
gaagauauuccuacagaug

SEQ ID NO: 808535 - RNA, 19 nt, Homo sapiens
gaauucuacugcuuuaaga

SEQ ID NO: 808536 - RNA, 19 nt, Homo sapiens
gcagaaguuacaucauuua

SEQ ID NO: 808537 - RNA, 19 nt, Homo sapiens
guguaaaucugcugaagaa

SEQ ID NO: 808538 - RNA, 19 nt, Homo sapiens
uaucagcggugucacuuaa

SEQ ID NO: 808539 - RNA, 19 nt, Homo sapiens
cagaugaacugaaagacuu

SEQ ID NO: 808540 - RNA, 19 nt, Homo sapiens
ugaacuaccuacagcuaua

SEQ ID NO: 808541 - RNA, 19 nt, Homo sapiens
ggcuauaaaugcuuuguuu

SEQ ID NO: 808542 - RNA, 19 nt, Homo sapiens
gagaacagaaaugguauua

SEQ ID NO: 808543 - RNA, 19 nt, Homo sapiens
gucacaaucuugaucauuu

SEQ ID NO: 808544 - RNA, 19 nt, Homo sapiens
gaagugagagaucugaauu

SEQ ID NO: 808545 - RNA, 19 nt, Homo sapiens
gcacaaugauaugcacaaa

SEQ ID NO: 808546 - RNA, 19 nt, Homo sapiens
caagaagcacagagauuua

SEQ ID NO: 808547 - RNA, 19 nt, Homo sapiens
gugcuaaccuguacuaaca

SEQ ID NO: 808548 - RNA, 19 nt, Homo sapiens
caaauaagccuagggaaau

SEQ ID NO: 808549 - RNA, 19 nt, Homo sapiens
gacaaucauuaccagauaa

SEQ ID NO: 808550 - RNA, 19 nt, Homo sapiens
ugguaaauguggacaaaua

SEQ ID NO: 808551 - RNA, 19 nt, Homo sapiens
gaaaauaucugugcaugug

SEQ ID NO: 808552 - RNA, 19 nt, Homo sapiens
gaagaagaugucagcauaa

SEQ ID NO: 808553 - RNA, 19 nt, Homo sapiens
gaucacagacgaaagcauu

SEQ ID NO: 808554 - RNA, 19 nt, Homo sapiens
gaaauagggccuucuaaac

SEQ ID NO: 808555 - RNA, 19 nt, Homo sapiens
guaggcagcuucaggaaca

SEQ ID NO: 808556 - RNA, 19 nt, Homo sapiens
aaaguuccguguccaaauu

SEQ ID NO: 808557 - RNA, 19 nt, Homo sapiens
aaauaagccuagggaaaua

SEQ ID NO: 808558 - RNA, 19 nt, Homo sapiens
cagcggaaguccuuuguug

SEQ ID NO: 808559 - RNA, 19 nt, Homo sapiens
uggaaucacuuuguuguaa

SEQ ID NO: 808560 - RNA, 19 nt, Homo sapiens
ugacagcucccuccaguuu

SEQ ID NO: 808561 - RNA, 19 nt, Homo sapiens
aauaguaugugcagaaguu

SEQ ID NO: 808562 - RNA, 19 nt, Homo sapiens
gaaguaauggguacagaga

SEQ ID NO: 808563 - RNA, 19 nt, Homo sapiens
aaacuuccaucaacccaaa

SEQ ID NO: 808564 - RNA, 19 nt, Homo sapiens
acauaugucuagcugcuua

SEQ ID NO: 808565 - RNA, 19 nt, Homo sapiens
gcagauuguucuaguucaa

SEQ ID NO: 808566 - RNA, 19 nt, Homo sapiens
caagaaaacucaguaaaga

SEQ ID NO: 808567 - RNA, 19 nt, Homo sapiens
cccaagaucugaccaugaa

SEQ ID NO: 808568 - RNA, 19 nt, Homo sapiens
gaggaccugucaucucauu

SEQ ID NO: 808569 - RNA, 19 nt, Homo sapiens
cacugacaaugaugaauua

SEQ ID NO: 808570 - RNA, 19 nt, Homo sapiens
gaaaauuagugcagaaugu

SEQ ID NO: 808571 - RNA, 19 nt, Homo sapiens
cauacaacaucagugguua

SEQ ID NO: 808572 - RNA, 19 nt, Homo sapiens
uaagagaacacuauacugu

SEQ ID NO: 808573 - RNA, 19 nt, Homo sapiens
gaaagaggugguuuagaga

SEQ ID NO: 808574 - RNA, 19 nt, Homo sapiens
ugugauagcuguggauuug

SEQ ID NO: 808575 - RNA, 19 nt, Homo sapiens
ugaaauagggccuucuaaa

SEQ ID NO: 808576 - RNA, 19 nt, Homo sapiens
gcagaccucuaaacauaag

SEQ ID NO: 808577 - RNA, 19 nt, Homo sapiens
gaaauguacuuagucaacu

SEQ ID NO: 808578 - RNA, 19 nt, Homo sapiens
ggaagagaauccugaugag

SEQ ID NO: 808579 - RNA, 19 nt, Homo sapiens
uuacuuagccaaacacauu

SEQ ID NO: 808580 - RNA, 19 nt, Homo sapiens
aguaagugcugaugaaaga

SEQ ID NO: 808581 - RNA, 19 nt, Homo sapiens
gaagagccauuuuauagau

SEQ ID NO: 808582 - RNA, 19 nt, Homo sapiens
agaguuaauugcaauguga

SEQ ID NO: 808583 - RNA, 19 nt, Homo sapiens
gcauaguacugcacaacug

SEQ ID NO: 808584 - RNA, 19 nt, Homo sapiens
aagaagaugucagcauaaa

SEQ ID NO: 808585 - RNA, 19 nt, Homo sapiens
gagaggaaaaggauuauua

SEQ ID NO: 808586 - RNA, 19 nt, Homo sapiens
aacacaagaucuuaccaua

SEQ ID NO: 808587 - RNA, 19 nt, Homo sapiens
caucagugguuacagcuau

SEQ ID NO: 808588 - RNA, 19 nt, Homo sapiens
cauggccaguggugaaaua

SEQ ID NO: 808589 - RNA, 19 nt, Homo sapiens
cugcuuagaucaagauaug

SEQ ID NO: 808590 - RNA, 19 nt, Homo sapiens
ugacugcuguauugcaauu

SEQ ID NO: 808591 - RNA, 19 nt, Homo sapiens
gccuguagcuccuauuuua

SEQ ID NO: 808592 - RNA, 19 nt, Homo sapiens
ggaauuauuggguuaaagu

SEQ ID NO: 808593 - RNA, 19 nt, Homo sapiens
acaagaagcacagagauuu

SEQ ID NO: 808594 - RNA, 19 nt, Homo sapiens
cuucaagggucuuucuaaa

SEQ ID NO: 808595 - RNA, 19 nt, Homo sapiens
ggaagaaaaugaaagagau

SEQ ID NO: 808596 - RNA, 19 nt, Homo sapiens
uaacaacagcaguccagua

SEQ ID NO: 808597 - RNA, 19 nt, Homo sapiens
ccacugacaaugaugaauu

SEQ ID NO: 808598 - RNA, 19 nt, Homo sapiens
ggguaagaauguaugaaga

SEQ ID NO: 808599 - RNA, 19 nt, Homo sapiens
acaaauaagccuagggaaa

SEQ ID NO: 808600 - RNA, 19 nt, Homo sapiens
cuucugaacuuggcaauau

SEQ ID NO: 808601 - RNA, 19 nt, Homo sapiens
acaaugauaugcacaaagg

SEQ ID NO: 808602 - RNA, 19 nt, Homo sapiens
augaauggguuaggaaaua

SEQ ID NO: 808603 - RNA, 19 nt, Homo sapiens
gaggugguuuagagaauau

SEQ ID NO: 808604 - RNA, 19 nt, Homo sapiens
gcuaaacaaccaaagagaa

SEQ ID NO: 808605 - RNA, 19 nt, Homo sapiens
uagagaggcugaugaagag

SEQ ID NO: 808606 - RNA, 19 nt, Homo sapiens
cuacagcuauacaauguuc

SEQ ID NO: 808607 - RNA, 19 nt, Homo sapiens
guauaaaccaugcuucuca

SEQ ID NO: 808608 - RNA, 19 nt, Homo sapiens
cugcacagacggacaaaua

SEQ ID NO: 808609 - RNA, 19 nt, Homo sapiens
ggaugcagauuguucuagu

SEQ ID NO: 808610 - RNA, 19 nt, Homo sapiens
gaucucauuuugcaguuua

SEQ ID NO: 808611 - RNA, 19 nt, Homo sapiens
aauuaaaggugccagauca

SEQ ID NO: 808612 - RNA, 19 nt, Homo sapiens
guagcacaguggagucuga

SEQ ID NO: 808613 - RNA, 19 nt, Homo sapiens
gaagaaaucaccaaaguuu

SEQ ID NO: 808614 - RNA, 19 nt, Homo sapiens
ggagauggcuuacucagaa

SEQ ID NO: 808615 - RNA, 19 nt, Homo sapiens
acaaagagcuguuaagaau

SEQ ID NO: 808616 - RNA, 19 nt, Homo sapiens
acagacaucuccucaaaua

SEQ ID NO: 808617 - RNA, 19 nt, Homo sapiens
guacagaaguuggaauauu

SEQ ID NO: 808618 - RNA, 19 nt, Homo sapiens
gcaauaagcaucaaauuag

SEQ ID NO: 808619 - RNA, 19 nt, Homo sapiens
ccaaguaucuggaguguuc

SEQ ID NO: 808620 - RNA, 19 nt, Homo sapiens
gaagagaauugauaaacuc

SEQ ID NO: 808621 - RNA, 19 nt, Homo sapiens
gaaggagguucaagggaaa

SEQ ID NO: 808622 - RNA, 19 nt, Homo sapiens
caaauuagcagcgcauuaa

SEQ ID NO: 808623 - RNA, 19 nt, Homo sapiens
uuacagacaucuccucaaa

SEQ ID NO: 808624 - RNA, 19 nt, Homo sapiens
uaaguaccauguccuguuu

SEQ ID NO: 808625 - RNA, 19 nt, Homo sapiens
gccaagcccuuuccuaaga

SEQ ID NO: 808626 - RNA, 19 nt, Homo sapiens
aagaagaaguugucacauu

SEQ ID NO: 808627 - RNA, 19 nt, Homo sapiens
gaccauaccagauuuagaa

SEQ ID NO: 808628 - RNA, 19 nt, Homo sapiens
gaauggcaguguaaaguuc

SEQ ID NO: 808629 - RNA, 19 nt, Homo sapiens
caacagccauugugaacau

SEQ ID NO: 808630 - RNA, 19 nt, Homo sapiens
cgagcuauguuaacuugua

SEQ ID NO: 808631 - RNA, 19 nt, Homo sapiens
guacaccucugccgucuuc

SEQ ID NO: 808632 - RNA, 19 nt, Homo sapiens
cugcagaccuccaaagaaa

SEQ ID NO: 808633 - RNA, 19 nt, Homo sapiens
agaauuuccugcuguauga

SEQ ID NO: 808634 - RNA, 19 nt, Homo sapiens
ucagguaucuuucaaccaa

SEQ ID NO: 808635 - RNA, 19 nt, Homo sapiens
gaaagaagaagaaguuguc

SEQ ID NO: 808636 - RNA, 19 nt, Homo sapiens
gaaaugauagcuguacuga

SEQ ID NO: 808637 - RNA, 19 nt, Homo sapiens
acacagaccuagucacuuc

SEQ ID NO: 808638 - RNA, 19 nt, Homo sapiens
aaacaugggagauggcuua

SEQ ID NO: 808639 - RNA, 19 nt, Homo sapiens
gccagccucuaucuuaaua

SEQ ID NO: 808640 - RNA, 19 nt, Homo sapiens
uggccuagaugcauguuua

SEQ ID NO: 808641 - RNA, 19 nt, Homo sapiens
caggcaagcaccucaauua

SEQ ID NO: 808642 - RNA, 19 nt, Homo sapiens
gcaaggaauggcaguguaa

SEQ ID NO: 808643 - RNA, 19 nt, Homo sapiens
caaaugggaaucuuaguga

SEQ ID NO: 808644 - RNA, 19 nt, Homo sapiens
ggguagaacuggcggagaa

SEQ ID NO: 808645 - RNA, 19 nt, Homo sapiens
agaagaaguugucacauuc

SEQ ID NO: 808646 - RNA, 19 nt, Homo sapiens
cgaguauucugguuaauca

SEQ ID NO: 808647 - RNA, 19 nt, Homo sapiens
gaaaguaccauaaugucau

SEQ ID NO: 808648 - RNA, 19 nt, Homo sapiens
uugauaaacucaccaaaga

SEQ ID NO: 808649 - RNA, 19 nt, Homo sapiens
ucaaguugcuuagacauug

SEQ ID NO: 808650 - RNA, 19 nt, Homo sapiens
cauguaaacugaauucucu

SEQ ID NO: 808651 - RNA, 19 nt, Homo sapiens
ucaguucguuuguuugauu

SEQ ID NO: 808652 - RNA, 19 nt, Homo sapiens
aaccagagcuuagcaaaug

SEQ ID NO: 808653 - RNA, 19 nt, Homo sapiens
gcaagcaccucaauuaacc

SEQ ID NO: 808654 - RNA, 19 nt, Homo sapiens
aggaggagcuucuuaggaa

SEQ ID NO: 808655 - RNA, 19 nt, Homo sapiens
cacuuugacuuucaguuua

SEQ ID NO: 808656 - RNA, 19 nt, Homo sapiens
gaaacauuccauaguaaga

SEQ ID NO: 808657 - RNA, 19 nt, Homo sapiens
ggaggagcuucuuaggaaa

SEQ ID NO: 808658 - RNA, 19 nt, Homo sapiens
ggacguggccguggaaaug

SEQ ID NO: 808659 - RNA, 19 nt, Homo sapiens
gaaguuggaauauucuguu

SEQ ID NO: 808660 - RNA, 19 nt, Homo sapiens
uacagaaguuggaauauuc

SEQ ID NO: 808661 - RNA, 19 nt, Homo sapiens
gggaaacuauguucaaggu

SEQ ID NO: 808662 - RNA, 19 nt, Homo sapiens
caaauaggaagcccaaaug

SEQ ID NO: 808663 - RNA, 19 nt, Homo sapiens
gcagaaaccgagcuauguu

SEQ ID NO: 808664 - RNA, 19 nt, Homo sapiens
gggcauggcaacucucuuu

SEQ ID NO: 808665 - RNA, 19 nt, Homo sapiens
ggagaaaguguguguuugu

SEQ ID NO: 808666 - RNA, 19 nt, Homo sapiens
gcaguguaaaguucuguua

SEQ ID NO: 808667 - RNA, 19 nt, Homo sapiens
ggaauggcaguguaaaguu

SEQ ID NO: 808668 - RNA, 19 nt, Homo sapiens
gcaaaugggaaucuuagug

SEQ ID NO: 808669 - RNA, 19 nt, Homo sapiens
cagaaaccgagcuauguua

SEQ ID NO: 808670 - RNA, 19 nt, Homo sapiens
uuaagaauuuccugcugua

SEQ ID NO: 808671 - RNA, 19 nt, Homo sapiens
ccacaaagagcuguuaaga

SEQ ID NO: 808672 - RNA, 19 nt, Homo sapiens
cuagaugcauguuuauuca

SEQ ID NO: 808673 - RNA, 19 nt, Homo sapiens
guaaaguucuguuaauagc

SEQ ID NO: 808674 - RNA, 19 nt, Homo sapiens
ggcaaggaauggcagugua

SEQ ID NO: 808675 - RNA, 19 nt, Homo sapiens
caacaguaaugucuuucug

SEQ ID NO: 808676 - RNA, 19 nt, Homo sapiens
gccguugaccuuagaguua

SEQ ID NO: 808677 - RNA, 19 nt, Homo sapiens
gcagaauuaugauuguuac

SEQ ID NO: 808678 - RNA, 19 nt, Homo sapiens
gagaaaguguguguuugug

SEQ ID NO: 808679 - RNA, 19 nt, Homo sapiens
ggagaccauaccagauuua

SEQ ID NO: 808680 - RNA, 19 nt, Homo sapiens
gaguuaaggcgguugcuuu

SEQ ID NO: 808681 - RNA, 19 nt, Homo sapiens
ccuagucacuuccucagaa

SEQ ID NO: 808682 - RNA, 19 nt, Homo sapiens
ucacuuugacuuucaguuu

SEQ ID NO: 808683 - RNA, 19 nt, Homo sapiens
ggcagaauuaugauuguua

SEQ ID NO: 808684 - RNA, 19 nt, Homo sapiens
guaauuaacauuggcagaa

SEQ ID NO: 808685 - RNA, 19 nt, Homo sapiens
gugcugacauucuucugaa

SEQ ID NO: 808686 - RNA, 19 nt, Homo sapiens
gcaacgugguaaagcagaa

SEQ ID NO: 808687 - RNA, 19 nt, Homo sapiens
guaccauaaugucauccua

SEQ ID NO: 808688 - RNA, 19 nt, Homo sapiens
cccaugaucuucagaaagu

SEQ ID NO: 808689 - RNA, 19 nt, Homo sapiens
gaaccuaccauaaugaaaa

SEQ ID NO: 808690 - RNA, 19 nt, Homo sapiens
cugcuucugugcccuguua

SEQ ID NO: 808691 - RNA, 19 nt, Homo sapiens
uaaccacccugaucucaag

SEQ ID NO: 808692 - RNA, 19 nt, Homo sapiens
ucacagcuacgaagaaaga

SEQ ID NO: 808693 - RNA, 19 nt, Homo sapiens
gaagaaguugucacauuca

SEQ ID NO: 808694 - RNA, 19 nt, Homo sapiens
ggaaagaagaagaaguugu

SEQ ID NO: 808695 - RNA, 19 nt, Homo sapiens
ucaaauuagcagcgcauua

SEQ ID NO: 808696 - RNA, 19 nt, Homo sapiens
gaaucuuagugaaccagaa

SEQ ID NO: 808697 - RNA, 19 nt, Homo sapiens
gagcuuagcaaaugggaau

SEQ ID NO: 808698 - RNA, 19 nt, Homo sapiens
gggaaggaaccaccugaaa

SEQ ID NO: 808699 - RNA, 19 nt, Homo sapiens
cgaggcacaugucagagaa

SEQ ID NO: 808700 - RNA, 19 nt, Homo sapiens
gcauacuccacuuaacaua

SEQ ID NO: 808701 - RNA, 19 nt, Homo sapiens
gaagcauacuccacuuaac

SEQ ID NO: 808702 - RNA, 19 nt, Homo sapiens
uguaaugugugugcaauga

SEQ ID NO: 808703 - RNA, 19 nt, Homo sapiens
ccaaggccauucacgaaca

SEQ ID NO: 808704 - RNA, 19 nt, Homo sapiens
uaggaaagaagaagaaguu

SEQ ID NO: 808705 - RNA, 19 nt, Homo sapiens
cagagaggccuguguccua

SEQ ID NO: 808706 - RNA, 19 nt, Homo sapiens
gccagucaguuguacagaa

SEQ ID NO: 808707 - RNA, 19 nt, Homo sapiens
cagaagcauacuccacuua

SEQ ID NO: 808708 - RNA, 19 nt, Homo sapiens
guuuacaagugcugacauu

SEQ ID NO: 808709 - RNA, 19 nt, Homo sapiens
gagaagagaauugauaaac

SEQ ID NO: 808710 - RNA, 19 nt, Homo sapiens
gauaggaccauugagaaga

SEQ ID NO: 808711 - RNA, 19 nt, Homo sapiens
uugaagaaaucaccaaagu

SEQ ID NO: 808712 - RNA, 19 nt, Homo sapiens
ucagaaaguaccauaaugu

SEQ ID NO: 808713 - RNA, 19 nt, Homo sapiens
gaacgcagcugcuuuccua

SEQ ID NO: 808714 - RNA, 19 nt, Homo sapiens
ggacuuggaucuccuuaua

SEQ ID NO: 808715 - RNA, 19 nt, Homo sapiens
gaauuucaauggaagcaua

SEQ ID NO: 808716 - RNA, 19 nt, Homo sapiens
uuacagaccugagcacuua

SEQ ID NO: 808717 - RNA, 19 nt, Homo sapiens
cgaaagaccuccacaccuu

SEQ ID NO: 808718 - RNA, 19 nt, Homo sapiens
ggaccaggcuuuccuagau

SEQ ID NO: 808719 - RNA, 19 nt, Homo sapiens
ccagaaaguuaacugauga

SEQ ID NO: 808720 - RNA, 19 nt, Homo sapiens
gaaagaccuccacaccuua

SEQ ID NO: 808721 - RNA, 19 nt, Homo sapiens
ucucuuagauguggaaaua

SEQ ID NO: 808722 - RNA, 19 nt, Homo sapiens
gagcuaaggacuugcauuu

SEQ ID NO: 808723 - RNA, 19 nt, Homo sapiens
caggaaaccucuugcagaa

SEQ ID NO: 808724 - RNA, 19 nt, Homo sapiens
aaaugcagcugguagaauu

SEQ ID NO: 808725 - RNA, 19 nt, Homo sapiens
gaaaguuaacugaugauug

SEQ ID NO: 808726 - RNA, 19 nt, Homo sapiens
ggaagcauaauccauguaa

SEQ ID NO: 808727 - RNA, 19 nt, Homo sapiens
gcaagaaucaacacuguau

SEQ ID NO: 808728 - RNA, 19 nt, Homo sapiens
gaucuguauuucaguguuu

SEQ ID NO: 808729 - RNA, 19 nt, Homo sapiens
ggaaaccucuugcagaacu

SEQ ID NO: 808730 - RNA, 19 nt, Homo sapiens
ccacagaggccuaaguuug

SEQ ID NO: 808731 - RNA, 19 nt, Homo sapiens
gaaagucccuucccaugcu

SEQ ID NO: 808732 - RNA, 19 nt, Homo sapiens
ggagcagccugguuauuuc

SEQ ID NO: 808733 - RNA, 19 nt, Homo sapiens
ggacuugcauuuucaguuu

SEQ ID NO: 808734 - RNA, 19 nt, Homo sapiens
gaugaacccagcaggcuua

SEQ ID NO: 808735 - RNA, 19 nt, Homo sapiens
gaaaaguagucuucucuga

SEQ ID NO: 808736 - RNA, 19 nt, Homo sapiens
ugacagagauuagaaguac

SEQ ID NO: 808737 - RNA, 19 nt, Homo sapiens
gaagcauaauccauguaaa

SEQ ID NO: 808738 - RNA, 19 nt, Homo sapiens
gaacccagcaggcuuagga

SEQ ID NO: 808739 - RNA, 19 nt, Homo sapiens
caggagagcugaugaugag

SEQ ID NO: 808740 - RNA, 19 nt, Homo sapiens
uaaaugagguuggcagagu

SEQ ID NO: 808741 - RNA, 19 nt, Homo sapiens
agacggagccacagcauuu

SEQ ID NO: 808742 - RNA, 19 nt, Homo sapiens
agagggagguggaaaugaa

SEQ ID NO: 808743 - RNA, 19 nt, Homo sapiens
acacccaccugaaaucaaa

SEQ ID NO: 808744 - RNA, 19 nt, Homo sapiens
caccugaaaucaaaccaaa

SEQ ID NO: 808745 - RNA, 19 nt, Homo sapiens
uagcaagaaucaacacugu

SEQ ID NO: 808746 - RNA, 19 nt, Homo sapiens
gaagcacagcacuugguua

SEQ ID NO: 808747 - RNA, 19 nt, Homo sapiens
ugaugagccuccuguggua

SEQ ID NO: 808748 - RNA, 19 nt, Homo sapiens
cgacuacaauggccugugu

SEQ ID NO: 808749 - RNA, 19 nt, Homo sapiens
ugacucgccuggagaaugu

SEQ ID NO: 808750 - RNA, 19 nt, Homo sapiens
gaaccuacugugugcauau

SEQ ID NO: 808751 - RNA, 19 nt, Homo sapiens
caaaguggcccaaggucaa

SEQ ID NO: 808752 - RNA, 19 nt, Homo sapiens
agaugaggcugaugagcua

SEQ ID NO: 808753 - RNA, 19 nt, Homo sapiens
ccugauuuguugaagauuu

SEQ ID NO: 808754 - RNA, 19 nt, Homo sapiens
gcauugaggagaagugcua

SEQ ID NO: 808755 - RNA, 19 nt, Homo sapiens
gugaauggcuacagcaucu

SEQ ID NO: 808756 - RNA, 19 nt, Homo sapiens
agacccagcucccaagaga

SEQ ID NO: 808757 - RNA, 19 nt, Homo sapiens
gagcauugacuuccucuuc

SEQ ID NO: 808758 - RNA, 19 nt, Homo sapiens
gggccaagccugagggaaa

SEQ ID NO: 808759 - RNA, 19 nt, Homo sapiens
gcaaggcugcccugaugaa

SEQ ID NO: 808760 - RNA, 19 nt, Homo sapiens
gcccauugguuccugagaa

SEQ ID NO: 808761 - RNA, 19 nt, Homo sapiens
ccacagcauuuggugacua

SEQ ID NO: 808762 - RNA, 19 nt, Homo sapiens
gaacaguguggccugcauu

SEQ ID NO: 808763 - RNA, 19 nt, Homo sapiens
gugagaaggcuguguaugu

SEQ ID NO: 808764 - RNA, 19 nt, Homo sapiens
uacaauggccuguguguug

SEQ ID NO: 808765 - RNA, 19 nt, Homo sapiens
ggaaguacuccaugacaca

SEQ ID NO: 808766 - RNA, 19 nt, Homo sapiens
gcagccugguuauuuccua

SEQ ID NO: 808767 - RNA, 19 nt, Homo sapiens
gcuaaggacuugcauuuuc

SEQ ID NO: 808768 - RNA, 19 nt, Homo sapiens
ucuaggagcuaaggacuug

SEQ ID NO: 808769 - RNA, 19 nt, Homo sapiens
caaguugacccaccucuca

SEQ ID NO: 808770 - RNA, 19 nt, Homo sapiens
gaagccagguuggaaguac

SEQ ID NO: 808771 - RNA, 19 nt, Homo sapiens
gcccaaggccugcaaagug

SEQ ID NO: 808772 - RNA, 19 nt, Homo sapiens
acuuggaucuccuuauauu

SEQ ID NO: 808773 - RNA, 19 nt, Homo sapiens
caccuuauguggccaagau

SEQ ID NO: 808774 - RNA, 19 nt, Homo sapiens
guauuucaguguuuacaag

SEQ ID NO: 808775 - RNA, 19 nt, Homo sapiens
gaagggaagggacuuggau

SEQ ID NO: 808776 - RNA, 19 nt, Homo sapiens
cccagaaaguuaacugaug

SEQ ID NO: 808777 - RNA, 19 nt, Homo sapiens
cacgagcccuugcagaaug

SEQ ID NO: 808778 - RNA, 19 nt, Homo sapiens
caaaucaggcccacgaaag

SEQ ID NO: 808779 - RNA, 19 nt, Homo sapiens
ugagaaggcuguguauguc

SEQ ID NO: 808780 - RNA, 19 nt, Homo sapiens
gaaaccucuugcagaacuu

SEQ ID NO: 808781 - RNA, 19 nt, Homo sapiens
gaccaggcuuuccuagauc

SEQ ID NO: 808782 - RNA, 19 nt, Homo sapiens
gggcaaggucuuucaggaa

SEQ ID NO: 808783 - RNA, 19 nt, Homo sapiens
ccgcaagaauuacccacuu

SEQ ID NO: 808784 - RNA, 19 nt, Homo sapiens
gcagagggagguggaaaug

SEQ ID NO: 808785 - RNA, 19 nt, Homo sapiens
gcagccacuugcucuagga

SEQ ID NO: 808786 - RNA, 19 nt, Homo sapiens
ggacuucccaucucucucu

SEQ ID NO: 808787 - RNA, 19 nt, Homo sapiens
gcacgagcccuugcagaau

SEQ ID NO: 808788 - RNA, 19 nt, Homo sapiens
caaggucaauggcaagaac

SEQ ID NO: 808789 - RNA, 19 nt, Homo sapiens
guagauugcacuaauuuac

SEQ ID NO: 808790 - RNA, 19 nt, Homo sapiens
gcauagagagccagagucu

SEQ ID NO: 808791 - RNA, 19 nt, Homo sapiens
ggccaagccugagggaaau

SEQ ID NO: 808792 - RNA, 19 nt, Homo sapiens
gaagugcuaugugcugacu

SEQ ID NO: 808793 - RNA, 19 nt, Homo sapiens
aagaauuacccacuucgua

SEQ ID NO: 808794 - RNA, 19 nt, Homo sapiens
gaaccauggccaucugcaa

SEQ ID NO: 808795 - RNA, 19 nt, Homo sapiens
gagacuggcuagccugaac

SEQ ID NO: 808796 - RNA, 19 nt, Homo sapiens
gaugaguugcuccugauug

SEQ ID NO: 808797 - RNA, 19 nt, Homo sapiens
uggagcagccugguuauuu

SEQ ID NO: 808798 - RNA, 19 nt, Homo sapiens
gugcagaugaggcugauga

SEQ ID NO: 808799 - RNA, 19 nt, Homo sapiens
gcugguagaauuucaaugg

SEQ ID NO: 808800 - RNA, 19 nt, Homo sapiens
gcacuuccacaagggcaua

SEQ ID NO: 808801 - RNA, 19 nt, Homo sapiens
gcccuguucucaccucaug

SEQ ID NO: 808802 - RNA, 19 nt, Homo sapiens
ugagccuccugugguauua

SEQ ID NO: 808803 - RNA, 19 nt, Homo sapiens
cagcaucugcggaguguug

SEQ ID NO: 808804 - RNA, 19 nt, Homo sapiens
uagaugaguugcuccugau

SEQ ID NO: 808805 - RNA, 19 nt, Homo sapiens
gccaugcccugucccuuag

SEQ ID NO: 808806 - RNA, 19 nt, Homo sapiens
uagcugagcacuuccacaa

SEQ ID NO: 808807 - RNA, 19 nt, Homo sapiens
uaccugauuuguugaagau

SEQ ID NO: 808808 - RNA, 19 nt, Homo sapiens
gagccagccauccgaaaga

SEQ ID NO: 808809 - RNA, 19 nt, Homo sapiens
aauaagcuguuuggaggaa

SEQ ID NO: 808810 - RNA, 19 nt, Homo sapiens
ggaagccagguuggaagua

SEQ ID NO: 808811 - RNA, 19 nt, Homo sapiens
ucccagcgguucuaaguca

SEQ ID NO: 808812 - RNA, 19 nt, Homo sapiens
uagaugggcgcuccacuga

SEQ ID NO: 808813 - RNA, 19 nt, Homo sapiens
gauaguagauucucucuuu

SEQ ID NO: 808814 - RNA, 19 nt, Homo sapiens
gggcaaacauuacaaauuu

SEQ ID NO: 808815 - RNA, 19 nt, Homo sapiens
caaagagguugaucauuua

SEQ ID NO: 808816 - RNA, 19 nt, Homo sapiens
acaaagagguugaucauuu

SEQ ID NO: 808817 - RNA, 19 nt, Homo sapiens
caaagguucuucaucauuu

SEQ ID NO: 808818 - RNA, 19 nt, Homo sapiens
ggacaaauuuggccacaau

SEQ ID NO: 808819 - RNA, 19 nt, Homo sapiens
gaaagaaggccaaacacaa

SEQ ID NO: 808820 - RNA, 19 nt, Homo sapiens
ggacaaugcugugagagaa

SEQ ID NO: 808821 - RNA, 19 nt, Homo sapiens
uuacaaagguucuucauca

SEQ ID NO: 808822 - RNA, 19 nt, Homo sapiens
ggaaugagacccucgugua

SEQ ID NO: 808823 - RNA, 19 nt, Homo sapiens
ccaacaagcuucguacaaa

SEQ ID NO: 808824 - RNA, 19 nt, Homo sapiens
aggaagagcugacugauga

SEQ ID NO: 808825 - RNA, 19 nt, Homo sapiens
gcaggacgcuuuccagauc

SEQ ID NO: 808826 - RNA, 19 nt, Homo sapiens
uuaauaaccucucaguuug

SEQ ID NO: 808827 - RNA, 19 nt, Homo sapiens
ggaagaauuucaacaucug

SEQ ID NO: 808828 - RNA, 19 nt, Homo sapiens
ggacuuagcgucuuucuac

SEQ ID NO: 808829 - RNA, 19 nt, Homo sapiens
acagugaccuggcaaagaa

SEQ ID NO: 808830 - RNA, 19 nt, Homo sapiens
ccaaugcccuugacucugu

SEQ ID NO: 808831 - RNA, 19 nt, Homo sapiens
cgaauucaaugaggaguuu

SEQ ID NO: 808832 - RNA, 19 nt, Homo sapiens
caaaucacaucucuuaacu

SEQ ID NO: 808833 - RNA, 19 nt, Homo sapiens
agacaggccugaugccaaa

SEQ ID NO: 808834 - RNA, 19 nt, Homo sapiens
gcucuuagguaaaugaaca

SEQ ID NO: 808835 - RNA, 19 nt, Homo sapiens
gaggaagaauuucaacauc

SEQ ID NO: 808836 - RNA, 19 nt, Homo sapiens
caucaucaaucuuucacuu

SEQ ID NO: 808837 - RNA, 19 nt, Homo sapiens
agaagucacuggacauuuc

SEQ ID NO: 808838 - RNA, 19 nt, Homo sapiens
gaaugagacccucguguau

SEQ ID NO: 808839 - RNA, 19 nt, Homo sapiens
gggaggaguuggcaagaau

SEQ ID NO: 808840 - RNA, 19 nt, Homo sapiens
ccugaucucucuucucuau

SEQ ID NO: 808841 - RNA, 19 nt, Homo sapiens
ggcaccagcuacagaauga

SEQ ID NO: 808842 - RNA, 19 nt, Homo sapiens
ggaaagaaggccaaacaca

SEQ ID NO: 808843 - RNA, 19 nt, Homo sapiens
gcgagugauuccuaugaaa

SEQ ID NO: 808844 - RNA, 19 nt, Homo sapiens
gugaaccgcugcauacugu

SEQ ID NO: 808845 - RNA, 19 nt, Homo sapiens
agaaagaaaucaucaacag

SEQ ID NO: 808846 - RNA, 19 nt, Homo sapiens
gggcucaucaucaaucuuu

SEQ ID NO: 808847 - RNA, 19 nt, Homo sapiens
ccacccagcaucuuucuuu

SEQ ID NO: 808848 - RNA, 19 nt, Homo sapiens
cugggagaaucaaauaaua

SEQ ID NO: 808849 - RNA, 19 nt, Homo sapiens
gcucuccucuuuccgaaug

SEQ ID NO: 808850 - RNA, 19 nt, Homo sapiens
gaagggagagagagagaga

SEQ ID NO: 808851 - RNA, 19 nt, Homo sapiens
ggagagagagagagagaga

SEQ ID NO: 808852 - RNA, 19 nt, Homo sapiens
gcugggcucugccugugua

SEQ ID NO: 808853 - RNA, 19 nt, Homo sapiens
aaacaaacgacaacaacaa

SEQ ID NO: 808854 - RNA, 19 nt, Homo sapiens
gaugugggcucugaauaca

SEQ ID NO: 808855 - RNA, 19 nt, Homo sapiens
ccaaccagaggaagaauuu

SEQ ID NO: 808856 - RNA, 19 nt, Homo sapiens
ugggaggacucauuucuug

SEQ ID NO: 808857 - RNA, 19 nt, Homo sapiens
cuuggacgcucuccucuuu

SEQ ID NO: 808858 - RNA, 19 nt, Homo sapiens
gcuuugggcucaucaucaa

SEQ ID NO: 808859 - RNA, 19 nt, Homo sapiens
gcacggaggcauuuagaag

SEQ ID NO: 808860 - RNA, 19 nt, Homo sapiens
ccaggaaacugagaaacug

SEQ ID NO: 808861 - RNA, 19 nt, Homo sapiens
caaauuuggccacaaugaa

SEQ ID NO: 808862 - RNA, 19 nt, Homo sapiens
gagcgugguucuucaaagg

SEQ ID NO: 808863 - RNA, 19 nt, Homo sapiens
ccaccucccugccuagaau

SEQ ID NO: 808864 - RNA, 19 nt, Homo sapiens
gaaaaucacucccagucau

SEQ ID NO: 808865 - RNA, 19 nt, Homo sapiens
gcagggaggccucauugug

SEQ ID NO: 808866 - RNA, 19 nt, Homo sapiens
gagcgagugauuccuauga

SEQ ID NO: 808867 - RNA, 19 nt, Homo sapiens
ccacagccuaugccuauaa

SEQ ID NO: 808868 - RNA, 19 nt, Homo sapiens
ucacaucucuuaacuuuuc

SEQ ID NO: 808869 - RNA, 19 nt, Homo sapiens
gaaugucaccugugugcuu

SEQ ID NO: 808870 - RNA, 19 nt, Homo sapiens
acacacacauguacacaca

SEQ ID NO: 808871 - RNA, 19 nt, Homo sapiens
caacaagcuucguacaaaa

SEQ ID NO: 808872 - RNA, 19 nt, Homo sapiens
ugugaggacuguaagaaga

SEQ ID NO: 808873 - RNA, 19 nt, Homo sapiens
agacaucuacuaugacuga

SEQ ID NO: 808874 - RNA, 19 nt, Homo sapiens
gaccuuaucuuuccccauu

SEQ ID NO: 808875 - RNA, 19 nt, Homo sapiens
ucagcucccugcacaauuc

SEQ ID NO: 808876 - RNA, 19 nt, Homo sapiens
ucauggcuauggaacagua

SEQ ID NO: 808877 - RNA, 19 nt, Homo sapiens
ccugcacucucguuacuaa

SEQ ID NO: 808878 - RNA, 19 nt, Homo sapiens
caaguccaaugauuacauc

SEQ ID NO: 808879 - RNA, 19 nt, Homo sapiens
ggacgcuaauggcuacuca

SEQ ID NO: 808880 - RNA, 19 nt, Homo sapiens
gaugaggacaugcaaagga

SEQ ID NO: 808881 - RNA, 19 nt, Homo sapiens
aaucuucaaugcccuguga

SEQ ID NO: 808882 - RNA, 19 nt, Homo sapiens
ucaucaaucuuucacuuuc

SEQ ID NO: 808883 - RNA, 19 nt, Homo sapiens
gaagccaacagcuacgauu

SEQ ID NO: 808884 - RNA, 19 nt, Homo sapiens
gaggaguuggcaagaauuu

SEQ ID NO: 808885 - RNA, 19 nt, Homo sapiens
ccuccagccuuucuccuuu

SEQ ID NO: 808886 - RNA, 19 nt, Homo sapiens
gggagacguuuacaaagag

SEQ ID NO: 808887 - RNA, 19 nt, Homo sapiens
ucaaacggcuuggcugauc

SEQ ID NO: 808888 - RNA, 19 nt, Homo sapiens
gggcucugccuguguagua

SEQ ID NO: 808889 - RNA, 19 nt, Homo sapiens
gcacaaccacccagcaucu

SEQ ID NO: 808890 - RNA, 19 nt, Homo sapiens
ggagagcgcuuaaaacacu

SEQ ID NO: 808891 - RNA, 19 nt, Homo sapiens
ggaauucagccuucucuac

SEQ ID NO: 808892 - RNA, 19 nt, Homo sapiens
gagaaagaaaucaucaaca

SEQ ID NO: 808893 - RNA, 19 nt, Homo sapiens
ucagacagauacucaaacu

SEQ ID NO: 808894 - RNA, 19 nt, Homo sapiens
ucccaucucucacucagaa

SEQ ID NO: 808895 - RNA, 19 nt, Homo sapiens
ccuugacucuguuucauug

SEQ ID NO: 808896 - RNA, 19 nt, Homo sapiens
uuucuccgcucuuagguaa

SEQ ID NO: 808897 - RNA, 19 nt, Homo sapiens
acacacacacccuuucauu

SEQ ID NO: 808898 - RNA, 19 nt, Homo sapiens
agaaccacgugucaaguga

SEQ ID NO: 808899 - RNA, 19 nt, Homo sapiens
gaaugagaaccacguguca

SEQ ID NO: 808900 - RNA, 19 nt, Homo sapiens
ggaagacccucaggaucuc

SEQ ID NO: 808901 - RNA, 19 nt, Homo sapiens
cagcuacgauucggaugaa

SEQ ID NO: 808902 - RNA, 19 nt, Homo sapiens
ggagaaagaaaucaucaac

SEQ ID NO: 808903 - RNA, 19 nt, Homo sapiens
ugacugaugaggagaaaga

SEQ ID NO: 808904 - RNA, 19 nt, Homo sapiens
caucagacagauacucaaa

SEQ ID NO: 808905 - RNA, 19 nt, Homo sapiens
ggcccacgcuucuuaacug

SEQ ID NO: 808906 - RNA, 19 nt, Homo sapiens
ggggagacguuuacaaaga

SEQ ID NO: 808907 - RNA, 19 nt, Homo sapiens
gcugggaugugggcucuga

SEQ ID NO: 808908 - RNA, 19 nt, Homo sapiens
gagaaccacgugucaagug

SEQ ID NO: 808909 - RNA, 19 nt, Homo sapiens
uggcugaucccuacguuaa

SEQ ID NO: 808910 - RNA, 19 nt, Homo sapiens
gccuuucucucucucuaaa

SEQ ID NO: 808911 - RNA, 19 nt, Homo sapiens
gagauguacacccugauug

SEQ ID NO: 808912 - RNA, 19 nt, Homo sapiens
uguguugugucucuguaua

SEQ ID NO: 808913 - RNA, 19 nt, Homo sapiens
gcaagaaccuggagaagga

SEQ ID NO: 808914 - RNA, 19 nt, Homo sapiens
gaacaaaccagaccaaaga

SEQ ID NO: 808915 - RNA, 19 nt, Homo sapiens
aaaggaagcuccaggauuu

SEQ ID NO: 808916 - RNA, 19 nt, Homo sapiens
gggcaaagcugucaacuuc

SEQ ID NO: 808917 - RNA, 19 nt, Homo sapiens
ggaaaucccuuggaacaaa

SEQ ID NO: 808918 - RNA, 19 nt, Homo sapiens
ggugcuaucuuccauauuu

SEQ ID NO: 808919 - RNA, 19 nt, Homo sapiens
gaugagaccuacauuccua

SEQ ID NO: 808920 - RNA, 19 nt, Homo sapiens
ggaagaagauuaugaugag

SEQ ID NO: 808921 - RNA, 19 nt, Homo sapiens
ccaaggagguuguguguau

SEQ ID NO: 808922 - RNA, 19 nt, Homo sapiens
gcacagaguucaccagaag

SEQ ID NO: 808923 - RNA, 19 nt, Homo sapiens
caggugacauuuacuauuu

SEQ ID NO: 808924 - RNA, 19 nt, Homo sapiens
acaggaagcucaacagaaa

SEQ ID NO: 808925 - RNA, 19 nt, Homo sapiens
ggaaauuagugaacacaug

SEQ ID NO: 808926 - RNA, 19 nt, Homo sapiens
ggccuuggguuccucauua

SEQ ID NO: 808927 - RNA, 19 nt, Homo sapiens
gccaagaacuggaaauuag

SEQ ID NO: 808928 - RNA, 19 nt, Homo sapiens
gaaaggaagcuccaggauu

SEQ ID NO: 808929 - RNA, 19 nt, Homo sapiens
ggagagguaccauagguua

SEQ ID NO: 808930 - RNA, 19 nt, Homo sapiens
gaaauuagugaacacauga

SEQ ID NO: 808931 - RNA, 19 nt, Homo sapiens
caagugagccucuuaggaa

SEQ ID NO: 808932 - RNA, 19 nt, Homo sapiens
gaauagaagacaaggauga

SEQ ID NO: 808933 - RNA, 19 nt, Homo sapiens
gcaaagcugucaacuucug

SEQ ID NO: 808934 - RNA, 19 nt, Homo sapiens
gcaaggaggacuuauacuu

SEQ ID NO: 808935 - RNA, 19 nt, Homo sapiens
gagaggagguuggacaaga

SEQ ID NO: 808936 - RNA, 19 nt, Homo sapiens
gggagaagcugugccaaga

SEQ ID NO: 808937 - RNA, 19 nt, Homo sapiens
ccaaggagccaaagaagaa

SEQ ID NO: 808938 - RNA, 19 nt, Homo sapiens
gggaugcucucugauguuu

SEQ ID NO: 808939 - RNA, 19 nt, Homo sapiens
ccacaucuaucuccaauac

SEQ ID NO: 808940 - RNA, 19 nt, Homo sapiens
gggaagaggccucagauga

SEQ ID NO: 808941 - RNA, 19 nt, Homo sapiens
ucaaggcccuggaagauau

SEQ ID NO: 808942 - RNA, 19 nt, Homo sapiens
ugagagaagugacaguuga

SEQ ID NO: 808943 - RNA, 19 nt, Homo sapiens
uguacgagcucuugucauu

SEQ ID NO: 808944 - RNA, 19 nt, Homo sapiens
uaaccuaucucaggcuaaa

SEQ ID NO: 808945 - RNA, 19 nt, Homo sapiens
gaagagugaaccuaagauu

SEQ ID NO: 808946 - RNA, 19 nt, Homo sapiens
gcuccaggauuuagaguug

SEQ ID NO: 808947 - RNA, 19 nt, Homo sapiens
caagaccucugcuuauaca

SEQ ID NO: 808948 - RNA, 19 nt, Homo sapiens
agaaguggcgcaaguauuu

SEQ ID NO: 808949 - RNA, 19 nt, Homo sapiens
gccacaaccugcugaagaa

SEQ ID NO: 808950 - RNA, 19 nt, Homo sapiens
gcagagggcccaugaacga

SEQ ID NO: 808951 - RNA, 19 nt, Homo sapiens
gaggagagguaccauaggu

SEQ ID NO: 808952 - RNA, 19 nt, Homo sapiens
aagaugagcugcagagcaa

SEQ ID NO: 808953 - RNA, 19 nt, Homo sapiens
gagcauuccaucucucuuu

SEQ ID NO: 808954 - RNA, 19 nt, Homo sapiens
gaagaagauuaugaugaga

SEQ ID NO: 808955 - RNA, 19 nt, Homo sapiens
ggagcugccugccuucuuc

SEQ ID NO: 808956 - RNA, 19 nt, Homo sapiens
gaggaaaucccuuggaaca

SEQ ID NO: 808957 - RNA, 19 nt, Homo sapiens
uaaaauguguggacuugua

SEQ ID NO: 808958 - RNA, 19 nt, Homo sapiens
agccagaucuccauauuga

SEQ ID NO: 808959 - RNA, 19 nt, Homo sapiens
gaaaccagagcuaaagaug

SEQ ID NO: 808960 - RNA, 19 nt, Homo sapiens
uggcaacgcuggagaagga

SEQ ID NO: 808961 - RNA, 19 nt, Homo sapiens
agaccuacauuccuaguga

SEQ ID NO: 808962 - RNA, 19 nt, Homo sapiens
gaugcucucugauguuugu

SEQ ID NO: 808963 - RNA, 19 nt, Homo sapiens
gaguucaccagaagucuua

SEQ ID NO: 808964 - RNA, 19 nt, Homo sapiens
cagaucagacccuuucuuu

SEQ ID NO: 808965 - RNA, 19 nt, Homo sapiens
gaagauacaggaagcucaa

SEQ ID NO: 808966 - RNA, 19 nt, Homo sapiens
gagaagagugaaccuaaga

SEQ ID NO: 808967 - RNA, 19 nt, Homo sapiens
gaaggauguuucucuggau

SEQ ID NO: 808968 - RNA, 19 nt, Homo sapiens
gaaccuacaccuggacauu

SEQ ID NO: 808969 - RNA, 19 nt, Homo sapiens
gcuggaacgugucaagaau

SEQ ID NO: 808970 - RNA, 19 nt, Homo sapiens
cucaagaccucugcuuaua

SEQ ID NO: 808971 - RNA, 19 nt, Homo sapiens
cauaggagaucagcugguu

SEQ ID NO: 808972 - RNA, 19 nt, Homo sapiens
uacgagcucuugucauuga

SEQ ID NO: 808973 - RNA, 19 nt, Homo sapiens
gcagugcaguggcaugauc

SEQ ID NO: 808974 - RNA, 19 nt, Homo sapiens
gcaaguggagcacagaguu

SEQ ID NO: 808975 - RNA, 19 nt, Homo sapiens
gccagcaacugcagaaaca

SEQ ID NO: 808976 - RNA, 19 nt, Homo sapiens
ucaaaggaaccacugauga

SEQ ID NO: 808977 - RNA, 19 nt, Homo sapiens
ugugaugucuucaaaggaa

SEQ ID NO: 808978 - RNA, 19 nt, Homo sapiens
agagugaaccuaagauuug

SEQ ID NO: 808979 - RNA, 19 nt, Homo sapiens
caaggaaccagaacugaug

SEQ ID NO: 808980 - RNA, 19 nt, Homo sapiens
ugagccagaucuccauauu

SEQ ID NO: 808981 - RNA, 19 nt, Homo sapiens
gagagaagcgccaggaagu

SEQ ID NO: 808982 - RNA, 19 nt, Homo sapiens
uagguuaucuccuccacuu

SEQ ID NO: 808983 - RNA, 19 nt, Homo sapiens
caagugacccuuccacauc

SEQ ID NO: 808984 - RNA, 19 nt, Homo sapiens
ccucuuggguuuaggagaa

SEQ ID NO: 808985 - RNA, 19 nt, Homo sapiens
gggccuggcuccuuuacga

SEQ ID NO: 808986 - RNA, 19 nt, Homo sapiens
cauuucagcuggagucuca

SEQ ID NO: 808987 - RNA, 19 nt, Homo sapiens
gagcaaggaggacuuauac

SEQ ID NO: 808988 - RNA, 19 nt, Homo sapiens
gauguuuguuccguuguuu

SEQ ID NO: 808989 - RNA, 19 nt, Homo sapiens
gggcauuguuuccaucugu

SEQ ID NO: 808990 - RNA, 19 nt, Homo sapiens
uggaacgugucaagaauga

SEQ ID NO: 808991 - RNA, 19 nt, Homo sapiens
gagaaguggcgcaaguauu

SEQ ID NO: 808992 - RNA, 19 nt, Homo sapiens
gaaaucccuuggaacaaac

SEQ ID NO: 808993 - RNA, 19 nt, Homo sapiens
gaaggaaccacagcucuca

SEQ ID NO: 808994 - RNA, 19 nt, Homo sapiens
uggaagauaugcgcaagaa

SEQ ID NO: 808995 - RNA, 19 nt, Homo sapiens
cgcaggagguggccaaaga

SEQ ID NO: 808996 - RNA, 19 nt, Homo sapiens
gaggagcaccagcaaguga

SEQ ID NO: 808997 - RNA, 19 nt, Homo sapiens
gggaauagaagacaaggau

SEQ ID NO: 808998 - RNA, 19 nt, Homo sapiens
gguuaccucucuucucuuc

SEQ ID NO: 808999 - RNA, 19 nt, Homo sapiens
ggagaaguggcgcaaguau

SEQ ID NO: 809000 - RNA, 19 nt, Homo sapiens
gaagugacaguugaggaaa

SEQ ID NO: 809001 - RNA, 19 nt, Homo sapiens
uuaaaugccucuuuucuug

SEQ ID NO: 809002 - RNA, 19 nt, Homo sapiens
guaugguucuuaauucauc

SEQ ID NO: 809003 - RNA, 19 nt, Homo sapiens
gcaccuggaugagaugaag

SEQ ID NO: 809004 - RNA, 19 nt, Homo sapiens
ggaacaaaccagaccaaag

SEQ ID NO: 809005 - RNA, 19 nt, Homo sapiens
gcagcucaaggaagagaua

SEQ ID NO: 809006 - RNA, 19 nt, Homo sapiens
gggaagaggcagccaagga

SEQ ID NO: 809007 - RNA, 19 nt, Homo sapiens
acagggaaguggagcaaga

SEQ ID NO: 809008 - RNA, 19 nt, Homo sapiens
gcccacaucuaucuccaau

SEQ ID NO: 809009 - RNA, 19 nt, Homo sapiens
ggacuuguacgagcucuug

SEQ ID NO: 809010 - RNA, 19 nt, Homo sapiens
gaugagcacaacagaguga

SEQ ID NO: 809011 - RNA, 19 nt, Homo sapiens
gcagugaaaguucugaauc

SEQ ID NO: 809012 - RNA, 19 nt, Homo sapiens
gaccucugcuuauacaaag

SEQ ID NO: 809013 - RNA, 19 nt, Homo sapiens
ggacagagcagccaaugaa

SEQ ID NO: 809014 - RNA, 19 nt, Homo sapiens
gaagagcacuggcauuugg

SEQ ID NO: 809015 - RNA, 19 nt, Homo sapiens
caagaaagaugcuaagucu

SEQ ID NO: 809016 - RNA, 19 nt, Homo sapiens
gaacaggaaugagcaggaa

SEQ ID NO: 809017 - RNA, 19 nt, Homo sapiens
gaggaugccuugaaugugu

SEQ ID NO: 809018 - RNA, 19 nt, Homo sapiens
gaaugaggaugccuugaau

SEQ ID NO: 809019 - RNA, 19 nt, Homo sapiens
gccagugccucgcaugaua

SEQ ID NO: 809020 - RNA, 19 nt, Homo sapiens
ccagaagaauucagaguau

SEQ ID NO: 809021 - RNA, 19 nt, Homo sapiens
gcagaucucccaacuugaa

SEQ ID NO: 809022 - RNA, 19 nt, Homo sapiens
gaugagagcccugagcuuu

SEQ ID NO: 809023 - RNA, 19 nt, Homo sapiens
cagagcaccucacuccuuu

SEQ ID NO: 809024 - RNA, 19 nt, Homo sapiens
gaagacaaaucuaggucau

SEQ ID NO: 809025 - RNA, 19 nt, Homo sapiens
gaggcuggcuggcagguuu

SEQ ID NO: 809026 - RNA, 19 nt, Homo sapiens
cugcagaucucccaacuug

SEQ ID NO: 809027 - RNA, 19 nt, Homo sapiens
acacuggccuccauaauuc

SEQ ID NO: 809028 - RNA, 19 nt, Homo sapiens
cagaguaugugucucagaa

SEQ ID NO: 809029 - RNA, 19 nt, Homo sapiens
ugaugaagcuccucagaau

SEQ ID NO: 809030 - RNA, 19 nt, Homo sapiens
gcgaagagcacuggcauuu

SEQ ID NO: 809031 - RNA, 19 nt, Homo sapiens
gcaccucacuccuuugaag

SEQ ID NO: 809032 - RNA, 19 nt, Homo sapiens
guagucacccugcuuguuu

SEQ ID NO: 809033 - RNA, 19 nt, Homo sapiens
ccauagagaucgagcuuca

SEQ ID NO: 809034 - RNA, 19 nt, Homo sapiens
caaagcccauucauccauu

SEQ ID NO: 809035 - RNA, 19 nt, Homo sapiens
agaaagaugcuaagucuga

SEQ ID NO: 809036 - RNA, 19 nt, Homo sapiens
gguuacagguucuggacua

SEQ ID NO: 809037 - RNA, 19 nt, Homo sapiens
gcaugaagcagacugaaga

SEQ ID NO: 809038 - RNA, 19 nt, Homo sapiens
ccaaacaccugcacaagac

SEQ ID NO: 809039 - RNA, 19 nt, Homo sapiens
gaacggugcuccagaugcu

SEQ ID NO: 809040 - RNA, 19 nt, Homo sapiens
caauggagacagaggcuua

SEQ ID NO: 809041 - RNA, 19 nt, Homo sapiens
gaugaagcuccucagaaua

SEQ ID NO: 809042 - RNA, 19 nt, Homo sapiens
gaacccacagcaauaagaa

SEQ ID NO: 809043 - RNA, 19 nt, Homo sapiens
ggaggcaccuucgccagaa

SEQ ID NO: 809044 - RNA, 19 nt, Homo sapiens
agggagagcugacugaguu

SEQ ID NO: 809045 - RNA, 19 nt, Homo sapiens
gcacuggcauuuggcaugu

SEQ ID NO: 809046 - RNA, 19 nt, Homo sapiens
gcagagcaccucacuccuu

SEQ ID NO: 809047 - RNA, 19 nt, Homo sapiens
ccaagcuucuucccuauca

SEQ ID NO: 809048 - RNA, 19 nt, Homo sapiens
caaugaguauuccugcuau

SEQ ID NO: 809049 - RNA, 19 nt, Homo sapiens
ucucccaacuugaacuaua

SEQ ID NO: 809050 - RNA, 19 nt, Homo sapiens
gagcuuuggaaccacauua

SEQ ID NO: 809051 - RNA, 19 nt, Homo sapiens
guguagauauguguguaua

SEQ ID NO: 809052 - RNA, 19 nt, Homo sapiens
ggcuagaggugcugaagga

SEQ ID NO: 809053 - RNA, 19 nt, Homo sapiens
gcuccugacccacaaauga

SEQ ID NO: 809054 - RNA, 19 nt, Homo sapiens
caagccaguucuucucuuc

SEQ ID NO: 809055 - RNA, 19 nt, Homo sapiens
gagcaccucacuccuuuga

SEQ ID NO: 809056 - RNA, 19 nt, Homo sapiens
ccacagcaauaagaaugaa

SEQ ID NO: 809057 - RNA, 19 nt, Homo sapiens
ccaaugaguauuccugcua

SEQ ID NO: 809058 - RNA, 19 nt, Homo sapiens
gaagagcacagaggaagau

SEQ ID NO: 809059 - RNA, 19 nt, Homo sapiens
ggggaacccucaguaaaua

SEQ ID NO: 809060 - RNA, 19 nt, Homo sapiens
ugaaugaggaugccuugaa

SEQ ID NO: 809061 - RNA, 19 nt, Homo sapiens
guguauauguaucaggaaa

SEQ ID NO: 809062 - RNA, 19 nt, Homo sapiens
caaacacuggccuccauaa

SEQ ID NO: 809063 - RNA, 19 nt, Homo sapiens
cagaagaauucagaguaug

SEQ ID NO: 809064 - RNA, 19 nt, Homo sapiens
gggccucauuggagauaaa

SEQ ID NO: 809065 - RNA, 19 nt, Homo sapiens
ggagagaacaaagcccauu

SEQ ID NO: 809066 - RNA, 19 nt, Homo sapiens
gaauacuccuccagcaacu

SEQ ID NO: 809067 - RNA, 19 nt, Homo sapiens
ccaaggaagacaaaucuag

SEQ ID NO: 809068 - RNA, 19 nt, Homo sapiens
gcucaucacucagccuaag

SEQ ID NO: 809069 - RNA, 19 nt, Homo sapiens
gaaaggcauucugcugacu

SEQ ID NO: 809070 - RNA, 19 nt, Homo sapiens
gaauucagaguaugugucu

SEQ ID NO: 809071 - RNA, 19 nt, Homo sapiens
cacacacucuucuccaaug

SEQ ID NO: 809072 - RNA, 19 nt, Homo sapiens
gaucucccaacuugaacua

SEQ ID NO: 809073 - RNA, 19 nt, Homo sapiens
ccaaacacuggccuccaua

SEQ ID NO: 809074 - RNA, 19 nt, Homo sapiens
gugcauguguagauaugug

SEQ ID NO: 809075 - RNA, 19 nt, Homo sapiens
aaugacugguccugucuuu

SEQ ID NO: 809076 - RNA, 19 nt, Homo sapiens
caaagaaaauggugaucug

SEQ ID NO: 809077 - RNA, 19 nt, Homo sapiens
gaucgagcuucaggacaga

SEQ ID NO: 809078 - RNA, 19 nt, Homo sapiens
cugcccagcugguguguga

SEQ ID NO: 809079 - RNA, 19 nt, Homo sapiens
cugcagagccucccuaagu

SEQ ID NO: 809080 - RNA, 19 nt, Homo sapiens
cgguguauguggauuaugu

SEQ ID NO: 809081 - RNA, 19 nt, Homo sapiens
ccucaagccucccaaacca

SEQ ID NO: 809082 - RNA, 19 nt, Homo sapiens
uggcuccucuccacaagaa

SEQ ID NO: 809083 - RNA, 19 nt, Homo sapiens
gcuccaagaaagaugcuaa

SEQ ID NO: 809084 - RNA, 19 nt, Homo sapiens
gaagaauucagaguaugug

SEQ ID NO: 809085 - RNA, 19 nt, Homo sapiens
cucccaacuugaacuauaa

SEQ ID NO: 809086 - RNA, 19 nt, Homo sapiens
ccaagaaagaugcuaaguc

SEQ ID NO: 809087 - RNA, 19 nt, Homo sapiens
gaaaaucuguguguguaca

SEQ ID NO: 809088 - RNA, 19 nt, Homo sapiens
gaguaugugucucagaaaa

SEQ ID NO: 809089 - RNA, 19 nt, Homo sapiens
gcuuguuucugcagcaaug

SEQ ID NO: 809090 - RNA, 19 nt, Homo sapiens
ggaagccaaucagccaaag

SEQ ID NO: 809091 - RNA, 19 nt, Homo sapiens
gcagagccucccuaagugu

SEQ ID NO: 809092 - RNA, 19 nt, Homo sapiens
gagcacagaggaagauguc

SEQ ID NO: 809093 - RNA, 19 nt, Homo sapiens
gcucaggcacagcaacuug

SEQ ID NO: 809094 - RNA, 19 nt, Homo sapiens
gugcuccauuucuuccuuu

SEQ ID NO: 809095 - RNA, 19 nt, Homo sapiens
gagagaacaaagcccauuc

SEQ ID NO: 809096 - RNA, 19 nt, Homo sapiens
gggcacauguugggagaca

SEQ ID NO: 809097 - RNA, 19 nt, Homo sapiens
guccugauccucucacaga

SEQ ID NO: 809098 - RNA, 19 nt, Homo sapiens
ccacaggccagccagugaa

SEQ ID NO: 809099 - RNA, 19 nt, Homo sapiens
caacuugaacuauaaucca

SEQ ID NO: 809100 - RNA, 19 nt, Homo sapiens
guauauguaucaggaaagg

SEQ ID NO: 809101 - RNA, 19 nt, Homo sapiens
uaugaggacugugacuguu

SEQ ID NO: 809102 - RNA, 19 nt, Homo sapiens
gagccagugccucgcauga

SEQ ID NO: 809103 - RNA, 19 nt, Homo sapiens
cagaaacacugggccaaac

SEQ ID NO: 809104 - RNA, 19 nt, Homo sapiens
ugacugagugcuccauuuc

SEQ ID NO: 809105 - RNA, 19 nt, Homo sapiens
gccugaacccacagcaaua

SEQ ID NO: 809106 - RNA, 19 nt, Homo sapiens
gacagagcagccaaugaaa

SEQ ID NO: 809107 - RNA, 19 nt, Homo sapiens
gcaucugggugaagaaacg

SEQ ID NO: 809108 - RNA, 19 nt, Homo sapiens
ugagagcccugagcuuugg

SEQ ID NO: 809109 - RNA, 19 nt, Homo sapiens
auuauucgcuccaagaaag

SEQ ID NO: 809110 - RNA, 19 nt, Homo sapiens
gcaaugacugguccugucu

SEQ ID NO: 809111 - RNA, 19 nt, Homo sapiens
gaagccaaucagccaaaga

SEQ ID NO: 809112 - RNA, 19 nt, Homo sapiens
ggagucagcgagcgguuuc

SEQ ID NO: 809113 - RNA, 19 nt, Homo sapiens
ggacagagcagccaaugaa

SEQ ID NO: 809114 - RNA, 19 nt, Homo sapiens
gaagagcacuggcauuugg

SEQ ID NO: 809115 - RNA, 19 nt, Homo sapiens
caagaaagaugcuaagucu

SEQ ID NO: 809116 - RNA, 19 nt, Homo sapiens
gaacaggaaugagcaggaa

SEQ ID NO: 809117 - RNA, 19 nt, Homo sapiens
gaggaugccuugaaugugu

SEQ ID NO: 809118 - RNA, 19 nt, Homo sapiens
gaaugaggaugccuugaau

SEQ ID NO: 809119 - RNA, 19 nt, Homo sapiens
gccagugccucgcaugaua

SEQ ID NO: 809120 - RNA, 19 nt, Homo sapiens
ccagaagaauucagaguau

SEQ ID NO: 809121 - RNA, 19 nt, Homo sapiens
gcagaucucccaacuugaa

SEQ ID NO: 809122 - RNA, 19 nt, Homo sapiens
gaugagagcccugagcuuu

SEQ ID NO: 809123 - RNA, 19 nt, Homo sapiens
cagagcaccucacuccuuu

SEQ ID NO: 809124 - RNA, 19 nt, Homo sapiens
gaagacaaaucuaggucau

SEQ ID NO: 809125 - RNA, 19 nt, Homo sapiens
gaggcuggcuggcagguuu

SEQ ID NO: 809126 - RNA, 19 nt, Homo sapiens
cugcagaucucccaacuug

SEQ ID NO: 809127 - RNA, 19 nt, Homo sapiens
acacuggccuccauaauuc

SEQ ID NO: 809128 - RNA, 19 nt, Homo sapiens
cagaguaugugucucagaa

SEQ ID NO: 809129 - RNA, 19 nt, Homo sapiens
ugaugaagcuccucagaau

SEQ ID NO: 809130 - RNA, 19 nt, Homo sapiens
gcgaagagcacuggcauuu

SEQ ID NO: 809131 - RNA, 19 nt, Homo sapiens
gcaccucacuccuuugaag

SEQ ID NO: 809132 - RNA, 19 nt, Homo sapiens
guagucacccugcuuguuu

SEQ ID NO: 809133 - RNA, 19 nt, Homo sapiens
ccauagagaucgagcuuca

SEQ ID NO: 809134 - RNA, 19 nt, Homo sapiens
caaagcccauucauccauu

SEQ ID NO: 809135 - RNA, 19 nt, Homo sapiens
agaaagaugcuaagucuga

SEQ ID NO: 809136 - RNA, 19 nt, Homo sapiens
gguuacagguucuggacua

SEQ ID NO: 809137 - RNA, 19 nt, Homo sapiens
gcaugaagcagacugaaga

SEQ ID NO: 809138 - RNA, 19 nt, Homo sapiens
ccaaacaccugcacaagac

SEQ ID NO: 809139 - RNA, 19 nt, Homo sapiens
gaacggugcuccagaugcu

SEQ ID NO: 809140 - RNA, 19 nt, Homo sapiens
caauggagacagaggcuua

SEQ ID NO: 809141 - RNA, 19 nt, Homo sapiens
gaugaagcuccucagaaua

SEQ ID NO: 809142 - RNA, 19 nt, Homo sapiens
gaacccacagcaauaagaa

SEQ ID NO: 809143 - RNA, 19 nt, Homo sapiens
ggaggcaccuucgccagaa

SEQ ID NO: 809144 - RNA, 19 nt, Homo sapiens
agggagagcugacugaguu

SEQ ID NO: 809145 - RNA, 19 nt, Homo sapiens
gcacuggcauuuggcaugu

SEQ ID NO: 809146 - RNA, 19 nt, Homo sapiens
gcagagcaccucacuccuu

SEQ ID NO: 809147 - RNA, 19 nt, Homo sapiens
ccaagcuucuucccuauca

SEQ ID NO: 809148 - RNA, 19 nt, Homo sapiens
caaugaguauuccugcuau

SEQ ID NO: 809149 - RNA, 19 nt, Homo sapiens
ucucccaacuugaacuaua

SEQ ID NO: 809150 - RNA, 19 nt, Homo sapiens
gagcuuuggaaccacauua

SEQ ID NO: 809151 - RNA, 19 nt, Homo sapiens
guguagauauguguguaua

SEQ ID NO: 809152 - RNA, 19 nt, Homo sapiens
ggcuagaggugcugaagga

SEQ ID NO: 809153 - RNA, 19 nt, Homo sapiens
gcuccugacccacaaauga

SEQ ID NO: 809154 - RNA, 19 nt, Homo sapiens
caagccaguucuucucuuc

SEQ ID NO: 809155 - RNA, 19 nt, Homo sapiens
gagcaccucacuccuuuga

SEQ ID NO: 809156 - RNA, 19 nt, Homo sapiens
ccacagcaauaagaaugaa

SEQ ID NO: 809157 - RNA, 19 nt, Homo sapiens
ccaaugaguauuccugcua

SEQ ID NO: 809158 - RNA, 19 nt, Homo sapiens
gaagagcacagaggaagau

SEQ ID NO: 809159 - RNA, 19 nt, Homo sapiens
ggggaacccucaguaaaua

SEQ ID NO: 809160 - RNA, 19 nt, Homo sapiens
ugaaugaggaugccuugaa

SEQ ID NO: 809161 - RNA, 19 nt, Homo sapiens
guguauauguaucaggaaa

SEQ ID NO: 809162 - RNA, 19 nt, Homo sapiens
caaacacuggccuccauaa

SEQ ID NO: 809163 - RNA, 19 nt, Homo sapiens
cagaagaauucagaguaug

SEQ ID NO: 809164 - RNA, 19 nt, Homo sapiens
gggccucauuggagauaaa

SEQ ID NO: 809165 - RNA, 19 nt, Homo sapiens
ggagagaacaaagcccauu

SEQ ID NO: 809166 - RNA, 19 nt, Homo sapiens
gaauacuccuccagcaacu

SEQ ID NO: 809167 - RNA, 19 nt, Homo sapiens
ccaaggaagacaaaucuag

SEQ ID NO: 809168 - RNA, 19 nt, Homo sapiens
gcucaucacucagccuaag

SEQ ID NO: 809169 - RNA, 19 nt, Homo sapiens
gaaaggcauucugcugacu

SEQ ID NO: 809170 - RNA, 19 nt, Homo sapiens
gaauucagaguaugugucu

SEQ ID NO: 809171 - RNA, 19 nt, Homo sapiens
cacacacucuucuccaaug

SEQ ID NO: 809172 - RNA, 19 nt, Homo sapiens
gaucucccaacuugaacua

SEQ ID NO: 809173 - RNA, 19 nt, Homo sapiens
ccaaacacuggccuccaua

SEQ ID NO: 809174 - RNA, 19 nt, Homo sapiens
gugcauguguagauaugug

SEQ ID NO: 809175 - RNA, 19 nt, Homo sapiens
aaugacugguccugucuuu

SEQ ID NO: 809176 - RNA, 19 nt, Homo sapiens
caaagaaaauggugaucug

SEQ ID NO: 809177 - RNA, 19 nt, Homo sapiens
gaucgagcuucaggacaga

SEQ ID NO: 809178 - RNA, 19 nt, Homo sapiens
cugcccagcugguguguga

SEQ ID NO: 809179 - RNA, 19 nt, Homo sapiens
cugcagagccucccuaagu

SEQ ID NO: 809180 - RNA, 19 nt, Homo sapiens
cgguguauguggauuaugu

SEQ ID NO: 809181 - RNA, 19 nt, Homo sapiens
ccucaagccucccaaacca

SEQ ID NO: 809182 - RNA, 19 nt, Homo sapiens
uggcuccucuccacaagaa

SEQ ID NO: 809183 - RNA, 19 nt, Homo sapiens
gcuccaagaaagaugcuaa

SEQ ID NO: 809184 - RNA, 19 nt, Homo sapiens
gaagaauucagaguaugug

SEQ ID NO: 809185 - RNA, 19 nt, Homo sapiens
cucccaacuugaacuauaa

SEQ ID NO: 809186 - RNA, 19 nt, Homo sapiens
ccaagaaagaugcuaaguc

SEQ ID NO: 809187 - RNA, 19 nt, Homo sapiens
gaaaaucuguguguguaca

SEQ ID NO: 809188 - RNA, 19 nt, Homo sapiens
gaguaugugucucagaaaa

SEQ ID NO: 809189 - RNA, 19 nt, Homo sapiens
gcuuguuucugcagcaaug

SEQ ID NO: 809190 - RNA, 19 nt, Homo sapiens
ggaagccaaucagccaaag

SEQ ID NO: 809191 - RNA, 19 nt, Homo sapiens
gcagagccucccuaagugu

SEQ ID NO: 809192 - RNA, 19 nt, Homo sapiens
gagcacagaggaagauguc

SEQ ID NO: 809193 - RNA, 19 nt, Homo sapiens
gcucaggcacagcaacuug

SEQ ID NO: 809194 - RNA, 19 nt, Homo sapiens
gugcuccauuucuuccuuu

SEQ ID NO: 809195 - RNA, 19 nt, Homo sapiens
gagagaacaaagcccauuc

SEQ ID NO: 809196 - RNA, 19 nt, Homo sapiens
gggcacauguugggagaca

SEQ ID NO: 809197 - RNA, 19 nt, Homo sapiens
guccugauccucucacaga

SEQ ID NO: 809198 - RNA, 19 nt, Homo sapiens
ccacaggccagccagugaa

SEQ ID NO: 809199 - RNA, 19 nt, Homo sapiens
caacuugaacuauaaucca

SEQ ID NO: 809200 - RNA, 19 nt, Homo sapiens
guauauguaucaggaaagg

SEQ ID NO: 809201 - RNA, 19 nt, Homo sapiens
uaugaggacugugacuguu

SEQ ID NO: 809202 - RNA, 19 nt, Homo sapiens
gagccagugccucgcauga

SEQ ID NO: 809203 - RNA, 19 nt, Homo sapiens
cagaaacacugggccaaac

SEQ ID NO: 809204 - RNA, 19 nt, Homo sapiens
ugacugagugcuccauuuc

SEQ ID NO: 809205 - RNA, 19 nt, Homo sapiens
gccugaacccacagcaaua

SEQ ID NO: 809206 - RNA, 19 nt, Homo sapiens
gacagagcagccaaugaaa

SEQ ID NO: 809207 - RNA, 19 nt, Homo sapiens
gcaucugggugaagaaacg

SEQ ID NO: 809208 - RNA, 19 nt, Homo sapiens
ugagagcccugagcuuugg

SEQ ID NO: 809209 - RNA, 19 nt, Homo sapiens
auuauucgcuccaagaaag

SEQ ID NO: 809210 - RNA, 19 nt, Homo sapiens
gcaaugacugguccugucu

SEQ ID NO: 809211 - RNA, 19 nt, Homo sapiens
gaagccaaucagccaaaga

SEQ ID NO: 809212 - RNA, 19 nt, Homo sapiens
ggagucagcgagcgguuuc

SEQ ID NO: 809213 - RNA, 19 nt, Homo sapiens
ggaaauaguuuaagugaug

SEQ ID NO: 809214 - RNA, 19 nt, Homo sapiens
gaacugaggucuuaauauc

SEQ ID NO: 809215 - RNA, 19 nt, Homo sapiens
ggaaauggauaaacagaaa

SEQ ID NO: 809216 - RNA, 19 nt, Homo sapiens
gaugaaaugugguaaauca

SEQ ID NO: 809217 - RNA, 19 nt, Homo sapiens
ugagaaaucugcagucauu

SEQ ID NO: 809218 - RNA, 19 nt, Homo sapiens
ccaguuauauugugucuaa

SEQ ID NO: 809219 - RNA, 19 nt, Homo sapiens
gggaugaguuuccuuguuu

SEQ ID NO: 809220 - RNA, 19 nt, Homo sapiens
uaacaaaggcgauagauga

SEQ ID NO: 809221 - RNA, 19 nt, Homo sapiens
gauguugaguugauugaua

SEQ ID NO: 809222 - RNA, 19 nt, Homo sapiens
acaaugagguucuuacuga

SEQ ID NO: 809223 - RNA, 19 nt, Homo sapiens
ccaacacauugaucuauua

SEQ ID NO: 809224 - RNA, 19 nt, Homo sapiens
caaauuugcuggaguguuc

SEQ ID NO: 809225 - RNA, 19 nt, Homo sapiens
caaaggcgauagaugauga

SEQ ID NO: 809226 - RNA, 19 nt, Homo sapiens
gagauugggugcaguguau

SEQ ID NO: 809227 - RNA, 19 nt, Homo sapiens
ugagaagaguaaucuguua

SEQ ID NO: 809228 - RNA, 19 nt, Homo sapiens
ccaagaagaugaugagaca

SEQ ID NO: 809229 - RNA, 19 nt, Homo sapiens
acacauauuuccauccuuu

SEQ ID NO: 809230 - RNA, 19 nt, Homo sapiens
gagaugaaaugugguaaau

SEQ ID NO: 809231 - RNA, 19 nt, Homo sapiens
gaagaagacuggguaacau

SEQ ID NO: 809232 - RNA, 19 nt, Homo sapiens
agacaggguuucaccauuu

SEQ ID NO: 809233 - RNA, 19 nt, Homo sapiens
ggauagguguguuuaugaa

SEQ ID NO: 809234 - RNA, 19 nt, Homo sapiens
gauaagagcacaaacagau

SEQ ID NO: 809235 - RNA, 19 nt, Homo sapiens
gaagaagguaguaauauuc

SEQ ID NO: 809236 - RNA, 19 nt, Homo sapiens
gaagaguaaucuguuaugu

SEQ ID NO: 809237 - RNA, 19 nt, Homo sapiens
gaaggaacccauucaacuu

SEQ ID NO: 809238 - RNA, 19 nt, Homo sapiens
gcauguaccuauugacugu

SEQ ID NO: 809239 - RNA, 19 nt, Homo sapiens
gauaaaggacauccggaua

SEQ ID NO: 809240 - RNA, 19 nt, Homo sapiens
ggcgauagaugaugaggaa

SEQ ID NO: 809241 - RNA, 19 nt, Homo sapiens
caaauaguuuccucuuaug

SEQ ID NO: 809242 - RNA, 19 nt, Homo sapiens
gguacagauucucuuauuu

SEQ ID NO: 809243 - RNA, 19 nt, Homo sapiens
gagacaggguuucaccauu

SEQ ID NO: 809244 - RNA, 19 nt, Homo sapiens
ucucaugucuucuacugua

SEQ ID NO: 809245 - RNA, 19 nt, Homo sapiens
ccuguuagcuccauucuca

SEQ ID NO: 809246 - RNA, 19 nt, Homo sapiens
gaugagaaaucugcaguca

SEQ ID NO: 809247 - RNA, 19 nt, Homo sapiens
ucagucagccaguuuguua

SEQ ID NO: 809248 - RNA, 19 nt, Homo sapiens
ggacacuccguuugaagua

SEQ ID NO: 809249 - RNA, 19 nt, Homo sapiens
ucugugaacugaggucuua

SEQ ID NO: 809250 - RNA, 19 nt, Homo sapiens
uaaaucaacuccacagaac

SEQ ID NO: 809251 - RNA, 19 nt, Homo sapiens
aaaugucccugauauucua

SEQ ID NO: 809252 - RNA, 19 nt, Homo sapiens
guaaaucaacuccacagaa

SEQ ID NO: 809253 - RNA, 19 nt, Homo sapiens
gaaaugugguaaaucaacu

SEQ ID NO: 809254 - RNA, 19 nt, Homo sapiens
gaaggagggcugucugaga

SEQ ID NO: 809255 - RNA, 19 nt, Homo sapiens
gcaaugaaugcucaaguug

SEQ ID NO: 809256 - RNA, 19 nt, Homo sapiens
uaagccaacucugacauuu

SEQ ID NO: 809257 - RNA, 19 nt, Homo sapiens
ggaauacugagaugaaaug

SEQ ID NO: 809258 - RNA, 19 nt, Homo sapiens
ccauugacaugauucuuga

SEQ ID NO: 809259 - RNA, 19 nt, Homo sapiens
ccaaggaguugaaauuguc

SEQ ID NO: 809260 - RNA, 19 nt, Homo sapiens
aaauguggauguugaguug

SEQ ID NO: 809261 - RNA, 19 nt, Homo sapiens
gcucauccuuguauucuca

SEQ ID NO: 809262 - RNA, 19 nt, Homo sapiens
acauuuggauucuaccaua

SEQ ID NO: 809263 - RNA, 19 nt, Homo sapiens
ucaguuagguagucuggaa

SEQ ID NO: 809264 - RNA, 19 nt, Homo sapiens
gaaauguggauguugaguu

SEQ ID NO: 809265 - RNA, 19 nt, Homo sapiens
gacaaguuccaauagcuua

SEQ ID NO: 809266 - RNA, 19 nt, Homo sapiens
caaggaauacugagaugaa

SEQ ID NO: 809267 - RNA, 19 nt, Homo sapiens
gcagugguauucggaucua

SEQ ID NO: 809268 - RNA, 19 nt, Homo sapiens
gaaucuaggcacuuuauca

SEQ ID NO: 809269 - RNA, 19 nt, Homo sapiens
caacuugagauuacugaaa

SEQ ID NO: 809270 - RNA, 19 nt, Homo sapiens
ggccucggcuuccugguaa

SEQ ID NO: 809271 - RNA, 19 nt, Homo sapiens
ggagacauuugcucagaag

SEQ ID NO: 809272 - RNA, 19 nt, Homo sapiens
ucacauuuguaccacuuaa

SEQ ID NO: 809273 - RNA, 19 nt, Homo sapiens
gaggguaauucagcuuauu

SEQ ID NO: 809274 - RNA, 19 nt, Homo sapiens
gaauccagcguucucauug

SEQ ID NO: 809275 - RNA, 19 nt, Homo sapiens
ggagugcaguggugugauc

SEQ ID NO: 809276 - RNA, 19 nt, Homo sapiens
cacuacaccuggcacauuu

SEQ ID NO: 809277 - RNA, 19 nt, Homo sapiens
ggcacuuuaucaccauuua

SEQ ID NO: 809278 - RNA, 19 nt, Homo sapiens
gccaguuuguuaugucuuu

SEQ ID NO: 809279 - RNA, 19 nt, Homo sapiens
gcaagcaucugggccaucu

SEQ ID NO: 809280 - RNA, 19 nt, Homo sapiens
ccucaagaaugucugaaga

SEQ ID NO: 809281 - RNA, 19 nt, Homo sapiens
aaggaaauguggauguuga

SEQ ID NO: 809282 - RNA, 19 nt, Homo sapiens
ugaaggaaauguggauguu

SEQ ID NO: 809283 - RNA, 19 nt, Homo sapiens
gacagaggcagagccauua

SEQ ID NO: 809284 - RNA, 19 nt, Homo sapiens
ucagggcguuugaauguga

SEQ ID NO: 809285 - RNA, 19 nt, Homo sapiens
ggugcaguguauccuguua

SEQ ID NO: 809286 - RNA, 19 nt, Homo sapiens
ccacugaguugucauuugc

SEQ ID NO: 809287 - RNA, 19 nt, Homo sapiens
ccaaagugcugggauuaca

SEQ ID NO: 809288 - RNA, 19 nt, Homo sapiens
ccaaagugcugggauuaca

SEQ ID NO: 809289 - RNA, 19 nt, Homo sapiens
guucagcaguuuccuuuua

SEQ ID NO: 809290 - RNA, 19 nt, Homo sapiens
gcacacauauuuccauccu

SEQ ID NO: 809291 - RNA, 19 nt, Homo sapiens
uaccauagacucugucauu

SEQ ID NO: 809292 - RNA, 19 nt, Homo sapiens
guuguuggguuaaauguuc

SEQ ID NO: 809293 - RNA, 19 nt, Homo sapiens
uuagacagcagaauuugua

SEQ ID NO: 809294 - RNA, 19 nt, Homo sapiens
ugaaaguaaugcccaagga

SEQ ID NO: 809295 - RNA, 19 nt, Homo sapiens
gacauuugcucagaagaga

SEQ ID NO: 809296 - RNA, 19 nt, Homo sapiens
ugucagauuucaagguauu

SEQ ID NO: 809297 - RNA, 19 nt, Homo sapiens
gaaaucugcagucauucaa

SEQ ID NO: 809298 - RNA, 19 nt, Homo sapiens
aagaaugucugaagaaggu

SEQ ID NO: 809299 - RNA, 19 nt, Homo sapiens
gugaugacaaguuccaaua

SEQ ID NO: 809300 - RNA, 19 nt, Homo sapiens
gagaagaguaaucuguuau

SEQ ID NO: 809301 - RNA, 19 nt, Homo sapiens
uaccucguguccuaucuua

SEQ ID NO: 809302 - RNA, 19 nt, Homo sapiens
ucgaugaucuccaggacaa

SEQ ID NO: 809303 - RNA, 19 nt, Homo sapiens
gauagaugaugaggaagau

SEQ ID NO: 809304 - RNA, 19 nt, Homo sapiens
cgcaaugaaugcucaaguu

SEQ ID NO: 809305 - RNA, 19 nt, Homo sapiens
gaagacuggguaacaucua

SEQ ID NO: 809306 - RNA, 19 nt, Homo sapiens
gguaagggaugaggucaca

SEQ ID NO: 809307 - RNA, 19 nt, Homo sapiens
gcucagaagagaaucaaau

SEQ ID NO: 809308 - RNA, 19 nt, Homo sapiens
guuugaaugugaauuagga

SEQ ID NO: 809309 - RNA, 19 nt, Homo sapiens
caccgugccuggccucauu

SEQ ID NO: 809310 - RNA, 19 nt, Homo sapiens
gagaaggagggcugucuga

SEQ ID NO: 809311 - RNA, 19 nt, Homo sapiens
uaucuuagacagcagaauu

SEQ ID NO: 809312 - RNA, 19 nt, Homo sapiens
gcagaugaaggaacccauu

SEQ ID NO: 809313 - RNA, 19 nt, Homo sapiens
gauaugggcuguacugaua

SEQ ID NO: 809314 - RNA, 19 nt, Homo sapiens
ucaaagagauguuccuaua

SEQ ID NO: 809315 - RNA, 19 nt, Homo sapiens
gaacuugggcaauuguuua

SEQ ID NO: 809316 - RNA, 19 nt, Homo sapiens
ggccugagcugcagcauaa

SEQ ID NO: 809317 - RNA, 19 nt, Homo sapiens
ggacaaaguugaccacaca

SEQ ID NO: 809318 - RNA, 19 nt, Homo sapiens
gcaaauuuccugauucuuu

SEQ ID NO: 809319 - RNA, 19 nt, Homo sapiens
gaaauccugucucugcuaa

SEQ ID NO: 809320 - RNA, 19 nt, Homo sapiens
ucacuggucuccaucuuua

SEQ ID NO: 809321 - RNA, 19 nt, Homo sapiens
gaaugagguuuguggauuu

SEQ ID NO: 809322 - RNA, 19 nt, Homo sapiens
gaaaggaagcucucagaaa

SEQ ID NO: 809323 - RNA, 19 nt, Homo sapiens
ggaaugagguuuguggauu

SEQ ID NO: 809324 - RNA, 19 nt, Homo sapiens
uacaaggccuucuacauua

SEQ ID NO: 809325 - RNA, 19 nt, Homo sapiens
caccagcacugccuuguua

SEQ ID NO: 809326 - RNA, 19 nt, Homo sapiens
caucaugacugcuucguuu

SEQ ID NO: 809327 - RNA, 19 nt, Homo sapiens
gagcacagauuuagaccaa

SEQ ID NO: 809328 - RNA, 19 nt, Homo sapiens
cagcauaaguuuccucuga

SEQ ID NO: 809329 - RNA, 19 nt, Homo sapiens
gagcagacauucaauacau

SEQ ID NO: 809330 - RNA, 19 nt, Homo sapiens
cauagaagaucaagccaaa

SEQ ID NO: 809331 - RNA, 19 nt, Homo sapiens
aaugagggauugcaaauuu

SEQ ID NO: 809332 - RNA, 19 nt, Homo sapiens
gcagacgaguccauggaua

SEQ ID NO: 809333 - RNA, 19 nt, Homo sapiens
gaagcuuggugaggaguua

SEQ ID NO: 809334 - RNA, 19 nt, Homo sapiens
caaaucaccugggaucuug

SEQ ID NO: 809335 - RNA, 19 nt, Homo sapiens
ggaagacgauaccgcagaa

SEQ ID NO: 809336 - RNA, 19 nt, Homo sapiens
gagcaagacuccaucucaa

SEQ ID NO: 809337 - RNA, 19 nt, Homo sapiens
gagcaguuguugacauuga

SEQ ID NO: 809338 - RNA, 19 nt, Homo sapiens
guaggcaggugcauuauca

SEQ ID NO: 809339 - RNA, 19 nt, Homo sapiens
ccagaaguaugcugagaaa

SEQ ID NO: 809340 - RNA, 19 nt, Homo sapiens
gcauaaguuuccucugauu

SEQ ID NO: 809341 - RNA, 19 nt, Homo sapiens
uuacgucacugggauaaua

SEQ ID NO: 809342 - RNA, 19 nt, Homo sapiens
ggagcaaacugggcagaaa

SEQ ID NO: 809343 - RNA, 19 nt, Homo sapiens
gcacagauuuagaccaaag

SEQ ID NO: 809344 - RNA, 19 nt, Homo sapiens
gcaaauuaccugacacaga

SEQ ID NO: 809345 - RNA, 19 nt, Homo sapiens
gggcaauuguuuaaccuaa

SEQ ID NO: 809346 - RNA, 19 nt, Homo sapiens
ccgcauaacagaccaauuu

SEQ ID NO: 809347 - RNA, 19 nt, Homo sapiens
gggauguccugauuucuga

SEQ ID NO: 809348 - RNA, 19 nt, Homo sapiens
caauugcacuccauucuuc

SEQ ID NO: 809349 - RNA, 19 nt, Homo sapiens
gaggaguaccuggaaauua

SEQ ID NO: 809350 - RNA, 19 nt, Homo sapiens
guaacucccugcuguaauc

SEQ ID NO: 809351 - RNA, 19 nt, Homo sapiens
gagacuuccugcuuugaaa

SEQ ID NO: 809352 - RNA, 19 nt, Homo sapiens
aaagagauguuccuauaag

SEQ ID NO: 809353 - RNA, 19 nt, Homo sapiens
uaaccuaaccugcaaguug

SEQ ID NO: 809354 - RNA, 19 nt, Homo sapiens
uguaaucccuaccaaauug

SEQ ID NO: 809355 - RNA, 19 nt, Homo sapiens
uuacaaggccuucuacauu

SEQ ID NO: 809356 - RNA, 19 nt, Homo sapiens
gcugggcacuguggaauuu

SEQ ID NO: 809357 - RNA, 19 nt, Homo sapiens
gauugcaaauuuccugauu

SEQ ID NO: 809358 - RNA, 19 nt, Homo sapiens
agacaaguaugacacaguu

SEQ ID NO: 809359 - RNA, 19 nt, Homo sapiens
caaagagauguuccuauaa

SEQ ID NO: 809360 - RNA, 19 nt, Homo sapiens
aaaggaagcucucagaaaa

SEQ ID NO: 809361 - RNA, 19 nt, Homo sapiens
cagaauggccuuacucuuc

SEQ ID NO: 809362 - RNA, 19 nt, Homo sapiens
gcagacauucaauacauuu

SEQ ID NO: 809363 - RNA, 19 nt, Homo sapiens
ccaauaugguuaauuagca

SEQ ID NO: 809364 - RNA, 19 nt, Homo sapiens
gaaagugagcagaaaggaa

SEQ ID NO: 809365 - RNA, 19 nt, Homo sapiens
ccagagacuuccugcuuug

SEQ ID NO: 809366 - RNA, 19 nt, Homo sapiens
gcauuuacacuauaguuug

SEQ ID NO: 809367 - RNA, 19 nt, Homo sapiens
gcauaucccuucuguaucc

SEQ ID NO: 809368 - RNA, 19 nt, Homo sapiens
ucacccagcuuauuuaggu

SEQ ID NO: 809369 - RNA, 19 nt, Homo sapiens
ucgaguagauccugaaauc

SEQ ID NO: 809370 - RNA, 19 nt, Homo sapiens
ggaguuagccuugcauauc

SEQ ID NO: 809371 - RNA, 19 nt, Homo sapiens
gaaagcaacccaguucauc

SEQ ID NO: 809372 - RNA, 19 nt, Homo sapiens
caguagggcucgaguagau

SEQ ID NO: 809373 - RNA, 19 nt, Homo sapiens
acacagagcagacauucaa

SEQ ID NO: 809374 - RNA, 19 nt, Homo sapiens
gaggaggaguaccuggaaa

SEQ ID NO: 809375 - RNA, 19 nt, Homo sapiens
gaggaaacacugaccauag

SEQ ID NO: 809376 - RNA, 19 nt, Homo sapiens
caugauguguauacaaugu

SEQ ID NO: 809377 - RNA, 19 nt, Homo sapiens
aaccuaaccugcaaguuga

SEQ ID NO: 809378 - RNA, 19 nt, Homo sapiens
gagcugcggugaggaaaca

SEQ ID NO: 809379 - RNA, 19 nt, Homo sapiens
caagaggacagaagccaaa

SEQ ID NO: 809380 - RNA, 19 nt, Homo sapiens
caaaugagggauugcaaau

SEQ ID NO: 809381 - RNA, 19 nt, Homo sapiens
ccugggaucuugugagaau

SEQ ID NO: 809382 - RNA, 19 nt, Homo sapiens
aggaaacacugaccauaga

SEQ ID NO: 809383 - RNA, 19 nt, Homo sapiens
gcagaguuccaguuaaugu

SEQ ID NO: 809384 - RNA, 19 nt, Homo sapiens
uggcagaguuccaguuaau

SEQ ID NO: 809385 - RNA, 19 nt, Homo sapiens
ggacugcucaaucacuauu

SEQ ID NO: 809386 - RNA, 19 nt, Homo sapiens
gcaggugcauuaucaacag

SEQ ID NO: 809387 - RNA, 19 nt, Homo sapiens
ugguguaaauccauucuaa

SEQ ID NO: 809388 - RNA, 19 nt, Homo sapiens
gcuguaaucccuaccaaau

SEQ ID NO: 809389 - RNA, 19 nt, Homo sapiens
uuacuggccuggcagaguu

SEQ ID NO: 809390 - RNA, 19 nt, Homo sapiens
aaacauggacugcucaauc

SEQ ID NO: 809391 - RNA, 19 nt, Homo sapiens
aggaguaccuggaaauuag

SEQ ID NO: 809392 - RNA, 19 nt, Homo sapiens
aagagcaguuguugacauu

SEQ ID NO: 809393 - RNA, 19 nt, Homo sapiens
agaauggucacccagcuua

SEQ ID NO: 809394 - RNA, 19 nt, Homo sapiens
aaacagccaagcagaugua

SEQ ID NO: 809395 - RNA, 19 nt, Homo sapiens
gaacacgaccagucauuuu

SEQ ID NO: 809396 - RNA, 19 nt, Homo sapiens
acaaacacacgcuuuaguu

SEQ ID NO: 809397 - RNA, 19 nt, Homo sapiens
ucaaagagacuguuacacu

SEQ ID NO: 809398 - RNA, 19 nt, Homo sapiens
caaacugggcagaaacaaa

SEQ ID NO: 809399 - RNA, 19 nt, Homo sapiens
gaaaccccaucgcuacuaa

SEQ ID NO: 809400 - RNA, 19 nt, Homo sapiens
gcucauggccacagaaugg

SEQ ID NO: 809401 - RNA, 19 nt, Homo sapiens
gaggugugcuucucaucau

SEQ ID NO: 809402 - RNA, 19 nt, Homo sapiens
caccugggaucuugugaga

SEQ ID NO: 809403 - RNA, 19 nt, Homo sapiens
gcucugaggcccugaauac

SEQ ID NO: 809404 - RNA, 19 nt, Homo sapiens
ggaaacacugaccauagaa

SEQ ID NO: 809405 - RNA, 19 nt, Homo sapiens
ccacaugcacgugcccuua

SEQ ID NO: 809406 - RNA, 19 nt, Homo sapiens
cccagagacuuccugcuuu

SEQ ID NO: 809407 - RNA, 19 nt, Homo sapiens
aacauggacugcucaauca

SEQ ID NO: 809408 - RNA, 19 nt, Homo sapiens
cacuauaguuugaacguau

SEQ ID NO: 809409 - RNA, 19 nt, Homo sapiens
ccacaaaccaguguacuca

SEQ ID NO: 809410 - RNA, 19 nt, Homo sapiens
gaguuuaguuuuggaguua

SEQ ID NO: 809411 - RNA, 19 nt, Homo sapiens
ggaggaguaccuggaaauu

SEQ ID NO: 809412 - RNA, 19 nt, Homo sapiens
uagaagaucaagccaaaug

SEQ ID NO: 809413 - RNA, 19 nt, Homo sapiens
gaagguaguugcccauuua

SEQ ID NO: 809414 - RNA, 19 nt, Homo sapiens
gcaaagaccuuaaauagug

SEQ ID NO: 809415 - RNA, 19 nt, Homo sapiens
aaacaaagcuccuacugua

SEQ ID NO: 809416 - RNA, 19 nt, Homo sapiens
caaauaaacugaucccaaa

SEQ ID NO: 809417 - RNA, 19 nt, Homo sapiens
gaagaacuauguagaagaa

SEQ ID NO: 809418 - RNA, 19 nt, Homo sapiens
gaagaaaucugaaaguuac

SEQ ID NO: 809419 - RNA, 19 nt, Homo sapiens
gcaaacaacaggaucauua

SEQ ID NO: 809420 - RNA, 19 nt, Homo sapiens
ggaagaaaucugaaaguua

SEQ ID NO: 809421 - RNA, 19 nt, Homo sapiens
gaacugaacagacauuuga

SEQ ID NO: 809422 - RNA, 19 nt, Homo sapiens
aaacacuccucuccuauua

SEQ ID NO: 809423 - RNA, 19 nt, Homo sapiens
caauuccgcuuccuacuua

SEQ ID NO: 809424 - RNA, 19 nt, Homo sapiens
cuaauuaucucauggcuaa

SEQ ID NO: 809425 - RNA, 19 nt, Homo sapiens
gcacaaaggaggaggauuu

SEQ ID NO: 809426 - RNA, 19 nt, Homo sapiens
gcuguaaacuguaguacua

SEQ ID NO: 809427 - RNA, 19 nt, Homo sapiens
uaagauagauuccaugugu

SEQ ID NO: 809428 - RNA, 19 nt, Homo sapiens
gaagaaauggaacgaguua

SEQ ID NO: 809429 - RNA, 19 nt, Homo sapiens
ggugaggguugauauauaa

SEQ ID NO: 809430 - RNA, 19 nt, Homo sapiens
gaaggagacggucagauua

SEQ ID NO: 809431 - RNA, 19 nt, Homo sapiens
ggaggacucuugacucuga

SEQ ID NO: 809432 - RNA, 19 nt, Homo sapiens
guauagacaugaaugauga

SEQ ID NO: 809433 - RNA, 19 nt, Homo sapiens
gaagaaggagccauaauug

SEQ ID NO: 809434 - RNA, 19 nt, Homo sapiens
ggaaauauagguuggguuu

SEQ ID NO: 809435 - RNA, 19 nt, Homo sapiens
uaaacaaccuucaggcaaa

SEQ ID NO: 809436 - RNA, 19 nt, Homo sapiens
ggaagaagaaggagccaua

SEQ ID NO: 809437 - RNA, 19 nt, Homo sapiens
acacauagcaugcguuuaa

SEQ ID NO: 809438 - RNA, 19 nt, Homo sapiens
cauaauugcuggucuguug

SEQ ID NO: 809439 - RNA, 19 nt, Homo sapiens
ggugcaaaguuauaagaua

SEQ ID NO: 809440 - RNA, 19 nt, Homo sapiens
gaauauggucagagucuua

SEQ ID NO: 809441 - RNA, 19 nt, Homo sapiens
ggaauuggcuaugaagaug

SEQ ID NO: 809442 - RNA, 19 nt, Homo sapiens
gaacuugaacucuucuaaa

SEQ ID NO: 809443 - RNA, 19 nt, Homo sapiens
gugaggagguuguauuuau

SEQ ID NO: 809444 - RNA, 19 nt, Homo sapiens
uggaaggagugaucaaaua

SEQ ID NO: 809445 - RNA, 19 nt, Homo sapiens
gggaaacccuccucauguu

SEQ ID NO: 809446 - RNA, 19 nt, Homo sapiens
gaagagaagacuaaucaga

SEQ ID NO: 809447 - RNA, 19 nt, Homo sapiens
ucagagcucucaagcauga

SEQ ID NO: 809448 - RNA, 19 nt, Homo sapiens
ccaugaagauccuaauuau

SEQ ID NO: 809449 - RNA, 19 nt, Homo sapiens
ggagacagccaaacucuga

SEQ ID NO: 809450 - RNA, 19 nt, Homo sapiens
gauauauaaugucccauga

SEQ ID NO: 809451 - RNA, 19 nt, Homo sapiens
acacuucuauucucaguaa

SEQ ID NO: 809452 - RNA, 19 nt, Homo sapiens
gauuggauguugagaaaga

SEQ ID NO: 809453 - RNA, 19 nt, Homo sapiens
uagaagaacugaacagaca

SEQ ID NO: 809454 - RNA, 19 nt, Homo sapiens
gguaggaacugucuauaag

SEQ ID NO: 809455 - RNA, 19 nt, Homo sapiens
ggaacgaguuaaagaggaa

SEQ ID NO: 809456 - RNA, 19 nt, Homo sapiens
gaucauuaccuuacaagaa

SEQ ID NO: 809457 - RNA, 19 nt, Homo sapiens
agacaagcaucaucuuauu

SEQ ID NO: 809458 - RNA, 19 nt, Homo sapiens
uugaagcucuguacauaua

SEQ ID NO: 809459 - RNA, 19 nt, Homo sapiens
gagauggaauuggcuauga

SEQ ID NO: 809460 - RNA, 19 nt, Homo sapiens
gaagcaagaaagcauuuaa

SEQ ID NO: 809461 - RNA, 19 nt, Homo sapiens
gggaacagcaguaaaggua

SEQ ID NO: 809462 - RNA, 19 nt, Homo sapiens
gagacaggcuuuacauaag

SEQ ID NO: 809463 - RNA, 19 nt, Homo sapiens
ucuaauggcuguaaacugu

SEQ ID NO: 809464 - RNA, 19 nt, Homo sapiens
ugaguucuuuguccacuua

SEQ ID NO: 809465 - RNA, 19 nt, Homo sapiens
gagcagauccuggaaguga

SEQ ID NO: 809466 - RNA, 19 nt, Homo sapiens
gcaguuuguucuuaaccua

SEQ ID NO: 809467 - RNA, 19 nt, Homo sapiens
agaaagaacuggagaugca

SEQ ID NO: 809468 - RNA, 19 nt, Homo sapiens
ggaaacauuuacuuaagag

SEQ ID NO: 809469 - RNA, 19 nt, Homo sapiens
uuucugaguugaccaauaa

SEQ ID NO: 809470 - RNA, 19 nt, Homo sapiens
gcugcagaguucagacuua

SEQ ID NO: 809471 - RNA, 19 nt, Homo sapiens
gagguuggcuuuggauaug

SEQ ID NO: 809472 - RNA, 19 nt, Homo sapiens
cagaauaggaaguaaauga

SEQ ID NO: 809473 - RNA, 19 nt, Homo sapiens
gcaagccuguucugccauu

SEQ ID NO: 809474 - RNA, 19 nt, Homo sapiens
gaaacaggcaaagaccuua

SEQ ID NO: 809475 - RNA, 19 nt, Homo sapiens
ugaagaugcuggagaagga

SEQ ID NO: 809476 - RNA, 19 nt, Homo sapiens
ggaagggucccaagcaaga

SEQ ID NO: 809477 - RNA, 19 nt, Homo sapiens
caacaggaucauuaccuua

SEQ ID NO: 809478 - RNA, 19 nt, Homo sapiens
ccaaugcccucaugaugga

SEQ ID NO: 809479 - RNA, 19 nt, Homo sapiens
caagugcuuuaccuucuaa

SEQ ID NO: 809480 - RNA, 19 nt, Homo sapiens
aauugaagcucuguacaua

SEQ ID NO: 809481 - RNA, 19 nt, Homo sapiens
gcagcuggaugaccucaga

SEQ ID NO: 809482 - RNA, 19 nt, Homo sapiens
cucuauaggugcaaaguua

SEQ ID NO: 809483 - RNA, 19 nt, Homo sapiens
uuucuaggcuuuaacauug

SEQ ID NO: 809484 - RNA, 19 nt, Homo sapiens
gaccacagacuaacccuuu

SEQ ID NO: 809485 - RNA, 19 nt, Homo sapiens
uaacuaccaugugaacuug

SEQ ID NO: 809486 - RNA, 19 nt, Homo sapiens
cauuuaagcucugauucua

SEQ ID NO: 809487 - RNA, 19 nt, Homo sapiens
ccucagagcucucaagcau

SEQ ID NO: 809488 - RNA, 19 nt, Homo sapiens
gaagagacacaauuacgau

SEQ ID NO: 809489 - RNA, 19 nt, Homo sapiens
gcccagugcugaguucuuu

SEQ ID NO: 809490 - RNA, 19 nt, Homo sapiens
guauuucacuacacuucua

SEQ ID NO: 809491 - RNA, 19 nt, Homo sapiens
aguccgauaucacaacuua

SEQ ID NO: 809492 - RNA, 19 nt, Homo sapiens
agcaugaacuugccuuuaa

SEQ ID NO: 809493 - RNA, 19 nt, Homo sapiens
ugaaggagacggucagauu

SEQ ID NO: 809494 - RNA, 19 nt, Homo sapiens
gaagaagaaggagccauaa

SEQ ID NO: 809495 - RNA, 19 nt, Homo sapiens
ugaggagguuguauuuauu

SEQ ID NO: 809496 - RNA, 19 nt, Homo sapiens
gaagagacaggcuuuacau

SEQ ID NO: 809497 - RNA, 19 nt, Homo sapiens
uagcagggcuucuguuucu

SEQ ID NO: 809498 - RNA, 19 nt, Homo sapiens
gcagugugaugaaccuaga

SEQ ID NO: 809499 - RNA, 19 nt, Homo sapiens
gaugccaauuucuguauga

SEQ ID NO: 809500 - RNA, 19 nt, Homo sapiens
ucugaaacauggcuugaaa

SEQ ID NO: 809501 - RNA, 19 nt, Homo sapiens
ccaagugcuuuaccuucua

SEQ ID NO: 809502 - RNA, 19 nt, Homo sapiens
gugaucaaauaccgaaauu

SEQ ID NO: 809503 - RNA, 19 nt, Homo sapiens
agagacaggcuuuacauaa

SEQ ID NO: 809504 - RNA, 19 nt, Homo sapiens
gggcuucuguuucuaagug

SEQ ID NO: 809505 - RNA, 19 nt, Homo sapiens
gaagaacugaacagacauu

SEQ ID NO: 809506 - RNA, 19 nt, Homo sapiens
ccaucuaccuuugcaaauu

SEQ ID NO: 809507 - RNA, 19 nt, Homo sapiens
gaggagguuguauuuauuu

SEQ ID NO: 809508 - RNA, 19 nt, Homo sapiens
gaggguugauauauaaugu

SEQ ID NO: 809509 - RNA, 19 nt, Homo sapiens
caaagcuccuacuguauuc

SEQ ID NO: 809510 - RNA, 19 nt, Homo sapiens
gaaccaaaauuaaguccaa

SEQ ID NO: 809511 - RNA, 19 nt, Homo sapiens
aaaagguccugacaaaaua

SEQ ID NO: 809512 - RNA, 19 nt, Homo sapiens
cugggaagcuaauaauuga

SEQ ID NO: 809513 - RNA, 19 nt, Homo sapiens
gaagauggcugcugauaua

SEQ ID NO: 809514 - RNA, 19 nt, Homo sapiens
gcagaucccugaacuuaua

SEQ ID NO: 809515 - RNA, 19 nt, Homo sapiens
ggagaacacuggauuauug

SEQ ID NO: 809516 - RNA, 19 nt, Homo sapiens
gaaauggaaugaaggcuaa

SEQ ID NO: 809517 - RNA, 19 nt, Homo sapiens
gagcuaacguucuuauuaa

SEQ ID NO: 809518 - RNA, 19 nt, Homo sapiens
caacugggcugaaguagaa

SEQ ID NO: 809519 - RNA, 19 nt, Homo sapiens
aaacauaucuaccaucuga

SEQ ID NO: 809520 - RNA, 19 nt, Homo sapiens
gaaaugcgaugauguucaa

SEQ ID NO: 809521 - RNA, 19 nt, Homo sapiens
gcaggcaacuuuauucuau

SEQ ID NO: 809522 - RNA, 19 nt, Homo sapiens
gcaaugaacucagcuacuu

SEQ ID NO: 809523 - RNA, 19 nt, Homo sapiens
guaaugagauaccuuuguu

SEQ ID NO: 809524 - RNA, 19 nt, Homo sapiens
ugaaguaccucauguugaa

SEQ ID NO: 809525 - RNA, 19 nt, Homo sapiens
gcaaagcauugaaguacaa

SEQ ID NO: 809526 - RNA, 19 nt, Homo sapiens
ucagauggguccagcaaua

SEQ ID NO: 809527 - RNA, 19 nt, Homo sapiens
gcgaugauguucaauaaug

SEQ ID NO: 809528 - RNA, 19 nt, Homo sapiens
agaaggcacuuguuuguaa

SEQ ID NO: 809529 - RNA, 19 nt, Homo sapiens
gagauaccuuuguucauuu

SEQ ID NO: 809530 - RNA, 19 nt, Homo sapiens
ccacuuugauuguauacua

SEQ ID NO: 809531 - RNA, 19 nt, Homo sapiens
ugagauaccuuuguucauu

SEQ ID NO: 809532 - RNA, 19 nt, Homo sapiens
gcauugaaguacaaaggua

SEQ ID NO: 809533 - RNA, 19 nt, Homo sapiens
aaacucuucucuccacuua

SEQ ID NO: 809534 - RNA, 19 nt, Homo sapiens
gggcagaucccugaacuua

SEQ ID NO: 809535 - RNA, 19 nt, Homo sapiens
caauggcccucgaugauuu

SEQ ID NO: 809536 - RNA, 19 nt, Homo sapiens
aaaccucaguguacaauuu

SEQ ID NO: 809537 - RNA, 19 nt, Homo sapiens
gcaaauugguagaccuuau

SEQ ID NO: 809538 - RNA, 19 nt, Homo sapiens
gugcagaucuuguuagaca

SEQ ID NO: 809539 - RNA, 19 nt, Homo sapiens
ggacaacauucuaaaagua

SEQ ID NO: 809540 - RNA, 19 nt, Homo sapiens
ugaaaugucucaccuucuu

SEQ ID NO: 809541 - RNA, 19 nt, Homo sapiens
caacuugccugaugcuuag

SEQ ID NO: 809542 - RNA, 19 nt, Homo sapiens
gaucuggcguugagcauug

SEQ ID NO: 809543 - RNA, 19 nt, Homo sapiens
guaaagaacagguccaaga

SEQ ID NO: 809544 - RNA, 19 nt, Homo sapiens
gcuagcaguucuaauguga

SEQ ID NO: 809545 - RNA, 19 nt, Homo sapiens
gaucagugccgguaauuug

SEQ ID NO: 809546 - RNA, 19 nt, Homo sapiens
gugccaagauugaacuuaa

SEQ ID NO: 809547 - RNA, 19 nt, Homo sapiens
ugacugcccugacguauuc

SEQ ID NO: 809548 - RNA, 19 nt, Homo sapiens
guaggcagguucuaauuuc

SEQ ID NO: 809549 - RNA, 19 nt, Homo sapiens
gauacuggauggcaaugaa

SEQ ID NO: 809550 - RNA, 19 nt, Homo sapiens
gcaccagcguccagcagua

SEQ ID NO: 809551 - RNA, 19 nt, Homo sapiens
uaccucauguugaauguua

SEQ ID NO: 809552 - RNA, 19 nt, Homo sapiens
gaaaguagacagugguugu

SEQ ID NO: 809553 - RNA, 19 nt, Homo sapiens
gagacacacuguacucaug

SEQ ID NO: 809554 - RNA, 19 nt, Homo sapiens
caaauugguagaccuuaua

SEQ ID NO: 809555 - RNA, 19 nt, Homo sapiens
gauccacuuugauuguaua

SEQ ID NO: 809556 - RNA, 19 nt, Homo sapiens
gagcuucaguuugugagua

SEQ ID NO: 809557 - RNA, 19 nt, Homo sapiens
caugguagaugacaaggaa

SEQ ID NO: 809558 - RNA, 19 nt, Homo sapiens
gucauacuguguagaauuu

SEQ ID NO: 809559 - RNA, 19 nt, Homo sapiens
uuaaacagaacuccucuua

SEQ ID NO: 809560 - RNA, 19 nt, Homo sapiens
gacaagaucuggcguugag

SEQ ID NO: 809561 - RNA, 19 nt, Homo sapiens
gauggcugcugauauauuc

SEQ ID NO: 809562 - RNA, 19 nt, Homo sapiens
uuuaguagcuuacagcauu

SEQ ID NO: 809563 - RNA, 19 nt, Homo sapiens
gccauuaccuacaucuauu

SEQ ID NO: 809564 - RNA, 19 nt, Homo sapiens
ccaaagaaauugugguuuu

SEQ ID NO: 809565 - RNA, 19 nt, Homo sapiens
gagaaaagcagcaaaauau

SEQ ID NO: 809566 - RNA, 19 nt, Homo sapiens
ucaaugaaauggaaugaag

SEQ ID NO: 809567 - RNA, 19 nt, Homo sapiens
cuagugagcugcuggugaa

SEQ ID NO: 809568 - RNA, 19 nt, Homo sapiens
ggaggagaacacuggauua

SEQ ID NO: 809569 - RNA, 19 nt, Homo sapiens
agagcuaacguucuuauua

SEQ ID NO: 809570 - RNA, 19 nt, Homo sapiens
ugacuuggcugcugacaca

SEQ ID NO: 809571 - RNA, 19 nt, Homo sapiens
acucauagcugcugugcaa

SEQ ID NO: 809572 - RNA, 19 nt, Homo sapiens
cagcaaggcccaugaguga

SEQ ID NO: 809573 - RNA, 19 nt, Homo sapiens
ucgcuaugcugaaauauau

SEQ ID NO: 809574 - RNA, 19 nt, Homo sapiens
caaauaagagaaacaggaa

SEQ ID NO: 809575 - RNA, 19 nt, Homo sapiens
uuucagugcuccucagaua

SEQ ID NO: 809576 - RNA, 19 nt, Homo sapiens
ccacagauaauguaaacaa

SEQ ID NO: 809577 - RNA, 19 nt, Homo sapiens
ggaccaaacaauucuuuau

SEQ ID NO: 809578 - RNA, 19 nt, Homo sapiens
uagcucaucugcaaauaug

SEQ ID NO: 809579 - RNA, 19 nt, Homo sapiens
agaauacagugccaagauu

SEQ ID NO: 809580 - RNA, 19 nt, Homo sapiens
caaauggaguagcaacuag

SEQ ID NO: 809581 - RNA, 19 nt, Homo sapiens
ucccugaacuuauauucua

SEQ ID NO: 809582 - RNA, 19 nt, Homo sapiens
uaaagccaguuucuauuca

SEQ ID NO: 809583 - RNA, 19 nt, Homo sapiens
gcuugaauuuaguagcuua

SEQ ID NO: 809584 - RNA, 19 nt, Homo sapiens
gaacacuggauuauuggaa

SEQ ID NO: 809585 - RNA, 19 nt, Homo sapiens
ggagugacacauuuuauua

SEQ ID NO: 809586 - RNA, 19 nt, Homo sapiens
ggccuggagugacacauuu

SEQ ID NO: 809587 - RNA, 19 nt, Homo sapiens
ccaacuugccugaugcuua

SEQ ID NO: 809588 - RNA, 19 nt, Homo sapiens
uaaagaacagguccaagaa

SEQ ID NO: 809589 - RNA, 19 nt, Homo sapiens
gcaucagugugcuugaauu

SEQ ID NO: 809590 - RNA, 19 nt, Homo sapiens
gagaagaaacuuuaauugc

SEQ ID NO: 809591 - RNA, 19 nt, Homo sapiens
uauaagaaggcacuuguuu

SEQ ID NO: 809592 - RNA, 19 nt, Homo sapiens
gaauacagugccaagauug

SEQ ID NO: 809593 - RNA, 19 nt, Homo sapiens
gccagagccuguguuaauu

SEQ ID NO: 809594 - RNA, 19 nt, Homo sapiens
ucagugugcuugaauuuag

SEQ ID NO: 809595 - RNA, 19 nt, Homo sapiens
gugacauucuuuaagcaua

SEQ ID NO: 809596 - RNA, 19 nt, Homo sapiens
uaagaaggcacuuguuugu

SEQ ID NO: 809597 - RNA, 19 nt, Homo sapiens
acauaugccugcaggguuu

SEQ ID NO: 809598 - RNA, 19 nt, Homo sapiens
uauuaaggcuuugugguuu

SEQ ID NO: 809599 - RNA, 19 nt, Homo sapiens
ggcagguucuaauuucuuu

SEQ ID NO: 809600 - RNA, 19 nt, Homo sapiens
gcacaucugguuccaacuu

SEQ ID NO: 809601 - RNA, 19 nt, Homo sapiens
gagggauucugcgauauug

SEQ ID NO: 809602 - RNA, 19 nt, Homo sapiens
ucugagggauucugcgaua

SEQ ID NO: 809603 - RNA, 19 nt, Homo sapiens
ccaucuugcugaccuaauu

SEQ ID NO: 809604 - RNA, 19 nt, Homo sapiens
ugggauaucuaacucuaaa

SEQ ID NO: 809605 - RNA, 19 nt, Homo sapiens
aaacagaacuccucuuacc

SEQ ID NO: 809606 - RNA, 19 nt, Homo sapiens
gauggcagauguacauuuu

SEQ ID NO: 809607 - RNA, 19 nt, Homo sapiens
ccaccaguuuguuaugaaa

SEQ ID NO: 809608 - RNA, 19 nt, Homo sapiens
gcuaauaugcuugcuuuau

SEQ ID NO: 809609 - RNA, 19 nt, Homo sapiens
gugaaauccuguacacugu

SEQ ID NO: 809610 - RNA, 19 nt, Homo sapiens
aguaagaggugggacagua

SEQ ID NO: 809611 - RNA, 19 nt, Homo sapiens
guagacagugguuguguuu

SEQ ID NO: 809612 - RNA, 19 nt, Homo sapiens
cgaugauguucaauaauga

SEQ ID NO: 809613 - RNA, 19 nt, Homo sapiens
gagaaggacuguuccauca

SEQ ID NO: 809614 - RNA, 19 nt, Homo sapiens
agaaugcccuguuccagua

SEQ ID NO: 809615 - RNA, 19 nt, Homo sapiens
gcuaauauaugcaauucuc

SEQ ID NO: 809616 - RNA, 19 nt, Homo sapiens
ggagaugaccggcaggaaa

SEQ ID NO: 809617 - RNA, 19 nt, Homo sapiens
ccaacgaccucaaguacga

SEQ ID NO: 809618 - RNA, 19 nt, Homo sapiens
gggauuacccgcagcauga

SEQ ID NO: 809619 - RNA, 19 nt, Homo sapiens
ggagcgagaagcccagaua

SEQ ID NO: 809620 - RNA, 19 nt, Homo sapiens
cccaagagcuagaaacuca

SEQ ID NO: 809621 - RNA, 19 nt, Homo sapiens
gagccagacugagaacaaa

SEQ ID NO: 809622 - RNA, 19 nt, Homo sapiens
ggaagaaagcauugugguu

SEQ ID NO: 809623 - RNA, 19 nt, Homo sapiens
gaagugggaggacgccuuu

SEQ ID NO: 809624 - RNA, 19 nt, Homo sapiens
gaguaugucuuccucaucu

SEQ ID NO: 809625 - RNA, 19 nt, Homo sapiens
caccagcgcuucuucaagu

SEQ ID NO: 809626 - RNA, 19 nt, Homo sapiens
gagaguggcuacgcuuugu

SEQ ID NO: 809627 - RNA, 19 nt, Homo sapiens
ccgagucccugguggauga

SEQ ID NO: 809628 - RNA, 19 nt, Homo sapiens
gcuucuaccucuccuacaa

SEQ ID NO: 809629 - RNA, 19 nt, Homo sapiens
ggaccuugcucccgguauc

SEQ ID NO: 809630 - RNA, 19 nt, Homo sapiens
cgccugcgguuucuaugua

SEQ ID NO: 809631 - RNA, 19 nt, Homo sapiens
ggagaguggcuacgcuuug

SEQ ID NO: 809632 - RNA, 19 nt, Homo sapiens
caagcagaaugcccuguuc

SEQ ID NO: 809633 - RNA, 19 nt, Homo sapiens
caagacacagggaccguuu

SEQ ID NO: 809634 - RNA, 19 nt, Homo sapiens
gcaagugggcaucaagauc

SEQ ID NO: 809635 - RNA, 19 nt, Homo sapiens
guacaacuuugagaacaag

SEQ ID NO: 809636 - RNA, 19 nt, Homo sapiens
caccagggcugcgacauca

SEQ ID NO: 809637 - RNA, 19 nt, Homo sapiens
gagaugaccggcaggaaag

SEQ ID NO: 809638 - RNA, 19 nt, Homo sapiens
gcacacccuuccggaacuu

SEQ ID NO: 809639 - RNA, 19 nt, Homo sapiens
aagaaagcauugugguuca

SEQ ID NO: 809640 - RNA, 19 nt, Homo sapiens
gugccucuccuccuaagua

SEQ ID NO: 809641 - RNA, 19 nt, Homo sapiens
gcugcgacaucaacuucaa

SEQ ID NO: 809642 - RNA, 19 nt, Homo sapiens
cccgugaccucagcaagua

SEQ ID NO: 809643 - RNA, 19 nt, Homo sapiens
gaggacuucuccaacaucu

SEQ ID NO: 809644 - RNA, 19 nt, Homo sapiens
gagcuagaaacucaggaaa

SEQ ID NO: 809645 - RNA, 19 nt, Homo sapiens
ggcagagcgugauccaguu

SEQ ID NO: 809646 - RNA, 19 nt, Homo sapiens
ggcagguggucuucuacaa

SEQ ID NO: 809647 - RNA, 19 nt, Homo sapiens
ccaagcgccuggagagucu

SEQ ID NO: 809648 - RNA, 19 nt, Homo sapiens
gcacaccagcgcuucuuca

SEQ ID NO: 809649 - RNA, 19 nt, Homo sapiens
gaaggucagcggcauguac

SEQ ID NO: 809650 - RNA, 19 nt, Homo sapiens
ccuacaagguccgcgguaa

SEQ ID NO: 809651 - RNA, 19 nt, Homo sapiens
cagaguaugucuuccucau

SEQ ID NO: 809652 - RNA, 19 nt, Homo sapiens
gcuagaaacucaggaaacc

SEQ ID NO: 809653 - RNA, 19 nt, Homo sapiens
ccugguggaugacgacguu

SEQ ID NO: 809654 - RNA, 19 nt, Homo sapiens
ccgaggcccugaacguguu

SEQ ID NO: 809655 - RNA, 19 nt, Homo sapiens
gaggacgccuuugccaagu

SEQ ID NO: 809656 - RNA, 19 nt, Homo sapiens
ggagggcaaauacgacaug

SEQ ID NO: 809657 - RNA, 19 nt, Homo sapiens
ccuucucgcugccgccaua

SEQ ID NO: 809658 - RNA, 19 nt, Homo sapiens
gagaagcucguggccauca

SEQ ID NO: 809659 - RNA, 19 nt, Homo sapiens
ugcuagaccugcagaacaa

SEQ ID NO: 809660 - RNA, 19 nt, Homo sapiens
ggcccaaacccuugaaauc

SEQ ID NO: 809661 - RNA, 19 nt, Homo sapiens
gaagcaagugggcaucaag

SEQ ID NO: 809662 - RNA, 19 nt, Homo sapiens
gcagguggucuucuacaag

SEQ ID NO: 809663 - RNA, 19 nt, Homo sapiens
caagagaaagcgggacaga

SEQ ID NO: 809664 - RNA, 19 nt, Homo sapiens
guucgacgagugucacaaa

SEQ ID NO: 809665 - RNA, 19 nt, Homo sapiens
ggacaagcgggagggcaaa

SEQ ID NO: 809666 - RNA, 19 nt, Homo sapiens
cagcucagcaggccguuug

SEQ ID NO: 809667 - RNA, 19 nt, Homo sapiens
cugcuaauauaugcaauuc

SEQ ID NO: 809668 - RNA, 19 nt, Homo sapiens
gcagagcgugauccaguuc

SEQ ID NO: 809669 - RNA, 19 nt, Homo sapiens
ccaaggacaggaagaagca

SEQ ID NO: 809670 - RNA, 19 nt, Homo sapiens
caccuacuccgcccugauu

SEQ ID NO: 809671 - RNA, 19 nt, Homo sapiens
gggcugcgacaucaacuuc

SEQ ID NO: 809672 - RNA, 19 nt, Homo sapiens
gggagaguggcuacgcuuu

SEQ ID NO: 809673 - RNA, 19 nt, Homo sapiens
ggcuggaggugcacaagca

SEQ ID NO: 809674 - RNA, 19 nt, Homo sapiens
gccuggacguggagaagga

SEQ ID NO: 809675 - RNA, 19 nt, Homo sapiens
gcgagaagcccagauagac

SEQ ID NO: 809676 - RNA, 19 nt, Homo sapiens
uuugaggacuucuccaaca

SEQ ID NO: 809677 - RNA, 19 nt, Homo sapiens
ucuccaacaucuccaucuu

SEQ ID NO: 809678 - RNA, 19 nt, Homo sapiens
acuguuccaucaccaaguu

SEQ ID NO: 809679 - RNA, 19 nt, Homo sapiens
gaacgaugggcaccucaac

SEQ ID NO: 809680 - RNA, 19 nt, Homo sapiens
guggagaccagcacacugu

SEQ ID NO: 809681 - RNA, 19 nt, Homo sapiens
ggacaggaagaagcaagug

SEQ ID NO: 809682 - RNA, 19 nt, Homo sapiens
aguacaacuuugagaacaa

SEQ ID NO: 809683 - RNA, 19 nt, Homo sapiens
gagcgagaagcccagauag

SEQ ID NO: 809684 - RNA, 19 nt, Homo sapiens
uccaacaucuccaucuucu

SEQ ID NO: 809685 - RNA, 19 nt, Homo sapiens
gcccuucccugaccccuaa

SEQ ID NO: 809686 - RNA, 19 nt, Homo sapiens
gccaguucuucacggugua

SEQ ID NO: 809687 - RNA, 19 nt, Homo sapiens
acgggcagguggucuucua

SEQ ID NO: 809688 - RNA, 19 nt, Homo sapiens
gaggugcacaagcagaaug

SEQ ID NO: 809689 - RNA, 19 nt, Homo sapiens
gcgugcacaugaccuugga

SEQ ID NO: 809690 - RNA, 19 nt, Homo sapiens
gugcuagaccugcagaaca

SEQ ID NO: 809691 - RNA, 19 nt, Homo sapiens
ccgacuacgugccguccaa

SEQ ID NO: 809692 - RNA, 19 nt, Homo sapiens
agaagcaagugggcaucaa

SEQ ID NO: 809693 - RNA, 19 nt, Homo sapiens
ugaagaccaaggacaggaa

SEQ ID NO: 809694 - RNA, 19 nt, Homo sapiens
gcgcucagcaagaucaagu

SEQ ID NO: 809695 - RNA, 19 nt, Homo sapiens
caccuacgccugccagcaa

SEQ ID NO: 809696 - RNA, 19 nt, Homo sapiens
caagguccgcgguaacaag

SEQ ID NO: 809697 - RNA, 19 nt, Homo sapiens
ggagagccagcagguguuc

SEQ ID NO: 809698 - RNA, 19 nt, Homo sapiens
ugagccagacugagaacaa

SEQ ID NO: 809699 - RNA, 19 nt, Homo sapiens
gaagcucguggccaucauc

SEQ ID NO: 809700 - RNA, 19 nt, Homo sapiens
cagcgcuucuucaaguauc

SEQ ID NO: 809701 - RNA, 19 nt, Homo sapiens
gaugggcaaggccgugcua

SEQ ID NO: 809702 - RNA, 19 nt, Homo sapiens
ccggagucauccuggagaa

SEQ ID NO: 809703 - RNA, 19 nt, Homo sapiens
ugcgguuucuauguauuua

SEQ ID NO: 809704 - RNA, 19 nt, Homo sapiens
gccuccagcuugccaccaa

SEQ ID NO: 809705 - RNA, 19 nt, Homo sapiens
acaagcgggagggcaaaua

SEQ ID NO: 809706 - RNA, 19 nt, Homo sapiens
ggcccgagaucaugaugcu

SEQ ID NO: 809707 - RNA, 19 nt, Homo sapiens
ggacguggagaaggacugu

SEQ ID NO: 809708 - RNA, 19 nt, Homo sapiens
caccaaagaccugcgacuu

SEQ ID NO: 809709 - RNA, 19 nt, Homo sapiens
guguuccugucgcuaauuc

SEQ ID NO: 809710 - RNA, 19 nt, Homo sapiens
gcguguuccugucgcuaau

SEQ ID NO: 809711 - RNA, 19 nt, Homo sapiens
ggauuacccgcagcaugaa

SEQ ID NO: 809712 - RNA, 19 nt, Homo sapiens
aaugccggcuccaccaaga

SEQ ID NO: 809713 - RNA, 19 nt, Homo sapiens
ggacaacucuugaauuaaa

SEQ ID NO: 809714 - RNA, 19 nt, Homo sapiens
gaacuuguguugacuguug

SEQ ID NO: 809715 - RNA, 19 nt, Homo sapiens
guggacaacucuugaauua

SEQ ID NO: 809716 - RNA, 19 nt, Homo sapiens
ggucauggcuuccagcuuu

SEQ ID NO: 809717 - RNA, 19 nt, Homo sapiens
uugaagggcuuuaaacuua

SEQ ID NO: 809718 - RNA, 19 nt, Homo sapiens
agacuacgcuguuggauuu

SEQ ID NO: 809719 - RNA, 19 nt, Homo sapiens
gaagggcuuuaaacuuaua

SEQ ID NO: 809720 - RNA, 19 nt, Homo sapiens
uaacgagucuuucaugaug

SEQ ID NO: 809721 - RNA, 19 nt, Homo sapiens
ggaauuugauuacacauag

SEQ ID NO: 809722 - RNA, 19 nt, Homo sapiens
ggacuucuguuuacaaugg

SEQ ID NO: 809723 - RNA, 19 nt, Homo sapiens
ccacugcacugaucaugaa

SEQ ID NO: 809724 - RNA, 19 nt, Homo sapiens
ccuuugagcucuucaguaa

SEQ ID NO: 809725 - RNA, 19 nt, Homo sapiens
gcaggaugcuugcccagaa

SEQ ID NO: 809726 - RNA, 19 nt, Homo sapiens
caggagagaucuuaaaugg

SEQ ID NO: 809727 - RNA, 19 nt, Homo sapiens
aguauuacgucgugcauua

SEQ ID NO: 809728 - RNA, 19 nt, Homo sapiens
ggaagugguugugcauauu

SEQ ID NO: 809729 - RNA, 19 nt, Homo sapiens
gaucuccucugucuuaauc

SEQ ID NO: 809730 - RNA, 19 nt, Homo sapiens
gaagguuucucuguuugaa

SEQ ID NO: 809731 - RNA, 19 nt, Homo sapiens
caggaagguuucucuguuu

SEQ ID NO: 809732 - RNA, 19 nt, Homo sapiens
ggacaggagccucauauca

SEQ ID NO: 809733 - RNA, 19 nt, Homo sapiens
gggaagugguugugcauau

SEQ ID NO: 809734 - RNA, 19 nt, Homo sapiens
gcacaggagagaucuuaaa

SEQ ID NO: 809735 - RNA, 19 nt, Homo sapiens
gaagugguugugcauauuu

SEQ ID NO: 809736 - RNA, 19 nt, Homo sapiens
caagccagcugccuccauu

SEQ ID NO: 809737 - RNA, 19 nt, Homo sapiens
ggaagucacccagcuguuu

SEQ ID NO: 809738 - RNA, 19 nt, Homo sapiens
gcaacagucccuaggcuaa

SEQ ID NO: 809739 - RNA, 19 nt, Homo sapiens
ccaacauccugaaaguuaa

SEQ ID NO: 809740 - RNA, 19 nt, Homo sapiens
gauuacacauagaugauga

SEQ ID NO: 809741 - RNA, 19 nt, Homo sapiens
ugaauuaaauccacuagag

SEQ ID NO: 809742 - RNA, 19 nt, Homo sapiens
gcaaccagaucaccuuugg

SEQ ID NO: 809743 - RNA, 19 nt, Homo sapiens
gaugaagguuaccaaacuu

SEQ ID NO: 809744 - RNA, 19 nt, Homo sapiens
agacuagacucgacuacuu

SEQ ID NO: 809745 - RNA, 19 nt, Homo sapiens
gaagagauguuuggaugac

SEQ ID NO: 809746 - RNA, 19 nt, Homo sapiens
ggacgggauccaagaguuu

SEQ ID NO: 809747 - RNA, 19 nt, Homo sapiens
ggagcagaguguucauuuc

SEQ ID NO: 809748 - RNA, 19 nt, Homo sapiens
gauguuggcacgugucauu

SEQ ID NO: 809749 - RNA, 19 nt, Homo sapiens
ugugaucuccucugucuua

SEQ ID NO: 809750 - RNA, 19 nt, Homo sapiens
gcuguuggauuuaauggau

SEQ ID NO: 809751 - RNA, 19 nt, Homo sapiens
gggaagccaccuccaauga

SEQ ID NO: 809752 - RNA, 19 nt, Homo sapiens
ccugcuaacuccagauauu

SEQ ID NO: 809753 - RNA, 19 nt, Homo sapiens
uuaaaggcaugcagggauu

SEQ ID NO: 809754 - RNA, 19 nt, Homo sapiens
aaacuaaucugagcauaac

SEQ ID NO: 809755 - RNA, 19 nt, Homo sapiens
gcagaugaagguuaccaaa

SEQ ID NO: 809756 - RNA, 19 nt, Homo sapiens
cagcuugccugguggaugu

SEQ ID NO: 809757 - RNA, 19 nt, Homo sapiens
ggaaaucugaaauggaaga

SEQ ID NO: 809758 - RNA, 19 nt, Homo sapiens
ccacugggcccugcaauga

SEQ ID NO: 809759 - RNA, 19 nt, Homo sapiens
gaaacaucuuuaaccuugu

SEQ ID NO: 809760 - RNA, 19 nt, Homo sapiens
cuaaacugauugacuuuca

SEQ ID NO: 809761 - RNA, 19 nt, Homo sapiens
gggaauuugauuacacaua

SEQ ID NO: 809762 - RNA, 19 nt, Homo sapiens
agaaguggcugagcaggaa

SEQ ID NO: 809763 - RNA, 19 nt, Homo sapiens
acaggagccucauaucaga

SEQ ID NO: 809764 - RNA, 19 nt, Homo sapiens
uguugacuguugauacuua

SEQ ID NO: 809765 - RNA, 19 nt, Homo sapiens
ggaagagauguuuggauga

SEQ ID NO: 809766 - RNA, 19 nt, Homo sapiens
cgugugaguucaaaguaaa

SEQ ID NO: 809767 - RNA, 19 nt, Homo sapiens
gggacgggauccaagaguu

SEQ ID NO: 809768 - RNA, 19 nt, Homo sapiens
auggaaaucugaaauggaa

SEQ ID NO: 809769 - RNA, 19 nt, Homo sapiens
caauggaaaucugaaaugg

SEQ ID NO: 809770 - RNA, 19 nt, Homo sapiens
accaacauccugaaaguua

SEQ ID NO: 809771 - RNA, 19 nt, Homo sapiens
ugauugacuuucagccuuu

SEQ ID NO: 809772 - RNA, 19 nt, Homo sapiens
ccaccaagcccgugucugu

SEQ ID NO: 809773 - RNA, 19 nt, Homo sapiens
ugaagggcuuuaaacuuau

SEQ ID NO: 809774 - RNA, 19 nt, Homo sapiens
ggucagugauucuuuugua

SEQ ID NO: 809775 - RNA, 19 nt, Homo sapiens
ugaagcaccggcuccauaa

SEQ ID NO: 809776 - RNA, 19 nt, Homo sapiens
gaaugaccauggcaagaac

SEQ ID NO: 809777 - RNA, 19 nt, Homo sapiens
uguaacgagucuuucauga

SEQ ID NO: 809778 - RNA, 19 nt, Homo sapiens
gugaugaccucagauuaca

SEQ ID NO: 809779 - RNA, 19 nt, Homo sapiens
ggaucuuacuccagcuuga

SEQ ID NO: 809780 - RNA, 19 nt, Homo sapiens
gagcagaguguucauuucu

SEQ ID NO: 809781 - RNA, 19 nt, Homo sapiens
aaacaucuuuaaccuugug

SEQ ID NO: 809782 - RNA, 19 nt, Homo sapiens
ggaagaaaauaugggaauu

SEQ ID NO: 809783 - RNA, 19 nt, Homo sapiens
gagcgagcuuuaaaacuaa

SEQ ID NO: 809784 - RNA, 19 nt, Homo sapiens
acaguggccuugucuuugu

SEQ ID NO: 809785 - RNA, 19 nt, Homo sapiens
caggaugcuugcccagaaa

SEQ ID NO: 809786 - RNA, 19 nt, Homo sapiens
caacauccugaaaguuaaa

SEQ ID NO: 809787 - RNA, 19 nt, Homo sapiens
agagcgagcuuuaaaacua

SEQ ID NO: 809788 - RNA, 19 nt, Homo sapiens
ggaagguuucucuguuuga

SEQ ID NO: 809789 - RNA, 19 nt, Homo sapiens
ggugcgcacuuaccaagga

SEQ ID NO: 809790 - RNA, 19 nt, Homo sapiens
uuacgaauauaccaacauc

SEQ ID NO: 809791 - RNA, 19 nt, Homo sapiens
cccagucccucaacccuuu

SEQ ID NO: 809792 - RNA, 19 nt, Homo sapiens
gcaucaaugugcgugagaa

SEQ ID NO: 809793 - RNA, 19 nt, Homo sapiens
gaugaccucagauuacaga

SEQ ID NO: 809794 - RNA, 19 nt, Homo sapiens
ugaaugaccauggcaagaa

SEQ ID NO: 809795 - RNA, 19 nt, Homo sapiens
ggagccgugucuagaguuc

SEQ ID NO: 809796 - RNA, 19 nt, Homo sapiens
caggacuucuguuuacaau

SEQ ID NO: 809797 - RNA, 19 nt, Homo sapiens
gaagguuaccaaacuugug

SEQ ID NO: 809798 - RNA, 19 nt, Homo sapiens
ccgagggucuccaggaugu

SEQ ID NO: 809799 - RNA, 19 nt, Homo sapiens
gacguggagucaucagugu

SEQ ID NO: 809800 - RNA, 19 nt, Homo sapiens
ggacgaggacguggaguca

SEQ ID NO: 809801 - RNA, 19 nt, Homo sapiens
caaccaacccuuuccuucu

SEQ ID NO: 809802 - RNA, 19 nt, Homo sapiens
agaugaagguuaccaaacu

SEQ ID NO: 809803 - RNA, 19 nt, Homo sapiens
gggugaugaccucagauua

SEQ ID NO: 809804 - RNA, 19 nt, Homo sapiens
gcaaggaccagggcaucaa

SEQ ID NO: 809805 - RNA, 19 nt, Homo sapiens
uguggaagcggcugaauga

SEQ ID NO: 809806 - RNA, 19 nt, Homo sapiens
guaacgagucuuucaugau

SEQ ID NO: 809807 - RNA, 19 nt, Homo sapiens
ggacaugcaggcucugagu

SEQ ID NO: 809808 - RNA, 19 nt, Homo sapiens
gcuaacuccagauauuauu

SEQ ID NO: 809809 - RNA, 19 nt, Homo sapiens
ccacuagagcgagcuuuaa

SEQ ID NO: 809810 - RNA, 19 nt, Homo sapiens
uuugagcucuucaguaauc

SEQ ID NO: 809811 - RNA, 19 nt, Homo sapiens
gcagcaaccagaucaccuu

SEQ ID NO: 809812 - RNA, 19 nt, Homo sapiens
gaacuggcggcauguguac

SEQ ID NO: 809813 - RNA, 19 nt, Homo sapiens
ggacaacucuugaauuaaa

SEQ ID NO: 809814 - RNA, 19 nt, Homo sapiens
gaacuuguguugacuguug

SEQ ID NO: 809815 - RNA, 19 nt, Homo sapiens
guggacaacucuugaauua

SEQ ID NO: 809816 - RNA, 19 nt, Homo sapiens
ggucauggcuuccagcuuu

SEQ ID NO: 809817 - RNA, 19 nt, Homo sapiens
uugaagggcuuuaaacuua

SEQ ID NO: 809818 - RNA, 19 nt, Homo sapiens
agacuacgcuguuggauuu

SEQ ID NO: 809819 - RNA, 19 nt, Homo sapiens
gaagggcuuuaaacuuaua

SEQ ID NO: 809820 - RNA, 19 nt, Homo sapiens
uaacgagucuuucaugaug

SEQ ID NO: 809821 - RNA, 19 nt, Homo sapiens
ggaauuugauuacacauag

SEQ ID NO: 809822 - RNA, 19 nt, Homo sapiens
ggacuucuguuuacaaugg

SEQ ID NO: 809823 - RNA, 19 nt, Homo sapiens
ccacugcacugaucaugaa

SEQ ID NO: 809824 - RNA, 19 nt, Homo sapiens
ccuuugagcucuucaguaa

SEQ ID NO: 809825 - RNA, 19 nt, Homo sapiens
gcaggaugcuugcccagaa

SEQ ID NO: 809826 - RNA, 19 nt, Homo sapiens
caggagagaucuuaaaugg

SEQ ID NO: 809827 - RNA, 19 nt, Homo sapiens
aguauuacgucgugcauua

SEQ ID NO: 809828 - RNA, 19 nt, Homo sapiens
ggaagugguugugcauauu

SEQ ID NO: 809829 - RNA, 19 nt, Homo sapiens
gaucuccucugucuuaauc

SEQ ID NO: 809830 - RNA, 19 nt, Homo sapiens
gaagguuucucuguuugaa

SEQ ID NO: 809831 - RNA, 19 nt, Homo sapiens
caggaagguuucucuguuu

SEQ ID NO: 809832 - RNA, 19 nt, Homo sapiens
ggacaggagccucauauca

SEQ ID NO: 809833 - RNA, 19 nt, Homo sapiens
gggaagugguugugcauau

SEQ ID NO: 809834 - RNA, 19 nt, Homo sapiens
gcacaggagagaucuuaaa

SEQ ID NO: 809835 - RNA, 19 nt, Homo sapiens
gaagugguugugcauauuu

SEQ ID NO: 809836 - RNA, 19 nt, Homo sapiens
caagccagcugccuccauu

SEQ ID NO: 809837 - RNA, 19 nt, Homo sapiens
ggaagucacccagcuguuu

SEQ ID NO: 809838 - RNA, 19 nt, Homo sapiens
gcaacagucccuaggcuaa

SEQ ID NO: 809839 - RNA, 19 nt, Homo sapiens
ccaacauccugaaaguuaa

SEQ ID NO: 809840 - RNA, 19 nt, Homo sapiens
gauuacacauagaugauga

SEQ ID NO: 809841 - RNA, 19 nt, Homo sapiens
ugaauuaaauccacuagag

SEQ ID NO: 809842 - RNA, 19 nt, Homo sapiens
gcaaccagaucaccuuugg

SEQ ID NO: 809843 - RNA, 19 nt, Homo sapiens
gaugaagguuaccaaacuu

SEQ ID NO: 809844 - RNA, 19 nt, Homo sapiens
agacuagacucgacuacuu

SEQ ID NO: 809845 - RNA, 19 nt, Homo sapiens
gaagagauguuuggaugac

SEQ ID NO: 809846 - RNA, 19 nt, Homo sapiens
ggacgggauccaagaguuu

SEQ ID NO: 809847 - RNA, 19 nt, Homo sapiens
ggagcagaguguucauuuc

SEQ ID NO: 809848 - RNA, 19 nt, Homo sapiens
gauguuggcacgugucauu

SEQ ID NO: 809849 - RNA, 19 nt, Homo sapiens
ugugaucuccucugucuua

SEQ ID NO: 809850 - RNA, 19 nt, Homo sapiens
gcuguuggauuuaauggau

SEQ ID NO: 809851 - RNA, 19 nt, Homo sapiens
gggaagccaccuccaauga

SEQ ID NO: 809852 - RNA, 19 nt, Homo sapiens
ccugcuaacuccagauauu

SEQ ID NO: 809853 - RNA, 19 nt, Homo sapiens
uuaaaggcaugcagggauu

SEQ ID NO: 809854 - RNA, 19 nt, Homo sapiens
aaacuaaucugagcauaac

SEQ ID NO: 809855 - RNA, 19 nt, Homo sapiens
gcagaugaagguuaccaaa

SEQ ID NO: 809856 - RNA, 19 nt, Homo sapiens
cagcuugccugguggaugu

SEQ ID NO: 809857 - RNA, 19 nt, Homo sapiens
ggaaaucugaaauggaaga

SEQ ID NO: 809858 - RNA, 19 nt, Homo sapiens
ccacugggcccugcaauga

SEQ ID NO: 809859 - RNA, 19 nt, Homo sapiens
gaaacaucuuuaaccuugu

SEQ ID NO: 809860 - RNA, 19 nt, Homo sapiens
cuaaacugauugacuuuca

SEQ ID NO: 809861 - RNA, 19 nt, Homo sapiens
gggaauuugauuacacaua

SEQ ID NO: 809862 - RNA, 19 nt, Homo sapiens
agaaguggcugagcaggaa

SEQ ID NO: 809863 - RNA, 19 nt, Homo sapiens
acaggagccucauaucaga

SEQ ID NO: 809864 - RNA, 19 nt, Homo sapiens
uguugacuguugauacuua

SEQ ID NO: 809865 - RNA, 19 nt, Homo sapiens
ggaagagauguuuggauga

SEQ ID NO: 809866 - RNA, 19 nt, Homo sapiens
cgugugaguucaaaguaaa

SEQ ID NO: 809867 - RNA, 19 nt, Homo sapiens
gggacgggauccaagaguu

SEQ ID NO: 809868 - RNA, 19 nt, Homo sapiens
auggaaaucugaaauggaa

SEQ ID NO: 809869 - RNA, 19 nt, Homo sapiens
caauggaaaucugaaaugg

SEQ ID NO: 809870 - RNA, 19 nt, Homo sapiens
accaacauccugaaaguua

SEQ ID NO: 809871 - RNA, 19 nt, Homo sapiens
ugauugacuuucagccuuu

SEQ ID NO: 809872 - RNA, 19 nt, Homo sapiens
ccaccaagcccgugucugu

SEQ ID NO: 809873 - RNA, 19 nt, Homo sapiens
ugaagggcuuuaaacuuau

SEQ ID NO: 809874 - RNA, 19 nt, Homo sapiens
ggucagugauucuuuugua

SEQ ID NO: 809875 - RNA, 19 nt, Homo sapiens
ugaagcaccggcuccauaa

SEQ ID NO: 809876 - RNA, 19 nt, Homo sapiens
gaaugaccauggcaagaac

SEQ ID NO: 809877 - RNA, 19 nt, Homo sapiens
uguaacgagucuuucauga

SEQ ID NO: 809878 - RNA, 19 nt, Homo sapiens
gugaugaccucagauuaca

SEQ ID NO: 809879 - RNA, 19 nt, Homo sapiens
ggaucuuacuccagcuuga

SEQ ID NO: 809880 - RNA, 19 nt, Homo sapiens
gagcagaguguucauuucu

SEQ ID NO: 809881 - RNA, 19 nt, Homo sapiens
aaacaucuuuaaccuugug

SEQ ID NO: 809882 - RNA, 19 nt, Homo sapiens
ggaagaaaauaugggaauu

SEQ ID NO: 809883 - RNA, 19 nt, Homo sapiens
gagcgagcuuuaaaacuaa

SEQ ID NO: 809884 - RNA, 19 nt, Homo sapiens
acaguggccuugucuuugu

SEQ ID NO: 809885 - RNA, 19 nt, Homo sapiens
caggaugcuugcccagaaa

SEQ ID NO: 809886 - RNA, 19 nt, Homo sapiens
caacauccugaaaguuaaa

SEQ ID NO: 809887 - RNA, 19 nt, Homo sapiens
agagcgagcuuuaaaacua

SEQ ID NO: 809888 - RNA, 19 nt, Homo sapiens
ggaagguuucucuguuuga

SEQ ID NO: 809889 - RNA, 19 nt, Homo sapiens
ggugcgcacuuaccaagga

SEQ ID NO: 809890 - RNA, 19 nt, Homo sapiens
uuacgaauauaccaacauc

SEQ ID NO: 809891 - RNA, 19 nt, Homo sapiens
cccagucccucaacccuuu

SEQ ID NO: 809892 - RNA, 19 nt, Homo sapiens
gcaucaaugugcgugagaa

SEQ ID NO: 809893 - RNA, 19 nt, Homo sapiens
gaugaccucagauuacaga

SEQ ID NO: 809894 - RNA, 19 nt, Homo sapiens
ugaaugaccauggcaagaa

SEQ ID NO: 809895 - RNA, 19 nt, Homo sapiens
ggagccgugucuagaguuc

SEQ ID NO: 809896 - RNA, 19 nt, Homo sapiens
caggacuucuguuuacaau

SEQ ID NO: 809897 - RNA, 19 nt, Homo sapiens
gaagguuaccaaacuugug

SEQ ID NO: 809898 - RNA, 19 nt, Homo sapiens
ccgagggucuccaggaugu

SEQ ID NO: 809899 - RNA, 19 nt, Homo sapiens
gacguggagucaucagugu

SEQ ID NO: 809900 - RNA, 19 nt, Homo sapiens
ggacgaggacguggaguca

SEQ ID NO: 809901 - RNA, 19 nt, Homo sapiens
caaccaacccuuuccuucu

SEQ ID NO: 809902 - RNA, 19 nt, Homo sapiens
agaugaagguuaccaaacu

SEQ ID NO: 809903 - RNA, 19 nt, Homo sapiens
gggugaugaccucagauua

SEQ ID NO: 809904 - RNA, 19 nt, Homo sapiens
gcaaggaccagggcaucaa

SEQ ID NO: 809905 - RNA, 19 nt, Homo sapiens
uguggaagcggcugaauga

SEQ ID NO: 809906 - RNA, 19 nt, Homo sapiens
guaacgagucuuucaugau

SEQ ID NO: 809907 - RNA, 19 nt, Homo sapiens
ggacaugcaggcucugagu

SEQ ID NO: 809908 - RNA, 19 nt, Homo sapiens
gcuaacuccagauauuauu

SEQ ID NO: 809909 - RNA, 19 nt, Homo sapiens
ccacuagagcgagcuuuaa

SEQ ID NO: 809910 - RNA, 19 nt, Homo sapiens
uuugagcucuucaguaauc

SEQ ID NO: 809911 - RNA, 19 nt, Homo sapiens
gcagcaaccagaucaccuu

SEQ ID NO: 809912 - RNA, 19 nt, Homo sapiens
gaacuggcggcauguguac

SEQ ID NO: 809913 - RNA, 19 nt, Homo sapiens
caagacaccuuuaacaaua

SEQ ID NO: 809914 - RNA, 19 nt, Homo sapiens
gcaaggagcugcaguugga

SEQ ID NO: 809915 - RNA, 19 nt, Homo sapiens
gcuaagcucuccaaacaaa

SEQ ID NO: 809916 - RNA, 19 nt, Homo sapiens
aaacaaggcuuugguauuc

SEQ ID NO: 809917 - RNA, 19 nt, Homo sapiens
ccaaaugucugacccgaaa

SEQ ID NO: 809918 - RNA, 19 nt, Homo sapiens
gaaacaaggcuuugguauu

SEQ ID NO: 809919 - RNA, 19 nt, Homo sapiens
ccaagccgcuaaugagaua

SEQ ID NO: 809920 - RNA, 19 nt, Homo sapiens
caauaggacugaaaggaaa

SEQ ID NO: 809921 - RNA, 19 nt, Homo sapiens
gaugaaagcuccugugacu

SEQ ID NO: 809922 - RNA, 19 nt, Homo sapiens
ugacacaggugaccacauu

SEQ ID NO: 809923 - RNA, 19 nt, Homo sapiens
ggagaaagagcgggauuua

SEQ ID NO: 809924 - RNA, 19 nt, Homo sapiens
ccaaccaugugacuuauuu

SEQ ID NO: 809925 - RNA, 19 nt, Homo sapiens
cagaggaacuggccaagaa

SEQ ID NO: 809926 - RNA, 19 nt, Homo sapiens
gugcuaagcucuccaaaca

SEQ ID NO: 809927 - RNA, 19 nt, Homo sapiens
gaagugccuuuggaguuua

SEQ ID NO: 809928 - RNA, 19 nt, Homo sapiens
cuaaugagauagcagcuuu

SEQ ID NO: 809929 - RNA, 19 nt, Homo sapiens
ugaaagaguuggccagaug

SEQ ID NO: 809930 - RNA, 19 nt, Homo sapiens
gaacacaagaguauugguu

SEQ ID NO: 809931 - RNA, 19 nt, Homo sapiens
gaacacaccaagccgcuaa

SEQ ID NO: 809932 - RNA, 19 nt, Homo sapiens
ccaugugacuuauuuauuc

SEQ ID NO: 809933 - RNA, 19 nt, Homo sapiens
gaaagagcgggauuuagaa

SEQ ID NO: 809934 - RNA, 19 nt, Homo sapiens
ugaagugccuuuggaguuu

SEQ ID NO: 809935 - RNA, 19 nt, Homo sapiens
ggaagguucugccacacuu

SEQ ID NO: 809936 - RNA, 19 nt, Homo sapiens
cagagaccaucaccuauga

SEQ ID NO: 809937 - RNA, 19 nt, Homo sapiens
ugacguggcuuuccugauc

SEQ ID NO: 809938 - RNA, 19 nt, Homo sapiens
gacgaaguguacugccuua

SEQ ID NO: 809939 - RNA, 19 nt, Homo sapiens
gcuccuaccugccugagaa

SEQ ID NO: 809940 - RNA, 19 nt, Homo sapiens
caggacagcucacaaucuu

SEQ ID NO: 809941 - RNA, 19 nt, Homo sapiens
ccuccucaguccagaauua

SEQ ID NO: 809942 - RNA, 19 nt, Homo sapiens
gcaaauugaagagacguua

SEQ ID NO: 809943 - RNA, 19 nt, Homo sapiens
gagaagccacucaucauug

SEQ ID NO: 809944 - RNA, 19 nt, Homo sapiens
acacaagaguauugguuaa

SEQ ID NO: 809945 - RNA, 19 nt, Homo sapiens
guacugccuuaacgacuuu

SEQ ID NO: 809946 - RNA, 19 nt, Homo sapiens
agaaagagcgggauuuaga

SEQ ID NO: 809947 - RNA, 19 nt, Homo sapiens
ugaagaaccuccggaacaa

SEQ ID NO: 809948 - RNA, 19 nt, Homo sapiens
aauaaacggucaacauugu

SEQ ID NO: 809949 - RNA, 19 nt, Homo sapiens
ggagaucacacaccugcua

SEQ ID NO: 809950 - RNA, 19 nt, Homo sapiens
agacagagaccaucaccua

SEQ ID NO: 809951 - RNA, 19 nt, Homo sapiens
aggaugagcugcuucaguu

SEQ ID NO: 809952 - RNA, 19 nt, Homo sapiens
cgaaagagaauguauuuac

SEQ ID NO: 809953 - RNA, 19 nt, Homo sapiens
ggacaaagucaggagguuu

SEQ ID NO: 809954 - RNA, 19 nt, Homo sapiens
uaacgacuuugaagaagau

SEQ ID NO: 809955 - RNA, 19 nt, Homo sapiens
guucagagguugcaauacu

SEQ ID NO: 809956 - RNA, 19 nt, Homo sapiens
ggacagcucacaaucuuag

SEQ ID NO: 809957 - RNA, 19 nt, Homo sapiens
ggaaacaaggcuuugguau

SEQ ID NO: 809958 - RNA, 19 nt, Homo sapiens
guacugguaguguauguuu

SEQ ID NO: 809959 - RNA, 19 nt, Homo sapiens
agacaucacucaccagaag

SEQ ID NO: 809960 - RNA, 19 nt, Homo sapiens
cagaauuacuuucauuugg

SEQ ID NO: 809961 - RNA, 19 nt, Homo sapiens
ccagaugacuaagacauau

SEQ ID NO: 809962 - RNA, 19 nt, Homo sapiens
gcacauggucacaacaaga

SEQ ID NO: 809963 - RNA, 19 nt, Homo sapiens
gaaguguacugccuuaacg

SEQ ID NO: 809964 - RNA, 19 nt, Homo sapiens
gaaacgaugagcggaguaa

SEQ ID NO: 809965 - RNA, 19 nt, Homo sapiens
gaaagaguuggccagauga

SEQ ID NO: 809966 - RNA, 19 nt, Homo sapiens
guagauagaauaacaaagg

SEQ ID NO: 809967 - RNA, 19 nt, Homo sapiens
gaacagcacauggucacaa

SEQ ID NO: 809968 - RNA, 19 nt, Homo sapiens
gaaccacaaccaggcauaa

SEQ ID NO: 809969 - RNA, 19 nt, Homo sapiens
ccaagacaccuuuaacaau

SEQ ID NO: 809970 - RNA, 19 nt, Homo sapiens
cuaugugguucaaauauga

SEQ ID NO: 809971 - RNA, 19 nt, Homo sapiens
gauaggaaaccagugaauu

SEQ ID NO: 809972 - RNA, 19 nt, Homo sapiens
gcugaguccuucacuaaca

SEQ ID NO: 809973 - RNA, 19 nt, Homo sapiens
gccagucguuguugaagaa

SEQ ID NO: 809974 - RNA, 19 nt, Homo sapiens
agagcgggauuuagaauug

SEQ ID NO: 809975 - RNA, 19 nt, Homo sapiens
caaccgagcaaauugaaga

SEQ ID NO: 809976 - RNA, 19 nt, Homo sapiens
gacaaacgccugugaugug

SEQ ID NO: 809977 - RNA, 19 nt, Homo sapiens
ggacaaacgccugugaugu

SEQ ID NO: 809978 - RNA, 19 nt, Homo sapiens
ugccagaaauaccauguaa

SEQ ID NO: 809979 - RNA, 19 nt, Homo sapiens
agacauuuauggaaggaaa

SEQ ID NO: 809980 - RNA, 19 nt, Homo sapiens
ggaugccaauguccagauu

SEQ ID NO: 809981 - RNA, 19 nt, Homo sapiens
ggagaauguuguacuucga

SEQ ID NO: 809982 - RNA, 19 nt, Homo sapiens
cauggaggcucucucuguu

SEQ ID NO: 809983 - RNA, 19 nt, Homo sapiens
uaaugguacugguagugua

SEQ ID NO: 809984 - RNA, 19 nt, Homo sapiens
gaagagacguuaaaauacu

SEQ ID NO: 809985 - RNA, 19 nt, Homo sapiens
ucggagggcuuuucuuuua

SEQ ID NO: 809986 - RNA, 19 nt, Homo sapiens
ccauacaccucucauuucu

SEQ ID NO: 809987 - RNA, 19 nt, Homo sapiens
ggacccaagacaccuuuaa

SEQ ID NO: 809988 - RNA, 19 nt, Homo sapiens
guccagaauuacuuucauu

SEQ ID NO: 809989 - RNA, 19 nt, Homo sapiens
gggaaacaaggcuuuggua

SEQ ID NO: 809990 - RNA, 19 nt, Homo sapiens
gaacucgccuaugcagaca

SEQ ID NO: 809991 - RNA, 19 nt, Homo sapiens
gagagaagccacucaucau

SEQ ID NO: 809992 - RNA, 19 nt, Homo sapiens
gcacgggucauaacacauc

SEQ ID NO: 809993 - RNA, 19 nt, Homo sapiens
gaagaaccuccggaacaaa

SEQ ID NO: 809994 - RNA, 19 nt, Homo sapiens
ucagagguugcaauacuua

SEQ ID NO: 809995 - RNA, 19 nt, Homo sapiens
auuuaugucugccguauuu

SEQ ID NO: 809996 - RNA, 19 nt, Homo sapiens
caaccaggcauaauaccaa

SEQ ID NO: 809997 - RNA, 19 nt, Homo sapiens
gcugaaagaccuugaagag

SEQ ID NO: 809998 - RNA, 19 nt, Homo sapiens
uaacaagcaaacucagaaa

SEQ ID NO: 809999 - RNA, 19 nt, Homo sapiens
caaauugaagagacguuaa

SEQ ID NO: 810000 - RNA, 19 nt, Homo sapiens
ccgacaccaucuacgguua

SEQ ID NO: 810001 - RNA, 19 nt, Homo sapiens
aggaaaacaucccauauaa

SEQ ID NO: 810002 - RNA, 19 nt, Homo sapiens
gaagucauccuguguuuug

SEQ ID NO: 810003 - RNA, 19 nt, Homo sapiens
gaaacucccaaguguguuc

SEQ ID NO: 810004 - RNA, 19 nt, Homo sapiens
gcugagggaugccaauguc

SEQ ID NO: 810005 - RNA, 19 nt, Homo sapiens
ucauuuggauucucuucaa

SEQ ID NO: 810006 - RNA, 19 nt, Homo sapiens
gcaagcucauucggacaaa

SEQ ID NO: 810007 - RNA, 19 nt, Homo sapiens
cacgacgacuggcuccaua

SEQ ID NO: 810008 - RNA, 19 nt, Homo sapiens
gagugaggguaaccuuaug

SEQ ID NO: 810009 - RNA, 19 nt, Homo sapiens
gggcugcacuguacaccau

SEQ ID NO: 810010 - RNA, 19 nt, Homo sapiens
gccagaugacuaagacaua

SEQ ID NO: 810011 - RNA, 19 nt, Homo sapiens
caacauugugcaaccacua

SEQ ID NO: 810012 - RNA, 19 nt, Homo sapiens
aaauaaacggucaacauug

SEQ ID NO: 810013 - RNA, 19 nt, Homo sapiens
caagacagcugacgacuga

SEQ ID NO: 810014 - RNA, 19 nt, Homo sapiens
gccgauggcugacguauuu

SEQ ID NO: 810015 - RNA, 19 nt, Homo sapiens
ggacgaggcugugaucuug

SEQ ID NO: 810016 - RNA, 19 nt, Homo sapiens
gaagggaccauagauguua

SEQ ID NO: 810017 - RNA, 19 nt, Homo sapiens
gaauucagcuccaguucaa

SEQ ID NO: 810018 - RNA, 19 nt, Homo sapiens
guacagagugcaaauguuu

SEQ ID NO: 810019 - RNA, 19 nt, Homo sapiens
cuaagaaccucaugcaguu

SEQ ID NO: 810020 - RNA, 19 nt, Homo sapiens
gcuaugaccugaagaccaa

SEQ ID NO: 810021 - RNA, 19 nt, Homo sapiens
uguauaaccuggccucuuu

SEQ ID NO: 810022 - RNA, 19 nt, Homo sapiens
gaaagucacacugcacaua

SEQ ID NO: 810023 - RNA, 19 nt, Homo sapiens
aagcagaggcugagaauaa

SEQ ID NO: 810024 - RNA, 19 nt, Homo sapiens
ggugcccgcugcaauguua

SEQ ID NO: 810025 - RNA, 19 nt, Homo sapiens
ggaggaagagcuagaagaa

SEQ ID NO: 810026 - RNA, 19 nt, Homo sapiens
gggcagagguggacaaggu

SEQ ID NO: 810027 - RNA, 19 nt, Homo sapiens
caaggugccuggcuucaug

SEQ ID NO: 810028 - RNA, 19 nt, Homo sapiens
gaugacagaugacgacagu

SEQ ID NO: 810029 - RNA, 19 nt, Homo sapiens
gaagaagggaccauagaug

SEQ ID NO: 810030 - RNA, 19 nt, Homo sapiens
cugcacaagucgaccauua

SEQ ID NO: 810031 - RNA, 19 nt, Homo sapiens
agaccuuccugaaccauua

SEQ ID NO: 810032 - RNA, 19 nt, Homo sapiens
ucucgaggcugaacguuaa

SEQ ID NO: 810033 - RNA, 19 nt, Homo sapiens
gcacaaggaagaacgcuau

SEQ ID NO: 810034 - RNA, 19 nt, Homo sapiens
gggccuaucccgcucuuua

SEQ ID NO: 810035 - RNA, 19 nt, Homo sapiens
gcgcuucucccgauacuuu

SEQ ID NO: 810036 - RNA, 19 nt, Homo sapiens
ggacgugaacacagacuuu

SEQ ID NO: 810037 - RNA, 19 nt, Homo sapiens
uuauaaggauuccagcuuu

SEQ ID NO: 810038 - RNA, 19 nt, Homo sapiens
ccauagauguuaccgacuu

SEQ ID NO: 810039 - RNA, 19 nt, Homo sapiens
gcacaccucuugagaaccu

SEQ ID NO: 810040 - RNA, 19 nt, Homo sapiens
ggacgaggaggaagagcua

SEQ ID NO: 810041 - RNA, 19 nt, Homo sapiens
acagugggcugcacaagga

SEQ ID NO: 810042 - RNA, 19 nt, Homo sapiens
ccuuugagaugacagauga

SEQ ID NO: 810043 - RNA, 19 nt, Homo sapiens
ccaacagcgucacauauag

SEQ ID NO: 810044 - RNA, 19 nt, Homo sapiens
gcgcacaccucuugagaac

SEQ ID NO: 810045 - RNA, 19 nt, Homo sapiens
gcaaagcagaggcugagaa

SEQ ID NO: 810046 - RNA, 19 nt, Homo sapiens
cacagaggcuuguuucaca

SEQ ID NO: 810047 - RNA, 19 nt, Homo sapiens
gcugagacuuccaucacaa

SEQ ID NO: 810048 - RNA, 19 nt, Homo sapiens
agaauuaccuggaggaaaa

SEQ ID NO: 810049 - RNA, 19 nt, Homo sapiens
ugaaugcgcacucgauuug

SEQ ID NO: 810050 - RNA, 19 nt, Homo sapiens
caggugcgguuggaaagua

SEQ ID NO: 810051 - RNA, 19 nt, Homo sapiens
gggaguuccuuugagauga

SEQ ID NO: 810052 - RNA, 19 nt, Homo sapiens
gaagagcccucggcaucuc

SEQ ID NO: 810053 - RNA, 19 nt, Homo sapiens
cuauuuaucccuugugaaa

SEQ ID NO: 810054 - RNA, 19 nt, Homo sapiens
gaccaaaucaggcaacauc

SEQ ID NO: 810055 - RNA, 19 nt, Homo sapiens
ucacauauaggaccaaauc

SEQ ID NO: 810056 - RNA, 19 nt, Homo sapiens
cccaacagcgucacauaua

SEQ ID NO: 810057 - RNA, 19 nt, Homo sapiens
ucaaggagcacuaccuaga

SEQ ID NO: 810058 - RNA, 19 nt, Homo sapiens
gaacaacgaaccgcuuaca

SEQ ID NO: 810059 - RNA, 19 nt, Homo sapiens
ggacauccuggccaaguug

SEQ ID NO: 810060 - RNA, 19 nt, Homo sapiens
gaugacgacagugccauua

SEQ ID NO: 810061 - RNA, 19 nt, Homo sapiens
agugcuagcugaucgcuuu

SEQ ID NO: 810062 - RNA, 19 nt, Homo sapiens
ccaagagcguggagguaga

SEQ ID NO: 810063 - RNA, 19 nt, Homo sapiens
aaagucacacugcacauaa

SEQ ID NO: 810064 - RNA, 19 nt, Homo sapiens
cagcgucagugcaaacuuc

SEQ ID NO: 810065 - RNA, 19 nt, Homo sapiens
agacuuccaucacaaucaa

SEQ ID NO: 810066 - RNA, 19 nt, Homo sapiens
gaugaaugcgcacucgauu

SEQ ID NO: 810067 - RNA, 19 nt, Homo sapiens
ggaauagcaaggagagaau

SEQ ID NO: 810068 - RNA, 19 nt, Homo sapiens
caaagcagaggcugagaau

SEQ ID NO: 810069 - RNA, 19 nt, Homo sapiens
gcuagaagaagggaccaua

SEQ ID NO: 810070 - RNA, 19 nt, Homo sapiens
uuucacaucuguaacaaca

SEQ ID NO: 810071 - RNA, 19 nt, Homo sapiens
gaagccggcuggagaaaau

SEQ ID NO: 810072 - RNA, 19 nt, Homo sapiens
gcagcugaauccagagagu

SEQ ID NO: 810073 - RNA, 19 nt, Homo sapiens
gaauagcaaggagagaauu

SEQ ID NO: 810074 - RNA, 19 nt, Homo sapiens
gagaauuaccuggaggaaa

SEQ ID NO: 810075 - RNA, 19 nt, Homo sapiens
gaagacggcgguggaguuc

SEQ ID NO: 810076 - RNA, 19 nt, Homo sapiens
ccgcaucucugcugugucu

SEQ ID NO: 810077 - RNA, 19 nt, Homo sapiens
gacacgggcugugggaaga

SEQ ID NO: 810078 - RNA, 19 nt, Homo sapiens
cagggaggccacacgguua

SEQ ID NO: 810079 - RNA, 19 nt, Homo sapiens
uuagggcucugacccaguu

SEQ ID NO: 810080 - RNA, 19 nt, Homo sapiens
aggcugaacguuaacauuu

SEQ ID NO: 810081 - RNA, 19 nt, Homo sapiens
gcagaggagguacgucuca

SEQ ID NO: 810082 - RNA, 19 nt, Homo sapiens
cugagacugucauugcuuu

SEQ ID NO: 810083 - RNA, 19 nt, Homo sapiens
ggcugaacguuaacauuuc

SEQ ID NO: 810084 - RNA, 19 nt, Homo sapiens
uauaaggauuccagcuuuc

SEQ ID NO: 810085 - RNA, 19 nt, Homo sapiens
aauggucccuuuccaagug

SEQ ID NO: 810086 - RNA, 19 nt, Homo sapiens
gauagagaccuuccugaac

SEQ ID NO: 810087 - RNA, 19 nt, Homo sapiens
ccaaggugauucagauugc

SEQ ID NO: 810088 - RNA, 19 nt, Homo sapiens
gcacaagucgaccauuaac

SEQ ID NO: 810089 - RNA, 19 nt, Homo sapiens
caaggugaaagcacuguug

SEQ ID NO: 810090 - RNA, 19 nt, Homo sapiens
guaucaagagccaauguga

SEQ ID NO: 810091 - RNA, 19 nt, Homo sapiens
ccaugagucugaggaugaa

SEQ ID NO: 810092 - RNA, 19 nt, Homo sapiens
gagcccauccuccgcaaga

SEQ ID NO: 810093 - RNA, 19 nt, Homo sapiens
cagcgggaguaccugacua

SEQ ID NO: 810094 - RNA, 19 nt, Homo sapiens
ugcguaagcugcagagcaa

SEQ ID NO: 810095 - RNA, 19 nt, Homo sapiens
gcccauccuccgcaagaua

SEQ ID NO: 810096 - RNA, 19 nt, Homo sapiens
acacaaauggaccgaagaa

SEQ ID NO: 810097 - RNA, 19 nt, Homo sapiens
gugaccaccuggccuuugu

SEQ ID NO: 810098 - RNA, 19 nt, Homo sapiens
uagaagaagggaccauaga

SEQ ID NO: 810099 - RNA, 19 nt, Homo sapiens
gaggcugaacguuaacauu

SEQ ID NO: 810100 - RNA, 19 nt, Homo sapiens
gcccaacagcgucacauau

SEQ ID NO: 810101 - RNA, 19 nt, Homo sapiens
ggagacaguguggguauca

SEQ ID NO: 810102 - RNA, 19 nt, Homo sapiens
ucaaaagccuacaaaaucu

SEQ ID NO: 810103 - RNA, 19 nt, Homo sapiens
ccuugugacugaucugguu

SEQ ID NO: 810104 - RNA, 19 nt, Homo sapiens
ggaugaaugcgcacucgau

SEQ ID NO: 810105 - RNA, 19 nt, Homo sapiens
ccgcugcaauguuaucauc

SEQ ID NO: 810106 - RNA, 19 nt, Homo sapiens
gcacagaggcuuguuucac

SEQ ID NO: 810107 - RNA, 19 nt, Homo sapiens
aagaagggaccauagaugu

SEQ ID NO: 810108 - RNA, 19 nt, Homo sapiens
uagucuacgugcacacaaa

SEQ ID NO: 810109 - RNA, 19 nt, Homo sapiens
cgacugagcccugcuucug

SEQ ID NO: 810110 - RNA, 19 nt, Homo sapiens
gagacaguguggguaucaa

SEQ ID NO: 810111 - RNA, 19 nt, Homo sapiens
gagacuuccaucacaauca

SEQ ID NO: 810112 - RNA, 19 nt, Homo sapiens
guuggaagcagaggaggua

SEQ ID NO: 810113 - RNA, 19 nt, Homo sapiens
caagacagcugacgacuga

SEQ ID NO: 810114 - RNA, 19 nt, Homo sapiens
gccgauggcugacguauuu

SEQ ID NO: 810115 - RNA, 19 nt, Homo sapiens
gaagggaccauagauguua

SEQ ID NO: 810116 - RNA, 19 nt, Homo sapiens
guacagagugcaaauguuu

SEQ ID NO: 810117 - RNA, 19 nt, Homo sapiens
cuaagaaccucaugcaguu

SEQ ID NO: 810118 - RNA, 19 nt, Homo sapiens
gaaagucacacugcacaua

SEQ ID NO: 810119 - RNA, 19 nt, Homo sapiens
aagcagaggcugagaauaa

SEQ ID NO: 810120 - RNA, 19 nt, Homo sapiens
ggaggaagagcuagaagaa

SEQ ID NO: 810121 - RNA, 19 nt, Homo sapiens
gaugacagaugacgacagu

SEQ ID NO: 810122 - RNA, 19 nt, Homo sapiens
gaagaagggaccauagaug

SEQ ID NO: 810123 - RNA, 19 nt, Homo sapiens
gggccuaucccgcucuuua

SEQ ID NO: 810124 - RNA, 19 nt, Homo sapiens
ccauagauguuaccgacuu

SEQ ID NO: 810125 - RNA, 19 nt, Homo sapiens
ggacgaggaggaagagcua

SEQ ID NO: 810126 - RNA, 19 nt, Homo sapiens
ccuuugagaugacagauga

SEQ ID NO: 810127 - RNA, 19 nt, Homo sapiens
gcaaagcagaggcugagaa

SEQ ID NO: 810128 - RNA, 19 nt, Homo sapiens
gggaguuccuuugagauga

SEQ ID NO: 810129 - RNA, 19 nt, Homo sapiens
gaagagcccucggcaucuc

SEQ ID NO: 810130 - RNA, 19 nt, Homo sapiens
gaacaacgaaccgcuuaca

SEQ ID NO: 810131 - RNA, 19 nt, Homo sapiens
gaugacgacagugccauua

SEQ ID NO: 810132 - RNA, 19 nt, Homo sapiens
agugcuagcugaucgcuuu

SEQ ID NO: 810133 - RNA, 19 nt, Homo sapiens
ccaagagcguggagguaga

SEQ ID NO: 810134 - RNA, 19 nt, Homo sapiens
aaagucacacugcacauaa

SEQ ID NO: 810135 - RNA, 19 nt, Homo sapiens
caaagcagaggcugagaau

SEQ ID NO: 810136 - RNA, 19 nt, Homo sapiens
gcuagaagaagggaccaua

SEQ ID NO: 810137 - RNA, 19 nt, Homo sapiens
gcagcugaauccagagagu

SEQ ID NO: 810138 - RNA, 19 nt, Homo sapiens
uuagggcucugacccaguu

SEQ ID NO: 810139 - RNA, 19 nt, Homo sapiens
ccaaggugauucagauugc

SEQ ID NO: 810140 - RNA, 19 nt, Homo sapiens
acacaaauggaccgaagaa

SEQ ID NO: 810141 - RNA, 19 nt, Homo sapiens
uagaagaagggaccauaga

SEQ ID NO: 810142 - RNA, 19 nt, Homo sapiens
aagaagggaccauagaugu

SEQ ID NO: 810143 - RNA, 19 nt, Homo sapiens
uagucuacgugcacacaaa

SEQ ID NO: 810144 - RNA, 19 nt, Homo sapiens
cgacugagcccugcuucug

SEQ ID NO: 810145 - RNA, 19 nt, Homo sapiens
gccaaggugauucagauug

SEQ ID NO: 810146 - RNA, 19 nt, Homo sapiens
uggccaaggugauucagau

SEQ ID NO: 810147 - RNA, 19 nt, Homo sapiens
ggaguuccuuugagaugac

SEQ ID NO: 810148 - RNA, 19 nt, Homo sapiens
gauguuaccgacuucuugu

SEQ ID NO: 810149 - RNA, 19 nt, Homo sapiens
ugacgacagugccauuagg

SEQ ID NO: 810150 - RNA, 19 nt, Homo sapiens
ggaagagcccucggcaucu

SEQ ID NO: 810151 - RNA, 19 nt, Homo sapiens
aagucacacugcacauaaa

SEQ ID NO: 810152 - RNA, 19 nt, Homo sapiens
acaacgaaccgcuuacaca

SEQ ID NO: 810153 - RNA, 19 nt, Homo sapiens
caacagugugauuggaaga

SEQ ID NO: 810154 - RNA, 19 nt, Homo sapiens
cauagauguuaccgacuuc

SEQ ID NO: 810155 - RNA, 19 nt, Homo sapiens
agaagggaccauagauguu

SEQ ID NO: 810156 - RNA, 19 nt, Homo sapiens
caagagcguggagguagaa

SEQ ID NO: 810157 - RNA, 19 nt, Homo sapiens
uacagagugcaaauguuua

SEQ ID NO: 810158 - RNA, 19 nt, Homo sapiens
uguacagagugcaaauguu

SEQ ID NO: 810159 - RNA, 19 nt, Homo sapiens
ucauggcagucaaguccaa

SEQ ID NO: 810160 - RNA, 19 nt, Homo sapiens
aggaacaacgaaccgcuua

SEQ ID NO: 810161 - RNA, 19 nt, Homo sapiens
cagcugaauccagagagua

SEQ ID NO: 810162 - RNA, 19 nt, Homo sapiens
acagagugcaaauguuuau

SEQ ID NO: 810163 - RNA, 19 nt, Homo sapiens
agaagaagggaccauagau

SEQ ID NO: 810164 - RNA, 19 nt, Homo sapiens
acaaauggaccgaagaaaa

SEQ ID NO: 810165 - RNA, 19 nt, Homo sapiens
cgucauccuccacagcuaa

SEQ ID NO: 810166 - RNA, 19 nt, Homo sapiens
ggcuauggcagcaagaaga

SEQ ID NO: 810167 - RNA, 19 nt, Homo sapiens
accaagcugucuacacuca

SEQ ID NO: 810168 - RNA, 19 nt, Homo sapiens
cagcuaagaaccucaugca

SEQ ID NO: 810169 - RNA, 19 nt, Homo sapiens
gcuauggcagcaagaagau

SEQ ID NO: 810170 - RNA, 19 nt, Homo sapiens
ucucaacagugugauugga

SEQ ID NO: 810171 - RNA, 19 nt, Homo sapiens
caaggugauucagauugca

SEQ ID NO: 810172 - RNA, 19 nt, Homo sapiens
guguacagagugcaaaugu

SEQ ID NO: 810173 - RNA, 19 nt, Homo sapiens
cacauaaaauggcccaaga

SEQ ID NO: 810174 - RNA, 19 nt, Homo sapiens
ggccaaggugauucagauu

SEQ ID NO: 810175 - RNA, 19 nt, Homo sapiens
gcccaagagcguggaggua

SEQ ID NO: 810176 - RNA, 19 nt, Homo sapiens
aaucuucucaacaguguga

SEQ ID NO: 810177 - RNA, 19 nt, Homo sapiens
caagacagcugacgacuga

SEQ ID NO: 810178 - RNA, 19 nt, Homo sapiens
gccgauggcugacguauuu

SEQ ID NO: 810179 - RNA, 19 nt, Homo sapiens
ggacgaggcugugaucuug

SEQ ID NO: 810180 - RNA, 19 nt, Homo sapiens
gaagggaccauagauguua

SEQ ID NO: 810181 - RNA, 19 nt, Homo sapiens
gaauucagcuccaguucaa

SEQ ID NO: 810182 - RNA, 19 nt, Homo sapiens
guacagagugcaaauguuu

SEQ ID NO: 810183 - RNA, 19 nt, Homo sapiens
cuaagaaccucaugcaguu

SEQ ID NO: 810184 - RNA, 19 nt, Homo sapiens
gcuaugaccugaagaccaa

SEQ ID NO: 810185 - RNA, 19 nt, Homo sapiens
uguauaaccuggccucuuu

SEQ ID NO: 810186 - RNA, 19 nt, Homo sapiens
gaaagucacacugcacaua

SEQ ID NO: 810187 - RNA, 19 nt, Homo sapiens
aagcagaggcugagaauaa

SEQ ID NO: 810188 - RNA, 19 nt, Homo sapiens
ggugcccgcugcaauguua

SEQ ID NO: 810189 - RNA, 19 nt, Homo sapiens
ggaggaagagcuagaagaa

SEQ ID NO: 810190 - RNA, 19 nt, Homo sapiens
gggcagagguggacaaggu

SEQ ID NO: 810191 - RNA, 19 nt, Homo sapiens
caaggugccuggcuucaug

SEQ ID NO: 810192 - RNA, 19 nt, Homo sapiens
gaugacagaugacgacagu

SEQ ID NO: 810193 - RNA, 19 nt, Homo sapiens
gaagaagggaccauagaug

SEQ ID NO: 810194 - RNA, 19 nt, Homo sapiens
cugcacaagucgaccauua

SEQ ID NO: 810195 - RNA, 19 nt, Homo sapiens
agaccuuccugaaccauua

SEQ ID NO: 810196 - RNA, 19 nt, Homo sapiens
gcacaaggaagaacgcuau

SEQ ID NO: 810197 - RNA, 19 nt, Homo sapiens
gggccuaucccgcucuuua

SEQ ID NO: 810198 - RNA, 19 nt, Homo sapiens
gcgcuucucccgauacuuu

SEQ ID NO: 810199 - RNA, 19 nt, Homo sapiens
ggacgugaacacagacuuu

SEQ ID NO: 810200 - RNA, 19 nt, Homo sapiens
uuauaaggauuccagcuuu

SEQ ID NO: 810201 - RNA, 19 nt, Homo sapiens
ccauagauguuaccgacuu

SEQ ID NO: 810202 - RNA, 19 nt, Homo sapiens
gcacaccucuugagaaccu

SEQ ID NO: 810203 - RNA, 19 nt, Homo sapiens
ggacgaggaggaagagcua

SEQ ID NO: 810204 - RNA, 19 nt, Homo sapiens
acagugggcugcacaagga

SEQ ID NO: 810205 - RNA, 19 nt, Homo sapiens
ccuuugagaugacagauga

SEQ ID NO: 810206 - RNA, 19 nt, Homo sapiens
ccaacagcgucacauauag

SEQ ID NO: 810207 - RNA, 19 nt, Homo sapiens
gcgcacaccucuugagaac

SEQ ID NO: 810208 - RNA, 19 nt, Homo sapiens
gcaaagcagaggcugagaa

SEQ ID NO: 810209 - RNA, 19 nt, Homo sapiens
cacagaggcuuguuucaca

SEQ ID NO: 810210 - RNA, 19 nt, Homo sapiens
gcugagacuuccaucacaa

SEQ ID NO: 810211 - RNA, 19 nt, Homo sapiens
gaccaucucucgagcuucu

SEQ ID NO: 810212 - RNA, 19 nt, Homo sapiens
agaauuaccuggaggaaaa

SEQ ID NO: 810213 - RNA, 19 nt, Homo sapiens
ugaaugcgcacucgauuug

SEQ ID NO: 810214 - RNA, 19 nt, Homo sapiens
caggugcgguuggaaagua

SEQ ID NO: 810215 - RNA, 19 nt, Homo sapiens
gggaguuccuuugagauga

SEQ ID NO: 810216 - RNA, 19 nt, Homo sapiens
gaagagcccucggcaucuc

SEQ ID NO: 810217 - RNA, 19 nt, Homo sapiens
cuauuuaucccuugugaaa

SEQ ID NO: 810218 - RNA, 19 nt, Homo sapiens
gaccaaaucaggcaacauc

SEQ ID NO: 810219 - RNA, 19 nt, Homo sapiens
ucacauauaggaccaaauc

SEQ ID NO: 810220 - RNA, 19 nt, Homo sapiens
cccaacagcgucacauaua

SEQ ID NO: 810221 - RNA, 19 nt, Homo sapiens
ucaaggagcacuaccuaga

SEQ ID NO: 810222 - RNA, 19 nt, Homo sapiens
gaacaacgaaccgcuuaca

SEQ ID NO: 810223 - RNA, 19 nt, Homo sapiens
ggacauccuggccaaguug

SEQ ID NO: 810224 - RNA, 19 nt, Homo sapiens
gaugacgacagugccauua

SEQ ID NO: 810225 - RNA, 19 nt, Homo sapiens
agugcuagcugaucgcuuu

SEQ ID NO: 810226 - RNA, 19 nt, Homo sapiens
ccaagagcguggagguaga

SEQ ID NO: 810227 - RNA, 19 nt, Homo sapiens
aaagucacacugcacauaa

SEQ ID NO: 810228 - RNA, 19 nt, Homo sapiens
cagcgucagugcaaacuuc

SEQ ID NO: 810229 - RNA, 19 nt, Homo sapiens
agacuuccaucacaaucaa

SEQ ID NO: 810230 - RNA, 19 nt, Homo sapiens
gaugaaugcgcacucgauu

SEQ ID NO: 810231 - RNA, 19 nt, Homo sapiens
caaagcagaggcugagaau

SEQ ID NO: 810232 - RNA, 19 nt, Homo sapiens
ggaauagcaaggagagaau

SEQ ID NO: 810233 - RNA, 19 nt, Homo sapiens
gcuagaagaagggaccaua

SEQ ID NO: 810234 - RNA, 19 nt, Homo sapiens
gggaccaucucucgagcuu

SEQ ID NO: 810235 - RNA, 19 nt, Homo sapiens
uuucacaucuguaacaaca

SEQ ID NO: 810236 - RNA, 19 nt, Homo sapiens
gaagccggcuggagaaaau

SEQ ID NO: 810237 - RNA, 19 nt, Homo sapiens
gaauagcaaggagagaauu

SEQ ID NO: 810238 - RNA, 19 nt, Homo sapiens
gcagcugaauccagagagu

SEQ ID NO: 810239 - RNA, 19 nt, Homo sapiens
gagaauuaccuggaggaaa

SEQ ID NO: 810240 - RNA, 19 nt, Homo sapiens
gaagacggcgguggaguuc

SEQ ID NO: 810241 - RNA, 19 nt, Homo sapiens
ccgcaucucugcugugucu

SEQ ID NO: 810242 - RNA, 19 nt, Homo sapiens
gacacgggcugugggaaga

SEQ ID NO: 810243 - RNA, 19 nt, Homo sapiens
cagggaggccacacgguua

SEQ ID NO: 810244 - RNA, 19 nt, Homo sapiens
uuagggcucugacccaguu

SEQ ID NO: 810245 - RNA, 19 nt, Homo sapiens
cugagacugucauugcuuu

SEQ ID NO: 810246 - RNA, 19 nt, Homo sapiens
gcagaggagguacgucuca

SEQ ID NO: 810247 - RNA, 19 nt, Homo sapiens
uauaaggauuccagcuuuc

SEQ ID NO: 810248 - RNA, 19 nt, Homo sapiens
aauggucccuuuccaagug

SEQ ID NO: 810249 - RNA, 19 nt, Homo sapiens
gauagagaccuuccugaac

SEQ ID NO: 810250 - RNA, 19 nt, Homo sapiens
ccaaggugauucagauugc

SEQ ID NO: 810251 - RNA, 19 nt, Homo sapiens
gcacaagucgaccauuaac

SEQ ID NO: 810252 - RNA, 19 nt, Homo sapiens
caaggugaaagcacuguug

SEQ ID NO: 810253 - RNA, 19 nt, Homo sapiens
guaucaagagccaauguga

SEQ ID NO: 810254 - RNA, 19 nt, Homo sapiens
ccaugagucugaggaugaa

SEQ ID NO: 810255 - RNA, 19 nt, Homo sapiens
gagcccauccuccgcaaga

SEQ ID NO: 810256 - RNA, 19 nt, Homo sapiens
cagcgggaguaccugacua

SEQ ID NO: 810257 - RNA, 19 nt, Homo sapiens
ugcguaagcugcagagcaa

SEQ ID NO: 810258 - RNA, 19 nt, Homo sapiens
gcccauccuccgcaagaua

SEQ ID NO: 810259 - RNA, 19 nt, Homo sapiens
acacaaauggaccgaagaa

SEQ ID NO: 810260 - RNA, 19 nt, Homo sapiens
gugaccaccuggccuuugu

SEQ ID NO: 810261 - RNA, 19 nt, Homo sapiens
uagaagaagggaccauaga

SEQ ID NO: 810262 - RNA, 19 nt, Homo sapiens
gcccaacagcgucacauau

SEQ ID NO: 810263 - RNA, 19 nt, Homo sapiens
ggagacaguguggguauca

SEQ ID NO: 810264 - RNA, 19 nt, Homo sapiens
ucaaaagccuacaaaaucu

SEQ ID NO: 810265 - RNA, 19 nt, Homo sapiens
ccuugugacugaucugguu

SEQ ID NO: 810266 - RNA, 19 nt, Homo sapiens
ggaugaaugcgcacucgau

SEQ ID NO: 810267 - RNA, 19 nt, Homo sapiens
ccgcugcaauguuaucauc

SEQ ID NO: 810268 - RNA, 19 nt, Homo sapiens
gcacagaggcuuguuucac

SEQ ID NO: 810269 - RNA, 19 nt, Homo sapiens
aagaagggaccauagaugu

SEQ ID NO: 810270 - RNA, 19 nt, Homo sapiens
uagucuacgugcacacaaa

SEQ ID NO: 810271 - RNA, 19 nt, Homo sapiens
cgacugagcccugcuucug

SEQ ID NO: 810272 - RNA, 19 nt, Homo sapiens
gagaauucagcuccaguuc

SEQ ID NO: 810273 - RNA, 19 nt, Homo sapiens
gagacaguguggguaucaa

SEQ ID NO: 810274 - RNA, 19 nt, Homo sapiens
gagacuuccaucacaauca

SEQ ID NO: 810275 - RNA, 19 nt, Homo sapiens
guuggaagcagaggaggua

SEQ ID NO: 810276 - RNA, 19 nt, Homo sapiens
agauagagaccuuccugaa

SEQ ID NO: 810277 - RNA, 19 nt, Homo sapiens
gaaguggaaugaugagaua

SEQ ID NO: 810278 - RNA, 19 nt, Homo sapiens
gaacuggagucuuuacuga

SEQ ID NO: 810279 - RNA, 19 nt, Homo sapiens
gaccaaaucugaacugcua

SEQ ID NO: 810280 - RNA, 19 nt, Homo sapiens
caacaaagaccaaaucuga

SEQ ID NO: 810281 - RNA, 19 nt, Homo sapiens
aaacacugcugcaauauuu

SEQ ID NO: 810282 - RNA, 19 nt, Homo sapiens
guuaaacacugcugcaaua

SEQ ID NO: 810283 - RNA, 19 nt, Homo sapiens
gugcagaacuggagucuuu

SEQ ID NO: 810284 - RNA, 19 nt, Homo sapiens
aaaccuagcuccuuucauu

SEQ ID NO: 810285 - RNA, 19 nt, Homo sapiens
gauggucucuuuacuauug

SEQ ID NO: 810286 - RNA, 19 nt, Homo sapiens
gaccaaaccucaaguacaa

SEQ ID NO: 810287 - RNA, 19 nt, Homo sapiens
guaauaagcuaacuguguu

SEQ ID NO: 810288 - RNA, 19 nt, Homo sapiens
gugcauaguucuaauugua

SEQ ID NO: 810289 - RNA, 19 nt, Homo sapiens
uuaauuagcuguugcagaa

SEQ ID NO: 810290 - RNA, 19 nt, Homo sapiens
ggaacucaaugauacgaua

SEQ ID NO: 810291 - RNA, 19 nt, Homo sapiens
ccacacaucuuuggacuuu

SEQ ID NO: 810292 - RNA, 19 nt, Homo sapiens
gaaaugagucucuuggaaa

SEQ ID NO: 810293 - RNA, 19 nt, Homo sapiens
caaaucacauggacgguuu

SEQ ID NO: 810294 - RNA, 19 nt, Homo sapiens
gagcuggugugcgcuauua

SEQ ID NO: 810295 - RNA, 19 nt, Homo sapiens
gcagcuaacuuuguagaaa

SEQ ID NO: 810296 - RNA, 19 nt, Homo sapiens
ugagauacauugccuuuga

SEQ ID NO: 810297 - RNA, 19 nt, Homo sapiens
ggugugcgcuauuauguaa

SEQ ID NO: 810298 - RNA, 19 nt, Homo sapiens
uuacagacaucaaguaguu

SEQ ID NO: 810299 - RNA, 19 nt, Homo sapiens
gaauugaucugauguuacu

SEQ ID NO: 810300 - RNA, 19 nt, Homo sapiens
uagcagaaaugcaagauga

SEQ ID NO: 810301 - RNA, 19 nt, Homo sapiens
gcaggaugaugacagaauu

SEQ ID NO: 810302 - RNA, 19 nt, Homo sapiens
ugcauuaucuguuugcuua

SEQ ID NO: 810303 - RNA, 19 nt, Homo sapiens
ccaaugugauccagaguuu

SEQ ID NO: 810304 - RNA, 19 nt, Homo sapiens
ggaauggacuaauaucagu

SEQ ID NO: 810305 - RNA, 19 nt, Homo sapiens
cagaaacacuggccuaugu

SEQ ID NO: 810306 - RNA, 19 nt, Homo sapiens
gagcagacauuugcaacaa

SEQ ID NO: 810307 - RNA, 19 nt, Homo sapiens
ggacuaauaucaguguguu

SEQ ID NO: 810308 - RNA, 19 nt, Homo sapiens
gagagggucuuguucuaga

SEQ ID NO: 810309 - RNA, 19 nt, Homo sapiens
guagaagcggucacuauua

SEQ ID NO: 810310 - RNA, 19 nt, Homo sapiens
gagaugggaucgacuaagu

SEQ ID NO: 810311 - RNA, 19 nt, Homo sapiens
gcagguaauuaucuuauag

SEQ ID NO: 810312 - RNA, 19 nt, Homo sapiens
caacaauggugucuuccuu

SEQ ID NO: 810313 - RNA, 19 nt, Homo sapiens
gaugagagaauucagauau

SEQ ID NO: 810314 - RNA, 19 nt, Homo sapiens
gaauuagaaucucauaguc

SEQ ID NO: 810315 - RNA, 19 nt, Homo sapiens
ggaaagagaacucauuugg

SEQ ID NO: 810316 - RNA, 19 nt, Homo sapiens
gcuaaaccaugucuugaau

SEQ ID NO: 810317 - RNA, 19 nt, Homo sapiens
uguguuagaucuuaaggua

SEQ ID NO: 810318 - RNA, 19 nt, Homo sapiens
caaaguagcaaaucacaug

SEQ ID NO: 810319 - RNA, 19 nt, Homo sapiens
gaaagauguuccuccuuca

SEQ ID NO: 810320 - RNA, 19 nt, Homo sapiens
uagcucaguuucauuauug

SEQ ID NO: 810321 - RNA, 19 nt, Homo sapiens
ccaugcagcuaacuuugua

SEQ ID NO: 810322 - RNA, 19 nt, Homo sapiens
uguagggaauggacuaaua

SEQ ID NO: 810323 - RNA, 19 nt, Homo sapiens
guccaaagcugccucuguu

SEQ ID NO: 810324 - RNA, 19 nt, Homo sapiens
uaucaugguuguugccuuu

SEQ ID NO: 810325 - RNA, 19 nt, Homo sapiens
caagaugaauuugagaaga

SEQ ID NO: 810326 - RNA, 19 nt, Homo sapiens
uuacauggcuuuauuacca

SEQ ID NO: 810327 - RNA, 19 nt, Homo sapiens
uaauguggcugcuuuguag

SEQ ID NO: 810328 - RNA, 19 nt, Homo sapiens
caacacuaguccugaauuc

SEQ ID NO: 810329 - RNA, 19 nt, Homo sapiens
uaaaccaugucuugaaugu

SEQ ID NO: 810330 - RNA, 19 nt, Homo sapiens
gaagacaauguugcacuua

SEQ ID NO: 810331 - RNA, 19 nt, Homo sapiens
gaacucauuugggacuuau

SEQ ID NO: 810332 - RNA, 19 nt, Homo sapiens
gcacuacaaugggagcaaa

SEQ ID NO: 810333 - RNA, 19 nt, Homo sapiens
gaucagcgguuuguaugga

SEQ ID NO: 810334 - RNA, 19 nt, Homo sapiens
agaaaugagucucuuggaa

SEQ ID NO: 810335 - RNA, 19 nt, Homo sapiens
caaaucaaggaccaacuua

SEQ ID NO: 810336 - RNA, 19 nt, Homo sapiens
gacaaaagcuugaagaaca

SEQ ID NO: 810337 - RNA, 19 nt, Homo sapiens
gaucuuaagguaucaguau

SEQ ID NO: 810338 - RNA, 19 nt, Homo sapiens
guagcucaguuucauuauu

SEQ ID NO: 810339 - RNA, 19 nt, Homo sapiens
ggcagguaauuaucuuaua

SEQ ID NO: 810340 - RNA, 19 nt, Homo sapiens
uaccuuauguuguccuuaa

SEQ ID NO: 810341 - RNA, 19 nt, Homo sapiens
uagaagcggucacuauuag

SEQ ID NO: 810342 - RNA, 19 nt, Homo sapiens
gaaacuauucaguggauga

SEQ ID NO: 810343 - RNA, 19 nt, Homo sapiens
gaugagauacauugccuuu

SEQ ID NO: 810344 - RNA, 19 nt, Homo sapiens
guagaaacagaacaaauug

SEQ ID NO: 810345 - RNA, 19 nt, Homo sapiens
gcagaucagcgguuuguau

SEQ ID NO: 810346 - RNA, 19 nt, Homo sapiens
gcauuucacuuaaagaacu

SEQ ID NO: 810347 - RNA, 19 nt, Homo sapiens
gcaugguacucuugauguu

SEQ ID NO: 810348 - RNA, 19 nt, Homo sapiens
aauggaagcugaaucuguu

SEQ ID NO: 810349 - RNA, 19 nt, Homo sapiens
ccacagaucagcaaaguag

SEQ ID NO: 810350 - RNA, 19 nt, Homo sapiens
aaucugaacugcuaaugug

SEQ ID NO: 810351 - RNA, 19 nt, Homo sapiens
gaauggaagcugaaucugu

SEQ ID NO: 810352 - RNA, 19 nt, Homo sapiens
ggugacacuuggacagaaa

SEQ ID NO: 810353 - RNA, 19 nt, Homo sapiens
gaacaagaugaauuugaga

SEQ ID NO: 810354 - RNA, 19 nt, Homo sapiens
guucaugucugcuguaaaa

SEQ ID NO: 810355 - RNA, 19 nt, Homo sapiens
aggaccaacuuaaacguua

SEQ ID NO: 810356 - RNA, 19 nt, Homo sapiens
cuagauagaaccaauguga

SEQ ID NO: 810357 - RNA, 19 nt, Homo sapiens
cgaagcaauugcauggauu

SEQ ID NO: 810358 - RNA, 19 nt, Homo sapiens
gaaggaaggaggugguugu

SEQ ID NO: 810359 - RNA, 19 nt, Homo sapiens
aauuagcuguugcagaaua

SEQ ID NO: 810360 - RNA, 19 nt, Homo sapiens
aagacaauguugcacuuaa

SEQ ID NO: 810361 - RNA, 19 nt, Homo sapiens
uccauagacuuauuucuug

SEQ ID NO: 810362 - RNA, 19 nt, Homo sapiens
cacaauaggguaaguaaau

SEQ ID NO: 810363 - RNA, 19 nt, Homo sapiens
uaaagauuaucccaaugug

SEQ ID NO: 810364 - RNA, 19 nt, Homo sapiens
cggcuuggcuuggaagauu

SEQ ID NO: 810365 - RNA, 19 nt, Homo sapiens
gaaggcguguuccgaagca

SEQ ID NO: 810366 - RNA, 19 nt, Homo sapiens
gccagagguucaucgguuu

SEQ ID NO: 810367 - RNA, 19 nt, Homo sapiens
cagcggcuauccaacacua

SEQ ID NO: 810368 - RNA, 19 nt, Homo sapiens
ccaaagauggaauauugaa

SEQ ID NO: 810369 - RNA, 19 nt, Homo sapiens
aaucaaggaccaacuuaaa

SEQ ID NO: 810370 - RNA, 19 nt, Homo sapiens
cauguagucuggaaagcaa

SEQ ID NO: 810371 - RNA, 19 nt, Homo sapiens
cuagcuccuuucauuauuu

SEQ ID NO: 810372 - RNA, 19 nt, Homo sapiens
ugggacaguuagauuuaua

SEQ ID NO: 810373 - RNA, 19 nt, Homo sapiens
acaagauuccauagacuua

SEQ ID NO: 810374 - RNA, 19 nt, Homo sapiens
ugggaucgacuaaguauuu

SEQ ID NO: 810375 - RNA, 19 nt, Homo sapiens
gggcauuucacuuaaagaa

SEQ ID NO: 810376 - RNA, 19 nt, Homo sapiens
gcugggcauuucacuuaaa

SEQ ID NO: 810377 - RNA, 19 nt, Homo sapiens
gaauggaguuuccuaguua

SEQ ID NO: 810378 - RNA, 19 nt, Homo sapiens
gaaugaagaugauauguug

SEQ ID NO: 810379 - RNA, 19 nt, Homo sapiens
gaagaucagucccuacuuu

SEQ ID NO: 810380 - RNA, 19 nt, Homo sapiens
ggucagaaguuauauguaa

SEQ ID NO: 810381 - RNA, 19 nt, Homo sapiens
ggauuaagaugaccaaauu

SEQ ID NO: 810382 - RNA, 19 nt, Homo sapiens
gcaccuggcugcugacuuu

SEQ ID NO: 810383 - RNA, 19 nt, Homo sapiens
guaaggcucuuucaacgua

SEQ ID NO: 810384 - RNA, 19 nt, Homo sapiens
guuaagagccugauugaua

SEQ ID NO: 810385 - RNA, 19 nt, Homo sapiens
gaagggaauuguaacuaaa

SEQ ID NO: 810386 - RNA, 19 nt, Homo sapiens
gaaaugaggaggagagaaa

SEQ ID NO: 810387 - RNA, 19 nt, Homo sapiens
cagguuggcuuaauaaauu

SEQ ID NO: 810388 - RNA, 19 nt, Homo sapiens
cguagaagcuuaucaauca

SEQ ID NO: 810389 - RNA, 19 nt, Homo sapiens
gcagagacuucacauguau

SEQ ID NO: 810390 - RNA, 19 nt, Homo sapiens
gcaaauuccugcaaaauaa

SEQ ID NO: 810391 - RNA, 19 nt, Homo sapiens
gaugauauguugcucuuug

SEQ ID NO: 810392 - RNA, 19 nt, Homo sapiens
gaaauugucgagacgaaua

SEQ ID NO: 810393 - RNA, 19 nt, Homo sapiens
gcagacggcauuccucuua

SEQ ID NO: 810394 - RNA, 19 nt, Homo sapiens
gcaagaguguaucaaagaa

SEQ ID NO: 810395 - RNA, 19 nt, Homo sapiens
gaaaauacguaaaggcuaa

SEQ ID NO: 810396 - RNA, 19 nt, Homo sapiens
uuaagagccugauugauaa

SEQ ID NO: 810397 - RNA, 19 nt, Homo sapiens
ggaacugccuuuacuuuua

SEQ ID NO: 810398 - RNA, 19 nt, Homo sapiens
ggaaaaccauucucuaaaa

SEQ ID NO: 810399 - RNA, 19 nt, Homo sapiens
gagauugccuuagacuuaa

SEQ ID NO: 810400 - RNA, 19 nt, Homo sapiens
guaaaccauugcuaucuuu

SEQ ID NO: 810401 - RNA, 19 nt, Homo sapiens
gagaugccacgaagauuua

SEQ ID NO: 810402 - RNA, 19 nt, Homo sapiens
gauacagucauuugaguua

SEQ ID NO: 810403 - RNA, 19 nt, Homo sapiens
aaauacagcugucagauuc

SEQ ID NO: 810404 - RNA, 19 nt, Homo sapiens
guaaugauguggugugcaa

SEQ ID NO: 810405 - RNA, 19 nt, Homo sapiens
gaauaagccuggaauuggu

SEQ ID NO: 810406 - RNA, 19 nt, Homo sapiens
agaagggaauuguaacuaa

SEQ ID NO: 810407 - RNA, 19 nt, Homo sapiens
cgaauggaguuuccuaguu

SEQ ID NO: 810408 - RNA, 19 nt, Homo sapiens
ggacgccuuucucaaauug

SEQ ID NO: 810409 - RNA, 19 nt, Homo sapiens
gacaguugcuuaaacaaug

SEQ ID NO: 810410 - RNA, 19 nt, Homo sapiens
gaugacaguugcuuaaaca

SEQ ID NO: 810411 - RNA, 19 nt, Homo sapiens
ccacuaauuugcuuaagga

SEQ ID NO: 810412 - RNA, 19 nt, Homo sapiens
gaagauguaacaccuaaga

SEQ ID NO: 810413 - RNA, 19 nt, Homo sapiens
uagaagauguaacaccuaa

SEQ ID NO: 810414 - RNA, 19 nt, Homo sapiens
caucuaaauuguccagaaa

SEQ ID NO: 810415 - RNA, 19 nt, Homo sapiens
gaacugccuuuacuuuuaa

SEQ ID NO: 810416 - RNA, 19 nt, Homo sapiens
gaauuucuccuuggaagua

SEQ ID NO: 810417 - RNA, 19 nt, Homo sapiens
uaacaccugugauugaaga

SEQ ID NO: 810418 - RNA, 19 nt, Homo sapiens
agagauugccuuagacuua

SEQ ID NO: 810419 - RNA, 19 nt, Homo sapiens
ugaaaugugugcuaacaau

SEQ ID NO: 810420 - RNA, 19 nt, Homo sapiens
ggacaccgccuuucacugu

SEQ ID NO: 810421 - RNA, 19 nt, Homo sapiens
gaucagucccuacuuuaaa

SEQ ID NO: 810422 - RNA, 19 nt, Homo sapiens
gaugaaaugugugcuaaca

SEQ ID NO: 810423 - RNA, 19 nt, Homo sapiens
caagaacaauggcaaacug

SEQ ID NO: 810424 - RNA, 19 nt, Homo sapiens
agagacacguggcagaaua

SEQ ID NO: 810425 - RNA, 19 nt, Homo sapiens
acagacagcuucuucacaa

SEQ ID NO: 810426 - RNA, 19 nt, Homo sapiens
aaaccguacuugagaauga

SEQ ID NO: 810427 - RNA, 19 nt, Homo sapiens
ucaccagauuucacucuua

SEQ ID NO: 810428 - RNA, 19 nt, Homo sapiens
gcaucuaaauuguccagaa

SEQ ID NO: 810429 - RNA, 19 nt, Homo sapiens
gagaaaucguagugugaaa

SEQ ID NO: 810430 - RNA, 19 nt, Homo sapiens
ccuuaaauauccuguguuu

SEQ ID NO: 810431 - RNA, 19 nt, Homo sapiens
ggugugcucuuuccaaugu

SEQ ID NO: 810432 - RNA, 19 nt, Homo sapiens
ggagggagagcuugugaaa

SEQ ID NO: 810433 - RNA, 19 nt, Homo sapiens
ccacgcacaugcugaguga

SEQ ID NO: 810434 - RNA, 19 nt, Homo sapiens
gcaccuugaugaaaugugu

SEQ ID NO: 810435 - RNA, 19 nt, Homo sapiens
guaaaauggugccuagaua

SEQ ID NO: 810436 - RNA, 19 nt, Homo sapiens
gcaagucuguguuugugau

SEQ ID NO: 810437 - RNA, 19 nt, Homo sapiens
gaaguaaagcagaagauca

SEQ ID NO: 810438 - RNA, 19 nt, Homo sapiens
agaaauggcugugcaagau

SEQ ID NO: 810439 - RNA, 19 nt, Homo sapiens
gugugaaagucauuuguuu

SEQ ID NO: 810440 - RNA, 19 nt, Homo sapiens
gaauuucagccucaaagaa

SEQ ID NO: 810441 - RNA, 19 nt, Homo sapiens
gaugcaauggcaaauauaa

SEQ ID NO: 810442 - RNA, 19 nt, Homo sapiens
gggaucgacuggcccuuaa

SEQ ID NO: 810443 - RNA, 19 nt, Homo sapiens
caaauuagaguaugaagag

SEQ ID NO: 810444 - RNA, 19 nt, Homo sapiens
ucccagagccgucacuuua

SEQ ID NO: 810445 - RNA, 19 nt, Homo sapiens
uauacaaggugugcucuuu

SEQ ID NO: 810446 - RNA, 19 nt, Homo sapiens
ucacggagccauucuguau

SEQ ID NO: 810447 - RNA, 19 nt, Homo sapiens
gaaauacugcagagacuuc

SEQ ID NO: 810448 - RNA, 19 nt, Homo sapiens
gcaagaacucucugaagug

SEQ ID NO: 810449 - RNA, 19 nt, Homo sapiens
ugaccaaauuagaguauga

SEQ ID NO: 810450 - RNA, 19 nt, Homo sapiens
aaacaaccggucauccuua

SEQ ID NO: 810451 - RNA, 19 nt, Homo sapiens
ugauaucccucacagcauu

SEQ ID NO: 810452 - RNA, 19 nt, Homo sapiens
agggaaaccuccugacaaa

SEQ ID NO: 810453 - RNA, 19 nt, Homo sapiens
ucauauagaaucccacuuu

SEQ ID NO: 810454 - RNA, 19 nt, Homo sapiens
gcucuuucaacguaaauua

SEQ ID NO: 810455 - RNA, 19 nt, Homo sapiens
gagaagggaauuguaacua

SEQ ID NO: 810456 - RNA, 19 nt, Homo sapiens
ccacagaguuccaaaucca

SEQ ID NO: 810457 - RNA, 19 nt, Homo sapiens
ggucacugaugauuccauu

SEQ ID NO: 810458 - RNA, 19 nt, Homo sapiens
gaaucccaauggacagaaa

SEQ ID NO: 810459 - RNA, 19 nt, Homo sapiens
gaagggaaaccuccugaca

SEQ ID NO: 810460 - RNA, 19 nt, Homo sapiens
ggaauacauuaaagucuac

SEQ ID NO: 810461 - RNA, 19 nt, Homo sapiens
gugcauuccugaacauaug

SEQ ID NO: 810462 - RNA, 19 nt, Homo sapiens
gguguuugguuacguguga

SEQ ID NO: 810463 - RNA, 19 nt, Homo sapiens
uagcacaguuuccacaguu

SEQ ID NO: 810464 - RNA, 19 nt, Homo sapiens
gagccaaagccuuagcuaa

SEQ ID NO: 810465 - RNA, 19 nt, Homo sapiens
ggcugcagcugauucauga

SEQ ID NO: 810466 - RNA, 19 nt, Homo sapiens
ugaggaagccgucagagaa

SEQ ID NO: 810467 - RNA, 19 nt, Homo sapiens
gguggacgccuuucucaaa

SEQ ID NO: 810468 - RNA, 19 nt, Homo sapiens
cuacuggucagaaguuaua

SEQ ID NO: 810469 - RNA, 19 nt, Homo sapiens
gugauucucuaaaggaaga

SEQ ID NO: 810470 - RNA, 19 nt, Homo sapiens
aaagggaaguaaagcagaa

SEQ ID NO: 810471 - RNA, 19 nt, Homo sapiens
ccaccaaagacaaauuuaa

SEQ ID NO: 810472 - RNA, 19 nt, Homo sapiens
uauagcaaauuccugcaaa

SEQ ID NO: 810473 - RNA, 19 nt, Homo sapiens
gcaggaugacaguugcuua

SEQ ID NO: 810474 - RNA, 19 nt, Homo sapiens
gcagguuggcuuaauaaau

SEQ ID NO: 810475 - RNA, 19 nt, Homo sapiens
gaacccagcggaaguagca

SEQ ID NO: 810476 - RNA, 19 nt, Homo sapiens
ucgacuggcccuuaauuua

SEQ ID NO: 810477 - RNA, 19 nt, Homo sapiens
gaaggaaaguggagucaua

SEQ ID NO: 810478 - RNA, 19 nt, Homo sapiens
gaagaaugguacaaaguua

SEQ ID NO: 810479 - RNA, 19 nt, Homo sapiens
caaagaagcuucacauuag

SEQ ID NO: 810480 - RNA, 19 nt, Homo sapiens
gcaagaagcugugcaaugu

SEQ ID NO: 810481 - RNA, 19 nt, Homo sapiens
ggaagaggaugacaaauca

SEQ ID NO: 810482 - RNA, 19 nt, Homo sapiens
gcacagagacuuaagacua

SEQ ID NO: 810483 - RNA, 19 nt, Homo sapiens
gaagaaacagugaauguaa

SEQ ID NO: 810484 - RNA, 19 nt, Homo sapiens
caacaaaucacauaccuuu

SEQ ID NO: 810485 - RNA, 19 nt, Homo sapiens
uaaagcaacuggagaagaa

SEQ ID NO: 810486 - RNA, 19 nt, Homo sapiens
ucaaagaagcuucacauua

SEQ ID NO: 810487 - RNA, 19 nt, Homo sapiens
ggucagaauuccauaauau

SEQ ID NO: 810488 - RNA, 19 nt, Homo sapiens
ccaaguuccucccagauua

SEQ ID NO: 810489 - RNA, 19 nt, Homo sapiens
cuaacaggcucuuaugaua

SEQ ID NO: 810490 - RNA, 19 nt, Homo sapiens
gagaagaaauuacagaaag

SEQ ID NO: 810491 - RNA, 19 nt, Homo sapiens
ugaaugcuguguagaauuu

SEQ ID NO: 810492 - RNA, 19 nt, Homo sapiens
ggacauacugggcauauuu

SEQ ID NO: 810493 - RNA, 19 nt, Homo sapiens
guagaagucucaugcuuga

SEQ ID NO: 810494 - RNA, 19 nt, Homo sapiens
gaacauaguguccaggaaa

SEQ ID NO: 810495 - RNA, 19 nt, Homo sapiens
gaaaguggagucauaaaug

SEQ ID NO: 810496 - RNA, 19 nt, Homo sapiens
gacaauguguuuacgguuu

SEQ ID NO: 810497 - RNA, 19 nt, Homo sapiens
aaacugaacuguagaagca

SEQ ID NO: 810498 - RNA, 19 nt, Homo sapiens
ccaaaucucuucagaacau

SEQ ID NO: 810499 - RNA, 19 nt, Homo sapiens
cuuaauagguccauucaaa

SEQ ID NO: 810500 - RNA, 19 nt, Homo sapiens
gcugugaccugcuauaugu

SEQ ID NO: 810501 - RNA, 19 nt, Homo sapiens
gaaagugguuuagcacgaa

SEQ ID NO: 810502 - RNA, 19 nt, Homo sapiens
ugaagaggcuugugucaug

SEQ ID NO: 810503 - RNA, 19 nt, Homo sapiens
gaaaggguauuagaagugu

SEQ ID NO: 810504 - RNA, 19 nt, Homo sapiens
gcaguuaugugaugcaaca

SEQ ID NO: 810505 - RNA, 19 nt, Homo sapiens
gcacaaggacaaagugauu

SEQ ID NO: 810506 - RNA, 19 nt, Homo sapiens
gaucagcagcagaaucuua

SEQ ID NO: 810507 - RNA, 19 nt, Homo sapiens
ggaagaaugguacaaaguu

SEQ ID NO: 810508 - RNA, 19 nt, Homo sapiens
gcaacaggaucaaaugaca

SEQ ID NO: 810509 - RNA, 19 nt, Homo sapiens
gcagauauaccaacagaug

SEQ ID NO: 810510 - RNA, 19 nt, Homo sapiens
caacagaacaauuucaaga

SEQ ID NO: 810511 - RNA, 19 nt, Homo sapiens
ggaauaaacaucauaaagg

SEQ ID NO: 810512 - RNA, 19 nt, Homo sapiens
gaagacacacaagcuguua

SEQ ID NO: 810513 - RNA, 19 nt, Homo sapiens
ggcaauggaucuaaugguu

SEQ ID NO: 810514 - RNA, 19 nt, Homo sapiens
gcacucaaccagcaaugua

SEQ ID NO: 810515 - RNA, 19 nt, Homo sapiens
caaaugcaguuguauuagu

SEQ ID NO: 810516 - RNA, 19 nt, Homo sapiens
ucccagguguucagaauua

SEQ ID NO: 810517 - RNA, 19 nt, Homo sapiens
ggagcucacuacuugcuaa

SEQ ID NO: 810518 - RNA, 19 nt, Homo sapiens
agucauaaauggccuguuu

SEQ ID NO: 810519 - RNA, 19 nt, Homo sapiens
aaguguaacugugcuauua

SEQ ID NO: 810520 - RNA, 19 nt, Homo sapiens
guucuucugugacuaguuu

SEQ ID NO: 810521 - RNA, 19 nt, Homo sapiens
uaagagaauuucagaccuu

SEQ ID NO: 810522 - RNA, 19 nt, Homo sapiens
gaccaaucaugccgaguuu

SEQ ID NO: 810523 - RNA, 19 nt, Homo sapiens
aagaagcugugcaauguuu

SEQ ID NO: 810524 - RNA, 19 nt, Homo sapiens
ucagaaacuuguuaacuuc

SEQ ID NO: 810525 - RNA, 19 nt, Homo sapiens
caugguugcuuucacuuaa

SEQ ID NO: 810526 - RNA, 19 nt, Homo sapiens
gguguugggugguguuauu

SEQ ID NO: 810527 - RNA, 19 nt, Homo sapiens
caucauaaaggauccauuu

SEQ ID NO: 810528 - RNA, 19 nt, Homo sapiens
caaaggcaauggaucuaau

SEQ ID NO: 810529 - RNA, 19 nt, Homo sapiens
aaacaaaacuucuccaaug

SEQ ID NO: 810530 - RNA, 19 nt, Homo sapiens
gguaaugguugugaugauu

SEQ ID NO: 810531 - RNA, 19 nt, Homo sapiens
ggagaagaaauuacagaaa

SEQ ID NO: 810532 - RNA, 19 nt, Homo sapiens
gaauucaucccugcugaua

SEQ ID NO: 810533 - RNA, 19 nt, Homo sapiens
caggauaccucccuuccaa

SEQ ID NO: 810534 - RNA, 19 nt, Homo sapiens
ucaaagugcugcccuucaa

SEQ ID NO: 810535 - RNA, 19 nt, Homo sapiens
agucagagauuaacacaug

SEQ ID NO: 810536 - RNA, 19 nt, Homo sapiens
acaauguguuuacgguuua

SEQ ID NO: 810537 - RNA, 19 nt, Homo sapiens
gaucuggaauuuaguaugc

SEQ ID NO: 810538 - RNA, 19 nt, Homo sapiens
ucaaaagcuuggugaauua

SEQ ID NO: 810539 - RNA, 19 nt, Homo sapiens
gauucuagcugcauguugu

SEQ ID NO: 810540 - RNA, 19 nt, Homo sapiens
gaaagcggaggagcuauuu

SEQ ID NO: 810541 - RNA, 19 nt, Homo sapiens
ucagaacauucggucauua

SEQ ID NO: 810542 - RNA, 19 nt, Homo sapiens
caacagcauuuagaacaga

SEQ ID NO: 810543 - RNA, 19 nt, Homo sapiens
caucuucugucuucucuug

SEQ ID NO: 810544 - RNA, 19 nt, Homo sapiens
ugucauggcuucagaaucu

SEQ ID NO: 810545 - RNA, 19 nt, Homo sapiens
uacaugcucuagaagaaua

SEQ ID NO: 810546 - RNA, 19 nt, Homo sapiens
ucaaugggaugaaguucuu

SEQ ID NO: 810547 - RNA, 19 nt, Homo sapiens
ggaaaguggagucauaaau

SEQ ID NO: 810548 - RNA, 19 nt, Homo sapiens
uaaauguguuugcuucaga

SEQ ID NO: 810549 - RNA, 19 nt, Homo sapiens
uggaguggcuggaugauug

SEQ ID NO: 810550 - RNA, 19 nt, Homo sapiens
cagaaugucacaguauuua

SEQ ID NO: 810551 - RNA, 19 nt, Homo sapiens
gcaacuggagaagaaauua

SEQ ID NO: 810552 - RNA, 19 nt, Homo sapiens
ugaggcagcuaauacuuga

SEQ ID NO: 810553 - RNA, 19 nt, Homo sapiens
ggaaaggguauuagaagug

SEQ ID NO: 810554 - RNA, 19 nt, Homo sapiens
gcaguuguauuaguucuca

SEQ ID NO: 810555 - RNA, 19 nt, Homo sapiens
cagcagcaguuaugugaug

SEQ ID NO: 810556 - RNA, 19 nt, Homo sapiens
gaggaagaaugguacaaag

SEQ ID NO: 810557 - RNA, 19 nt, Homo sapiens
gcagugcaguggcaucugu

SEQ ID NO: 810558 - RNA, 19 nt, Homo sapiens
gcaaaggcaauggaucuaa

SEQ ID NO: 810559 - RNA, 19 nt, Homo sapiens
gcaaauggagcacagaauc

SEQ ID NO: 810560 - RNA, 19 nt, Homo sapiens
ggaucauuauggaguuuaa

SEQ ID NO: 810561 - RNA, 19 nt, Homo sapiens
uaacacaugaugcuucaaa

SEQ ID NO: 810562 - RNA, 19 nt, Homo sapiens
ucuaaugguucuucuguga

SEQ ID NO: 810563 - RNA, 19 nt, Homo sapiens
guacaaaaccucaguagaa

SEQ ID NO: 810564 - RNA, 19 nt, Homo sapiens
gaucugaguuuacugucau

SEQ ID NO: 810565 - RNA, 19 nt, Homo sapiens
ccaaucaugccgaguuuaa

SEQ ID NO: 810566 - RNA, 19 nt, Homo sapiens
gaucccauauuguauuauc

SEQ ID NO: 810567 - RNA, 19 nt, Homo sapiens
gaucuucgaguaccaaguu

SEQ ID NO: 810568 - RNA, 19 nt, Homo sapiens
gaauuuaguaugcaugaug

SEQ ID NO: 810569 - RNA, 19 nt, Homo sapiens
caugaugcuucaaauauuc

SEQ ID NO: 810570 - RNA, 19 nt, Homo sapiens
gaauggauggccuugguaa

SEQ ID NO: 810571 - RNA, 19 nt, Homo sapiens
ucacaguauuuacgaagaa

SEQ ID NO: 810572 - RNA, 19 nt, Homo sapiens
ugauuuggaucugaguuua

SEQ ID NO: 810573 - RNA, 19 nt, Homo sapiens
gggaagaggaugacaaauc

SEQ ID NO: 810574 - RNA, 19 nt, Homo sapiens
gcaaagauuacgcuaucaa

SEQ ID NO: 810575 - RNA, 19 nt, Homo sapiens
uaugacggcugaagaaaca

SEQ ID NO: 810576 - RNA, 19 nt, Homo sapiens
ccaggaaagugguuuagca

SEQ ID NO: 810577 - RNA, 19 nt, Homo sapiens
gcuaagcucaucauuguua

SEQ ID NO: 810578 - RNA, 19 nt, Homo sapiens
acacagcucuggugaagaa

SEQ ID NO: 810579 - RNA, 19 nt, Homo sapiens
cagccaagaucaaguuaaa

SEQ ID NO: 810580 - RNA, 19 nt, Homo sapiens
caacacagcucuggugaag

SEQ ID NO: 810581 - RNA, 19 nt, Homo sapiens
ugacacagaucaaguccaa

SEQ ID NO: 810582 - RNA, 19 nt, Homo sapiens
ggaggaaacagcuggcuaa

SEQ ID NO: 810583 - RNA, 19 nt, Homo sapiens
agacggagcugacacagau

SEQ ID NO: 810584 - RNA, 19 nt, Homo sapiens
uggcuaagcucaucauugu

SEQ ID NO: 810585 - RNA, 19 nt, Homo sapiens
gcuaugccuuuguucagua

SEQ ID NO: 810586 - RNA, 19 nt, Homo sapiens
acacagaucaaguccaaua

SEQ ID NO: 810587 - RNA, 19 nt, Homo sapiens
uauacaggcucuucgacua

SEQ ID NO: 810588 - RNA, 19 nt, Homo sapiens
gcaauguaaccaacaagaa

SEQ ID NO: 810589 - RNA, 19 nt, Homo sapiens
caagcaauguaaccaacaa

SEQ ID NO: 810590 - RNA, 19 nt, Homo sapiens
gaagggcuccugacacaca

SEQ ID NO: 810591 - RNA, 19 nt, Homo sapiens
gaucaaguccaauaucgau

SEQ ID NO: 810592 - RNA, 19 nt, Homo sapiens
gccaagaucaaguuaaaga

SEQ ID NO: 810593 - RNA, 19 nt, Homo sapiens
ucucgagucuucauuggaa

SEQ ID NO: 810594 - RNA, 19 nt, Homo sapiens
aaacuaacguaccugucaa

SEQ ID NO: 810595 - RNA, 19 nt, Homo sapiens
caauguaaccaacaagaau

SEQ ID NO: 810596 - RNA, 19 nt, Homo sapiens
ggcagacccuggacaucaa

SEQ ID NO: 810597 - RNA, 19 nt, Homo sapiens
gaccaucuucucuaaguau

SEQ ID NO: 810598 - RNA, 19 nt, Homo sapiens
gcucagccaagaucaaguu

SEQ ID NO: 810599 - RNA, 19 nt, Homo sapiens
gggcagacccuggacauca

SEQ ID NO: 810600 - RNA, 19 nt, Homo sapiens
ggacacagacgcggaugau

SEQ ID NO: 810601 - RNA, 19 nt, Homo sapiens
cagaucaaguccaauaucg

SEQ ID NO: 810602 - RNA, 19 nt, Homo sapiens
aaucagauguggagaccau

SEQ ID NO: 810603 - RNA, 19 nt, Homo sapiens
caauccagauggcaagaag

SEQ ID NO: 810604 - RNA, 19 nt, Homo sapiens
agaccaucuucucuaagua

SEQ ID NO: 810605 - RNA, 19 nt, Homo sapiens
gagcugacacagaucaagu

SEQ ID NO: 810606 - RNA, 19 nt, Homo sapiens
cagcucuggugaagaaauc

SEQ ID NO: 810607 - RNA, 19 nt, Homo sapiens
caagaagaagggugaugga

SEQ ID NO: 810608 - RNA, 19 nt, Homo sapiens
gcaaaaggccaauccagau

SEQ ID NO: 810609 - RNA, 19 nt, Homo sapiens
gcaagcaauguaaccaaca

SEQ ID NO: 810610 - RNA, 19 nt, Homo sapiens
gagcugcaggccaucaaga

SEQ ID NO: 810611 - RNA, 19 nt, Homo sapiens
ugacacacagcgaggaaga

SEQ ID NO: 810612 - RNA, 19 nt, Homo sapiens
agacgacggcgaugaggaa

SEQ ID NO: 810613 - RNA, 19 nt, Homo sapiens
cccaagagaacacaacuuc

SEQ ID NO: 810614 - RNA, 19 nt, Homo sapiens
cuucaggcaagcaauguaa

SEQ ID NO: 810615 - RNA, 19 nt, Homo sapiens
guaccugucaagcucuuug

SEQ ID NO: 810616 - RNA, 19 nt, Homo sapiens
gcgaggaagagcuggaaca

SEQ ID NO: 810617 - RNA, 19 nt, Homo sapiens
gcuaaagagagcagcaucu

SEQ ID NO: 810618 - RNA, 19 nt, Homo sapiens
ggugaagaaaucagaugug

SEQ ID NO: 810619 - RNA, 19 nt, Homo sapiens
ggcuaugccuuuguucagu

SEQ ID NO: 810620 - RNA, 19 nt, Homo sapiens
gcuaagcucaucauuguua

SEQ ID NO: 810621 - RNA, 19 nt, Homo sapiens
acacagcucuggugaagaa

SEQ ID NO: 810622 - RNA, 19 nt, Homo sapiens
cagccaagaucaaguuaaa

SEQ ID NO: 810623 - RNA, 19 nt, Homo sapiens
caacacagcucuggugaag

SEQ ID NO: 810624 - RNA, 19 nt, Homo sapiens
ugacacagaucaaguccaa

SEQ ID NO: 810625 - RNA, 19 nt, Homo sapiens
ggaggaaacagcuggcuaa

SEQ ID NO: 810626 - RNA, 19 nt, Homo sapiens
agacggagcugacacagau

SEQ ID NO: 810627 - RNA, 19 nt, Homo sapiens
uggcuaagcucaucauugu

SEQ ID NO: 810628 - RNA, 19 nt, Homo sapiens
gcuaugccuuuguucagua

SEQ ID NO: 810629 - RNA, 19 nt, Homo sapiens
acacagaucaaguccaaua

SEQ ID NO: 810630 - RNA, 19 nt, Homo sapiens
gcaauguaaccaacaagaa

SEQ ID NO: 810631 - RNA, 19 nt, Homo sapiens
caagcaauguaaccaacaa

SEQ ID NO: 810632 - RNA, 19 nt, Homo sapiens
gaagggcuccugacacaca

SEQ ID NO: 810633 - RNA, 19 nt, Homo sapiens
gaucaaguccaauaucgau

SEQ ID NO: 810634 - RNA, 19 nt, Homo sapiens
gccaagaucaaguuaaaga

SEQ ID NO: 810635 - RNA, 19 nt, Homo sapiens
ucucgagucuucauuggaa

SEQ ID NO: 810636 - RNA, 19 nt, Homo sapiens
aaacuaacguaccugucaa

SEQ ID NO: 810637 - RNA, 19 nt, Homo sapiens
caauguaaccaacaagaau

SEQ ID NO: 810638 - RNA, 19 nt, Homo sapiens
cuacaucuuugacuaugau

SEQ ID NO: 810639 - RNA, 19 nt, Homo sapiens
gcuacaucuuugacuauga

SEQ ID NO: 810640 - RNA, 19 nt, Homo sapiens
uacaguggcuacaucuuug

SEQ ID NO: 810641 - RNA, 19 nt, Homo sapiens
cauauacaguggcuacauc

SEQ ID NO: 810642 - RNA, 19 nt, Homo sapiens
guggcuacaucuuugacua

SEQ ID NO: 810643 - RNA, 19 nt, Homo sapiens
ggcagacccuggacaucaa

SEQ ID NO: 810644 - RNA, 19 nt, Homo sapiens
gaccaucuucucuaaguau

SEQ ID NO: 810645 - RNA, 19 nt, Homo sapiens
gcucagccaagaucaaguu

SEQ ID NO: 810646 - RNA, 19 nt, Homo sapiens
gggcagacccuggacauca

SEQ ID NO: 810647 - RNA, 19 nt, Homo sapiens
ggacacagacgcggaugau

SEQ ID NO: 810648 - RNA, 19 nt, Homo sapiens
cagaucaaguccaauaucg

SEQ ID NO: 810649 - RNA, 19 nt, Homo sapiens
auacaguggcuacaucuuu

SEQ ID NO: 810650 - RNA, 19 nt, Homo sapiens
aaucagauguggagaccau

SEQ ID NO: 810651 - RNA, 19 nt, Homo sapiens
acgacaggcucuucgacua

SEQ ID NO: 810652 - RNA, 19 nt, Homo sapiens
caauccagauggcaagaag

SEQ ID NO: 810653 - RNA, 19 nt, Homo sapiens
agaccaucuucucuaagua

SEQ ID NO: 810654 - RNA, 19 nt, Homo sapiens
gagcugacacagaucaagu

SEQ ID NO: 810655 - RNA, 19 nt, Homo sapiens
cagcucuggugaagaaauc

SEQ ID NO: 810656 - RNA, 19 nt, Homo sapiens
caagaagaagggugaugga

SEQ ID NO: 810657 - RNA, 19 nt, Homo sapiens
gcaaaaggccaauccagau

SEQ ID NO: 810658 - RNA, 19 nt, Homo sapiens
gcaagcaauguaaccaaca

SEQ ID NO: 810659 - RNA, 19 nt, Homo sapiens
gagcugcaggccaucaaga

SEQ ID NO: 810660 - RNA, 19 nt, Homo sapiens
ugacacacagcgaggaaga

SEQ ID NO: 810661 - RNA, 19 nt, Homo sapiens
agacgacggcgaugaggaa

SEQ ID NO: 810662 - RNA, 19 nt, Homo sapiens
cccaagagaacacaacuuc

SEQ ID NO: 810663 - RNA, 19 nt, Homo sapiens
ggcuacaucuuugacuaug

SEQ ID NO: 810664 - RNA, 19 nt, Homo sapiens
cuucaggcaagcaauguaa

SEQ ID NO: 810665 - RNA, 19 nt, Homo sapiens
guaccugucaagcucuuug

SEQ ID NO: 810666 - RNA, 19 nt, Homo sapiens
caucuuugacuaugauuac

SEQ ID NO: 810667 - RNA, 19 nt, Homo sapiens
gcgaggaagagcuggaaca

SEQ ID NO: 810668 - RNA, 19 nt, Homo sapiens
gcuaaagagagcagcaucu

SEQ ID NO: 810669 - RNA, 19 nt, Homo sapiens
ggugaagaaaucagaugug

SEQ ID NO: 810670 - RNA, 19 nt, Homo sapiens
cgacaggcucuucgacuac

SEQ ID NO: 810671 - RNA, 19 nt, Homo sapiens
ggcuaugccuuuguucagu

SEQ ID NO: 810672 - RNA, 19 nt, Homo sapiens
gcacauaacuuguuugguu

SEQ ID NO: 810673 - RNA, 19 nt, Homo sapiens
ggaauccguuucauuauua

SEQ ID NO: 810674 - RNA, 19 nt, Homo sapiens
gaacugaggacauaucuaa

SEQ ID NO: 810675 - RNA, 19 nt, Homo sapiens
gcaaaggacuguguaaaga

SEQ ID NO: 810676 - RNA, 19 nt, Homo sapiens
gaagaacucugaucugcuu

SEQ ID NO: 810677 - RNA, 19 nt, Homo sapiens
gaucaaccaucucaauaaa

SEQ ID NO: 810678 - RNA, 19 nt, Homo sapiens
gcaaagaggaccaggauuu

SEQ ID NO: 810679 - RNA, 19 nt, Homo sapiens
gcaaagauguccaguaguc

SEQ ID NO: 810680 - RNA, 19 nt, Homo sapiens
ggaagcacauaacuuguuu

SEQ ID NO: 810681 - RNA, 19 nt, Homo sapiens
caaauucccuugaccgaaa

SEQ ID NO: 810682 - RNA, 19 nt, Homo sapiens
gcauuauucuccagccuua

SEQ ID NO: 810683 - RNA, 19 nt, Homo sapiens
gggaauccguuucauuauu

SEQ ID NO: 810684 - RNA, 19 nt, Homo sapiens
cgacacagcugggagauga

SEQ ID NO: 810685 - RNA, 19 nt, Homo sapiens
gaccaaagacugucagauu

SEQ ID NO: 810686 - RNA, 19 nt, Homo sapiens
uuucacagguucacaguua

SEQ ID NO: 810687 - RNA, 19 nt, Homo sapiens
caaagaggaccaggauuua

SEQ ID NO: 810688 - RNA, 19 nt, Homo sapiens
caaccaagaaguucaaauu

SEQ ID NO: 810689 - RNA, 19 nt, Homo sapiens
cgaaauagaucaggaacug

SEQ ID NO: 810690 - RNA, 19 nt, Homo sapiens
gaacuaaacgaaauagauc

SEQ ID NO: 810691 - RNA, 19 nt, Homo sapiens
gcuguaaguugccauuuga

SEQ ID NO: 810692 - RNA, 19 nt, Homo sapiens
caauuucacugcaaacaug

SEQ ID NO: 810693 - RNA, 19 nt, Homo sapiens
aagaagaacuugggaagaa

SEQ ID NO: 810694 - RNA, 19 nt, Homo sapiens
gaacagagaagagauuaca

SEQ ID NO: 810695 - RNA, 19 nt, Homo sapiens
aagcaaagauguccaguag

SEQ ID NO: 810696 - RNA, 19 nt, Homo sapiens
uuaaacuggugaagucaua

SEQ ID NO: 810697 - RNA, 19 nt, Homo sapiens
ggaccaaaccauagaacaa

SEQ ID NO: 810698 - RNA, 19 nt, Homo sapiens
gaaaguauacagcaaagag

SEQ ID NO: 810699 - RNA, 19 nt, Homo sapiens
ggagugcuguauuccuaaa

SEQ ID NO: 810700 - RNA, 19 nt, Homo sapiens
gcugggagaugagugaauu

SEQ ID NO: 810701 - RNA, 19 nt, Homo sapiens
acucugaucugcuuucuau

SEQ ID NO: 810702 - RNA, 19 nt, Homo sapiens
cgguagacgugcacuuaua

SEQ ID NO: 810703 - RNA, 19 nt, Homo sapiens
gaaggaauuuugccucuga

SEQ ID NO: 810704 - RNA, 19 nt, Homo sapiens
cacauaacuuguuugguuu

SEQ ID NO: 810705 - RNA, 19 nt, Homo sapiens
accaaagacugucagauuu

SEQ ID NO: 810706 - RNA, 19 nt, Homo sapiens
gggagacugugcacucuau

SEQ ID NO: 810707 - RNA, 19 nt, Homo sapiens
gggccaugauuaucuuaaa

SEQ ID NO: 810708 - RNA, 19 nt, Homo sapiens
gcauugaagacuuuagauu

SEQ ID NO: 810709 - RNA, 19 nt, Homo sapiens
gauuacauauuccaacagu

SEQ ID NO: 810710 - RNA, 19 nt, Homo sapiens
gaauuuugccucugaauaa

SEQ ID NO: 810711 - RNA, 19 nt, Homo sapiens
uaacuuguuugguuucaca

SEQ ID NO: 810712 - RNA, 19 nt, Homo sapiens
gaagagaaggccagcagau

SEQ ID NO: 810713 - RNA, 19 nt, Homo sapiens
ggggaggggugcuguuuua

SEQ ID NO: 810714 - RNA, 19 nt, Homo sapiens
gcaugauucuccaagacaa

SEQ ID NO: 810715 - RNA, 19 nt, Homo sapiens
aaaggacuguguaaagaug

SEQ ID NO: 810716 - RNA, 19 nt, Homo sapiens
gguagacgugcacuuauaa

SEQ ID NO: 810717 - RNA, 19 nt, Homo sapiens
uaacuuggaucugaagaag

SEQ ID NO: 810718 - RNA, 19 nt, Homo sapiens
ggaauccuuugugcauuga

SEQ ID NO: 810719 - RNA, 19 nt, Homo sapiens
cugaggacauaucuaaauu

SEQ ID NO: 810720 - RNA, 19 nt, Homo sapiens
cacaggaaauugccucaug

SEQ ID NO: 810721 - RNA, 19 nt, Homo sapiens
gaggggugcuguuuuaauu

SEQ ID NO: 810722 - RNA, 19 nt, Homo sapiens
gagcuuuaaaggcuauaua

SEQ ID NO: 810723 - RNA, 19 nt, Homo sapiens
aggaagaaaugguaugugu

SEQ ID NO: 810724 - RNA, 19 nt, Homo sapiens
gacguuuccuuugcuauga

SEQ ID NO: 810725 - RNA, 19 nt, Homo sapiens
ccaaaccauagaacaauuu

SEQ ID NO: 810726 - RNA, 19 nt, Homo sapiens
uaguacacauuccaacaaa

SEQ ID NO: 810727 - RNA, 19 nt, Homo sapiens
gaucugaagaagagugauu

SEQ ID NO: 810728 - RNA, 19 nt, Homo sapiens
ggacguuuccuuugcuaug

SEQ ID NO: 810729 - RNA, 19 nt, Homo sapiens
agaacaauuucacugcaaa

SEQ ID NO: 810730 - RNA, 19 nt, Homo sapiens
caagaucuucccucucuga

SEQ ID NO: 810731 - RNA, 19 nt, Homo sapiens
caaagacugucagauuucu

SEQ ID NO: 810732 - RNA, 19 nt, Homo sapiens
ugaucaaccaucucaauaa

SEQ ID NO: 810733 - RNA, 19 nt, Homo sapiens
agaagaacuugggaagaaa

SEQ ID NO: 810734 - RNA, 19 nt, Homo sapiens
gaacuugggaagaaagagu

SEQ ID NO: 810735 - RNA, 19 nt, Homo sapiens
gaucagugaaggaagagaa

SEQ ID NO: 810736 - RNA, 19 nt, Homo sapiens
gaacucugaucugcuuucu

SEQ ID NO: 810737 - RNA, 19 nt, Homo sapiens
guguaaagaugaucaacca

SEQ ID NO: 810738 - RNA, 19 nt, Homo sapiens
uagaacaauuucacugcaa

SEQ ID NO: 810739 - RNA, 19 nt, Homo sapiens
cuggugaagucauaucauu

SEQ ID NO: 810740 - RNA, 19 nt, Homo sapiens
ggcuguaaguugccauuug

SEQ ID NO: 810741 - RNA, 19 nt, Homo sapiens
gaggaccaggauuuacuua

SEQ ID NO: 810742 - RNA, 19 nt, Homo sapiens
uaaugaggaagaaauggua

SEQ ID NO: 810743 - RNA, 19 nt, Homo sapiens
gaccaaaccauagaacaau

SEQ ID NO: 810744 - RNA, 19 nt, Homo sapiens
ccacaggaccaaaccauag

SEQ ID NO: 810745 - RNA, 19 nt, Homo sapiens
ccaaagacugucagauuuc

SEQ ID NO: 810746 - RNA, 19 nt, Homo sapiens
caaaggacuguguaaagau

SEQ ID NO: 810747 - RNA, 19 nt, Homo sapiens
ccagccuucugaaaguaua

SEQ ID NO: 810748 - RNA, 19 nt, Homo sapiens
guaauauccauccuauguu

SEQ ID NO: 810749 - RNA, 19 nt, Homo sapiens
ggacuaguacacauuccaa

SEQ ID NO: 810750 - RNA, 19 nt, Homo sapiens
gauuuguacuugcuugagu

SEQ ID NO: 810751 - RNA, 19 nt, Homo sapiens
gguaaggaaagaagaacuu

SEQ ID NO: 810752 - RNA, 19 nt, Homo sapiens
augggaauccguuucauua

SEQ ID NO: 810753 - RNA, 19 nt, Homo sapiens
aguaauauccauccuaugu

SEQ ID NO: 810754 - RNA, 19 nt, Homo sapiens
ggaugggacuaguacacau

SEQ ID NO: 810755 - RNA, 19 nt, Homo sapiens
cauugaagacuuuagauuc

SEQ ID NO: 810756 - RNA, 19 nt, Homo sapiens
cacccaaccuacuaacaau

SEQ ID NO: 810757 - RNA, 19 nt, Homo sapiens
gaagaacuugggaagaaag

SEQ ID NO: 810758 - RNA, 19 nt, Homo sapiens
gaaaacuguucaacuccaa

SEQ ID NO: 810759 - RNA, 19 nt, Homo sapiens
cucuaugccucgagcuuua

SEQ ID NO: 810760 - RNA, 19 nt, Homo sapiens
gaugggacuaguacacauu

SEQ ID NO: 810761 - RNA, 19 nt, Homo sapiens
aaacgaaauagaucaggaa

SEQ ID NO: 810762 - RNA, 19 nt, Homo sapiens
gcuaugauuuguacuugcu

SEQ ID NO: 810763 - RNA, 19 nt, Homo sapiens
ggccaugauuaucuuaaag

SEQ ID NO: 810764 - RNA, 19 nt, Homo sapiens
ucacccaaccuacuaacaa

SEQ ID NO: 810765 - RNA, 19 nt, Homo sapiens
ggaauuuugccucugaaua

SEQ ID NO: 810766 - RNA, 19 nt, Homo sapiens
guucacaguuaagaaggaa

SEQ ID NO: 810767 - RNA, 19 nt, Homo sapiens
cccaaccuacuaacaauaa

SEQ ID NO: 810768 - RNA, 19 nt, Homo sapiens
cagcaaagaggaccaggau

SEQ ID NO: 810769 - RNA, 19 nt, Homo sapiens
caaaaugccagccuucuga

SEQ ID NO: 810770 - RNA, 19 nt, Homo sapiens
ucacaguuaagaaggaauu

SEQ ID NO: 810771 - RNA, 19 nt, Homo sapiens
aaagaagagagauccuaaa

SEQ ID NO: 810772 - RNA, 19 nt, Homo sapiens
gcaauaaugucacugagua

SEQ ID NO: 810773 - RNA, 19 nt, Homo sapiens
gaagauggccucaauaaga

SEQ ID NO: 810774 - RNA, 19 nt, Homo sapiens
gaagagaauuuacaugugu

SEQ ID NO: 810775 - RNA, 19 nt, Homo sapiens
gaaagcaccaggcaaauaa

SEQ ID NO: 810776 - RNA, 19 nt, Homo sapiens
gacauugagucuaaaguua

SEQ ID NO: 810777 - RNA, 19 nt, Homo sapiens
gaagacauguuauccaaau

SEQ ID NO: 810778 - RNA, 19 nt, Homo sapiens
gaagcauucuguauuauga

SEQ ID NO: 810779 - RNA, 19 nt, Homo sapiens
gaaguucucuuuccaaugg

SEQ ID NO: 810780 - RNA, 19 nt, Homo sapiens
ccaaagaacugacuaccaa

SEQ ID NO: 810781 - RNA, 19 nt, Homo sapiens
gaacaagcaacuucucuaa

SEQ ID NO: 810782 - RNA, 19 nt, Homo sapiens
agacacaacuuacuuagaa

SEQ ID NO: 810783 - RNA, 19 nt, Homo sapiens
gaauuggugugcuuaugua

SEQ ID NO: 810784 - RNA, 19 nt, Homo sapiens
ggaaagaauuggugugcuu

SEQ ID NO: 810785 - RNA, 19 nt, Homo sapiens
ucagaaaggucuaacagaa

SEQ ID NO: 810786 - RNA, 19 nt, Homo sapiens
caagauaacuaugcccuaa

SEQ ID NO: 810787 - RNA, 19 nt, Homo sapiens
ggacacagaagagaauuua

SEQ ID NO: 810788 - RNA, 19 nt, Homo sapiens
gauaagagacauaguaaga

SEQ ID NO: 810789 - RNA, 19 nt, Homo sapiens
gaugggaacucucagaaga

SEQ ID NO: 810790 - RNA, 19 nt, Homo sapiens
gaaauuuaguggcacagaa

SEQ ID NO: 810791 - RNA, 19 nt, Homo sapiens
gguccuauccuguuuaaua

SEQ ID NO: 810792 - RNA, 19 nt, Homo sapiens
gaacuaaggaaucacauug

SEQ ID NO: 810793 - RNA, 19 nt, Homo sapiens
uagacaagcuugcauuuga

SEQ ID NO: 810794 - RNA, 19 nt, Homo sapiens
caaugaauaugccuuagaa

SEQ ID NO: 810795 - RNA, 19 nt, Homo sapiens
gacagacaaugacauauga

SEQ ID NO: 810796 - RNA, 19 nt, Homo sapiens
ggugacaacugcacuauca

SEQ ID NO: 810797 - RNA, 19 nt, Homo sapiens
gaauaugccuuagaaaugg

SEQ ID NO: 810798 - RNA, 19 nt, Homo sapiens
gaacaggaacacucaagaa

SEQ ID NO: 810799 - RNA, 19 nt, Homo sapiens
agaaaugacucuuacaugu

SEQ ID NO: 810800 - RNA, 19 nt, Homo sapiens
agaaaggucuaacagaauu

SEQ ID NO: 810801 - RNA, 19 nt, Homo sapiens
uaagagacauaguaagaga

SEQ ID NO: 810802 - RNA, 19 nt, Homo sapiens
gggccgaaaugucaacuaa

SEQ ID NO: 810803 - RNA, 19 nt, Homo sapiens
gaacaauuccagccaaguu

SEQ ID NO: 810804 - RNA, 19 nt, Homo sapiens
auagugagauccaucauaa

SEQ ID NO: 810805 - RNA, 19 nt, Homo sapiens
ugagaagccuauuaaagaa

SEQ ID NO: 810806 - RNA, 19 nt, Homo sapiens
gugagaagccuauuaaaga

SEQ ID NO: 810807 - RNA, 19 nt, Homo sapiens
ccucagagaucucagaaga

SEQ ID NO: 810808 - RNA, 19 nt, Homo sapiens
gcaaugaaacugacucuuc

SEQ ID NO: 810809 - RNA, 19 nt, Homo sapiens
gaaguaaagcagacucauu

SEQ ID NO: 810810 - RNA, 19 nt, Homo sapiens
uaacaaaacucuccacgaa

SEQ ID NO: 810811 - RNA, 19 nt, Homo sapiens
cccagacgcucauaccuua

SEQ ID NO: 810812 - RNA, 19 nt, Homo sapiens
caagaaagcaagauuaaca

SEQ ID NO: 810813 - RNA, 19 nt, Homo sapiens
gagaaucggcccacuuuga

SEQ ID NO: 810814 - RNA, 19 nt, Homo sapiens
gccgaaaugucaacuaaga

SEQ ID NO: 810815 - RNA, 19 nt, Homo sapiens
ucuauaggaugcaacauaa

SEQ ID NO: 810816 - RNA, 19 nt, Homo sapiens
gaaagaauuggugugcuua

SEQ ID NO: 810817 - RNA, 19 nt, Homo sapiens
ugagcuaccuugcuucaaa

SEQ ID NO: 810818 - RNA, 19 nt, Homo sapiens
gaacuaccaggcaaugaaa

SEQ ID NO: 810819 - RNA, 19 nt, Homo sapiens
caacugcacuaucaagcuu

SEQ ID NO: 810820 - RNA, 19 nt, Homo sapiens
aaacacggacaacauaaua

SEQ ID NO: 810821 - RNA, 19 nt, Homo sapiens
ucacaaugcuucuacaagu

SEQ ID NO: 810822 - RNA, 19 nt, Homo sapiens
ugagauccaucauaaaugu

SEQ ID NO: 810823 - RNA, 19 nt, Homo sapiens
aaaggaagcaauagugaua

SEQ ID NO: 810824 - RNA, 19 nt, Homo sapiens
aaaugacucuuacauguga

SEQ ID NO: 810825 - RNA, 19 nt, Homo sapiens
caacuucucuaaacacagu

SEQ ID NO: 810826 - RNA, 19 nt, Homo sapiens
guccuauccuguuuaauaa

SEQ ID NO: 810827 - RNA, 19 nt, Homo sapiens
agaaagacguaucaaugaa

SEQ ID NO: 810828 - RNA, 19 nt, Homo sapiens
gcagggagcaucacucaga

SEQ ID NO: 810829 - RNA, 19 nt, Homo sapiens
gugaagacauguuauccaa

SEQ ID NO: 810830 - RNA, 19 nt, Homo sapiens
ggaaguacaugagcagcuu

SEQ ID NO: 810831 - RNA, 19 nt, Homo sapiens
aaagcagacucauuuagaa

SEQ ID NO: 810832 - RNA, 19 nt, Homo sapiens
gaaaugacucuuacaugug

SEQ ID NO: 810833 - RNA, 19 nt, Homo sapiens
gauauccaauccugucuau

SEQ ID NO: 810834 - RNA, 19 nt, Homo sapiens
gaaauuucuucagagcuuu

SEQ ID NO: 810835 - RNA, 19 nt, Homo sapiens
cagaaggaguggucaaguu

SEQ ID NO: 810836 - RNA, 19 nt, Homo sapiens
ugaguaaacuuguaugucu

SEQ ID NO: 810837 - RNA, 19 nt, Homo sapiens
aaacauucccugccagaua

SEQ ID NO: 810838 - RNA, 19 nt, Homo sapiens
gaaaucaaacucucacauc

SEQ ID NO: 810839 - RNA, 19 nt, Homo sapiens
gaguaaacuuguaugucua

SEQ ID NO: 810840 - RNA, 19 nt, Homo sapiens
aaacagacuaucaccuuua

SEQ ID NO: 810841 - RNA, 19 nt, Homo sapiens
cgaaacaacuagaggaaag

SEQ ID NO: 810842 - RNA, 19 nt, Homo sapiens
gaauagacaagcuugcauu

SEQ ID NO: 810843 - RNA, 19 nt, Homo sapiens
aaaccaacgguaaaucuua

SEQ ID NO: 810844 - RNA, 19 nt, Homo sapiens
caaauguugucaagucuca

SEQ ID NO: 810845 - RNA, 19 nt, Homo sapiens
gaucgaucguugccuggua

SEQ ID NO: 810846 - RNA, 19 nt, Homo sapiens
ucaaugacaaucagagaua

SEQ ID NO: 810847 - RNA, 19 nt, Homo sapiens
aaacuacucuuaacuacca

SEQ ID NO: 810848 - RNA, 19 nt, Homo sapiens
gagaugagaaacuaaauca

SEQ ID NO: 810849 - RNA, 19 nt, Homo sapiens
gaaagacguaucaaugaau

SEQ ID NO: 810850 - RNA, 19 nt, Homo sapiens
gaauguaaggcaagaaaug

SEQ ID NO: 810851 - RNA, 19 nt, Homo sapiens
gcauugggcuuaacaacag

SEQ ID NO: 810852 - RNA, 19 nt, Homo sapiens
uugcacaucugcucuguuu

SEQ ID NO: 810853 - RNA, 19 nt, Homo sapiens
ucucagaggugaaugugaa

SEQ ID NO: 810854 - RNA, 19 nt, Homo sapiens
cgaaagcaccaggcaaaua

SEQ ID NO: 810855 - RNA, 19 nt, Homo sapiens
ugacugaucaggugaacua

SEQ ID NO: 810856 - RNA, 19 nt, Homo sapiens
ugacauuuauuccucaguu

SEQ ID NO: 810857 - RNA, 19 nt, Homo sapiens
uagaaagacguaucaauga

SEQ ID NO: 810858 - RNA, 19 nt, Homo sapiens
caaugaaacugacucuucu

SEQ ID NO: 810859 - RNA, 19 nt, Homo sapiens
caagcugcccuaucuaauu

SEQ ID NO: 810860 - RNA, 19 nt, Homo sapiens
gaauuuguggaaccaauaa

SEQ ID NO: 810861 - RNA, 19 nt, Homo sapiens
ugaauaugccuuagaaaug

SEQ ID NO: 810862 - RNA, 19 nt, Homo sapiens
ugagugagcaacuaaauga

SEQ ID NO: 810863 - RNA, 19 nt, Homo sapiens
caaaugaacaagcaacuuc

SEQ ID NO: 810864 - RNA, 19 nt, Homo sapiens
agaaggaguggucaaguua

SEQ ID NO: 810865 - RNA, 19 nt, Homo sapiens
cccaagaacuggaaaauuu

SEQ ID NO: 810866 - RNA, 19 nt, Homo sapiens
gauauucaacuucuucaga

SEQ ID NO: 810867 - RNA, 19 nt, Homo sapiens
ucagacagacaaugacaua

SEQ ID NO: 810868 - RNA, 19 nt, Homo sapiens
guuaaugaaucugugguuu

SEQ ID NO: 810869 - RNA, 19 nt, Homo sapiens
cuucagagcuuugccagaa

SEQ ID NO: 810870 - RNA, 19 nt, Homo sapiens
cuaucaagcuuguggaaga

SEQ ID NO: 810871 - RNA, 19 nt, Homo sapiens
gaaacacggacaacauaau

SEQ ID NO: 810872 - RNA, 19 nt, Homo sapiens
ggccagaacuugaguauuu

SEQ ID NO: 810873 - RNA, 19 nt, Homo sapiens
caaaguaccuucuaauuuc

SEQ ID NO: 810874 - RNA, 19 nt, Homo sapiens
ggaagaaacuuugcaaaca

SEQ ID NO: 810875 - RNA, 19 nt, Homo sapiens
gcaacaaaguaccuucuaa

SEQ ID NO: 810876 - RNA, 19 nt, Homo sapiens
gaacaaaucuaugaacucu

SEQ ID NO: 810877 - RNA, 19 nt, Homo sapiens
gaaauuguguucuuugaca

SEQ ID NO: 810878 - RNA, 19 nt, Homo sapiens
gaagaaacuuugcaaacau

SEQ ID NO: 810879 - RNA, 19 nt, Homo sapiens
gauuggaucuguaauguug

SEQ ID NO: 810880 - RNA, 19 nt, Homo sapiens
caacauaacucagauuucu

SEQ ID NO: 810881 - RNA, 19 nt, Homo sapiens
ugagauagccuaauaaaug

SEQ ID NO: 810882 - RNA, 19 nt, Homo sapiens
uggauugucuucuguaaua

SEQ ID NO: 810883 - RNA, 19 nt, Homo sapiens
gaaaugaggccagaacuug

SEQ ID NO: 810884 - RNA, 19 nt, Homo sapiens
caauaaagcuggaugaacu

SEQ ID NO: 810885 - RNA, 19 nt, Homo sapiens
gaggauacacuguucauuu

SEQ ID NO: 810886 - RNA, 19 nt, Homo sapiens
ggaagccucugaaaguuau

SEQ ID NO: 810887 - RNA, 19 nt, Homo sapiens
ggugauuucucucuaauau

SEQ ID NO: 810888 - RNA, 19 nt, Homo sapiens
uuacacaacugaagaacaa

SEQ ID NO: 810889 - RNA, 19 nt, Homo sapiens
gagauagccuaauaaaugg

SEQ ID NO: 810890 - RNA, 19 nt, Homo sapiens
gaagaaaagcuguacguua

SEQ ID NO: 810891 - RNA, 19 nt, Homo sapiens
ugauuagucuuuagccaua

SEQ ID NO: 810892 - RNA, 19 nt, Homo sapiens
uaaguagguucaugaucua

SEQ ID NO: 810893 - RNA, 19 nt, Homo sapiens
caaauggaguugugcuaug

SEQ ID NO: 810894 - RNA, 19 nt, Homo sapiens
cauaaugagucuuaaguag

SEQ ID NO: 810895 - RNA, 19 nt, Homo sapiens
acaaaucuaugaacucuuc

SEQ ID NO: 810896 - RNA, 19 nt, Homo sapiens
gccagaacuugaguauuua

SEQ ID NO: 810897 - RNA, 19 nt, Homo sapiens
ugcaugagauagccuaaua

SEQ ID NO: 810898 - RNA, 19 nt, Homo sapiens
cuagggaauuuauuuggua

SEQ ID NO: 810899 - RNA, 19 nt, Homo sapiens
aaagcuggaugaacuuaaa

SEQ ID NO: 810900 - RNA, 19 nt, Homo sapiens
uaaaagagcuguaacuagu

SEQ ID NO: 810901 - RNA, 19 nt, Homo sapiens
ggaguugugcuauguugua

SEQ ID NO: 810902 - RNA, 19 nt, Homo sapiens
gagauguugucaauaggaa

SEQ ID NO: 810903 - RNA, 19 nt, Homo sapiens
uaaacugaguguagaaauc

SEQ ID NO: 810904 - RNA, 19 nt, Homo sapiens
gaagagggaauguuugaca

SEQ ID NO: 810905 - RNA, 19 nt, Homo sapiens
aaagagcuguaacuaguug

SEQ ID NO: 810906 - RNA, 19 nt, Homo sapiens
ggaauggacuggguuuuaa

SEQ ID NO: 810907 - RNA, 19 nt, Homo sapiens
uuaaguagguucaugaucu

SEQ ID NO: 810908 - RNA, 19 nt, Homo sapiens
cagcaaaaguggugacaua

SEQ ID NO: 810909 - RNA, 19 nt, Homo sapiens
guugugcuauguuguauug

SEQ ID NO: 810910 - RNA, 19 nt, Homo sapiens
ccuuuggccuguugaauuu

SEQ ID NO: 810911 - RNA, 19 nt, Homo sapiens
caacaaaguaccuucuaau

SEQ ID NO: 810912 - RNA, 19 nt, Homo sapiens
gcaaggguuugucauagag

SEQ ID NO: 810913 - RNA, 19 nt, Homo sapiens
gccauaaccacuacacuuu

SEQ ID NO: 810914 - RNA, 19 nt, Homo sapiens
gaaaacagcauguggauuc

SEQ ID NO: 810915 - RNA, 19 nt, Homo sapiens
ggaaaugaggccagaacuu

SEQ ID NO: 810916 - RNA, 19 nt, Homo sapiens
gaaaagcuguacguuauau

SEQ ID NO: 810917 - RNA, 19 nt, Homo sapiens
gggcugaaguaccuaagug

SEQ ID NO: 810918 - RNA, 19 nt, Homo sapiens
ggaccuuccuguguaguug

SEQ ID NO: 810919 - RNA, 19 nt, Homo sapiens
uaaugagucuuaaguaggu

SEQ ID NO: 810920 - RNA, 19 nt, Homo sapiens
gcuggaagccucugaaagu

SEQ ID NO: 810921 - RNA, 19 nt, Homo sapiens
ccgcuucucugcacuaugu

SEQ ID NO: 810922 - RNA, 19 nt, Homo sapiens
aaagcaaggguuugucaua

SEQ ID NO: 810923 - RNA, 19 nt, Homo sapiens
gauuugaucagugucuuua

SEQ ID NO: 810924 - RNA, 19 nt, Homo sapiens
gccaugcgguacauaaaug

SEQ ID NO: 810925 - RNA, 19 nt, Homo sapiens
caacugaagaacaaaucua

SEQ ID NO: 810926 - RNA, 19 nt, Homo sapiens
gccaggaguuugagacuag

SEQ ID NO: 810927 - RNA, 19 nt, Homo sapiens
cauaaccacuacacuuuua

SEQ ID NO: 810928 - RNA, 19 nt, Homo sapiens
aagaaaagcuguacguuau

SEQ ID NO: 810929 - RNA, 19 nt, Homo sapiens
ugaaguaccuaagugugaa

SEQ ID NO: 810930 - RNA, 19 nt, Homo sapiens
uaaugaggauacacuguuc

SEQ ID NO: 810931 - RNA, 19 nt, Homo sapiens
caugagauagccuaauaaa

SEQ ID NO: 810932 - RNA, 19 nt, Homo sapiens
ccaauaguccgugaaaguu

SEQ ID NO: 810933 - RNA, 19 nt, Homo sapiens
gagucuagggaauuuauuu

SEQ ID NO: 810934 - RNA, 19 nt, Homo sapiens
gcuugaagagggaauguuu

SEQ ID NO: 810935 - RNA, 19 nt, Homo sapiens
caaaagaugucaguguuau

SEQ ID NO: 810936 - RNA, 19 nt, Homo sapiens
cuucauacaucaggaaaug

SEQ ID NO: 810937 - RNA, 19 nt, Homo sapiens
ugugaauucuaaccucuaa

SEQ ID NO: 810938 - RNA, 19 nt, Homo sapiens
gaagaacaaaucuaugaac

SEQ ID NO: 810939 - RNA, 19 nt, Homo sapiens
guuaccaggucagaaauug

SEQ ID NO: 810940 - RNA, 19 nt, Homo sapiens
gugcuuaggaagaaacuuu

SEQ ID NO: 810941 - RNA, 19 nt, Homo sapiens
ugacaaugaagaacaagaa

SEQ ID NO: 810942 - RNA, 19 nt, Homo sapiens
gcaugagauagccuaauaa

SEQ ID NO: 810943 - RNA, 19 nt, Homo sapiens
ccauaaugagucuuaagua

SEQ ID NO: 810944 - RNA, 19 nt, Homo sapiens
ggagaggaggcuauggaaa

SEQ ID NO: 810945 - RNA, 19 nt, Homo sapiens
caugaggaccagcaaguuu

SEQ ID NO: 810946 - RNA, 19 nt, Homo sapiens
caaaaguggugacauaaag

SEQ ID NO: 810947 - RNA, 19 nt, Homo sapiens
cugaagaacaaaucuauga

SEQ ID NO: 810948 - RNA, 19 nt, Homo sapiens
gcauguggauucuguuuug

SEQ ID NO: 810949 - RNA, 19 nt, Homo sapiens
gccuuuaauucuugucuga

SEQ ID NO: 810950 - RNA, 19 nt, Homo sapiens
ggagacagugguuuuauuu

SEQ ID NO: 810951 - RNA, 19 nt, Homo sapiens
gaguguagaaaucugaauu

SEQ ID NO: 810952 - RNA, 19 nt, Homo sapiens
ggagauguugucaauagga

SEQ ID NO: 810953 - RNA, 19 nt, Homo sapiens
acagguguuugacaauuga

SEQ ID NO: 810954 - RNA, 19 nt, Homo sapiens
gauuagucuuuagccauaa

SEQ ID NO: 810955 - RNA, 19 nt, Homo sapiens
uuaaaggacagaauccaaa

SEQ ID NO: 810956 - RNA, 19 nt, Homo sapiens
gacaaugaagaacaagaaa

SEQ ID NO: 810957 - RNA, 19 nt, Homo sapiens
gggugacaaugaagaacaa

SEQ ID NO: 810958 - RNA, 19 nt, Homo sapiens
gucaauaggaaaugggaua

SEQ ID NO: 810959 - RNA, 19 nt, Homo sapiens
aaauggaguugugcuaugu

SEQ ID NO: 810960 - RNA, 19 nt, Homo sapiens
ggccaggaguuugagacua

SEQ ID NO: 810961 - RNA, 19 nt, Homo sapiens
uggaagccucugaaaguua

SEQ ID NO: 810962 - RNA, 19 nt, Homo sapiens
gagcuggaagccucugaaa

SEQ ID NO: 810963 - RNA, 19 nt, Homo sapiens
gagaggaggcuauggaaaa

SEQ ID NO: 810964 - RNA, 19 nt, Homo sapiens
ugucuucuguaauagguuu

SEQ ID NO: 810965 - RNA, 19 nt, Homo sapiens
accagcaaguuuauucuuu

SEQ ID NO: 810966 - RNA, 19 nt, Homo sapiens
gcuauguuguauugcuuug

SEQ ID NO: 810967 - RNA, 19 nt, Homo sapiens
gagcuguaacuaguuguaa

SEQ ID NO: 810968 - RNA, 19 nt, Homo sapiens
gaaaguuggggcugaagua

SEQ ID NO: 810969 - RNA, 19 nt, Homo sapiens
caauaguccgugaaaguug

SEQ ID NO: 810970 - RNA, 19 nt, Homo sapiens
ggggagauguugucaauag

SEQ ID NO: 810971 - RNA, 19 nt, Homo sapiens
aagcaaggguuugucauag

SEQ ID NO: 810972 - RNA, 19 nt, Homo sapiens
ggaaagagaugacuaacua

SEQ ID NO: 810973 - RNA, 19 nt, Homo sapiens
gaacagagaugagauuuga

SEQ ID NO: 810974 - RNA, 19 nt, Homo sapiens
ccaaauaggucaauaauuc

SEQ ID NO: 810975 - RNA, 19 nt, Homo sapiens
caacacagauggcucauuu

SEQ ID NO: 810976 - RNA, 19 nt, Homo sapiens
gcucaaagccauuuaaauu

SEQ ID NO: 810977 - RNA, 19 nt, Homo sapiens
ggaagugccucuuuaguuc

SEQ ID NO: 810978 - RNA, 19 nt, Homo sapiens
gaugucagauguaauugua

SEQ ID NO: 810979 - RNA, 19 nt, Homo sapiens
agacuggacuggaaucuua

SEQ ID NO: 810980 - RNA, 19 nt, Homo sapiens
gcaaauauuucucccuaug

SEQ ID NO: 810981 - RNA, 19 nt, Homo sapiens
gaaguucuuugcauagauu

SEQ ID NO: 810982 - RNA, 19 nt, Homo sapiens
gcacuacgacguuauguuu

SEQ ID NO: 810983 - RNA, 19 nt, Homo sapiens
gaucaacacuaacaaggaa

SEQ ID NO: 810984 - RNA, 19 nt, Homo sapiens
ggacaauucccacagauaa

SEQ ID NO: 810985 - RNA, 19 nt, Homo sapiens
agaaaugggugauaaagaa

SEQ ID NO: 810986 - RNA, 19 nt, Homo sapiens
gaccuucgcugucaucuga

SEQ ID NO: 810987 - RNA, 19 nt, Homo sapiens
ugaauuagaucccugcaaa

SEQ ID NO: 810988 - RNA, 19 nt, Homo sapiens
caacaucagcacuuaaaua

SEQ ID NO: 810989 - RNA, 19 nt, Homo sapiens
ggacuggaaucuuagcaaa

SEQ ID NO: 810990 - RNA, 19 nt, Homo sapiens
ccaacgagcccuccuauuu

SEQ ID NO: 810991 - RNA, 19 nt, Homo sapiens
gaaacaaauucaaggacaa

SEQ ID NO: 810992 - RNA, 19 nt, Homo sapiens
ggucuguucuuguagauaa

SEQ ID NO: 810993 - RNA, 19 nt, Homo sapiens
ggauggagaugaucauuag

SEQ ID NO: 810994 - RNA, 19 nt, Homo sapiens
uuaauacucuugccaguuu

SEQ ID NO: 810995 - RNA, 19 nt, Homo sapiens
guacugagguuaccacaca

SEQ ID NO: 810996 - RNA, 19 nt, Homo sapiens
ggaaaccacugggcucaaa

SEQ ID NO: 810997 - RNA, 19 nt, Homo sapiens
gcauggaaauucuuguuug

SEQ ID NO: 810998 - RNA, 19 nt, Homo sapiens
ucaaacacgugcuuuauuc

SEQ ID NO: 810999 - RNA, 19 nt, Homo sapiens
ccaagacaaugaagauuug

SEQ ID NO: 811000 - RNA, 19 nt, Homo sapiens
cuucuuagcuucuccauug

SEQ ID NO: 811001 - RNA, 19 nt, Homo sapiens
ggacaaaggagagaaagaa

SEQ ID NO: 811002 - RNA, 19 nt, Homo sapiens
aaacaucugucucuacuuc

SEQ ID NO: 811003 - RNA, 19 nt, Homo sapiens
gccacaaggugcaggguua

SEQ ID NO: 811004 - RNA, 19 nt, Homo sapiens
gaaggaagagggaaagaga

SEQ ID NO: 811005 - RNA, 19 nt, Homo sapiens
gaagugcaauuaaccucuu

SEQ ID NO: 811006 - RNA, 19 nt, Homo sapiens
ugaccaacaucagcacuua

SEQ ID NO: 811007 - RNA, 19 nt, Homo sapiens
ggcuuaagcuugaauuaga

SEQ ID NO: 811008 - RNA, 19 nt, Homo sapiens
gcucuggaaucccuuuauu

SEQ ID NO: 811009 - RNA, 19 nt, Homo sapiens
ggaggacaauucccacaga

SEQ ID NO: 811010 - RNA, 19 nt, Homo sapiens
ccucugagcugaaguucuu

SEQ ID NO: 811011 - RNA, 19 nt, Homo sapiens
gaaguuaccugaguaucuc

SEQ ID NO: 811012 - RNA, 19 nt, Homo sapiens
caacgcagucuguguauga

SEQ ID NO: 811013 - RNA, 19 nt, Homo sapiens
ucuaauagccuuggguuua

SEQ ID NO: 811014 - RNA, 19 nt, Homo sapiens
gacaaugcauuagaacuug

SEQ ID NO: 811015 - RNA, 19 nt, Homo sapiens
ucacugcucuuucuuucuu

SEQ ID NO: 811016 - RNA, 19 nt, Homo sapiens
gagaugaugcacuguguuu

SEQ ID NO: 811017 - RNA, 19 nt, Homo sapiens
gagcugaaguucuuugcau

SEQ ID NO: 811018 - RNA, 19 nt, Homo sapiens
cuauaugguuugugcauuu

SEQ ID NO: 811019 - RNA, 19 nt, Homo sapiens
ggacaguuaucgacaaugc

SEQ ID NO: 811020 - RNA, 19 nt, Homo sapiens
gcaggacaguuaucgacaa

SEQ ID NO: 811021 - RNA, 19 nt, Homo sapiens
ucucaaagcagacaaugua

SEQ ID NO: 811022 - RNA, 19 nt, Homo sapiens
ccaagaggccauuaacaaa

SEQ ID NO: 811023 - RNA, 19 nt, Homo sapiens
gaaagagaugacuaacuaa

SEQ ID NO: 811024 - RNA, 19 nt, Homo sapiens
ccaucaggcuguuuccuaa

SEQ ID NO: 811025 - RNA, 19 nt, Homo sapiens
ggaaggugcagcuuuguug

SEQ ID NO: 811026 - RNA, 19 nt, Homo sapiens
gagaugauaauccgaauuc

SEQ ID NO: 811027 - RNA, 19 nt, Homo sapiens
uccaucaccuugaacaaua

SEQ ID NO: 811028 - RNA, 19 nt, Homo sapiens
uaucgacaaugcauuagaa

SEQ ID NO: 811029 - RNA, 19 nt, Homo sapiens
caugaaugcuaaaugagaa

SEQ ID NO: 811030 - RNA, 19 nt, Homo sapiens
gcagagggccacacagaga

SEQ ID NO: 811031 - RNA, 19 nt, Homo sapiens
uuucgugacucuauaauga

SEQ ID NO: 811032 - RNA, 19 nt, Homo sapiens
gggauuucgugacucuaua

SEQ ID NO: 811033 - RNA, 19 nt, Homo sapiens
uuaugugccuauccuaaua

SEQ ID NO: 811034 - RNA, 19 nt, Homo sapiens
aguaaucacuucaugaaug

SEQ ID NO: 811035 - RNA, 19 nt, Homo sapiens
ggacacgccuuacucuaac

SEQ ID NO: 811036 - RNA, 19 nt, Homo sapiens
gaguugcucaugcugauua

SEQ ID NO: 811037 - RNA, 19 nt, Homo sapiens
uaucuucucugcucacuuc

SEQ ID NO: 811038 - RNA, 19 nt, Homo sapiens
aaagugagguggcccuaga

SEQ ID NO: 811039 - RNA, 19 nt, Homo sapiens
ccuuugagcuuucuguuau

SEQ ID NO: 811040 - RNA, 19 nt, Homo sapiens
agauuuggcuuaagcuuga

SEQ ID NO: 811041 - RNA, 19 nt, Homo sapiens
gauaaugcccuucuauuuu

SEQ ID NO: 811042 - RNA, 19 nt, Homo sapiens
ucacugaagggcuuguuua

SEQ ID NO: 811043 - RNA, 19 nt, Homo sapiens
ggagaacagagaugagauu

SEQ ID NO: 811044 - RNA, 19 nt, Homo sapiens
gagaaaugggugauaaaga

SEQ ID NO: 811045 - RNA, 19 nt, Homo sapiens
caacagggaggucauggaa

SEQ ID NO: 811046 - RNA, 19 nt, Homo sapiens
gaacagacagaggaaaugu

SEQ ID NO: 811047 - RNA, 19 nt, Homo sapiens
gagggaaagagaugacuaa

SEQ ID NO: 811048 - RNA, 19 nt, Homo sapiens
cggaugugaucaacacuaa

SEQ ID NO: 811049 - RNA, 19 nt, Homo sapiens
gccaagaggccauuaacaa

SEQ ID NO: 811050 - RNA, 19 nt, Homo sapiens
agauaaugcccuucuauuu

SEQ ID NO: 811051 - RNA, 19 nt, Homo sapiens
gaugaucauuagguacuuu

SEQ ID NO: 811052 - RNA, 19 nt, Homo sapiens
gacucuaggugauguguga

SEQ ID NO: 811053 - RNA, 19 nt, Homo sapiens
uuggaacucugguguuuaa

SEQ ID NO: 811054 - RNA, 19 nt, Homo sapiens
ccagggauuuguucacaga

SEQ ID NO: 811055 - RNA, 19 nt, Homo sapiens
cuaauagccuuggguuuau

SEQ ID NO: 811056 - RNA, 19 nt, Homo sapiens
uuaggaaggugcagcuuug

SEQ ID NO: 811057 - RNA, 19 nt, Homo sapiens
uugcauagauuuggcuuaa

SEQ ID NO: 811058 - RNA, 19 nt, Homo sapiens
aauccgaauucuccauaua

SEQ ID NO: 811059 - RNA, 19 nt, Homo sapiens
ugagcaaucuuucgaugga

SEQ ID NO: 811060 - RNA, 19 nt, Homo sapiens
ccuggaggccugucuguua

SEQ ID NO: 811061 - RNA, 19 nt, Homo sapiens
cgacaaugcauuagaacuu

SEQ ID NO: 811062 - RNA, 19 nt, Homo sapiens
caagaggccauuaacaaau

SEQ ID NO: 811063 - RNA, 19 nt, Homo sapiens
ccagacagcucagguugug

SEQ ID NO: 811064 - RNA, 19 nt, Homo sapiens
cgagagaggccagggauuu

SEQ ID NO: 811065 - RNA, 19 nt, Homo sapiens
gcauagauuuggcuuaagc

SEQ ID NO: 811066 - RNA, 19 nt, Homo sapiens
gaaaacaucugucucuacu

SEQ ID NO: 811067 - RNA, 19 nt, Homo sapiens
agucaaaccuuuauaugca

SEQ ID NO: 811068 - RNA, 19 nt, Homo sapiens
gcaugaggcucugauuaag

SEQ ID NO: 811069 - RNA, 19 nt, Homo sapiens
caucacugcucuuucuuuc

SEQ ID NO: 811070 - RNA, 19 nt, Homo sapiens
gcaaugcaucggucucuga

SEQ ID NO: 811071 - RNA, 19 nt, Homo sapiens
gagaacagacagaggaaau

SEQ ID NO: 811072 - RNA, 19 nt, Homo sapiens
guaaaugccuuaagaguau

SEQ ID NO: 811073 - RNA, 19 nt, Homo sapiens
gagaauggguguugacaaa

SEQ ID NO: 811074 - RNA, 19 nt, Homo sapiens
ggagaaauguaaagacuga

SEQ ID NO: 811075 - RNA, 19 nt, Homo sapiens
gauaauagaggauguguuu

SEQ ID NO: 811076 - RNA, 19 nt, Homo sapiens
ugacaaagaucgaacaguu

SEQ ID NO: 811077 - RNA, 19 nt, Homo sapiens
gcaaguaacuagccauugu

SEQ ID NO: 811078 - RNA, 19 nt, Homo sapiens
ggagagauguauguaauau

SEQ ID NO: 811079 - RNA, 19 nt, Homo sapiens
gaaguuugcugcuuagagu

SEQ ID NO: 811080 - RNA, 19 nt, Homo sapiens
gcagaggauuguagacauu

SEQ ID NO: 811081 - RNA, 19 nt, Homo sapiens
gaaaucagagaauguugua

SEQ ID NO: 811082 - RNA, 19 nt, Homo sapiens
caaagggaguggucaguga

SEQ ID NO: 811083 - RNA, 19 nt, Homo sapiens
gaagauggcagugaacgua

SEQ ID NO: 811084 - RNA, 19 nt, Homo sapiens
ccacaucucugggauuuga

SEQ ID NO: 811085 - RNA, 19 nt, Homo sapiens
ggaaagcuacggaacauug

SEQ ID NO: 811086 - RNA, 19 nt, Homo sapiens
ggugguagcuuguccugaa

SEQ ID NO: 811087 - RNA, 19 nt, Homo sapiens
aaagugaaauuccaagcua

SEQ ID NO: 811088 - RNA, 19 nt, Homo sapiens
ccagugcacuaaucucuuu

SEQ ID NO: 811089 - RNA, 19 nt, Homo sapiens
ccaauugcaucccagcuaa

SEQ ID NO: 811090 - RNA, 19 nt, Homo sapiens
caaaucaugugcuuaacug

SEQ ID NO: 811091 - RNA, 19 nt, Homo sapiens
aaacccagauucagugauu

SEQ ID NO: 811092 - RNA, 19 nt, Homo sapiens
gcccugagauguuacaguu

SEQ ID NO: 811093 - RNA, 19 nt, Homo sapiens
uaccgugucugaauuaauu

SEQ ID NO: 811094 - RNA, 19 nt, Homo sapiens
gacaagagauuuugcguuu

SEQ ID NO: 811095 - RNA, 19 nt, Homo sapiens
ggccuaggcuuuggucuaa

SEQ ID NO: 811096 - RNA, 19 nt, Homo sapiens
gaugaaggcuuugugauac

SEQ ID NO: 811097 - RNA, 19 nt, Homo sapiens
uuagaggacucacugguuu

SEQ ID NO: 811098 - RNA, 19 nt, Homo sapiens
gaaacuuacuguugaagac

SEQ ID NO: 811099 - RNA, 19 nt, Homo sapiens
aaguugcccuguaaaguua

SEQ ID NO: 811100 - RNA, 19 nt, Homo sapiens
cagauucagugauuaacaa

SEQ ID NO: 811101 - RNA, 19 nt, Homo sapiens
ccuuaacucucccucauuu

SEQ ID NO: 811102 - RNA, 19 nt, Homo sapiens
ccaauaaguuugaguuagg

SEQ ID NO: 811103 - RNA, 19 nt, Homo sapiens
agagagggauuucuacuuc

SEQ ID NO: 811104 - RNA, 19 nt, Homo sapiens
gaagaaagugaaauuccaa

SEQ ID NO: 811105 - RNA, 19 nt, Homo sapiens
cagagaauguuguaauaag

SEQ ID NO: 811106 - RNA, 19 nt, Homo sapiens
gaagagcuugguuucauug

SEQ ID NO: 811107 - RNA, 19 nt, Homo sapiens
aagcuaaugugaaaucaga

SEQ ID NO: 811108 - RNA, 19 nt, Homo sapiens
uagcagagcaguauuaaca

SEQ ID NO: 811109 - RNA, 19 nt, Homo sapiens
ccaguuaucccgaaauuuc

SEQ ID NO: 811110 - RNA, 19 nt, Homo sapiens
ccugagauguuacaguuga

SEQ ID NO: 811111 - RNA, 19 nt, Homo sapiens
gcaagaagaguauuaacag

SEQ ID NO: 811112 - RNA, 19 nt, Homo sapiens
ggaaaacgacccuguauug

SEQ ID NO: 811113 - RNA, 19 nt, Homo sapiens
aaaugugucucacccacua

SEQ ID NO: 811114 - RNA, 19 nt, Homo sapiens
gaaagcuacggaacauuga

SEQ ID NO: 811115 - RNA, 19 nt, Homo sapiens
guaacuagccauuguucaa

SEQ ID NO: 811116 - RNA, 19 nt, Homo sapiens
caaugagucucugcaguug

SEQ ID NO: 811117 - RNA, 19 nt, Homo sapiens
guaaaguuauuugguguca

SEQ ID NO: 811118 - RNA, 19 nt, Homo sapiens
ccucauaggccuaggcuuu

SEQ ID NO: 811119 - RNA, 19 nt, Homo sapiens
gcuguucccuggcuccauu

SEQ ID NO: 811120 - RNA, 19 nt, Homo sapiens
cuauucaguuccuuuguuu

SEQ ID NO: 811121 - RNA, 19 nt, Homo sapiens
gcccacagccuauucaguu

SEQ ID NO: 811122 - RNA, 19 nt, Homo sapiens
cgaccucaguggagaaaug

SEQ ID NO: 811123 - RNA, 19 nt, Homo sapiens
ggagcaagaagaguauuaa

SEQ ID NO: 811124 - RNA, 19 nt, Homo sapiens
guauugaaacuuacuguug

SEQ ID NO: 811125 - RNA, 19 nt, Homo sapiens
caagagauuuugcguuuga

SEQ ID NO: 811126 - RNA, 19 nt, Homo sapiens
gcagagcaacaucggaauu

SEQ ID NO: 811127 - RNA, 19 nt, Homo sapiens
agaugaaggcuuugugaua

SEQ ID NO: 811128 - RNA, 19 nt, Homo sapiens
cgaggcagcugaguugaug

SEQ ID NO: 811129 - RNA, 19 nt, Homo sapiens
ccugaaauguguguagaaa

SEQ ID NO: 811130 - RNA, 19 nt, Homo sapiens
gcagugaacguauacucaa

SEQ ID NO: 811131 - RNA, 19 nt, Homo sapiens
caucguugccuggauaaua

SEQ ID NO: 811132 - RNA, 19 nt, Homo sapiens
aaaguugcccuguaaaguu

SEQ ID NO: 811133 - RNA, 19 nt, Homo sapiens
ugaaauguguguagaaagc

SEQ ID NO: 811134 - RNA, 19 nt, Homo sapiens
ugaagaaagugaaauucca

SEQ ID NO: 811135 - RNA, 19 nt, Homo sapiens
ucauugagcauuucucuau

SEQ ID NO: 811136 - RNA, 19 nt, Homo sapiens
uaauagaggauguguuuca

SEQ ID NO: 811137 - RNA, 19 nt, Homo sapiens
ggccagaccuuggaaccuu

SEQ ID NO: 811138 - RNA, 19 nt, Homo sapiens
gaccagugauaaccuaagu

SEQ ID NO: 811139 - RNA, 19 nt, Homo sapiens
ugccacagaugaaggcuuu

SEQ ID NO: 811140 - RNA, 19 nt, Homo sapiens
gauuguagacauucuguau

SEQ ID NO: 811141 - RNA, 19 nt, Homo sapiens
cagacaaggucaagaaacu

SEQ ID NO: 811142 - RNA, 19 nt, Homo sapiens
ugacaguggugcuauuucu

SEQ ID NO: 811143 - RNA, 19 nt, Homo sapiens
acaguaccgugucugaauu

SEQ ID NO: 811144 - RNA, 19 nt, Homo sapiens
guacauccagaacuucaaa

SEQ ID NO: 811145 - RNA, 19 nt, Homo sapiens
guguagaaagcaaguauuu

SEQ ID NO: 811146 - RNA, 19 nt, Homo sapiens
ccuauucaguuccuuuguu

SEQ ID NO: 811147 - RNA, 19 nt, Homo sapiens
ucaaugagucucugcaguu

SEQ ID NO: 811148 - RNA, 19 nt, Homo sapiens
uaacuagccauuguucaaa

SEQ ID NO: 811149 - RNA, 19 nt, Homo sapiens
ucucugcaguugaaucuga

SEQ ID NO: 811150 - RNA, 19 nt, Homo sapiens
ucagugaaggccaucguua

SEQ ID NO: 811151 - RNA, 19 nt, Homo sapiens
aguaaaugccuuaagagua

SEQ ID NO: 811152 - RNA, 19 nt, Homo sapiens
agagauguauguaauaugc

SEQ ID NO: 811153 - RNA, 19 nt, Homo sapiens
aggacucacugguuucuuu

SEQ ID NO: 811154 - RNA, 19 nt, Homo sapiens
uugaagacuuggagaaaga

SEQ ID NO: 811155 - RNA, 19 nt, Homo sapiens
gcaguugaaucugacaaag

SEQ ID NO: 811156 - RNA, 19 nt, Homo sapiens
aauaauuccuguggacaaa

SEQ ID NO: 811157 - RNA, 19 nt, Homo sapiens
gacaaagaucgaacaguug

SEQ ID NO: 811158 - RNA, 19 nt, Homo sapiens
acuguaauccgaauacuuu

SEQ ID NO: 811159 - RNA, 19 nt, Homo sapiens
cuggagagauguauguaau

SEQ ID NO: 811160 - RNA, 19 nt, Homo sapiens
caauaaguuugaguuagga

SEQ ID NO: 811161 - RNA, 19 nt, Homo sapiens
ccugauguauuuguauuga

SEQ ID NO: 811162 - RNA, 19 nt, Homo sapiens
gcaggcaggugaucaugcu

SEQ ID NO: 811163 - RNA, 19 nt, Homo sapiens
ccacugggacuccucuuug

SEQ ID NO: 811164 - RNA, 19 nt, Homo sapiens
ggaugcgggucacacugaa

SEQ ID NO: 811165 - RNA, 19 nt, Homo sapiens
guucagugguucaagaagu

SEQ ID NO: 811166 - RNA, 19 nt, Homo sapiens
caccuggucuuucuugaca

SEQ ID NO: 811167 - RNA, 19 nt, Homo sapiens
guggagaaauguaaagacu

SEQ ID NO: 811168 - RNA, 19 nt, Homo sapiens
gaauggguguugacaaaau

SEQ ID NO: 811169 - RNA, 19 nt, Homo sapiens
aaaugacaguggugcuauu

SEQ ID NO: 811170 - RNA, 19 nt, Homo sapiens
gccagaccuuggaaccuuu

SEQ ID NO: 811171 - RNA, 19 nt, Homo sapiens
gaaagugaaauuccaagcu

SEQ ID NO: 811172 - RNA, 19 nt, Homo sapiens
gaagaaagcuguugaugaa

SEQ ID NO: 811173 - RNA, 19 nt, Homo sapiens
gaagcaaagugucgaguua

SEQ ID NO: 811174 - RNA, 19 nt, Homo sapiens
gaacagcuauuacgaguug

SEQ ID NO: 811175 - RNA, 19 nt, Homo sapiens
gaagaacucucaaagaaga

SEQ ID NO: 811176 - RNA, 19 nt, Homo sapiens
caacucagauggauuaauu

SEQ ID NO: 811177 - RNA, 19 nt, Homo sapiens
cgaguuagcuacaaacaua

SEQ ID NO: 811178 - RNA, 19 nt, Homo sapiens
cgaaaggucugugauaaua

SEQ ID NO: 811179 - RNA, 19 nt, Homo sapiens
gcauuaaucuugcugcuaa

SEQ ID NO: 811180 - RNA, 19 nt, Homo sapiens
ggaaauggauauuguugaa

SEQ ID NO: 811181 - RNA, 19 nt, Homo sapiens
ggaauaagaugguacaagu

SEQ ID NO: 811182 - RNA, 19 nt, Homo sapiens
gaauuugugugucagauaa

SEQ ID NO: 811183 - RNA, 19 nt, Homo sapiens
guuguuagcugcagauuaa

SEQ ID NO: 811184 - RNA, 19 nt, Homo sapiens
gcuaaaugcucaacaagaa

SEQ ID NO: 811185 - RNA, 19 nt, Homo sapiens
aagaagaacucucaaagaa

SEQ ID NO: 811186 - RNA, 19 nt, Homo sapiens
gaaggugguugaagaaugu

SEQ ID NO: 811187 - RNA, 19 nt, Homo sapiens
uaaguaacauuucccauga

SEQ ID NO: 811188 - RNA, 19 nt, Homo sapiens
gaauggagauugaugaagu

SEQ ID NO: 811189 - RNA, 19 nt, Homo sapiens
caaggaaggugguugaaga

SEQ ID NO: 811190 - RNA, 19 nt, Homo sapiens
gaagaggaguuugugauug

SEQ ID NO: 811191 - RNA, 19 nt, Homo sapiens
cauaaucccugcacucauu

SEQ ID NO: 811192 - RNA, 19 nt, Homo sapiens
uaaugaagaugcuguuuga

SEQ ID NO: 811193 - RNA, 19 nt, Homo sapiens
caagagacgucauaaucaa

SEQ ID NO: 811194 - RNA, 19 nt, Homo sapiens
gaaaugggcugaagaugcu

SEQ ID NO: 811195 - RNA, 19 nt, Homo sapiens
ggagcucuguguaugaaua

SEQ ID NO: 811196 - RNA, 19 nt, Homo sapiens
gaaccgccgugauucauug

SEQ ID NO: 811197 - RNA, 19 nt, Homo sapiens
gcccagaucucuaaugaug

SEQ ID NO: 811198 - RNA, 19 nt, Homo sapiens
acacaggacugaggaauaa

SEQ ID NO: 811199 - RNA, 19 nt, Homo sapiens
gaugaccgcuuuaaaucaa

SEQ ID NO: 811200 - RNA, 19 nt, Homo sapiens
gaagaacuacuauugaaug

SEQ ID NO: 811201 - RNA, 19 nt, Homo sapiens
gacaugagcuuuggcaaga

SEQ ID NO: 811202 - RNA, 19 nt, Homo sapiens
ggaaggugguugaagaaug

SEQ ID NO: 811203 - RNA, 19 nt, Homo sapiens
cuacaacucagauggauua

SEQ ID NO: 811204 - RNA, 19 nt, Homo sapiens
gcgccugccucucaagaua

SEQ ID NO: 811205 - RNA, 19 nt, Homo sapiens
gaaugaaacugcccuuggu

SEQ ID NO: 811206 - RNA, 19 nt, Homo sapiens
ugaugaaccuuacuacuau

SEQ ID NO: 811207 - RNA, 19 nt, Homo sapiens
ccagaucucuaaugaugaa

SEQ ID NO: 811208 - RNA, 19 nt, Homo sapiens
ugaagaugcuguuugaaug

SEQ ID NO: 811209 - RNA, 19 nt, Homo sapiens
ggacuuauuacucacuaua

SEQ ID NO: 811210 - RNA, 19 nt, Homo sapiens
gaaaacaaacacugcauua

SEQ ID NO: 811211 - RNA, 19 nt, Homo sapiens
aaacacaggcuccagcaua

SEQ ID NO: 811212 - RNA, 19 nt, Homo sapiens
uuccauaccucaaggauaa

SEQ ID NO: 811213 - RNA, 19 nt, Homo sapiens
cagcccagaucucuaauga

SEQ ID NO: 811214 - RNA, 19 nt, Homo sapiens
uggaagaacuacuauugaa

SEQ ID NO: 811215 - RNA, 19 nt, Homo sapiens
aaacaaacacugcauuaug

SEQ ID NO: 811216 - RNA, 19 nt, Homo sapiens
caagcucacugcacuccua

SEQ ID NO: 811217 - RNA, 19 nt, Homo sapiens
gaagaccugcugaauauca

SEQ ID NO: 811218 - RNA, 19 nt, Homo sapiens
augaagaccugcugaauau

SEQ ID NO: 811219 - RNA, 19 nt, Homo sapiens
caugaagaccugcugaaua

SEQ ID NO: 811220 - RNA, 19 nt, Homo sapiens
agaaagcuguugaugaaga

SEQ ID NO: 811221 - RNA, 19 nt, Homo sapiens
caagaagaacucucaaaga

SEQ ID NO: 811222 - RNA, 19 nt, Homo sapiens
agagaagacuggaagcaaa

SEQ ID NO: 811223 - RNA, 19 nt, Homo sapiens
gaugaaguugcuaacauua

SEQ ID NO: 811224 - RNA, 19 nt, Homo sapiens
cuacagaaccgccgugauu

SEQ ID NO: 811225 - RNA, 19 nt, Homo sapiens
gaugaagaaugggcuaaga

SEQ ID NO: 811226 - RNA, 19 nt, Homo sapiens
gaauauaaguugguuccau

SEQ ID NO: 811227 - RNA, 19 nt, Homo sapiens
cagcuuaucugugaaggaa

SEQ ID NO: 811228 - RNA, 19 nt, Homo sapiens
gcaaugacaacuacaaaca

SEQ ID NO: 811229 - RNA, 19 nt, Homo sapiens
uaacuuggaagaacuacua

SEQ ID NO: 811230 - RNA, 19 nt, Homo sapiens
aagaggaguuugugauuga

SEQ ID NO: 811231 - RNA, 19 nt, Homo sapiens
ugaugaaguugcuaacauu

SEQ ID NO: 811232 - RNA, 19 nt, Homo sapiens
aaucucagcuuagaagaaa

SEQ ID NO: 811233 - RNA, 19 nt, Homo sapiens
guacuuguauggugaugau

SEQ ID NO: 811234 - RNA, 19 nt, Homo sapiens
gaucucuaaugaugaagaa

SEQ ID NO: 811235 - RNA, 19 nt, Homo sapiens
cgaauugacuuggaacuca

SEQ ID NO: 811236 - RNA, 19 nt, Homo sapiens
gcaagaagaacucucaaag

SEQ ID NO: 811237 - RNA, 19 nt, Homo sapiens
aacaaacacugcauuaugu

SEQ ID NO: 811238 - RNA, 19 nt, Homo sapiens
ggcuauggaucuugauaaa

SEQ ID NO: 811239 - RNA, 19 nt, Homo sapiens
caaaagaaauguacagcuu

SEQ ID NO: 811240 - RNA, 19 nt, Homo sapiens
gaauaucacccuccgacuu

SEQ ID NO: 811241 - RNA, 19 nt, Homo sapiens
uagcaaggguccugagaga

SEQ ID NO: 811242 - RNA, 19 nt, Homo sapiens
cuauggaucuugauaaagu

SEQ ID NO: 811243 - RNA, 19 nt, Homo sapiens
gaagaagaggaguuuguga

SEQ ID NO: 811244 - RNA, 19 nt, Homo sapiens
uaaucuugcugcuaacaaa

SEQ ID NO: 811245 - RNA, 19 nt, Homo sapiens
gaagaugcuguuugaaugu

SEQ ID NO: 811246 - RNA, 19 nt, Homo sapiens
gcucuguguaugaauauua

SEQ ID NO: 811247 - RNA, 19 nt, Homo sapiens
guauggugaugaucgaauu

SEQ ID NO: 811248 - RNA, 19 nt, Homo sapiens
ccuaaugcaugauaagaau

SEQ ID NO: 811249 - RNA, 19 nt, Homo sapiens
ccagauaccucaaaaggaa

SEQ ID NO: 811250 - RNA, 19 nt, Homo sapiens
ucgaaauccugauaacuug

SEQ ID NO: 811251 - RNA, 19 nt, Homo sapiens
ugacauuguucacucauca

SEQ ID NO: 811252 - RNA, 19 nt, Homo sapiens
cauguguaaucucagcuua

SEQ ID NO: 811253 - RNA, 19 nt, Homo sapiens
ccgauuucuucaaugauua

SEQ ID NO: 811254 - RNA, 19 nt, Homo sapiens
agagugagcaguacuugua

SEQ ID NO: 811255 - RNA, 19 nt, Homo sapiens
gguagagagucgucagaug

SEQ ID NO: 811256 - RNA, 19 nt, Homo sapiens
gaagugguuauaaugauug

SEQ ID NO: 811257 - RNA, 19 nt, Homo sapiens
ugaagaugcucaugaagag

SEQ ID NO: 811258 - RNA, 19 nt, Homo sapiens
acuuggaacucauuucuuu

SEQ ID NO: 811259 - RNA, 19 nt, Homo sapiens
guugaagaauguaaacuca

SEQ ID NO: 811260 - RNA, 19 nt, Homo sapiens
gcauguugauguuauugug

SEQ ID NO: 811261 - RNA, 19 nt, Homo sapiens
uuacuaaaccuauccuuug

SEQ ID NO: 811262 - RNA, 19 nt, Homo sapiens
ggaagaacuacuauugaau

SEQ ID NO: 811263 - RNA, 19 nt, Homo sapiens
gaauaagaugguacaaguu

SEQ ID NO: 811264 - RNA, 19 nt, Homo sapiens
gacacaggacugaggaaua

SEQ ID NO: 811265 - RNA, 19 nt, Homo sapiens
agaagaaagcuguugauga

SEQ ID NO: 811266 - RNA, 19 nt, Homo sapiens
aaacugcccuuggugcauu

SEQ ID NO: 811267 - RNA, 19 nt, Homo sapiens
ugaacgaauugacuuggaa

SEQ ID NO: 811268 - RNA, 19 nt, Homo sapiens
ugaagaaacucagcauuuu

SEQ ID NO: 811269 - RNA, 19 nt, Homo sapiens
gcaaggguccugagagaag

SEQ ID NO: 811270 - RNA, 19 nt, Homo sapiens
agauauuccugacaaaguu

SEQ ID NO: 811271 - RNA, 19 nt, Homo sapiens
gaaggaauggagauugaug

SEQ ID NO: 811272 - RNA, 19 nt, Homo sapiens
ucacuugaaugacuuguuu

SEQ ID NO: 811273 - RNA, 19 nt, Homo sapiens
ggaucuaccugaauaacaa

SEQ ID NO: 811274 - RNA, 19 nt, Homo sapiens
caaggaagcaggaauguau

SEQ ID NO: 811275 - RNA, 19 nt, Homo sapiens
guucuuguguugcuauaaa

SEQ ID NO: 811276 - RNA, 19 nt, Homo sapiens
ucaucuaggucacguguuu

SEQ ID NO: 811277 - RNA, 19 nt, Homo sapiens
gaacggaaccgccuuucag

SEQ ID NO: 811278 - RNA, 19 nt, Homo sapiens
gaaguucaaaccaaggaaa

SEQ ID NO: 811279 - RNA, 19 nt, Homo sapiens
ucacgugcacccucaauuu

SEQ ID NO: 811280 - RNA, 19 nt, Homo sapiens
ggucagagguuuugcauca

SEQ ID NO: 811281 - RNA, 19 nt, Homo sapiens
uaacaaggaagcaggaaug

SEQ ID NO: 811282 - RNA, 19 nt, Homo sapiens
auaaagaaguaccugauca

SEQ ID NO: 811283 - RNA, 19 nt, Homo sapiens
aaacugggcugaauuugcu

SEQ ID NO: 811284 - RNA, 19 nt, Homo sapiens
ggucacguguuuccugaug

SEQ ID NO: 811285 - RNA, 19 nt, Homo sapiens
agugggaucuaccugaaua

SEQ ID NO: 811286 - RNA, 19 nt, Homo sapiens
agucauugcuucucuuaau

SEQ ID NO: 811287 - RNA, 19 nt, Homo sapiens
gcaguucuacgucacaaga

SEQ ID NO: 811288 - RNA, 19 nt, Homo sapiens
gucauugcuucucuuaauu

SEQ ID NO: 811289 - RNA, 19 nt, Homo sapiens
gugugaagcucaucuaggu

SEQ ID NO: 811290 - RNA, 19 nt, Homo sapiens
guguugcuauaaagaagua

SEQ ID NO: 811291 - RNA, 19 nt, Homo sapiens
aacuuaauccuguguguua

SEQ ID NO: 811292 - RNA, 19 nt, Homo sapiens
caucaacaguguggcuuug

SEQ ID NO: 811293 - RNA, 19 nt, Homo sapiens
gaggcagggucucuugcaa

SEQ ID NO: 811294 - RNA, 19 nt, Homo sapiens
cgagucauugcuucucuua

SEQ ID NO: 811295 - RNA, 19 nt, Homo sapiens
aggaaacacugaccaucuu

SEQ ID NO: 811296 - RNA, 19 nt, Homo sapiens
guuaggcuguucuuguguu

SEQ ID NO: 811297 - RNA, 19 nt, Homo sapiens
gagcaguucuacgucacaa

SEQ ID NO: 811298 - RNA, 19 nt, Homo sapiens
gcccaauggucagagguuu

SEQ ID NO: 811299 - RNA, 19 nt, Homo sapiens
cuggauaccucguuaggau

SEQ ID NO: 811300 - RNA, 19 nt, Homo sapiens
guacgucuggcucugauga

SEQ ID NO: 811301 - RNA, 19 nt, Homo sapiens
guguuaggcuguucuugug

SEQ ID NO: 811302 - RNA, 19 nt, Homo sapiens
gaaacacugaccaucuuca

SEQ ID NO: 811303 - RNA, 19 nt, Homo sapiens
acaguccacucuucaguuc

SEQ ID NO: 811304 - RNA, 19 nt, Homo sapiens
gcagugugaagcucaucua

SEQ ID NO: 811305 - RNA, 19 nt, Homo sapiens
gcacuggguggccuucguu

SEQ ID NO: 811306 - RNA, 19 nt, Homo sapiens
ggaucugggagaauugaaa

SEQ ID NO: 811307 - RNA, 19 nt, Homo sapiens
ggaacggaaccgccuuuca

SEQ ID NO: 811308 - RNA, 19 nt, Homo sapiens
caguguggcuuugaaguuc

SEQ ID NO: 811309 - RNA, 19 nt, Homo sapiens
ucacguguuuccugaugga

SEQ ID NO: 811310 - RNA, 19 nt, Homo sapiens
ggauaccucguuaggauca

SEQ ID NO: 811311 - RNA, 19 nt, Homo sapiens
uaccuggaaucaacuuaau

SEQ ID NO: 811312 - RNA, 19 nt, Homo sapiens
uuauuuaccuggaaucaac

SEQ ID NO: 811313 - RNA, 19 nt, Homo sapiens
caauaaaacugggcugaau

SEQ ID NO: 811314 - RNA, 19 nt, Homo sapiens
ggaaacacugaccaucuuc

SEQ ID NO: 811315 - RNA, 19 nt, Homo sapiens
gcaucaacaguguggcuuu

SEQ ID NO: 811316 - RNA, 19 nt, Homo sapiens
gacaguccacucuucaguu

SEQ ID NO: 811317 - RNA, 19 nt, Homo sapiens
cuaccugaauaacaaggaa

SEQ ID NO: 811318 - RNA, 19 nt, Homo sapiens
caacuuaauccuguguguu

SEQ ID NO: 811319 - RNA, 19 nt, Homo sapiens
ucaacuuaauccugugugu

SEQ ID NO: 811320 - RNA, 19 nt, Homo sapiens
gcgagucauugcuucucuu

SEQ ID NO: 811321 - RNA, 19 nt, Homo sapiens
caaaccaaggaaacacuga

SEQ ID NO: 811322 - RNA, 19 nt, Homo sapiens
aaacacugaccaucuucaa

SEQ ID NO: 811323 - RNA, 19 nt, Homo sapiens
uuaccuggaaucaacuuaa

SEQ ID NO: 811324 - RNA, 19 nt, Homo sapiens
cacccucaauuuccacaau

SEQ ID NO: 811325 - RNA, 19 nt, Homo sapiens
gggaucuaccugaauaaca

SEQ ID NO: 811326 - RNA, 19 nt, Homo sapiens
caacaguguggcuuugaag

SEQ ID NO: 811327 - RNA, 19 nt, Homo sapiens
acaaggaagcaggaaugua

SEQ ID NO: 811328 - RNA, 19 nt, Homo sapiens
uauaaagaaguaccugauc

SEQ ID NO: 811329 - RNA, 19 nt, Homo sapiens
acaguguggcuuugaaguu

SEQ ID NO: 811330 - RNA, 19 nt, Homo sapiens
ugauggaccugggcccaau

SEQ ID NO: 811331 - RNA, 19 nt, Homo sapiens
caagcagugugaagcucau

SEQ ID NO: 811332 - RNA, 19 nt, Homo sapiens
cgacaguccacucuucagu

SEQ ID NO: 811333 - RNA, 19 nt, Homo sapiens
uaaagaaguaccugaucag

SEQ ID NO: 811334 - RNA, 19 nt, Homo sapiens
ggaggcagggucucuugca

SEQ ID NO: 811335 - RNA, 19 nt, Homo sapiens
cugcgacaguccacucuuc

SEQ ID NO: 811336 - RNA, 19 nt, Homo sapiens
aaauaccugagacugagua

SEQ ID NO: 811337 - RNA, 19 nt, Homo sapiens
aucaggaucugggagaauu

SEQ ID NO: 811338 - RNA, 19 nt, Homo sapiens
ccaaggaaacacugaccau

SEQ ID NO: 811339 - RNA, 19 nt, Homo sapiens
gaagauggguguugacaaa

SEQ ID NO: 811340 - RNA, 19 nt, Homo sapiens
gaacgugacuucuacuuca

SEQ ID NO: 811341 - RNA, 19 nt, Homo sapiens
ggacucacccauucuaauu

SEQ ID NO: 811342 - RNA, 19 nt, Homo sapiens
cugcauauguguucacuuu

SEQ ID NO: 811343 - RNA, 19 nt, Homo sapiens
gcauauguguucacuuuua

SEQ ID NO: 811344 - RNA, 19 nt, Homo sapiens
ggauucuccuugcacuuua

SEQ ID NO: 811345 - RNA, 19 nt, Homo sapiens
ugaagagcaucaacaagaa

SEQ ID NO: 811346 - RNA, 19 nt, Homo sapiens
gcaccagccugcauaugug

SEQ ID NO: 811347 - RNA, 19 nt, Homo sapiens
ccucaacuauaccaagaua

SEQ ID NO: 811348 - RNA, 19 nt, Homo sapiens
aaucauuccuguagagaaa

SEQ ID NO: 811349 - RNA, 19 nt, Homo sapiens
acucacccauucuaauuua

SEQ ID NO: 811350 - RNA, 19 nt, Homo sapiens
guagagaaauuagugaaag

SEQ ID NO: 811351 - RNA, 19 nt, Homo sapiens
gcuccacucccacauuaua

SEQ ID NO: 811352 - RNA, 19 nt, Homo sapiens
ugagacugaugcccaaauu

SEQ ID NO: 811353 - RNA, 19 nt, Homo sapiens
gccaggagcaugaaaguga

SEQ ID NO: 811354 - RNA, 19 nt, Homo sapiens
cugcuccacucccacauua

SEQ ID NO: 811355 - RNA, 19 nt, Homo sapiens
gaauacauccacaacuuca

SEQ ID NO: 811356 - RNA, 19 nt, Homo sapiens
cagcaaacuucgugacauc

SEQ ID NO: 811357 - RNA, 19 nt, Homo sapiens
caaacuagagcaugaauac

SEQ ID NO: 811358 - RNA, 19 nt, Homo sapiens
aaacuaugauggaaaggau

SEQ ID NO: 811359 - RNA, 19 nt, Homo sapiens
gacaaagucauugguauau

SEQ ID NO: 811360 - RNA, 19 nt, Homo sapiens
uggaugggcuggagaagga

SEQ ID NO: 811361 - RNA, 19 nt, Homo sapiens
guauggccgucaaugugua

SEQ ID NO: 811362 - RNA, 19 nt, Homo sapiens
aagaagaccaggacgagua

SEQ ID NO: 811363 - RNA, 19 nt, Homo sapiens
cauuauaguccuuuccuaa

SEQ ID NO: 811364 - RNA, 19 nt, Homo sapiens
aaucugagucgccaugaua

SEQ ID NO: 811365 - RNA, 19 nt, Homo sapiens
caagauagaacagcuuugu

SEQ ID NO: 811366 - RNA, 19 nt, Homo sapiens
ccaggagcaugaaagugaa

SEQ ID NO: 811367 - RNA, 19 nt, Homo sapiens
caacaaauccaagaaacuc

SEQ ID NO: 811368 - RNA, 19 nt, Homo sapiens
gaguuuauucagugguuua

SEQ ID NO: 811369 - RNA, 19 nt, Homo sapiens
caccucaacuauaccaaga

SEQ ID NO: 811370 - RNA, 19 nt, Homo sapiens
gcagcuguguauuugacaa

SEQ ID NO: 811371 - RNA, 19 nt, Homo sapiens
gagaaauuagugaaaggaa

SEQ ID NO: 811372 - RNA, 19 nt, Homo sapiens
augaauacauccacaacuu

SEQ ID NO: 811373 - RNA, 19 nt, Homo sapiens
ugaggacgaugagauugaa

SEQ ID NO: 811374 - RNA, 19 nt, Homo sapiens
ggaacgugacuucuacuuc

SEQ ID NO: 811375 - RNA, 19 nt, Homo sapiens
guaggacucacccauucua

SEQ ID NO: 811376 - RNA, 19 nt, Homo sapiens
cugaggagguagugcugua

SEQ ID NO: 811377 - RNA, 19 nt, Homo sapiens
ugacuucuacuucagcaaa

SEQ ID NO: 811378 - RNA, 19 nt, Homo sapiens
ccaaacuagagcaugaaua

SEQ ID NO: 811379 - RNA, 19 nt, Homo sapiens
ccaugugucccucaacuga

SEQ ID NO: 811380 - RNA, 19 nt, Homo sapiens
uuauaguccuuuccuaaca

SEQ ID NO: 811381 - RNA, 19 nt, Homo sapiens
gaagagcaucaacaagaag

SEQ ID NO: 811382 - RNA, 19 nt, Homo sapiens
ccggaagaauccuccauca

SEQ ID NO: 811383 - RNA, 19 nt, Homo sapiens
gacgcaaacuaugauggaa

SEQ ID NO: 811384 - RNA, 19 nt, Homo sapiens
aggccaaacuagagcauga

SEQ ID NO: 811385 - RNA, 19 nt, Homo sapiens
gcacuuuaccuguucuuuu

SEQ ID NO: 811386 - RNA, 19 nt, Homo sapiens
caaauccaagaaacucauu

SEQ ID NO: 811387 - RNA, 19 nt, Homo sapiens
ucauuccuguagagaaauu

SEQ ID NO: 811388 - RNA, 19 nt, Homo sapiens
ggguauggccgucaaugug

SEQ ID NO: 811389 - RNA, 19 nt, Homo sapiens
ggcaccagccugcauaugu

SEQ ID NO: 811390 - RNA, 19 nt, Homo sapiens
gacucacccauucuaauuu

SEQ ID NO: 811391 - RNA, 19 nt, Homo sapiens
gguauggccgucaaugugu

SEQ ID NO: 811392 - RNA, 19 nt, Homo sapiens
acuaugauggaaaggauua

SEQ ID NO: 811393 - RNA, 19 nt, Homo sapiens
caacagcugguggacuuga

SEQ ID NO: 811394 - RNA, 19 nt, Homo sapiens
caaacuaugauggaaagga

SEQ ID NO: 811395 - RNA, 19 nt, Homo sapiens
cgcaaacuaugauggaaag

SEQ ID NO: 811396 - RNA, 19 nt, Homo sapiens
uagagaaauuagugaaagg

SEQ ID NO: 811397 - RNA, 19 nt, Homo sapiens
caaaaucauuccuguagag

SEQ ID NO: 811398 - RNA, 19 nt, Homo sapiens
caucauuggcauccucuau

SEQ ID NO: 811399 - RNA, 19 nt, Homo sapiens
gcaaacuucgugacaucga

SEQ ID NO: 811400 - RNA, 19 nt, Homo sapiens
ugacgcaaacuaugaugga

SEQ ID NO: 811401 - RNA, 19 nt, Homo sapiens
ugaauacauccacaacuuc

SEQ ID NO: 811402 - RNA, 19 nt, Homo sapiens
acauuauaguccuuuccua

SEQ ID NO: 811403 - RNA, 19 nt, Homo sapiens
gagucgccaugauaugcuu

SEQ ID NO: 811404 - RNA, 19 nt, Homo sapiens
uggauucuccuugcacuuu

SEQ ID NO: 811405 - RNA, 19 nt, Homo sapiens
gacaaaaucauuccuguag

SEQ ID NO: 811406 - RNA, 19 nt, Homo sapiens
ugugugcacuugaggaaag

SEQ ID NO: 811407 - RNA, 19 nt, Homo sapiens
ucagcaaacuucgugacau

SEQ ID NO: 811408 - RNA, 19 nt, Homo sapiens
agacugaugcccaaauucu

SEQ ID NO: 811409 - RNA, 19 nt, Homo sapiens
acuagagcaugaauacauc

SEQ ID NO: 811410 - RNA, 19 nt, Homo sapiens
ucccugcaccucaacuaua

SEQ ID NO: 811411 - RNA, 19 nt, Homo sapiens
gcugugugcacuugaggaa

SEQ ID NO: 811412 - RNA, 19 nt, Homo sapiens
cuucaacaaauccaagaaa

SEQ ID NO: 811413 - RNA, 19 nt, Homo sapiens
ucagugguuuaagaaauuc

SEQ ID NO: 811414 - RNA, 19 nt, Homo sapiens
gcaugugagggauggaaau

SEQ ID NO: 811415 - RNA, 19 nt, Homo sapiens
ugaguuuauucagugguuu

SEQ ID NO: 811416 - RNA, 19 nt, Homo sapiens
ggacgaugagauugaagag

SEQ ID NO: 811417 - RNA, 19 nt, Homo sapiens
gcccaaauucuugaacuca

SEQ ID NO: 811418 - RNA, 19 nt, Homo sapiens
gagacugaugcccaaauuc

SEQ ID NO: 811419 - RNA, 19 nt, Homo sapiens
gcaugaauacauccacaac

SEQ ID NO: 811420 - RNA, 19 nt, Homo sapiens
gagagaagcugaagcauuu

SEQ ID NO: 811421 - RNA, 19 nt, Homo sapiens
gcaaagaccuucauuagca

SEQ ID NO: 811422 - RNA, 19 nt, Homo sapiens
ccacauugaucaugaaaua

SEQ ID NO: 811423 - RNA, 19 nt, Homo sapiens
gaguuuagguguucuauuu

SEQ ID NO: 811424 - RNA, 19 nt, Homo sapiens
uagaagagcuguuugcuuu

SEQ ID NO: 811425 - RNA, 19 nt, Homo sapiens
ggaaguauauucauaagug

SEQ ID NO: 811426 - RNA, 19 nt, Homo sapiens
gaagagagauggcccuuuc

SEQ ID NO: 811427 - RNA, 19 nt, Homo sapiens
gcaaggagguacgcuguua

SEQ ID NO: 811428 - RNA, 19 nt, Homo sapiens
gcucucaacugauauuuaa

SEQ ID NO: 811429 - RNA, 19 nt, Homo sapiens
gaagagugaccaauaauaa

SEQ ID NO: 811430 - RNA, 19 nt, Homo sapiens
gaaaggcaguucuggauug

SEQ ID NO: 811431 - RNA, 19 nt, Homo sapiens
gagcuaaagaucuguauua

SEQ ID NO: 811432 - RNA, 19 nt, Homo sapiens
aaacugugauccauucuua

SEQ ID NO: 811433 - RNA, 19 nt, Homo sapiens
gaauuucgcuggagagaug

SEQ ID NO: 811434 - RNA, 19 nt, Homo sapiens
gaacgccgcucaacuaucu

SEQ ID NO: 811435 - RNA, 19 nt, Homo sapiens
aaacauggcuaaauggaaa

SEQ ID NO: 811436 - RNA, 19 nt, Homo sapiens
gagaaagaacugugaauaa

SEQ ID NO: 811437 - RNA, 19 nt, Homo sapiens
gguacgcuguuaaguauua

SEQ ID NO: 811438 - RNA, 19 nt, Homo sapiens
gagguacgcuguuaaguau

SEQ ID NO: 811439 - RNA, 19 nt, Homo sapiens
gcuacaaacuucagaaaga

SEQ ID NO: 811440 - RNA, 19 nt, Homo sapiens
gugaauaucuacacaaaga

SEQ ID NO: 811441 - RNA, 19 nt, Homo sapiens
gagcaagcuuucauuacua

SEQ ID NO: 811442 - RNA, 19 nt, Homo sapiens
ugagaagagugaccaauaa

SEQ ID NO: 811443 - RNA, 19 nt, Homo sapiens
ucacggaaguauauucaua

SEQ ID NO: 811444 - RNA, 19 nt, Homo sapiens
ccagagauguggcuuuauu

SEQ ID NO: 811445 - RNA, 19 nt, Homo sapiens
gaagaaagagccaaugaug

SEQ ID NO: 811446 - RNA, 19 nt, Homo sapiens
ggccuuaaacuuucaauua

SEQ ID NO: 811447 - RNA, 19 nt, Homo sapiens
ggagguacgcuguuaagua

SEQ ID NO: 811448 - RNA, 19 nt, Homo sapiens
ggucuaacaucucaagcua

SEQ ID NO: 811449 - RNA, 19 nt, Homo sapiens
gagguggaguuucuuguaa

SEQ ID NO: 811450 - RNA, 19 nt, Homo sapiens
ggaccucaauucacacauu

SEQ ID NO: 811451 - RNA, 19 nt, Homo sapiens
gcacagaugccauuagaau

SEQ ID NO: 811452 - RNA, 19 nt, Homo sapiens
gaacuccuguugucucuuc

SEQ ID NO: 811453 - RNA, 19 nt, Homo sapiens
gacaagccguuaugaaaga

SEQ ID NO: 811454 - RNA, 19 nt, Homo sapiens
agacagauguuguugagaa

SEQ ID NO: 811455 - RNA, 19 nt, Homo sapiens
uaaaagcgcuauccaagua

SEQ ID NO: 811456 - RNA, 19 nt, Homo sapiens
ggagacauguggauucugu

SEQ ID NO: 811457 - RNA, 19 nt, Homo sapiens
gaagaucacuguggaacau

SEQ ID NO: 811458 - RNA, 19 nt, Homo sapiens
gagcagccauuaagcuuau

SEQ ID NO: 811459 - RNA, 19 nt, Homo sapiens
guucugggcucucaacuga

SEQ ID NO: 811460 - RNA, 19 nt, Homo sapiens
gcauaacgguggcuucuuc

SEQ ID NO: 811461 - RNA, 19 nt, Homo sapiens
cagaaugguugaacuuuga

SEQ ID NO: 811462 - RNA, 19 nt, Homo sapiens
gcagguaaaucgguucuga

SEQ ID NO: 811463 - RNA, 19 nt, Homo sapiens
ggagcaagcuuucauuacu

SEQ ID NO: 811464 - RNA, 19 nt, Homo sapiens
gaacaccagugauauacca

SEQ ID NO: 811465 - RNA, 19 nt, Homo sapiens
ucagaaacauggauugguu

SEQ ID NO: 811466 - RNA, 19 nt, Homo sapiens
aaagaugcguggaaauauu

SEQ ID NO: 811467 - RNA, 19 nt, Homo sapiens
gcuauggguuuguuuguga

SEQ ID NO: 811468 - RNA, 19 nt, Homo sapiens
uaugaaacauggcuaaaug

SEQ ID NO: 811469 - RNA, 19 nt, Homo sapiens
guagcuggcugcacaguga

SEQ ID NO: 811470 - RNA, 19 nt, Homo sapiens
uaaaccacauugaucauga

SEQ ID NO: 811471 - RNA, 19 nt, Homo sapiens
gcagaaguagguugugaua

SEQ ID NO: 811472 - RNA, 19 nt, Homo sapiens
cagcacagaugccauuaga

SEQ ID NO: 811473 - RNA, 19 nt, Homo sapiens
aaaggaagguucuaaucuu

SEQ ID NO: 811474 - RNA, 19 nt, Homo sapiens
uaacuggucuccauuugau

SEQ ID NO: 811475 - RNA, 19 nt, Homo sapiens
ggaagguucuaaucuuuua

SEQ ID NO: 811476 - RNA, 19 nt, Homo sapiens
gaagaguguucaguuucua

SEQ ID NO: 811477 - RNA, 19 nt, Homo sapiens
ggagagaagcugaagcauu

SEQ ID NO: 811478 - RNA, 19 nt, Homo sapiens
gaaagaacugugaauaauc

SEQ ID NO: 811479 - RNA, 19 nt, Homo sapiens
aaacauugcugcccuuaca

SEQ ID NO: 811480 - RNA, 19 nt, Homo sapiens
gaccucaauucacacauuu

SEQ ID NO: 811481 - RNA, 19 nt, Homo sapiens
guggagacauuugugaaua

SEQ ID NO: 811482 - RNA, 19 nt, Homo sapiens
gaguagagcuaaagaucug

SEQ ID NO: 811483 - RNA, 19 nt, Homo sapiens
acauuuaccugcacucgua

SEQ ID NO: 811484 - RNA, 19 nt, Homo sapiens
ucagauggguuuugauuua

SEQ ID NO: 811485 - RNA, 19 nt, Homo sapiens
gcaaauaugacuugguaug

SEQ ID NO: 811486 - RNA, 19 nt, Homo sapiens
gaaacacauuccucucugu

SEQ ID NO: 811487 - RNA, 19 nt, Homo sapiens
gagggacacuggaaaguca

SEQ ID NO: 811488 - RNA, 19 nt, Homo sapiens
gaguccaccuugccauaua

SEQ ID NO: 811489 - RNA, 19 nt, Homo sapiens
ucuaacaucucaagcuaaa

SEQ ID NO: 811490 - RNA, 19 nt, Homo sapiens
gaaggauuauggcagcuau

SEQ ID NO: 811491 - RNA, 19 nt, Homo sapiens
gaaaaccugugguauauuc

SEQ ID NO: 811492 - RNA, 19 nt, Homo sapiens
gaucuucucacaauucauu

SEQ ID NO: 811493 - RNA, 19 nt, Homo sapiens
agaaggaccucaauucaca

SEQ ID NO: 811494 - RNA, 19 nt, Homo sapiens
ggagaaggaccucaauuca

SEQ ID NO: 811495 - RNA, 19 nt, Homo sapiens
aaaagaaacucccuauuga

SEQ ID NO: 811496 - RNA, 19 nt, Homo sapiens
gguaaauuaugcauugguu

SEQ ID NO: 811497 - RNA, 19 nt, Homo sapiens
gcaaccaacuuuaguacag

SEQ ID NO: 811498 - RNA, 19 nt, Homo sapiens
ccaaaucuucuuucacuuu

SEQ ID NO: 811499 - RNA, 19 nt, Homo sapiens
agaaagagccaaugaugaa

SEQ ID NO: 811500 - RNA, 19 nt, Homo sapiens
cagauguuguugagaagua

SEQ ID NO: 811501 - RNA, 19 nt, Homo sapiens
ggacacaggaagagaaaga

SEQ ID NO: 811502 - RNA, 19 nt, Homo sapiens
gaacugggacacaggaaga

SEQ ID NO: 811503 - RNA, 19 nt, Homo sapiens
gaagcacugucggcacuuu

SEQ ID NO: 811504 - RNA, 19 nt, Homo sapiens
aaauguggccuuaaacuuu

SEQ ID NO: 811505 - RNA, 19 nt, Homo sapiens
ggaaggcuauggguuuguu

SEQ ID NO: 811506 - RNA, 19 nt, Homo sapiens
cuacaaacuucagaaagaa

SEQ ID NO: 811507 - RNA, 19 nt, Homo sapiens
gaagcaagcaagcaaacaa

SEQ ID NO: 811508 - RNA, 19 nt, Homo sapiens
ucaucugucuuucccuuua

SEQ ID NO: 811509 - RNA, 19 nt, Homo sapiens
aaggaagguucuaaucuuu

SEQ ID NO: 811510 - RNA, 19 nt, Homo sapiens
aaacaucuauucccuggau

SEQ ID NO: 811511 - RNA, 19 nt, Homo sapiens
ggaguggucugauagaacu

SEQ ID NO: 811512 - RNA, 19 nt, Homo sapiens
gaaacauggcuaaauggaa

SEQ ID NO: 811513 - RNA, 19 nt, Homo sapiens
ggaagagaaagaacuguga

SEQ ID NO: 811514 - RNA, 19 nt, Homo sapiens
gauaacagugcauuaauag

SEQ ID NO: 811515 - RNA, 19 nt, Homo sapiens
uggaaucccuacaaucgua

SEQ ID NO: 811516 - RNA, 19 nt, Homo sapiens
gacuugguaugcagcaaua

SEQ ID NO: 811517 - RNA, 19 nt, Homo sapiens
aaaggaaggcuauggguuu

SEQ ID NO: 811518 - RNA, 19 nt, Homo sapiens
ugaagacuguggaaaggaa

SEQ ID NO: 811519 - RNA, 19 nt, Homo sapiens
ccaaaggauggcuauauuu

SEQ ID NO: 811520 - RNA, 19 nt, Homo sapiens
gcaagaagaagaaagaaua

SEQ ID NO: 811521 - RNA, 19 nt, Homo sapiens
gaacagggcucaaauucuc

SEQ ID NO: 811522 - RNA, 19 nt, Homo sapiens
aaccaaaucuguacaguua

SEQ ID NO: 811523 - RNA, 19 nt, Homo sapiens
gcaaagcagcaaccaauua

SEQ ID NO: 811524 - RNA, 19 nt, Homo sapiens
ucacacagcucccuaauca

SEQ ID NO: 811525 - RNA, 19 nt, Homo sapiens
gaacaggauuccaggagaa

SEQ ID NO: 811526 - RNA, 19 nt, Homo sapiens
gaauucagaugcaagagaa

SEQ ID NO: 811527 - RNA, 19 nt, Homo sapiens
gaagaaccauugcuuuaca

SEQ ID NO: 811528 - RNA, 19 nt, Homo sapiens
ggaggcaccuucuaggauu

SEQ ID NO: 811529 - RNA, 19 nt, Homo sapiens
aaaagaagcugcuccauuu

SEQ ID NO: 811530 - RNA, 19 nt, Homo sapiens
gcugauggcuguucaauac

SEQ ID NO: 811531 - RNA, 19 nt, Homo sapiens
caaaguaccaugagaaaug

SEQ ID NO: 811532 - RNA, 19 nt, Homo sapiens
ccaaaucuguacaguuaaa

SEQ ID NO: 811533 - RNA, 19 nt, Homo sapiens
gcaaccaauuaucaguuua

SEQ ID NO: 811534 - RNA, 19 nt, Homo sapiens
gaacaagacugaaaaugga

SEQ ID NO: 811535 - RNA, 19 nt, Homo sapiens
ggaaagcacuggaauucag

SEQ ID NO: 811536 - RNA, 19 nt, Homo sapiens
guucgucgguuccuccuua

SEQ ID NO: 811537 - RNA, 19 nt, Homo sapiens
caccaucccugagucauua

SEQ ID NO: 811538 - RNA, 19 nt, Homo sapiens
gacuaaaccuguccuacaa

SEQ ID NO: 811539 - RNA, 19 nt, Homo sapiens
gcaaaugagacguaugaaa

SEQ ID NO: 811540 - RNA, 19 nt, Homo sapiens
gaagugaugaugcagauug

SEQ ID NO: 811541 - RNA, 19 nt, Homo sapiens
gaggauggguucauagaca

SEQ ID NO: 811542 - RNA, 19 nt, Homo sapiens
uaccaacgcuuaugccauu

SEQ ID NO: 811543 - RNA, 19 nt, Homo sapiens
cuacagauaugaucauucu

SEQ ID NO: 811544 - RNA, 19 nt, Homo sapiens
ucagagaaccagaggcuua

SEQ ID NO: 811545 - RNA, 19 nt, Homo sapiens
ccauuucacuuauugauuc

SEQ ID NO: 811546 - RNA, 19 nt, Homo sapiens
agaaaugucgguucagaua

SEQ ID NO: 811547 - RNA, 19 nt, Homo sapiens
aaaaggaacuugugaaaug

SEQ ID NO: 811548 - RNA, 19 nt, Homo sapiens
gcacuggaauucagaugca

SEQ ID NO: 811549 - RNA, 19 nt, Homo sapiens
cagguuaaaucaugaacuu

SEQ ID NO: 811550 - RNA, 19 nt, Homo sapiens
gauaugaucauucuguuuc

SEQ ID NO: 811551 - RNA, 19 nt, Homo sapiens
aaaugucgguucagauauu

SEQ ID NO: 811552 - RNA, 19 nt, Homo sapiens
aaaccuguccuacaaagua

SEQ ID NO: 811553 - RNA, 19 nt, Homo sapiens
gcgaauagcccagugaaug

SEQ ID NO: 811554 - RNA, 19 nt, Homo sapiens
uugcugaacuugguuauuu

SEQ ID NO: 811555 - RNA, 19 nt, Homo sapiens
gaagggaucaccugcuguu

SEQ ID NO: 811556 - RNA, 19 nt, Homo sapiens
caaagcagcaaccaauuau

SEQ ID NO: 811557 - RNA, 19 nt, Homo sapiens
caauucagcccaagccuuu

SEQ ID NO: 811558 - RNA, 19 nt, Homo sapiens
cagaugguauuauccagaa

SEQ ID NO: 811559 - RNA, 19 nt, Homo sapiens
cagcaaaugagacguauga

SEQ ID NO: 811560 - RNA, 19 nt, Homo sapiens
gcagcuggaugaaguugug

SEQ ID NO: 811561 - RNA, 19 nt, Homo sapiens
agacagcaacguaugauaa

SEQ ID NO: 811562 - RNA, 19 nt, Homo sapiens
ggacaucaacaaccaaauc

SEQ ID NO: 811563 - RNA, 19 nt, Homo sapiens
gaucagcagaggaaucaaa

SEQ ID NO: 811564 - RNA, 19 nt, Homo sapiens
gaugauaguauuggcauuu

SEQ ID NO: 811565 - RNA, 19 nt, Homo sapiens
uaaagucccuaguccaaag

SEQ ID NO: 811566 - RNA, 19 nt, Homo sapiens
caugagaaaugucgguuca

SEQ ID NO: 811567 - RNA, 19 nt, Homo sapiens
ggauuugucuucuaguucu

SEQ ID NO: 811568 - RNA, 19 nt, Homo sapiens
gcaauuggaagcagcaaau

SEQ ID NO: 811569 - RNA, 19 nt, Homo sapiens
cugaugagcugcaauugga

SEQ ID NO: 811570 - RNA, 19 nt, Homo sapiens
gggcaggacuacgaaguga

SEQ ID NO: 811571 - RNA, 19 nt, Homo sapiens
cugaagaaccauugcuuua

SEQ ID NO: 811572 - RNA, 19 nt, Homo sapiens
ucaguggacucuuauucuu

SEQ ID NO: 811573 - RNA, 19 nt, Homo sapiens
caaaugagacguaugaaaa

SEQ ID NO: 811574 - RNA, 19 nt, Homo sapiens
aaaccucucuucccucugu

SEQ ID NO: 811575 - RNA, 19 nt, Homo sapiens
ucaauuguguuaccagcaa

SEQ ID NO: 811576 - RNA, 19 nt, Homo sapiens
gaaaugucgguucagauau

SEQ ID NO: 811577 - RNA, 19 nt, Homo sapiens
ugagaaaugucgguucaga

SEQ ID NO: 811578 - RNA, 19 nt, Homo sapiens
ggaaucaaaccaacaccuu

SEQ ID NO: 811579 - RNA, 19 nt, Homo sapiens
ggaugaagauugggauucu

SEQ ID NO: 811580 - RNA, 19 nt, Homo sapiens
ggaauucagaugcaagaga

SEQ ID NO: 811581 - RNA, 19 nt, Homo sapiens
gaaagcacuggaauucaga

SEQ ID NO: 811582 - RNA, 19 nt, Homo sapiens
gaggcaccuucuaggauuu

SEQ ID NO: 811583 - RNA, 19 nt, Homo sapiens
gacagcaacguaugauaaa

SEQ ID NO: 811584 - RNA, 19 nt, Homo sapiens
ucucucagguuaaaucaug

SEQ ID NO: 811585 - RNA, 19 nt, Homo sapiens
acgagcaacugaagaaaga

SEQ ID NO: 811586 - RNA, 19 nt, Homo sapiens
cuaaggagacagcaacgua

SEQ ID NO: 811587 - RNA, 19 nt, Homo sapiens
acaccaggauccuccauau

SEQ ID NO: 811588 - RNA, 19 nt, Homo sapiens
uggaugaaguugugucaga

SEQ ID NO: 811589 - RNA, 19 nt, Homo sapiens
gcaccaucccugagucauu

SEQ ID NO: 811590 - RNA, 19 nt, Homo sapiens
gagaucagcagaggaauca

SEQ ID NO: 811591 - RNA, 19 nt, Homo sapiens
acaaguguauuaugcuuca

SEQ ID NO: 811592 - RNA, 19 nt, Homo sapiens
gaaccauugcuuuacauuc

SEQ ID NO: 811593 - RNA, 19 nt, Homo sapiens
gagcaacugaagaaagaaa

SEQ ID NO: 811594 - RNA, 19 nt, Homo sapiens
cuacccaucuauuuggaaa

SEQ ID NO: 811595 - RNA, 19 nt, Homo sapiens
ggaaaaggaacuugugaaa

SEQ ID NO: 811596 - RNA, 19 nt, Homo sapiens
agaguugucugugugauga

SEQ ID NO: 811597 - RNA, 19 nt, Homo sapiens
gagacagcaacguaugaua

SEQ ID NO: 811598 - RNA, 19 nt, Homo sapiens
ucaagcaccuggaguucug

SEQ ID NO: 811599 - RNA, 19 nt, Homo sapiens
ggugaaaacucuaauaguc

SEQ ID NO: 811600 - RNA, 19 nt, Homo sapiens
gaguuggauuugucuucua

SEQ ID NO: 811601 - RNA, 19 nt, Homo sapiens
acacagaaaccacuaguag

SEQ ID NO: 811602 - RNA, 19 nt, Homo sapiens
gaauauaugcuaggguuag

SEQ ID NO: 811603 - RNA, 19 nt, Homo sapiens
cuacaaaguaccaugagaa

SEQ ID NO: 811604 - RNA, 19 nt, Homo sapiens
ggaguuggauuugucuucu

SEQ ID NO: 811605 - RNA, 19 nt, Homo sapiens
caaccaaaucuguacaguu

SEQ ID NO: 811606 - RNA, 19 nt, Homo sapiens
uaauauccaccucuccuuu

SEQ ID NO: 811607 - RNA, 19 nt, Homo sapiens
gcaggacuacgaagugaug

SEQ ID NO: 811608 - RNA, 19 nt, Homo sapiens
uauguugugucauuucgaa

SEQ ID NO: 811609 - RNA, 19 nt, Homo sapiens
ggugcuaacugaagaacca

SEQ ID NO: 811610 - RNA, 19 nt, Homo sapiens
auuaaaggcugcccucuca

SEQ ID NO: 811611 - RNA, 19 nt, Homo sapiens
agaauccgcuugucagucu

SEQ ID NO: 811612 - RNA, 19 nt, Homo sapiens
aaaguaccaugagaaaugu

SEQ ID NO: 811613 - RNA, 19 nt, Homo sapiens
ccaauuaucaguuuacaac

SEQ ID NO: 811614 - RNA, 19 nt, Homo sapiens
ccugcauccuccaguguua

SEQ ID NO: 811615 - RNA, 19 nt, Homo sapiens
caucaucuacccaucuauu

SEQ ID NO: 811616 - RNA, 19 nt, Homo sapiens
ccaggauccuccauaucaa

SEQ ID NO: 811617 - RNA, 19 nt, Homo sapiens
guuaccagcaauaaacaua

SEQ ID NO: 811618 - RNA, 19 nt, Homo sapiens
gaaggggagacacauuuua

SEQ ID NO: 811619 - RNA, 19 nt, Homo sapiens
cuucgaggauggguucaua

SEQ ID NO: 811620 - RNA, 19 nt, Homo sapiens
gaccaaagccugaguuuaa

SEQ ID NO: 811621 - RNA, 19 nt, Homo sapiens
gaagaaccaaggaagauua

SEQ ID NO: 811622 - RNA, 19 nt, Homo sapiens
auacagagaugauauggua

SEQ ID NO: 811623 - RNA, 19 nt, Homo sapiens
gggcugugcuuuagcguua

SEQ ID NO: 811624 - RNA, 19 nt, Homo sapiens
ccaagaagaugaagaaugg

SEQ ID NO: 811625 - RNA, 19 nt, Homo sapiens
gaagaauggugacuguguu

SEQ ID NO: 811626 - RNA, 19 nt, Homo sapiens
gaagcggacuccuagaaga

SEQ ID NO: 811627 - RNA, 19 nt, Homo sapiens
caucccagcuggagauuaa

SEQ ID NO: 811628 - RNA, 19 nt, Homo sapiens
gcgagaauuugaaagauau

SEQ ID NO: 811629 - RNA, 19 nt, Homo sapiens
gagaggaaagcgagaauuu

SEQ ID NO: 811630 - RNA, 19 nt, Homo sapiens
ggaaagcgagaauuugaaa

SEQ ID NO: 811631 - RNA, 19 nt, Homo sapiens
gaggaaagcgagaauuuga

SEQ ID NO: 811632 - RNA, 19 nt, Homo sapiens
gacaauagauguugcuuuu

SEQ ID NO: 811633 - RNA, 19 nt, Homo sapiens
ugaaagauauggugggaau

SEQ ID NO: 811634 - RNA, 19 nt, Homo sapiens
gcugagaaguuuccagaug

SEQ ID NO: 811635 - RNA, 19 nt, Homo sapiens
gaugaagaauggugacugu

SEQ ID NO: 811636 - RNA, 19 nt, Homo sapiens
cagaugacccggaagauuu

SEQ ID NO: 811637 - RNA, 19 nt, Homo sapiens
gagcagaaguggugaugca

SEQ ID NO: 811638 - RNA, 19 nt, Homo sapiens
gcuggaaccuguuaaugga

SEQ ID NO: 811639 - RNA, 19 nt, Homo sapiens
gaacagaccagaccaaagc

SEQ ID NO: 811640 - RNA, 19 nt, Homo sapiens
ccaaagccguggugauuca

SEQ ID NO: 811641 - RNA, 19 nt, Homo sapiens
gagaugauaugguaaaaga

SEQ ID NO: 811642 - RNA, 19 nt, Homo sapiens
gggaauaccgacccuauga

SEQ ID NO: 811643 - RNA, 19 nt, Homo sapiens
gaggacgauucccauguuu

SEQ ID NO: 811644 - RNA, 19 nt, Homo sapiens
cagcaaggauggaaugaca

SEQ ID NO: 811645 - RNA, 19 nt, Homo sapiens
gaagaagaaacccaaguuc

SEQ ID NO: 811646 - RNA, 19 nt, Homo sapiens
cagaaguggugaugcaaga

SEQ ID NO: 811647 - RNA, 19 nt, Homo sapiens
caagagaugacuuuagaug

SEQ ID NO: 811648 - RNA, 19 nt, Homo sapiens
gaagaaacccaaguucaag

SEQ ID NO: 811649 - RNA, 19 nt, Homo sapiens
gaauaccgacccuaugaga

SEQ ID NO: 811650 - RNA, 19 nt, Homo sapiens
ggaagaaccaaggaagauu

SEQ ID NO: 811651 - RNA, 19 nt, Homo sapiens
ugaggacgauucccauguu

SEQ ID NO: 811652 - RNA, 19 nt, Homo sapiens
gcaggccauuucccaagaa

SEQ ID NO: 811653 - RNA, 19 nt, Homo sapiens
guaaagauaccagugaugu

SEQ ID NO: 811654 - RNA, 19 nt, Homo sapiens
cugagaaguuuccagauga

SEQ ID NO: 811655 - RNA, 19 nt, Homo sapiens
gagcugagcggagauccua

SEQ ID NO: 811656 - RNA, 19 nt, Homo sapiens
gaaaccagaauccacuguu

SEQ ID NO: 811657 - RNA, 19 nt, Homo sapiens
uucaagagaugacuuuaga

SEQ ID NO: 811658 - RNA, 19 nt, Homo sapiens
cagccaaaguuccugaguu

SEQ ID NO: 811659 - RNA, 19 nt, Homo sapiens
ggagggagucgcagaagga

SEQ ID NO: 811660 - RNA, 19 nt, Homo sapiens
ugagaaguuuccagaugaa

SEQ ID NO: 811661 - RNA, 19 nt, Homo sapiens
ucccugcgcugucuugaaa

SEQ ID NO: 811662 - RNA, 19 nt, Homo sapiens
gacuuuagaugaguggaaa

SEQ ID NO: 811663 - RNA, 19 nt, Homo sapiens
aaaccagaauccacuguuc

SEQ ID NO: 811664 - RNA, 19 nt, Homo sapiens
gagaugacuuuagaugagu

SEQ ID NO: 811665 - RNA, 19 nt, Homo sapiens
agaagaaacccaaguucaa

SEQ ID NO: 811666 - RNA, 19 nt, Homo sapiens
gaaguggugaugcaagaug

SEQ ID NO: 811667 - RNA, 19 nt, Homo sapiens
agagaugacuuuagaugag

SEQ ID NO: 811668 - RNA, 19 nt, Homo sapiens
gaaccaaggaagauuaaaa

SEQ ID NO: 811669 - RNA, 19 nt, Homo sapiens
gucagacucuaagacaaua

SEQ ID NO: 811670 - RNA, 19 nt, Homo sapiens
ggagggcagagaacaacua

SEQ ID NO: 811671 - RNA, 19 nt, Homo sapiens
agcgagaauuugaaagaua

SEQ ID NO: 811672 - RNA, 19 nt, Homo sapiens
gaucgagacagaccguuga

SEQ ID NO: 811673 - RNA, 19 nt, Homo sapiens
ccccggagguuguaaaaua

SEQ ID NO: 811674 - RNA, 19 nt, Homo sapiens
gaaacccgccaaugacauc

SEQ ID NO: 811675 - RNA, 19 nt, Homo sapiens
agccaaaguuccugaguug

SEQ ID NO: 811676 - RNA, 19 nt, Homo sapiens
aaagauauggugggaauga

SEQ ID NO: 811677 - RNA, 19 nt, Homo sapiens
aaagcgagaauuugaaaga

SEQ ID NO: 811678 - RNA, 19 nt, Homo sapiens
ccauggagacucuuaggaa

SEQ ID NO: 811679 - RNA, 19 nt, Homo sapiens
cagaagcggacuccuagaa

SEQ ID NO: 811680 - RNA, 19 nt, Homo sapiens
gagcagcaaggauggaaug

SEQ ID NO: 811681 - RNA, 19 nt, Homo sapiens
gguaaaagaugacuaugag

SEQ ID NO: 811682 - RNA, 19 nt, Homo sapiens
gaagacaacauggguggau

SEQ ID NO: 811683 - RNA, 19 nt, Homo sapiens
ggagauccuacagggaaua

SEQ ID NO: 811684 - RNA, 19 nt, Homo sapiens
ccagaugacccggaagauu

SEQ ID NO: 811685 - RNA, 19 nt, Homo sapiens
aaacccaaguucaagagau

SEQ ID NO: 811686 - RNA, 19 nt, Homo sapiens
ggccagaagcggacuccua

SEQ ID NO: 811687 - RNA, 19 nt, Homo sapiens
uggaaccuguuaauggaaa

SEQ ID NO: 811688 - RNA, 19 nt, Homo sapiens
gaaacccaaguucaagaga

SEQ ID NO: 811689 - RNA, 19 nt, Homo sapiens
agaagaagaaacccaaguu

SEQ ID NO: 811690 - RNA, 19 nt, Homo sapiens
caacuaucccagagcagaa

SEQ ID NO: 811691 - RNA, 19 nt, Homo sapiens
gagcuggaaccuguuaaug

SEQ ID NO: 811692 - RNA, 19 nt, Homo sapiens
uagaggaaaccacauagga

SEQ ID NO: 811693 - RNA, 19 nt, Homo sapiens
acagagaugauaugguaaa

SEQ ID NO: 811694 - RNA, 19 nt, Homo sapiens
ugaguuggagguagaagaa

SEQ ID NO: 811695 - RNA, 19 nt, Homo sapiens
ugaagaauggugacugugu

SEQ ID NO: 811696 - RNA, 19 nt, Homo sapiens
uaacauccggaaaccagaa

SEQ ID NO: 811697 - RNA, 19 nt, Homo sapiens
uagguuugaucgagacaga

SEQ ID NO: 811698 - RNA, 19 nt, Homo sapiens
caaaauagcagucagaacu

SEQ ID NO: 811699 - RNA, 19 nt, Homo sapiens
gauauggugggaaugacaa

SEQ ID NO: 811700 - RNA, 19 nt, Homo sapiens
gggcagagaacaacuaucc

SEQ ID NO: 811701 - RNA, 19 nt, Homo sapiens
ggaaacccgccaaugacau

SEQ ID NO: 811702 - RNA, 19 nt, Homo sapiens
agaccaaagccugaguuua

SEQ ID NO: 811703 - RNA, 19 nt, Homo sapiens
caagaacagaccagaccaa

SEQ ID NO: 811704 - RNA, 19 nt, Homo sapiens
aagaagaaacccaaguuca

SEQ ID NO: 811705 - RNA, 19 nt, Homo sapiens
agucacagcuggagguuuu

SEQ ID NO: 811706 - RNA, 19 nt, Homo sapiens
ggagcuggaaccuguuaau

SEQ ID NO: 811707 - RNA, 19 nt, Homo sapiens
cguuagaggaaaccacaua

SEQ ID NO: 811708 - RNA, 19 nt, Homo sapiens
ucccgugucauguaaauuu

SEQ ID NO: 811709 - RNA, 19 nt, Homo sapiens
cgugucauguaaauuuguu

SEQ ID NO: 811710 - RNA, 19 nt, Homo sapiens
gagggcagagaacaacuau

SEQ ID NO: 811711 - RNA, 19 nt, Homo sapiens
ggaaaccagaauccacugu

SEQ ID NO: 811712 - RNA, 19 nt, Homo sapiens
aagagaugacuuuagauga

SEQ ID NO: 811713 - RNA, 19 nt, Homo sapiens
ggagguagaagaagaaacc

SEQ ID NO: 811714 - RNA, 19 nt, Homo sapiens
ggccauuucccaagaagau

SEQ ID NO: 811715 - RNA, 19 nt, Homo sapiens
agacaauagauguugcuuu

SEQ ID NO: 811716 - RNA, 19 nt, Homo sapiens
ucacaucccagcuggagau

SEQ ID NO: 811717 - RNA, 19 nt, Homo sapiens
gaaagcgagaauuugaaag

SEQ ID NO: 811718 - RNA, 19 nt, Homo sapiens
aagaaccaaggaagauuaa

SEQ ID NO: 811719 - RNA, 19 nt, Homo sapiens
uaggagcuggaaccuguua

SEQ ID NO: 811720 - RNA, 19 nt, Homo sapiens
ggaccaauauuguugauaa

SEQ ID NO: 811721 - RNA, 19 nt, Homo sapiens
gaaaugaaguguccuuugu

SEQ ID NO: 811722 - RNA, 19 nt, Homo sapiens
ggagugagauuauuaaagu

SEQ ID NO: 811723 - RNA, 19 nt, Homo sapiens
ggucaacccuuggauuaua

SEQ ID NO: 811724 - RNA, 19 nt, Homo sapiens
gcagauuccuggugauuug

SEQ ID NO: 811725 - RNA, 19 nt, Homo sapiens
gaaaucaaauccuccaagu

SEQ ID NO: 811726 - RNA, 19 nt, Homo sapiens
caaggaaccucagcugaaa

SEQ ID NO: 811727 - RNA, 19 nt, Homo sapiens
gagaaucccugcagguaau

SEQ ID NO: 811728 - RNA, 19 nt, Homo sapiens
ggaaucagcccaucuaaag

SEQ ID NO: 811729 - RNA, 19 nt, Homo sapiens
gaaguguccuuuguuauuc

SEQ ID NO: 811730 - RNA, 19 nt, Homo sapiens
aaugaaguguccuuuguua

SEQ ID NO: 811731 - RNA, 19 nt, Homo sapiens
gauauuuguucaucacuug

SEQ ID NO: 811732 - RNA, 19 nt, Homo sapiens
ggacaagaauugagcaacu

SEQ ID NO: 811733 - RNA, 19 nt, Homo sapiens
gcacagggagugagauuau

SEQ ID NO: 811734 - RNA, 19 nt, Homo sapiens
gcacgggguugauuaauuu

SEQ ID NO: 811735 - RNA, 19 nt, Homo sapiens
ggaauaaaguaaagauggu

SEQ ID NO: 811736 - RNA, 19 nt, Homo sapiens
ugacgucucucccucuaaa

SEQ ID NO: 811737 - RNA, 19 nt, Homo sapiens
uaacacacacacaaaguaa

SEQ ID NO: 811738 - RNA, 19 nt, Homo sapiens
ggaugguucucaagaguug

SEQ ID NO: 811739 - RNA, 19 nt, Homo sapiens
agagagaucuuauaaugca

SEQ ID NO: 811740 - RNA, 19 nt, Homo sapiens
gcagguaauauuugacuuu

SEQ ID NO: 811741 - RNA, 19 nt, Homo sapiens
guucaucacuuggguagaa

SEQ ID NO: 811742 - RNA, 19 nt, Homo sapiens
guaacacacacacaaagua

SEQ ID NO: 811743 - RNA, 19 nt, Homo sapiens
ggagaaucccugcagguaa

SEQ ID NO: 811744 - RNA, 19 nt, Homo sapiens
ggaagaggcgucccaggaa

SEQ ID NO: 811745 - RNA, 19 nt, Homo sapiens
gaaguuguuuggaccuuag

SEQ ID NO: 811746 - RNA, 19 nt, Homo sapiens
ugaaguguccuuuguuauu

SEQ ID NO: 811747 - RNA, 19 nt, Homo sapiens
gcagaccacggacuucuuu

SEQ ID NO: 811748 - RNA, 19 nt, Homo sapiens
uaaaguaacacacacacaa

SEQ ID NO: 811749 - RNA, 19 nt, Homo sapiens
caaaguaagaugaagcuau

SEQ ID NO: 811750 - RNA, 19 nt, Homo sapiens
gacaagaauugagcaacuu

SEQ ID NO: 811751 - RNA, 19 nt, Homo sapiens
ggauauuuguucaucacuu

SEQ ID NO: 811752 - RNA, 19 nt, Homo sapiens
gaugaaagaacagaaguug

SEQ ID NO: 811753 - RNA, 19 nt, Homo sapiens
guggucaacccuuggauua

SEQ ID NO: 811754 - RNA, 19 nt, Homo sapiens
guucaaaugccuccucuga

SEQ ID NO: 811755 - RNA, 19 nt, Homo sapiens
caggaagccauguucaaua

SEQ ID NO: 811756 - RNA, 19 nt, Homo sapiens
ggagcuggccuaucaggaa

SEQ ID NO: 811757 - RNA, 19 nt, Homo sapiens
aggaagccauguucaauau

SEQ ID NO: 811758 - RNA, 19 nt, Homo sapiens
caaggccaguggacgguuu

SEQ ID NO: 811759 - RNA, 19 nt, Homo sapiens
caauauggcuacccucaac

SEQ ID NO: 811760 - RNA, 19 nt, Homo sapiens
gucaacccuuggauuauaa

SEQ ID NO: 811761 - RNA, 19 nt, Homo sapiens
ugacaagccgcgaguuauu

SEQ ID NO: 811762 - RNA, 19 nt, Homo sapiens
ugauuugucugccaagaga

SEQ ID NO: 811763 - RNA, 19 nt, Homo sapiens
gcccaccaauggcuggaua

SEQ ID NO: 811764 - RNA, 19 nt, Homo sapiens
gaucuuauaaugcaacauc

SEQ ID NO: 811765 - RNA, 19 nt, Homo sapiens
ggccggagcuucucgaacu

SEQ ID NO: 811766 - RNA, 19 nt, Homo sapiens
ucaaggaaccucagcugaa

SEQ ID NO: 811767 - RNA, 19 nt, Homo sapiens
caacaaagaaaugaagugu

SEQ ID NO: 811768 - RNA, 19 nt, Homo sapiens
uaacgccacucauggucaa

SEQ ID NO: 811769 - RNA, 19 nt, Homo sapiens
caucugacuuggucucugu

SEQ ID NO: 811770 - RNA, 19 nt, Homo sapiens
acagggagugagauuauua

SEQ ID NO: 811771 - RNA, 19 nt, Homo sapiens
gugccaacgugcugaguga

SEQ ID NO: 811772 - RNA, 19 nt, Homo sapiens
uagaagaucccuacaugau

SEQ ID NO: 811773 - RNA, 19 nt, Homo sapiens
ugagcaacuugucugauga

SEQ ID NO: 811774 - RNA, 19 nt, Homo sapiens
ccucaguggucauuaagau

SEQ ID NO: 811775 - RNA, 19 nt, Homo sapiens
agaaguuguuuggaccuua

SEQ ID NO: 811776 - RNA, 19 nt, Homo sapiens
ggaugcggcugaggaagga

SEQ ID NO: 811777 - RNA, 19 nt, Homo sapiens
aaaguaacacacacacaaa

SEQ ID NO: 811778 - RNA, 19 nt, Homo sapiens
guacggagagggucaccaa

SEQ ID NO: 811779 - RNA, 19 nt, Homo sapiens
gaguagcgcuagggagaau

SEQ ID NO: 811780 - RNA, 19 nt, Homo sapiens
uaucacaggcuuuggcauu

SEQ ID NO: 811781 - RNA, 19 nt, Homo sapiens
guaguaugccaaccaaaug

SEQ ID NO: 811782 - RNA, 19 nt, Homo sapiens
gacuuggucucuguuaaug

SEQ ID NO: 811783 - RNA, 19 nt, Homo sapiens
aaucaaauccuccaaguac

SEQ ID NO: 811784 - RNA, 19 nt, Homo sapiens
cauauuaaucugaguggaa

SEQ ID NO: 811785 - RNA, 19 nt, Homo sapiens
gaguaugagugaggaggaa

SEQ ID NO: 811786 - RNA, 19 nt, Homo sapiens
gaaggagggacggcaguga

SEQ ID NO: 811787 - RNA, 19 nt, Homo sapiens
aaagguaacgccacucaug

SEQ ID NO: 811788 - RNA, 19 nt, Homo sapiens
gacaagccgcgaguuauug

SEQ ID NO: 811789 - RNA, 19 nt, Homo sapiens
agguggagcuggccuauca

SEQ ID NO: 811790 - RNA, 19 nt, Homo sapiens
acacacacaaaguaaauug

SEQ ID NO: 811791 - RNA, 19 nt, Homo sapiens
gcaaaacaacaaagaaaug

SEQ ID NO: 811792 - RNA, 19 nt, Homo sapiens
ggaguugccacuguaguau

SEQ ID NO: 811793 - RNA, 19 nt, Homo sapiens
gcagugaccggugggcaaa

SEQ ID NO: 811794 - RNA, 19 nt, Homo sapiens
uugagcaacuugucugaug

SEQ ID NO: 811795 - RNA, 19 nt, Homo sapiens
gagagaucuuauaaugcaa

SEQ ID NO: 811796 - RNA, 19 nt, Homo sapiens
acacacacacaaaguaaau

SEQ ID NO: 811797 - RNA, 19 nt, Homo sapiens
ucacggaugguucucaaga

SEQ ID NO: 811798 - RNA, 19 nt, Homo sapiens
gcuccugacaguucaaaug

SEQ ID NO: 811799 - RNA, 19 nt, Homo sapiens
guggaucguuggcauugug

SEQ ID NO: 811800 - RNA, 19 nt, Homo sapiens
gcccaugcggccacagaua

SEQ ID NO: 811801 - RNA, 19 nt, Homo sapiens
ggaggaacgcgaaaaggua

SEQ ID NO: 811802 - RNA, 19 nt, Homo sapiens
aaugacgucucucccucua

SEQ ID NO: 811803 - RNA, 19 nt, Homo sapiens
ugacuuggucucuguuaau

SEQ ID NO: 811804 - RNA, 19 nt, Homo sapiens
gggaaaggaggaccugcaa

SEQ ID NO: 811805 - RNA, 19 nt, Homo sapiens
aaaucaaauccuccaagua

SEQ ID NO: 811806 - RNA, 19 nt, Homo sapiens
gagaucuuauaaugcaaca

SEQ ID NO: 811807 - RNA, 19 nt, Homo sapiens
cacagggagugagauuauu

SEQ ID NO: 811808 - RNA, 19 nt, Homo sapiens
gcauuccgaggccagagua

SEQ ID NO: 811809 - RNA, 19 nt, Homo sapiens
aaucacggaugguucucaa

SEQ ID NO: 811810 - RNA, 19 nt, Homo sapiens
gagaugaaagaacagaagu

SEQ ID NO: 811811 - RNA, 19 nt, Homo sapiens
gaucguuggcauuguggaa

SEQ ID NO: 811812 - RNA, 19 nt, Homo sapiens
gaacaggcggcucgcuuuu

SEQ ID NO: 811813 - RNA, 19 nt, Homo sapiens
agaaaugaaguguccuuug

SEQ ID NO: 811814 - RNA, 19 nt, Homo sapiens
cacaggcuuuggcauucua

SEQ ID NO: 811815 - RNA, 19 nt, Homo sapiens
gccggagcuucucgaacua

SEQ ID NO: 811816 - RNA, 19 nt, Homo sapiens
ucugaugacugggaaagga

SEQ ID NO: 811817 - RNA, 19 nt, Homo sapiens
cacacaaaguaaauugcaa

SEQ ID NO: 811818 - RNA, 19 nt, Homo sapiens
cagggagugagauuauuaa

SEQ ID NO: 811819 - RNA, 19 nt, Homo sapiens
aggccucaguggucauuaa

SEQ ID NO: 811820 - RNA, 19 nt, Homo sapiens
ggaaagggauaaagugaug

SEQ ID NO: 811821 - RNA, 19 nt, Homo sapiens
ccaagaagaugagcaguuu

SEQ ID NO: 811822 - RNA, 19 nt, Homo sapiens
gcaagcagcucgguucugu

SEQ ID NO: 811823 - RNA, 19 nt, Homo sapiens
gacaaaagcuuccggcuaa

SEQ ID NO: 811824 - RNA, 19 nt, Homo sapiens
aaagugaugccucugauua

SEQ ID NO: 811825 - RNA, 19 nt, Homo sapiens
ccugagaaauggaauaaga

SEQ ID NO: 811826 - RNA, 19 nt, Homo sapiens
caccaagcauggauuauug

SEQ ID NO: 811827 - RNA, 19 nt, Homo sapiens
gaagcaggaacaucuguaa

SEQ ID NO: 811828 - RNA, 19 nt, Homo sapiens
ggagaaccacuuccaagaa

SEQ ID NO: 811829 - RNA, 19 nt, Homo sapiens
ggauaucccugagaaaugg

SEQ ID NO: 811830 - RNA, 19 nt, Homo sapiens
ucagugaccucuaugcaau

SEQ ID NO: 811831 - RNA, 19 nt, Homo sapiens
gcgagccgguggauccaua

SEQ ID NO: 811832 - RNA, 19 nt, Homo sapiens
agacgacccuuacaugaug

SEQ ID NO: 811833 - RNA, 19 nt, Homo sapiens
ucccuuaucacuucaauua

SEQ ID NO: 811834 - RNA, 19 nt, Homo sapiens
gaauuuaucaugccagaca

SEQ ID NO: 811835 - RNA, 19 nt, Homo sapiens
gauaaagugaugccucuga

SEQ ID NO: 811836 - RNA, 19 nt, Homo sapiens
uaaagacgcagcugaggaa

SEQ ID NO: 811837 - RNA, 19 nt, Homo sapiens
guagacgacccuuacauga

SEQ ID NO: 811838 - RNA, 19 nt, Homo sapiens
gaagggcacaggcugcaaa

SEQ ID NO: 811839 - RNA, 19 nt, Homo sapiens
gccgguggauccauaaaga

SEQ ID NO: 811840 - RNA, 19 nt, Homo sapiens
cgaggugucguuuguaauu

SEQ ID NO: 811841 - RNA, 19 nt, Homo sapiens
gugccaauguccucaguga

SEQ ID NO: 811842 - RNA, 19 nt, Homo sapiens
ggccaccucuuaaucuaga

SEQ ID NO: 811843 - RNA, 19 nt, Homo sapiens
ggaagcaggaacaucugua

SEQ ID NO: 811844 - RNA, 19 nt, Homo sapiens
ucaaaccacagauuacauu

SEQ ID NO: 811845 - RNA, 19 nt, Homo sapiens
gggcuuuccuugguucaaa

SEQ ID NO: 811846 - RNA, 19 nt, Homo sapiens
cuauuucccuuaucacuuc

SEQ ID NO: 811847 - RNA, 19 nt, Homo sapiens
gagcaaggccugcggaaac

SEQ ID NO: 811848 - RNA, 19 nt, Homo sapiens
cccggaaaguuacgaauug

SEQ ID NO: 811849 - RNA, 19 nt, Homo sapiens
gcacagccagaaucauaga

SEQ ID NO: 811850 - RNA, 19 nt, Homo sapiens
ccaccaagcauggauuauu

SEQ ID NO: 811851 - RNA, 19 nt, Homo sapiens
gggcacaggcugcaaagug

SEQ ID NO: 811852 - RNA, 19 nt, Homo sapiens
cacggaaugugacaauaug

SEQ ID NO: 811853 - RNA, 19 nt, Homo sapiens
uuauugggauuguagagaa

SEQ ID NO: 811854 - RNA, 19 nt, Homo sapiens
guacuaaaccccuggauug

SEQ ID NO: 811855 - RNA, 19 nt, Homo sapiens
caaaccacagauuacauuu

SEQ ID NO: 811856 - RNA, 19 nt, Homo sapiens
aaccacagauuacauuuac

SEQ ID NO: 811857 - RNA, 19 nt, Homo sapiens
gaggugucguuuguaauuc

SEQ ID NO: 811858 - RNA, 19 nt, Homo sapiens
caggauagcgugugccaau

SEQ ID NO: 811859 - RNA, 19 nt, Homo sapiens
ggaauggauacuuguguca

SEQ ID NO: 811860 - RNA, 19 nt, Homo sapiens
ggccaccaagcauggauua

SEQ ID NO: 811861 - RNA, 19 nt, Homo sapiens
agacgcagcugaggaagca

SEQ ID NO: 811862 - RNA, 19 nt, Homo sapiens
gcggccuucugaucuguuu

SEQ ID NO: 811863 - RNA, 19 nt, Homo sapiens
ccaacccaaugaauuuauc

SEQ ID NO: 811864 - RNA, 19 nt, Homo sapiens
gauagcgugugccaauguc

SEQ ID NO: 811865 - RNA, 19 nt, Homo sapiens
ggauagcgugugccaaugu

SEQ ID NO: 811866 - RNA, 19 nt, Homo sapiens
cagccagaaucauagacaa

SEQ ID NO: 811867 - RNA, 19 nt, Homo sapiens
gaacauggcgaggcucaac

SEQ ID NO: 811868 - RNA, 19 nt, Homo sapiens
ggcuggauaucccugagaa

SEQ ID NO: 811869 - RNA, 19 nt, Homo sapiens
uaaagugaugccucugauu

SEQ ID NO: 811870 - RNA, 19 nt, Homo sapiens
cgcagaaccuggccaagca

SEQ ID NO: 811871 - RNA, 19 nt, Homo sapiens
gcaaagugccccaagaugu

SEQ ID NO: 811872 - RNA, 19 nt, Homo sapiens
cgaggucgcaccacaagug

SEQ ID NO: 811873 - RNA, 19 nt, Homo sapiens
ggacucaugcacacguuca

SEQ ID NO: 811874 - RNA, 19 nt, Homo sapiens
cugccaacccaaugaauuu

SEQ ID NO: 811875 - RNA, 19 nt, Homo sapiens
ugaggaagcaggaacaucu

SEQ ID NO: 811876 - RNA, 19 nt, Homo sapiens
agaucuauuucccuuauca

SEQ ID NO: 811877 - RNA, 19 nt, Homo sapiens
uuaggucgguuuguaagug

SEQ ID NO: 811878 - RNA, 19 nt, Homo sapiens
caucacgggcuucgggauu

SEQ ID NO: 811879 - RNA, 19 nt, Homo sapiens
gcuuccggcuaaccagauu

SEQ ID NO: 811880 - RNA, 19 nt, Homo sapiens
gcaaagcgagccgguggau

SEQ ID NO: 811881 - RNA, 19 nt, Homo sapiens
gggaaagggauaaagugau

SEQ ID NO: 811882 - RNA, 19 nt, Homo sapiens
uggaaucuuuacaggagaa

SEQ ID NO: 811883 - RNA, 19 nt, Homo sapiens
cgacagggaaagggauaaa

SEQ ID NO: 811884 - RNA, 19 nt, Homo sapiens
cuacgcgggaguccuuuaa

SEQ ID NO: 811885 - RNA, 19 nt, Homo sapiens
auaaagugaugccucugau

SEQ ID NO: 811886 - RNA, 19 nt, Homo sapiens
guucaaaccacagauuaca

SEQ ID NO: 811887 - RNA, 19 nt, Homo sapiens
cguagacgacccuuacaug

SEQ ID NO: 811888 - RNA, 19 nt, Homo sapiens
uguccucagugaccucuau

SEQ ID NO: 811889 - RNA, 19 nt, Homo sapiens
uuacaugaugggcaggaua

SEQ ID NO: 811890 - RNA, 19 nt, Homo sapiens
acauuuacccgaucguaga

SEQ ID NO: 811891 - RNA, 19 nt, Homo sapiens
aggaggcgaugaugaacau

SEQ ID NO: 811892 - RNA, 19 nt, Homo sapiens
cccaagauguccugcaaaa

SEQ ID NO: 811893 - RNA, 19 nt, Homo sapiens
uagacgacccuuacaugau

SEQ ID NO: 811894 - RNA, 19 nt, Homo sapiens
gcauggauuauugggauug

SEQ ID NO: 811895 - RNA, 19 nt, Homo sapiens
ccaagcagcagaggaacga

SEQ ID NO: 811896 - RNA, 19 nt, Homo sapiens
caacccaaugaauuuauca

SEQ ID NO: 811897 - RNA, 19 nt, Homo sapiens
caaggccugcggaaacaug

SEQ ID NO: 811898 - RNA, 19 nt, Homo sapiens
caggacucaugcacacguu

SEQ ID NO: 811899 - RNA, 19 nt, Homo sapiens
gccaacccaaugaauuuau

SEQ ID NO: 811900 - RNA, 19 nt, Homo sapiens
cagggaaagggauaaagug

SEQ ID NO: 811901 - RNA, 19 nt, Homo sapiens
uggauaucccugagaaaug

SEQ ID NO: 811902 - RNA, 19 nt, Homo sapiens
gaauggauacuugugucau

SEQ ID NO: 811903 - RNA, 19 nt, Homo sapiens
uuauucaggcgacgcuuaa

SEQ ID NO: 811904 - RNA, 19 nt, Homo sapiens
gaauagagguaucaucaaa

SEQ ID NO: 811905 - RNA, 19 nt, Homo sapiens
caucaaacguggcaaauuu

SEQ ID NO: 811906 - RNA, 19 nt, Homo sapiens
ggacaugaauaguguguuu

SEQ ID NO: 811907 - RNA, 19 nt, Homo sapiens
gaaacauacuguacaagaa

SEQ ID NO: 811908 - RNA, 19 nt, Homo sapiens
guacugagauugacccaaa

SEQ ID NO: 811909 - RNA, 19 nt, Homo sapiens
gaaaugaaggccugaaauu

SEQ ID NO: 811910 - RNA, 19 nt, Homo sapiens
caagagagguuuagaacau

SEQ ID NO: 811911 - RNA, 19 nt, Homo sapiens
aaacagcauugauagguua

SEQ ID NO: 811912 - RNA, 19 nt, Homo sapiens
gaaagaacacuaacacaug

SEQ ID NO: 811913 - RNA, 19 nt, Homo sapiens
cauaauggcuaguugauau

SEQ ID NO: 811914 - RNA, 19 nt, Homo sapiens
caauagguguugacuuuaa

SEQ ID NO: 811915 - RNA, 19 nt, Homo sapiens
acacugaucucugcuauuu

SEQ ID NO: 811916 - RNA, 19 nt, Homo sapiens
ggaaauaaggcuaaacuug

SEQ ID NO: 811917 - RNA, 19 nt, Homo sapiens
gcauauugcuuccagauuc

SEQ ID NO: 811918 - RNA, 19 nt, Homo sapiens
guucacagaugauacguuu

SEQ ID NO: 811919 - RNA, 19 nt, Homo sapiens
gaauaaauauagccugcuu

SEQ ID NO: 811920 - RNA, 19 nt, Homo sapiens
ucaguaagauuccaguauu

SEQ ID NO: 811921 - RNA, 19 nt, Homo sapiens
gaaauuccaucucuugcau

SEQ ID NO: 811922 - RNA, 19 nt, Homo sapiens
gcaguuuguucucuguaua

SEQ ID NO: 811923 - RNA, 19 nt, Homo sapiens
caacuuguacagacuaaua

SEQ ID NO: 811924 - RNA, 19 nt, Homo sapiens
ggaaacauacuguacaaga

SEQ ID NO: 811925 - RNA, 19 nt, Homo sapiens
caguaagauuccaguauua

SEQ ID NO: 811926 - RNA, 19 nt, Homo sapiens
ccagguaccuuaacuguag

SEQ ID NO: 811927 - RNA, 19 nt, Homo sapiens
caaauuauguggcuuucau

SEQ ID NO: 811928 - RNA, 19 nt, Homo sapiens
gaaagcauuccauguuauu

SEQ ID NO: 811929 - RNA, 19 nt, Homo sapiens
gaaagugagaaccagaaua

SEQ ID NO: 811930 - RNA, 19 nt, Homo sapiens
aaagugagaaccagaauaa

SEQ ID NO: 811931 - RNA, 19 nt, Homo sapiens
acgaaagcauuccauguua

SEQ ID NO: 811932 - RNA, 19 nt, Homo sapiens
gaacauuaacucccagcua

SEQ ID NO: 811933 - RNA, 19 nt, Homo sapiens
cuagaaauuuggagaaaga

SEQ ID NO: 811934 - RNA, 19 nt, Homo sapiens
ggaauaauaaagagcauga

SEQ ID NO: 811935 - RNA, 19 nt, Homo sapiens
uauaaacucugggaaauuc

SEQ ID NO: 811936 - RNA, 19 nt, Homo sapiens
gaauaaaggagucaaacug

SEQ ID NO: 811937 - RNA, 19 nt, Homo sapiens
aaagaacacuaacacaugu

SEQ ID NO: 811938 - RNA, 19 nt, Homo sapiens
cauguuggguucuuucuga

SEQ ID NO: 811939 - RNA, 19 nt, Homo sapiens
uuccaucucuugcauauuu

SEQ ID NO: 811940 - RNA, 19 nt, Homo sapiens
cgaaagcauuccauguuau

SEQ ID NO: 811941 - RNA, 19 nt, Homo sapiens
ugaagucgauagaaaugaa

SEQ ID NO: 811942 - RNA, 19 nt, Homo sapiens
agagagguuuagaacauua

SEQ ID NO: 811943 - RNA, 19 nt, Homo sapiens
ugcacaggguguuauauua

SEQ ID NO: 811944 - RNA, 19 nt, Homo sapiens
gagauugacccaaacaaau

SEQ ID NO: 811945 - RNA, 19 nt, Homo sapiens
gguaguguuuguccaggua

SEQ ID NO: 811946 - RNA, 19 nt, Homo sapiens
gcaaaauucucaucacaga

SEQ ID NO: 811947 - RNA, 19 nt, Homo sapiens
agugacaucuuucuguaua

SEQ ID NO: 811948 - RNA, 19 nt, Homo sapiens
uaaacaugcuaguuggaaa

SEQ ID NO: 811949 - RNA, 19 nt, Homo sapiens
gaaaauacugucacaauga

SEQ ID NO: 811950 - RNA, 19 nt, Homo sapiens
ggaaaauacugucacaaug

SEQ ID NO: 811951 - RNA, 19 nt, Homo sapiens
ccaggccaauuuauaacua

SEQ ID NO: 811952 - RNA, 19 nt, Homo sapiens
guuauaaacucugggaaau

SEQ ID NO: 811953 - RNA, 19 nt, Homo sapiens
ggauuguugucuugauuug

SEQ ID NO: 811954 - RNA, 19 nt, Homo sapiens
gagcaugauuccacagcuu

SEQ ID NO: 811955 - RNA, 19 nt, Homo sapiens
caugcuaguuggaaauaaa

SEQ ID NO: 811956 - RNA, 19 nt, Homo sapiens
ucacagaugauacguuuga

SEQ ID NO: 811957 - RNA, 19 nt, Homo sapiens
cucaucagcugaagaauau

SEQ ID NO: 811958 - RNA, 19 nt, Homo sapiens
uaacaaguaaccaguaguu

SEQ ID NO: 811959 - RNA, 19 nt, Homo sapiens
gcauugauagguuaaagaa

SEQ ID NO: 811960 - RNA, 19 nt, Homo sapiens
uuagggaccuugcaguuug

SEQ ID NO: 811961 - RNA, 19 nt, Homo sapiens
ggaggagccuguggugguu

SEQ ID NO: 811962 - RNA, 19 nt, Homo sapiens
gcacaggguguuauauuag

SEQ ID NO: 811963 - RNA, 19 nt, Homo sapiens
aggcuaaacuugcaauaug

SEQ ID NO: 811964 - RNA, 19 nt, Homo sapiens
uugcagaugguacaaauua

SEQ ID NO: 811965 - RNA, 19 nt, Homo sapiens
cauuaacucccagcuauua

SEQ ID NO: 811966 - RNA, 19 nt, Homo sapiens
agauugacccaaacaaaua

SEQ ID NO: 811967 - RNA, 19 nt, Homo sapiens
gcagaugguacaaauuaga

SEQ ID NO: 811968 - RNA, 19 nt, Homo sapiens
gaaauuuggagaaagaaca

SEQ ID NO: 811969 - RNA, 19 nt, Homo sapiens
gcacgaaagcauuccaugu

SEQ ID NO: 811970 - RNA, 19 nt, Homo sapiens
guauuuauguagagucugu

SEQ ID NO: 811971 - RNA, 19 nt, Homo sapiens
gauuuacacuuccuagucu

SEQ ID NO: 811972 - RNA, 19 nt, Homo sapiens
gaaauuugcacgaaagcau

SEQ ID NO: 811973 - RNA, 19 nt, Homo sapiens
cacaagaagagauacauuu

SEQ ID NO: 811974 - RNA, 19 nt, Homo sapiens
gaugucacaagaagagaua

SEQ ID NO: 811975 - RNA, 19 nt, Homo sapiens
aacuguagcuuguguaaug

SEQ ID NO: 811976 - RNA, 19 nt, Homo sapiens
ucaugacugugcagcauuu

SEQ ID NO: 811977 - RNA, 19 nt, Homo sapiens
gauuagcucaguugcuuaa

SEQ ID NO: 811978 - RNA, 19 nt, Homo sapiens
auagugacaucuuucugua

SEQ ID NO: 811979 - RNA, 19 nt, Homo sapiens
gauagugacaucuuucugu

SEQ ID NO: 811980 - RNA, 19 nt, Homo sapiens
aacauuaacucccagcuau

SEQ ID NO: 811981 - RNA, 19 nt, Homo sapiens
guauuggauuguugucuug

SEQ ID NO: 811982 - RNA, 19 nt, Homo sapiens
gaccaccuuugcaauaugu

SEQ ID NO: 811983 - RNA, 19 nt, Homo sapiens
uaccuuaacuguagcuugu

SEQ ID NO: 811984 - RNA, 19 nt, Homo sapiens
gcaagaaaucccacucauc

SEQ ID NO: 811985 - RNA, 19 nt, Homo sapiens
gcaguaaauauuugcaaga

SEQ ID NO: 811986 - RNA, 19 nt, Homo sapiens
aaugaaggccugaaauuug

SEQ ID NO: 811987 - RNA, 19 nt, Homo sapiens
gaauuggaaacauacugua

SEQ ID NO: 811988 - RNA, 19 nt, Homo sapiens
ggauacugcuggucaagag

SEQ ID NO: 811989 - RNA, 19 nt, Homo sapiens
gauugacccaaacaaauaa

SEQ ID NO: 811990 - RNA, 19 nt, Homo sapiens
ggauggaaauaaggcuaaa

SEQ ID NO: 811991 - RNA, 19 nt, Homo sapiens
aaauaaggcuaaacuugca

SEQ ID NO: 811992 - RNA, 19 nt, Homo sapiens
gcagaaugacaauaagguu

SEQ ID NO: 811993 - RNA, 19 nt, Homo sapiens
gaauguagcccaggccaau

SEQ ID NO: 811994 - RNA, 19 nt, Homo sapiens
gcaguuugcacauaauugu

SEQ ID NO: 811995 - RNA, 19 nt, Homo sapiens
acaaugugccuuugaagaa

SEQ ID NO: 811996 - RNA, 19 nt, Homo sapiens
guacuauuguguuacucaa

SEQ ID NO: 811997 - RNA, 19 nt, Homo sapiens
cauaaauguugguaguguu

SEQ ID NO: 811998 - RNA, 19 nt, Homo sapiens
aaucauugaagcagucuua

SEQ ID NO: 811999 - RNA, 19 nt, Homo sapiens
ggucaagagagguuuagaa

SEQ ID NO: 812000 - RNA, 19 nt, Homo sapiens
ucucaucagcugaagaaua

SEQ ID NO: 812001 - RNA, 19 nt, Homo sapiens
aaacuugcaauaugggaua

SEQ ID NO: 812002 - RNA, 19 nt, Homo sapiens
cagaaugacaauaagguuu

SEQ ID NO: 812003 - RNA, 19 nt, Homo sapiens
uaaaggagucaaacuguca

SEQ ID NO: 812004 - RNA, 19 nt, Homo sapiens
ggaagaagaccaaauauuc

SEQ ID NO: 812005 - RNA, 19 nt, Homo sapiens
ggaggaagaagaccaaaua

SEQ ID NO: 812006 - RNA, 19 nt, Homo sapiens
ccagaucgguuuguaauaa

SEQ ID NO: 812007 - RNA, 19 nt, Homo sapiens
gaccaaauauuccuugaug

SEQ ID NO: 812008 - RNA, 19 nt, Homo sapiens
gcuaaugacuccagaaaca

SEQ ID NO: 812009 - RNA, 19 nt, Homo sapiens
ccagaaacaugauauacau

SEQ ID NO: 812010 - RNA, 19 nt, Homo sapiens
ucaaagagaagaagaagaa

SEQ ID NO: 812011 - RNA, 19 nt, Homo sapiens
gcaggcaugugacagaaga

SEQ ID NO: 812012 - RNA, 19 nt, Homo sapiens
auaaucagcucaacacugu

SEQ ID NO: 812013 - RNA, 19 nt, Homo sapiens
ggacccagaugaacucaac

SEQ ID NO: 812014 - RNA, 19 nt, Homo sapiens
uguaauaacaccucaaaga

SEQ ID NO: 812015 - RNA, 19 nt, Homo sapiens
aaaggagacuguacugagu

SEQ ID NO: 812016 - RNA, 19 nt, Homo sapiens
ggaaugguuaucacaagaa

SEQ ID NO: 812017 - RNA, 19 nt, Homo sapiens
ggacaguggaggaagaaga

SEQ ID NO: 812018 - RNA, 19 nt, Homo sapiens
gcaaaggagacuguacuga

SEQ ID NO: 812019 - RNA, 19 nt, Homo sapiens
cgacaucggcgaacacugu

SEQ ID NO: 812020 - RNA, 19 nt, Homo sapiens
gaaugguuaucacaagaag

SEQ ID NO: 812021 - RNA, 19 nt, Homo sapiens
ugugucugcuuccgaauaa

SEQ ID NO: 812022 - RNA, 19 nt, Homo sapiens
gcagugggcuuugccuucu

SEQ ID NO: 812023 - RNA, 19 nt, Homo sapiens
aaaggacaguggaggaaga

SEQ ID NO: 812024 - RNA, 19 nt, Homo sapiens
ugucaaugcuguaacaaag

SEQ ID NO: 812025 - RNA, 19 nt, Homo sapiens
acagugugcuggaaugguu

SEQ ID NO: 812026 - RNA, 19 nt, Homo sapiens
caacggaaaccuccuagag

SEQ ID NO: 812027 - RNA, 19 nt, Homo sapiens
gaagaagaccaaauauucc

SEQ ID NO: 812028 - RNA, 19 nt, Homo sapiens
guaauaacaccucaaagac

SEQ ID NO: 812029 - RNA, 19 nt, Homo sapiens
ccagauacacuccaguuca

SEQ ID NO: 812030 - RNA, 19 nt, Homo sapiens
gaggaagaagaccaaauau

SEQ ID NO: 812031 - RNA, 19 nt, Homo sapiens
gcagauaaucagcucaaca

SEQ ID NO: 812032 - RNA, 19 nt, Homo sapiens
ccaucgcguucaccacuuu

SEQ ID NO: 812033 - RNA, 19 nt, Homo sapiens
uggaaugguuaucacaaga

SEQ ID NO: 812034 - RNA, 19 nt, Homo sapiens
gacuuuaccagaucgguuu

SEQ ID NO: 812035 - RNA, 19 nt, Homo sapiens
ucaaugcuguaacaaaggu

SEQ ID NO: 812036 - RNA, 19 nt, Homo sapiens
acacuguccucaccaucaa

SEQ ID NO: 812037 - RNA, 19 nt, Homo sapiens
gcuguuauccugguucuca

SEQ ID NO: 812038 - RNA, 19 nt, Homo sapiens
gacgcuauccgauccauca

SEQ ID NO: 812039 - RNA, 19 nt, Homo sapiens
cguaaccgcaggcauguga

SEQ ID NO: 812040 - RNA, 19 nt, Homo sapiens
gcgauaccagagcagauaa

SEQ ID NO: 812041 - RNA, 19 nt, Homo sapiens
ugacagaagaagcagaugu

SEQ ID NO: 812042 - RNA, 19 nt, Homo sapiens
ggccagauacacuccaguu

SEQ ID NO: 812043 - RNA, 19 nt, Homo sapiens
aggaagaagaccaaauauu

SEQ ID NO: 812044 - RNA, 19 nt, Homo sapiens
caaagagaagaagaagaaa

SEQ ID NO: 812045 - RNA, 19 nt, Homo sapiens
gcaugugacagaagaagca

SEQ ID NO: 812046 - RNA, 19 nt, Homo sapiens
ccgcaggcaugugacagaa

SEQ ID NO: 812047 - RNA, 19 nt, Homo sapiens
uaaugacuccagaaacaug

SEQ ID NO: 812048 - RNA, 19 nt, Homo sapiens
gaaaaggacaguggaggaa

SEQ ID NO: 812049 - RNA, 19 nt, Homo sapiens
gacucugacugcuguuauc

SEQ ID NO: 812050 - RNA, 19 nt, Homo sapiens
gcaggacccagaugaacuc

SEQ ID NO: 812051 - RNA, 19 nt, Homo sapiens
cagauacacuccaguucac

SEQ ID NO: 812052 - RNA, 19 nt, Homo sapiens
uaccagaucgguuuguaau

SEQ ID NO: 812053 - RNA, 19 nt, Homo sapiens
gcuggaaugguuaucacaa

SEQ ID NO: 812054 - RNA, 19 nt, Homo sapiens
gaccugacccugccgaacu

SEQ ID NO: 812055 - RNA, 19 nt, Homo sapiens
gagcaggacccagaugaac

SEQ ID NO: 812056 - RNA, 19 nt, Homo sapiens
ugacuccagaaacaugaua

SEQ ID NO: 812057 - RNA, 19 nt, Homo sapiens
gaucgccccuccugacaga

SEQ ID NO: 812058 - RNA, 19 nt, Homo sapiens
cagaucgguuuguaauaac

SEQ ID NO: 812059 - RNA, 19 nt, Homo sapiens
guagagcagugggcuuugc

SEQ ID NO: 812060 - RNA, 19 nt, Homo sapiens
guucacaguggaugucuuc

SEQ ID NO: 812061 - RNA, 19 nt, Homo sapiens
aagaccaaauauuccuuga

SEQ ID NO: 812062 - RNA, 19 nt, Homo sapiens
ucagcaagccuuccaacag

SEQ ID NO: 812063 - RNA, 19 nt, Homo sapiens
ucaacacuguccucaccau

SEQ ID NO: 812064 - RNA, 19 nt, Homo sapiens
cgugggacuuuaccagauc

SEQ ID NO: 812065 - RNA, 19 nt, Homo sapiens
gauaccagagcagauaauc

SEQ ID NO: 812066 - RNA, 19 nt, Homo sapiens
uuuaccagaucgguuugua

SEQ ID NO: 812067 - RNA, 19 nt, Homo sapiens
gaugucuuccacuuugcua

SEQ ID NO: 812068 - RNA, 19 nt, Homo sapiens
ugccucuucugcauucaaa

SEQ ID NO: 812069 - RNA, 19 nt, Homo sapiens
ugucgacggucucacugau

SEQ ID NO: 812070 - RNA, 19 nt, Homo sapiens
uguccucaccaucaaguaa

SEQ ID NO: 812071 - RNA, 19 nt, Homo sapiens
guucagaaggcgcgacauc

SEQ ID NO: 812072 - RNA, 19 nt, Homo sapiens
ggaagaagaccaaauauuc

SEQ ID NO: 812073 - RNA, 19 nt, Homo sapiens
ggaggaagaagaccaaaua

SEQ ID NO: 812074 - RNA, 19 nt, Homo sapiens
ccagaucgguuuguaauaa

SEQ ID NO: 812075 - RNA, 19 nt, Homo sapiens
gaccaaauauuccuugaug

SEQ ID NO: 812076 - RNA, 19 nt, Homo sapiens
gcuaaugacuccagaaaca

SEQ ID NO: 812077 - RNA, 19 nt, Homo sapiens
ucaaagagaagaagaagaa

SEQ ID NO: 812078 - RNA, 19 nt, Homo sapiens
agaaacaugugacagaaga

SEQ ID NO: 812079 - RNA, 19 nt, Homo sapiens
ccagaaacaugugacagaa

SEQ ID NO: 812080 - RNA, 19 nt, Homo sapiens
auaaucagcucaacacugu

SEQ ID NO: 812081 - RNA, 19 nt, Homo sapiens
uguaauaacaccucaaaga

SEQ ID NO: 812082 - RNA, 19 nt, Homo sapiens
aaaggagacuguacugagu

SEQ ID NO: 812083 - RNA, 19 nt, Homo sapiens
ggaaugguuaucacaagaa

SEQ ID NO: 812084 - RNA, 19 nt, Homo sapiens
ggacaguggaggaagaaga

SEQ ID NO: 812085 - RNA, 19 nt, Homo sapiens
gcaaaggagacuguacuga

SEQ ID NO: 812086 - RNA, 19 nt, Homo sapiens
gaaugguuaucacaagaag

SEQ ID NO: 812087 - RNA, 19 nt, Homo sapiens
cgacaucggcgaacacugu

SEQ ID NO: 812088 - RNA, 19 nt, Homo sapiens
ugugucugcuuccgaauaa

SEQ ID NO: 812089 - RNA, 19 nt, Homo sapiens
gcagugggcuuugccuucu

SEQ ID NO: 812090 - RNA, 19 nt, Homo sapiens
aaaggacaguggaggaaga

SEQ ID NO: 812091 - RNA, 19 nt, Homo sapiens
acagugugcuggaaugguu

SEQ ID NO: 812092 - RNA, 19 nt, Homo sapiens
caacggaaaccuccuagag

SEQ ID NO: 812093 - RNA, 19 nt, Homo sapiens
gaagaagaccaaauauucc

SEQ ID NO: 812094 - RNA, 19 nt, Homo sapiens
guaauaacaccucaaagac

SEQ ID NO: 812095 - RNA, 19 nt, Homo sapiens
ccagauacacuccaguuca

SEQ ID NO: 812096 - RNA, 19 nt, Homo sapiens
gaggaagaagaccaaauau

SEQ ID NO: 812097 - RNA, 19 nt, Homo sapiens
gcagauaaucagcucaaca

SEQ ID NO: 812098 - RNA, 19 nt, Homo sapiens
ccaucgcguucaccacuuu

SEQ ID NO: 812099 - RNA, 19 nt, Homo sapiens
uggaaugguuaucacaaga

SEQ ID NO: 812100 - RNA, 19 nt, Homo sapiens
gacuuuaccagaucgguuu

SEQ ID NO: 812101 - RNA, 19 nt, Homo sapiens
acacuguccucaccaucaa

SEQ ID NO: 812102 - RNA, 19 nt, Homo sapiens
gaaacaugugacagaagaa

SEQ ID NO: 812103 - RNA, 19 nt, Homo sapiens
gcuguuauccugguucuca

SEQ ID NO: 812104 - RNA, 19 nt, Homo sapiens
gacgcuauccgauccauca

SEQ ID NO: 812105 - RNA, 19 nt, Homo sapiens
gcgauaccagagcagauaa

SEQ ID NO: 812106 - RNA, 19 nt, Homo sapiens
ugacagaagaagcagaugu

SEQ ID NO: 812107 - RNA, 19 nt, Homo sapiens
ggccagauacacuccaguu

SEQ ID NO: 812108 - RNA, 19 nt, Homo sapiens
aggaagaagaccaaauauu

SEQ ID NO: 812109 - RNA, 19 nt, Homo sapiens
caaagagaagaagaagaaa

SEQ ID NO: 812110 - RNA, 19 nt, Homo sapiens
uaaugacuccagaaacaug

SEQ ID NO: 812111 - RNA, 19 nt, Homo sapiens
gaaaaggacaguggaggaa

SEQ ID NO: 812112 - RNA, 19 nt, Homo sapiens
gacucugacugcuguuauc

SEQ ID NO: 812113 - RNA, 19 nt, Homo sapiens
cagauacacuccaguucac

SEQ ID NO: 812114 - RNA, 19 nt, Homo sapiens
uaccagaucgguuuguaau

SEQ ID NO: 812115 - RNA, 19 nt, Homo sapiens
gcuggaaugguuaucacaa

SEQ ID NO: 812116 - RNA, 19 nt, Homo sapiens
gaccugacccugccgaacu

SEQ ID NO: 812117 - RNA, 19 nt, Homo sapiens
gaucgccccuccugacaga

SEQ ID NO: 812118 - RNA, 19 nt, Homo sapiens
cagaucgguuuguaauaac

SEQ ID NO: 812119 - RNA, 19 nt, Homo sapiens
guagagcagugggcuuugc

SEQ ID NO: 812120 - RNA, 19 nt, Homo sapiens
guucacaguggaugucuuc

SEQ ID NO: 812121 - RNA, 19 nt, Homo sapiens
aagaccaaauauuccuuga

SEQ ID NO: 812122 - RNA, 19 nt, Homo sapiens
ucaacacuguccucaccau

SEQ ID NO: 812123 - RNA, 19 nt, Homo sapiens
uuuaccagaucgguuugua

SEQ ID NO: 812124 - RNA, 19 nt, Homo sapiens
gauaccagagcagauaauc

SEQ ID NO: 812125 - RNA, 19 nt, Homo sapiens
cgugggacuuuaccagauc

SEQ ID NO: 812126 - RNA, 19 nt, Homo sapiens
gaugucuuccacuuugcua

SEQ ID NO: 812127 - RNA, 19 nt, Homo sapiens
ugccucuucugcauucaaa

SEQ ID NO: 812128 - RNA, 19 nt, Homo sapiens
ugucgacggucucacugau

SEQ ID NO: 812129 - RNA, 19 nt, Homo sapiens
guucagaaggcgcgacauc

SEQ ID NO: 812130 - RNA, 19 nt, Homo sapiens
uguccucaccaucaaguaa

SEQ ID NO: 812131 - RNA, 19 nt, Homo sapiens
cagaagacauugcuuauug

SEQ ID NO: 812132 - RNA, 19 nt, Homo sapiens
gagaucagcuauuucaaga

SEQ ID NO: 812133 - RNA, 19 nt, Homo sapiens
uaaccucccucaucucuaa

SEQ ID NO: 812134 - RNA, 19 nt, Homo sapiens
ggacucagauucagacucu

SEQ ID NO: 812135 - RNA, 19 nt, Homo sapiens
gaggaggcauggacuuuga

SEQ ID NO: 812136 - RNA, 19 nt, Homo sapiens
gggcagaagacauugcuua

SEQ ID NO: 812137 - RNA, 19 nt, Homo sapiens
gcaggaggcucaggacuca

SEQ ID NO: 812138 - RNA, 19 nt, Homo sapiens
guaguucugugcccuauca

SEQ ID NO: 812139 - RNA, 19 nt, Homo sapiens
uaagcuggaugaaagagaa

SEQ ID NO: 812140 - RNA, 19 nt, Homo sapiens
ccgcuaagcuggaugaaag

SEQ ID NO: 812141 - RNA, 19 nt, Homo sapiens
gaagccugauaucgucuuu

SEQ ID NO: 812142 - RNA, 19 nt, Homo sapiens
cuaaguaaaccauaccuaa

SEQ ID NO: 812143 - RNA, 19 nt, Homo sapiens
gcgcguuucuucuccugua

SEQ ID NO: 812144 - RNA, 19 nt, Homo sapiens
ggugugggccucugaauau

SEQ ID NO: 812145 - RNA, 19 nt, Homo sapiens
gcuuauuggagacaaauua

SEQ ID NO: 812146 - RNA, 19 nt, Homo sapiens
gcagaagacauugcuuauu

SEQ ID NO: 812147 - RNA, 19 nt, Homo sapiens
gcugagaguuguaguucug

SEQ ID NO: 812148 - RNA, 19 nt, Homo sapiens
gcacggcaccuucuacaca

SEQ ID NO: 812149 - RNA, 19 nt, Homo sapiens
ucuuugagaucagcuauuu

SEQ ID NO: 812150 - RNA, 19 nt, Homo sapiens
gcccaagugugaagacugu

SEQ ID NO: 812151 - RNA, 19 nt, Homo sapiens
ccaccggccucuaugacaa

SEQ ID NO: 812152 - RNA, 19 nt, Homo sapiens
gaagacauugcuuauugga

SEQ ID NO: 812153 - RNA, 19 nt, Homo sapiens
uagauacccuggagcgaau

SEQ ID NO: 812154 - RNA, 19 nt, Homo sapiens
gccuucagcucccaaagug

SEQ ID NO: 812155 - RNA, 19 nt, Homo sapiens
ggacuuugacuccaagaag

SEQ ID NO: 812156 - RNA, 19 nt, Homo sapiens
uggacgagcugaccuugga

SEQ ID NO: 812157 - RNA, 19 nt, Homo sapiens
augacaaccuagagaagua

SEQ ID NO: 812158 - RNA, 19 nt, Homo sapiens
gugugggccucugaauaua

SEQ ID NO: 812159 - RNA, 19 nt, Homo sapiens
ccagaggccaucuuugaga

SEQ ID NO: 812160 - RNA, 19 nt, Homo sapiens
gggugugggccucugaaua

SEQ ID NO: 812161 - RNA, 19 nt, Homo sapiens
gagcacgccagcauagaug

SEQ ID NO: 812162 - RNA, 19 nt, Homo sapiens
gagggagcacgccagcaua

SEQ ID NO: 812163 - RNA, 19 nt, Homo sapiens
caacagagagggagaaacc

SEQ ID NO: 812164 - RNA, 19 nt, Homo sapiens
ggacaacagagagggagaa

SEQ ID NO: 812165 - RNA, 19 nt, Homo sapiens
ggaggaggcauggacuuug

SEQ ID NO: 812166 - RNA, 19 nt, Homo sapiens
gcuacacgcagaacauaga

SEQ ID NO: 812167 - RNA, 19 nt, Homo sapiens
ggagcacgccagcauagau

SEQ ID NO: 812168 - RNA, 19 nt, Homo sapiens
aaccaucugucacuacuuc

SEQ ID NO: 812169 - RNA, 19 nt, Homo sapiens
cgcaaugucugcugagagu

SEQ ID NO: 812170 - RNA, 19 nt, Homo sapiens
gagaagcagacauggacuu

SEQ ID NO: 812171 - RNA, 19 nt, Homo sapiens
caaugucugcugagaguug

SEQ ID NO: 812172 - RNA, 19 nt, Homo sapiens
ggcagaagacauugcuuau

SEQ ID NO: 812173 - RNA, 19 nt, Homo sapiens
guaaaccauaccuaaccua

SEQ ID NO: 812174 - RNA, 19 nt, Homo sapiens
gcuaaguaaaccauaccua

SEQ ID NO: 812175 - RNA, 19 nt, Homo sapiens
ggacgaggccaggacaaca

SEQ ID NO: 812176 - RNA, 19 nt, Homo sapiens
ccaaccaucugucacuacu

SEQ ID NO: 812177 - RNA, 19 nt, Homo sapiens
gaacgcugucgcagaguca

SEQ ID NO: 812178 - RNA, 19 nt, Homo sapiens
gcucaggacucagauucag

SEQ ID NO: 812179 - RNA, 19 nt, Homo sapiens
agaagacauugcuuauugg

SEQ ID NO: 812180 - RNA, 19 nt, Homo sapiens
ccagcugccggcacgaaua

SEQ ID NO: 812181 - RNA, 19 nt, Homo sapiens
uggaugggcagaagacauu

SEQ ID NO: 812182 - RNA, 19 nt, Homo sapiens
cggccucuaugacaaccua

SEQ ID NO: 812183 - RNA, 19 nt, Homo sapiens
gcucaucaacaaggagaaa

SEQ ID NO: 812184 - RNA, 19 nt, Homo sapiens
cggcacgaauacccgcuaa

SEQ ID NO: 812185 - RNA, 19 nt, Homo sapiens
gacuuucgcucuccaucca

SEQ ID NO: 812186 - RNA, 19 nt, Homo sapiens
aggagccgcugguggagaa

SEQ ID NO: 812187 - RNA, 19 nt, Homo sapiens
uaaacaggcaucucuacca

SEQ ID NO: 812188 - RNA, 19 nt, Homo sapiens
ucaugcgccugcugaagga

SEQ ID NO: 812189 - RNA, 19 nt, Homo sapiens
acccagaggccaucuuuga

SEQ ID NO: 812190 - RNA, 19 nt, Homo sapiens
cuacccagaggccaucuuu

SEQ ID NO: 812191 - RNA, 19 nt, Homo sapiens
uaaguaaaccauaccuaac

SEQ ID NO: 812192 - RNA, 19 nt, Homo sapiens
gcuuaaacaggcaucucua

SEQ ID NO: 812193 - RNA, 19 nt, Homo sapiens
uccuagaggccaaggcuua

SEQ ID NO: 812194 - RNA, 19 nt, Homo sapiens
ugagaucagcuauuucaag

SEQ ID NO: 812195 - RNA, 19 nt, Homo sapiens
gcacgaauacccgcuaagc

SEQ ID NO: 812196 - RNA, 19 nt, Homo sapiens
uaucacggccacucccauu

SEQ ID NO: 812197 - RNA, 19 nt, Homo sapiens
gacaacagagagggagaaa

SEQ ID NO: 812198 - RNA, 19 nt, Homo sapiens
ccagaacuuuuaacucuuc

SEQ ID NO: 812199 - RNA, 19 nt, Homo sapiens
ucacggccacucccauuuc

SEQ ID NO: 812200 - RNA, 19 nt, Homo sapiens
ucuccuguaugcagucaga

SEQ ID NO: 812201 - RNA, 19 nt, Homo sapiens
cggaggaggcauggacuuu

SEQ ID NO: 812202 - RNA, 19 nt, Homo sapiens
ggacgagcugaccuuggaa

SEQ ID NO: 812203 - RNA, 19 nt, Homo sapiens
guucaagccaaccaucugu

SEQ ID NO: 812204 - RNA, 19 nt, Homo sapiens
uuugagaucagcuauuuca

SEQ ID NO: 812205 - RNA, 19 nt, Homo sapiens
cagaagacauugcuuauug

SEQ ID NO: 812206 - RNA, 19 nt, Homo sapiens
gagaucagcuauuucaaga

SEQ ID NO: 812207 - RNA, 19 nt, Homo sapiens
uaaccucccucaucucuaa

SEQ ID NO: 812208 - RNA, 19 nt, Homo sapiens
gaggaggcauggacuuuga

SEQ ID NO: 812209 - RNA, 19 nt, Homo sapiens
gggcagaagacauugcuua

SEQ ID NO: 812210 - RNA, 19 nt, Homo sapiens
guaguucugugcccuauca

SEQ ID NO: 812211 - RNA, 19 nt, Homo sapiens
uaagcuggaugaaagagaa

SEQ ID NO: 812212 - RNA, 19 nt, Homo sapiens
ccgcuaagcuggaugaaag

SEQ ID NO: 812213 - RNA, 19 nt, Homo sapiens
gaagccugauaucgucuuu

SEQ ID NO: 812214 - RNA, 19 nt, Homo sapiens
cuaaguaaaccauaccuaa

SEQ ID NO: 812215 - RNA, 19 nt, Homo sapiens
gcgcguuucuucuccugua

SEQ ID NO: 812216 - RNA, 19 nt, Homo sapiens
cgacucagauucagacucu

SEQ ID NO: 812217 - RNA, 19 nt, Homo sapiens
ggugugggccucugaauau

SEQ ID NO: 812218 - RNA, 19 nt, Homo sapiens
gcuuauuggagacaaauua

SEQ ID NO: 812219 - RNA, 19 nt, Homo sapiens
gcagaagacauugcuuauu

SEQ ID NO: 812220 - RNA, 19 nt, Homo sapiens
gcacggcaccuucuacaca

SEQ ID NO: 812221 - RNA, 19 nt, Homo sapiens
gcugagaguuguaguucug

SEQ ID NO: 812222 - RNA, 19 nt, Homo sapiens
ucuuugagaucagcuauuu

SEQ ID NO: 812223 - RNA, 19 nt, Homo sapiens
gcccaagugugaagacugu

SEQ ID NO: 812224 - RNA, 19 nt, Homo sapiens
ccaccggccucuaugacaa

SEQ ID NO: 812225 - RNA, 19 nt, Homo sapiens
gaagacauugcuuauugga

SEQ ID NO: 812226 - RNA, 19 nt, Homo sapiens
uagauacccuggagcgaau

SEQ ID NO: 812227 - RNA, 19 nt, Homo sapiens
gccuucagcucccaaagug

SEQ ID NO: 812228 - RNA, 19 nt, Homo sapiens
ggacuuugacuccaagaag

SEQ ID NO: 812229 - RNA, 19 nt, Homo sapiens
uggacgagcugaccuugga

SEQ ID NO: 812230 - RNA, 19 nt, Homo sapiens
augacaaccuagagaagua

SEQ ID NO: 812231 - RNA, 19 nt, Homo sapiens
gugugggccucugaauaua

SEQ ID NO: 812232 - RNA, 19 nt, Homo sapiens
ccagaggccaucuuugaga

SEQ ID NO: 812233 - RNA, 19 nt, Homo sapiens
gggugugggccucugaaua

SEQ ID NO: 812234 - RNA, 19 nt, Homo sapiens
gagcacgccagcauagaug

SEQ ID NO: 812235 - RNA, 19 nt, Homo sapiens
gagggagcacgccagcaua

SEQ ID NO: 812236 - RNA, 19 nt, Homo sapiens
caacagagagggagaaacc

SEQ ID NO: 812237 - RNA, 19 nt, Homo sapiens
ggacaacagagagggagaa

SEQ ID NO: 812238 - RNA, 19 nt, Homo sapiens
ggaggaggcauggacuuug

SEQ ID NO: 812239 - RNA, 19 nt, Homo sapiens
gcuacacgcagaacauaga

SEQ ID NO: 812240 - RNA, 19 nt, Homo sapiens
ggagcacgccagcauagau

SEQ ID NO: 812241 - RNA, 19 nt, Homo sapiens
caaugucugcugagaguug

SEQ ID NO: 812242 - RNA, 19 nt, Homo sapiens
aaccaucugucacuacuuc

SEQ ID NO: 812243 - RNA, 19 nt, Homo sapiens
cgcaaugucugcugagagu

SEQ ID NO: 812244 - RNA, 19 nt, Homo sapiens
gagaagcagacauggacuu

SEQ ID NO: 812245 - RNA, 19 nt, Homo sapiens
ggcagaagacauugcuuau

SEQ ID NO: 812246 - RNA, 19 nt, Homo sapiens
guaaaccauaccuaaccua

SEQ ID NO: 812247 - RNA, 19 nt, Homo sapiens
gcuaaguaaaccauaccua

SEQ ID NO: 812248 - RNA, 19 nt, Homo sapiens
ggacgaggccaggacaaca

SEQ ID NO: 812249 - RNA, 19 nt, Homo sapiens
ccagaccgacucagauuca

SEQ ID NO: 812250 - RNA, 19 nt, Homo sapiens
ccaaccaucugucacuacu

SEQ ID NO: 812251 - RNA, 19 nt, Homo sapiens
gaacgcugucgcagaguca

SEQ ID NO: 812252 - RNA, 19 nt, Homo sapiens
agaagacauugcuuauugg

SEQ ID NO: 812253 - RNA, 19 nt, Homo sapiens
ccagcugccggcacgaaua

SEQ ID NO: 812254 - RNA, 19 nt, Homo sapiens
uggaugggcagaagacauu

SEQ ID NO: 812255 - RNA, 19 nt, Homo sapiens
cggccucuaugacaaccua

SEQ ID NO: 812256 - RNA, 19 nt, Homo sapiens
gcucaucaacaaggagaaa

SEQ ID NO: 812257 - RNA, 19 nt, Homo sapiens
cggcacgaauacccgcuaa

SEQ ID NO: 812258 - RNA, 19 nt, Homo sapiens
gacuuucgcucuccaucca

SEQ ID NO: 812259 - RNA, 19 nt, Homo sapiens
aggagccgcugguggagaa

SEQ ID NO: 812260 - RNA, 19 nt, Homo sapiens
uaaacaggcaucucuacca

SEQ ID NO: 812261 - RNA, 19 nt, Homo sapiens
gagccagaccgacucagau

SEQ ID NO: 812262 - RNA, 19 nt, Homo sapiens
ucaugcgccugcugaagga

SEQ ID NO: 812263 - RNA, 19 nt, Homo sapiens
acccagaggccaucuuuga

SEQ ID NO: 812264 - RNA, 19 nt, Homo sapiens
cuacccagaggccaucuuu

SEQ ID NO: 812265 - RNA, 19 nt, Homo sapiens
uaaguaaaccauaccuaac

SEQ ID NO: 812266 - RNA, 19 nt, Homo sapiens
gcuuaaacaggcaucucua

SEQ ID NO: 812267 - RNA, 19 nt, Homo sapiens
uccuagaggccaaggcuua

SEQ ID NO: 812268 - RNA, 19 nt, Homo sapiens
ugagaucagcuauuucaag

SEQ ID NO: 812269 - RNA, 19 nt, Homo sapiens
gcacgaauacccgcuaagc

SEQ ID NO: 812270 - RNA, 19 nt, Homo sapiens
uaucacggccacucccauu

SEQ ID NO: 812271 - RNA, 19 nt, Homo sapiens
gacaacagagagggagaaa

SEQ ID NO: 812272 - RNA, 19 nt, Homo sapiens
gcagagccagaccgacuca

SEQ ID NO: 812273 - RNA, 19 nt, Homo sapiens
ccagaacuuuuaacucuuc

SEQ ID NO: 812274 - RNA, 19 nt, Homo sapiens
ucacggccacucccauuuc

SEQ ID NO: 812275 - RNA, 19 nt, Homo sapiens
ucuccuguaugcagucaga

SEQ ID NO: 812276 - RNA, 19 nt, Homo sapiens
cggaggaggcauggacuuu

SEQ ID NO: 812277 - RNA, 19 nt, Homo sapiens
ggacgagcugaccuuggaa

SEQ ID NO: 812278 - RNA, 19 nt, Homo sapiens
guucaagccaaccaucugu

SEQ ID NO: 812279 - RNA, 19 nt, Homo sapiens
uuugagaucagcuauuuca

SEQ ID NO: 812280 - RNA, 19 nt, Homo sapiens
ggaguuaaauccagucuua

SEQ ID NO: 812281 - RNA, 19 nt, Homo sapiens
ggaaugacuuggaauguaa

SEQ ID NO: 812282 - RNA, 19 nt, Homo sapiens
ggaagugguucuacaauug

SEQ ID NO: 812283 - RNA, 19 nt, Homo sapiens
gcacugcugugaaauguga

SEQ ID NO: 812284 - RNA, 19 nt, Homo sapiens
ggaagcaguugaccagaaa

SEQ ID NO: 812285 - RNA, 19 nt, Homo sapiens
cagaaguccuuaccucuuu

SEQ ID NO: 812286 - RNA, 19 nt, Homo sapiens
ugguaaagcuucugaauau

SEQ ID NO: 812287 - RNA, 19 nt, Homo sapiens
guccuuaccucuuuauauu

SEQ ID NO: 812288 - RNA, 19 nt, Homo sapiens
guaccuaguuacaucuuaa

SEQ ID NO: 812289 - RNA, 19 nt, Homo sapiens
caaauggagugaagugaau

SEQ ID NO: 812290 - RNA, 19 nt, Homo sapiens
ugaguuugcugagaaauaa

SEQ ID NO: 812291 - RNA, 19 nt, Homo sapiens
gaauacagcuaucaaaaug

SEQ ID NO: 812292 - RNA, 19 nt, Homo sapiens
cgauggugcugaugaagua

SEQ ID NO: 812293 - RNA, 19 nt, Homo sapiens
guaaagcuucugaauauug

SEQ ID NO: 812294 - RNA, 19 nt, Homo sapiens
gcacacauaguaccuaguu

SEQ ID NO: 812295 - RNA, 19 nt, Homo sapiens
guacacaaauggagugaag

SEQ ID NO: 812296 - RNA, 19 nt, Homo sapiens
gcuacccucugauuuguuu

SEQ ID NO: 812297 - RNA, 19 nt, Homo sapiens
aauccagucuuaugaagua

SEQ ID NO: 812298 - RNA, 19 nt, Homo sapiens
gagaaccacgugaggaaua

SEQ ID NO: 812299 - RNA, 19 nt, Homo sapiens
guuauuacuugcaugguuu

SEQ ID NO: 812300 - RNA, 19 nt, Homo sapiens
ggacacaggccuauucauc

SEQ ID NO: 812301 - RNA, 19 nt, Homo sapiens
gguauggaaugacuuggaa

SEQ ID NO: 812302 - RNA, 19 nt, Homo sapiens
cuuaagaucagguguauaa

SEQ ID NO: 812303 - RNA, 19 nt, Homo sapiens
cauaguaccuaguuacauc

SEQ ID NO: 812304 - RNA, 19 nt, Homo sapiens
gaaaugugaaguacuuugu

SEQ ID NO: 812305 - RNA, 19 nt, Homo sapiens
ugacagauaaugggaauuu

SEQ ID NO: 812306 - RNA, 19 nt, Homo sapiens
cagaaaugcuugccaguac

SEQ ID NO: 812307 - RNA, 19 nt, Homo sapiens
uggaaugacuuggaaugua

SEQ ID NO: 812308 - RNA, 19 nt, Homo sapiens
gguaaagcuucugaauauu

SEQ ID NO: 812309 - RNA, 19 nt, Homo sapiens
ggagcgguaugguauggaa

SEQ ID NO: 812310 - RNA, 19 nt, Homo sapiens
ccugaugccuuacuggaaa

SEQ ID NO: 812311 - RNA, 19 nt, Homo sapiens
ugugaaaugugaaguacuu

SEQ ID NO: 812312 - RNA, 19 nt, Homo sapiens
ggaguggagcgguauggua

SEQ ID NO: 812313 - RNA, 19 nt, Homo sapiens
gugaucuccugaugccuua

SEQ ID NO: 812314 - RNA, 19 nt, Homo sapiens
ccaggagccuuugccuuaa

SEQ ID NO: 812315 - RNA, 19 nt, Homo sapiens
gcaaggagcagaguguguu

SEQ ID NO: 812316 - RNA, 19 nt, Homo sapiens
ucgaauggcugucaacaag

SEQ ID NO: 812317 - RNA, 19 nt, Homo sapiens
uggaagugguucuacaauu

SEQ ID NO: 812318 - RNA, 19 nt, Homo sapiens
cagcagugaucuccugaug

SEQ ID NO: 812319 - RNA, 19 nt, Homo sapiens
acacaggccuauucaucaa

SEQ ID NO: 812320 - RNA, 19 nt, Homo sapiens
agaaguccuuaccucuuua

SEQ ID NO: 812321 - RNA, 19 nt, Homo sapiens
uccaggagccuuugccuua

SEQ ID NO: 812322 - RNA, 19 nt, Homo sapiens
cagaguguguucaccuuga

SEQ ID NO: 812323 - RNA, 19 nt, Homo sapiens
uaaauccagucuuaugaag

SEQ ID NO: 812324 - RNA, 19 nt, Homo sapiens
ccagucuuaugaaguauug

SEQ ID NO: 812325 - RNA, 19 nt, Homo sapiens
cugaaagggugaagcaaga

SEQ ID NO: 812326 - RNA, 19 nt, Homo sapiens
gaagugguucuacaauugu

SEQ ID NO: 812327 - RNA, 19 nt, Homo sapiens
gcugagagagucuacuuug

SEQ ID NO: 812328 - RNA, 19 nt, Homo sapiens
ggugacagauaaugggaau

SEQ ID NO: 812329 - RNA, 19 nt, Homo sapiens
gaacuucgaauggcuguca

SEQ ID NO: 812330 - RNA, 19 nt, Homo sapiens
ccagaaaugcuugccagua

SEQ ID NO: 812331 - RNA, 19 nt, Homo sapiens
ggaauuggaagugguucua

SEQ ID NO: 812332 - RNA, 19 nt, Homo sapiens
guuaaauccagucuuauga

SEQ ID NO: 812333 - RNA, 19 nt, Homo sapiens
ccagugagccgagcuguga

SEQ ID NO: 812334 - RNA, 19 nt, Homo sapiens
gcugugagccagaaguuug

SEQ ID NO: 812335 - RNA, 19 nt, Homo sapiens
agaaccacgugaggaauaa

SEQ ID NO: 812336 - RNA, 19 nt, Homo sapiens
gaaagggugaagcaagaga

SEQ ID NO: 812337 - RNA, 19 nt, Homo sapiens
caggauggcucagugaaca

SEQ ID NO: 812338 - RNA, 19 nt, Homo sapiens
gacacaggccuauucauca

SEQ ID NO: 812339 - RNA, 19 nt, Homo sapiens
gaagugaauacagcuauca

SEQ ID NO: 812340 - RNA, 19 nt, Homo sapiens
uggaagcaguugaccagaa

SEQ ID NO: 812341 - RNA, 19 nt, Homo sapiens
gaguggagcgguaugguau

SEQ ID NO: 812342 - RNA, 19 nt, Homo sapiens
gagaaaauguuguuacacu

SEQ ID NO: 812343 - RNA, 19 nt, Homo sapiens
aaacuucuuuaagcuggua

SEQ ID NO: 812344 - RNA, 19 nt, Homo sapiens
gguaugguauggaaugacu

SEQ ID NO: 812345 - RNA, 19 nt, Homo sapiens
gcuucugaauauugaguuu

SEQ ID NO: 812346 - RNA, 19 nt, Homo sapiens
gaagauuguggcuggcuau

SEQ ID NO: 812347 - RNA, 19 nt, Homo sapiens
guuccuuuguuauuacuug

SEQ ID NO: 812348 - RNA, 19 nt, Homo sapiens
gaaaugcuugccaguacug

SEQ ID NO: 812349 - RNA, 19 nt, Homo sapiens
ucaggaaagauucgaagaa

SEQ ID NO: 812350 - RNA, 19 nt, Homo sapiens
ucauauuccugcuguugga

SEQ ID NO: 812351 - RNA, 19 nt, Homo sapiens
ccuuaccucuuuauauugu

SEQ ID NO: 812352 - RNA, 19 nt, Homo sapiens
gcugugaaaugugaaguac

SEQ ID NO: 812353 - RNA, 19 nt, Homo sapiens
cacacauaguaccuaguua

SEQ ID NO: 812354 - RNA, 19 nt, Homo sapiens
auauugaguuugcugagaa

SEQ ID NO: 812355 - RNA, 19 nt, Homo sapiens
uaucuuggacuggaaguuu

SEQ ID NO: 812356 - RNA, 19 nt, Homo sapiens
gggcgugguugaacuucga

SEQ ID NO: 812357 - RNA, 19 nt, Homo sapiens
gagcugugagccagaaguu

SEQ ID NO: 812358 - RNA, 19 nt, Homo sapiens
ccaucgaggucaucccaau

SEQ ID NO: 812359 - RNA, 19 nt, Homo sapiens
ucaucgugaucgcugauuu

SEQ ID NO: 812360 - RNA, 19 nt, Homo sapiens
gauuguggcuggcuaugcu

SEQ ID NO: 812361 - RNA, 19 nt, Homo sapiens
cugguaaagcuucugaaua

SEQ ID NO: 812362 - RNA, 19 nt, Homo sapiens
gagccuuugccuuaaugua

SEQ ID NO: 812363 - RNA, 19 nt, Homo sapiens
acaaauggagugaagugaa

SEQ ID NO: 812364 - RNA, 19 nt, Homo sapiens
gaaguccuuaccucuuuau

SEQ ID NO: 812365 - RNA, 19 nt, Homo sapiens
gcgguaugguauggaauga

SEQ ID NO: 812366 - RNA, 19 nt, Homo sapiens
caggagccuuugccuuaau

SEQ ID NO: 812367 - RNA, 19 nt, Homo sapiens
uuucucuguuccuuuguua

SEQ ID NO: 812368 - RNA, 19 nt, Homo sapiens
ugaagugaauacagcuauc

SEQ ID NO: 812369 - RNA, 19 nt, Homo sapiens
ucagaaguccuuaccucuu

SEQ ID NO: 812370 - RNA, 19 nt, Homo sapiens
gggagaaaauguuguuaca

SEQ ID NO: 812371 - RNA, 19 nt, Homo sapiens
caagugcugggaauuggaa

SEQ ID NO: 812372 - RNA, 19 nt, Homo sapiens
uguuauuacuugcaugguu

SEQ ID NO: 812373 - RNA, 19 nt, Homo sapiens
aauauugaguuugcugaga

SEQ ID NO: 812374 - RNA, 19 nt, Homo sapiens
gaaucugaaccucgucugu

SEQ ID NO: 812375 - RNA, 19 nt, Homo sapiens
gaagcaagagaaucugaac

SEQ ID NO: 812376 - RNA, 19 nt, Homo sapiens
cgaagaaucucggggauca

SEQ ID NO: 812377 - RNA, 19 nt, Homo sapiens
cgugaggaauaaccaagug

SEQ ID NO: 812378 - RNA, 19 nt, Homo sapiens
ugaaaugugaaguacuuug

SEQ ID NO: 812379 - RNA, 19 nt, Homo sapiens
cagcucauccugcaguaug

SEQ ID NO: 812380 - RNA, 19 nt, Homo sapiens
caauugaacucccagauua

SEQ ID NO: 812381 - RNA, 19 nt, Homo sapiens
gaagagagauaugcaaaga

SEQ ID NO: 812382 - RNA, 19 nt, Homo sapiens
caaacuagaugcacaaaga

SEQ ID NO: 812383 - RNA, 19 nt, Homo sapiens
ggaggaagaucuuaagaga

SEQ ID NO: 812384 - RNA, 19 nt, Homo sapiens
uuaaagagcuucaaagaga

SEQ ID NO: 812385 - RNA, 19 nt, Homo sapiens
gaaauugccaagcuaaaua

SEQ ID NO: 812386 - RNA, 19 nt, Homo sapiens
gaaagcaccucaagcuguu

SEQ ID NO: 812387 - RNA, 19 nt, Homo sapiens
gcaaagaagcuauuaccua

SEQ ID NO: 812388 - RNA, 19 nt, Homo sapiens
gaguuuaucuguugacauu

SEQ ID NO: 812389 - RNA, 19 nt, Homo sapiens
gagcaacgccagaauuaua

SEQ ID NO: 812390 - RNA, 19 nt, Homo sapiens
gacuugaucuagaacauua

SEQ ID NO: 812391 - RNA, 19 nt, Homo sapiens
gcaaauacaauucgaaaga

SEQ ID NO: 812392 - RNA, 19 nt, Homo sapiens
caaaugaguugcucuagau

SEQ ID NO: 812393 - RNA, 19 nt, Homo sapiens
ggacuucucuggaaaccuu

SEQ ID NO: 812394 - RNA, 19 nt, Homo sapiens
gaaagauggugucaaucaa

SEQ ID NO: 812395 - RNA, 19 nt, Homo sapiens
cuaaauaacuccaguccaa

SEQ ID NO: 812396 - RNA, 19 nt, Homo sapiens
ccagaaagauggugucaau

SEQ ID NO: 812397 - RNA, 19 nt, Homo sapiens
caagcuggcucacaucaaa

SEQ ID NO: 812398 - RNA, 19 nt, Homo sapiens
uagccaaucugaauucuaa

SEQ ID NO: 812399 - RNA, 19 nt, Homo sapiens
gacuguagcuagaagauuu

SEQ ID NO: 812400 - RNA, 19 nt, Homo sapiens
gcacaaacuuucauuucau

SEQ ID NO: 812401 - RNA, 19 nt, Homo sapiens
gcaaaacucuagugacuuu

SEQ ID NO: 812402 - RNA, 19 nt, Homo sapiens
cauggaaccuucagcaauu

SEQ ID NO: 812403 - RNA, 19 nt, Homo sapiens
gaccagaagaugugaauaa

SEQ ID NO: 812404 - RNA, 19 nt, Homo sapiens
gaguuugucagcuuuauua

SEQ ID NO: 812405 - RNA, 19 nt, Homo sapiens
caacgaguuugucagcuuu

SEQ ID NO: 812406 - RNA, 19 nt, Homo sapiens
ggaccucucauauaccuua

SEQ ID NO: 812407 - RNA, 19 nt, Homo sapiens
cuaaggaccucucauauac

SEQ ID NO: 812408 - RNA, 19 nt, Homo sapiens
auagaaagguguaugugua

SEQ ID NO: 812409 - RNA, 19 nt, Homo sapiens
gcuagaagauuuaucaaac

SEQ ID NO: 812410 - RNA, 19 nt, Homo sapiens
aaauauaccucuaggacuu

SEQ ID NO: 812411 - RNA, 19 nt, Homo sapiens
gauuuaaacugucacuugu

SEQ ID NO: 812412 - RNA, 19 nt, Homo sapiens
gccaaacgcucagguuaaa

SEQ ID NO: 812413 - RNA, 19 nt, Homo sapiens
caacaacaguaaugugcaa

SEQ ID NO: 812414 - RNA, 19 nt, Homo sapiens
gcuaauaggugaauuugac

SEQ ID NO: 812415 - RNA, 19 nt, Homo sapiens
caaagagacuggccuggau

SEQ ID NO: 812416 - RNA, 19 nt, Homo sapiens
ccaaaugaguugcucuaga

SEQ ID NO: 812417 - RNA, 19 nt, Homo sapiens
gcaauugaacucccagauu

SEQ ID NO: 812418 - RNA, 19 nt, Homo sapiens
aggaagaucuuaagagaga

SEQ ID NO: 812419 - RNA, 19 nt, Homo sapiens
ggaaaaggaccaaauaaaa

SEQ ID NO: 812420 - RNA, 19 nt, Homo sapiens
gaacagaguaccaccaaca

SEQ ID NO: 812421 - RNA, 19 nt, Homo sapiens
gcuauuaccuacauaagag

SEQ ID NO: 812422 - RNA, 19 nt, Homo sapiens
uuaaacaacugacgagugu

SEQ ID NO: 812423 - RNA, 19 nt, Homo sapiens
cagaagaugugaauaaacu

SEQ ID NO: 812424 - RNA, 19 nt, Homo sapiens
caagacaaauauaccucua

SEQ ID NO: 812425 - RNA, 19 nt, Homo sapiens
gauaaacguaagccuauuu

SEQ ID NO: 812426 - RNA, 19 nt, Homo sapiens
ugacguuucuuaaugcaaa

SEQ ID NO: 812427 - RNA, 19 nt, Homo sapiens
gauggagacuguagcuaga

SEQ ID NO: 812428 - RNA, 19 nt, Homo sapiens
ugacuucaaugcagaguau

SEQ ID NO: 812429 - RNA, 19 nt, Homo sapiens
gaagcuauuaccuacauaa

SEQ ID NO: 812430 - RNA, 19 nt, Homo sapiens
ugccuuaaaugguagaaua

SEQ ID NO: 812431 - RNA, 19 nt, Homo sapiens
ggaagugugugcucgaucu

SEQ ID NO: 812432 - RNA, 19 nt, Homo sapiens
gaauaucucaccugacgaa

SEQ ID NO: 812433 - RNA, 19 nt, Homo sapiens
cuaaauccgucucagaaug

SEQ ID NO: 812434 - RNA, 19 nt, Homo sapiens
cuacacugcuucccacuug

SEQ ID NO: 812435 - RNA, 19 nt, Homo sapiens
uaagagagaagaggaaauu

SEQ ID NO: 812436 - RNA, 19 nt, Homo sapiens
ucauggaguuuaucuguug

SEQ ID NO: 812437 - RNA, 19 nt, Homo sapiens
gaagggaacaagaccaaug

SEQ ID NO: 812438 - RNA, 19 nt, Homo sapiens
ucaauugccugggauuuau

SEQ ID NO: 812439 - RNA, 19 nt, Homo sapiens
aagggaagcauuauguuua

SEQ ID NO: 812440 - RNA, 19 nt, Homo sapiens
gacaaaagcauuuccauuu

SEQ ID NO: 812441 - RNA, 19 nt, Homo sapiens
gugcagaggugguguggau

SEQ ID NO: 812442 - RNA, 19 nt, Homo sapiens
ucagaauguucaugaagaa

SEQ ID NO: 812443 - RNA, 19 nt, Homo sapiens
ucuaaggaccucucauaua

SEQ ID NO: 812444 - RNA, 19 nt, Homo sapiens
caacagguagccaaucuga

SEQ ID NO: 812445 - RNA, 19 nt, Homo sapiens
caaacccgguggaccauau

SEQ ID NO: 812446 - RNA, 19 nt, Homo sapiens
ggauaaacguaagccuauu

SEQ ID NO: 812447 - RNA, 19 nt, Homo sapiens
ggaaauugccaagcuaaau

SEQ ID NO: 812448 - RNA, 19 nt, Homo sapiens
gugaaaugcuuuuggauaa

SEQ ID NO: 812449 - RNA, 19 nt, Homo sapiens
caaccuaucugcccaucuc

SEQ ID NO: 812450 - RNA, 19 nt, Homo sapiens
agucagugcucucuagaaa

SEQ ID NO: 812451 - RNA, 19 nt, Homo sapiens
caugaacccugcaaauaca

SEQ ID NO: 812452 - RNA, 19 nt, Homo sapiens
gguguuugcuaguugugua

SEQ ID NO: 812453 - RNA, 19 nt, Homo sapiens
gcagagucaugguccuaga

SEQ ID NO: 812454 - RNA, 19 nt, Homo sapiens
acucccagauuauuugaua

SEQ ID NO: 812455 - RNA, 19 nt, Homo sapiens
gcacgacauugagacuauu

SEQ ID NO: 812456 - RNA, 19 nt, Homo sapiens
cagaguuuauugauccuuu

SEQ ID NO: 812457 - RNA, 19 nt, Homo sapiens
agagagauaugcaaagaag

SEQ ID NO: 812458 - RNA, 19 nt, Homo sapiens
gcaaugggaagcauacugu

SEQ ID NO: 812459 - RNA, 19 nt, Homo sapiens
cagaaucuccuguauguuc

SEQ ID NO: 812460 - RNA, 19 nt, Homo sapiens
guuuaucuguugacauuga

SEQ ID NO: 812461 - RNA, 19 nt, Homo sapiens
ucaaacagcacaaacuuuc

SEQ ID NO: 812462 - RNA, 19 nt, Homo sapiens
gaaagguguauguguauag

SEQ ID NO: 812463 - RNA, 19 nt, Homo sapiens
gaauguucaugaagaaguc

SEQ ID NO: 812464 - RNA, 19 nt, Homo sapiens
uaccagagccacaagaauu

SEQ ID NO: 812465 - RNA, 19 nt, Homo sapiens
gaaaagggaagcauuaugu

SEQ ID NO: 812466 - RNA, 19 nt, Homo sapiens
caacaucaccguacugcau

SEQ ID NO: 812467 - RNA, 19 nt, Homo sapiens
gauccauugucuauauuuc

SEQ ID NO: 812468 - RNA, 19 nt, Homo sapiens
ggugaaacuuuggcuguug

SEQ ID NO: 812469 - RNA, 19 nt, Homo sapiens
guagcuagaagauuuauca

SEQ ID NO: 812470 - RNA, 19 nt, Homo sapiens
aaagggaagcauuauguuu

SEQ ID NO: 812471 - RNA, 19 nt, Homo sapiens
ggccaaacgcucagguuaa

SEQ ID NO: 812472 - RNA, 19 nt, Homo sapiens
agaaagguguauguguaua

SEQ ID NO: 812473 - RNA, 19 nt, Homo sapiens
gaggaaauugccaagcuaa

SEQ ID NO: 812474 - RNA, 19 nt, Homo sapiens
ccugaaggccuacaagaaa

SEQ ID NO: 812475 - RNA, 19 nt, Homo sapiens
ucaacgaguuugucagcuu

SEQ ID NO: 812476 - RNA, 19 nt, Homo sapiens
ugucaaaugugggcaaaga

SEQ ID NO: 812477 - RNA, 19 nt, Homo sapiens
uauacaggcugacuugauc

SEQ ID NO: 812478 - RNA, 19 nt, Homo sapiens
uuucugacguuucuuaaug

SEQ ID NO: 812479 - RNA, 19 nt, Homo sapiens
gggauccauugucuauauu

SEQ ID NO: 812480 - RNA, 19 nt, Homo sapiens
gcacaggcaucaaguucua

SEQ ID NO: 812481 - RNA, 19 nt, Homo sapiens
cagcagagguuguccauga

SEQ ID NO: 812482 - RNA, 19 nt, Homo sapiens
gaccucaccugcuuaauug

SEQ ID NO: 812483 - RNA, 19 nt, Homo sapiens
ccuccugacuguaauaaua

SEQ ID NO: 812484 - RNA, 19 nt, Homo sapiens
ccacuguccuguccauuga

SEQ ID NO: 812485 - RNA, 19 nt, Homo sapiens
ggccgacgcucuucagcua

SEQ ID NO: 812486 - RNA, 19 nt, Homo sapiens
gccauugucugcaacuuug

SEQ ID NO: 812487 - RNA, 19 nt, Homo sapiens
gcuggugucugacuucuuc

SEQ ID NO: 812488 - RNA, 19 nt, Homo sapiens
gagagcugguccaucauga

SEQ ID NO: 812489 - RNA, 19 nt, Homo sapiens
gcugguccaucaugaagaa

SEQ ID NO: 812490 - RNA, 19 nt, Homo sapiens
gaggaacuuuggaggaaau

SEQ ID NO: 812491 - RNA, 19 nt, Homo sapiens
ggaugacccugacugaaag

SEQ ID NO: 812492 - RNA, 19 nt, Homo sapiens
gaacuuuggaggaaauugu

SEQ ID NO: 812493 - RNA, 19 nt, Homo sapiens
ccagggcugugucuccuuu

SEQ ID NO: 812494 - RNA, 19 nt, Homo sapiens
ugaccucaccugcuuaauu

SEQ ID NO: 812495 - RNA, 19 nt, Homo sapiens
ccaagaggcugcguguugu

SEQ ID NO: 812496 - RNA, 19 nt, Homo sapiens
ggaacgacuuucagauggu

SEQ ID NO: 812497 - RNA, 19 nt, Homo sapiens
caggaguucugucucuuug

SEQ ID NO: 812498 - RNA, 19 nt, Homo sapiens
ccacggagcugggcaucau

SEQ ID NO: 812499 - RNA, 19 nt, Homo sapiens
ggugcaagcuuggguguca

SEQ ID NO: 812500 - RNA, 19 nt, Homo sapiens
gaaaggcugcgugagaaga

SEQ ID NO: 812501 - RNA, 19 nt, Homo sapiens
ugacuucggcugaggauga

SEQ ID NO: 812502 - RNA, 19 nt, Homo sapiens
caacgguucccuugauuuc

SEQ ID NO: 812503 - RNA, 19 nt, Homo sapiens
guuauuggguuagagaaug

SEQ ID NO: 812504 - RNA, 19 nt, Homo sapiens
gaccugggcuguggugcaa

SEQ ID NO: 812505 - RNA, 19 nt, Homo sapiens
aagcuugggugucaucuca

SEQ ID NO: 812506 - RNA, 19 nt, Homo sapiens
cgacgcucuucagcuauua

SEQ ID NO: 812507 - RNA, 19 nt, Homo sapiens
gcaucaaguucuacuccau

SEQ ID NO: 812508 - RNA, 19 nt, Homo sapiens
cugaaaggcugcgugagaa

SEQ ID NO: 812509 - RNA, 19 nt, Homo sapiens
caucagcaguggccuggau

SEQ ID NO: 812510 - RNA, 19 nt, Homo sapiens
agcgagagcugguccauca

SEQ ID NO: 812511 - RNA, 19 nt, Homo sapiens
ucaccucccuuaccuguac

SEQ ID NO: 812512 - RNA, 19 nt, Homo sapiens
gagcugggaacgacuuuca

SEQ ID NO: 812513 - RNA, 19 nt, Homo sapiens
ggaguucugucucuuugcu

SEQ ID NO: 812514 - RNA, 19 nt, Homo sapiens
gcuccucugugcauccuau

SEQ ID NO: 812515 - RNA, 19 nt, Homo sapiens
ccaagucuguggucucaac

SEQ ID NO: 812516 - RNA, 19 nt, Homo sapiens
cagccugaguggcgagauu

SEQ ID NO: 812517 - RNA, 19 nt, Homo sapiens
ggacucugaccgcaaacaa

SEQ ID NO: 812518 - RNA, 19 nt, Homo sapiens
gagcucagccugguguaug

SEQ ID NO: 812519 - RNA, 19 nt, Homo sapiens
gaugucaccucccuuaccu

SEQ ID NO: 812520 - RNA, 19 nt, Homo sapiens
ccgacgcucuucagcuauu

SEQ ID NO: 812521 - RNA, 19 nt, Homo sapiens
ucacaggguucugcaucuu

SEQ ID NO: 812522 - RNA, 19 nt, Homo sapiens
cuucagcuauuacaacauc

SEQ ID NO: 812523 - RNA, 19 nt, Homo sapiens
aggaugacccugacugaaa

SEQ ID NO: 812524 - RNA, 19 nt, Homo sapiens
gacccugccuucuccaucu

SEQ ID NO: 812525 - RNA, 19 nt, Homo sapiens
cccaagaggcugcguguug

SEQ ID NO: 812526 - RNA, 19 nt, Homo sapiens
uguggugguuauuggguua

SEQ ID NO: 812527 - RNA, 19 nt, Homo sapiens
gggaaagagccgaguaucu

SEQ ID NO: 812528 - RNA, 19 nt, Homo sapiens
gcuugggugucaucucaga

SEQ ID NO: 812529 - RNA, 19 nt, Homo sapiens
ggacucgugcugccucuuc

SEQ ID NO: 812530 - RNA, 19 nt, Homo sapiens
ucacacuggccaagaggua

SEQ ID NO: 812531 - RNA, 19 nt, Homo sapiens
ccaggaguucugucucuuu

SEQ ID NO: 812532 - RNA, 19 nt, Homo sapiens
caucaaguucuacuccauu

SEQ ID NO: 812533 - RNA, 19 nt, Homo sapiens
ugaggaacuuuggaggaaa

SEQ ID NO: 812534 - RNA, 19 nt, Homo sapiens
ggagcuagcagaccugaac

SEQ ID NO: 812535 - RNA, 19 nt, Homo sapiens
cacaggguucugcaucuua

SEQ ID NO: 812536 - RNA, 19 nt, Homo sapiens
uguggacucugaccgcaaa

SEQ ID NO: 812537 - RNA, 19 nt, Homo sapiens
cagcacaggcaucaaguuc

SEQ ID NO: 812538 - RNA, 19 nt, Homo sapiens
uuaccgcucugguguucuu

SEQ ID NO: 812539 - RNA, 19 nt, Homo sapiens
ggagagcugggaacgacuu

SEQ ID NO: 812540 - RNA, 19 nt, Homo sapiens
gaggaugacccugacugaa

SEQ ID NO: 812541 - RNA, 19 nt, Homo sapiens
gagcugguccaucaugaag

SEQ ID NO: 812542 - RNA, 19 nt, Homo sapiens
gcagcacaggcaucaaguu

SEQ ID NO: 812543 - RNA, 19 nt, Homo sapiens
cauuaccgcucugguguuc

SEQ ID NO: 812544 - RNA, 19 nt, Homo sapiens
ggugugggacgccauugaa

SEQ ID NO: 812545 - RNA, 19 nt, Homo sapiens
gcuacccacugcugaaacu

SEQ ID NO: 812546 - RNA, 19 nt, Homo sapiens
uguaccaccuccuguguca

SEQ ID NO: 812547 - RNA, 19 nt, Homo sapiens
gcacaccaagaacccauca

SEQ ID NO: 812548 - RNA, 19 nt, Homo sapiens
aaacuacggggaccuguua

SEQ ID NO: 812549 - RNA, 19 nt, Homo sapiens
ccaccccugugaaggauua

SEQ ID NO: 812550 - RNA, 19 nt, Homo sapiens
ggaggugugggacgccauu

SEQ ID NO: 812551 - RNA, 19 nt, Homo sapiens
gcugggaacgacuuucaga

SEQ ID NO: 812552 - RNA, 19 nt, Homo sapiens
gaggcugcguguugucuac

SEQ ID NO: 812553 - RNA, 19 nt, Homo sapiens
ugucugacuucuuccuuca

SEQ ID NO: 812554 - RNA, 19 nt, Homo sapiens
uggcaccguugucuggauu

SEQ ID NO: 812555 - RNA, 19 nt, Homo sapiens
ccaagaccacacacugaga

SEQ ID NO: 812556 - RNA, 19 nt, Homo sapiens
guacagcagcagcgacaca

SEQ ID NO: 812557 - RNA, 19 nt, Homo sapiens
cuuaauugacaccaacuuu

SEQ ID NO: 812558 - RNA, 19 nt, Homo sapiens
auggagacgucacgcugua

SEQ ID NO: 812559 - RNA, 19 nt, Homo sapiens
augaggaacuuuggaggaa

SEQ ID NO: 812560 - RNA, 19 nt, Homo sapiens
ugacggaacagagcccauu

SEQ ID NO: 812561 - RNA, 19 nt, Homo sapiens
acaggguucugcaucuuag

SEQ ID NO: 812562 - RNA, 19 nt, Homo sapiens
aaacaaggagagccuacug

SEQ ID NO: 812563 - RNA, 19 nt, Homo sapiens
gcccugugcacaccaagaa

SEQ ID NO: 812564 - RNA, 19 nt, Homo sapiens
gcauuaccgcucugguguu

SEQ ID NO: 812565 - RNA, 19 nt, Homo sapiens
ugacuucuuccuucagaug

SEQ ID NO: 812566 - RNA, 19 nt, Homo sapiens
ugaggaugacccugacuga

SEQ ID NO: 812567 - RNA, 19 nt, Homo sapiens
acugaaaggcugcgugaga

SEQ ID NO: 812568 - RNA, 19 nt, Homo sapiens
acgguucccuugauuucuu

SEQ ID NO: 812569 - RNA, 19 nt, Homo sapiens
agccugaccucaccugcuu

SEQ ID NO: 812570 - RNA, 19 nt, Homo sapiens
ggagacgucacgcuguaca

SEQ ID NO: 812571 - RNA, 19 nt, Homo sapiens
ucacguugcagccgucuuc

SEQ ID NO: 812572 - RNA, 19 nt, Homo sapiens
gguccaucaugaagaacau

SEQ ID NO: 812573 - RNA, 19 nt, Homo sapiens
cgagagcugguccaucaug

SEQ ID NO: 812574 - RNA, 19 nt, Homo sapiens
gcuauuacaacaucacacu

SEQ ID NO: 812575 - RNA, 19 nt, Homo sapiens
uuauuggguuagagaaugu

SEQ ID NO: 812576 - RNA, 19 nt, Homo sapiens
ccucugugcuggagaagcu

SEQ ID NO: 812577 - RNA, 19 nt, Homo sapiens
ugggaacgacuuucagaug

SEQ ID NO: 812578 - RNA, 19 nt, Homo sapiens
gagagcugggaacgacuuu

SEQ ID NO: 812579 - RNA, 19 nt, Homo sapiens
gcauccugguauacacaga

SEQ ID NO: 812580 - RNA, 19 nt, Homo sapiens
gaacuguccugccaaauaa

SEQ ID NO: 812581 - RNA, 19 nt, Homo sapiens
caaagugaaugaacucuua

SEQ ID NO: 812582 - RNA, 19 nt, Homo sapiens
ggaaaugcgugcccaagua

SEQ ID NO: 812583 - RNA, 19 nt, Homo sapiens
gagaagagcugggaucaaa

SEQ ID NO: 812584 - RNA, 19 nt, Homo sapiens
gauaagaggucgaaacuuc

SEQ ID NO: 812585 - RNA, 19 nt, Homo sapiens
gaagagaaacuuagagaaa

SEQ ID NO: 812586 - RNA, 19 nt, Homo sapiens
gaauaaagaccaacagauu

SEQ ID NO: 812587 - RNA, 19 nt, Homo sapiens
ggucgaaacuucagagaaa

SEQ ID NO: 812588 - RNA, 19 nt, Homo sapiens
gcacaggucucuccaaagu

SEQ ID NO: 812589 - RNA, 19 nt, Homo sapiens
gaagauuccuccuuguauu

SEQ ID NO: 812590 - RNA, 19 nt, Homo sapiens
gcaaaggguuauacaauuc

SEQ ID NO: 812591 - RNA, 19 nt, Homo sapiens
caaauacacugaccugguu

SEQ ID NO: 812592 - RNA, 19 nt, Homo sapiens
ggaacuguccugccaaaua

SEQ ID NO: 812593 - RNA, 19 nt, Homo sapiens
caaaggagguuaugaaugc

SEQ ID NO: 812594 - RNA, 19 nt, Homo sapiens
ggauaucagugaaguuauu

SEQ ID NO: 812595 - RNA, 19 nt, Homo sapiens
caacaagaguggaagauuc

SEQ ID NO: 812596 - RNA, 19 nt, Homo sapiens
gcaaaggcccgaugaagaa

SEQ ID NO: 812597 - RNA, 19 nt, Homo sapiens
ccuccaagguucaagauua

SEQ ID NO: 812598 - RNA, 19 nt, Homo sapiens
gaacagcugcauaugagua

SEQ ID NO: 812599 - RNA, 19 nt, Homo sapiens
aaagaugacuguaaaggaa

SEQ ID NO: 812600 - RNA, 19 nt, Homo sapiens
ggaagaagcggaagaagau

SEQ ID NO: 812601 - RNA, 19 nt, Homo sapiens
gaagaggacuacagacagu

SEQ ID NO: 812602 - RNA, 19 nt, Homo sapiens
caaaggcucuucaaccaau

SEQ ID NO: 812603 - RNA, 19 nt, Homo sapiens
ugaagaagcuauuaaagag

SEQ ID NO: 812604 - RNA, 19 nt, Homo sapiens
aaugaacucuuacccauaa

SEQ ID NO: 812605 - RNA, 19 nt, Homo sapiens
gaucaaaacucauguggaa

SEQ ID NO: 812606 - RNA, 19 nt, Homo sapiens
gcagaagcccucuacauug

SEQ ID NO: 812607 - RNA, 19 nt, Homo sapiens
cuggauaccucgguuauua

SEQ ID NO: 812608 - RNA, 19 nt, Homo sapiens
gauauggcccagaguauuu

SEQ ID NO: 812609 - RNA, 19 nt, Homo sapiens
gccgaaagaugacuguaaa

SEQ ID NO: 812610 - RNA, 19 nt, Homo sapiens
acacugaccugguuccaaa

SEQ ID NO: 812611 - RNA, 19 nt, Homo sapiens
gaaagaugacuguaaagga

SEQ ID NO: 812612 - RNA, 19 nt, Homo sapiens
ucgagcagcugacaaauug

SEQ ID NO: 812613 - RNA, 19 nt, Homo sapiens
gaaugaacucuuacccaua

SEQ ID NO: 812614 - RNA, 19 nt, Homo sapiens
cagcaugaccggaaucuuu

SEQ ID NO: 812615 - RNA, 19 nt, Homo sapiens
uaagaacagcugcauauga

SEQ ID NO: 812616 - RNA, 19 nt, Homo sapiens
ggcagaagcccucuacauu

SEQ ID NO: 812617 - RNA, 19 nt, Homo sapiens
caaggucauuuauagcaaa

SEQ ID NO: 812618 - RNA, 19 nt, Homo sapiens
guggagaagaugaaauuua

SEQ ID NO: 812619 - RNA, 19 nt, Homo sapiens
cuacagacaguacacauaa

SEQ ID NO: 812620 - RNA, 19 nt, Homo sapiens
caaaagacaaggucauuua

SEQ ID NO: 812621 - RNA, 19 nt, Homo sapiens
ggaagaagccaaacagcau

SEQ ID NO: 812622 - RNA, 19 nt, Homo sapiens
ggacauguauggugaugac

SEQ ID NO: 812623 - RNA, 19 nt, Homo sapiens
gaugaaauccggcaugaca

SEQ ID NO: 812624 - RNA, 19 nt, Homo sapiens
acaggucucuccaaaguga

SEQ ID NO: 812625 - RNA, 19 nt, Homo sapiens
ccaaggaacacgagcauga

SEQ ID NO: 812626 - RNA, 19 nt, Homo sapiens
gaaguucaguaugaccaaa

SEQ ID NO: 812627 - RNA, 19 nt, Homo sapiens
gaacaacaagaguggaaga

SEQ ID NO: 812628 - RNA, 19 nt, Homo sapiens
gcauucaacucuggagcua

SEQ ID NO: 812629 - RNA, 19 nt, Homo sapiens
aagacaaggucauuuauag

SEQ ID NO: 812630 - RNA, 19 nt, Homo sapiens
ugcaaaggguuauacaauu

SEQ ID NO: 812631 - RNA, 19 nt, Homo sapiens
gggaacacuuuguaaaugg

SEQ ID NO: 812632 - RNA, 19 nt, Homo sapiens
uuagagaaauggcccagaa

SEQ ID NO: 812633 - RNA, 19 nt, Homo sapiens
ggagcuaaacagaggguua

SEQ ID NO: 812634 - RNA, 19 nt, Homo sapiens
gaagaagcuauuaaagaga

SEQ ID NO: 812635 - RNA, 19 nt, Homo sapiens
ggauaugggacgaaagaaa

SEQ ID NO: 812636 - RNA, 19 nt, Homo sapiens
gacaagaguagccuuagaa

SEQ ID NO: 812637 - RNA, 19 nt, Homo sapiens
cugcauaugaguaaaguua

SEQ ID NO: 812638 - RNA, 19 nt, Homo sapiens
ugaccuagaagccagaaua

SEQ ID NO: 812639 - RNA, 19 nt, Homo sapiens
gagaggugguaaagauaug

SEQ ID NO: 812640 - RNA, 19 nt, Homo sapiens
ggagaggugguaaagauau

SEQ ID NO: 812641 - RNA, 19 nt, Homo sapiens
gaaaagagagacagcauga

SEQ ID NO: 812642 - RNA, 19 nt, Homo sapiens
uaaagaguggguuguguuu

SEQ ID NO: 812643 - RNA, 19 nt, Homo sapiens
guauggugaugaccuagaa

SEQ ID NO: 812644 - RNA, 19 nt, Homo sapiens
agagaaacuuagagaaaug

SEQ ID NO: 812645 - RNA, 19 nt, Homo sapiens
ccaagguucaagauuaaua

SEQ ID NO: 812646 - RNA, 19 nt, Homo sapiens
gagaaggaccagugcaguu

SEQ ID NO: 812647 - RNA, 19 nt, Homo sapiens
aaagauauggcccagagua

SEQ ID NO: 812648 - RNA, 19 nt, Homo sapiens
aagaacagcugcauaugag

SEQ ID NO: 812649 - RNA, 19 nt, Homo sapiens
gcaagaagaggaggaagga

SEQ ID NO: 812650 - RNA, 19 nt, Homo sapiens
gaccuagaagccagaauaa

SEQ ID NO: 812651 - RNA, 19 nt, Homo sapiens
aaagacaagaguagccuua

SEQ ID NO: 812652 - RNA, 19 nt, Homo sapiens
caagaccacuuacuuuuau

SEQ ID NO: 812653 - RNA, 19 nt, Homo sapiens
gaaaugcgugcccaaguag

SEQ ID NO: 812654 - RNA, 19 nt, Homo sapiens
gauggaagaggacuacaga

SEQ ID NO: 812655 - RNA, 19 nt, Homo sapiens
agaagaggaggaaggaaua

SEQ ID NO: 812656 - RNA, 19 nt, Homo sapiens
guauuuauaggcccaguaa

SEQ ID NO: 812657 - RNA, 19 nt, Homo sapiens
cagaagcccucuacauugc

SEQ ID NO: 812658 - RNA, 19 nt, Homo sapiens
agacaguacacauaaauga

SEQ ID NO: 812659 - RNA, 19 nt, Homo sapiens
cgggauaucagugaaguua

SEQ ID NO: 812660 - RNA, 19 nt, Homo sapiens
cuccaagguucaagauuaa

SEQ ID NO: 812661 - RNA, 19 nt, Homo sapiens
ugguagaaaugcagaaaga

SEQ ID NO: 812662 - RNA, 19 nt, Homo sapiens
agacaagaguagccuuaga

SEQ ID NO: 812663 - RNA, 19 nt, Homo sapiens
cgaugaagaagcuauuaaa

SEQ ID NO: 812664 - RNA, 19 nt, Homo sapiens
gagcaugaaggcaagaaga

SEQ ID NO: 812665 - RNA, 19 nt, Homo sapiens
ggaagauccuuuugguuug

SEQ ID NO: 812666 - RNA, 19 nt, Homo sapiens
cauguauggugaugaccua

SEQ ID NO: 812667 - RNA, 19 nt, Homo sapiens
cuggagaggugguaaagau

SEQ ID NO: 812668 - RNA, 19 nt, Homo sapiens
uguaagaacagcugcauau

SEQ ID NO: 812669 - RNA, 19 nt, Homo sapiens
aagaguggguuguguuugu

SEQ ID NO: 812670 - RNA, 19 nt, Homo sapiens
ggaacacuuuguaaauggu

SEQ ID NO: 812671 - RNA, 19 nt, Homo sapiens
gaaggaccagugcaguuug

SEQ ID NO: 812672 - RNA, 19 nt, Homo sapiens
cuagaagccagaauaaaga

SEQ ID NO: 812673 - RNA, 19 nt, Homo sapiens
gacaguacacauaaaugaa

SEQ ID NO: 812674 - RNA, 19 nt, Homo sapiens
aggcacaggucucuccaaa

SEQ ID NO: 812675 - RNA, 19 nt, Homo sapiens
ucuccuagccgaaagauga

SEQ ID NO: 812676 - RNA, 19 nt, Homo sapiens
guagaaaugcagaaagauc

SEQ ID NO: 812677 - RNA, 19 nt, Homo sapiens
ccaaaggagguuaugaaug

SEQ ID NO: 812678 - RNA, 19 nt, Homo sapiens
gacaaggucauuuauagca

SEQ ID NO: 812679 - RNA, 19 nt, Homo sapiens
ccaccuuucagcauuuaua

SEQ ID NO: 812680 - RNA, 19 nt, Homo sapiens
cuaaagagcugauaacaua

SEQ ID NO: 812681 - RNA, 19 nt, Homo sapiens
caacaaaccucuuuacauu

SEQ ID NO: 812682 - RNA, 19 nt, Homo sapiens
caacagagaugaacaaaga

SEQ ID NO: 812683 - RNA, 19 nt, Homo sapiens
gcagagcuguguuauauuu

SEQ ID NO: 812684 - RNA, 19 nt, Homo sapiens
ggaauucucucuacaguga

SEQ ID NO: 812685 - RNA, 19 nt, Homo sapiens
gcaaugcacuuuaucaaga

SEQ ID NO: 812686 - RNA, 19 nt, Homo sapiens
ggaaucaccugguccuuaa

SEQ ID NO: 812687 - RNA, 19 nt, Homo sapiens
ggaauguguuucuguauuu

SEQ ID NO: 812688 - RNA, 19 nt, Homo sapiens
gagcauuacucuagauaaa

SEQ ID NO: 812689 - RNA, 19 nt, Homo sapiens
gagcuaaucugccuugguu

SEQ ID NO: 812690 - RNA, 19 nt, Homo sapiens
ccgcagaucucaucacuuu

SEQ ID NO: 812691 - RNA, 19 nt, Homo sapiens
gaaaggcgaugacaagaag

SEQ ID NO: 812692 - RNA, 19 nt, Homo sapiens
ccaaagaaauacugaguug

SEQ ID NO: 812693 - RNA, 19 nt, Homo sapiens
gcucuagaaugaacacaua

SEQ ID NO: 812694 - RNA, 19 nt, Homo sapiens
uggaacagcucuagaauga

SEQ ID NO: 812695 - RNA, 19 nt, Homo sapiens
aaacuugggugaacauaaa

SEQ ID NO: 812696 - RNA, 19 nt, Homo sapiens
gaacagcucuagaaugaac

SEQ ID NO: 812697 - RNA, 19 nt, Homo sapiens
cugcaaaucuguuagcaua

SEQ ID NO: 812698 - RNA, 19 nt, Homo sapiens
caacagccaaucucaaaua

SEQ ID NO: 812699 - RNA, 19 nt, Homo sapiens
uggaggagcucguggauaa

SEQ ID NO: 812700 - RNA, 19 nt, Homo sapiens
gcacuaagguugugguucu

SEQ ID NO: 812701 - RNA, 19 nt, Homo sapiens
gcaaaugaaccgagagaaa

SEQ ID NO: 812702 - RNA, 19 nt, Homo sapiens
caaugugacuguugauuug

SEQ ID NO: 812703 - RNA, 19 nt, Homo sapiens
gagcugauaacauaguuua

SEQ ID NO: 812704 - RNA, 19 nt, Homo sapiens
cagcccaucucuaauuaua

SEQ ID NO: 812705 - RNA, 19 nt, Homo sapiens
gcaaaucuguuagcauaau

SEQ ID NO: 812706 - RNA, 19 nt, Homo sapiens
gagaugggcucgugcugaa

SEQ ID NO: 812707 - RNA, 19 nt, Homo sapiens
ggaagaagauguagauagc

SEQ ID NO: 812708 - RNA, 19 nt, Homo sapiens
gauguuauucccuuucuua

SEQ ID NO: 812709 - RNA, 19 nt, Homo sapiens
gcaggucaaucuuuguauu

SEQ ID NO: 812710 - RNA, 19 nt, Homo sapiens
acaaaccucuuuacauuga

SEQ ID NO: 812711 - RNA, 19 nt, Homo sapiens
caagcuggcugcaagacua

SEQ ID NO: 812712 - RNA, 19 nt, Homo sapiens
gcccaucucuaauuauaaa

SEQ ID NO: 812713 - RNA, 19 nt, Homo sapiens
caacauggcugggucuuca

SEQ ID NO: 812714 - RNA, 19 nt, Homo sapiens
gcacugaccaacaaauaaa

SEQ ID NO: 812715 - RNA, 19 nt, Homo sapiens
gaaaauacacagucguuua

SEQ ID NO: 812716 - RNA, 19 nt, Homo sapiens
gcagaucucaucacuuuga

SEQ ID NO: 812717 - RNA, 19 nt, Homo sapiens
gcaaguaggugaacauucc

SEQ ID NO: 812718 - RNA, 19 nt, Homo sapiens
ccaaaucucucaaaaugua

SEQ ID NO: 812719 - RNA, 19 nt, Homo sapiens
gcuagaacuucgucauuga

SEQ ID NO: 812720 - RNA, 19 nt, Homo sapiens
ccaaggaccuccaaguugu

SEQ ID NO: 812721 - RNA, 19 nt, Homo sapiens
gcucguggauaaagauaaa

SEQ ID NO: 812722 - RNA, 19 nt, Homo sapiens
gaaaggacgguucgagcua

SEQ ID NO: 812723 - RNA, 19 nt, Homo sapiens
aauacgagccuucaaauaa

SEQ ID NO: 812724 - RNA, 19 nt, Homo sapiens
cuucagugcuagaaaguua

SEQ ID NO: 812725 - RNA, 19 nt, Homo sapiens
gaacugagaagcccauauc

SEQ ID NO: 812726 - RNA, 19 nt, Homo sapiens
gaaucggucucuaucucua

SEQ ID NO: 812727 - RNA, 19 nt, Homo sapiens
caaugagaauguugucaaa

SEQ ID NO: 812728 - RNA, 19 nt, Homo sapiens
gaacacugucugaauuaaa

SEQ ID NO: 812729 - RNA, 19 nt, Homo sapiens
ucaaagugguuacaauuca

SEQ ID NO: 812730 - RNA, 19 nt, Homo sapiens
ggaggauacucgaauguca

SEQ ID NO: 812731 - RNA, 19 nt, Homo sapiens
cagagaauuuccaaacuug

SEQ ID NO: 812732 - RNA, 19 nt, Homo sapiens
caaaggagagucaaggaaa

SEQ ID NO: 812733 - RNA, 19 nt, Homo sapiens
gcagaugggcaagcauuua

SEQ ID NO: 812734 - RNA, 19 nt, Homo sapiens
ccuaguuucuguaauauug

SEQ ID NO: 812735 - RNA, 19 nt, Homo sapiens
uaccaaaccugcagaagga

SEQ ID NO: 812736 - RNA, 19 nt, Homo sapiens
auacgagccuucaaauaaa

SEQ ID NO: 812737 - RNA, 19 nt, Homo sapiens
ucuaauccaugcuguauug

SEQ ID NO: 812738 - RNA, 19 nt, Homo sapiens
ucagagaauuuccaaacuu

SEQ ID NO: 812739 - RNA, 19 nt, Homo sapiens
gaacuaagccaggaagaca

SEQ ID NO: 812740 - RNA, 19 nt, Homo sapiens
gaaaugauccaauccaacu

SEQ ID NO: 812741 - RNA, 19 nt, Homo sapiens
gaaagcaggaccucaggaa

SEQ ID NO: 812742 - RNA, 19 nt, Homo sapiens
ggacaacgcccugcaggaa

SEQ ID NO: 812743 - RNA, 19 nt, Homo sapiens
ggaaaggcgaugacaagaa

SEQ ID NO: 812744 - RNA, 19 nt, Homo sapiens
aggcaaacguuauuaguga

SEQ ID NO: 812745 - RNA, 19 nt, Homo sapiens
cgaaggugcuuuacagauc

SEQ ID NO: 812746 - RNA, 19 nt, Homo sapiens
gagagaauuugugucuauu

SEQ ID NO: 812747 - RNA, 19 nt, Homo sapiens
agagagaauuugugucuau

SEQ ID NO: 812748 - RNA, 19 nt, Homo sapiens
gcucagcccaucucuaauu

SEQ ID NO: 812749 - RNA, 19 nt, Homo sapiens
gcacagaaugaacauagaa

SEQ ID NO: 812750 - RNA, 19 nt, Homo sapiens
ggacuggauucaccaaugg

SEQ ID NO: 812751 - RNA, 19 nt, Homo sapiens
gauccggacccuucccuua

SEQ ID NO: 812752 - RNA, 19 nt, Homo sapiens
gaacuggaauguguuucug

SEQ ID NO: 812753 - RNA, 19 nt, Homo sapiens
aaaaguggcuggucuacua

SEQ ID NO: 812754 - RNA, 19 nt, Homo sapiens
uagcucagcccaucucuaa

SEQ ID NO: 812755 - RNA, 19 nt, Homo sapiens
gaugguacuuagaggcuuu

SEQ ID NO: 812756 - RNA, 19 nt, Homo sapiens
caaaugaaccgagagaaau

SEQ ID NO: 812757 - RNA, 19 nt, Homo sapiens
gcaagaagccagccagucu

SEQ ID NO: 812758 - RNA, 19 nt, Homo sapiens
gggaaucaccugguccuua

SEQ ID NO: 812759 - RNA, 19 nt, Homo sapiens
acacacccauugaagaauu

SEQ ID NO: 812760 - RNA, 19 nt, Homo sapiens
gaauguguuucuguauuug

SEQ ID NO: 812761 - RNA, 19 nt, Homo sapiens
gagaauuugugucuauugg

SEQ ID NO: 812762 - RNA, 19 nt, Homo sapiens
gaucgauggcagucacuua

SEQ ID NO: 812763 - RNA, 19 nt, Homo sapiens
gaaggugcuuuacagaucu

SEQ ID NO: 812764 - RNA, 19 nt, Homo sapiens
ccucauaucuuuuguaguu

SEQ ID NO: 812765 - RNA, 19 nt, Homo sapiens
ccuuaaaucucuuguaugg

SEQ ID NO: 812766 - RNA, 19 nt, Homo sapiens
ucacauggaguuagucaaa

SEQ ID NO: 812767 - RNA, 19 nt, Homo sapiens
cgaaaccgaaggugcuuua

SEQ ID NO: 812768 - RNA, 19 nt, Homo sapiens
aaaucucucucaucgagua

SEQ ID NO: 812769 - RNA, 19 nt, Homo sapiens
gaucagagcaggugagcau

SEQ ID NO: 812770 - RNA, 19 nt, Homo sapiens
ggacuuggaugaggauuuu

SEQ ID NO: 812771 - RNA, 19 nt, Homo sapiens
uaauacgagccuucaaaua

SEQ ID NO: 812772 - RNA, 19 nt, Homo sapiens
ggccagcucugccucucua

SEQ ID NO: 812773 - RNA, 19 nt, Homo sapiens
gugaacacugucugaauua

SEQ ID NO: 812774 - RNA, 19 nt, Homo sapiens
uuacaugccuaguuucugu

SEQ ID NO: 812775 - RNA, 19 nt, Homo sapiens
caauaguuccucauucaaa

SEQ ID NO: 812776 - RNA, 19 nt, Homo sapiens
caagaugaaucggucucua

SEQ ID NO: 812777 - RNA, 19 nt, Homo sapiens
cagcuugucuuaacaguac

SEQ ID NO: 812778 - RNA, 19 nt, Homo sapiens
gagcauccacuuugacaug

SEQ ID NO: 812779 - RNA, 19 nt, Homo sapiens
caagagagaauuugugucu

SEQ ID NO: 812780 - RNA, 19 nt, Homo sapiens
ggaauucucucuacaguga

SEQ ID NO: 812781 - RNA, 19 nt, Homo sapiens
ggaaucaccugguccuuaa

SEQ ID NO: 812782 - RNA, 19 nt, Homo sapiens
ggaauacccuuaucgaaug

SEQ ID NO: 812783 - RNA, 19 nt, Homo sapiens
gaaauaauguacugugugu

SEQ ID NO: 812784 - RNA, 19 nt, Homo sapiens
ggucaggucucgaaaugaa

SEQ ID NO: 812785 - RNA, 19 nt, Homo sapiens
uggaggagcucguggauaa

SEQ ID NO: 812786 - RNA, 19 nt, Homo sapiens
gaaucuuucuaucagguua

SEQ ID NO: 812787 - RNA, 19 nt, Homo sapiens
ggauaaacccgaggagaua

SEQ ID NO: 812788 - RNA, 19 nt, Homo sapiens
caaugagaauguugucaaa

SEQ ID NO: 812789 - RNA, 19 nt, Homo sapiens
aggcagaaaucaauaggua

SEQ ID NO: 812790 - RNA, 19 nt, Homo sapiens
gaagcccaguuaucuguga

SEQ ID NO: 812791 - RNA, 19 nt, Homo sapiens
ccacaaggaguauguuaaa

SEQ ID NO: 812792 - RNA, 19 nt, Homo sapiens
gaacgagccaucuuugcaa

SEQ ID NO: 812793 - RNA, 19 nt, Homo sapiens
gggaaucaccugguccuua

SEQ ID NO: 812794 - RNA, 19 nt, Homo sapiens
ggaacagaauugccagaca

SEQ ID NO: 812795 - RNA, 19 nt, Homo sapiens
gaacaucugaguggcauga

SEQ ID NO: 812796 - RNA, 19 nt, Homo sapiens
acacacccauugaagaauu

SEQ ID NO: 812797 - RNA, 19 nt, Homo sapiens
gagcucagcagauguacuu

SEQ ID NO: 812798 - RNA, 19 nt, Homo sapiens
gauaauuccagcaggguaa

SEQ ID NO: 812799 - RNA, 19 nt, Homo sapiens
uuuggaaucuguaaucuga

SEQ ID NO: 812800 - RNA, 19 nt, Homo sapiens
uaaguggguucccugcauu

SEQ ID NO: 812801 - RNA, 19 nt, Homo sapiens
guaaguggguucccugcau

SEQ ID NO: 812802 - RNA, 19 nt, Homo sapiens
ugacacacccauugaagaa

SEQ ID NO: 812803 - RNA, 19 nt, Homo sapiens
cagggaaagcugcguauuu

SEQ ID NO: 812804 - RNA, 19 nt, Homo sapiens
agggaaagcugcguauuug

SEQ ID NO: 812805 - RNA, 19 nt, Homo sapiens
caugaacucuguguacgaa

SEQ ID NO: 812806 - RNA, 19 nt, Homo sapiens
ggucaauggagaacacuuu

SEQ ID NO: 812807 - RNA, 19 nt, Homo sapiens
ccaguuuacuuuauaaggu

SEQ ID NO: 812808 - RNA, 19 nt, Homo sapiens
ggaaagcugcguauuuguc

SEQ ID NO: 812809 - RNA, 19 nt, Homo sapiens
aaacugccuuccuuucuuc

SEQ ID NO: 812810 - RNA, 19 nt, Homo sapiens
ggaguauguuaaauuugga

SEQ ID NO: 812811 - RNA, 19 nt, Homo sapiens
gcgaaggcagaaaucaaua

SEQ ID NO: 812812 - RNA, 19 nt, Homo sapiens
caauggagaacacuuugaa

SEQ ID NO: 812813 - RNA, 19 nt, Homo sapiens
gguggugucugcugugcuu

SEQ ID NO: 812814 - RNA, 19 nt, Homo sapiens
gcagcgugcuugugagucu

SEQ ID NO: 812815 - RNA, 19 nt, Homo sapiens
ccucugggcugcugugcaa

SEQ ID NO: 812816 - RNA, 19 nt, Homo sapiens
uaauucagcauugccuuua

SEQ ID NO: 812817 - RNA, 19 nt, Homo sapiens
gugagauaauucagcauug

SEQ ID NO: 812818 - RNA, 19 nt, Homo sapiens
cugccuuccuuucuucuua

SEQ ID NO: 812819 - RNA, 19 nt, Homo sapiens
gcagaaaucaauagguaag

SEQ ID NO: 812820 - RNA, 19 nt, Homo sapiens
gaugaugacgggcuacaau

SEQ ID NO: 812821 - RNA, 19 nt, Homo sapiens
gucuugcgguuacugguua

SEQ ID NO: 812822 - RNA, 19 nt, Homo sapiens
gaaagcugcguauuugucu

SEQ ID NO: 812823 - RNA, 19 nt, Homo sapiens
ggcagucacuaggcaguaa

SEQ ID NO: 812824 - RNA, 19 nt, Homo sapiens
aguaugagcucagcagaug

SEQ ID NO: 812825 - RNA, 19 nt, Homo sapiens
uaggguggcuucugucauc

SEQ ID NO: 812826 - RNA, 19 nt, Homo sapiens
gaaaucaauagguaagaag

SEQ ID NO: 812827 - RNA, 19 nt, Homo sapiens
caaggaaucgccgugauga

SEQ ID NO: 812828 - RNA, 19 nt, Homo sapiens
guacgaacgccaaggaauc

SEQ ID NO: 812829 - RNA, 19 nt, Homo sapiens
gaauacccuuaucgaaugg

SEQ ID NO: 812830 - RNA, 19 nt, Homo sapiens
gcaggcaaagguacacuug

SEQ ID NO: 812831 - RNA, 19 nt, Homo sapiens
guauuugucuugcgguuac

SEQ ID NO: 812832 - RNA, 19 nt, Homo sapiens
aaucuaggguggcuucugu

SEQ ID NO: 812833 - RNA, 19 nt, Homo sapiens
ggaagaagaaggauaaacc

SEQ ID NO: 812834 - RNA, 19 nt, Homo sapiens
gaugacgggcuacaauaau

SEQ ID NO: 812835 - RNA, 19 nt, Homo sapiens
ugcgguuacugguuaauaa

SEQ ID NO: 812836 - RNA, 19 nt, Homo sapiens
acaaugagggcuuuggauu

SEQ ID NO: 812837 - RNA, 19 nt, Homo sapiens
gacagucccuuugugagau

SEQ ID NO: 812838 - RNA, 19 nt, Homo sapiens
ugagacagucccuuuguga

SEQ ID NO: 812839 - RNA, 19 nt, Homo sapiens
aauaauguacuguguguug

SEQ ID NO: 812840 - RNA, 19 nt, Homo sapiens
gguggcuucugucaucuug

SEQ ID NO: 812841 - RNA, 19 nt, Homo sapiens
uggaauacccuuaucgaau

SEQ ID NO: 812842 - RNA, 19 nt, Homo sapiens
ucagacagcagaaucuuuc

SEQ ID NO: 812843 - RNA, 19 nt, Homo sapiens
caaugagggcuuuggauuc

SEQ ID NO: 812844 - RNA, 19 nt, Homo sapiens
acagucccuuugugagaua

SEQ ID NO: 812845 - RNA, 19 nt, Homo sapiens
ugaugacgggcuacaauaa

SEQ ID NO: 812846 - RNA, 19 nt, Homo sapiens
ugagaauguugucaaaguc

SEQ ID NO: 812847 - RNA, 19 nt, Homo sapiens
agacggugguccugcagaa

SEQ ID NO: 812848 - RNA, 19 nt, Homo sapiens
gaaucuguaaucugaaugu

SEQ ID NO: 812849 - RNA, 19 nt, Homo sapiens
ggugucugcugugcuuaaa

SEQ ID NO: 812850 - RNA, 19 nt, Homo sapiens
ugggucaggucucgaaaug

SEQ ID NO: 812851 - RNA, 19 nt, Homo sapiens
uaugagcucagcagaugua

SEQ ID NO: 812852 - RNA, 19 nt, Homo sapiens
aggaguauguuaaauuugg

SEQ ID NO: 812853 - RNA, 19 nt, Homo sapiens
uggaaucuguaaucugaau

SEQ ID NO: 812854 - RNA, 19 nt, Homo sapiens
gcacuguccuguguguucu

SEQ ID NO: 812855 - RNA, 19 nt, Homo sapiens
uggcuucugucaucuugaa

SEQ ID NO: 812856 - RNA, 19 nt, Homo sapiens
ccagcaaacucagggaaag

SEQ ID NO: 812857 - RNA, 19 nt, Homo sapiens
agacagucccuuugugaga

SEQ ID NO: 812858 - RNA, 19 nt, Homo sapiens
aaccuggccuugcccacua

SEQ ID NO: 812859 - RNA, 19 nt, Homo sapiens
ccaaggaaucgccgugaug

SEQ ID NO: 812860 - RNA, 19 nt, Homo sapiens
cgacaccgccaggaagaaa

SEQ ID NO: 812861 - RNA, 19 nt, Homo sapiens
cacaaggaguauguuaaau

SEQ ID NO: 812862 - RNA, 19 nt, Homo sapiens
cugaauguaacccaguuua

SEQ ID NO: 812863 - RNA, 19 nt, Homo sapiens
acaggcagguggugaacau

SEQ ID NO: 812864 - RNA, 19 nt, Homo sapiens
ucuguaaucugaauguaac

SEQ ID NO: 812865 - RNA, 19 nt, Homo sapiens
gucucgaaaugaaauaaug

SEQ ID NO: 812866 - RNA, 19 nt, Homo sapiens
ggcagaaaucaauagguaa

SEQ ID NO: 812867 - RNA, 19 nt, Homo sapiens
gaagaauucacaccaacac

SEQ ID NO: 812868 - RNA, 19 nt, Homo sapiens
augagaauguugucaaagu

SEQ ID NO: 812869 - RNA, 19 nt, Homo sapiens
ggacuucuugauugagguu

SEQ ID NO: 812870 - RNA, 19 nt, Homo sapiens
gagguuaacaaugagaaug

SEQ ID NO: 812871 - RNA, 19 nt, Homo sapiens
cuuccuuucuucuuaaugu

SEQ ID NO: 812872 - RNA, 19 nt, Homo sapiens
gaaggcagaaaucaauagg

SEQ ID NO: 812873 - RNA, 19 nt, Homo sapiens
gccaaggaaucgccgugau

SEQ ID NO: 812874 - RNA, 19 nt, Homo sapiens
agucucagguggauaacug

SEQ ID NO: 812875 - RNA, 19 nt, Homo sapiens
ccggaauucucucuacagu

SEQ ID NO: 812876 - RNA, 19 nt, Homo sapiens
cuagggagccauuggaaca

SEQ ID NO: 812877 - RNA, 19 nt, Homo sapiens
gcuuucaaacacagccuua

SEQ ID NO: 812878 - RNA, 19 nt, Homo sapiens
gugaugacgcccacuguuc

SEQ ID NO: 812879 - RNA, 19 nt, Homo sapiens
gacgacaccgccaggaaga

SEQ ID NO: 812880 - RNA, 19 nt, Homo sapiens
gaaagaaggucaagugugu

SEQ ID NO: 812881 - RNA, 19 nt, Homo sapiens
gaauaugugugucuucuga

SEQ ID NO: 812882 - RNA, 19 nt, Homo sapiens
gcagugaacuccuuuuaua

SEQ ID NO: 812883 - RNA, 19 nt, Homo sapiens
gaaccaccuugucuucaaa

SEQ ID NO: 812884 - RNA, 19 nt, Homo sapiens
uaaaccagcuauccaaaug

SEQ ID NO: 812885 - RNA, 19 nt, Homo sapiens
guaaaccuguccugaaaga

SEQ ID NO: 812886 - RNA, 19 nt, Homo sapiens
gaggaaaccaucacugaaa

SEQ ID NO: 812887 - RNA, 19 nt, Homo sapiens
acagaaagaucaccaucaa

SEQ ID NO: 812888 - RNA, 19 nt, Homo sapiens
caaaugcagugaacuccuu

SEQ ID NO: 812889 - RNA, 19 nt, Homo sapiens
caguuaagcauuccaauaa

SEQ ID NO: 812890 - RNA, 19 nt, Homo sapiens
ggagugagcgccaccuuga

SEQ ID NO: 812891 - RNA, 19 nt, Homo sapiens
gaggagaaauugaggaaac

SEQ ID NO: 812892 - RNA, 19 nt, Homo sapiens
gacccaggcuugcaaagug

SEQ ID NO: 812893 - RNA, 19 nt, Homo sapiens
aaccaucacugaaagcuuu

SEQ ID NO: 812894 - RNA, 19 nt, Homo sapiens
cuucuaggcuucacacuug

SEQ ID NO: 812895 - RNA, 19 nt, Homo sapiens
gaaauauuccagcguuguu

SEQ ID NO: 812896 - RNA, 19 nt, Homo sapiens
ggauggguauuccagaaga

SEQ ID NO: 812897 - RNA, 19 nt, Homo sapiens
gaaugacaaaugauaggua

SEQ ID NO: 812898 - RNA, 19 nt, Homo sapiens
acugaaagcuuugguaaug

SEQ ID NO: 812899 - RNA, 19 nt, Homo sapiens
gagcuuuguuucuuuaugg

SEQ ID NO: 812900 - RNA, 19 nt, Homo sapiens
guucugugguuucaguuaa

SEQ ID NO: 812901 - RNA, 19 nt, Homo sapiens
caaguucugugguuucagu

SEQ ID NO: 812902 - RNA, 19 nt, Homo sapiens
ucaguuaagcauuccaaua

SEQ ID NO: 812903 - RNA, 19 nt, Homo sapiens
guaccaagcauaggagaaa

SEQ ID NO: 812904 - RNA, 19 nt, Homo sapiens
cuguaaaccuguccugaaa

SEQ ID NO: 812905 - RNA, 19 nt, Homo sapiens
gaaauugaggaaaccauca

SEQ ID NO: 812906 - RNA, 19 nt, Homo sapiens
ugaaagcuuugguaaugau

SEQ ID NO: 812907 - RNA, 19 nt, Homo sapiens
ucacugaaagcuuugguaa

SEQ ID NO: 812908 - RNA, 19 nt, Homo sapiens
gaguguaagagcuuuguuu

SEQ ID NO: 812909 - RNA, 19 nt, Homo sapiens
cacauugauuguuaucuug

SEQ ID NO: 812910 - RNA, 19 nt, Homo sapiens
gauggguauuccagaagaa

SEQ ID NO: 812911 - RNA, 19 nt, Homo sapiens
gaauaaguaccagaccauu

SEQ ID NO: 812912 - RNA, 19 nt, Homo sapiens
uauacaaguucugugguuu

SEQ ID NO: 812913 - RNA, 19 nt, Homo sapiens
agacacuucugguccaaga

SEQ ID NO: 812914 - RNA, 19 nt, Homo sapiens
agaaccaccuugucuucaa

SEQ ID NO: 812915 - RNA, 19 nt, Homo sapiens
aaaaggcucucauggacua

SEQ ID NO: 812916 - RNA, 19 nt, Homo sapiens
ggaauaaguaccagaccau

SEQ ID NO: 812917 - RNA, 19 nt, Homo sapiens
cauuucagcuuauaguucu

SEQ ID NO: 812918 - RNA, 19 nt, Homo sapiens
uucaucaacucaauccuaa

SEQ ID NO: 812919 - RNA, 19 nt, Homo sapiens
guaaugaucauagcaccuu

SEQ ID NO: 812920 - RNA, 19 nt, Homo sapiens
auaaguaccagaccauuga

SEQ ID NO: 812921 - RNA, 19 nt, Homo sapiens
gcuucacacuugucagaga

SEQ ID NO: 812922 - RNA, 19 nt, Homo sapiens
ccauuuaauucuagagucu

SEQ ID NO: 812923 - RNA, 19 nt, Homo sapiens
ugauuguuaucuugacuga

SEQ ID NO: 812924 - RNA, 19 nt, Homo sapiens
ucaggauuguguugugcua

SEQ ID NO: 812925 - RNA, 19 nt, Homo sapiens
agacugugccucaggauug

SEQ ID NO: 812926 - RNA, 19 nt, Homo sapiens
gaugaguacugcgcuaguc

SEQ ID NO: 812927 - RNA, 19 nt, Homo sapiens
ccuuuaggcugugauaguu

SEQ ID NO: 812928 - RNA, 19 nt, Homo sapiens
cuaaggauauacaaguucu

SEQ ID NO: 812929 - RNA, 19 nt, Homo sapiens
caucaagccaguaauucuu

SEQ ID NO: 812930 - RNA, 19 nt, Homo sapiens
gagcuacccgggucuuugu

SEQ ID NO: 812931 - RNA, 19 nt, Homo sapiens
cagaagaaccaccuugucu

SEQ ID NO: 812932 - RNA, 19 nt, Homo sapiens
ucucauggacuagaaauau

SEQ ID NO: 812933 - RNA, 19 nt, Homo sapiens
ggagcuacccgggucuuug

SEQ ID NO: 812934 - RNA, 19 nt, Homo sapiens
caccaucaagccaguaauu

SEQ ID NO: 812935 - RNA, 19 nt, Homo sapiens
cucauggacuagaaauauu

SEQ ID NO: 812936 - RNA, 19 nt, Homo sapiens
cugaaagcuuugguaauga

SEQ ID NO: 812937 - RNA, 19 nt, Homo sapiens
auauacaaguucugugguu

SEQ ID NO: 812938 - RNA, 19 nt, Homo sapiens
aaauauuccagcguuguua

SEQ ID NO: 812939 - RNA, 19 nt, Homo sapiens
ccaauaacaccuuccaaaa

SEQ ID NO: 812940 - RNA, 19 nt, Homo sapiens
caaguguguaccaagcaua

SEQ ID NO: 812941 - RNA, 19 nt, Homo sapiens
ugaggaaaccaucacugaa

SEQ ID NO: 812942 - RNA, 19 nt, Homo sapiens
uccaauaacaccuuccaaa

SEQ ID NO: 812943 - RNA, 19 nt, Homo sapiens
ugaccuucaucaacucaau

SEQ ID NO: 812944 - RNA, 19 nt, Homo sapiens
guggagaaggucugucuug

SEQ ID NO: 812945 - RNA, 19 nt, Homo sapiens
gaaggucaaguguguacca

SEQ ID NO: 812946 - RNA, 19 nt, Homo sapiens
ccugaaagaaggucaagug

SEQ ID NO: 812947 - RNA, 19 nt, Homo sapiens
ucacaccaaaggacaagaa

SEQ ID NO: 812948 - RNA, 19 nt, Homo sapiens
auuguuaucuugacugaca

SEQ ID NO: 812949 - RNA, 19 nt, Homo sapiens
accagaccauugacaacua

SEQ ID NO: 812950 - RNA, 19 nt, Homo sapiens
cuuggaaugacaaaugaua

SEQ ID NO: 812951 - RNA, 19 nt, Homo sapiens
ccagaccauugacaacuac

SEQ ID NO: 812952 - RNA, 19 nt, Homo sapiens
ggacccaggcuugcaaagu

SEQ ID NO: 812953 - RNA, 19 nt, Homo sapiens
uacaaguucugugguuuca

SEQ ID NO: 812954 - RNA, 19 nt, Homo sapiens
cuucaucaacucaauccua

SEQ ID NO: 812955 - RNA, 19 nt, Homo sapiens
cuaaaccagcuauccaaau

SEQ ID NO: 812956 - RNA, 19 nt, Homo sapiens
aaaccuguccugaaagaag

SEQ ID NO: 812957 - RNA, 19 nt, Homo sapiens
cuugaguccuucugagaug

SEQ ID NO: 812958 - RNA, 19 nt, Homo sapiens
aggaaaccaucacugaaag

SEQ ID NO: 812959 - RNA, 19 nt, Homo sapiens
ggaaugacaaaugauaggu

SEQ ID NO: 812960 - RNA, 19 nt, Homo sapiens
ucaaguguguaccaagcau

SEQ ID NO: 812961 - RNA, 19 nt, Homo sapiens
caccaaaggacaagaaggu

SEQ ID NO: 812962 - RNA, 19 nt, Homo sapiens
ucucuuggaaugacaaaug

SEQ ID NO: 812963 - RNA, 19 nt, Homo sapiens
aauaaguaccagaccauug

SEQ ID NO: 812964 - RNA, 19 nt, Homo sapiens
guacacauugauuguuauc

SEQ ID NO: 812965 - RNA, 19 nt, Homo sapiens
accuguaaaugcaaugaaa

SEQ ID NO: 812966 - RNA, 19 nt, Homo sapiens
gacugugccucaggauugu

SEQ ID NO: 812967 - RNA, 19 nt, Homo sapiens
cacccaggcucugcaguca

SEQ ID NO: 812968 - RNA, 19 nt, Homo sapiens
ucuguaaaccuguccugaa

SEQ ID NO: 812969 - RNA, 19 nt, Homo sapiens
gguccaagaucuguaaacc

SEQ ID NO: 812970 - RNA, 19 nt, Homo sapiens
aggauuguguugugcuaga

SEQ ID NO: 812971 - RNA, 19 nt, Homo sapiens
aaauguaucacaccaaagg

SEQ ID NO: 812972 - RNA, 19 nt, Homo sapiens
gaaaccaucacugaaagcu

SEQ ID NO: 812973 - RNA, 19 nt, Homo sapiens
uggaauaugugugucuucu

SEQ ID NO: 812974 - RNA, 19 nt, Homo sapiens
uugaggaaaccaucacuga

SEQ ID NO: 812975 - RNA, 19 nt, Homo sapiens
ggaauaugugugucuucug

SEQ ID NO: 812976 - RNA, 19 nt, Homo sapiens
acucgguucucaauuccaa

SEQ ID NO: 812977 - RNA, 19 nt, Homo sapiens
ucauuucagcuuauaguuc

SEQ ID NO: 812978 - RNA, 19 nt, Homo sapiens
agagcuuuguuucuuuaug

SEQ ID NO: 812979 - RNA, 19 nt, Homo sapiens
ucaauuccaacgcuaucaa

SEQ ID NO: 812980 - RNA, 19 nt, Homo sapiens
gggaaacucugacugauuu

SEQ ID NO: 812981 - RNA, 19 nt, Homo sapiens
ggagagaaauaucauaaga

SEQ ID NO: 812982 - RNA, 19 nt, Homo sapiens
gaagacauuucuaaacuug

SEQ ID NO: 812983 - RNA, 19 nt, Homo sapiens
gaagagaaagucacguuua

SEQ ID NO: 812984 - RNA, 19 nt, Homo sapiens
gaaagucacguuuaauuug

SEQ ID NO: 812985 - RNA, 19 nt, Homo sapiens
gauaggaaguucagcauca

SEQ ID NO: 812986 - RNA, 19 nt, Homo sapiens
gagaaagucacguuuaauu

SEQ ID NO: 812987 - RNA, 19 nt, Homo sapiens
gaaaagaacugcccgaaca

SEQ ID NO: 812988 - RNA, 19 nt, Homo sapiens
cauugaaacuggcccuuua

SEQ ID NO: 812989 - RNA, 19 nt, Homo sapiens
aaagaaaucugcacuggau

SEQ ID NO: 812990 - RNA, 19 nt, Homo sapiens
ggaccuugaugaugaagaa

SEQ ID NO: 812991 - RNA, 19 nt, Homo sapiens
gcuacagccugaaauuauu

SEQ ID NO: 812992 - RNA, 19 nt, Homo sapiens
aagagaaagucacguuuaa

SEQ ID NO: 812993 - RNA, 19 nt, Homo sapiens
ccaagaaacugggagagaa

SEQ ID NO: 812994 - RNA, 19 nt, Homo sapiens
ccaaaaggcugguauauuc

SEQ ID NO: 812995 - RNA, 19 nt, Homo sapiens
gagcucaacucagucuaaa

SEQ ID NO: 812996 - RNA, 19 nt, Homo sapiens
gagagcacauccacaugaa

SEQ ID NO: 812997 - RNA, 19 nt, Homo sapiens
cagcuaaacuuugagaaga

SEQ ID NO: 812998 - RNA, 19 nt, Homo sapiens
ggacgagaauggcuuuaag

SEQ ID NO: 812999 - RNA, 19 nt, Homo sapiens
gaaaugaagguacccuaga

SEQ ID NO: 813000 - RNA, 19 nt, Homo sapiens
ugacaaauauacagcuguu

SEQ ID NO: 813001 - RNA, 19 nt, Homo sapiens
cagcaucagugaaacgaaa

SEQ ID NO: 813002 - RNA, 19 nt, Homo sapiens
ucagaggaauuccgaaaug

SEQ ID NO: 813003 - RNA, 19 nt, Homo sapiens
uagaauccaucaaugagaa

SEQ ID NO: 813004 - RNA, 19 nt, Homo sapiens
cagcuacuaucgucauuga

SEQ ID NO: 813005 - RNA, 19 nt, Homo sapiens
gaacaggaggucccuacuu

SEQ ID NO: 813006 - RNA, 19 nt, Homo sapiens
aaaugaagguacccuagaa

SEQ ID NO: 813007 - RNA, 19 nt, Homo sapiens
ucaacucagucuaaagaaa

SEQ ID NO: 813008 - RNA, 19 nt, Homo sapiens
aacaggaggucccuacuuu

SEQ ID NO: 813009 - RNA, 19 nt, Homo sapiens
aauuaugucucaugaggua

SEQ ID NO: 813010 - RNA, 19 nt, Homo sapiens
gaacugcccgaacagacua

SEQ ID NO: 813011 - RNA, 19 nt, Homo sapiens
gcucaacucagucuaaaga

SEQ ID NO: 813012 - RNA, 19 nt, Homo sapiens
gcacugaagacgauaggaa

SEQ ID NO: 813013 - RNA, 19 nt, Homo sapiens
gcaggaccuugaugaugaa

SEQ ID NO: 813014 - RNA, 19 nt, Homo sapiens
ggagcaacaucuuccaagu

SEQ ID NO: 813015 - RNA, 19 nt, Homo sapiens
agagaaggcuugugcaaag

SEQ ID NO: 813016 - RNA, 19 nt, Homo sapiens
acgcagaguugaaggaauu

SEQ ID NO: 813017 - RNA, 19 nt, Homo sapiens
ggaauuccgaaaugacuuu

SEQ ID NO: 813018 - RNA, 19 nt, Homo sapiens
gaaacugggagagaaauau

SEQ ID NO: 813019 - RNA, 19 nt, Homo sapiens
gagcacauccacaugaaug

SEQ ID NO: 813020 - RNA, 19 nt, Homo sapiens
ggcuuuaagugucauugua

SEQ ID NO: 813021 - RNA, 19 nt, Homo sapiens
gcuacuaucgucauugaaa

SEQ ID NO: 813022 - RNA, 19 nt, Homo sapiens
gcugguauauucaguacau

SEQ ID NO: 813023 - RNA, 19 nt, Homo sapiens
cagaggaauuccgaaauga

SEQ ID NO: 813024 - RNA, 19 nt, Homo sapiens
ccaacaggaucaaguccaa

SEQ ID NO: 813025 - RNA, 19 nt, Homo sapiens
ggagacgcuuuggcacuaa

SEQ ID NO: 813026 - RNA, 19 nt, Homo sapiens
ccucagcaguuuauggauu

SEQ ID NO: 813027 - RNA, 19 nt, Homo sapiens
caagaaacugggagagaaa

SEQ ID NO: 813028 - RNA, 19 nt, Homo sapiens
guauaguuguucagcuaaa

SEQ ID NO: 813029 - RNA, 19 nt, Homo sapiens
cucagcaguuuauggauua

SEQ ID NO: 813030 - RNA, 19 nt, Homo sapiens
aaucugcacuggaugaaau

SEQ ID NO: 813031 - RNA, 19 nt, Homo sapiens
ucccagagcucaacucagu

SEQ ID NO: 813032 - RNA, 19 nt, Homo sapiens
cgagugcacugaagacgau

SEQ ID NO: 813033 - RNA, 19 nt, Homo sapiens
cuaaguggcugggcagaga

SEQ ID NO: 813034 - RNA, 19 nt, Homo sapiens
caugagguaucaaacuaug

SEQ ID NO: 813035 - RNA, 19 nt, Homo sapiens
guguuaggguauauucuuu

SEQ ID NO: 813036 - RNA, 19 nt, Homo sapiens
augagacucuacuguguua

SEQ ID NO: 813037 - RNA, 19 nt, Homo sapiens
aaacuugaccagacucauu

SEQ ID NO: 813038 - RNA, 19 nt, Homo sapiens
gcagagaaggcuugugcaa

SEQ ID NO: 813039 - RNA, 19 nt, Homo sapiens
agcaggaccuugaugauga

SEQ ID NO: 813040 - RNA, 19 nt, Homo sapiens
cgagagcacauccacauga

SEQ ID NO: 813041 - RNA, 19 nt, Homo sapiens
ugagguaucaaacuaugua

SEQ ID NO: 813042 - RNA, 19 nt, Homo sapiens
gcuaaacuuugagaagaau

SEQ ID NO: 813043 - RNA, 19 nt, Homo sapiens
gguguucgccaaggcauua

SEQ ID NO: 813044 - RNA, 19 nt, Homo sapiens
ugaccagacucauuuagag

SEQ ID NO: 813045 - RNA, 19 nt, Homo sapiens
cucaugagguaucaaacua

SEQ ID NO: 813046 - RNA, 19 nt, Homo sapiens
auacagcuguugugaagau

SEQ ID NO: 813047 - RNA, 19 nt, Homo sapiens
gaagagcaagugagaagag

SEQ ID NO: 813048 - RNA, 19 nt, Homo sapiens
gagaaggcuugugcaaagu

SEQ ID NO: 813049 - RNA, 19 nt, Homo sapiens
gagacgcuuuggcacuaaa

SEQ ID NO: 813050 - RNA, 19 nt, Homo sapiens
gaaaauccucagcaguuua

SEQ ID NO: 813051 - RNA, 19 nt, Homo sapiens
ggaaguucagcaucaguga

SEQ ID NO: 813052 - RNA, 19 nt, Homo sapiens
agaauggcuuuaaguguca

SEQ ID NO: 813053 - RNA, 19 nt, Homo sapiens
ggaccgagugcacugaaga

SEQ ID NO: 813054 - RNA, 19 nt, Homo sapiens
auauacagcuguugugaag

SEQ ID NO: 813055 - RNA, 19 nt, Homo sapiens
gaaaucugcacuggaugaa

SEQ ID NO: 813056 - RNA, 19 nt, Homo sapiens
cuguauaguuguucagcua

SEQ ID NO: 813057 - RNA, 19 nt, Homo sapiens
uuucuaaacuugccugagu

SEQ ID NO: 813058 - RNA, 19 nt, Homo sapiens
ggacgcagaguugaaggaa

SEQ ID NO: 813059 - RNA, 19 nt, Homo sapiens
gaagguacccuagaaucca

SEQ ID NO: 813060 - RNA, 19 nt, Homo sapiens
ugaagacgauaggaaguuc

SEQ ID NO: 813061 - RNA, 19 nt, Homo sapiens
caacaucuuccaagucaag

SEQ ID NO: 813062 - RNA, 19 nt, Homo sapiens
aauggaggcuacagaggaa

SEQ ID NO: 813063 - RNA, 19 nt, Homo sapiens
agcaacaucuuccaaguca

SEQ ID NO: 813064 - RNA, 19 nt, Homo sapiens
gacagggacccagaaacua

SEQ ID NO: 813065 - RNA, 19 nt, Homo sapiens
gaccagacucauuuagaga

SEQ ID NO: 813066 - RNA, 19 nt, Homo sapiens
gcugaaacuugaccagacu

SEQ ID NO: 813067 - RNA, 19 nt, Homo sapiens
gauugauucuggagacaag

SEQ ID NO: 813068 - RNA, 19 nt, Homo sapiens
ugggagagaaauaucauaa

SEQ ID NO: 813069 - RNA, 19 nt, Homo sapiens
ugcagaagcuacgcuggua

SEQ ID NO: 813070 - RNA, 19 nt, Homo sapiens
gcaacuggaacuggagaaa

SEQ ID NO: 813071 - RNA, 19 nt, Homo sapiens
cuaaaaggguccacaacaa

SEQ ID NO: 813072 - RNA, 19 nt, Homo sapiens
uuaugagacucuacugugu

SEQ ID NO: 813073 - RNA, 19 nt, Homo sapiens
cgagaauggcuuuaagugu

SEQ ID NO: 813074 - RNA, 19 nt, Homo sapiens
caaauauacagcuguugug

SEQ ID NO: 813075 - RNA, 19 nt, Homo sapiens
cagaagcuacgcugguauu

SEQ ID NO: 813076 - RNA, 19 nt, Homo sapiens
gagcaacaucuuccaaguc

SEQ ID NO: 813077 - RNA, 19 nt, Homo sapiens
ugaagagaaagucacguuu

SEQ ID NO: 813078 - RNA, 19 nt, Homo sapiens
gaauuaagcagagaaaaug

SEQ ID NO: 813079 - RNA, 19 nt, Homo sapiens
cauggagauugaagaggaa

SEQ ID NO: 813080 - RNA, 19 nt, Homo sapiens
gaacggagggagagacaga

SEQ ID NO: 813081 - RNA, 19 nt, Homo sapiens
ggauucagaucugguuuca

SEQ ID NO: 813082 - RNA, 19 nt, Homo sapiens
cagauuugguuucagaaug

SEQ ID NO: 813083 - RNA, 19 nt, Homo sapiens
ggacgacggaggcgugauu

SEQ ID NO: 813084 - RNA, 19 nt, Homo sapiens
agauuugguuucagaauga

SEQ ID NO: 813085 - RNA, 19 nt, Homo sapiens
ccacggagguucaguucca

SEQ ID NO: 813086 - RNA, 19 nt, Homo sapiens
guccagauuugguuucaga

SEQ ID NO: 813087 - RNA, 19 nt, Homo sapiens
gggcaucgccaccagagaa

SEQ ID NO: 813088 - RNA, 19 nt, Homo sapiens
gagcccaggguccagauuu

SEQ ID NO: 813089 - RNA, 19 nt, Homo sapiens
gcucaccgccauucaugaa

SEQ ID NO: 813090 - RNA, 19 nt, Homo sapiens
ugagaaggaucgcuuucca

SEQ ID NO: 813091 - RNA, 19 nt, Homo sapiens
gaggaaggcagggaggaaa

SEQ ID NO: 813092 - RNA, 19 nt, Homo sapiens
ggaggaaggcagggaggaa

SEQ ID NO: 813093 - RNA, 19 nt, Homo sapiens
gagaggaacgggagagacu

SEQ ID NO: 813094 - RNA, 19 nt, Homo sapiens
ccacggagacucguuugga

SEQ ID NO: 813095 - RNA, 19 nt, Homo sapiens
gggcucaccgccauucaug

SEQ ID NO: 813096 - RNA, 19 nt, Homo sapiens
gggccuggcacacucaaga

SEQ ID NO: 813097 - RNA, 19 nt, Homo sapiens
gaggagcuggccagagaga

SEQ ID NO: 813098 - RNA, 19 nt, Homo sapiens
ggucuucuacguggaaaug

SEQ ID NO: 813099 - RNA, 19 nt, Homo sapiens
gaggaacgggagagacuag

SEQ ID NO: 813100 - RNA, 19 nt, Homo sapiens
ccuccgagccuuugagaag

SEQ ID NO: 813101 - RNA, 19 nt, Homo sapiens
gagagaggaacgggagaga

SEQ ID NO: 813102 - RNA, 19 nt, Homo sapiens
gggucucgcucuggucuuc

SEQ ID NO: 813103 - RNA, 19 nt, Homo sapiens
gcaggcgcaaccucuccua

SEQ ID NO: 813104 - RNA, 19 nt, Homo sapiens
gcaaaucacuuacuucuuc

SEQ ID NO: 813105 - RNA, 19 nt, Homo sapiens
ggagagacguugacuuuga

SEQ ID NO: 813106 - RNA, 19 nt, Homo sapiens
caaaugggcuugauaagau

SEQ ID NO: 813107 - RNA, 19 nt, Homo sapiens
auaaagcccuucagaaaua

SEQ ID NO: 813108 - RNA, 19 nt, Homo sapiens
caacagauaucucuugcaa

SEQ ID NO: 813109 - RNA, 19 nt, Homo sapiens
ggagaaauuugaagagaug

SEQ ID NO: 813110 - RNA, 19 nt, Homo sapiens
caacacaaaugguuagaau

SEQ ID NO: 813111 - RNA, 19 nt, Homo sapiens
ggaaauaagaugaucauug

SEQ ID NO: 813112 - RNA, 19 nt, Homo sapiens
gaagagaugauucaacaaa

SEQ ID NO: 813113 - RNA, 19 nt, Homo sapiens
caaaugauaugaagcaaca

SEQ ID NO: 813114 - RNA, 19 nt, Homo sapiens
ggaggacacuaaacugauu

SEQ ID NO: 813115 - RNA, 19 nt, Homo sapiens
uggagaaucugaagaauga

SEQ ID NO: 813116 - RNA, 19 nt, Homo sapiens
gcaacagcaugucauagaa

SEQ ID NO: 813117 - RNA, 19 nt, Homo sapiens
cacuguagaugcuauaaua

SEQ ID NO: 813118 - RNA, 19 nt, Homo sapiens
ccucaagucucauauaaug

SEQ ID NO: 813119 - RNA, 19 nt, Homo sapiens
gaccgcaagucccgucuua

SEQ ID NO: 813120 - RNA, 19 nt, Homo sapiens
gggcuuugcuggucuugua

SEQ ID NO: 813121 - RNA, 19 nt, Homo sapiens
ugaccucugucgaagauua

SEQ ID NO: 813122 - RNA, 19 nt, Homo sapiens
gcccucaagucucauauaa

SEQ ID NO: 813123 - RNA, 19 nt, Homo sapiens
gaagcaacagcaugucaua

SEQ ID NO: 813124 - RNA, 19 nt, Homo sapiens
gcggagagacguugacuuu

SEQ ID NO: 813125 - RNA, 19 nt, Homo sapiens
cgugaugcgucuacaguua

SEQ ID NO: 813126 - RNA, 19 nt, Homo sapiens
acagauaucucuugcaaca

SEQ ID NO: 813127 - RNA, 19 nt, Homo sapiens
gaaaguaauuccggcuguu

SEQ ID NO: 813128 - RNA, 19 nt, Homo sapiens
gaaacgaucccuucacgau

SEQ ID NO: 813129 - RNA, 19 nt, Homo sapiens
gacguugacuuugagcuua

SEQ ID NO: 813130 - RNA, 19 nt, Homo sapiens
gguacuaucucaacugcuu

SEQ ID NO: 813131 - RNA, 19 nt, Homo sapiens
cgucuacaguuauuuauug

SEQ ID NO: 813132 - RNA, 19 nt, Homo sapiens
ggacaaaugauaugaagca

SEQ ID NO: 813133 - RNA, 19 nt, Homo sapiens
ggaugugacuguaacuaau

SEQ ID NO: 813134 - RNA, 19 nt, Homo sapiens
gaccaaaugggcuugauaa

SEQ ID NO: 813135 - RNA, 19 nt, Homo sapiens
gcaaauacaaugagaacau

SEQ ID NO: 813136 - RNA, 19 nt, Homo sapiens
gaagauugaugacauucgu

SEQ ID NO: 813137 - RNA, 19 nt, Homo sapiens
caaaguagaaggcaaagug

SEQ ID NO: 813138 - RNA, 19 nt, Homo sapiens
gaucagcgauagcguccuu

SEQ ID NO: 813139 - RNA, 19 nt, Homo sapiens
guucaaagcuguguaaucg

SEQ ID NO: 813140 - RNA, 19 nt, Homo sapiens
acacaaaugguuagaauga

SEQ ID NO: 813141 - RNA, 19 nt, Homo sapiens
ugaagcaaaucacuuacuu

SEQ ID NO: 813142 - RNA, 19 nt, Homo sapiens
gguaggaggaccugaaauu

SEQ ID NO: 813143 - RNA, 19 nt, Homo sapiens
cuccagagcuguaaccauu

SEQ ID NO: 813144 - RNA, 19 nt, Homo sapiens
gcaaaggcuguagcaaaua

SEQ ID NO: 813145 - RNA, 19 nt, Homo sapiens
uuauaaagcccuucagaaa

SEQ ID NO: 813146 - RNA, 19 nt, Homo sapiens
gauaagaugaugguggaua

SEQ ID NO: 813147 - RNA, 19 nt, Homo sapiens
gagaugaacccugcucuug

SEQ ID NO: 813148 - RNA, 19 nt, Homo sapiens
caaaggcuguagcaaauac

SEQ ID NO: 813149 - RNA, 19 nt, Homo sapiens
ccagacaggugaaggagau

SEQ ID NO: 813150 - RNA, 19 nt, Homo sapiens
caaauacaaugagaacauc

SEQ ID NO: 813151 - RNA, 19 nt, Homo sapiens
gccaccaucuuaagcauga

SEQ ID NO: 813152 - RNA, 19 nt, Homo sapiens
auaagaugaugguggauaa

SEQ ID NO: 813153 - RNA, 19 nt, Homo sapiens
ggaccaaaugggcuugaua

SEQ ID NO: 813154 - RNA, 19 nt, Homo sapiens
gcgauagcguccuuguuga

SEQ ID NO: 813155 - RNA, 19 nt, Homo sapiens
gcaagauccacuucuguga

SEQ ID NO: 813156 - RNA, 19 nt, Homo sapiens
uagcguccuuguugacaua

SEQ ID NO: 813157 - RNA, 19 nt, Homo sapiens
ccaaaugggcuugauaaga

SEQ ID NO: 813158 - RNA, 19 nt, Homo sapiens
aaccauaguuucacuuguu

SEQ ID NO: 813159 - RNA, 19 nt, Homo sapiens
caacagcaugucauagaaa

SEQ ID NO: 813160 - RNA, 19 nt, Homo sapiens
guacaggagaucucauuug

SEQ ID NO: 813161 - RNA, 19 nt, Homo sapiens
gggaugugacuguaacuaa

SEQ ID NO: 813162 - RNA, 19 nt, Homo sapiens
guagcaagauccacuucug

SEQ ID NO: 813163 - RNA, 19 nt, Homo sapiens
gaccugaaauugagcugau

SEQ ID NO: 813164 - RNA, 19 nt, Homo sapiens
uaaagagacuggugcuaac

SEQ ID NO: 813165 - RNA, 19 nt, Homo sapiens
gaagauugcaauucucaca

SEQ ID NO: 813166 - RNA, 19 nt, Homo sapiens
acaaugagaacaucacuug

SEQ ID NO: 813167 - RNA, 19 nt, Homo sapiens
uagaagaagcggagcaauu

SEQ ID NO: 813168 - RNA, 19 nt, Homo sapiens
ccaagucucaggaugauga

SEQ ID NO: 813169 - RNA, 19 nt, Homo sapiens
aaauggaugucucgugaug

SEQ ID NO: 813170 - RNA, 19 nt, Homo sapiens
aagauccacuucugugauu

SEQ ID NO: 813171 - RNA, 19 nt, Homo sapiens
uaagaacuccagagcugua

SEQ ID NO: 813172 - RNA, 19 nt, Homo sapiens
caaaucacuuacuucuuca

SEQ ID NO: 813173 - RNA, 19 nt, Homo sapiens
uuaaagagacuggugcuaa

SEQ ID NO: 813174 - RNA, 19 nt, Homo sapiens
ugaaucccauccagacuau

SEQ ID NO: 813175 - RNA, 19 nt, Homo sapiens
gccaagaggcggauaagug

SEQ ID NO: 813176 - RNA, 19 nt, Homo sapiens
ucucacauguccauuugaa

SEQ ID NO: 813177 - RNA, 19 nt, Homo sapiens
agaagaagcggagcaauug

SEQ ID NO: 813178 - RNA, 19 nt, Homo sapiens
uauaaagcccuucagaaau

SEQ ID NO: 813179 - RNA, 19 nt, Homo sapiens
gaggacacuaaacugauua

SEQ ID NO: 813180 - RNA, 19 nt, Homo sapiens
gagagacguugacuuugag

SEQ ID NO: 813181 - RNA, 19 nt, Homo sapiens
uggcugagauugcugugaa

SEQ ID NO: 813182 - RNA, 19 nt, Homo sapiens
ggaugugaccucugucgaa

SEQ ID NO: 813183 - RNA, 19 nt, Homo sapiens
ugaaugccguccucacugu

SEQ ID NO: 813184 - RNA, 19 nt, Homo sapiens
gcuggugccuuguuagaag

SEQ ID NO: 813185 - RNA, 19 nt, Homo sapiens
uaagcaugauggauguuga

SEQ ID NO: 813186 - RNA, 19 nt, Homo sapiens
gauccacuucugugauuaa

SEQ ID NO: 813187 - RNA, 19 nt, Homo sapiens
agauaucucuugcaacaca

SEQ ID NO: 813188 - RNA, 19 nt, Homo sapiens
agcaaaggcuguagcaaau

SEQ ID NO: 813189 - RNA, 19 nt, Homo sapiens
uacaggagaucucauuugg

SEQ ID NO: 813190 - RNA, 19 nt, Homo sapiens
uaggaggaccugaaauuga

SEQ ID NO: 813191 - RNA, 19 nt, Homo sapiens
guaggaggaccugaaauug

SEQ ID NO: 813192 - RNA, 19 nt, Homo sapiens
gauuauaaagcccuucaga

SEQ ID NO: 813193 - RNA, 19 nt, Homo sapiens
gagaaagggaagugcauuc

SEQ ID NO: 813194 - RNA, 19 nt, Homo sapiens
gcaauucucacauguccau

SEQ ID NO: 813195 - RNA, 19 nt, Homo sapiens
uaucucaacugcuuuugua

SEQ ID NO: 813196 - RNA, 19 nt, Homo sapiens
aaggagaaauuugaagaga

SEQ ID NO: 813197 - RNA, 19 nt, Homo sapiens
uaucaaaguagaaggcaaa

SEQ ID NO: 813198 - RNA, 19 nt, Homo sapiens
gaugugacuguaacuaaug

SEQ ID NO: 813199 - RNA, 19 nt, Homo sapiens
gaacaccuggacaagauca

SEQ ID NO: 813200 - RNA, 19 nt, Homo sapiens
gaagaugcgaagauugcaa

SEQ ID NO: 813201 - RNA, 19 nt, Homo sapiens
uugaacaccuggacaagau

SEQ ID NO: 813202 - RNA, 19 nt, Homo sapiens
ucaggaugaugaaauugga

SEQ ID NO: 813203 - RNA, 19 nt, Homo sapiens
agaacaguaugccaugaga

SEQ ID NO: 813204 - RNA, 19 nt, Homo sapiens
gaagaaaccuugaagaaag

SEQ ID NO: 813205 - RNA, 19 nt, Homo sapiens
gaaggaaggugauacaaug

SEQ ID NO: 813206 - RNA, 19 nt, Homo sapiens
gaagaaauuuggaaggauu

SEQ ID NO: 813207 - RNA, 19 nt, Homo sapiens
ggagccaucucuacauaua

SEQ ID NO: 813208 - RNA, 19 nt, Homo sapiens
gagaaacagugaugguuaa

SEQ ID NO: 813209 - RNA, 19 nt, Homo sapiens
uaauguagguggagaguuu

SEQ ID NO: 813210 - RNA, 19 nt, Homo sapiens
gauuugaugucgucuuuaa

SEQ ID NO: 813211 - RNA, 19 nt, Homo sapiens
ggagaaacagugaugguua

SEQ ID NO: 813212 - RNA, 19 nt, Homo sapiens
ggaagaaaccuugaagaaa

SEQ ID NO: 813213 - RNA, 19 nt, Homo sapiens
ccaaaguuguggaaaguaa

SEQ ID NO: 813214 - RNA, 19 nt, Homo sapiens
ggacaacgcacuccauuuc

SEQ ID NO: 813215 - RNA, 19 nt, Homo sapiens
caaaguuguuggagcagua

SEQ ID NO: 813216 - RNA, 19 nt, Homo sapiens
gaagaaagcgucuccugau

SEQ ID NO: 813217 - RNA, 19 nt, Homo sapiens
gcaguagggucugaugaaa

SEQ ID NO: 813218 - RNA, 19 nt, Homo sapiens
gaauaggaaagcuugguua

SEQ ID NO: 813219 - RNA, 19 nt, Homo sapiens
uaggaaagcuugguuacaa

SEQ ID NO: 813220 - RNA, 19 nt, Homo sapiens
ggaaggugauacaaugaug

SEQ ID NO: 813221 - RNA, 19 nt, Homo sapiens
gaaagcgucuccugauggu

SEQ ID NO: 813222 - RNA, 19 nt, Homo sapiens
ugaaggacuugcugaaaug

SEQ ID NO: 813223 - RNA, 19 nt, Homo sapiens
guggagccaucucuacaua

SEQ ID NO: 813224 - RNA, 19 nt, Homo sapiens
gaguuugagcuacuuaaua

SEQ ID NO: 813225 - RNA, 19 nt, Homo sapiens
gcugaaaggagauaauuug

SEQ ID NO: 813226 - RNA, 19 nt, Homo sapiens
gaggccauuuagaugauua

SEQ ID NO: 813227 - RNA, 19 nt, Homo sapiens
gcucaagggcugcaaaguu

SEQ ID NO: 813228 - RNA, 19 nt, Homo sapiens
ggaaagaucuggaaaagcu

SEQ ID NO: 813229 - RNA, 19 nt, Homo sapiens
ggaaucuggaggccauuua

SEQ ID NO: 813230 - RNA, 19 nt, Homo sapiens
aaacagugaugguuaaugc

SEQ ID NO: 813231 - RNA, 19 nt, Homo sapiens
gcaaguggccaaaguugug

SEQ ID NO: 813232 - RNA, 19 nt, Homo sapiens
gaagcacuuuguuggcuau

SEQ ID NO: 813233 - RNA, 19 nt, Homo sapiens
ugaaaucuguggugugaag

SEQ ID NO: 813234 - RNA, 19 nt, Homo sapiens
cucaagggcugcaaaguug

SEQ ID NO: 813235 - RNA, 19 nt, Homo sapiens
agacauggacccugaagaa

SEQ ID NO: 813236 - RNA, 19 nt, Homo sapiens
ggaagacaauagugaaagc

SEQ ID NO: 813237 - RNA, 19 nt, Homo sapiens
uggauuugaugucgucuuu

SEQ ID NO: 813238 - RNA, 19 nt, Homo sapiens
ggagagguccugcuugaag

SEQ ID NO: 813239 - RNA, 19 nt, Homo sapiens
gacaauagugaaagcauga

SEQ ID NO: 813240 - RNA, 19 nt, Homo sapiens
cugaaggacuugcugaaau

SEQ ID NO: 813241 - RNA, 19 nt, Homo sapiens
ggaauaggaaagcuugguu

SEQ ID NO: 813242 - RNA, 19 nt, Homo sapiens
gaugucgucuuuaacuaca

SEQ ID NO: 813243 - RNA, 19 nt, Homo sapiens
cuugaaaucugugguguga

SEQ ID NO: 813244 - RNA, 19 nt, Homo sapiens
gcaguuccuuggagagcuu

SEQ ID NO: 813245 - RNA, 19 nt, Homo sapiens
caacgcacuccauuucuga

SEQ ID NO: 813246 - RNA, 19 nt, Homo sapiens
aagcgucuccugaugguua

SEQ ID NO: 813247 - RNA, 19 nt, Homo sapiens
uggaagaaaccuugaagaa

SEQ ID NO: 813248 - RNA, 19 nt, Homo sapiens
ggccaaaguuguggaaagu

SEQ ID NO: 813249 - RNA, 19 nt, Homo sapiens
ucaggaugguucguacuaa

SEQ ID NO: 813250 - RNA, 19 nt, Homo sapiens
aagaaagcgucuccugaug

SEQ ID NO: 813251 - RNA, 19 nt, Homo sapiens
uaauagugacuuugaguug

SEQ ID NO: 813252 - RNA, 19 nt, Homo sapiens
acacaauaccacugucuuu

SEQ ID NO: 813253 - RNA, 19 nt, Homo sapiens
uggaaaagcugcugacaga

SEQ ID NO: 813254 - RNA, 19 nt, Homo sapiens
aauagugacuuugaguuga

SEQ ID NO: 813255 - RNA, 19 nt, Homo sapiens
ggaggccauuuagaugauu

SEQ ID NO: 813256 - RNA, 19 nt, Homo sapiens
ggaaugcugaaaggagaua

SEQ ID NO: 813257 - RNA, 19 nt, Homo sapiens
gaaacagugaugguuaaug

SEQ ID NO: 813258 - RNA, 19 nt, Homo sapiens
gcagcaaguggccaaaguu

SEQ ID NO: 813259 - RNA, 19 nt, Homo sapiens
caccguggaucccuacaug

SEQ ID NO: 813260 - RNA, 19 nt, Homo sapiens
uuuguuggcuauccuacua

SEQ ID NO: 813261 - RNA, 19 nt, Homo sapiens
ggaaggauugccauaugug

SEQ ID NO: 813262 - RNA, 19 nt, Homo sapiens
ugugaaggguggagaaaca

SEQ ID NO: 813263 - RNA, 19 nt, Homo sapiens
cauggacccugaagaagca

SEQ ID NO: 813264 - RNA, 19 nt, Homo sapiens
gagccaucucuacauauaa

SEQ ID NO: 813265 - RNA, 19 nt, Homo sapiens
ucggccagaugaagaaauu

SEQ ID NO: 813266 - RNA, 19 nt, Homo sapiens
uggaaggauugccauaugu

SEQ ID NO: 813267 - RNA, 19 nt, Homo sapiens
gacgguagagucuuuggaa

SEQ ID NO: 813268 - RNA, 19 nt, Homo sapiens
ugaagaaauuuggaaggau

SEQ ID NO: 813269 - RNA, 19 nt, Homo sapiens
gagcaguagggucugauga

SEQ ID NO: 813270 - RNA, 19 nt, Homo sapiens
agaguggccagacacaaua

SEQ ID NO: 813271 - RNA, 19 nt, Homo sapiens
aaaaggaacuauuguacug

SEQ ID NO: 813272 - RNA, 19 nt, Homo sapiens
caaaguuguggaaaguaaa

SEQ ID NO: 813273 - RNA, 19 nt, Homo sapiens
auagugacuuugaguugaa

SEQ ID NO: 813274 - RNA, 19 nt, Homo sapiens
ugaaggaaggugauacaau

SEQ ID NO: 813275 - RNA, 19 nt, Homo sapiens
ggcagcaaguggccaaagu

SEQ ID NO: 813276 - RNA, 19 nt, Homo sapiens
ggagauaauuuggggaaga

SEQ ID NO: 813277 - RNA, 19 nt, Homo sapiens
ggccagaugaagaaauuug

SEQ ID NO: 813278 - RNA, 19 nt, Homo sapiens
ggaauauaucauugaagga

SEQ ID NO: 813279 - RNA, 19 nt, Homo sapiens
auggagagguccugcuuga

SEQ ID NO: 813280 - RNA, 19 nt, Homo sapiens
uuggaaggauugccauaug

SEQ ID NO: 813281 - RNA, 19 nt, Homo sapiens
cagcaaguggccaaaguug

SEQ ID NO: 813282 - RNA, 19 nt, Homo sapiens
aaagaggacacauggaauc

SEQ ID NO: 813283 - RNA, 19 nt, Homo sapiens
ucaggagcuucgcauggaa

SEQ ID NO: 813284 - RNA, 19 nt, Homo sapiens
cagaguggccagacacaau

SEQ ID NO: 813285 - RNA, 19 nt, Homo sapiens
gaugggaaagaucuggaaa

SEQ ID NO: 813286 - RNA, 19 nt, Homo sapiens
acaacgcacuccauuucug

SEQ ID NO: 813287 - RNA, 19 nt, Homo sapiens
caggaugguucguacuaag

SEQ ID NO: 813288 - RNA, 19 nt, Homo sapiens
gaaucuggaggccauuuag

SEQ ID NO: 813289 - RNA, 19 nt, Homo sapiens
caauagugaaagcaugaaa

SEQ ID NO: 813290 - RNA, 19 nt, Homo sapiens
ugaaggauuugaaaacaug

SEQ ID NO: 813291 - RNA, 19 nt, Homo sapiens
ggagggaauaggaaagcuu

SEQ ID NO: 813292 - RNA, 19 nt, Homo sapiens
augaagaaauuuggaagga

SEQ ID NO: 813293 - RNA, 19 nt, Homo sapiens
cagaugaagaaauuuggaa

SEQ ID NO: 813294 - RNA, 19 nt, Homo sapiens
gaaaagcugcugacagagu

SEQ ID NO: 813295 - RNA, 19 nt, Homo sapiens
uugaugucgucuuuaacua

SEQ ID NO: 813296 - RNA, 19 nt, Homo sapiens
cuaauagugacuuugaguu

SEQ ID NO: 813297 - RNA, 19 nt, Homo sapiens
gaugguucguacuaagaca

SEQ ID NO: 813298 - RNA, 19 nt, Homo sapiens
gaagacaauagugaaagca

SEQ ID NO: 813299 - RNA, 19 nt, Homo sapiens
gcugaaaugggucuuagag

SEQ ID NO: 813300 - RNA, 19 nt, Homo sapiens
cugaagaagcacuuuguug

SEQ ID NO: 813301 - RNA, 19 nt, Homo sapiens
ggauuugaugucgucuuua

SEQ ID NO: 813302 - RNA, 19 nt, Homo sapiens
caagggcugcaaaguuguu

SEQ ID NO: 813303 - RNA, 19 nt, Homo sapiens
cuacuuuggccuacuugaa

SEQ ID NO: 813304 - RNA, 19 nt, Homo sapiens
gaagaaggcuggcaagauu

SEQ ID NO: 813305 - RNA, 19 nt, Homo sapiens
ccacagaucucacacauuu

SEQ ID NO: 813306 - RNA, 19 nt, Homo sapiens
gaaaugaaaucaggcagua

SEQ ID NO: 813307 - RNA, 19 nt, Homo sapiens
gaaaacaugucucaacuua

SEQ ID NO: 813308 - RNA, 19 nt, Homo sapiens
gaaaucaggcaguacauua

SEQ ID NO: 813309 - RNA, 19 nt, Homo sapiens
gaugacacauuucuugaua

SEQ ID NO: 813310 - RNA, 19 nt, Homo sapiens
guucuuggcuuccuaaauu

SEQ ID NO: 813311 - RNA, 19 nt, Homo sapiens
gaacccaucuuaaugacaa

SEQ ID NO: 813312 - RNA, 19 nt, Homo sapiens
ccaaauauccugaagauga

SEQ ID NO: 813313 - RNA, 19 nt, Homo sapiens
ggacuggccugauugagaa

SEQ ID NO: 813314 - RNA, 19 nt, Homo sapiens
uaacacaguugaaggaauu

SEQ ID NO: 813315 - RNA, 19 nt, Homo sapiens
ggaaauggauaccucugaa

SEQ ID NO: 813316 - RNA, 19 nt, Homo sapiens
agagaacccuauugucuua

SEQ ID NO: 813317 - RNA, 19 nt, Homo sapiens
gaagagaacccuauugucu

SEQ ID NO: 813318 - RNA, 19 nt, Homo sapiens
gcagaacccaucuuaauga

SEQ ID NO: 813319 - RNA, 19 nt, Homo sapiens
gcaagcagcagcaaauauu

SEQ ID NO: 813320 - RNA, 19 nt, Homo sapiens
ugacaaguauggcuauuga

SEQ ID NO: 813321 - RNA, 19 nt, Homo sapiens
gaaagaugagccugaagua

SEQ ID NO: 813322 - RNA, 19 nt, Homo sapiens
gaaaggaggaagcaaauuc

SEQ ID NO: 813323 - RNA, 19 nt, Homo sapiens
agaagaagaugcuaagaga

SEQ ID NO: 813324 - RNA, 19 nt, Homo sapiens
caaauugaauggccagaga

SEQ ID NO: 813325 - RNA, 19 nt, Homo sapiens
aaagcugguuuguugauua

SEQ ID NO: 813326 - RNA, 19 nt, Homo sapiens
ggagaagaauuagaauaug

SEQ ID NO: 813327 - RNA, 19 nt, Homo sapiens
ugagagacaugauccuauu

SEQ ID NO: 813328 - RNA, 19 nt, Homo sapiens
gaaagcugguuuguugauu

SEQ ID NO: 813329 - RNA, 19 nt, Homo sapiens
gagacaugauccuauuaaa

SEQ ID NO: 813330 - RNA, 19 nt, Homo sapiens
guuguaaccucuaaauaug

SEQ ID NO: 813331 - RNA, 19 nt, Homo sapiens
cccgaaagcugguuuguug

SEQ ID NO: 813332 - RNA, 19 nt, Homo sapiens
ggaagaggaagaagagaaa

SEQ ID NO: 813333 - RNA, 19 nt, Homo sapiens
ccgagaaggagaagaauua

SEQ ID NO: 813334 - RNA, 19 nt, Homo sapiens
ccagagaaguuuagaugau

SEQ ID NO: 813335 - RNA, 19 nt, Homo sapiens
gaacaacagagacuuaaag

SEQ ID NO: 813336 - RNA, 19 nt, Homo sapiens
gaauccgaguuaacaguaa

SEQ ID NO: 813337 - RNA, 19 nt, Homo sapiens
aaauuuaucugcccacaug

SEQ ID NO: 813338 - RNA, 19 nt, Homo sapiens
gaacagggacauagcacuu

SEQ ID NO: 813339 - RNA, 19 nt, Homo sapiens
gggagaagaugcaguagag

SEQ ID NO: 813340 - RNA, 19 nt, Homo sapiens
gaagaagaggaaauggaua

SEQ ID NO: 813341 - RNA, 19 nt, Homo sapiens
acagagacuuaaaggguua

SEQ ID NO: 813342 - RNA, 19 nt, Homo sapiens
ugaaauuucugagagauug

SEQ ID NO: 813343 - RNA, 19 nt, Homo sapiens
gagauuaccuguggacgau

SEQ ID NO: 813344 - RNA, 19 nt, Homo sapiens
gagaauuuguaaagugaga

SEQ ID NO: 813345 - RNA, 19 nt, Homo sapiens
cagagaaguuuagaugauu

SEQ ID NO: 813346 - RNA, 19 nt, Homo sapiens
cauggaauauuugggauaa

SEQ ID NO: 813347 - RNA, 19 nt, Homo sapiens
ggaggaagcaaauucaaau

SEQ ID NO: 813348 - RNA, 19 nt, Homo sapiens
gaugaugacacauuucuug

SEQ ID NO: 813349 - RNA, 19 nt, Homo sapiens
gaggauggcugacauucuc

SEQ ID NO: 813350 - RNA, 19 nt, Homo sapiens
acaaggagguaccacacua

SEQ ID NO: 813351 - RNA, 19 nt, Homo sapiens
gcagagauuccagaacuaa

SEQ ID NO: 813352 - RNA, 19 nt, Homo sapiens
gaggaaagaacaacagaga

SEQ ID NO: 813353 - RNA, 19 nt, Homo sapiens
ugauaggacuggccugauu

SEQ ID NO: 813354 - RNA, 19 nt, Homo sapiens
gaacucccuccaacucuaa

SEQ ID NO: 813355 - RNA, 19 nt, Homo sapiens
aaagaacaacagagacuua

SEQ ID NO: 813356 - RNA, 19 nt, Homo sapiens
gccaagaacugggaagaug

SEQ ID NO: 813357 - RNA, 19 nt, Homo sapiens
gaaauggauaccucugaaa

SEQ ID NO: 813358 - RNA, 19 nt, Homo sapiens
caacacuuucuuccaaaua

SEQ ID NO: 813359 - RNA, 19 nt, Homo sapiens
cagcagagauuccagaacu

SEQ ID NO: 813360 - RNA, 19 nt, Homo sapiens
cugggaagaugaagacuuu

SEQ ID NO: 813361 - RNA, 19 nt, Homo sapiens
ggagguaccacacuauuca

SEQ ID NO: 813362 - RNA, 19 nt, Homo sapiens
aagcagaggugaauugaag

SEQ ID NO: 813363 - RNA, 19 nt, Homo sapiens
ucauuacgaucccguugua

SEQ ID NO: 813364 - RNA, 19 nt, Homo sapiens
ggaggaagaggaagaggaa

SEQ ID NO: 813365 - RNA, 19 nt, Homo sapiens
gaaccgagacaaggaggua

SEQ ID NO: 813366 - RNA, 19 nt, Homo sapiens
uaagagaagacucagauga

SEQ ID NO: 813367 - RNA, 19 nt, Homo sapiens
caccaacacuuucuuccaa

SEQ ID NO: 813368 - RNA, 19 nt, Homo sapiens
cagcaucaaagaaugaaua

SEQ ID NO: 813369 - RNA, 19 nt, Homo sapiens
aaacaugucucaacuuagc

SEQ ID NO: 813370 - RNA, 19 nt, Homo sapiens
aagcuuacauugccucuau

SEQ ID NO: 813371 - RNA, 19 nt, Homo sapiens
gagaagaagcgucugaaca

SEQ ID NO: 813372 - RNA, 19 nt, Homo sapiens
gagagacaugauccuauua

SEQ ID NO: 813373 - RNA, 19 nt, Homo sapiens
gcuauugauugcuucagaa

SEQ ID NO: 813374 - RNA, 19 nt, Homo sapiens
aaacuuccaccaacacuuu

SEQ ID NO: 813375 - RNA, 19 nt, Homo sapiens
uagccaagaugaugagaug

SEQ ID NO: 813376 - RNA, 19 nt, Homo sapiens
caagccaaguucuaucaga

SEQ ID NO: 813377 - RNA, 19 nt, Homo sapiens
agaaggagaagaauuagaa

SEQ ID NO: 813378 - RNA, 19 nt, Homo sapiens
gaagaagaugcuaagagaa

SEQ ID NO: 813379 - RNA, 19 nt, Homo sapiens
ggaagaacagaauaaagau

SEQ ID NO: 813380 - RNA, 19 nt, Homo sapiens
cagagaccuuugaaucauu

SEQ ID NO: 813381 - RNA, 19 nt, Homo sapiens
gcgaggaagaacagaauaa

SEQ ID NO: 813382 - RNA, 19 nt, Homo sapiens
aaacuucaccugagaacuu

SEQ ID NO: 813383 - RNA, 19 nt, Homo sapiens
gauggugugucccggaaga

SEQ ID NO: 813384 - RNA, 19 nt, Homo sapiens
gaaagccucaagccaaguu

SEQ ID NO: 813385 - RNA, 19 nt, Homo sapiens
ccagagaccuuugaaucau

SEQ ID NO: 813386 - RNA, 19 nt, Homo sapiens
caaauauuguuggagaaga

SEQ ID NO: 813387 - RNA, 19 nt, Homo sapiens
caaguauggcuauugauug

SEQ ID NO: 813388 - RNA, 19 nt, Homo sapiens
gcaggacccucagcaucaa

SEQ ID NO: 813389 - RNA, 19 nt, Homo sapiens
gccauucacucaggaaaga

SEQ ID NO: 813390 - RNA, 19 nt, Homo sapiens
gggacgaguuacugccuuu

SEQ ID NO: 813391 - RNA, 19 nt, Homo sapiens
agaugagccugaaguagaa

SEQ ID NO: 813392 - RNA, 19 nt, Homo sapiens
gaaagaacaacagagacuu

SEQ ID NO: 813393 - RNA, 19 nt, Homo sapiens
ggaaagaacaacagagacu

SEQ ID NO: 813394 - RNA, 19 nt, Homo sapiens
guaacacaguugaaggaau

SEQ ID NO: 813395 - RNA, 19 nt, Homo sapiens
caaauauccugaagaugac

SEQ ID NO: 813396 - RNA, 19 nt, Homo sapiens
gaaaagcagaggugaauug

SEQ ID NO: 813397 - RNA, 19 nt, Homo sapiens
ggaagaggaagaggaagaa

SEQ ID NO: 813398 - RNA, 19 nt, Homo sapiens
cuaaugagaaugaaagaug

SEQ ID NO: 813399 - RNA, 19 nt, Homo sapiens
agacucagaugaagaagag

SEQ ID NO: 813400 - RNA, 19 nt, Homo sapiens
gagaagacucagaugaaga

SEQ ID NO: 813401 - RNA, 19 nt, Homo sapiens
gcuaagagaagacucagau

SEQ ID NO: 813402 - RNA, 19 nt, Homo sapiens
gaauggccagagaaguuua

SEQ ID NO: 813403 - RNA, 19 nt, Homo sapiens
uaucaagacuguagcaaaa

SEQ ID NO: 813404 - RNA, 19 nt, Homo sapiens
ucacagagcucgcacacaa

SEQ ID NO: 813405 - RNA, 19 nt, Homo sapiens
caacauacucaguccaaua

SEQ ID NO: 813406 - RNA, 19 nt, Homo sapiens
cuacagggcugcucacuuc

SEQ ID NO: 813407 - RNA, 19 nt, Homo sapiens
ccuuagaagucacaacaua

SEQ ID NO: 813408 - RNA, 19 nt, Homo sapiens
cuacagccauaagaaauuu

SEQ ID NO: 813409 - RNA, 19 nt, Homo sapiens
ccacaggcguuguaaccuu

SEQ ID NO: 813410 - RNA, 19 nt, Homo sapiens
ggacgugggcaccucagua

SEQ ID NO: 813411 - RNA, 19 nt, Homo sapiens
cccgagagcuccaucauca

SEQ ID NO: 813412 - RNA, 19 nt, Homo sapiens
gcacagacggguaccugaa

SEQ ID NO: 813413 - RNA, 19 nt, Homo sapiens
ggcgcugugugcccuauua

SEQ ID NO: 813414 - RNA, 19 nt, Homo sapiens
gauccgcauugacgucauu

SEQ ID NO: 813415 - RNA, 19 nt, Homo sapiens
ucaccauccucaucaagaa

SEQ ID NO: 813416 - RNA, 19 nt, Homo sapiens
aacaaggucuacagccaua

SEQ ID NO: 813417 - RNA, 19 nt, Homo sapiens
gacuggaucuugcuaacau

SEQ ID NO: 813418 - RNA, 19 nt, Homo sapiens
cugauucccaccauuauua

SEQ ID NO: 813419 - RNA, 19 nt, Homo sapiens
gccaaauacuacaagauca

SEQ ID NO: 813420 - RNA, 19 nt, Homo sapiens
ggucuacagccauaagaaa

SEQ ID NO: 813421 - RNA, 19 nt, Homo sapiens
ggcuacaacuucagguuug

SEQ ID NO: 813422 - RNA, 19 nt, Homo sapiens
ccacagaccccaaagguuu

SEQ ID NO: 813423 - RNA, 19 nt, Homo sapiens
ccaaauacuacaagaucaa

SEQ ID NO: 813424 - RNA, 19 nt, Homo sapiens
ucaagaacagcauccacua

SEQ ID NO: 813425 - RNA, 19 nt, Homo sapiens
acucugagcuccuuuccau

SEQ ID NO: 813426 - RNA, 19 nt, Homo sapiens
ugugggacguggaggagua

SEQ ID NO: 813427 - RNA, 19 nt, Homo sapiens
ugcccagacucuucccuua

SEQ ID NO: 813428 - RNA, 19 nt, Homo sapiens
gacccuugcccguguauug

SEQ ID NO: 813429 - RNA, 19 nt, Homo sapiens
cccagacucuucccuuaga

SEQ ID NO: 813430 - RNA, 19 nt, Homo sapiens
gaaauuugacaaggugugu

SEQ ID NO: 813431 - RNA, 19 nt, Homo sapiens
aacauacucaguccaauaa

SEQ ID NO: 813432 - RNA, 19 nt, Homo sapiens
agguuuggcucaacucuga

SEQ ID NO: 813433 - RNA, 19 nt, Homo sapiens
ccagacucuucccuuagaa

SEQ ID NO: 813434 - RNA, 19 nt, Homo sapiens
ccaaauuccacuucuccaa

SEQ ID NO: 813435 - RNA, 19 nt, Homo sapiens
cauacucaguccaauaaac

SEQ ID NO: 813436 - RNA, 19 nt, Homo sapiens
uugcuaacauucaugaaca

SEQ ID NO: 813437 - RNA, 19 nt, Homo sapiens
ggaucuugcuaacauucau

SEQ ID NO: 813438 - RNA, 19 nt, Homo sapiens
gggccucugucagccaauu

SEQ ID NO: 813439 - RNA, 19 nt, Homo sapiens
gccauaagaaauuugacaa

SEQ ID NO: 813440 - RNA, 19 nt, Homo sapiens
guacgauggccccaaauuu

SEQ ID NO: 813441 - RNA, 19 nt, Homo sapiens
gccaauuucuggguacgau

SEQ ID NO: 813442 - RNA, 19 nt, Homo sapiens
ucuacagccauaagaaauu

SEQ ID NO: 813443 - RNA, 19 nt, Homo sapiens
gcuaacauucaugaacaaa

SEQ ID NO: 813444 - RNA, 19 nt, Homo sapiens
gcgacuggaucuugcuaac

SEQ ID NO: 813445 - RNA, 19 nt, Homo sapiens
ggugaucgugguacguauu

SEQ ID NO: 813446 - RNA, 19 nt, Homo sapiens
caagaacagcauccacuac

SEQ ID NO: 813447 - RNA, 19 nt, Homo sapiens
ugauucccaccauuauuaa

SEQ ID NO: 813448 - RNA, 19 nt, Homo sapiens
cagccugauucccaccauu

SEQ ID NO: 813449 - RNA, 19 nt, Homo sapiens
ccuacgggauccgcauuga

SEQ ID NO: 813450 - RNA, 19 nt, Homo sapiens
gaagauggggccucuguca

SEQ ID NO: 813451 - RNA, 19 nt, Homo sapiens
gacgugggcaccucaguag

SEQ ID NO: 813452 - RNA, 19 nt, Homo sapiens
cacaacauacucaguccaa

SEQ ID NO: 813453 - RNA, 19 nt, Homo sapiens
agaagucacaacauacuca

SEQ ID NO: 813454 - RNA, 19 nt, Homo sapiens
agccugauucccaccauua

SEQ ID NO: 813455 - RNA, 19 nt, Homo sapiens
gaucuugcuaacauucaug

SEQ ID NO: 813456 - RNA, 19 nt, Homo sapiens
ugacgucauugugcaugga

SEQ ID NO: 813457 - RNA, 19 nt, Homo sapiens
ucacagagcucgcacacaa

SEQ ID NO: 813458 - RNA, 19 nt, Homo sapiens
caacauacucaguccaaua

SEQ ID NO: 813459 - RNA, 19 nt, Homo sapiens
cuacagggcugcucacuuc

SEQ ID NO: 813460 - RNA, 19 nt, Homo sapiens
ccuuagaagucacaacaua

SEQ ID NO: 813461 - RNA, 19 nt, Homo sapiens
cuacagccauaagaaauuu

SEQ ID NO: 813462 - RNA, 19 nt, Homo sapiens
ccacaggcguuguaaccuu

SEQ ID NO: 813463 - RNA, 19 nt, Homo sapiens
ggacgugggcaccucagua

SEQ ID NO: 813464 - RNA, 19 nt, Homo sapiens
cccgagagcuccaucauca

SEQ ID NO: 813465 - RNA, 19 nt, Homo sapiens
gcacagacggguaccugaa

SEQ ID NO: 813466 - RNA, 19 nt, Homo sapiens
ggcgcugugugcccuauua

SEQ ID NO: 813467 - RNA, 19 nt, Homo sapiens
gauccgcauugacgucauu

SEQ ID NO: 813468 - RNA, 19 nt, Homo sapiens
ucaccauccucaucaagaa

SEQ ID NO: 813469 - RNA, 19 nt, Homo sapiens
aacaaggucuacagccaua

SEQ ID NO: 813470 - RNA, 19 nt, Homo sapiens
gacuggaucuugcuaacau

SEQ ID NO: 813471 - RNA, 19 nt, Homo sapiens
cugauucccaccauuauua

SEQ ID NO: 813472 - RNA, 19 nt, Homo sapiens
gccaaauacuacaagauca

SEQ ID NO: 813473 - RNA, 19 nt, Homo sapiens
ggucuacagccauaagaaa

SEQ ID NO: 813474 - RNA, 19 nt, Homo sapiens
ggcuacaacuucagguuug

SEQ ID NO: 813475 - RNA, 19 nt, Homo sapiens
ccacagaccccaaagguuu

SEQ ID NO: 813476 - RNA, 19 nt, Homo sapiens
ccaaauacuacaagaucaa

SEQ ID NO: 813477 - RNA, 19 nt, Homo sapiens
ucaagaacagcauccacua

SEQ ID NO: 813478 - RNA, 19 nt, Homo sapiens
acucugagcuccuuuccau

SEQ ID NO: 813479 - RNA, 19 nt, Homo sapiens
ugugggacguggaggagua

SEQ ID NO: 813480 - RNA, 19 nt, Homo sapiens
ugcccagacucuucccuua

SEQ ID NO: 813481 - RNA, 19 nt, Homo sapiens
gacccuugcccguguauug

SEQ ID NO: 813482 - RNA, 19 nt, Homo sapiens
cccagacucuucccuuaga

SEQ ID NO: 813483 - RNA, 19 nt, Homo sapiens
gaaauuugacaaggugugu

SEQ ID NO: 813484 - RNA, 19 nt, Homo sapiens
aacauacucaguccaauaa

SEQ ID NO: 813485 - RNA, 19 nt, Homo sapiens
agguuuggcucaacucuga

SEQ ID NO: 813486 - RNA, 19 nt, Homo sapiens
ccagacucuucccuuagaa

SEQ ID NO: 813487 - RNA, 19 nt, Homo sapiens
ccaaauuccacuucuccaa

SEQ ID NO: 813488 - RNA, 19 nt, Homo sapiens
gagcauaaggguccacaac

SEQ ID NO: 813489 - RNA, 19 nt, Homo sapiens
cauacucaguccaauaaac

SEQ ID NO: 813490 - RNA, 19 nt, Homo sapiens
uugcuaacauucaugaaca

SEQ ID NO: 813491 - RNA, 19 nt, Homo sapiens
ggaucuugcuaacauucau

SEQ ID NO: 813492 - RNA, 19 nt, Homo sapiens
gggccucugucagccaauu

SEQ ID NO: 813493 - RNA, 19 nt, Homo sapiens
gccauaagaaauuugacaa

SEQ ID NO: 813494 - RNA, 19 nt, Homo sapiens
guacgauggccccaaauuu

SEQ ID NO: 813495 - RNA, 19 nt, Homo sapiens
gccaauuucuggguacgau

SEQ ID NO: 813496 - RNA, 19 nt, Homo sapiens
ucuacagccauaagaaauu

SEQ ID NO: 813497 - RNA, 19 nt, Homo sapiens
gcuaacauucaugaacaaa

SEQ ID NO: 813498 - RNA, 19 nt, Homo sapiens
gcgacuggaucuugcuaac

SEQ ID NO: 813499 - RNA, 19 nt, Homo sapiens
caagaacagcauccacuac

SEQ ID NO: 813500 - RNA, 19 nt, Homo sapiens
ugauucccaccauuauuaa

SEQ ID NO: 813501 - RNA, 19 nt, Homo sapiens
cagccugauucccaccauu

SEQ ID NO: 813502 - RNA, 19 nt, Homo sapiens
ccuacgggauccgcauuga

SEQ ID NO: 813503 - RNA, 19 nt, Homo sapiens
gaagauggggccucuguca

SEQ ID NO: 813504 - RNA, 19 nt, Homo sapiens
gacgugggcaccucaguag

SEQ ID NO: 813505 - RNA, 19 nt, Homo sapiens
cacaacauacucaguccaa

SEQ ID NO: 813506 - RNA, 19 nt, Homo sapiens
gcucauccugcucuacuuc

SEQ ID NO: 813507 - RNA, 19 nt, Homo sapiens
agaagucacaacauacuca

SEQ ID NO: 813508 - RNA, 19 nt, Homo sapiens
agccugauucccaccauua

SEQ ID NO: 813509 - RNA, 19 nt, Homo sapiens
gaucuugcuaacauucaug

SEQ ID NO: 813510 - RNA, 19 nt, Homo sapiens
ugacgucauugugcaugga

SEQ ID NO: 813511 - RNA, 19 nt, Homo sapiens
ucacagagcucgcacacaa

SEQ ID NO: 813512 - RNA, 19 nt, Homo sapiens
caacauacucaguccaaua

SEQ ID NO: 813513 - RNA, 19 nt, Homo sapiens
cuacagggcugcucacuuc

SEQ ID NO: 813514 - RNA, 19 nt, Homo sapiens
ccuuagaagucacaacaua

SEQ ID NO: 813515 - RNA, 19 nt, Homo sapiens
cuacagccauaagaaauuu

SEQ ID NO: 813516 - RNA, 19 nt, Homo sapiens
ccacaggcguuguaaccuu

SEQ ID NO: 813517 - RNA, 19 nt, Homo sapiens
ggacgugggcaccucagua

SEQ ID NO: 813518 - RNA, 19 nt, Homo sapiens
cccgagagcuccaucauca

SEQ ID NO: 813519 - RNA, 19 nt, Homo sapiens
gcacagacggguaccugaa

SEQ ID NO: 813520 - RNA, 19 nt, Homo sapiens
ggcgcugugugcccuauua

SEQ ID NO: 813521 - RNA, 19 nt, Homo sapiens
gauccgcauugacgucauu

SEQ ID NO: 813522 - RNA, 19 nt, Homo sapiens
ucaccauccucaucaagaa

SEQ ID NO: 813523 - RNA, 19 nt, Homo sapiens
aacaaggucuacagccaua

SEQ ID NO: 813524 - RNA, 19 nt, Homo sapiens
gacuggaucuugcuaacau

SEQ ID NO: 813525 - RNA, 19 nt, Homo sapiens
cugauucccaccauuauua

SEQ ID NO: 813526 - RNA, 19 nt, Homo sapiens
gccaaauacuacaagauca

SEQ ID NO: 813527 - RNA, 19 nt, Homo sapiens
ggucuacagccauaagaaa

SEQ ID NO: 813528 - RNA, 19 nt, Homo sapiens
ggcuacaacuucagguuug

SEQ ID NO: 813529 - RNA, 19 nt, Homo sapiens
ccacagaccccaaagguuu

SEQ ID NO: 813530 - RNA, 19 nt, Homo sapiens
ccaaauacuacaagaucaa

SEQ ID NO: 813531 - RNA, 19 nt, Homo sapiens
ucaagaacagcauccacua

SEQ ID NO: 813532 - RNA, 19 nt, Homo sapiens
acucugagcuccuuuccau

SEQ ID NO: 813533 - RNA, 19 nt, Homo sapiens
ugugggacguggaggagua

SEQ ID NO: 813534 - RNA, 19 nt, Homo sapiens
ugcccagacucuucccuua

SEQ ID NO: 813535 - RNA, 19 nt, Homo sapiens
gacccuugcccguguauug

SEQ ID NO: 813536 - RNA, 19 nt, Homo sapiens
cccagacucuucccuuaga

SEQ ID NO: 813537 - RNA, 19 nt, Homo sapiens
gaaauuugacaaggugugu

SEQ ID NO: 813538 - RNA, 19 nt, Homo sapiens
aacauacucaguccaauaa

SEQ ID NO: 813539 - RNA, 19 nt, Homo sapiens
agguuuggcucaacucuga

SEQ ID NO: 813540 - RNA, 19 nt, Homo sapiens
ccagacucuucccuuagaa

SEQ ID NO: 813541 - RNA, 19 nt, Homo sapiens
ccaaauuccacuucuccaa

SEQ ID NO: 813542 - RNA, 19 nt, Homo sapiens
gagcauaaggguccacaac

SEQ ID NO: 813543 - RNA, 19 nt, Homo sapiens
cauacucaguccaauaaac

SEQ ID NO: 813544 - RNA, 19 nt, Homo sapiens
uugcuaacauucaugaaca

SEQ ID NO: 813545 - RNA, 19 nt, Homo sapiens
ggaucuugcuaacauucau

SEQ ID NO: 813546 - RNA, 19 nt, Homo sapiens
gggccucugucagccaauu

SEQ ID NO: 813547 - RNA, 19 nt, Homo sapiens
gccauaagaaauuugacaa

SEQ ID NO: 813548 - RNA, 19 nt, Homo sapiens
guacgauggccccaaauuu

SEQ ID NO: 813549 - RNA, 19 nt, Homo sapiens
gccaauuucuggguacgau

SEQ ID NO: 813550 - RNA, 19 nt, Homo sapiens
ggcagcguguucagcauca

SEQ ID NO: 813551 - RNA, 19 nt, Homo sapiens
ucuacagccauaagaaauu

SEQ ID NO: 813552 - RNA, 19 nt, Homo sapiens
gcuaacauucaugaacaaa

SEQ ID NO: 813553 - RNA, 19 nt, Homo sapiens
gcgacuggaucuugcuaac

SEQ ID NO: 813554 - RNA, 19 nt, Homo sapiens
caagaacagcauccacuac

SEQ ID NO: 813555 - RNA, 19 nt, Homo sapiens
ugauucccaccauuauuaa

SEQ ID NO: 813556 - RNA, 19 nt, Homo sapiens
cagccugauucccaccauu

SEQ ID NO: 813557 - RNA, 19 nt, Homo sapiens
ccuacgggauccgcauuga

SEQ ID NO: 813558 - RNA, 19 nt, Homo sapiens
gaagauggggccucuguca

SEQ ID NO: 813559 - RNA, 19 nt, Homo sapiens
gacgugggcaccucaguag

SEQ ID NO: 813560 - RNA, 19 nt, Homo sapiens
cacaacauacucaguccaa

SEQ ID NO: 813561 - RNA, 19 nt, Homo sapiens
gcucauccugcucuacuuc

SEQ ID NO: 813562 - RNA, 19 nt, Homo sapiens
agaagucacaacauacuca

SEQ ID NO: 813563 - RNA, 19 nt, Homo sapiens
agccugauucccaccauua

SEQ ID NO: 813564 - RNA, 19 nt, Homo sapiens
gaucuugcuaacauucaug

SEQ ID NO: 813565 - RNA, 19 nt, Homo sapiens
ugacgucauugugcaugga

SEQ ID NO: 813566 - RNA, 19 nt, Homo sapiens
ucacagagcucgcacacaa

SEQ ID NO: 813567 - RNA, 19 nt, Homo sapiens
caacauacucaguccaaua

SEQ ID NO: 813568 - RNA, 19 nt, Homo sapiens
cuacagggcugcucacuuc

SEQ ID NO: 813569 - RNA, 19 nt, Homo sapiens
ccuuagaagucacaacaua

SEQ ID NO: 813570 - RNA, 19 nt, Homo sapiens
cuacagccauaagaaauuu

SEQ ID NO: 813571 - RNA, 19 nt, Homo sapiens
ccacaggcguuguaaccuu

SEQ ID NO: 813572 - RNA, 19 nt, Homo sapiens
ggacgugggcaccucagua

SEQ ID NO: 813573 - RNA, 19 nt, Homo sapiens
cccgagagcuccaucauca

SEQ ID NO: 813574 - RNA, 19 nt, Homo sapiens
gcacagacggguaccugaa

SEQ ID NO: 813575 - RNA, 19 nt, Homo sapiens
ggcgcugugugcccuauua

SEQ ID NO: 813576 - RNA, 19 nt, Homo sapiens
gauccgcauugacgucauu

SEQ ID NO: 813577 - RNA, 19 nt, Homo sapiens
ucaccauccucaucaagaa

SEQ ID NO: 813578 - RNA, 19 nt, Homo sapiens
aacaaggucuacagccaua

SEQ ID NO: 813579 - RNA, 19 nt, Homo sapiens
gacuggaucuugcuaacau

SEQ ID NO: 813580 - RNA, 19 nt, Homo sapiens
cugauucccaccauuauua

SEQ ID NO: 813581 - RNA, 19 nt, Homo sapiens
gccaaauacuacaagauca

SEQ ID NO: 813582 - RNA, 19 nt, Homo sapiens
ggucuacagccauaagaaa

SEQ ID NO: 813583 - RNA, 19 nt, Homo sapiens
ggcuacaacuucagguuug

SEQ ID NO: 813584 - RNA, 19 nt, Homo sapiens
ccacagaccccaaagguuu

SEQ ID NO: 813585 - RNA, 19 nt, Homo sapiens
ccaaauacuacaagaucaa

SEQ ID NO: 813586 - RNA, 19 nt, Homo sapiens
ucaagaacagcauccacua

SEQ ID NO: 813587 - RNA, 19 nt, Homo sapiens
acucugagcuccuuuccau

SEQ ID NO: 813588 - RNA, 19 nt, Homo sapiens
ugugggacguggaggagua

SEQ ID NO: 813589 - RNA, 19 nt, Homo sapiens
ugcccagacucuucccuua

SEQ ID NO: 813590 - RNA, 19 nt, Homo sapiens
gacccuugcccguguauug

SEQ ID NO: 813591 - RNA, 19 nt, Homo sapiens
cccagacucuucccuuaga

SEQ ID NO: 813592 - RNA, 19 nt, Homo sapiens
gaaauuugacaaggugugu

SEQ ID NO: 813593 - RNA, 19 nt, Homo sapiens
aacauacucaguccaauaa

SEQ ID NO: 813594 - RNA, 19 nt, Homo sapiens
agguuuggcucaacucuga

SEQ ID NO: 813595 - RNA, 19 nt, Homo sapiens
ccagacucuucccuuagaa

SEQ ID NO: 813596 - RNA, 19 nt, Homo sapiens
ccaaauuccacuucuccaa

SEQ ID NO: 813597 - RNA, 19 nt, Homo sapiens
gagcauaaggguccacaac

SEQ ID NO: 813598 - RNA, 19 nt, Homo sapiens
cauacucaguccaauaaac

SEQ ID NO: 813599 - RNA, 19 nt, Homo sapiens
uugcuaacauucaugaaca

SEQ ID NO: 813600 - RNA, 19 nt, Homo sapiens
ggaucuugcuaacauucau

SEQ ID NO: 813601 - RNA, 19 nt, Homo sapiens
gggccucugucagccaauu

SEQ ID NO: 813602 - RNA, 19 nt, Homo sapiens
gccauaagaaauuugacaa

SEQ ID NO: 813603 - RNA, 19 nt, Homo sapiens
guacgauggccccaaauuu

SEQ ID NO: 813604 - RNA, 19 nt, Homo sapiens
gccaauuucuggguacgau

SEQ ID NO: 813605 - RNA, 19 nt, Homo sapiens
ggcagcguguucagcauca

SEQ ID NO: 813606 - RNA, 19 nt, Homo sapiens
ucuacagccauaagaaauu

SEQ ID NO: 813607 - RNA, 19 nt, Homo sapiens
gcuaacauucaugaacaaa

SEQ ID NO: 813608 - RNA, 19 nt, Homo sapiens
gcgacuggaucuugcuaac

SEQ ID NO: 813609 - RNA, 19 nt, Homo sapiens
caagaacagcauccacuac

SEQ ID NO: 813610 - RNA, 19 nt, Homo sapiens
ugauucccaccauuauuaa

SEQ ID NO: 813611 - RNA, 19 nt, Homo sapiens
cagccugauucccaccauu

SEQ ID NO: 813612 - RNA, 19 nt, Homo sapiens
ccuacgggauccgcauuga

SEQ ID NO: 813613 - RNA, 19 nt, Homo sapiens
gaagauggggccucuguca

SEQ ID NO: 813614 - RNA, 19 nt, Homo sapiens
gacgugggcaccucaguag

SEQ ID NO: 813615 - RNA, 19 nt, Homo sapiens
cacaacauacucaguccaa

SEQ ID NO: 813616 - RNA, 19 nt, Homo sapiens
gcucauccugcucuacuuc

SEQ ID NO: 813617 - RNA, 19 nt, Homo sapiens
agaagucacaacauacuca

SEQ ID NO: 813618 - RNA, 19 nt, Homo sapiens
agccugauucccaccauua

SEQ ID NO: 813619 - RNA, 19 nt, Homo sapiens
gaucuugcuaacauucaug

SEQ ID NO: 813620 - RNA, 19 nt, Homo sapiens
ugacgucauugugcaugga

SEQ ID NO: 813621 - RNA, 19 nt, Homo sapiens
ucacagagcucgcacacaa

SEQ ID NO: 813622 - RNA, 19 nt, Homo sapiens
caacauacucaguccaaua

SEQ ID NO: 813623 - RNA, 19 nt, Homo sapiens
cuacagggcugcucacuuc

SEQ ID NO: 813624 - RNA, 19 nt, Homo sapiens
ccuuagaagucacaacaua

SEQ ID NO: 813625 - RNA, 19 nt, Homo sapiens
cuacagccauaagaaauuu

SEQ ID NO: 813626 - RNA, 19 nt, Homo sapiens
ccacaggcguuguaaccuu

SEQ ID NO: 813627 - RNA, 19 nt, Homo sapiens
ggacgugggcaccucagua

SEQ ID NO: 813628 - RNA, 19 nt, Homo sapiens
gcacagacggguaccugaa

SEQ ID NO: 813629 - RNA, 19 nt, Homo sapiens
ggcgcugugugcccuauua

SEQ ID NO: 813630 - RNA, 19 nt, Homo sapiens
gauccgcauugacgucauu

SEQ ID NO: 813631 - RNA, 19 nt, Homo sapiens
ucaccauccucaucaagaa

SEQ ID NO: 813632 - RNA, 19 nt, Homo sapiens
aacaaggucuacagccaua

SEQ ID NO: 813633 - RNA, 19 nt, Homo sapiens
gacuggaucuugcuaacau

SEQ ID NO: 813634 - RNA, 19 nt, Homo sapiens
cugauucccaccauuauua

SEQ ID NO: 813635 - RNA, 19 nt, Homo sapiens
gccaaauacuacaagauca

SEQ ID NO: 813636 - RNA, 19 nt, Homo sapiens
ggucuacagccauaagaaa

SEQ ID NO: 813637 - RNA, 19 nt, Homo sapiens
ggcuacaacuucagguuug

SEQ ID NO: 813638 - RNA, 19 nt, Homo sapiens
ccacagaccccaaagguuu

SEQ ID NO: 813639 - RNA, 19 nt, Homo sapiens
ccaaauacuacaagaucaa

SEQ ID NO: 813640 - RNA, 19 nt, Homo sapiens
ucaagaacagcauccacua

SEQ ID NO: 813641 - RNA, 19 nt, Homo sapiens
acucugagcuccuuuccau

SEQ ID NO: 813642 - RNA, 19 nt, Homo sapiens
ugcccagacucuucccuua

SEQ ID NO: 813643 - RNA, 19 nt, Homo sapiens
gacccuugcccguguauug

SEQ ID NO: 813644 - RNA, 19 nt, Homo sapiens
cccagacucuucccuuaga

SEQ ID NO: 813645 - RNA, 19 nt, Homo sapiens
aaggugaucgugagcauaa

SEQ ID NO: 813646 - RNA, 19 nt, Homo sapiens
gaaauuugacaaggugugu

SEQ ID NO: 813647 - RNA, 19 nt, Homo sapiens
aacauacucaguccaauaa

SEQ ID NO: 813648 - RNA, 19 nt, Homo sapiens
agguuuggcucaacucuga

SEQ ID NO: 813649 - RNA, 19 nt, Homo sapiens
ccaaggugaucgugagcau

SEQ ID NO: 813650 - RNA, 19 nt, Homo sapiens
ccagacucuucccuuagaa

SEQ ID NO: 813651 - RNA, 19 nt, Homo sapiens
ccaaauuccacuucuccaa

SEQ ID NO: 813652 - RNA, 19 nt, Homo sapiens
gagcauaaggguccacaac

SEQ ID NO: 813653 - RNA, 19 nt, Homo sapiens
cauacucaguccaauaaac

SEQ ID NO: 813654 - RNA, 19 nt, Homo sapiens
uugcuaacauucaugaaca

SEQ ID NO: 813655 - RNA, 19 nt, Homo sapiens
gggccucugucagccaauu

SEQ ID NO: 813656 - RNA, 19 nt, Homo sapiens
ggaucuugcuaacauucau

SEQ ID NO: 813657 - RNA, 19 nt, Homo sapiens
gccauaagaaauuugacaa

SEQ ID NO: 813658 - RNA, 19 nt, Homo sapiens
guacgauggccccaaauuu

SEQ ID NO: 813659 - RNA, 19 nt, Homo sapiens
gccaauuucuggguacgau

SEQ ID NO: 813660 - RNA, 19 nt, Homo sapiens
caaggugaucgugagcaua

SEQ ID NO: 813661 - RNA, 19 nt, Homo sapiens
ucuacagccauaagaaauu

SEQ ID NO: 813662 - RNA, 19 nt, Homo sapiens
gcuaacauucaugaacaaa

SEQ ID NO: 813663 - RNA, 19 nt, Homo sapiens
gcgacuggaucuugcuaac

SEQ ID NO: 813664 - RNA, 19 nt, Homo sapiens
caagaacagcauccacuac

SEQ ID NO: 813665 - RNA, 19 nt, Homo sapiens
gaagauggggccucuguca

SEQ ID NO: 813666 - RNA, 19 nt, Homo sapiens
ugauucccaccauuauuaa

SEQ ID NO: 813667 - RNA, 19 nt, Homo sapiens
cagccugauucccaccauu

SEQ ID NO: 813668 - RNA, 19 nt, Homo sapiens
ccuacgggauccgcauuga

SEQ ID NO: 813669 - RNA, 19 nt, Homo sapiens
gacgugggcaccucaguag

SEQ ID NO: 813670 - RNA, 19 nt, Homo sapiens
cacaacauacucaguccaa

SEQ ID NO: 813671 - RNA, 19 nt, Homo sapiens
agaagucacaacauacuca

SEQ ID NO: 813672 - RNA, 19 nt, Homo sapiens
agccugauucccaccauua

SEQ ID NO: 813673 - RNA, 19 nt, Homo sapiens
gaucuugcuaacauucaug

SEQ ID NO: 813674 - RNA, 19 nt, Homo sapiens
ugacgucauugugcaugga

SEQ ID NO: 813675 - RNA, 19 nt, Homo sapiens
ucacagagcucgcacacaa

SEQ ID NO: 813676 - RNA, 19 nt, Homo sapiens
caacauacucaguccaaua

SEQ ID NO: 813677 - RNA, 19 nt, Homo sapiens
cuacagggcugcucacuuc

SEQ ID NO: 813678 - RNA, 19 nt, Homo sapiens
ccuuagaagucacaacaua

SEQ ID NO: 813679 - RNA, 19 nt, Homo sapiens
cuacagccauaagaaauuu

SEQ ID NO: 813680 - RNA, 19 nt, Homo sapiens
ccacaggcguuguaaccuu

SEQ ID NO: 813681 - RNA, 19 nt, Homo sapiens
ggacgugggcaccucagua

SEQ ID NO: 813682 - RNA, 19 nt, Homo sapiens
cccgagagcuccaucauca

SEQ ID NO: 813683 - RNA, 19 nt, Homo sapiens
gcacagacggguaccugaa

SEQ ID NO: 813684 - RNA, 19 nt, Homo sapiens
ggcgcugugugcccuauua

SEQ ID NO: 813685 - RNA, 19 nt, Homo sapiens
gauccgcauugacgucauu

SEQ ID NO: 813686 - RNA, 19 nt, Homo sapiens
ucaccauccucaucaagaa

SEQ ID NO: 813687 - RNA, 19 nt, Homo sapiens
aacaaggucuacagccaua

SEQ ID NO: 813688 - RNA, 19 nt, Homo sapiens
gacuggaucuugcuaacau

SEQ ID NO: 813689 - RNA, 19 nt, Homo sapiens
cugauucccaccauuauua

SEQ ID NO: 813690 - RNA, 19 nt, Homo sapiens
gccaaauacuacaagauca

SEQ ID NO: 813691 - RNA, 19 nt, Homo sapiens
ggucuacagccauaagaaa

SEQ ID NO: 813692 - RNA, 19 nt, Homo sapiens
ggcuacaacuucagguuug

SEQ ID NO: 813693 - RNA, 19 nt, Homo sapiens
ccacagaccccaaagguuu

SEQ ID NO: 813694 - RNA, 19 nt, Homo sapiens
ccaaauacuacaagaucaa

SEQ ID NO: 813695 - RNA, 19 nt, Homo sapiens
ucaagaacagcauccacua

SEQ ID NO: 813696 - RNA, 19 nt, Homo sapiens
acucugagcuccuuuccau

SEQ ID NO: 813697 - RNA, 19 nt, Homo sapiens
ugugggacguggaggagua

SEQ ID NO: 813698 - RNA, 19 nt, Homo sapiens
ugcccagacucuucccuua

SEQ ID NO: 813699 - RNA, 19 nt, Homo sapiens
cccagacucuucccuuaga

SEQ ID NO: 813700 - RNA, 19 nt, Homo sapiens
aacauacucaguccaauaa

SEQ ID NO: 813701 - RNA, 19 nt, Homo sapiens
agguuuggcucaacucuga

SEQ ID NO: 813702 - RNA, 19 nt, Homo sapiens
ccagacucuucccuuagaa

SEQ ID NO: 813703 - RNA, 19 nt, Homo sapiens
ccaaauuccacuucuccaa

SEQ ID NO: 813704 - RNA, 19 nt, Homo sapiens
gagcauaaggguccacaac

SEQ ID NO: 813705 - RNA, 19 nt, Homo sapiens
cauacucaguccaauaaac

SEQ ID NO: 813706 - RNA, 19 nt, Homo sapiens
uugcuaacauucaugaaca

SEQ ID NO: 813707 - RNA, 19 nt, Homo sapiens
ggaucuugcuaacauucau

SEQ ID NO: 813708 - RNA, 19 nt, Homo sapiens
gggccucugucagccaauu

SEQ ID NO: 813709 - RNA, 19 nt, Homo sapiens
gccauaagaaauuugacaa

SEQ ID NO: 813710 - RNA, 19 nt, Homo sapiens
guacgauggccccaaauuu

SEQ ID NO: 813711 - RNA, 19 nt, Homo sapiens
gccaauuucuggguacgau

SEQ ID NO: 813712 - RNA, 19 nt, Homo sapiens
ggcagcguguucagcauca

SEQ ID NO: 813713 - RNA, 19 nt, Homo sapiens
ucuacagccauaagaaauu

SEQ ID NO: 813714 - RNA, 19 nt, Homo sapiens
gcuaacauucaugaacaaa

SEQ ID NO: 813715 - RNA, 19 nt, Homo sapiens
gcgacuggaucuugcuaac

SEQ ID NO: 813716 - RNA, 19 nt, Homo sapiens
caagaacagcauccacuac

SEQ ID NO: 813717 - RNA, 19 nt, Homo sapiens
ugauucccaccauuauuaa

SEQ ID NO: 813718 - RNA, 19 nt, Homo sapiens
cagccugauucccaccauu

SEQ ID NO: 813719 - RNA, 19 nt, Homo sapiens
ccuacgggauccgcauuga

SEQ ID NO: 813720 - RNA, 19 nt, Homo sapiens
gaagauggggccucuguca

SEQ ID NO: 813721 - RNA, 19 nt, Homo sapiens
gacgugggcaccucaguag

SEQ ID NO: 813722 - RNA, 19 nt, Homo sapiens
cacaacauacucaguccaa

SEQ ID NO: 813723 - RNA, 19 nt, Homo sapiens
gcucauccugcucuacuuc

SEQ ID NO: 813724 - RNA, 19 nt, Homo sapiens
agaagucacaacauacuca

SEQ ID NO: 813725 - RNA, 19 nt, Homo sapiens
agccugauucccaccauua

SEQ ID NO: 813726 - RNA, 19 nt, Homo sapiens
gaucuugcuaacauucaug

SEQ ID NO: 813727 - RNA, 19 nt, Homo sapiens
ugacgucauugugcaugga

SEQ ID NO: 813728 - RNA, 19 nt, Homo sapiens
gaaauuugcccuuguauua

SEQ ID NO: 813729 - RNA, 19 nt, Homo sapiens
gcaaacaaaugcugauaua

SEQ ID NO: 813730 - RNA, 19 nt, Homo sapiens
ggaaauugcuugccuuuua

SEQ ID NO: 813731 - RNA, 19 nt, Homo sapiens
gguguuagcugaaguuuga

SEQ ID NO: 813732 - RNA, 19 nt, Homo sapiens
gaaagucauucauuuagug

SEQ ID NO: 813733 - RNA, 19 nt, Homo sapiens
caucuuggauugagaauug

SEQ ID NO: 813734 - RNA, 19 nt, Homo sapiens
guggaaagcuuugguguuu

SEQ ID NO: 813735 - RNA, 19 nt, Homo sapiens
gcaggcagauguagcacua

SEQ ID NO: 813736 - RNA, 19 nt, Homo sapiens
gaucagggguggucaaaua

SEQ ID NO: 813737 - RNA, 19 nt, Homo sapiens
aagaugcacugcccaaaua

SEQ ID NO: 813738 - RNA, 19 nt, Homo sapiens
gcauagcccuaacuccuaa

SEQ ID NO: 813739 - RNA, 19 nt, Homo sapiens
gcaucaagaucuacagcua

SEQ ID NO: 813740 - RNA, 19 nt, Homo sapiens
gagcugugguuugguguua

SEQ ID NO: 813741 - RNA, 19 nt, Homo sapiens
gagaagcuauuggccagua

SEQ ID NO: 813742 - RNA, 19 nt, Homo sapiens
gaggaucugugccaucuug

SEQ ID NO: 813743 - RNA, 19 nt, Homo sapiens
guggagagguggacacauu

SEQ ID NO: 813744 - RNA, 19 nt, Homo sapiens
caacuucccuucccuuagu

SEQ ID NO: 813745 - RNA, 19 nt, Homo sapiens
gaaauugcuugccuuuuaa

SEQ ID NO: 813746 - RNA, 19 nt, Homo sapiens
gcaggaauuugacccucua

SEQ ID NO: 813747 - RNA, 19 nt, Homo sapiens
caaccucacuccucucuca

SEQ ID NO: 813748 - RNA, 19 nt, Homo sapiens
ccaggaauguucaaucuuc

SEQ ID NO: 813749 - RNA, 19 nt, Homo sapiens
caaauuggacaagcuguua

SEQ ID NO: 813750 - RNA, 19 nt, Homo sapiens
gauauagucagcaaauuug

SEQ ID NO: 813751 - RNA, 19 nt, Homo sapiens
ggaauaagcaaacaaaugc

SEQ ID NO: 813752 - RNA, 19 nt, Homo sapiens
gcauauauggguuggaauu

SEQ ID NO: 813753 - RNA, 19 nt, Homo sapiens
gaaguugagaaguccaaua

SEQ ID NO: 813754 - RNA, 19 nt, Homo sapiens
gggaauaagcaaacaaaug

SEQ ID NO: 813755 - RNA, 19 nt, Homo sapiens
ucauauucccguaacauua

SEQ ID NO: 813756 - RNA, 19 nt, Homo sapiens
ugacugacagcuaugauaa

SEQ ID NO: 813757 - RNA, 19 nt, Homo sapiens
gaucaagcaggcagaugua

SEQ ID NO: 813758 - RNA, 19 nt, Homo sapiens
caaauacagcugccuaugu

SEQ ID NO: 813759 - RNA, 19 nt, Homo sapiens
caggauuucuuuccauuuc

SEQ ID NO: 813760 - RNA, 19 nt, Homo sapiens
cagucaaggugaaguacua

SEQ ID NO: 813761 - RNA, 19 nt, Homo sapiens
ugacccagcugacagacaa

SEQ ID NO: 813762 - RNA, 19 nt, Homo sapiens
cuauuugguuucaggauuu

SEQ ID NO: 813763 - RNA, 19 nt, Homo sapiens
cagcaaauuuggauagucu

SEQ ID NO: 813764 - RNA, 19 nt, Homo sapiens
gggcuauaguguccuuauu

SEQ ID NO: 813765 - RNA, 19 nt, Homo sapiens
auaacucccucaagguaua

SEQ ID NO: 813766 - RNA, 19 nt, Homo sapiens
gacccuaguugguugguau

SEQ ID NO: 813767 - RNA, 19 nt, Homo sapiens
guagagagagccacuuuag

SEQ ID NO: 813768 - RNA, 19 nt, Homo sapiens
guugagaaguccaauaguc

SEQ ID NO: 813769 - RNA, 19 nt, Homo sapiens
uauauggguuggaauuaug

SEQ ID NO: 813770 - RNA, 19 nt, Homo sapiens
cauaggggaugagaaauua

SEQ ID NO: 813771 - RNA, 19 nt, Homo sapiens
guucugagcugugcuagca

SEQ ID NO: 813772 - RNA, 19 nt, Homo sapiens
gaggguggcuuuuccauug

SEQ ID NO: 813773 - RNA, 19 nt, Homo sapiens
gagcucacccugcaagaug

SEQ ID NO: 813774 - RNA, 19 nt, Homo sapiens
cauaggaagcugggaauaa

SEQ ID NO: 813775 - RNA, 19 nt, Homo sapiens
gauugagaauugcagaugu

SEQ ID NO: 813776 - RNA, 19 nt, Homo sapiens
ugacaguagucgcaaggaa

SEQ ID NO: 813777 - RNA, 19 nt, Homo sapiens
caucguggcugacaguagu

SEQ ID NO: 813778 - RNA, 19 nt, Homo sapiens
cagcaagauuacccgcaua

SEQ ID NO: 813779 - RNA, 19 nt, Homo sapiens
gguuuguuauucuguguuu

SEQ ID NO: 813780 - RNA, 19 nt, Homo sapiens
gaagauauuccaccccaua

SEQ ID NO: 813781 - RNA, 19 nt, Homo sapiens
gaggauuuccgcugcauug

SEQ ID NO: 813782 - RNA, 19 nt, Homo sapiens
ugauaacucccucaaggua

SEQ ID NO: 813783 - RNA, 19 nt, Homo sapiens
caagauguggagcuccuua

SEQ ID NO: 813784 - RNA, 19 nt, Homo sapiens
guacacucccugucaaaga

SEQ ID NO: 813785 - RNA, 19 nt, Homo sapiens
cuaaggaauuguacaacau

SEQ ID NO: 813786 - RNA, 19 nt, Homo sapiens
aagcauauauggguuggaa

SEQ ID NO: 813787 - RNA, 19 nt, Homo sapiens
gagaauugcagaugugaca

SEQ ID NO: 813788 - RNA, 19 nt, Homo sapiens
cuugaacucugauuggauu

SEQ ID NO: 813789 - RNA, 19 nt, Homo sapiens
uaaugugcuucaucuguga

SEQ ID NO: 813790 - RNA, 19 nt, Homo sapiens
gcugaaguuugauuagcaa

SEQ ID NO: 813791 - RNA, 19 nt, Homo sapiens
ccuagggccucaccugcua

SEQ ID NO: 813792 - RNA, 19 nt, Homo sapiens
uggacaagcuguuaagaag

SEQ ID NO: 813793 - RNA, 19 nt, Homo sapiens
ggcaagguauaaagcaguu

SEQ ID NO: 813794 - RNA, 19 nt, Homo sapiens
guacauacuauuugguuuc

SEQ ID NO: 813795 - RNA, 19 nt, Homo sapiens
gggauacacaagcccuuua

SEQ ID NO: 813796 - RNA, 19 nt, Homo sapiens
ucagugacauuuaagacau

SEQ ID NO: 813797 - RNA, 19 nt, Homo sapiens
gaagcuccaucuuuuaaug

SEQ ID NO: 813798 - RNA, 19 nt, Homo sapiens
ccuuaguucuugguuguua

SEQ ID NO: 813799 - RNA, 19 nt, Homo sapiens
gacaguagucgcaaggaaa

SEQ ID NO: 813800 - RNA, 19 nt, Homo sapiens
guaacuaucguauacaagu

SEQ ID NO: 813801 - RNA, 19 nt, Homo sapiens
uuagagagauggacaugag

SEQ ID NO: 813802 - RNA, 19 nt, Homo sapiens
ugacagugcuaaagaucau

SEQ ID NO: 813803 - RNA, 19 nt, Homo sapiens
cugaucgucuuuaccagua

SEQ ID NO: 813804 - RNA, 19 nt, Homo sapiens
gcccuuguauuaaauccuu

SEQ ID NO: 813805 - RNA, 19 nt, Homo sapiens
gugguuugguguuauguga

SEQ ID NO: 813806 - RNA, 19 nt, Homo sapiens
cauacuaccucucucuucu

SEQ ID NO: 813807 - RNA, 19 nt, Homo sapiens
aacaaaugcugauauaguc

SEQ ID NO: 813808 - RNA, 19 nt, Homo sapiens
cauauauggguuggaauua

SEQ ID NO: 813809 - RNA, 19 nt, Homo sapiens
gcggucagcaggaauuuga

SEQ ID NO: 813810 - RNA, 19 nt, Homo sapiens
ggauugacccuaguugguu

SEQ ID NO: 813811 - RNA, 19 nt, Homo sapiens
uugcagaugugacagaaug

SEQ ID NO: 813812 - RNA, 19 nt, Homo sapiens
cauauucccguaacauuau

SEQ ID NO: 813813 - RNA, 19 nt, Homo sapiens
ccaguggcauugauagcuu

SEQ ID NO: 813814 - RNA, 19 nt, Homo sapiens
caguuaacguggaagauuc

SEQ ID NO: 813815 - RNA, 19 nt, Homo sapiens
ucuaaggaauuguacaaca

SEQ ID NO: 813816 - RNA, 19 nt, Homo sapiens
uuugaaauuugcccuugua

SEQ ID NO: 813817 - RNA, 19 nt, Homo sapiens
cggcuucccaccuaaauuu

SEQ ID NO: 813818 - RNA, 19 nt, Homo sapiens
gcaugaauacugugcuguu

SEQ ID NO: 813819 - RNA, 19 nt, Homo sapiens
gggcagaucuacccaaccu

SEQ ID NO: 813820 - RNA, 19 nt, Homo sapiens
cgugguaacuaucguauac

SEQ ID NO: 813821 - RNA, 19 nt, Homo sapiens
ggacaguuaacguggaaga

SEQ ID NO: 813822 - RNA, 19 nt, Homo sapiens
uacacucccugucaaagaa

SEQ ID NO: 813823 - RNA, 19 nt, Homo sapiens
uggagaaucggcagaauga

SEQ ID NO: 813824 - RNA, 19 nt, Homo sapiens
gauaacucccucaagguau

SEQ ID NO: 813825 - RNA, 19 nt, Homo sapiens
cagcagugccucuuucuca

SEQ ID NO: 813826 - RNA, 19 nt, Homo sapiens
aaauuuggauagucucuag

SEQ ID NO: 813827 - RNA, 19 nt, Homo sapiens
gaucgucuuuaccaguaug

SEQ ID NO: 813828 - RNA, 19 nt, Homo sapiens
gaagaacccucauuucauu

SEQ ID NO: 813829 - RNA, 19 nt, Homo sapiens
caagacagcugaaccuuug

SEQ ID NO: 813830 - RNA, 19 nt, Homo sapiens
gaucuaggguuguaaagaa

SEQ ID NO: 813831 - RNA, 19 nt, Homo sapiens
gcagugacaugaugaugaa

SEQ ID NO: 813832 - RNA, 19 nt, Homo sapiens
uaaggucccucuauuuauu

SEQ ID NO: 813833 - RNA, 19 nt, Homo sapiens
gaagugaagcauucuauga

SEQ ID NO: 813834 - RNA, 19 nt, Homo sapiens
caacuuuggaggauuauua

SEQ ID NO: 813835 - RNA, 19 nt, Homo sapiens
ucaagaagcugcugacauc

SEQ ID NO: 813836 - RNA, 19 nt, Homo sapiens
caaauauggucaccuauca

SEQ ID NO: 813837 - RNA, 19 nt, Homo sapiens
gcucuaaggucccucuauu

SEQ ID NO: 813838 - RNA, 19 nt, Homo sapiens
acacaaauauggucaccua

SEQ ID NO: 813839 - RNA, 19 nt, Homo sapiens
gggcaaacccuguaguuaa

SEQ ID NO: 813840 - RNA, 19 nt, Homo sapiens
ggccagaacugcugucgaa

SEQ ID NO: 813841 - RNA, 19 nt, Homo sapiens
cagaggugcuugucacuuu

SEQ ID NO: 813842 - RNA, 19 nt, Homo sapiens
aaugugagcugaagaaaug

SEQ ID NO: 813843 - RNA, 19 nt, Homo sapiens
cagcugaaccuuugaaauu

SEQ ID NO: 813844 - RNA, 19 nt, Homo sapiens
gcccucagauggagaaauu

SEQ ID NO: 813845 - RNA, 19 nt, Homo sapiens
caagaucaguaugaaauug

SEQ ID NO: 813846 - RNA, 19 nt, Homo sapiens
ggagaaauuagcauacaaa

SEQ ID NO: 813847 - RNA, 19 nt, Homo sapiens
ggcaaacccuguaguuaau

SEQ ID NO: 813848 - RNA, 19 nt, Homo sapiens
ucuaaggucccucuauuua

SEQ ID NO: 813849 - RNA, 19 nt, Homo sapiens
gaacugcugucgaagaaaa

SEQ ID NO: 813850 - RNA, 19 nt, Homo sapiens
cagaacugcugucgaagaa

SEQ ID NO: 813851 - RNA, 19 nt, Homo sapiens
ccaaaguugugauuccaaa

SEQ ID NO: 813852 - RNA, 19 nt, Homo sapiens
ggaagaacccucauuucau

SEQ ID NO: 813853 - RNA, 19 nt, Homo sapiens
agccacagcugccaugaua

SEQ ID NO: 813854 - RNA, 19 nt, Homo sapiens
gaagucagagcaagguauu

SEQ ID NO: 813855 - RNA, 19 nt, Homo sapiens
gcaacucccugaccauuuu

SEQ ID NO: 813856 - RNA, 19 nt, Homo sapiens
caaaucuucugacauucuu

SEQ ID NO: 813857 - RNA, 19 nt, Homo sapiens
gaaccacacucagacucaa

SEQ ID NO: 813858 - RNA, 19 nt, Homo sapiens
gagcugaagaaaugaauga

SEQ ID NO: 813859 - RNA, 19 nt, Homo sapiens
gugauagacuggagugaug

SEQ ID NO: 813860 - RNA, 19 nt, Homo sapiens
gugacaugaugaugaagua

SEQ ID NO: 813861 - RNA, 19 nt, Homo sapiens
uuucaacuuuggaggauua

SEQ ID NO: 813862 - RNA, 19 nt, Homo sapiens
gcugccaucuggacuuauu

SEQ ID NO: 813863 - RNA, 19 nt, Homo sapiens
cauaaagccuugaccacau

SEQ ID NO: 813864 - RNA, 19 nt, Homo sapiens
gcaaccagcccuuuacaca

SEQ ID NO: 813865 - RNA, 19 nt, Homo sapiens
ccaccugccucaccaacaa

SEQ ID NO: 813866 - RNA, 19 nt, Homo sapiens
gaaauaaugcaguccuaca

SEQ ID NO: 813867 - RNA, 19 nt, Homo sapiens
gugcaaaccucuaccuuuu

SEQ ID NO: 813868 - RNA, 19 nt, Homo sapiens
caagucagcagcacagcua

SEQ ID NO: 813869 - RNA, 19 nt, Homo sapiens
acagccaccucuuggauuu

SEQ ID NO: 813870 - RNA, 19 nt, Homo sapiens
cuagggcacuuucucuuug

SEQ ID NO: 813871 - RNA, 19 nt, Homo sapiens
gcaaacccuguaguuaaua

SEQ ID NO: 813872 - RNA, 19 nt, Homo sapiens
gcaacgaguucaagaucag

SEQ ID NO: 813873 - RNA, 19 nt, Homo sapiens
cagacucacuugucacuca

SEQ ID NO: 813874 - RNA, 19 nt, Homo sapiens
ccuccgaugugaauacuga

SEQ ID NO: 813875 - RNA, 19 nt, Homo sapiens
agacuggagugauguuaga

SEQ ID NO: 813876 - RNA, 19 nt, Homo sapiens
uccacaggcuuccuuguaa

SEQ ID NO: 813877 - RNA, 19 nt, Homo sapiens
gccacaaccuucguaguga

SEQ ID NO: 813878 - RNA, 19 nt, Homo sapiens
gaaauucccaaagaagaga

SEQ ID NO: 813879 - RNA, 19 nt, Homo sapiens
gcaccaaaguugugauucc

SEQ ID NO: 813880 - RNA, 19 nt, Homo sapiens
uaugcagccuaaugugaua

SEQ ID NO: 813881 - RNA, 19 nt, Homo sapiens
ggugcaaaccucuaccuuu

SEQ ID NO: 813882 - RNA, 19 nt, Homo sapiens
caagcucuccuaccacauu

SEQ ID NO: 813883 - RNA, 19 nt, Homo sapiens
ccaagacagcugaaccuuu

SEQ ID NO: 813884 - RNA, 19 nt, Homo sapiens
gaaugugagcugaagaaau

SEQ ID NO: 813885 - RNA, 19 nt, Homo sapiens
uaauacuccucccacacua

SEQ ID NO: 813886 - RNA, 19 nt, Homo sapiens
aaccagcccuuuacacaga

SEQ ID NO: 813887 - RNA, 19 nt, Homo sapiens
gaaacucugccacaaccuu

SEQ ID NO: 813888 - RNA, 19 nt, Homo sapiens
agaagaagguccagcaacu

SEQ ID NO: 813889 - RNA, 19 nt, Homo sapiens
acaggaagaacccucauuu

SEQ ID NO: 813890 - RNA, 19 nt, Homo sapiens
gaccacaucacuccauaug

SEQ ID NO: 813891 - RNA, 19 nt, Homo sapiens
ucgaggaugugaugcaguu

SEQ ID NO: 813892 - RNA, 19 nt, Homo sapiens
gcugaagaaaugaaugaaa

SEQ ID NO: 813893 - RNA, 19 nt, Homo sapiens
gauaaaucccaaacuucuu

SEQ ID NO: 813894 - RNA, 19 nt, Homo sapiens
cauugacuaugcagccuaa

SEQ ID NO: 813895 - RNA, 19 nt, Homo sapiens
ugaaguacaugggccugaa

SEQ ID NO: 813896 - RNA, 19 nt, Homo sapiens
gguuaucucagccguguuu

SEQ ID NO: 813897 - RNA, 19 nt, Homo sapiens
ugacauucuuugaagugaa

SEQ ID NO: 813898 - RNA, 19 nt, Homo sapiens
cgcgaugccucucgacuga

SEQ ID NO: 813899 - RNA, 19 nt, Homo sapiens
ggaaccacacucagacuca

SEQ ID NO: 813900 - RNA, 19 nt, Homo sapiens
gacauucuuugaagugaag

SEQ ID NO: 813901 - RNA, 19 nt, Homo sapiens
guccacaggcuuccuugua

SEQ ID NO: 813902 - RNA, 19 nt, Homo sapiens
auacaaagaaacugacuug

SEQ ID NO: 813903 - RNA, 19 nt, Homo sapiens
ugauaaguccuuccaugaa

SEQ ID NO: 813904 - RNA, 19 nt, Homo sapiens
gggaacagcauacccucaa

SEQ ID NO: 813905 - RNA, 19 nt, Homo sapiens
caguuuguaucuacuugaa

SEQ ID NO: 813906 - RNA, 19 nt, Homo sapiens
gagguggagagacccauaa

SEQ ID NO: 813907 - RNA, 19 nt, Homo sapiens
caaacccuguaguuaauac

SEQ ID NO: 813908 - RNA, 19 nt, Homo sapiens
guuuguaucuacuugaaca

SEQ ID NO: 813909 - RNA, 19 nt, Homo sapiens
uagcauacaaagaaacuga

SEQ ID NO: 813910 - RNA, 19 nt, Homo sapiens
aggaagaacccucauuuca

SEQ ID NO: 813911 - RNA, 19 nt, Homo sapiens
caucuggacuuauuuuaug

SEQ ID NO: 813912 - RNA, 19 nt, Homo sapiens
ccacaggcuuccuuguaag

SEQ ID NO: 813913 - RNA, 19 nt, Homo sapiens
ccagaacugcugucgaaga

SEQ ID NO: 813914 - RNA, 19 nt, Homo sapiens
aauggacucugccucaaau

SEQ ID NO: 813915 - RNA, 19 nt, Homo sapiens
caauggacucugccucaaa

SEQ ID NO: 813916 - RNA, 19 nt, Homo sapiens
ugacuaugcagccuaaugu

SEQ ID NO: 813917 - RNA, 19 nt, Homo sapiens
aaacugucuuggaacauca

SEQ ID NO: 813918 - RNA, 19 nt, Homo sapiens
gaguucaagaucaguauga

SEQ ID NO: 813919 - RNA, 19 nt, Homo sapiens
uacucagacuuuacucuaa

SEQ ID NO: 813920 - RNA, 19 nt, Homo sapiens
gggcguaaaccaggaaaga

SEQ ID NO: 813921 - RNA, 19 nt, Homo sapiens
gcagccuccuggcaccaaa

SEQ ID NO: 813922 - RNA, 19 nt, Homo sapiens
gggaugggagggcagguuu

SEQ ID NO: 813923 - RNA, 19 nt, Homo sapiens
cuaaggucccucuauuuau

SEQ ID NO: 813924 - RNA, 19 nt, Homo sapiens
gaggaugugaugcaguuug

SEQ ID NO: 813925 - RNA, 19 nt, Homo sapiens
ucaauggacucugccucaa

SEQ ID NO: 813926 - RNA, 19 nt, Homo sapiens
ggagaaacucugccacaac

SEQ ID NO: 813927 - RNA, 19 nt, Homo sapiens
gaacccucauuucauuugc

SEQ ID NO: 813928 - RNA, 19 nt, Homo sapiens
ggagagaacuggugcauaa

SEQ ID NO: 813929 - RNA, 19 nt, Homo sapiens
gagauuaagucaugguuua

SEQ ID NO: 813930 - RNA, 19 nt, Homo sapiens
gcacuucccuugccucauu

SEQ ID NO: 813931 - RNA, 19 nt, Homo sapiens
ggcaagaacuguggaaaua

SEQ ID NO: 813932 - RNA, 19 nt, Homo sapiens
gcaagaaggaugauauuaa

SEQ ID NO: 813933 - RNA, 19 nt, Homo sapiens
ugacaacacuuacuacaaa

SEQ ID NO: 813934 - RNA, 19 nt, Homo sapiens
gagaauggcugagguagaa

SEQ ID NO: 813935 - RNA, 19 nt, Homo sapiens
uaacgguucuugauacaua

SEQ ID NO: 813936 - RNA, 19 nt, Homo sapiens
ggacgaaccgguagugaua

SEQ ID NO: 813937 - RNA, 19 nt, Homo sapiens
gaagaagacugcguggauu

SEQ ID NO: 813938 - RNA, 19 nt, Homo sapiens
aagagaagauugcaacuuu

SEQ ID NO: 813939 - RNA, 19 nt, Homo sapiens
gaaauucuacccucuaaga

SEQ ID NO: 813940 - RNA, 19 nt, Homo sapiens
agacaaagaacgucaguua

SEQ ID NO: 813941 - RNA, 19 nt, Homo sapiens
ggaugaacacuuugaauuu

SEQ ID NO: 813942 - RNA, 19 nt, Homo sapiens
gaaaaggggugaaagagaa

SEQ ID NO: 813943 - RNA, 19 nt, Homo sapiens
caagaacuguggaaauaug

SEQ ID NO: 813944 - RNA, 19 nt, Homo sapiens
cugaggagcucgagaaauu

SEQ ID NO: 813945 - RNA, 19 nt, Homo sapiens
gaacuuuacaucugaacua

SEQ ID NO: 813946 - RNA, 19 nt, Homo sapiens
gcaaugggaccugcucuua

SEQ ID NO: 813947 - RNA, 19 nt, Homo sapiens
caagaaaccaccugugaaa

SEQ ID NO: 813948 - RNA, 19 nt, Homo sapiens
gcauaaggcaaauccaaua

SEQ ID NO: 813949 - RNA, 19 nt, Homo sapiens
gaugaacacuuugaauuuc

SEQ ID NO: 813950 - RNA, 19 nt, Homo sapiens
gagcgagaaucaaagaaga

SEQ ID NO: 813951 - RNA, 19 nt, Homo sapiens
gaccuggccuggaauaaau

SEQ ID NO: 813952 - RNA, 19 nt, Homo sapiens
gaagagaauggcugaggua

SEQ ID NO: 813953 - RNA, 19 nt, Homo sapiens
agaagaagguaaagaaugu

SEQ ID NO: 813954 - RNA, 19 nt, Homo sapiens
caagaaggaugauauuaac

SEQ ID NO: 813955 - RNA, 19 nt, Homo sapiens
ccucggauuucaucaauuu

SEQ ID NO: 813956 - RNA, 19 nt, Homo sapiens
uaaagaaugugacccagau

SEQ ID NO: 813957 - RNA, 19 nt, Homo sapiens
gcucuuaaccucaaaccua

SEQ ID NO: 813958 - RNA, 19 nt, Homo sapiens
caaagaagaugaggaagag

SEQ ID NO: 813959 - RNA, 19 nt, Homo sapiens
agauagagauuaagucaug

SEQ ID NO: 813960 - RNA, 19 nt, Homo sapiens
ccuaacagauaucauuuga

SEQ ID NO: 813961 - RNA, 19 nt, Homo sapiens
ccauuaaccugccagagaa

SEQ ID NO: 813962 - RNA, 19 nt, Homo sapiens
gagaaagcauacuugacaa

SEQ ID NO: 813963 - RNA, 19 nt, Homo sapiens
gaacugagacagcagaaag

SEQ ID NO: 813964 - RNA, 19 nt, Homo sapiens
ugaacuugaucccagaaua

SEQ ID NO: 813965 - RNA, 19 nt, Homo sapiens
ggaagaagacugcguggau

SEQ ID NO: 813966 - RNA, 19 nt, Homo sapiens
gaacaaucaguaaaucaga

SEQ ID NO: 813967 - RNA, 19 nt, Homo sapiens
agauguaacucaugaaugu

SEQ ID NO: 813968 - RNA, 19 nt, Homo sapiens
ugacccagauugaaccuuu

SEQ ID NO: 813969 - RNA, 19 nt, Homo sapiens
gagaagaagguaaagaaug

SEQ ID NO: 813970 - RNA, 19 nt, Homo sapiens
cuaagaaccaggaggaaua

SEQ ID NO: 813971 - RNA, 19 nt, Homo sapiens
gagaaaggcuaaucuucag

SEQ ID NO: 813972 - RNA, 19 nt, Homo sapiens
gaauuuagucucuguguca

SEQ ID NO: 813973 - RNA, 19 nt, Homo sapiens
gggaggcugucggcuaaua

SEQ ID NO: 813974 - RNA, 19 nt, Homo sapiens
caaagcacgugaacuugau

SEQ ID NO: 813975 - RNA, 19 nt, Homo sapiens
ucaaacaacauccuaagaa

SEQ ID NO: 813976 - RNA, 19 nt, Homo sapiens
ggaauagggcaaccuguga

SEQ ID NO: 813977 - RNA, 19 nt, Homo sapiens
gagaagauugcaacuuuga

SEQ ID NO: 813978 - RNA, 19 nt, Homo sapiens
uaauaacgguucuugauac

SEQ ID NO: 813979 - RNA, 19 nt, Homo sapiens
ccagaaagcccagcaguug

SEQ ID NO: 813980 - RNA, 19 nt, Homo sapiens
ggcaggagcuggagaagag

SEQ ID NO: 813981 - RNA, 19 nt, Homo sapiens
cuaauaacgguucuugaua

SEQ ID NO: 813982 - RNA, 19 nt, Homo sapiens
uaagggauguaccauuguu

SEQ ID NO: 813983 - RNA, 19 nt, Homo sapiens
gagaaaagugguacaaaua

SEQ ID NO: 813984 - RNA, 19 nt, Homo sapiens
caaauccaauacgcaagua

SEQ ID NO: 813985 - RNA, 19 nt, Homo sapiens
caaacaccgucaucucuca

SEQ ID NO: 813986 - RNA, 19 nt, Homo sapiens
gcugugaccugcaaaagua

SEQ ID NO: 813987 - RNA, 19 nt, Homo sapiens
gagcaagaaggaugauauu

SEQ ID NO: 813988 - RNA, 19 nt, Homo sapiens
caaacaacauccuaagaac

SEQ ID NO: 813989 - RNA, 19 nt, Homo sapiens
gaggaacaaucaguaaauc

SEQ ID NO: 813990 - RNA, 19 nt, Homo sapiens
gccuguaucucccaaauuc

SEQ ID NO: 813991 - RNA, 19 nt, Homo sapiens
uaaaagaacugcagaaagg

SEQ ID NO: 813992 - RNA, 19 nt, Homo sapiens
acuaagggauguaccauug

SEQ ID NO: 813993 - RNA, 19 nt, Homo sapiens
ggaggaauauaaggaagug

SEQ ID NO: 813994 - RNA, 19 nt, Homo sapiens
aaccugcucuucugcguua

SEQ ID NO: 813995 - RNA, 19 nt, Homo sapiens
aguguaaucucuauugcua

SEQ ID NO: 813996 - RNA, 19 nt, Homo sapiens
guaguuacuuccuuuaaac

SEQ ID NO: 813997 - RNA, 19 nt, Homo sapiens
ccauguaguuacuuccuuu

SEQ ID NO: 813998 - RNA, 19 nt, Homo sapiens
gaaagagaagaaaucaguu

SEQ ID NO: 813999 - RNA, 19 nt, Homo sapiens
aacagaggaugaacacuuu

SEQ ID NO: 814000 - RNA, 19 nt, Homo sapiens
gaaaccaccugugaaacca

SEQ ID NO: 814001 - RNA, 19 nt, Homo sapiens
guaccauuguuaagccuuu

SEQ ID NO: 814002 - RNA, 19 nt, Homo sapiens
gaaucaaacaacauccuaa

SEQ ID NO: 814003 - RNA, 19 nt, Homo sapiens
gaaagaaaagcaucaugua

SEQ ID NO: 814004 - RNA, 19 nt, Homo sapiens
agaaggauuuggaacagaa

SEQ ID NO: 814005 - RNA, 19 nt, Homo sapiens
uuuaagaccuggccuggaa

SEQ ID NO: 814006 - RNA, 19 nt, Homo sapiens
gcuaauaacgguucuugau

SEQ ID NO: 814007 - RNA, 19 nt, Homo sapiens
cagagaagaagguaaagaa

SEQ ID NO: 814008 - RNA, 19 nt, Homo sapiens
ccaaagaagaugaggaaga

SEQ ID NO: 814009 - RNA, 19 nt, Homo sapiens
gaacuugaucccagaauac

SEQ ID NO: 814010 - RNA, 19 nt, Homo sapiens
ggagcaagaaggaugauau

SEQ ID NO: 814011 - RNA, 19 nt, Homo sapiens
ugagaaagcauacuugaca

SEQ ID NO: 814012 - RNA, 19 nt, Homo sapiens
gaccugcucuuaaccucaa

SEQ ID NO: 814013 - RNA, 19 nt, Homo sapiens
caaauucuccacucgauuc

SEQ ID NO: 814014 - RNA, 19 nt, Homo sapiens
ggaagcaccagcuggaaga

SEQ ID NO: 814015 - RNA, 19 nt, Homo sapiens
aaacagaggaugaacacuu

SEQ ID NO: 814016 - RNA, 19 nt, Homo sapiens
ggaaguugaggcagccaua

SEQ ID NO: 814017 - RNA, 19 nt, Homo sapiens
gcugagggccuuucugguu

SEQ ID NO: 814018 - RNA, 19 nt, Homo sapiens
ugaccaagauuugcagaga

SEQ ID NO: 814019 - RNA, 19 nt, Homo sapiens
gaacaauccauuccgucaa

SEQ ID NO: 814020 - RNA, 19 nt, Homo sapiens
gaagaacagaauucgaaug

SEQ ID NO: 814021 - RNA, 19 nt, Homo sapiens
gaagaaggcagugcucauc

SEQ ID NO: 814022 - RNA, 19 nt, Homo sapiens
ugagaaaggcuaaucuuca

SEQ ID NO: 814023 - RNA, 19 nt, Homo sapiens
ugcauaccgugaauuuaua

SEQ ID NO: 814024 - RNA, 19 nt, Homo sapiens
caagaaagagaagaaauca

SEQ ID NO: 814025 - RNA, 19 nt, Homo sapiens
caaagaacgucaguuacag

SEQ ID NO: 814026 - RNA, 19 nt, Homo sapiens
gcaagaacuguggaaauau

SEQ ID NO: 814027 - RNA, 19 nt, Homo sapiens
gaacauuugaugaaacagu

SEQ ID NO: 814028 - RNA, 19 nt, Homo sapiens
gggcagagauguacaggaa

SEQ ID NO: 814029 - RNA, 19 nt, Homo sapiens
ggaaggagcaccacuuuga

SEQ ID NO: 814030 - RNA, 19 nt, Homo sapiens
gcagagauguacaggaauc

SEQ ID NO: 814031 - RNA, 19 nt, Homo sapiens
gggaauaccugggcagaga

SEQ ID NO: 814032 - RNA, 19 nt, Homo sapiens
gcauugcccugguggagaa

SEQ ID NO: 814033 - RNA, 19 nt, Homo sapiens
ggacaaggaugggaaacag

SEQ ID NO: 814034 - RNA, 19 nt, Homo sapiens
caaggccauuccacuguuu

SEQ ID NO: 814035 - RNA, 19 nt, Homo sapiens
ucacgaaugucccaacuac

SEQ ID NO: 814036 - RNA, 19 nt, Homo sapiens
ggaaguggccgagaucugu

SEQ ID NO: 814037 - RNA, 19 nt, Homo sapiens
guacaaguaugaggacaag

SEQ ID NO: 814038 - RNA, 19 nt, Homo sapiens
uggagcagcuggagcagaa

SEQ ID NO: 814039 - RNA, 19 nt, Homo sapiens
gaaguggccgagaucugua

SEQ ID NO: 814040 - RNA, 19 nt, Homo sapiens
ccaaggccauuccacuguu

SEQ ID NO: 814041 - RNA, 19 nt, Homo sapiens
aaucaagccuggcauuugg

SEQ ID NO: 814042 - RNA, 19 nt, Homo sapiens
gaccucuucuaccugcaua

SEQ ID NO: 814043 - RNA, 19 nt, Homo sapiens
gagguucuaugccuucaac

SEQ ID NO: 814044 - RNA, 19 nt, Homo sapiens
uaaucaagccuggcauuug

SEQ ID NO: 814045 - RNA, 19 nt, Homo sapiens
ggauguaccaccacucaca

SEQ ID NO: 814046 - RNA, 19 nt, Homo sapiens
gcaccacuuugagggcauu

SEQ ID NO: 814047 - RNA, 19 nt, Homo sapiens
gaguggaccucuucuaccu

SEQ ID NO: 814048 - RNA, 19 nt, Homo sapiens
gcaccaggagggcaaguuc

SEQ ID NO: 814049 - RNA, 19 nt, Homo sapiens
guggacgccuuuaaucaag

SEQ ID NO: 814050 - RNA, 19 nt, Homo sapiens
gaaggagcaccacuuugag

SEQ ID NO: 814051 - RNA, 19 nt, Homo sapiens
ggccgcuucuuugggaaua

SEQ ID NO: 814052 - RNA, 19 nt, Homo sapiens
gcuggauccugcccacugu

SEQ ID NO: 814053 - RNA, 19 nt, Homo sapiens
acaggaaucgcuacuggaa

SEQ ID NO: 814054 - RNA, 19 nt, Homo sapiens
gaauaccugggcagagaug

SEQ ID NO: 814055 - RNA, 19 nt, Homo sapiens
acaaguaugaggacaagga

SEQ ID NO: 814056 - RNA, 19 nt, Homo sapiens
uaccagggcauguacaaug

SEQ ID NO: 814057 - RNA, 19 nt, Homo sapiens
ugaccggcaaguacaagua

SEQ ID NO: 814058 - RNA, 19 nt, Homo sapiens
acgaaugucccaacuacuu

SEQ ID NO: 814059 - RNA, 19 nt, Homo sapiens
gaccggcaaguacaaguau

SEQ ID NO: 814060 - RNA, 19 nt, Homo sapiens
cgaaugucccaacuacuuc

SEQ ID NO: 814061 - RNA, 19 nt, Homo sapiens
gagugaaaauugauaccaa

SEQ ID NO: 814062 - RNA, 19 nt, Homo sapiens
uuaaucaagccuggcauuu

SEQ ID NO: 814063 - RNA, 19 nt, Homo sapiens
cguggacgccuuuaaucaa

SEQ ID NO: 814064 - RNA, 19 nt, Homo sapiens
gcagcuggagcagaacuug

SEQ ID NO: 814065 - RNA, 19 nt, Homo sapiens
ggaauaccugggcagagau

SEQ ID NO: 814066 - RNA, 19 nt, Homo sapiens
cagcgacugcagagugaaa

SEQ ID NO: 814067 - RNA, 19 nt, Homo sapiens
ccugggaaguggccgagau

SEQ ID NO: 814068 - RNA, 19 nt, Homo sapiens
cagcuggagacgucacuga

SEQ ID NO: 814069 - RNA, 19 nt, Homo sapiens
ggauccugcccacugugua

SEQ ID NO: 814070 - RNA, 19 nt, Homo sapiens
gcacauggauuuaacuuua

SEQ ID NO: 814071 - RNA, 19 nt, Homo sapiens
gaggugaucuguaauguua

SEQ ID NO: 814072 - RNA, 19 nt, Homo sapiens
gggaagaggugaucuguaa

SEQ ID NO: 814073 - RNA, 19 nt, Homo sapiens
gaaaucaccucuuguuuua

SEQ ID NO: 814074 - RNA, 19 nt, Homo sapiens
gaaacaggauuuaaagaug

SEQ ID NO: 814075 - RNA, 19 nt, Homo sapiens
gaacugccuucuuauacua

SEQ ID NO: 814076 - RNA, 19 nt, Homo sapiens
gaaagucgaugccuaugga

SEQ ID NO: 814077 - RNA, 19 nt, Homo sapiens
ucaucaaccugcuguauua

SEQ ID NO: 814078 - RNA, 19 nt, Homo sapiens
ggaaguagggaaaguauuu

SEQ ID NO: 814079 - RNA, 19 nt, Homo sapiens
cuucagagcuuggauauuu

SEQ ID NO: 814080 - RNA, 19 nt, Homo sapiens
gcacaucaguggauuucaa

SEQ ID NO: 814081 - RNA, 19 nt, Homo sapiens
uagauuagcugcuccagaa

SEQ ID NO: 814082 - RNA, 19 nt, Homo sapiens
gaucaaauguagucucugu

SEQ ID NO: 814083 - RNA, 19 nt, Homo sapiens
gaacaaaacuccaucucaa

SEQ ID NO: 814084 - RNA, 19 nt, Homo sapiens
gagaacaguauccaaauaa

SEQ ID NO: 814085 - RNA, 19 nt, Homo sapiens
ccagagacguauuaagaaa

SEQ ID NO: 814086 - RNA, 19 nt, Homo sapiens
ugacuuaccuguuugacuu

SEQ ID NO: 814087 - RNA, 19 nt, Homo sapiens
caaauguagucucuguuaa

SEQ ID NO: 814088 - RNA, 19 nt, Homo sapiens
caaagacacugacuacaag

SEQ ID NO: 814089 - RNA, 19 nt, Homo sapiens
ggauaagcaugcccugaaa

SEQ ID NO: 814090 - RNA, 19 nt, Homo sapiens
gagaugauacugaaagauu

SEQ ID NO: 814091 - RNA, 19 nt, Homo sapiens
ccagucaagugaugcguua

SEQ ID NO: 814092 - RNA, 19 nt, Homo sapiens
gguuauagacucuuucuuu

SEQ ID NO: 814093 - RNA, 19 nt, Homo sapiens
ggaggaggaggaagaauaa

SEQ ID NO: 814094 - RNA, 19 nt, Homo sapiens
gaacuucagagcuuggaua

SEQ ID NO: 814095 - RNA, 19 nt, Homo sapiens
ugagaaguauguagucaaa

SEQ ID NO: 814096 - RNA, 19 nt, Homo sapiens
agagaacaguauccaaaua

SEQ ID NO: 814097 - RNA, 19 nt, Homo sapiens
gccagaaccuuacuaaagu

SEQ ID NO: 814098 - RNA, 19 nt, Homo sapiens
ucaaauguagucucuguua

SEQ ID NO: 814099 - RNA, 19 nt, Homo sapiens
guauaucaguggagaaaug

SEQ ID NO: 814100 - RNA, 19 nt, Homo sapiens
gaagaggugaucuguaaug

SEQ ID NO: 814101 - RNA, 19 nt, Homo sapiens
caaacgaggucccuguuag

SEQ ID NO: 814102 - RNA, 19 nt, Homo sapiens
gaacacacuauucaaccua

SEQ ID NO: 814103 - RNA, 19 nt, Homo sapiens
caaggcugcuucucuauca

SEQ ID NO: 814104 - RNA, 19 nt, Homo sapiens
aggcugaacugcauguaua

SEQ ID NO: 814105 - RNA, 19 nt, Homo sapiens
gaaggaaguagggaaagua

SEQ ID NO: 814106 - RNA, 19 nt, Homo sapiens
agaaguauguagucaaaga

SEQ ID NO: 814107 - RNA, 19 nt, Homo sapiens
ggagugaucgguuacagaa

SEQ ID NO: 814108 - RNA, 19 nt, Homo sapiens
gagccaggauugugccauu

SEQ ID NO: 814109 - RNA, 19 nt, Homo sapiens
ggaaaagacaguauccuua

SEQ ID NO: 814110 - RNA, 19 nt, Homo sapiens
ggaguacagugaugugauc

SEQ ID NO: 814111 - RNA, 19 nt, Homo sapiens
guggagagauuaguuucua

SEQ ID NO: 814112 - RNA, 19 nt, Homo sapiens
gcacagaaguaugcucuac

SEQ ID NO: 814113 - RNA, 19 nt, Homo sapiens
gaacaaagagugggaagag

SEQ ID NO: 814114 - RNA, 19 nt, Homo sapiens
ucaaagacacugacuacaa

SEQ ID NO: 814115 - RNA, 19 nt, Homo sapiens
gcaaugagcguccagacau

SEQ ID NO: 814116 - RNA, 19 nt, Homo sapiens
uggcaaggcugcuucucua

SEQ ID NO: 814117 - RNA, 19 nt, Homo sapiens
aaacugccuuugcuucuga

SEQ ID NO: 814118 - RNA, 19 nt, Homo sapiens
aauggagucuguauuagaa

SEQ ID NO: 814119 - RNA, 19 nt, Homo sapiens
uaccaacagugacuauaaa

SEQ ID NO: 814120 - RNA, 19 nt, Homo sapiens
ggagagauuaguuucuauu

SEQ ID NO: 814121 - RNA, 19 nt, Homo sapiens
gcauuagugugggcuauau

SEQ ID NO: 814122 - RNA, 19 nt, Homo sapiens
ccagcgagaugauacugaa

SEQ ID NO: 814123 - RNA, 19 nt, Homo sapiens
gaguaugagucccuugguu

SEQ ID NO: 814124 - RNA, 19 nt, Homo sapiens
ccaacagugacuauaaaua

SEQ ID NO: 814125 - RNA, 19 nt, Homo sapiens
gcgagaugauacugaaaga

SEQ ID NO: 814126 - RNA, 19 nt, Homo sapiens
aagaguugauugcuguaua

SEQ ID NO: 814127 - RNA, 19 nt, Homo sapiens
gcuacccaauuccagauuu

SEQ ID NO: 814128 - RNA, 19 nt, Homo sapiens
gcuguugacuggguucauu

SEQ ID NO: 814129 - RNA, 19 nt, Homo sapiens
ggaguauguuccaggaugu

SEQ ID NO: 814130 - RNA, 19 nt, Homo sapiens
agauaugccugcuaacaug

SEQ ID NO: 814131 - RNA, 19 nt, Homo sapiens
gaccauggcaguccuacuu

SEQ ID NO: 814132 - RNA, 19 nt, Homo sapiens
cagcuuugcuuaugauucu

SEQ ID NO: 814133 - RNA, 19 nt, Homo sapiens
gcaggagaauugcuugaac

SEQ ID NO: 814134 - RNA, 19 nt, Homo sapiens
gaaaccccaucucuacuaa

SEQ ID NO: 814135 - RNA, 19 nt, Homo sapiens
gcguuaugcugaccucuau

SEQ ID NO: 814136 - RNA, 19 nt, Homo sapiens
gaugaaggaaguagggaaa

SEQ ID NO: 814137 - RNA, 19 nt, Homo sapiens
ggucugugcacauggauuu

SEQ ID NO: 814138 - RNA, 19 nt, Homo sapiens
gcuccagaauucaauaaag

SEQ ID NO: 814139 - RNA, 19 nt, Homo sapiens
uaaaguagagggcacaauc

SEQ ID NO: 814140 - RNA, 19 nt, Homo sapiens
uacagaacaugcauuagug

SEQ ID NO: 814141 - RNA, 19 nt, Homo sapiens
caaccuccuucuuaucugu

SEQ ID NO: 814142 - RNA, 19 nt, Homo sapiens
gaaaagacaguauccuuau

SEQ ID NO: 814143 - RNA, 19 nt, Homo sapiens
ggaggaggaagaauaagga

SEQ ID NO: 814144 - RNA, 19 nt, Homo sapiens
gaugaugggaagccuguuu

SEQ ID NO: 814145 - RNA, 19 nt, Homo sapiens
gcacaggagcuacaugucu

SEQ ID NO: 814146 - RNA, 19 nt, Homo sapiens
cggcaaggguggcgaacuu

SEQ ID NO: 814147 - RNA, 19 nt, Homo sapiens
cuagagaacaguauccaaa

SEQ ID NO: 814148 - RNA, 19 nt, Homo sapiens
agaguugauugcuguauau

SEQ ID NO: 814149 - RNA, 19 nt, Homo sapiens
ggucaauuagugagauuaa

SEQ ID NO: 814150 - RNA, 19 nt, Homo sapiens
uggcugaacucuacaagca

SEQ ID NO: 814151 - RNA, 19 nt, Homo sapiens
cuaccaacagugacuauaa

SEQ ID NO: 814152 - RNA, 19 nt, Homo sapiens
ccagauauaccaguuguga

SEQ ID NO: 814153 - RNA, 19 nt, Homo sapiens
gcucagcuuugcuuaugau

SEQ ID NO: 814154 - RNA, 19 nt, Homo sapiens
gagagauuaguuucuauug

SEQ ID NO: 814155 - RNA, 19 nt, Homo sapiens
gcaaguggacaaaggaaca

SEQ ID NO: 814156 - RNA, 19 nt, Homo sapiens
ccaaaguucugggauuaca

SEQ ID NO: 814157 - RNA, 19 nt, Homo sapiens
uguauuacccuuucagcua

SEQ ID NO: 814158 - RNA, 19 nt, Homo sapiens
gacgucaagugauccauuc

SEQ ID NO: 814159 - RNA, 19 nt, Homo sapiens
gacaugugcuaugggauga

SEQ ID NO: 814160 - RNA, 19 nt, Homo sapiens
gagcuuggauauuuucuug

SEQ ID NO: 814161 - RNA, 19 nt, Homo sapiens
ggaaaagacaguugaaaau

SEQ ID NO: 814162 - RNA, 19 nt, Homo sapiens
gaaacuagagaacaguauc

SEQ ID NO: 814163 - RNA, 19 nt, Homo sapiens
ucaguggagaaauguauua

SEQ ID NO: 814164 - RNA, 19 nt, Homo sapiens
gaaaauugguaccuacaca

SEQ ID NO: 814165 - RNA, 19 nt, Homo sapiens
ugacuggguucauuacaag

SEQ ID NO: 814166 - RNA, 19 nt, Homo sapiens
agauauaccaguugugaaa

SEQ ID NO: 814167 - RNA, 19 nt, Homo sapiens
ccuguuggccugccuagua

SEQ ID NO: 814168 - RNA, 19 nt, Homo sapiens
gauuagcugcuccagaauu

SEQ ID NO: 814169 - RNA, 19 nt, Homo sapiens
ccaguacagugaaaguugu

SEQ ID NO: 814170 - RNA, 19 nt, Homo sapiens
gaaggccucucuccugaua

SEQ ID NO: 814171 - RNA, 19 nt, Homo sapiens
gauaaacauugacgaucuu

SEQ ID NO: 814172 - RNA, 19 nt, Homo sapiens
ugucccagcucccuaauuu

SEQ ID NO: 814173 - RNA, 19 nt, Homo sapiens
acacagaacugaaaaggua

SEQ ID NO: 814174 - RNA, 19 nt, Homo sapiens
gaaacaccauugcucucuu

SEQ ID NO: 814175 - RNA, 19 nt, Homo sapiens
ccagagaggcuaaguccua

SEQ ID NO: 814176 - RNA, 19 nt, Homo sapiens
gacgagcccuuaccacguu

SEQ ID NO: 814177 - RNA, 19 nt, Homo sapiens
gaacuacgaguaccugauc

SEQ ID NO: 814178 - RNA, 19 nt, Homo sapiens
ggucacacuuucucuggaa

SEQ ID NO: 814179 - RNA, 19 nt, Homo sapiens
ggacagcacuggguugaac

SEQ ID NO: 814180 - RNA, 19 nt, Homo sapiens
caccauugcucucuucuuc

SEQ ID NO: 814181 - RNA, 19 nt, Homo sapiens
ggucacuguugccaaacua

SEQ ID NO: 814182 - RNA, 19 nt, Homo sapiens
agauaucgaucgcauccua

SEQ ID NO: 814183 - RNA, 19 nt, Homo sapiens
gcaaacuccggaagaagaa

SEQ ID NO: 814184 - RNA, 19 nt, Homo sapiens
gcuucgagcugauaaacau

SEQ ID NO: 814185 - RNA, 19 nt, Homo sapiens
ggagaacguccacgagguu

SEQ ID NO: 814186 - RNA, 19 nt, Homo sapiens
ugagcuggcuggaggagaa

SEQ ID NO: 814187 - RNA, 19 nt, Homo sapiens
gaaaacggacuagaagaua

SEQ ID NO: 814188 - RNA, 19 nt, Homo sapiens
ugauaaacauugacgaucu

SEQ ID NO: 814189 - RNA, 19 nt, Homo sapiens
gccaugugauccucucuga

SEQ ID NO: 814190 - RNA, 19 nt, Homo sapiens
gcauuucgaucuccgugau

SEQ ID NO: 814191 - RNA, 19 nt, Homo sapiens
ucaagaggaucaggagaug

SEQ ID NO: 814192 - RNA, 19 nt, Homo sapiens
ccaggaagcacguucucua

SEQ ID NO: 814193 - RNA, 19 nt, Homo sapiens
augaugauguucccgauuu

SEQ ID NO: 814194 - RNA, 19 nt, Homo sapiens
aaacaccauugcucucuuc

SEQ ID NO: 814195 - RNA, 19 nt, Homo sapiens
ucagagcagucucaugcaa

SEQ ID NO: 814196 - RNA, 19 nt, Homo sapiens
gcaagacggauggagauga

SEQ ID NO: 814197 - RNA, 19 nt, Homo sapiens
ggaaacacagagagcaaga

SEQ ID NO: 814198 - RNA, 19 nt, Homo sapiens
gagcacagacacuugaauc

SEQ ID NO: 814199 - RNA, 19 nt, Homo sapiens
uugacgaucuugaggauga

SEQ ID NO: 814200 - RNA, 19 nt, Homo sapiens
ggcaaacuccggaagaaga

SEQ ID NO: 814201 - RNA, 19 nt, Homo sapiens
gaauauccaccgccaugug

SEQ ID NO: 814202 - RNA, 19 nt, Homo sapiens
gcagagacaacguguguac

SEQ ID NO: 814203 - RNA, 19 nt, Homo sapiens
gcaaaggccacggcagaga

SEQ ID NO: 814204 - RNA, 19 nt, Homo sapiens
gagcaagacggauggagau

SEQ ID NO: 814205 - RNA, 19 nt, Homo sapiens
cagagaggcuaaguccuau

SEQ ID NO: 814206 - RNA, 19 nt, Homo sapiens
gagaugacaccgagacagu

SEQ ID NO: 814207 - RNA, 19 nt, Homo sapiens
gagaggcuaaguccuauca

SEQ ID NO: 814208 - RNA, 19 nt, Homo sapiens
cagcgugcacccaggaaua

SEQ ID NO: 814209 - RNA, 19 nt, Homo sapiens
acacuugaauccagacaca

SEQ ID NO: 814210 - RNA, 19 nt, Homo sapiens
guagggaagcugagugugu

SEQ ID NO: 814211 - RNA, 19 nt, Homo sapiens
uggacccaaugcugaaaua

SEQ ID NO: 814212 - RNA, 19 nt, Homo sapiens
gcuucuaccuggcccucua

SEQ ID NO: 814213 - RNA, 19 nt, Homo sapiens
gaaaagccguaugaugaug

SEQ ID NO: 814214 - RNA, 19 nt, Homo sapiens
ccgcagaggugaccgaaaa

SEQ ID NO: 814215 - RNA, 19 nt, Homo sapiens
gcgacaugauggccaacuu

SEQ ID NO: 814216 - RNA, 19 nt, Homo sapiens
ggaaacaccauugcucucu

SEQ ID NO: 814217 - RNA, 19 nt, Homo sapiens
caagacggauggagaugac

SEQ ID NO: 814218 - RNA, 19 nt, Homo sapiens
ccgaaaagccguaugauga

SEQ ID NO: 814219 - RNA, 19 nt, Homo sapiens
cgaugacgcggaagaagaa

SEQ ID NO: 814220 - RNA, 19 nt, Homo sapiens
guggcaaacuccggaagaa

SEQ ID NO: 814221 - RNA, 19 nt, Homo sapiens
ucacuguugccaaacuaua

SEQ ID NO: 814222 - RNA, 19 nt, Homo sapiens
ggacccaaugcugaaauaa

SEQ ID NO: 814223 - RNA, 19 nt, Homo sapiens
guagagagagcgcuguaca

SEQ ID NO: 814224 - RNA, 19 nt, Homo sapiens
gcacagacacuugaaucca

SEQ ID NO: 814225 - RNA, 19 nt, Homo sapiens
gaggacagcacuggguuga

SEQ ID NO: 814226 - RNA, 19 nt, Homo sapiens
cggacacaaucuacuccua

SEQ ID NO: 814227 - RNA, 19 nt, Homo sapiens
gcaugcugcugcucaucga

SEQ ID NO: 814228 - RNA, 19 nt, Homo sapiens
ccaugcggcugcuggaauc

SEQ ID NO: 814229 - RNA, 19 nt, Homo sapiens
gcugauaaacauugacgau

SEQ ID NO: 814230 - RNA, 19 nt, Homo sapiens
cauugacgaucuugaggau

SEQ ID NO: 814231 - RNA, 19 nt, Homo sapiens
gcaccagggaacaaaggaa

SEQ ID NO: 814232 - RNA, 19 nt, Homo sapiens
ggcggaaggugcucuacca

SEQ ID NO: 814233 - RNA, 19 nt, Homo sapiens
ccgagacagugcccucaga

SEQ ID NO: 814234 - RNA, 19 nt, Homo sapiens
cuguuccacuggcguauuu

SEQ ID NO: 814235 - RNA, 19 nt, Homo sapiens
ggaaaacggacuagaagau

SEQ ID NO: 814236 - RNA, 19 nt, Homo sapiens
aaagccguaugaugauguu

SEQ ID NO: 814237 - RNA, 19 nt, Homo sapiens
ccacgagguucugcaagca

SEQ ID NO: 814238 - RNA, 19 nt, Homo sapiens
cuugggaggucacacuuuc

SEQ ID NO: 814239 - RNA, 19 nt, Homo sapiens
gccagcuggugaaccugua

SEQ ID NO: 814240 - RNA, 19 nt, Homo sapiens
agcaggcgcucaccauguu

SEQ ID NO: 814241 - RNA, 19 nt, Homo sapiens
ggaugacccuguggugaac

SEQ ID NO: 814242 - RNA, 19 nt, Homo sapiens
cuauggagccgaacaacau

SEQ ID NO: 814243 - RNA, 19 nt, Homo sapiens
cggcagagacaacgugugu

SEQ ID NO: 814244 - RNA, 19 nt, Homo sapiens
aaacauugacgaucuugag

SEQ ID NO: 814245 - RNA, 19 nt, Homo sapiens
ggaacuacgaguaccugau

SEQ ID NO: 814246 - RNA, 19 nt, Homo sapiens
caaccgcuucgagcugaua

SEQ ID NO: 814247 - RNA, 19 nt, Homo sapiens
agagcagucucaugcaagu

SEQ ID NO: 814248 - RNA, 19 nt, Homo sapiens
cgacaugauggccaacuuc

SEQ ID NO: 814249 - RNA, 19 nt, Homo sapiens
ccagcaggcucagcacaag

SEQ ID NO: 814250 - RNA, 19 nt, Homo sapiens
gacccaaugcugaaauaag

SEQ ID NO: 814251 - RNA, 19 nt, Homo sapiens
gaauccagacacagaacug

SEQ ID NO: 814252 - RNA, 19 nt, Homo sapiens
aaaacggacuagaagauau

SEQ ID NO: 814253 - RNA, 19 nt, Homo sapiens
aauauccaccgccauguga

SEQ ID NO: 814254 - RNA, 19 nt, Homo sapiens
cagcaggcgcucaccaugu

SEQ ID NO: 814255 - RNA, 19 nt, Homo sapiens
guggagcacagacacuuga

SEQ ID NO: 814256 - RNA, 19 nt, Homo sapiens
uccggucacuguugccaaa

SEQ ID NO: 814257 - RNA, 19 nt, Homo sapiens
ggaauauccaccgccaugu

SEQ ID NO: 814258 - RNA, 19 nt, Homo sapiens
gcaaaccaggucuguccau

SEQ ID NO: 814259 - RNA, 19 nt, Homo sapiens
aaacggacuagaagauauc

SEQ ID NO: 814260 - RNA, 19 nt, Homo sapiens
ugaugauguucccgauuuc

SEQ ID NO: 814261 - RNA, 19 nt, Homo sapiens
ucgagcugauaaacauuga

SEQ ID NO: 814262 - RNA, 19 nt, Homo sapiens
ggagcacagacacuugaau

SEQ ID NO: 814263 - RNA, 19 nt, Homo sapiens
guucccgauuucucuguug

SEQ ID NO: 814264 - RNA, 19 nt, Homo sapiens
cuaccuggcccucuacaag

SEQ ID NO: 814265 - RNA, 19 nt, Homo sapiens
ggagaaacauguagauuug

SEQ ID NO: 814266 - RNA, 19 nt, Homo sapiens
ggaauguacuacuguaaua

SEQ ID NO: 814267 - RNA, 19 nt, Homo sapiens
gaacuacaaggaucaauua

SEQ ID NO: 814268 - RNA, 19 nt, Homo sapiens
gcagguaagugagcaguua

SEQ ID NO: 814269 - RNA, 19 nt, Homo sapiens
uaaagaagcucagaaugaa

SEQ ID NO: 814270 - RNA, 19 nt, Homo sapiens
ggacagcacuuuccaugug

SEQ ID NO: 814271 - RNA, 19 nt, Homo sapiens
gcagagaccugaccuugga

SEQ ID NO: 814272 - RNA, 19 nt, Homo sapiens
gcaaggagcagguaaguga

SEQ ID NO: 814273 - RNA, 19 nt, Homo sapiens
gaacuugaaugccugaauc

SEQ ID NO: 814274 - RNA, 19 nt, Homo sapiens
aaacggagcugaugaugga

SEQ ID NO: 814275 - RNA, 19 nt, Homo sapiens
gcagauaguuaaugaaugg

SEQ ID NO: 814276 - RNA, 19 nt, Homo sapiens
gaaaugcuccuccaagaga

SEQ ID NO: 814277 - RNA, 19 nt, Homo sapiens
caaagugagucuugaggaa

SEQ ID NO: 814278 - RNA, 19 nt, Homo sapiens
ggaaauugcggcacugaaa

SEQ ID NO: 814279 - RNA, 19 nt, Homo sapiens
gaaaaggccugcucugaga

SEQ ID NO: 814280 - RNA, 19 nt, Homo sapiens
ggacccagcuggagaccaa

SEQ ID NO: 814281 - RNA, 19 nt, Homo sapiens
uaaaggagcauuaccaaga

SEQ ID NO: 814282 - RNA, 19 nt, Homo sapiens
ucagggcucuguacaguuu

SEQ ID NO: 814283 - RNA, 19 nt, Homo sapiens
ggauugggauucuuuguuc

SEQ ID NO: 814284 - RNA, 19 nt, Homo sapiens
gaaacaaagccgccucuug

SEQ ID NO: 814285 - RNA, 19 nt, Homo sapiens
cuaaagaagcucagaauga

SEQ ID NO: 814286 - RNA, 19 nt, Homo sapiens
gcuaugggauggaugaaga

SEQ ID NO: 814287 - RNA, 19 nt, Homo sapiens
ggaaggaaauugagguuuu

SEQ ID NO: 814288 - RNA, 19 nt, Homo sapiens
gaagagaaccacuaugucu

SEQ ID NO: 814289 - RNA, 19 nt, Homo sapiens
aaauagcgcuggagagaga

SEQ ID NO: 814290 - RNA, 19 nt, Homo sapiens
gaaccuggaguuugugaaa

SEQ ID NO: 814291 - RNA, 19 nt, Homo sapiens
ucaacaaacucgucaguag

SEQ ID NO: 814292 - RNA, 19 nt, Homo sapiens
gaaggaaauugagguuuua

SEQ ID NO: 814293 - RNA, 19 nt, Homo sapiens
agaaggaccuggaguuugu

SEQ ID NO: 814294 - RNA, 19 nt, Homo sapiens
ccauauggcugauuggaau

SEQ ID NO: 814295 - RNA, 19 nt, Homo sapiens
gcacagaggaaggaaauug

SEQ ID NO: 814296 - RNA, 19 nt, Homo sapiens
aaaccaaacuucuacaucu

SEQ ID NO: 814297 - RNA, 19 nt, Homo sapiens
gaagaggaaccuggaguuu

SEQ ID NO: 814298 - RNA, 19 nt, Homo sapiens
uuaacaaacuggaucaaga

SEQ ID NO: 814299 - RNA, 19 nt, Homo sapiens
gaccuuaucuguggacuca

SEQ ID NO: 814300 - RNA, 19 nt, Homo sapiens
ccacugugcugccuuagau

SEQ ID NO: 814301 - RNA, 19 nt, Homo sapiens
gaaaguggauaagcugaag

SEQ ID NO: 814302 - RNA, 19 nt, Homo sapiens
gcagaaggaccuggaguuu

SEQ ID NO: 814303 - RNA, 19 nt, Homo sapiens
gacaguaguucuuuggaau

SEQ ID NO: 814304 - RNA, 19 nt, Homo sapiens
agagaaggaugacauggaa

SEQ ID NO: 814305 - RNA, 19 nt, Homo sapiens
uauuagcgguccugaguaa

SEQ ID NO: 814306 - RNA, 19 nt, Homo sapiens
gggaagaacaugagaaaca

SEQ ID NO: 814307 - RNA, 19 nt, Homo sapiens
gcauuucauuccuggguaa

SEQ ID NO: 814308 - RNA, 19 nt, Homo sapiens
agaaggagauuguggaagu

SEQ ID NO: 814309 - RNA, 19 nt, Homo sapiens
ggaacucgaagaccuguuu

SEQ ID NO: 814310 - RNA, 19 nt, Homo sapiens
agagugaaauguaaaguca

SEQ ID NO: 814311 - RNA, 19 nt, Homo sapiens
ggaagaggcggagaugauu

SEQ ID NO: 814312 - RNA, 19 nt, Homo sapiens
ggaagaacaugagaaacag

SEQ ID NO: 814313 - RNA, 19 nt, Homo sapiens
acaacgagcucaugacagu

SEQ ID NO: 814314 - RNA, 19 nt, Homo sapiens
gggaugaugguguuuauug

SEQ ID NO: 814315 - RNA, 19 nt, Homo sapiens
ccgcagcccucucugugua

SEQ ID NO: 814316 - RNA, 19 nt, Homo sapiens
cagaagagcggguggaaga

SEQ ID NO: 814317 - RNA, 19 nt, Homo sapiens
agaggaaccuggaguuugu

SEQ ID NO: 814318 - RNA, 19 nt, Homo sapiens
gaacucgaagaccuguuua

SEQ ID NO: 814319 - RNA, 19 nt, Homo sapiens
guacacacauuccagaaaa

SEQ ID NO: 814320 - RNA, 19 nt, Homo sapiens
gaagaggccgagagcacua

SEQ ID NO: 814321 - RNA, 19 nt, Homo sapiens
gacagaaucagaacuacaa

SEQ ID NO: 814322 - RNA, 19 nt, Homo sapiens
gcagcagagugaccaaauc

SEQ ID NO: 814323 - RNA, 19 nt, Homo sapiens
gaaaccaaacuucuacauc

SEQ ID NO: 814324 - RNA, 19 nt, Homo sapiens
ugacccagcucugccuuaa

SEQ ID NO: 814325 - RNA, 19 nt, Homo sapiens
gguuaacuuugaggaauuu

SEQ ID NO: 814326 - RNA, 19 nt, Homo sapiens
ggguuaacuuugaggaauu

SEQ ID NO: 814327 - RNA, 19 nt, Homo sapiens
gaaggagauuguggaagug

SEQ ID NO: 814328 - RNA, 19 nt, Homo sapiens
cacuggaaauuguacuaua

SEQ ID NO: 814329 - RNA, 19 nt, Homo sapiens
gcacuaaagaagcucagaa

SEQ ID NO: 814330 - RNA, 19 nt, Homo sapiens
gagggugcguacacacauu

SEQ ID NO: 814331 - RNA, 19 nt, Homo sapiens
gaccauuucgccaggguua

SEQ ID NO: 814332 - RNA, 19 nt, Homo sapiens
uagcgguccugaguaauuu

SEQ ID NO: 814333 - RNA, 19 nt, Homo sapiens
uggagaaacauguagauuu

SEQ ID NO: 814334 - RNA, 19 nt, Homo sapiens
gagagaaggaugacaugga

SEQ ID NO: 814335 - RNA, 19 nt, Homo sapiens
agacaguaguucuuuggaa

SEQ ID NO: 814336 - RNA, 19 nt, Homo sapiens
ccauuucacuguucugcuu

SEQ ID NO: 814337 - RNA, 19 nt, Homo sapiens
ccauucagauguuaacaca

SEQ ID NO: 814338 - RNA, 19 nt, Homo sapiens
gcgggaagaacaugagaaa

SEQ ID NO: 814339 - RNA, 19 nt, Homo sapiens
gcagagugaccaaauccaa

SEQ ID NO: 814340 - RNA, 19 nt, Homo sapiens
ggaguuccauagacuuucu

SEQ ID NO: 814341 - RNA, 19 nt, Homo sapiens
gaaagaggaacucgaagac

SEQ ID NO: 814342 - RNA, 19 nt, Homo sapiens
ugccaucccuccaaaguau

SEQ ID NO: 814343 - RNA, 19 nt, Homo sapiens
ccagugccaucccuccaaa

SEQ ID NO: 814344 - RNA, 19 nt, Homo sapiens
ugaagaauauggaaaugcu

SEQ ID NO: 814345 - RNA, 19 nt, Homo sapiens
gcuguguugucuucaaaug

SEQ ID NO: 814346 - RNA, 19 nt, Homo sapiens
auucagauguuaacacaga

SEQ ID NO: 814347 - RNA, 19 nt, Homo sapiens
aagaagagaaccacuaugu

SEQ ID NO: 814348 - RNA, 19 nt, Homo sapiens
gcugaaagccacagaagag

SEQ ID NO: 814349 - RNA, 19 nt, Homo sapiens
cagggaugaugguguuuau

SEQ ID NO: 814350 - RNA, 19 nt, Homo sapiens
gcugucagagugaaaugua

SEQ ID NO: 814351 - RNA, 19 nt, Homo sapiens
acagacagaaucagaacua

SEQ ID NO: 814352 - RNA, 19 nt, Homo sapiens
gagagagacgccucgcaaa

SEQ ID NO: 814353 - RNA, 19 nt, Homo sapiens
ugaagaagagaaccacuau

SEQ ID NO: 814354 - RNA, 19 nt, Homo sapiens
gcucagaaugaauuauuug

SEQ ID NO: 814355 - RNA, 19 nt, Homo sapiens
gaugguguuuauugcaaau

SEQ ID NO: 814356 - RNA, 19 nt, Homo sapiens
uuucuaggauucauucgaa

SEQ ID NO: 814357 - RNA, 19 nt, Homo sapiens
gaagaggcggagaugauuc

SEQ ID NO: 814358 - RNA, 19 nt, Homo sapiens
gagcaucgugugaccauuc

SEQ ID NO: 814359 - RNA, 19 nt, Homo sapiens
ucaauuaucccagcucaau

SEQ ID NO: 814360 - RNA, 19 nt, Homo sapiens
uccauagacuuucugaaga

SEQ ID NO: 814361 - RNA, 19 nt, Homo sapiens
gaaacauguagauuugaga

SEQ ID NO: 814362 - RNA, 19 nt, Homo sapiens
cauggaaaccaaacuucua

SEQ ID NO: 814363 - RNA, 19 nt, Homo sapiens
uggagaccaagguaaauua

SEQ ID NO: 814364 - RNA, 19 nt, Homo sapiens
gaaaacagucgccuacaga

SEQ ID NO: 814365 - RNA, 19 nt, Homo sapiens
gaucaaaucucauugcuuu

SEQ ID NO: 814366 - RNA, 19 nt, Homo sapiens
ggaaagaauugauugguaa

SEQ ID NO: 814367 - RNA, 19 nt, Homo sapiens
gaaggaaccugaagcagaa

SEQ ID NO: 814368 - RNA, 19 nt, Homo sapiens
aaacgaacaucuccgauua

SEQ ID NO: 814369 - RNA, 19 nt, Homo sapiens
ucacaaggcuuaaaggaaa

SEQ ID NO: 814370 - RNA, 19 nt, Homo sapiens
gaaaugagccagaacaguu

SEQ ID NO: 814371 - RNA, 19 nt, Homo sapiens
ggagggagauuuacaagau

SEQ ID NO: 814372 - RNA, 19 nt, Homo sapiens
ggaagaggaucaagaaaca

SEQ ID NO: 814373 - RNA, 19 nt, Homo sapiens
ugaaagaguuuaaggaaga

SEQ ID NO: 814374 - RNA, 19 nt, Homo sapiens
ggagaaagacgaucaucua

SEQ ID NO: 814375 - RNA, 19 nt, Homo sapiens
ggucgaggguuuccgaaua

SEQ ID NO: 814376 - RNA, 19 nt, Homo sapiens
gaaaggagcaagaagaaga

SEQ ID NO: 814377 - RNA, 19 nt, Homo sapiens
aagaugagcuggauuauca

SEQ ID NO: 814378 - RNA, 19 nt, Homo sapiens
ggaggaagaaagagaaaua

SEQ ID NO: 814379 - RNA, 19 nt, Homo sapiens
cagaggagaugauggauga

SEQ ID NO: 814380 - RNA, 19 nt, Homo sapiens
uaaaugauguggucuaugg

SEQ ID NO: 814381 - RNA, 19 nt, Homo sapiens
gaagaucuccguugucuca

SEQ ID NO: 814382 - RNA, 19 nt, Homo sapiens
gaaagaaggccucacuugu

SEQ ID NO: 814383 - RNA, 19 nt, Homo sapiens
ccaaaggaaucacugaaga

SEQ ID NO: 814384 - RNA, 19 nt, Homo sapiens
gcaggaggcuguuguggau

SEQ ID NO: 814385 - RNA, 19 nt, Homo sapiens
ccaagggucuuucacauca

SEQ ID NO: 814386 - RNA, 19 nt, Homo sapiens
gagagaggagggagauuua

SEQ ID NO: 814387 - RNA, 19 nt, Homo sapiens
gacagucacucagguagua

SEQ ID NO: 814388 - RNA, 19 nt, Homo sapiens
aaagaaggccucacuugua

SEQ ID NO: 814389 - RNA, 19 nt, Homo sapiens
gaacaucuccgauuauggu

SEQ ID NO: 814390 - RNA, 19 nt, Homo sapiens
caucaccuaucccuacaua

SEQ ID NO: 814391 - RNA, 19 nt, Homo sapiens
cagagcagaucgaaauuug

SEQ ID NO: 814392 - RNA, 19 nt, Homo sapiens
gaagggcacccgaagauug

SEQ ID NO: 814393 - RNA, 19 nt, Homo sapiens
ccaaaucauucaagaggaa

SEQ ID NO: 814394 - RNA, 19 nt, Homo sapiens
gaaccucccaugccuauug

SEQ ID NO: 814395 - RNA, 19 nt, Homo sapiens
gaaagaguuuaaggaagaa

SEQ ID NO: 814396 - RNA, 19 nt, Homo sapiens
ggaggaagaggaucaagaa

SEQ ID NO: 814397 - RNA, 19 nt, Homo sapiens
gaaaggagaaagacgauca

SEQ ID NO: 814398 - RNA, 19 nt, Homo sapiens
ccaccucccuggguacuua

SEQ ID NO: 814399 - RNA, 19 nt, Homo sapiens
gaagggcguuggcggaaau

SEQ ID NO: 814400 - RNA, 19 nt, Homo sapiens
cagcagaaguccggaguuu

SEQ ID NO: 814401 - RNA, 19 nt, Homo sapiens
ggaauuagcacuggccaaa

SEQ ID NO: 814402 - RNA, 19 nt, Homo sapiens
ucgagaagcugcagaacuu

SEQ ID NO: 814403 - RNA, 19 nt, Homo sapiens
gcaagaagaagaagagcaa

SEQ ID NO: 814404 - RNA, 19 nt, Homo sapiens
gguccguccuuucacuuua

SEQ ID NO: 814405 - RNA, 19 nt, Homo sapiens
gagcagaucgaaauuugaa

SEQ ID NO: 814406 - RNA, 19 nt, Homo sapiens
ggucagagcagaucgaaau

SEQ ID NO: 814407 - RNA, 19 nt, Homo sapiens
caagaaacaccuuccagaa

SEQ ID NO: 814408 - RNA, 19 nt, Homo sapiens
uggaaagaauugauuggua

SEQ ID NO: 814409 - RNA, 19 nt, Homo sapiens
uaucaccacugaaucacua

SEQ ID NO: 814410 - RNA, 19 nt, Homo sapiens
caaaggggcucuaaugcua

SEQ ID NO: 814411 - RNA, 19 nt, Homo sapiens
ggaaagggaccgagaacga

SEQ ID NO: 814412 - RNA, 19 nt, Homo sapiens
ucaguuaucuccuccuaau

SEQ ID NO: 814413 - RNA, 19 nt, Homo sapiens
cuacauacauaccaaaugg

SEQ ID NO: 814414 - RNA, 19 nt, Homo sapiens
gaguuuccauuaccauuga

SEQ ID NO: 814415 - RNA, 19 nt, Homo sapiens
ggagggcaguguugaagau

SEQ ID NO: 814416 - RNA, 19 nt, Homo sapiens
gaaacagccaucuuuggaa

SEQ ID NO: 814417 - RNA, 19 nt, Homo sapiens
ccauagcgaagaagaaaua

SEQ ID NO: 814418 - RNA, 19 nt, Homo sapiens
ggaggugguuggccagaga

SEQ ID NO: 814419 - RNA, 19 nt, Homo sapiens
gaccgucccucugaaacua

SEQ ID NO: 814420 - RNA, 19 nt, Homo sapiens
ggaaauaaacgaacaucuc

SEQ ID NO: 814421 - RNA, 19 nt, Homo sapiens
gcacagccaccacacagaa

SEQ ID NO: 814422 - RNA, 19 nt, Homo sapiens
ccagggagcuauuaguauc

SEQ ID NO: 814423 - RNA, 19 nt, Homo sapiens
aaacagaggaggaagaaga

SEQ ID NO: 814424 - RNA, 19 nt, Homo sapiens
ccgaguaccucacgcaaga

SEQ ID NO: 814425 - RNA, 19 nt, Homo sapiens
cugcagcccuugccucuuu

SEQ ID NO: 814426 - RNA, 19 nt, Homo sapiens
aaagaagagugagaagaaa

SEQ ID NO: 814427 - RNA, 19 nt, Homo sapiens
ggaagaagaggaagaagag

SEQ ID NO: 814428 - RNA, 19 nt, Homo sapiens
ggacacaagugaaaacaga

SEQ ID NO: 814429 - RNA, 19 nt, Homo sapiens
gaaacagucagcugauuca

SEQ ID NO: 814430 - RNA, 19 nt, Homo sapiens
aggaaucacugaagaaugu

SEQ ID NO: 814431 - RNA, 19 nt, Homo sapiens
gcaccaauccugaaagagu

SEQ ID NO: 814432 - RNA, 19 nt, Homo sapiens
ugcggcagcuuccaaauuu

SEQ ID NO: 814433 - RNA, 19 nt, Homo sapiens
gcaaggaacgugcgaaguc

SEQ ID NO: 814434 - RNA, 19 nt, Homo sapiens
cagcuauacugaaaccaaa

SEQ ID NO: 814435 - RNA, 19 nt, Homo sapiens
ugaaugggaucgggacaaa

SEQ ID NO: 814436 - RNA, 19 nt, Homo sapiens
gggcaagauuagcaacauu

SEQ ID NO: 814437 - RNA, 19 nt, Homo sapiens
gaauucaucacacuguuga

SEQ ID NO: 814438 - RNA, 19 nt, Homo sapiens
aaagaagugugaagcugaa

SEQ ID NO: 814439 - RNA, 19 nt, Homo sapiens
cgaaagaaggccucacuug

SEQ ID NO: 814440 - RNA, 19 nt, Homo sapiens
gcgaaaggagcaagaagaa

SEQ ID NO: 814441 - RNA, 19 nt, Homo sapiens
gcagagggaagaagaggaa

SEQ ID NO: 814442 - RNA, 19 nt, Homo sapiens
gacagcagcaccagcuaua

SEQ ID NO: 814443 - RNA, 19 nt, Homo sapiens
caagaugggcuccagauca

SEQ ID NO: 814444 - RNA, 19 nt, Homo sapiens
cugccaagcugcuggauga

SEQ ID NO: 814445 - RNA, 19 nt, Homo sapiens
aagaaaccuuccaucagua

SEQ ID NO: 814446 - RNA, 19 nt, Homo sapiens
caaaggaaucacugaagaa

SEQ ID NO: 814447 - RNA, 19 nt, Homo sapiens
aagaaggccucacuuguag

SEQ ID NO: 814448 - RNA, 19 nt, Homo sapiens
ugacucugaugaugagaaa

SEQ ID NO: 814449 - RNA, 19 nt, Homo sapiens
gaaaggugacucugaugau

SEQ ID NO: 814450 - RNA, 19 nt, Homo sapiens
uuaacucgacguuccauua

SEQ ID NO: 814451 - RNA, 19 nt, Homo sapiens
gacuuuaggagauaccuua

SEQ ID NO: 814452 - RNA, 19 nt, Homo sapiens
aaacagaccugaaaaugau

SEQ ID NO: 814453 - RNA, 19 nt, Homo sapiens
gccagaaucagaaagaauu

SEQ ID NO: 814454 - RNA, 19 nt, Homo sapiens
aaagcacacuggcugacua

SEQ ID NO: 814455 - RNA, 19 nt, Homo sapiens
gaggaagaaagagaaauaa

SEQ ID NO: 814456 - RNA, 19 nt, Homo sapiens
agaaacaccuuccagaaac

SEQ ID NO: 814457 - RNA, 19 nt, Homo sapiens
ccagaacaguuucauaaaa

SEQ ID NO: 814458 - RNA, 19 nt, Homo sapiens
caucuccgauuaugguuau

SEQ ID NO: 814459 - RNA, 19 nt, Homo sapiens
gaacagaaggaaggcagaa

SEQ ID NO: 814460 - RNA, 19 nt, Homo sapiens
cuauuaguaucucagcaua

SEQ ID NO: 814461 - RNA, 19 nt, Homo sapiens
agaaauagagcccauggaa

SEQ ID NO: 814462 - RNA, 19 nt, Homo sapiens
gcuccucaauuucugaaga

SEQ ID NO: 814463 - RNA, 19 nt, Homo sapiens
gcagacauucgcccagaaa

SEQ ID NO: 814464 - RNA, 19 nt, Homo sapiens
ggaaacauccgaggacauc

SEQ ID NO: 814465 - RNA, 19 nt, Homo sapiens
ggagacagaucuuugauga

SEQ ID NO: 814466 - RNA, 19 nt, Homo sapiens
ggacaaacauccagcuuga

SEQ ID NO: 814467 - RNA, 19 nt, Homo sapiens
ggucuagccuuuaaugaua

SEQ ID NO: 814468 - RNA, 19 nt, Homo sapiens
agauaaagcugccuaagua

SEQ ID NO: 814469 - RNA, 19 nt, Homo sapiens
caacugcacuaguguuuaa

SEQ ID NO: 814470 - RNA, 19 nt, Homo sapiens
acagauggcuuauuguaua

SEQ ID NO: 814471 - RNA, 19 nt, Homo sapiens
ggucaaagcuaccuuaaca

SEQ ID NO: 814472 - RNA, 19 nt, Homo sapiens
guacacaacuuccuuaaag

SEQ ID NO: 814473 - RNA, 19 nt, Homo sapiens
gaaguuggguuggcucuuu

SEQ ID NO: 814474 - RNA, 19 nt, Homo sapiens
gaaaacagcuuccucucua

SEQ ID NO: 814475 - RNA, 19 nt, Homo sapiens
ugacgaagcuguaugacuu

SEQ ID NO: 814476 - RNA, 19 nt, Homo sapiens
ggaagacgguggcaacuca

SEQ ID NO: 814477 - RNA, 19 nt, Homo sapiens
agacauacaucacuuacaa

SEQ ID NO: 814478 - RNA, 19 nt, Homo sapiens
ggacucuagugacaucaua

SEQ ID NO: 814479 - RNA, 19 nt, Homo sapiens
ggaggagggugaucuacaa

SEQ ID NO: 814480 - RNA, 19 nt, Homo sapiens
gaaaguggacuacaaaucu

SEQ ID NO: 814481 - RNA, 19 nt, Homo sapiens
caagcgagcucugguuaaa

SEQ ID NO: 814482 - RNA, 19 nt, Homo sapiens
gcaucaagcacguguauaa

SEQ ID NO: 814483 - RNA, 19 nt, Homo sapiens
gcagacaauugcaauacuu

SEQ ID NO: 814484 - RNA, 19 nt, Homo sapiens
gagagaaugugauauagag

SEQ ID NO: 814485 - RNA, 19 nt, Homo sapiens
ggauauuucuggcaaacaa

SEQ ID NO: 814486 - RNA, 19 nt, Homo sapiens
gguaacaacuaguggaaga

SEQ ID NO: 814487 - RNA, 19 nt, Homo sapiens
gaaggacucuagugacauc

SEQ ID NO: 814488 - RNA, 19 nt, Homo sapiens
gaaaugagacaaagggaau

SEQ ID NO: 814489 - RNA, 19 nt, Homo sapiens
gaaauaaggaggucaacau

SEQ ID NO: 814490 - RNA, 19 nt, Homo sapiens
gcuauuugcuugucagaug

SEQ ID NO: 814491 - RNA, 19 nt, Homo sapiens
ggaagaggcauuuguggaa

SEQ ID NO: 814492 - RNA, 19 nt, Homo sapiens
acagaucauuucccaguua

SEQ ID NO: 814493 - RNA, 19 nt, Homo sapiens
uaacaucuaugcucaaguc

SEQ ID NO: 814494 - RNA, 19 nt, Homo sapiens
cauagcugguuucuacuua

SEQ ID NO: 814495 - RNA, 19 nt, Homo sapiens
ggauguagcugcagaaagc

SEQ ID NO: 814496 - RNA, 19 nt, Homo sapiens
ggacaaguaugguuucacu

SEQ ID NO: 814497 - RNA, 19 nt, Homo sapiens
gcccggagcucucauauac

SEQ ID NO: 814498 - RNA, 19 nt, Homo sapiens
cauauacuguucuugguuu

SEQ ID NO: 814499 - RNA, 19 nt, Homo sapiens
gcacuaguguuuaauacca

SEQ ID NO: 814500 - RNA, 19 nt, Homo sapiens
cuucacacauuuacacaua

SEQ ID NO: 814501 - RNA, 19 nt, Homo sapiens
ucaaaugucugccuucagu

SEQ ID NO: 814502 - RNA, 19 nt, Homo sapiens
caaccaccuuucugacuuu

SEQ ID NO: 814503 - RNA, 19 nt, Homo sapiens
gauugcaguucaugaauau

SEQ ID NO: 814504 - RNA, 19 nt, Homo sapiens
gagcaaaggaugcaucuuc

SEQ ID NO: 814505 - RNA, 19 nt, Homo sapiens
gcuauuaucagugguauuu

SEQ ID NO: 814506 - RNA, 19 nt, Homo sapiens
acagagagaaugugauaua

SEQ ID NO: 814507 - RNA, 19 nt, Homo sapiens
caaaagagauugcaguuca

SEQ ID NO: 814508 - RNA, 19 nt, Homo sapiens
caaaggacaugcacaucau

SEQ ID NO: 814509 - RNA, 19 nt, Homo sapiens
gaagaggcauuuguggaau

SEQ ID NO: 814510 - RNA, 19 nt, Homo sapiens
acacuuaacucuugcaucu

SEQ ID NO: 814511 - RNA, 19 nt, Homo sapiens
gggagagccuugugucaug

SEQ ID NO: 814512 - RNA, 19 nt, Homo sapiens
ugacaucaguucccugguu

SEQ ID NO: 814513 - RNA, 19 nt, Homo sapiens
agacagagagaaugugaua

SEQ ID NO: 814514 - RNA, 19 nt, Homo sapiens
guauauauaugggaggaaa

SEQ ID NO: 814515 - RNA, 19 nt, Homo sapiens
acuagaggcuucauacuga

SEQ ID NO: 814516 - RNA, 19 nt, Homo sapiens
cagaaagcaugcacaacuu

SEQ ID NO: 814517 - RNA, 19 nt, Homo sapiens
gcaaacagcgaaagcacaa

SEQ ID NO: 814518 - RNA, 19 nt, Homo sapiens
gcacaaagccucucaucac

SEQ ID NO: 814519 - RNA, 19 nt, Homo sapiens
caaugcaacuuucaucauc

SEQ ID NO: 814520 - RNA, 19 nt, Homo sapiens
ggacuucgagugugacuau

SEQ ID NO: 814521 - RNA, 19 nt, Homo sapiens
aaaguggacuacaaaucua

SEQ ID NO: 814522 - RNA, 19 nt, Homo sapiens
aaagaaagaugcguguguu

SEQ ID NO: 814523 - RNA, 19 nt, Homo sapiens
ggcuacagauggcuuauug

SEQ ID NO: 814524 - RNA, 19 nt, Homo sapiens
gauccucauugccguguuu

SEQ ID NO: 814525 - RNA, 19 nt, Homo sapiens
gagagcagcauauugauca

SEQ ID NO: 814526 - RNA, 19 nt, Homo sapiens
ucaguuaccucuaugucaa

SEQ ID NO: 814527 - RNA, 19 nt, Homo sapiens
uaugaaaggugaagaagag

SEQ ID NO: 814528 - RNA, 19 nt, Homo sapiens
gcagaaagcaugcacaacu

SEQ ID NO: 814529 - RNA, 19 nt, Homo sapiens
gcaccaaggaggacuauca

SEQ ID NO: 814530 - RNA, 19 nt, Homo sapiens
agacagaucuuugaugaag

SEQ ID NO: 814531 - RNA, 19 nt, Homo sapiens
acuaaacacuggaauacaa

SEQ ID NO: 814532 - RNA, 19 nt, Homo sapiens
gggaggaguuaaagagguu

SEQ ID NO: 814533 - RNA, 19 nt, Homo sapiens
ugagguagcagguaucaaa

SEQ ID NO: 814534 - RNA, 19 nt, Homo sapiens
ggaaccagaaugacacgua

SEQ ID NO: 814535 - RNA, 19 nt, Homo sapiens
ggauggauaugcucacuac

SEQ ID NO: 814536 - RNA, 19 nt, Homo sapiens
cuauggaggucgacagauu

SEQ ID NO: 814537 - RNA, 19 nt, Homo sapiens
caacagcagcgucauacuu

SEQ ID NO: 814538 - RNA, 19 nt, Homo sapiens
ucagugagccaaagugaaa

SEQ ID NO: 814539 - RNA, 19 nt, Homo sapiens
gagcucucauauacugaua

SEQ ID NO: 814540 - RNA, 19 nt, Homo sapiens
gagaaugugauauagagaa

SEQ ID NO: 814541 - RNA, 19 nt, Homo sapiens
ccaguuagauccgcaggaa

SEQ ID NO: 814542 - RNA, 19 nt, Homo sapiens
caucuaugcucaaguccaa

SEQ ID NO: 814543 - RNA, 19 nt, Homo sapiens
agauugcaguucaugaaua

SEQ ID NO: 814544 - RNA, 19 nt, Homo sapiens
gaaggaaccgacaccauca

SEQ ID NO: 814545 - RNA, 19 nt, Homo sapiens
aaacauccagcuugacuuu

SEQ ID NO: 814546 - RNA, 19 nt, Homo sapiens
gaacgcaucacacccaaca

SEQ ID NO: 814547 - RNA, 19 nt, Homo sapiens
ucaauagggucacguuaag

SEQ ID NO: 814548 - RNA, 19 nt, Homo sapiens
gauguacacaacuuccuua

SEQ ID NO: 814549 - RNA, 19 nt, Homo sapiens
ggcagucaguggaucuuaa

SEQ ID NO: 814550 - RNA, 19 nt, Homo sapiens
gauaaaggaaggacucuag

SEQ ID NO: 814551 - RNA, 19 nt, Homo sapiens
gcugguuucuacuuaugua

SEQ ID NO: 814552 - RNA, 19 nt, Homo sapiens
ucacacagcugacguuagc

SEQ ID NO: 814553 - RNA, 19 nt, Homo sapiens
guagaucaguauuaggaau

SEQ ID NO: 814554 - RNA, 19 nt, Homo sapiens
gaagggaagaggcauuugu

SEQ ID NO: 814555 - RNA, 19 nt, Homo sapiens
ugccauagcugguuucuac

SEQ ID NO: 814556 - RNA, 19 nt, Homo sapiens
ggacuacaaaucuaucuuc

SEQ ID NO: 814557 - RNA, 19 nt, Homo sapiens
ggcaacacauggagacaga

SEQ ID NO: 814558 - RNA, 19 nt, Homo sapiens
gggaacaucauuauugaau

SEQ ID NO: 814559 - RNA, 19 nt, Homo sapiens
agacgagaaccaaguauuu

SEQ ID NO: 814560 - RNA, 19 nt, Homo sapiens
agaggcauuuguggaauua

SEQ ID NO: 814561 - RNA, 19 nt, Homo sapiens
gaauggaaccagaaugaca

SEQ ID NO: 814562 - RNA, 19 nt, Homo sapiens
gacaugcacaucaucagua

SEQ ID NO: 814563 - RNA, 19 nt, Homo sapiens
gcauauugaucagcucaga

SEQ ID NO: 814564 - RNA, 19 nt, Homo sapiens
ccacagccuccucgcuuua

SEQ ID NO: 814565 - RNA, 19 nt, Homo sapiens
gcaauggucuggucacuuu

SEQ ID NO: 814566 - RNA, 19 nt, Homo sapiens
caaagaaacugaauacaga

SEQ ID NO: 814567 - RNA, 19 nt, Homo sapiens
gcaaagacguggauuagau

SEQ ID NO: 814568 - RNA, 19 nt, Homo sapiens
caucauauguccaguaauu

SEQ ID NO: 814569 - RNA, 19 nt, Homo sapiens
ggacuugaauucagaggua

SEQ ID NO: 814570 - RNA, 19 nt, Homo sapiens
uaaaggagauuuccguauu

SEQ ID NO: 814571 - RNA, 19 nt, Homo sapiens
ggaaggaagugaagaacaa

SEQ ID NO: 814572 - RNA, 19 nt, Homo sapiens
gcaagaagagcauccaaua

SEQ ID NO: 814573 - RNA, 19 nt, Homo sapiens
ugacacagauucucaugua

SEQ ID NO: 814574 - RNA, 19 nt, Homo sapiens
caaacacacucauaaagaa

SEQ ID NO: 814575 - RNA, 19 nt, Homo sapiens
gaacggaccgggacacuaa

SEQ ID NO: 814576 - RNA, 19 nt, Homo sapiens
caaggauucuucagagaua

SEQ ID NO: 814577 - RNA, 19 nt, Homo sapiens
gaacagcagcaacuauuaa

SEQ ID NO: 814578 - RNA, 19 nt, Homo sapiens
caaaugaguucacggauca

SEQ ID NO: 814579 - RNA, 19 nt, Homo sapiens
gagcaaagccuguggaugu

SEQ ID NO: 814580 - RNA, 19 nt, Homo sapiens
gaagaugccugcagguauc

SEQ ID NO: 814581 - RNA, 19 nt, Homo sapiens
uaacagugguggcaauauu

SEQ ID NO: 814582 - RNA, 19 nt, Homo sapiens
gaucuuugcugacauggaa

SEQ ID NO: 814583 - RNA, 19 nt, Homo sapiens
agaggaagaugaaggauuu

SEQ ID NO: 814584 - RNA, 19 nt, Homo sapiens
uuauuuggcucuuggauua

SEQ ID NO: 814585 - RNA, 19 nt, Homo sapiens
gcaaccaaguucaaauuau

SEQ ID NO: 814586 - RNA, 19 nt, Homo sapiens
ggaauaacuuucaccaauc

SEQ ID NO: 814587 - RNA, 19 nt, Homo sapiens
guaaagauguugguggaaa

SEQ ID NO: 814588 - RNA, 19 nt, Homo sapiens
gcuaagacuucugaugaua

SEQ ID NO: 814589 - RNA, 19 nt, Homo sapiens
ggaaauaucaggaacuuca

SEQ ID NO: 814590 - RNA, 19 nt, Homo sapiens
ccuaucagcuugggaaaua

SEQ ID NO: 814591 - RNA, 19 nt, Homo sapiens
gcuguuggaucucuucuuu

SEQ ID NO: 814592 - RNA, 19 nt, Homo sapiens
gcaguagccuuauuguaug

SEQ ID NO: 814593 - RNA, 19 nt, Homo sapiens
uaacagugcugcuucuaug

SEQ ID NO: 814594 - RNA, 19 nt, Homo sapiens
gaaagcuacugcaguggaa

SEQ ID NO: 814595 - RNA, 19 nt, Homo sapiens
ggauugaaaugucugaguu

SEQ ID NO: 814596 - RNA, 19 nt, Homo sapiens
agaaauagcuggaaagacu

SEQ ID NO: 814597 - RNA, 19 nt, Homo sapiens
uaauuggugugcuguauuu

SEQ ID NO: 814598 - RNA, 19 nt, Homo sapiens
gaaaguauaaagcccuuaa

SEQ ID NO: 814599 - RNA, 19 nt, Homo sapiens
ggaacagcagcaacuauua

SEQ ID NO: 814600 - RNA, 19 nt, Homo sapiens
ggagagagacuauaacaca

SEQ ID NO: 814601 - RNA, 19 nt, Homo sapiens
ggauuggcauuaacuuuga

SEQ ID NO: 814602 - RNA, 19 nt, Homo sapiens
gaugagcuaucuuuauuag

SEQ ID NO: 814603 - RNA, 19 nt, Homo sapiens
gagaguuucugugugauuu

SEQ ID NO: 814604 - RNA, 19 nt, Homo sapiens
gaagugaagaacaagauuu

SEQ ID NO: 814605 - RNA, 19 nt, Homo sapiens
aaacucaucuugugaucaa

SEQ ID NO: 814606 - RNA, 19 nt, Homo sapiens
gacauggaauugcuaagaa

SEQ ID NO: 814607 - RNA, 19 nt, Homo sapiens
gagaagaaccucguaauag

SEQ ID NO: 814608 - RNA, 19 nt, Homo sapiens
gaauggaucuuugcugaca

SEQ ID NO: 814609 - RNA, 19 nt, Homo sapiens
uagcuucucuuguaccuuu

SEQ ID NO: 814610 - RNA, 19 nt, Homo sapiens
aaaggagauuuccguauuu

SEQ ID NO: 814611 - RNA, 19 nt, Homo sapiens
gagagagacuauaacacaa

SEQ ID NO: 814612 - RNA, 19 nt, Homo sapiens
caacaagcuuugggaacua

SEQ ID NO: 814613 - RNA, 19 nt, Homo sapiens
ccaauccacugguguuuau

SEQ ID NO: 814614 - RNA, 19 nt, Homo sapiens
ugucaauacucacugcuua

SEQ ID NO: 814615 - RNA, 19 nt, Homo sapiens
ugagcuaucuuuauuagga

SEQ ID NO: 814616 - RNA, 19 nt, Homo sapiens
caacaggacauugaucuaa

SEQ ID NO: 814617 - RNA, 19 nt, Homo sapiens
cggaagcucuuucgucuug

SEQ ID NO: 814618 - RNA, 19 nt, Homo sapiens
gcacagucuucacaguauu

SEQ ID NO: 814619 - RNA, 19 nt, Homo sapiens
gaucuauucuucucauaca

SEQ ID NO: 814620 - RNA, 19 nt, Homo sapiens
ugagaagaaccucguaaua

SEQ ID NO: 814621 - RNA, 19 nt, Homo sapiens
gauguggacccgaccuuua

SEQ ID NO: 814622 - RNA, 19 nt, Homo sapiens
uggaauaacuuucaccaau

SEQ ID NO: 814623 - RNA, 19 nt, Homo sapiens
caaagugcguaaagauguu

SEQ ID NO: 814624 - RNA, 19 nt, Homo sapiens
ugucggcgcucuucuacua

SEQ ID NO: 814625 - RNA, 19 nt, Homo sapiens
caaucugaauuccaucuuu

SEQ ID NO: 814626 - RNA, 19 nt, Homo sapiens
uugcagcacuuuacaguuu

SEQ ID NO: 814627 - RNA, 19 nt, Homo sapiens
gaccauugauacagauuug

SEQ ID NO: 814628 - RNA, 19 nt, Homo sapiens
gaaugacucaaacagguua

SEQ ID NO: 814629 - RNA, 19 nt, Homo sapiens
ccaaacacacucauaaaga

SEQ ID NO: 814630 - RNA, 19 nt, Homo sapiens
gcagauacagugcucuaaa

SEQ ID NO: 814631 - RNA, 19 nt, Homo sapiens
gauuagauccaguuaguga

SEQ ID NO: 814632 - RNA, 19 nt, Homo sapiens
gacccgaccuuuaauccaa

SEQ ID NO: 814633 - RNA, 19 nt, Homo sapiens
ccucacaugcuuucauuua

SEQ ID NO: 814634 - RNA, 19 nt, Homo sapiens
cagauuggcuucccagcuu

SEQ ID NO: 814635 - RNA, 19 nt, Homo sapiens
ggucauaaucguaucauug

SEQ ID NO: 814636 - RNA, 19 nt, Homo sapiens
gaucagagugacuugagua

SEQ ID NO: 814637 - RNA, 19 nt, Homo sapiens
caaagaauccuugguggaa

SEQ ID NO: 814638 - RNA, 19 nt, Homo sapiens
ccaagggacuucagugaca

SEQ ID NO: 814639 - RNA, 19 nt, Homo sapiens
gaugauaucaguuuaaguc

SEQ ID NO: 814640 - RNA, 19 nt, Homo sapiens
gagcuacaguggccugaug

SEQ ID NO: 814641 - RNA, 19 nt, Homo sapiens
gagcagcagugcagagaca

SEQ ID NO: 814642 - RNA, 19 nt, Homo sapiens
gguaguaugcauuguaauu

SEQ ID NO: 814643 - RNA, 19 nt, Homo sapiens
gacgaagacucuagugauc

SEQ ID NO: 814644 - RNA, 19 nt, Homo sapiens
gccacacagugcuauauuu

SEQ ID NO: 814645 - RNA, 19 nt, Homo sapiens
gaagugugagccaguguuu

SEQ ID NO: 814646 - RNA, 19 nt, Homo sapiens
ugagaaacaugauaaacuc

SEQ ID NO: 814647 - RNA, 19 nt, Homo sapiens
ccaguaauuuagagucauu

SEQ ID NO: 814648 - RNA, 19 nt, Homo sapiens
gaccuuuaauccaaacauu

SEQ ID NO: 814649 - RNA, 19 nt, Homo sapiens
ggccauuacugaaggugua

SEQ ID NO: 814650 - RNA, 19 nt, Homo sapiens
agccagggauuuaguuaua

SEQ ID NO: 814651 - RNA, 19 nt, Homo sapiens
uggauugcaugcccuauuu

SEQ ID NO: 814652 - RNA, 19 nt, Homo sapiens
aaagauucaucccuaguga

SEQ ID NO: 814653 - RNA, 19 nt, Homo sapiens
gcuaaagacacuagaguau

SEQ ID NO: 814654 - RNA, 19 nt, Homo sapiens
gcaguuuauuguccuguga

SEQ ID NO: 814655 - RNA, 19 nt, Homo sapiens
cgugaacgcagcacauuua

SEQ ID NO: 814656 - RNA, 19 nt, Homo sapiens
aggacgggcuucccaguua

SEQ ID NO: 814657 - RNA, 19 nt, Homo sapiens
uaaaggagauacagacacu

SEQ ID NO: 814658 - RNA, 19 nt, Homo sapiens
gaugaaggaauccgguuaa

SEQ ID NO: 814659 - RNA, 19 nt, Homo sapiens
gauaucgcuucgaaacuug

SEQ ID NO: 814660 - RNA, 19 nt, Homo sapiens
caaagcaagcccugagaaa

SEQ ID NO: 814661 - RNA, 19 nt, Homo sapiens
gaauguguccgaggucuuu

SEQ ID NO: 814662 - RNA, 19 nt, Homo sapiens
gaugauggcaccaaugaau

SEQ ID NO: 814663 - RNA, 19 nt, Homo sapiens
gaaaugcagccacuaugau

SEQ ID NO: 814664 - RNA, 19 nt, Homo sapiens
gagcauccaauaucuguga

SEQ ID NO: 814665 - RNA, 19 nt, Homo sapiens
caacagcgaucccaaguua

SEQ ID NO: 814666 - RNA, 19 nt, Homo sapiens
ggcaagagcuuauaaauga

SEQ ID NO: 814667 - RNA, 19 nt, Homo sapiens
ggacacggguuccaaauaa

SEQ ID NO: 814668 - RNA, 19 nt, Homo sapiens
gcagagacaugaagaaguu

SEQ ID NO: 814669 - RNA, 19 nt, Homo sapiens
caacaucccuaugcaguua

SEQ ID NO: 814670 - RNA, 19 nt, Homo sapiens
ggaaagaagugucucuguu

SEQ ID NO: 814671 - RNA, 19 nt, Homo sapiens
gcaagcagaucacucgaaa

SEQ ID NO: 814672 - RNA, 19 nt, Homo sapiens
gcagagaacuuugugaaug

SEQ ID NO: 814673 - RNA, 19 nt, Homo sapiens
ggacucaucuucugacugu

SEQ ID NO: 814674 - RNA, 19 nt, Homo sapiens
ggaagagagugacgaagaa

SEQ ID NO: 814675 - RNA, 19 nt, Homo sapiens
gagaaacucuauaauguca

SEQ ID NO: 814676 - RNA, 19 nt, Homo sapiens
cagcauggauuuggaguua

SEQ ID NO: 814677 - RNA, 19 nt, Homo sapiens
gaaagaaaggucggaauuu

SEQ ID NO: 814678 - RNA, 19 nt, Homo sapiens
cagaaguacugucuaauga

SEQ ID NO: 814679 - RNA, 19 nt, Homo sapiens
gaaagaagugucucuguug

SEQ ID NO: 814680 - RNA, 19 nt, Homo sapiens
ccacagggauagaagauga

SEQ ID NO: 814681 - RNA, 19 nt, Homo sapiens
gagucaaccuggauuauga

SEQ ID NO: 814682 - RNA, 19 nt, Homo sapiens
agaagaaacucauggaaug

SEQ ID NO: 814683 - RNA, 19 nt, Homo sapiens
uaacuggccuuagaagaaa

SEQ ID NO: 814684 - RNA, 19 nt, Homo sapiens
gaaguacugucuaaugagu

SEQ ID NO: 814685 - RNA, 19 nt, Homo sapiens
gugcagaaguacugucuaa

SEQ ID NO: 814686 - RNA, 19 nt, Homo sapiens
gaagaaaggauucguuaca

SEQ ID NO: 814687 - RNA, 19 nt, Homo sapiens
gcauggauuuggaguuaaa

SEQ ID NO: 814688 - RNA, 19 nt, Homo sapiens
ccaaauaaguuucgcuauc

SEQ ID NO: 814689 - RNA, 19 nt, Homo sapiens
gaaacagggagacaucuuu

SEQ ID NO: 814690 - RNA, 19 nt, Homo sapiens
guaaauuggucagcagaaa

SEQ ID NO: 814691 - RNA, 19 nt, Homo sapiens
ggcauuaacuggccuuaga

SEQ ID NO: 814692 - RNA, 19 nt, Homo sapiens
gaaaugccagugacuuauu

SEQ ID NO: 814693 - RNA, 19 nt, Homo sapiens
ccaaagauccucucucuag

SEQ ID NO: 814694 - RNA, 19 nt, Homo sapiens
ccaagccaaugguuucuuu

SEQ ID NO: 814695 - RNA, 19 nt, Homo sapiens
gauggaacccgaagaagaa

SEQ ID NO: 814696 - RNA, 19 nt, Homo sapiens
gcagaaguacugucuaaug

SEQ ID NO: 814697 - RNA, 19 nt, Homo sapiens
gaaacucuauaaugucauc

SEQ ID NO: 814698 - RNA, 19 nt, Homo sapiens
cugaagcccuacagaguua

SEQ ID NO: 814699 - RNA, 19 nt, Homo sapiens
gcagccaccuuacagauca

SEQ ID NO: 814700 - RNA, 19 nt, Homo sapiens
gauagaagaugaagaugcu

SEQ ID NO: 814701 - RNA, 19 nt, Homo sapiens
caaccuggauuaugaugga

SEQ ID NO: 814702 - RNA, 19 nt, Homo sapiens
caacaaaugccaucuugga

SEQ ID NO: 814703 - RNA, 19 nt, Homo sapiens
acgagaagcugauacagaa

SEQ ID NO: 814704 - RNA, 19 nt, Homo sapiens
guggagagguggaucagaa

SEQ ID NO: 814705 - RNA, 19 nt, Homo sapiens
gaucaguccuccaaucuac

SEQ ID NO: 814706 - RNA, 19 nt, Homo sapiens
cacaagacuuugagaagaa

SEQ ID NO: 814707 - RNA, 19 nt, Homo sapiens
ccaaguggauucugagaca

SEQ ID NO: 814708 - RNA, 19 nt, Homo sapiens
caaauucgggacuugcuua

SEQ ID NO: 814709 - RNA, 19 nt, Homo sapiens
gaagaagaaaggauucguu

SEQ ID NO: 814710 - RNA, 19 nt, Homo sapiens
guugcaaucugguuccuaa

SEQ ID NO: 814711 - RNA, 19 nt, Homo sapiens
gacaagagacuuuggacaa

SEQ ID NO: 814712 - RNA, 19 nt, Homo sapiens
cagagaacuuugugaaugu

SEQ ID NO: 814713 - RNA, 19 nt, Homo sapiens
gagaagaaacucauggaau

SEQ ID NO: 814714 - RNA, 19 nt, Homo sapiens
gaugauggcauuucagaug

SEQ ID NO: 814715 - RNA, 19 nt, Homo sapiens
gaagaucagcuaagacaca

SEQ ID NO: 814716 - RNA, 19 nt, Homo sapiens
gaacaaucccagcggcaaa

SEQ ID NO: 814717 - RNA, 19 nt, Homo sapiens
acacaagacuuugagaaga

SEQ ID NO: 814718 - RNA, 19 nt, Homo sapiens
caaggagagugugguguuu

SEQ ID NO: 814719 - RNA, 19 nt, Homo sapiens
uuacgaagccucacacuau

SEQ ID NO: 814720 - RNA, 19 nt, Homo sapiens
gagcagaaucuccguguug

SEQ ID NO: 814721 - RNA, 19 nt, Homo sapiens
ggacauuucauccacagaa

SEQ ID NO: 814722 - RNA, 19 nt, Homo sapiens
ugaacggccuguccaaaga

SEQ ID NO: 814723 - RNA, 19 nt, Homo sapiens
gcgcgucucuccuccauca

SEQ ID NO: 814724 - RNA, 19 nt, Homo sapiens
ggaaugcuguaucugcaau

SEQ ID NO: 814725 - RNA, 19 nt, Homo sapiens
gcuauccauucuacuauga

SEQ ID NO: 814726 - RNA, 19 nt, Homo sapiens
gcaagacgugguauaaaug

SEQ ID NO: 814727 - RNA, 19 nt, Homo sapiens
gcaaggagagugugguguu

SEQ ID NO: 814728 - RNA, 19 nt, Homo sapiens
gcccuggagugguuucuuu

SEQ ID NO: 814729 - RNA, 19 nt, Homo sapiens
gaacacacagaaaggcauu

SEQ ID NO: 814730 - RNA, 19 nt, Homo sapiens
ccuacaaucugcucuuaga

SEQ ID NO: 814731 - RNA, 19 nt, Homo sapiens
uauggcagguugcaauaaa

SEQ ID NO: 814732 - RNA, 19 nt, Homo sapiens
gcagcaagcuccggaacau

SEQ ID NO: 814733 - RNA, 19 nt, Homo sapiens
guucgaggcugcuauacug

SEQ ID NO: 814734 - RNA, 19 nt, Homo sapiens
cuaugaagaugauggcauu

SEQ ID NO: 814735 - RNA, 19 nt, Homo sapiens
aagaagaaaggauucguua

SEQ ID NO: 814736 - RNA, 19 nt, Homo sapiens
gaggacagcucggagaaag

SEQ ID NO: 814737 - RNA, 19 nt, Homo sapiens
ugaagagacacaagacuuu

SEQ ID NO: 814738 - RNA, 19 nt, Homo sapiens
ggccuucgcugccuuguag

SEQ ID NO: 814739 - RNA, 19 nt, Homo sapiens
aagagaaacugcacaccaa

SEQ ID NO: 814740 - RNA, 19 nt, Homo sapiens
gcaagagcuuauaaaugau

SEQ ID NO: 814741 - RNA, 19 nt, Homo sapiens
gcacuucaucucagacuug

SEQ ID NO: 814742 - RNA, 19 nt, Homo sapiens
agccagagauugcguggua

SEQ ID NO: 814743 - RNA, 19 nt, Homo sapiens
gaaacugcacaccaacaaa

SEQ ID NO: 814744 - RNA, 19 nt, Homo sapiens
gguugaaacuuugaggaaa

SEQ ID NO: 814745 - RNA, 19 nt, Homo sapiens
aaucaaggacccucaaauu

SEQ ID NO: 814746 - RNA, 19 nt, Homo sapiens
cgacgacgcuaugaagaug

SEQ ID NO: 814747 - RNA, 19 nt, Homo sapiens
gaagagacacaagacuuug

SEQ ID NO: 814748 - RNA, 19 nt, Homo sapiens
gcaugaagcaguccugugu

SEQ ID NO: 814749 - RNA, 19 nt, Homo sapiens
ucucauugcugauguaaag

SEQ ID NO: 814750 - RNA, 19 nt, Homo sapiens
gagauguguugguaugugu

SEQ ID NO: 814751 - RNA, 19 nt, Homo sapiens
ggacgugaacacacagaaa

SEQ ID NO: 814752 - RNA, 19 nt, Homo sapiens
guugaaacuuugaggaaau

SEQ ID NO: 814753 - RNA, 19 nt, Homo sapiens
cacuggaguuccuauagua

SEQ ID NO: 814754 - RNA, 19 nt, Homo sapiens
uaugagauguguugguaug

SEQ ID NO: 814755 - RNA, 19 nt, Homo sapiens
cagacugaaucaacaaaug

SEQ ID NO: 814756 - RNA, 19 nt, Homo sapiens
gaaaugaccauggcucagu

SEQ ID NO: 814757 - RNA, 19 nt, Homo sapiens
ggagugguuucuuuacagu

SEQ ID NO: 814758 - RNA, 19 nt, Homo sapiens
ggaaaugccagugacuuau

SEQ ID NO: 814759 - RNA, 19 nt, Homo sapiens
guccaaagauccucucucu

SEQ ID NO: 814760 - RNA, 19 nt, Homo sapiens
uacagaagaucagcuaaga

SEQ ID NO: 814761 - RNA, 19 nt, Homo sapiens
ccucauaauucgccacaug

SEQ ID NO: 814762 - RNA, 19 nt, Homo sapiens
gaucuucggugggcaguag

SEQ ID NO: 814763 - RNA, 19 nt, Homo sapiens
ugcaagacgugguauaaau

SEQ ID NO: 814764 - RNA, 19 nt, Homo sapiens
gggaauguccaaagugcua

SEQ ID NO: 814765 - RNA, 19 nt, Homo sapiens
gaaguuauuucccacauuu

SEQ ID NO: 814766 - RNA, 19 nt, Homo sapiens
gaacaaccaugcccaaaga

SEQ ID NO: 814767 - RNA, 19 nt, Homo sapiens
gaaagugucuaccuugaaa

SEQ ID NO: 814768 - RNA, 19 nt, Homo sapiens
gaacuauccagguuuauua

SEQ ID NO: 814769 - RNA, 19 nt, Homo sapiens
guacaaacuuucccacaaa

SEQ ID NO: 814770 - RNA, 19 nt, Homo sapiens
gaaccaguuucugcaauua

SEQ ID NO: 814771 - RNA, 19 nt, Homo sapiens
ggagaaagcucuagcaaaa

SEQ ID NO: 814772 - RNA, 19 nt, Homo sapiens
gagauugcaucaacaguuu

SEQ ID NO: 814773 - RNA, 19 nt, Homo sapiens
cgggagacaucaccuauua

SEQ ID NO: 814774 - RNA, 19 nt, Homo sapiens
gaagaggagaggaacauua

SEQ ID NO: 814775 - RNA, 19 nt, Homo sapiens
aaacaggcuuggagacuua

SEQ ID NO: 814776 - RNA, 19 nt, Homo sapiens
gcagugucauuguuucaua

SEQ ID NO: 814777 - RNA, 19 nt, Homo sapiens
gaagugaaccuccuagaga

SEQ ID NO: 814778 - RNA, 19 nt, Homo sapiens
gcagaaugccuacauacua

SEQ ID NO: 814779 - RNA, 19 nt, Homo sapiens
gaaaggugauuuggauuau

SEQ ID NO: 814780 - RNA, 19 nt, Homo sapiens
aaacauaugucaccagugu

SEQ ID NO: 814781 - RNA, 19 nt, Homo sapiens
gguauaaacuucagacaca

SEQ ID NO: 814782 - RNA, 19 nt, Homo sapiens
gagagauccucauagaauu

SEQ ID NO: 814783 - RNA, 19 nt, Homo sapiens
ggagagauccucauagaau

SEQ ID NO: 814784 - RNA, 19 nt, Homo sapiens
gauggaacccugagugaua

SEQ ID NO: 814785 - RNA, 19 nt, Homo sapiens
ggucaucucugcuccuauu

SEQ ID NO: 814786 - RNA, 19 nt, Homo sapiens
gagccaagaucacaccauu

SEQ ID NO: 814787 - RNA, 19 nt, Homo sapiens
ggaaccaguuucugcaauu

SEQ ID NO: 814788 - RNA, 19 nt, Homo sapiens
gagaggagauuugcuugaa

SEQ ID NO: 814789 - RNA, 19 nt, Homo sapiens
ugagauguuucaccaauaa

SEQ ID NO: 814790 - RNA, 19 nt, Homo sapiens
caugaacuauccagguuua

SEQ ID NO: 814791 - RNA, 19 nt, Homo sapiens
gaaacaggcuuggagacuu

SEQ ID NO: 814792 - RNA, 19 nt, Homo sapiens
cgagaaaggugauuuggau

SEQ ID NO: 814793 - RNA, 19 nt, Homo sapiens
gugucuaccuugaaauuua

SEQ ID NO: 814794 - RNA, 19 nt, Homo sapiens
gaaauucauccaacaagaa

SEQ ID NO: 814795 - RNA, 19 nt, Homo sapiens
guacuacgacaauaagaua

SEQ ID NO: 814796 - RNA, 19 nt, Homo sapiens
gauuggugcuuugcuaaua

SEQ ID NO: 814797 - RNA, 19 nt, Homo sapiens
gagaaagaaagagguauua

SEQ ID NO: 814798 - RNA, 19 nt, Homo sapiens
gaaagccgcguucacguuu

SEQ ID NO: 814799 - RNA, 19 nt, Homo sapiens
gggaugaaguucuagaaug

SEQ ID NO: 814800 - RNA, 19 nt, Homo sapiens
cauguucacuuaggacuua

SEQ ID NO: 814801 - RNA, 19 nt, Homo sapiens
ccacaacuuuauauggaua

SEQ ID NO: 814802 - RNA, 19 nt, Homo sapiens
cagaaaugcugcaguacaa

SEQ ID NO: 814803 - RNA, 19 nt, Homo sapiens
caagaggucuaaucugugu

SEQ ID NO: 814804 - RNA, 19 nt, Homo sapiens
ccagagauguggauaguca

SEQ ID NO: 814805 - RNA, 19 nt, Homo sapiens
gaaccaaaauggaaucaaa

SEQ ID NO: 814806 - RNA, 19 nt, Homo sapiens
ggcaggaacuugaacauuc

SEQ ID NO: 814807 - RNA, 19 nt, Homo sapiens
caagcacaguguuaaauau

SEQ ID NO: 814808 - RNA, 19 nt, Homo sapiens
ggagauagagacaacauga

SEQ ID NO: 814809 - RNA, 19 nt, Homo sapiens
uaagauuggugcuuugcua

SEQ ID NO: 814810 - RNA, 19 nt, Homo sapiens
ccacacauauuccugucua

SEQ ID NO: 814811 - RNA, 19 nt, Homo sapiens
gagaacgaauguuagaaau

SEQ ID NO: 814812 - RNA, 19 nt, Homo sapiens
gacaccagcugauuguaaa

SEQ ID NO: 814813 - RNA, 19 nt, Homo sapiens
ggacaccagcugauuguaa

SEQ ID NO: 814814 - RNA, 19 nt, Homo sapiens
gaacgggagcgcaaagaaa

SEQ ID NO: 814815 - RNA, 19 nt, Homo sapiens
ugucagaaaugcugcagua

SEQ ID NO: 814816 - RNA, 19 nt, Homo sapiens
cacaagaggucuaaucugu

SEQ ID NO: 814817 - RNA, 19 nt, Homo sapiens
gaucauagaaccagagaug

SEQ ID NO: 814818 - RNA, 19 nt, Homo sapiens
ggaugaaguucuagaaugg

SEQ ID NO: 814819 - RNA, 19 nt, Homo sapiens
cauaacuacugccauguuu

SEQ ID NO: 814820 - RNA, 19 nt, Homo sapiens
gcaagaagaagaaagugaa

SEQ ID NO: 814821 - RNA, 19 nt, Homo sapiens
gcuuagagccugaugcuuu

SEQ ID NO: 814822 - RNA, 19 nt, Homo sapiens
acaaaggcauauaacagua

SEQ ID NO: 814823 - RNA, 19 nt, Homo sapiens
gauauucaaccugaucuua

SEQ ID NO: 814824 - RNA, 19 nt, Homo sapiens
gaaguccaguugaucauag

SEQ ID NO: 814825 - RNA, 19 nt, Homo sapiens
gugaaguugugguaugaua

SEQ ID NO: 814826 - RNA, 19 nt, Homo sapiens
gagacaacaugaguucaaa

SEQ ID NO: 814827 - RNA, 19 nt, Homo sapiens
caguaugaaugccucuuua

SEQ ID NO: 814828 - RNA, 19 nt, Homo sapiens
gaaguugugguaugauaaa

SEQ ID NO: 814829 - RNA, 19 nt, Homo sapiens
guucuagaauggaauggua

SEQ ID NO: 814830 - RNA, 19 nt, Homo sapiens
gaaaagaggaggauuauca

SEQ ID NO: 814831 - RNA, 19 nt, Homo sapiens
caauuuaugucgaaagcaa

SEQ ID NO: 814832 - RNA, 19 nt, Homo sapiens
cuuagagccugaugcuuua

SEQ ID NO: 814833 - RNA, 19 nt, Homo sapiens
gacuaaagcuucaaaagaa

SEQ ID NO: 814834 - RNA, 19 nt, Homo sapiens
guccucaacuuguacuuaa

SEQ ID NO: 814835 - RNA, 19 nt, Homo sapiens
ggacagguacuacgacaau

SEQ ID NO: 814836 - RNA, 19 nt, Homo sapiens
gaggaaagagaaagaaaga

SEQ ID NO: 814837 - RNA, 19 nt, Homo sapiens
ggcuauaggucuagugcua

SEQ ID NO: 814838 - RNA, 19 nt, Homo sapiens
gauuguaaauguucugcaa

SEQ ID NO: 814839 - RNA, 19 nt, Homo sapiens
uaacguggcaaccaucuaa

SEQ ID NO: 814840 - RNA, 19 nt, Homo sapiens
agaaaggugauuuggauua

SEQ ID NO: 814841 - RNA, 19 nt, Homo sapiens
cagaggaguuuagaugaaa

SEQ ID NO: 814842 - RNA, 19 nt, Homo sapiens
ccaguaggcuauaggucua

SEQ ID NO: 814843 - RNA, 19 nt, Homo sapiens
gaagcgggcagaucacuug

SEQ ID NO: 814844 - RNA, 19 nt, Homo sapiens
ucgaggaagugguaguaua

SEQ ID NO: 814845 - RNA, 19 nt, Homo sapiens
ucucuaauguguaaugcua

SEQ ID NO: 814846 - RNA, 19 nt, Homo sapiens
aauagucucuguauguuga

SEQ ID NO: 814847 - RNA, 19 nt, Homo sapiens
ggaaauauuaguucugcuu

SEQ ID NO: 814848 - RNA, 19 nt, Homo sapiens
ggaaguaguaagucaguga

SEQ ID NO: 814849 - RNA, 19 nt, Homo sapiens
ggaaagccgcguucacguu

SEQ ID NO: 814850 - RNA, 19 nt, Homo sapiens
acaaagaucucagcgaauc

SEQ ID NO: 814851 - RNA, 19 nt, Homo sapiens
caaagacucaggugcauug

SEQ ID NO: 814852 - RNA, 19 nt, Homo sapiens
gcaagaagcggcagauguc

SEQ ID NO: 814853 - RNA, 19 nt, Homo sapiens
gaagccugcugccugcaaa

SEQ ID NO: 814854 - RNA, 19 nt, Homo sapiens
ccaguggucuaaauauaau

SEQ ID NO: 814855 - RNA, 19 nt, Homo sapiens
gaaguuaaggaaguaguaa

SEQ ID NO: 814856 - RNA, 19 nt, Homo sapiens
caaauuaggugggcauggu

SEQ ID NO: 814857 - RNA, 19 nt, Homo sapiens
aaacgugucucgaggaagu

SEQ ID NO: 814858 - RNA, 19 nt, Homo sapiens
ccagguuuauuauuacuug

SEQ ID NO: 814859 - RNA, 19 nt, Homo sapiens
ggucaaagcaugaacuauc

SEQ ID NO: 814860 - RNA, 19 nt, Homo sapiens
gcccaauaaugcaaacaaa

SEQ ID NO: 814861 - RNA, 19 nt, Homo sapiens
gcaagaggaaagagaaaga

SEQ ID NO: 814862 - RNA, 19 nt, Homo sapiens
gaagaagccaugcucaagu

SEQ ID NO: 814863 - RNA, 19 nt, Homo sapiens
gaucucagcgaaucaguga

SEQ ID NO: 814864 - RNA, 19 nt, Homo sapiens
gaaccgcauugguauaaac

SEQ ID NO: 814865 - RNA, 19 nt, Homo sapiens
ggaauuaccuccuugcuuu

SEQ ID NO: 814866 - RNA, 19 nt, Homo sapiens
gaucgaaccuguaucauuu

SEQ ID NO: 814867 - RNA, 19 nt, Homo sapiens
aaacagagauucaguauga

SEQ ID NO: 814868 - RNA, 19 nt, Homo sapiens
gaaaccagcuuaagaacaa

SEQ ID NO: 814869 - RNA, 19 nt, Homo sapiens
gaaagacggcuucauauuu

SEQ ID NO: 814870 - RNA, 19 nt, Homo sapiens
gaucuaggcuguaaacaaa

SEQ ID NO: 814871 - RNA, 19 nt, Homo sapiens
gcaaagaaauggaaagaau

SEQ ID NO: 814872 - RNA, 19 nt, Homo sapiens
acaaacagaugaacgauua

SEQ ID NO: 814873 - RNA, 19 nt, Homo sapiens
gaaaugagaaguaguauga

SEQ ID NO: 814874 - RNA, 19 nt, Homo sapiens
gaagagaaacuguauauga

SEQ ID NO: 814875 - RNA, 19 nt, Homo sapiens
ggacugaacugauacauag

SEQ ID NO: 814876 - RNA, 19 nt, Homo sapiens
caaauugccucauugguuu

SEQ ID NO: 814877 - RNA, 19 nt, Homo sapiens
gaaccagaaucaaguguuu

SEQ ID NO: 814878 - RNA, 19 nt, Homo sapiens
gcagaaagguggucagaug

SEQ ID NO: 814879 - RNA, 19 nt, Homo sapiens
caagcaaacuccacuaauu

SEQ ID NO: 814880 - RNA, 19 nt, Homo sapiens
gaucuuggcuccgagaaua

SEQ ID NO: 814881 - RNA, 19 nt, Homo sapiens
uaacuucccuaacaacaua

SEQ ID NO: 814882 - RNA, 19 nt, Homo sapiens
gaacagcacaagaagaaua

SEQ ID NO: 814883 - RNA, 19 nt, Homo sapiens
agacauaucugaccaauca

SEQ ID NO: 814884 - RNA, 19 nt, Homo sapiens
uaacagaacuuccauaacu

SEQ ID NO: 814885 - RNA, 19 nt, Homo sapiens
caaagaaccuguaggacaa

SEQ ID NO: 814886 - RNA, 19 nt, Homo sapiens
gaacuguggucucuucuau

SEQ ID NO: 814887 - RNA, 19 nt, Homo sapiens
gaaagugccugccauucuu

SEQ ID NO: 814888 - RNA, 19 nt, Homo sapiens
guggagagcuuaucauuga

SEQ ID NO: 814889 - RNA, 19 nt, Homo sapiens
gagauuaguuuacagagaa

SEQ ID NO: 814890 - RNA, 19 nt, Homo sapiens
gaagaugggccucgaaauu

SEQ ID NO: 814891 - RNA, 19 nt, Homo sapiens
aaagaaaccugcucgauau

SEQ ID NO: 814892 - RNA, 19 nt, Homo sapiens
gaagggcccugcaggauga

SEQ ID NO: 814893 - RNA, 19 nt, Homo sapiens
ugacugaccuugaugauga

SEQ ID NO: 814894 - RNA, 19 nt, Homo sapiens
gagaaagaguguuuaucua

SEQ ID NO: 814895 - RNA, 19 nt, Homo sapiens
ggacagcagugauucagaa

SEQ ID NO: 814896 - RNA, 19 nt, Homo sapiens
caaaucguauguacagaua

SEQ ID NO: 814897 - RNA, 19 nt, Homo sapiens
ucagaucccuaaacaguua

SEQ ID NO: 814898 - RNA, 19 nt, Homo sapiens
caaagucuaucaaagguuu

SEQ ID NO: 814899 - RNA, 19 nt, Homo sapiens
caacaucaaugacccacua

SEQ ID NO: 814900 - RNA, 19 nt, Homo sapiens
gcuugcagcugauguguua

SEQ ID NO: 814901 - RNA, 19 nt, Homo sapiens
ggaguaagcugacuaugca

SEQ ID NO: 814902 - RNA, 19 nt, Homo sapiens
guaaaugucuuccaucauc

SEQ ID NO: 814903 - RNA, 19 nt, Homo sapiens
gaaacaaagucuaucaaag

SEQ ID NO: 814904 - RNA, 19 nt, Homo sapiens
ggaagacacuauugcuaaa

SEQ ID NO: 814905 - RNA, 19 nt, Homo sapiens
gaauguguguguguaguua

SEQ ID NO: 814906 - RNA, 19 nt, Homo sapiens
gaaagaaguguacagaauu

SEQ ID NO: 814907 - RNA, 19 nt, Homo sapiens
gacauuaucuguggucuuu

SEQ ID NO: 814908 - RNA, 19 nt, Homo sapiens
gcacaugacucagaaggaa

SEQ ID NO: 814909 - RNA, 19 nt, Homo sapiens
gcacuaaaaugcacauaua

SEQ ID NO: 814910 - RNA, 19 nt, Homo sapiens
uagcuuaucuugcauagaa

SEQ ID NO: 814911 - RNA, 19 nt, Homo sapiens
gagcccagauuucaaguuu

SEQ ID NO: 814912 - RNA, 19 nt, Homo sapiens
gaacugauacauaguaaga

SEQ ID NO: 814913 - RNA, 19 nt, Homo sapiens
caugagaccuccauuauuc

SEQ ID NO: 814914 - RNA, 19 nt, Homo sapiens
gaaacagugugggagaaua

SEQ ID NO: 814915 - RNA, 19 nt, Homo sapiens
ggacaugagaccuccauua

SEQ ID NO: 814916 - RNA, 19 nt, Homo sapiens
uaaauaugcugcccuguug

SEQ ID NO: 814917 - RNA, 19 nt, Homo sapiens
uggcagagguguucuuuaa

SEQ ID NO: 814918 - RNA, 19 nt, Homo sapiens
ccacguguuugaaguguua

SEQ ID NO: 814919 - RNA, 19 nt, Homo sapiens
aaacacaaaugcaggaauu

SEQ ID NO: 814920 - RNA, 19 nt, Homo sapiens
guucauccauguauucuaa

SEQ ID NO: 814921 - RNA, 19 nt, Homo sapiens
ccauugaggugcggaauua

SEQ ID NO: 814922 - RNA, 19 nt, Homo sapiens
aaagacggcuucauauuug

SEQ ID NO: 814923 - RNA, 19 nt, Homo sapiens
gaacaaacugucauuucua

SEQ ID NO: 814924 - RNA, 19 nt, Homo sapiens
caaguucacugaguuauga

SEQ ID NO: 814925 - RNA, 19 nt, Homo sapiens
uacaagacaugacuacaua

SEQ ID NO: 814926 - RNA, 19 nt, Homo sapiens
gaaagaguguuuaucuaca

SEQ ID NO: 814927 - RNA, 19 nt, Homo sapiens
gagaauagcugcccauagc

SEQ ID NO: 814928 - RNA, 19 nt, Homo sapiens
caacuuccauuacuaacuu

SEQ ID NO: 814929 - RNA, 19 nt, Homo sapiens
gaagagccguaaguuauga

SEQ ID NO: 814930 - RNA, 19 nt, Homo sapiens
caacagaaguaaauugaag

SEQ ID NO: 814931 - RNA, 19 nt, Homo sapiens
cgucugagaucccaaguaa

SEQ ID NO: 814932 - RNA, 19 nt, Homo sapiens
gaagcaacguggauggauu

SEQ ID NO: 814933 - RNA, 19 nt, Homo sapiens
gauuggaacuguauuagga

SEQ ID NO: 814934 - RNA, 19 nt, Homo sapiens
cuucaugggucaucaguua

SEQ ID NO: 814935 - RNA, 19 nt, Homo sapiens
gcggauguuugaacgauua

SEQ ID NO: 814936 - RNA, 19 nt, Homo sapiens
cuacauguguucagaauau

SEQ ID NO: 814937 - RNA, 19 nt, Homo sapiens
caacaucuauugucaacau

SEQ ID NO: 814938 - RNA, 19 nt, Homo sapiens
uauaugggaugaacacuuu

SEQ ID NO: 814939 - RNA, 19 nt, Homo sapiens
gcagagguguucuuuaaag

SEQ ID NO: 814940 - RNA, 19 nt, Homo sapiens
ggacagcggcuuuggcuuu

SEQ ID NO: 814941 - RNA, 19 nt, Homo sapiens
gaaaccugcucgauauaga

SEQ ID NO: 814942 - RNA, 19 nt, Homo sapiens
caauguugcuuaagaagaa

SEQ ID NO: 814943 - RNA, 19 nt, Homo sapiens
gcaagaauccggaaagugu

SEQ ID NO: 814944 - RNA, 19 nt, Homo sapiens
gaaguaguaugaucacauc

SEQ ID NO: 814945 - RNA, 19 nt, Homo sapiens
gaaaggaaccagcaaguca

SEQ ID NO: 814946 - RNA, 19 nt, Homo sapiens
aaacacuucuggaugauuu

SEQ ID NO: 814947 - RNA, 19 nt, Homo sapiens
gagaaagagugcuggagaa

SEQ ID NO: 814948 - RNA, 19 nt, Homo sapiens
cacaguaucuccacuuaaa

SEQ ID NO: 814949 - RNA, 19 nt, Homo sapiens
gagcuacucauccuuauuu

SEQ ID NO: 814950 - RNA, 19 nt, Homo sapiens
ugagaaagacggcuucaua

SEQ ID NO: 814951 - RNA, 19 nt, Homo sapiens
gaaaagaaaugcauaaguc

SEQ ID NO: 814952 - RNA, 19 nt, Homo sapiens
cagcaugccuugaugacua

SEQ ID NO: 814953 - RNA, 19 nt, Homo sapiens
ggacuacuccagaaaguuu

SEQ ID NO: 814954 - RNA, 19 nt, Homo sapiens
ggacuuaacugccuguaac

SEQ ID NO: 814955 - RNA, 19 nt, Homo sapiens
uaggaaaguuggaggauuu

SEQ ID NO: 814956 - RNA, 19 nt, Homo sapiens
gcaaucagaugaccugucu

SEQ ID NO: 814957 - RNA, 19 nt, Homo sapiens
gaaaaguuguguucuguuu

SEQ ID NO: 814958 - RNA, 19 nt, Homo sapiens
ugagagagguucagaagau

SEQ ID NO: 814959 - RNA, 19 nt, Homo sapiens
gaaaggaaucagaaacaaa

SEQ ID NO: 814960 - RNA, 19 nt, Homo sapiens
gaaacaagucuuagaggaa

SEQ ID NO: 814961 - RNA, 19 nt, Homo sapiens
caacguggauggauuugga

SEQ ID NO: 814962 - RNA, 19 nt, Homo sapiens
ccugaaaggucuacaagaa

SEQ ID NO: 814963 - RNA, 19 nt, Homo sapiens
gaacaugcuuuggaucuuc

SEQ ID NO: 814964 - RNA, 19 nt, Homo sapiens
ccaaggaauucccuaaaga

SEQ ID NO: 814965 - RNA, 19 nt, Homo sapiens
gaacagcucuugaaauuug

SEQ ID NO: 814966 - RNA, 19 nt, Homo sapiens
gaacaacauugccagagua

SEQ ID NO: 814967 - RNA, 19 nt, Homo sapiens
agacagagcuggaauauca

SEQ ID NO: 814968 - RNA, 19 nt, Homo sapiens
ugacugagcuggacaaaga

SEQ ID NO: 814969 - RNA, 19 nt, Homo sapiens
ggaagaggcugacacauag

SEQ ID NO: 814970 - RNA, 19 nt, Homo sapiens
ggaagaggcuggcaaaaua

SEQ ID NO: 814971 - RNA, 19 nt, Homo sapiens
gaaagaagcagaugccauu

SEQ ID NO: 814972 - RNA, 19 nt, Homo sapiens
gaaauuauccaaugacgaa

SEQ ID NO: 814973 - RNA, 19 nt, Homo sapiens
gaaaaucucugcuggcuuu

SEQ ID NO: 814974 - RNA, 19 nt, Homo sapiens
gagaacaucuugcacacaa

SEQ ID NO: 814975 - RNA, 19 nt, Homo sapiens
uggaacagcucuugaaauu

SEQ ID NO: 814976 - RNA, 19 nt, Homo sapiens
ggaagaagaagaagaaaga

SEQ ID NO: 814977 - RNA, 19 nt, Homo sapiens
gaaggaagaagaagaagaa

SEQ ID NO: 814978 - RNA, 19 nt, Homo sapiens
uaaagugacuagaacguuu

SEQ ID NO: 814979 - RNA, 19 nt, Homo sapiens
gagauaaguuugugucugu

SEQ ID NO: 814980 - RNA, 19 nt, Homo sapiens
gagaugagccgaauuaauc

SEQ ID NO: 814981 - RNA, 19 nt, Homo sapiens
uaaaugcaauccaugcuuu

SEQ ID NO: 814982 - RNA, 19 nt, Homo sapiens
caaauauacuguagcaaga

SEQ ID NO: 814983 - RNA, 19 nt, Homo sapiens
ggucuaaacugcccgagaa

SEQ ID NO: 814984 - RNA, 19 nt, Homo sapiens
gaacgagaaugugaugcua

SEQ ID NO: 814985 - RNA, 19 nt, Homo sapiens
agaauucucugaagggaua

SEQ ID NO: 814986 - RNA, 19 nt, Homo sapiens
gaaauaaguaccuugagaa

SEQ ID NO: 814987 - RNA, 19 nt, Homo sapiens
caaaugcccugaaauccuu

SEQ ID NO: 814988 - RNA, 19 nt, Homo sapiens
caagauaucuagccuaaac

SEQ ID NO: 814989 - RNA, 19 nt, Homo sapiens
acaaugagcuacaacagaa

SEQ ID NO: 814990 - RNA, 19 nt, Homo sapiens
gccaucauguccuucauua

SEQ ID NO: 814991 - RNA, 19 nt, Homo sapiens
uaagagacauucccuagau

SEQ ID NO: 814992 - RNA, 19 nt, Homo sapiens
gaagaaagcggagaguuug

SEQ ID NO: 814993 - RNA, 19 nt, Homo sapiens
guacgaauguugguuaaug

SEQ ID NO: 814994 - RNA, 19 nt, Homo sapiens
gaagaagaagaaagaagua

SEQ ID NO: 814995 - RNA, 19 nt, Homo sapiens
gaacguguguauguaaaug

SEQ ID NO: 814996 - RNA, 19 nt, Homo sapiens
ggaggaacauaaacacgaa

SEQ ID NO: 814997 - RNA, 19 nt, Homo sapiens
cgacuuggauggccuauca

SEQ ID NO: 814998 - RNA, 19 nt, Homo sapiens
gcgaaaugauagcaacuuu

SEQ ID NO: 814999 - RNA, 19 nt, Homo sapiens
uaaaauaucucacccaaga

SEQ ID NO: 815000 - RNA, 19 nt, Homo sapiens
uagcagcccucuaaaguga

SEQ ID NO: 815001 - RNA, 19 nt, Homo sapiens
caaaauugcugacacaaaa

SEQ ID NO: 815002 - RNA, 19 nt, Homo sapiens
gacauucccuagauucaaa

SEQ ID NO: 815003 - RNA, 19 nt, Homo sapiens
gaugaguucuuuggcauuu

SEQ ID NO: 815004 - RNA, 19 nt, Homo sapiens
gagaaaagcuaaagagaau

SEQ ID NO: 815005 - RNA, 19 nt, Homo sapiens
ggaccgaaauugaugauac

SEQ ID NO: 815006 - RNA, 19 nt, Homo sapiens
gaaaugaagaugaacuaga

SEQ ID NO: 815007 - RNA, 19 nt, Homo sapiens
gaaaugcuccgaaaugaag

SEQ ID NO: 815008 - RNA, 19 nt, Homo sapiens
gaacaucuugcacacaauu

SEQ ID NO: 815009 - RNA, 19 nt, Homo sapiens
ugacuagaacguuucauua

SEQ ID NO: 815010 - RNA, 19 nt, Homo sapiens
caaguuggccugaauucua

SEQ ID NO: 815011 - RNA, 19 nt, Homo sapiens
ggaacaguauggaccgaaa

SEQ ID NO: 815012 - RNA, 19 nt, Homo sapiens
gaauucaaccuguaauaga

SEQ ID NO: 815013 - RNA, 19 nt, Homo sapiens
gcuaugaauuucugauguu

SEQ ID NO: 815014 - RNA, 19 nt, Homo sapiens
cggaaucgcaaacguauua

SEQ ID NO: 815015 - RNA, 19 nt, Homo sapiens
agaaauaaguaccuugaga

SEQ ID NO: 815016 - RNA, 19 nt, Homo sapiens
aaagugacauugaccuauu

SEQ ID NO: 815017 - RNA, 19 nt, Homo sapiens
gaagaugaacuagaauuug

SEQ ID NO: 815018 - RNA, 19 nt, Homo sapiens
aauacuaucuccugaaaga

SEQ ID NO: 815019 - RNA, 19 nt, Homo sapiens
cagcuucucugauguugaa

SEQ ID NO: 815020 - RNA, 19 nt, Homo sapiens
uggcagaagugaaaccuaa

SEQ ID NO: 815021 - RNA, 19 nt, Homo sapiens
gugcaggaguggagaguuu

SEQ ID NO: 815022 - RNA, 19 nt, Homo sapiens
gaacuggaccucacagaca

SEQ ID NO: 815023 - RNA, 19 nt, Homo sapiens
acaauacuaucuccugaaa

SEQ ID NO: 815024 - RNA, 19 nt, Homo sapiens
auaaguaccuugagaagug

SEQ ID NO: 815025 - RNA, 19 nt, Homo sapiens
aaugaagaauugcgagaua

SEQ ID NO: 815026 - RNA, 19 nt, Homo sapiens
guauaaaggcguuaaugaa

SEQ ID NO: 815027 - RNA, 19 nt, Homo sapiens
ggagcuggaugucauguuc

SEQ ID NO: 815028 - RNA, 19 nt, Homo sapiens
guggagaguuuggacuuua

SEQ ID NO: 815029 - RNA, 19 nt, Homo sapiens
gacauuaauuaacgacuug

SEQ ID NO: 815030 - RNA, 19 nt, Homo sapiens
acacagagaagccauguuu

SEQ ID NO: 815031 - RNA, 19 nt, Homo sapiens
gcaaacguauuaccaacca

SEQ ID NO: 815032 - RNA, 19 nt, Homo sapiens
auacauacuucucucauug

SEQ ID NO: 815033 - RNA, 19 nt, Homo sapiens
caaguuaucucugccaagu

SEQ ID NO: 815034 - RNA, 19 nt, Homo sapiens
ugaagaaagcggagaguuu

SEQ ID NO: 815035 - RNA, 19 nt, Homo sapiens
cagcaggauuucuuuguga

SEQ ID NO: 815036 - RNA, 19 nt, Homo sapiens
gaacaaacuggaaggaaca

SEQ ID NO: 815037 - RNA, 19 nt, Homo sapiens
gcuccgaaaugaagaugaa

SEQ ID NO: 815038 - RNA, 19 nt, Homo sapiens
uaaaggcguuaaugaacaa

SEQ ID NO: 815039 - RNA, 19 nt, Homo sapiens
caagcuugauauccuuuaa

SEQ ID NO: 815040 - RNA, 19 nt, Homo sapiens
gaaaucaaacgggcaauuc

SEQ ID NO: 815041 - RNA, 19 nt, Homo sapiens
gcccacaaaugcccugaaa

SEQ ID NO: 815042 - RNA, 19 nt, Homo sapiens
agauaggcauuuagacuuu

SEQ ID NO: 815043 - RNA, 19 nt, Homo sapiens
uaucauguauccucaacuu

SEQ ID NO: 815044 - RNA, 19 nt, Homo sapiens
agacagcacugaggacaaa

SEQ ID NO: 815045 - RNA, 19 nt, Homo sapiens
ccacaaaugcccugaaauc

SEQ ID NO: 815046 - RNA, 19 nt, Homo sapiens
aaagaaagaacgagaaugu

SEQ ID NO: 815047 - RNA, 19 nt, Homo sapiens
ugacacauagugaagcuua

SEQ ID NO: 815048 - RNA, 19 nt, Homo sapiens
uaaagaccauggacuacga

SEQ ID NO: 815049 - RNA, 19 nt, Homo sapiens
ggccugaauucuacauuga

SEQ ID NO: 815050 - RNA, 19 nt, Homo sapiens
gagagagaccaaucacaaa

SEQ ID NO: 815051 - RNA, 19 nt, Homo sapiens
caggagaaguguuugacaa

SEQ ID NO: 815052 - RNA, 19 nt, Homo sapiens
ccaguguucucaaucuaaa

SEQ ID NO: 815053 - RNA, 19 nt, Homo sapiens
guuaggaauucaaccugua

SEQ ID NO: 815054 - RNA, 19 nt, Homo sapiens
gagcacagagaacauuaaa

SEQ ID NO: 815055 - RNA, 19 nt, Homo sapiens
gaaacggaaucgcaaacgu

SEQ ID NO: 815056 - RNA, 19 nt, Homo sapiens
aggaagaucugcccaagga

SEQ ID NO: 815057 - RNA, 19 nt, Homo sapiens
gagaugaugcagaccuuaa

SEQ ID NO: 815058 - RNA, 19 nt, Homo sapiens
gcuuugaauuucugacauu

SEQ ID NO: 815059 - RNA, 19 nt, Homo sapiens
ugaaagcaguagagacaga

SEQ ID NO: 815060 - RNA, 19 nt, Homo sapiens
gagccgaauuaaucacuau

SEQ ID NO: 815061 - RNA, 19 nt, Homo sapiens
gccuagcacugaagaagaa

SEQ ID NO: 815062 - RNA, 19 nt, Homo sapiens
ugaccuuguuucagcuuua

SEQ ID NO: 815063 - RNA, 19 nt, Homo sapiens
gaaagggaacguaaaauga

SEQ ID NO: 815064 - RNA, 19 nt, Homo sapiens
gaaagaacgagaaugugau

SEQ ID NO: 815065 - RNA, 19 nt, Homo sapiens
gaauuucacuucugcaaua

SEQ ID NO: 815066 - RNA, 19 nt, Homo sapiens
gcagagaccuuaagugcua

SEQ ID NO: 815067 - RNA, 19 nt, Homo sapiens
gaacacagauuguagagau

SEQ ID NO: 815068 - RNA, 19 nt, Homo sapiens
gaagagaucccagauagua

SEQ ID NO: 815069 - RNA, 19 nt, Homo sapiens
ggaauaauaugcauguaga

SEQ ID NO: 815070 - RNA, 19 nt, Homo sapiens
ggagagacauguuuccauu

SEQ ID NO: 815071 - RNA, 19 nt, Homo sapiens
gaacaaaggaauugaggaa

SEQ ID NO: 815072 - RNA, 19 nt, Homo sapiens
gaguaaaccuugccauaug

SEQ ID NO: 815073 - RNA, 19 nt, Homo sapiens
uaaccaagacucauucaua

SEQ ID NO: 815074 - RNA, 19 nt, Homo sapiens
cuacagagauucaaaugga

SEQ ID NO: 815075 - RNA, 19 nt, Homo sapiens
agacugaacuuaaaugugu

SEQ ID NO: 815076 - RNA, 19 nt, Homo sapiens
caagagagauuccaugcau

SEQ ID NO: 815077 - RNA, 19 nt, Homo sapiens
ucauauagcacguaguuua

SEQ ID NO: 815078 - RNA, 19 nt, Homo sapiens
gaauuuggguggcucaugu

SEQ ID NO: 815079 - RNA, 19 nt, Homo sapiens
caugaagacugccauauuc

SEQ ID NO: 815080 - RNA, 19 nt, Homo sapiens
gaacaaguuuaacgacaag

SEQ ID NO: 815081 - RNA, 19 nt, Homo sapiens
agagauggguucaguggua

SEQ ID NO: 815082 - RNA, 19 nt, Homo sapiens
guucacgccuaagaaauua

SEQ ID NO: 815083 - RNA, 19 nt, Homo sapiens
ucacuucugucuuaacuug

SEQ ID NO: 815084 - RNA, 19 nt, Homo sapiens
ccgaguagcugggacuaua

SEQ ID NO: 815085 - RNA, 19 nt, Homo sapiens
ggagugcacuggcuugauc

SEQ ID NO: 815086 - RNA, 19 nt, Homo sapiens
aaacugggucaaagaauua

SEQ ID NO: 815087 - RNA, 19 nt, Homo sapiens
ccaauuuacuacagagauu

SEQ ID NO: 815088 - RNA, 19 nt, Homo sapiens
gcagaaggaacacagauug

SEQ ID NO: 815089 - RNA, 19 nt, Homo sapiens
guucauugcuugccagaga

SEQ ID NO: 815090 - RNA, 19 nt, Homo sapiens
ggucaaagaauuacggaaa

SEQ ID NO: 815091 - RNA, 19 nt, Homo sapiens
cauaacagaugaagauucu

SEQ ID NO: 815092 - RNA, 19 nt, Homo sapiens
gaucauugcccucaacaug

SEQ ID NO: 815093 - RNA, 19 nt, Homo sapiens
gauaacuguucacgccuaa

SEQ ID NO: 815094 - RNA, 19 nt, Homo sapiens
gugcuguucuucuggauaa

SEQ ID NO: 815095 - RNA, 19 nt, Homo sapiens
guguacagauuauugauga

SEQ ID NO: 815096 - RNA, 19 nt, Homo sapiens
gagaugacuucugcugauu

SEQ ID NO: 815097 - RNA, 19 nt, Homo sapiens
guaacugucuacuacuuug

SEQ ID NO: 815098 - RNA, 19 nt, Homo sapiens
gauagaaacagcacaagug

SEQ ID NO: 815099 - RNA, 19 nt, Homo sapiens
ucucauaggcuuuauaaga

SEQ ID NO: 815100 - RNA, 19 nt, Homo sapiens
cuacaaauguuaacaaagc

SEQ ID NO: 815101 - RNA, 19 nt, Homo sapiens
ugacauaacagaugaagau

SEQ ID NO: 815102 - RNA, 19 nt, Homo sapiens
aaccaagacucauucauau

SEQ ID NO: 815103 - RNA, 19 nt, Homo sapiens
acaaagcaauuaccaaugg

SEQ ID NO: 815104 - RNA, 19 nt, Homo sapiens
uaaauuagucccucauuag

SEQ ID NO: 815105 - RNA, 19 nt, Homo sapiens
uagaaugguuaccuuagaa

SEQ ID NO: 815106 - RNA, 19 nt, Homo sapiens
gaaggaacacagauuguag

SEQ ID NO: 815107 - RNA, 19 nt, Homo sapiens
ugauugagcaguagcauuu

SEQ ID NO: 815108 - RNA, 19 nt, Homo sapiens
ugugguaguugaaauugua

SEQ ID NO: 815109 - RNA, 19 nt, Homo sapiens
gaccagagaauuggcauuu

SEQ ID NO: 815110 - RNA, 19 nt, Homo sapiens
gaacaaaacuguggaucau

SEQ ID NO: 815111 - RNA, 19 nt, Homo sapiens
gcacguaguuuauguuccu

SEQ ID NO: 815112 - RNA, 19 nt, Homo sapiens
gcccguaacugucuacuac

SEQ ID NO: 815113 - RNA, 19 nt, Homo sapiens
cauauuccaagucacauua

SEQ ID NO: 815114 - RNA, 19 nt, Homo sapiens
ggagggugcuguucuucug

SEQ ID NO: 815115 - RNA, 19 nt, Homo sapiens
gauaguagccaguuaacca

SEQ ID NO: 815116 - RNA, 19 nt, Homo sapiens
gaggaagagaucccagaua

SEQ ID NO: 815117 - RNA, 19 nt, Homo sapiens
gcaauuaccaauggccuuu

SEQ ID NO: 815118 - RNA, 19 nt, Homo sapiens
aaacagaacaaaggaauug

SEQ ID NO: 815119 - RNA, 19 nt, Homo sapiens
ugccagagaugaacacaga

SEQ ID NO: 815120 - RNA, 19 nt, Homo sapiens
ugagcaaguucuauuuguu

SEQ ID NO: 815121 - RNA, 19 nt, Homo sapiens
aggaagagaucccagauag

SEQ ID NO: 815122 - RNA, 19 nt, Homo sapiens
gccuacaaauguuaacaaa

SEQ ID NO: 815123 - RNA, 19 nt, Homo sapiens
ccaaagugcugggauuaca

SEQ ID NO: 815124 - RNA, 19 nt, Homo sapiens
caacaugaagacugccaua

SEQ ID NO: 815125 - RNA, 19 nt, Homo sapiens
ccaagacucauucauauag

SEQ ID NO: 815126 - RNA, 19 nt, Homo sapiens
ccagauaguagccaguuaa

SEQ ID NO: 815127 - RNA, 19 nt, Homo sapiens
uauaagagauggguucagu

SEQ ID NO: 815128 - RNA, 19 nt, Homo sapiens
ggaacucuuucuugaccuu

SEQ ID NO: 815129 - RNA, 19 nt, Homo sapiens
uugaggaacucuuucuuga

SEQ ID NO: 815130 - RNA, 19 nt, Homo sapiens
gaaaaggagagacauguuu

SEQ ID NO: 815131 - RNA, 19 nt, Homo sapiens
gagcaaguucuauuuguuc

SEQ ID NO: 815132 - RNA, 19 nt, Homo sapiens
gcaggcaucauucuuaaca

SEQ ID NO: 815133 - RNA, 19 nt, Homo sapiens
agagacauguuuccauuca

SEQ ID NO: 815134 - RNA, 19 nt, Homo sapiens
guugggaaaugaaaucugu

SEQ ID NO: 815135 - RNA, 19 nt, Homo sapiens
uuauugcuguugucacaua

SEQ ID NO: 815136 - RNA, 19 nt, Homo sapiens
agaacaaguuuaacgacaa

SEQ ID NO: 815137 - RNA, 19 nt, Homo sapiens
gggaaaugaaaucuguuua

SEQ ID NO: 815138 - RNA, 19 nt, Homo sapiens
gguggcucauguugaauuu

SEQ ID NO: 815139 - RNA, 19 nt, Homo sapiens
cugcaggcaucauucuuaa

SEQ ID NO: 815140 - RNA, 19 nt, Homo sapiens
gaagacugccauauuccaa

SEQ ID NO: 815141 - RNA, 19 nt, Homo sapiens
acacagauuguagagauua

SEQ ID NO: 815142 - RNA, 19 nt, Homo sapiens
uacaagaacuauccugagu

SEQ ID NO: 815143 - RNA, 19 nt, Homo sapiens
gugagcaaguucuauuugu

SEQ ID NO: 815144 - RNA, 19 nt, Homo sapiens
gagauggguucagugguau

SEQ ID NO: 815145 - RNA, 19 nt, Homo sapiens
uuagaaugguuaccuuaga

SEQ ID NO: 815146 - RNA, 19 nt, Homo sapiens
gcauuugccuuuuggguuu

SEQ ID NO: 815147 - RNA, 19 nt, Homo sapiens
gaggaauaauaugcaugua

SEQ ID NO: 815148 - RNA, 19 nt, Homo sapiens
augcugagcugguaaaaua

SEQ ID NO: 815149 - RNA, 19 nt, Homo sapiens
aaacagcacaaguggauga

SEQ ID NO: 815150 - RNA, 19 nt, Homo sapiens
ggaaaauguugggaaauga

SEQ ID NO: 815151 - RNA, 19 nt, Homo sapiens
auugaugacuguaaaguga

SEQ ID NO: 815152 - RNA, 19 nt, Homo sapiens
gcagagagggaucguucuu

SEQ ID NO: 815153 - RNA, 19 nt, Homo sapiens
uaacacugcagagaccuua

SEQ ID NO: 815154 - RNA, 19 nt, Homo sapiens
gaugauagaaacagcacaa

SEQ ID NO: 815155 - RNA, 19 nt, Homo sapiens
aagaguaaaccuugccaua

SEQ ID NO: 815156 - RNA, 19 nt, Homo sapiens
uauagcacguaguuuaugu

SEQ ID NO: 815157 - RNA, 19 nt, Homo sapiens
ccaaacagaacaaaggaau

SEQ ID NO: 815158 - RNA, 19 nt, Homo sapiens
auuagucccucauuagauu

SEQ ID NO: 815159 - RNA, 19 nt, Homo sapiens
ucauaggcuuuauaagaga

SEQ ID NO: 815160 - RNA, 19 nt, Homo sapiens
agagaugacuucugcugau

SEQ ID NO: 815161 - RNA, 19 nt, Homo sapiens
aggcaucauucuuaacaaa

SEQ ID NO: 815162 - RNA, 19 nt, Homo sapiens
gaauuggcauuuucuacaa

SEQ ID NO: 815163 - RNA, 19 nt, Homo sapiens
gguggagggugcuguucuu

SEQ ID NO: 815164 - RNA, 19 nt, Homo sapiens
aaggcgagguguacagauu

SEQ ID NO: 815165 - RNA, 19 nt, Homo sapiens
gaaauucacugguucuuua

SEQ ID NO: 815166 - RNA, 19 nt, Homo sapiens
gaaagaaacucugguauuu

SEQ ID NO: 815167 - RNA, 19 nt, Homo sapiens
gaacagacaucccuuucua

SEQ ID NO: 815168 - RNA, 19 nt, Homo sapiens
ggacuuaauucucagauuu

SEQ ID NO: 815169 - RNA, 19 nt, Homo sapiens
gaaacacaguucuacauuu

SEQ ID NO: 815170 - RNA, 19 nt, Homo sapiens
agaaagagcuugcaaauag

SEQ ID NO: 815171 - RNA, 19 nt, Homo sapiens
gcacuccacuaauauauuu

SEQ ID NO: 815172 - RNA, 19 nt, Homo sapiens
caugaaagcugggaaguua

SEQ ID NO: 815173 - RNA, 19 nt, Homo sapiens
ggagacaacuggcauauuc

SEQ ID NO: 815174 - RNA, 19 nt, Homo sapiens
ggacaucuguagaauauau

SEQ ID NO: 815175 - RNA, 19 nt, Homo sapiens
gaagacaauuucuguaaug

SEQ ID NO: 815176 - RNA, 19 nt, Homo sapiens
gaacauugcccuauugguu

SEQ ID NO: 815177 - RNA, 19 nt, Homo sapiens
caacauaggcuaaccugua

SEQ ID NO: 815178 - RNA, 19 nt, Homo sapiens
gagaaagucugauaugcuu

SEQ ID NO: 815179 - RNA, 19 nt, Homo sapiens
gaaggcugcuuguagaauu

SEQ ID NO: 815180 - RNA, 19 nt, Homo sapiens
uuacauugcuccagaagua

SEQ ID NO: 815181 - RNA, 19 nt, Homo sapiens
gaagaaggauuagcagaug

SEQ ID NO: 815182 - RNA, 19 nt, Homo sapiens
gaggaacacauaucauuua

SEQ ID NO: 815183 - RNA, 19 nt, Homo sapiens
gugaugaacuggaaagaaa

SEQ ID NO: 815184 - RNA, 19 nt, Homo sapiens
gcagaaacuuggaagaaga

SEQ ID NO: 815185 - RNA, 19 nt, Homo sapiens
ggaaagaaacucugguauu

SEQ ID NO: 815186 - RNA, 19 nt, Homo sapiens
acaacaaccuuuccuauga

SEQ ID NO: 815187 - RNA, 19 nt, Homo sapiens
uaucauggcugguuaacuu

SEQ ID NO: 815188 - RNA, 19 nt, Homo sapiens
gcugggaaguuaugaauga

SEQ ID NO: 815189 - RNA, 19 nt, Homo sapiens
ugaaacaccucaagaaaca

SEQ ID NO: 815190 - RNA, 19 nt, Homo sapiens
gaggugacaugaugacauu

SEQ ID NO: 815191 - RNA, 19 nt, Homo sapiens
uaacaccucuaaucaauuc

SEQ ID NO: 815192 - RNA, 19 nt, Homo sapiens
uaacugcacugcuuacaug

SEQ ID NO: 815193 - RNA, 19 nt, Homo sapiens
gcaaaguacccuugagauu

SEQ ID NO: 815194 - RNA, 19 nt, Homo sapiens
gauagaggucagcuuauua

SEQ ID NO: 815195 - RNA, 19 nt, Homo sapiens
guaaauggacuuauagaga

SEQ ID NO: 815196 - RNA, 19 nt, Homo sapiens
gcagacugguuacaacaaa

SEQ ID NO: 815197 - RNA, 19 nt, Homo sapiens
aaaguacccuugagauuga

SEQ ID NO: 815198 - RNA, 19 nt, Homo sapiens
gacaauuucuguaaugguu

SEQ ID NO: 815199 - RNA, 19 nt, Homo sapiens
aaacacaguucuacauuuc

SEQ ID NO: 815200 - RNA, 19 nt, Homo sapiens
ugagauaauugcaacauug

SEQ ID NO: 815201 - RNA, 19 nt, Homo sapiens
ggguaucucucuaagaauu

SEQ ID NO: 815202 - RNA, 19 nt, Homo sapiens
gaggucagcuuauuaaagg

SEQ ID NO: 815203 - RNA, 19 nt, Homo sapiens
gaaaauaaguguggaguau

SEQ ID NO: 815204 - RNA, 19 nt, Homo sapiens
gaaagagcuugcaaauagu

SEQ ID NO: 815205 - RNA, 19 nt, Homo sapiens
gaaacugauuuaccuaagu

SEQ ID NO: 815206 - RNA, 19 nt, Homo sapiens
gcagcaaucccuauagaaa

SEQ ID NO: 815207 - RNA, 19 nt, Homo sapiens
gccaaggacuuaauucuca

SEQ ID NO: 815208 - RNA, 19 nt, Homo sapiens
ggaaacacaguucuacauu

SEQ ID NO: 815209 - RNA, 19 nt, Homo sapiens
gaagaaagacaccuugaca

SEQ ID NO: 815210 - RNA, 19 nt, Homo sapiens
ggaaagagagcuauuaaaa

SEQ ID NO: 815211 - RNA, 19 nt, Homo sapiens
guugaguacuuauguguuu

SEQ ID NO: 815212 - RNA, 19 nt, Homo sapiens
gcaaaucuacacaagcuuu

SEQ ID NO: 815213 - RNA, 19 nt, Homo sapiens
ggacauggcauuauuuuaa

SEQ ID NO: 815214 - RNA, 19 nt, Homo sapiens
agacaaaguuuaacaccuu

SEQ ID NO: 815215 - RNA, 19 nt, Homo sapiens
uacacaaacuucacaguaa

SEQ ID NO: 815216 - RNA, 19 nt, Homo sapiens
ggaggaacacauaucauuu

SEQ ID NO: 815217 - RNA, 19 nt, Homo sapiens
aagauaacauucacccaua

SEQ ID NO: 815218 - RNA, 19 nt, Homo sapiens
ccacagaaccggacuacaa

SEQ ID NO: 815219 - RNA, 19 nt, Homo sapiens
ugagaaagccaaggacuua

SEQ ID NO: 815220 - RNA, 19 nt, Homo sapiens
caaaguacccuugagauug

SEQ ID NO: 815221 - RNA, 19 nt, Homo sapiens
cucaagcacuccacuaaua

SEQ ID NO: 815222 - RNA, 19 nt, Homo sapiens
gaaaagugaugaacuggaa

SEQ ID NO: 815223 - RNA, 19 nt, Homo sapiens
gaaagacaccuugacagaa

SEQ ID NO: 815224 - RNA, 19 nt, Homo sapiens
gcuccacaguguuucauaa

SEQ ID NO: 815225 - RNA, 19 nt, Homo sapiens
ugacagaucuuugauagag

SEQ ID NO: 815226 - RNA, 19 nt, Homo sapiens
caugaaggcugcuuguaga

SEQ ID NO: 815227 - RNA, 19 nt, Homo sapiens
guagauaacaauacacuga

SEQ ID NO: 815228 - RNA, 19 nt, Homo sapiens
gaaagccaaggacuuaauu

SEQ ID NO: 815229 - RNA, 19 nt, Homo sapiens
acaacacgcucgcaaagaa

SEQ ID NO: 815230 - RNA, 19 nt, Homo sapiens
ggccuaauguuugucauaa

SEQ ID NO: 815231 - RNA, 19 nt, Homo sapiens
gcaaagaauggccuaaugu

SEQ ID NO: 815232 - RNA, 19 nt, Homo sapiens
cauggaagaagaaggauua

SEQ ID NO: 815233 - RNA, 19 nt, Homo sapiens
gcaacauugucuaguucua

SEQ ID NO: 815234 - RNA, 19 nt, Homo sapiens
uaacaguucacuuccauuu

SEQ ID NO: 815235 - RNA, 19 nt, Homo sapiens
agacaucccuuucuaacug

SEQ ID NO: 815236 - RNA, 19 nt, Homo sapiens
gaaagucugauaugcuuga

SEQ ID NO: 815237 - RNA, 19 nt, Homo sapiens
ucacaacugaguagaauuu

SEQ ID NO: 815238 - RNA, 19 nt, Homo sapiens
guuagaacauugcccuauu

SEQ ID NO: 815239 - RNA, 19 nt, Homo sapiens
ggaagaagaaggauuagca

SEQ ID NO: 815240 - RNA, 19 nt, Homo sapiens
guaaggagugacaaguuua

SEQ ID NO: 815241 - RNA, 19 nt, Homo sapiens
aaagccaucuuccauaguu

SEQ ID NO: 815242 - RNA, 19 nt, Homo sapiens
gggaaguuaugaaugaaga

SEQ ID NO: 815243 - RNA, 19 nt, Homo sapiens
auagaaaucucacacacaa

SEQ ID NO: 815244 - RNA, 19 nt, Homo sapiens
ugauagaggucagcuuauu

SEQ ID NO: 815245 - RNA, 19 nt, Homo sapiens
uguaacaccucuaaucaau

SEQ ID NO: 815246 - RNA, 19 nt, Homo sapiens
aggaaauucuacaggauua

SEQ ID NO: 815247 - RNA, 19 nt, Homo sapiens
aaagacaccuugacagaag

SEQ ID NO: 815248 - RNA, 19 nt, Homo sapiens
gaauugcauaggagcauua

SEQ ID NO: 815249 - RNA, 19 nt, Homo sapiens
aagaggacauggcauuauu

SEQ ID NO: 815250 - RNA, 19 nt, Homo sapiens
gggucuagauaaucaguaa

SEQ ID NO: 815251 - RNA, 19 nt, Homo sapiens
cagcagcaaucccuauaga

SEQ ID NO: 815252 - RNA, 19 nt, Homo sapiens
gaguugaauuuaagacaug

SEQ ID NO: 815253 - RNA, 19 nt, Homo sapiens
uacguugcauucagaaaua

SEQ ID NO: 815254 - RNA, 19 nt, Homo sapiens
caagggucauguaaaauua

SEQ ID NO: 815255 - RNA, 19 nt, Homo sapiens
aaaguuacgucgaucacaa

SEQ ID NO: 815256 - RNA, 19 nt, Homo sapiens
caaagaauggccuaauguu

SEQ ID NO: 815257 - RNA, 19 nt, Homo sapiens
cagaaauacugaugaccuu

SEQ ID NO: 815258 - RNA, 19 nt, Homo sapiens
aguaaggagugacaaguuu

SEQ ID NO: 815259 - RNA, 19 nt, Homo sapiens
caagagaacucagguagcu

SEQ ID NO: 815260 - RNA, 19 nt, Homo sapiens
ggagugauuauguaugaaa

SEQ ID NO: 815261 - RNA, 19 nt, Homo sapiens
gaauagguaagauaugaga

SEQ ID NO: 815262 - RNA, 19 nt, Homo sapiens
gcuagugugauaaugaaua

SEQ ID NO: 815263 - RNA, 19 nt, Homo sapiens
aaagaauggccuaauguuu

SEQ ID NO: 815264 - RNA, 19 nt, Homo sapiens
cguagucuguauacucaua

SEQ ID NO: 815265 - RNA, 19 nt, Homo sapiens
gggaauaucuuggaaauaa

SEQ ID NO: 815266 - RNA, 19 nt, Homo sapiens
ggaaaggacuccaaccaaa

SEQ ID NO: 815267 - RNA, 19 nt, Homo sapiens
gaaggaagcugccaagaca

SEQ ID NO: 815268 - RNA, 19 nt, Homo sapiens
uaaagaagcugccaugaug

SEQ ID NO: 815269 - RNA, 19 nt, Homo sapiens
gaaagagcaugccuacaaa

SEQ ID NO: 815270 - RNA, 19 nt, Homo sapiens
ccaguacgcucuacagaua

SEQ ID NO: 815271 - RNA, 19 nt, Homo sapiens
ccaaagagguugagaaaca

SEQ ID NO: 815272 - RNA, 19 nt, Homo sapiens
gagaacagauggcagauau

SEQ ID NO: 815273 - RNA, 19 nt, Homo sapiens
gaaagaggaccauaaagaa

SEQ ID NO: 815274 - RNA, 19 nt, Homo sapiens
gaacggaauuacagaaguu

SEQ ID NO: 815275 - RNA, 19 nt, Homo sapiens
ggaaagagcaugccuacaa

SEQ ID NO: 815276 - RNA, 19 nt, Homo sapiens
gcaaacagcacaacugauu

SEQ ID NO: 815277 - RNA, 19 nt, Homo sapiens
gguauuagaugaucaagga

SEQ ID NO: 815278 - RNA, 19 nt, Homo sapiens
ucaaacagcugcagguauu

SEQ ID NO: 815279 - RNA, 19 nt, Homo sapiens
gaauauaguuacaggcaaa

SEQ ID NO: 815280 - RNA, 19 nt, Homo sapiens
ggacaagccugcacaccaa

SEQ ID NO: 815281 - RNA, 19 nt, Homo sapiens
gaaccaaguuugccucuca

SEQ ID NO: 815282 - RNA, 19 nt, Homo sapiens
uaaccaagaucguacauau

SEQ ID NO: 815283 - RNA, 19 nt, Homo sapiens
ggaaucaguuagaaugaaa

SEQ ID NO: 815284 - RNA, 19 nt, Homo sapiens
gaacagggcaguggaauga

SEQ ID NO: 815285 - RNA, 19 nt, Homo sapiens
gcagauacauggaacuuca

SEQ ID NO: 815286 - RNA, 19 nt, Homo sapiens
agaaguagauccuccagua

SEQ ID NO: 815287 - RNA, 19 nt, Homo sapiens
gaaagggccugugaauguu

SEQ ID NO: 815288 - RNA, 19 nt, Homo sapiens
caaggaaccugcagaaaca

SEQ ID NO: 815289 - RNA, 19 nt, Homo sapiens
ggagaaaucuggucaagac

SEQ ID NO: 815290 - RNA, 19 nt, Homo sapiens
ggacagagaagacaagcua

SEQ ID NO: 815291 - RNA, 19 nt, Homo sapiens
ugaaacaccugaacguaaa

SEQ ID NO: 815292 - RNA, 19 nt, Homo sapiens
guaauaaacugagcagaga

SEQ ID NO: 815293 - RNA, 19 nt, Homo sapiens
uaaauggaguuccucagua

SEQ ID NO: 815294 - RNA, 19 nt, Homo sapiens
gaacugccuuugcacuaaa

SEQ ID NO: 815295 - RNA, 19 nt, Homo sapiens
gaugaaagacucucuaguu

SEQ ID NO: 815296 - RNA, 19 nt, Homo sapiens
gagaaauuguggauauuga

SEQ ID NO: 815297 - RNA, 19 nt, Homo sapiens
gcugcuaccuuguauguuu

SEQ ID NO: 815298 - RNA, 19 nt, Homo sapiens
uuacacagcucaaucuuug

SEQ ID NO: 815299 - RNA, 19 nt, Homo sapiens
ccaaacagcauaauuaaga

SEQ ID NO: 815300 - RNA, 19 nt, Homo sapiens
ggaaugauccuuaugaaca

SEQ ID NO: 815301 - RNA, 19 nt, Homo sapiens
ggaaacagcagauggaaau

SEQ ID NO: 815302 - RNA, 19 nt, Homo sapiens
uauaaugccucuccuguga

SEQ ID NO: 815303 - RNA, 19 nt, Homo sapiens
aaagguggcuccagucauu

SEQ ID NO: 815304 - RNA, 19 nt, Homo sapiens
gaagaugaacuaaaucguu

SEQ ID NO: 815305 - RNA, 19 nt, Homo sapiens
gaaugauccuuaugaacaa

SEQ ID NO: 815306 - RNA, 19 nt, Homo sapiens
aaacagaacugccuuugca

SEQ ID NO: 815307 - RNA, 19 nt, Homo sapiens
caaagggucuaaagaagug

SEQ ID NO: 815308 - RNA, 19 nt, Homo sapiens
gaacagaaacgugacagaa

SEQ ID NO: 815309 - RNA, 19 nt, Homo sapiens
cagcacaacugauuccauu

SEQ ID NO: 815310 - RNA, 19 nt, Homo sapiens
gaaugaaaguaccaaagga

SEQ ID NO: 815311 - RNA, 19 nt, Homo sapiens
ggagagagagagacgcuua

SEQ ID NO: 815312 - RNA, 19 nt, Homo sapiens
gauacaagccuuaaagaug

SEQ ID NO: 815313 - RNA, 19 nt, Homo sapiens
ggaagugcauuaucaccuu

SEQ ID NO: 815314 - RNA, 19 nt, Homo sapiens
gagaauucgucccaagaaa

SEQ ID NO: 815315 - RNA, 19 nt, Homo sapiens
gaacaucccgaaccaaguu

SEQ ID NO: 815316 - RNA, 19 nt, Homo sapiens
ggaaggagaggcugaaaga

SEQ ID NO: 815317 - RNA, 19 nt, Homo sapiens
gcaaagggaacgagaaaga

SEQ ID NO: 815318 - RNA, 19 nt, Homo sapiens
gaacuugggauguguguau

SEQ ID NO: 815319 - RNA, 19 nt, Homo sapiens
gcccguauccucacaguua

SEQ ID NO: 815320 - RNA, 19 nt, Homo sapiens
aaacuggacagacuuaaua

SEQ ID NO: 815321 - RNA, 19 nt, Homo sapiens
aaagaaagccugugaggaa

SEQ ID NO: 815322 - RNA, 19 nt, Homo sapiens
agagaaagcugacaaagag

SEQ ID NO: 815323 - RNA, 19 nt, Homo sapiens
aaacaacucugagauacaa

SEQ ID NO: 815324 - RNA, 19 nt, Homo sapiens
gagagaagacguuaggaaa

SEQ ID NO: 815325 - RNA, 19 nt, Homo sapiens
aagagaacgugaaagauuu

SEQ ID NO: 815326 - RNA, 19 nt, Homo sapiens
gggauuggaugauacaguu

SEQ ID NO: 815327 - RNA, 19 nt, Homo sapiens
gaucaucgagcauuucaaa

SEQ ID NO: 815328 - RNA, 19 nt, Homo sapiens
ggguugugcuccugaguua

SEQ ID NO: 815329 - RNA, 19 nt, Homo sapiens
uaagaaagaggaccauaaa

SEQ ID NO: 815330 - RNA, 19 nt, Homo sapiens
gaaaaucggugggaauaaa

SEQ ID NO: 815331 - RNA, 19 nt, Homo sapiens
ggcagcggcucuagaagua

SEQ ID NO: 815332 - RNA, 19 nt, Homo sapiens
ggacaagacauuacgauca

SEQ ID NO: 815333 - RNA, 19 nt, Homo sapiens
cuacagaagucaaccaugu

SEQ ID NO: 815334 - RNA, 19 nt, Homo sapiens
gacaaacaacucugagaua

SEQ ID NO: 815335 - RNA, 19 nt, Homo sapiens
aaaggaggaugguuuauca

SEQ ID NO: 815336 - RNA, 19 nt, Homo sapiens
gaaaaccgcucuccuguca

SEQ ID NO: 815337 - RNA, 19 nt, Homo sapiens
cgaagauggugaacacaaa

SEQ ID NO: 815338 - RNA, 19 nt, Homo sapiens
uagaugggcuuucuucgaa

SEQ ID NO: 815339 - RNA, 19 nt, Homo sapiens
gacauuacgaucaggauua

SEQ ID NO: 815340 - RNA, 19 nt, Homo sapiens
ggguuucucuuuccucuuu

SEQ ID NO: 815341 - RNA, 19 nt, Homo sapiens
ggauggaucaugucgauuu

SEQ ID NO: 815342 - RNA, 19 nt, Homo sapiens
ggaacagagucguaggaaa

SEQ ID NO: 815343 - RNA, 19 nt, Homo sapiens
gucaggagcuugccaguau

SEQ ID NO: 815344 - RNA, 19 nt, Homo sapiens
gaaagccugugaggaaaga

SEQ ID NO: 815345 - RNA, 19 nt, Homo sapiens
gagagaaagcugacaaaga

SEQ ID NO: 815346 - RNA, 19 nt, Homo sapiens
gaaaucuggucaagacauc

SEQ ID NO: 815347 - RNA, 19 nt, Homo sapiens
gauaugggccugugguaaa

SEQ ID NO: 815348 - RNA, 19 nt, Homo sapiens
cgacauuucugccgauaug

SEQ ID NO: 815349 - RNA, 19 nt, Homo sapiens
gaaaguaaauggaguuccu

SEQ ID NO: 815350 - RNA, 19 nt, Homo sapiens
gagcggacuuuacaacaug

SEQ ID NO: 815351 - RNA, 19 nt, Homo sapiens
ucaccgggauguacaguuu

SEQ ID NO: 815352 - RNA, 19 nt, Homo sapiens
ugaaagggccugugaaugu

SEQ ID NO: 815353 - RNA, 19 nt, Homo sapiens
gaaagagagcuccauggaa

SEQ ID NO: 815354 - RNA, 19 nt, Homo sapiens
caaauaggcgugaaagaga

SEQ ID NO: 815355 - RNA, 19 nt, Homo sapiens
gaacagagucguaggaaac

SEQ ID NO: 815356 - RNA, 19 nt, Homo sapiens
aagcaaagccugcaucuga

SEQ ID NO: 815357 - RNA, 19 nt, Homo sapiens
gagcaaacagcacaacuga

SEQ ID NO: 815358 - RNA, 19 nt, Homo sapiens
cuaaaucccucucuucauc

SEQ ID NO: 815359 - RNA, 19 nt, Homo sapiens
uaaaucaggccaagagaaa

SEQ ID NO: 815360 - RNA, 19 nt, Homo sapiens
gcccaggaguuguaauaaa

SEQ ID NO: 815361 - RNA, 19 nt, Homo sapiens
aaagagaacgugaaagauu

SEQ ID NO: 815362 - RNA, 19 nt, Homo sapiens
gcagcaagaugccucaagu

SEQ ID NO: 815363 - RNA, 19 nt, Homo sapiens
gcugguagcugcugacaag

SEQ ID NO: 815364 - RNA, 19 nt, Homo sapiens
aaaccgcucuccugucaaa

SEQ ID NO: 815365 - RNA, 19 nt, Homo sapiens
gaacauagaugaguaaagu

SEQ ID NO: 815366 - RNA, 19 nt, Homo sapiens
gaacugguguguauccuaa

SEQ ID NO: 815367 - RNA, 19 nt, Homo sapiens
gaaguuaguugcauauuca

SEQ ID NO: 815368 - RNA, 19 nt, Homo sapiens
gaaagccacuccaccagua

SEQ ID NO: 815369 - RNA, 19 nt, Homo sapiens
gcaugucucugcucuauuu

SEQ ID NO: 815370 - RNA, 19 nt, Homo sapiens
gcaagcagcugacagugaa

SEQ ID NO: 815371 - RNA, 19 nt, Homo sapiens
ggacggcacuggcuccuuu

SEQ ID NO: 815372 - RNA, 19 nt, Homo sapiens
gagaggacauugcaccuuu

SEQ ID NO: 815373 - RNA, 19 nt, Homo sapiens
gaaaggagaugugcguguu

SEQ ID NO: 815374 - RNA, 19 nt, Homo sapiens
gaacgggacuccggaagaa

SEQ ID NO: 815375 - RNA, 19 nt, Homo sapiens
ucaaaugaaugccaagauu

SEQ ID NO: 815376 - RNA, 19 nt, Homo sapiens
gcacaucucuauaaaucau

SEQ ID NO: 815377 - RNA, 19 nt, Homo sapiens
ugaaggugcuguauauauu

SEQ ID NO: 815378 - RNA, 19 nt, Homo sapiens
gagguaaaguugugugcua

SEQ ID NO: 815379 - RNA, 19 nt, Homo sapiens
gaaagaaugcgaguacuug

SEQ ID NO: 815380 - RNA, 19 nt, Homo sapiens
ggacaucuuugacuacauc

SEQ ID NO: 815381 - RNA, 19 nt, Homo sapiens
ucaauugguuggaagagua

SEQ ID NO: 815382 - RNA, 19 nt, Homo sapiens
gcugagaguugcaauuguu

SEQ ID NO: 815383 - RNA, 19 nt, Homo sapiens
gaaacggugcagaauauuu

SEQ ID NO: 815384 - RNA, 19 nt, Homo sapiens
gcaauaauuuccuucugau

SEQ ID NO: 815385 - RNA, 19 nt, Homo sapiens
gaauguggcagguuagaaa

SEQ ID NO: 815386 - RNA, 19 nt, Homo sapiens
aaacggugcagaauauuua

SEQ ID NO: 815387 - RNA, 19 nt, Homo sapiens
gaacaggaaucccaaucag

SEQ ID NO: 815388 - RNA, 19 nt, Homo sapiens
gcauuugucucagaacauu

SEQ ID NO: 815389 - RNA, 19 nt, Homo sapiens
ggugacaguuugugacauu

SEQ ID NO: 815390 - RNA, 19 nt, Homo sapiens
cgccuacacuagugaauua

SEQ ID NO: 815391 - RNA, 19 nt, Homo sapiens
uuacuuugcucucaacauu

SEQ ID NO: 815392 - RNA, 19 nt, Homo sapiens
gaagaguguuggacuugug

SEQ ID NO: 815393 - RNA, 19 nt, Homo sapiens
cagagcacguuccuuguaa

SEQ ID NO: 815394 - RNA, 19 nt, Homo sapiens
ugaaugagcuauuuaaucc

SEQ ID NO: 815395 - RNA, 19 nt, Homo sapiens
gcaguauucucacccaugu

SEQ ID NO: 815396 - RNA, 19 nt, Homo sapiens
agaaagagaacauagauga

SEQ ID NO: 815397 - RNA, 19 nt, Homo sapiens
ugacccagcuguacauaug

SEQ ID NO: 815398 - RNA, 19 nt, Homo sapiens
gacaauugcucggcaguug

SEQ ID NO: 815399 - RNA, 19 nt, Homo sapiens
gagguggccuucccuuaug

SEQ ID NO: 815400 - RNA, 19 nt, Homo sapiens
gaguugcaauuguugguuu

SEQ ID NO: 815401 - RNA, 19 nt, Homo sapiens
aaaguugugugcuaucuug

SEQ ID NO: 815402 - RNA, 19 nt, Homo sapiens
guuugaauguggcagguua

SEQ ID NO: 815403 - RNA, 19 nt, Homo sapiens
gaguaggucuuacaucagu

SEQ ID NO: 815404 - RNA, 19 nt, Homo sapiens
caaagaaagagaacauaga

SEQ ID NO: 815405 - RNA, 19 nt, Homo sapiens
gcaaagaaagagaacauag

SEQ ID NO: 815406 - RNA, 19 nt, Homo sapiens
cauaccagcuccugagaga

SEQ ID NO: 815407 - RNA, 19 nt, Homo sapiens
cuauaaugcccucaacuua

SEQ ID NO: 815408 - RNA, 19 nt, Homo sapiens
gaaggugcuguauauauug

SEQ ID NO: 815409 - RNA, 19 nt, Homo sapiens
uguaauggcuucagugaca

SEQ ID NO: 815410 - RNA, 19 nt, Homo sapiens
caccugagaccacuucaua

SEQ ID NO: 815411 - RNA, 19 nt, Homo sapiens
uuucacaccucuuguuauu

SEQ ID NO: 815412 - RNA, 19 nt, Homo sapiens
aagagaacauagaugagua

SEQ ID NO: 815413 - RNA, 19 nt, Homo sapiens
gcaccugucuguccaucug

SEQ ID NO: 815414 - RNA, 19 nt, Homo sapiens
caucuacaauuccuccauu

SEQ ID NO: 815415 - RNA, 19 nt, Homo sapiens
gaacuuugugaauggauuu

SEQ ID NO: 815416 - RNA, 19 nt, Homo sapiens
ucuuagagauggagacauu

SEQ ID NO: 815417 - RNA, 19 nt, Homo sapiens
ugaaguuaguugcauauuc

SEQ ID NO: 815418 - RNA, 19 nt, Homo sapiens
ggccuucccuuaugaaaca

SEQ ID NO: 815419 - RNA, 19 nt, Homo sapiens
gcaauccucucuccgacau

SEQ ID NO: 815420 - RNA, 19 nt, Homo sapiens
gaaaagcuuugaccuggaa

SEQ ID NO: 815421 - RNA, 19 nt, Homo sapiens
aggaugaacugguguguau

SEQ ID NO: 815422 - RNA, 19 nt, Homo sapiens
cgacgcuccuguaaucauu

SEQ ID NO: 815423 - RNA, 19 nt, Homo sapiens
cgggugaggugcuggagua

SEQ ID NO: 815424 - RNA, 19 nt, Homo sapiens
acuuugcucucaacauuua

SEQ ID NO: 815425 - RNA, 19 nt, Homo sapiens
guuaauguuugcucuuaga

SEQ ID NO: 815426 - RNA, 19 nt, Homo sapiens
gaguggauccggaacauga

SEQ ID NO: 815427 - RNA, 19 nt, Homo sapiens
gccaugaacuauguccuuu

SEQ ID NO: 815428 - RNA, 19 nt, Homo sapiens
gagagagaaugucuuucau

SEQ ID NO: 815429 - RNA, 19 nt, Homo sapiens
ggaagauuguagccucguu

SEQ ID NO: 815430 - RNA, 19 nt, Homo sapiens
ugaacuauguccuuuacga

SEQ ID NO: 815431 - RNA, 19 nt, Homo sapiens
cagaauauuuacagugcaa

SEQ ID NO: 815432 - RNA, 19 nt, Homo sapiens
cagagaaggugcuugacau

SEQ ID NO: 815433 - RNA, 19 nt, Homo sapiens
aagaagguguuacagagaa

SEQ ID NO: 815434 - RNA, 19 nt, Homo sapiens
gauccuguacucuaauaaa

SEQ ID NO: 815435 - RNA, 19 nt, Homo sapiens
ugagaccacuucauagcaa

SEQ ID NO: 815436 - RNA, 19 nt, Homo sapiens
guagugagacauacaaauc

SEQ ID NO: 815437 - RNA, 19 nt, Homo sapiens
ugcaauaauuuccuucuga

SEQ ID NO: 815438 - RNA, 19 nt, Homo sapiens
gauccgguauccagaagau

SEQ ID NO: 815439 - RNA, 19 nt, Homo sapiens
gggcgacccuggacaucuu

SEQ ID NO: 815440 - RNA, 19 nt, Homo sapiens
gcccucaacuuauauaugc

SEQ ID NO: 815441 - RNA, 19 nt, Homo sapiens
cuguauauauugaccagua

SEQ ID NO: 815442 - RNA, 19 nt, Homo sapiens
ucuugaaggugcuguauau

SEQ ID NO: 815443 - RNA, 19 nt, Homo sapiens
ucagucaaauccaaaguca

SEQ ID NO: 815444 - RNA, 19 nt, Homo sapiens
uaaauaccgugugcucuuc

SEQ ID NO: 815445 - RNA, 19 nt, Homo sapiens
augaaacggugcagaauau

SEQ ID NO: 815446 - RNA, 19 nt, Homo sapiens
uaacguggagccucaagaa

SEQ ID NO: 815447 - RNA, 19 nt, Homo sapiens
ccuguacucuaauaaauca

SEQ ID NO: 815448 - RNA, 19 nt, Homo sapiens
gguauuugggcacuuuaua

SEQ ID NO: 815449 - RNA, 19 nt, Homo sapiens
gaaugccugcugcuuguuu

SEQ ID NO: 815450 - RNA, 19 nt, Homo sapiens
guaacugagcccagaguaa

SEQ ID NO: 815451 - RNA, 19 nt, Homo sapiens
guguuggacuugugugaaa

SEQ ID NO: 815452 - RNA, 19 nt, Homo sapiens
gcugguugccuccuacuaa

SEQ ID NO: 815453 - RNA, 19 nt, Homo sapiens
uaugaaacggugcagaaua

SEQ ID NO: 815454 - RNA, 19 nt, Homo sapiens
uaagagguauggcuauaac

SEQ ID NO: 815455 - RNA, 19 nt, Homo sapiens
uuaauccacuguccauguu

SEQ ID NO: 815456 - RNA, 19 nt, Homo sapiens
cagccugaaugagcuauuu

SEQ ID NO: 815457 - RNA, 19 nt, Homo sapiens
ucaguggcauggcuuguau

SEQ ID NO: 815458 - RNA, 19 nt, Homo sapiens
ggacggcuccugucgauac

SEQ ID NO: 815459 - RNA, 19 nt, Homo sapiens
gacaucagccucaaagaca

SEQ ID NO: 815460 - RNA, 19 nt, Homo sapiens
ggcaacagaagaucuuaaa

SEQ ID NO: 815461 - RNA, 19 nt, Homo sapiens
ggaggauuguacacuacuu

SEQ ID NO: 815462 - RNA, 19 nt, Homo sapiens
ccucaucagucaaauccaa

SEQ ID NO: 815463 - RNA, 19 nt, Homo sapiens
gguuucacaccucuuguua

SEQ ID NO: 815464 - RNA, 19 nt, Homo sapiens
gaucuggaguuugucuaug

SEQ ID NO: 815465 - RNA, 19 nt, Homo sapiens
gaacauagaugaguaaagu

SEQ ID NO: 815466 - RNA, 19 nt, Homo sapiens
gaacugguguguauccuaa

SEQ ID NO: 815467 - RNA, 19 nt, Homo sapiens
gaaguuaguugcauauuca

SEQ ID NO: 815468 - RNA, 19 nt, Homo sapiens
gaaagccacuccaccagua

SEQ ID NO: 815469 - RNA, 19 nt, Homo sapiens
gcaugucucugcucuauuu

SEQ ID NO: 815470 - RNA, 19 nt, Homo sapiens
gcaagcagcugacagugaa

SEQ ID NO: 815471 - RNA, 19 nt, Homo sapiens
ggacggcacuggcuccuuu

SEQ ID NO: 815472 - RNA, 19 nt, Homo sapiens
gagaggacauugcaccuuu

SEQ ID NO: 815473 - RNA, 19 nt, Homo sapiens
gaaaggagaugugcguguu

SEQ ID NO: 815474 - RNA, 19 nt, Homo sapiens
gaacgggacuccggaagaa

SEQ ID NO: 815475 - RNA, 19 nt, Homo sapiens
ucaaaugaaugccaagauu

SEQ ID NO: 815476 - RNA, 19 nt, Homo sapiens
gcacaucucuauaaaucau

SEQ ID NO: 815477 - RNA, 19 nt, Homo sapiens
ugaaggugcuguauauauu

SEQ ID NO: 815478 - RNA, 19 nt, Homo sapiens
gagguaaaguugugugcua

SEQ ID NO: 815479 - RNA, 19 nt, Homo sapiens
gaaagaaugcgaguacuug

SEQ ID NO: 815480 - RNA, 19 nt, Homo sapiens
ggacaucuuugacuacauc

SEQ ID NO: 815481 - RNA, 19 nt, Homo sapiens
ucaauugguuggaagagua

SEQ ID NO: 815482 - RNA, 19 nt, Homo sapiens
gcugagaguugcaauuguu

SEQ ID NO: 815483 - RNA, 19 nt, Homo sapiens
gaaacggugcagaauauuu

SEQ ID NO: 815484 - RNA, 19 nt, Homo sapiens
gcaauaauuuccuucugau

SEQ ID NO: 815485 - RNA, 19 nt, Homo sapiens
gaauguggcagguuagaaa

SEQ ID NO: 815486 - RNA, 19 nt, Homo sapiens
aaacggugcagaauauuua

SEQ ID NO: 815487 - RNA, 19 nt, Homo sapiens
gaacaggaaucccaaucag

SEQ ID NO: 815488 - RNA, 19 nt, Homo sapiens
gcauuugucucagaacauu

SEQ ID NO: 815489 - RNA, 19 nt, Homo sapiens
ggugacaguuugugacauu

SEQ ID NO: 815490 - RNA, 19 nt, Homo sapiens
cgccuacacuagugaauua

SEQ ID NO: 815491 - RNA, 19 nt, Homo sapiens
uuacuuugcucucaacauu

SEQ ID NO: 815492 - RNA, 19 nt, Homo sapiens
gaagaguguuggacuugug

SEQ ID NO: 815493 - RNA, 19 nt, Homo sapiens
cagagcacguuccuuguaa

SEQ ID NO: 815494 - RNA, 19 nt, Homo sapiens
ugaaugagcuauuuaaucc

SEQ ID NO: 815495 - RNA, 19 nt, Homo sapiens
gcaguauucucacccaugu

SEQ ID NO: 815496 - RNA, 19 nt, Homo sapiens
agaaagagaacauagauga

SEQ ID NO: 815497 - RNA, 19 nt, Homo sapiens
ugacccagcuguacauaug

SEQ ID NO: 815498 - RNA, 19 nt, Homo sapiens
gacaauugcucggcaguug

SEQ ID NO: 815499 - RNA, 19 nt, Homo sapiens
gagguggccuucccuuaug

SEQ ID NO: 815500 - RNA, 19 nt, Homo sapiens
gaguugcaauuguugguuu

SEQ ID NO: 815501 - RNA, 19 nt, Homo sapiens
aaaguugugugcuaucuug

SEQ ID NO: 815502 - RNA, 19 nt, Homo sapiens
guuugaauguggcagguua

SEQ ID NO: 815503 - RNA, 19 nt, Homo sapiens
gaguaggucuuacaucagu

SEQ ID NO: 815504 - RNA, 19 nt, Homo sapiens
caaagaaagagaacauaga

SEQ ID NO: 815505 - RNA, 19 nt, Homo sapiens
gcaaagaaagagaacauag

SEQ ID NO: 815506 - RNA, 19 nt, Homo sapiens
cauaccagcuccugagaga

SEQ ID NO: 815507 - RNA, 19 nt, Homo sapiens
cuauaaugcccucaacuua

SEQ ID NO: 815508 - RNA, 19 nt, Homo sapiens
gaaggugcuguauauauug

SEQ ID NO: 815509 - RNA, 19 nt, Homo sapiens
uguaauggcuucagugaca

SEQ ID NO: 815510 - RNA, 19 nt, Homo sapiens
caccugagaccacuucaua

SEQ ID NO: 815511 - RNA, 19 nt, Homo sapiens
uuucacaccucuuguuauu

SEQ ID NO: 815512 - RNA, 19 nt, Homo sapiens
aagagaacauagaugagua

SEQ ID NO: 815513 - RNA, 19 nt, Homo sapiens
gcaccugucuguccaucug

SEQ ID NO: 815514 - RNA, 19 nt, Homo sapiens
caucuacaauuccuccauu

SEQ ID NO: 815515 - RNA, 19 nt, Homo sapiens
gaacuuugugaauggauuu

SEQ ID NO: 815516 - RNA, 19 nt, Homo sapiens
ucuuagagauggagacauu

SEQ ID NO: 815517 - RNA, 19 nt, Homo sapiens
ugaaguuaguugcauauuc

SEQ ID NO: 815518 - RNA, 19 nt, Homo sapiens
ggccuucccuuaugaaaca

SEQ ID NO: 815519 - RNA, 19 nt, Homo sapiens
gcaauccucucuccgacau

SEQ ID NO: 815520 - RNA, 19 nt, Homo sapiens
gaaaagcuuugaccuggaa

SEQ ID NO: 815521 - RNA, 19 nt, Homo sapiens
aggaugaacugguguguau

SEQ ID NO: 815522 - RNA, 19 nt, Homo sapiens
cgacgcuccuguaaucauu

SEQ ID NO: 815523 - RNA, 19 nt, Homo sapiens
cgggugaggugcuggagua

SEQ ID NO: 815524 - RNA, 19 nt, Homo sapiens
acuuugcucucaacauuua

SEQ ID NO: 815525 - RNA, 19 nt, Homo sapiens
guuaauguuugcucuuaga

SEQ ID NO: 815526 - RNA, 19 nt, Homo sapiens
gaguggauccggaacauga

SEQ ID NO: 815527 - RNA, 19 nt, Homo sapiens
gccaugaacuauguccuuu

SEQ ID NO: 815528 - RNA, 19 nt, Homo sapiens
gagagagaaugucuuucau

SEQ ID NO: 815529 - RNA, 19 nt, Homo sapiens
ggaagauuguagccucguu

SEQ ID NO: 815530 - RNA, 19 nt, Homo sapiens
ugaacuauguccuuuacga

SEQ ID NO: 815531 - RNA, 19 nt, Homo sapiens
cagaauauuuacagugcaa

SEQ ID NO: 815532 - RNA, 19 nt, Homo sapiens
aagaagguguuacagagaa

SEQ ID NO: 815533 - RNA, 19 nt, Homo sapiens
gauccuguacucuaauaaa

SEQ ID NO: 815534 - RNA, 19 nt, Homo sapiens
ugagaccacuucauagcaa

SEQ ID NO: 815535 - RNA, 19 nt, Homo sapiens
guagugagacauacaaauc

SEQ ID NO: 815536 - RNA, 19 nt, Homo sapiens
ugcaauaauuuccuucuga

SEQ ID NO: 815537 - RNA, 19 nt, Homo sapiens
gauccgguauccagaagau

SEQ ID NO: 815538 - RNA, 19 nt, Homo sapiens
gggcgacccuggacaucuu

SEQ ID NO: 815539 - RNA, 19 nt, Homo sapiens
gcccucaacuuauauaugc

SEQ ID NO: 815540 - RNA, 19 nt, Homo sapiens
cuguauauauugaccagua

SEQ ID NO: 815541 - RNA, 19 nt, Homo sapiens
ucuugaaggugcuguauau

SEQ ID NO: 815542 - RNA, 19 nt, Homo sapiens
ucagucaaauccaaaguca

SEQ ID NO: 815543 - RNA, 19 nt, Homo sapiens
uaaauaccgugugcucuuc

SEQ ID NO: 815544 - RNA, 19 nt, Homo sapiens
augaaacggugcagaauau

SEQ ID NO: 815545 - RNA, 19 nt, Homo sapiens
uaacguggagccucaagaa

SEQ ID NO: 815546 - RNA, 19 nt, Homo sapiens
ccuguacucuaauaaauca

SEQ ID NO: 815547 - RNA, 19 nt, Homo sapiens
gguauuugggcacuuuaua

SEQ ID NO: 815548 - RNA, 19 nt, Homo sapiens
gaaugccugcugcuuguuu

SEQ ID NO: 815549 - RNA, 19 nt, Homo sapiens
guaacugagcccagaguaa

SEQ ID NO: 815550 - RNA, 19 nt, Homo sapiens
guguuggacuugugugaaa

SEQ ID NO: 815551 - RNA, 19 nt, Homo sapiens
gcugguugccuccuacuaa

SEQ ID NO: 815552 - RNA, 19 nt, Homo sapiens
uaugaaacggugcagaaua

SEQ ID NO: 815553 - RNA, 19 nt, Homo sapiens
uaagagguauggcuauaac

SEQ ID NO: 815554 - RNA, 19 nt, Homo sapiens
uuaauccacuguccauguu

SEQ ID NO: 815555 - RNA, 19 nt, Homo sapiens
cagccugaaugagcuauuu

SEQ ID NO: 815556 - RNA, 19 nt, Homo sapiens
ucaguggcauggcuuguau

SEQ ID NO: 815557 - RNA, 19 nt, Homo sapiens
ggacggcuccugucgauac

SEQ ID NO: 815558 - RNA, 19 nt, Homo sapiens
gacaucagccucaaagaca

SEQ ID NO: 815559 - RNA, 19 nt, Homo sapiens
ggcaacagaagaucuuaaa

SEQ ID NO: 815560 - RNA, 19 nt, Homo sapiens
ggaggauuguacacuacuu

SEQ ID NO: 815561 - RNA, 19 nt, Homo sapiens
ccucaucagucaaauccaa

SEQ ID NO: 815562 - RNA, 19 nt, Homo sapiens
gguuucacaccucuuguua

SEQ ID NO: 815563 - RNA, 19 nt, Homo sapiens
gaucuggaguuugucuaug

SEQ ID NO: 815564 - RNA, 19 nt, Homo sapiens
ucagagcacguuccuugua

SEQ ID NO: 815565 - RNA, 19 nt, Homo sapiens
ggacauacuuugugcaaua

SEQ ID NO: 815566 - RNA, 19 nt, Homo sapiens
gaaaguacaucgccuucua

SEQ ID NO: 815567 - RNA, 19 nt, Homo sapiens
gggaaagaaucaacaguua

SEQ ID NO: 815568 - RNA, 19 nt, Homo sapiens
uaaaggagcugcaggagaa

SEQ ID NO: 815569 - RNA, 19 nt, Homo sapiens
ggaaggagcuggagagagu

SEQ ID NO: 815570 - RNA, 19 nt, Homo sapiens
ggucuuugcuguuugauuu

SEQ ID NO: 815571 - RNA, 19 nt, Homo sapiens
ggaauaggcucccgugcuu

SEQ ID NO: 815572 - RNA, 19 nt, Homo sapiens
gauauggucuuugcuguuu

SEQ ID NO: 815573 - RNA, 19 nt, Homo sapiens
ggaaacaugucuauacgau

SEQ ID NO: 815574 - RNA, 19 nt, Homo sapiens
gugaaugucuguauuauca

SEQ ID NO: 815575 - RNA, 19 nt, Homo sapiens
uaacggaaauacugaaaga

SEQ ID NO: 815576 - RNA, 19 nt, Homo sapiens
gagcuacucaugauuauuu

SEQ ID NO: 815577 - RNA, 19 nt, Homo sapiens
acagugagcucuucuauag

SEQ ID NO: 815578 - RNA, 19 nt, Homo sapiens
ggaccuguaucacaugaaa

SEQ ID NO: 815579 - RNA, 19 nt, Homo sapiens
uaacagauuugccggcauu

SEQ ID NO: 815580 - RNA, 19 nt, Homo sapiens
ccaauggaauaacagauuu

SEQ ID NO: 815581 - RNA, 19 nt, Homo sapiens
ucacaaacuucuuuacgaa

SEQ ID NO: 815582 - RNA, 19 nt, Homo sapiens
ggaaagaaucaacaguuaa

SEQ ID NO: 815583 - RNA, 19 nt, Homo sapiens
gcaggagguuugcacauug

SEQ ID NO: 815584 - RNA, 19 nt, Homo sapiens
ggagagagaucaauaugcu

SEQ ID NO: 815585 - RNA, 19 nt, Homo sapiens
gcucugggcucaugaagau

SEQ ID NO: 815586 - RNA, 19 nt, Homo sapiens
gcaguucccuuuggauuug

SEQ ID NO: 815587 - RNA, 19 nt, Homo sapiens
gcucuucuauagcucaaua

SEQ ID NO: 815588 - RNA, 19 nt, Homo sapiens
gaaagcaaacaaugagaaa

SEQ ID NO: 815589 - RNA, 19 nt, Homo sapiens
gcacuuggcagccucauga

SEQ ID NO: 815590 - RNA, 19 nt, Homo sapiens
ggauguccauuacagaauu

SEQ ID NO: 815591 - RNA, 19 nt, Homo sapiens
gaaggagucgcuuaaagaa

SEQ ID NO: 815592 - RNA, 19 nt, Homo sapiens
gacaaaggguccaagauag

SEQ ID NO: 815593 - RNA, 19 nt, Homo sapiens
caacugacucuuccaaauu

SEQ ID NO: 815594 - RNA, 19 nt, Homo sapiens
gaaacauucucucagauac

SEQ ID NO: 815595 - RNA, 19 nt, Homo sapiens
gaacagccacuucccauca

SEQ ID NO: 815596 - RNA, 19 nt, Homo sapiens
ugauagaggugguauuguu

SEQ ID NO: 815597 - RNA, 19 nt, Homo sapiens
caugaaacauucucucaga

SEQ ID NO: 815598 - RNA, 19 nt, Homo sapiens
cuaauuaacagucguauga

SEQ ID NO: 815599 - RNA, 19 nt, Homo sapiens
gagagaaguuggcacaaag

SEQ ID NO: 815600 - RNA, 19 nt, Homo sapiens
gauaagaaccgugagagaa

SEQ ID NO: 815601 - RNA, 19 nt, Homo sapiens
caaauccaguuucagaaug

SEQ ID NO: 815602 - RNA, 19 nt, Homo sapiens
gcaaucuacuguuugugaa

SEQ ID NO: 815603 - RNA, 19 nt, Homo sapiens
ucagauacuuugaagaaga

SEQ ID NO: 815604 - RNA, 19 nt, Homo sapiens
gagagcagcaauacgauuu

SEQ ID NO: 815605 - RNA, 19 nt, Homo sapiens
uaacaggagagcagcaaua

SEQ ID NO: 815606 - RNA, 19 nt, Homo sapiens
gaauuagagugaaggaaag

SEQ ID NO: 815607 - RNA, 19 nt, Homo sapiens
guuaaucuccuacacaauu

SEQ ID NO: 815608 - RNA, 19 nt, Homo sapiens
gaguuuaaaugucucugaa

SEQ ID NO: 815609 - RNA, 19 nt, Homo sapiens
uagcaugcauaucgaguuu

SEQ ID NO: 815610 - RNA, 19 nt, Homo sapiens
gagauaaacaccaccauca

SEQ ID NO: 815611 - RNA, 19 nt, Homo sapiens
cgacaagcauggugaucuu

SEQ ID NO: 815612 - RNA, 19 nt, Homo sapiens
gguauuguuugacuuguau

SEQ ID NO: 815613 - RNA, 19 nt, Homo sapiens
agaaacaaguggaacauca

SEQ ID NO: 815614 - RNA, 19 nt, Homo sapiens
guucugcuaugauguuuga

SEQ ID NO: 815615 - RNA, 19 nt, Homo sapiens
ugaaacauucucucagaua

SEQ ID NO: 815616 - RNA, 19 nt, Homo sapiens
ugagagaaguuggcacaaa

SEQ ID NO: 815617 - RNA, 19 nt, Homo sapiens
gaaggaaagcugugugaca

SEQ ID NO: 815618 - RNA, 19 nt, Homo sapiens
gcuaugauguuugaucuca

SEQ ID NO: 815619 - RNA, 19 nt, Homo sapiens
gagaaagaaaugccaauuc

SEQ ID NO: 815620 - RNA, 19 nt, Homo sapiens
uuacacaaauccaguuuca

SEQ ID NO: 815621 - RNA, 19 nt, Homo sapiens
aaacagccuuuccuccauu

SEQ ID NO: 815622 - RNA, 19 nt, Homo sapiens
guacauggccugcugucaa

SEQ ID NO: 815623 - RNA, 19 nt, Homo sapiens
ggguuaaucuccuacacaa

SEQ ID NO: 815624 - RNA, 19 nt, Homo sapiens
gaaacuggaacuuggauuc

SEQ ID NO: 815625 - RNA, 19 nt, Homo sapiens
gaggagaagaagcaugaua

SEQ ID NO: 815626 - RNA, 19 nt, Homo sapiens
gauagaggugguauuguuu

SEQ ID NO: 815627 - RNA, 19 nt, Homo sapiens
gaccaaauaaugcggcuaa

SEQ ID NO: 815628 - RNA, 19 nt, Homo sapiens
ucaacugacucuuccaaau

SEQ ID NO: 815629 - RNA, 19 nt, Homo sapiens
uuagagcuacucaugauua

SEQ ID NO: 815630 - RNA, 19 nt, Homo sapiens
guacaucgccuucuaacag

SEQ ID NO: 815631 - RNA, 19 nt, Homo sapiens
gcaguuagagcaguccaua

SEQ ID NO: 815632 - RNA, 19 nt, Homo sapiens
ugaaagagggcagauauug

SEQ ID NO: 815633 - RNA, 19 nt, Homo sapiens
gaaugcauuucaaucauac

SEQ ID NO: 815634 - RNA, 19 nt, Homo sapiens
ugaauuagagugaaggaaa

SEQ ID NO: 815635 - RNA, 19 nt, Homo sapiens
gugaagaucauaagaaauc

SEQ ID NO: 815636 - RNA, 19 nt, Homo sapiens
acacaaauccaguuucaga

SEQ ID NO: 815637 - RNA, 19 nt, Homo sapiens
gccuaugcaugaugaauga

SEQ ID NO: 815638 - RNA, 19 nt, Homo sapiens
guggugcaaucuacuguuu

SEQ ID NO: 815639 - RNA, 19 nt, Homo sapiens
ugagaguacuuaguugaaa

SEQ ID NO: 815640 - RNA, 19 nt, Homo sapiens
caagaaugaauuagaguga

SEQ ID NO: 815641 - RNA, 19 nt, Homo sapiens
gugcacuguuuauuacuuu

SEQ ID NO: 815642 - RNA, 19 nt, Homo sapiens
cuaauguucugcuaugaug

SEQ ID NO: 815643 - RNA, 19 nt, Homo sapiens
gagcuuguccagacucaaa

SEQ ID NO: 815644 - RNA, 19 nt, Homo sapiens
ugaaggagucgcuuaaaga

SEQ ID NO: 815645 - RNA, 19 nt, Homo sapiens
gaagaaauggugggaagga

SEQ ID NO: 815646 - RNA, 19 nt, Homo sapiens
gauauuggguccuuguaac

SEQ ID NO: 815647 - RNA, 19 nt, Homo sapiens
gaaagagggcagauauugg

SEQ ID NO: 815648 - RNA, 19 nt, Homo sapiens
gcacauugaaggaggagaa

SEQ ID NO: 815649 - RNA, 19 nt, Homo sapiens
gaaaagaaagcaaacaaug

SEQ ID NO: 815650 - RNA, 19 nt, Homo sapiens
gaugaugcuugggaaagaa

SEQ ID NO: 815651 - RNA, 19 nt, Homo sapiens
gggcagauauuggguccuu

SEQ ID NO: 815652 - RNA, 19 nt, Homo sapiens
ugacauaggaauuuacuuc

SEQ ID NO: 815653 - RNA, 19 nt, Homo sapiens
gaaaggcugccaucauugg

SEQ ID NO: 815654 - RNA, 19 nt, Homo sapiens
gauaaacaccaccaucauc

SEQ ID NO: 815655 - RNA, 19 nt, Homo sapiens
aacaucagcuggaagaaga

SEQ ID NO: 815656 - RNA, 19 nt, Homo sapiens
ugaaacaacagaagaaaca

SEQ ID NO: 815657 - RNA, 19 nt, Homo sapiens
caaaggaguuaugggacaa

SEQ ID NO: 815658 - RNA, 19 nt, Homo sapiens
cagaauguguaacggaaau

SEQ ID NO: 815659 - RNA, 19 nt, Homo sapiens
aaauccaguuucagaauga

SEQ ID NO: 815660 - RNA, 19 nt, Homo sapiens
gaaguucuaaugucugugu

SEQ ID NO: 815661 - RNA, 19 nt, Homo sapiens
gacauacuuugugcaauau

SEQ ID NO: 815662 - RNA, 19 nt, Homo sapiens
cauacaggcucuagucaag

SEQ ID NO: 815663 - RNA, 19 nt, Homo sapiens
gaguucguguucccuguuu

SEQ ID NO: 815664 - RNA, 19 nt, Homo sapiens
gagaagaaggagauaaaca

SEQ ID NO: 815665 - RNA, 19 nt, Homo sapiens
uuaaagacccucugcauua

SEQ ID NO: 815666 - RNA, 19 nt, Homo sapiens
gcucaacuguggauuguuu

SEQ ID NO: 815667 - RNA, 19 nt, Homo sapiens
ggaaugugguggaaauuug

SEQ ID NO: 815668 - RNA, 19 nt, Homo sapiens
uaaaagcagugucgacuua

SEQ ID NO: 815669 - RNA, 19 nt, Homo sapiens
uguaaaggcugcucucuuc

SEQ ID NO: 815670 - RNA, 19 nt, Homo sapiens
aaacugaugugguguccaa

SEQ ID NO: 815671 - RNA, 19 nt, Homo sapiens
uuaaaccgguucguauaua

SEQ ID NO: 815672 - RNA, 19 nt, Homo sapiens
uaaaccgguucguauauau

SEQ ID NO: 815673 - RNA, 19 nt, Homo sapiens
ggaguucuuuguugacugu

SEQ ID NO: 815674 - RNA, 19 nt, Homo sapiens
ggucgaaggacauugaauu

SEQ ID NO: 815675 - RNA, 19 nt, Homo sapiens
uaaagacccucugcauuag

SEQ ID NO: 815676 - RNA, 19 nt, Homo sapiens
gguggaaauuuguuugaug

SEQ ID NO: 815677 - RNA, 19 nt, Homo sapiens
gcaccgagaucgcuaacac

SEQ ID NO: 815678 - RNA, 19 nt, Homo sapiens
gcugcucucuucaauacaa

SEQ ID NO: 815679 - RNA, 19 nt, Homo sapiens
uaaaggcuauuuucuggua

SEQ ID NO: 815680 - RNA, 19 nt, Homo sapiens
gacuaaguguggagaaugu

SEQ ID NO: 815681 - RNA, 19 nt, Homo sapiens
cgaauuuacagcagcauuu

SEQ ID NO: 815682 - RNA, 19 nt, Homo sapiens
gaagguagaggaggugaug

SEQ ID NO: 815683 - RNA, 19 nt, Homo sapiens
cagcagcauuuguacaugu

SEQ ID NO: 815684 - RNA, 19 nt, Homo sapiens
aaagcagugucgacuuaaa

SEQ ID NO: 815685 - RNA, 19 nt, Homo sapiens
ccauuuccauugcuguaaa

SEQ ID NO: 815686 - RNA, 19 nt, Homo sapiens
gcacugcuggguucucuau

SEQ ID NO: 815687 - RNA, 19 nt, Homo sapiens
caaaugaaggcuacuugga

SEQ ID NO: 815688 - RNA, 19 nt, Homo sapiens
acauugaauugucagauga

SEQ ID NO: 815689 - RNA, 19 nt, Homo sapiens
gaauuuacagcagcauuug

SEQ ID NO: 815690 - RNA, 19 nt, Homo sapiens
cuaccgaugugucgaagug

SEQ ID NO: 815691 - RNA, 19 nt, Homo sapiens
cagcauuuguacauguaaa

SEQ ID NO: 815692 - RNA, 19 nt, Homo sapiens
ggacuaccgaugugucgaa

SEQ ID NO: 815693 - RNA, 19 nt, Homo sapiens
gcacaucaacugcucaacu

SEQ ID NO: 815694 - RNA, 19 nt, Homo sapiens
ucucuucaauacaaggaua

SEQ ID NO: 815695 - RNA, 19 nt, Homo sapiens
cacaucaacugcucaacug

SEQ ID NO: 815696 - RNA, 19 nt, Homo sapiens
ggaguugugacgugcauga

SEQ ID NO: 815697 - RNA, 19 nt, Homo sapiens
aaaggcugcucucuucaau

SEQ ID NO: 815698 - RNA, 19 nt, Homo sapiens
gaaugugguggaaauuugu

SEQ ID NO: 815699 - RNA, 19 nt, Homo sapiens
caagagacagaaaguugga

SEQ ID NO: 815700 - RNA, 19 nt, Homo sapiens
uaaaggcugcucucuucaa

SEQ ID NO: 815701 - RNA, 19 nt, Homo sapiens
ggacgccgaagcuggagaa

SEQ ID NO: 815702 - RNA, 19 nt, Homo sapiens
cccaagagacagaaaguug

SEQ ID NO: 815703 - RNA, 19 nt, Homo sapiens
gugucgaaguggaaacuga

SEQ ID NO: 815704 - RNA, 19 nt, Homo sapiens
aggcugcucucuucaauac

SEQ ID NO: 815705 - RNA, 19 nt, Homo sapiens
ucuggaaugugguggaaau

SEQ ID NO: 815706 - RNA, 19 nt, Homo sapiens
cuacuuggaguucuuuguu

SEQ ID NO: 815707 - RNA, 19 nt, Homo sapiens
gaagcuggagaaaccaaau

SEQ ID NO: 815708 - RNA, 19 nt, Homo sapiens
ugacgugcaugaggaaagu

SEQ ID NO: 815709 - RNA, 19 nt, Homo sapiens
gggagugaaagcagaaaug

SEQ ID NO: 815710 - RNA, 19 nt, Homo sapiens
cggagaagguguacaucgu

SEQ ID NO: 815711 - RNA, 19 nt, Homo sapiens
auaccaaggguucgaguuu

SEQ ID NO: 815712 - RNA, 19 nt, Homo sapiens
cuuaaagacccucugcauu

SEQ ID NO: 815713 - RNA, 19 nt, Homo sapiens
gcgaggcggagaaggugua

SEQ ID NO: 815714 - RNA, 19 nt, Homo sapiens
gucacucugugcaagauug

SEQ ID NO: 815715 - RNA, 19 nt, Homo sapiens
ggagugaaagcagaaaugg

SEQ ID NO: 815716 - RNA, 19 nt, Homo sapiens
gcaagcgugugggcaaggu

SEQ ID NO: 815717 - RNA, 19 nt, Homo sapiens
gucgaaggacauugaauug

SEQ ID NO: 815718 - RNA, 19 nt, Homo sapiens
guucuuuguugacuguuca

SEQ ID NO: 815719 - RNA, 19 nt, Homo sapiens
aaaccgguucguauauauu

SEQ ID NO: 815720 - RNA, 19 nt, Homo sapiens
caacugcucaacuguggau

SEQ ID NO: 815721 - RNA, 19 nt, Homo sapiens
ggacccagagagcaucuuc

SEQ ID NO: 815722 - RNA, 19 nt, Homo sapiens
ggaagaccuccguguggau

SEQ ID NO: 815723 - RNA, 19 nt, Homo sapiens
gaaggcuacuuggaguucu

SEQ ID NO: 815724 - RNA, 19 nt, Homo sapiens
caucuuggugggagugaaa

SEQ ID NO: 815725 - RNA, 19 nt, Homo sapiens
gagacagaaaguuggauuc

SEQ ID NO: 815726 - RNA, 19 nt, Homo sapiens
gcagcauuuguacauguaa

SEQ ID NO: 815727 - RNA, 19 nt, Homo sapiens
gaagguguacaucgugcau

SEQ ID NO: 815728 - RNA, 19 nt, Homo sapiens
cgacuaaguguggagaaug

SEQ ID NO: 815729 - RNA, 19 nt, Homo sapiens
ucagaugacccuuaugacu

SEQ ID NO: 815730 - RNA, 19 nt, Homo sapiens
gauaccaaggguucgaguu

SEQ ID NO: 815731 - RNA, 19 nt, Homo sapiens
guaaaggcugcucucuuca

SEQ ID NO: 815732 - RNA, 19 nt, Homo sapiens
gaugugcugcuucuggaau

SEQ ID NO: 815733 - RNA, 19 nt, Homo sapiens
acuuggaguucuuuguuga

SEQ ID NO: 815734 - RNA, 19 nt, Homo sapiens
uacuuggaguucuuuguug

SEQ ID NO: 815735 - RNA, 19 nt, Homo sapiens
aaccgguucguauauauuu

SEQ ID NO: 815736 - RNA, 19 nt, Homo sapiens
uggaaugugguggaaauuu

SEQ ID NO: 815737 - RNA, 19 nt, Homo sapiens
cgccgaagcuggagaaacc

SEQ ID NO: 815738 - RNA, 19 nt, Homo sapiens
agcagcauuuguacaugua

SEQ ID NO: 815739 - RNA, 19 nt, Homo sapiens
ugugaggacuaccgaugug

SEQ ID NO: 815740 - RNA, 19 nt, Homo sapiens
ggauuccugggaugauuug

SEQ ID NO: 815741 - RNA, 19 nt, Homo sapiens
cugcucaacuguggauugu

SEQ ID NO: 815742 - RNA, 19 nt, Homo sapiens
cgaaguggaaacugaugug

SEQ ID NO: 815743 - RNA, 19 nt, Homo sapiens
agagacagaaaguuggauu

SEQ ID NO: 815744 - RNA, 19 nt, Homo sapiens
gcuggagaaaccaaaugaa

SEQ ID NO: 815745 - RNA, 19 nt, Homo sapiens
cagcugggaugaccaagaa

SEQ ID NO: 815746 - RNA, 19 nt, Homo sapiens
uuggagcccucaacauuua

SEQ ID NO: 815747 - RNA, 19 nt, Homo sapiens
ucagaaaggucuacaccau

SEQ ID NO: 815748 - RNA, 19 nt, Homo sapiens
gacaucaucuauaucuuca

SEQ ID NO: 815749 - RNA, 19 nt, Homo sapiens
caugagcucuucaccacuu

SEQ ID NO: 815750 - RNA, 19 nt, Homo sapiens
gcugagcccugaggaguau

SEQ ID NO: 815751 - RNA, 19 nt, Homo sapiens
gcaggugcauggcgagaag

SEQ ID NO: 815752 - RNA, 19 nt, Homo sapiens
gugcuucucaugacucuuu

SEQ ID NO: 815753 - RNA, 19 nt, Homo sapiens
caacauuuaccuagacauc

SEQ ID NO: 815754 - RNA, 19 nt, Homo sapiens
ucguggcucucuuuacuuu

SEQ ID NO: 815755 - RNA, 19 nt, Homo sapiens
gagaccagauauaaaacua

SEQ ID NO: 815756 - RNA, 19 nt, Homo sapiens
ccuccuacccuuccaauau

SEQ ID NO: 815757 - RNA, 19 nt, Homo sapiens
acugggagcggguguauuu

SEQ ID NO: 815758 - RNA, 19 nt, Homo sapiens
gacccuggcuugcuguucu

SEQ ID NO: 815759 - RNA, 19 nt, Homo sapiens
cgucgagucuuugucagaa

SEQ ID NO: 815760 - RNA, 19 nt, Homo sapiens
gggaugaccaagaaaguuc

SEQ ID NO: 815761 - RNA, 19 nt, Homo sapiens
ccaccguccuccagagaau

SEQ ID NO: 815762 - RNA, 19 nt, Homo sapiens
gaaagcucuccguggcuaa

SEQ ID NO: 815763 - RNA, 19 nt, Homo sapiens
ucaucuauaucuucaccuu

SEQ ID NO: 815764 - RNA, 19 nt, Homo sapiens
gcacugggagcggguguau

SEQ ID NO: 815765 - RNA, 19 nt, Homo sapiens
agacaucaucuauaucuuc

SEQ ID NO: 815766 - RNA, 19 nt, Homo sapiens
ugucguggcucucuuuacu

SEQ ID NO: 815767 - RNA, 19 nt, Homo sapiens
acaccauccugcugauuca

SEQ ID NO: 815768 - RNA, 19 nt, Homo sapiens
cauuguuccuggcacuuga

SEQ ID NO: 815769 - RNA, 19 nt, Homo sapiens
acauuuaccuagacaucau

SEQ ID NO: 815770 - RNA, 19 nt, Homo sapiens
cuccuacccuuccaauaug

SEQ ID NO: 815771 - RNA, 19 nt, Homo sapiens
ccagcuaugacaacgguuu

SEQ ID NO: 815772 - RNA, 19 nt, Homo sapiens
ccugcgagaccagauauaa

SEQ ID NO: 815773 - RNA, 19 nt, Homo sapiens
gcuccugcgagaccagaua

SEQ ID NO: 815774 - RNA, 19 nt, Homo sapiens
ucucaugacucuuuucuuc

SEQ ID NO: 815775 - RNA, 19 nt, Homo sapiens
cacccuagcugggccuaug

SEQ ID NO: 815776 - RNA, 19 nt, Homo sapiens
cauccuggccauccuccua

SEQ ID NO: 815777 - RNA, 19 nt, Homo sapiens
guggcucucuuuacuuucu

SEQ ID NO: 815778 - RNA, 19 nt, Homo sapiens
ccucaacauuuaccuagac

SEQ ID NO: 815779 - RNA, 19 nt, Homo sapiens
gcucuucgugcuucucaug

SEQ ID NO: 815780 - RNA, 19 nt, Homo sapiens
guucgucgagucuuuguca

SEQ ID NO: 815781 - RNA, 19 nt, Homo sapiens
cauccuaugcuguguucuu

SEQ ID NO: 815782 - RNA, 19 nt, Homo sapiens
gcugucguggcucucuuua

SEQ ID NO: 815783 - RNA, 19 nt, Homo sapiens
uaugcuguguucuuugcaa

SEQ ID NO: 815784 - RNA, 19 nt, Homo sapiens
ccuaugcuguguucuuugc

SEQ ID NO: 815785 - RNA, 19 nt, Homo sapiens
ccgagagacggcaccauga

SEQ ID NO: 815786 - RNA, 19 nt, Homo sapiens
gucgagucuuugucagaaa

SEQ ID NO: 815787 - RNA, 19 nt, Homo sapiens
uuuggagcccucaacauuu

SEQ ID NO: 815788 - RNA, 19 nt, Homo sapiens
gagcucuucaccacuuuca

SEQ ID NO: 815789 - RNA, 19 nt, Homo sapiens
gcaaguacauaaacuggua

SEQ ID NO: 815790 - RNA, 19 nt, Homo sapiens
gcacuugucugagggcaua

SEQ ID NO: 815791 - RNA, 19 nt, Homo sapiens
aggcuaagcugaauaauga

SEQ ID NO: 815792 - RNA, 19 nt, Homo sapiens
ggaucagccuccugucuua

SEQ ID NO: 815793 - RNA, 19 nt, Homo sapiens
gggcauagcuccaugucuu

SEQ ID NO: 815794 - RNA, 19 nt, Homo sapiens
gaauuuggcuguggacuug

SEQ ID NO: 815795 - RNA, 19 nt, Homo sapiens
gaugugaucccaccuaauu

SEQ ID NO: 815796 - RNA, 19 nt, Homo sapiens
caauuucacuggaguaaug

SEQ ID NO: 815797 - RNA, 19 nt, Homo sapiens
gcacagcuacugauugauu

SEQ ID NO: 815798 - RNA, 19 nt, Homo sapiens
gcgcagaaccguacaggua

SEQ ID NO: 815799 - RNA, 19 nt, Homo sapiens
gauuuggauuccuaucuua

SEQ ID NO: 815800 - RNA, 19 nt, Homo sapiens
caacuucccuaccaucgaa

SEQ ID NO: 815801 - RNA, 19 nt, Homo sapiens
ggaaccaaaucucauuaau

SEQ ID NO: 815802 - RNA, 19 nt, Homo sapiens
gggaagggcucacuauugg

SEQ ID NO: 815803 - RNA, 19 nt, Homo sapiens
gcaagaaugcuggcacaua

SEQ ID NO: 815804 - RNA, 19 nt, Homo sapiens
guaaauaggccacauccuu

SEQ ID NO: 815805 - RNA, 19 nt, Homo sapiens
ucaaauauuuagcgccuuu

SEQ ID NO: 815806 - RNA, 19 nt, Homo sapiens
gaaagggaaccaaaucuca

SEQ ID NO: 815807 - RNA, 19 nt, Homo sapiens
gaaacugcaucucuguugu

SEQ ID NO: 815808 - RNA, 19 nt, Homo sapiens
caagaaugcuggcacauac

SEQ ID NO: 815809 - RNA, 19 nt, Homo sapiens
ucacuccgguacccaaaua

SEQ ID NO: 815810 - RNA, 19 nt, Homo sapiens
cagaguuccuuugugauua

SEQ ID NO: 815811 - RNA, 19 nt, Homo sapiens
aaagcugacugcauuugua

SEQ ID NO: 815812 - RNA, 19 nt, Homo sapiens
ggauuuggauuccuaucuu

SEQ ID NO: 815813 - RNA, 19 nt, Homo sapiens
gcaauacauuccacaucuu

SEQ ID NO: 815814 - RNA, 19 nt, Homo sapiens
gaauggccauacaggcuaa

SEQ ID NO: 815815 - RNA, 19 nt, Homo sapiens
gaagcaggcccagcaagua

SEQ ID NO: 815816 - RNA, 19 nt, Homo sapiens
caucggauauuuauugcaa

SEQ ID NO: 815817 - RNA, 19 nt, Homo sapiens
gaacgguugauuguaaaua

SEQ ID NO: 815818 - RNA, 19 nt, Homo sapiens
gcugaauaaugacaaaguu

SEQ ID NO: 815819 - RNA, 19 nt, Homo sapiens
uagaagaugcugugaauau

SEQ ID NO: 815820 - RNA, 19 nt, Homo sapiens
gaagggcucacuauuggaa

SEQ ID NO: 815821 - RNA, 19 nt, Homo sapiens
ggggucagcucuuuauaua

SEQ ID NO: 815822 - RNA, 19 nt, Homo sapiens
gaagaugcugugaauauca

SEQ ID NO: 815823 - RNA, 19 nt, Homo sapiens
caaauagccacacucacua

SEQ ID NO: 815824 - RNA, 19 nt, Homo sapiens
guacagguauccaaugaac

SEQ ID NO: 815825 - RNA, 19 nt, Homo sapiens
uacuguagcuaaccauuaa

SEQ ID NO: 815826 - RNA, 19 nt, Homo sapiens
guggacauguugagugaaa

SEQ ID NO: 815827 - RNA, 19 nt, Homo sapiens
uuccaaagcugacugcauu

SEQ ID NO: 815828 - RNA, 19 nt, Homo sapiens
ggacauguugagugaaauu

SEQ ID NO: 815829 - RNA, 19 nt, Homo sapiens
gaaaccagaccaggccuaa

SEQ ID NO: 815830 - RNA, 19 nt, Homo sapiens
uuggaacgguugauuguaa

SEQ ID NO: 815831 - RNA, 19 nt, Homo sapiens
cagcacacauggauaucuu

SEQ ID NO: 815832 - RNA, 19 nt, Homo sapiens
gcuacugauugauuuauuc

SEQ ID NO: 815833 - RNA, 19 nt, Homo sapiens
gcauuuguaccaucuuauu

SEQ ID NO: 815834 - RNA, 19 nt, Homo sapiens
cauuauggguucugugaug

SEQ ID NO: 815835 - RNA, 19 nt, Homo sapiens
gcuccuggcuuuguauaug

SEQ ID NO: 815836 - RNA, 19 nt, Homo sapiens
caauacagccccuuuuaua

SEQ ID NO: 815837 - RNA, 19 nt, Homo sapiens
gugaugugaucccaccuaa

SEQ ID NO: 815838 - RNA, 19 nt, Homo sapiens
ucccagaguuccuuuguga

SEQ ID NO: 815839 - RNA, 19 nt, Homo sapiens
aagaacagaucacaagagu

SEQ ID NO: 815840 - RNA, 19 nt, Homo sapiens
ccaaauagccacacucacu

SEQ ID NO: 815841 - RNA, 19 nt, Homo sapiens
uaagagugcugcugguucu

SEQ ID NO: 815842 - RNA, 19 nt, Homo sapiens
aauccucuccugaaacuua

SEQ ID NO: 815843 - RNA, 19 nt, Homo sapiens
uaaacugacugaagaaucc

SEQ ID NO: 815844 - RNA, 19 nt, Homo sapiens
uaucaugcuucucuuggaa

SEQ ID NO: 815845 - RNA, 19 nt, Homo sapiens
gcaccaugcuguaccuuuu

SEQ ID NO: 815846 - RNA, 19 nt, Homo sapiens
cccauucacuccuaaucua

SEQ ID NO: 815847 - RNA, 19 nt, Homo sapiens
cugagugccuuuccaagaa

SEQ ID NO: 815848 - RNA, 19 nt, Homo sapiens
ccagaguuccuuugugauu

SEQ ID NO: 815849 - RNA, 19 nt, Homo sapiens
acugguaccuuguaaugaa

SEQ ID NO: 815850 - RNA, 19 nt, Homo sapiens
aaacugguaccuuguaaug

SEQ ID NO: 815851 - RNA, 19 nt, Homo sapiens
uuuagaagaugcugugaau

SEQ ID NO: 815852 - RNA, 19 nt, Homo sapiens
ucacugcaccgaguucaua

SEQ ID NO: 815853 - RNA, 19 nt, Homo sapiens
gcagaaccguacagguauc

SEQ ID NO: 815854 - RNA, 19 nt, Homo sapiens
cacagcuacugauugauuu

SEQ ID NO: 815855 - RNA, 19 nt, Homo sapiens
gauuucccaucggauauuu

SEQ ID NO: 815856 - RNA, 19 nt, Homo sapiens
guauaugccuggcuugaac

SEQ ID NO: 815857 - RNA, 19 nt, Homo sapiens
cugcauuuguaccaucuua

SEQ ID NO: 815858 - RNA, 19 nt, Homo sapiens
cauaaacugguaccuugua

SEQ ID NO: 815859 - RNA, 19 nt, Homo sapiens
cuggaaccaugaauuugua

SEQ ID NO: 815860 - RNA, 19 nt, Homo sapiens
uaacauugcuccccggauu

SEQ ID NO: 815861 - RNA, 19 nt, Homo sapiens
ugagugaaauuaacauugc

SEQ ID NO: 815862 - RNA, 19 nt, Homo sapiens
cuaauuguauccaguuaag

SEQ ID NO: 815863 - RNA, 19 nt, Homo sapiens
cuacaagggcacuuuaaga

SEQ ID NO: 815864 - RNA, 19 nt, Homo sapiens
caccaaaccuaugcaaauc

SEQ ID NO: 815865 - RNA, 19 nt, Homo sapiens
ucaccaaaccuaugcaaau

SEQ ID NO: 815866 - RNA, 19 nt, Homo sapiens
gggaaccaaaucucauuaa

SEQ ID NO: 815867 - RNA, 19 nt, Homo sapiens
ccaugaauuuguacacugu

SEQ ID NO: 815868 - RNA, 19 nt, Homo sapiens
uccagacacuuacagcuuu

SEQ ID NO: 815869 - RNA, 19 nt, Homo sapiens
gaacucaccaaaccuaugc

SEQ ID NO: 815870 - RNA, 19 nt, Homo sapiens
augcacagcuacugauuga

SEQ ID NO: 815871 - RNA, 19 nt, Homo sapiens
aaaguugaaaggaccaaua

SEQ ID NO: 815872 - RNA, 19 nt, Homo sapiens
aaauguggaugugcuagaa

SEQ ID NO: 815873 - RNA, 19 nt, Homo sapiens
cgaaacugcaucucuguug

SEQ ID NO: 815874 - RNA, 19 nt, Homo sapiens
ccguacagguauccaauga

SEQ ID NO: 815875 - RNA, 19 nt, Homo sapiens
ggaguaaugccaccucagu

SEQ ID NO: 815876 - RNA, 19 nt, Homo sapiens
gaucccaccuaauuguauc

SEQ ID NO: 815877 - RNA, 19 nt, Homo sapiens
uagcuaaccauuaaaguca

SEQ ID NO: 815878 - RNA, 19 nt, Homo sapiens
auaaacugguaccuuguaa

SEQ ID NO: 815879 - RNA, 19 nt, Homo sapiens
gggcacguuccaaaguuua

SEQ ID NO: 815880 - RNA, 19 nt, Homo sapiens
uagccacacucacuacuuc

SEQ ID NO: 815881 - RNA, 19 nt, Homo sapiens
gagcauguguuggaaacca

SEQ ID NO: 815882 - RNA, 19 nt, Homo sapiens
ggaaagggaaccaaaucuc

SEQ ID NO: 815883 - RNA, 19 nt, Homo sapiens
ccuggugucccaaagaaua

SEQ ID NO: 815884 - RNA, 19 nt, Homo sapiens
caaggcaaguacauaaacu

SEQ ID NO: 815885 - RNA, 19 nt, Homo sapiens
guccaaggcaaguacauaa

SEQ ID NO: 815886 - RNA, 19 nt, Homo sapiens
aaacugcaucucuguugua

SEQ ID NO: 815887 - RNA, 19 nt, Homo sapiens
gagggucgcuaucucuuuu

SEQ ID NO: 815888 - RNA, 19 nt, Homo sapiens
ucacuuuccugucugaucu

SEQ ID NO: 815889 - RNA, 19 nt, Homo sapiens
gaaagcgccuggccacuua

SEQ ID NO: 815890 - RNA, 19 nt, Homo sapiens
ggaagaccauccacaaaua

SEQ ID NO: 815891 - RNA, 19 nt, Homo sapiens
gaaggcagaugaaguauug

SEQ ID NO: 815892 - RNA, 19 nt, Homo sapiens
gaagaaggcagaugaagua

SEQ ID NO: 815893 - RNA, 19 nt, Homo sapiens
ugaagaagauugagaagaa

SEQ ID NO: 815894 - RNA, 19 nt, Homo sapiens
gaaacucccugaggaagua

SEQ ID NO: 815895 - RNA, 19 nt, Homo sapiens
guggaugacuucaagauua

SEQ ID NO: 815896 - RNA, 19 nt, Homo sapiens
ugaaugaaaucgucuauga

SEQ ID NO: 815897 - RNA, 19 nt, Homo sapiens
gaaugggccugucuuagaa

SEQ ID NO: 815898 - RNA, 19 nt, Homo sapiens
agaacaaucuggucaagua

SEQ ID NO: 815899 - RNA, 19 nt, Homo sapiens
gcaagaaccuagagcugaa

SEQ ID NO: 815900 - RNA, 19 nt, Homo sapiens
gaaggagacuggaaagaca

SEQ ID NO: 815901 - RNA, 19 nt, Homo sapiens
gggcacagcuuacagacaa

SEQ ID NO: 815902 - RNA, 19 nt, Homo sapiens
gcaagaacgugcagaacau

SEQ ID NO: 815903 - RNA, 19 nt, Homo sapiens
ggaaacacauaaacaugga

SEQ ID NO: 815904 - RNA, 19 nt, Homo sapiens
gaugaaguauuggagauuu

SEQ ID NO: 815905 - RNA, 19 nt, Homo sapiens
caacaccuuugauuucauu

SEQ ID NO: 815906 - RNA, 19 nt, Homo sapiens
gaucaacguucuucugcaa

SEQ ID NO: 815907 - RNA, 19 nt, Homo sapiens
gcagaaaucgugcuaggaa

SEQ ID NO: 815908 - RNA, 19 nt, Homo sapiens
ugucaugggucaagcauaa

SEQ ID NO: 815909 - RNA, 19 nt, Homo sapiens
uguaaccgcuacccuaaua

SEQ ID NO: 815910 - RNA, 19 nt, Homo sapiens
ugaaucggauccagaguaa

SEQ ID NO: 815911 - RNA, 19 nt, Homo sapiens
gagaguugagccugaauua

SEQ ID NO: 815912 - RNA, 19 nt, Homo sapiens
gcacauacagucaucauca

SEQ ID NO: 815913 - RNA, 19 nt, Homo sapiens
ggucaagcauaaaucauau

SEQ ID NO: 815914 - RNA, 19 nt, Homo sapiens
ccaagaagccugucauugu

SEQ ID NO: 815915 - RNA, 19 nt, Homo sapiens
acaaauauguccaucuguu

SEQ ID NO: 815916 - RNA, 19 nt, Homo sapiens
ccacaaauauguccaucug

SEQ ID NO: 815917 - RNA, 19 nt, Homo sapiens
cgagauaaauuuccuuucu

SEQ ID NO: 815918 - RNA, 19 nt, Homo sapiens
gagagucuuuaccgagaua

SEQ ID NO: 815919 - RNA, 19 nt, Homo sapiens
uguacgaccugaaucauaa

SEQ ID NO: 815920 - RNA, 19 nt, Homo sapiens
gaagaagaauuuccccuuu

SEQ ID NO: 815921 - RNA, 19 nt, Homo sapiens
gcuaggaaauguccagaau

SEQ ID NO: 815922 - RNA, 19 nt, Homo sapiens
agacagugauucagauuga

SEQ ID NO: 815923 - RNA, 19 nt, Homo sapiens
ggagaugccaaguccaaua

SEQ ID NO: 815924 - RNA, 19 nt, Homo sapiens
gaauaacccuaaguucaau

SEQ ID NO: 815925 - RNA, 19 nt, Homo sapiens
caagaagccugucauuguc

SEQ ID NO: 815926 - RNA, 19 nt, Homo sapiens
ggagauggaggaugaagaa

SEQ ID NO: 815927 - RNA, 19 nt, Homo sapiens
caacaacuuccuauugaaa

SEQ ID NO: 815928 - RNA, 19 nt, Homo sapiens
ugaagcagcugccacacuu

SEQ ID NO: 815929 - RNA, 19 nt, Homo sapiens
ccaagaccauugagaacaa

SEQ ID NO: 815930 - RNA, 19 nt, Homo sapiens
uggaaaagcugccaaagua

SEQ ID NO: 815931 - RNA, 19 nt, Homo sapiens
ugacagaacugggccguau

SEQ ID NO: 815932 - RNA, 19 nt, Homo sapiens
acacagaucuggaaaccau

SEQ ID NO: 815933 - RNA, 19 nt, Homo sapiens
caacuuccaucccaaugug

SEQ ID NO: 815934 - RNA, 19 nt, Homo sapiens
gcucuucgcucuccaaugc

SEQ ID NO: 815935 - RNA, 19 nt, Homo sapiens
gaggauguccgacucauug

SEQ ID NO: 815936 - RNA, 19 nt, Homo sapiens
guacuacaauggcaagauc

SEQ ID NO: 815937 - RNA, 19 nt, Homo sapiens
gaagaccauccacaaauau

SEQ ID NO: 815938 - RNA, 19 nt, Homo sapiens
gcagcucagucguuucuau

SEQ ID NO: 815939 - RNA, 19 nt, Homo sapiens
ucucacagcugaaauugga

SEQ ID NO: 815940 - RNA, 19 nt, Homo sapiens
ucauacagcugcccugaug

SEQ ID NO: 815941 - RNA, 19 nt, Homo sapiens
caaauauguccaucuguuu

SEQ ID NO: 815942 - RNA, 19 nt, Homo sapiens
gacuagaucugguucauac

SEQ ID NO: 815943 - RNA, 19 nt, Homo sapiens
aaagccagaugguuucaaa

SEQ ID NO: 815944 - RNA, 19 nt, Homo sapiens
gaaucucccugcacauaca

SEQ ID NO: 815945 - RNA, 19 nt, Homo sapiens
ugaaagaagcugagacaga

SEQ ID NO: 815946 - RNA, 19 nt, Homo sapiens
gagaaacagugccuuugag

SEQ ID NO: 815947 - RNA, 19 nt, Homo sapiens
gaagaagauugagaagaag

SEQ ID NO: 815948 - RNA, 19 nt, Homo sapiens
ccagaugguuucaaagcuu

SEQ ID NO: 815949 - RNA, 19 nt, Homo sapiens
gaaugaaaucgucuaugaa

SEQ ID NO: 815950 - RNA, 19 nt, Homo sapiens
cagagguccugucuuagaa

SEQ ID NO: 815951 - RNA, 19 nt, Homo sapiens
gagauugggaaacacauaa

SEQ ID NO: 815952 - RNA, 19 nt, Homo sapiens
ccauugagcucuucagcau

SEQ ID NO: 815953 - RNA, 19 nt, Homo sapiens
guucuuauaugagccauug

SEQ ID NO: 815954 - RNA, 19 nt, Homo sapiens
caagggagccacuuuaugg

SEQ ID NO: 815955 - RNA, 19 nt, Homo sapiens
gaaaggauuaugggaaaga

SEQ ID NO: 815956 - RNA, 19 nt, Homo sapiens
cagcacaggaugaugauuu

SEQ ID NO: 815957 - RNA, 19 nt, Homo sapiens
gggucaagcauaaaucaua

SEQ ID NO: 815958 - RNA, 19 nt, Homo sapiens
gaccaggaguacaaauuca

SEQ ID NO: 815959 - RNA, 19 nt, Homo sapiens
ccaauagccucaucuccau

SEQ ID NO: 815960 - RNA, 19 nt, Homo sapiens
aggaaacgcugcuaaaugg

SEQ ID NO: 815961 - RNA, 19 nt, Homo sapiens
caacaucagccauacacaa

SEQ ID NO: 815962 - RNA, 19 nt, Homo sapiens
gggaagaccauccacaaau

SEQ ID NO: 815963 - RNA, 19 nt, Homo sapiens
gaacacucguggaggaucu

SEQ ID NO: 815964 - RNA, 19 nt, Homo sapiens
ggaaagcgccuggccacuu

SEQ ID NO: 815965 - RNA, 19 nt, Homo sapiens
ccacuucaaugcugagauc

SEQ ID NO: 815966 - RNA, 19 nt, Homo sapiens
gcaagaugaucgacaaacg

SEQ ID NO: 815967 - RNA, 19 nt, Homo sapiens
acccagagcuauccaaguu

SEQ ID NO: 815968 - RNA, 19 nt, Homo sapiens
aggaaaggauuaugggaaa

SEQ ID NO: 815969 - RNA, 19 nt, Homo sapiens
cagcguggaugugaaagaa

SEQ ID NO: 815970 - RNA, 19 nt, Homo sapiens
gcaaagggaacauuaucau

SEQ ID NO: 815971 - RNA, 19 nt, Homo sapiens
gacuauuugugcagaguuu

SEQ ID NO: 815972 - RNA, 19 nt, Homo sapiens
ggagggcuuugcacugaug

SEQ ID NO: 815973 - RNA, 19 nt, Homo sapiens
acauugagaugacccaaga

SEQ ID NO: 815974 - RNA, 19 nt, Homo sapiens
caauguggaugacuucaag

SEQ ID NO: 815975 - RNA, 19 nt, Homo sapiens
gcaugugccugcucugaag

SEQ ID NO: 815976 - RNA, 19 nt, Homo sapiens
gcacaaagugaagcugaaa

SEQ ID NO: 815977 - RNA, 19 nt, Homo sapiens
cgagaaugggccugucuua

SEQ ID NO: 815978 - RNA, 19 nt, Homo sapiens
uuucaaagcuuccugacau

SEQ ID NO: 815979 - RNA, 19 nt, Homo sapiens
ggacuuggaggaccugguu

SEQ ID NO: 815980 - RNA, 19 nt, Homo sapiens
gaugugaccaggaguacaa

SEQ ID NO: 815981 - RNA, 19 nt, Homo sapiens
gcccacaacuacacucugu

SEQ ID NO: 815982 - RNA, 19 nt, Homo sapiens
gcagucagauacggaggaa

SEQ ID NO: 815983 - RNA, 19 nt, Homo sapiens
gcccgugucugcucugaga

SEQ ID NO: 815984 - RNA, 19 nt, Homo sapiens
gaaguagugaagaagauug

SEQ ID NO: 815985 - RNA, 19 nt, Homo sapiens
gaaauuggagggcuuugca

SEQ ID NO: 815986 - RNA, 19 nt, Homo sapiens
gaagacggccagugaugau

SEQ ID NO: 815987 - RNA, 19 nt, Homo sapiens
cagaaaucgugcuaggaaa

SEQ ID NO: 815988 - RNA, 19 nt, Homo sapiens
gagucugacauucuaauaa

SEQ ID NO: 815989 - RNA, 19 nt, Homo sapiens
gagcuaacauccauauuua

SEQ ID NO: 815990 - RNA, 19 nt, Homo sapiens
gcacaacacuccugauauu

SEQ ID NO: 815991 - RNA, 19 nt, Homo sapiens
ggaaacagcuaaucaggaa

SEQ ID NO: 815992 - RNA, 19 nt, Homo sapiens
ggaguuggcuucaaagaaa

SEQ ID NO: 815993 - RNA, 19 nt, Homo sapiens
gcacuuauaugcauugcua

SEQ ID NO: 815994 - RNA, 19 nt, Homo sapiens
cuacuugccuuaaauguua

SEQ ID NO: 815995 - RNA, 19 nt, Homo sapiens
gaucuaagcuggcaacuag

SEQ ID NO: 815996 - RNA, 19 nt, Homo sapiens
agaugaagcugaaacauua

SEQ ID NO: 815997 - RNA, 19 nt, Homo sapiens
gcaacugucuuuaauauuc

SEQ ID NO: 815998 - RNA, 19 nt, Homo sapiens
gcagggaucuuuacauguu

SEQ ID NO: 815999 - RNA, 19 nt, Homo sapiens
gaaaugcucaucugaaauu

SEQ ID NO: 816000 - RNA, 19 nt, Homo sapiens
ggaccuaucucuauuguag

SEQ ID NO: 816001 - RNA, 19 nt, Homo sapiens
gaaauugccuguagcaucu

SEQ ID NO: 816002 - RNA, 19 nt, Homo sapiens
ggaagcagaucucuccaaa

SEQ ID NO: 816003 - RNA, 19 nt, Homo sapiens
ugaaggaaguggagacaua

SEQ ID NO: 816004 - RNA, 19 nt, Homo sapiens
gggauuaacuagcauuauu

SEQ ID NO: 816005 - RNA, 19 nt, Homo sapiens
ugacaaggcagcuaauuua

SEQ ID NO: 816006 - RNA, 19 nt, Homo sapiens
gaggaaaccugccauguca

SEQ ID NO: 816007 - RNA, 19 nt, Homo sapiens
gaagaccguucaaauaugu

SEQ ID NO: 816008 - RNA, 19 nt, Homo sapiens
aagaagagaugacaaagaa

SEQ ID NO: 816009 - RNA, 19 nt, Homo sapiens
aaacuaggauuuccaaaga

SEQ ID NO: 816010 - RNA, 19 nt, Homo sapiens
ggaaagaacugcacaacac

SEQ ID NO: 816011 - RNA, 19 nt, Homo sapiens
gaccaaggcauauauagua

SEQ ID NO: 816012 - RNA, 19 nt, Homo sapiens
aagcagaucucuccaaaga

SEQ ID NO: 816013 - RNA, 19 nt, Homo sapiens
guaaaggcaucucgguaaa

SEQ ID NO: 816014 - RNA, 19 nt, Homo sapiens
ugacaaagaauccaaguaa

SEQ ID NO: 816015 - RNA, 19 nt, Homo sapiens
gcaccucgauucauccaaa

SEQ ID NO: 816016 - RNA, 19 nt, Homo sapiens
ggagcuaacauccauauuu

SEQ ID NO: 816017 - RNA, 19 nt, Homo sapiens
ggaacuacuugccuuaaau

SEQ ID NO: 816018 - RNA, 19 nt, Homo sapiens
gaagaaagcaagaauacug

SEQ ID NO: 816019 - RNA, 19 nt, Homo sapiens
gaagaaaugcucaucugaa

SEQ ID NO: 816020 - RNA, 19 nt, Homo sapiens
gcacaaaggaugcuguuau

SEQ ID NO: 816021 - RNA, 19 nt, Homo sapiens
gacaaagaauccaaguaaa

SEQ ID NO: 816022 - RNA, 19 nt, Homo sapiens
gaaccaagugcaauaugua

SEQ ID NO: 816023 - RNA, 19 nt, Homo sapiens
gcuggaaugucguguauug

SEQ ID NO: 816024 - RNA, 19 nt, Homo sapiens
gugcaacugucuuuaauau

SEQ ID NO: 816025 - RNA, 19 nt, Homo sapiens
gagauuugcacccuaguua

SEQ ID NO: 816026 - RNA, 19 nt, Homo sapiens
ggaguaaauggacugauua

SEQ ID NO: 816027 - RNA, 19 nt, Homo sapiens
gaauugcugugauuaaagu

SEQ ID NO: 816028 - RNA, 19 nt, Homo sapiens
gcaaagcuaacaguaauaa

SEQ ID NO: 816029 - RNA, 19 nt, Homo sapiens
ccaagacucuccagauuuc

SEQ ID NO: 816030 - RNA, 19 nt, Homo sapiens
guaaaugccuugucuuugc

SEQ ID NO: 816031 - RNA, 19 nt, Homo sapiens
gaagcacaguguauucaga

SEQ ID NO: 816032 - RNA, 19 nt, Homo sapiens
ugacagugcucacaagaug

SEQ ID NO: 816033 - RNA, 19 nt, Homo sapiens
ccaguaacuuucacaugua

SEQ ID NO: 816034 - RNA, 19 nt, Homo sapiens
aagaaaugcucaucugaaa

SEQ ID NO: 816035 - RNA, 19 nt, Homo sapiens
gcaagggagugaaauccaa

SEQ ID NO: 816036 - RNA, 19 nt, Homo sapiens
gcagagaaacaaacuaaga

SEQ ID NO: 816037 - RNA, 19 nt, Homo sapiens
gaagaagagaugacaaaga

SEQ ID NO: 816038 - RNA, 19 nt, Homo sapiens
gccaguaacuuucacaugu

SEQ ID NO: 816039 - RNA, 19 nt, Homo sapiens
gagaugaagcugaaacauu

SEQ ID NO: 816040 - RNA, 19 nt, Homo sapiens
cacaaaggaugcuguuauu

SEQ ID NO: 816041 - RNA, 19 nt, Homo sapiens
gaucauagcagaggccuuu

SEQ ID NO: 816042 - RNA, 19 nt, Homo sapiens
gaguuuaucuggaguguag

SEQ ID NO: 816043 - RNA, 19 nt, Homo sapiens
guacuacaaugauucugaa

SEQ ID NO: 816044 - RNA, 19 nt, Homo sapiens
cacauuuacuguccaauuu

SEQ ID NO: 816045 - RNA, 19 nt, Homo sapiens
cuucagaccucacuucuug

SEQ ID NO: 816046 - RNA, 19 nt, Homo sapiens
acaugaggcuuuaauggua

SEQ ID NO: 816047 - RNA, 19 nt, Homo sapiens
ggaggagaaugaaggaaau

SEQ ID NO: 816048 - RNA, 19 nt, Homo sapiens
gcugaaacauuacaagauc

SEQ ID NO: 816049 - RNA, 19 nt, Homo sapiens
gaaacauaccuuugacuau

SEQ ID NO: 816050 - RNA, 19 nt, Homo sapiens
gaaacaaacuaagaguauc

SEQ ID NO: 816051 - RNA, 19 nt, Homo sapiens
gagaaacaaacuaagagua

SEQ ID NO: 816052 - RNA, 19 nt, Homo sapiens
ugucuuacuuggcaaauuu

SEQ ID NO: 816053 - RNA, 19 nt, Homo sapiens
uuaagaaggugcuggauuc

SEQ ID NO: 816054 - RNA, 19 nt, Homo sapiens
gaagagaugacaaagaauc

SEQ ID NO: 816055 - RNA, 19 nt, Homo sapiens
caacacuccugauauucaa

SEQ ID NO: 816056 - RNA, 19 nt, Homo sapiens
guggguaccugucuccuaa

SEQ ID NO: 816057 - RNA, 19 nt, Homo sapiens
gagacugcaugguggcaua

SEQ ID NO: 816058 - RNA, 19 nt, Homo sapiens
gcaaccagcaugauuauag

SEQ ID NO: 816059 - RNA, 19 nt, Homo sapiens
gagguuaacauacgaagaa

SEQ ID NO: 816060 - RNA, 19 nt, Homo sapiens
caaaggaugcuguuauuca

SEQ ID NO: 816061 - RNA, 19 nt, Homo sapiens
gcagaagggagccgaguuu

SEQ ID NO: 816062 - RNA, 19 nt, Homo sapiens
gugaacauccuucccauaa

SEQ ID NO: 816063 - RNA, 19 nt, Homo sapiens
ccaugaaacuuugccuuaa

SEQ ID NO: 816064 - RNA, 19 nt, Homo sapiens
gaugaaagaagaagagaug

SEQ ID NO: 816065 - RNA, 19 nt, Homo sapiens
gagcaggacagaacucauu

SEQ ID NO: 816066 - RNA, 19 nt, Homo sapiens
cggcaaagcuaacaguaau

SEQ ID NO: 816067 - RNA, 19 nt, Homo sapiens
ggugaacaacccugaguua

SEQ ID NO: 816068 - RNA, 19 nt, Homo sapiens
gaguaucucuucaccuguu

SEQ ID NO: 816069 - RNA, 19 nt, Homo sapiens
guacagcuuucuacuucuu

SEQ ID NO: 816070 - RNA, 19 nt, Homo sapiens
gaaggaaguggagacauaa

SEQ ID NO: 816071 - RNA, 19 nt, Homo sapiens
uggcauaaaugagaaauug

SEQ ID NO: 816072 - RNA, 19 nt, Homo sapiens
caaagaauccaaguaaaug

SEQ ID NO: 816073 - RNA, 19 nt, Homo sapiens
ucacagguaacuacaauuu

SEQ ID NO: 816074 - RNA, 19 nt, Homo sapiens
ggaaaacucugcagaaugg

SEQ ID NO: 816075 - RNA, 19 nt, Homo sapiens
gcaccauucuuugagauga

SEQ ID NO: 816076 - RNA, 19 nt, Homo sapiens
aaacagcuaaucaggaaua

SEQ ID NO: 816077 - RNA, 19 nt, Homo sapiens
gaagggagccgaguuuauc

SEQ ID NO: 816078 - RNA, 19 nt, Homo sapiens
gccaugaaacuuugccuua

SEQ ID NO: 816079 - RNA, 19 nt, Homo sapiens
ggaguagggaggagaauga

SEQ ID NO: 816080 - RNA, 19 nt, Homo sapiens
caaaugaccaaggcauaua

SEQ ID NO: 816081 - RNA, 19 nt, Homo sapiens
gaacuacuugccuuaaaug

SEQ ID NO: 816082 - RNA, 19 nt, Homo sapiens
ucaaagaaaccaucugaga

SEQ ID NO: 816083 - RNA, 19 nt, Homo sapiens
gcaaagccaagaaacagaa

SEQ ID NO: 816084 - RNA, 19 nt, Homo sapiens
gcaaaacacauguaucuuu

SEQ ID NO: 816085 - RNA, 19 nt, Homo sapiens
gaaagaagaagagaugaca

SEQ ID NO: 816086 - RNA, 19 nt, Homo sapiens
uaauccagcauucuuguua

SEQ ID NO: 816087 - RNA, 19 nt, Homo sapiens
caacccaucucaccugaca

SEQ ID NO: 816088 - RNA, 19 nt, Homo sapiens
ccaaagaaggccaguagaa

SEQ ID NO: 816089 - RNA, 19 nt, Homo sapiens
ggagaaggauaucaaauuu

SEQ ID NO: 816090 - RNA, 19 nt, Homo sapiens
ggaaauacuuguuacauga

SEQ ID NO: 816091 - RNA, 19 nt, Homo sapiens
cagcagagcuucagaauau

SEQ ID NO: 816092 - RNA, 19 nt, Homo sapiens
gagaauagauguucauaug

SEQ ID NO: 816093 - RNA, 19 nt, Homo sapiens
gacaguggcuuaauaaauu

SEQ ID NO: 816094 - RNA, 19 nt, Homo sapiens
gagaagaugugcaauaaga

SEQ ID NO: 816095 - RNA, 19 nt, Homo sapiens
guaguaaccuugcaagauu

SEQ ID NO: 816096 - RNA, 19 nt, Homo sapiens
ucacuacgauuguugauaa

SEQ ID NO: 816097 - RNA, 19 nt, Homo sapiens
uaagaaaccugccauuugu

SEQ ID NO: 816098 - RNA, 19 nt, Homo sapiens
gaaacuagggugucacuuu

SEQ ID NO: 816099 - RNA, 19 nt, Homo sapiens
gcaggaugcucaagaauuc

SEQ ID NO: 816100 - RNA, 19 nt, Homo sapiens
gaaagaggagggacaauug

SEQ ID NO: 816101 - RNA, 19 nt, Homo sapiens
ccagaggucuuacagguuu

SEQ ID NO: 816102 - RNA, 19 nt, Homo sapiens
gcuauuugcuugauuaugu

SEQ ID NO: 816103 - RNA, 19 nt, Homo sapiens
gaaacucggucuuuguaau

SEQ ID NO: 816104 - RNA, 19 nt, Homo sapiens
aagacaaccucaccaaaua

SEQ ID NO: 816105 - RNA, 19 nt, Homo sapiens
gaagagguuuguugucuca

SEQ ID NO: 816106 - RNA, 19 nt, Homo sapiens
gggcaugucuggagaauag

SEQ ID NO: 816107 - RNA, 19 nt, Homo sapiens
gaucacagcaccauacauu

SEQ ID NO: 816108 - RNA, 19 nt, Homo sapiens
gcagauaucaguaacuuau

SEQ ID NO: 816109 - RNA, 19 nt, Homo sapiens
cagcucaaauugugacaua

SEQ ID NO: 816110 - RNA, 19 nt, Homo sapiens
ccaggaaacugucaaagug

SEQ ID NO: 816111 - RNA, 19 nt, Homo sapiens
ucagaaaugucaaaggauu

SEQ ID NO: 816112 - RNA, 19 nt, Homo sapiens
gaaccaagccuccuucagu

SEQ ID NO: 816113 - RNA, 19 nt, Homo sapiens
aagagaagaugugcaauaa

SEQ ID NO: 816114 - RNA, 19 nt, Homo sapiens
gaagauccgcaaaccauaa

SEQ ID NO: 816115 - RNA, 19 nt, Homo sapiens
cgaaaucauuguccacauu

SEQ ID NO: 816116 - RNA, 19 nt, Homo sapiens
gaucuucugucagucauuu

SEQ ID NO: 816117 - RNA, 19 nt, Homo sapiens
guacaaaacuuuccugaga

SEQ ID NO: 816118 - RNA, 19 nt, Homo sapiens
gaucuguccuugccaauuc

SEQ ID NO: 816119 - RNA, 19 nt, Homo sapiens
gaagaugugcaauaagauu

SEQ ID NO: 816120 - RNA, 19 nt, Homo sapiens
gauaagaaaccugccauuu

SEQ ID NO: 816121 - RNA, 19 nt, Homo sapiens
ggcaagcccuccuaaauca

SEQ ID NO: 816122 - RNA, 19 nt, Homo sapiens
ugucauggcuucauauaau

SEQ ID NO: 816123 - RNA, 19 nt, Homo sapiens
ggacaauugugaaaucagu

SEQ ID NO: 816124 - RNA, 19 nt, Homo sapiens
gaaccuggcccuauuucaa

SEQ ID NO: 816125 - RNA, 19 nt, Homo sapiens
cauaugaucuucugucagu

SEQ ID NO: 816126 - RNA, 19 nt, Homo sapiens
ucacugauguccauucgaa

SEQ ID NO: 816127 - RNA, 19 nt, Homo sapiens
caacagugauagagcagaa

SEQ ID NO: 816128 - RNA, 19 nt, Homo sapiens
guacuugucaggauuguaa

SEQ ID NO: 816129 - RNA, 19 nt, Homo sapiens
ucaaccaucuguacauuug

SEQ ID NO: 816130 - RNA, 19 nt, Homo sapiens
gaaauggagugaaguuuug

SEQ ID NO: 816131 - RNA, 19 nt, Homo sapiens
uaaaucacccugacucuga

SEQ ID NO: 816132 - RNA, 19 nt, Homo sapiens
agaauuccuucgauguuua

SEQ ID NO: 816133 - RNA, 19 nt, Homo sapiens
ggacuagcucgaacagaua

SEQ ID NO: 816134 - RNA, 19 nt, Homo sapiens
ugucauacuugccaaauug

SEQ ID NO: 816135 - RNA, 19 nt, Homo sapiens
ccacagauccuuccaucaa

SEQ ID NO: 816136 - RNA, 19 nt, Homo sapiens
aaagagaagaugugcaaua

SEQ ID NO: 816137 - RNA, 19 nt, Homo sapiens
gaacauuugggauaaccua

SEQ ID NO: 816138 - RNA, 19 nt, Homo sapiens
gcagauccauaguauccuu

SEQ ID NO: 816139 - RNA, 19 nt, Homo sapiens
ccacagguugguauauuua

SEQ ID NO: 816140 - RNA, 19 nt, Homo sapiens
ucucgacaguggcuuaaua

SEQ ID NO: 816141 - RNA, 19 nt, Homo sapiens
uaauggauuugcuucauga

SEQ ID NO: 816142 - RNA, 19 nt, Homo sapiens
ugaagaagaugaacuuagg

SEQ ID NO: 816143 - RNA, 19 nt, Homo sapiens
gcuuggaucuucagccauu

SEQ ID NO: 816144 - RNA, 19 nt, Homo sapiens
cagcagauaucaguaacuu

SEQ ID NO: 816145 - RNA, 19 nt, Homo sapiens
gucauggcuucauauaaua

SEQ ID NO: 816146 - RNA, 19 nt, Homo sapiens
gagggacaauugugaaauc

SEQ ID NO: 816147 - RNA, 19 nt, Homo sapiens
gugacaauauguacaguug

SEQ ID NO: 816148 - RNA, 19 nt, Homo sapiens
uggaauaugugaagagguu

SEQ ID NO: 816149 - RNA, 19 nt, Homo sapiens
gaaagagcaagucauggaa

SEQ ID NO: 816150 - RNA, 19 nt, Homo sapiens
uauagaagcggaugaagaa

SEQ ID NO: 816151 - RNA, 19 nt, Homo sapiens
gacaaagcauuaucuaacu

SEQ ID NO: 816152 - RNA, 19 nt, Homo sapiens
gagacaaagcauuaucuaa

SEQ ID NO: 816153 - RNA, 19 nt, Homo sapiens
gaaugugucacuacgauug

SEQ ID NO: 816154 - RNA, 19 nt, Homo sapiens
cauaguauccuuuguagug

SEQ ID NO: 816155 - RNA, 19 nt, Homo sapiens
gccgaaacaaucuaaauaa

SEQ ID NO: 816156 - RNA, 19 nt, Homo sapiens
gaaaauggcucuagaugcu

SEQ ID NO: 816157 - RNA, 19 nt, Homo sapiens
gcucaagaauuccuucgau

SEQ ID NO: 816158 - RNA, 19 nt, Homo sapiens
ucauguugauccagauaua

SEQ ID NO: 816159 - RNA, 19 nt, Homo sapiens
uaaaugugguaaugugaug

SEQ ID NO: 816160 - RNA, 19 nt, Homo sapiens
ccucagaacauuugggaua

SEQ ID NO: 816161 - RNA, 19 nt, Homo sapiens
gaucauguggcgaagcaua

SEQ ID NO: 816162 - RNA, 19 nt, Homo sapiens
agacauauuugauggaaca

SEQ ID NO: 816163 - RNA, 19 nt, Homo sapiens
acagaaguguuauuucaga

SEQ ID NO: 816164 - RNA, 19 nt, Homo sapiens
ggagacaaagcauuaucua

SEQ ID NO: 816165 - RNA, 19 nt, Homo sapiens
gaaaucaguagguuaucuu

SEQ ID NO: 816166 - RNA, 19 nt, Homo sapiens
gaucuucagccauuucuug

SEQ ID NO: 816167 - RNA, 19 nt, Homo sapiens
uuacaugaaugcagcuuug

SEQ ID NO: 816168 - RNA, 19 nt, Homo sapiens
ugaaaguaguagucagaaa

SEQ ID NO: 816169 - RNA, 19 nt, Homo sapiens
aaagagaggagaaggauau

SEQ ID NO: 816170 - RNA, 19 nt, Homo sapiens
gaaguguuauuucagacau

SEQ ID NO: 816171 - RNA, 19 nt, Homo sapiens
caauguuaauucaggauga

SEQ ID NO: 816172 - RNA, 19 nt, Homo sapiens
uaagacaaccucaccaaau

SEQ ID NO: 816173 - RNA, 19 nt, Homo sapiens
uauugccgcuuauauugua

SEQ ID NO: 816174 - RNA, 19 nt, Homo sapiens
cgacaguggcuuaauaaau

SEQ ID NO: 816175 - RNA, 19 nt, Homo sapiens
gauaguccagcucaaauug

SEQ ID NO: 816176 - RNA, 19 nt, Homo sapiens
gauggaacaaucauuaguu

SEQ ID NO: 816177 - RNA, 19 nt, Homo sapiens
cacaagaaauacagaagug

SEQ ID NO: 816178 - RNA, 19 nt, Homo sapiens
uugaugaucuggauauaga

SEQ ID NO: 816179 - RNA, 19 nt, Homo sapiens
gcuaaagcaauguuguuaa

SEQ ID NO: 816180 - RNA, 19 nt, Homo sapiens
gcacugcuauuugcuugau

SEQ ID NO: 816181 - RNA, 19 nt, Homo sapiens
cauauacacuaacuagcuu

SEQ ID NO: 816182 - RNA, 19 nt, Homo sapiens
ccaaagugcugggauuaca

SEQ ID NO: 816183 - RNA, 19 nt, Homo sapiens
ggaauuuucugcagucuau

SEQ ID NO: 816184 - RNA, 19 nt, Homo sapiens
gaaggcgaauuugauaaag

SEQ ID NO: 816185 - RNA, 19 nt, Homo sapiens
caagaauuccuucgauguu

SEQ ID NO: 816186 - RNA, 19 nt, Homo sapiens
ggaugaagaagaugaacuu

SEQ ID NO: 816187 - RNA, 19 nt, Homo sapiens
gauaggaaauuaggaacuc

SEQ ID NO: 816188 - RNA, 19 nt, Homo sapiens
uagcauucaugauggcuuu

SEQ ID NO: 816189 - RNA, 19 nt, Homo sapiens
ucaaaugccuucccuaaua

SEQ ID NO: 816190 - RNA, 19 nt, Homo sapiens
aaacauaacuccuucugua

SEQ ID NO: 816191 - RNA, 19 nt, Homo sapiens
gcucaaagcaguucacuua

SEQ ID NO: 816192 - RNA, 19 nt, Homo sapiens
gacgaaaucuugaaguuaa

SEQ ID NO: 816193 - RNA, 19 nt, Homo sapiens
ugacuucucuucaguauuu

SEQ ID NO: 816194 - RNA, 19 nt, Homo sapiens
gcagugaaauugaccagua

SEQ ID NO: 816195 - RNA, 19 nt, Homo sapiens
gaacacauuucagauugua

SEQ ID NO: 816196 - RNA, 19 nt, Homo sapiens
gguaauggcuucucuacuu

SEQ ID NO: 816197 - RNA, 19 nt, Homo sapiens
caaaugccuucccuaauaa

SEQ ID NO: 816198 - RNA, 19 nt, Homo sapiens
gaggacagccuuauuaauu

SEQ ID NO: 816199 - RNA, 19 nt, Homo sapiens
gaagauauuucacggacuu

SEQ ID NO: 816200 - RNA, 19 nt, Homo sapiens
gaaagacucuauacaacug

SEQ ID NO: 816201 - RNA, 19 nt, Homo sapiens
uuacagccauuauccauua

SEQ ID NO: 816202 - RNA, 19 nt, Homo sapiens
gaacacagaguaaugacua

SEQ ID NO: 816203 - RNA, 19 nt, Homo sapiens
ccaguggacucaaaucaua

SEQ ID NO: 816204 - RNA, 19 nt, Homo sapiens
gaagacaacucagggagaa

SEQ ID NO: 816205 - RNA, 19 nt, Homo sapiens
ggauuuggcucucgcauug

SEQ ID NO: 816206 - RNA, 19 nt, Homo sapiens
ggacucaaaucauaacuuc

SEQ ID NO: 816207 - RNA, 19 nt, Homo sapiens
caacauggcugcgacgaaa

SEQ ID NO: 816208 - RNA, 19 nt, Homo sapiens
ggauguaacucacaaaaua

SEQ ID NO: 816209 - RNA, 19 nt, Homo sapiens
gaaagugauucuucauugu

SEQ ID NO: 816210 - RNA, 19 nt, Homo sapiens
caagagagauugguugaga

SEQ ID NO: 816211 - RNA, 19 nt, Homo sapiens
ggaacucacugcugaugaa

SEQ ID NO: 816212 - RNA, 19 nt, Homo sapiens
gaaaucacagugcacauaa

SEQ ID NO: 816213 - RNA, 19 nt, Homo sapiens
aaagagaccuucaggaugu

SEQ ID NO: 816214 - RNA, 19 nt, Homo sapiens
cuacaacugugcagaaauu

SEQ ID NO: 816215 - RNA, 19 nt, Homo sapiens
gcucagaaauggcauagug

SEQ ID NO: 816216 - RNA, 19 nt, Homo sapiens
cauguaaaguccauuguuu

SEQ ID NO: 816217 - RNA, 19 nt, Homo sapiens
gcucugcguuguauaguuu

SEQ ID NO: 816218 - RNA, 19 nt, Homo sapiens
caaagcaguucacuuaauc

SEQ ID NO: 816219 - RNA, 19 nt, Homo sapiens
aaacuaacccuauagcuuu

SEQ ID NO: 816220 - RNA, 19 nt, Homo sapiens
caacauucauccucucuau

SEQ ID NO: 816221 - RNA, 19 nt, Homo sapiens
uaacagaacacauuucaga

SEQ ID NO: 816222 - RNA, 19 nt, Homo sapiens
ggagagcaauuauggacaa

SEQ ID NO: 816223 - RNA, 19 nt, Homo sapiens
caaauacgaaacaggauua

SEQ ID NO: 816224 - RNA, 19 nt, Homo sapiens
cagaacacauuucagauug

SEQ ID NO: 816225 - RNA, 19 nt, Homo sapiens
gaaucaugguguucacuuu

SEQ ID NO: 816226 - RNA, 19 nt, Homo sapiens
caacgagaauuuaaaccuu

SEQ ID NO: 816227 - RNA, 19 nt, Homo sapiens
gcaguucacuuaaucucuu

SEQ ID NO: 816228 - RNA, 19 nt, Homo sapiens
ggacagccuuauuaauuuc

SEQ ID NO: 816229 - RNA, 19 nt, Homo sapiens
ucagaggacagccuuauua

SEQ ID NO: 816230 - RNA, 19 nt, Homo sapiens
ccuaagagagcuauauaua

SEQ ID NO: 816231 - RNA, 19 nt, Homo sapiens
gaacuugagacaacagauu

SEQ ID NO: 816232 - RNA, 19 nt, Homo sapiens
gcgacgaaaucuugaaguu

SEQ ID NO: 816233 - RNA, 19 nt, Homo sapiens
caaaugaugagcauagaaa

SEQ ID NO: 816234 - RNA, 19 nt, Homo sapiens
gagcaaaugucugaaugug

SEQ ID NO: 816235 - RNA, 19 nt, Homo sapiens
ucaaagcaguucacuuaau

SEQ ID NO: 816236 - RNA, 19 nt, Homo sapiens
gguuauuccuuuacuugua

SEQ ID NO: 816237 - RNA, 19 nt, Homo sapiens
cauaacuccuucuguauau

SEQ ID NO: 816238 - RNA, 19 nt, Homo sapiens
acaaagaacuugagacaac

SEQ ID NO: 816239 - RNA, 19 nt, Homo sapiens
ggagcggguuauuccuuua

SEQ ID NO: 816240 - RNA, 19 nt, Homo sapiens
ccgcaucucuuaccacuau

SEQ ID NO: 816241 - RNA, 19 nt, Homo sapiens
ccagaagccucagaugauu

SEQ ID NO: 816242 - RNA, 19 nt, Homo sapiens
gcaguggaauccucucaau

SEQ ID NO: 816243 - RNA, 19 nt, Homo sapiens
ucacaucuacucugccuua

SEQ ID NO: 816244 - RNA, 19 nt, Homo sapiens
caaaccauguuccagcaaa

SEQ ID NO: 816245 - RNA, 19 nt, Homo sapiens
gcaauuauggacaaucuga

SEQ ID NO: 816246 - RNA, 19 nt, Homo sapiens
ggguauacaucaacgagaa

SEQ ID NO: 816247 - RNA, 19 nt, Homo sapiens
gagcaauuauggacaaucu

SEQ ID NO: 816248 - RNA, 19 nt, Homo sapiens
guuaucaccugcaauggaa

SEQ ID NO: 816249 - RNA, 19 nt, Homo sapiens
gaagggauuacagccauua

SEQ ID NO: 816250 - RNA, 19 nt, Homo sapiens
ucaauuauuccaccagaua

SEQ ID NO: 816251 - RNA, 19 nt, Homo sapiens
ugacacuacucuucacuga

SEQ ID NO: 816252 - RNA, 19 nt, Homo sapiens
uauaagagcaaaugucuga

SEQ ID NO: 816253 - RNA, 19 nt, Homo sapiens
agagagcuaugcuucuuaa

SEQ ID NO: 816254 - RNA, 19 nt, Homo sapiens
gugauggucuggauuuaga

SEQ ID NO: 816255 - RNA, 19 nt, Homo sapiens
gaucccaguuucuuucaga

SEQ ID NO: 816256 - RNA, 19 nt, Homo sapiens
ucucucugcuugcaaauuu

SEQ ID NO: 816257 - RNA, 19 nt, Homo sapiens
guaauggcuucucuacuuc

SEQ ID NO: 816258 - RNA, 19 nt, Homo sapiens
cgacgaaaucuugaaguua

SEQ ID NO: 816259 - RNA, 19 nt, Homo sapiens
ccaaagagaccuucaggau

SEQ ID NO: 816260 - RNA, 19 nt, Homo sapiens
aggacagccuuauuaauuu

SEQ ID NO: 816261 - RNA, 19 nt, Homo sapiens
caagguuacugcacaagau

SEQ ID NO: 816262 - RNA, 19 nt, Homo sapiens
gaggaugaauuugacaaug

SEQ ID NO: 816263 - RNA, 19 nt, Homo sapiens
gaauguggccugaaucaag

SEQ ID NO: 816264 - RNA, 19 nt, Homo sapiens
uagaagagaugguagaaaa

SEQ ID NO: 816265 - RNA, 19 nt, Homo sapiens
gaaggcaggguauacauca

SEQ ID NO: 816266 - RNA, 19 nt, Homo sapiens
ggaugccucuuguguuaau

SEQ ID NO: 816267 - RNA, 19 nt, Homo sapiens
auggaugccucuuguguua

SEQ ID NO: 816268 - RNA, 19 nt, Homo sapiens
ggaagggauuacagccauu

SEQ ID NO: 816269 - RNA, 19 nt, Homo sapiens
gaaacuggagaaccacaaa

SEQ ID NO: 816270 - RNA, 19 nt, Homo sapiens
ccucuuguguuaaucauug

SEQ ID NO: 816271 - RNA, 19 nt, Homo sapiens
aauggaaaccgcaaacaua

SEQ ID NO: 816272 - RNA, 19 nt, Homo sapiens
ggauccaacuacacaguau

SEQ ID NO: 816273 - RNA, 19 nt, Homo sapiens
uguuguaucugacuuagaa

SEQ ID NO: 816274 - RNA, 19 nt, Homo sapiens
caacucaugucaagguuac

SEQ ID NO: 816275 - RNA, 19 nt, Homo sapiens
cacuuaaucucuuugcaaa

SEQ ID NO: 816276 - RNA, 19 nt, Homo sapiens
ccaggacuuuguaugcuuu

SEQ ID NO: 816277 - RNA, 19 nt, Homo sapiens
caaagaacuugagacaaca

SEQ ID NO: 816278 - RNA, 19 nt, Homo sapiens
gaaaaguucugcagagagu

SEQ ID NO: 816279 - RNA, 19 nt, Homo sapiens
caucuacucugccuuacau

SEQ ID NO: 816280 - RNA, 19 nt, Homo sapiens
guuccucugugcagugaua

SEQ ID NO: 816281 - RNA, 19 nt, Homo sapiens
gaagagaaugaaacagguu

SEQ ID NO: 816282 - RNA, 19 nt, Homo sapiens
uaaugacuauuccugaaga

SEQ ID NO: 816283 - RNA, 19 nt, Homo sapiens
cgaaacaugcaaaugauga

SEQ ID NO: 816284 - RNA, 19 nt, Homo sapiens
aaucgaaacaugcaaauga

SEQ ID NO: 816285 - RNA, 19 nt, Homo sapiens
agacaccggauuucuguua

SEQ ID NO: 816286 - RNA, 19 nt, Homo sapiens
ucagauggaugccucuugu

SEQ ID NO: 816287 - RNA, 19 nt, Homo sapiens
uauauaguguccaugcauu

SEQ ID NO: 816288 - RNA, 19 nt, Homo sapiens
gcuccuguaucuccaguug

SEQ ID NO: 816289 - RNA, 19 nt, Homo sapiens
ggaaacagcaggugcagaa

SEQ ID NO: 816290 - RNA, 19 nt, Homo sapiens
gcagccagguucccaaguu

SEQ ID NO: 816291 - RNA, 19 nt, Homo sapiens
gaaaacccuucuagacaua

SEQ ID NO: 816292 - RNA, 19 nt, Homo sapiens
acaagugucuaauucauga

SEQ ID NO: 816293 - RNA, 19 nt, Homo sapiens
gagauuaaccgacaucauc

SEQ ID NO: 816294 - RNA, 19 nt, Homo sapiens
cacagaauccuccaagaua

SEQ ID NO: 816295 - RNA, 19 nt, Homo sapiens
gcacagaauccuccaagau

SEQ ID NO: 816296 - RNA, 19 nt, Homo sapiens
cggaguuacugaacccuua

SEQ ID NO: 816297 - RNA, 19 nt, Homo sapiens
ggucauccucguaaacaua

SEQ ID NO: 816298 - RNA, 19 nt, Homo sapiens
gaccgaaccugacaucaac

SEQ ID NO: 816299 - RNA, 19 nt, Homo sapiens
gaccggaccuccaccaucu

SEQ ID NO: 816300 - RNA, 19 nt, Homo sapiens
ggauaucgacagcaaagaa

SEQ ID NO: 816301 - RNA, 19 nt, Homo sapiens
cagaagcucuuucggucuu

SEQ ID NO: 816302 - RNA, 19 nt, Homo sapiens
acaacaggcuggagucguu

SEQ ID NO: 816303 - RNA, 19 nt, Homo sapiens
caugaggcauuuacagaga

SEQ ID NO: 816304 - RNA, 19 nt, Homo sapiens
aaagauuguugucauggaa

SEQ ID NO: 816305 - RNA, 19 nt, Homo sapiens
gaaccugacaucaacaaca

SEQ ID NO: 816306 - RNA, 19 nt, Homo sapiens
gauaucgacagcaaagaaa

SEQ ID NO: 816307 - RNA, 19 nt, Homo sapiens
ggaccuccaccaucuagaa

SEQ ID NO: 816308 - RNA, 19 nt, Homo sapiens
ggaaaacccuucuagacau

SEQ ID NO: 816309 - RNA, 19 nt, Homo sapiens
cuccagaccugaugaggaa

SEQ ID NO: 816310 - RNA, 19 nt, Homo sapiens
gcaguucacacgcgucaug

SEQ ID NO: 816311 - RNA, 19 nt, Homo sapiens
ccuggucccucucccguuu

SEQ ID NO: 816312 - RNA, 19 nt, Homo sapiens
aagauacuuugcagccuuu

SEQ ID NO: 816313 - RNA, 19 nt, Homo sapiens
ccucguaaacauaucagua

SEQ ID NO: 816314 - RNA, 19 nt, Homo sapiens
uuacugaacccuuaucaag

SEQ ID NO: 816315 - RNA, 19 nt, Homo sapiens
gaaacaaggaagacagaac

SEQ ID NO: 816316 - RNA, 19 nt, Homo sapiens
acagaauccuccaagauac

SEQ ID NO: 816317 - RNA, 19 nt, Homo sapiens
ucuaauucaugaggcauuu

SEQ ID NO: 816318 - RNA, 19 nt, Homo sapiens
ugaccgaaccugacaucaa

SEQ ID NO: 816319 - RNA, 19 nt, Homo sapiens
caucaugaaacaaggaaga

SEQ ID NO: 816320 - RNA, 19 nt, Homo sapiens
gcguaggucauccucguaa

SEQ ID NO: 816321 - RNA, 19 nt, Homo sapiens
acugaacccuuaucaagca

SEQ ID NO: 816322 - RNA, 19 nt, Homo sapiens
cuucaggguugcacagaau

SEQ ID NO: 816323 - RNA, 19 nt, Homo sapiens
gaagcucuuucggucuuuc

SEQ ID NO: 816324 - RNA, 19 nt, Homo sapiens
cagccagguucccaaguuc

SEQ ID NO: 816325 - RNA, 19 nt, Homo sapiens
gcauuuacagagacacaga

SEQ ID NO: 816326 - RNA, 19 nt, Homo sapiens
gagucguugugccucagua

SEQ ID NO: 816327 - RNA, 19 nt, Homo sapiens
ccagggagaauuccagcuu

SEQ ID NO: 816328 - RNA, 19 nt, Homo sapiens
uccaggaacugcaccagau

SEQ ID NO: 816329 - RNA, 19 nt, Homo sapiens
aaucgaggcuuugggcaau

SEQ ID NO: 816330 - RNA, 19 nt, Homo sapiens
gcagcugccugggacucaa

SEQ ID NO: 816331 - RNA, 19 nt, Homo sapiens
cagcgcaacaccacagcua

SEQ ID NO: 816332 - RNA, 19 nt, Homo sapiens
auuuacagcucauagacaa

SEQ ID NO: 816333 - RNA, 19 nt, Homo sapiens
cguaggucauccucguaaa

SEQ ID NO: 816334 - RNA, 19 nt, Homo sapiens
ggaguuacugaacccuuau

SEQ ID NO: 816335 - RNA, 19 nt, Homo sapiens
gcaucccgcuccaggaacu

SEQ ID NO: 816336 - RNA, 19 nt, Homo sapiens
ggagauuaaccgacaucau

SEQ ID NO: 816337 - RNA, 19 nt, Homo sapiens
ucguaaacauaucaguaga

SEQ ID NO: 816338 - RNA, 19 nt, Homo sapiens
cauaucaguagaccuggaa

SEQ ID NO: 816339 - RNA, 19 nt, Homo sapiens
gcaggugcagaagcucuuu

SEQ ID NO: 816340 - RNA, 19 nt, Homo sapiens
caggaacugcaccagauga

SEQ ID NO: 816341 - RNA, 19 nt, Homo sapiens
gaauccuccaagauacuuu

SEQ ID NO: 816342 - RNA, 19 nt, Homo sapiens
caggauaucgacagcaaag

SEQ ID NO: 816343 - RNA, 19 nt, Homo sapiens
ugaacaagcuggaauaaua

SEQ ID NO: 816344 - RNA, 19 nt, Homo sapiens
agaagaagcuggucaguua

SEQ ID NO: 816345 - RNA, 19 nt, Homo sapiens
gcagaaaggucaacaucua

SEQ ID NO: 816346 - RNA, 19 nt, Homo sapiens
ccacacaucucauugaauu

SEQ ID NO: 816347 - RNA, 19 nt, Homo sapiens
ggacagauguggagccaaa

SEQ ID NO: 816348 - RNA, 19 nt, Homo sapiens
ggaggaaguuggccgaaua

SEQ ID NO: 816349 - RNA, 19 nt, Homo sapiens
gaaccugucuugauaagug

SEQ ID NO: 816350 - RNA, 19 nt, Homo sapiens
guacagacacggacuauaa

SEQ ID NO: 816351 - RNA, 19 nt, Homo sapiens
ugacagagcugaggaagaa

SEQ ID NO: 816352 - RNA, 19 nt, Homo sapiens
gaacaugaccugcuagaug

SEQ ID NO: 816353 - RNA, 19 nt, Homo sapiens
ccaaaguucugucauuaaa

SEQ ID NO: 816354 - RNA, 19 nt, Homo sapiens
gacacacccuucuuuauuu

SEQ ID NO: 816355 - RNA, 19 nt, Homo sapiens
gagaugaaauucuugcuau

SEQ ID NO: 816356 - RNA, 19 nt, Homo sapiens
guaaauggcuuggaacaug

SEQ ID NO: 816357 - RNA, 19 nt, Homo sapiens
ggaaguaacacucaacaaa

SEQ ID NO: 816358 - RNA, 19 nt, Homo sapiens
gcagaggacggaagacuua

SEQ ID NO: 816359 - RNA, 19 nt, Homo sapiens
ggccuuggcuuuaguauug

SEQ ID NO: 816360 - RNA, 19 nt, Homo sapiens
ggucagucauucacaauaa

SEQ ID NO: 816361 - RNA, 19 nt, Homo sapiens
gaauagcacuucugauaag

SEQ ID NO: 816362 - RNA, 19 nt, Homo sapiens
acacaaaugucacaccuaa

SEQ ID NO: 816363 - RNA, 19 nt, Homo sapiens
gcauaggaauucuucauga

SEQ ID NO: 816364 - RNA, 19 nt, Homo sapiens
gaacggcccugacccugaa

SEQ ID NO: 816365 - RNA, 19 nt, Homo sapiens
ucaguucucuucuuucuuu

SEQ ID NO: 816366 - RNA, 19 nt, Homo sapiens
agaaggaccugugcaguua

SEQ ID NO: 816367 - RNA, 19 nt, Homo sapiens
gagacgagcugccuaguca

SEQ ID NO: 816368 - RNA, 19 nt, Homo sapiens
gaaaucacuugguccuuug

SEQ ID NO: 816369 - RNA, 19 nt, Homo sapiens
gagcauagaauuccaaaga

SEQ ID NO: 816370 - RNA, 19 nt, Homo sapiens
uuacagcugugccuaauaa

SEQ ID NO: 816371 - RNA, 19 nt, Homo sapiens
agaaauagcuggcuugucu

SEQ ID NO: 816372 - RNA, 19 nt, Homo sapiens
gaugaaauccuagauguaa

SEQ ID NO: 816373 - RNA, 19 nt, Homo sapiens
gaugggcccuuggucauua

SEQ ID NO: 816374 - RNA, 19 nt, Homo sapiens
ggacagggcauauauagug

SEQ ID NO: 816375 - RNA, 19 nt, Homo sapiens
ccucauaucuggaguacaa

SEQ ID NO: 816376 - RNA, 19 nt, Homo sapiens
uuugaugccuggaauauua

SEQ ID NO: 816377 - RNA, 19 nt, Homo sapiens
ccugugcaguuauuaauua

SEQ ID NO: 816378 - RNA, 19 nt, Homo sapiens
aauagaagcuggagaugaa

SEQ ID NO: 816379 - RNA, 19 nt, Homo sapiens
gaacagacaggaauuucuu

SEQ ID NO: 816380 - RNA, 19 nt, Homo sapiens
aaucugaacucucccagua

SEQ ID NO: 816381 - RNA, 19 nt, Homo sapiens
gaucaaauccuggaaguga

SEQ ID NO: 816382 - RNA, 19 nt, Homo sapiens
ugacuuaauuggcaccaua

SEQ ID NO: 816383 - RNA, 19 nt, Homo sapiens
gcaagaauauaccaugaag

SEQ ID NO: 816384 - RNA, 19 nt, Homo sapiens
guacaggaguuaguuagaa

SEQ ID NO: 816385 - RNA, 19 nt, Homo sapiens
gaacuaaagaaaucacuug

SEQ ID NO: 816386 - RNA, 19 nt, Homo sapiens
acgaaacccugaaucaaua

SEQ ID NO: 816387 - RNA, 19 nt, Homo sapiens
caacaaagagccaagaguu

SEQ ID NO: 816388 - RNA, 19 nt, Homo sapiens
gaccuuugcuuccuucuug

SEQ ID NO: 816389 - RNA, 19 nt, Homo sapiens
ccacauggcuguccucucu

SEQ ID NO: 816390 - RNA, 19 nt, Homo sapiens
auaaggaccugucuaagaa

SEQ ID NO: 816391 - RNA, 19 nt, Homo sapiens
ggaagaguuugacagagaa

SEQ ID NO: 816392 - RNA, 19 nt, Homo sapiens
cggaguggauuauuuguuu

SEQ ID NO: 816393 - RNA, 19 nt, Homo sapiens
gaaguuggccgaauaugga

SEQ ID NO: 816394 - RNA, 19 nt, Homo sapiens
gcugugagguguccaguga

SEQ ID NO: 816395 - RNA, 19 nt, Homo sapiens
uagaggagcuuaauggaau

SEQ ID NO: 816396 - RNA, 19 nt, Homo sapiens
ggaauauuaugaagucugu

SEQ ID NO: 816397 - RNA, 19 nt, Homo sapiens
ccacaucucugaaagucaa

SEQ ID NO: 816398 - RNA, 19 nt, Homo sapiens
gaagacagcaccucccuau

SEQ ID NO: 816399 - RNA, 19 nt, Homo sapiens
caauuccucuccuggcuua

SEQ ID NO: 816400 - RNA, 19 nt, Homo sapiens
auaaagggcuugacauuuc

SEQ ID NO: 816401 - RNA, 19 nt, Homo sapiens
gcacuccaaccaugaauuu

SEQ ID NO: 816402 - RNA, 19 nt, Homo sapiens
ccucagaccucaucucuuc

SEQ ID NO: 816403 - RNA, 19 nt, Homo sapiens
ggugcaugcuugauugaua

SEQ ID NO: 816404 - RNA, 19 nt, Homo sapiens
caacugcagugacuuaagu

SEQ ID NO: 816405 - RNA, 19 nt, Homo sapiens
gccaugagcuucacugcuu

SEQ ID NO: 816406 - RNA, 19 nt, Homo sapiens
caacagcaaugaaauuaac

SEQ ID NO: 816407 - RNA, 19 nt, Homo sapiens
gaaauggccaacacuggua

SEQ ID NO: 816408 - RNA, 19 nt, Homo sapiens
gggcauauauaguguaaag

SEQ ID NO: 816409 - RNA, 19 nt, Homo sapiens
gaaaugcuucugacuaaug

SEQ ID NO: 816410 - RNA, 19 nt, Homo sapiens
ggacggaagacuuaaagaa

SEQ ID NO: 816411 - RNA, 19 nt, Homo sapiens
guucaaggcaugacuagua

SEQ ID NO: 816412 - RNA, 19 nt, Homo sapiens
ggagagugcauuugccaua

SEQ ID NO: 816413 - RNA, 19 nt, Homo sapiens
uaaaggagcagaaauguag

SEQ ID NO: 816414 - RNA, 19 nt, Homo sapiens
gcagauguuugcuucauag

SEQ ID NO: 816415 - RNA, 19 nt, Homo sapiens
gaaggaacaaccucuaaug

SEQ ID NO: 816416 - RNA, 19 nt, Homo sapiens
uaaauggcuuggaacauga

SEQ ID NO: 816417 - RNA, 19 nt, Homo sapiens
gaacaugaacacaggcaaa

SEQ ID NO: 816418 - RNA, 19 nt, Homo sapiens
ccacaucucuguaaacaac

SEQ ID NO: 816419 - RNA, 19 nt, Homo sapiens
cagcugugccuaauaauaa

SEQ ID NO: 816420 - RNA, 19 nt, Homo sapiens
agaaaucacuugguccuuu

SEQ ID NO: 816421 - RNA, 19 nt, Homo sapiens
caaauggaauggucuccuu

SEQ ID NO: 816422 - RNA, 19 nt, Homo sapiens
ugacacacccuucuuuauu

SEQ ID NO: 816423 - RNA, 19 nt, Homo sapiens
gaacaagcuggaauaauag

SEQ ID NO: 816424 - RNA, 19 nt, Homo sapiens
ggaggaccaucucuacuuc

SEQ ID NO: 816425 - RNA, 19 nt, Homo sapiens
gaagaaaccacagaaguca

SEQ ID NO: 816426 - RNA, 19 nt, Homo sapiens
gaacugucaggaucaagua

SEQ ID NO: 816427 - RNA, 19 nt, Homo sapiens
gcauagaauuccaaagaca

SEQ ID NO: 816428 - RNA, 19 nt, Homo sapiens
uccagaagcugcaggagua

SEQ ID NO: 816429 - RNA, 19 nt, Homo sapiens
gaauuugaugguugacuua

SEQ ID NO: 816430 - RNA, 19 nt, Homo sapiens
gaaagcauaggaauucuuc

SEQ ID NO: 816431 - RNA, 19 nt, Homo sapiens
gcacuuugaugccuggaau

SEQ ID NO: 816432 - RNA, 19 nt, Homo sapiens
gaacaaaccagcugaaaau

SEQ ID NO: 816433 - RNA, 19 nt, Homo sapiens
caucaucacucuuggagau

SEQ ID NO: 816434 - RNA, 19 nt, Homo sapiens
gcacuuaucaggagagcaa

SEQ ID NO: 816435 - RNA, 19 nt, Homo sapiens
gaaguaacacucaacaaag

SEQ ID NO: 816436 - RNA, 19 nt, Homo sapiens
ggagcaagaccucugauga

SEQ ID NO: 816437 - RNA, 19 nt, Homo sapiens
caauaaagggcuugacauu

SEQ ID NO: 816438 - RNA, 19 nt, Homo sapiens
acaaagcccacuccacuua

SEQ ID NO: 816439 - RNA, 19 nt, Homo sapiens
gaacacuaaugguauuguc

SEQ ID NO: 816440 - RNA, 19 nt, Homo sapiens
ggagauguaggucuguaua

SEQ ID NO: 816441 - RNA, 19 nt, Homo sapiens
agaggacaaucaaucauuu

SEQ ID NO: 816442 - RNA, 19 nt, Homo sapiens
aggcacagcugcacaaaga

SEQ ID NO: 816443 - RNA, 19 nt, Homo sapiens
gcaaauaucuucucuguca

SEQ ID NO: 816444 - RNA, 19 nt, Homo sapiens
gcacagagcuacuagucaa

SEQ ID NO: 816445 - RNA, 19 nt, Homo sapiens
ggaacaagcugaacugucu

SEQ ID NO: 816446 - RNA, 19 nt, Homo sapiens
gacaugggcuccugaaguu

SEQ ID NO: 816447 - RNA, 19 nt, Homo sapiens
cagcugcccucuucucuaa

SEQ ID NO: 816448 - RNA, 19 nt, Homo sapiens
caucacagcugcccucuuc

SEQ ID NO: 816449 - RNA, 19 nt, Homo sapiens
ugauugaccugacagagua

SEQ ID NO: 816450 - RNA, 19 nt, Homo sapiens
uauuauagcuuccuucugu

SEQ ID NO: 816451 - RNA, 19 nt, Homo sapiens
cagugaagcuuccugacua

SEQ ID NO: 816452 - RNA, 19 nt, Homo sapiens
gacgauggcuccuucuuca

SEQ ID NO: 816453 - RNA, 19 nt, Homo sapiens
ccacaaagaccaaagaagu

SEQ ID NO: 816454 - RNA, 19 nt, Homo sapiens
ggacacaccgcaaauaucu

SEQ ID NO: 816455 - RNA, 19 nt, Homo sapiens
ugaaacagcaagccaauga

SEQ ID NO: 816456 - RNA, 19 nt, Homo sapiens
uaucuucucugucaaguuc

SEQ ID NO: 816457 - RNA, 19 nt, Homo sapiens
ccgcaaauaucuucucugu

SEQ ID NO: 816458 - RNA, 19 nt, Homo sapiens
acaagaagcugcucuccau

SEQ ID NO: 816459 - RNA, 19 nt, Homo sapiens
gagugagggugacgcaauu

SEQ ID NO: 816460 - RNA, 19 nt, Homo sapiens
ccauucagcuuuacagcaa

SEQ ID NO: 816461 - RNA, 19 nt, Homo sapiens
gcagcaacgcucaguauau

SEQ ID NO: 816462 - RNA, 19 nt, Homo sapiens
cagcagcgcuugugaugca

SEQ ID NO: 816463 - RNA, 19 nt, Homo sapiens
ccaauggccugcaccuuca

SEQ ID NO: 816464 - RNA, 19 nt, Homo sapiens
ggacaugggcuccugaagu

SEQ ID NO: 816465 - RNA, 19 nt, Homo sapiens
gaaagucaacauaacuaga

SEQ ID NO: 816466 - RNA, 19 nt, Homo sapiens
cagcaacgcucaguauauc

SEQ ID NO: 816467 - RNA, 19 nt, Homo sapiens
ggcaccaucucauugcuuu

SEQ ID NO: 816468 - RNA, 19 nt, Homo sapiens
gcuacaacuugcuggcuuu

SEQ ID NO: 816469 - RNA, 19 nt, Homo sapiens
gcaaggacuccaucucaga

SEQ ID NO: 816470 - RNA, 19 nt, Homo sapiens
ucaacugucuggaguggaa

SEQ ID NO: 816471 - RNA, 19 nt, Homo sapiens
gagcgaagcuacgacuauc

SEQ ID NO: 816472 - RNA, 19 nt, Homo sapiens
ggaguggaaugagaaagga

SEQ ID NO: 816473 - RNA, 19 nt, Homo sapiens
gcgaaagucaacauaacua

SEQ ID NO: 816474 - RNA, 19 nt, Homo sapiens
gaagggagagcaggaguau

SEQ ID NO: 816475 - RNA, 19 nt, Homo sapiens
ucaaggccaucucccuaaa

SEQ ID NO: 816476 - RNA, 19 nt, Homo sapiens
gcaguggacccaagccauu

SEQ ID NO: 816477 - RNA, 19 nt, Homo sapiens
gaccugggcuuggcuggaa

SEQ ID NO: 816478 - RNA, 19 nt, Homo sapiens
acucggaggugcugauuga

SEQ ID NO: 816479 - RNA, 19 nt, Homo sapiens
uccugaagauccuauuaua

SEQ ID NO: 816480 - RNA, 19 nt, Homo sapiens
gacaggagggccauguuaa

SEQ ID NO: 816481 - RNA, 19 nt, Homo sapiens
gagcagcagccuacaugaa

SEQ ID NO: 816482 - RNA, 19 nt, Homo sapiens
gaagcuacgacuaucaguu

SEQ ID NO: 816483 - RNA, 19 nt, Homo sapiens
ggagaccauccacauguuu

SEQ ID NO: 816484 - RNA, 19 nt, Homo sapiens
agacaggagggccauguua

SEQ ID NO: 816485 - RNA, 19 nt, Homo sapiens
gacagguaauuaaaugugu

SEQ ID NO: 816486 - RNA, 19 nt, Homo sapiens
ggacggugcagcccaguau

SEQ ID NO: 816487 - RNA, 19 nt, Homo sapiens
uaucaaagaggccaauuuc

SEQ ID NO: 816488 - RNA, 19 nt, Homo sapiens
ggagcgaagcuacgacuau

SEQ ID NO: 816489 - RNA, 19 nt, Homo sapiens
gacauccgcaugauccaua

SEQ ID NO: 816490 - RNA, 19 nt, Homo sapiens
gagggugacgcaauugauu

SEQ ID NO: 816491 - RNA, 19 nt, Homo sapiens
gaagcuuccugacuacaac

SEQ ID NO: 816492 - RNA, 19 nt, Homo sapiens
uaaaggagaccauccacau

SEQ ID NO: 816493 - RNA, 19 nt, Homo sapiens
gugcacgaccugacaguaa

SEQ ID NO: 816494 - RNA, 19 nt, Homo sapiens
gaaugagaaaggagacuug

SEQ ID NO: 816495 - RNA, 19 nt, Homo sapiens
gcaacaccaccacggauau

SEQ ID NO: 816496 - RNA, 19 nt, Homo sapiens
gggcuuauccgccaguaug

SEQ ID NO: 816497 - RNA, 19 nt, Homo sapiens
gaaaagauggcgaaaguca

SEQ ID NO: 816498 - RNA, 19 nt, Homo sapiens
gcuugguaaugaaguauau

SEQ ID NO: 816499 - RNA, 19 nt, Homo sapiens
ccacucagaugggaaaguc

SEQ ID NO: 816500 - RNA, 19 nt, Homo sapiens
ugccagcacuucugcacua

SEQ ID NO: 816501 - RNA, 19 nt, Homo sapiens
gcucaaguauguggcugaa

SEQ ID NO: 816502 - RNA, 19 nt, Homo sapiens
ccaggugccuccucucagu

SEQ ID NO: 816503 - RNA, 19 nt, Homo sapiens
gguccagaauggcaagaug

SEQ ID NO: 816504 - RNA, 19 nt, Homo sapiens
caugauccauaaccacaga

SEQ ID NO: 816505 - RNA, 19 nt, Homo sapiens
ucuucuagcuugguaauga

SEQ ID NO: 816506 - RNA, 19 nt, Homo sapiens
cgacuucaaagggaaauuu

SEQ ID NO: 816507 - RNA, 19 nt, Homo sapiens
caaauaucuucucugucaa

SEQ ID NO: 816508 - RNA, 19 nt, Homo sapiens
gguccugaagauccuauua

SEQ ID NO: 816509 - RNA, 19 nt, Homo sapiens
gcgaucaacccaccacuca

SEQ ID NO: 816510 - RNA, 19 nt, Homo sapiens
uggcaucgauccuguugug

SEQ ID NO: 816511 - RNA, 19 nt, Homo sapiens
ggagugugaguguguguga

SEQ ID NO: 816512 - RNA, 19 nt, Homo sapiens
cuacaacaaccguuugaga

SEQ ID NO: 816513 - RNA, 19 nt, Homo sapiens
agggagagcaggaguauug

SEQ ID NO: 816514 - RNA, 19 nt, Homo sapiens
cuagcuugguaaugaagua

SEQ ID NO: 816515 - RNA, 19 nt, Homo sapiens
ggucuggcaccaucucauu

SEQ ID NO: 816516 - RNA, 19 nt, Homo sapiens
ccaacgguguguccaaugg

SEQ ID NO: 816517 - RNA, 19 nt, Homo sapiens
aguaugaccuucgagagaa

SEQ ID NO: 816518 - RNA, 19 nt, Homo sapiens
gcccuucucugcccuuucu

SEQ ID NO: 816519 - RNA, 19 nt, Homo sapiens
ggaggaacaagcugaacug

SEQ ID NO: 816520 - RNA, 19 nt, Homo sapiens
gcucuggccugccucaaaa

SEQ ID NO: 816521 - RNA, 19 nt, Homo sapiens
gauggcgaaagucaacaua

SEQ ID NO: 816522 - RNA, 19 nt, Homo sapiens
acaaagaccaaagaaguga

SEQ ID NO: 816523 - RNA, 19 nt, Homo sapiens
ggcagcaacgcucaguaua

SEQ ID NO: 816524 - RNA, 19 nt, Homo sapiens
ccaccacggauaucaaaga

SEQ ID NO: 816525 - RNA, 19 nt, Homo sapiens
ggacgacuucaaagggaaa

SEQ ID NO: 816526 - RNA, 19 nt, Homo sapiens
ggaaugagaaaggagacuu

SEQ ID NO: 816527 - RNA, 19 nt, Homo sapiens
caggaugugucaacugucu

SEQ ID NO: 816528 - RNA, 19 nt, Homo sapiens
gggugacgcaauugauuaa

SEQ ID NO: 816529 - RNA, 19 nt, Homo sapiens
gaggugaugcugcucaaca

SEQ ID NO: 816530 - RNA, 19 nt, Homo sapiens
gagaccauccacauguuug

SEQ ID NO: 816531 - RNA, 19 nt, Homo sapiens
caccaucucauugcuuuaa

SEQ ID NO: 816532 - RNA, 19 nt, Homo sapiens
gagccacucagaugggaaa

SEQ ID NO: 816533 - RNA, 19 nt, Homo sapiens
ugcacgaccugacaguaaa

SEQ ID NO: 816534 - RNA, 19 nt, Homo sapiens
aagaaaagauggcgaaagu

SEQ ID NO: 816535 - RNA, 19 nt, Homo sapiens
ugucuggaguggaaugaga

SEQ ID NO: 816536 - RNA, 19 nt, Homo sapiens
gcaccaucucauugcuuua

SEQ ID NO: 816537 - RNA, 19 nt, Homo sapiens
acaggagggccauguuaaa

SEQ ID NO: 816538 - RNA, 19 nt, Homo sapiens
gaagauauggagggugcuu

SEQ ID NO: 816539 - RNA, 19 nt, Homo sapiens
gccgagucguggaagauau

SEQ ID NO: 816540 - RNA, 19 nt, Homo sapiens
gggaugaguccauugucaa

SEQ ID NO: 816541 - RNA, 19 nt, Homo sapiens
ugacagguaauuaaaugug

SEQ ID NO: 816542 - RNA, 19 nt, Homo sapiens
gaacaagcugaacugucuu

SEQ ID NO: 816543 - RNA, 19 nt, Homo sapiens
gauaagagauacaaacuga

SEQ ID NO: 816544 - RNA, 19 nt, Homo sapiens
acagugaucucuuggauua

SEQ ID NO: 816545 - RNA, 19 nt, Homo sapiens
gcaaacagcuguaugaaac

SEQ ID NO: 816546 - RNA, 19 nt, Homo sapiens
ggaacuaugugcucaacua

SEQ ID NO: 816547 - RNA, 19 nt, Homo sapiens
uaucagacccaaacaauua

SEQ ID NO: 816548 - RNA, 19 nt, Homo sapiens
gcaagaugauaacaaugua

SEQ ID NO: 816549 - RNA, 19 nt, Homo sapiens
gaauagcaaugacaugaug

SEQ ID NO: 816550 - RNA, 19 nt, Homo sapiens
ugacauaccucuucaagca

SEQ ID NO: 816551 - RNA, 19 nt, Homo sapiens
gaacaagguuuauauugac

SEQ ID NO: 816552 - RNA, 19 nt, Homo sapiens
gaaaccagcaagaugauaa

SEQ ID NO: 816553 - RNA, 19 nt, Homo sapiens
gucagaagaucccuguuua

SEQ ID NO: 816554 - RNA, 19 nt, Homo sapiens
ggaaagaaucuaaacuuga

SEQ ID NO: 816555 - RNA, 19 nt, Homo sapiens
caaugaagaauuccacuua

SEQ ID NO: 816556 - RNA, 19 nt, Homo sapiens
ugacauggcugguuuacau

SEQ ID NO: 816557 - RNA, 19 nt, Homo sapiens
gguauuauccugcuuggua

SEQ ID NO: 816558 - RNA, 19 nt, Homo sapiens
uaucucagcuaaccaauga

SEQ ID NO: 816559 - RNA, 19 nt, Homo sapiens
gccauaaccugccuuguau

SEQ ID NO: 816560 - RNA, 19 nt, Homo sapiens
ucacagacgucacaagguu

SEQ ID NO: 816561 - RNA, 19 nt, Homo sapiens
guugauggcugaauugguu

SEQ ID NO: 816562 - RNA, 19 nt, Homo sapiens
gagaaagccuugguugaau

SEQ ID NO: 816563 - RNA, 19 nt, Homo sapiens
acagaucgcuucagucaga

SEQ ID NO: 816564 - RNA, 19 nt, Homo sapiens
gacuaugucuucagaaaug

SEQ ID NO: 816565 - RNA, 19 nt, Homo sapiens
cacuacagcuucucaauga

SEQ ID NO: 816566 - RNA, 19 nt, Homo sapiens
gaaccaaucaccuccaaga

SEQ ID NO: 816567 - RNA, 19 nt, Homo sapiens
gaucagccuucuuagauuc

SEQ ID NO: 816568 - RNA, 19 nt, Homo sapiens
guucugggcuugaaugaug

SEQ ID NO: 816569 - RNA, 19 nt, Homo sapiens
guacagaucgcuucaguca

SEQ ID NO: 816570 - RNA, 19 nt, Homo sapiens
gagaucagccuucuuagau

SEQ ID NO: 816571 - RNA, 19 nt, Homo sapiens
cacaagcacuuauucaguu

SEQ ID NO: 816572 - RNA, 19 nt, Homo sapiens
gaccagcuguccaccauug

SEQ ID NO: 816573 - RNA, 19 nt, Homo sapiens
ccagcaagaugauaacaau

SEQ ID NO: 816574 - RNA, 19 nt, Homo sapiens
gaaacaguauugugaacag

SEQ ID NO: 816575 - RNA, 19 nt, Homo sapiens
gaacaucaucaucuuugaa

SEQ ID NO: 816576 - RNA, 19 nt, Homo sapiens
ccuaacagauucucguuug

SEQ ID NO: 816577 - RNA, 19 nt, Homo sapiens
gaaagccuugguugaauuu

SEQ ID NO: 816578 - RNA, 19 nt, Homo sapiens
cgagaaaccagcaagauga

SEQ ID NO: 816579 - RNA, 19 nt, Homo sapiens
guaaugagaagcuagaguu

SEQ ID NO: 816580 - RNA, 19 nt, Homo sapiens
ggaugacuaugucuucaga

SEQ ID NO: 816581 - RNA, 19 nt, Homo sapiens
acaagcacuuauucaguua

SEQ ID NO: 816582 - RNA, 19 nt, Homo sapiens
uaggagaggucccaaagga

SEQ ID NO: 816583 - RNA, 19 nt, Homo sapiens
cuacagcacugggaauuug

SEQ ID NO: 816584 - RNA, 19 nt, Homo sapiens
cuaagaaacaguauuguga

SEQ ID NO: 816585 - RNA, 19 nt, Homo sapiens
gcagacuacuggcccgauu

SEQ ID NO: 816586 - RNA, 19 nt, Homo sapiens
cagcuaaccaaugaaauua

SEQ ID NO: 816587 - RNA, 19 nt, Homo sapiens
guugaauacugcaucauug

SEQ ID NO: 816588 - RNA, 19 nt, Homo sapiens
agaaagccuugguugaauu

SEQ ID NO: 816589 - RNA, 19 nt, Homo sapiens
uaaccugccuuguauaaac

SEQ ID NO: 816590 - RNA, 19 nt, Homo sapiens
gaccauaugaacuuuauug

SEQ ID NO: 816591 - RNA, 19 nt, Homo sapiens
ucacguagcaccaagaaga

SEQ ID NO: 816592 - RNA, 19 nt, Homo sapiens
ucaagggcaucuccaucua

SEQ ID NO: 816593 - RNA, 19 nt, Homo sapiens
ggagaucagccuucuuaga

SEQ ID NO: 816594 - RNA, 19 nt, Homo sapiens
cauaaccugccuuguauaa

SEQ ID NO: 816595 - RNA, 19 nt, Homo sapiens
gaccuaagaaacaguauug

SEQ ID NO: 816596 - RNA, 19 nt, Homo sapiens
cuacuuggcuugauauugc

SEQ ID NO: 816597 - RNA, 19 nt, Homo sapiens
gcacuugacaccaugguau

SEQ ID NO: 816598 - RNA, 19 nt, Homo sapiens
cagccagucuuauuauuca

SEQ ID NO: 816599 - RNA, 19 nt, Homo sapiens
gaugcucuuugaauggaua

SEQ ID NO: 816600 - RNA, 19 nt, Homo sapiens
gguccuaagcgucuucaua

SEQ ID NO: 816601 - RNA, 19 nt, Homo sapiens
gcacuuauucaguuauaug

SEQ ID NO: 816602 - RNA, 19 nt, Homo sapiens
uagagaaucugugcaaaca

SEQ ID NO: 816603 - RNA, 19 nt, Homo sapiens
ucauguauauucucucuuc

SEQ ID NO: 816604 - RNA, 19 nt, Homo sapiens
gaaccucacgucaucaugu

SEQ ID NO: 816605 - RNA, 19 nt, Homo sapiens
ucaagcugcuccucucuau

SEQ ID NO: 816606 - RNA, 19 nt, Homo sapiens
cuaagcgucuucauaggaa

SEQ ID NO: 816607 - RNA, 19 nt, Homo sapiens
cccacaugcuggaaacuua

SEQ ID NO: 816608 - RNA, 19 nt, Homo sapiens
gcagagagggccaaguuuc

SEQ ID NO: 816609 - RNA, 19 nt, Homo sapiens
agacaccacccauccuuua

SEQ ID NO: 816610 - RNA, 19 nt, Homo sapiens
ucaguuauaugccagaauc

SEQ ID NO: 816611 - RNA, 19 nt, Homo sapiens
gagacagguucacccagaa

SEQ ID NO: 816612 - RNA, 19 nt, Homo sapiens
gagcaugaauggagcaaaa

SEQ ID NO: 816613 - RNA, 19 nt, Homo sapiens
gccaagaccagcuucauga

SEQ ID NO: 816614 - RNA, 19 nt, Homo sapiens
gaaauccucuaagcuguac

SEQ ID NO: 816615 - RNA, 19 nt, Homo sapiens
gauugaagaguaacuauca

SEQ ID NO: 816616 - RNA, 19 nt, Homo sapiens
gggccaaguuucucucuca

SEQ ID NO: 816617 - RNA, 19 nt, Homo sapiens
aggaaagaaucuaaacuug

SEQ ID NO: 816618 - RNA, 19 nt, Homo sapiens
uaagagauacaaacugaga

SEQ ID NO: 816619 - RNA, 19 nt, Homo sapiens
ugaugaaccuaacagauuc

SEQ ID NO: 816620 - RNA, 19 nt, Homo sapiens
gcgaaaucuucuuacgaaa

SEQ ID NO: 816621 - RNA, 19 nt, Homo sapiens
ggcuugauauugcuuaaug

SEQ ID NO: 816622 - RNA, 19 nt, Homo sapiens
acaaugcucugcagaccuu

SEQ ID NO: 816623 - RNA, 19 nt, Homo sapiens
caaaggaucaggucuaugc

SEQ ID NO: 816624 - RNA, 19 nt, Homo sapiens
caauugagcucugguacca

SEQ ID NO: 816625 - RNA, 19 nt, Homo sapiens
gagaggaugaagaucagua

SEQ ID NO: 816626 - RNA, 19 nt, Homo sapiens
caccaaagccuacaucaca

SEQ ID NO: 816627 - RNA, 19 nt, Homo sapiens
caacugggagaauugguaa

SEQ ID NO: 816628 - RNA, 19 nt, Homo sapiens
gaagaguaacuaucaacug

SEQ ID NO: 816629 - RNA, 19 nt, Homo sapiens
ucagaaggaugacuauguc

SEQ ID NO: 816630 - RNA, 19 nt, Homo sapiens
cccagaaccugucagcauu

SEQ ID NO: 816631 - RNA, 19 nt, Homo sapiens
ccaaguuucucucucaucu

SEQ ID NO: 816632 - RNA, 19 nt, Homo sapiens
aaacaggcuucaggaaaga

SEQ ID NO: 816633 - RNA, 19 nt, Homo sapiens
cuacaugccuuaccaagcu

SEQ ID NO: 816634 - RNA, 19 nt, Homo sapiens
gucaacgacucaaugaaga

SEQ ID NO: 816635 - RNA, 19 nt, Homo sapiens
ccaauggcaucuuacucuu

SEQ ID NO: 816636 - RNA, 19 nt, Homo sapiens
ucaugaugcucuuugaaug

SEQ ID NO: 816637 - RNA, 19 nt, Homo sapiens
gcagcuacaugccuuacca

SEQ ID NO: 816638 - RNA, 19 nt, Homo sapiens
uuccaucccuccuucauuu

SEQ ID NO: 816639 - RNA, 19 nt, Homo sapiens
caggaaagaaucuaaacuu

SEQ ID NO: 816640 - RNA, 19 nt, Homo sapiens
gagcagcgucccuuugguu

SEQ ID NO: 816641 - RNA, 19 nt, Homo sapiens
ggaugaagaucaguaugag

SEQ ID NO: 816642 - RNA, 19 nt, Homo sapiens
gaaguucugggcuugaaug

SEQ ID NO: 816643 - RNA, 19 nt, Homo sapiens
ggaguugccuugcgagauu

SEQ ID NO: 816644 - RNA, 19 nt, Homo sapiens
gcucauggcuuguccuaau

SEQ ID NO: 816645 - RNA, 19 nt, Homo sapiens
gaacauaacacuucuuugc

SEQ ID NO: 816646 - RNA, 19 nt, Homo sapiens
ggaguaaagcgcucucuaa

SEQ ID NO: 816647 - RNA, 19 nt, Homo sapiens
guacauuucuguuccuaga

SEQ ID NO: 816648 - RNA, 19 nt, Homo sapiens
ggucagaaauacuucaguu

SEQ ID NO: 816649 - RNA, 19 nt, Homo sapiens
ggauguguguguucuaaga

SEQ ID NO: 816650 - RNA, 19 nt, Homo sapiens
gcacaagcacccuaaaugu

SEQ ID NO: 816651 - RNA, 19 nt, Homo sapiens
guaaagcgcucucuaaacc

SEQ ID NO: 816652 - RNA, 19 nt, Homo sapiens
gcacaagguguauauaugu

SEQ ID NO: 816653 - RNA, 19 nt, Homo sapiens
gaguaaagcgcucucuaaa

SEQ ID NO: 816654 - RNA, 19 nt, Homo sapiens
caaggaaggaggaaagauu

SEQ ID NO: 816655 - RNA, 19 nt, Homo sapiens
gaacugcuccuucgacucu

SEQ ID NO: 816656 - RNA, 19 nt, Homo sapiens
aauagaaacuccuccacaa

SEQ ID NO: 816657 - RNA, 19 nt, Homo sapiens
gcuucucucucucugguua

SEQ ID NO: 816658 - RNA, 19 nt, Homo sapiens
gcacgaagugugaucuuau

SEQ ID NO: 816659 - RNA, 19 nt, Homo sapiens
ccgccaaccugaacagaaa

SEQ ID NO: 816660 - RNA, 19 nt, Homo sapiens
gcagggaaguaggaaauag

SEQ ID NO: 816661 - RNA, 19 nt, Homo sapiens
gggaacauaacacuucuuu

SEQ ID NO: 816662 - RNA, 19 nt, Homo sapiens
cauugacucucuaaacuug

SEQ ID NO: 816663 - RNA, 19 nt, Homo sapiens
gagaggugcucaucaucau

SEQ ID NO: 816664 - RNA, 19 nt, Homo sapiens
agaaacuccuccacaaaga

SEQ ID NO: 816665 - RNA, 19 nt, Homo sapiens
gccgauggcuguacauagu

SEQ ID NO: 816666 - RNA, 19 nt, Homo sapiens
ugaagagcuuggacugauu

SEQ ID NO: 816667 - RNA, 19 nt, Homo sapiens
gagauggucagaaauacuu

SEQ ID NO: 816668 - RNA, 19 nt, Homo sapiens
gcagugacguuagggaaca

SEQ ID NO: 816669 - RNA, 19 nt, Homo sapiens
gggaaauuguuaaaucagu

SEQ ID NO: 816670 - RNA, 19 nt, Homo sapiens
ucaguucaguauuugcuuu

SEQ ID NO: 816671 - RNA, 19 nt, Homo sapiens
gaccaggccuuggcucaug

SEQ ID NO: 816672 - RNA, 19 nt, Homo sapiens
ccgcaugacuguuuacaag

SEQ ID NO: 816673 - RNA, 19 nt, Homo sapiens
gaaggaggaaagauuaaca

SEQ ID NO: 816674 - RNA, 19 nt, Homo sapiens
aaggaaggaggaaagauua

SEQ ID NO: 816675 - RNA, 19 nt, Homo sapiens
acaagcacccuaaauguug

SEQ ID NO: 816676 - RNA, 19 nt, Homo sapiens
gcugggagguggcuuggau

SEQ ID NO: 816677 - RNA, 19 nt, Homo sapiens
ccacaugugucuucucacu

SEQ ID NO: 816678 - RNA, 19 nt, Homo sapiens
ggacucgucaucuuacuuc

SEQ ID NO: 816679 - RNA, 19 nt, Homo sapiens
caaccugaacagaaaguuu

SEQ ID NO: 816680 - RNA, 19 nt, Homo sapiens
gcagagggcaguuuaaagc

SEQ ID NO: 816681 - RNA, 19 nt, Homo sapiens
gaagagcuuggacugauuc

SEQ ID NO: 816682 - RNA, 19 nt, Homo sapiens
caaaguugcccacccuguu

SEQ ID NO: 816683 - RNA, 19 nt, Homo sapiens
caccacaugugucuucuca

SEQ ID NO: 816684 - RNA, 19 nt, Homo sapiens
cacaagguguauauauguu

SEQ ID NO: 816685 - RNA, 19 nt, Homo sapiens
gggcagagggcaguuuaaa

SEQ ID NO: 816686 - RNA, 19 nt, Homo sapiens
agagggaguuggcagaguu

SEQ ID NO: 816687 - RNA, 19 nt, Homo sapiens
gcagaaaauuaucaaggaa

SEQ ID NO: 816688 - RNA, 19 nt, Homo sapiens
ggaaguaggaaauagaaac

SEQ ID NO: 816689 - RNA, 19 nt, Homo sapiens
gauagaaacacguaagacu

SEQ ID NO: 816690 - RNA, 19 nt, Homo sapiens
acauuucuguuccuagauu

SEQ ID NO: 816691 - RNA, 19 nt, Homo sapiens
gaagcagccagaacucuca

SEQ ID NO: 816692 - RNA, 19 nt, Homo sapiens
ccagggagucuucuagcua

SEQ ID NO: 816693 - RNA, 19 nt, Homo sapiens
ucagucaguucaguauuug

SEQ ID NO: 816694 - RNA, 19 nt, Homo sapiens
uagcacaagguguauauau

SEQ ID NO: 816695 - RNA, 19 nt, Homo sapiens
gugacuagcacaaggugua

SEQ ID NO: 816696 - RNA, 19 nt, Homo sapiens
gaaguaggaaauagaaacu

SEQ ID NO: 816697 - RNA, 19 nt, Homo sapiens
caggagcagugacuuucuu

SEQ ID NO: 816698 - RNA, 19 nt, Homo sapiens
acacuucuuugcccugcua

SEQ ID NO: 816699 - RNA, 19 nt, Homo sapiens
gucagaaauacuucaguua

SEQ ID NO: 816700 - RNA, 19 nt, Homo sapiens
cacaagcacccuaaauguu

SEQ ID NO: 816701 - RNA, 19 nt, Homo sapiens
cacgaagugugaucuuaug

SEQ ID NO: 816702 - RNA, 19 nt, Homo sapiens
uugcaucgcuggucuugug

SEQ ID NO: 816703 - RNA, 19 nt, Homo sapiens
aaaguugcccacccuguuu

SEQ ID NO: 816704 - RNA, 19 nt, Homo sapiens
guuccuagauuggaugugu

SEQ ID NO: 816705 - RNA, 19 nt, Homo sapiens
ccuugcagcuaacccuuaa

SEQ ID NO: 816706 - RNA, 19 nt, Homo sapiens
cagaggacgcagugacuuu

SEQ ID NO: 816707 - RNA, 19 nt, Homo sapiens
ugagcggguucccuggaua

SEQ ID NO: 816708 - RNA, 19 nt, Homo sapiens
gcagugacuuuuggacuuu

SEQ ID NO: 816709 - RNA, 19 nt, Homo sapiens
cagcacucaugaucuugaa

SEQ ID NO: 816710 - RNA, 19 nt, Homo sapiens
gcgauagaaacacguaaga

SEQ ID NO: 816711 - RNA, 19 nt, Homo sapiens
cugaagagcuuggacugau

SEQ ID NO: 816712 - RNA, 19 nt, Homo sapiens
ugcacgaagugugaucuua

SEQ ID NO: 816713 - RNA, 19 nt, Homo sapiens
gagcugccacagaggcuaa

SEQ ID NO: 816714 - RNA, 19 nt, Homo sapiens
uagauuggauguguguguu

SEQ ID NO: 816715 - RNA, 19 nt, Homo sapiens
gcuguugccuccuggaaac

SEQ ID NO: 816716 - RNA, 19 nt, Homo sapiens
uuugauaccuuuguucugu

SEQ ID NO: 816717 - RNA, 19 nt, Homo sapiens
ugugguaugugucccuuug

SEQ ID NO: 816718 - RNA, 19 nt, Homo sapiens
gaguugccuugcgagauuu

SEQ ID NO: 816719 - RNA, 19 nt, Homo sapiens
cgagaggugcucaucauca

SEQ ID NO: 816720 - RNA, 19 nt, Homo sapiens
caagcgauagaaacacgua

SEQ ID NO: 816721 - RNA, 19 nt, Homo sapiens
ccugggaccugaacagucu

SEQ ID NO: 816722 - RNA, 19 nt, Homo sapiens
cgccuccucuguuugcuuu

SEQ ID NO: 816723 - RNA, 19 nt, Homo sapiens
gaagaccccugagaugaau

SEQ ID NO: 816724 - RNA, 19 nt, Homo sapiens
gagaagaccccugagauga

SEQ ID NO: 816725 - RNA, 19 nt, Homo sapiens
uagaaacuccuccacaaag

SEQ ID NO: 816726 - RNA, 19 nt, Homo sapiens
aucagucaguucaguauuu

SEQ ID NO: 816727 - RNA, 19 nt, Homo sapiens
gagcccaacauccaugaga

SEQ ID NO: 816728 - RNA, 19 nt, Homo sapiens
gggagauggucagaaauac

SEQ ID NO: 816729 - RNA, 19 nt, Homo sapiens
gaaacuccuccacaaagag

SEQ ID NO: 816730 - RNA, 19 nt, Homo sapiens
guucuugcacgaaguguga

SEQ ID NO: 816731 - RNA, 19 nt, Homo sapiens
gaaacacguaagacucugu

SEQ ID NO: 816732 - RNA, 19 nt, Homo sapiens
aaagaauccguccgcauga

SEQ ID NO: 816733 - RNA, 19 nt, Homo sapiens
ggucagagugccaccuuca

SEQ ID NO: 816734 - RNA, 19 nt, Homo sapiens
cucgucaucuuacuucuug

SEQ ID NO: 816735 - RNA, 19 nt, Homo sapiens
uguccaagguccauguuag

SEQ ID NO: 816736 - RNA, 19 nt, Homo sapiens
cgaguugugcuucaugaga

SEQ ID NO: 816737 - RNA, 19 nt, Homo sapiens
gaccuugcaaccuguaaga

SEQ ID NO: 816738 - RNA, 19 nt, Homo sapiens
agcacaagguguauauaug

SEQ ID NO: 816739 - RNA, 19 nt, Homo sapiens
uuagggaacauaacacuuc

SEQ ID NO: 816740 - RNA, 19 nt, Homo sapiens
ggggagauggucagaaaua

SEQ ID NO: 816741 - RNA, 19 nt, Homo sapiens
gcccuucugugcccaucuu

SEQ ID NO: 816742 - RNA, 19 nt, Homo sapiens
ucugggacucgucaucuua

SEQ ID NO: 816743 - RNA, 19 nt, Homo sapiens
ggauagaucuuaagcagua

SEQ ID NO: 816744 - RNA, 19 nt, Homo sapiens
gggauuaucuuacguuuaa

SEQ ID NO: 816745 - RNA, 19 nt, Homo sapiens
gaaauaugcuuuacaguca

SEQ ID NO: 816746 - RNA, 19 nt, Homo sapiens
gaacggcgaugaacaaaug

SEQ ID NO: 816747 - RNA, 19 nt, Homo sapiens
gaucuucacuguauaugua

SEQ ID NO: 816748 - RNA, 19 nt, Homo sapiens
ggaggaaguuucuacagua

SEQ ID NO: 816749 - RNA, 19 nt, Homo sapiens
ugaaagaucuucucaugaa

SEQ ID NO: 816750 - RNA, 19 nt, Homo sapiens
gaacggaucuuugcucaau

SEQ ID NO: 816751 - RNA, 19 nt, Homo sapiens
ugauaaagauguucgcuua

SEQ ID NO: 816752 - RNA, 19 nt, Homo sapiens
guaagaaugucaggaauuu

SEQ ID NO: 816753 - RNA, 19 nt, Homo sapiens
gaagugguauauccaagua

SEQ ID NO: 816754 - RNA, 19 nt, Homo sapiens
guaacaaguuccauuauga

SEQ ID NO: 816755 - RNA, 19 nt, Homo sapiens
gaugaaugcuaucaaguaa

SEQ ID NO: 816756 - RNA, 19 nt, Homo sapiens
uaaauggucucuucccuuu

SEQ ID NO: 816757 - RNA, 19 nt, Homo sapiens
gcaguaaucugucaguguu

SEQ ID NO: 816758 - RNA, 19 nt, Homo sapiens
ggauuuaaaugcugugaaa

SEQ ID NO: 816759 - RNA, 19 nt, Homo sapiens
gaaauuugcuagccauugu

SEQ ID NO: 816760 - RNA, 19 nt, Homo sapiens
gagcaugucuuugacuuaa

SEQ ID NO: 816761 - RNA, 19 nt, Homo sapiens
guuagaagaugaugagaaa

SEQ ID NO: 816762 - RNA, 19 nt, Homo sapiens
ccagaaauguuuauggaaa

SEQ ID NO: 816763 - RNA, 19 nt, Homo sapiens
guauagauauuuccucuug

SEQ ID NO: 816764 - RNA, 19 nt, Homo sapiens
gaagaaagacaaaguggaa

SEQ ID NO: 816765 - RNA, 19 nt, Homo sapiens
gaacuucuaccuuaagauu

SEQ ID NO: 816766 - RNA, 19 nt, Homo sapiens
gaucuuugcucaauacaug

SEQ ID NO: 816767 - RNA, 19 nt, Homo sapiens
ggacuugcccaaauuuaua

SEQ ID NO: 816768 - RNA, 19 nt, Homo sapiens
caugaaccauccugauuua

SEQ ID NO: 816769 - RNA, 19 nt, Homo sapiens
gcaaacuauuucagugaua

SEQ ID NO: 816770 - RNA, 19 nt, Homo sapiens
gaacaaaucaauagaugga

SEQ ID NO: 816771 - RNA, 19 nt, Homo sapiens
gcuauugagccauauauua

SEQ ID NO: 816772 - RNA, 19 nt, Homo sapiens
gauuaaagaugguugugaa

SEQ ID NO: 816773 - RNA, 19 nt, Homo sapiens
gaggaaguuucuacaguaa

SEQ ID NO: 816774 - RNA, 19 nt, Homo sapiens
gaucaaagacaaauugcua

SEQ ID NO: 816775 - RNA, 19 nt, Homo sapiens
aaaccuagcuuuacaucuu

SEQ ID NO: 816776 - RNA, 19 nt, Homo sapiens
ggaaguuucuacaguaaau

SEQ ID NO: 816777 - RNA, 19 nt, Homo sapiens
ugggagaaguggaaauuua

SEQ ID NO: 816778 - RNA, 19 nt, Homo sapiens
ccaugcaaauugugaaaua

SEQ ID NO: 816779 - RNA, 19 nt, Homo sapiens
cuucagaggugcuaaauug

SEQ ID NO: 816780 - RNA, 19 nt, Homo sapiens
ggucaagucauauaacaua

SEQ ID NO: 816781 - RNA, 19 nt, Homo sapiens
gagaggcugucauauauca

SEQ ID NO: 816782 - RNA, 19 nt, Homo sapiens
gaaagacaaaguggaaaua

SEQ ID NO: 816783 - RNA, 19 nt, Homo sapiens
gaccuuaugagcucuauua

SEQ ID NO: 816784 - RNA, 19 nt, Homo sapiens
uaaauugucugccauuaca

SEQ ID NO: 816785 - RNA, 19 nt, Homo sapiens
caacaauauugcauaguga

SEQ ID NO: 816786 - RNA, 19 nt, Homo sapiens
ccaaauaugccauucauug

SEQ ID NO: 816787 - RNA, 19 nt, Homo sapiens
agacgacucugaucuugua

SEQ ID NO: 816788 - RNA, 19 nt, Homo sapiens
gacaagaauuucaguaaca

SEQ ID NO: 816789 - RNA, 19 nt, Homo sapiens
gcaugcagcuguuagugaa

SEQ ID NO: 816790 - RNA, 19 nt, Homo sapiens
gaagcugcacuacaaauuu

SEQ ID NO: 816791 - RNA, 19 nt, Homo sapiens
aaacaucuaucagcgauuu

SEQ ID NO: 816792 - RNA, 19 nt, Homo sapiens
caugguuccucacaauuua

SEQ ID NO: 816793 - RNA, 19 nt, Homo sapiens
ccaggacucugaagaagaa

SEQ ID NO: 816794 - RNA, 19 nt, Homo sapiens
gaugcagugugucuuuaua

SEQ ID NO: 816795 - RNA, 19 nt, Homo sapiens
gcuaaauugucugccauua

SEQ ID NO: 816796 - RNA, 19 nt, Homo sapiens
ugaaugcuaucaaguaaga

SEQ ID NO: 816797 - RNA, 19 nt, Homo sapiens
gcauagugauggagacuug

SEQ ID NO: 816798 - RNA, 19 nt, Homo sapiens
gcaugucuuugacuuaauu

SEQ ID NO: 816799 - RNA, 19 nt, Homo sapiens
gcauaucucugccaucaca

SEQ ID NO: 816800 - RNA, 19 nt, Homo sapiens
gcaauugaauccacacagu

SEQ ID NO: 816801 - RNA, 19 nt, Homo sapiens
ggaggaagaagaagaaaga

SEQ ID NO: 816802 - RNA, 19 nt, Homo sapiens
gaaagaucuucucaugaau

SEQ ID NO: 816803 - RNA, 19 nt, Homo sapiens
gaacagcagaugaugaaga

SEQ ID NO: 816804 - RNA, 19 nt, Homo sapiens
gacaucaaguaaaggauuu

SEQ ID NO: 816805 - RNA, 19 nt, Homo sapiens
ggucaaugaucacuuacuu

SEQ ID NO: 816806 - RNA, 19 nt, Homo sapiens
gaaccauccugauuuagca

SEQ ID NO: 816807 - RNA, 19 nt, Homo sapiens
gaggagcgccuacaaguug

SEQ ID NO: 816808 - RNA, 19 nt, Homo sapiens
acaaagagcccacaauuca

SEQ ID NO: 816809 - RNA, 19 nt, Homo sapiens
gccaaugagucuguaauuu

SEQ ID NO: 816810 - RNA, 19 nt, Homo sapiens
gaacagaaguccaaaagca

SEQ ID NO: 816811 - RNA, 19 nt, Homo sapiens
ggaagaagaagaaagacaa

SEQ ID NO: 816812 - RNA, 19 nt, Homo sapiens
uaucaacgaugaaugcuau

SEQ ID NO: 816813 - RNA, 19 nt, Homo sapiens
cggaugaaaugcuuauauu

SEQ ID NO: 816814 - RNA, 19 nt, Homo sapiens
uaaacaagcaagcauauga

SEQ ID NO: 816815 - RNA, 19 nt, Homo sapiens
uauagugaguugcauguuu

SEQ ID NO: 816816 - RNA, 19 nt, Homo sapiens
gaauuucaguaacaccaaa

SEQ ID NO: 816817 - RNA, 19 nt, Homo sapiens
gaugaucgacuacuuguug

SEQ ID NO: 816818 - RNA, 19 nt, Homo sapiens
ccaaacacauaauuucugu

SEQ ID NO: 816819 - RNA, 19 nt, Homo sapiens
ucaauuugcugcuccuuug

SEQ ID NO: 816820 - RNA, 19 nt, Homo sapiens
gaaucuaucagugcucuua

SEQ ID NO: 816821 - RNA, 19 nt, Homo sapiens
uaaaggauuugcuugacuu

SEQ ID NO: 816822 - RNA, 19 nt, Homo sapiens
ugaaugaaauguggaaaug

SEQ ID NO: 816823 - RNA, 19 nt, Homo sapiens
caagcaagcauaugauuug

SEQ ID NO: 816824 - RNA, 19 nt, Homo sapiens
guuagaagauagcaaugaa

SEQ ID NO: 816825 - RNA, 19 nt, Homo sapiens
ggauuucugugaaguugaa

SEQ ID NO: 816826 - RNA, 19 nt, Homo sapiens
gguuacuacuuaaugcuua

SEQ ID NO: 816827 - RNA, 19 nt, Homo sapiens
guaggacgcuccaaacaag

SEQ ID NO: 816828 - RNA, 19 nt, Homo sapiens
gcaagcagcagcucaaauc

SEQ ID NO: 816829 - RNA, 19 nt, Homo sapiens
gaacaucucauaacaccau

SEQ ID NO: 816830 - RNA, 19 nt, Homo sapiens
caucccaucucauuucauu

SEQ ID NO: 816831 - RNA, 19 nt, Homo sapiens
gugaacaaaucaauagaug

SEQ ID NO: 816832 - RNA, 19 nt, Homo sapiens
ucagugcucuuauuaaaca

SEQ ID NO: 816833 - RNA, 19 nt, Homo sapiens
gcaguuagaaguacuuguu

SEQ ID NO: 816834 - RNA, 19 nt, Homo sapiens
gaaauaguccugaaguucu

SEQ ID NO: 816835 - RNA, 19 nt, Homo sapiens
gaagaagaagaaagacaaa

SEQ ID NO: 816836 - RNA, 19 nt, Homo sapiens
cacaaugucuucaccuuug

SEQ ID NO: 816837 - RNA, 19 nt, Homo sapiens
gaaugucuuugguuuguuc

SEQ ID NO: 816838 - RNA, 19 nt, Homo sapiens
ggagauggugagacgauua

SEQ ID NO: 816839 - RNA, 19 nt, Homo sapiens
uaagaaagcaguuagaagu

SEQ ID NO: 816840 - RNA, 19 nt, Homo sapiens
gacaaacgauggagaguac

SEQ ID NO: 816841 - RNA, 19 nt, Homo sapiens
gaaaguccauaugcacaug

SEQ ID NO: 816842 - RNA, 19 nt, Homo sapiens
gcugaagaguggacaguug

SEQ ID NO: 816843 - RNA, 19 nt, Homo sapiens
ggauagaucuuaagcagua

SEQ ID NO: 816844 - RNA, 19 nt, Homo sapiens
gaaauaugcuuuacaguca

SEQ ID NO: 816845 - RNA, 19 nt, Homo sapiens
gaacggcgaugaacaaaug

SEQ ID NO: 816846 - RNA, 19 nt, Homo sapiens
ugaaagaucuucucaugaa

SEQ ID NO: 816847 - RNA, 19 nt, Homo sapiens
gaacggaucuuugcucaau

SEQ ID NO: 816848 - RNA, 19 nt, Homo sapiens
ugauaaagauguucgcuua

SEQ ID NO: 816849 - RNA, 19 nt, Homo sapiens
gaugaaugcuaucaaguaa

SEQ ID NO: 816850 - RNA, 19 nt, Homo sapiens
gcaugucucugacuuaauu

SEQ ID NO: 816851 - RNA, 19 nt, Homo sapiens
uaaauggucucuucccuuu

SEQ ID NO: 816852 - RNA, 19 nt, Homo sapiens
gcaguaaucugucaguguu

SEQ ID NO: 816853 - RNA, 19 nt, Homo sapiens
ggauuuaaaugcugugaaa

SEQ ID NO: 816854 - RNA, 19 nt, Homo sapiens
gaaauuugcuagccauugu

SEQ ID NO: 816855 - RNA, 19 nt, Homo sapiens
guuagaagaugaugagaaa

SEQ ID NO: 816856 - RNA, 19 nt, Homo sapiens
gaagaaagacaaaguggaa

SEQ ID NO: 816857 - RNA, 19 nt, Homo sapiens
gagcaugucucugacuuaa

SEQ ID NO: 816858 - RNA, 19 nt, Homo sapiens
gaacuucuaccuuaagauu

SEQ ID NO: 816859 - RNA, 19 nt, Homo sapiens
gaucuuugcucaauacaug

SEQ ID NO: 816860 - RNA, 19 nt, Homo sapiens
ggacuugcccaaauuuaua

SEQ ID NO: 816861 - RNA, 19 nt, Homo sapiens
caugaaccauccugauuua

SEQ ID NO: 816862 - RNA, 19 nt, Homo sapiens
gaaaagaagugacaagaga

SEQ ID NO: 816863 - RNA, 19 nt, Homo sapiens
gaacaaaucaauagaugga

SEQ ID NO: 816864 - RNA, 19 nt, Homo sapiens
gcuauugagccauauauua

SEQ ID NO: 816865 - RNA, 19 nt, Homo sapiens
gauuaaagaugguugugaa

SEQ ID NO: 816866 - RNA, 19 nt, Homo sapiens
gaucaaagacaaauugcua

SEQ ID NO: 816867 - RNA, 19 nt, Homo sapiens
aaaccuagcuuuacaucuu

SEQ ID NO: 816868 - RNA, 19 nt, Homo sapiens
ccaugcaaauugugaaaua

SEQ ID NO: 816869 - RNA, 19 nt, Homo sapiens
cuucagaggugcuaaauug

SEQ ID NO: 816870 - RNA, 19 nt, Homo sapiens
ggucaagucauauaacaua

SEQ ID NO: 816871 - RNA, 19 nt, Homo sapiens
gaaagacaaaguggaaaua

SEQ ID NO: 816872 - RNA, 19 nt, Homo sapiens
gaccuuaugagcucuauua

SEQ ID NO: 816873 - RNA, 19 nt, Homo sapiens
uaaauugucugccauuaca

SEQ ID NO: 816874 - RNA, 19 nt, Homo sapiens
caacaauauugcauaguga

SEQ ID NO: 816875 - RNA, 19 nt, Homo sapiens
ccaaauaugccauucauug

SEQ ID NO: 816876 - RNA, 19 nt, Homo sapiens
agacgacucugaucuugua

SEQ ID NO: 816877 - RNA, 19 nt, Homo sapiens
gacaagaauuucaguaaca

SEQ ID NO: 816878 - RNA, 19 nt, Homo sapiens
gcaugcagcuguuagugaa

SEQ ID NO: 816879 - RNA, 19 nt, Homo sapiens
gaagcugcacuacaaauuu

SEQ ID NO: 816880 - RNA, 19 nt, Homo sapiens
aaacaucuaucagcgauuu

SEQ ID NO: 816881 - RNA, 19 nt, Homo sapiens
caugguuccucacaauuua

SEQ ID NO: 816882 - RNA, 19 nt, Homo sapiens
ccaggacucugaagaagaa

SEQ ID NO: 816883 - RNA, 19 nt, Homo sapiens
gcuaaauugucugccauua

SEQ ID NO: 816884 - RNA, 19 nt, Homo sapiens
ugaaugcuaucaaguaaga

SEQ ID NO: 816885 - RNA, 19 nt, Homo sapiens
gcauagugauggagacuug

SEQ ID NO: 816886 - RNA, 19 nt, Homo sapiens
gcaauugaauccacacagu

SEQ ID NO: 816887 - RNA, 19 nt, Homo sapiens
ggaggaagaagaagaaaga

SEQ ID NO: 816888 - RNA, 19 nt, Homo sapiens
gaaagaucuucucaugaau

SEQ ID NO: 816889 - RNA, 19 nt, Homo sapiens
gaacagcagaugaugaaga

SEQ ID NO: 816890 - RNA, 19 nt, Homo sapiens
gacaucaaguaaaggauuu

SEQ ID NO: 816891 - RNA, 19 nt, Homo sapiens
ggucaaugaucacuuacuu

SEQ ID NO: 816892 - RNA, 19 nt, Homo sapiens
gaaccauccugauuuagca

SEQ ID NO: 816893 - RNA, 19 nt, Homo sapiens
gaggagcgccuacaaguug

SEQ ID NO: 816894 - RNA, 19 nt, Homo sapiens
gaacagaaguccaaaagca

SEQ ID NO: 816895 - RNA, 19 nt, Homo sapiens
ggaagaagaagaaagacaa

SEQ ID NO: 816896 - RNA, 19 nt, Homo sapiens
uaucaacgaugaaugcuau

SEQ ID NO: 816897 - RNA, 19 nt, Homo sapiens
cggaugaaaugcuuauauu

SEQ ID NO: 816898 - RNA, 19 nt, Homo sapiens
uaaacaagcaagcauauga

SEQ ID NO: 816899 - RNA, 19 nt, Homo sapiens
gcccacaguucaauaggua

SEQ ID NO: 816900 - RNA, 19 nt, Homo sapiens
gaauuucaguaacaccaaa

SEQ ID NO: 816901 - RNA, 19 nt, Homo sapiens
gaugaucgacuacuuguug

SEQ ID NO: 816902 - RNA, 19 nt, Homo sapiens
ucaauuugcugcuccuuug

SEQ ID NO: 816903 - RNA, 19 nt, Homo sapiens
gaaucuaucagugcucuua

SEQ ID NO: 816904 - RNA, 19 nt, Homo sapiens
uaaaggauuugcuugacuu

SEQ ID NO: 816905 - RNA, 19 nt, Homo sapiens
ugaaugaaauguggaaaug

SEQ ID NO: 816906 - RNA, 19 nt, Homo sapiens
caagcaagcauaugauuug

SEQ ID NO: 816907 - RNA, 19 nt, Homo sapiens
guuagaagauagcaaugaa

SEQ ID NO: 816908 - RNA, 19 nt, Homo sapiens
gcaagcagcagcucaaauc

SEQ ID NO: 816909 - RNA, 19 nt, Homo sapiens
gaacaucucauaacaccau

SEQ ID NO: 816910 - RNA, 19 nt, Homo sapiens
caucccaucucauuucauu

SEQ ID NO: 816911 - RNA, 19 nt, Homo sapiens
gugaacaaaucaauagaug

SEQ ID NO: 816912 - RNA, 19 nt, Homo sapiens
ucagugcucuuauuaaaca

SEQ ID NO: 816913 - RNA, 19 nt, Homo sapiens
gcaguuagaaguacuuguu

SEQ ID NO: 816914 - RNA, 19 nt, Homo sapiens
gaaauaguccugaaguucu

SEQ ID NO: 816915 - RNA, 19 nt, Homo sapiens
gaagaagaagaaagacaaa

SEQ ID NO: 816916 - RNA, 19 nt, Homo sapiens
cacaaugucuucaccuuug

SEQ ID NO: 816917 - RNA, 19 nt, Homo sapiens
gaaugucuuugguuuguuc

SEQ ID NO: 816918 - RNA, 19 nt, Homo sapiens
ggagauggugagacgauua

SEQ ID NO: 816919 - RNA, 19 nt, Homo sapiens
uaagaaagcaguuagaagu

SEQ ID NO: 816920 - RNA, 19 nt, Homo sapiens
gacaaacgauggagaguac

SEQ ID NO: 816921 - RNA, 19 nt, Homo sapiens
gaaaguccauaugcacaug

SEQ ID NO: 816922 - RNA, 19 nt, Homo sapiens
gcugaagaguggacaguug

SEQ ID NO: 816923 - RNA, 19 nt, Homo sapiens
gcgaugaacaaauguaauu

SEQ ID NO: 816924 - RNA, 19 nt, Homo sapiens
gaagaagaaagacaaagug

SEQ ID NO: 816925 - RNA, 19 nt, Homo sapiens
gaggagaaauuagguaugg

SEQ ID NO: 816926 - RNA, 19 nt, Homo sapiens
caagcaaucucagaccaaa

SEQ ID NO: 816927 - RNA, 19 nt, Homo sapiens
ugucaaagaguacuacaua

SEQ ID NO: 816928 - RNA, 19 nt, Homo sapiens
gagagaagagcucaugcua

SEQ ID NO: 816929 - RNA, 19 nt, Homo sapiens
guagcuacuuucauuguga

SEQ ID NO: 816930 - RNA, 19 nt, Homo sapiens
ggagagagaacauuagaca

SEQ ID NO: 816931 - RNA, 19 nt, Homo sapiens
gaaauuagguauggaugac

SEQ ID NO: 816932 - RNA, 19 nt, Homo sapiens
caaaguacaggauauugaa

SEQ ID NO: 816933 - RNA, 19 nt, Homo sapiens
gcacaugacccagauuaug

SEQ ID NO: 816934 - RNA, 19 nt, Homo sapiens
ugugaaagaucuucucaug

SEQ ID NO: 816935 - RNA, 19 nt, Homo sapiens
caucagagcaggucuugaa

SEQ ID NO: 816936 - RNA, 19 nt, Homo sapiens
gcucaggauuucaugaaga

SEQ ID NO: 816937 - RNA, 19 nt, Homo sapiens
ggauuugcuugacuugauu

SEQ ID NO: 816938 - RNA, 19 nt, Homo sapiens
cuacagaacggaugaaaug

SEQ ID NO: 816939 - RNA, 19 nt, Homo sapiens
uagcauggaucaaagacaa

SEQ ID NO: 816940 - RNA, 19 nt, Homo sapiens
gcaaaagacuuaacagagu

SEQ ID NO: 816941 - RNA, 19 nt, Homo sapiens
gaccaaaucaucacgaaug

SEQ ID NO: 816942 - RNA, 19 nt, Homo sapiens
ucaggaacuucuaccuuaa

SEQ ID NO: 816943 - RNA, 19 nt, Homo sapiens
gcaaagagcuguucaggaa

SEQ ID NO: 816944 - RNA, 19 nt, Homo sapiens
gaacaaacagucccaauua

SEQ ID NO: 816945 - RNA, 19 nt, Homo sapiens
gcacuucgauguuuaauga

SEQ ID NO: 816946 - RNA, 19 nt, Homo sapiens
gaagaucaguugaaagaaa

SEQ ID NO: 816947 - RNA, 19 nt, Homo sapiens
gaacugccaucuguuaaua

SEQ ID NO: 816948 - RNA, 19 nt, Homo sapiens
gaacacaguuucuaacaga

SEQ ID NO: 816949 - RNA, 19 nt, Homo sapiens
gaaauugaacguugcauua

SEQ ID NO: 816950 - RNA, 19 nt, Homo sapiens
gaagcuagcugcacuugaa

SEQ ID NO: 816951 - RNA, 19 nt, Homo sapiens
gaacuuacuucugaaauga

SEQ ID NO: 816952 - RNA, 19 nt, Homo sapiens
ucacaggucuuucuacuuu

SEQ ID NO: 816953 - RNA, 19 nt, Homo sapiens
gaggaacucugcaguauga

SEQ ID NO: 816954 - RNA, 19 nt, Homo sapiens
uggaagagcucaucuguaa

SEQ ID NO: 816955 - RNA, 19 nt, Homo sapiens
gaagaagucugaaacauac

SEQ ID NO: 816956 - RNA, 19 nt, Homo sapiens
gcagcaauaucauucauuu

SEQ ID NO: 816957 - RNA, 19 nt, Homo sapiens
gaugaaugguggagaguua

SEQ ID NO: 816958 - RNA, 19 nt, Homo sapiens
gaagguguauuuaggcuuu

SEQ ID NO: 816959 - RNA, 19 nt, Homo sapiens
ucaaaggacuggaggauuu

SEQ ID NO: 816960 - RNA, 19 nt, Homo sapiens
gcagaaaggugguugacaa

SEQ ID NO: 816961 - RNA, 19 nt, Homo sapiens
aaacaucucuugaaagcua

SEQ ID NO: 816962 - RNA, 19 nt, Homo sapiens
gaacauaacauccagauag

SEQ ID NO: 816963 - RNA, 19 nt, Homo sapiens
ggaacaagaucaggacuaa

SEQ ID NO: 816964 - RNA, 19 nt, Homo sapiens
caagauuucucugauguua

SEQ ID NO: 816965 - RNA, 19 nt, Homo sapiens
gaauacacguuagaaagua

SEQ ID NO: 816966 - RNA, 19 nt, Homo sapiens
gaacguugcauuaaaguuu

SEQ ID NO: 816967 - RNA, 19 nt, Homo sapiens
ggagaagaauugcugguuu

SEQ ID NO: 816968 - RNA, 19 nt, Homo sapiens
gaacagggaaggacaauug

SEQ ID NO: 816969 - RNA, 19 nt, Homo sapiens
cuagaaagcugauccagaa

SEQ ID NO: 816970 - RNA, 19 nt, Homo sapiens
gaaugggccuguacagauu

SEQ ID NO: 816971 - RNA, 19 nt, Homo sapiens
cgaagaagaugacaugguu

SEQ ID NO: 816972 - RNA, 19 nt, Homo sapiens
gugaagauguucccuauga

SEQ ID NO: 816973 - RNA, 19 nt, Homo sapiens
agaaagcgguggaacauaa

SEQ ID NO: 816974 - RNA, 19 nt, Homo sapiens
gagaacagcugguugaucu

SEQ ID NO: 816975 - RNA, 19 nt, Homo sapiens
gaggaaaguuguagauaga

SEQ ID NO: 816976 - RNA, 19 nt, Homo sapiens
guaaaguacuugaagcaaa

SEQ ID NO: 816977 - RNA, 19 nt, Homo sapiens
gaacuggacggucuuauug

SEQ ID NO: 816978 - RNA, 19 nt, Homo sapiens
gcaauaaggaugaaccuaa

SEQ ID NO: 816979 - RNA, 19 nt, Homo sapiens
gaucagaaguggcagucua

SEQ ID NO: 816980 - RNA, 19 nt, Homo sapiens
gcgaaagauugacaucaua

SEQ ID NO: 816981 - RNA, 19 nt, Homo sapiens
gcacacagcuuugaugaag

SEQ ID NO: 816982 - RNA, 19 nt, Homo sapiens
ucucgcagcucacacauua

SEQ ID NO: 816983 - RNA, 19 nt, Homo sapiens
ggaagcaacuaaucuagau

SEQ ID NO: 816984 - RNA, 19 nt, Homo sapiens
gucaagagcucuauaggaa

SEQ ID NO: 816985 - RNA, 19 nt, Homo sapiens
ggauuggccucuucaugua

SEQ ID NO: 816986 - RNA, 19 nt, Homo sapiens
gcauuaagguauacuaugu

SEQ ID NO: 816987 - RNA, 19 nt, Homo sapiens
gagguuagcugcggaaaga

SEQ ID NO: 816988 - RNA, 19 nt, Homo sapiens
gggaagagcuauccuuauc

SEQ ID NO: 816989 - RNA, 19 nt, Homo sapiens
ggaggaaaguuguagauag

SEQ ID NO: 816990 - RNA, 19 nt, Homo sapiens
gcacuucccucaaccugaa

SEQ ID NO: 816991 - RNA, 19 nt, Homo sapiens
guuagagcuucguuuauua

SEQ ID NO: 816992 - RNA, 19 nt, Homo sapiens
gcagaaacaccucaugaaa

SEQ ID NO: 816993 - RNA, 19 nt, Homo sapiens
caauaaggaugaaccuaaa

SEQ ID NO: 816994 - RNA, 19 nt, Homo sapiens
ccacugcaauuccaacuuu

SEQ ID NO: 816995 - RNA, 19 nt, Homo sapiens
uagcuuagaugaauaccua

SEQ ID NO: 816996 - RNA, 19 nt, Homo sapiens
gcacaacaccugaugaaug

SEQ ID NO: 816997 - RNA, 19 nt, Homo sapiens
gcucgacacuauucuguaa

SEQ ID NO: 816998 - RNA, 19 nt, Homo sapiens
uaauagaacugccaucugu

SEQ ID NO: 816999 - RNA, 19 nt, Homo sapiens
gaagcugaaugaauuugaa

SEQ ID NO: 817000 - RNA, 19 nt, Homo sapiens
gagaugagaugcugguugu

SEQ ID NO: 817001 - RNA, 19 nt, Homo sapiens
ccaaagagcucuggucauc

SEQ ID NO: 817002 - RNA, 19 nt, Homo sapiens
gaagagaaagagagaauau

SEQ ID NO: 817003 - RNA, 19 nt, Homo sapiens
ggaagcagcuguuuuaaug

SEQ ID NO: 817004 - RNA, 19 nt, Homo sapiens
gcauucagauucucgugua

SEQ ID NO: 817005 - RNA, 19 nt, Homo sapiens
ggucagacauccaccagaa

SEQ ID NO: 817006 - RNA, 19 nt, Homo sapiens
uaacuuggcucagcuguau

SEQ ID NO: 817007 - RNA, 19 nt, Homo sapiens
gaaacggucugugaaacaa

SEQ ID NO: 817008 - RNA, 19 nt, Homo sapiens
ggaaguaaccauuaugaug

SEQ ID NO: 817009 - RNA, 19 nt, Homo sapiens
caagacaccuuccagacaa

SEQ ID NO: 817010 - RNA, 19 nt, Homo sapiens
gagcuucguuuauuacaga

SEQ ID NO: 817011 - RNA, 19 nt, Homo sapiens
caacaugaagaucuacuua

SEQ ID NO: 817012 - RNA, 19 nt, Homo sapiens
gaaguucucucagcugguu

SEQ ID NO: 817013 - RNA, 19 nt, Homo sapiens
gaugaucucuguaagaaag

SEQ ID NO: 817014 - RNA, 19 nt, Homo sapiens
gcuuucagcuuauuaguug

SEQ ID NO: 817015 - RNA, 19 nt, Homo sapiens
ucagaaacaucgaauugaa

SEQ ID NO: 817016 - RNA, 19 nt, Homo sapiens
gaaugaauuugaacaaugg

SEQ ID NO: 817017 - RNA, 19 nt, Homo sapiens
caacaacaccuuacgcaaa

SEQ ID NO: 817018 - RNA, 19 nt, Homo sapiens
acucaacgcuggucaaauu

SEQ ID NO: 817019 - RNA, 19 nt, Homo sapiens
cgagggaacuucagaaauc

SEQ ID NO: 817020 - RNA, 19 nt, Homo sapiens
gauguuguccuaagcaaua

SEQ ID NO: 817021 - RNA, 19 nt, Homo sapiens
caagagcucuauaggaaau

SEQ ID NO: 817022 - RNA, 19 nt, Homo sapiens
gcaaacuacuggaggaaau

SEQ ID NO: 817023 - RNA, 19 nt, Homo sapiens
caacuuuacuuggcaauau

SEQ ID NO: 817024 - RNA, 19 nt, Homo sapiens
gaacagagcacugaugaca

SEQ ID NO: 817025 - RNA, 19 nt, Homo sapiens
gaauuggaaguaaccauua

SEQ ID NO: 817026 - RNA, 19 nt, Homo sapiens
gggaaugaauuggaaguaa

SEQ ID NO: 817027 - RNA, 19 nt, Homo sapiens
uaacagauacacuacagua

SEQ ID NO: 817028 - RNA, 19 nt, Homo sapiens
gagaagaauugcugguuuc

SEQ ID NO: 817029 - RNA, 19 nt, Homo sapiens
gaaaggugguugacaaugc

SEQ ID NO: 817030 - RNA, 19 nt, Homo sapiens
gaaagacuguucuauagcu

SEQ ID NO: 817031 - RNA, 19 nt, Homo sapiens
ugaagaagucugaaacaua

SEQ ID NO: 817032 - RNA, 19 nt, Homo sapiens
ccaccaacaucuuuuauua

SEQ ID NO: 817033 - RNA, 19 nt, Homo sapiens
gaacacggagauugucuuu

SEQ ID NO: 817034 - RNA, 19 nt, Homo sapiens
agacaucauugcucaagua

SEQ ID NO: 817035 - RNA, 19 nt, Homo sapiens
gagcacugaugacaugauu

SEQ ID NO: 817036 - RNA, 19 nt, Homo sapiens
ggagagcuauguaacagau

SEQ ID NO: 817037 - RNA, 19 nt, Homo sapiens
cagcagauguguucguuug

SEQ ID NO: 817038 - RNA, 19 nt, Homo sapiens
gaaaguuuacgaacaagaa

SEQ ID NO: 817039 - RNA, 19 nt, Homo sapiens
ggaguacucaaguuaauuu

SEQ ID NO: 817040 - RNA, 19 nt, Homo sapiens
ggucaggcccacuugauua

SEQ ID NO: 817041 - RNA, 19 nt, Homo sapiens
caaguuggacgguagcuua

SEQ ID NO: 817042 - RNA, 19 nt, Homo sapiens
uggagaaguuguucacaua

SEQ ID NO: 817043 - RNA, 19 nt, Homo sapiens
gcaaagagcuguucaggaa

SEQ ID NO: 817044 - RNA, 19 nt, Homo sapiens
gaacaaacagucccaauua

SEQ ID NO: 817045 - RNA, 19 nt, Homo sapiens
gcacuucgauguuuaauga

SEQ ID NO: 817046 - RNA, 19 nt, Homo sapiens
gaagaucaguugaaagaaa

SEQ ID NO: 817047 - RNA, 19 nt, Homo sapiens
gaacugccaucuguuaaua

SEQ ID NO: 817048 - RNA, 19 nt, Homo sapiens
gaacacaguuucuaacaga

SEQ ID NO: 817049 - RNA, 19 nt, Homo sapiens
gaaauugaacguugcauua

SEQ ID NO: 817050 - RNA, 19 nt, Homo sapiens
gaagcuagcugcacuugaa

SEQ ID NO: 817051 - RNA, 19 nt, Homo sapiens
gaacuuacuucugaaauga

SEQ ID NO: 817052 - RNA, 19 nt, Homo sapiens
ucacaggucuuucuacuuu

SEQ ID NO: 817053 - RNA, 19 nt, Homo sapiens
gaggaacucugcaguauga

SEQ ID NO: 817054 - RNA, 19 nt, Homo sapiens
uggaagagcucaucuguaa

SEQ ID NO: 817055 - RNA, 19 nt, Homo sapiens
gaagaagucugaaacauac

SEQ ID NO: 817056 - RNA, 19 nt, Homo sapiens
gcagcaauaucauucauuu

SEQ ID NO: 817057 - RNA, 19 nt, Homo sapiens
gaugaaugguggagaguua

SEQ ID NO: 817058 - RNA, 19 nt, Homo sapiens
gaagguguauuuaggcuuu

SEQ ID NO: 817059 - RNA, 19 nt, Homo sapiens
ucaaaggacuggaggauuu

SEQ ID NO: 817060 - RNA, 19 nt, Homo sapiens
gcagaaaggugguugacaa

SEQ ID NO: 817061 - RNA, 19 nt, Homo sapiens
aaacaucucuugaaagcua

SEQ ID NO: 817062 - RNA, 19 nt, Homo sapiens
gaacauaacauccagauag

SEQ ID NO: 817063 - RNA, 19 nt, Homo sapiens
ggaacaagaucaggacuaa

SEQ ID NO: 817064 - RNA, 19 nt, Homo sapiens
caagauuucucugauguua

SEQ ID NO: 817065 - RNA, 19 nt, Homo sapiens
gaauacacguuagaaagua

SEQ ID NO: 817066 - RNA, 19 nt, Homo sapiens
gaacguugcauuaaaguuu

SEQ ID NO: 817067 - RNA, 19 nt, Homo sapiens
ggagaagaauugcugguuu

SEQ ID NO: 817068 - RNA, 19 nt, Homo sapiens
gaacagggaaggacaauug

SEQ ID NO: 817069 - RNA, 19 nt, Homo sapiens
cuagaaagcugauccagaa

SEQ ID NO: 817070 - RNA, 19 nt, Homo sapiens
gaaugggccuguacagauu

SEQ ID NO: 817071 - RNA, 19 nt, Homo sapiens
cgaagaagaugacaugguu

SEQ ID NO: 817072 - RNA, 19 nt, Homo sapiens
gugaagauguucccuauga

SEQ ID NO: 817073 - RNA, 19 nt, Homo sapiens
agaaagcgguggaacauaa

SEQ ID NO: 817074 - RNA, 19 nt, Homo sapiens
gagaacagcugguugaucu

SEQ ID NO: 817075 - RNA, 19 nt, Homo sapiens
gaggaaaguuguagauaga

SEQ ID NO: 817076 - RNA, 19 nt, Homo sapiens
guaaaguacuugaagcaaa

SEQ ID NO: 817077 - RNA, 19 nt, Homo sapiens
gaaaugacuugugcccuaa

SEQ ID NO: 817078 - RNA, 19 nt, Homo sapiens
ggagacugccuauaaguua

SEQ ID NO: 817079 - RNA, 19 nt, Homo sapiens
gaacuggacggucuuauug

SEQ ID NO: 817080 - RNA, 19 nt, Homo sapiens
gcaauaaggaugaaccuaa

SEQ ID NO: 817081 - RNA, 19 nt, Homo sapiens
gaucagaaguggcagucua

SEQ ID NO: 817082 - RNA, 19 nt, Homo sapiens
gcgaaagauugacaucaua

SEQ ID NO: 817083 - RNA, 19 nt, Homo sapiens
gcacacagcuuugaugaag

SEQ ID NO: 817084 - RNA, 19 nt, Homo sapiens
ucucgcagcucacacauua

SEQ ID NO: 817085 - RNA, 19 nt, Homo sapiens
ggaagcaacuaaucuagau

SEQ ID NO: 817086 - RNA, 19 nt, Homo sapiens
gucaagagcucuauaggaa

SEQ ID NO: 817087 - RNA, 19 nt, Homo sapiens
ggauuggccucuucaugua

SEQ ID NO: 817088 - RNA, 19 nt, Homo sapiens
gcauuaagguauacuaugu

SEQ ID NO: 817089 - RNA, 19 nt, Homo sapiens
gagguuagcugcggaaaga

SEQ ID NO: 817090 - RNA, 19 nt, Homo sapiens
gggaagagcuauccuuauc

SEQ ID NO: 817091 - RNA, 19 nt, Homo sapiens
ggaggaaaguuguagauag

SEQ ID NO: 817092 - RNA, 19 nt, Homo sapiens
gcacuucccucaaccugaa

SEQ ID NO: 817093 - RNA, 19 nt, Homo sapiens
ggagggagcuugcugucuu

SEQ ID NO: 817094 - RNA, 19 nt, Homo sapiens
guaaagcaguugaaagaau

SEQ ID NO: 817095 - RNA, 19 nt, Homo sapiens
guuagagcuucguuuauua

SEQ ID NO: 817096 - RNA, 19 nt, Homo sapiens
gcagaaacaccucaugaaa

SEQ ID NO: 817097 - RNA, 19 nt, Homo sapiens
caauaaggaugaaccuaaa

SEQ ID NO: 817098 - RNA, 19 nt, Homo sapiens
ccacugcaauuccaacuuu

SEQ ID NO: 817099 - RNA, 19 nt, Homo sapiens
gcacuucuccggguauuua

SEQ ID NO: 817100 - RNA, 19 nt, Homo sapiens
uagcuuagaugaauaccua

SEQ ID NO: 817101 - RNA, 19 nt, Homo sapiens
gcacaacaccugaugaaug

SEQ ID NO: 817102 - RNA, 19 nt, Homo sapiens
gcucgacacuauucuguaa

SEQ ID NO: 817103 - RNA, 19 nt, Homo sapiens
uaauagaacugccaucugu

SEQ ID NO: 817104 - RNA, 19 nt, Homo sapiens
gaaacugccaucaucauuu

SEQ ID NO: 817105 - RNA, 19 nt, Homo sapiens
ggcaagagcugaggguuaa

SEQ ID NO: 817106 - RNA, 19 nt, Homo sapiens
gaagcugaaugaauuugaa

SEQ ID NO: 817107 - RNA, 19 nt, Homo sapiens
gagaugagaugcugguugu

SEQ ID NO: 817108 - RNA, 19 nt, Homo sapiens
ccaaagagcucuggucauc

SEQ ID NO: 817109 - RNA, 19 nt, Homo sapiens
gaagagaaagagagaauau

SEQ ID NO: 817110 - RNA, 19 nt, Homo sapiens
ggaagcagcuguuuuaaug

SEQ ID NO: 817111 - RNA, 19 nt, Homo sapiens
gcauucagauucucgugua

SEQ ID NO: 817112 - RNA, 19 nt, Homo sapiens
ggucagacauccaccagaa

SEQ ID NO: 817113 - RNA, 19 nt, Homo sapiens
uaacuuggcucagcuguau

SEQ ID NO: 817114 - RNA, 19 nt, Homo sapiens
gaaacggucugugaaacaa

SEQ ID NO: 817115 - RNA, 19 nt, Homo sapiens
ggaaguaaccauuaugaug

SEQ ID NO: 817116 - RNA, 19 nt, Homo sapiens
caagacaccuuccagacaa

SEQ ID NO: 817117 - RNA, 19 nt, Homo sapiens
gagcuucguuuauuacaga

SEQ ID NO: 817118 - RNA, 19 nt, Homo sapiens
caacaugaagaucuacuua

SEQ ID NO: 817119 - RNA, 19 nt, Homo sapiens
gaaguucucucagcugguu

SEQ ID NO: 817120 - RNA, 19 nt, Homo sapiens
gaugaucucuguaagaaag

SEQ ID NO: 817121 - RNA, 19 nt, Homo sapiens
gcuuucagcuuauuaguug

SEQ ID NO: 817122 - RNA, 19 nt, Homo sapiens
ucagaaacaucgaauugaa

SEQ ID NO: 817123 - RNA, 19 nt, Homo sapiens
gaaugaauuugaacaaugg

SEQ ID NO: 817124 - RNA, 19 nt, Homo sapiens
caacaacaccuuacgcaaa

SEQ ID NO: 817125 - RNA, 19 nt, Homo sapiens
acucaacgcuggucaaauu

SEQ ID NO: 817126 - RNA, 19 nt, Homo sapiens
cgagggaacuucagaaauc

SEQ ID NO: 817127 - RNA, 19 nt, Homo sapiens
gauguuguccuaagcaaua

SEQ ID NO: 817128 - RNA, 19 nt, Homo sapiens
cgacagagaccgaagauug

SEQ ID NO: 817129 - RNA, 19 nt, Homo sapiens
caagagcucuauaggaaau

SEQ ID NO: 817130 - RNA, 19 nt, Homo sapiens
gcaaacuacuggaggaaau

SEQ ID NO: 817131 - RNA, 19 nt, Homo sapiens
ggacugcaaccuucaaauu

SEQ ID NO: 817132 - RNA, 19 nt, Homo sapiens
caacuuuacuuggcaauau

SEQ ID NO: 817133 - RNA, 19 nt, Homo sapiens
gaacagagcacugaugaca

SEQ ID NO: 817134 - RNA, 19 nt, Homo sapiens
gaauuggaaguaaccauua

SEQ ID NO: 817135 - RNA, 19 nt, Homo sapiens
gggaaugaauuggaaguaa

SEQ ID NO: 817136 - RNA, 19 nt, Homo sapiens
gggauacaguugauauauu

SEQ ID NO: 817137 - RNA, 19 nt, Homo sapiens
gcauggcagucgugcuuua

SEQ ID NO: 817138 - RNA, 19 nt, Homo sapiens
uaacagauacacuacagua

SEQ ID NO: 817139 - RNA, 19 nt, Homo sapiens
gagaagaauugcugguuuc

SEQ ID NO: 817140 - RNA, 19 nt, Homo sapiens
gaaaggugguugacaaugc

SEQ ID NO: 817141 - RNA, 19 nt, Homo sapiens
gaaagacuguucuauagcu

SEQ ID NO: 817142 - RNA, 19 nt, Homo sapiens
ugaagaagucugaaacaua

SEQ ID NO: 817143 - RNA, 19 nt, Homo sapiens
ccacaaaucugaccucuuu

SEQ ID NO: 817144 - RNA, 19 nt, Homo sapiens
gaaaugggccucaauggua

SEQ ID NO: 817145 - RNA, 19 nt, Homo sapiens
gaacagacacuuggaauuu

SEQ ID NO: 817146 - RNA, 19 nt, Homo sapiens
ggacguaaguggaaaucua

SEQ ID NO: 817147 - RNA, 19 nt, Homo sapiens
gagaggagccugagcauuu

SEQ ID NO: 817148 - RNA, 19 nt, Homo sapiens
gaaacaagaacucuacuuu

SEQ ID NO: 817149 - RNA, 19 nt, Homo sapiens
gagaguagcugguaaagag

SEQ ID NO: 817150 - RNA, 19 nt, Homo sapiens
gaaaauggcucucuggaaa

SEQ ID NO: 817151 - RNA, 19 nt, Homo sapiens
ggaccaauauccucagauu

SEQ ID NO: 817152 - RNA, 19 nt, Homo sapiens
gaacuuaacuucgguuugg

SEQ ID NO: 817153 - RNA, 19 nt, Homo sapiens
gaaacagacugaauuugau

SEQ ID NO: 817154 - RNA, 19 nt, Homo sapiens
caaugaaacuuuagccaaa

SEQ ID NO: 817155 - RNA, 19 nt, Homo sapiens
gcagagucauccauucuaa

SEQ ID NO: 817156 - RNA, 19 nt, Homo sapiens
uagcuccgcucauuucuua

SEQ ID NO: 817157 - RNA, 19 nt, Homo sapiens
gaagaacggccaacucaaa

SEQ ID NO: 817158 - RNA, 19 nt, Homo sapiens
gcuggaacuuguauuguua

SEQ ID NO: 817159 - RNA, 19 nt, Homo sapiens
gcacacugccuaaggguua

SEQ ID NO: 817160 - RNA, 19 nt, Homo sapiens
gaaaccagaugaucauucu

SEQ ID NO: 817161 - RNA, 19 nt, Homo sapiens
caauagggaccacaucuua

SEQ ID NO: 817162 - RNA, 19 nt, Homo sapiens
ucaguuacgucaucucuaa

SEQ ID NO: 817163 - RNA, 19 nt, Homo sapiens
gaucacaguuccaucauca

SEQ ID NO: 817164 - RNA, 19 nt, Homo sapiens
gaaaugcccagcagccaua

SEQ ID NO: 817165 - RNA, 19 nt, Homo sapiens
uaagaaaucucaugaacag

SEQ ID NO: 817166 - RNA, 19 nt, Homo sapiens
guaguuauaugcuggagaa

SEQ ID NO: 817167 - RNA, 19 nt, Homo sapiens
guaaagauguuuggucuca

SEQ ID NO: 817168 - RNA, 19 nt, Homo sapiens
gaccaaguauccagaagaa

SEQ ID NO: 817169 - RNA, 19 nt, Homo sapiens
cacuuuagauggcuauuua

SEQ ID NO: 817170 - RNA, 19 nt, Homo sapiens
gaugugcccuuguggguuu

SEQ ID NO: 817171 - RNA, 19 nt, Homo sapiens
ggugaaggcuggagggauu

SEQ ID NO: 817172 - RNA, 19 nt, Homo sapiens
cgaaacagacugaauuuga

SEQ ID NO: 817173 - RNA, 19 nt, Homo sapiens
cagcauacucuaucacuua

SEQ ID NO: 817174 - RNA, 19 nt, Homo sapiens
gaggcacaaugaaacuuua

SEQ ID NO: 817175 - RNA, 19 nt, Homo sapiens
gaaucaaaccugaguagaa

SEQ ID NO: 817176 - RNA, 19 nt, Homo sapiens
ugaaaugucagguuguuua

SEQ ID NO: 817177 - RNA, 19 nt, Homo sapiens
gcauuuaccugccauuagu

SEQ ID NO: 817178 - RNA, 19 nt, Homo sapiens
gaguuuaccugggagauuu

SEQ ID NO: 817179 - RNA, 19 nt, Homo sapiens
caagaaggcugaggagaau

SEQ ID NO: 817180 - RNA, 19 nt, Homo sapiens
gaacuggaccgccugagaa

SEQ ID NO: 817181 - RNA, 19 nt, Homo sapiens
gcaccagacuccugacuuc

SEQ ID NO: 817182 - RNA, 19 nt, Homo sapiens
gagcagagcaucccugaga

SEQ ID NO: 817183 - RNA, 19 nt, Homo sapiens
uaaugugacuggaguuaaa

SEQ ID NO: 817184 - RNA, 19 nt, Homo sapiens
ggaaggagaaucacuugaa

SEQ ID NO: 817185 - RNA, 19 nt, Homo sapiens
uaacugcccugaagucuag

SEQ ID NO: 817186 - RNA, 19 nt, Homo sapiens
gcucuugccugcccacaaa

SEQ ID NO: 817187 - RNA, 19 nt, Homo sapiens
uggcuaaucuuaucccuuu

SEQ ID NO: 817188 - RNA, 19 nt, Homo sapiens
uuacuuguauucacgguua

SEQ ID NO: 817189 - RNA, 19 nt, Homo sapiens
aaucaaaccugaguagaaa

SEQ ID NO: 817190 - RNA, 19 nt, Homo sapiens
gaauagagagcuacaagug

SEQ ID NO: 817191 - RNA, 19 nt, Homo sapiens
ccacagcccugagaauuug

SEQ ID NO: 817192 - RNA, 19 nt, Homo sapiens
gaccacaucuuauuugucu

SEQ ID NO: 817193 - RNA, 19 nt, Homo sapiens
gagcuguucuaaaugguaa

SEQ ID NO: 817194 - RNA, 19 nt, Homo sapiens
ggagggauuuguugacuuc

SEQ ID NO: 817195 - RNA, 19 nt, Homo sapiens
aggcaaagcugaagccaaa

SEQ ID NO: 817196 - RNA, 19 nt, Homo sapiens
guuauaugcuggagaagaa

SEQ ID NO: 817197 - RNA, 19 nt, Homo sapiens
cagaugugcuuuuguauua

SEQ ID NO: 817198 - RNA, 19 nt, Homo sapiens
gaggagagccagccaagaa

SEQ ID NO: 817199 - RNA, 19 nt, Homo sapiens
guuagucucuccugaagaa

SEQ ID NO: 817200 - RNA, 19 nt, Homo sapiens
gggcagggcuaaccaagug

SEQ ID NO: 817201 - RNA, 19 nt, Homo sapiens
ggaaauggugccuuugaaa

SEQ ID NO: 817202 - RNA, 19 nt, Homo sapiens
cacacaagaugcuguauga

SEQ ID NO: 817203 - RNA, 19 nt, Homo sapiens
gcacagcaauccgguuguu

SEQ ID NO: 817204 - RNA, 19 nt, Homo sapiens
gcucacacauguacuagug

SEQ ID NO: 817205 - RNA, 19 nt, Homo sapiens
gaaguuggacagaacauug

SEQ ID NO: 817206 - RNA, 19 nt, Homo sapiens
ggcacuagcucaucuuuca

SEQ ID NO: 817207 - RNA, 19 nt, Homo sapiens
gauuagcguuggaugcuuu

SEQ ID NO: 817208 - RNA, 19 nt, Homo sapiens
gacgucagcucgaaacaga

SEQ ID NO: 817209 - RNA, 19 nt, Homo sapiens
gcagugguuugcugagaaa

SEQ ID NO: 817210 - RNA, 19 nt, Homo sapiens
ccagagaggugcggaaaug

SEQ ID NO: 817211 - RNA, 19 nt, Homo sapiens
gagcacacagacuuuaaua

SEQ ID NO: 817212 - RNA, 19 nt, Homo sapiens
aaucugaccucuuugaaug

SEQ ID NO: 817213 - RNA, 19 nt, Homo sapiens
auaacacacuggcccauua

SEQ ID NO: 817214 - RNA, 19 nt, Homo sapiens
gcucacagcaguucacaaa

SEQ ID NO: 817215 - RNA, 19 nt, Homo sapiens
caauuacgguucuaaauac

SEQ ID NO: 817216 - RNA, 19 nt, Homo sapiens
gauugugccauaauuguua

SEQ ID NO: 817217 - RNA, 19 nt, Homo sapiens
ucaggagacuggcuugaaa

SEQ ID NO: 817218 - RNA, 19 nt, Homo sapiens
guagugauuguacaacuua

SEQ ID NO: 817219 - RNA, 19 nt, Homo sapiens
ggagaggucuugcuuuuga

SEQ ID NO: 817220 - RNA, 19 nt, Homo sapiens
cuaaugugcugaccuaugu

SEQ ID NO: 817221 - RNA, 19 nt, Homo sapiens
guagaugccuccugacaag

SEQ ID NO: 817222 - RNA, 19 nt, Homo sapiens
gcaguugcuuuguucagaa

SEQ ID NO: 817223 - RNA, 19 nt, Homo sapiens
gaagcuggaacuuguauug

SEQ ID NO: 817224 - RNA, 19 nt, Homo sapiens
gaucucugcugcauuaagu

SEQ ID NO: 817225 - RNA, 19 nt, Homo sapiens
acaagaugcuguaugaaga

SEQ ID NO: 817226 - RNA, 19 nt, Homo sapiens
gcaggacuauuacaugaca

SEQ ID NO: 817227 - RNA, 19 nt, Homo sapiens
gccgagcucugcuauuuga

SEQ ID NO: 817228 - RNA, 19 nt, Homo sapiens
aagccgagcucugcuauuu

SEQ ID NO: 817229 - RNA, 19 nt, Homo sapiens
gcugagaccuugccugaag

SEQ ID NO: 817230 - RNA, 19 nt, Homo sapiens
gaaggagaaucacuugaac

SEQ ID NO: 817231 - RNA, 19 nt, Homo sapiens
gaacauauagguacuagcu

SEQ ID NO: 817232 - RNA, 19 nt, Homo sapiens
aacaagaacucuacuuuag

SEQ ID NO: 817233 - RNA, 19 nt, Homo sapiens
gcaccuguauguguuaaug

SEQ ID NO: 817234 - RNA, 19 nt, Homo sapiens
ucacauaucacauccauuc

SEQ ID NO: 817235 - RNA, 19 nt, Homo sapiens
aaacacaguugguggacaa

SEQ ID NO: 817236 - RNA, 19 nt, Homo sapiens
gagaggauuuucuugguua

SEQ ID NO: 817237 - RNA, 19 nt, Homo sapiens
gggcaucacugguccuugu

SEQ ID NO: 817238 - RNA, 19 nt, Homo sapiens
guuaucagaucaacuaaag

SEQ ID NO: 817239 - RNA, 19 nt, Homo sapiens
ucaacacugucauuacgua

SEQ ID NO: 817240 - RNA, 19 nt, Homo sapiens
gcacagaaccccagcagua

SEQ ID NO: 817241 - RNA, 19 nt, Homo sapiens
guaaguggaugauucaaaa

SEQ ID NO: 817242 - RNA, 19 nt, Homo sapiens
agaggagccugagcauuua

SEQ ID NO: 817243 - RNA, 19 nt, Homo sapiens
ccacagagcuggacaguaa

SEQ ID NO: 817244 - RNA, 19 nt, Homo sapiens
caaauuagauucuguggua

SEQ ID NO: 817245 - RNA, 19 nt, Homo sapiens
gaacauagccacacucauu

SEQ ID NO: 817246 - RNA, 19 nt, Homo sapiens
ggaauaagcagcaguuuaa

SEQ ID NO: 817247 - RNA, 19 nt, Homo sapiens
ccaaggagcuacuuaguuu

SEQ ID NO: 817248 - RNA, 19 nt, Homo sapiens
gauuugaccuguauaagua

SEQ ID NO: 817249 - RNA, 19 nt, Homo sapiens
gaaauggaccagugaauaa

SEQ ID NO: 817250 - RNA, 19 nt, Homo sapiens
ggaaauauggugcaguuua

SEQ ID NO: 817251 - RNA, 19 nt, Homo sapiens
ggagguaaaugcugccaua

SEQ ID NO: 817252 - RNA, 19 nt, Homo sapiens
gauaaagacuucaaaugga

SEQ ID NO: 817253 - RNA, 19 nt, Homo sapiens
caaauaaaccgaagaagaa

SEQ ID NO: 817254 - RNA, 19 nt, Homo sapiens
acacauaccucagaacaua

SEQ ID NO: 817255 - RNA, 19 nt, Homo sapiens
gaaguacugugugugaaua

SEQ ID NO: 817256 - RNA, 19 nt, Homo sapiens
gcacagaaccuucagaaau

SEQ ID NO: 817257 - RNA, 19 nt, Homo sapiens
gcaagcccauauucauuua

SEQ ID NO: 817258 - RNA, 19 nt, Homo sapiens
gcaagcaccuucaaaucuu

SEQ ID NO: 817259 - RNA, 19 nt, Homo sapiens
gcaaauaaaccgaagaaga

SEQ ID NO: 817260 - RNA, 19 nt, Homo sapiens
ggaaguaacaccuccagua

SEQ ID NO: 817261 - RNA, 19 nt, Homo sapiens
cccacaaacucacaaauua

SEQ ID NO: 817262 - RNA, 19 nt, Homo sapiens
ccucugaguuucugacuua

SEQ ID NO: 817263 - RNA, 19 nt, Homo sapiens
ggaauuaacuuggauaacu

SEQ ID NO: 817264 - RNA, 19 nt, Homo sapiens
caacagaacccaaugauag

SEQ ID NO: 817265 - RNA, 19 nt, Homo sapiens
ccuagaacaugcucaauaa

SEQ ID NO: 817266 - RNA, 19 nt, Homo sapiens
ucacaaagcuggaaauacu

SEQ ID NO: 817267 - RNA, 19 nt, Homo sapiens
ggacagugauugccagaau

SEQ ID NO: 817268 - RNA, 19 nt, Homo sapiens
gaaauauggugcaguuuac

SEQ ID NO: 817269 - RNA, 19 nt, Homo sapiens
ggaugaccuuccaaacuua

SEQ ID NO: 817270 - RNA, 19 nt, Homo sapiens
ggcauaugcuucuggaaua

SEQ ID NO: 817271 - RNA, 19 nt, Homo sapiens
ggauguauuuguuguagaa

SEQ ID NO: 817272 - RNA, 19 nt, Homo sapiens
gcaagguuaugguuucuga

SEQ ID NO: 817273 - RNA, 19 nt, Homo sapiens
caacaaggccuaaauccaa

SEQ ID NO: 817274 - RNA, 19 nt, Homo sapiens
gcccuaaacugccagaauu

SEQ ID NO: 817275 - RNA, 19 nt, Homo sapiens
caaaugaacccagcuaauu

SEQ ID NO: 817276 - RNA, 19 nt, Homo sapiens
aaagcaaucuucucauuug

SEQ ID NO: 817277 - RNA, 19 nt, Homo sapiens
ggaaagcagucuaauucug

SEQ ID NO: 817278 - RNA, 19 nt, Homo sapiens
caaauaacgaugucaguuu

SEQ ID NO: 817279 - RNA, 19 nt, Homo sapiens
uagccacacucauuuauuu

SEQ ID NO: 817280 - RNA, 19 nt, Homo sapiens
gcaaucuucucauuuggaa

SEQ ID NO: 817281 - RNA, 19 nt, Homo sapiens
cgaagaaacucccgaacug

SEQ ID NO: 817282 - RNA, 19 nt, Homo sapiens
caagcaccuucaaaucuua

SEQ ID NO: 817283 - RNA, 19 nt, Homo sapiens
guucacagcuccucagaug

SEQ ID NO: 817284 - RNA, 19 nt, Homo sapiens
gaaggaacagguaaacauu

SEQ ID NO: 817285 - RNA, 19 nt, Homo sapiens
caugggagcuggaaauuca

SEQ ID NO: 817286 - RNA, 19 nt, Homo sapiens
aagaugaccuggauaaaug

SEQ ID NO: 817287 - RNA, 19 nt, Homo sapiens
ggaaguguccuaccuauag

SEQ ID NO: 817288 - RNA, 19 nt, Homo sapiens
ccaugaauccuuccaauuu

SEQ ID NO: 817289 - RNA, 19 nt, Homo sapiens
gggaagcaauucaaggaaa

SEQ ID NO: 817290 - RNA, 19 nt, Homo sapiens
gaaauucaguuaggaugga

SEQ ID NO: 817291 - RNA, 19 nt, Homo sapiens
gaagaugaccuggauaaau

SEQ ID NO: 817292 - RNA, 19 nt, Homo sapiens
gcaccaacaucguuaaguc

SEQ ID NO: 817293 - RNA, 19 nt, Homo sapiens
gcagcaggaucccaaauca

SEQ ID NO: 817294 - RNA, 19 nt, Homo sapiens
caaaugauggcgccacaua

SEQ ID NO: 817295 - RNA, 19 nt, Homo sapiens
gcauaugcuucuggaauaa

SEQ ID NO: 817296 - RNA, 19 nt, Homo sapiens
ugagugaggucaguucuaa

SEQ ID NO: 817297 - RNA, 19 nt, Homo sapiens
cagcagggcccacaaauga

SEQ ID NO: 817298 - RNA, 19 nt, Homo sapiens
aaacgugcccaauuuguua

SEQ ID NO: 817299 - RNA, 19 nt, Homo sapiens
gguaaaugcugccauaguc

SEQ ID NO: 817300 - RNA, 19 nt, Homo sapiens
gaauuuagucucaaaggaa

SEQ ID NO: 817301 - RNA, 19 nt, Homo sapiens
ggaagcaccaacaucguua

SEQ ID NO: 817302 - RNA, 19 nt, Homo sapiens
gcagaugccuccucaacuc

SEQ ID NO: 817303 - RNA, 19 nt, Homo sapiens
gggaauaagcagcaguuua

SEQ ID NO: 817304 - RNA, 19 nt, Homo sapiens
ggaccaaggccaccucaaa

SEQ ID NO: 817305 - RNA, 19 nt, Homo sapiens
ggcaagugguccaggaaua

SEQ ID NO: 817306 - RNA, 19 nt, Homo sapiens
gauguucaaccucuaauuu

SEQ ID NO: 817307 - RNA, 19 nt, Homo sapiens
ugacagagauguguugugu

SEQ ID NO: 817308 - RNA, 19 nt, Homo sapiens
gcagugagcccaaagagau

SEQ ID NO: 817309 - RNA, 19 nt, Homo sapiens
gaccaaggcauguaagaaa

SEQ ID NO: 817310 - RNA, 19 nt, Homo sapiens
ugaccuggauaaaugauaa

SEQ ID NO: 817311 - RNA, 19 nt, Homo sapiens
ggaucugucuucuucuaaa

SEQ ID NO: 817312 - RNA, 19 nt, Homo sapiens
gaugucaguuuaucucaga

SEQ ID NO: 817313 - RNA, 19 nt, Homo sapiens
gaaaugugccaccuaacuu

SEQ ID NO: 817314 - RNA, 19 nt, Homo sapiens
gcacuacuguucauuucug

SEQ ID NO: 817315 - RNA, 19 nt, Homo sapiens
ccaaagagauaguugaaaa

SEQ ID NO: 817316 - RNA, 19 nt, Homo sapiens
acaccugucuuuaucaauu

SEQ ID NO: 817317 - RNA, 19 nt, Homo sapiens
ccaagcaucccuccaguaa

SEQ ID NO: 817318 - RNA, 19 nt, Homo sapiens
gaaguaacaccuccaguag

SEQ ID NO: 817319 - RNA, 19 nt, Homo sapiens
cacagaaccuucagaaauc

SEQ ID NO: 817320 - RNA, 19 nt, Homo sapiens
caaacaacaugccuucaca

SEQ ID NO: 817321 - RNA, 19 nt, Homo sapiens
ccaaugauagagcagauua

SEQ ID NO: 817322 - RNA, 19 nt, Homo sapiens
uagcagagguugcaaacug

SEQ ID NO: 817323 - RNA, 19 nt, Homo sapiens
uaauguaucuggaauggau

SEQ ID NO: 817324 - RNA, 19 nt, Homo sapiens
cuaaggauuuguacaaugu

SEQ ID NO: 817325 - RNA, 19 nt, Homo sapiens
uugcaaagcugucaagugu

SEQ ID NO: 817326 - RNA, 19 nt, Homo sapiens
ccugcaaccuguuucauaa

SEQ ID NO: 817327 - RNA, 19 nt, Homo sapiens
gaacugaagagccaacugu

SEQ ID NO: 817328 - RNA, 19 nt, Homo sapiens
aagcaucccuccaguaaug

SEQ ID NO: 817329 - RNA, 19 nt, Homo sapiens
gcuuacagaucuggaagua

SEQ ID NO: 817330 - RNA, 19 nt, Homo sapiens
gcaagugguccaggaauaa

SEQ ID NO: 817331 - RNA, 19 nt, Homo sapiens
ccuuuaagauuugcaguua

SEQ ID NO: 817332 - RNA, 19 nt, Homo sapiens
caaaagcaaucuucucauu

SEQ ID NO: 817333 - RNA, 19 nt, Homo sapiens
gaacuucuacccagcauag

SEQ ID NO: 817334 - RNA, 19 nt, Homo sapiens
guagcaagguuaugguuuc

SEQ ID NO: 817335 - RNA, 19 nt, Homo sapiens
gaauuaacuuggauaacuc

SEQ ID NO: 817336 - RNA, 19 nt, Homo sapiens
gcaugcagguggucaagga

SEQ ID NO: 817337 - RNA, 19 nt, Homo sapiens
ccacaaagugcugggauua

SEQ ID NO: 817338 - RNA, 19 nt, Homo sapiens
cuaacaaacuucccagugu

SEQ ID NO: 817339 - RNA, 19 nt, Homo sapiens
ggaaggaacagguaaacau

SEQ ID NO: 817340 - RNA, 19 nt, Homo sapiens
ggaauccuaugguucaaca

SEQ ID NO: 817341 - RNA, 19 nt, Homo sapiens
ggaguguacugugugguaa

SEQ ID NO: 817342 - RNA, 19 nt, Homo sapiens
gaagaaacucccgaacuga

SEQ ID NO: 817343 - RNA, 19 nt, Homo sapiens
gaaauaaucuucagaggaa

SEQ ID NO: 817344 - RNA, 19 nt, Homo sapiens
gaaaguggcugauguaaga

SEQ ID NO: 817345 - RNA, 19 nt, Homo sapiens
gaaagucucuuacugaagu

SEQ ID NO: 817346 - RNA, 19 nt, Homo sapiens
gaacuuggaugaaaucagu

SEQ ID NO: 817347 - RNA, 19 nt, Homo sapiens
gguggcaucuguucauuua

SEQ ID NO: 817348 - RNA, 19 nt, Homo sapiens
gcacauacacacacacaua

SEQ ID NO: 817349 - RNA, 19 nt, Homo sapiens
gaaggccacuguuagguuu

SEQ ID NO: 817350 - RNA, 19 nt, Homo sapiens
gacuagggaucaugaaaua

SEQ ID NO: 817351 - RNA, 19 nt, Homo sapiens
gaucuuaucuuuguggauu

SEQ ID NO: 817352 - RNA, 19 nt, Homo sapiens
caacacaccuuccaugaca

SEQ ID NO: 817353 - RNA, 19 nt, Homo sapiens
ggacccaucugcaccauga

SEQ ID NO: 817354 - RNA, 19 nt, Homo sapiens
gaggaaggcucgauuucuu

SEQ ID NO: 817355 - RNA, 19 nt, Homo sapiens
gaaggaagccagaacgaaa

SEQ ID NO: 817356 - RNA, 19 nt, Homo sapiens
gucaauaacucuguccuua

SEQ ID NO: 817357 - RNA, 19 nt, Homo sapiens
gagaaauagucccugagua

SEQ ID NO: 817358 - RNA, 19 nt, Homo sapiens
gaaagaugauucagagucu

SEQ ID NO: 817359 - RNA, 19 nt, Homo sapiens
ggaauagcauuguaguaau

SEQ ID NO: 817360 - RNA, 19 nt, Homo sapiens
gggaaagucucuuacugaa

SEQ ID NO: 817361 - RNA, 19 nt, Homo sapiens
gggaaagugagaugaauua

SEQ ID NO: 817362 - RNA, 19 nt, Homo sapiens
gaacuugauuuaacagaag

SEQ ID NO: 817363 - RNA, 19 nt, Homo sapiens
ggaacuugauuuaacagaa

SEQ ID NO: 817364 - RNA, 19 nt, Homo sapiens
guaaggaaggccacuguua

SEQ ID NO: 817365 - RNA, 19 nt, Homo sapiens
gauccaacacuuuccuuua

SEQ ID NO: 817366 - RNA, 19 nt, Homo sapiens
gaaggucacagcacaacua

SEQ ID NO: 817367 - RNA, 19 nt, Homo sapiens
ggugggaccugaaagcaaa

SEQ ID NO: 817368 - RNA, 19 nt, Homo sapiens
caggugcucuccacacaua

SEQ ID NO: 817369 - RNA, 19 nt, Homo sapiens
uaaggaaauugcugucuug

SEQ ID NO: 817370 - RNA, 19 nt, Homo sapiens
gaacuaggagaaagcaauu

SEQ ID NO: 817371 - RNA, 19 nt, Homo sapiens
ggacagacuuuccucuagu

SEQ ID NO: 817372 - RNA, 19 nt, Homo sapiens
gaagagagcagagcaauac

SEQ ID NO: 817373 - RNA, 19 nt, Homo sapiens
gaagcggacuccaucaauc

SEQ ID NO: 817374 - RNA, 19 nt, Homo sapiens
ggaaaaggaacuugauuua

SEQ ID NO: 817375 - RNA, 19 nt, Homo sapiens
ggagagccauaaggaaauu

SEQ ID NO: 817376 - RNA, 19 nt, Homo sapiens
gcacggugaugcgguauga

SEQ ID NO: 817377 - RNA, 19 nt, Homo sapiens
guaguaauggugaugaaua

SEQ ID NO: 817378 - RNA, 19 nt, Homo sapiens
ggaaaugaaacaaaggaaa

SEQ ID NO: 817379 - RNA, 19 nt, Homo sapiens
caauaacucuguccuuaag

SEQ ID NO: 817380 - RNA, 19 nt, Homo sapiens
cacauaaucugccauuuua

SEQ ID NO: 817381 - RNA, 19 nt, Homo sapiens
gaauaugcucugccaaauu

SEQ ID NO: 817382 - RNA, 19 nt, Homo sapiens
guacuuaccagcccaauuc

SEQ ID NO: 817383 - RNA, 19 nt, Homo sapiens
caagcaaccuccacuucuu

SEQ ID NO: 817384 - RNA, 19 nt, Homo sapiens
gagagaagcauguuauuac

SEQ ID NO: 817385 - RNA, 19 nt, Homo sapiens
gagacucaauaauaacuga

SEQ ID NO: 817386 - RNA, 19 nt, Homo sapiens
ggucacagcacaacuaaau

SEQ ID NO: 817387 - RNA, 19 nt, Homo sapiens
gaaggaagacccacagagu

SEQ ID NO: 817388 - RNA, 19 nt, Homo sapiens
acacacacauauagcagua

SEQ ID NO: 817389 - RNA, 19 nt, Homo sapiens
gcagaggcccaugggauua

SEQ ID NO: 817390 - RNA, 19 nt, Homo sapiens
gaggucaguuucuucuuga

SEQ ID NO: 817391 - RNA, 19 nt, Homo sapiens
ccucaauacuccgcaaaua

SEQ ID NO: 817392 - RNA, 19 nt, Homo sapiens
ggugauuguuggugacuuu

SEQ ID NO: 817393 - RNA, 19 nt, Homo sapiens
aauaugcucugccaaauuc

SEQ ID NO: 817394 - RNA, 19 nt, Homo sapiens
cauaugauuucuacacuuc

SEQ ID NO: 817395 - RNA, 19 nt, Homo sapiens
uaacggcucuuucccucaa

SEQ ID NO: 817396 - RNA, 19 nt, Homo sapiens
gaaaucaguguccaugguu

SEQ ID NO: 817397 - RNA, 19 nt, Homo sapiens
ggacggccauguuguggau

SEQ ID NO: 817398 - RNA, 19 nt, Homo sapiens
gaagguuuauugugauugg

SEQ ID NO: 817399 - RNA, 19 nt, Homo sapiens
uaacugaacuacagcaaaa

SEQ ID NO: 817400 - RNA, 19 nt, Homo sapiens
aaagagaucucagcagcuu

SEQ ID NO: 817401 - RNA, 19 nt, Homo sapiens
gagagcagagcaauacaaa

SEQ ID NO: 817402 - RNA, 19 nt, Homo sapiens
uaaguugcuucacuccuuu

SEQ ID NO: 817403 - RNA, 19 nt, Homo sapiens
ucuagagccuucuugcuuu

SEQ ID NO: 817404 - RNA, 19 nt, Homo sapiens
agaaaggcauggacuggaa

SEQ ID NO: 817405 - RNA, 19 nt, Homo sapiens
gaugcgguaugaagagauu

SEQ ID NO: 817406 - RNA, 19 nt, Homo sapiens
gcucuuucccucaaccuua

SEQ ID NO: 817407 - RNA, 19 nt, Homo sapiens
agaaauagucccugaguau

SEQ ID NO: 817408 - RNA, 19 nt, Homo sapiens
ugaggucaguuucuucuug

SEQ ID NO: 817409 - RNA, 19 nt, Homo sapiens
cgacacagaccgaaucaug

SEQ ID NO: 817410 - RNA, 19 nt, Homo sapiens
gaguaagauuugcuuuaug

SEQ ID NO: 817411 - RNA, 19 nt, Homo sapiens
ggguaucaguguuugacua

SEQ ID NO: 817412 - RNA, 19 nt, Homo sapiens
gcagugccuuggucuuguu

SEQ ID NO: 817413 - RNA, 19 nt, Homo sapiens
gcacgcacauacacacaca

SEQ ID NO: 817414 - RNA, 19 nt, Homo sapiens
acuggaagguuuauuguga

SEQ ID NO: 817415 - RNA, 19 nt, Homo sapiens
agagagaagcauguuauua

SEQ ID NO: 817416 - RNA, 19 nt, Homo sapiens
acaauguucucuaguuuca

SEQ ID NO: 817417 - RNA, 19 nt, Homo sapiens
gaaagugagaugaauuaag

SEQ ID NO: 817418 - RNA, 19 nt, Homo sapiens
ggaaggccacuguuagguu

SEQ ID NO: 817419 - RNA, 19 nt, Homo sapiens
cuaaguugcuucacuccuu

SEQ ID NO: 817420 - RNA, 19 nt, Homo sapiens
aaagccagcuguacaucaa

SEQ ID NO: 817421 - RNA, 19 nt, Homo sapiens
ugaaagagccagggauuau

SEQ ID NO: 817422 - RNA, 19 nt, Homo sapiens
caauucuacucuccucaaa

SEQ ID NO: 817423 - RNA, 19 nt, Homo sapiens
gagggaaagugagaugaau

SEQ ID NO: 817424 - RNA, 19 nt, Homo sapiens
gaaagcaaagacaauguuc

SEQ ID NO: 817425 - RNA, 19 nt, Homo sapiens
uaacucagacagugcauga

SEQ ID NO: 817426 - RNA, 19 nt, Homo sapiens
caguguccaugguucuuua

SEQ ID NO: 817427 - RNA, 19 nt, Homo sapiens
gaucacauaaucugccauu

SEQ ID NO: 817428 - RNA, 19 nt, Homo sapiens
ucaauaacucuguccuuaa

SEQ ID NO: 817429 - RNA, 19 nt, Homo sapiens
gucaauaccagaaagauga

SEQ ID NO: 817430 - RNA, 19 nt, Homo sapiens
ggaaagugagaugaauuaa

SEQ ID NO: 817431 - RNA, 19 nt, Homo sapiens
ggaguuauggauggaauuu

SEQ ID NO: 817432 - RNA, 19 nt, Homo sapiens
ggucuuugcuaauuggaau

SEQ ID NO: 817433 - RNA, 19 nt, Homo sapiens
gagcuuaugaucacacaga

SEQ ID NO: 817434 - RNA, 19 nt, Homo sapiens
gagaugggaagaauggaaa

SEQ ID NO: 817435 - RNA, 19 nt, Homo sapiens
ggagggaaagugagaugaa

SEQ ID NO: 817436 - RNA, 19 nt, Homo sapiens
gccaggaaaugaaacaaag

SEQ ID NO: 817437 - RNA, 19 nt, Homo sapiens
gccuuacccuggcaucuuu

SEQ ID NO: 817438 - RNA, 19 nt, Homo sapiens
guaaguccaggaugaacua

SEQ ID NO: 817439 - RNA, 19 nt, Homo sapiens
ccaaagggcacauucagau

SEQ ID NO: 817440 - RNA, 19 nt, Homo sapiens
ugaauaugcucugccaaau

SEQ ID NO: 817441 - RNA, 19 nt, Homo sapiens
uuaggacaccuuaggaaua

SEQ ID NO: 817442 - RNA, 19 nt, Homo sapiens
gagagagaagcauguuauu

SEQ ID NO: 817443 - RNA, 19 nt, Homo sapiens
gaacuuggaugaaaucagu

SEQ ID NO: 817444 - RNA, 19 nt, Homo sapiens
gguggcaucuguucauuua

SEQ ID NO: 817445 - RNA, 19 nt, Homo sapiens
gcacauacacacacacaua

SEQ ID NO: 817446 - RNA, 19 nt, Homo sapiens
gcacagggcugcaaguagu

SEQ ID NO: 817447 - RNA, 19 nt, Homo sapiens
caacacaccuuccaugaca

SEQ ID NO: 817448 - RNA, 19 nt, Homo sapiens
caaacaagaucagcaacaa

SEQ ID NO: 817449 - RNA, 19 nt, Homo sapiens
ggacagacuuuccucuagu

SEQ ID NO: 817450 - RNA, 19 nt, Homo sapiens
gcacggugaugcgguauga

SEQ ID NO: 817451 - RNA, 19 nt, Homo sapiens
caagcaaccuccacuucuu

SEQ ID NO: 817452 - RNA, 19 nt, Homo sapiens
acacacacauauagcagua

SEQ ID NO: 817453 - RNA, 19 nt, Homo sapiens
ccucaauacuccgcaaaua

SEQ ID NO: 817454 - RNA, 19 nt, Homo sapiens
ggugauuguuggugacuuu

SEQ ID NO: 817455 - RNA, 19 nt, Homo sapiens
gggagcagcugcaccacuu

SEQ ID NO: 817456 - RNA, 19 nt, Homo sapiens
gaaaucaguguccaugguu

SEQ ID NO: 817457 - RNA, 19 nt, Homo sapiens
ggacggccauguuguggau

SEQ ID NO: 817458 - RNA, 19 nt, Homo sapiens
gaagguuuauugugauugg

SEQ ID NO: 817459 - RNA, 19 nt, Homo sapiens
ccagacaaauagauggaaa

SEQ ID NO: 817460 - RNA, 19 nt, Homo sapiens
gaugcgguaugaagagauu

SEQ ID NO: 817461 - RNA, 19 nt, Homo sapiens
cgacacagaccgaaucaug

SEQ ID NO: 817462 - RNA, 19 nt, Homo sapiens
gcacgcacauacacacaca

SEQ ID NO: 817463 - RNA, 19 nt, Homo sapiens
acuggaagguuuauuguga

SEQ ID NO: 817464 - RNA, 19 nt, Homo sapiens
aaagccagcuguacaucaa

SEQ ID NO: 817465 - RNA, 19 nt, Homo sapiens
gagcaaacaagaucagcaa

SEQ ID NO: 817466 - RNA, 19 nt, Homo sapiens
caguguccaugguucuuua

SEQ ID NO: 817467 - RNA, 19 nt, Homo sapiens
gagcuuaugaucacacaga

SEQ ID NO: 817468 - RNA, 19 nt, Homo sapiens
gcaaacaagaucagcaaca

SEQ ID NO: 817469 - RNA, 19 nt, Homo sapiens
guccaugguucuuuauguu

SEQ ID NO: 817470 - RNA, 19 nt, Homo sapiens
cagaaagagccagggauua

SEQ ID NO: 817471 - RNA, 19 nt, Homo sapiens
gaugugcuccugugguauu

SEQ ID NO: 817472 - RNA, 19 nt, Homo sapiens
gcaugcccuuuacuacaaa

SEQ ID NO: 817473 - RNA, 19 nt, Homo sapiens
gauauggaggugauuguug

SEQ ID NO: 817474 - RNA, 19 nt, Homo sapiens
ccaugguucuuuauguuug

SEQ ID NO: 817475 - RNA, 19 nt, Homo sapiens
ugaaaucaguguccauggu

SEQ ID NO: 817476 - RNA, 19 nt, Homo sapiens
agaaagagccagggauuau

SEQ ID NO: 817477 - RNA, 19 nt, Homo sapiens
caucaaccaucccaugucu

SEQ ID NO: 817478 - RNA, 19 nt, Homo sapiens
ggaacgaggcagauaugga

SEQ ID NO: 817479 - RNA, 19 nt, Homo sapiens
ggaaauccaggaacuagag

SEQ ID NO: 817480 - RNA, 19 nt, Homo sapiens
gacacagaccgaaucauga

SEQ ID NO: 817481 - RNA, 19 nt, Homo sapiens
ucagaaagagccagggauu

SEQ ID NO: 817482 - RNA, 19 nt, Homo sapiens
gcugcaccacuuuguguua

SEQ ID NO: 817483 - RNA, 19 nt, Homo sapiens
gaaagagccagggauuauc

SEQ ID NO: 817484 - RNA, 19 nt, Homo sapiens
gggaaguguuuguuacucu

SEQ ID NO: 817485 - RNA, 19 nt, Homo sapiens
gccaguccauccucauuuc

SEQ ID NO: 817486 - RNA, 19 nt, Homo sapiens
uugaugugcuccuguggua

SEQ ID NO: 817487 - RNA, 19 nt, Homo sapiens
guggagcguuucaccuuug

SEQ ID NO: 817488 - RNA, 19 nt, Homo sapiens
ggccaugcuuagacacauu

SEQ ID NO: 817489 - RNA, 19 nt, Homo sapiens
ucaauacuccgcaaauaca

SEQ ID NO: 817490 - RNA, 19 nt, Homo sapiens
caugaaucacuccucaaua

SEQ ID NO: 817491 - RNA, 19 nt, Homo sapiens
acacagaccgaaucaugaa

SEQ ID NO: 817492 - RNA, 19 nt, Homo sapiens
guuggugacuuugggauug

SEQ ID NO: 817493 - RNA, 19 nt, Homo sapiens
uguagaacuuggaugaaau

SEQ ID NO: 817494 - RNA, 19 nt, Homo sapiens
cuguagaacuuggaugaaa

SEQ ID NO: 817495 - RNA, 19 nt, Homo sapiens
gcagauauggaggugauug

SEQ ID NO: 817496 - RNA, 19 nt, Homo sapiens
gagccaguccauccucauu

SEQ ID NO: 817497 - RNA, 19 nt, Homo sapiens
acagucaucuuuggacaga

SEQ ID NO: 817498 - RNA, 19 nt, Homo sapiens
gguaguggagcaaacaaga

SEQ ID NO: 817499 - RNA, 19 nt, Homo sapiens
gggauuaucugcacaaaac

SEQ ID NO: 817500 - RNA, 19 nt, Homo sapiens
augaaucacuccucaauac

SEQ ID NO: 817501 - RNA, 19 nt, Homo sapiens
uggaagguuuauugugauu

SEQ ID NO: 817502 - RNA, 19 nt, Homo sapiens
cagcagcaaccuuugauca

SEQ ID NO: 817503 - RNA, 19 nt, Homo sapiens
ccucugauaggacauugua

SEQ ID NO: 817504 - RNA, 19 nt, Homo sapiens
gaaccauggcauucccuau

SEQ ID NO: 817505 - RNA, 19 nt, Homo sapiens
gagcagcugcaccacuuug

SEQ ID NO: 817506 - RNA, 19 nt, Homo sapiens
cagaccgaaucaugaauca

SEQ ID NO: 817507 - RNA, 19 nt, Homo sapiens
guaugaagagauugagcua

SEQ ID NO: 817508 - RNA, 19 nt, Homo sapiens
gaaagccucagccggaucu

SEQ ID NO: 817509 - RNA, 19 nt, Homo sapiens
gcugcauccucuccaaugu

SEQ ID NO: 817510 - RNA, 19 nt, Homo sapiens
caucuguucauuuaccuuu

SEQ ID NO: 817511 - RNA, 19 nt, Homo sapiens
ggaacuagaggaaauucag

SEQ ID NO: 817512 - RNA, 19 nt, Homo sapiens
gguauuacuuccccucuga

SEQ ID NO: 817513 - RNA, 19 nt, Homo sapiens
gaaucacuccucaauacuc

SEQ ID NO: 817514 - RNA, 19 nt, Homo sapiens
gcuuagacacauuccugua

SEQ ID NO: 817515 - RNA, 19 nt, Homo sapiens
ccacacacacgcacacaca

SEQ ID NO: 817516 - RNA, 19 nt, Homo sapiens
gcaaguaguggcugcaaaa

SEQ ID NO: 817517 - RNA, 19 nt, Homo sapiens
cagcaugcccuuuacuaca

SEQ ID NO: 817518 - RNA, 19 nt, Homo sapiens
cuccucgucuugacuguuu

SEQ ID NO: 817519 - RNA, 19 nt, Homo sapiens
acggccauguuguggauua

SEQ ID NO: 817520 - RNA, 19 nt, Homo sapiens
uccaggaacuagaggaaau

SEQ ID NO: 817521 - RNA, 19 nt, Homo sapiens
aacaagaucagcaacaaug

SEQ ID NO: 817522 - RNA, 19 nt, Homo sapiens
guuuguuacucucucagaa

SEQ ID NO: 817523 - RNA, 19 nt, Homo sapiens
aaacagggccucgugucaa

SEQ ID NO: 817524 - RNA, 19 nt, Homo sapiens
cagcagcagcaaccuuuga

SEQ ID NO: 817525 - RNA, 19 nt, Homo sapiens
acauacacacacacauaua

SEQ ID NO: 817526 - RNA, 19 nt, Homo sapiens
acacacacacgcacacaug

SEQ ID NO: 817527 - RNA, 19 nt, Homo sapiens
guagaacuuggaugaaauc

SEQ ID NO: 817528 - RNA, 19 nt, Homo sapiens
agcaugcccuuuacuacaa

SEQ ID NO: 817529 - RNA, 19 nt, Homo sapiens
gugcaguccuuggagaugu

SEQ ID NO: 817530 - RNA, 19 nt, Homo sapiens
gggaagugcaguccuugga

SEQ ID NO: 817531 - RNA, 19 nt, Homo sapiens
uggacagacuuuccucuag

SEQ ID NO: 817532 - RNA, 19 nt, Homo sapiens
gagcguuucaccuuuguag

SEQ ID NO: 817533 - RNA, 19 nt, Homo sapiens
gucaacacaccuuccauga

SEQ ID NO: 817534 - RNA, 19 nt, Homo sapiens
cauacacacacacauauag

SEQ ID NO: 817535 - RNA, 19 nt, Homo sapiens
cacauacacacacacauau

SEQ ID NO: 817536 - RNA, 19 nt, Homo sapiens
ggccacacccaguagagaa

SEQ ID NO: 817537 - RNA, 19 nt, Homo sapiens
uucccuacuugcugacuua

SEQ ID NO: 817538 - RNA, 19 nt, Homo sapiens
ucaaccaucccaugucugu

SEQ ID NO: 817539 - RNA, 19 nt, Homo sapiens
gaccgaaucaugaaucacu

SEQ ID NO: 817540 - RNA, 19 nt, Homo sapiens
gugaugcgguaugaagaga

SEQ ID NO: 817541 - RNA, 19 nt, Homo sapiens
ccauuuaccagaacagcaa

SEQ ID NO: 817542 - RNA, 19 nt, Homo sapiens
gaucaggagugagauuuuc

SEQ ID NO: 817543 - RNA, 19 nt, Homo sapiens
cuaaagaccugcucaauaa

SEQ ID NO: 817544 - RNA, 19 nt, Homo sapiens
gaaagaagguuagcuaaag

SEQ ID NO: 817545 - RNA, 19 nt, Homo sapiens
acacuuaucuggagaaauu

SEQ ID NO: 817546 - RNA, 19 nt, Homo sapiens
ggaaggagccaauuaagaa

SEQ ID NO: 817547 - RNA, 19 nt, Homo sapiens
caugaucacugaagcaaua

SEQ ID NO: 817548 - RNA, 19 nt, Homo sapiens
gaaauaaacgagacugaaa

SEQ ID NO: 817549 - RNA, 19 nt, Homo sapiens
guagguaaaugggaacuua

SEQ ID NO: 817550 - RNA, 19 nt, Homo sapiens
gaacuuagaagguuaggaa

SEQ ID NO: 817551 - RNA, 19 nt, Homo sapiens
gaagacugaggaagaauua

SEQ ID NO: 817552 - RNA, 19 nt, Homo sapiens
ucaauaauguggccucuga

SEQ ID NO: 817553 - RNA, 19 nt, Homo sapiens
gaaauuagaaguggaguug

SEQ ID NO: 817554 - RNA, 19 nt, Homo sapiens
ugacuuaucuggaacaaca

SEQ ID NO: 817555 - RNA, 19 nt, Homo sapiens
guuaaucacuugcacaguu

SEQ ID NO: 817556 - RNA, 19 nt, Homo sapiens
gagaagcgccugcucaaga

SEQ ID NO: 817557 - RNA, 19 nt, Homo sapiens
gcaggagaaucacuugaga

SEQ ID NO: 817558 - RNA, 19 nt, Homo sapiens
agacuagccuggacaacua

SEQ ID NO: 817559 - RNA, 19 nt, Homo sapiens
ugacgaggaugacgauuug

SEQ ID NO: 817560 - RNA, 19 nt, Homo sapiens
gcuuuagccuccuauguuu

SEQ ID NO: 817561 - RNA, 19 nt, Homo sapiens
caacacaggauugaauuaa

SEQ ID NO: 817562 - RNA, 19 nt, Homo sapiens
aaauugacauggaagauga

SEQ ID NO: 817563 - RNA, 19 nt, Homo sapiens
gagaacauuuccuauacau

SEQ ID NO: 817564 - RNA, 19 nt, Homo sapiens
gcaagaaagguuugaggaa

SEQ ID NO: 817565 - RNA, 19 nt, Homo sapiens
caacaacacaggauugaau

SEQ ID NO: 817566 - RNA, 19 nt, Homo sapiens
gaaggagccaauuaagaaa

SEQ ID NO: 817567 - RNA, 19 nt, Homo sapiens
gcagcucgcuaccuaagug

SEQ ID NO: 817568 - RNA, 19 nt, Homo sapiens
gaagguuagcuaaaguuaa

SEQ ID NO: 817569 - RNA, 19 nt, Homo sapiens
gaaugcauguguucuuagu

SEQ ID NO: 817570 - RNA, 19 nt, Homo sapiens
uaagcuggcuggacucaug

SEQ ID NO: 817571 - RNA, 19 nt, Homo sapiens
ugagaagacugaggaagaa

SEQ ID NO: 817572 - RNA, 19 nt, Homo sapiens
ggaaauaaacgagacugaa

SEQ ID NO: 817573 - RNA, 19 nt, Homo sapiens
cuaccuaaguguuucugua

SEQ ID NO: 817574 - RNA, 19 nt, Homo sapiens
cuaaguagcugggauuaca

SEQ ID NO: 817575 - RNA, 19 nt, Homo sapiens
guugagaacauuuccuaua

SEQ ID NO: 817576 - RNA, 19 nt, Homo sapiens
gagugacaaugacuucuga

SEQ ID NO: 817577 - RNA, 19 nt, Homo sapiens
gaaauugacauggaagaug

SEQ ID NO: 817578 - RNA, 19 nt, Homo sapiens
uaaaguguggcaagacaua

SEQ ID NO: 817579 - RNA, 19 nt, Homo sapiens
uagcugggauuacaggaaa

SEQ ID NO: 817580 - RNA, 19 nt, Homo sapiens
aguaauagcacuagaagaa

SEQ ID NO: 817581 - RNA, 19 nt, Homo sapiens
ugaagcaaaucccuaagau

SEQ ID NO: 817582 - RNA, 19 nt, Homo sapiens
gagugaaauugacauggaa

SEQ ID NO: 817583 - RNA, 19 nt, Homo sapiens
gcaaggaagaccuggcaaa

SEQ ID NO: 817584 - RNA, 19 nt, Homo sapiens
ccucagacuuguagguaaa

SEQ ID NO: 817585 - RNA, 19 nt, Homo sapiens
gggaaggagccaauuaaga

SEQ ID NO: 817586 - RNA, 19 nt, Homo sapiens
ugaaagaagguuagcuaaa

SEQ ID NO: 817587 - RNA, 19 nt, Homo sapiens
aggaaugcauguguucuua

SEQ ID NO: 817588 - RNA, 19 nt, Homo sapiens
gaagguaaccccuguuuug

SEQ ID NO: 817589 - RNA, 19 nt, Homo sapiens
ugacacagguucagaagac

SEQ ID NO: 817590 - RNA, 19 nt, Homo sapiens
gggcaugccuguggucuca

SEQ ID NO: 817591 - RNA, 19 nt, Homo sapiens
gagacaggcuccagaugag

SEQ ID NO: 817592 - RNA, 19 nt, Homo sapiens
gugaugagaauugcaauaa

SEQ ID NO: 817593 - RNA, 19 nt, Homo sapiens
gguaaccccuguuuuguuu

SEQ ID NO: 817594 - RNA, 19 nt, Homo sapiens
acuaaagaccugcucaaua

SEQ ID NO: 817595 - RNA, 19 nt, Homo sapiens
acacaggauugaauuaagu

SEQ ID NO: 817596 - RNA, 19 nt, Homo sapiens
gacagugaguuggaagaaa

SEQ ID NO: 817597 - RNA, 19 nt, Homo sapiens
aaagaagguuagcuaaagu

SEQ ID NO: 817598 - RNA, 19 nt, Homo sapiens
ggcaagacauagugcacaa

SEQ ID NO: 817599 - RNA, 19 nt, Homo sapiens
cagccaggguuucucuaaa

SEQ ID NO: 817600 - RNA, 19 nt, Homo sapiens
ggacucauguuuggaaucg

SEQ ID NO: 817601 - RNA, 19 nt, Homo sapiens
agagugaaauugacaugga

SEQ ID NO: 817602 - RNA, 19 nt, Homo sapiens
gagaugcucaugcaaggaa

SEQ ID NO: 817603 - RNA, 19 nt, Homo sapiens
ggauggagcaagaaagguu

SEQ ID NO: 817604 - RNA, 19 nt, Homo sapiens
gaaguugaggcugcaauga

SEQ ID NO: 817605 - RNA, 19 nt, Homo sapiens
aaaucugacuuaucuggaa

SEQ ID NO: 817606 - RNA, 19 nt, Homo sapiens
aaacaacaacacaggauug

SEQ ID NO: 817607 - RNA, 19 nt, Homo sapiens
uaauguggccucugaugaa

SEQ ID NO: 817608 - RNA, 19 nt, Homo sapiens
gauuacagccaccuucaug

SEQ ID NO: 817609 - RNA, 19 nt, Homo sapiens
cacaauaccaagcauuaaa

SEQ ID NO: 817610 - RNA, 19 nt, Homo sapiens
uuaaucacuugcacaguug

SEQ ID NO: 817611 - RNA, 19 nt, Homo sapiens
gcacaguugagaacauuuc

SEQ ID NO: 817612 - RNA, 19 nt, Homo sapiens
acucauguuuggaaucgua

SEQ ID NO: 817613 - RNA, 19 nt, Homo sapiens
uaacgaugacucggacaua

SEQ ID NO: 817614 - RNA, 19 nt, Homo sapiens
ugagaacauuuccuauaca

SEQ ID NO: 817615 - RNA, 19 nt, Homo sapiens
uggaugagagugacaauga

SEQ ID NO: 817616 - RNA, 19 nt, Homo sapiens
gggauuacaggaaaugaga

SEQ ID NO: 817617 - RNA, 19 nt, Homo sapiens
ggaggagagugaaauugac

SEQ ID NO: 817618 - RNA, 19 nt, Homo sapiens
ggaaguugaggcugcaaug

SEQ ID NO: 817619 - RNA, 19 nt, Homo sapiens
guagaguaauagcacuaga

SEQ ID NO: 817620 - RNA, 19 nt, Homo sapiens
agagacaggcuccagauga

SEQ ID NO: 817621 - RNA, 19 nt, Homo sapiens
aaugggaacuuagaagguu

SEQ ID NO: 817622 - RNA, 19 nt, Homo sapiens
acagugaguuggaagaaag

SEQ ID NO: 817623 - RNA, 19 nt, Homo sapiens
aaagcaguaugacacuuau

SEQ ID NO: 817624 - RNA, 19 nt, Homo sapiens
uacuaaaucuggaaacucu

SEQ ID NO: 817625 - RNA, 19 nt, Homo sapiens
gaaaaucaggcaauagaga

SEQ ID NO: 817626 - RNA, 19 nt, Homo sapiens
agaagguuagcuaaaguua

SEQ ID NO: 817627 - RNA, 19 nt, Homo sapiens
gcauguguucuuagugauu

SEQ ID NO: 817628 - RNA, 19 nt, Homo sapiens
ccaccuuauuuaucuucua

SEQ ID NO: 817629 - RNA, 19 nt, Homo sapiens
cggaggagagugaaauuga

SEQ ID NO: 817630 - RNA, 19 nt, Homo sapiens
gagacuccgaugacaauga

SEQ ID NO: 817631 - RNA, 19 nt, Homo sapiens
gcucaagaguggaaguaac

SEQ ID NO: 817632 - RNA, 19 nt, Homo sapiens
ugccucagccuccuaagua

SEQ ID NO: 817633 - RNA, 19 nt, Homo sapiens
gcucgcuaccuaaguguuu

SEQ ID NO: 817634 - RNA, 19 nt, Homo sapiens
gagcugacgccacacaagu

SEQ ID NO: 817635 - RNA, 19 nt, Homo sapiens
augcauguguucuuaguga

SEQ ID NO: 817636 - RNA, 19 nt, Homo sapiens
gaggaaugcauguguucuu

SEQ ID NO: 817637 - RNA, 19 nt, Homo sapiens
cauggaagaugaugaugac

SEQ ID NO: 817638 - RNA, 19 nt, Homo sapiens
gaacaagcucaaggaggaa

SEQ ID NO: 817639 - RNA, 19 nt, Homo sapiens
acaacacaggauugaauua

SEQ ID NO: 817640 - RNA, 19 nt, Homo sapiens
gcacaacacagggacaaag

SEQ ID NO: 817641 - RNA, 19 nt, Homo sapiens
ucacaauaccaagcauuaa

SEQ ID NO: 817642 - RNA, 19 nt, Homo sapiens
uugagaacauuuccuauac

SEQ ID NO: 817643 - RNA, 19 nt, Homo sapiens
gcaagacgcuuuacaacau

SEQ ID NO: 817644 - RNA, 19 nt, Homo sapiens
ggacauugguuucuccauu

SEQ ID NO: 817645 - RNA, 19 nt, Homo sapiens
ggacagcuccucagaagaa

SEQ ID NO: 817646 - RNA, 19 nt, Homo sapiens
gggcagaacauguuuauug

SEQ ID NO: 817647 - RNA, 19 nt, Homo sapiens
cuuaagagauugacaacaa

SEQ ID NO: 817648 - RNA, 19 nt, Homo sapiens
ugaccaguguccaguguua

SEQ ID NO: 817649 - RNA, 19 nt, Homo sapiens
gaaauuacacugugcucaa

SEQ ID NO: 817650 - RNA, 19 nt, Homo sapiens
gcucaaugccuuaauaaau

SEQ ID NO: 817651 - RNA, 19 nt, Homo sapiens
gacauugguuucuccauug

SEQ ID NO: 817652 - RNA, 19 nt, Homo sapiens
gcauacauaccugugauua

SEQ ID NO: 817653 - RNA, 19 nt, Homo sapiens
gcucagaaggagacgauua

SEQ ID NO: 817654 - RNA, 19 nt, Homo sapiens
gaagagaguggacauugga

SEQ ID NO: 817655 - RNA, 19 nt, Homo sapiens
ucacuuggcuagaaauuac

SEQ ID NO: 817656 - RNA, 19 nt, Homo sapiens
ccuuaucaguuucucuuua

SEQ ID NO: 817657 - RNA, 19 nt, Homo sapiens
gagaagagaguggacauug

SEQ ID NO: 817658 - RNA, 19 nt, Homo sapiens
uuaggcaccuuaagagauu

SEQ ID NO: 817659 - RNA, 19 nt, Homo sapiens
gaccagcucuccggacuau

SEQ ID NO: 817660 - RNA, 19 nt, Homo sapiens
ugaauuaggcaccuuaaga

SEQ ID NO: 817661 - RNA, 19 nt, Homo sapiens
agaaagaggcucagaagga

SEQ ID NO: 817662 - RNA, 19 nt, Homo sapiens
gaaaguggagagacaguuc

SEQ ID NO: 817663 - RNA, 19 nt, Homo sapiens
acaaggauacccucacuuu

SEQ ID NO: 817664 - RNA, 19 nt, Homo sapiens
ggagaaagaggcucagaag

SEQ ID NO: 817665 - RNA, 19 nt, Homo sapiens
gaaugugggccaaggagaa

SEQ ID NO: 817666 - RNA, 19 nt, Homo sapiens
gggcugcucuugcuucuac

SEQ ID NO: 817667 - RNA, 19 nt, Homo sapiens
gcuuaggccucccaacuuc

SEQ ID NO: 817668 - RNA, 19 nt, Homo sapiens
ccugauauauuuccuugga

SEQ ID NO: 817669 - RNA, 19 nt, Homo sapiens
gccugaaccuccugacuga

SEQ ID NO: 817670 - RNA, 19 nt, Homo sapiens
caagacgcuuuacaacaug

SEQ ID NO: 817671 - RNA, 19 nt, Homo sapiens
agaaggagacgauuaagga

SEQ ID NO: 817672 - RNA, 19 nt, Homo sapiens
gaauuaggcaccuuaagag

SEQ ID NO: 817673 - RNA, 19 nt, Homo sapiens
gagcaguaccggauugaug

SEQ ID NO: 817674 - RNA, 19 nt, Homo sapiens
auacauaccugugauuaag

SEQ ID NO: 817675 - RNA, 19 nt, Homo sapiens
cuuaauaaaucccugaaag

SEQ ID NO: 817676 - RNA, 19 nt, Homo sapiens
cucaaugccuuaauaaauc

SEQ ID NO: 817677 - RNA, 19 nt, Homo sapiens
cuggugaacuucuuugaga

SEQ ID NO: 817678 - RNA, 19 nt, Homo sapiens
gacauuggacucaagauca

SEQ ID NO: 817679 - RNA, 19 nt, Homo sapiens
gcugcugucugacgaugaa

SEQ ID NO: 817680 - RNA, 19 nt, Homo sapiens
gagcaagaaggaaguggaa

SEQ ID NO: 817681 - RNA, 19 nt, Homo sapiens
ugugcucaaugccuuaaua

SEQ ID NO: 817682 - RNA, 19 nt, Homo sapiens
gaucaaggaccaaaagaaa

SEQ ID NO: 817683 - RNA, 19 nt, Homo sapiens
gcaagaaggaaguggaagu

SEQ ID NO: 817684 - RNA, 19 nt, Homo sapiens
ccacaaggauacccucacu

SEQ ID NO: 817685 - RNA, 19 nt, Homo sapiens
ucauuucacuuggcuagaa

SEQ ID NO: 817686 - RNA, 19 nt, Homo sapiens
ggacauuggacucaagauc

SEQ ID NO: 817687 - RNA, 19 nt, Homo sapiens
uaucggcacuaccuucgaa

SEQ ID NO: 817688 - RNA, 19 nt, Homo sapiens
aacaaggacucgcugauca

SEQ ID NO: 817689 - RNA, 19 nt, Homo sapiens
ucaucauccuuuccaguaa

SEQ ID NO: 817690 - RNA, 19 nt, Homo sapiens
uuuccucccuuaucaguuu

SEQ ID NO: 817691 - RNA, 19 nt, Homo sapiens
caaagcaggcggagacaca

SEQ ID NO: 817692 - RNA, 19 nt, Homo sapiens
ggcagaacauguuuauugc

SEQ ID NO: 817693 - RNA, 19 nt, Homo sapiens
acauaccugugauuaaguu

SEQ ID NO: 817694 - RNA, 19 nt, Homo sapiens
cauacauaccugugauuaa

SEQ ID NO: 817695 - RNA, 19 nt, Homo sapiens
gaaggagacgauuaaggau

SEQ ID NO: 817696 - RNA, 19 nt, Homo sapiens
ucaaggugcucuacaagcu

SEQ ID NO: 817697 - RNA, 19 nt, Homo sapiens
ugacagagaagcucaaggu

SEQ ID NO: 817698 - RNA, 19 nt, Homo sapiens
aaaggagcccggaguguga

SEQ ID NO: 817699 - RNA, 19 nt, Homo sapiens
ugcccuaccuggagcagua

SEQ ID NO: 817700 - RNA, 19 nt, Homo sapiens
gcucucagcucaucauccu

SEQ ID NO: 817701 - RNA, 19 nt, Homo sapiens
caggagcagugaguuguga

SEQ ID NO: 817702 - RNA, 19 nt, Homo sapiens
uuuacaacauguucaguga

SEQ ID NO: 817703 - RNA, 19 nt, Homo sapiens
caaggauacccucacuuug

SEQ ID NO: 817704 - RNA, 19 nt, Homo sapiens
gcuguguucuggaaguuca

SEQ ID NO: 817705 - RNA, 19 nt, Homo sapiens
ggcccaaggugucaucagu

SEQ ID NO: 817706 - RNA, 19 nt, Homo sapiens
acggguaccugacagagaa

SEQ ID NO: 817707 - RNA, 19 nt, Homo sapiens
caugaggagcugaaacuga

SEQ ID NO: 817708 - RNA, 19 nt, Homo sapiens
uggaggaccuuuacauggu

SEQ ID NO: 817709 - RNA, 19 nt, Homo sapiens
aaauuacacugugcucaau

SEQ ID NO: 817710 - RNA, 19 nt, Homo sapiens
acauuggacucaagaucaa

SEQ ID NO: 817711 - RNA, 19 nt, Homo sapiens
gagcugugcaagacgcuuu

SEQ ID NO: 817712 - RNA, 19 nt, Homo sapiens
ggaaaggagcccggagugu

SEQ ID NO: 817713 - RNA, 19 nt, Homo sapiens
aggacucgcugaucaacuu

SEQ ID NO: 817714 - RNA, 19 nt, Homo sapiens
gcucuugcuucuacuaaaa

SEQ ID NO: 817715 - RNA, 19 nt, Homo sapiens
ugcccuugcuugccucaua

SEQ ID NO: 817716 - RNA, 19 nt, Homo sapiens
cagcugccuuagacagauu

SEQ ID NO: 817717 - RNA, 19 nt, Homo sapiens
gcaccgccagugaccauga

SEQ ID NO: 817718 - RNA, 19 nt, Homo sapiens
agaagagaguggacauugg

SEQ ID NO: 817719 - RNA, 19 nt, Homo sapiens
ggaagagcaagaaggaagu

SEQ ID NO: 817720 - RNA, 19 nt, Homo sapiens
gguuguggguccuggugaa

SEQ ID NO: 817721 - RNA, 19 nt, Homo sapiens
gaagagcuggaggaccuuu

SEQ ID NO: 817722 - RNA, 19 nt, Homo sapiens
gugcucaaugccuuaauaa

SEQ ID NO: 817723 - RNA, 19 nt, Homo sapiens
ucucagcucaucauccuuu

SEQ ID NO: 817724 - RNA, 19 nt, Homo sapiens
ggagagaggagaggagaag

SEQ ID NO: 817725 - RNA, 19 nt, Homo sapiens
gcuggaggaccuuuacaug

SEQ ID NO: 817726 - RNA, 19 nt, Homo sapiens
caaggugcucuacaagcua

SEQ ID NO: 817727 - RNA, 19 nt, Homo sapiens
gaccuuuacaugguguuua

SEQ ID NO: 817728 - RNA, 19 nt, Homo sapiens
ucucagaucugcccuugcu

SEQ ID NO: 817729 - RNA, 19 nt, Homo sapiens
cgacuggugcaucuccuuu

SEQ ID NO: 817730 - RNA, 19 nt, Homo sapiens
caagaaggaaguggaagug

SEQ ID NO: 817731 - RNA, 19 nt, Homo sapiens
gauauauuuccuuggauuc

SEQ ID NO: 817732 - RNA, 19 nt, Homo sapiens
agacccagcugccuuagac

SEQ ID NO: 817733 - RNA, 19 nt, Homo sapiens
cgggcucccugcaauguga

SEQ ID NO: 817734 - RNA, 19 nt, Homo sapiens
ucauugagcugugcaagac

SEQ ID NO: 817735 - RNA, 19 nt, Homo sapiens
ggcacuaccuucgaaugug

SEQ ID NO: 817736 - RNA, 19 nt, Homo sapiens
accuuuacaugguguuuaa

SEQ ID NO: 817737 - RNA, 19 nt, Homo sapiens
acauugguuucuccauuga

SEQ ID NO: 817738 - RNA, 19 nt, Homo sapiens
aaaagaaaguggagagaca

SEQ ID NO: 817739 - RNA, 19 nt, Homo sapiens
ccaaagacgacauguccau

SEQ ID NO: 817740 - RNA, 19 nt, Homo sapiens
caaaccuuauacauacugu

SEQ ID NO: 817741 - RNA, 19 nt, Homo sapiens
aaacaaggacucgcugauc

SEQ ID NO: 817742 - RNA, 19 nt, Homo sapiens
ggaccagcucuccggacua

SEQ ID NO: 817743 - RNA, 19 nt, Homo sapiens
gaagagagcuuagcaguga

SEQ ID NO: 817744 - RNA, 19 nt, Homo sapiens
caaagaaccuauccgcuua

SEQ ID NO: 817745 - RNA, 19 nt, Homo sapiens
gaaaguggcugugguuuau

SEQ ID NO: 817746 - RNA, 19 nt, Homo sapiens
gaaauacucuucaguugga

SEQ ID NO: 817747 - RNA, 19 nt, Homo sapiens
ggucagcuauccagaauuu

SEQ ID NO: 817748 - RNA, 19 nt, Homo sapiens
gcaaaccgguuaaucaaga

SEQ ID NO: 817749 - RNA, 19 nt, Homo sapiens
gaacaggauuggucagcua

SEQ ID NO: 817750 - RNA, 19 nt, Homo sapiens
ggaaaucugccaauacuaa

SEQ ID NO: 817751 - RNA, 19 nt, Homo sapiens
ggacuguggugccaucuuu

SEQ ID NO: 817752 - RNA, 19 nt, Homo sapiens
gaagagguacccaucauaa

SEQ ID NO: 817753 - RNA, 19 nt, Homo sapiens
ugaaagcaccugagacuua

SEQ ID NO: 817754 - RNA, 19 nt, Homo sapiens
gaaagcaccugagacuuau

SEQ ID NO: 817755 - RNA, 19 nt, Homo sapiens
gcuaggaacuugaaugugu

SEQ ID NO: 817756 - RNA, 19 nt, Homo sapiens
gaacuugaauguguauguu

SEQ ID NO: 817757 - RNA, 19 nt, Homo sapiens
ugaaggauguagaagcuua

SEQ ID NO: 817758 - RNA, 19 nt, Homo sapiens
caggagagguggauauuug

SEQ ID NO: 817759 - RNA, 19 nt, Homo sapiens
gcacagggcuugggauauc

SEQ ID NO: 817760 - RNA, 19 nt, Homo sapiens
gcaaauucaugaugugugu

SEQ ID NO: 817761 - RNA, 19 nt, Homo sapiens
caagauggacccuucauuu

SEQ ID NO: 817762 - RNA, 19 nt, Homo sapiens
gcuccaagcuuccugcauu

SEQ ID NO: 817763 - RNA, 19 nt, Homo sapiens
ugacaaggcuucuaaagag

SEQ ID NO: 817764 - RNA, 19 nt, Homo sapiens
gaagagagaaccugaagau

SEQ ID NO: 817765 - RNA, 19 nt, Homo sapiens
gguacaagcugacauucaa

SEQ ID NO: 817766 - RNA, 19 nt, Homo sapiens
ugaauuauguuucgcagaa

SEQ ID NO: 817767 - RNA, 19 nt, Homo sapiens
uaaauaaucccacaucaug

SEQ ID NO: 817768 - RNA, 19 nt, Homo sapiens
ggagugcggugguauaauc

SEQ ID NO: 817769 - RNA, 19 nt, Homo sapiens
gagagaaccugaagaucug

SEQ ID NO: 817770 - RNA, 19 nt, Homo sapiens
gaaagccaguugcauuuag

SEQ ID NO: 817771 - RNA, 19 nt, Homo sapiens
ugauugagguggugacuaa

SEQ ID NO: 817772 - RNA, 19 nt, Homo sapiens
gauggaagaauucaaguuu

SEQ ID NO: 817773 - RNA, 19 nt, Homo sapiens
uggcaucacucccuucuaa

SEQ ID NO: 817774 - RNA, 19 nt, Homo sapiens
gaauguguauguuugacaa

SEQ ID NO: 817775 - RNA, 19 nt, Homo sapiens
aaagggaacugucuucugu

SEQ ID NO: 817776 - RNA, 19 nt, Homo sapiens
ggaaagccaguugcauuua

SEQ ID NO: 817777 - RNA, 19 nt, Homo sapiens
gcuccuaccucuucauuca

SEQ ID NO: 817778 - RNA, 19 nt, Homo sapiens
ugaacgaacugaucaaagu

SEQ ID NO: 817779 - RNA, 19 nt, Homo sapiens
guagucagguggcucuaaa

SEQ ID NO: 817780 - RNA, 19 nt, Homo sapiens
gaagcaaauucaugaugug

SEQ ID NO: 817781 - RNA, 19 nt, Homo sapiens
gaauaaauaccauguagca

SEQ ID NO: 817782 - RNA, 19 nt, Homo sapiens
ggaagcucuuuaugccuua

SEQ ID NO: 817783 - RNA, 19 nt, Homo sapiens
gauggacccuucauuucaa

SEQ ID NO: 817784 - RNA, 19 nt, Homo sapiens
ggccagugcuuuccaguau

SEQ ID NO: 817785 - RNA, 19 nt, Homo sapiens
gauauuuguugauggaaga

SEQ ID NO: 817786 - RNA, 19 nt, Homo sapiens
gcagaguaguugcauguca

SEQ ID NO: 817787 - RNA, 19 nt, Homo sapiens
gugcugcucuugaccauga

SEQ ID NO: 817788 - RNA, 19 nt, Homo sapiens
cgaaguaggagaagugaaa

SEQ ID NO: 817789 - RNA, 19 nt, Homo sapiens
gaagugcgaagccauguga

SEQ ID NO: 817790 - RNA, 19 nt, Homo sapiens
ucaagaauuuggucaagga

SEQ ID NO: 817791 - RNA, 19 nt, Homo sapiens
gugagcaggugaacacuga

SEQ ID NO: 817792 - RNA, 19 nt, Homo sapiens
uacaugcucuuacuugaaa

SEQ ID NO: 817793 - RNA, 19 nt, Homo sapiens
gggagaagcaaauucauga

SEQ ID NO: 817794 - RNA, 19 nt, Homo sapiens
uaaauaccauguagcaagu

SEQ ID NO: 817795 - RNA, 19 nt, Homo sapiens
gaaauucuccaggcaaaug

SEQ ID NO: 817796 - RNA, 19 nt, Homo sapiens
gaagagucauugaaauacu

SEQ ID NO: 817797 - RNA, 19 nt, Homo sapiens
ugaaaguggcugugguuua

SEQ ID NO: 817798 - RNA, 19 nt, Homo sapiens
uaacggugcuggagaugug

SEQ ID NO: 817799 - RNA, 19 nt, Homo sapiens
gacaggauuucaccauguu

SEQ ID NO: 817800 - RNA, 19 nt, Homo sapiens
caaugccucugucccaauu

SEQ ID NO: 817801 - RNA, 19 nt, Homo sapiens
gacagcaucucccucugaa

SEQ ID NO: 817802 - RNA, 19 nt, Homo sapiens
gaauacaccucuggcucaa

SEQ ID NO: 817803 - RNA, 19 nt, Homo sapiens
acagcgagguggccaaauu

SEQ ID NO: 817804 - RNA, 19 nt, Homo sapiens
aaagggaccugguuagucu

SEQ ID NO: 817805 - RNA, 19 nt, Homo sapiens
cagaauugcugugaggaaa

SEQ ID NO: 817806 - RNA, 19 nt, Homo sapiens
ggacaggagagguggauau

SEQ ID NO: 817807 - RNA, 19 nt, Homo sapiens
ccaguugcauuuagagaug

SEQ ID NO: 817808 - RNA, 19 nt, Homo sapiens
ucgagacgcuuaucagaug

SEQ ID NO: 817809 - RNA, 19 nt, Homo sapiens
aaaggaagagucauugaaa

SEQ ID NO: 817810 - RNA, 19 nt, Homo sapiens
cagcugacgucacagucua

SEQ ID NO: 817811 - RNA, 19 nt, Homo sapiens
caaagucaaugagagugaa

SEQ ID NO: 817812 - RNA, 19 nt, Homo sapiens
ggucaaggaggaacaagaa

SEQ ID NO: 817813 - RNA, 19 nt, Homo sapiens
agaagcaaauucaugaugu

SEQ ID NO: 817814 - RNA, 19 nt, Homo sapiens
cuacuaugcuuagguguug

SEQ ID NO: 817815 - RNA, 19 nt, Homo sapiens
uauaggcucuguuacuguu

SEQ ID NO: 817816 - RNA, 19 nt, Homo sapiens
guuuggagcucuuaauuac

SEQ ID NO: 817817 - RNA, 19 nt, Homo sapiens
guaaaggaaacuucaugaa

SEQ ID NO: 817818 - RNA, 19 nt, Homo sapiens
ugucugggauaucauguuu

SEQ ID NO: 817819 - RNA, 19 nt, Homo sapiens
ccugaugccugacuuuaug

SEQ ID NO: 817820 - RNA, 19 nt, Homo sapiens
cuaggaacuugaaugugua

SEQ ID NO: 817821 - RNA, 19 nt, Homo sapiens
guacagauagacaugaaga

SEQ ID NO: 817822 - RNA, 19 nt, Homo sapiens
ugacaccacugaugacgau

SEQ ID NO: 817823 - RNA, 19 nt, Homo sapiens
uaaaggaagagucauugaa

SEQ ID NO: 817824 - RNA, 19 nt, Homo sapiens
gagaagcaaauucaugaug

SEQ ID NO: 817825 - RNA, 19 nt, Homo sapiens
guacuuucuugcuuguauu

SEQ ID NO: 817826 - RNA, 19 nt, Homo sapiens
gagguggugacuaaauaua

SEQ ID NO: 817827 - RNA, 19 nt, Homo sapiens
cuaaauggaaugcuuguug

SEQ ID NO: 817828 - RNA, 19 nt, Homo sapiens
guacaggugcugcucuuga

SEQ ID NO: 817829 - RNA, 19 nt, Homo sapiens
caauggaccugcgcagaug

SEQ ID NO: 817830 - RNA, 19 nt, Homo sapiens
caaaccgguuaaucaagaa

SEQ ID NO: 817831 - RNA, 19 nt, Homo sapiens
aaacaagacccuaaacuac

SEQ ID NO: 817832 - RNA, 19 nt, Homo sapiens
ugccauaauucacauaaga

SEQ ID NO: 817833 - RNA, 19 nt, Homo sapiens
gaugggaacuguaaaagau

SEQ ID NO: 817834 - RNA, 19 nt, Homo sapiens
gaaaucugccaauacuaau

SEQ ID NO: 817835 - RNA, 19 nt, Homo sapiens
guggaaaucugccaauacu

SEQ ID NO: 817836 - RNA, 19 nt, Homo sapiens
uugagguggugacuaaaua

SEQ ID NO: 817837 - RNA, 19 nt, Homo sapiens
ucaccacugugccuuagaa

SEQ ID NO: 817838 - RNA, 19 nt, Homo sapiens
cggaaauucuccaggcaaa

SEQ ID NO: 817839 - RNA, 19 nt, Homo sapiens
aggaagagucauugaaaua

SEQ ID NO: 817840 - RNA, 19 nt, Homo sapiens
gaacgaacugaucaaagug

SEQ ID NO: 817841 - RNA, 19 nt, Homo sapiens
caugucauuuggccuguuu

SEQ ID NO: 817842 - RNA, 19 nt, Homo sapiens
guaguugcaugucauuugg

SEQ ID NO: 817843 - RNA, 19 nt, Homo sapiens
gaagagagcuuagcaguga

SEQ ID NO: 817844 - RNA, 19 nt, Homo sapiens
caaagaaccuauccgcuua

SEQ ID NO: 817845 - RNA, 19 nt, Homo sapiens
gaaaguggcugugguuuau

SEQ ID NO: 817846 - RNA, 19 nt, Homo sapiens
gaaauacucuucaguugga

SEQ ID NO: 817847 - RNA, 19 nt, Homo sapiens
ggucagcuauccagaauuu

SEQ ID NO: 817848 - RNA, 19 nt, Homo sapiens
gcaaaccgguuaaucaaga

SEQ ID NO: 817849 - RNA, 19 nt, Homo sapiens
gaacaggauuggucagcua

SEQ ID NO: 817850 - RNA, 19 nt, Homo sapiens
ggaaaucugccaauacuaa

SEQ ID NO: 817851 - RNA, 19 nt, Homo sapiens
ggacuguggugccaucuuu

SEQ ID NO: 817852 - RNA, 19 nt, Homo sapiens
gaagagguacccaucauaa

SEQ ID NO: 817853 - RNA, 19 nt, Homo sapiens
ugaaagcaccugagacuua

SEQ ID NO: 817854 - RNA, 19 nt, Homo sapiens
gaaagcaccugagacuuau

SEQ ID NO: 817855 - RNA, 19 nt, Homo sapiens
gcuaggaacuugaaugugu

SEQ ID NO: 817856 - RNA, 19 nt, Homo sapiens
gaacuugaauguguauguu

SEQ ID NO: 817857 - RNA, 19 nt, Homo sapiens
ugaaggauguagaagcuua

SEQ ID NO: 817858 - RNA, 19 nt, Homo sapiens
caggagagguggauauuug

SEQ ID NO: 817859 - RNA, 19 nt, Homo sapiens
gcacagggcuugggauauc

SEQ ID NO: 817860 - RNA, 19 nt, Homo sapiens
gcaaauucaugaugugugu

SEQ ID NO: 817861 - RNA, 19 nt, Homo sapiens
caagauggacccuucauuu

SEQ ID NO: 817862 - RNA, 19 nt, Homo sapiens
gcuccaagcuuccugcauu

SEQ ID NO: 817863 - RNA, 19 nt, Homo sapiens
ugacaaggcuucuaaagag

SEQ ID NO: 817864 - RNA, 19 nt, Homo sapiens
gaagagagaaccugaagau

SEQ ID NO: 817865 - RNA, 19 nt, Homo sapiens
gguacaagcugacauucaa

SEQ ID NO: 817866 - RNA, 19 nt, Homo sapiens
ugaauuauguuucgcagaa

SEQ ID NO: 817867 - RNA, 19 nt, Homo sapiens
uaaauaaucccacaucaug

SEQ ID NO: 817868 - RNA, 19 nt, Homo sapiens
ggagugcggugguauaauc

SEQ ID NO: 817869 - RNA, 19 nt, Homo sapiens
gagagaaccugaagaucug

SEQ ID NO: 817870 - RNA, 19 nt, Homo sapiens
gaaagccaguugcauuuag

SEQ ID NO: 817871 - RNA, 19 nt, Homo sapiens
ugauugagguggugacuaa

SEQ ID NO: 817872 - RNA, 19 nt, Homo sapiens
gauggaagaauucaaguuu

SEQ ID NO: 817873 - RNA, 19 nt, Homo sapiens
uggcaucacucccuucuaa

SEQ ID NO: 817874 - RNA, 19 nt, Homo sapiens
gaauguguauguuugacaa

SEQ ID NO: 817875 - RNA, 19 nt, Homo sapiens
aaagggaacugucuucugu

SEQ ID NO: 817876 - RNA, 19 nt, Homo sapiens
ggaaagccaguugcauuua

SEQ ID NO: 817877 - RNA, 19 nt, Homo sapiens
gcuccuaccucuucauuca

SEQ ID NO: 817878 - RNA, 19 nt, Homo sapiens
ugaacgaacugaucaaagu

SEQ ID NO: 817879 - RNA, 19 nt, Homo sapiens
guagucagguggcucuaaa

SEQ ID NO: 817880 - RNA, 19 nt, Homo sapiens
gaagcaaauucaugaugug

SEQ ID NO: 817881 - RNA, 19 nt, Homo sapiens
gaauaaauaccauguagca

SEQ ID NO: 817882 - RNA, 19 nt, Homo sapiens
ggaagcucuuuaugccuua

SEQ ID NO: 817883 - RNA, 19 nt, Homo sapiens
gauggacccuucauuucaa

SEQ ID NO: 817884 - RNA, 19 nt, Homo sapiens
ggccagugcuuuccaguau

SEQ ID NO: 817885 - RNA, 19 nt, Homo sapiens
gauauuuguugauggaaga

SEQ ID NO: 817886 - RNA, 19 nt, Homo sapiens
gcagaguaguugcauguca

SEQ ID NO: 817887 - RNA, 19 nt, Homo sapiens
cgaaguaggagaagugaaa

SEQ ID NO: 817888 - RNA, 19 nt, Homo sapiens
gaagugcgaagccauguga

SEQ ID NO: 817889 - RNA, 19 nt, Homo sapiens
ucaagaauuuggucaagga

SEQ ID NO: 817890 - RNA, 19 nt, Homo sapiens
gugagcaggugaacacuga

SEQ ID NO: 817891 - RNA, 19 nt, Homo sapiens
uacaugcucuuacuugaaa

SEQ ID NO: 817892 - RNA, 19 nt, Homo sapiens
gggagaagcaaauucauga

SEQ ID NO: 817893 - RNA, 19 nt, Homo sapiens
uaaauaccauguagcaagu

SEQ ID NO: 817894 - RNA, 19 nt, Homo sapiens
gaaauucuccaggcaaaug

SEQ ID NO: 817895 - RNA, 19 nt, Homo sapiens
gaagagucauugaaauacu

SEQ ID NO: 817896 - RNA, 19 nt, Homo sapiens
ugaaaguggcugugguuua

SEQ ID NO: 817897 - RNA, 19 nt, Homo sapiens
uaacggugcuggagaugug

SEQ ID NO: 817898 - RNA, 19 nt, Homo sapiens
gacaggauuucaccauguu

SEQ ID NO: 817899 - RNA, 19 nt, Homo sapiens
caaugccucugucccaauu

SEQ ID NO: 817900 - RNA, 19 nt, Homo sapiens
gacagcaucucccucugaa

SEQ ID NO: 817901 - RNA, 19 nt, Homo sapiens
acagcgagguggccaaauu

SEQ ID NO: 817902 - RNA, 19 nt, Homo sapiens
aaagggaccugguuagucu

SEQ ID NO: 817903 - RNA, 19 nt, Homo sapiens
cagaauugcugugaggaaa

SEQ ID NO: 817904 - RNA, 19 nt, Homo sapiens
ggacaggagagguggauau

SEQ ID NO: 817905 - RNA, 19 nt, Homo sapiens
ccaguugcauuuagagaug

SEQ ID NO: 817906 - RNA, 19 nt, Homo sapiens
ucgagacgcuuaucagaug

SEQ ID NO: 817907 - RNA, 19 nt, Homo sapiens
aaaggaagagucauugaaa

SEQ ID NO: 817908 - RNA, 19 nt, Homo sapiens
cagcugacgucacagucua

SEQ ID NO: 817909 - RNA, 19 nt, Homo sapiens
caaagucaaugagagugaa

SEQ ID NO: 817910 - RNA, 19 nt, Homo sapiens
ggucaaggaggaacaagaa

SEQ ID NO: 817911 - RNA, 19 nt, Homo sapiens
agaagcaaauucaugaugu

SEQ ID NO: 817912 - RNA, 19 nt, Homo sapiens
cuacuaugcuuagguguug

SEQ ID NO: 817913 - RNA, 19 nt, Homo sapiens
uauaggcucuguuacuguu

SEQ ID NO: 817914 - RNA, 19 nt, Homo sapiens
guuuggagcucuuaauuac

SEQ ID NO: 817915 - RNA, 19 nt, Homo sapiens
guaaaggaaacuucaugaa

SEQ ID NO: 817916 - RNA, 19 nt, Homo sapiens
ccugaugccugacuuuaug

SEQ ID NO: 817917 - RNA, 19 nt, Homo sapiens
cuaggaacuugaaugugua

SEQ ID NO: 817918 - RNA, 19 nt, Homo sapiens
guacagauagacaugaaga

SEQ ID NO: 817919 - RNA, 19 nt, Homo sapiens
ugacaccacugaugacgau

SEQ ID NO: 817920 - RNA, 19 nt, Homo sapiens
uaaaggaagagucauugaa

SEQ ID NO: 817921 - RNA, 19 nt, Homo sapiens
gagaagcaaauucaugaug

SEQ ID NO: 817922 - RNA, 19 nt, Homo sapiens
guacuuucuugcuuguauu

SEQ ID NO: 817923 - RNA, 19 nt, Homo sapiens
gagguggugacuaaauaua

SEQ ID NO: 817924 - RNA, 19 nt, Homo sapiens
cuaaauggaaugcuuguug

SEQ ID NO: 817925 - RNA, 19 nt, Homo sapiens
guccugggauaucauguuu

SEQ ID NO: 817926 - RNA, 19 nt, Homo sapiens
caauggaccugcgcagaug

SEQ ID NO: 817927 - RNA, 19 nt, Homo sapiens
caaaccgguuaaucaagaa

SEQ ID NO: 817928 - RNA, 19 nt, Homo sapiens
aaacaagacccuaaacuac

SEQ ID NO: 817929 - RNA, 19 nt, Homo sapiens
ugccauaauucacauaaga

SEQ ID NO: 817930 - RNA, 19 nt, Homo sapiens
gaugggaacuguaaaagau

SEQ ID NO: 817931 - RNA, 19 nt, Homo sapiens
gaaaucugccaauacuaau

SEQ ID NO: 817932 - RNA, 19 nt, Homo sapiens
guggaaaucugccaauacu

SEQ ID NO: 817933 - RNA, 19 nt, Homo sapiens
gaacgaacugaucaaagug

SEQ ID NO: 817934 - RNA, 19 nt, Homo sapiens
uugagguggugacuaaaua

SEQ ID NO: 817935 - RNA, 19 nt, Homo sapiens
ucaccacugugccuuagaa

SEQ ID NO: 817936 - RNA, 19 nt, Homo sapiens
cggaaauucuccaggcaaa

SEQ ID NO: 817937 - RNA, 19 nt, Homo sapiens
aggaagagucauugaaaua

SEQ ID NO: 817938 - RNA, 19 nt, Homo sapiens
caugucauuuggccuguuu

SEQ ID NO: 817939 - RNA, 19 nt, Homo sapiens
guaguugcaugucauuugg

SEQ ID NO: 817940 - RNA, 19 nt, Homo sapiens
gcuaguuguugaccagcua

SEQ ID NO: 817941 - RNA, 19 nt, Homo sapiens
aaucucagccucucgagua

SEQ ID NO: 817942 - RNA, 19 nt, Homo sapiens
ggagggcuuugaaguccaa

SEQ ID NO: 817943 - RNA, 19 nt, Homo sapiens
gaagaaagauacagagaga

SEQ ID NO: 817944 - RNA, 19 nt, Homo sapiens
gcagaaggauuguguuauu

SEQ ID NO: 817945 - RNA, 19 nt, Homo sapiens
uaaacgaacuugugaauug

SEQ ID NO: 817946 - RNA, 19 nt, Homo sapiens
gcaauaagcucauccuagu

SEQ ID NO: 817947 - RNA, 19 nt, Homo sapiens
ggacagcaguuccaagaaa

SEQ ID NO: 817948 - RNA, 19 nt, Homo sapiens
gagcacaaguggugguuua

SEQ ID NO: 817949 - RNA, 19 nt, Homo sapiens
gcaaauagcauccaagguu

SEQ ID NO: 817950 - RNA, 19 nt, Homo sapiens
uacaagaucuccacgaaua

SEQ ID NO: 817951 - RNA, 19 nt, Homo sapiens
ggaaauuacucuuacuguu

SEQ ID NO: 817952 - RNA, 19 nt, Homo sapiens
ggcaggaacuugcuucuaa

SEQ ID NO: 817953 - RNA, 19 nt, Homo sapiens
gagaauaaaugaagagaag

SEQ ID NO: 817954 - RNA, 19 nt, Homo sapiens
acaaagaguucgauagaaa

SEQ ID NO: 817955 - RNA, 19 nt, Homo sapiens
gaacuuuccggccaauuua

SEQ ID NO: 817956 - RNA, 19 nt, Homo sapiens
gcacgucagucaugcguaa

SEQ ID NO: 817957 - RNA, 19 nt, Homo sapiens
gaaaugacauacaagaucu

SEQ ID NO: 817958 - RNA, 19 nt, Homo sapiens
gcucaacucuccaaauaga

SEQ ID NO: 817959 - RNA, 19 nt, Homo sapiens
ggacaaagaguucgauaga

SEQ ID NO: 817960 - RNA, 19 nt, Homo sapiens
guaaucaguucucugguaa

SEQ ID NO: 817961 - RNA, 19 nt, Homo sapiens
guaauaauguccuugaagu

SEQ ID NO: 817962 - RNA, 19 nt, Homo sapiens
caaugcagcuguugaugaa

SEQ ID NO: 817963 - RNA, 19 nt, Homo sapiens
uggcucaacucuccaaaua

SEQ ID NO: 817964 - RNA, 19 nt, Homo sapiens
caaguaaaccacagaauga

SEQ ID NO: 817965 - RNA, 19 nt, Homo sapiens
gaaggauuguguuauuguu

SEQ ID NO: 817966 - RNA, 19 nt, Homo sapiens
gcaggaacuugcuucuaaa

SEQ ID NO: 817967 - RNA, 19 nt, Homo sapiens
gagaauuauugcguacuua

SEQ ID NO: 817968 - RNA, 19 nt, Homo sapiens
gagcuguucugaauccaaa

SEQ ID NO: 817969 - RNA, 19 nt, Homo sapiens
gaagcguggugccauuauu

SEQ ID NO: 817970 - RNA, 19 nt, Homo sapiens
gaacuugugaauuguauug

SEQ ID NO: 817971 - RNA, 19 nt, Homo sapiens
ucgaaacauuggcauaaua

SEQ ID NO: 817972 - RNA, 19 nt, Homo sapiens
agagagaaaugacauacaa

SEQ ID NO: 817973 - RNA, 19 nt, Homo sapiens
ggucaaaggaggaauauuc

SEQ ID NO: 817974 - RNA, 19 nt, Homo sapiens
agaguuaccuucucauguu

SEQ ID NO: 817975 - RNA, 19 nt, Homo sapiens
uggaaauguugaucucuua

SEQ ID NO: 817976 - RNA, 19 nt, Homo sapiens
ggacagucuugugaaauug

SEQ ID NO: 817977 - RNA, 19 nt, Homo sapiens
ggaacuugcuucuaaaauu

SEQ ID NO: 817978 - RNA, 19 nt, Homo sapiens
uuaggaaacuguggagaua

SEQ ID NO: 817979 - RNA, 19 nt, Homo sapiens
agaagacgaugauucagaa

SEQ ID NO: 817980 - RNA, 19 nt, Homo sapiens
ggcuagagcuguucugaau

SEQ ID NO: 817981 - RNA, 19 nt, Homo sapiens
cauacaagaucuccacgaa

SEQ ID NO: 817982 - RNA, 19 nt, Homo sapiens
gacaaagaguucgauagaa

SEQ ID NO: 817983 - RNA, 19 nt, Homo sapiens
auagugagguucuaaaguu

SEQ ID NO: 817984 - RNA, 19 nt, Homo sapiens
cgaaacauuggcauaauaa

SEQ ID NO: 817985 - RNA, 19 nt, Homo sapiens
ccucuucccuucuaauuau

SEQ ID NO: 817986 - RNA, 19 nt, Homo sapiens
uguaaucaguucucuggua

SEQ ID NO: 817987 - RNA, 19 nt, Homo sapiens
cuggucaucuucaguauuu

SEQ ID NO: 817988 - RNA, 19 nt, Homo sapiens
ggagagaggccagggcuuu

SEQ ID NO: 817989 - RNA, 19 nt, Homo sapiens
ccaaggaaauuacucuuac

SEQ ID NO: 817990 - RNA, 19 nt, Homo sapiens
caguuuaucuggaagaaug

SEQ ID NO: 817991 - RNA, 19 nt, Homo sapiens
cagaaagacgggauaauga

SEQ ID NO: 817992 - RNA, 19 nt, Homo sapiens
aggaaacuguggagauaua

SEQ ID NO: 817993 - RNA, 19 nt, Homo sapiens
gaaacacucaccaucaguu

SEQ ID NO: 817994 - RNA, 19 nt, Homo sapiens
agccauaccuuguguuuga

SEQ ID NO: 817995 - RNA, 19 nt, Homo sapiens
cacaaguggugguuuacua

SEQ ID NO: 817996 - RNA, 19 nt, Homo sapiens
gaaauacagaggcaagaau

SEQ ID NO: 817997 - RNA, 19 nt, Homo sapiens
ugaaagccaugucucuguu

SEQ ID NO: 817998 - RNA, 19 nt, Homo sapiens
caagcuagacaguggauuu

SEQ ID NO: 817999 - RNA, 19 nt, Homo sapiens
uugcagagauugaauguca

SEQ ID NO: 818000 - RNA, 19 nt, Homo sapiens
gcuggacagucuugugaaa

SEQ ID NO: 818001 - RNA, 19 nt, Homo sapiens
ccuauggacuucuguacaa

SEQ ID NO: 818002 - RNA, 19 nt, Homo sapiens
gaggacagcaguuccaaga

SEQ ID NO: 818003 - RNA, 19 nt, Homo sapiens
ugaagaggaugggcauuga

SEQ ID NO: 818004 - RNA, 19 nt, Homo sapiens
cagcagaaguagacacugu

SEQ ID NO: 818005 - RNA, 19 nt, Homo sapiens
gaauuucuaucaguugcaa

SEQ ID NO: 818006 - RNA, 19 nt, Homo sapiens
cagaaggauuguguuauug

SEQ ID NO: 818007 - RNA, 19 nt, Homo sapiens
aaugugaacuggcuaaaca

SEQ ID NO: 818008 - RNA, 19 nt, Homo sapiens
ggaagagaauguagaacac

SEQ ID NO: 818009 - RNA, 19 nt, Homo sapiens
uggacagucuugugaaauu

SEQ ID NO: 818010 - RNA, 19 nt, Homo sapiens
ccaaguaaaccacagaaug

SEQ ID NO: 818011 - RNA, 19 nt, Homo sapiens
gacagaagccauucgaugu

SEQ ID NO: 818012 - RNA, 19 nt, Homo sapiens
ugacagagaaccagaggaa

SEQ ID NO: 818013 - RNA, 19 nt, Homo sapiens
uacaacaucugagagaauu

SEQ ID NO: 818014 - RNA, 19 nt, Homo sapiens
gagaagaaagauacagaga

SEQ ID NO: 818015 - RNA, 19 nt, Homo sapiens
ggaaauacagaggcaagaa

SEQ ID NO: 818016 - RNA, 19 nt, Homo sapiens
guucuaaaguucaguuugg

SEQ ID NO: 818017 - RNA, 19 nt, Homo sapiens
agaaagauacagagagaaa

SEQ ID NO: 818018 - RNA, 19 nt, Homo sapiens
gacaguggauuugccaaga

SEQ ID NO: 818019 - RNA, 19 nt, Homo sapiens
gaaacuguggagauauaaa

SEQ ID NO: 818020 - RNA, 19 nt, Homo sapiens
ucagaagcguggugccauu

SEQ ID NO: 818021 - RNA, 19 nt, Homo sapiens
uagauuaucagcuggauga

SEQ ID NO: 818022 - RNA, 19 nt, Homo sapiens
ccaacuggcuagagcuguu

SEQ ID NO: 818023 - RNA, 19 nt, Homo sapiens
gucagagacuggaaauguu

SEQ ID NO: 818024 - RNA, 19 nt, Homo sapiens
ugaacuggcuaaacagcuu

SEQ ID NO: 818025 - RNA, 19 nt, Homo sapiens
ccaaugcagcuguugauga

SEQ ID NO: 818026 - RNA, 19 nt, Homo sapiens
aaagaccuccuguucauga

SEQ ID NO: 818027 - RNA, 19 nt, Homo sapiens
ugaagauucugaaacucaa

SEQ ID NO: 818028 - RNA, 19 nt, Homo sapiens
agacgaugauucagaagga

SEQ ID NO: 818029 - RNA, 19 nt, Homo sapiens
ucagaaagacgggauaaug

SEQ ID NO: 818030 - RNA, 19 nt, Homo sapiens
ucaaggacgcccacagaaa

SEQ ID NO: 818031 - RNA, 19 nt, Homo sapiens
cauuguguauccguaauaa

SEQ ID NO: 818032 - RNA, 19 nt, Homo sapiens
cggcagaaggauuguguua

SEQ ID NO: 818033 - RNA, 19 nt, Homo sapiens
gaaauugagacucuuacuc

SEQ ID NO: 818034 - RNA, 19 nt, Homo sapiens
aaacgaacuugugaauugu

SEQ ID NO: 818035 - RNA, 19 nt, Homo sapiens
gcauuguguauccguaaua

SEQ ID NO: 818036 - RNA, 19 nt, Homo sapiens
cauggaaaaugcauccuua

SEQ ID NO: 818037 - RNA, 19 nt, Homo sapiens
gagaaaugacauacaagau

SEQ ID NO: 818038 - RNA, 19 nt, Homo sapiens
aaacaaauagacagacaga

SEQ ID NO: 818039 - RNA, 19 nt, Homo sapiens
ggaaacuguggagauauaa

SEQ ID NO: 818040 - RNA, 19 nt, Homo sapiens
gaacuggcuaaacagcuuu

SEQ ID NO: 818041 - RNA, 19 nt, Homo sapiens
gaaagauacagagagaaau

SEQ ID NO: 818042 - RNA, 19 nt, Homo sapiens
caauagaaacugcauaugc

SEQ ID NO: 818043 - RNA, 19 nt, Homo sapiens
gaaaggaucucaccacuga

SEQ ID NO: 818044 - RNA, 19 nt, Homo sapiens
gaacaaagacugugccuaa

SEQ ID NO: 818045 - RNA, 19 nt, Homo sapiens
ggagucagauuaagaauga

SEQ ID NO: 818046 - RNA, 19 nt, Homo sapiens
aaucagaccuacaccauua

SEQ ID NO: 818047 - RNA, 19 nt, Homo sapiens
uaaagcaagugacaaauga

SEQ ID NO: 818048 - RNA, 19 nt, Homo sapiens
gagguacacucgaauguuu

SEQ ID NO: 818049 - RNA, 19 nt, Homo sapiens
ggauauacaugaugcagaa

SEQ ID NO: 818050 - RNA, 19 nt, Homo sapiens
ggaaugaguucucuguaug

SEQ ID NO: 818051 - RNA, 19 nt, Homo sapiens
ugaaagagguacacucgaa

SEQ ID NO: 818052 - RNA, 19 nt, Homo sapiens
gcaauucuuucccuuccua

SEQ ID NO: 818053 - RNA, 19 nt, Homo sapiens
gcacagacgcgcaccauga

SEQ ID NO: 818054 - RNA, 19 nt, Homo sapiens
gaaguggugugccuagaga

SEQ ID NO: 818055 - RNA, 19 nt, Homo sapiens
gaucuaaccuuugaagcuu

SEQ ID NO: 818056 - RNA, 19 nt, Homo sapiens
gggaaugaguucucuguau

SEQ ID NO: 818057 - RNA, 19 nt, Homo sapiens
gcauaaagcaagugacaaa

SEQ ID NO: 818058 - RNA, 19 nt, Homo sapiens
guugauagaugaugaauac

SEQ ID NO: 818059 - RNA, 19 nt, Homo sapiens
gaaacaguaucuacccaau

SEQ ID NO: 818060 - RNA, 19 nt, Homo sapiens
ggagaagucuaguucaaag

SEQ ID NO: 818061 - RNA, 19 nt, Homo sapiens
gaacaucucccagaaagug

SEQ ID NO: 818062 - RNA, 19 nt, Homo sapiens
ggaguccacuuguuugguu

SEQ ID NO: 818063 - RNA, 19 nt, Homo sapiens
caaaggcccuguccauauc

SEQ ID NO: 818064 - RNA, 19 nt, Homo sapiens
uaacaugugggucauuaua

SEQ ID NO: 818065 - RNA, 19 nt, Homo sapiens
gauccuacauggagagaga

SEQ ID NO: 818066 - RNA, 19 nt, Homo sapiens
gcagaaaggauccuacaug

SEQ ID NO: 818067 - RNA, 19 nt, Homo sapiens
gcagugagcacguucauuc

SEQ ID NO: 818068 - RNA, 19 nt, Homo sapiens
gaaugggaguugagacaga

SEQ ID NO: 818069 - RNA, 19 nt, Homo sapiens
gcagagcgauucaucaacu

SEQ ID NO: 818070 - RNA, 19 nt, Homo sapiens
ggccugaacugggagauaa

SEQ ID NO: 818071 - RNA, 19 nt, Homo sapiens
ugugaggccuguuuaaauu

SEQ ID NO: 818072 - RNA, 19 nt, Homo sapiens
aaaggcgucugcauuguuu

SEQ ID NO: 818073 - RNA, 19 nt, Homo sapiens
gcagagaggagaacuuaau

SEQ ID NO: 818074 - RNA, 19 nt, Homo sapiens
gagaacuacugcucauuuc

SEQ ID NO: 818075 - RNA, 19 nt, Homo sapiens
ggacaccacgauaacauuu

SEQ ID NO: 818076 - RNA, 19 nt, Homo sapiens
gaagccaagugcauacuag

SEQ ID NO: 818077 - RNA, 19 nt, Homo sapiens
ccuaugguuuggacauuua

SEQ ID NO: 818078 - RNA, 19 nt, Homo sapiens
gauaucggcuucgaaagga

SEQ ID NO: 818079 - RNA, 19 nt, Homo sapiens
ugacuaugacuacguguua

SEQ ID NO: 818080 - RNA, 19 nt, Homo sapiens
gauagaugaugaauacaag

SEQ ID NO: 818081 - RNA, 19 nt, Homo sapiens
gaauucaaccuccagaaga

SEQ ID NO: 818082 - RNA, 19 nt, Homo sapiens
gauaacauuuagccuggaa

SEQ ID NO: 818083 - RNA, 19 nt, Homo sapiens
uggcuucccuccaaaguaa

SEQ ID NO: 818084 - RNA, 19 nt, Homo sapiens
ggacugauccagccucuca

SEQ ID NO: 818085 - RNA, 19 nt, Homo sapiens
uaagaauuccggcugauuu

SEQ ID NO: 818086 - RNA, 19 nt, Homo sapiens
ccagacaguuucucgaaug

SEQ ID NO: 818087 - RNA, 19 nt, Homo sapiens
ccaaaggcccuguccauau

SEQ ID NO: 818088 - RNA, 19 nt, Homo sapiens
gacaaggagucgggaauga

SEQ ID NO: 818089 - RNA, 19 nt, Homo sapiens
aauacaaggucacagcuuu

SEQ ID NO: 818090 - RNA, 19 nt, Homo sapiens
ugaaacgccucucgucuca

SEQ ID NO: 818091 - RNA, 19 nt, Homo sapiens
gacgguggcugcagucaug

SEQ ID NO: 818092 - RNA, 19 nt, Homo sapiens
gaagauggagagauuguuc

SEQ ID NO: 818093 - RNA, 19 nt, Homo sapiens
gcacugggaagaaauagga

SEQ ID NO: 818094 - RNA, 19 nt, Homo sapiens
ggccagagaugaauucaac

SEQ ID NO: 818095 - RNA, 19 nt, Homo sapiens
gguggaacaucucccagaa

SEQ ID NO: 818096 - RNA, 19 nt, Homo sapiens
cacguucccuccaaacuuu

SEQ ID NO: 818097 - RNA, 19 nt, Homo sapiens
caugagcgcaccuuuauug

SEQ ID NO: 818098 - RNA, 19 nt, Homo sapiens
aagccagacuccuccuuua

SEQ ID NO: 818099 - RNA, 19 nt, Homo sapiens
ugagugggcuucucguuuc

SEQ ID NO: 818100 - RNA, 19 nt, Homo sapiens
ggaacgcugaguuugcuua

SEQ ID NO: 818101 - RNA, 19 nt, Homo sapiens
uguggaagauggagagauu

SEQ ID NO: 818102 - RNA, 19 nt, Homo sapiens
acacucgaauguuugcaua

SEQ ID NO: 818103 - RNA, 19 nt, Homo sapiens
ugaauugucugagccuuga

SEQ ID NO: 818104 - RNA, 19 nt, Homo sapiens
ucucauggcuucccuccaa

SEQ ID NO: 818105 - RNA, 19 nt, Homo sapiens
ggaaugaagugcagaaaag

SEQ ID NO: 818106 - RNA, 19 nt, Homo sapiens
gcauuaaauucccgaacug

SEQ ID NO: 818107 - RNA, 19 nt, Homo sapiens
gccaagguguugcuguuga

SEQ ID NO: 818108 - RNA, 19 nt, Homo sapiens
gaggaucaucugcuacuuu

SEQ ID NO: 818109 - RNA, 19 nt, Homo sapiens
ggccugagcggcuguauau

SEQ ID NO: 818110 - RNA, 19 nt, Homo sapiens
gaacgcugaguuugcuuaa

SEQ ID NO: 818111 - RNA, 19 nt, Homo sapiens
gagcucacguucccuccaa

SEQ ID NO: 818112 - RNA, 19 nt, Homo sapiens
guauagcacugccgauugg

SEQ ID NO: 818113 - RNA, 19 nt, Homo sapiens
acaugugggucauuauauu

SEQ ID NO: 818114 - RNA, 19 nt, Homo sapiens
aagauguccuuguuuaaga

SEQ ID NO: 818115 - RNA, 19 nt, Homo sapiens
cugaugggcuuucucuuga

SEQ ID NO: 818116 - RNA, 19 nt, Homo sapiens
gagcgauucaucaacuaua

SEQ ID NO: 818117 - RNA, 19 nt, Homo sapiens
guugagggaucuauaugug

SEQ ID NO: 818118 - RNA, 19 nt, Homo sapiens
caagugggcaaguuugauu

SEQ ID NO: 818119 - RNA, 19 nt, Homo sapiens
guacaucgcaguccugaag

SEQ ID NO: 818120 - RNA, 19 nt, Homo sapiens
ucuaaccuuugaagcuuua

SEQ ID NO: 818121 - RNA, 19 nt, Homo sapiens
gauaaagaacaaagacugu

SEQ ID NO: 818122 - RNA, 19 nt, Homo sapiens
aagcagagaggagaacuua

SEQ ID NO: 818123 - RNA, 19 nt, Homo sapiens
ucaaguggguggaacaucu

SEQ ID NO: 818124 - RNA, 19 nt, Homo sapiens
ggagauaacccuggacagu

SEQ ID NO: 818125 - RNA, 19 nt, Homo sapiens
gugggaaacuggcauacug

SEQ ID NO: 818126 - RNA, 19 nt, Homo sapiens
caacagaacaaagcagaga

SEQ ID NO: 818127 - RNA, 19 nt, Homo sapiens
gcaacgaguuuaccguacu

SEQ ID NO: 818128 - RNA, 19 nt, Homo sapiens
gggcuuuggugcagacaga

SEQ ID NO: 818129 - RNA, 19 nt, Homo sapiens
gaaagagguacacucgaau

SEQ ID NO: 818130 - RNA, 19 nt, Homo sapiens
ggaucuauaugugauguca

SEQ ID NO: 818131 - RNA, 19 nt, Homo sapiens
ugaggccuguuuaaauuga

SEQ ID NO: 818132 - RNA, 19 nt, Homo sapiens
caaaggcgucugcauuguu

SEQ ID NO: 818133 - RNA, 19 nt, Homo sapiens
ugaguucucuguaugucuu

SEQ ID NO: 818134 - RNA, 19 nt, Homo sapiens
ccuacaccauuaaccuaua

SEQ ID NO: 818135 - RNA, 19 nt, Homo sapiens
gagauuguucagcagguua

SEQ ID NO: 818136 - RNA, 19 nt, Homo sapiens
ugugaacauugucaaguuu

SEQ ID NO: 818137 - RNA, 19 nt, Homo sapiens
ccaaaggcgucugcauugu

SEQ ID NO: 818138 - RNA, 19 nt, Homo sapiens
gccaaaggcccuguccaua

SEQ ID NO: 818139 - RNA, 19 nt, Homo sapiens
ggacggcuguguggauauc

SEQ ID NO: 818140 - RNA, 19 nt, Homo sapiens
agagaacuacugcucauuu

SEQ ID NO: 818141 - RNA, 19 nt, Homo sapiens
ccagagaacuacugcucau

SEQ ID NO: 818142 - RNA, 19 nt, Homo sapiens
aacaguaucuacccaaugu

SEQ ID NO: 818143 - RNA, 19 nt, Homo sapiens
ggaaagagaaagaugauua

SEQ ID NO: 818144 - RNA, 19 nt, Homo sapiens
gaucaaagcucuggcgaaa

SEQ ID NO: 818145 - RNA, 19 nt, Homo sapiens
gaauucagcuugccgagaa

SEQ ID NO: 818146 - RNA, 19 nt, Homo sapiens
gaagauggcuaacauggau

SEQ ID NO: 818147 - RNA, 19 nt, Homo sapiens
gcagaaucuuggaucauua

SEQ ID NO: 818148 - RNA, 19 nt, Homo sapiens
gaggagaacugacccagaa

SEQ ID NO: 818149 - RNA, 19 nt, Homo sapiens
caagggagaccaugaauuu

SEQ ID NO: 818150 - RNA, 19 nt, Homo sapiens
cgaggagucuucuuucuaa

SEQ ID NO: 818151 - RNA, 19 nt, Homo sapiens
ccacacugcucaccucuaa

SEQ ID NO: 818152 - RNA, 19 nt, Homo sapiens
gaaccucccuccucuguca

SEQ ID NO: 818153 - RNA, 19 nt, Homo sapiens
gaagagauggagaagauuu

SEQ ID NO: 818154 - RNA, 19 nt, Homo sapiens
gaagauccgcccuguguuu

SEQ ID NO: 818155 - RNA, 19 nt, Homo sapiens
cugcugagaugcuguauuu

SEQ ID NO: 818156 - RNA, 19 nt, Homo sapiens
ggaagccacuggugaagga

SEQ ID NO: 818157 - RNA, 19 nt, Homo sapiens
ccacagugcuggcuucuuc

SEQ ID NO: 818158 - RNA, 19 nt, Homo sapiens
uagaugauguucgggauua

SEQ ID NO: 818159 - RNA, 19 nt, Homo sapiens
gaacgaguuugucucuuca

SEQ ID NO: 818160 - RNA, 19 nt, Homo sapiens
ggaggccacuucaucugua

SEQ ID NO: 818161 - RNA, 19 nt, Homo sapiens
cgaagaggcuugggucuga

SEQ ID NO: 818162 - RNA, 19 nt, Homo sapiens
caacacagcucugacucuu

SEQ ID NO: 818163 - RNA, 19 nt, Homo sapiens
gaucgcauguucacaaauc

SEQ ID NO: 818164 - RNA, 19 nt, Homo sapiens
gagaagauccgcccugugu

SEQ ID NO: 818165 - RNA, 19 nt, Homo sapiens
gaaaauccaugccuuuguu

SEQ ID NO: 818166 - RNA, 19 nt, Homo sapiens
cagggaaggugaaggauug

SEQ ID NO: 818167 - RNA, 19 nt, Homo sapiens
ccuaagagccucagaaugu

SEQ ID NO: 818168 - RNA, 19 nt, Homo sapiens
caaugaagauggcuaacau

SEQ ID NO: 818169 - RNA, 19 nt, Homo sapiens
guaagagcguguuugaugu

SEQ ID NO: 818170 - RNA, 19 nt, Homo sapiens
gagcguguuugaugucuug

SEQ ID NO: 818171 - RNA, 19 nt, Homo sapiens
gagcaggugucaugguuuc

SEQ ID NO: 818172 - RNA, 19 nt, Homo sapiens
caaacucucaucccugaua

SEQ ID NO: 818173 - RNA, 19 nt, Homo sapiens
guggagaccugcugucaug

SEQ ID NO: 818174 - RNA, 19 nt, Homo sapiens
uggaagagauggagaagau

SEQ ID NO: 818175 - RNA, 19 nt, Homo sapiens
ggaucaagcuagaccugaa

SEQ ID NO: 818176 - RNA, 19 nt, Homo sapiens
ugaauuuacugacuacaug

SEQ ID NO: 818177 - RNA, 19 nt, Homo sapiens
ggagucuucuuucuaaaca

SEQ ID NO: 818178 - RNA, 19 nt, Homo sapiens
gugaaggauuggguaaaua

SEQ ID NO: 818179 - RNA, 19 nt, Homo sapiens
ggaaacaacacagcucuga

SEQ ID NO: 818180 - RNA, 19 nt, Homo sapiens
ggaagaaguggcaugcaaa

SEQ ID NO: 818181 - RNA, 19 nt, Homo sapiens
gauccgaggagucuucuuu

SEQ ID NO: 818182 - RNA, 19 nt, Homo sapiens
gcaaaagcaucuacuacaa

SEQ ID NO: 818183 - RNA, 19 nt, Homo sapiens
gaaguucuuugagcuaauc

SEQ ID NO: 818184 - RNA, 19 nt, Homo sapiens
ggugaaggauuggguaaau

SEQ ID NO: 818185 - RNA, 19 nt, Homo sapiens
ugaacgaguuugucucuuc

SEQ ID NO: 818186 - RNA, 19 nt, Homo sapiens
ccagguggcuucucagagu

SEQ ID NO: 818187 - RNA, 19 nt, Homo sapiens
aaaccaaggacucuacuuu

SEQ ID NO: 818188 - RNA, 19 nt, Homo sapiens
cuaaaucgaaguucuuuga

SEQ ID NO: 818189 - RNA, 19 nt, Homo sapiens
gaucaagggagaccaugaa

SEQ ID NO: 818190 - RNA, 19 nt, Homo sapiens
gcaggaagcagccuugaag

SEQ ID NO: 818191 - RNA, 19 nt, Homo sapiens
ugaaugagcccuggacuau

SEQ ID NO: 818192 - RNA, 19 nt, Homo sapiens
ugaaggagguguacagacu

SEQ ID NO: 818193 - RNA, 19 nt, Homo sapiens
ggaauuuuguccuggauaa

SEQ ID NO: 818194 - RNA, 19 nt, Homo sapiens
gggacacucugcuaucugu

SEQ ID NO: 818195 - RNA, 19 nt, Homo sapiens
gaggccacuucaucuguaa

SEQ ID NO: 818196 - RNA, 19 nt, Homo sapiens
gugagcaggugucaugguu

SEQ ID NO: 818197 - RNA, 19 nt, Homo sapiens
ucacucccauuuccuuuau

SEQ ID NO: 818198 - RNA, 19 nt, Homo sapiens
caaagcagacucucuugug

SEQ ID NO: 818199 - RNA, 19 nt, Homo sapiens
gaccaugaauuuacugacu

SEQ ID NO: 818200 - RNA, 19 nt, Homo sapiens
gauuaccucuucgcaguga

SEQ ID NO: 818201 - RNA, 19 nt, Homo sapiens
gaggagucuucuuucuaaa

SEQ ID NO: 818202 - RNA, 19 nt, Homo sapiens
gccaaucccuaugagauga

SEQ ID NO: 818203 - RNA, 19 nt, Homo sapiens
gaacuucuucucgcuauuc

SEQ ID NO: 818204 - RNA, 19 nt, Homo sapiens
aagugcagcucccuuacua

SEQ ID NO: 818205 - RNA, 19 nt, Homo sapiens
ugauggagauggagauauc

SEQ ID NO: 818206 - RNA, 19 nt, Homo sapiens
uguaagagcguguuugaug

SEQ ID NO: 818207 - RNA, 19 nt, Homo sapiens
gcacugcugagaugcugua

SEQ ID NO: 818208 - RNA, 19 nt, Homo sapiens
gcagugaauauuaaacuca

SEQ ID NO: 818209 - RNA, 19 nt, Homo sapiens
ucaaagcucuggcgaaaau

SEQ ID NO: 818210 - RNA, 19 nt, Homo sapiens
gcugugggcucugcuguuc

SEQ ID NO: 818211 - RNA, 19 nt, Homo sapiens
guacagacuggaagagaug

SEQ ID NO: 818212 - RNA, 19 nt, Homo sapiens
ccaaugagagccacuguag

SEQ ID NO: 818213 - RNA, 19 nt, Homo sapiens
gaauuuacugacuacauga

SEQ ID NO: 818214 - RNA, 19 nt, Homo sapiens
gaagaaguggcaugcaaag

SEQ ID NO: 818215 - RNA, 19 nt, Homo sapiens
ugucaugguuuccagaaug

SEQ ID NO: 818216 - RNA, 19 nt, Homo sapiens
ggaacuucuucucgcuauu

SEQ ID NO: 818217 - RNA, 19 nt, Homo sapiens
guucaagacacgacacuga

SEQ ID NO: 818218 - RNA, 19 nt, Homo sapiens
gcuuuggaaugacuuugaa

SEQ ID NO: 818219 - RNA, 19 nt, Homo sapiens
aaacagggcagcaaugaag

SEQ ID NO: 818220 - RNA, 19 nt, Homo sapiens
acacagcucugacucuuuu

SEQ ID NO: 818221 - RNA, 19 nt, Homo sapiens
cagaaucuuggaucauuaa

SEQ ID NO: 818222 - RNA, 19 nt, Homo sapiens
ugcagaaucuuggaucauu

SEQ ID NO: 818223 - RNA, 19 nt, Homo sapiens
ggagaacugacccagaaug

SEQ ID NO: 818224 - RNA, 19 nt, Homo sapiens
ggccuucccuggaguucuu

SEQ ID NO: 818225 - RNA, 19 nt, Homo sapiens
acaccugccugggaacuuu

SEQ ID NO: 818226 - RNA, 19 nt, Homo sapiens
gaaggugggcauagaugau

SEQ ID NO: 818227 - RNA, 19 nt, Homo sapiens
gcaaugaagauggcuaaca

SEQ ID NO: 818228 - RNA, 19 nt, Homo sapiens
acaguguguugcaguguaa

SEQ ID NO: 818229 - RNA, 19 nt, Homo sapiens
gauccugggagcccucuuu

SEQ ID NO: 818230 - RNA, 19 nt, Homo sapiens
agagguauguggugugcaa

SEQ ID NO: 818231 - RNA, 19 nt, Homo sapiens
gaccuguucacaccguuua

SEQ ID NO: 818232 - RNA, 19 nt, Homo sapiens
gaacguggacuggcgagau

SEQ ID NO: 818233 - RNA, 19 nt, Homo sapiens
aaugagcccuggacuaugg

SEQ ID NO: 818234 - RNA, 19 nt, Homo sapiens
gaucagugccauccacauc

SEQ ID NO: 818235 - RNA, 19 nt, Homo sapiens
ucugcuaucuguggaaauu

SEQ ID NO: 818236 - RNA, 19 nt, Homo sapiens
ggaaaucccagaucuacac

SEQ ID NO: 818237 - RNA, 19 nt, Homo sapiens
ucgaaguucuuugagcuaa

SEQ ID NO: 818238 - RNA, 19 nt, Homo sapiens
gacaggaggccacuucauc

SEQ ID NO: 818239 - RNA, 19 nt, Homo sapiens
gcaucuacuacaagccuua

SEQ ID NO: 818240 - RNA, 19 nt, Homo sapiens
ggauuccgacgucaacuug

SEQ ID NO: 818241 - RNA, 19 nt, Homo sapiens
cuacucugcuuccagugaa

SEQ ID NO: 818242 - RNA, 19 nt, Homo sapiens
aggaagaaguggcaugcaa

SEQ ID NO: 818243 - RNA, 19 nt, Homo sapiens
ggaaagagcuccagcgaaa

SEQ ID NO: 818244 - RNA, 19 nt, Homo sapiens
gaaauaaacccaaccauaa

SEQ ID NO: 818245 - RNA, 19 nt, Homo sapiens
ccacauaccuccauuacua

SEQ ID NO: 818246 - RNA, 19 nt, Homo sapiens
ugagugaccuggaauauuu

SEQ ID NO: 818247 - RNA, 19 nt, Homo sapiens
caacaucacagacaucuua

SEQ ID NO: 818248 - RNA, 19 nt, Homo sapiens
gcaaauaugacacuucuaa

SEQ ID NO: 818249 - RNA, 19 nt, Homo sapiens
cuaaaugacuggcggaaua

SEQ ID NO: 818250 - RNA, 19 nt, Homo sapiens
ggagaggccucagaaguuu

SEQ ID NO: 818251 - RNA, 19 nt, Homo sapiens
aagaagagauuauguccua

SEQ ID NO: 818252 - RNA, 19 nt, Homo sapiens
gaggagauuucccugagua

SEQ ID NO: 818253 - RNA, 19 nt, Homo sapiens
gaugaggucuuguccgaaa

SEQ ID NO: 818254 - RNA, 19 nt, Homo sapiens
gaaggugaauguccuauac

SEQ ID NO: 818255 - RNA, 19 nt, Homo sapiens
gaucaagggcaacauagua

SEQ ID NO: 818256 - RNA, 19 nt, Homo sapiens
gaccucacuuucacuguua

SEQ ID NO: 818257 - RNA, 19 nt, Homo sapiens
ugaaauaaacccaaccaua

SEQ ID NO: 818258 - RNA, 19 nt, Homo sapiens
uagccuguaugcaauauua

SEQ ID NO: 818259 - RNA, 19 nt, Homo sapiens
guggagcgcuucaauaaug

SEQ ID NO: 818260 - RNA, 19 nt, Homo sapiens
gagcaucccuagugaauac

SEQ ID NO: 818261 - RNA, 19 nt, Homo sapiens
ggacauauuaccuugguuu

SEQ ID NO: 818262 - RNA, 19 nt, Homo sapiens
cauauuaccuugguuugaa

SEQ ID NO: 818263 - RNA, 19 nt, Homo sapiens
gcaagaaaccacacacuca

SEQ ID NO: 818264 - RNA, 19 nt, Homo sapiens
caacagagagguccgaaga

SEQ ID NO: 818265 - RNA, 19 nt, Homo sapiens
gagguagcaugaaggauga

SEQ ID NO: 818266 - RNA, 19 nt, Homo sapiens
guucuguacuguucuguuu

SEQ ID NO: 818267 - RNA, 19 nt, Homo sapiens
uaaagcacaugauucugaa

SEQ ID NO: 818268 - RNA, 19 nt, Homo sapiens
gggauaggguggucagcua

SEQ ID NO: 818269 - RNA, 19 nt, Homo sapiens
gaugccagcucguacuuug

SEQ ID NO: 818270 - RNA, 19 nt, Homo sapiens
aaaggcacguugauuugua

SEQ ID NO: 818271 - RNA, 19 nt, Homo sapiens
cagccaagcuuagcaagaa

SEQ ID NO: 818272 - RNA, 19 nt, Homo sapiens
ccacugacgugcuggaaau

SEQ ID NO: 818273 - RNA, 19 nt, Homo sapiens
acuaagaucugcuucaaau

SEQ ID NO: 818274 - RNA, 19 nt, Homo sapiens
ugacacuucuaacgauuaa

SEQ ID NO: 818275 - RNA, 19 nt, Homo sapiens
acacacaggugacggagaa

SEQ ID NO: 818276 - RNA, 19 nt, Homo sapiens
caucaucacuacccaacaa

SEQ ID NO: 818277 - RNA, 19 nt, Homo sapiens
aaacuaagaucugcuucaa

SEQ ID NO: 818278 - RNA, 19 nt, Homo sapiens
gcacauguccaagaaagaa

SEQ ID NO: 818279 - RNA, 19 nt, Homo sapiens
ggacaacaguggcaaagcu

SEQ ID NO: 818280 - RNA, 19 nt, Homo sapiens
gagaaguuguccugugaug

SEQ ID NO: 818281 - RNA, 19 nt, Homo sapiens
gagcagaggcugagauuac

SEQ ID NO: 818282 - RNA, 19 nt, Homo sapiens
gaagccaacaucaacauga

SEQ ID NO: 818283 - RNA, 19 nt, Homo sapiens
cuaggaagcugcagagagu

SEQ ID NO: 818284 - RNA, 19 nt, Homo sapiens
ggacuugagugaggacaug

SEQ ID NO: 818285 - RNA, 19 nt, Homo sapiens
gaacggucgucuucccaau

SEQ ID NO: 818286 - RNA, 19 nt, Homo sapiens
caacauaguacuucuccuu

SEQ ID NO: 818287 - RNA, 19 nt, Homo sapiens
ccacaguucuucacaaagg

SEQ ID NO: 818288 - RNA, 19 nt, Homo sapiens
gcugaucaacucuuuguuu

SEQ ID NO: 818289 - RNA, 19 nt, Homo sapiens
gggccucggugaagagaaa

SEQ ID NO: 818290 - RNA, 19 nt, Homo sapiens
ugaacaaccugauggaaag

SEQ ID NO: 818291 - RNA, 19 nt, Homo sapiens
uagaugauaccaugacuuu

SEQ ID NO: 818292 - RNA, 19 nt, Homo sapiens
cccauugucuuauguagaa

SEQ ID NO: 818293 - RNA, 19 nt, Homo sapiens
gaaugcaaguuaagcuaca

SEQ ID NO: 818294 - RNA, 19 nt, Homo sapiens
gaaccucgccugacauuuu

SEQ ID NO: 818295 - RNA, 19 nt, Homo sapiens
gagcuaccacuuucauuga

SEQ ID NO: 818296 - RNA, 19 nt, Homo sapiens
gcacaugauucugaaaguc

SEQ ID NO: 818297 - RNA, 19 nt, Homo sapiens
cagcugcaauuccgauuug

SEQ ID NO: 818298 - RNA, 19 nt, Homo sapiens
aaauugaggugaaggacaa

SEQ ID NO: 818299 - RNA, 19 nt, Homo sapiens
gcuucucucucucagauuu

SEQ ID NO: 818300 - RNA, 19 nt, Homo sapiens
guacuguucuguuuuguuu

SEQ ID NO: 818301 - RNA, 19 nt, Homo sapiens
gggcucaacucaagagaag

SEQ ID NO: 818302 - RNA, 19 nt, Homo sapiens
gaaaacaccugcugcugau

SEQ ID NO: 818303 - RNA, 19 nt, Homo sapiens
gaggaaaccagcaccuuug

SEQ ID NO: 818304 - RNA, 19 nt, Homo sapiens
uaccgagucuucaccagua

SEQ ID NO: 818305 - RNA, 19 nt, Homo sapiens
gucagcagcuccuacuauu

SEQ ID NO: 818306 - RNA, 19 nt, Homo sapiens
ugagauuacugcaguuugu

SEQ ID NO: 818307 - RNA, 19 nt, Homo sapiens
ggacuggauuggcauguac

SEQ ID NO: 818308 - RNA, 19 nt, Homo sapiens
agacauacggugcaaauau

SEQ ID NO: 818309 - RNA, 19 nt, Homo sapiens
auaaccaacuccagaacua

SEQ ID NO: 818310 - RNA, 19 nt, Homo sapiens
aggcuucucuccucuguuu

SEQ ID NO: 818311 - RNA, 19 nt, Homo sapiens
gaaacuaagaucugcuuca

SEQ ID NO: 818312 - RNA, 19 nt, Homo sapiens
cagccuaaccucucaacua

SEQ ID NO: 818313 - RNA, 19 nt, Homo sapiens
gaaagggaagaaggacaua

SEQ ID NO: 818314 - RNA, 19 nt, Homo sapiens
gacaaaagcugugcaugaa

SEQ ID NO: 818315 - RNA, 19 nt, Homo sapiens
gaaaucgaccuaaaugacu

SEQ ID NO: 818316 - RNA, 19 nt, Homo sapiens
ggaaaucgaccuaaaugac

SEQ ID NO: 818317 - RNA, 19 nt, Homo sapiens
gagaggagggccuggacua

SEQ ID NO: 818318 - RNA, 19 nt, Homo sapiens
uccagaggcuccgaaguua

SEQ ID NO: 818319 - RNA, 19 nt, Homo sapiens
ggacauaaaggaggaagug

SEQ ID NO: 818320 - RNA, 19 nt, Homo sapiens
guggucagcuacacacuug

SEQ ID NO: 818321 - RNA, 19 nt, Homo sapiens
gugcaaauaugacacuucu

SEQ ID NO: 818322 - RNA, 19 nt, Homo sapiens
agacugcccugugauuuga

SEQ ID NO: 818323 - RNA, 19 nt, Homo sapiens
ucacgaggcccuucuacaa

SEQ ID NO: 818324 - RNA, 19 nt, Homo sapiens
aggccaagcuccgcaauuu

SEQ ID NO: 818325 - RNA, 19 nt, Homo sapiens
cagcuucucucucucagau

SEQ ID NO: 818326 - RNA, 19 nt, Homo sapiens
aagcuacacuugaccaaau

SEQ ID NO: 818327 - RNA, 19 nt, Homo sapiens
caaaagcugugcaugaaga

SEQ ID NO: 818328 - RNA, 19 nt, Homo sapiens
guuaacagcaguagaggaa

SEQ ID NO: 818329 - RNA, 19 nt, Homo sapiens
gagacugcccugugauuug

SEQ ID NO: 818330 - RNA, 19 nt, Homo sapiens
ggcauauaaugacaagauu

SEQ ID NO: 818331 - RNA, 19 nt, Homo sapiens
uuaaagcacaugauucuga

SEQ ID NO: 818332 - RNA, 19 nt, Homo sapiens
agagugauggugcuuguua

SEQ ID NO: 818333 - RNA, 19 nt, Homo sapiens
gggacuggauuggcaugua

SEQ ID NO: 818334 - RNA, 19 nt, Homo sapiens
cauggaaccucgccugaca

SEQ ID NO: 818335 - RNA, 19 nt, Homo sapiens
cguacuccauguuguauga

SEQ ID NO: 818336 - RNA, 19 nt, Homo sapiens
ccgcggaaaucgaccuaaa

SEQ ID NO: 818337 - RNA, 19 nt, Homo sapiens
ggaagucggaggcugauca

SEQ ID NO: 818338 - RNA, 19 nt, Homo sapiens
cuugagugguucagguuua

SEQ ID NO: 818339 - RNA, 19 nt, Homo sapiens
gcuccgcaauuucuacaga

SEQ ID NO: 818340 - RNA, 19 nt, Homo sapiens
gaagggaagaagaggagaa

SEQ ID NO: 818341 - RNA, 19 nt, Homo sapiens
gcaaugcaucccaaugguu

SEQ ID NO: 818342 - RNA, 19 nt, Homo sapiens
acauucaacucaugauuca

SEQ ID NO: 818343 - RNA, 19 nt, Homo sapiens
gaaggaagcucgauauauu

SEQ ID NO: 818344 - RNA, 19 nt, Homo sapiens
gaaaaggacuugcauauua

SEQ ID NO: 818345 - RNA, 19 nt, Homo sapiens
gaaaugagauaucuacguu

SEQ ID NO: 818346 - RNA, 19 nt, Homo sapiens
gaagauuugugcagaauaa

SEQ ID NO: 818347 - RNA, 19 nt, Homo sapiens
ggacaggucuucacauuug

SEQ ID NO: 818348 - RNA, 19 nt, Homo sapiens
ggaguaagcugacuaacuu

SEQ ID NO: 818349 - RNA, 19 nt, Homo sapiens
ucagauaccucaguuauua

SEQ ID NO: 818350 - RNA, 19 nt, Homo sapiens
ggaaguaguucuguuauuu

SEQ ID NO: 818351 - RNA, 19 nt, Homo sapiens
ggaagagacucaagcagua

SEQ ID NO: 818352 - RNA, 19 nt, Homo sapiens
gcaagaaggauaccaaaua

SEQ ID NO: 818353 - RNA, 19 nt, Homo sapiens
gaauuuaggucuccaguga

SEQ ID NO: 818354 - RNA, 19 nt, Homo sapiens
caaagaacaugcuccuaua

SEQ ID NO: 818355 - RNA, 19 nt, Homo sapiens
gaagauggagaaucaauua

SEQ ID NO: 818356 - RNA, 19 nt, Homo sapiens
gcaaagcaguagaagauuu

SEQ ID NO: 818357 - RNA, 19 nt, Homo sapiens
ggaaacaucucaacaucuu

SEQ ID NO: 818358 - RNA, 19 nt, Homo sapiens
gaagaugccuccucugaug

SEQ ID NO: 818359 - RNA, 19 nt, Homo sapiens
ggaauaaaguuaccucaau

SEQ ID NO: 818360 - RNA, 19 nt, Homo sapiens
ggaacgugcucauccuuua

SEQ ID NO: 818361 - RNA, 19 nt, Homo sapiens
cuagagagcugugguguua

SEQ ID NO: 818362 - RNA, 19 nt, Homo sapiens
agacaaaccuggaauaguu

SEQ ID NO: 818363 - RNA, 19 nt, Homo sapiens
ucagauagcugcuucaaga

SEQ ID NO: 818364 - RNA, 19 nt, Homo sapiens
gaaaucaccguucgaagua

SEQ ID NO: 818365 - RNA, 19 nt, Homo sapiens
ggaauaagcuggguaucuu

SEQ ID NO: 818366 - RNA, 19 nt, Homo sapiens
ucuagaaggucuugaaaua

SEQ ID NO: 818367 - RNA, 19 nt, Homo sapiens
ggacaucucuggaauuagu

SEQ ID NO: 818368 - RNA, 19 nt, Homo sapiens
aaagaaaccucaaaggauu

SEQ ID NO: 818369 - RNA, 19 nt, Homo sapiens
gaacgaugcuggcuuucaa

SEQ ID NO: 818370 - RNA, 19 nt, Homo sapiens
ccaaauaccauguacauaa

SEQ ID NO: 818371 - RNA, 19 nt, Homo sapiens
gauuacgucucaaguauuu

SEQ ID NO: 818372 - RNA, 19 nt, Homo sapiens
gaaaucugcuugucgaguu

SEQ ID NO: 818373 - RNA, 19 nt, Homo sapiens
caaugucuguggaaauuua

SEQ ID NO: 818374 - RNA, 19 nt, Homo sapiens
gaauaaaguuaccucaaug

SEQ ID NO: 818375 - RNA, 19 nt, Homo sapiens
ccacagcucucuuucuaaa

SEQ ID NO: 818376 - RNA, 19 nt, Homo sapiens
gggcaaagcucacacuugu

SEQ ID NO: 818377 - RNA, 19 nt, Homo sapiens
gaugggagcauauucuuua

SEQ ID NO: 818378 - RNA, 19 nt, Homo sapiens
uaagaacgaugcuggcuuu

SEQ ID NO: 818379 - RNA, 19 nt, Homo sapiens
ucaacuggcuucuguguaa

SEQ ID NO: 818380 - RNA, 19 nt, Homo sapiens
caacagcaauggaugaaga

SEQ ID NO: 818381 - RNA, 19 nt, Homo sapiens
gcagaaaugcccacacuuu

SEQ ID NO: 818382 - RNA, 19 nt, Homo sapiens
gaacagggccucucugcuu

SEQ ID NO: 818383 - RNA, 19 nt, Homo sapiens
caacugggcagaccaauuu

SEQ ID NO: 818384 - RNA, 19 nt, Homo sapiens
ggagaacucuacauguuug

SEQ ID NO: 818385 - RNA, 19 nt, Homo sapiens
gcaaagaaaccucaaagga

SEQ ID NO: 818386 - RNA, 19 nt, Homo sapiens
gaugagaagucuaugaugu

SEQ ID NO: 818387 - RNA, 19 nt, Homo sapiens
ggagagguguggacauuug

SEQ ID NO: 818388 - RNA, 19 nt, Homo sapiens
caaaugacaucaaacuugu

SEQ ID NO: 818389 - RNA, 19 nt, Homo sapiens
ccacaagccugaagcaaga

SEQ ID NO: 818390 - RNA, 19 nt, Homo sapiens
caagauggaagaagaauuu

SEQ ID NO: 818391 - RNA, 19 nt, Homo sapiens
ggaagaagaggaugaagaa

SEQ ID NO: 818392 - RNA, 19 nt, Homo sapiens
ccacuucucuccaugauau

SEQ ID NO: 818393 - RNA, 19 nt, Homo sapiens
gugaaucccucaucuuaaa

SEQ ID NO: 818394 - RNA, 19 nt, Homo sapiens
cagauuaugugaaagauga

SEQ ID NO: 818395 - RNA, 19 nt, Homo sapiens
cagcuacacuccuagauuu

SEQ ID NO: 818396 - RNA, 19 nt, Homo sapiens
ugaagaacuuagaggauua

SEQ ID NO: 818397 - RNA, 19 nt, Homo sapiens
gcaaaccagugaaccugua

SEQ ID NO: 818398 - RNA, 19 nt, Homo sapiens
gaacuugccuuaccaacag

SEQ ID NO: 818399 - RNA, 19 nt, Homo sapiens
gaaaggguuuggaguugaa

SEQ ID NO: 818400 - RNA, 19 nt, Homo sapiens
gcaaggauggauuauauaa

SEQ ID NO: 818401 - RNA, 19 nt, Homo sapiens
agaagaagcuauaaagguu

SEQ ID NO: 818402 - RNA, 19 nt, Homo sapiens
gcaaaggaguuacaacagu

SEQ ID NO: 818403 - RNA, 19 nt, Homo sapiens
agagaaagauacaagagua

SEQ ID NO: 818404 - RNA, 19 nt, Homo sapiens
aaacacagcagaucgcuua

SEQ ID NO: 818405 - RNA, 19 nt, Homo sapiens
caucuuugauccugaauaa

SEQ ID NO: 818406 - RNA, 19 nt, Homo sapiens
cagcagcucugaugaagaa

SEQ ID NO: 818407 - RNA, 19 nt, Homo sapiens
gaaaugauaccuuuagauc

SEQ ID NO: 818408 - RNA, 19 nt, Homo sapiens
gaaagauugugguauauac

SEQ ID NO: 818409 - RNA, 19 nt, Homo sapiens
ggaauguacaugucaauaa

SEQ ID NO: 818410 - RNA, 19 nt, Homo sapiens
agaggaauauucugguuua

SEQ ID NO: 818411 - RNA, 19 nt, Homo sapiens
gaaacaggcccuaaggaaa

SEQ ID NO: 818412 - RNA, 19 nt, Homo sapiens
gcccacagcucucuuucua

SEQ ID NO: 818413 - RNA, 19 nt, Homo sapiens
gaaagucaauggaacuauc

SEQ ID NO: 818414 - RNA, 19 nt, Homo sapiens
gcagauaggcauagugaaa

SEQ ID NO: 818415 - RNA, 19 nt, Homo sapiens
ccacagauacucuacuaua

SEQ ID NO: 818416 - RNA, 19 nt, Homo sapiens
aaggaaagauugugguaua

SEQ ID NO: 818417 - RNA, 19 nt, Homo sapiens
gugaagcauuggacauuua

SEQ ID NO: 818418 - RNA, 19 nt, Homo sapiens
gcaugucgcuucugugguu

SEQ ID NO: 818419 - RNA, 19 nt, Homo sapiens
gggaaaggauggacaacaa

SEQ ID NO: 818420 - RNA, 19 nt, Homo sapiens
caaaggaguuacaacaguu

SEQ ID NO: 818421 - RNA, 19 nt, Homo sapiens
gaauaguugugguugguuu

SEQ ID NO: 818422 - RNA, 19 nt, Homo sapiens
caacagaucuucacuugcu

SEQ ID NO: 818423 - RNA, 19 nt, Homo sapiens
gaucaaagagacacgauuu

SEQ ID NO: 818424 - RNA, 19 nt, Homo sapiens
ucaaugaccuucuuaacug

SEQ ID NO: 818425 - RNA, 19 nt, Homo sapiens
gaacaucaccaucaacugu

SEQ ID NO: 818426 - RNA, 19 nt, Homo sapiens
gaaagagugugagaaagga

SEQ ID NO: 818427 - RNA, 19 nt, Homo sapiens
gaagaagaccuugaaauuc

SEQ ID NO: 818428 - RNA, 19 nt, Homo sapiens
gcaaacagcaaaccaguga

SEQ ID NO: 818429 - RNA, 19 nt, Homo sapiens
gcaaggauuuggugugugu

SEQ ID NO: 818430 - RNA, 19 nt, Homo sapiens
gauggagaaucaauuaaga

SEQ ID NO: 818431 - RNA, 19 nt, Homo sapiens
gaugauggcuuuguuguca

SEQ ID NO: 818432 - RNA, 19 nt, Homo sapiens
gaugacagcagugaauuua

SEQ ID NO: 818433 - RNA, 19 nt, Homo sapiens
ggacagaucccacagauac

SEQ ID NO: 818434 - RNA, 19 nt, Homo sapiens
gaacguacacaacggauga

SEQ ID NO: 818435 - RNA, 19 nt, Homo sapiens
ggaagaagaacuagaugaa

SEQ ID NO: 818436 - RNA, 19 nt, Homo sapiens
gaacauaugguuggaauca

SEQ ID NO: 818437 - RNA, 19 nt, Homo sapiens
caacgucuuucaucacauu

SEQ ID NO: 818438 - RNA, 19 nt, Homo sapiens
gaaauaucaucugcacuga

SEQ ID NO: 818439 - RNA, 19 nt, Homo sapiens
ccaacaaccuacagaagaa

SEQ ID NO: 818440 - RNA, 19 nt, Homo sapiens
gcagugaauuuaagagugu

SEQ ID NO: 818441 - RNA, 19 nt, Homo sapiens
ccaaaggauucuacagauu

SEQ ID NO: 818442 - RNA, 19 nt, Homo sapiens
gaggaaacaucucaacauc

SEQ ID NO: 818443 - RNA, 19 nt, Homo sapiens
gaacaagucucccaaauuu

SEQ ID NO: 818444 - RNA, 19 nt, Homo sapiens
ggaaacagcugcuuaagua

SEQ ID NO: 818445 - RNA, 19 nt, Homo sapiens
gaacauagcucgcaucaau

SEQ ID NO: 818446 - RNA, 19 nt, Homo sapiens
gaaggacucucacuuauuu

SEQ ID NO: 818447 - RNA, 19 nt, Homo sapiens
gaaaucaucucuagucuug

SEQ ID NO: 818448 - RNA, 19 nt, Homo sapiens
gaacaagucuccuuauuuc

SEQ ID NO: 818449 - RNA, 19 nt, Homo sapiens
ugacaaagcuuaugcauau

SEQ ID NO: 818450 - RNA, 19 nt, Homo sapiens
gaaguucgauucacuaaug

SEQ ID NO: 818451 - RNA, 19 nt, Homo sapiens
ggaaagacauggugaagau

SEQ ID NO: 818452 - RNA, 19 nt, Homo sapiens
gagaggacaucuacacuuu

SEQ ID NO: 818453 - RNA, 19 nt, Homo sapiens
gugcugagcuccagguuua

SEQ ID NO: 818454 - RNA, 19 nt, Homo sapiens
gaagaagagucaucugcua

SEQ ID NO: 818455 - RNA, 19 nt, Homo sapiens
gaagauggaucccagauag

SEQ ID NO: 818456 - RNA, 19 nt, Homo sapiens
gaacagcugucaccuagug

SEQ ID NO: 818457 - RNA, 19 nt, Homo sapiens
gaaaggaaauacuagugaa

SEQ ID NO: 818458 - RNA, 19 nt, Homo sapiens
gaagaagaguguggcauuu

SEQ ID NO: 818459 - RNA, 19 nt, Homo sapiens
gagaauucaugaucacuuu

SEQ ID NO: 818460 - RNA, 19 nt, Homo sapiens
ggaacaagucuccuuauuu

SEQ ID NO: 818461 - RNA, 19 nt, Homo sapiens
gagcaguugucuucuauga

SEQ ID NO: 818462 - RNA, 19 nt, Homo sapiens
gaugauggcuccuuuagca

SEQ ID NO: 818463 - RNA, 19 nt, Homo sapiens
caaaggugauuccuccuaa

SEQ ID NO: 818464 - RNA, 19 nt, Homo sapiens
aaacacaaauggcauguau

SEQ ID NO: 818465 - RNA, 19 nt, Homo sapiens
gaaaggauauauacaccau

SEQ ID NO: 818466 - RNA, 19 nt, Homo sapiens
gauaucagcuuuggaaaca

SEQ ID NO: 818467 - RNA, 19 nt, Homo sapiens
gcaguugucuucuaugauc

SEQ ID NO: 818468 - RNA, 19 nt, Homo sapiens
gcagcaaucugaaaucauc

SEQ ID NO: 818469 - RNA, 19 nt, Homo sapiens
cacuuuagaugaagaguua

SEQ ID NO: 818470 - RNA, 19 nt, Homo sapiens
acaaauaccuugcauacau

SEQ ID NO: 818471 - RNA, 19 nt, Homo sapiens
gagcagaauuuaucagauc

SEQ ID NO: 818472 - RNA, 19 nt, Homo sapiens
ccaagggugugaugcauuu

SEQ ID NO: 818473 - RNA, 19 nt, Homo sapiens
gggaaggacucucacuuau

SEQ ID NO: 818474 - RNA, 19 nt, Homo sapiens
gaucaaauauugcccacau

SEQ ID NO: 818475 - RNA, 19 nt, Homo sapiens
ggaacaagucucccaaauu

SEQ ID NO: 818476 - RNA, 19 nt, Homo sapiens
guaaugguguguuaacaga

SEQ ID NO: 818477 - RNA, 19 nt, Homo sapiens
gaaaggacacaaauagaug

SEQ ID NO: 818478 - RNA, 19 nt, Homo sapiens
caugaucacuuucccauau

SEQ ID NO: 818479 - RNA, 19 nt, Homo sapiens
cagaagaagugccagaaga

SEQ ID NO: 818480 - RNA, 19 nt, Homo sapiens
gaugaagaguuacccaaga

SEQ ID NO: 818481 - RNA, 19 nt, Homo sapiens
ccagacagauaucagcuuu

SEQ ID NO: 818482 - RNA, 19 nt, Homo sapiens
ccagagauguguuuuauuu

SEQ ID NO: 818483 - RNA, 19 nt, Homo sapiens
gccaagugaugaagaauug

SEQ ID NO: 818484 - RNA, 19 nt, Homo sapiens
ccagcaagaucuccgauga

SEQ ID NO: 818485 - RNA, 19 nt, Homo sapiens
ggaaggacucucacuuauu

SEQ ID NO: 818486 - RNA, 19 nt, Homo sapiens
gaggacaucuacacuuuag

SEQ ID NO: 818487 - RNA, 19 nt, Homo sapiens
gaagagagaggacaucuac

SEQ ID NO: 818488 - RNA, 19 nt, Homo sapiens
cagcugagcaagaguauaa

SEQ ID NO: 818489 - RNA, 19 nt, Homo sapiens
agagaguaaugguguguua

SEQ ID NO: 818490 - RNA, 19 nt, Homo sapiens
gaaacaaggaaaggauaua

SEQ ID NO: 818491 - RNA, 19 nt, Homo sapiens
caaauaccuugcauacaug

SEQ ID NO: 818492 - RNA, 19 nt, Homo sapiens
guauuucccuuguacagaa

SEQ ID NO: 818493 - RNA, 19 nt, Homo sapiens
gcuccagguuuaagaauga

SEQ ID NO: 818494 - RNA, 19 nt, Homo sapiens
gugcagaaucuacaaauuu

SEQ ID NO: 818495 - RNA, 19 nt, Homo sapiens
gagauuugcuggcauaggu

SEQ ID NO: 818496 - RNA, 19 nt, Homo sapiens
gcaagaguauaaugcaaca

SEQ ID NO: 818497 - RNA, 19 nt, Homo sapiens
gagcaagaguauaaugcaa

SEQ ID NO: 818498 - RNA, 19 nt, Homo sapiens
agagagaaauagcuucaaa

SEQ ID NO: 818499 - RNA, 19 nt, Homo sapiens
caacaaauaccuugcauac

SEQ ID NO: 818500 - RNA, 19 nt, Homo sapiens
ucagauggauugacuaugg

SEQ ID NO: 818501 - RNA, 19 nt, Homo sapiens
uuaauuaucuccacuuugg

SEQ ID NO: 818502 - RNA, 19 nt, Homo sapiens
gcuaugaugacauugauaa

SEQ ID NO: 818503 - RNA, 19 nt, Homo sapiens
uugcauacauggagucuaa

SEQ ID NO: 818504 - RNA, 19 nt, Homo sapiens
ggaugcagguggagcagaa

SEQ ID NO: 818505 - RNA, 19 nt, Homo sapiens
gacucucacuuauuuguuu

SEQ ID NO: 818506 - RNA, 19 nt, Homo sapiens
gauggaacaagucuccuua

SEQ ID NO: 818507 - RNA, 19 nt, Homo sapiens
caaagucaccugagucaug

SEQ ID NO: 818508 - RNA, 19 nt, Homo sapiens
ccaagacagugcuaugaug

SEQ ID NO: 818509 - RNA, 19 nt, Homo sapiens
caugcaaguuguuauggua

SEQ ID NO: 818510 - RNA, 19 nt, Homo sapiens
gaaagacuagcucaagguu

SEQ ID NO: 818511 - RNA, 19 nt, Homo sapiens
gaagacauggaccucuaua

SEQ ID NO: 818512 - RNA, 19 nt, Homo sapiens
gcaaaggugauuccuccua

SEQ ID NO: 818513 - RNA, 19 nt, Homo sapiens
ggagagaaagagacaaaga

SEQ ID NO: 818514 - RNA, 19 nt, Homo sapiens
gcagguggagcagaauuua

SEQ ID NO: 818515 - RNA, 19 nt, Homo sapiens
aagaggaagugucagauga

SEQ ID NO: 818516 - RNA, 19 nt, Homo sapiens
gguauucccuuugacaaga

SEQ ID NO: 818517 - RNA, 19 nt, Homo sapiens
gcggguagggcgauaauuu

SEQ ID NO: 818518 - RNA, 19 nt, Homo sapiens
gcuguaagauaaugaccuu

SEQ ID NO: 818519 - RNA, 19 nt, Homo sapiens
gaucccagauagcaaugaa

SEQ ID NO: 818520 - RNA, 19 nt, Homo sapiens
ccagaaaggacacaaauag

SEQ ID NO: 818521 - RNA, 19 nt, Homo sapiens
uagcaggccuccagcaaga

SEQ ID NO: 818522 - RNA, 19 nt, Homo sapiens
ugacaucgcagaccuucua

SEQ ID NO: 818523 - RNA, 19 nt, Homo sapiens
ucacuaaugucccagaaag

SEQ ID NO: 818524 - RNA, 19 nt, Homo sapiens
gaagaggaagugucagaug

SEQ ID NO: 818525 - RNA, 19 nt, Homo sapiens
ggaccucuauagcauuaau

SEQ ID NO: 818526 - RNA, 19 nt, Homo sapiens
ucaauacagucuuggaugu

SEQ ID NO: 818527 - RNA, 19 nt, Homo sapiens
caaauauuguacuccaaga

SEQ ID NO: 818528 - RNA, 19 nt, Homo sapiens
cauguaugcuaaugagauu

SEQ ID NO: 818529 - RNA, 19 nt, Homo sapiens
ggagaagucguccaaguca

SEQ ID NO: 818530 - RNA, 19 nt, Homo sapiens
gaacauuacaugcuuucga

SEQ ID NO: 818531 - RNA, 19 nt, Homo sapiens
ugaagaggauggaacaagu

SEQ ID NO: 818532 - RNA, 19 nt, Homo sapiens
caaagcuuaugcauauaga

SEQ ID NO: 818533 - RNA, 19 nt, Homo sapiens
gacaaagcuuaugcauaua

SEQ ID NO: 818534 - RNA, 19 nt, Homo sapiens
cagaggaggaggaaaguaa

SEQ ID NO: 818535 - RNA, 19 nt, Homo sapiens
ggaaacaaggaaaggauau

SEQ ID NO: 818536 - RNA, 19 nt, Homo sapiens
gaguguggcauuucuauug

SEQ ID NO: 818537 - RNA, 19 nt, Homo sapiens
cgugagauuugcuggcaua

SEQ ID NO: 818538 - RNA, 19 nt, Homo sapiens
caucgcagaccuucuauga

SEQ ID NO: 818539 - RNA, 19 nt, Homo sapiens
gucaaacggucaucacgaa

SEQ ID NO: 818540 - RNA, 19 nt, Homo sapiens
uggaacaagucuccuuauu

SEQ ID NO: 818541 - RNA, 19 nt, Homo sapiens
gaucuccgaugacucuugu

SEQ ID NO: 818542 - RNA, 19 nt, Homo sapiens
ccgaagacauggaccucua

SEQ ID NO: 818543 - RNA, 19 nt, Homo sapiens
ggacucagccugcuuauug

SEQ ID NO: 818544 - RNA, 19 nt, Homo sapiens
ggaaugacaugaacacuag

SEQ ID NO: 818545 - RNA, 19 nt, Homo sapiens
ucaaagagguuguggauuc

SEQ ID NO: 818546 - RNA, 19 nt, Homo sapiens
gaugaaggcucuagcaugu

SEQ ID NO: 818547 - RNA, 19 nt, Homo sapiens
guacagaagugaccucuca

SEQ ID NO: 818548 - RNA, 19 nt, Homo sapiens
uaacuugcauuccuaugua

SEQ ID NO: 818549 - RNA, 19 nt, Homo sapiens
caucaucccugaagucaaa

SEQ ID NO: 818550 - RNA, 19 nt, Homo sapiens
guacagcucuuaucguuca

SEQ ID NO: 818551 - RNA, 19 nt, Homo sapiens
gagaagugcuggacaaagu

SEQ ID NO: 818552 - RNA, 19 nt, Homo sapiens
gaaacagccucaggaagaa

SEQ ID NO: 818553 - RNA, 19 nt, Homo sapiens
ggagagaagugcuggacaa

SEQ ID NO: 818554 - RNA, 19 nt, Homo sapiens
ggaggaagauaaagcaaca

SEQ ID NO: 818555 - RNA, 19 nt, Homo sapiens
gagcaaauuugauucucuu

SEQ ID NO: 818556 - RNA, 19 nt, Homo sapiens
uaacagguauugaaacaag

SEQ ID NO: 818557 - RNA, 19 nt, Homo sapiens
ugaaaugucucuuccagau

SEQ ID NO: 818558 - RNA, 19 nt, Homo sapiens
gcgcagugauggagaagaa

SEQ ID NO: 818559 - RNA, 19 nt, Homo sapiens
ugacggagaucuuggacaa

SEQ ID NO: 818560 - RNA, 19 nt, Homo sapiens
gcaagaggagcuauucuga

SEQ ID NO: 818561 - RNA, 19 nt, Homo sapiens
ucagugagauuggaauuga

SEQ ID NO: 818562 - RNA, 19 nt, Homo sapiens
gaaagggcaggaagaagaa

SEQ ID NO: 818563 - RNA, 19 nt, Homo sapiens
gaacccaccugccaaugca

SEQ ID NO: 818564 - RNA, 19 nt, Homo sapiens
ucacuaugcagacuaauaa

SEQ ID NO: 818565 - RNA, 19 nt, Homo sapiens
gcucuuaucguucacauga

SEQ ID NO: 818566 - RNA, 19 nt, Homo sapiens
ccacagggcuggcagacau

SEQ ID NO: 818567 - RNA, 19 nt, Homo sapiens
gagcagcgcuggguguuca

SEQ ID NO: 818568 - RNA, 19 nt, Homo sapiens
acaaggaccuggaaaugga

SEQ ID NO: 818569 - RNA, 19 nt, Homo sapiens
ggacaaggaccuggaaaug

SEQ ID NO: 818570 - RNA, 19 nt, Homo sapiens
gcagagaagcccugaaaca

SEQ ID NO: 818571 - RNA, 19 nt, Homo sapiens
ccuaagaacuuggagagaa

SEQ ID NO: 818572 - RNA, 19 nt, Homo sapiens
guagacaacuugcagaaac

SEQ ID NO: 818573 - RNA, 19 nt, Homo sapiens
gaggagcuauucugaucuu

SEQ ID NO: 818574 - RNA, 19 nt, Homo sapiens
gcaaaccuguggccucauc

SEQ ID NO: 818575 - RNA, 19 nt, Homo sapiens
gaaagugguaccagugcua

SEQ ID NO: 818576 - RNA, 19 nt, Homo sapiens
ugaaacaggcccagaagaa

SEQ ID NO: 818577 - RNA, 19 nt, Homo sapiens
ccauggagcuccucagaca

SEQ ID NO: 818578 - RNA, 19 nt, Homo sapiens
gguuguggauucucugaaa

SEQ ID NO: 818579 - RNA, 19 nt, Homo sapiens
cgaaagggcaggaagaaga

SEQ ID NO: 818580 - RNA, 19 nt, Homo sapiens
gcagccagaugauuugaca

SEQ ID NO: 818581 - RNA, 19 nt, Homo sapiens
aaaggagcgugcaauagaa

SEQ ID NO: 818582 - RNA, 19 nt, Homo sapiens
gguacaggcuuucaucagu

SEQ ID NO: 818583 - RNA, 19 nt, Homo sapiens
gcagcugccuuggagaauu

SEQ ID NO: 818584 - RNA, 19 nt, Homo sapiens
agaaacagccucaggaaga

SEQ ID NO: 818585 - RNA, 19 nt, Homo sapiens
ggaaauggaggagcuaaug

SEQ ID NO: 818586 - RNA, 19 nt, Homo sapiens
cagaugagcagcccuuuga

SEQ ID NO: 818587 - RNA, 19 nt, Homo sapiens
aaagaugccugcccuaguc

SEQ ID NO: 818588 - RNA, 19 nt, Homo sapiens
gcagaaacagccucaggaa

SEQ ID NO: 818589 - RNA, 19 nt, Homo sapiens
gagcagcccuuugaucucu

SEQ ID NO: 818590 - RNA, 19 nt, Homo sapiens
ggaggcauuugcagccauu

SEQ ID NO: 818591 - RNA, 19 nt, Homo sapiens
ggccugugcuccuggauga

SEQ ID NO: 818592 - RNA, 19 nt, Homo sapiens
gcaaauuugauucucuuga

SEQ ID NO: 818593 - RNA, 19 nt, Homo sapiens
aagaggagcuauucugauc

SEQ ID NO: 818594 - RNA, 19 nt, Homo sapiens
ugagaaaucagaagccaaa

SEQ ID NO: 818595 - RNA, 19 nt, Homo sapiens
agacagagccuaccaaggu

SEQ ID NO: 818596 - RNA, 19 nt, Homo sapiens
ggaagaagaagagcaagga

SEQ ID NO: 818597 - RNA, 19 nt, Homo sapiens
guaacccucugcucugaga

SEQ ID NO: 818598 - RNA, 19 nt, Homo sapiens
cagcuucaguggccagauu

SEQ ID NO: 818599 - RNA, 19 nt, Homo sapiens
ucccuuaucucccucauug

SEQ ID NO: 818600 - RNA, 19 nt, Homo sapiens
cgguacagcucuuaucguu

SEQ ID NO: 818601 - RNA, 19 nt, Homo sapiens
uggcgaagguccagcugua

SEQ ID NO: 818602 - RNA, 19 nt, Homo sapiens
gcaguucgccuccaagaag

SEQ ID NO: 818603 - RNA, 19 nt, Homo sapiens
caacccaucucucauuggu

SEQ ID NO: 818604 - RNA, 19 nt, Homo sapiens
aaaguaguccugcuaaaga

SEQ ID NO: 818605 - RNA, 19 nt, Homo sapiens
gcaggaagaagaagagcaa

SEQ ID NO: 818606 - RNA, 19 nt, Homo sapiens
gcagcgcagugauggagaa

SEQ ID NO: 818607 - RNA, 19 nt, Homo sapiens
uugauucucuugacuuuga

SEQ ID NO: 818608 - RNA, 19 nt, Homo sapiens
gcccuuugaucucugcuuu

SEQ ID NO: 818609 - RNA, 19 nt, Homo sapiens
cacaagagguggcgaaggu

SEQ ID NO: 818610 - RNA, 19 nt, Homo sapiens
ugaaggcucuagcaugugu

SEQ ID NO: 818611 - RNA, 19 nt, Homo sapiens
gaaccuuucuccauuugac

SEQ ID NO: 818612 - RNA, 19 nt, Homo sapiens
gagagcugcuagugagaug

SEQ ID NO: 818613 - RNA, 19 nt, Homo sapiens
caaauuugauucucuugac

SEQ ID NO: 818614 - RNA, 19 nt, Homo sapiens
ucacaugaccauuaccaaa

SEQ ID NO: 818615 - RNA, 19 nt, Homo sapiens
ccugaagccugaaggaguu

SEQ ID NO: 818616 - RNA, 19 nt, Homo sapiens
aguacuaccugauccguuu

SEQ ID NO: 818617 - RNA, 19 nt, Homo sapiens
acaaaguaguccugcuaaa

SEQ ID NO: 818618 - RNA, 19 nt, Homo sapiens
gagcaucuccucccugagu

SEQ ID NO: 818619 - RNA, 19 nt, Homo sapiens
gcccugaggaggaagauaa

SEQ ID NO: 818620 - RNA, 19 nt, Homo sapiens
cuaguuaaguccagaccaa

SEQ ID NO: 818621 - RNA, 19 nt, Homo sapiens
gcguagugcuggagauugu

SEQ ID NO: 818622 - RNA, 19 nt, Homo sapiens
ucacggcucugacggagau

SEQ ID NO: 818623 - RNA, 19 nt, Homo sapiens
ucaaaccugucuuguccuu

SEQ ID NO: 818624 - RNA, 19 nt, Homo sapiens
ugagccaccuguaagcaaa

SEQ ID NO: 818625 - RNA, 19 nt, Homo sapiens
gacaaaguaguccugcuaa

SEQ ID NO: 818626 - RNA, 19 nt, Homo sapiens
ggagaauucuagcccuaag

SEQ ID NO: 818627 - RNA, 19 nt, Homo sapiens
ccaaaccaauccuauacca

SEQ ID NO: 818628 - RNA, 19 nt, Homo sapiens
gagcuugacaacuguguga

SEQ ID NO: 818629 - RNA, 19 nt, Homo sapiens
gcagacuaauaaacaucaa

SEQ ID NO: 818630 - RNA, 19 nt, Homo sapiens
gcuagugagaugacuguuu

SEQ ID NO: 818631 - RNA, 19 nt, Homo sapiens
gcccuucccugcuauccuu

SEQ ID NO: 818632 - RNA, 19 nt, Homo sapiens
caaccggacuagcgaagca

SEQ ID NO: 818633 - RNA, 19 nt, Homo sapiens
gcaguuggcccuguucuag

SEQ ID NO: 818634 - RNA, 19 nt, Homo sapiens
gacucagccugcuuauuga

SEQ ID NO: 818635 - RNA, 19 nt, Homo sapiens
caaagagguuguggauucu

SEQ ID NO: 818636 - RNA, 19 nt, Homo sapiens
uauccaaaccaauccuaua

SEQ ID NO: 818637 - RNA, 19 nt, Homo sapiens
uaaagaaggcccucuagac

SEQ ID NO: 818638 - RNA, 19 nt, Homo sapiens
caaaguaguccugcuaaag

SEQ ID NO: 818639 - RNA, 19 nt, Homo sapiens
cagcugccuuggagaauuc

SEQ ID NO: 818640 - RNA, 19 nt, Homo sapiens
aaagagggguugucauuga

SEQ ID NO: 818641 - RNA, 19 nt, Homo sapiens
gagcuauucugaucuugac

SEQ ID NO: 818642 - RNA, 19 nt, Homo sapiens
ggagcuauucugaucuuga

SEQ ID NO: 818643 - RNA, 19 nt, Homo sapiens
gaagauagcugaguuggaa

SEQ ID NO: 818644 - RNA, 19 nt, Homo sapiens
gaagagugcacaaauguua

SEQ ID NO: 818645 - RNA, 19 nt, Homo sapiens
ggagaaggaucgucuggua

SEQ ID NO: 818646 - RNA, 19 nt, Homo sapiens
gacacaagcuggagagaua

SEQ ID NO: 818647 - RNA, 19 nt, Homo sapiens
gaaacucacuugacuaauc

SEQ ID NO: 818648 - RNA, 19 nt, Homo sapiens
ggaaggauguggaaguaaa

SEQ ID NO: 818649 - RNA, 19 nt, Homo sapiens
gauguggucucuacacuaa

SEQ ID NO: 818650 - RNA, 19 nt, Homo sapiens
ggagaugcaucgaagguuu

SEQ ID NO: 818651 - RNA, 19 nt, Homo sapiens
gcccagagcugaagaagga

SEQ ID NO: 818652 - RNA, 19 nt, Homo sapiens
gggcggagcuguagauaug

SEQ ID NO: 818653 - RNA, 19 nt, Homo sapiens
ggucgaaucucucugaaga

SEQ ID NO: 818654 - RNA, 19 nt, Homo sapiens
gaacuagaauccaugaaag

SEQ ID NO: 818655 - RNA, 19 nt, Homo sapiens
agagagagaucaccaggua

SEQ ID NO: 818656 - RNA, 19 nt, Homo sapiens
gaaauggagcugcguauug

SEQ ID NO: 818657 - RNA, 19 nt, Homo sapiens
agacauaccugcuggaguu

SEQ ID NO: 818658 - RNA, 19 nt, Homo sapiens
agaaugagcugcagaagau

SEQ ID NO: 818659 - RNA, 19 nt, Homo sapiens
ggaaguggcugcccugaag

SEQ ID NO: 818660 - RNA, 19 nt, Homo sapiens
gaagaagacccaagaggaa

SEQ ID NO: 818661 - RNA, 19 nt, Homo sapiens
gaaaucgaauggugcuuug

SEQ ID NO: 818662 - RNA, 19 nt, Homo sapiens
gaaagacauuggaggaaau

SEQ ID NO: 818663 - RNA, 19 nt, Homo sapiens
ggagagauguaguggauuc

SEQ ID NO: 818664 - RNA, 19 nt, Homo sapiens
ggauauggcugaagagaag

SEQ ID NO: 818665 - RNA, 19 nt, Homo sapiens
agaaguugaucgacucuua

SEQ ID NO: 818666 - RNA, 19 nt, Homo sapiens
gauaaagggucgaaucucu

SEQ ID NO: 818667 - RNA, 19 nt, Homo sapiens
gcagauagcagaccauugu

SEQ ID NO: 818668 - RNA, 19 nt, Homo sapiens
guagauaugguguaagaua

SEQ ID NO: 818669 - RNA, 19 nt, Homo sapiens
ggaaagggaagaagaaaug

SEQ ID NO: 818670 - RNA, 19 nt, Homo sapiens
gaaccuucuucuagcauaa

SEQ ID NO: 818671 - RNA, 19 nt, Homo sapiens
uagcaaaucugaagcacaa

SEQ ID NO: 818672 - RNA, 19 nt, Homo sapiens
ccaccagucucuccuguuu

SEQ ID NO: 818673 - RNA, 19 nt, Homo sapiens
acacuaaccuucuugaugu

SEQ ID NO: 818674 - RNA, 19 nt, Homo sapiens
ugaaagaccagaauaagaa

SEQ ID NO: 818675 - RNA, 19 nt, Homo sapiens
gcacguucaucaccuagaa

SEQ ID NO: 818676 - RNA, 19 nt, Homo sapiens
ggaacuagaauccaugaaa

SEQ ID NO: 818677 - RNA, 19 nt, Homo sapiens
ggaaccuucuucuagcaua

SEQ ID NO: 818678 - RNA, 19 nt, Homo sapiens
agaaagagcggacaauuga

SEQ ID NO: 818679 - RNA, 19 nt, Homo sapiens
acaaaccaguucucagaua

SEQ ID NO: 818680 - RNA, 19 nt, Homo sapiens
cgaaagacauuggaggaaa

SEQ ID NO: 818681 - RNA, 19 nt, Homo sapiens
aaagaagagugcacaaaug

SEQ ID NO: 818682 - RNA, 19 nt, Homo sapiens
agagaugagugaccgaaua

SEQ ID NO: 818683 - RNA, 19 nt, Homo sapiens
gagaaagagcggacaauug

SEQ ID NO: 818684 - RNA, 19 nt, Homo sapiens
gaaggaaguauuaagagaa

SEQ ID NO: 818685 - RNA, 19 nt, Homo sapiens
gcggacaauugaacgcuua

SEQ ID NO: 818686 - RNA, 19 nt, Homo sapiens
aggaaaccauguugaauaa

SEQ ID NO: 818687 - RNA, 19 nt, Homo sapiens
gcggaaggauguggaagua

SEQ ID NO: 818688 - RNA, 19 nt, Homo sapiens
gaagaagaaaugaagcaaa

SEQ ID NO: 818689 - RNA, 19 nt, Homo sapiens
agacacagcugaaggaagu

SEQ ID NO: 818690 - RNA, 19 nt, Homo sapiens
ggaagugcccgcucuguug

SEQ ID NO: 818691 - RNA, 19 nt, Homo sapiens
ggaauggacuuggaguuca

SEQ ID NO: 818692 - RNA, 19 nt, Homo sapiens
gaaaauggaaucacaauug

SEQ ID NO: 818693 - RNA, 19 nt, Homo sapiens
gaaggaggagugucugaaa

SEQ ID NO: 818694 - RNA, 19 nt, Homo sapiens
gagcugaguguucuaauau

SEQ ID NO: 818695 - RNA, 19 nt, Homo sapiens
ugacaacccucugccauga

SEQ ID NO: 818696 - RNA, 19 nt, Homo sapiens
gagaagaaugacaaagaua

SEQ ID NO: 818697 - RNA, 19 nt, Homo sapiens
aaaccaacuuguagccaua

SEQ ID NO: 818698 - RNA, 19 nt, Homo sapiens
ugaaggagcggaagguuaa

SEQ ID NO: 818699 - RNA, 19 nt, Homo sapiens
ugaagcaaauggaagugua

SEQ ID NO: 818700 - RNA, 19 nt, Homo sapiens
aaauggagcugcguauuga

SEQ ID NO: 818701 - RNA, 19 nt, Homo sapiens
gagagcaaauugaguucuu

SEQ ID NO: 818702 - RNA, 19 nt, Homo sapiens
ugaaggaaguauuaagaga

SEQ ID NO: 818703 - RNA, 19 nt, Homo sapiens
gaauggacuuggaguucaa

SEQ ID NO: 818704 - RNA, 19 nt, Homo sapiens
gaaucucucugaagaacug

SEQ ID NO: 818705 - RNA, 19 nt, Homo sapiens
gaucgacucuuagaaaucu

SEQ ID NO: 818706 - RNA, 19 nt, Homo sapiens
agacaaagcuagaaacacu

SEQ ID NO: 818707 - RNA, 19 nt, Homo sapiens
uagaauccaugaaagcaaa

SEQ ID NO: 818708 - RNA, 19 nt, Homo sapiens
gaaggaacaguacagaguu

SEQ ID NO: 818709 - RNA, 19 nt, Homo sapiens
auacugagguguuagauca

SEQ ID NO: 818710 - RNA, 19 nt, Homo sapiens
gagcuuucguccucuaaga

SEQ ID NO: 818711 - RNA, 19 nt, Homo sapiens
gaagguagcaaaucugaag

SEQ ID NO: 818712 - RNA, 19 nt, Homo sapiens
cuuaaagacuugaaggaaa

SEQ ID NO: 818713 - RNA, 19 nt, Homo sapiens
guaaacagcacauugaagu

SEQ ID NO: 818714 - RNA, 19 nt, Homo sapiens
ucggagccauucuaaauuu

SEQ ID NO: 818715 - RNA, 19 nt, Homo sapiens
ugaaggagguggaaaauga

SEQ ID NO: 818716 - RNA, 19 nt, Homo sapiens
gauaguaaacagcacauug

SEQ ID NO: 818717 - RNA, 19 nt, Homo sapiens
agagcugaguguucuaaua

SEQ ID NO: 818718 - RNA, 19 nt, Homo sapiens
ugagaagaaugacaaagau

SEQ ID NO: 818719 - RNA, 19 nt, Homo sapiens
gguggaugcucuccgauug

SEQ ID NO: 818720 - RNA, 19 nt, Homo sapiens
caaaccaguucucagauag

SEQ ID NO: 818721 - RNA, 19 nt, Homo sapiens
ucacaaaccaguucucaga

SEQ ID NO: 818722 - RNA, 19 nt, Homo sapiens
gaagaaaugaagcaaaugg

SEQ ID NO: 818723 - RNA, 19 nt, Homo sapiens
caucgaagguuugagaaug

SEQ ID NO: 818724 - RNA, 19 nt, Homo sapiens
ggaaggaacaguacagagu

SEQ ID NO: 818725 - RNA, 19 nt, Homo sapiens
gaagguaaagcaggaacua

SEQ ID NO: 818726 - RNA, 19 nt, Homo sapiens
ugaaagaacgggucaaauc

SEQ ID NO: 818727 - RNA, 19 nt, Homo sapiens
gcaaacuguuauugagaug

SEQ ID NO: 818728 - RNA, 19 nt, Homo sapiens
caaaagcucugcaaacugu

SEQ ID NO: 818729 - RNA, 19 nt, Homo sapiens
guaaaggagagcaaauuga

SEQ ID NO: 818730 - RNA, 19 nt, Homo sapiens
gaacaugugagguugaaag

SEQ ID NO: 818731 - RNA, 19 nt, Homo sapiens
gcugaguguucuaauauca

SEQ ID NO: 818732 - RNA, 19 nt, Homo sapiens
caaacuucaucccaacuug

SEQ ID NO: 818733 - RNA, 19 nt, Homo sapiens
caagugaaagaccagaaua

SEQ ID NO: 818734 - RNA, 19 nt, Homo sapiens
gagagaagcaagaggaaau

SEQ ID NO: 818735 - RNA, 19 nt, Homo sapiens
aaggaaaccauguugaaua

SEQ ID NO: 818736 - RNA, 19 nt, Homo sapiens
gaagagaaggaaaccaugu

SEQ ID NO: 818737 - RNA, 19 nt, Homo sapiens
ggaguugaagcaguaaaua

SEQ ID NO: 818738 - RNA, 19 nt, Homo sapiens
gaacauacaaaguugacau

SEQ ID NO: 818739 - RNA, 19 nt, Homo sapiens
gagaaugagcugcagaaga

SEQ ID NO: 818740 - RNA, 19 nt, Homo sapiens
cuacgaggaugaccacuuc

SEQ ID NO: 818741 - RNA, 19 nt, Homo sapiens
aaaggaaacucacuugacu

SEQ ID NO: 818742 - RNA, 19 nt, Homo sapiens
gacacugccuugacaacuu

SEQ ID NO: 818743 - RNA, 19 nt, Homo sapiens
gaaagugacucaucuguua

SEQ ID NO: 818744 - RNA, 19 nt, Homo sapiens
caaagaagcuuccucauuu

SEQ ID NO: 818745 - RNA, 19 nt, Homo sapiens
gcacagaaaucuagaguaa

SEQ ID NO: 818746 - RNA, 19 nt, Homo sapiens
gauaagagguuuacugaaa

SEQ ID NO: 818747 - RNA, 19 nt, Homo sapiens
ccaaggagcuuaaguguaa

SEQ ID NO: 818748 - RNA, 19 nt, Homo sapiens
gaacuaagguguacaugug

SEQ ID NO: 818749 - RNA, 19 nt, Homo sapiens
caacuuggaugaccuagua

SEQ ID NO: 818750 - RNA, 19 nt, Homo sapiens
ggaaaggaaugaggaguua

SEQ ID NO: 818751 - RNA, 19 nt, Homo sapiens
gaaagcagguugagugaga

SEQ ID NO: 818752 - RNA, 19 nt, Homo sapiens
gaagaggaaucuaaagcua

SEQ ID NO: 818753 - RNA, 19 nt, Homo sapiens
caucauauauccuguauug

SEQ ID NO: 818754 - RNA, 19 nt, Homo sapiens
gaaagcaugugaagaaauc

SEQ ID NO: 818755 - RNA, 19 nt, Homo sapiens
ggaaauggcuucuguugag

SEQ ID NO: 818756 - RNA, 19 nt, Homo sapiens
gaucuucucuuucaaacaa

SEQ ID NO: 818757 - RNA, 19 nt, Homo sapiens
aaacaaggcaggugaaaua

SEQ ID NO: 818758 - RNA, 19 nt, Homo sapiens
gaagacauguagcuacuau

SEQ ID NO: 818759 - RNA, 19 nt, Homo sapiens
caucaaagcaacacauuua

SEQ ID NO: 818760 - RNA, 19 nt, Homo sapiens
caaagcaauuccaaaguuu

SEQ ID NO: 818761 - RNA, 19 nt, Homo sapiens
gcaagaagcuuacauuuuc

SEQ ID NO: 818762 - RNA, 19 nt, Homo sapiens
uaacagacaugguaauauc

SEQ ID NO: 818763 - RNA, 19 nt, Homo sapiens
gagguggucucaauauauu

SEQ ID NO: 818764 - RNA, 19 nt, Homo sapiens
gcacacagauaaauccaau

SEQ ID NO: 818765 - RNA, 19 nt, Homo sapiens
caaauaagccugccucuca

SEQ ID NO: 818766 - RNA, 19 nt, Homo sapiens
gagcaagaguggguuuaua

SEQ ID NO: 818767 - RNA, 19 nt, Homo sapiens
gauuugggcuuucugcuuu

SEQ ID NO: 818768 - RNA, 19 nt, Homo sapiens
caagugaaccgcuuaauau

SEQ ID NO: 818769 - RNA, 19 nt, Homo sapiens
ccacaugccucaacuggaa

SEQ ID NO: 818770 - RNA, 19 nt, Homo sapiens
uaagaacccuggcuuccua

SEQ ID NO: 818771 - RNA, 19 nt, Homo sapiens
gaaaugaaaguugggcuua

SEQ ID NO: 818772 - RNA, 19 nt, Homo sapiens
ucaaagcaauuccaaaguu

SEQ ID NO: 818773 - RNA, 19 nt, Homo sapiens
ggaagcaaauaguguauca

SEQ ID NO: 818774 - RNA, 19 nt, Homo sapiens
gaagucagcuugggaucaa

SEQ ID NO: 818775 - RNA, 19 nt, Homo sapiens
gaaugaauguuccaaaguc

SEQ ID NO: 818776 - RNA, 19 nt, Homo sapiens
ggacaagcacaauuuauga

SEQ ID NO: 818777 - RNA, 19 nt, Homo sapiens
gauguuagccaaauguuaa

SEQ ID NO: 818778 - RNA, 19 nt, Homo sapiens
gugaaccgcuuaauaucua

SEQ ID NO: 818779 - RNA, 19 nt, Homo sapiens
ccaagagaauuaccucaaa

SEQ ID NO: 818780 - RNA, 19 nt, Homo sapiens
ugacagagacuuugaaaug

SEQ ID NO: 818781 - RNA, 19 nt, Homo sapiens
gaaagcacuucuauugaca

SEQ ID NO: 818782 - RNA, 19 nt, Homo sapiens
cacagcagcucagaauuua

SEQ ID NO: 818783 - RNA, 19 nt, Homo sapiens
caucaaagcaugagaauuc

SEQ ID NO: 818784 - RNA, 19 nt, Homo sapiens
gaucuggcuuugaccauuu

SEQ ID NO: 818785 - RNA, 19 nt, Homo sapiens
gaaaguuccuccggcguuu

SEQ ID NO: 818786 - RNA, 19 nt, Homo sapiens
gcaggaaggcugaagauga

SEQ ID NO: 818787 - RNA, 19 nt, Homo sapiens
gacagagacuuugaaauga

SEQ ID NO: 818788 - RNA, 19 nt, Homo sapiens
aaacuuggcucaacagcuu

SEQ ID NO: 818789 - RNA, 19 nt, Homo sapiens
cgucaaaucuagugaguug

SEQ ID NO: 818790 - RNA, 19 nt, Homo sapiens
gccauaauguuucuucuga

SEQ ID NO: 818791 - RNA, 19 nt, Homo sapiens
ugacuuggauagcaaauug

SEQ ID NO: 818792 - RNA, 19 nt, Homo sapiens
ccacuuacauacaggcuaa

SEQ ID NO: 818793 - RNA, 19 nt, Homo sapiens
gaacaacaguuagcuuucu

SEQ ID NO: 818794 - RNA, 19 nt, Homo sapiens
caggaaggcugaagaugaa

SEQ ID NO: 818795 - RNA, 19 nt, Homo sapiens
gagagaaugacaaauguaa

SEQ ID NO: 818796 - RNA, 19 nt, Homo sapiens
gaagaagacaaacagcuaa

SEQ ID NO: 818797 - RNA, 19 nt, Homo sapiens
ugaauucucugucaacaau

SEQ ID NO: 818798 - RNA, 19 nt, Homo sapiens
caacagggcuaugucaugu

SEQ ID NO: 818799 - RNA, 19 nt, Homo sapiens
caaggaagauuauggaaac

SEQ ID NO: 818800 - RNA, 19 nt, Homo sapiens
gaagucaggaggcaaauau

SEQ ID NO: 818801 - RNA, 19 nt, Homo sapiens
caccaggaauuaacuguaa

SEQ ID NO: 818802 - RNA, 19 nt, Homo sapiens
uuaccaacguguuaguuua

SEQ ID NO: 818803 - RNA, 19 nt, Homo sapiens
agaauuaccuacaucaaga

SEQ ID NO: 818804 - RNA, 19 nt, Homo sapiens
ccaagugaaccgcuuaaua

SEQ ID NO: 818805 - RNA, 19 nt, Homo sapiens
gaagaaauccgagaaccuu

SEQ ID NO: 818806 - RNA, 19 nt, Homo sapiens
agaauuaccucaaagaagu

SEQ ID NO: 818807 - RNA, 19 nt, Homo sapiens
gcucagacuugucaggaaa

SEQ ID NO: 818808 - RNA, 19 nt, Homo sapiens
gaaaggagacuucaaagcu

SEQ ID NO: 818809 - RNA, 19 nt, Homo sapiens
ccacagaugaugaauacua

SEQ ID NO: 818810 - RNA, 19 nt, Homo sapiens
gguagagccauuccauuua

SEQ ID NO: 818811 - RNA, 19 nt, Homo sapiens
gcaauucaguugacucucu

SEQ ID NO: 818812 - RNA, 19 nt, Homo sapiens
ggaaaucauucaguucuuc

SEQ ID NO: 818813 - RNA, 19 nt, Homo sapiens
ggacagaaaggaugugaug

SEQ ID NO: 818814 - RNA, 19 nt, Homo sapiens
uuacuucccuccuaacauu

SEQ ID NO: 818815 - RNA, 19 nt, Homo sapiens
gugaaacccugcauacuuc

SEQ ID NO: 818816 - RNA, 19 nt, Homo sapiens
uaagacgacuaguacguuu

SEQ ID NO: 818817 - RNA, 19 nt, Homo sapiens
gaccucgugugauucuuua

SEQ ID NO: 818818 - RNA, 19 nt, Homo sapiens
gugaaacucuguauugcuu

SEQ ID NO: 818819 - RNA, 19 nt, Homo sapiens
auacagaccuaucgacuau

SEQ ID NO: 818820 - RNA, 19 nt, Homo sapiens
ucacagcagcucagaauuu

SEQ ID NO: 818821 - RNA, 19 nt, Homo sapiens
ccagaagucuaacagcauu

SEQ ID NO: 818822 - RNA, 19 nt, Homo sapiens
guagucaggugccagaaga

SEQ ID NO: 818823 - RNA, 19 nt, Homo sapiens
ggaagauuauggaaaccaa

SEQ ID NO: 818824 - RNA, 19 nt, Homo sapiens
caaagcaugagaauucuaa

SEQ ID NO: 818825 - RNA, 19 nt, Homo sapiens
ccaccucccuuccaaauca

SEQ ID NO: 818826 - RNA, 19 nt, Homo sapiens
caaagagucagaacuguga

SEQ ID NO: 818827 - RNA, 19 nt, Homo sapiens
uagagagucugcagucuga

SEQ ID NO: 818828 - RNA, 19 nt, Homo sapiens
cugauucacugucugauuu

SEQ ID NO: 818829 - RNA, 19 nt, Homo sapiens
caaacucuuuaccugauuu

SEQ ID NO: 818830 - RNA, 19 nt, Homo sapiens
guggugaucuucucuuuca

SEQ ID NO: 818831 - RNA, 19 nt, Homo sapiens
uauagacacuuccugaaug

SEQ ID NO: 818832 - RNA, 19 nt, Homo sapiens
uaacagcauuucacaacga

SEQ ID NO: 818833 - RNA, 19 nt, Homo sapiens
ggagguggucucaauauau

SEQ ID NO: 818834 - RNA, 19 nt, Homo sapiens
ccacagagagaaugacaaa

SEQ ID NO: 818835 - RNA, 19 nt, Homo sapiens
gaacaugccauucuaccau

SEQ ID NO: 818836 - RNA, 19 nt, Homo sapiens
gguaacagacaugguaaua

SEQ ID NO: 818837 - RNA, 19 nt, Homo sapiens
cugagaaacugauugcaaa

SEQ ID NO: 818838 - RNA, 19 nt, Homo sapiens
aaacauuuccuaacgcuuu

SEQ ID NO: 818839 - RNA, 19 nt, Homo sapiens
ccacuuccauuccucauca

SEQ ID NO: 818840 - RNA, 19 nt, Homo sapiens
cagagagaaugacaaaugu

SEQ ID NO: 818841 - RNA, 19 nt, Homo sapiens
ggacgaagcggagaacaga

SEQ ID NO: 818842 - RNA, 19 nt, Homo sapiens
gaucagauuccucuagaga

SEQ ID NO: 818843 - RNA, 19 nt, Homo sapiens
gaugauguccuuugaaaua

SEQ ID NO: 818844 - RNA, 19 nt, Homo sapiens
uaacuuagccauccuagua

SEQ ID NO: 818845 - RNA, 19 nt, Homo sapiens
gcacaucagugucaaggaa

SEQ ID NO: 818846 - RNA, 19 nt, Homo sapiens
guagcuggcuugaguaauu

SEQ ID NO: 818847 - RNA, 19 nt, Homo sapiens
aaggagaguuuguuacuua

SEQ ID NO: 818848 - RNA, 19 nt, Homo sapiens
guauuuaucccacccauua

SEQ ID NO: 818849 - RNA, 19 nt, Homo sapiens
uagcauguguucaacuuua

SEQ ID NO: 818850 - RNA, 19 nt, Homo sapiens
uuagaucacuugcucauuu

SEQ ID NO: 818851 - RNA, 19 nt, Homo sapiens
ggacauauguuuucauuuc

SEQ ID NO: 818852 - RNA, 19 nt, Homo sapiens
gcgauuucaucccuaauuu

SEQ ID NO: 818853 - RNA, 19 nt, Homo sapiens
gaucuauucuugcacgauu

SEQ ID NO: 818854 - RNA, 19 nt, Homo sapiens
ccacaucccucagugcuuu

SEQ ID NO: 818855 - RNA, 19 nt, Homo sapiens
caccaugccugcagacuuu

SEQ ID NO: 818856 - RNA, 19 nt, Homo sapiens
ggacacugcccacgacuuu

SEQ ID NO: 818857 - RNA, 19 nt, Homo sapiens
gcacaagucccuuuaacug

SEQ ID NO: 818858 - RNA, 19 nt, Homo sapiens
cagauuugcuggaucauau

SEQ ID NO: 818859 - RNA, 19 nt, Homo sapiens
ccauuugcauaucuucuua

SEQ ID NO: 818860 - RNA, 19 nt, Homo sapiens
gaaugggccuguuguaaac

SEQ ID NO: 818861 - RNA, 19 nt, Homo sapiens
ucaacaaccugguggagaa

SEQ ID NO: 818862 - RNA, 19 nt, Homo sapiens
cgaaugauauugagcaucu

SEQ ID NO: 818863 - RNA, 19 nt, Homo sapiens
gcaaaguucauccauguug

SEQ ID NO: 818864 - RNA, 19 nt, Homo sapiens
uccgugagcuguuucauuu

SEQ ID NO: 818865 - RNA, 19 nt, Homo sapiens
gaucguuucuacuucuuga

SEQ ID NO: 818866 - RNA, 19 nt, Homo sapiens
uguguacacugguuagaua

SEQ ID NO: 818867 - RNA, 19 nt, Homo sapiens
gaaaggagaguuuguuacu

SEQ ID NO: 818868 - RNA, 19 nt, Homo sapiens
cggguaauauuccauugua

SEQ ID NO: 818869 - RNA, 19 nt, Homo sapiens
ucacacguauuaauugguu

SEQ ID NO: 818870 - RNA, 19 nt, Homo sapiens
guacaggaaauacaguuaa

SEQ ID NO: 818871 - RNA, 19 nt, Homo sapiens
guguggagcuggaguguga

SEQ ID NO: 818872 - RNA, 19 nt, Homo sapiens
uaggacagcuaucuuuaga

SEQ ID NO: 818873 - RNA, 19 nt, Homo sapiens
aaucaugacucacacguau

SEQ ID NO: 818874 - RNA, 19 nt, Homo sapiens
ccagaguacuuaaacacaa

SEQ ID NO: 818875 - RNA, 19 nt, Homo sapiens
aagcaaaguucauccaugu

SEQ ID NO: 818876 - RNA, 19 nt, Homo sapiens
gauguccuuugaaauacua

SEQ ID NO: 818877 - RNA, 19 nt, Homo sapiens
gcuaggaacuuuuguguau

SEQ ID NO: 818878 - RNA, 19 nt, Homo sapiens
aaacaaaucaugacucaca

SEQ ID NO: 818879 - RNA, 19 nt, Homo sapiens
uaccagagcaucaagagua

SEQ ID NO: 818880 - RNA, 19 nt, Homo sapiens
cccaggaaguggcaucaua

SEQ ID NO: 818881 - RNA, 19 nt, Homo sapiens
cccuuuaacugguauauga

SEQ ID NO: 818882 - RNA, 19 nt, Homo sapiens
caagucccuuuaacuggua

SEQ ID NO: 818883 - RNA, 19 nt, Homo sapiens
ugacucacacguauuaauu

SEQ ID NO: 818884 - RNA, 19 nt, Homo sapiens
gacccucuccuguaaagua

SEQ ID NO: 818885 - RNA, 19 nt, Homo sapiens
ucaugacucacacguauua

SEQ ID NO: 818886 - RNA, 19 nt, Homo sapiens
gcaggaguuugauaagcuu

SEQ ID NO: 818887 - RNA, 19 nt, Homo sapiens
caaaguucauccauguugu

SEQ ID NO: 818888 - RNA, 19 nt, Homo sapiens
gaaguuccucugguuaauu

SEQ ID NO: 818889 - RNA, 19 nt, Homo sapiens
agaaugggccuguuguaaa

SEQ ID NO: 818890 - RNA, 19 nt, Homo sapiens
uugaugauguccuuugaaa

SEQ ID NO: 818891 - RNA, 19 nt, Homo sapiens
gcagauuugcuggaucaua

SEQ ID NO: 818892 - RNA, 19 nt, Homo sapiens
gugugacccucuccuguaa

SEQ ID NO: 818893 - RNA, 19 nt, Homo sapiens
caucaagaguacaggaaau

SEQ ID NO: 818894 - RNA, 19 nt, Homo sapiens
ccacacugcuugggcacua

SEQ ID NO: 818895 - RNA, 19 nt, Homo sapiens
gguaauauuccauuguaug

SEQ ID NO: 818896 - RNA, 19 nt, Homo sapiens
guucauccauguuguagca

SEQ ID NO: 818897 - RNA, 19 nt, Homo sapiens
ccaggaaguggcaucauaa

SEQ ID NO: 818898 - RNA, 19 nt, Homo sapiens
gaaggaggacgacguuucu

SEQ ID NO: 818899 - RNA, 19 nt, Homo sapiens
ucugauugaucuauucuug

SEQ ID NO: 818900 - RNA, 19 nt, Homo sapiens
guggacauuuggaucguuu

SEQ ID NO: 818901 - RNA, 19 nt, Homo sapiens
uuagauaugggaagaguuu

SEQ ID NO: 818902 - RNA, 19 nt, Homo sapiens
ccucuccuguaaaguauuu

SEQ ID NO: 818903 - RNA, 19 nt, Homo sapiens
ccauggacguggcccuaaa

SEQ ID NO: 818904 - RNA, 19 nt, Homo sapiens
aaggguagcuggcuugagu

SEQ ID NO: 818905 - RNA, 19 nt, Homo sapiens
uucaguggcucucaggaua

SEQ ID NO: 818906 - RNA, 19 nt, Homo sapiens
uagcuggcuugaguaauuu

SEQ ID NO: 818907 - RNA, 19 nt, Homo sapiens
uggaaaggagaguuuguua

SEQ ID NO: 818908 - RNA, 19 nt, Homo sapiens
ggcaugaggguucugauga

SEQ ID NO: 818909 - RNA, 19 nt, Homo sapiens
gaggugugguaaagccauu

SEQ ID NO: 818910 - RNA, 19 nt, Homo sapiens
uagaaugggccuguuguaa

SEQ ID NO: 818911 - RNA, 19 nt, Homo sapiens
gugccucucuccauguuug

SEQ ID NO: 818912 - RNA, 19 nt, Homo sapiens
gaugaaggaggacgacguu

SEQ ID NO: 818913 - RNA, 19 nt, Homo sapiens
gcaucaagaguacaggaaa

SEQ ID NO: 818914 - RNA, 19 nt, Homo sapiens
uugauaagcuucgcgaguu

SEQ ID NO: 818915 - RNA, 19 nt, Homo sapiens
aaacuuaaggccacaagga

SEQ ID NO: 818916 - RNA, 19 nt, Homo sapiens
uuucaucccuaauuucuuc

SEQ ID NO: 818917 - RNA, 19 nt, Homo sapiens
acacaggguuccagaguac

SEQ ID NO: 818918 - RNA, 19 nt, Homo sapiens
cagcucugauugaucuauu

SEQ ID NO: 818919 - RNA, 19 nt, Homo sapiens
uggaucauaugaaacucua

SEQ ID NO: 818920 - RNA, 19 nt, Homo sapiens
uauaguugcuguggaggaa

SEQ ID NO: 818921 - RNA, 19 nt, Homo sapiens
uuaguugguuuccauagga

SEQ ID NO: 818922 - RNA, 19 nt, Homo sapiens
aaaggagaguuuguuacuu

SEQ ID NO: 818923 - RNA, 19 nt, Homo sapiens
ggaaaggagaguuuguuac

SEQ ID NO: 818924 - RNA, 19 nt, Homo sapiens
agggcgagcugucuuucua

SEQ ID NO: 818925 - RNA, 19 nt, Homo sapiens
ggacagcucagccucuucu

SEQ ID NO: 818926 - RNA, 19 nt, Homo sapiens
uguagcauguguucaacuu

SEQ ID NO: 818927 - RNA, 19 nt, Homo sapiens
uaucccacccauuaauaua

SEQ ID NO: 818928 - RNA, 19 nt, Homo sapiens
gcggacagcucagccucuu

SEQ ID NO: 818929 - RNA, 19 nt, Homo sapiens
ugauugaucuauucuugca

SEQ ID NO: 818930 - RNA, 19 nt, Homo sapiens
ggaggggacugccauggaa

SEQ ID NO: 818931 - RNA, 19 nt, Homo sapiens
gcaccaaccacacccucaa

SEQ ID NO: 818932 - RNA, 19 nt, Homo sapiens
cuuauuggccauuugcaua

SEQ ID NO: 818933 - RNA, 19 nt, Homo sapiens
gcaugaggguucugaugac

SEQ ID NO: 818934 - RNA, 19 nt, Homo sapiens
caccuuagauaugggaaga

SEQ ID NO: 818935 - RNA, 19 nt, Homo sapiens
ggauuucugggaauaaugu

SEQ ID NO: 818936 - RNA, 19 nt, Homo sapiens
ggguaauauuccauuguau

SEQ ID NO: 818937 - RNA, 19 nt, Homo sapiens
aaaguucauccauguugua

SEQ ID NO: 818938 - RNA, 19 nt, Homo sapiens
gaaguggcaucauaaaagg

SEQ ID NO: 818939 - RNA, 19 nt, Homo sapiens
ggauuaguugguuuccaua

SEQ ID NO: 818940 - RNA, 19 nt, Homo sapiens
cggauuaguugguuuccau

SEQ ID NO: 818941 - RNA, 19 nt, Homo sapiens
ggcaggaguuugauaagcu

SEQ ID NO: 818942 - RNA, 19 nt, Homo sapiens
gaaaugggcaaggcagagu

SEQ ID NO: 818943 - RNA, 19 nt, Homo sapiens
gaugauguccuuugaaaua

SEQ ID NO: 818944 - RNA, 19 nt, Homo sapiens
uaacuuagccauccuagua

SEQ ID NO: 818945 - RNA, 19 nt, Homo sapiens
gcacaucagugucaaggaa

SEQ ID NO: 818946 - RNA, 19 nt, Homo sapiens
guagcuggcuugaguaauu

SEQ ID NO: 818947 - RNA, 19 nt, Homo sapiens
aaggagaguuuguuacuua

SEQ ID NO: 818948 - RNA, 19 nt, Homo sapiens
guauuuaucccacccauua

SEQ ID NO: 818949 - RNA, 19 nt, Homo sapiens
uagcauguguucaacuuua

SEQ ID NO: 818950 - RNA, 19 nt, Homo sapiens
uuagaucacuugcucauuu

SEQ ID NO: 818951 - RNA, 19 nt, Homo sapiens
ggacauauguuuucauuuc

SEQ ID NO: 818952 - RNA, 19 nt, Homo sapiens
gcgauuucaucccuaauuu

SEQ ID NO: 818953 - RNA, 19 nt, Homo sapiens
gaucuauucuugcacgauu

SEQ ID NO: 818954 - RNA, 19 nt, Homo sapiens
ccacaucccucagugcuuu

SEQ ID NO: 818955 - RNA, 19 nt, Homo sapiens
caccaugccugcagacuuu

SEQ ID NO: 818956 - RNA, 19 nt, Homo sapiens
ggacacugcccacgacuuu

SEQ ID NO: 818957 - RNA, 19 nt, Homo sapiens
gcacaagucccuuuaacug

SEQ ID NO: 818958 - RNA, 19 nt, Homo sapiens
cagauuugcuggaucauau

SEQ ID NO: 818959 - RNA, 19 nt, Homo sapiens
ccauuugcauaucuucuua

SEQ ID NO: 818960 - RNA, 19 nt, Homo sapiens
gaaugggccuguuguaaac

SEQ ID NO: 818961 - RNA, 19 nt, Homo sapiens
ucaacaaccugguggagaa

SEQ ID NO: 818962 - RNA, 19 nt, Homo sapiens
cgaaugauauugagcaucu

SEQ ID NO: 818963 - RNA, 19 nt, Homo sapiens
gcaaaguucauccauguug

SEQ ID NO: 818964 - RNA, 19 nt, Homo sapiens
uccgugagcuguuucauuu

SEQ ID NO: 818965 - RNA, 19 nt, Homo sapiens
gaucguuucuacuucuuga

SEQ ID NO: 818966 - RNA, 19 nt, Homo sapiens
uguguacacugguuagaua

SEQ ID NO: 818967 - RNA, 19 nt, Homo sapiens
gaaaggagaguuuguuacu

SEQ ID NO: 818968 - RNA, 19 nt, Homo sapiens
cggguaauauuccauugua

SEQ ID NO: 818969 - RNA, 19 nt, Homo sapiens
ucacacguauuaauugguu

SEQ ID NO: 818970 - RNA, 19 nt, Homo sapiens
guacaggaaauacaguuaa

SEQ ID NO: 818971 - RNA, 19 nt, Homo sapiens
guguggagcuggaguguga

SEQ ID NO: 818972 - RNA, 19 nt, Homo sapiens
uaggacagcuaucuuuaga

SEQ ID NO: 818973 - RNA, 19 nt, Homo sapiens
aaucaugacucacacguau

SEQ ID NO: 818974 - RNA, 19 nt, Homo sapiens
ccagaguacuuaaacacaa

SEQ ID NO: 818975 - RNA, 19 nt, Homo sapiens
aagcaaaguucauccaugu

SEQ ID NO: 818976 - RNA, 19 nt, Homo sapiens
gauguccuuugaaauacua

SEQ ID NO: 818977 - RNA, 19 nt, Homo sapiens
gcuaggaacuuuuguguau

SEQ ID NO: 818978 - RNA, 19 nt, Homo sapiens
aaacaaaucaugacucaca

SEQ ID NO: 818979 - RNA, 19 nt, Homo sapiens
uaccagagcaucaagagua

SEQ ID NO: 818980 - RNA, 19 nt, Homo sapiens
cccaggaaguggcaucaua

SEQ ID NO: 818981 - RNA, 19 nt, Homo sapiens
gaagagagaaggaacuuuu

SEQ ID NO: 818982 - RNA, 19 nt, Homo sapiens
cccuuuaacugguauauga

SEQ ID NO: 818983 - RNA, 19 nt, Homo sapiens
caagucccuuuaacuggua

SEQ ID NO: 818984 - RNA, 19 nt, Homo sapiens
ugacucacacguauuaauu

SEQ ID NO: 818985 - RNA, 19 nt, Homo sapiens
gacccucuccuguaaagua

SEQ ID NO: 818986 - RNA, 19 nt, Homo sapiens
ucaugacucacacguauua

SEQ ID NO: 818987 - RNA, 19 nt, Homo sapiens
gcaggaguuugauaagcuu

SEQ ID NO: 818988 - RNA, 19 nt, Homo sapiens
caaaguucauccauguugu

SEQ ID NO: 818989 - RNA, 19 nt, Homo sapiens
ccugauagccgaagagaga

SEQ ID NO: 818990 - RNA, 19 nt, Homo sapiens
gaaguuccucugguuaauu

SEQ ID NO: 818991 - RNA, 19 nt, Homo sapiens
agaaugggccuguuguaaa

SEQ ID NO: 818992 - RNA, 19 nt, Homo sapiens
uugaugauguccuuugaaa

SEQ ID NO: 818993 - RNA, 19 nt, Homo sapiens
gcagauuugcuggaucaua

SEQ ID NO: 818994 - RNA, 19 nt, Homo sapiens
gugugacccucuccuguaa

SEQ ID NO: 818995 - RNA, 19 nt, Homo sapiens
caucaagaguacaggaaau

SEQ ID NO: 818996 - RNA, 19 nt, Homo sapiens
ccacacugcuugggcacua

SEQ ID NO: 818997 - RNA, 19 nt, Homo sapiens
gguaauauuccauuguaug

SEQ ID NO: 818998 - RNA, 19 nt, Homo sapiens
guucauccauguuguagca

SEQ ID NO: 818999 - RNA, 19 nt, Homo sapiens
ccaggaaguggcaucauaa

SEQ ID NO: 819000 - RNA, 19 nt, Homo sapiens
gaaggaggacgacguuucu

SEQ ID NO: 819001 - RNA, 19 nt, Homo sapiens
caaaccagcucuccuaacc

SEQ ID NO: 819002 - RNA, 19 nt, Homo sapiens
ucugauugaucuauucuug

SEQ ID NO: 819003 - RNA, 19 nt, Homo sapiens
guggacauuuggaucguuu

SEQ ID NO: 819004 - RNA, 19 nt, Homo sapiens
uuagauaugggaagaguuu

SEQ ID NO: 819005 - RNA, 19 nt, Homo sapiens
ccucuccuguaaaguauuu

SEQ ID NO: 819006 - RNA, 19 nt, Homo sapiens
ccauggacguggcccuaaa

SEQ ID NO: 819007 - RNA, 19 nt, Homo sapiens
aaggguagcuggcuugagu

SEQ ID NO: 819008 - RNA, 19 nt, Homo sapiens
uucaguggcucucaggaua

SEQ ID NO: 819009 - RNA, 19 nt, Homo sapiens
uagcuggcuugaguaauuu

SEQ ID NO: 819010 - RNA, 19 nt, Homo sapiens
uggaaaggagaguuuguua

SEQ ID NO: 819011 - RNA, 19 nt, Homo sapiens
ggcaugaggguucugauga

SEQ ID NO: 819012 - RNA, 19 nt, Homo sapiens
gaggugugguaaagccauu

SEQ ID NO: 819013 - RNA, 19 nt, Homo sapiens
uagaaugggccuguuguaa

SEQ ID NO: 819014 - RNA, 19 nt, Homo sapiens
gugccucucuccauguuug

SEQ ID NO: 819015 - RNA, 19 nt, Homo sapiens
gaugaaggaggacgacguu

SEQ ID NO: 819016 - RNA, 19 nt, Homo sapiens
gcaucaagaguacaggaaa

SEQ ID NO: 819017 - RNA, 19 nt, Homo sapiens
uugauaagcuucgcgaguu

SEQ ID NO: 819018 - RNA, 19 nt, Homo sapiens
aaacuuaaggccacaagga

SEQ ID NO: 819019 - RNA, 19 nt, Homo sapiens
uuucaucccuaauuucuuc

SEQ ID NO: 819020 - RNA, 19 nt, Homo sapiens
acacaggguuccagaguac

SEQ ID NO: 819021 - RNA, 19 nt, Homo sapiens
cagcucugauugaucuauu

SEQ ID NO: 819022 - RNA, 19 nt, Homo sapiens
acaaagacaaggcuccaaa

SEQ ID NO: 819023 - RNA, 19 nt, Homo sapiens
uggaucauaugaaacucua

SEQ ID NO: 819024 - RNA, 19 nt, Homo sapiens
uauaguugcuguggaggaa

SEQ ID NO: 819025 - RNA, 19 nt, Homo sapiens
uuaguugguuuccauagga

SEQ ID NO: 819026 - RNA, 19 nt, Homo sapiens
aaaggagaguuuguuacuu

SEQ ID NO: 819027 - RNA, 19 nt, Homo sapiens
ggaaaggagaguuuguuac

SEQ ID NO: 819028 - RNA, 19 nt, Homo sapiens
agggcgagcugucuuucua

SEQ ID NO: 819029 - RNA, 19 nt, Homo sapiens
ggacagcucagccucuucu

SEQ ID NO: 819030 - RNA, 19 nt, Homo sapiens
uguagcauguguucaacuu

SEQ ID NO: 819031 - RNA, 19 nt, Homo sapiens
uaucccacccauuaauaua

SEQ ID NO: 819032 - RNA, 19 nt, Homo sapiens
gcggacagcucagccucuu

SEQ ID NO: 819033 - RNA, 19 nt, Homo sapiens
ugauugaucuauucuugca

SEQ ID NO: 819034 - RNA, 19 nt, Homo sapiens
ggaggggacugccauggaa

SEQ ID NO: 819035 - RNA, 19 nt, Homo sapiens
gcaccaaccacacccucaa

SEQ ID NO: 819036 - RNA, 19 nt, Homo sapiens
cuuauuggccauuugcaua

SEQ ID NO: 819037 - RNA, 19 nt, Homo sapiens
gcaugaggguucugaugac

SEQ ID NO: 819038 - RNA, 19 nt, Homo sapiens
caccuuagauaugggaaga

SEQ ID NO: 819039 - RNA, 19 nt, Homo sapiens
aaccagcucuccuaaccuu

SEQ ID NO: 819040 - RNA, 19 nt, Homo sapiens
ggauuucugggaauaaugu

SEQ ID NO: 819041 - RNA, 19 nt, Homo sapiens
ggguaauauuccauuguau

SEQ ID NO: 819042 - RNA, 19 nt, Homo sapiens
aaaguucauccauguugua

SEQ ID NO: 819043 - RNA, 19 nt, Homo sapiens
ggagauagaugaauuagua

SEQ ID NO: 819044 - RNA, 19 nt, Homo sapiens
gauggacucuugcauguua

SEQ ID NO: 819045 - RNA, 19 nt, Homo sapiens
ggaaagaccugggcagaaa

SEQ ID NO: 819046 - RNA, 19 nt, Homo sapiens
ucagaaagcuugucaauca

SEQ ID NO: 819047 - RNA, 19 nt, Homo sapiens
agaaugaacuugucaauga

SEQ ID NO: 819048 - RNA, 19 nt, Homo sapiens
caaaagaccuucaacauuu

SEQ ID NO: 819049 - RNA, 19 nt, Homo sapiens
guucaaaggugauuagauu

SEQ ID NO: 819050 - RNA, 19 nt, Homo sapiens
ggaauucuguuuaaguuug

SEQ ID NO: 819051 - RNA, 19 nt, Homo sapiens
gaauuagucugaucaaauc

SEQ ID NO: 819052 - RNA, 19 nt, Homo sapiens
ccucagaacuggagcauuu

SEQ ID NO: 819053 - RNA, 19 nt, Homo sapiens
caaggaagaucacuauaug

SEQ ID NO: 819054 - RNA, 19 nt, Homo sapiens
guacuaugcucuauugcua

SEQ ID NO: 819055 - RNA, 19 nt, Homo sapiens
ggaagaaucuauccaugug

SEQ ID NO: 819056 - RNA, 19 nt, Homo sapiens
ucaaauaccuggauaccaa

SEQ ID NO: 819057 - RNA, 19 nt, Homo sapiens
guagauggauacagaguuu

SEQ ID NO: 819058 - RNA, 19 nt, Homo sapiens
gaagagaucaacaacuuaa

SEQ ID NO: 819059 - RNA, 19 nt, Homo sapiens
ggacaugcguacuuacuug

SEQ ID NO: 819060 - RNA, 19 nt, Homo sapiens
gagaggugcugucauuuga

SEQ ID NO: 819061 - RNA, 19 nt, Homo sapiens
gaacgagccugcgcugauu

SEQ ID NO: 819062 - RNA, 19 nt, Homo sapiens
agagagaacuagcuaaauu

SEQ ID NO: 819063 - RNA, 19 nt, Homo sapiens
gaaggaagaagaucuaaga

SEQ ID NO: 819064 - RNA, 19 nt, Homo sapiens
gcccaaauuuacauuguua

SEQ ID NO: 819065 - RNA, 19 nt, Homo sapiens
ucauuagacuguagcauua

SEQ ID NO: 819066 - RNA, 19 nt, Homo sapiens
uaagagauuuguccuggua

SEQ ID NO: 819067 - RNA, 19 nt, Homo sapiens
gaaaugggccguugucugu

SEQ ID NO: 819068 - RNA, 19 nt, Homo sapiens
ccacagacaucucacauca

SEQ ID NO: 819069 - RNA, 19 nt, Homo sapiens
gaaagucccugauccacau

SEQ ID NO: 819070 - RNA, 19 nt, Homo sapiens
cagaagaccucccagagaa

SEQ ID NO: 819071 - RNA, 19 nt, Homo sapiens
gcaaaucaguagucgaguu

SEQ ID NO: 819072 - RNA, 19 nt, Homo sapiens
aaacggcuauggaagguua

SEQ ID NO: 819073 - RNA, 19 nt, Homo sapiens
gagagaaggucaugaagca

SEQ ID NO: 819074 - RNA, 19 nt, Homo sapiens
gggagggacuauuaaguaa

SEQ ID NO: 819075 - RNA, 19 nt, Homo sapiens
ggagagaggagaaaugauu

SEQ ID NO: 819076 - RNA, 19 nt, Homo sapiens
ggaaaugaagcaugucuuu

SEQ ID NO: 819077 - RNA, 19 nt, Homo sapiens
gucaaucacucauguguuu

SEQ ID NO: 819078 - RNA, 19 nt, Homo sapiens
ggauggagcugaugugaag

SEQ ID NO: 819079 - RNA, 19 nt, Homo sapiens
guagaaugguauugaauug

SEQ ID NO: 819080 - RNA, 19 nt, Homo sapiens
gcaaaagucuggagaaguu

SEQ ID NO: 819081 - RNA, 19 nt, Homo sapiens
ggacauguguauucacugu

SEQ ID NO: 819082 - RNA, 19 nt, Homo sapiens
gcagggagaccaacuuauu

SEQ ID NO: 819083 - RNA, 19 nt, Homo sapiens
acauuuggcuguuuacuaa

SEQ ID NO: 819084 - RNA, 19 nt, Homo sapiens
caaauugccugacaugaag

SEQ ID NO: 819085 - RNA, 19 nt, Homo sapiens
gggacgagcucucugaaga

SEQ ID NO: 819086 - RNA, 19 nt, Homo sapiens
ucacuacgcugacaauugu

SEQ ID NO: 819087 - RNA, 19 nt, Homo sapiens
guagguaccucuuggacuu

SEQ ID NO: 819088 - RNA, 19 nt, Homo sapiens
gaacuggagcauuuguaua

SEQ ID NO: 819089 - RNA, 19 nt, Homo sapiens
gccaauaaaugaucucuca

SEQ ID NO: 819090 - RNA, 19 nt, Homo sapiens
ggacaaggaagaucacuau

SEQ ID NO: 819091 - RNA, 19 nt, Homo sapiens
gcuaauuacuccaacgauu

SEQ ID NO: 819092 - RNA, 19 nt, Homo sapiens
agugaccucugauaaauua

SEQ ID NO: 819093 - RNA, 19 nt, Homo sapiens
caacaugaccgaacgaaga

SEQ ID NO: 819094 - RNA, 19 nt, Homo sapiens
gauguggacuuccuuagug

SEQ ID NO: 819095 - RNA, 19 nt, Homo sapiens
gcacacaugaucccaauau

SEQ ID NO: 819096 - RNA, 19 nt, Homo sapiens
gagaacaaccugcuggaaa

SEQ ID NO: 819097 - RNA, 19 nt, Homo sapiens
gagagaacuagcuaaauuu

SEQ ID NO: 819098 - RNA, 19 nt, Homo sapiens
guuguuagauguucaugaa

SEQ ID NO: 819099 - RNA, 19 nt, Homo sapiens
cagagaagcugauacaaac

SEQ ID NO: 819100 - RNA, 19 nt, Homo sapiens
auuauaggcugccaaauuu

SEQ ID NO: 819101 - RNA, 19 nt, Homo sapiens
caacuucauugaucacgaa

SEQ ID NO: 819102 - RNA, 19 nt, Homo sapiens
uaagagggccacaucuaua

SEQ ID NO: 819103 - RNA, 19 nt, Homo sapiens
gaucaaaucgugaaguaau

SEQ ID NO: 819104 - RNA, 19 nt, Homo sapiens
gcuaggauauugaaacaca

SEQ ID NO: 819105 - RNA, 19 nt, Homo sapiens
ucuaagagcucccauugau

SEQ ID NO: 819106 - RNA, 19 nt, Homo sapiens
gaaaccuaauuggcuauuu

SEQ ID NO: 819107 - RNA, 19 nt, Homo sapiens
caggaucucugcccucaaa

SEQ ID NO: 819108 - RNA, 19 nt, Homo sapiens
gccuaucuauuccaaauuu

SEQ ID NO: 819109 - RNA, 19 nt, Homo sapiens
gaaugaacuugucaaugau

SEQ ID NO: 819110 - RNA, 19 nt, Homo sapiens
gaucuaagagcucccauug

SEQ ID NO: 819111 - RNA, 19 nt, Homo sapiens
gaaaagagaaaccuaauug

SEQ ID NO: 819112 - RNA, 19 nt, Homo sapiens
gcuacuaccuugaacuguu

SEQ ID NO: 819113 - RNA, 19 nt, Homo sapiens
gaucagaauccacguaaug

SEQ ID NO: 819114 - RNA, 19 nt, Homo sapiens
caaaucacauguacccaau

SEQ ID NO: 819115 - RNA, 19 nt, Homo sapiens
aagcacaccuggcaacgua

SEQ ID NO: 819116 - RNA, 19 nt, Homo sapiens
gagaauuagucugaucaaa

SEQ ID NO: 819117 - RNA, 19 nt, Homo sapiens
cugaagagaucaacaacuu

SEQ ID NO: 819118 - RNA, 19 nt, Homo sapiens
gagcacacaugaucccaau

SEQ ID NO: 819119 - RNA, 19 nt, Homo sapiens
gaaaagagcaccagggauu

SEQ ID NO: 819120 - RNA, 19 nt, Homo sapiens
gagaccaacuuauuuagag

SEQ ID NO: 819121 - RNA, 19 nt, Homo sapiens
acagacaucucacaucaga

SEQ ID NO: 819122 - RNA, 19 nt, Homo sapiens
ccaugugucugccuccaua

SEQ ID NO: 819123 - RNA, 19 nt, Homo sapiens
gugacugugugcuaaauuu

SEQ ID NO: 819124 - RNA, 19 nt, Homo sapiens
ugagugaccucugauaaau

SEQ ID NO: 819125 - RNA, 19 nt, Homo sapiens
gaugagugaccucugauaa

SEQ ID NO: 819126 - RNA, 19 nt, Homo sapiens
gaaaugugaccaccucuca

SEQ ID NO: 819127 - RNA, 19 nt, Homo sapiens
caugauggcuuccacaaag

SEQ ID NO: 819128 - RNA, 19 nt, Homo sapiens
aaacuucaccgucuucaaa

SEQ ID NO: 819129 - RNA, 19 nt, Homo sapiens
caaaucaguagucgaguuu

SEQ ID NO: 819130 - RNA, 19 nt, Homo sapiens
ccaacgacaagaacgauua

SEQ ID NO: 819131 - RNA, 19 nt, Homo sapiens
acaaagcacuauccaguuc

SEQ ID NO: 819132 - RNA, 19 nt, Homo sapiens
aagcacaguuugagcagua

SEQ ID NO: 819133 - RNA, 19 nt, Homo sapiens
cuacuaccuugaacuguuu

SEQ ID NO: 819134 - RNA, 19 nt, Homo sapiens
gaagggacgagcucucuga

SEQ ID NO: 819135 - RNA, 19 nt, Homo sapiens
cacaaccgccacucuauua

SEQ ID NO: 819136 - RNA, 19 nt, Homo sapiens
gaucuaucgucuuugauuc

SEQ ID NO: 819137 - RNA, 19 nt, Homo sapiens
cuacccagcuuucaugaug

SEQ ID NO: 819138 - RNA, 19 nt, Homo sapiens
uguauucucuucacucuau

SEQ ID NO: 819139 - RNA, 19 nt, Homo sapiens
caacuuauuuagagcgaau

SEQ ID NO: 819140 - RNA, 19 nt, Homo sapiens
caagaaggaagaagaucua

SEQ ID NO: 819141 - RNA, 19 nt, Homo sapiens
ccuggaagcuuugugcuaa

SEQ ID NO: 819142 - RNA, 19 nt, Homo sapiens
cagauggacucuugcaugu

SEQ ID NO: 819143 - RNA, 19 nt, Homo sapiens
gaugauggcucacgcaaga

SEQ ID NO: 819144 - RNA, 19 nt, Homo sapiens
gcaaugagaagaagaugua

SEQ ID NO: 819145 - RNA, 19 nt, Homo sapiens
gcaagaaggcugaguuuau

SEQ ID NO: 819146 - RNA, 19 nt, Homo sapiens
gcaagaaguauaacuguaa

SEQ ID NO: 819147 - RNA, 19 nt, Homo sapiens
gagaagcacuguguguuug

SEQ ID NO: 819148 - RNA, 19 nt, Homo sapiens
gacuacauuucuagaguua

SEQ ID NO: 819149 - RNA, 19 nt, Homo sapiens
caagaaggcugaguuuauc

SEQ ID NO: 819150 - RNA, 19 nt, Homo sapiens
ggagaagcacuguguguuu

SEQ ID NO: 819151 - RNA, 19 nt, Homo sapiens
gagggccauuugaacauua

SEQ ID NO: 819152 - RNA, 19 nt, Homo sapiens
cgagugcagugucaaguuu

SEQ ID NO: 819153 - RNA, 19 nt, Homo sapiens
gaggaugaaucaauuuaca

SEQ ID NO: 819154 - RNA, 19 nt, Homo sapiens
gaacauuacauccaaucaa

SEQ ID NO: 819155 - RNA, 19 nt, Homo sapiens
gcgacaagcugccguucaa

SEQ ID NO: 819156 - RNA, 19 nt, Homo sapiens
ggacagugauuaaaacuau

SEQ ID NO: 819157 - RNA, 19 nt, Homo sapiens
auaagcagcuggaaaugaa

SEQ ID NO: 819158 - RNA, 19 nt, Homo sapiens
ggaguauccuugcaaucaa

SEQ ID NO: 819159 - RNA, 19 nt, Homo sapiens
cagcuggaaaugaauauua

SEQ ID NO: 819160 - RNA, 19 nt, Homo sapiens
ccaagcacaucaaggagaa

SEQ ID NO: 819161 - RNA, 19 nt, Homo sapiens
gaauauuaauggcagagau

SEQ ID NO: 819162 - RNA, 19 nt, Homo sapiens
agaagaagaugcgggauga

SEQ ID NO: 819163 - RNA, 19 nt, Homo sapiens
ggagggccauuugaacauu

SEQ ID NO: 819164 - RNA, 19 nt, Homo sapiens
gcacagcaaugagaagaag

SEQ ID NO: 819165 - RNA, 19 nt, Homo sapiens
ccacacacagcaagaagua

SEQ ID NO: 819166 - RNA, 19 nt, Homo sapiens
gagcugcagugccacauca

SEQ ID NO: 819167 - RNA, 19 nt, Homo sapiens
augaggcgcugcuauuaua

SEQ ID NO: 819168 - RNA, 19 nt, Homo sapiens
gcaguucuccucaguggaa

SEQ ID NO: 819169 - RNA, 19 nt, Homo sapiens
ugcagaagcucuacaagug

SEQ ID NO: 819170 - RNA, 19 nt, Homo sapiens
gcgaggaggaguuuauuga

SEQ ID NO: 819171 - RNA, 19 nt, Homo sapiens
cggaggagcuggagaagca

SEQ ID NO: 819172 - RNA, 19 nt, Homo sapiens
gcaucaaccacgaguguaa

SEQ ID NO: 819173 - RNA, 19 nt, Homo sapiens
cuacaugugucccaucugu

SEQ ID NO: 819174 - RNA, 19 nt, Homo sapiens
ucaaggagaaccacaagaa

SEQ ID NO: 819175 - RNA, 19 nt, Homo sapiens
acacacagcaagaaguaua

SEQ ID NO: 819176 - RNA, 19 nt, Homo sapiens
acacacugcucgcccauau

SEQ ID NO: 819177 - RNA, 19 nt, Homo sapiens
cggccaagcuccucuguca

SEQ ID NO: 819178 - RNA, 19 nt, Homo sapiens
guuccaagcgggacuuuaa

SEQ ID NO: 819179 - RNA, 19 nt, Homo sapiens
gccauacccuugccaguuc

SEQ ID NO: 819180 - RNA, 19 nt, Homo sapiens
ggacaccucuccgcagaag

SEQ ID NO: 819181 - RNA, 19 nt, Homo sapiens
ggaaaggcacccagacauc

SEQ ID NO: 819182 - RNA, 19 nt, Homo sapiens
gcuccucugucaccucauu

SEQ ID NO: 819183 - RNA, 19 nt, Homo sapiens
gcagagcgaggaggaguuu

SEQ ID NO: 819184 - RNA, 19 nt, Homo sapiens
caagaaguauaacuguaag

SEQ ID NO: 819185 - RNA, 19 nt, Homo sapiens
gagcugcgacaagcaauuu

SEQ ID NO: 819186 - RNA, 19 nt, Homo sapiens
gggaguauccuugcaauca

SEQ ID NO: 819187 - RNA, 19 nt, Homo sapiens
guaauaaugcuuucuucug

SEQ ID NO: 819188 - RNA, 19 nt, Homo sapiens
cuaaugcuuugauuggauu

SEQ ID NO: 819189 - RNA, 19 nt, Homo sapiens
ccaugaggcgcugcuauua

SEQ ID NO: 819190 - RNA, 19 nt, Homo sapiens
gaguauccuugcaaucaau

SEQ ID NO: 819191 - RNA, 19 nt, Homo sapiens
agacuacauuucuagaguu

SEQ ID NO: 819192 - RNA, 19 nt, Homo sapiens
agagagagauccaaaucca

SEQ ID NO: 819193 - RNA, 19 nt, Homo sapiens
agucacaagugcaacguuu

SEQ ID NO: 819194 - RNA, 19 nt, Homo sapiens
ccacgucgacccacuaugu

SEQ ID NO: 819195 - RNA, 19 nt, Homo sapiens
ccagcaagcccuucaagug

SEQ ID NO: 819196 - RNA, 19 nt, Homo sapiens
cagacuacauuucuagagu

SEQ ID NO: 819197 - RNA, 19 nt, Homo sapiens
agaccgagcugcagaacca

SEQ ID NO: 819198 - RNA, 19 nt, Homo sapiens
gcucacaagugcaucuucu

SEQ ID NO: 819199 - RNA, 19 nt, Homo sapiens
ucaccaagcacaucaagga

SEQ ID NO: 819200 - RNA, 19 nt, Homo sapiens
uugcuuggcuauugucuga

SEQ ID NO: 819201 - RNA, 19 nt, Homo sapiens
ugugauugcuuggcuauug

SEQ ID NO: 819202 - RNA, 19 nt, Homo sapiens
uggaugaccugcagaagca

SEQ ID NO: 819203 - RNA, 19 nt, Homo sapiens
uggcagagauuaaaaguau

SEQ ID NO: 819204 - RNA, 19 nt, Homo sapiens
ucacugcccugaggucuuc

SEQ ID NO: 819205 - RNA, 19 nt, Homo sapiens
gauuggauuugccaguuca

SEQ ID NO: 819206 - RNA, 19 nt, Homo sapiens
gaagcacuguguguuugau

SEQ ID NO: 819207 - RNA, 19 nt, Homo sapiens
ucaaugcgaccucaaguuc

SEQ ID NO: 819208 - RNA, 19 nt, Homo sapiens
ggagaaggaagccaagaag

SEQ ID NO: 819209 - RNA, 19 nt, Homo sapiens
ccacaugcaggcccacaaa

SEQ ID NO: 819210 - RNA, 19 nt, Homo sapiens
cgagagagagauccaaauc

SEQ ID NO: 819211 - RNA, 19 nt, Homo sapiens
ggagaaccacaagaacauu

SEQ ID NO: 819212 - RNA, 19 nt, Homo sapiens
ccauggguuuccuuacuga

SEQ ID NO: 819213 - RNA, 19 nt, Homo sapiens
aaccaugccuacccuguga

SEQ ID NO: 819214 - RNA, 19 nt, Homo sapiens
gcagccgccucuucaagca

SEQ ID NO: 819215 - RNA, 19 nt, Homo sapiens
gccaugaggcgcugcuauu

SEQ ID NO: 819216 - RNA, 19 nt, Homo sapiens
ucaaggaguuccgcagcaa

SEQ ID NO: 819217 - RNA, 19 nt, Homo sapiens
agcaagaaguauaacugua

SEQ ID NO: 819218 - RNA, 19 nt, Homo sapiens
gcagcgaccaccucaagau

SEQ ID NO: 819219 - RNA, 19 nt, Homo sapiens
gacuaaugcuuugauugga

SEQ ID NO: 819220 - RNA, 19 nt, Homo sapiens
agaagcaccugcgggagaa

SEQ ID NO: 819221 - RNA, 19 nt, Homo sapiens
gagaaccacaagaacauuc

SEQ ID NO: 819222 - RNA, 19 nt, Homo sapiens
cagcagagccacacauguc

SEQ ID NO: 819223 - RNA, 19 nt, Homo sapiens
agaaggaagccaagaagga

SEQ ID NO: 819224 - RNA, 19 nt, Homo sapiens
gcuuggcuauugucugaau

SEQ ID NO: 819225 - RNA, 19 nt, Homo sapiens
aguauuccaugcucaguau

SEQ ID NO: 819226 - RNA, 19 nt, Homo sapiens
uauaagcagcuggaaauga

SEQ ID NO: 819227 - RNA, 19 nt, Homo sapiens
ggcaggaggacaagaucua

SEQ ID NO: 819228 - RNA, 19 nt, Homo sapiens
gagcgaggaggaguuuauu

SEQ ID NO: 819229 - RNA, 19 nt, Homo sapiens
gugaagcacagcaaugaga

SEQ ID NO: 819230 - RNA, 19 nt, Homo sapiens
gaagaggcacgagcagauc

SEQ ID NO: 819231 - RNA, 19 nt, Homo sapiens
ucacagugcccucagaagu

SEQ ID NO: 819232 - RNA, 19 nt, Homo sapiens
gcaccugucgcaucugcaa

SEQ ID NO: 819233 - RNA, 19 nt, Homo sapiens
gugauugcuuggcuauugu

SEQ ID NO: 819234 - RNA, 19 nt, Homo sapiens
cuaaugauuuggccaugag

SEQ ID NO: 819235 - RNA, 19 nt, Homo sapiens
cugcagaaccacacgauga

SEQ ID NO: 819236 - RNA, 19 nt, Homo sapiens
ucaaaugccccguguguuu

SEQ ID NO: 819237 - RNA, 19 nt, Homo sapiens
caagugcaacguuuguuca

SEQ ID NO: 819238 - RNA, 19 nt, Homo sapiens
gaugaucggagaugguugu

SEQ ID NO: 819239 - RNA, 19 nt, Homo sapiens
gagccagcacgcacaguga

SEQ ID NO: 819240 - RNA, 19 nt, Homo sapiens
cacagugcccucagaaguu

SEQ ID NO: 819241 - RNA, 19 nt, Homo sapiens
gaacgagagagagauccaa

SEQ ID NO: 819242 - RNA, 19 nt, Homo sapiens
cccaauggccaccaagaaa

SEQ ID NO: 819243 - RNA, 19 nt, Homo sapiens
gaacugauguauuaucuug

SEQ ID NO: 819244 - RNA, 19 nt, Homo sapiens
caagggagaugagagauua

SEQ ID NO: 819245 - RNA, 19 nt, Homo sapiens
gaagagauccgagaagaua

SEQ ID NO: 819246 - RNA, 19 nt, Homo sapiens
ggaccgagaugcugauaaa

SEQ ID NO: 819247 - RNA, 19 nt, Homo sapiens
cgaaguagcuauccugaaa

SEQ ID NO: 819248 - RNA, 19 nt, Homo sapiens
gaaagaggaugauguugga

SEQ ID NO: 819249 - RNA, 19 nt, Homo sapiens
ccacagagaugacagagaa

SEQ ID NO: 819250 - RNA, 19 nt, Homo sapiens
gacacuaacuccaccuuua

SEQ ID NO: 819251 - RNA, 19 nt, Homo sapiens
caacagggaucgagauaga

SEQ ID NO: 819252 - RNA, 19 nt, Homo sapiens
gaagaugccagaucccuua

SEQ ID NO: 819253 - RNA, 19 nt, Homo sapiens
caaagaagcgcuauagaaa

SEQ ID NO: 819254 - RNA, 19 nt, Homo sapiens
gaaagagagagacuaauuu

SEQ ID NO: 819255 - RNA, 19 nt, Homo sapiens
ggaaagagagagacuaauu

SEQ ID NO: 819256 - RNA, 19 nt, Homo sapiens
ggaaagaggaggaucguaa

SEQ ID NO: 819257 - RNA, 19 nt, Homo sapiens
gagagagacuaauuucuga

SEQ ID NO: 819258 - RNA, 19 nt, Homo sapiens
gauagucacaguaguaaua

SEQ ID NO: 819259 - RNA, 19 nt, Homo sapiens
caaaggugauucugauauu

SEQ ID NO: 819260 - RNA, 19 nt, Homo sapiens
gagaagagauccgagaaga

SEQ ID NO: 819261 - RNA, 19 nt, Homo sapiens
ugaagauggucaaguauuu

SEQ ID NO: 819262 - RNA, 19 nt, Homo sapiens
cacaguggcucaagagaua

SEQ ID NO: 819263 - RNA, 19 nt, Homo sapiens
gagaagaacgagaauauga

SEQ ID NO: 819264 - RNA, 19 nt, Homo sapiens
gaacuucacagucucauga

SEQ ID NO: 819265 - RNA, 19 nt, Homo sapiens
guaccuaccuuaguuuauu

SEQ ID NO: 819266 - RNA, 19 nt, Homo sapiens
gaagaguuaucccacagaa

SEQ ID NO: 819267 - RNA, 19 nt, Homo sapiens
cuaguagcauuucaaguua

SEQ ID NO: 819268 - RNA, 19 nt, Homo sapiens
caauaaaccuagaguauac

SEQ ID NO: 819269 - RNA, 19 nt, Homo sapiens
gaucaucuauucaaagaca

SEQ ID NO: 819270 - RNA, 19 nt, Homo sapiens
guugaaaugugcaauggua

SEQ ID NO: 819271 - RNA, 19 nt, Homo sapiens
agaccaagcucaccaauuc

SEQ ID NO: 819272 - RNA, 19 nt, Homo sapiens
ggagaacccagucgaagua

SEQ ID NO: 819273 - RNA, 19 nt, Homo sapiens
ugaaagggcuagagagaga

SEQ ID NO: 819274 - RNA, 19 nt, Homo sapiens
ucaagagguucucaaauug

SEQ ID NO: 819275 - RNA, 19 nt, Homo sapiens
uaacguguauuaaccgaaa

SEQ ID NO: 819276 - RNA, 19 nt, Homo sapiens
ggacagagacagagacaga

SEQ ID NO: 819277 - RNA, 19 nt, Homo sapiens
gaaaugagucucgaaguga

SEQ ID NO: 819278 - RNA, 19 nt, Homo sapiens
guucggcccuuacuuauug

SEQ ID NO: 819279 - RNA, 19 nt, Homo sapiens
guacggaaauaaggaauga

SEQ ID NO: 819280 - RNA, 19 nt, Homo sapiens
ggucuggucuuaugccaaa

SEQ ID NO: 819281 - RNA, 19 nt, Homo sapiens
gugcagggauuugaagaua

SEQ ID NO: 819282 - RNA, 19 nt, Homo sapiens
ucaaauagagucugugaaa

SEQ ID NO: 819283 - RNA, 19 nt, Homo sapiens
ggaaugaguccagaaauga

SEQ ID NO: 819284 - RNA, 19 nt, Homo sapiens
ggugaaaggaacaacauua

SEQ ID NO: 819285 - RNA, 19 nt, Homo sapiens
ggaauaaucauaccaccaa

SEQ ID NO: 819286 - RNA, 19 nt, Homo sapiens
caaagaaacaugucagaga

SEQ ID NO: 819287 - RNA, 19 nt, Homo sapiens
caaguuagaugaugcacau

SEQ ID NO: 819288 - RNA, 19 nt, Homo sapiens
ccacagaacacgaguagaa

SEQ ID NO: 819289 - RNA, 19 nt, Homo sapiens
gaaagaggaggaucguaaa

SEQ ID NO: 819290 - RNA, 19 nt, Homo sapiens
ccaauaaaccuagaguaua

SEQ ID NO: 819291 - RNA, 19 nt, Homo sapiens
ggauuggucuggucuuaug

SEQ ID NO: 819292 - RNA, 19 nt, Homo sapiens
ggaaaucacaggagagaga

SEQ ID NO: 819293 - RNA, 19 nt, Homo sapiens
gcacaucugccaucacuau

SEQ ID NO: 819294 - RNA, 19 nt, Homo sapiens
aagaagcgcuauagaaaug

SEQ ID NO: 819295 - RNA, 19 nt, Homo sapiens
uuacccaccucuaaagaua

SEQ ID NO: 819296 - RNA, 19 nt, Homo sapiens
ccaaaguggucgaaagaga

SEQ ID NO: 819297 - RNA, 19 nt, Homo sapiens
cucaagagguucucaaauu

SEQ ID NO: 819298 - RNA, 19 nt, Homo sapiens
ucaaagugcucagugguuu

SEQ ID NO: 819299 - RNA, 19 nt, Homo sapiens
ccagaucccuuagauguga

SEQ ID NO: 819300 - RNA, 19 nt, Homo sapiens
gauaaagagagaauggaua

SEQ ID NO: 819301 - RNA, 19 nt, Homo sapiens
ucaaagaagcgcuauagaa

SEQ ID NO: 819302 - RNA, 19 nt, Homo sapiens
agagagaacuagaaagaga

SEQ ID NO: 819303 - RNA, 19 nt, Homo sapiens
gaaaaggacucaagagaag

SEQ ID NO: 819304 - RNA, 19 nt, Homo sapiens
gauacgagccaaucaguga

SEQ ID NO: 819305 - RNA, 19 nt, Homo sapiens
gagaauggauaaagaucug

SEQ ID NO: 819306 - RNA, 19 nt, Homo sapiens
cagcaucauucuccuauau

SEQ ID NO: 819307 - RNA, 19 nt, Homo sapiens
ccaccaauaccaccaauaa

SEQ ID NO: 819308 - RNA, 19 nt, Homo sapiens
gaaaggagggaagauacua

SEQ ID NO: 819309 - RNA, 19 nt, Homo sapiens
gagaacugauguauuaucu

SEQ ID NO: 819310 - RNA, 19 nt, Homo sapiens
guguguagguugagucuuu

SEQ ID NO: 819311 - RNA, 19 nt, Homo sapiens
gacuuaaccuaaacaguga

SEQ ID NO: 819312 - RNA, 19 nt, Homo sapiens
guucuuauguagcacuuaa

SEQ ID NO: 819313 - RNA, 19 nt, Homo sapiens
gaucuguucuuauguagca

SEQ ID NO: 819314 - RNA, 19 nt, Homo sapiens
gcagggauuugaagauaca

SEQ ID NO: 819315 - RNA, 19 nt, Homo sapiens
cgagauagauugcgagaac

SEQ ID NO: 819316 - RNA, 19 nt, Homo sapiens
gauaugaacacgacagaga

SEQ ID NO: 819317 - RNA, 19 nt, Homo sapiens
agaacgagaucgauaugaa

SEQ ID NO: 819318 - RNA, 19 nt, Homo sapiens
gaagaaucccggaguuaug

SEQ ID NO: 819319 - RNA, 19 nt, Homo sapiens
agacaucgcucuccaaugc

SEQ ID NO: 819320 - RNA, 19 nt, Homo sapiens
gaacuccuucaccaucuua

SEQ ID NO: 819321 - RNA, 19 nt, Homo sapiens
ucaguaggcacaccacuua

SEQ ID NO: 819322 - RNA, 19 nt, Homo sapiens
cgaacuagaugaaauucug

SEQ ID NO: 819323 - RNA, 19 nt, Homo sapiens
acaaauaaauccgagagaa

SEQ ID NO: 819324 - RNA, 19 nt, Homo sapiens
caaucaggaucaucuauuc

SEQ ID NO: 819325 - RNA, 19 nt, Homo sapiens
ucacucaucuuccucacaa

SEQ ID NO: 819326 - RNA, 19 nt, Homo sapiens
cggaguaaccguagucaua

SEQ ID NO: 819327 - RNA, 19 nt, Homo sapiens
gaagcagcccagcaaagua

SEQ ID NO: 819328 - RNA, 19 nt, Homo sapiens
gaagcgcuauagaaaugaa

SEQ ID NO: 819329 - RNA, 19 nt, Homo sapiens
gagagaaagggauaaagaa

SEQ ID NO: 819330 - RNA, 19 nt, Homo sapiens
ugaccucacugcagcaauu

SEQ ID NO: 819331 - RNA, 19 nt, Homo sapiens
ggauucugaucuguucuua

SEQ ID NO: 819332 - RNA, 19 nt, Homo sapiens
ggacagugaugccuacaac

SEQ ID NO: 819333 - RNA, 19 nt, Homo sapiens
caaucagacuucuucuauu

SEQ ID NO: 819334 - RNA, 19 nt, Homo sapiens
agaggaugauguuggaaua

SEQ ID NO: 819335 - RNA, 19 nt, Homo sapiens
cgagaaagagcgagagaaa

SEQ ID NO: 819336 - RNA, 19 nt, Homo sapiens
ucuaguaccuaccuuaguu

SEQ ID NO: 819337 - RNA, 19 nt, Homo sapiens
ggacagggacagagacaga

SEQ ID NO: 819338 - RNA, 19 nt, Homo sapiens
ucaaagacauucuccuucu

SEQ ID NO: 819339 - RNA, 19 nt, Homo sapiens
gaaguucuccagagucaga

SEQ ID NO: 819340 - RNA, 19 nt, Homo sapiens
agacagaaauccuggaaag

SEQ ID NO: 819341 - RNA, 19 nt, Homo sapiens
gaugaaagggcuagagaga

SEQ ID NO: 819342 - RNA, 19 nt, Homo sapiens
gaaggaaugacgagcuuga

SEQ ID NO: 819343 - RNA, 19 nt, Homo sapiens
gaacaugacucagaacuuu

SEQ ID NO: 819344 - RNA, 19 nt, Homo sapiens
ggaaggaacuugaagacua

SEQ ID NO: 819345 - RNA, 19 nt, Homo sapiens
gaaggaacuugaagacuaa

SEQ ID NO: 819346 - RNA, 19 nt, Homo sapiens
gaaagggaguauacuagua

SEQ ID NO: 819347 - RNA, 19 nt, Homo sapiens
gaagaaacauucagacuag

SEQ ID NO: 819348 - RNA, 19 nt, Homo sapiens
uaagcgcgcucaagaauuu

SEQ ID NO: 819349 - RNA, 19 nt, Homo sapiens
ucaaggagcucaucaagga

SEQ ID NO: 819350 - RNA, 19 nt, Homo sapiens
aaacagagcugcugccaau

SEQ ID NO: 819351 - RNA, 19 nt, Homo sapiens
gaagaaguauguuuaagag

SEQ ID NO: 819352 - RNA, 19 nt, Homo sapiens
ggagagcauuugauaacua

SEQ ID NO: 819353 - RNA, 19 nt, Homo sapiens
gaagaaagggaguauacua

SEQ ID NO: 819354 - RNA, 19 nt, Homo sapiens
gaacggauacggaugauug

SEQ ID NO: 819355 - RNA, 19 nt, Homo sapiens
ggaguauacuaguagguua

SEQ ID NO: 819356 - RNA, 19 nt, Homo sapiens
gagagcauuugauaacuaa

SEQ ID NO: 819357 - RNA, 19 nt, Homo sapiens
gggagaagaugaaucaguu

SEQ ID NO: 819358 - RNA, 19 nt, Homo sapiens
ggagaaacgucacuuugga

SEQ ID NO: 819359 - RNA, 19 nt, Homo sapiens
gaaguuugcagauuccuua

SEQ ID NO: 819360 - RNA, 19 nt, Homo sapiens
gauaguagcugggaacugu

SEQ ID NO: 819361 - RNA, 19 nt, Homo sapiens
ccaaacagcauccuuaauu

SEQ ID NO: 819362 - RNA, 19 nt, Homo sapiens
uuuaucagcucaaggauua

SEQ ID NO: 819363 - RNA, 19 nt, Homo sapiens
caaagaaguuucaucaaag

SEQ ID NO: 819364 - RNA, 19 nt, Homo sapiens
gaauuaggguggucuacuu

SEQ ID NO: 819365 - RNA, 19 nt, Homo sapiens
gaaagauguuugaguuugu

SEQ ID NO: 819366 - RNA, 19 nt, Homo sapiens
ggaaugagaauuaagaaug

SEQ ID NO: 819367 - RNA, 19 nt, Homo sapiens
agagaaagauguuugaguu

SEQ ID NO: 819368 - RNA, 19 nt, Homo sapiens
gaugagauguguauagcaa

SEQ ID NO: 819369 - RNA, 19 nt, Homo sapiens
uagaacagcuccaagaaga

SEQ ID NO: 819370 - RNA, 19 nt, Homo sapiens
agaugaagcucaggauuua

SEQ ID NO: 819371 - RNA, 19 nt, Homo sapiens
cuaguaaccucuugagauu

SEQ ID NO: 819372 - RNA, 19 nt, Homo sapiens
gaacaaaggaacagcauca

SEQ ID NO: 819373 - RNA, 19 nt, Homo sapiens
ggacaagaccaacaaauuc

SEQ ID NO: 819374 - RNA, 19 nt, Homo sapiens
gagaaugaauugguuauca

SEQ ID NO: 819375 - RNA, 19 nt, Homo sapiens
gaagucagauagaaauagu

SEQ ID NO: 819376 - RNA, 19 nt, Homo sapiens
gaauaugagccaaugagua

SEQ ID NO: 819377 - RNA, 19 nt, Homo sapiens
gaaugagaauuaagaaugg

SEQ ID NO: 819378 - RNA, 19 nt, Homo sapiens
caagauaucaggccagaaa

SEQ ID NO: 819379 - RNA, 19 nt, Homo sapiens
ggaauuauuucucagucuu

SEQ ID NO: 819380 - RNA, 19 nt, Homo sapiens
gaaucugucucaucaaauc

SEQ ID NO: 819381 - RNA, 19 nt, Homo sapiens
gaacaaagacagccagagu

SEQ ID NO: 819382 - RNA, 19 nt, Homo sapiens
gacgggaagucacucauaa

SEQ ID NO: 819383 - RNA, 19 nt, Homo sapiens
caaacagcauccuuaauuc

SEQ ID NO: 819384 - RNA, 19 nt, Homo sapiens
ggagaaguuucgaaaggaa

SEQ ID NO: 819385 - RNA, 19 nt, Homo sapiens
agaaacagaugaugagaug

SEQ ID NO: 819386 - RNA, 19 nt, Homo sapiens
cauaggagaugcagaaaca

SEQ ID NO: 819387 - RNA, 19 nt, Homo sapiens
uaacacauuugaugagguu

SEQ ID NO: 819388 - RNA, 19 nt, Homo sapiens
gaaggaaagagaagacauu

SEQ ID NO: 819389 - RNA, 19 nt, Homo sapiens
caacgggauuccaaacaaa

SEQ ID NO: 819390 - RNA, 19 nt, Homo sapiens
gaaagaaucucagcuucag

SEQ ID NO: 819391 - RNA, 19 nt, Homo sapiens
gagacauucuucugauaaa

SEQ ID NO: 819392 - RNA, 19 nt, Homo sapiens
gaacagcuccaagaagaaa

SEQ ID NO: 819393 - RNA, 19 nt, Homo sapiens
gcaggugguugcagcauug

SEQ ID NO: 819394 - RNA, 19 nt, Homo sapiens
gagauacaauccagucuuc

SEQ ID NO: 819395 - RNA, 19 nt, Homo sapiens
aaaguauuguggcaucuua

SEQ ID NO: 819396 - RNA, 19 nt, Homo sapiens
ggauacggaugauugagaa

SEQ ID NO: 819397 - RNA, 19 nt, Homo sapiens
uaaacuagaaggucaagua

SEQ ID NO: 819398 - RNA, 19 nt, Homo sapiens
gcuccagacucaauuagaa

SEQ ID NO: 819399 - RNA, 19 nt, Homo sapiens
ggucaaguaucacuagaau

SEQ ID NO: 819400 - RNA, 19 nt, Homo sapiens
uguaaucugucccaucaua

SEQ ID NO: 819401 - RNA, 19 nt, Homo sapiens
agaaagagaugagucaguu

SEQ ID NO: 819402 - RNA, 19 nt, Homo sapiens
uaacuaagaggaagacuug

SEQ ID NO: 819403 - RNA, 19 nt, Homo sapiens
caucauggacaucaaauuu

SEQ ID NO: 819404 - RNA, 19 nt, Homo sapiens
gaacacaagaaaucgcuuu

SEQ ID NO: 819405 - RNA, 19 nt, Homo sapiens
ggcagagaaucagguauua

SEQ ID NO: 819406 - RNA, 19 nt, Homo sapiens
aaucagggaaugagaauua

SEQ ID NO: 819407 - RNA, 19 nt, Homo sapiens
caacagaguuauccguauc

SEQ ID NO: 819408 - RNA, 19 nt, Homo sapiens
gagaagagguuuugcuuug

SEQ ID NO: 819409 - RNA, 19 nt, Homo sapiens
ggacuucaagacacaguua

SEQ ID NO: 819410 - RNA, 19 nt, Homo sapiens
cuauuacgcuucucaaaga

SEQ ID NO: 819411 - RNA, 19 nt, Homo sapiens
gcacaggaucaaggaauua

SEQ ID NO: 819412 - RNA, 19 nt, Homo sapiens
gaaagaggaagucagauag

SEQ ID NO: 819413 - RNA, 19 nt, Homo sapiens
gcacuacuguacauaucaa

SEQ ID NO: 819414 - RNA, 19 nt, Homo sapiens
cacaagaaaucgcuuugaa

SEQ ID NO: 819415 - RNA, 19 nt, Homo sapiens
ucccugagcuuucccagua

SEQ ID NO: 819416 - RNA, 19 nt, Homo sapiens
gcaugucccucccucuuga

SEQ ID NO: 819417 - RNA, 19 nt, Homo sapiens
caaaggaacagcaucauca

SEQ ID NO: 819418 - RNA, 19 nt, Homo sapiens
ucauugagauccuaauaga

SEQ ID NO: 819419 - RNA, 19 nt, Homo sapiens
caagggcuguaucgaauug

SEQ ID NO: 819420 - RNA, 19 nt, Homo sapiens
gaacuucggcaacagaaug

SEQ ID NO: 819421 - RNA, 19 nt, Homo sapiens
agacagaacucaagaaagc

SEQ ID NO: 819422 - RNA, 19 nt, Homo sapiens
caagacagaacucaagaaa

SEQ ID NO: 819423 - RNA, 19 nt, Homo sapiens
ucagguguauuucuuggua

SEQ ID NO: 819424 - RNA, 19 nt, Homo sapiens
cguauggccuauaguuuaa

SEQ ID NO: 819425 - RNA, 19 nt, Homo sapiens
acuguucccuuucugauua

SEQ ID NO: 819426 - RNA, 19 nt, Homo sapiens
cagaggagagcauuugaua

SEQ ID NO: 819427 - RNA, 19 nt, Homo sapiens
ggacgggaagucacucaua

SEQ ID NO: 819428 - RNA, 19 nt, Homo sapiens
ugaguuggcucugauuuga

SEQ ID NO: 819429 - RNA, 19 nt, Homo sapiens
guuguaaucugucccauca

SEQ ID NO: 819430 - RNA, 19 nt, Homo sapiens
aagaagaccuugggaaaug

SEQ ID NO: 819431 - RNA, 19 nt, Homo sapiens
gcucaggauuuaaauaagu

SEQ ID NO: 819432 - RNA, 19 nt, Homo sapiens
ucagugguguucagucuuu

SEQ ID NO: 819433 - RNA, 19 nt, Homo sapiens
uaaguuaguugcucacaca

SEQ ID NO: 819434 - RNA, 19 nt, Homo sapiens
cagccaacaugcaucagua

SEQ ID NO: 819435 - RNA, 19 nt, Homo sapiens
caggaccacucaugaugua

SEQ ID NO: 819436 - RNA, 19 nt, Homo sapiens
gagcaagggcuguaucgaa

SEQ ID NO: 819437 - RNA, 19 nt, Homo sapiens
caaggacucuucacuuucu

SEQ ID NO: 819438 - RNA, 19 nt, Homo sapiens
ucaaguaucacuagaauuc

SEQ ID NO: 819439 - RNA, 19 nt, Homo sapiens
gcaacagaaugaugaacug

SEQ ID NO: 819440 - RNA, 19 nt, Homo sapiens
ggauaaacuucagaauaug

SEQ ID NO: 819441 - RNA, 19 nt, Homo sapiens
gaagcucaggauuuaaaua

SEQ ID NO: 819442 - RNA, 19 nt, Homo sapiens
aguaaccucuugagauuaa

SEQ ID NO: 819443 - RNA, 19 nt, Homo sapiens
gaagaaaguugaggaagaa

SEQ ID NO: 819444 - RNA, 19 nt, Homo sapiens
caaauaaccuccagcauuc

SEQ ID NO: 819445 - RNA, 19 nt, Homo sapiens
gaagaagucgcauuagaua

SEQ ID NO: 819446 - RNA, 19 nt, Homo sapiens
ggaggagucugcaggauuu

SEQ ID NO: 819447 - RNA, 19 nt, Homo sapiens
ggacacugcugcaaacuug

SEQ ID NO: 819448 - RNA, 19 nt, Homo sapiens
gaugaaagauguuuaagag

SEQ ID NO: 819449 - RNA, 19 nt, Homo sapiens
ggaggaagaagucgcauua

SEQ ID NO: 819450 - RNA, 19 nt, Homo sapiens
caaagaggaugaacagaug

SEQ ID NO: 819451 - RNA, 19 nt, Homo sapiens
gguccuaccucgagcauaa

SEQ ID NO: 819452 - RNA, 19 nt, Homo sapiens
gaaagaaaccugaggagau

SEQ ID NO: 819453 - RNA, 19 nt, Homo sapiens
guucgugaauggaauaaua

SEQ ID NO: 819454 - RNA, 19 nt, Homo sapiens
cagcugaaaugaauguuaa

SEQ ID NO: 819455 - RNA, 19 nt, Homo sapiens
gagcuagagccuaaauuua

SEQ ID NO: 819456 - RNA, 19 nt, Homo sapiens
aaagaaaccugaggagauu

SEQ ID NO: 819457 - RNA, 19 nt, Homo sapiens
caggaaauauggagaaaga

SEQ ID NO: 819458 - RNA, 19 nt, Homo sapiens
ggaaauauggagaaagaaa

SEQ ID NO: 819459 - RNA, 19 nt, Homo sapiens
gagcauaagaccucaauga

SEQ ID NO: 819460 - RNA, 19 nt, Homo sapiens
cuaccuaacuccaauuuau

SEQ ID NO: 819461 - RNA, 19 nt, Homo sapiens
ggagcuagagccuaaauuu

SEQ ID NO: 819462 - RNA, 19 nt, Homo sapiens
uagagagucugaauucaaa

SEQ ID NO: 819463 - RNA, 19 nt, Homo sapiens
gcaggaucgugcuaucuaa

SEQ ID NO: 819464 - RNA, 19 nt, Homo sapiens
ucaaauaaccuccagcauu

SEQ ID NO: 819465 - RNA, 19 nt, Homo sapiens
ccaaccagcugaaaugaau

SEQ ID NO: 819466 - RNA, 19 nt, Homo sapiens
gaaaauacacccaaagaaa

SEQ ID NO: 819467 - RNA, 19 nt, Homo sapiens
uggaggagguguugacuuu

SEQ ID NO: 819468 - RNA, 19 nt, Homo sapiens
gaaaguucgugaauggaau

SEQ ID NO: 819469 - RNA, 19 nt, Homo sapiens
gaagauagagagucugaau

SEQ ID NO: 819470 - RNA, 19 nt, Homo sapiens
gaaaauaaacaccggcuua

SEQ ID NO: 819471 - RNA, 19 nt, Homo sapiens
aaacguagacgacggagua

SEQ ID NO: 819472 - RNA, 19 nt, Homo sapiens
cauaagaccucaaugaacu

SEQ ID NO: 819473 - RNA, 19 nt, Homo sapiens
ugaacugucucuuguaaau

SEQ ID NO: 819474 - RNA, 19 nt, Homo sapiens
caaggaaacagaacaaaug

SEQ ID NO: 819475 - RNA, 19 nt, Homo sapiens
ggaagaagucgcauuagau

SEQ ID NO: 819476 - RNA, 19 nt, Homo sapiens
caucugaacugucucuugu

SEQ ID NO: 819477 - RNA, 19 nt, Homo sapiens
agaagaaaguugaggaaga

SEQ ID NO: 819478 - RNA, 19 nt, Homo sapiens
ccaagaagaagcuuauuga

SEQ ID NO: 819479 - RNA, 19 nt, Homo sapiens
gaggucagccguaugauga

SEQ ID NO: 819480 - RNA, 19 nt, Homo sapiens
uaacgacuguucuguguca

SEQ ID NO: 819481 - RNA, 19 nt, Homo sapiens
gguaacgacuguucugugu

SEQ ID NO: 819482 - RNA, 19 nt, Homo sapiens
gaauaauggugcagguugu

SEQ ID NO: 819483 - RNA, 19 nt, Homo sapiens
gcuaucagcuucaauuugc

SEQ ID NO: 819484 - RNA, 19 nt, Homo sapiens
caccaaaucccaauuaaug

SEQ ID NO: 819485 - RNA, 19 nt, Homo sapiens
caaauucgccugaugaaag

SEQ ID NO: 819486 - RNA, 19 nt, Homo sapiens
ggugcagguuguagaauuu

SEQ ID NO: 819487 - RNA, 19 nt, Homo sapiens
gcagcaacuugaacaacaa

SEQ ID NO: 819488 - RNA, 19 nt, Homo sapiens
acaaauggcugaaaagaaa

SEQ ID NO: 819489 - RNA, 19 nt, Homo sapiens
ccaaauauacacccucauu

SEQ ID NO: 819490 - RNA, 19 nt, Homo sapiens
caugaaaguucgugaaugg

SEQ ID NO: 819491 - RNA, 19 nt, Homo sapiens
gcugagaugaccuucuuua

SEQ ID NO: 819492 - RNA, 19 nt, Homo sapiens
gcauauuuccuacaucuga

SEQ ID NO: 819493 - RNA, 19 nt, Homo sapiens
gaaucauacucuccaggaa

SEQ ID NO: 819494 - RNA, 19 nt, Homo sapiens
gcaacuggcaucauaaaca

SEQ ID NO: 819495 - RNA, 19 nt, Homo sapiens
acacaucuauagccagaaa

SEQ ID NO: 819496 - RNA, 19 nt, Homo sapiens
gagaaaaucaagccaaaua

SEQ ID NO: 819497 - RNA, 19 nt, Homo sapiens
uagcugagaugaccuucuu

SEQ ID NO: 819498 - RNA, 19 nt, Homo sapiens
ccagaaagcuuccaauacc

SEQ ID NO: 819499 - RNA, 19 nt, Homo sapiens
uuucagagccagaaucaua

SEQ ID NO: 819500 - RNA, 19 nt, Homo sapiens
gacgacagccuacaaacaa

SEQ ID NO: 819501 - RNA, 19 nt, Homo sapiens
aaacugagacagagaguga

SEQ ID NO: 819502 - RNA, 19 nt, Homo sapiens
gagauuaaugucagaagaa

SEQ ID NO: 819503 - RNA, 19 nt, Homo sapiens
ucugaacugucucuuguaa

SEQ ID NO: 819504 - RNA, 19 nt, Homo sapiens
gacauggucuacacaguca

SEQ ID NO: 819505 - RNA, 19 nt, Homo sapiens
gauagagagucugaauuca

SEQ ID NO: 819506 - RNA, 19 nt, Homo sapiens
agaccucaaugaacuauau

SEQ ID NO: 819507 - RNA, 19 nt, Homo sapiens
caacuggcaucauaaacag

SEQ ID NO: 819508 - RNA, 19 nt, Homo sapiens
gcaacagacgacagaaauu

SEQ ID NO: 819509 - RNA, 19 nt, Homo sapiens
uaaugaagaugaagaacag

SEQ ID NO: 819510 - RNA, 19 nt, Homo sapiens
cugaggagauugaaguuug

SEQ ID NO: 819511 - RNA, 19 nt, Homo sapiens
gaucggcgagguggauuua

SEQ ID NO: 819512 - RNA, 19 nt, Homo sapiens
caacagacgacagaaauuc

SEQ ID NO: 819513 - RNA, 19 nt, Homo sapiens
aaauaaagccaccuaaaca

SEQ ID NO: 819514 - RNA, 19 nt, Homo sapiens
gaaaauaaagccaccuaaa

SEQ ID NO: 819515 - RNA, 19 nt, Homo sapiens
gggacucacucuaaaauuu

SEQ ID NO: 819516 - RNA, 19 nt, Homo sapiens
caacaaggaaacagaacaa

SEQ ID NO: 819517 - RNA, 19 nt, Homo sapiens
uaauggcaaucuuagcaaa

SEQ ID NO: 819518 - RNA, 19 nt, Homo sapiens
gauaauggcaaucuuagca

SEQ ID NO: 819519 - RNA, 19 nt, Homo sapiens
gaaagggccagggaaguug

SEQ ID NO: 819520 - RNA, 19 nt, Homo sapiens
caauuaauguuaccugaac

SEQ ID NO: 819521 - RNA, 19 nt, Homo sapiens
gggcuuaggugauucucau

SEQ ID NO: 819522 - RNA, 19 nt, Homo sapiens
ucaaauuccuucagcuauc

SEQ ID NO: 819523 - RNA, 19 nt, Homo sapiens
ccaaagaggaugaacagau

SEQ ID NO: 819524 - RNA, 19 nt, Homo sapiens
aaauauacacccucauuga

SEQ ID NO: 819525 - RNA, 19 nt, Homo sapiens
caaauauacacccucauug

SEQ ID NO: 819526 - RNA, 19 nt, Homo sapiens
gaguggaaguuggugguaa

SEQ ID NO: 819527 - RNA, 19 nt, Homo sapiens
ggacgacagccuacaaaca

SEQ ID NO: 819528 - RNA, 19 nt, Homo sapiens
aaauucgccugaugaaaga

SEQ ID NO: 819529 - RNA, 19 nt, Homo sapiens
aggaagaagucgcauuaga

SEQ ID NO: 819530 - RNA, 19 nt, Homo sapiens
ccaaaucccaauuaauguu

SEQ ID NO: 819531 - RNA, 19 nt, Homo sapiens
uagcaccaaaucccaauua

SEQ ID NO: 819532 - RNA, 19 nt, Homo sapiens
cagacugaaugaauuugaa

SEQ ID NO: 819533 - RNA, 19 nt, Homo sapiens
gacacuaccuaacuccaau

SEQ ID NO: 819534 - RNA, 19 nt, Homo sapiens
ccaccauucuucuuuaucu

SEQ ID NO: 819535 - RNA, 19 nt, Homo sapiens
ggucagccguaugaugaaa

SEQ ID NO: 819536 - RNA, 19 nt, Homo sapiens
ggugaggucagccguauga

SEQ ID NO: 819537 - RNA, 19 nt, Homo sapiens
gcaccaaaucccaauuaau

SEQ ID NO: 819538 - RNA, 19 nt, Homo sapiens
ggccaaagauguuguaacc

SEQ ID NO: 819539 - RNA, 19 nt, Homo sapiens
caagucugcuagugucuuc

SEQ ID NO: 819540 - RNA, 19 nt, Homo sapiens
ugauggagcgccagaauug

SEQ ID NO: 819541 - RNA, 19 nt, Homo sapiens
acaacuacaugcaucugaa

SEQ ID NO: 819542 - RNA, 19 nt, Homo sapiens
ggauuuauucgcauauuuc

SEQ ID NO: 819543 - RNA, 19 nt, Homo sapiens
gaagaaaucagucgaauua

SEQ ID NO: 819544 - RNA, 19 nt, Homo sapiens
ggagaucacugaaucauuu

SEQ ID NO: 819545 - RNA, 19 nt, Homo sapiens
gcaaugcuguuaucaauga

SEQ ID NO: 819546 - RNA, 19 nt, Homo sapiens
caaacugguucgugaauua

SEQ ID NO: 819547 - RNA, 19 nt, Homo sapiens
gcacuuugcuggaugguaa

SEQ ID NO: 819548 - RNA, 19 nt, Homo sapiens
ugaagaagcuccugauuau

SEQ ID NO: 819549 - RNA, 19 nt, Homo sapiens
gaacucagcuuaugcaaaa

SEQ ID NO: 819550 - RNA, 19 nt, Homo sapiens
ggacacagcaugaauuuga

SEQ ID NO: 819551 - RNA, 19 nt, Homo sapiens
gaagaucauugcugaguug

SEQ ID NO: 819552 - RNA, 19 nt, Homo sapiens
agaaagagcuggcuaccaa

SEQ ID NO: 819553 - RNA, 19 nt, Homo sapiens
gaaaucagucgaauuaaug

SEQ ID NO: 819554 - RNA, 19 nt, Homo sapiens
gcaaggaaaugcucuuaca

SEQ ID NO: 819555 - RNA, 19 nt, Homo sapiens
caaggcaacucgaccagua

SEQ ID NO: 819556 - RNA, 19 nt, Homo sapiens
gaggugagcuacauggaaa

SEQ ID NO: 819557 - RNA, 19 nt, Homo sapiens
ugagcuacauggaaauuua

SEQ ID NO: 819558 - RNA, 19 nt, Homo sapiens
ugggauagcucucugcaua

SEQ ID NO: 819559 - RNA, 19 nt, Homo sapiens
ggaugaagcugcaguugau

SEQ ID NO: 819560 - RNA, 19 nt, Homo sapiens
ggaagaagaggaagaaguu

SEQ ID NO: 819561 - RNA, 19 nt, Homo sapiens
gaagggaaaugccaaggau

SEQ ID NO: 819562 - RNA, 19 nt, Homo sapiens
ucugauaucucuccaauug

SEQ ID NO: 819563 - RNA, 19 nt, Homo sapiens
aagaugagauggaggauuu

SEQ ID NO: 819564 - RNA, 19 nt, Homo sapiens
gcaaugccguguaccuaaa

SEQ ID NO: 819565 - RNA, 19 nt, Homo sapiens
caaagggacucgcuuaaag

SEQ ID NO: 819566 - RNA, 19 nt, Homo sapiens
ggucaucacuccuccagaa

SEQ ID NO: 819567 - RNA, 19 nt, Homo sapiens
aaacuuggcuguaacuuca

SEQ ID NO: 819568 - RNA, 19 nt, Homo sapiens
gcacaugccuguaauucca

SEQ ID NO: 819569 - RNA, 19 nt, Homo sapiens
ucucagaucucaaccacua

SEQ ID NO: 819570 - RNA, 19 nt, Homo sapiens
gccauccucucccuaaaua

SEQ ID NO: 819571 - RNA, 19 nt, Homo sapiens
ggagagagaggcuuuguug

SEQ ID NO: 819572 - RNA, 19 nt, Homo sapiens
caacuguaaugaagaaaug

SEQ ID NO: 819573 - RNA, 19 nt, Homo sapiens
gagccaagaucgcgcuauu

SEQ ID NO: 819574 - RNA, 19 nt, Homo sapiens
gacuguaaguugucugaua

SEQ ID NO: 819575 - RNA, 19 nt, Homo sapiens
gauuauggcucuggaauuc

SEQ ID NO: 819576 - RNA, 19 nt, Homo sapiens
gcagcgaucccuucuauga

SEQ ID NO: 819577 - RNA, 19 nt, Homo sapiens
gaaggagcaaucaucaaua

SEQ ID NO: 819578 - RNA, 19 nt, Homo sapiens
gaauuagugccaugucaua

SEQ ID NO: 819579 - RNA, 19 nt, Homo sapiens
ccauugcucuguacucuuu

SEQ ID NO: 819580 - RNA, 19 nt, Homo sapiens
acaauacggucaaagcuuu

SEQ ID NO: 819581 - RNA, 19 nt, Homo sapiens
gcucaguggucucuaagaa

SEQ ID NO: 819582 - RNA, 19 nt, Homo sapiens
ugaggaaacuuggcuguaa

SEQ ID NO: 819583 - RNA, 19 nt, Homo sapiens
gaucauugcugaguugaau

SEQ ID NO: 819584 - RNA, 19 nt, Homo sapiens
ccacaaggcgggaguguuu

SEQ ID NO: 819585 - RNA, 19 nt, Homo sapiens
cugagugccuacuuuauua

SEQ ID NO: 819586 - RNA, 19 nt, Homo sapiens
ggaaauuuacugugaaaga

SEQ ID NO: 819587 - RNA, 19 nt, Homo sapiens
ggaagcuauugaacguuua

SEQ ID NO: 819588 - RNA, 19 nt, Homo sapiens
gaaauuuacugugaaagag

SEQ ID NO: 819589 - RNA, 19 nt, Homo sapiens
ugacaacuguaaugaagaa

SEQ ID NO: 819590 - RNA, 19 nt, Homo sapiens
gaagacaccaaacaccuuu

SEQ ID NO: 819591 - RNA, 19 nt, Homo sapiens
gaaguccccuggccuuuua

SEQ ID NO: 819592 - RNA, 19 nt, Homo sapiens
caguagaaguccaggauuu

SEQ ID NO: 819593 - RNA, 19 nt, Homo sapiens
ggaaauggaagucucauca

SEQ ID NO: 819594 - RNA, 19 nt, Homo sapiens
caacuacgaugagacuuug

SEQ ID NO: 819595 - RNA, 19 nt, Homo sapiens
aaggagcaaucaucaauaa

SEQ ID NO: 819596 - RNA, 19 nt, Homo sapiens
ggaaggagcaaucaucaau

SEQ ID NO: 819597 - RNA, 19 nt, Homo sapiens
gaggagacaucuggccuuu

SEQ ID NO: 819598 - RNA, 19 nt, Homo sapiens
gaaugaaacuugggaagag

SEQ ID NO: 819599 - RNA, 19 nt, Homo sapiens
caagcucaguggucucuaa

SEQ ID NO: 819600 - RNA, 19 nt, Homo sapiens
gagacagccucauccuuga

SEQ ID NO: 819601 - RNA, 19 nt, Homo sapiens
aaccaagccuauuguauuu

SEQ ID NO: 819602 - RNA, 19 nt, Homo sapiens
aaaccaagccuauuguauu

SEQ ID NO: 819603 - RNA, 19 nt, Homo sapiens
gaaggugcaguuucaguuu

SEQ ID NO: 819604 - RNA, 19 nt, Homo sapiens
ggccuuaugucuucaucua

SEQ ID NO: 819605 - RNA, 19 nt, Homo sapiens
guaacugggcuaaacauuu

SEQ ID NO: 819606 - RNA, 19 nt, Homo sapiens
ccaagccuauuguauuuga

SEQ ID NO: 819607 - RNA, 19 nt, Homo sapiens
gaauggagcaacacacuau

SEQ ID NO: 819608 - RNA, 19 nt, Homo sapiens
gaagaaacacgauaaugag

SEQ ID NO: 819609 - RNA, 19 nt, Homo sapiens
agaagaaacacgauaauga

SEQ ID NO: 819610 - RNA, 19 nt, Homo sapiens
agacauugcugaccucaug

SEQ ID NO: 819611 - RNA, 19 nt, Homo sapiens
caaaucaugacaacuguaa

SEQ ID NO: 819612 - RNA, 19 nt, Homo sapiens
ccuuaugucuucaucuaua

SEQ ID NO: 819613 - RNA, 19 nt, Homo sapiens
uaacugggcuaaacauuuu

SEQ ID NO: 819614 - RNA, 19 nt, Homo sapiens
ucagaaaccuacguaaaug

SEQ ID NO: 819615 - RNA, 19 nt, Homo sapiens
gaaguuaucgugaccuuag

SEQ ID NO: 819616 - RNA, 19 nt, Homo sapiens
aaacagaggccaucagaau

SEQ ID NO: 819617 - RNA, 19 nt, Homo sapiens
uaaaugcaaugcuguuauc

SEQ ID NO: 819618 - RNA, 19 nt, Homo sapiens
uauguaauccuguggcuua

SEQ ID NO: 819619 - RNA, 19 nt, Homo sapiens
gacggugacucuuguaugu

SEQ ID NO: 819620 - RNA, 19 nt, Homo sapiens
caaggagccucuuuacagu

SEQ ID NO: 819621 - RNA, 19 nt, Homo sapiens
uaaguugucugauaucucu

SEQ ID NO: 819622 - RNA, 19 nt, Homo sapiens
gcacagugguagcaguaga

SEQ ID NO: 819623 - RNA, 19 nt, Homo sapiens
gggcucacauuaaagaaga

SEQ ID NO: 819624 - RNA, 19 nt, Homo sapiens
uggcaucauuccacaguua

SEQ ID NO: 819625 - RNA, 19 nt, Homo sapiens
uuucuggacugcauauaua

SEQ ID NO: 819626 - RNA, 19 nt, Homo sapiens
cugcauaacucccuucuuc

SEQ ID NO: 819627 - RNA, 19 nt, Homo sapiens
gaauaagccugagguggau

SEQ ID NO: 819628 - RNA, 19 nt, Homo sapiens
gagcaaucaucaauaaguc

SEQ ID NO: 819629 - RNA, 19 nt, Homo sapiens
gcccagaauuugaacaguu

SEQ ID NO: 819630 - RNA, 19 nt, Homo sapiens
gcucagaaaccuacguaaa

SEQ ID NO: 819631 - RNA, 19 nt, Homo sapiens
caaugaagacccacuaaug

SEQ ID NO: 819632 - RNA, 19 nt, Homo sapiens
caagagaggaucaugucua

SEQ ID NO: 819633 - RNA, 19 nt, Homo sapiens
gauaucaacuacgaugaga

SEQ ID NO: 819634 - RNA, 19 nt, Homo sapiens
cuacaaacaugaaugaaac

SEQ ID NO: 819635 - RNA, 19 nt, Homo sapiens
gaccaccucugaugucugu

SEQ ID NO: 819636 - RNA, 19 nt, Homo sapiens
gugaaucuccaaauuauug

SEQ ID NO: 819637 - RNA, 19 nt, Homo sapiens
gcucacgccuguaauccaa

SEQ ID NO: 819638 - RNA, 19 nt, Homo sapiens
acaguuauauucugaguca

SEQ ID NO: 819639 - RNA, 19 nt, Homo sapiens
gaaagcgccaucacaccua

SEQ ID NO: 819640 - RNA, 19 nt, Homo sapiens
gaucucaaccacuaccuuu

SEQ ID NO: 819641 - RNA, 19 nt, Homo sapiens
ggaaauggagaucuuauac

SEQ ID NO: 819642 - RNA, 19 nt, Homo sapiens
gggauucuguacuuacuug

SEQ ID NO: 819643 - RNA, 19 nt, Homo sapiens
agaaagggcuccauuauga

SEQ ID NO: 819644 - RNA, 19 nt, Homo sapiens
ucagaaagguugaggauaa

SEQ ID NO: 819645 - RNA, 19 nt, Homo sapiens
acaaauggcugcuauuaaa

SEQ ID NO: 819646 - RNA, 19 nt, Homo sapiens
gagcaccugugaagaaaua

SEQ ID NO: 819647 - RNA, 19 nt, Homo sapiens
ggcaaaggguugucacuua

SEQ ID NO: 819648 - RNA, 19 nt, Homo sapiens
gaaagcacccuccaauaaa

SEQ ID NO: 819649 - RNA, 19 nt, Homo sapiens
gcacgaagcccucacaaau

SEQ ID NO: 819650 - RNA, 19 nt, Homo sapiens
gguaccacauucauuguua

SEQ ID NO: 819651 - RNA, 19 nt, Homo sapiens
gaaguggccuuuccuccaa

SEQ ID NO: 819652 - RNA, 19 nt, Homo sapiens
gaacugcucagggacauua

SEQ ID NO: 819653 - RNA, 19 nt, Homo sapiens
gagcacauguucaagcauu

SEQ ID NO: 819654 - RNA, 19 nt, Homo sapiens
gcugagagcuggaggacaa

SEQ ID NO: 819655 - RNA, 19 nt, Homo sapiens
caucauggcucuccacuca

SEQ ID NO: 819656 - RNA, 19 nt, Homo sapiens
gaccaugacugcaaggauu

SEQ ID NO: 819657 - RNA, 19 nt, Homo sapiens
gcaaaggguugucacuuag

SEQ ID NO: 819658 - RNA, 19 nt, Homo sapiens
ucacggagcucaagaccuu

SEQ ID NO: 819659 - RNA, 19 nt, Homo sapiens
ggucauauguggacaguag

SEQ ID NO: 819660 - RNA, 19 nt, Homo sapiens
gguauacccuccacuguug

SEQ ID NO: 819661 - RNA, 19 nt, Homo sapiens
aaacaaauggcugcuauua

SEQ ID NO: 819662 - RNA, 19 nt, Homo sapiens
gcacugcccuuagacaaga

SEQ ID NO: 819663 - RNA, 19 nt, Homo sapiens
ggacagcgccaauaacaau

SEQ ID NO: 819664 - RNA, 19 nt, Homo sapiens
agaaagcacccuccaauaa

SEQ ID NO: 819665 - RNA, 19 nt, Homo sapiens
gagcaggaauaucccauug

SEQ ID NO: 819666 - RNA, 19 nt, Homo sapiens
gagagcaccugugaagaaa

SEQ ID NO: 819667 - RNA, 19 nt, Homo sapiens
gaagguuuguuucaguuug

SEQ ID NO: 819668 - RNA, 19 nt, Homo sapiens
gcacagcgagucaguagaa

SEQ ID NO: 819669 - RNA, 19 nt, Homo sapiens
gaugauuucuggcucuuug

SEQ ID NO: 819670 - RNA, 19 nt, Homo sapiens
ugacagaacccagcacaua

SEQ ID NO: 819671 - RNA, 19 nt, Homo sapiens
gaccgggaguagucacuua

SEQ ID NO: 819672 - RNA, 19 nt, Homo sapiens
acacaguucugcugccaua

SEQ ID NO: 819673 - RNA, 19 nt, Homo sapiens
guuaaggaauggcugauga

SEQ ID NO: 819674 - RNA, 19 nt, Homo sapiens
ucaccacgauucaacaauu

SEQ ID NO: 819675 - RNA, 19 nt, Homo sapiens
acaauacagugucugagua

SEQ ID NO: 819676 - RNA, 19 nt, Homo sapiens
ugacaaggauucaguaagg

SEQ ID NO: 819677 - RNA, 19 nt, Homo sapiens
gaggagaagaggaaacuuu

SEQ ID NO: 819678 - RNA, 19 nt, Homo sapiens
ggagggcagugacauaauc

SEQ ID NO: 819679 - RNA, 19 nt, Homo sapiens
ccacauucauuguuaagga

SEQ ID NO: 819680 - RNA, 19 nt, Homo sapiens
gcaaggauugggugcauaa

SEQ ID NO: 819681 - RNA, 19 nt, Homo sapiens
gagaaagggcuccauuaug

SEQ ID NO: 819682 - RNA, 19 nt, Homo sapiens
cagagaaucagcuaaguuu

SEQ ID NO: 819683 - RNA, 19 nt, Homo sapiens
gacagaacccagcacauaa

SEQ ID NO: 819684 - RNA, 19 nt, Homo sapiens
gaaaagagagcaccuguga

SEQ ID NO: 819685 - RNA, 19 nt, Homo sapiens
ggacauggcucuggaaaau

SEQ ID NO: 819686 - RNA, 19 nt, Homo sapiens
aaagagagcacugcccuua

SEQ ID NO: 819687 - RNA, 19 nt, Homo sapiens
guaccacauucauuguuaa

SEQ ID NO: 819688 - RNA, 19 nt, Homo sapiens
gaacauugugcccaucauu

SEQ ID NO: 819689 - RNA, 19 nt, Homo sapiens
cuaaacaaauggcugcuau

SEQ ID NO: 819690 - RNA, 19 nt, Homo sapiens
gguuauaagugauggauag

SEQ ID NO: 819691 - RNA, 19 nt, Homo sapiens
caacccacuuuccucagua

SEQ ID NO: 819692 - RNA, 19 nt, Homo sapiens
agagagagaguuuggauuu

SEQ ID NO: 819693 - RNA, 19 nt, Homo sapiens
caaaugugaucaccacgau

SEQ ID NO: 819694 - RNA, 19 nt, Homo sapiens
gaauugcuuuccugagaau

SEQ ID NO: 819695 - RNA, 19 nt, Homo sapiens
gggcgaggguugaggcaaa

SEQ ID NO: 819696 - RNA, 19 nt, Homo sapiens
ggaaggaggccgagguuca

SEQ ID NO: 819697 - RNA, 19 nt, Homo sapiens
ggaguagucacuuaaccua

SEQ ID NO: 819698 - RNA, 19 nt, Homo sapiens
gagaagugacacaggauuu

SEQ ID NO: 819699 - RNA, 19 nt, Homo sapiens
ugcugaagcugauuuguaa

SEQ ID NO: 819700 - RNA, 19 nt, Homo sapiens
gagcugaugcuggugguua

SEQ ID NO: 819701 - RNA, 19 nt, Homo sapiens
ccacacucauucauccuuu

SEQ ID NO: 819702 - RNA, 19 nt, Homo sapiens
uaagaaagcacccuccaau

SEQ ID NO: 819703 - RNA, 19 nt, Homo sapiens
caagucaccugggaauguu

SEQ ID NO: 819704 - RNA, 19 nt, Homo sapiens
gagacaaccugggcucuuc

SEQ ID NO: 819705 - RNA, 19 nt, Homo sapiens
gagcguggcaggcaucuug

SEQ ID NO: 819706 - RNA, 19 nt, Homo sapiens
agagagcacugcccuuaga

SEQ ID NO: 819707 - RNA, 19 nt, Homo sapiens
cagaagguuuguuucaguu

SEQ ID NO: 819708 - RNA, 19 nt, Homo sapiens
uaacuuguccauccaaaug

SEQ ID NO: 819709 - RNA, 19 nt, Homo sapiens
uggaacagcugaagucaca

SEQ ID NO: 819710 - RNA, 19 nt, Homo sapiens
gaagcugauuuguaaugau

SEQ ID NO: 819711 - RNA, 19 nt, Homo sapiens
caccacgauucaacaauuu

SEQ ID NO: 819712 - RNA, 19 nt, Homo sapiens
ggacaaacacagcucagau

SEQ ID NO: 819713 - RNA, 19 nt, Homo sapiens
gaagcccucacaaaucuuu

SEQ ID NO: 819714 - RNA, 19 nt, Homo sapiens
ucaagaccuucgccaacua

SEQ ID NO: 819715 - RNA, 19 nt, Homo sapiens
cgaaagggccauauuccaa

SEQ ID NO: 819716 - RNA, 19 nt, Homo sapiens
gggcagugacauaaucaua

SEQ ID NO: 819717 - RNA, 19 nt, Homo sapiens
gagagagaguuuggauuuc

SEQ ID NO: 819718 - RNA, 19 nt, Homo sapiens
ccagaagguuuguuucagu

SEQ ID NO: 819719 - RNA, 19 nt, Homo sapiens
ggcagcuucuccaacuuua

SEQ ID NO: 819720 - RNA, 19 nt, Homo sapiens
gaggugaggaucagccuuu

SEQ ID NO: 819721 - RNA, 19 nt, Homo sapiens
ccagguaccacauucauug

SEQ ID NO: 819722 - RNA, 19 nt, Homo sapiens
ucacaagccuccucuaagc

SEQ ID NO: 819723 - RNA, 19 nt, Homo sapiens
caagggcaguauucagaga

SEQ ID NO: 819724 - RNA, 19 nt, Homo sapiens
ccacuuuccugucauuagu

SEQ ID NO: 819725 - RNA, 19 nt, Homo sapiens
agacaggaauuaaggcaau

SEQ ID NO: 819726 - RNA, 19 nt, Homo sapiens
ccaccuagcucgccaucuc

SEQ ID NO: 819727 - RNA, 19 nt, Homo sapiens
ccugggcacuguauucuga

SEQ ID NO: 819728 - RNA, 19 nt, Homo sapiens
ugaagcugauuuguaauga

SEQ ID NO: 819729 - RNA, 19 nt, Homo sapiens
uuacagauaaugacacuga

SEQ ID NO: 819730 - RNA, 19 nt, Homo sapiens
gaagcugccauuucugguu

SEQ ID NO: 819731 - RNA, 19 nt, Homo sapiens
gugccagccucgaugcuuu

SEQ ID NO: 819732 - RNA, 19 nt, Homo sapiens
aaagagagcaccugugaag

SEQ ID NO: 819733 - RNA, 19 nt, Homo sapiens
aagagaaagggcuccauua

SEQ ID NO: 819734 - RNA, 19 nt, Homo sapiens
uaagagaaagggcuccauu

SEQ ID NO: 819735 - RNA, 19 nt, Homo sapiens
ggagaagugacacaggauu

SEQ ID NO: 819736 - RNA, 19 nt, Homo sapiens
agagagaguuuggauuuca

SEQ ID NO: 819737 - RNA, 19 nt, Homo sapiens
agaggcaucucauuguaga

SEQ ID NO: 819738 - RNA, 19 nt, Homo sapiens
gcuucucccuugcuucaaa

SEQ ID NO: 819739 - RNA, 19 nt, Homo sapiens
cuaggacucugcauuucuu

SEQ ID NO: 819740 - RNA, 19 nt, Homo sapiens
ggccuaggacucugcauuu

SEQ ID NO: 819741 - RNA, 19 nt, Homo sapiens
gggcagcuucuccaacuuu

SEQ ID NO: 819742 - RNA, 19 nt, Homo sapiens
guagucacuuaaccuaugu

SEQ ID NO: 819743 - RNA, 19 nt, Homo sapiens
gagagugacuuucuaaaua

SEQ ID NO: 819744 - RNA, 19 nt, Homo sapiens
guacaaggcugacauagug

SEQ ID NO: 819745 - RNA, 19 nt, Homo sapiens
ggaauagucucuucucuuc

SEQ ID NO: 819746 - RNA, 19 nt, Homo sapiens
uaacagggauuaaagaaga

SEQ ID NO: 819747 - RNA, 19 nt, Homo sapiens
gauccuagccauuauauuu

SEQ ID NO: 819748 - RNA, 19 nt, Homo sapiens
gauauuaccucuugguugu

SEQ ID NO: 819749 - RNA, 19 nt, Homo sapiens
ggacaaaacugcccaagaa

SEQ ID NO: 819750 - RNA, 19 nt, Homo sapiens
caaaugcacugaaguuuua

SEQ ID NO: 819751 - RNA, 19 nt, Homo sapiens
ggagaagucugagagguaa

SEQ ID NO: 819752 - RNA, 19 nt, Homo sapiens
gaaaguggaagcugaguuu

SEQ ID NO: 819753 - RNA, 19 nt, Homo sapiens
ucacaacacuguaucauuc

SEQ ID NO: 819754 - RNA, 19 nt, Homo sapiens
caaagagagugguccauga

SEQ ID NO: 819755 - RNA, 19 nt, Homo sapiens
gaaagaccagcucuaagua

SEQ ID NO: 819756 - RNA, 19 nt, Homo sapiens
gcucacaucuguucuuuua

SEQ ID NO: 819757 - RNA, 19 nt, Homo sapiens
uaaacgagcaagacuaaua

SEQ ID NO: 819758 - RNA, 19 nt, Homo sapiens
cgaaacagguggacagaga

SEQ ID NO: 819759 - RNA, 19 nt, Homo sapiens
gcacuggaauguguuugua

SEQ ID NO: 819760 - RNA, 19 nt, Homo sapiens
uaaauaaguugcucacauc

SEQ ID NO: 819761 - RNA, 19 nt, Homo sapiens
aaacagggauuuauucaca

SEQ ID NO: 819762 - RNA, 19 nt, Homo sapiens
gguaugauccuagccauua

SEQ ID NO: 819763 - RNA, 19 nt, Homo sapiens
gagcaagacuaauacuaau

SEQ ID NO: 819764 - RNA, 19 nt, Homo sapiens
gcucuaaguaggccaauua

SEQ ID NO: 819765 - RNA, 19 nt, Homo sapiens
cuccagaaauuguuaguua

SEQ ID NO: 819766 - RNA, 19 nt, Homo sapiens
gaaaugguaacagggauua

SEQ ID NO: 819767 - RNA, 19 nt, Homo sapiens
ccaagcagcaguaguuaua

SEQ ID NO: 819768 - RNA, 19 nt, Homo sapiens
gagccgagaucacaccauu

SEQ ID NO: 819769 - RNA, 19 nt, Homo sapiens
gcaagacuaauacuaauga

SEQ ID NO: 819770 - RNA, 19 nt, Homo sapiens
gcaaaacucuaucucaaaa

SEQ ID NO: 819771 - RNA, 19 nt, Homo sapiens
cuacuaccaugucaucuuu

SEQ ID NO: 819772 - RNA, 19 nt, Homo sapiens
gaugagaaauugguuaaca

SEQ ID NO: 819773 - RNA, 19 nt, Homo sapiens
ggguagaauuuccugauuu

SEQ ID NO: 819774 - RNA, 19 nt, Homo sapiens
gaauggguaucuuguuugu

SEQ ID NO: 819775 - RNA, 19 nt, Homo sapiens
caacuauucugagaccuuu

SEQ ID NO: 819776 - RNA, 19 nt, Homo sapiens
uguaauaucugugcaaaga

SEQ ID NO: 819777 - RNA, 19 nt, Homo sapiens
gaugaaagcaauuaugaug

SEQ ID NO: 819778 - RNA, 19 nt, Homo sapiens
gcaggagaaucgcucgaaa

SEQ ID NO: 819779 - RNA, 19 nt, Homo sapiens
ccacaaucguacuggguua

SEQ ID NO: 819780 - RNA, 19 nt, Homo sapiens
gguaaacgagcaagacuaa

SEQ ID NO: 819781 - RNA, 19 nt, Homo sapiens
uggcuuugcuguaauguaa

SEQ ID NO: 819782 - RNA, 19 nt, Homo sapiens
ucaguuagaugauuuaggu

SEQ ID NO: 819783 - RNA, 19 nt, Homo sapiens
gcaggaugauagcuugauu

SEQ ID NO: 819784 - RNA, 19 nt, Homo sapiens
ccuauaaucccaacacuuu

SEQ ID NO: 819785 - RNA, 19 nt, Homo sapiens
cgagcaagacuaauacuaa

SEQ ID NO: 819786 - RNA, 19 nt, Homo sapiens
acacgcaccugcaagcuuu

SEQ ID NO: 819787 - RNA, 19 nt, Homo sapiens
gcuuugcuguaauguaaua

SEQ ID NO: 819788 - RNA, 19 nt, Homo sapiens
gaacugagagauggugaaa

SEQ ID NO: 819789 - RNA, 19 nt, Homo sapiens
gaggaagaguuucuguuca

SEQ ID NO: 819790 - RNA, 19 nt, Homo sapiens
guacuggguuauuuacuuc

SEQ ID NO: 819791 - RNA, 19 nt, Homo sapiens
gagaauacacucuuucaag

SEQ ID NO: 819792 - RNA, 19 nt, Homo sapiens
gggcuggaauuuguacuaa

SEQ ID NO: 819793 - RNA, 19 nt, Homo sapiens
gcagugaacuaugauugug

SEQ ID NO: 819794 - RNA, 19 nt, Homo sapiens
ucaccucaauauagcuuua

SEQ ID NO: 819795 - RNA, 19 nt, Homo sapiens
ccaguuaacucuuguaagc

SEQ ID NO: 819796 - RNA, 19 nt, Homo sapiens
gagcuaauacuaccaguuc

SEQ ID NO: 819797 - RNA, 19 nt, Homo sapiens
aauaggaucuggcccuuga

SEQ ID NO: 819798 - RNA, 19 nt, Homo sapiens
caugugacuucuuguacua

SEQ ID NO: 819799 - RNA, 19 nt, Homo sapiens
guacauacagucccagcua

SEQ ID NO: 819800 - RNA, 19 nt, Homo sapiens
gcugagaguucccugugaa

SEQ ID NO: 819801 - RNA, 19 nt, Homo sapiens
gagaaggagccacaaguug

SEQ ID NO: 819802 - RNA, 19 nt, Homo sapiens
cuaagagagugacuuucua

SEQ ID NO: 819803 - RNA, 19 nt, Homo sapiens
gauguccuguuucucauug

SEQ ID NO: 819804 - RNA, 19 nt, Homo sapiens
uaagagagugacuuucuaa

SEQ ID NO: 819805 - RNA, 19 nt, Homo sapiens
caacugaggcuaacuaaaa

SEQ ID NO: 819806 - RNA, 19 nt, Homo sapiens
guagacaaaugcacugaag

SEQ ID NO: 819807 - RNA, 19 nt, Homo sapiens
gagcaaaacucuaucucaa

SEQ ID NO: 819808 - RNA, 19 nt, Homo sapiens
uagcuucucuuaguauuga

SEQ ID NO: 819809 - RNA, 19 nt, Homo sapiens
gggaaacccuacaguccuu

SEQ ID NO: 819810 - RNA, 19 nt, Homo sapiens
auugaaacguuacugguua

SEQ ID NO: 819811 - RNA, 19 nt, Homo sapiens
auagugcccuugucaguuu

SEQ ID NO: 819812 - RNA, 19 nt, Homo sapiens
ucagagagaucggcacaug

SEQ ID NO: 819813 - RNA, 19 nt, Homo sapiens
cuaauaaguuuggaugguu

SEQ ID NO: 819814 - RNA, 19 nt, Homo sapiens
gaagacuauuuacaugauc

SEQ ID NO: 819815 - RNA, 19 nt, Homo sapiens
uaagcaagauuacaaacag

SEQ ID NO: 819816 - RNA, 19 nt, Homo sapiens
uaugagcacuggaaugugu

SEQ ID NO: 819817 - RNA, 19 nt, Homo sapiens
gcagauaggcaggauucua

SEQ ID NO: 819818 - RNA, 19 nt, Homo sapiens
cuauggagaugcuaagaga

SEQ ID NO: 819819 - RNA, 19 nt, Homo sapiens
gcaaaggcugagcagaaua

SEQ ID NO: 819820 - RNA, 19 nt, Homo sapiens
gaugaacccaagaguguuu

SEQ ID NO: 819821 - RNA, 19 nt, Homo sapiens
ucacgucaauggccuacaa

SEQ ID NO: 819822 - RNA, 19 nt, Homo sapiens
ggacauugcaggagaaguc

SEQ ID NO: 819823 - RNA, 19 nt, Homo sapiens
gaaagguaauauugcacau

SEQ ID NO: 819824 - RNA, 19 nt, Homo sapiens
agauagguauuucucauug

SEQ ID NO: 819825 - RNA, 19 nt, Homo sapiens
uagguaauguggauuuguu

SEQ ID NO: 819826 - RNA, 19 nt, Homo sapiens
acaaggucaugcugaaauu

SEQ ID NO: 819827 - RNA, 19 nt, Homo sapiens
ugaaagaccagcucuaagu

SEQ ID NO: 819828 - RNA, 19 nt, Homo sapiens
ugaaagcaauuaugaugag

SEQ ID NO: 819829 - RNA, 19 nt, Homo sapiens
auggguaucuuguuuguuu

SEQ ID NO: 819830 - RNA, 19 nt, Homo sapiens
uugaauggguaucuuguuu

SEQ ID NO: 819831 - RNA, 19 nt, Homo sapiens
ggaaagaggaaagaaaaua

SEQ ID NO: 819832 - RNA, 19 nt, Homo sapiens
guucuaacauugaguuugg

SEQ ID NO: 819833 - RNA, 19 nt, Homo sapiens
gcuacuugcuauuaugaga

SEQ ID NO: 819834 - RNA, 19 nt, Homo sapiens
guaaugcccgcuccagaaa

SEQ ID NO: 819835 - RNA, 19 nt, Homo sapiens
uacaggacgucuaguaaug

SEQ ID NO: 819836 - RNA, 19 nt, Homo sapiens
gcagucaguugugcuagga

SEQ ID NO: 819837 - RNA, 19 nt, Homo sapiens
gcauagugcccuugucaug

SEQ ID NO: 819838 - RNA, 19 nt, Homo sapiens
ccugcucugucuuagauua

SEQ ID NO: 819839 - RNA, 19 nt, Homo sapiens
ucaccaagcagcaguaguu

SEQ ID NO: 819840 - RNA, 19 nt, Homo sapiens
gcaggagaaucacuugaac

SEQ ID NO: 819841 - RNA, 19 nt, Homo sapiens
gaaaccccaucucuacuaa

SEQ ID NO: 819842 - RNA, 19 nt, Homo sapiens
gaaaccccaucucuacuaa

SEQ ID NO: 819843 - RNA, 19 nt, Homo sapiens
gaaauggacuugagaaaua

SEQ ID NO: 819844 - RNA, 19 nt, Homo sapiens
gcacauugcuuucucaaga

SEQ ID NO: 819845 - RNA, 19 nt, Homo sapiens
ggaauaguguucuguaaga

SEQ ID NO: 819846 - RNA, 19 nt, Homo sapiens
ggaccaagccagagacuua

SEQ ID NO: 819847 - RNA, 19 nt, Homo sapiens
ccaaggaaauccacaguuu

SEQ ID NO: 819848 - RNA, 19 nt, Homo sapiens
ucacaaggaucguuauaaa

SEQ ID NO: 819849 - RNA, 19 nt, Homo sapiens
gaauguaacuaccauggaa

SEQ ID NO: 819850 - RNA, 19 nt, Homo sapiens
gagcugaaauuacuuggaa

SEQ ID NO: 819851 - RNA, 19 nt, Homo sapiens
uaacaaggacuuucucuuu

SEQ ID NO: 819852 - RNA, 19 nt, Homo sapiens
gggacaagcugcaggauga

SEQ ID NO: 819853 - RNA, 19 nt, Homo sapiens
gaagaccacugcccagaug

SEQ ID NO: 819854 - RNA, 19 nt, Homo sapiens
ugaagggucugcuggauuu

SEQ ID NO: 819855 - RNA, 19 nt, Homo sapiens
gaaaugagcacgagcaaag

SEQ ID NO: 819856 - RNA, 19 nt, Homo sapiens
gaacgucugaggaaccuua

SEQ ID NO: 819857 - RNA, 19 nt, Homo sapiens
gaucaaguccugugaguug

SEQ ID NO: 819858 - RNA, 19 nt, Homo sapiens
ccaaagagaaccaaagauu

SEQ ID NO: 819859 - RNA, 19 nt, Homo sapiens
gcaagugagucugaugaaa

SEQ ID NO: 819860 - RNA, 19 nt, Homo sapiens
gggauuaucuccucauuac

SEQ ID NO: 819861 - RNA, 19 nt, Homo sapiens
acgaauagcuguggcauuu

SEQ ID NO: 819862 - RNA, 19 nt, Homo sapiens
caaaaugggugucaucaaa

SEQ ID NO: 819863 - RNA, 19 nt, Homo sapiens
ucacugacauuggcauuaa

SEQ ID NO: 819864 - RNA, 19 nt, Homo sapiens
ggaaauccacaguuugaaa

SEQ ID NO: 819865 - RNA, 19 nt, Homo sapiens
uaacuaccauggaaagguu

SEQ ID NO: 819866 - RNA, 19 nt, Homo sapiens
ggagauagacccaggugaa

SEQ ID NO: 819867 - RNA, 19 nt, Homo sapiens
gagcaucaucugaagcuua

SEQ ID NO: 819868 - RNA, 19 nt, Homo sapiens
gaaagcagccagggagaaa

SEQ ID NO: 819869 - RNA, 19 nt, Homo sapiens
gcaggcagcuucaaaagaa

SEQ ID NO: 819870 - RNA, 19 nt, Homo sapiens
ggaagaugaugagacuaaa

SEQ ID NO: 819871 - RNA, 19 nt, Homo sapiens
ugaaggauuugauucgauu

SEQ ID NO: 819872 - RNA, 19 nt, Homo sapiens
cauagaaaguuugagauug

SEQ ID NO: 819873 - RNA, 19 nt, Homo sapiens
ugaacgacauugcgacauu

SEQ ID NO: 819874 - RNA, 19 nt, Homo sapiens
gaagagcaagcagaguuua

SEQ ID NO: 819875 - RNA, 19 nt, Homo sapiens
ggacaccuuugaagacugu

SEQ ID NO: 819876 - RNA, 19 nt, Homo sapiens
gaaauccacaguuugaaau

SEQ ID NO: 819877 - RNA, 19 nt, Homo sapiens
caacaagcuuuggcaguga

SEQ ID NO: 819878 - RNA, 19 nt, Homo sapiens
gaaccaaagauucagcauu

SEQ ID NO: 819879 - RNA, 19 nt, Homo sapiens
gaucacaaucucccucuuu

SEQ ID NO: 819880 - RNA, 19 nt, Homo sapiens
gcaccucugugacgauuuc

SEQ ID NO: 819881 - RNA, 19 nt, Homo sapiens
caaccaacuugagaaugua

SEQ ID NO: 819882 - RNA, 19 nt, Homo sapiens
aaccaaagauucagcauuc

SEQ ID NO: 819883 - RNA, 19 nt, Homo sapiens
gccagagacuuauaaaaua

SEQ ID NO: 819884 - RNA, 19 nt, Homo sapiens
gaacgacauugcgacauuc

SEQ ID NO: 819885 - RNA, 19 nt, Homo sapiens
ggaagagcaagcagaguuu

SEQ ID NO: 819886 - RNA, 19 nt, Homo sapiens
cgaaaccuguuccuccaaa

SEQ ID NO: 819887 - RNA, 19 nt, Homo sapiens
gcuugagacugaagagauu

SEQ ID NO: 819888 - RNA, 19 nt, Homo sapiens
ucaacuggaugaaacagaa

SEQ ID NO: 819889 - RNA, 19 nt, Homo sapiens
ccacauugcugucaugcau

SEQ ID NO: 819890 - RNA, 19 nt, Homo sapiens
aaucagagacuguugguuu

SEQ ID NO: 819891 - RNA, 19 nt, Homo sapiens
gauagacccaggugaacua

SEQ ID NO: 819892 - RNA, 19 nt, Homo sapiens
uaaaagaguuggaaaagug

SEQ ID NO: 819893 - RNA, 19 nt, Homo sapiens
ggauauaucacuccaaugg

SEQ ID NO: 819894 - RNA, 19 nt, Homo sapiens
caaacucaaucucaaccaa

SEQ ID NO: 819895 - RNA, 19 nt, Homo sapiens
gaaacuuacagcucauauu

SEQ ID NO: 819896 - RNA, 19 nt, Homo sapiens
gacuuucucuuugggaaua

SEQ ID NO: 819897 - RNA, 19 nt, Homo sapiens
gcaaccaaaugucccaaca

SEQ ID NO: 819898 - RNA, 19 nt, Homo sapiens
gaaagugccgaucaucaug

SEQ ID NO: 819899 - RNA, 19 nt, Homo sapiens
ggcauuaaauacuaucgaa

SEQ ID NO: 819900 - RNA, 19 nt, Homo sapiens
uaucaaagaccaaggaaau

SEQ ID NO: 819901 - RNA, 19 nt, Homo sapiens
gauagaggauuugaucaag

SEQ ID NO: 819902 - RNA, 19 nt, Homo sapiens
gcaggaugagcugaaauua

SEQ ID NO: 819903 - RNA, 19 nt, Homo sapiens
caaagagaaccaaagauuc

SEQ ID NO: 819904 - RNA, 19 nt, Homo sapiens
cugaagauauggagauaga

SEQ ID NO: 819905 - RNA, 19 nt, Homo sapiens
ggccaaagcccagaaaguu

SEQ ID NO: 819906 - RNA, 19 nt, Homo sapiens
ccaacugacccgggaauua

SEQ ID NO: 819907 - RNA, 19 nt, Homo sapiens
gagauugccagucgaaaug

SEQ ID NO: 819908 - RNA, 19 nt, Homo sapiens
aaagagaaccaaagauuca

SEQ ID NO: 819909 - RNA, 19 nt, Homo sapiens
ugaaagccaucaugaaagg

SEQ ID NO: 819910 - RNA, 19 nt, Homo sapiens
gccuacaacuacagcauuu

SEQ ID NO: 819911 - RNA, 19 nt, Homo sapiens
ccaaaugucccaacagcaa

SEQ ID NO: 819912 - RNA, 19 nt, Homo sapiens
ccaagaaccagcaaccaaa

SEQ ID NO: 819913 - RNA, 19 nt, Homo sapiens
aaacuuacagcucauauuc

SEQ ID NO: 819914 - RNA, 19 nt, Homo sapiens
ccaugaagcugaugacacu

SEQ ID NO: 819915 - RNA, 19 nt, Homo sapiens
aaaggaagaugaugagacu

SEQ ID NO: 819916 - RNA, 19 nt, Homo sapiens
ggucugagcaucaucugaa

SEQ ID NO: 819917 - RNA, 19 nt, Homo sapiens
ggaccacauugcugucaug

SEQ ID NO: 819918 - RNA, 19 nt, Homo sapiens
gcugaugacacuuucaauu

SEQ ID NO: 819919 - RNA, 19 nt, Homo sapiens
gaauaguguucuguaagau

SEQ ID NO: 819920 - RNA, 19 nt, Homo sapiens
ugaguuggcuguggaccua

SEQ ID NO: 819921 - RNA, 19 nt, Homo sapiens
aacaaggacuuucucuuug

SEQ ID NO: 819922 - RNA, 19 nt, Homo sapiens
gugacuugcuugagacuga

SEQ ID NO: 819923 - RNA, 19 nt, Homo sapiens
gaugaugagacuaaauuug

SEQ ID NO: 819924 - RNA, 19 nt, Homo sapiens
ggagcagauucuuaaggaa

SEQ ID NO: 819925 - RNA, 19 nt, Homo sapiens
cagaggacauucacugaca

SEQ ID NO: 819926 - RNA, 19 nt, Homo sapiens
auacgugacuugcuugaga

SEQ ID NO: 819927 - RNA, 19 nt, Homo sapiens
gggaccagcucauccaaag

SEQ ID NO: 819928 - RNA, 19 nt, Homo sapiens
gaaaccuguuccuccaaau

SEQ ID NO: 819929 - RNA, 19 nt, Homo sapiens
gccaaagcccagaaaguuu

SEQ ID NO: 819930 - RNA, 19 nt, Homo sapiens
aaacgaaagugccgaucau

SEQ ID NO: 819931 - RNA, 19 nt, Homo sapiens
caaaggaccaagccagaga

SEQ ID NO: 819932 - RNA, 19 nt, Homo sapiens
gcuaaagcaucuaauucca

SEQ ID NO: 819933 - RNA, 19 nt, Homo sapiens
cauuauacgugacuugcuu

SEQ ID NO: 819934 - RNA, 19 nt, Homo sapiens
ggguugauaucgccuugaa

SEQ ID NO: 819935 - RNA, 19 nt, Homo sapiens
gaaagguuauuaguucaac

SEQ ID NO: 819936 - RNA, 19 nt, Homo sapiens
ucaccgcacugccaucgaa

SEQ ID NO: 819937 - RNA, 19 nt, Homo sapiens
caacugacccgggaauuag

SEQ ID NO: 819938 - RNA, 19 nt, Homo sapiens
ccauagaaaguuugagauu

SEQ ID NO: 819939 - RNA, 19 nt, Homo sapiens
cuucguccaucucgcuuua

SEQ ID NO: 819940 - RNA, 19 nt, Homo sapiens
gaagaugaugagacuaaau

SEQ ID NO: 819941 - RNA, 19 nt, Homo sapiens
gaugauguccaggaaauau

SEQ ID NO: 819942 - RNA, 19 nt, Homo sapiens
uggagcagauucuuaagga

SEQ ID NO: 819943 - RNA, 19 nt, Homo sapiens
gagcuggccucuauauuua

SEQ ID NO: 819944 - RNA, 19 nt, Homo sapiens
ggaaaucauucaccaagua

SEQ ID NO: 819945 - RNA, 19 nt, Homo sapiens
gaaccucuguuaauacuuu

SEQ ID NO: 819946 - RNA, 19 nt, Homo sapiens
gcacaucccuuguucagaa

SEQ ID NO: 819947 - RNA, 19 nt, Homo sapiens
caacuacgguauauugaua

SEQ ID NO: 819948 - RNA, 19 nt, Homo sapiens
ucagagaccuuaugaguga

SEQ ID NO: 819949 - RNA, 19 nt, Homo sapiens
gggaugggauuccaaguaa

SEQ ID NO: 819950 - RNA, 19 nt, Homo sapiens
ggaaugcccuucuugacuu

SEQ ID NO: 819951 - RNA, 19 nt, Homo sapiens
ggagcuggccucuauauuu

SEQ ID NO: 819952 - RNA, 19 nt, Homo sapiens
cuaggaagcugaucaguau

SEQ ID NO: 819953 - RNA, 19 nt, Homo sapiens
gcuaggaauugccaacuuu

SEQ ID NO: 819954 - RNA, 19 nt, Homo sapiens
agacggagcuggccucuau

SEQ ID NO: 819955 - RNA, 19 nt, Homo sapiens
gaaaucauccuuuguugug

SEQ ID NO: 819956 - RNA, 19 nt, Homo sapiens
gaacuguaauacuaaagga

SEQ ID NO: 819957 - RNA, 19 nt, Homo sapiens
ggagcaagcauuuguuaaa

SEQ ID NO: 819958 - RNA, 19 nt, Homo sapiens
ccaggugacucucuccuuu

SEQ ID NO: 819959 - RNA, 19 nt, Homo sapiens
gaaguaaggacgcugaaga

SEQ ID NO: 819960 - RNA, 19 nt, Homo sapiens
uaaaugaucucaguggaau

SEQ ID NO: 819961 - RNA, 19 nt, Homo sapiens
ggucuaaucuguuuacaac

SEQ ID NO: 819962 - RNA, 19 nt, Homo sapiens
uaaggacgcugaagagcaa

SEQ ID NO: 819963 - RNA, 19 nt, Homo sapiens
acacugagacuaagaauug

SEQ ID NO: 819964 - RNA, 19 nt, Homo sapiens
uuagugacauccucuuuaa

SEQ ID NO: 819965 - RNA, 19 nt, Homo sapiens
gaauggcagugcuauaaag

SEQ ID NO: 819966 - RNA, 19 nt, Homo sapiens
gaaguauucuagacagauc

SEQ ID NO: 819967 - RNA, 19 nt, Homo sapiens
caacuccacuaauguuuca

SEQ ID NO: 819968 - RNA, 19 nt, Homo sapiens
cagaagccuuugccucuuu

SEQ ID NO: 819969 - RNA, 19 nt, Homo sapiens
ggugggaggucuaaucugu

SEQ ID NO: 819970 - RNA, 19 nt, Homo sapiens
gaacucugcccaacaacaa

SEQ ID NO: 819971 - RNA, 19 nt, Homo sapiens
agaaggcgcuggagaaaca

SEQ ID NO: 819972 - RNA, 19 nt, Homo sapiens
uggacaggcugaaagauaa

SEQ ID NO: 819973 - RNA, 19 nt, Homo sapiens
guucagaaauggccacugu

SEQ ID NO: 819974 - RNA, 19 nt, Homo sapiens
gcaggcacaucccuuguuc

SEQ ID NO: 819975 - RNA, 19 nt, Homo sapiens
gggaucugauggcaaagua

SEQ ID NO: 819976 - RNA, 19 nt, Homo sapiens
agagggaucugauggcaaa

SEQ ID NO: 819977 - RNA, 19 nt, Homo sapiens
auacagaaguuacgcaaug

SEQ ID NO: 819978 - RNA, 19 nt, Homo sapiens
ggacuguaccugaggauga

SEQ ID NO: 819979 - RNA, 19 nt, Homo sapiens
guacaaaacccaaaacaaa

SEQ ID NO: 819980 - RNA, 19 nt, Homo sapiens
gcuaggaagcugaucagua

SEQ ID NO: 819981 - RNA, 19 nt, Homo sapiens
cggcaaaguugguguuuca

SEQ ID NO: 819982 - RNA, 19 nt, Homo sapiens
ucaguggaauguuucauau

SEQ ID NO: 819983 - RNA, 19 nt, Homo sapiens
gcugaucaguaucuccuuu

SEQ ID NO: 819984 - RNA, 19 nt, Homo sapiens
uaugaaggaccaaagguua

SEQ ID NO: 819985 - RNA, 19 nt, Homo sapiens
cagaaggcauacagaaguu

SEQ ID NO: 819986 - RNA, 19 nt, Homo sapiens
caacugguuucugguggua

SEQ ID NO: 819987 - RNA, 19 nt, Homo sapiens
ccaggaaguucaaggacaa

SEQ ID NO: 819988 - RNA, 19 nt, Homo sapiens
ugauauugcuccaagaaau

SEQ ID NO: 819989 - RNA, 19 nt, Homo sapiens
uuaaccaacuccacuaaug

SEQ ID NO: 819990 - RNA, 19 nt, Homo sapiens
gaacacacugagacuaaga

SEQ ID NO: 819991 - RNA, 19 nt, Homo sapiens
caaccaaagugugcccaaa

SEQ ID NO: 819992 - RNA, 19 nt, Homo sapiens
gggacucuuuccuuuauga

SEQ ID NO: 819993 - RNA, 19 nt, Homo sapiens
gauaucggcuacugucaag

SEQ ID NO: 819994 - RNA, 19 nt, Homo sapiens
gcagaaggcgcuggagaaa

SEQ ID NO: 819995 - RNA, 19 nt, Homo sapiens
ggaggaugcucugcagguu

SEQ ID NO: 819996 - RNA, 19 nt, Homo sapiens
ccaaaggccuguccaaacg

SEQ ID NO: 819997 - RNA, 19 nt, Homo sapiens
uagaauagccuuugcucuu

SEQ ID NO: 819998 - RNA, 19 nt, Homo sapiens
cauauucucucuccuguac

SEQ ID NO: 819999 - RNA, 19 nt, Homo sapiens
gagcaagcauuuguuaaac

SEQ ID NO: 820000 - RNA, 19 nt, Homo sapiens
gaaugcccuucuugacuug

SEQ ID NO: 820001 - RNA, 19 nt, Homo sapiens
gaaauggccacuguaggaa

SEQ ID NO: 820002 - RNA, 19 nt, Homo sapiens
agggugagcuggucaguga

SEQ ID NO: 820003 - RNA, 19 nt, Homo sapiens
gaacuggacaggcugaaag

SEQ ID NO: 820004 - RNA, 19 nt, Homo sapiens
gaucugauggcaaaguauu

SEQ ID NO: 820005 - RNA, 19 nt, Homo sapiens
gaacaugccagcacacacu

SEQ ID NO: 820006 - RNA, 19 nt, Homo sapiens
gugaacacacugagacuaa

SEQ ID NO: 820007 - RNA, 19 nt, Homo sapiens
ugggaggucuaaucuguuu

SEQ ID NO: 820008 - RNA, 19 nt, Homo sapiens
guuagugacauccucuuua

SEQ ID NO: 820009 - RNA, 19 nt, Homo sapiens
cgacuacacucucaucacu

SEQ ID NO: 820010 - RNA, 19 nt, Homo sapiens
ggaacaagaagaugcuuuc

SEQ ID NO: 820011 - RNA, 19 nt, Homo sapiens
ggaaaucauccuuuguugu

SEQ ID NO: 820012 - RNA, 19 nt, Homo sapiens
ggaugggauuccaaguaaa

SEQ ID NO: 820013 - RNA, 19 nt, Homo sapiens
gcauggcucugugagauuc

SEQ ID NO: 820014 - RNA, 19 nt, Homo sapiens
gugcugaccuucaaguuac

SEQ ID NO: 820015 - RNA, 19 nt, Homo sapiens
gugacucccuuguguguau

SEQ ID NO: 820016 - RNA, 19 nt, Homo sapiens
ucugugagauucuguggaa

SEQ ID NO: 820017 - RNA, 19 nt, Homo sapiens
aggcugcccuuccucauuu

SEQ ID NO: 820018 - RNA, 19 nt, Homo sapiens
acucucagcucuacgaaga

SEQ ID NO: 820019 - RNA, 19 nt, Homo sapiens
guuucuagauuccacauau

SEQ ID NO: 820020 - RNA, 19 nt, Homo sapiens
gggcuaagagcugccuuua

SEQ ID NO: 820021 - RNA, 19 nt, Homo sapiens
gcacaguguuaugaaaaua

SEQ ID NO: 820022 - RNA, 19 nt, Homo sapiens
gggcaguggugugugguuu

SEQ ID NO: 820023 - RNA, 19 nt, Homo sapiens
acuacacucucaucacuuu

SEQ ID NO: 820024 - RNA, 19 nt, Homo sapiens
ccucgagacuauuauacaa

SEQ ID NO: 820025 - RNA, 19 nt, Homo sapiens
uuucaugccucgagacuau

SEQ ID NO: 820026 - RNA, 19 nt, Homo sapiens
aaccucaucuugucaguga

SEQ ID NO: 820027 - RNA, 19 nt, Homo sapiens
gauauugcuccaagaaaug

SEQ ID NO: 820028 - RNA, 19 nt, Homo sapiens
guacaaggaagaggagauu

SEQ ID NO: 820029 - RNA, 19 nt, Homo sapiens
gaaggaccaaagguuauuu

SEQ ID NO: 820030 - RNA, 19 nt, Homo sapiens
ucaagguguuucuagauuc

SEQ ID NO: 820031 - RNA, 19 nt, Homo sapiens
agaauagccuuugcucuuc

SEQ ID NO: 820032 - RNA, 19 nt, Homo sapiens
agaaauggccacuguagga

SEQ ID NO: 820033 - RNA, 19 nt, Homo sapiens
guacaaagucgacuacacu

SEQ ID NO: 820034 - RNA, 19 nt, Homo sapiens
guucagagaccuuaugagu

SEQ ID NO: 820035 - RNA, 19 nt, Homo sapiens
ggagagagagggaucugau

SEQ ID NO: 820036 - RNA, 19 nt, Homo sapiens
ggagacgguucugguuuca

SEQ ID NO: 820037 - RNA, 19 nt, Homo sapiens
caacaccugcuaggaauug

SEQ ID NO: 820038 - RNA, 19 nt, Homo sapiens
cgaaucaaguguuggaaac

SEQ ID NO: 820039 - RNA, 19 nt, Homo sapiens
gaugccagcugugcuuuag

SEQ ID NO: 820040 - RNA, 19 nt, Homo sapiens
cuacuucacucgcacuauc

SEQ ID NO: 820041 - RNA, 19 nt, Homo sapiens
caagauucgaugucuauau

SEQ ID NO: 820042 - RNA, 19 nt, Homo sapiens
uggauagugucguuaguga

SEQ ID NO: 820043 - RNA, 19 nt, Homo sapiens
gagagaaaguugccuguua

SEQ ID NO: 820044 - RNA, 19 nt, Homo sapiens
gcacagggauuaguuauga

SEQ ID NO: 820045 - RNA, 19 nt, Homo sapiens
ccagauaacuuuacauuca

SEQ ID NO: 820046 - RNA, 19 nt, Homo sapiens
gcaagaagccuuugaagug

SEQ ID NO: 820047 - RNA, 19 nt, Homo sapiens
caccacaccuuucuaauuu

SEQ ID NO: 820048 - RNA, 19 nt, Homo sapiens
ccaaagugcugggaugaua

SEQ ID NO: 820049 - RNA, 19 nt, Homo sapiens
gaaaguugccuguuaguuc

SEQ ID NO: 820050 - RNA, 19 nt, Homo sapiens
caacuucucucccucuaug

SEQ ID NO: 820051 - RNA, 19 nt, Homo sapiens
cgucucagcucauuuauca

SEQ ID NO: 820052 - RNA, 19 nt, Homo sapiens
caacaugccucugauaugg

SEQ ID NO: 820053 - RNA, 19 nt, Homo sapiens
aguccaagcuuccucaaua

SEQ ID NO: 820054 - RNA, 19 nt, Homo sapiens
ugacagagcccuucaagug

SEQ ID NO: 820055 - RNA, 19 nt, Homo sapiens
uuaacaauaucacggcuua

SEQ ID NO: 820056 - RNA, 19 nt, Homo sapiens
gccaugaacucacuggauu

SEQ ID NO: 820057 - RNA, 19 nt, Homo sapiens
gaagggcuauggaacuaug

SEQ ID NO: 820058 - RNA, 19 nt, Homo sapiens
gaucuugcaucuuuaaugg

SEQ ID NO: 820059 - RNA, 19 nt, Homo sapiens
acugauggauucuuucaua

SEQ ID NO: 820060 - RNA, 19 nt, Homo sapiens
uugcugaucuugcaucuuu

SEQ ID NO: 820061 - RNA, 19 nt, Homo sapiens
caagacaaagcccuauaua

SEQ ID NO: 820062 - RNA, 19 nt, Homo sapiens
gauagaucaugcagaguau

SEQ ID NO: 820063 - RNA, 19 nt, Homo sapiens
ucaauuuacugauggauuc

SEQ ID NO: 820064 - RNA, 19 nt, Homo sapiens
uaucacggcuuauagacaa

SEQ ID NO: 820065 - RNA, 19 nt, Homo sapiens
acauaaagcuguguagaga

SEQ ID NO: 820066 - RNA, 19 nt, Homo sapiens
caucgucucagcucauuua

SEQ ID NO: 820067 - RNA, 19 nt, Homo sapiens
caucagagguaugaauguu

SEQ ID NO: 820068 - RNA, 19 nt, Homo sapiens
cagaggacaucgccaccua

SEQ ID NO: 820069 - RNA, 19 nt, Homo sapiens
gcaguuagacaucgaggaa

SEQ ID NO: 820070 - RNA, 19 nt, Homo sapiens
ucaaaagccucuggaaaua

SEQ ID NO: 820071 - RNA, 19 nt, Homo sapiens
ccaccacaccuuucuaauu

SEQ ID NO: 820072 - RNA, 19 nt, Homo sapiens
guuaugagcauuaaaguuc

SEQ ID NO: 820073 - RNA, 19 nt, Homo sapiens
gcaguggcaucuagaccuu

SEQ ID NO: 820074 - RNA, 19 nt, Homo sapiens
gcauuaaaguuccuaagac

SEQ ID NO: 820075 - RNA, 19 nt, Homo sapiens
ugaagucaccagcugaaua

SEQ ID NO: 820076 - RNA, 19 nt, Homo sapiens
cacaagaacuucacucaac

SEQ ID NO: 820077 - RNA, 19 nt, Homo sapiens
gaagacauaaagcugugua

SEQ ID NO: 820078 - RNA, 19 nt, Homo sapiens
gagaggaacuuuggugcau

SEQ ID NO: 820079 - RNA, 19 nt, Homo sapiens
gaagaggagaggaacuuug

SEQ ID NO: 820080 - RNA, 19 nt, Homo sapiens
aaccaaggcugaagaguca

SEQ ID NO: 820081 - RNA, 19 nt, Homo sapiens
gaagucaccagcugaauac

SEQ ID NO: 820082 - RNA, 19 nt, Homo sapiens
aagaagggcuauggaacua

SEQ ID NO: 820083 - RNA, 19 nt, Homo sapiens
ggauuaguuaugagcauua

SEQ ID NO: 820084 - RNA, 19 nt, Homo sapiens
caaaugggaagcaagagaa

SEQ ID NO: 820085 - RNA, 19 nt, Homo sapiens
cucaauaccuggaacgauu

SEQ ID NO: 820086 - RNA, 19 nt, Homo sapiens
uagaucaugcagaguauua

SEQ ID NO: 820087 - RNA, 19 nt, Homo sapiens
ccacaaaugggaagcaaga

SEQ ID NO: 820088 - RNA, 19 nt, Homo sapiens
ucagcucauuuaucaagua

SEQ ID NO: 820089 - RNA, 19 nt, Homo sapiens
gcaguggccuggacaacag

SEQ ID NO: 820090 - RNA, 19 nt, Homo sapiens
gacagagcccuucaaguga

SEQ ID NO: 820091 - RNA, 19 nt, Homo sapiens
ggagugcaguggcgcaauc

SEQ ID NO: 820092 - RNA, 19 nt, Homo sapiens
ggacaucgccaccuaugag

SEQ ID NO: 820093 - RNA, 19 nt, Homo sapiens
gaaggucuuuuaagucuga

SEQ ID NO: 820094 - RNA, 19 nt, Homo sapiens
agagaaaguugccuguuag

SEQ ID NO: 820095 - RNA, 19 nt, Homo sapiens
ucagagguaugaauguugu

SEQ ID NO: 820096 - RNA, 19 nt, Homo sapiens
gcucauuuaucaaguaggu

SEQ ID NO: 820097 - RNA, 19 nt, Homo sapiens
gggauuaguuaugagcauu

SEQ ID NO: 820098 - RNA, 19 nt, Homo sapiens
guaccaggcucagaaagca

SEQ ID NO: 820099 - RNA, 19 nt, Homo sapiens
guagagaagcgcucgaugu

SEQ ID NO: 820100 - RNA, 19 nt, Homo sapiens
ccacaacaugccucugaua

SEQ ID NO: 820101 - RNA, 19 nt, Homo sapiens
agauugugcucuucuauca

SEQ ID NO: 820102 - RNA, 19 nt, Homo sapiens
uauguaguguugcccuuaa

SEQ ID NO: 820103 - RNA, 19 nt, Homo sapiens
caauaucacggcuuauaga

SEQ ID NO: 820104 - RNA, 19 nt, Homo sapiens
aaaccaggcuaccuugaca

SEQ ID NO: 820105 - RNA, 19 nt, Homo sapiens
agauagaucaugcagagua

SEQ ID NO: 820106 - RNA, 19 nt, Homo sapiens
acucacacauucccacauu

SEQ ID NO: 820107 - RNA, 19 nt, Homo sapiens
gagaaaccaaggcugaaga

SEQ ID NO: 820108 - RNA, 19 nt, Homo sapiens
aaacagagcaguccaagcu

SEQ ID NO: 820109 - RNA, 19 nt, Homo sapiens
gaacucaguggguuucagu

SEQ ID NO: 820110 - RNA, 19 nt, Homo sapiens
ggaagaggagaggaacuuu

SEQ ID NO: 820111 - RNA, 19 nt, Homo sapiens
gcugguaccugagaaacug

SEQ ID NO: 820112 - RNA, 19 nt, Homo sapiens
guaguguugcccuuaagua

SEQ ID NO: 820113 - RNA, 19 nt, Homo sapiens
aaaguugccuguuaguucu

SEQ ID NO: 820114 - RNA, 19 nt, Homo sapiens
gaggagaaagcuagcucua

SEQ ID NO: 820115 - RNA, 19 nt, Homo sapiens
gaccugcacugggagaaau

SEQ ID NO: 820116 - RNA, 19 nt, Homo sapiens
cugauggauucuuucauaa

SEQ ID NO: 820117 - RNA, 19 nt, Homo sapiens
ggaguaccaggcucagaaa

SEQ ID NO: 820118 - RNA, 19 nt, Homo sapiens
ggaaaccaggcuaccuuga

SEQ ID NO: 820119 - RNA, 19 nt, Homo sapiens
aagugucucuucugugaaa

SEQ ID NO: 820120 - RNA, 19 nt, Homo sapiens
gcucucuccugcagguaaa

SEQ ID NO: 820121 - RNA, 19 nt, Homo sapiens
ggguuucaguucccaguug

SEQ ID NO: 820122 - RNA, 19 nt, Homo sapiens
aaaagccucuggaaauaaa

SEQ ID NO: 820123 - RNA, 19 nt, Homo sapiens
gccucggccuccuuuagua

SEQ ID NO: 820124 - RNA, 19 nt, Homo sapiens
ccaccugucucacaagaac

SEQ ID NO: 820125 - RNA, 19 nt, Homo sapiens
acagagcccuucaagugau

SEQ ID NO: 820126 - RNA, 19 nt, Homo sapiens
guauggcuaugcacuucuu

SEQ ID NO: 820127 - RNA, 19 nt, Homo sapiens
gaugcaagaagccuuugaa

SEQ ID NO: 820128 - RNA, 19 nt, Homo sapiens
gcagaguauuaccuuuaca

SEQ ID NO: 820129 - RNA, 19 nt, Homo sapiens
gcugaucuugcaucuuuaa

SEQ ID NO: 820130 - RNA, 19 nt, Homo sapiens
caccaugacugcccaucga

SEQ ID NO: 820131 - RNA, 19 nt, Homo sapiens
caauaccuggaacgauuua

SEQ ID NO: 820132 - RNA, 19 nt, Homo sapiens
auaaagcuguguagagaag

SEQ ID NO: 820133 - RNA, 19 nt, Homo sapiens
ugaagugcaucagagguau

SEQ ID NO: 820134 - RNA, 19 nt, Homo sapiens
gucaccagcugaauaccuu

SEQ ID NO: 820135 - RNA, 19 nt, Homo sapiens
caagaagggcuauggaacu

SEQ ID NO: 820136 - RNA, 19 nt, Homo sapiens
gaaagcagcaaaggcaucu

SEQ ID NO: 820137 - RNA, 19 nt, Homo sapiens
gacauaaagcuguguagag

SEQ ID NO: 820138 - RNA, 19 nt, Homo sapiens
aacaauaucacggcuuaua

SEQ ID NO: 820139 - RNA, 19 nt, Homo sapiens
gcacaagacaaagcccuau

SEQ ID NO: 820140 - RNA, 19 nt, Homo sapiens
caacugcugguaccugaga

SEQ ID NO: 820141 - RNA, 19 nt, Homo sapiens
ggauaaaacauuugagaga

SEQ ID NO: 820142 - RNA, 19 nt, Homo sapiens
gaggagcagucccaaaaug

SEQ ID NO: 820143 - RNA, 19 nt, Homo sapiens
gaaagaaacucuacagaau

SEQ ID NO: 820144 - RNA, 19 nt, Homo sapiens
gaacagagcagaagaagaa

SEQ ID NO: 820145 - RNA, 19 nt, Homo sapiens
guaacugccuacaauauua

SEQ ID NO: 820146 - RNA, 19 nt, Homo sapiens
ucacagcccuauuuacuua

SEQ ID NO: 820147 - RNA, 19 nt, Homo sapiens
gcagcuaaaugcaucguua

SEQ ID NO: 820148 - RNA, 19 nt, Homo sapiens
ggaaacaccucaacuccaa

SEQ ID NO: 820149 - RNA, 19 nt, Homo sapiens
ucuaguggcuacuuaauua

SEQ ID NO: 820150 - RNA, 19 nt, Homo sapiens
gggaaucacuuauaccaaa

SEQ ID NO: 820151 - RNA, 19 nt, Homo sapiens
gcaaagaacuacuauaagc

SEQ ID NO: 820152 - RNA, 19 nt, Homo sapiens
ggaacaugauuguauugua

SEQ ID NO: 820153 - RNA, 19 nt, Homo sapiens
gaauacagaugaauuaggu

SEQ ID NO: 820154 - RNA, 19 nt, Homo sapiens
gaaaggugcuucuaaacuc

SEQ ID NO: 820155 - RNA, 19 nt, Homo sapiens
gaacuagacccuccucuga

SEQ ID NO: 820156 - RNA, 19 nt, Homo sapiens
ggaaagguucuauucauaa

SEQ ID NO: 820157 - RNA, 19 nt, Homo sapiens
ggaugcagaugaauugauu

SEQ ID NO: 820158 - RNA, 19 nt, Homo sapiens
uggcaugucuucuauuuaa

SEQ ID NO: 820159 - RNA, 19 nt, Homo sapiens
uaucauaucugcuucuguu

SEQ ID NO: 820160 - RNA, 19 nt, Homo sapiens
gaagaaaacugcaacacaa

SEQ ID NO: 820161 - RNA, 19 nt, Homo sapiens
ucaaagcaauggugaagaa

SEQ ID NO: 820162 - RNA, 19 nt, Homo sapiens
uaacaaaggucugaauaca

SEQ ID NO: 820163 - RNA, 19 nt, Homo sapiens
gcgcagaaauggagcaaga

SEQ ID NO: 820164 - RNA, 19 nt, Homo sapiens
gcauuaugguuuccacuuu

SEQ ID NO: 820165 - RNA, 19 nt, Homo sapiens
ccucacagauuaaccagua

SEQ ID NO: 820166 - RNA, 19 nt, Homo sapiens
gaagaaugcacuuuaugaa

SEQ ID NO: 820167 - RNA, 19 nt, Homo sapiens
uggaauuccucacagauua

SEQ ID NO: 820168 - RNA, 19 nt, Homo sapiens
caagaagcauggaagcaaa

SEQ ID NO: 820169 - RNA, 19 nt, Homo sapiens
gaaguuaaccugagucaca

SEQ ID NO: 820170 - RNA, 19 nt, Homo sapiens
uggagaaccugcugaaauu

SEQ ID NO: 820171 - RNA, 19 nt, Homo sapiens
ggauguacgucauaaagga

SEQ ID NO: 820172 - RNA, 19 nt, Homo sapiens
gaucuccgguucugaaaug

SEQ ID NO: 820173 - RNA, 19 nt, Homo sapiens
ggacuacuuuuguaacuua

SEQ ID NO: 820174 - RNA, 19 nt, Homo sapiens
gaggaucuguuaaggcaaa

SEQ ID NO: 820175 - RNA, 19 nt, Homo sapiens
ggccaaggauaauguacua

SEQ ID NO: 820176 - RNA, 19 nt, Homo sapiens
gaaggcaaauaggaaacua

SEQ ID NO: 820177 - RNA, 19 nt, Homo sapiens
gauaguacauguguuguuc

SEQ ID NO: 820178 - RNA, 19 nt, Homo sapiens
uaaccugagucacauugua

SEQ ID NO: 820179 - RNA, 19 nt, Homo sapiens
gaagcugucugaagaaugc

SEQ ID NO: 820180 - RNA, 19 nt, Homo sapiens
cuaaaugcaucguuaacaa

SEQ ID NO: 820181 - RNA, 19 nt, Homo sapiens
caaguaguguucaaggauu

SEQ ID NO: 820182 - RNA, 19 nt, Homo sapiens
gaacuacuauaagcaagga

SEQ ID NO: 820183 - RNA, 19 nt, Homo sapiens
gcagaaggcagacuauuca

SEQ ID NO: 820184 - RNA, 19 nt, Homo sapiens
agucaaaggugcugagauu

SEQ ID NO: 820185 - RNA, 19 nt, Homo sapiens
uaccagagccucagucuuu

SEQ ID NO: 820186 - RNA, 19 nt, Homo sapiens
ugaauuaggucagaaggaa

SEQ ID NO: 820187 - RNA, 19 nt, Homo sapiens
ugaauugccugaccucguu

SEQ ID NO: 820188 - RNA, 19 nt, Homo sapiens
uaaaggaggcaaagaagaa

SEQ ID NO: 820189 - RNA, 19 nt, Homo sapiens
caaggauaauguacuaguu

SEQ ID NO: 820190 - RNA, 19 nt, Homo sapiens
gagaaccugcugaaauuaa

SEQ ID NO: 820191 - RNA, 19 nt, Homo sapiens
aggaaagguucuauucaua

SEQ ID NO: 820192 - RNA, 19 nt, Homo sapiens
uauggcaugucuucuauuu

SEQ ID NO: 820193 - RNA, 19 nt, Homo sapiens
ugaaagaaacucuacagaa

SEQ ID NO: 820194 - RNA, 19 nt, Homo sapiens
cuagacagaugcaacagaa

SEQ ID NO: 820195 - RNA, 19 nt, Homo sapiens
ggauaggcauuaugguuuc

SEQ ID NO: 820196 - RNA, 19 nt, Homo sapiens
guuaugagccuaggaaauu

SEQ ID NO: 820197 - RNA, 19 nt, Homo sapiens
guacauguguuguucaaac

SEQ ID NO: 820198 - RNA, 19 nt, Homo sapiens
ccuuagaaaugugaaguua

SEQ ID NO: 820199 - RNA, 19 nt, Homo sapiens
caacauugguaucaaagca

SEQ ID NO: 820200 - RNA, 19 nt, Homo sapiens
gcagaugaauugauuuuga

SEQ ID NO: 820201 - RNA, 19 nt, Homo sapiens
gcuguaguccauucuaaua

SEQ ID NO: 820202 - RNA, 19 nt, Homo sapiens
guaacuaaauaccuaaugg

SEQ ID NO: 820203 - RNA, 19 nt, Homo sapiens
ccaaaucccuggaagaacu

SEQ ID NO: 820204 - RNA, 19 nt, Homo sapiens
ggaucagcauuucaucaaa

SEQ ID NO: 820205 - RNA, 19 nt, Homo sapiens
gaaauuugggaacaugauu

SEQ ID NO: 820206 - RNA, 19 nt, Homo sapiens
ggagaaccugcugaaauua

SEQ ID NO: 820207 - RNA, 19 nt, Homo sapiens
aagaaacucuacagaaugu

SEQ ID NO: 820208 - RNA, 19 nt, Homo sapiens
guuaucacaugagcuuaua

SEQ ID NO: 820209 - RNA, 19 nt, Homo sapiens
ugaagaaugcacuuuauga

SEQ ID NO: 820210 - RNA, 19 nt, Homo sapiens
uaccaaagccuuaugaaau

SEQ ID NO: 820211 - RNA, 19 nt, Homo sapiens
gcaaacuuguuccagaauc

SEQ ID NO: 820212 - RNA, 19 nt, Homo sapiens
aaaaguggcucacaacauu

SEQ ID NO: 820213 - RNA, 19 nt, Homo sapiens
gccuacauguuuccugaua

SEQ ID NO: 820214 - RNA, 19 nt, Homo sapiens
uagaaggaaugacuuaaag

SEQ ID NO: 820215 - RNA, 19 nt, Homo sapiens
gaagcaaagaacuacuaua

SEQ ID NO: 820216 - RNA, 19 nt, Homo sapiens
ggaauuccucacagauuaa

SEQ ID NO: 820217 - RNA, 19 nt, Homo sapiens
cacaugagcuuauauuuug

SEQ ID NO: 820218 - RNA, 19 nt, Homo sapiens
guucaaaccuuguuaaacc

SEQ ID NO: 820219 - RNA, 19 nt, Homo sapiens
guauugagacuguauuguu

SEQ ID NO: 820220 - RNA, 19 nt, Homo sapiens
gaucaucagagaagcauau

SEQ ID NO: 820221 - RNA, 19 nt, Homo sapiens
gcaucuggccuuagaaaug

SEQ ID NO: 820222 - RNA, 19 nt, Homo sapiens
gaacuagcuccacauguca

SEQ ID NO: 820223 - RNA, 19 nt, Homo sapiens
guaaggcaauccagaaagg

SEQ ID NO: 820224 - RNA, 19 nt, Homo sapiens
gcucuuugaggaucuguua

SEQ ID NO: 820225 - RNA, 19 nt, Homo sapiens
ucagguuugugacugguua

SEQ ID NO: 820226 - RNA, 19 nt, Homo sapiens
caaaccuuguuaaaccuaa

SEQ ID NO: 820227 - RNA, 19 nt, Homo sapiens
guuaacaaaggucugaaua

SEQ ID NO: 820228 - RNA, 19 nt, Homo sapiens
caucuggccuuagaaaugu

SEQ ID NO: 820229 - RNA, 19 nt, Homo sapiens
uaaauaggcaaauguggaa

SEQ ID NO: 820230 - RNA, 19 nt, Homo sapiens
aagcaaacuuguuccagaa

SEQ ID NO: 820231 - RNA, 19 nt, Homo sapiens
agaacuagcuccacauguc

SEQ ID NO: 820232 - RNA, 19 nt, Homo sapiens
ggaaucacuuauaccaaag

SEQ ID NO: 820233 - RNA, 19 nt, Homo sapiens
uggcguaacugccuacaau

SEQ ID NO: 820234 - RNA, 19 nt, Homo sapiens
ugauggaguuugcacugua

SEQ ID NO: 820235 - RNA, 19 nt, Homo sapiens
gagaggaguuuuauaggaa

SEQ ID NO: 820236 - RNA, 19 nt, Homo sapiens
gaaggaagaagcaaagaac

SEQ ID NO: 820237 - RNA, 19 nt, Homo sapiens
uagcuguaguccauucuaa

SEQ ID NO: 820238 - RNA, 19 nt, Homo sapiens
uuucauagcuguaguccau

SEQ ID NO: 820239 - RNA, 19 nt, Homo sapiens
gaaagacugaugaaaagua

SEQ ID NO: 820240 - RNA, 19 nt, Homo sapiens
aggcaaagaagaaagauaa

SEQ ID NO: 820241 - RNA, 19 nt, Homo sapiens
cagaaacuguacaaacugu

SEQ ID NO: 820242 - RNA, 19 nt, Homo sapiens
gcaaguaguguucaaggau

SEQ ID NO: 820243 - RNA, 19 nt, Homo sapiens
gaaagugccuucccacaga

SEQ ID NO: 820244 - RNA, 19 nt, Homo sapiens
guacagauguccucucuug

SEQ ID NO: 820245 - RNA, 19 nt, Homo sapiens
caacugcucugccauggua

SEQ ID NO: 820246 - RNA, 19 nt, Homo sapiens
gagauucuauccacucuuu

SEQ ID NO: 820247 - RNA, 19 nt, Homo sapiens
gagagaagcuagugaagau

SEQ ID NO: 820248 - RNA, 19 nt, Homo sapiens
gaacaugucucuucuacac

SEQ ID NO: 820249 - RNA, 19 nt, Homo sapiens
ccaagcagcucgucuacuu

SEQ ID NO: 820250 - RNA, 19 nt, Homo sapiens
gcaggaagaugaggaggaa

SEQ ID NO: 820251 - RNA, 19 nt, Homo sapiens
caaaguggguguggaagaa

SEQ ID NO: 820252 - RNA, 19 nt, Homo sapiens
gaagaacucauucgacaga

SEQ ID NO: 820253 - RNA, 19 nt, Homo sapiens
gcacuucuaucagcauuau

SEQ ID NO: 820254 - RNA, 19 nt, Homo sapiens
acacaaaccugcagcuuuc

SEQ ID NO: 820255 - RNA, 19 nt, Homo sapiens
gaaccaagcagcucgucua

SEQ ID NO: 820256 - RNA, 19 nt, Homo sapiens
gggcugagcugcaguuugg

SEQ ID NO: 820257 - RNA, 19 nt, Homo sapiens
ggaagaggaugaagaugag

SEQ ID NO: 820258 - RNA, 19 nt, Homo sapiens
ggaugacccugcccacuga

SEQ ID NO: 820259 - RNA, 19 nt, Homo sapiens
gaaaagggccuccacauug

SEQ ID NO: 820260 - RNA, 19 nt, Homo sapiens
gguguggccuguaccagua

SEQ ID NO: 820261 - RNA, 19 nt, Homo sapiens
agaggaagcugagaaagaa

SEQ ID NO: 820262 - RNA, 19 nt, Homo sapiens
gaucaguacuuagaacaga

SEQ ID NO: 820263 - RNA, 19 nt, Homo sapiens
uaacccgacugcuggauuu

SEQ ID NO: 820264 - RNA, 19 nt, Homo sapiens
ugacagagugugagaagua

SEQ ID NO: 820265 - RNA, 19 nt, Homo sapiens
gcugggagcuggagaccaa

SEQ ID NO: 820266 - RNA, 19 nt, Homo sapiens
ggaagaggaagcugagaaa

SEQ ID NO: 820267 - RNA, 19 nt, Homo sapiens
gauggcugcuggaucagua

SEQ ID NO: 820268 - RNA, 19 nt, Homo sapiens
aguaugggcugcugucuaa

SEQ ID NO: 820269 - RNA, 19 nt, Homo sapiens
gaaaccacauccucugaag

SEQ ID NO: 820270 - RNA, 19 nt, Homo sapiens
augaggagcuggacaauga

SEQ ID NO: 820271 - RNA, 19 nt, Homo sapiens
gaggucaucuccaaguaug

SEQ ID NO: 820272 - RNA, 19 nt, Homo sapiens
gaacuuagagccagauguc

SEQ ID NO: 820273 - RNA, 19 nt, Homo sapiens
gugaugcccuugaccguuu

SEQ ID NO: 820274 - RNA, 19 nt, Homo sapiens
ggaagcugagaaagaauua

SEQ ID NO: 820275 - RNA, 19 nt, Homo sapiens
cagaggaggugucaguaga

SEQ ID NO: 820276 - RNA, 19 nt, Homo sapiens
ucaaugaccugcucaacuc

SEQ ID NO: 820277 - RNA, 19 nt, Homo sapiens
ggaugaagaugaggccuau

SEQ ID NO: 820278 - RNA, 19 nt, Homo sapiens
ggaagacgaugaggaugau

SEQ ID NO: 820279 - RNA, 19 nt, Homo sapiens
gaaguagaaggguugauga

SEQ ID NO: 820280 - RNA, 19 nt, Homo sapiens
uggaugggcuguacccuuu

SEQ ID NO: 820281 - RNA, 19 nt, Homo sapiens
gcaagcaccuggccaagcu

SEQ ID NO: 820282 - RNA, 19 nt, Homo sapiens
gcaggagacgcugaacuua

SEQ ID NO: 820283 - RNA, 19 nt, Homo sapiens
gcugcuggaucaguacuua

SEQ ID NO: 820284 - RNA, 19 nt, Homo sapiens
ggaggcagccagugaaaug

SEQ ID NO: 820285 - RNA, 19 nt, Homo sapiens
ucacgucccuccuggauca

SEQ ID NO: 820286 - RNA, 19 nt, Homo sapiens
gaaguacgcacagcucuau

SEQ ID NO: 820287 - RNA, 19 nt, Homo sapiens
cagaggucaucuccaagua

SEQ ID NO: 820288 - RNA, 19 nt, Homo sapiens
ggaagaggaggaagaggaa

SEQ ID NO: 820289 - RNA, 19 nt, Homo sapiens
gagcacuucuaucagcauu

SEQ ID NO: 820290 - RNA, 19 nt, Homo sapiens
gaaggaggcagccagugaa

SEQ ID NO: 820291 - RNA, 19 nt, Homo sapiens
gcacauggauuuugacagu

SEQ ID NO: 820292 - RNA, 19 nt, Homo sapiens
ggaggaagacgaugaggau

SEQ ID NO: 820293 - RNA, 19 nt, Homo sapiens
gaacguagagaaggaugaa

SEQ ID NO: 820294 - RNA, 19 nt, Homo sapiens
gauggaguguccugaagug

SEQ ID NO: 820295 - RNA, 19 nt, Homo sapiens
ccagguacauugaccaaca

SEQ ID NO: 820296 - RNA, 19 nt, Homo sapiens
gugagcaguuugccaggua

SEQ ID NO: 820297 - RNA, 19 nt, Homo sapiens
acagaucgcugagagagaa

SEQ ID NO: 820298 - RNA, 19 nt, Homo sapiens
gacacaaaccugcagcuuu

SEQ ID NO: 820299 - RNA, 19 nt, Homo sapiens
gugaagcgcuaccuuugug

SEQ ID NO: 820300 - RNA, 19 nt, Homo sapiens
ucacaaagacuauuacaac

SEQ ID NO: 820301 - RNA, 19 nt, Homo sapiens
gccgaacccuggaacagaa

SEQ ID NO: 820302 - RNA, 19 nt, Homo sapiens
ggaaguagaaggguugaug

SEQ ID NO: 820303 - RNA, 19 nt, Homo sapiens
aggcauaccugaacguaga

SEQ ID NO: 820304 - RNA, 19 nt, Homo sapiens
gaagccaaaucacaaagac

SEQ ID NO: 820305 - RNA, 19 nt, Homo sapiens
cgaugacgguggcuacuau

SEQ ID NO: 820306 - RNA, 19 nt, Homo sapiens
gcaaaguggguguggaaga

SEQ ID NO: 820307 - RNA, 19 nt, Homo sapiens
ccacauugaucagcugguu

SEQ ID NO: 820308 - RNA, 19 nt, Homo sapiens
acgcacagcucuauagcaa

SEQ ID NO: 820309 - RNA, 19 nt, Homo sapiens
ggauuucccugaggcaaug

SEQ ID NO: 820310 - RNA, 19 nt, Homo sapiens
ucacugagccagcaagaug

SEQ ID NO: 820311 - RNA, 19 nt, Homo sapiens
cugagaaccuggaccaaga

SEQ ID NO: 820312 - RNA, 19 nt, Homo sapiens
uaaacucuaugagcacuug

SEQ ID NO: 820313 - RNA, 19 nt, Homo sapiens
gaccaaagcuccccaugug

SEQ ID NO: 820314 - RNA, 19 nt, Homo sapiens
aggagacgcugaacuuaga

SEQ ID NO: 820315 - RNA, 19 nt, Homo sapiens
gaggaggugucaguagaga

SEQ ID NO: 820316 - RNA, 19 nt, Homo sapiens
ugcggaugcuggaugauua

SEQ ID NO: 820317 - RNA, 19 nt, Homo sapiens
gcucugccaugguaagcaa

SEQ ID NO: 820318 - RNA, 19 nt, Homo sapiens
gcagaaggguccaaauccu

SEQ ID NO: 820319 - RNA, 19 nt, Homo sapiens
ugggauggcugcuggauca

SEQ ID NO: 820320 - RNA, 19 nt, Homo sapiens
cagggaggguggcaucuau

SEQ ID NO: 820321 - RNA, 19 nt, Homo sapiens
gugauucucagcuguuuaa

SEQ ID NO: 820322 - RNA, 19 nt, Homo sapiens
gagugauucucagcuguuu

SEQ ID NO: 820323 - RNA, 19 nt, Homo sapiens
ggaagccacugaggauaag

SEQ ID NO: 820324 - RNA, 19 nt, Homo sapiens
gagugcggaugcuggauga

SEQ ID NO: 820325 - RNA, 19 nt, Homo sapiens
auacauugcuggagcuguu

SEQ ID NO: 820326 - RNA, 19 nt, Homo sapiens
gacagucgcuauacauugc

SEQ ID NO: 820327 - RNA, 19 nt, Homo sapiens
cagaagaggaggaggaaga

SEQ ID NO: 820328 - RNA, 19 nt, Homo sapiens
ggaagccaaaucacaaaga

SEQ ID NO: 820329 - RNA, 19 nt, Homo sapiens
cgccagaggucaucuccaa

SEQ ID NO: 820330 - RNA, 19 nt, Homo sapiens
ggagcugaccugcuuccua

SEQ ID NO: 820331 - RNA, 19 nt, Homo sapiens
gcccgaaccucagaagaau

SEQ ID NO: 820332 - RNA, 19 nt, Homo sapiens
ccaaauguaaccauggauu

SEQ ID NO: 820333 - RNA, 19 nt, Homo sapiens
uggccaagcucaucuccaa

SEQ ID NO: 820334 - RNA, 19 nt, Homo sapiens
gaggcacacuacccugcua

SEQ ID NO: 820335 - RNA, 19 nt, Homo sapiens
uagaaggguugaugaagca

SEQ ID NO: 820336 - RNA, 19 nt, Homo sapiens
ggaaaagggccuccacauu

SEQ ID NO: 820337 - RNA, 19 nt, Homo sapiens
guacauugaccaacagauc

SEQ ID NO: 820338 - RNA, 19 nt, Homo sapiens
cagacuuugugccucguua

SEQ ID NO: 820339 - RNA, 19 nt, Homo sapiens
ugacgggcauccugaauac

SEQ ID NO: 820340 - RNA, 19 nt, Homo sapiens
gcaccaagaacagaaccua

SEQ ID NO: 820341 - RNA, 19 nt, Homo sapiens
gcugagagacacguuguuu

SEQ ID NO: 820342 - RNA, 19 nt, Homo sapiens
gggcagcacucucaaugac

SEQ ID NO: 820343 - RNA, 19 nt, Homo sapiens
gaaaucagcccacuguuua

SEQ ID NO: 820344 - RNA, 19 nt, Homo sapiens
gaucaaagguccaucauca

SEQ ID NO: 820345 - RNA, 19 nt, Homo sapiens
gaaaguaugcacagaauaa

SEQ ID NO: 820346 - RNA, 19 nt, Homo sapiens
gaagagaugaguacuauuu

SEQ ID NO: 820347 - RNA, 19 nt, Homo sapiens
uaagggaagugcugaaaua

SEQ ID NO: 820348 - RNA, 19 nt, Homo sapiens
ggaacaagguuuaacuauu

SEQ ID NO: 820349 - RNA, 19 nt, Homo sapiens
ccucaaggcuuuaauguuu

SEQ ID NO: 820350 - RNA, 19 nt, Homo sapiens
gaacgugucuccacucugu

SEQ ID NO: 820351 - RNA, 19 nt, Homo sapiens
caacaaacucccagauuua

SEQ ID NO: 820352 - RNA, 19 nt, Homo sapiens
guacaaaugugcagcgaaa

SEQ ID NO: 820353 - RNA, 19 nt, Homo sapiens
gaacaugucugggcaagug

SEQ ID NO: 820354 - RNA, 19 nt, Homo sapiens
aaacaaggcuagccauauu

SEQ ID NO: 820355 - RNA, 19 nt, Homo sapiens
aaaguaaucugcugaaaga

SEQ ID NO: 820356 - RNA, 19 nt, Homo sapiens
aaagagaacuugagauuca

SEQ ID NO: 820357 - RNA, 19 nt, Homo sapiens
gagcauggguccugccuuu

SEQ ID NO: 820358 - RNA, 19 nt, Homo sapiens
ucaacaaacucccagauuu

SEQ ID NO: 820359 - RNA, 19 nt, Homo sapiens
guacagaucucucgagucu

SEQ ID NO: 820360 - RNA, 19 nt, Homo sapiens
ccagauaccuucccuugaa

SEQ ID NO: 820361 - RNA, 19 nt, Homo sapiens
ugaaguaccugaaguuguu

SEQ ID NO: 820362 - RNA, 19 nt, Homo sapiens
guaauacuccuacaucuuu

SEQ ID NO: 820363 - RNA, 19 nt, Homo sapiens
gagagaaguuuaaaugcuu

SEQ ID NO: 820364 - RNA, 19 nt, Homo sapiens
gacaguaucauguguauuu

SEQ ID NO: 820365 - RNA, 19 nt, Homo sapiens
ugacaauccuagguaauua

SEQ ID NO: 820366 - RNA, 19 nt, Homo sapiens
cagaauaacuuuccucuac

SEQ ID NO: 820367 - RNA, 19 nt, Homo sapiens
gaagcaaccucaagcaucu

SEQ ID NO: 820368 - RNA, 19 nt, Homo sapiens
caaggaagccaccaaauug

SEQ ID NO: 820369 - RNA, 19 nt, Homo sapiens
gcugagaaguuguaauaga

SEQ ID NO: 820370 - RNA, 19 nt, Homo sapiens
ccaaucaguucaccuacua

SEQ ID NO: 820371 - RNA, 19 nt, Homo sapiens
ccacuaaggccuagaauug

SEQ ID NO: 820372 - RNA, 19 nt, Homo sapiens
gaauaacuuuccucuacuu

SEQ ID NO: 820373 - RNA, 19 nt, Homo sapiens
gcacauguggauagaauaa

SEQ ID NO: 820374 - RNA, 19 nt, Homo sapiens
cagaagagaugaguacuau

SEQ ID NO: 820375 - RNA, 19 nt, Homo sapiens
gagcaaaggauggaagaua

SEQ ID NO: 820376 - RNA, 19 nt, Homo sapiens
cagcugagaaguuguaaua

SEQ ID NO: 820377 - RNA, 19 nt, Homo sapiens
ggaacgacuucaaagagaa

SEQ ID NO: 820378 - RNA, 19 nt, Homo sapiens
ggaaguaggaugaauggaa

SEQ ID NO: 820379 - RNA, 19 nt, Homo sapiens
gaagaaauaugacaauccu

SEQ ID NO: 820380 - RNA, 19 nt, Homo sapiens
ucaagaaacuagucuguca

SEQ ID NO: 820381 - RNA, 19 nt, Homo sapiens
ugacagaacaacaagguua

SEQ ID NO: 820382 - RNA, 19 nt, Homo sapiens
ugaguacuauuuccacuaa

SEQ ID NO: 820383 - RNA, 19 nt, Homo sapiens
ucacauaccucaucucaac

SEQ ID NO: 820384 - RNA, 19 nt, Homo sapiens
gcaaguggcuguguuuuaa

SEQ ID NO: 820385 - RNA, 19 nt, Homo sapiens
ggagcucaguggaauugua

SEQ ID NO: 820386 - RNA, 19 nt, Homo sapiens
gaacaucuagccuuucuca

SEQ ID NO: 820387 - RNA, 19 nt, Homo sapiens
gcaaucacaugacuucucu

SEQ ID NO: 820388 - RNA, 19 nt, Homo sapiens
gcaguucuaugugaagauu

SEQ ID NO: 820389 - RNA, 19 nt, Homo sapiens
ggagagaaguuuaaaugcu

SEQ ID NO: 820390 - RNA, 19 nt, Homo sapiens
ggaggaaggaauagaauga

SEQ ID NO: 820391 - RNA, 19 nt, Homo sapiens
caagguggccaguccaaua

SEQ ID NO: 820392 - RNA, 19 nt, Homo sapiens
gaucaggaauguauauaac

SEQ ID NO: 820393 - RNA, 19 nt, Homo sapiens
ucaugucacuacugaauuu

SEQ ID NO: 820394 - RNA, 19 nt, Homo sapiens
gaacaggucaugcggaauc

SEQ ID NO: 820395 - RNA, 19 nt, Homo sapiens
gggaagugcugaaauagag

SEQ ID NO: 820396 - RNA, 19 nt, Homo sapiens
gaacaacaagguuaagcuu

SEQ ID NO: 820397 - RNA, 19 nt, Homo sapiens
gcccacagagcuaauaaua

SEQ ID NO: 820398 - RNA, 19 nt, Homo sapiens
ccaaggaagccaccaaauu

SEQ ID NO: 820399 - RNA, 19 nt, Homo sapiens
gauugacauugacugcuua

SEQ ID NO: 820400 - RNA, 19 nt, Homo sapiens
gagcugaugucccguaguc

SEQ ID NO: 820401 - RNA, 19 nt, Homo sapiens
cagggaaauucuaucuaua

SEQ ID NO: 820402 - RNA, 19 nt, Homo sapiens
ucaaguuccucaaggcuuu

SEQ ID NO: 820403 - RNA, 19 nt, Homo sapiens
caucugcaguucuauguga

SEQ ID NO: 820404 - RNA, 19 nt, Homo sapiens
ccucaagcaucucuuuauu

SEQ ID NO: 820405 - RNA, 19 nt, Homo sapiens
gaaagcagcaugcauuguc

SEQ ID NO: 820406 - RNA, 19 nt, Homo sapiens
guaaucugcugaaagacuu

SEQ ID NO: 820407 - RNA, 19 nt, Homo sapiens
acagggaaauucuaucuau

SEQ ID NO: 820408 - RNA, 19 nt, Homo sapiens
ugacuucucucaacuugga

SEQ ID NO: 820409 - RNA, 19 nt, Homo sapiens
guacaaauaguccugauca

SEQ ID NO: 820410 - RNA, 19 nt, Homo sapiens
aagcaaacuugaacacuga

SEQ ID NO: 820411 - RNA, 19 nt, Homo sapiens
ggcuaaagaugcaaaggaa

SEQ ID NO: 820412 - RNA, 19 nt, Homo sapiens
caaauggcccuguaucuuc

SEQ ID NO: 820413 - RNA, 19 nt, Homo sapiens
auagacaacuccagauuga

SEQ ID NO: 820414 - RNA, 19 nt, Homo sapiens
guagaaaccgagaauauuc

SEQ ID NO: 820415 - RNA, 19 nt, Homo sapiens
gaaggaaguaggaugaaug

SEQ ID NO: 820416 - RNA, 19 nt, Homo sapiens
uaucuugaguugaugguuu

SEQ ID NO: 820417 - RNA, 19 nt, Homo sapiens
caguugaucucuaugaaug

SEQ ID NO: 820418 - RNA, 19 nt, Homo sapiens
caaaggauggaagauaaua

SEQ ID NO: 820419 - RNA, 19 nt, Homo sapiens
cagaugauauuacagaagu

SEQ ID NO: 820420 - RNA, 19 nt, Homo sapiens
gaaccauccagccuuaauu

SEQ ID NO: 820421 - RNA, 19 nt, Homo sapiens
ggaaucagcccacacucuu

SEQ ID NO: 820422 - RNA, 19 nt, Homo sapiens
gauggaagauaauauagac

SEQ ID NO: 820423 - RNA, 19 nt, Homo sapiens
ggaacaaugccuuaaaaua

SEQ ID NO: 820424 - RNA, 19 nt, Homo sapiens
ccacagagcuaauaauacc

SEQ ID NO: 820425 - RNA, 19 nt, Homo sapiens
gaaacacggaaacugagua

SEQ ID NO: 820426 - RNA, 19 nt, Homo sapiens
cuacuuguccugcaucuaa

SEQ ID NO: 820427 - RNA, 19 nt, Homo sapiens
gcacagcauuagugaugga

SEQ ID NO: 820428 - RNA, 19 nt, Homo sapiens
ucacaugacuucucucaac

SEQ ID NO: 820429 - RNA, 19 nt, Homo sapiens
uggguaaacuaucuuugua

SEQ ID NO: 820430 - RNA, 19 nt, Homo sapiens
caaauucuauaucccagau

SEQ ID NO: 820431 - RNA, 19 nt, Homo sapiens
gcccauagccaauauaaca

SEQ ID NO: 820432 - RNA, 19 nt, Homo sapiens
gaacauuuaccaccaugga

SEQ ID NO: 820433 - RNA, 19 nt, Homo sapiens
agcaaaggauggaagauaa

SEQ ID NO: 820434 - RNA, 19 nt, Homo sapiens
cacauuaaauacugacuug

SEQ ID NO: 820435 - RNA, 19 nt, Homo sapiens
gucaugagcaguugaaauu

SEQ ID NO: 820436 - RNA, 19 nt, Homo sapiens
ucaaagguccaucaucaaa

SEQ ID NO: 820437 - RNA, 19 nt, Homo sapiens
ucagcccacuguuuacaua

SEQ ID NO: 820438 - RNA, 19 nt, Homo sapiens
caucuagccuuucucaaca

SEQ ID NO: 820439 - RNA, 19 nt, Homo sapiens
ggaagccaccaaauugauu

SEQ ID NO: 820440 - RNA, 19 nt, Homo sapiens
gcccuaacuuucaggcuuu

SEQ ID NO: 820441 - RNA, 19 nt, Homo sapiens
cagggaagcuuaaaacaaa

SEQ ID NO: 820442 - RNA, 19 nt, Homo sapiens
ggacagaagagaugaguac

SEQ ID NO: 820443 - RNA, 19 nt, Homo sapiens
gaaaucagcccacuguuua

SEQ ID NO: 820444 - RNA, 19 nt, Homo sapiens
gaucaaagguccaucauca

SEQ ID NO: 820445 - RNA, 19 nt, Homo sapiens
gaaaguaugcacagaauaa

SEQ ID NO: 820446 - RNA, 19 nt, Homo sapiens
gaagagaugaguacuauuu

SEQ ID NO: 820447 - RNA, 19 nt, Homo sapiens
uaagggaagugcugaaaua

SEQ ID NO: 820448 - RNA, 19 nt, Homo sapiens
ggaacaagguuuaacuauu

SEQ ID NO: 820449 - RNA, 19 nt, Homo sapiens
ccucaaggcuuuaauguuu

SEQ ID NO: 820450 - RNA, 19 nt, Homo sapiens
gaacgugucuccacucugu

SEQ ID NO: 820451 - RNA, 19 nt, Homo sapiens
caacaaacucccagauuua

SEQ ID NO: 820452 - RNA, 19 nt, Homo sapiens
guacaaaugugcagcgaaa

SEQ ID NO: 820453 - RNA, 19 nt, Homo sapiens
gaacaugucugggcaagug

SEQ ID NO: 820454 - RNA, 19 nt, Homo sapiens
aaacaaggcuagccauauu

SEQ ID NO: 820455 - RNA, 19 nt, Homo sapiens
aaaguaaucugcugaaaga

SEQ ID NO: 820456 - RNA, 19 nt, Homo sapiens
aaagagaacuugagauuca

SEQ ID NO: 820457 - RNA, 19 nt, Homo sapiens
gagcauggguccugccuuu

SEQ ID NO: 820458 - RNA, 19 nt, Homo sapiens
ucaacaaacucccagauuu

SEQ ID NO: 820459 - RNA, 19 nt, Homo sapiens
guacagaucucucgagucu

SEQ ID NO: 820460 - RNA, 19 nt, Homo sapiens
ccagauaccuucccuugaa

SEQ ID NO: 820461 - RNA, 19 nt, Homo sapiens
ugaaguaccugaaguuguu

SEQ ID NO: 820462 - RNA, 19 nt, Homo sapiens
guaauacuccuacaucuuu

SEQ ID NO: 820463 - RNA, 19 nt, Homo sapiens
gagagaaguuuaaaugcuu

SEQ ID NO: 820464 - RNA, 19 nt, Homo sapiens
gacaguaucauguguauuu

SEQ ID NO: 820465 - RNA, 19 nt, Homo sapiens
ugacaauccuagguaauua

SEQ ID NO: 820466 - RNA, 19 nt, Homo sapiens
cagaauaacuuuccucuac

SEQ ID NO: 820467 - RNA, 19 nt, Homo sapiens
gaagcaaccucaagcaucu

SEQ ID NO: 820468 - RNA, 19 nt, Homo sapiens
caaggaagccaccaaauug

SEQ ID NO: 820469 - RNA, 19 nt, Homo sapiens
gcugagaaguuguaauaga

SEQ ID NO: 820470 - RNA, 19 nt, Homo sapiens
ccaaucaguucaccuacua

SEQ ID NO: 820471 - RNA, 19 nt, Homo sapiens
ccacuaaggccuagaauug

SEQ ID NO: 820472 - RNA, 19 nt, Homo sapiens
gaauaacuuuccucuacuu

SEQ ID NO: 820473 - RNA, 19 nt, Homo sapiens
gcacauguggauagaauaa

SEQ ID NO: 820474 - RNA, 19 nt, Homo sapiens
cagaagagaugaguacuau

SEQ ID NO: 820475 - RNA, 19 nt, Homo sapiens
gagcaaaggauggaagaua

SEQ ID NO: 820476 - RNA, 19 nt, Homo sapiens
cagcugagaaguuguaaua

SEQ ID NO: 820477 - RNA, 19 nt, Homo sapiens
ggaacgacuucaaagagaa

SEQ ID NO: 820478 - RNA, 19 nt, Homo sapiens
ggaaguaggaugaauggaa

SEQ ID NO: 820479 - RNA, 19 nt, Homo sapiens
gaagaaauaugacaauccu

SEQ ID NO: 820480 - RNA, 19 nt, Homo sapiens
ucaagaaacuagucuguca

SEQ ID NO: 820481 - RNA, 19 nt, Homo sapiens
ugacagaacaacaagguua

SEQ ID NO: 820482 - RNA, 19 nt, Homo sapiens
ugaguacuauuuccacuaa

SEQ ID NO: 820483 - RNA, 19 nt, Homo sapiens
ucacauaccucaucucaac

SEQ ID NO: 820484 - RNA, 19 nt, Homo sapiens
gcaaguggcuguguuuuaa

SEQ ID NO: 820485 - RNA, 19 nt, Homo sapiens
ggagcucaguggaauugua

SEQ ID NO: 820486 - RNA, 19 nt, Homo sapiens
gaacaucuagccuuucuca

SEQ ID NO: 820487 - RNA, 19 nt, Homo sapiens
gcaaucacaugacuucucu

SEQ ID NO: 820488 - RNA, 19 nt, Homo sapiens
gcaguucuaugugaagauu

SEQ ID NO: 820489 - RNA, 19 nt, Homo sapiens
ggagagaaguuuaaaugcu

SEQ ID NO: 820490 - RNA, 19 nt, Homo sapiens
ggaggaaggaauagaauga

SEQ ID NO: 820491 - RNA, 19 nt, Homo sapiens
caagaugggaggaucauuu

SEQ ID NO: 820492 - RNA, 19 nt, Homo sapiens
caagguggccaguccaaua

SEQ ID NO: 820493 - RNA, 19 nt, Homo sapiens
gaucaggaauguauauaac

SEQ ID NO: 820494 - RNA, 19 nt, Homo sapiens
ucaugucacuacugaauuu

SEQ ID NO: 820495 - RNA, 19 nt, Homo sapiens
gaacaggucaugcggaauc

SEQ ID NO: 820496 - RNA, 19 nt, Homo sapiens
gggaagugcugaaauagag

SEQ ID NO: 820497 - RNA, 19 nt, Homo sapiens
gaacaacaagguuaagcuu

SEQ ID NO: 820498 - RNA, 19 nt, Homo sapiens
gcccacagagcuaauaaua

SEQ ID NO: 820499 - RNA, 19 nt, Homo sapiens
ccaaggaagccaccaaauu

SEQ ID NO: 820500 - RNA, 19 nt, Homo sapiens
gauugacauugacugcuua

SEQ ID NO: 820501 - RNA, 19 nt, Homo sapiens
gagcugaugucccguaguc

SEQ ID NO: 820502 - RNA, 19 nt, Homo sapiens
cagggaaauucuaucuaua

SEQ ID NO: 820503 - RNA, 19 nt, Homo sapiens
ucaaguuccucaaggcuuu

SEQ ID NO: 820504 - RNA, 19 nt, Homo sapiens
caucugcaguucuauguga

SEQ ID NO: 820505 - RNA, 19 nt, Homo sapiens
ccucaagcaucucuuuauu

SEQ ID NO: 820506 - RNA, 19 nt, Homo sapiens
gaaagcagcaugcauuguc

SEQ ID NO: 820507 - RNA, 19 nt, Homo sapiens
guaaucugcugaaagacuu

SEQ ID NO: 820508 - RNA, 19 nt, Homo sapiens
agacugagcucuuuuggua

SEQ ID NO: 820509 - RNA, 19 nt, Homo sapiens
acagggaaauucuaucuau

SEQ ID NO: 820510 - RNA, 19 nt, Homo sapiens
ugacuucucucaacuugga

SEQ ID NO: 820511 - RNA, 19 nt, Homo sapiens
aagcaaacuugaacacuga

SEQ ID NO: 820512 - RNA, 19 nt, Homo sapiens
ggcuaaagaugcaaaggaa

SEQ ID NO: 820513 - RNA, 19 nt, Homo sapiens
caaauggcccuguaucuuc

SEQ ID NO: 820514 - RNA, 19 nt, Homo sapiens
auagacaacuccagauuga

SEQ ID NO: 820515 - RNA, 19 nt, Homo sapiens
guagaaaccgagaauauuc

SEQ ID NO: 820516 - RNA, 19 nt, Homo sapiens
guacaaauaguccugauca

SEQ ID NO: 820517 - RNA, 19 nt, Homo sapiens
gaaggaaguaggaugaaug

SEQ ID NO: 820518 - RNA, 19 nt, Homo sapiens
uaucuugaguugaugguuu

SEQ ID NO: 820519 - RNA, 19 nt, Homo sapiens
caguugaucucuaugaaug

SEQ ID NO: 820520 - RNA, 19 nt, Homo sapiens
caaaggauggaagauaaua

SEQ ID NO: 820521 - RNA, 19 nt, Homo sapiens
cagaugauauuacagaagu

SEQ ID NO: 820522 - RNA, 19 nt, Homo sapiens
gaaccauccagccuuaauu

SEQ ID NO: 820523 - RNA, 19 nt, Homo sapiens
ggaaucagcccacacucuu

SEQ ID NO: 820524 - RNA, 19 nt, Homo sapiens
gauggaagauaauauagac

SEQ ID NO: 820525 - RNA, 19 nt, Homo sapiens
ggaacaaugccuuaaaaua

SEQ ID NO: 820526 - RNA, 19 nt, Homo sapiens
ccacagagcuaauaauacc

SEQ ID NO: 820527 - RNA, 19 nt, Homo sapiens
gaaacacggaaacugagua

SEQ ID NO: 820528 - RNA, 19 nt, Homo sapiens
cuacuuguccugcaucuaa

SEQ ID NO: 820529 - RNA, 19 nt, Homo sapiens
gcacagcauuagugaugga

SEQ ID NO: 820530 - RNA, 19 nt, Homo sapiens
ucacaugacuucucucaac

SEQ ID NO: 820531 - RNA, 19 nt, Homo sapiens
uggguaaacuaucuuugua

SEQ ID NO: 820532 - RNA, 19 nt, Homo sapiens
caaauucuauaucccagau

SEQ ID NO: 820533 - RNA, 19 nt, Homo sapiens
gcccauagccaauauaaca

SEQ ID NO: 820534 - RNA, 19 nt, Homo sapiens
gaacauuuaccaccaugga

SEQ ID NO: 820535 - RNA, 19 nt, Homo sapiens
agcaaaggauggaagauaa

SEQ ID NO: 820536 - RNA, 19 nt, Homo sapiens
cacauuaaauacugacuug

SEQ ID NO: 820537 - RNA, 19 nt, Homo sapiens
gucaugagcaguugaaauu

SEQ ID NO: 820538 - RNA, 19 nt, Homo sapiens
ucaaagguccaucaucaaa

SEQ ID NO: 820539 - RNA, 19 nt, Homo sapiens
ggaagccaccaaauugauu

SEQ ID NO: 820540 - RNA, 19 nt, Homo sapiens
ucagcccacuguuuacaua

SEQ ID NO: 820541 - RNA, 19 nt, Homo sapiens
caucuagccuuucucaaca

SEQ ID NO: 820542 - RNA, 19 nt, Homo sapiens
gcccuaacuuucaggcuuu

SEQ ID NO: 820543 - RNA, 19 nt, Homo sapiens
gcaagaaggugaaauaucg

SEQ ID NO: 820544 - RNA, 19 nt, Homo sapiens
gaauacaaaugaggagauu

SEQ ID NO: 820545 - RNA, 19 nt, Homo sapiens
caucaucucucccaaagug

SEQ ID NO: 820546 - RNA, 19 nt, Homo sapiens
caacguggaucauuucucu

SEQ ID NO: 820547 - RNA, 19 nt, Homo sapiens
ugagggaacugaagcagaa

SEQ ID NO: 820548 - RNA, 19 nt, Homo sapiens
gcauuacuccugugucuuu

SEQ ID NO: 820549 - RNA, 19 nt, Homo sapiens
ccagcgaacugcccuuuga

SEQ ID NO: 820550 - RNA, 19 nt, Homo sapiens
ugggagaacucaucaguga

SEQ ID NO: 820551 - RNA, 19 nt, Homo sapiens
guaguggucuugguagaaa

SEQ ID NO: 820552 - RNA, 19 nt, Homo sapiens
gcacuuaaguuugcacucu

SEQ ID NO: 820553 - RNA, 19 nt, Homo sapiens
ugaccuggauugcacuuaa

SEQ ID NO: 820554 - RNA, 19 nt, Homo sapiens
gagcauuacuccugugucu

SEQ ID NO: 820555 - RNA, 19 nt, Homo sapiens
gauccuaggccuuccauga

SEQ ID NO: 820556 - RNA, 19 nt, Homo sapiens
gagaggcuacgguggaaua

SEQ ID NO: 820557 - RNA, 19 nt, Homo sapiens
guggcaagauggaaaguga

SEQ ID NO: 820558 - RNA, 19 nt, Homo sapiens
ccucugagaugacuaugga

SEQ ID NO: 820559 - RNA, 19 nt, Homo sapiens
agaggaaacugcuucuuca

SEQ ID NO: 820560 - RNA, 19 nt, Homo sapiens
cgacgcgucucugaaugua

SEQ ID NO: 820561 - RNA, 19 nt, Homo sapiens
ggauugcacuuaaguuugc

SEQ ID NO: 820562 - RNA, 19 nt, Homo sapiens
acaagcagcugaccuggau

SEQ ID NO: 820563 - RNA, 19 nt, Homo sapiens
cauccuaccugaucaccuu

SEQ ID NO: 820564 - RNA, 19 nt, Homo sapiens
cuucugugcucuuugagua

SEQ ID NO: 820565 - RNA, 19 nt, Homo sapiens
cuggagcccuucagucuuu

SEQ ID NO: 820566 - RNA, 19 nt, Homo sapiens
gaacgucuggcccauggaa

SEQ ID NO: 820567 - RNA, 19 nt, Homo sapiens
gaagaggagaggccuuguu

SEQ ID NO: 820568 - RNA, 19 nt, Homo sapiens
gggcuugguuuauacgaau

SEQ ID NO: 820569 - RNA, 19 nt, Homo sapiens
ugcaugggcuugguuuaua

SEQ ID NO: 820570 - RNA, 19 nt, Homo sapiens
ggacuuagagcaggagguu

SEQ ID NO: 820571 - RNA, 19 nt, Homo sapiens
gcacacaccuccccaucuu

SEQ ID NO: 820572 - RNA, 19 nt, Homo sapiens
agacaaggccucagaaugg

SEQ ID NO: 820573 - RNA, 19 nt, Homo sapiens
cccggaagaucaugagauu

SEQ ID NO: 820574 - RNA, 19 nt, Homo sapiens
gcugucggauggcaccuuu

SEQ ID NO: 820575 - RNA, 19 nt, Homo sapiens
agguagggcuggugucuuu

SEQ ID NO: 820576 - RNA, 19 nt, Homo sapiens
gaggagaggccuuguuugg

SEQ ID NO: 820577 - RNA, 19 nt, Homo sapiens
ggaauggaacagaagaguu

SEQ ID NO: 820578 - RNA, 19 nt, Homo sapiens
gaggugguguacauaggaa

SEQ ID NO: 820579 - RNA, 19 nt, Homo sapiens
ccuccugacuugccuuauu

SEQ ID NO: 820580 - RNA, 19 nt, Homo sapiens
ccaaagacaaggccucaga

SEQ ID NO: 820581 - RNA, 19 nt, Homo sapiens
cacgggcacuuucuacuug

SEQ ID NO: 820582 - RNA, 19 nt, Homo sapiens
gacaaccaguuccggaugu

SEQ ID NO: 820583 - RNA, 19 nt, Homo sapiens
gggcauggagugucucuau

SEQ ID NO: 820584 - RNA, 19 nt, Homo sapiens
ggaagcugcugugcuccuu

SEQ ID NO: 820585 - RNA, 19 nt, Homo sapiens
gcccuucagucuuucauca

SEQ ID NO: 820586 - RNA, 19 nt, Homo sapiens
gcugcuacguucacucuuc

SEQ ID NO: 820587 - RNA, 19 nt, Homo sapiens
ggugaaauaucggaaggau

SEQ ID NO: 820588 - RNA, 19 nt, Homo sapiens
gaagcuacuaugaacagaa

SEQ ID NO: 820589 - RNA, 19 nt, Homo sapiens
gaaacugcuucuucaucca

SEQ ID NO: 820590 - RNA, 19 nt, Homo sapiens
gcaugggcuugguuuauac

SEQ ID NO: 820591 - RNA, 19 nt, Homo sapiens
cuccugacuugccuuauuu

SEQ ID NO: 820592 - RNA, 19 nt, Homo sapiens
ggagcccucaccaugaaua

SEQ ID NO: 820593 - RNA, 19 nt, Homo sapiens
ccaccgagguugcugaaaa

SEQ ID NO: 820594 - RNA, 19 nt, Homo sapiens
gcuguuaccggaaguacaa

SEQ ID NO: 820595 - RNA, 19 nt, Homo sapiens
cgacaggcacugagcauuc

SEQ ID NO: 820596 - RNA, 19 nt, Homo sapiens
gcaggugggagaagaggaa

SEQ ID NO: 820597 - RNA, 19 nt, Homo sapiens
ggaauacaaaugaggagau

SEQ ID NO: 820598 - RNA, 19 nt, Homo sapiens
cgaauugccauuaaacauc

SEQ ID NO: 820599 - RNA, 19 nt, Homo sapiens
cagcuuuccuguucaccuu

SEQ ID NO: 820600 - RNA, 19 nt, Homo sapiens
gucggcagcuuuccuguuc

SEQ ID NO: 820601 - RNA, 19 nt, Homo sapiens
aagaggagaggccuuguuu

SEQ ID NO: 820602 - RNA, 19 nt, Homo sapiens
gggaguaagcccagacuuc

SEQ ID NO: 820603 - RNA, 19 nt, Homo sapiens
caaagacaaggccucagaa

SEQ ID NO: 820604 - RNA, 19 nt, Homo sapiens
cagacggccuuccgaaagu

SEQ ID NO: 820605 - RNA, 19 nt, Homo sapiens
cagagaggcuacgguggaa

SEQ ID NO: 820606 - RNA, 19 nt, Homo sapiens
caaaugcagcagcacgaaa

SEQ ID NO: 820607 - RNA, 19 nt, Homo sapiens
uacagaguauagugaagaa

SEQ ID NO: 820608 - RNA, 19 nt, Homo sapiens
gaaggagcagcaggaggua

SEQ ID NO: 820609 - RNA, 19 nt, Homo sapiens
gcaagauggaaagugauuu

SEQ ID NO: 820610 - RNA, 19 nt, Homo sapiens
aggcuacgguggaauacaa

SEQ ID NO: 820611 - RNA, 19 nt, Homo sapiens
ggaggugguguacauagga

SEQ ID NO: 820612 - RNA, 19 nt, Homo sapiens
aguuugcacucuauaagaa

SEQ ID NO: 820613 - RNA, 19 nt, Homo sapiens
agacggccuuccgaaagua

SEQ ID NO: 820614 - RNA, 19 nt, Homo sapiens
gacuggaagcuuggacuua

SEQ ID NO: 820615 - RNA, 19 nt, Homo sapiens
cugcuucugugcucuuuga

SEQ ID NO: 820616 - RNA, 19 nt, Homo sapiens
gaccuagcccucccacuuc

SEQ ID NO: 820617 - RNA, 19 nt, Homo sapiens
cuuuaacccugaccucuau

SEQ ID NO: 820618 - RNA, 19 nt, Homo sapiens
gcuuuaacccugaccucua

SEQ ID NO: 820619 - RNA, 19 nt, Homo sapiens
gaugguuaccucuggaaga

SEQ ID NO: 820620 - RNA, 19 nt, Homo sapiens
ccacgggcacuuucuacuu

SEQ ID NO: 820621 - RNA, 19 nt, Homo sapiens
ggcaagauggaaagugauu

SEQ ID NO: 820622 - RNA, 19 nt, Homo sapiens
ggauuaaacgagaggacuu

SEQ ID NO: 820623 - RNA, 19 nt, Homo sapiens
gcucaacguggaucauuuc

SEQ ID NO: 820624 - RNA, 19 nt, Homo sapiens
gccaccaccugaagaucuu

SEQ ID NO: 820625 - RNA, 19 nt, Homo sapiens
gacuggagcagauggagaa

SEQ ID NO: 820626 - RNA, 19 nt, Homo sapiens
ccuucagucuuucaucauu

SEQ ID NO: 820627 - RNA, 19 nt, Homo sapiens
ggcauggagugucucuaug

SEQ ID NO: 820628 - RNA, 19 nt, Homo sapiens
cuggagcccucaccaugaa

SEQ ID NO: 820629 - RNA, 19 nt, Homo sapiens
caaggacaccaccgagguu

SEQ ID NO: 820630 - RNA, 19 nt, Homo sapiens
caugaugaguggcugucuu

SEQ ID NO: 820631 - RNA, 19 nt, Homo sapiens
ucaagaggaggcacugcua

SEQ ID NO: 820632 - RNA, 19 nt, Homo sapiens
ggacagcugaagcccaugu

SEQ ID NO: 820633 - RNA, 19 nt, Homo sapiens
gagaggaccacaugaagcu

SEQ ID NO: 820634 - RNA, 19 nt, Homo sapiens
gugaagaaucuauuuaagg

SEQ ID NO: 820635 - RNA, 19 nt, Homo sapiens
ggaggggucuuguacauac

SEQ ID NO: 820636 - RNA, 19 nt, Homo sapiens
cacuuaaguuugcacucua

SEQ ID NO: 820637 - RNA, 19 nt, Homo sapiens
gaccuggauugcacuuaag

SEQ ID NO: 820638 - RNA, 19 nt, Homo sapiens
ggguaguggucuugguaga

SEQ ID NO: 820639 - RNA, 19 nt, Homo sapiens
gagaagcggauggcagaga

SEQ ID NO: 820640 - RNA, 19 nt, Homo sapiens
gaguuuggcagugguugua

SEQ ID NO: 820641 - RNA, 19 nt, Homo sapiens
caagaggaggcacugcuau

SEQ ID NO: 820642 - RNA, 19 nt, Homo sapiens
agaccuagcccucccacuu

SEQ ID NO: 820643 - RNA, 19 nt, Homo sapiens
gaagagagcuguuaggaaa

SEQ ID NO: 820644 - RNA, 19 nt, Homo sapiens
guacauaaguggaacauuu

SEQ ID NO: 820645 - RNA, 19 nt, Homo sapiens
gcaaugaaguggccaaauu

SEQ ID NO: 820646 - RNA, 19 nt, Homo sapiens
gaaagucccuggauucaga

SEQ ID NO: 820647 - RNA, 19 nt, Homo sapiens
gcucauggcucucaaagaa

SEQ ID NO: 820648 - RNA, 19 nt, Homo sapiens
ccaaggagcuggcccauug

SEQ ID NO: 820649 - RNA, 19 nt, Homo sapiens
gcaggacucuucauugauu

SEQ ID NO: 820650 - RNA, 19 nt, Homo sapiens
gaaaccaccuuuaauuauc

SEQ ID NO: 820651 - RNA, 19 nt, Homo sapiens
gcccagaaaugguugaaua

SEQ ID NO: 820652 - RNA, 19 nt, Homo sapiens
gaagucagccuuugccuuu

SEQ ID NO: 820653 - RNA, 19 nt, Homo sapiens
gcaacuagcuguucagucu

SEQ ID NO: 820654 - RNA, 19 nt, Homo sapiens
ugaagaagcugaccuagau

SEQ ID NO: 820655 - RNA, 19 nt, Homo sapiens
ggagagaugccuuauguuu

SEQ ID NO: 820656 - RNA, 19 nt, Homo sapiens
gaucauacagguguuauua

SEQ ID NO: 820657 - RNA, 19 nt, Homo sapiens
gucaagaacuuccugcaua

SEQ ID NO: 820658 - RNA, 19 nt, Homo sapiens
ggaccugagucuucaauga

SEQ ID NO: 820659 - RNA, 19 nt, Homo sapiens
gguuuaagaucuccuauga

SEQ ID NO: 820660 - RNA, 19 nt, Homo sapiens
uagcccagcucacaaauuu

SEQ ID NO: 820661 - RNA, 19 nt, Homo sapiens
ucaagaacuuccugcauaa

SEQ ID NO: 820662 - RNA, 19 nt, Homo sapiens
gaaaauauguccacgaugu

SEQ ID NO: 820663 - RNA, 19 nt, Homo sapiens
gaagcgaccugguguuaca

SEQ ID NO: 820664 - RNA, 19 nt, Homo sapiens
cuaaucauuucccuacuua

SEQ ID NO: 820665 - RNA, 19 nt, Homo sapiens
gagaguggcuacagugaug

SEQ ID NO: 820666 - RNA, 19 nt, Homo sapiens
guacaggugugacauuugu

SEQ ID NO: 820667 - RNA, 19 nt, Homo sapiens
ggagcuaauuguucaagaa

SEQ ID NO: 820668 - RNA, 19 nt, Homo sapiens
cagcaacccuagauauaaa

SEQ ID NO: 820669 - RNA, 19 nt, Homo sapiens
caaauuauguagcucacaa

SEQ ID NO: 820670 - RNA, 19 nt, Homo sapiens
ggaacaggcucgggaaaug

SEQ ID NO: 820671 - RNA, 19 nt, Homo sapiens
gggcaaauaucugagcuuu

SEQ ID NO: 820672 - RNA, 19 nt, Homo sapiens
gaagagaaauguuuaucac

SEQ ID NO: 820673 - RNA, 19 nt, Homo sapiens
ccagguacccaguuuguua

SEQ ID NO: 820674 - RNA, 19 nt, Homo sapiens
uaacucaccuacaagaaau

SEQ ID NO: 820675 - RNA, 19 nt, Homo sapiens
gcacucacuugucagaaga

SEQ ID NO: 820676 - RNA, 19 nt, Homo sapiens
gcugaacacuuccgaaauc

SEQ ID NO: 820677 - RNA, 19 nt, Homo sapiens
caaguguucucccagauga

SEQ ID NO: 820678 - RNA, 19 nt, Homo sapiens
uaggugacccuguuuaaua

SEQ ID NO: 820679 - RNA, 19 nt, Homo sapiens
gcaaaggcaugcuugugau

SEQ ID NO: 820680 - RNA, 19 nt, Homo sapiens
uaacaugccagacuccaua

SEQ ID NO: 820681 - RNA, 19 nt, Homo sapiens
gaccggaacgugaagaaua

SEQ ID NO: 820682 - RNA, 19 nt, Homo sapiens
caucugcucugcccuuauu

SEQ ID NO: 820683 - RNA, 19 nt, Homo sapiens
caauaucgcuccucacucu

SEQ ID NO: 820684 - RNA, 19 nt, Homo sapiens
gacagacaauggacuuuga

SEQ ID NO: 820685 - RNA, 19 nt, Homo sapiens
gacuuacccuugucuauga

SEQ ID NO: 820686 - RNA, 19 nt, Homo sapiens
ccgaaugucugaauguuga

SEQ ID NO: 820687 - RNA, 19 nt, Homo sapiens
caugaaaccaccuuuaauu

SEQ ID NO: 820688 - RNA, 19 nt, Homo sapiens
cagaagagguacuggcuau

SEQ ID NO: 820689 - RNA, 19 nt, Homo sapiens
cagcaaggccaaacgguua

SEQ ID NO: 820690 - RNA, 19 nt, Homo sapiens
ggucugggcacaaugguua

SEQ ID NO: 820691 - RNA, 19 nt, Homo sapiens
gaugcuaucuaaucauugu

SEQ ID NO: 820692 - RNA, 19 nt, Homo sapiens
aaagaacugucaagaacuu

SEQ ID NO: 820693 - RNA, 19 nt, Homo sapiens
gcuccucacucuacucuga

SEQ ID NO: 820694 - RNA, 19 nt, Homo sapiens
gcagaacggugagguagau

SEQ ID NO: 820695 - RNA, 19 nt, Homo sapiens
caaaguaccagaaccaaau

SEQ ID NO: 820696 - RNA, 19 nt, Homo sapiens
ugagaggucacauguguua

SEQ ID NO: 820697 - RNA, 19 nt, Homo sapiens
caaugaaagugaccucuuc

SEQ ID NO: 820698 - RNA, 19 nt, Homo sapiens
ccaaucaugugacuaguuc

SEQ ID NO: 820699 - RNA, 19 nt, Homo sapiens
ccagagauguugguuucua

SEQ ID NO: 820700 - RNA, 19 nt, Homo sapiens
gaaucuagagggcaaauau

SEQ ID NO: 820701 - RNA, 19 nt, Homo sapiens
ggaaagacaaauuauguag

SEQ ID NO: 820702 - RNA, 19 nt, Homo sapiens
ggucacauguguuacuguu

SEQ ID NO: 820703 - RNA, 19 nt, Homo sapiens
caauaguaaucacgucuga

SEQ ID NO: 820704 - RNA, 19 nt, Homo sapiens
gagcagugaugaucgaaag

SEQ ID NO: 820705 - RNA, 19 nt, Homo sapiens
aaaggaaagucccuggauu

SEQ ID NO: 820706 - RNA, 19 nt, Homo sapiens
gcacacgauugacuuucuu

SEQ ID NO: 820707 - RNA, 19 nt, Homo sapiens
caaccuaauccuacucuuu

SEQ ID NO: 820708 - RNA, 19 nt, Homo sapiens
gcuaauuguucaagaagug

SEQ ID NO: 820709 - RNA, 19 nt, Homo sapiens
gccaggagcuaauuguuca

SEQ ID NO: 820710 - RNA, 19 nt, Homo sapiens
ugaggacucuguaguugaa

SEQ ID NO: 820711 - RNA, 19 nt, Homo sapiens
gauggagauuugaguguug

SEQ ID NO: 820712 - RNA, 19 nt, Homo sapiens
ucacaaauuucccuaaggu

SEQ ID NO: 820713 - RNA, 19 nt, Homo sapiens
aaccaagucuucuguuuau

SEQ ID NO: 820714 - RNA, 19 nt, Homo sapiens
gggaaagacaaauuaugua

SEQ ID NO: 820715 - RNA, 19 nt, Homo sapiens
uacaagaaaugcugacaug

SEQ ID NO: 820716 - RNA, 19 nt, Homo sapiens
aacauuaacucaccuacaa

SEQ ID NO: 820717 - RNA, 19 nt, Homo sapiens
uaaaugaggagaccuuguu

SEQ ID NO: 820718 - RNA, 19 nt, Homo sapiens
gagcagcugucugugaaga

SEQ ID NO: 820719 - RNA, 19 nt, Homo sapiens
gagagaugccuuauguuug

SEQ ID NO: 820720 - RNA, 19 nt, Homo sapiens
caaacgguuagaccaauua

SEQ ID NO: 820721 - RNA, 19 nt, Homo sapiens
ccaaacgguuagaccaauu

SEQ ID NO: 820722 - RNA, 19 nt, Homo sapiens
caaaagaacugucaagaac

SEQ ID NO: 820723 - RNA, 19 nt, Homo sapiens
ggacuuacccuugucuaug

SEQ ID NO: 820724 - RNA, 19 nt, Homo sapiens
acaggcagcugaacacuuc

SEQ ID NO: 820725 - RNA, 19 nt, Homo sapiens
ccaagaaccugagcuagca

SEQ ID NO: 820726 - RNA, 19 nt, Homo sapiens
ggaagagccccaaguauuu

SEQ ID NO: 820727 - RNA, 19 nt, Homo sapiens
gaaaggaaagucccuggau

SEQ ID NO: 820728 - RNA, 19 nt, Homo sapiens
ccaggaaguugucuuugug

SEQ ID NO: 820729 - RNA, 19 nt, Homo sapiens
caauuugcaugagggauuu

SEQ ID NO: 820730 - RNA, 19 nt, Homo sapiens
guggauuuguggauuaauu

SEQ ID NO: 820731 - RNA, 19 nt, Homo sapiens
ggaucagccugcuaacaug

SEQ ID NO: 820732 - RNA, 19 nt, Homo sapiens
ccucaauuguaucauagua

SEQ ID NO: 820733 - RNA, 19 nt, Homo sapiens
aauaggacguucuuuggaa

SEQ ID NO: 820734 - RNA, 19 nt, Homo sapiens
ucauaagccuggagagaug

SEQ ID NO: 820735 - RNA, 19 nt, Homo sapiens
caaaguagcccagcucaca

SEQ ID NO: 820736 - RNA, 19 nt, Homo sapiens
guccagaccaaacucauua

SEQ ID NO: 820737 - RNA, 19 nt, Homo sapiens
gaccacgaaucccaagcua

SEQ ID NO: 820738 - RNA, 19 nt, Homo sapiens
gccaggaaguugucuuugu

SEQ ID NO: 820739 - RNA, 19 nt, Homo sapiens
uuauguagcucacaaacug

SEQ ID NO: 820740 - RNA, 19 nt, Homo sapiens
gucauucacuucugcuaaa

SEQ ID NO: 820741 - RNA, 19 nt, Homo sapiens
gaaccuuggugugauguag

SEQ ID NO: 820742 - RNA, 19 nt, Homo sapiens
cuaaggauguagcagagaa

SEQ ID NO: 820743 - RNA, 19 nt, Homo sapiens
gaagagagcuguuaggaaa

SEQ ID NO: 820744 - RNA, 19 nt, Homo sapiens
gcaaugaaguggccaaauu

SEQ ID NO: 820745 - RNA, 19 nt, Homo sapiens
gaaagucccuggauucaga

SEQ ID NO: 820746 - RNA, 19 nt, Homo sapiens
gcucauggcucucaaagaa

SEQ ID NO: 820747 - RNA, 19 nt, Homo sapiens
gcccagaaaugguugaaua

SEQ ID NO: 820748 - RNA, 19 nt, Homo sapiens
gaagucagccuuugccuuu

SEQ ID NO: 820749 - RNA, 19 nt, Homo sapiens
gcaacuagcuguucagucu

SEQ ID NO: 820750 - RNA, 19 nt, Homo sapiens
ggagagaugccuuauguuu

SEQ ID NO: 820751 - RNA, 19 nt, Homo sapiens
ggaccugagucuucaauga

SEQ ID NO: 820752 - RNA, 19 nt, Homo sapiens
gguuuaagaucuccuauga

SEQ ID NO: 820753 - RNA, 19 nt, Homo sapiens
uagcccagcucacaaauuu

SEQ ID NO: 820754 - RNA, 19 nt, Homo sapiens
gaaaauauguccacgaugu

SEQ ID NO: 820755 - RNA, 19 nt, Homo sapiens
gaagcgaccugguguuaca

SEQ ID NO: 820756 - RNA, 19 nt, Homo sapiens
cuaaucauuucccuacuua

SEQ ID NO: 820757 - RNA, 19 nt, Homo sapiens
gggcaaauaucugagcuuu

SEQ ID NO: 820758 - RNA, 19 nt, Homo sapiens
gaagagaaauguuuaucac

SEQ ID NO: 820759 - RNA, 19 nt, Homo sapiens
ccagguacccaguuuguua

SEQ ID NO: 820760 - RNA, 19 nt, Homo sapiens
gcugaacacuuccgaaauc

SEQ ID NO: 820761 - RNA, 19 nt, Homo sapiens
caaguguucucccagauga

SEQ ID NO: 820762 - RNA, 19 nt, Homo sapiens
gaccggaacgugaagaaua

SEQ ID NO: 820763 - RNA, 19 nt, Homo sapiens
caucugcucugcccuuauu

SEQ ID NO: 820764 - RNA, 19 nt, Homo sapiens
caauaucgcuccucacucu

SEQ ID NO: 820765 - RNA, 19 nt, Homo sapiens
gacagacaauggacuuuga

SEQ ID NO: 820766 - RNA, 19 nt, Homo sapiens
ccgaaugucugaauguuga

SEQ ID NO: 820767 - RNA, 19 nt, Homo sapiens
cagcaaggccaaacgguua

SEQ ID NO: 820768 - RNA, 19 nt, Homo sapiens
ggucugggcacaaugguua

SEQ ID NO: 820769 - RNA, 19 nt, Homo sapiens
gcuccucacucuacucuga

SEQ ID NO: 820770 - RNA, 19 nt, Homo sapiens
gcagaacggugagguagau

SEQ ID NO: 820771 - RNA, 19 nt, Homo sapiens
caaaguaccagaaccaaau

SEQ ID NO: 820772 - RNA, 19 nt, Homo sapiens
ugagaggucacauguguua

SEQ ID NO: 820773 - RNA, 19 nt, Homo sapiens
caaugaaagugaccucuuc

SEQ ID NO: 820774 - RNA, 19 nt, Homo sapiens
ccaaucaugugacuaguuc

SEQ ID NO: 820775 - RNA, 19 nt, Homo sapiens
gaaucuagagggcaaauau

SEQ ID NO: 820776 - RNA, 19 nt, Homo sapiens
ggucacauguguuacuguu

SEQ ID NO: 820777 - RNA, 19 nt, Homo sapiens
aaaggaaagucccuggauu

SEQ ID NO: 820778 - RNA, 19 nt, Homo sapiens
gcacacgauugacuuucuu

SEQ ID NO: 820779 - RNA, 19 nt, Homo sapiens
caaccuaauccuacucuuu

SEQ ID NO: 820780 - RNA, 19 nt, Homo sapiens
ugaggacucuguaguugaa

SEQ ID NO: 820781 - RNA, 19 nt, Homo sapiens
ucacaaauuucccuaaggu

SEQ ID NO: 820782 - RNA, 19 nt, Homo sapiens
uaaaugaggagaccuuguu

SEQ ID NO: 820783 - RNA, 19 nt, Homo sapiens
gagcagcugucugugaaga

SEQ ID NO: 820784 - RNA, 19 nt, Homo sapiens
gagagaugccuuauguuug

SEQ ID NO: 820785 - RNA, 19 nt, Homo sapiens
caaacgguuagaccaauua

SEQ ID NO: 820786 - RNA, 19 nt, Homo sapiens
ccaaacgguuagaccaauu

SEQ ID NO: 820787 - RNA, 19 nt, Homo sapiens
acaggcagcugaacacuuc

SEQ ID NO: 820788 - RNA, 19 nt, Homo sapiens
ccaagaaccugagcuagca

SEQ ID NO: 820789 - RNA, 19 nt, Homo sapiens
ggaagagccccaaguauuu

SEQ ID NO: 820790 - RNA, 19 nt, Homo sapiens
gaaaggaaagucccuggau

SEQ ID NO: 820791 - RNA, 19 nt, Homo sapiens
ccaggaaguugucuuugug

SEQ ID NO: 820792 - RNA, 19 nt, Homo sapiens
aauaggacguucuuuggaa

SEQ ID NO: 820793 - RNA, 19 nt, Homo sapiens
ucauaagccuggagagaug

SEQ ID NO: 820794 - RNA, 19 nt, Homo sapiens
caaaguagcccagcucaca

SEQ ID NO: 820795 - RNA, 19 nt, Homo sapiens
guccagaccaaacucauua

SEQ ID NO: 820796 - RNA, 19 nt, Homo sapiens
gaccacgaaucccaagcua

SEQ ID NO: 820797 - RNA, 19 nt, Homo sapiens
gccaggaaguugucuuugu

SEQ ID NO: 820798 - RNA, 19 nt, Homo sapiens
ccaaccacaugaucaacaa

SEQ ID NO: 820799 - RNA, 19 nt, Homo sapiens
ucauuucccuacuuacgua

SEQ ID NO: 820800 - RNA, 19 nt, Homo sapiens
agacuucccuaaucauuuc

SEQ ID NO: 820801 - RNA, 19 nt, Homo sapiens
cuggagagaugccuuaugu

SEQ ID NO: 820802 - RNA, 19 nt, Homo sapiens
ugaauacccuuaacaccau

SEQ ID NO: 820803 - RNA, 19 nt, Homo sapiens
uuuaagaucuccuaugagu

SEQ ID NO: 820804 - RNA, 19 nt, Homo sapiens
guuuaucacugcaacaaau

SEQ ID NO: 820805 - RNA, 19 nt, Homo sapiens
ugagguagauguccauuuu

SEQ ID NO: 820806 - RNA, 19 nt, Homo sapiens
aaugcucaauuucguguua

SEQ ID NO: 820807 - RNA, 19 nt, Homo sapiens
gaaaagucccuuccagaaa

SEQ ID NO: 820808 - RNA, 19 nt, Homo sapiens
guaguacuguuugcucuau

SEQ ID NO: 820809 - RNA, 19 nt, Homo sapiens
ccgcugaccuccucaaugg

SEQ ID NO: 820810 - RNA, 19 nt, Homo sapiens
gaaugggcguuugaaagug

SEQ ID NO: 820811 - RNA, 19 nt, Homo sapiens
gcucacaaauuucccuaag

SEQ ID NO: 820812 - RNA, 19 nt, Homo sapiens
gugaagcgaccugguguua

SEQ ID NO: 820813 - RNA, 19 nt, Homo sapiens
acucuguaguugaagauua

SEQ ID NO: 820814 - RNA, 19 nt, Homo sapiens
gaagagaaacuggcugagu

SEQ ID NO: 820815 - RNA, 19 nt, Homo sapiens
ccacucacccgcaggcuuu

SEQ ID NO: 820816 - RNA, 19 nt, Homo sapiens
ggaacgugaagaauaugua

SEQ ID NO: 820817 - RNA, 19 nt, Homo sapiens
ggacaaaauugaacacaag

SEQ ID NO: 820818 - RNA, 19 nt, Homo sapiens
ggauugugcugaacguaca

SEQ ID NO: 820819 - RNA, 19 nt, Homo sapiens
caccagaagagaaauguuu

SEQ ID NO: 820820 - RNA, 19 nt, Homo sapiens
acaccgaccuguucaugga

SEQ ID NO: 820821 - RNA, 19 nt, Homo sapiens
gcucuaugcugcaauacag

SEQ ID NO: 820822 - RNA, 19 nt, Homo sapiens
gcagaaugccaaucaugug

SEQ ID NO: 820823 - RNA, 19 nt, Homo sapiens
uaugaaacaccacguagaa

SEQ ID NO: 820824 - RNA, 19 nt, Homo sapiens
ugacuuucuugauggguaa

SEQ ID NO: 820825 - RNA, 19 nt, Homo sapiens
acgauugacuuucuugaug

SEQ ID NO: 820826 - RNA, 19 nt, Homo sapiens
gaaccuuugacaucugaaa

SEQ ID NO: 820827 - RNA, 19 nt, Homo sapiens
gugaaccuuugacaucuga

SEQ ID NO: 820828 - RNA, 19 nt, Homo sapiens
gccguuggcuucgacguuu

SEQ ID NO: 820829 - RNA, 19 nt, Homo sapiens
ccuaaucauuucccuacuu

SEQ ID NO: 820830 - RNA, 19 nt, Homo sapiens
ccacagcuggcaauccuuu

SEQ ID NO: 820831 - RNA, 19 nt, Homo sapiens
ucaccagccucaacugcaa

SEQ ID NO: 820832 - RNA, 19 nt, Homo sapiens
guuccuguauccucuaaug

SEQ ID NO: 820833 - RNA, 19 nt, Homo sapiens
ugaaugggcguuugaaagu

SEQ ID NO: 820834 - RNA, 19 nt, Homo sapiens
ugagguagauggucacacu

SEQ ID NO: 820835 - RNA, 19 nt, Homo sapiens
acgauguaaugcucaauuu

SEQ ID NO: 820836 - RNA, 19 nt, Homo sapiens
ccagaaggccaccaaaaua

SEQ ID NO: 820837 - RNA, 19 nt, Homo sapiens
cagcugaacacuuccgaaa

SEQ ID NO: 820838 - RNA, 19 nt, Homo sapiens
ggagccgaaugucugaaug

SEQ ID NO: 820839 - RNA, 19 nt, Homo sapiens
caaagcugccacugugaaa

SEQ ID NO: 820840 - RNA, 19 nt, Homo sapiens
cauaaaaccuuccguaaac

SEQ ID NO: 820841 - RNA, 19 nt, Homo sapiens
agagaugccuuauguuugc

SEQ ID NO: 820842 - RNA, 19 nt, Homo sapiens
caaacucauuaugcuugua

SEQ ID NO: 820843 - RNA, 19 nt, Homo sapiens
ggacuuaaauccuagcauu

SEQ ID NO: 820844 - RNA, 19 nt, Homo sapiens
ggaaacaaaugauucucua

SEQ ID NO: 820845 - RNA, 19 nt, Homo sapiens
ggaagaggaugcaaguaaa

SEQ ID NO: 820846 - RNA, 19 nt, Homo sapiens
ugaugaagcugauggauaa

SEQ ID NO: 820847 - RNA, 19 nt, Homo sapiens
ugagaaaccuggucagaaa

SEQ ID NO: 820848 - RNA, 19 nt, Homo sapiens
aaagugaucuagugugaua

SEQ ID NO: 820849 - RNA, 19 nt, Homo sapiens
gaaaggcacucaacacaag

SEQ ID NO: 820850 - RNA, 19 nt, Homo sapiens
ggaaggaaauaaggaaauu

SEQ ID NO: 820851 - RNA, 19 nt, Homo sapiens
gggaagugauaaacuauuu

SEQ ID NO: 820852 - RNA, 19 nt, Homo sapiens
gagcaucaguuuaagaaga

SEQ ID NO: 820853 - RNA, 19 nt, Homo sapiens
ccuaagggcuucuauaaga

SEQ ID NO: 820854 - RNA, 19 nt, Homo sapiens
ucaggaugcucuauuuaua

SEQ ID NO: 820855 - RNA, 19 nt, Homo sapiens
guucauagauguugacaau

SEQ ID NO: 820856 - RNA, 19 nt, Homo sapiens
ugaaggcacugaauauuga

SEQ ID NO: 820857 - RNA, 19 nt, Homo sapiens
gcuaaacccugucuggauu

SEQ ID NO: 820858 - RNA, 19 nt, Homo sapiens
gauacugauugccacauua

SEQ ID NO: 820859 - RNA, 19 nt, Homo sapiens
gauacugauucccacauua

SEQ ID NO: 820860 - RNA, 19 nt, Homo sapiens
ccaaagugaucuaguguga

SEQ ID NO: 820861 - RNA, 19 nt, Homo sapiens
guagauauuugacaguuug

SEQ ID NO: 820862 - RNA, 19 nt, Homo sapiens
acccugagcuucacacuua

SEQ ID NO: 820863 - RNA, 19 nt, Homo sapiens
uaagaguccuuucugcuuu

SEQ ID NO: 820864 - RNA, 19 nt, Homo sapiens
caagacauuugaccuuuga

SEQ ID NO: 820865 - RNA, 19 nt, Homo sapiens
ucaccaagcugucucauca

SEQ ID NO: 820866 - RNA, 19 nt, Homo sapiens
ggacaggaaucacuuaaaa

SEQ ID NO: 820867 - RNA, 19 nt, Homo sapiens
ggaacucacccaacucuaa

SEQ ID NO: 820868 - RNA, 19 nt, Homo sapiens
gcagaacccuugcucaucu

SEQ ID NO: 820869 - RNA, 19 nt, Homo sapiens
gaugggauuugaugagauu

SEQ ID NO: 820870 - RNA, 19 nt, Homo sapiens
caaaagauauccccuaaga

SEQ ID NO: 820871 - RNA, 19 nt, Homo sapiens
ucaccgagcugucacauca

SEQ ID NO: 820872 - RNA, 19 nt, Homo sapiens
gguaauugaucgagagcua

SEQ ID NO: 820873 - RNA, 19 nt, Homo sapiens
gaacucacccaacucuaaa

SEQ ID NO: 820874 - RNA, 19 nt, Homo sapiens
gagucaggaugcucuauuu

SEQ ID NO: 820875 - RNA, 19 nt, Homo sapiens
caacauggcucagagucuu

SEQ ID NO: 820876 - RNA, 19 nt, Homo sapiens
uaaccaaagugaucuagug

SEQ ID NO: 820877 - RNA, 19 nt, Homo sapiens
cagggaagcucuuagaauc

SEQ ID NO: 820878 - RNA, 19 nt, Homo sapiens
cggacaagcugacuuucua

SEQ ID NO: 820879 - RNA, 19 nt, Homo sapiens
gaguuggacuacacgauuu

SEQ ID NO: 820880 - RNA, 19 nt, Homo sapiens
auauagaggugaccaguuu

SEQ ID NO: 820881 - RNA, 19 nt, Homo sapiens
cagcaaauauguagucaag

SEQ ID NO: 820882 - RNA, 19 nt, Homo sapiens
uaaggaaauucaacccaaa

SEQ ID NO: 820883 - RNA, 19 nt, Homo sapiens
gaaggaaguuuggguugau

SEQ ID NO: 820884 - RNA, 19 nt, Homo sapiens
guacaaggaguauuaugaa

SEQ ID NO: 820885 - RNA, 19 nt, Homo sapiens
caacccaaauuucccaaga

SEQ ID NO: 820886 - RNA, 19 nt, Homo sapiens
cauuugaccuuugacauuu

SEQ ID NO: 820887 - RNA, 19 nt, Homo sapiens
gccaagacauuugaccuuu

SEQ ID NO: 820888 - RNA, 19 nt, Homo sapiens
gaaaauuccuuaggugauu

SEQ ID NO: 820889 - RNA, 19 nt, Homo sapiens
caacuagaccacacuuauu

SEQ ID NO: 820890 - RNA, 19 nt, Homo sapiens
ggauuucucuugggaucua

SEQ ID NO: 820891 - RNA, 19 nt, Homo sapiens
gcaugacuuuaaugacuuu

SEQ ID NO: 820892 - RNA, 19 nt, Homo sapiens
gggcuggucaccugauuua

SEQ ID NO: 820893 - RNA, 19 nt, Homo sapiens
caaccucccuggacacugu

SEQ ID NO: 820894 - RNA, 19 nt, Homo sapiens
acugggaacugauuuauau

SEQ ID NO: 820895 - RNA, 19 nt, Homo sapiens
ucucaguugucccuaaaua

SEQ ID NO: 820896 - RNA, 19 nt, Homo sapiens
caauggaacccucccagua

SEQ ID NO: 820897 - RNA, 19 nt, Homo sapiens
ggaaggaggccucggacaa

SEQ ID NO: 820898 - RNA, 19 nt, Homo sapiens
gcucugagaacaagaaaga

SEQ ID NO: 820899 - RNA, 19 nt, Homo sapiens
ggacugaacaccugcacuu

SEQ ID NO: 820900 - RNA, 19 nt, Homo sapiens
aaagucaucucuucagcaa

SEQ ID NO: 820901 - RNA, 19 nt, Homo sapiens
cagcauggcucagagucua

SEQ ID NO: 820902 - RNA, 19 nt, Homo sapiens
caaaugauucucuaucuca

SEQ ID NO: 820903 - RNA, 19 nt, Homo sapiens
agaaagcagugcccaaugu

SEQ ID NO: 820904 - RNA, 19 nt, Homo sapiens
ggaaaggcacucaacacaa

SEQ ID NO: 820905 - RNA, 19 nt, Homo sapiens
ccgaguacaaggaguauua

SEQ ID NO: 820906 - RNA, 19 nt, Homo sapiens
ggacuacaccuggaccuuu

SEQ ID NO: 820907 - RNA, 19 nt, Homo sapiens
ccacagacccucaaucuac

SEQ ID NO: 820908 - RNA, 19 nt, Homo sapiens
ucacccaacucuaaauugu

SEQ ID NO: 820909 - RNA, 19 nt, Homo sapiens
ccagacaccuaauucuuca

SEQ ID NO: 820910 - RNA, 19 nt, Homo sapiens
ccagacaccuaauucuuca

SEQ ID NO: 820911 - RNA, 19 nt, Homo sapiens
ucacagucaucuaaccaaa

SEQ ID NO: 820912 - RNA, 19 nt, Homo sapiens
cuaaagggcuauucaucug

SEQ ID NO: 820913 - RNA, 19 nt, Homo sapiens
caagcugucucaucaccaa

SEQ ID NO: 820914 - RNA, 19 nt, Homo sapiens
cagacaagaugggauuuga

SEQ ID NO: 820915 - RNA, 19 nt, Homo sapiens
ccaagacauuugaccuuug

SEQ ID NO: 820916 - RNA, 19 nt, Homo sapiens
ggacuguucuacugugaag

SEQ ID NO: 820917 - RNA, 19 nt, Homo sapiens
cuaaauauccagacaagau

SEQ ID NO: 820918 - RNA, 19 nt, Homo sapiens
uggaugaaccagagucuua

SEQ ID NO: 820919 - RNA, 19 nt, Homo sapiens
uaauugaccucaggaagga

SEQ ID NO: 820920 - RNA, 19 nt, Homo sapiens
ccacuccaccuuccuaauu

SEQ ID NO: 820921 - RNA, 19 nt, Homo sapiens
ugaaggaaguuuggguuga

SEQ ID NO: 820922 - RNA, 19 nt, Homo sapiens
gcugucucaucaccaaaua

SEQ ID NO: 820923 - RNA, 19 nt, Homo sapiens
uagagaaagugaucaccaa

SEQ ID NO: 820924 - RNA, 19 nt, Homo sapiens
gcggacacccuuucucaaa

SEQ ID NO: 820925 - RNA, 19 nt, Homo sapiens
uaagagacagagcacauuu

SEQ ID NO: 820926 - RNA, 19 nt, Homo sapiens
ucgagaaccucauccaugu

SEQ ID NO: 820927 - RNA, 19 nt, Homo sapiens
gacuacaccuggaccuuug

SEQ ID NO: 820928 - RNA, 19 nt, Homo sapiens
gugcaugacuuuaaugacu

SEQ ID NO: 820929 - RNA, 19 nt, Homo sapiens
ugucacaagucuuauugaa

SEQ ID NO: 820930 - RNA, 19 nt, Homo sapiens
caggaugcucuauuuauaa

SEQ ID NO: 820931 - RNA, 19 nt, Homo sapiens
gagacucuaucacuaugug

SEQ ID NO: 820932 - RNA, 19 nt, Homo sapiens
agacuacauucuguucaua

SEQ ID NO: 820933 - RNA, 19 nt, Homo sapiens
ucaaguuuauguucucaug

SEQ ID NO: 820934 - RNA, 19 nt, Homo sapiens
gauucugucacaagucuua

SEQ ID NO: 820935 - RNA, 19 nt, Homo sapiens
caauguggauaauacaaca

SEQ ID NO: 820936 - RNA, 19 nt, Homo sapiens
cagcugaaggcacugaaua

SEQ ID NO: 820937 - RNA, 19 nt, Homo sapiens
gcagaaaacaaaacuauug

SEQ ID NO: 820938 - RNA, 19 nt, Homo sapiens
gauaaacuauuugccuucu

SEQ ID NO: 820939 - RNA, 19 nt, Homo sapiens
gacuaggacuguucuacug

SEQ ID NO: 820940 - RNA, 19 nt, Homo sapiens
aaagggaacucacccaacu

SEQ ID NO: 820941 - RNA, 19 nt, Homo sapiens
gaaaccuggucagaaacaa

SEQ ID NO: 820942 - RNA, 19 nt, Homo sapiens
ccaacuagaccacacuuau

SEQ ID NO: 820943 - RNA, 19 nt, Homo sapiens
uaaagacgaugaugugaua

SEQ ID NO: 820944 - RNA, 19 nt, Homo sapiens
ucagugagcuucagcagua

SEQ ID NO: 820945 - RNA, 19 nt, Homo sapiens
ggacagcucucggaacuga

SEQ ID NO: 820946 - RNA, 19 nt, Homo sapiens
caacaagccugaagaaguc

SEQ ID NO: 820947 - RNA, 19 nt, Homo sapiens
gcccagagaucaucaguga

SEQ ID NO: 820948 - RNA, 19 nt, Homo sapiens
gcacaaauccauccaugaa

SEQ ID NO: 820949 - RNA, 19 nt, Homo sapiens
gcacagaaguggguucgaa

SEQ ID NO: 820950 - RNA, 19 nt, Homo sapiens
gaaguacccucaccucauc

SEQ ID NO: 820951 - RNA, 19 nt, Homo sapiens
caucguaugcgcaguauua

SEQ ID NO: 820952 - RNA, 19 nt, Homo sapiens
gagagggagcggcuuauua

SEQ ID NO: 820953 - RNA, 19 nt, Homo sapiens
gggagcggcuuauuaauca

SEQ ID NO: 820954 - RNA, 19 nt, Homo sapiens
ccaugucaaugaugucuua

SEQ ID NO: 820955 - RNA, 19 nt, Homo sapiens
cagaagcccucccacauga

SEQ ID NO: 820956 - RNA, 19 nt, Homo sapiens
caacagcuccacagaugua

SEQ ID NO: 820957 - RNA, 19 nt, Homo sapiens
gaaguggguucgaaacauc

SEQ ID NO: 820958 - RNA, 19 nt, Homo sapiens
ugugaaaccucaucagauu

SEQ ID NO: 820959 - RNA, 19 nt, Homo sapiens
gagaugaggugauugaacu

SEQ ID NO: 820960 - RNA, 19 nt, Homo sapiens
agaauuggcuggcagaguu

SEQ ID NO: 820961 - RNA, 19 nt, Homo sapiens
ggaggacacucugcacauu

SEQ ID NO: 820962 - RNA, 19 nt, Homo sapiens
caagaagaguuggaaagaa

SEQ ID NO: 820963 - RNA, 19 nt, Homo sapiens
gauguacaggcaagaauua

SEQ ID NO: 820964 - RNA, 19 nt, Homo sapiens
caacuggccugucugaagu

SEQ ID NO: 820965 - RNA, 19 nt, Homo sapiens
gaacacggguauccagucu

SEQ ID NO: 820966 - RNA, 19 nt, Homo sapiens
cuaaagugauggcugauug

SEQ ID NO: 820967 - RNA, 19 nt, Homo sapiens
ccgaaaggaucacaagcua

SEQ ID NO: 820968 - RNA, 19 nt, Homo sapiens
ggugguggaugaucuaaau

SEQ ID NO: 820969 - RNA, 19 nt, Homo sapiens
cacaggcucugaagaauau

SEQ ID NO: 820970 - RNA, 19 nt, Homo sapiens
gcaagaagaguuggaaaga

SEQ ID NO: 820971 - RNA, 19 nt, Homo sapiens
gcuggaaggcagugauuua

SEQ ID NO: 820972 - RNA, 19 nt, Homo sapiens
ccaaugaugaugaggauaa

SEQ ID NO: 820973 - RNA, 19 nt, Homo sapiens
gcacccaugucaaugaugu

SEQ ID NO: 820974 - RNA, 19 nt, Homo sapiens
ggauaaagacgaugaugug

SEQ ID NO: 820975 - RNA, 19 nt, Homo sapiens
acuaccagcuguccaauuu

SEQ ID NO: 820976 - RNA, 19 nt, Homo sapiens
aaacaguccuugccauugu

SEQ ID NO: 820977 - RNA, 19 nt, Homo sapiens
gagcucuguugcuguuuaa

SEQ ID NO: 820978 - RNA, 19 nt, Homo sapiens
uaaauccaaugcugaacuu

SEQ ID NO: 820979 - RNA, 19 nt, Homo sapiens
ggaaggcagugauuuagac

SEQ ID NO: 820980 - RNA, 19 nt, Homo sapiens
cgacagauauuguuauucc

SEQ ID NO: 820981 - RNA, 19 nt, Homo sapiens
cccaggaagucauuuguuu

SEQ ID NO: 820982 - RNA, 19 nt, Homo sapiens
ucaaugaugucuuaaacca

SEQ ID NO: 820983 - RNA, 19 nt, Homo sapiens
gcagugaaucugucaguga

SEQ ID NO: 820984 - RNA, 19 nt, Homo sapiens
ggguucagcuccaaugaug

SEQ ID NO: 820985 - RNA, 19 nt, Homo sapiens
guacaggcaagaauuaaug

SEQ ID NO: 820986 - RNA, 19 nt, Homo sapiens
gaagaaacauacgaaagcu

SEQ ID NO: 820987 - RNA, 19 nt, Homo sapiens
ggugagagcauccacauca

SEQ ID NO: 820988 - RNA, 19 nt, Homo sapiens
gaaaggaucacaagcuaac

SEQ ID NO: 820989 - RNA, 19 nt, Homo sapiens
agagggagcggcuuauuaa

SEQ ID NO: 820990 - RNA, 19 nt, Homo sapiens
ggaccuagacguggaagaa

SEQ ID NO: 820991 - RNA, 19 nt, Homo sapiens
cagugaagaugaugaggaa

SEQ ID NO: 820992 - RNA, 19 nt, Homo sapiens
ggaguucagcaacauguuu

SEQ ID NO: 820993 - RNA, 19 nt, Homo sapiens
caaagcagcacagcaagaa

SEQ ID NO: 820994 - RNA, 19 nt, Homo sapiens
cacgacagauauuguuauu

SEQ ID NO: 820995 - RNA, 19 nt, Homo sapiens
ccaaugagcaggaccuaga

SEQ ID NO: 820996 - RNA, 19 nt, Homo sapiens
ucacaggcucugaagaaua

SEQ ID NO: 820997 - RNA, 19 nt, Homo sapiens
ccacaugagaagaaacaua

SEQ ID NO: 820998 - RNA, 19 nt, Homo sapiens
gaucaauuggagccuguua

SEQ ID NO: 820999 - RNA, 19 nt, Homo sapiens
aagaagaguuggaaagaag

SEQ ID NO: 821000 - RNA, 19 nt, Homo sapiens
cagaucgggugguggauga

SEQ ID NO: 821001 - RNA, 19 nt, Homo sapiens
gagcgaggcaacaacauug

SEQ ID NO: 821002 - RNA, 19 nt, Homo sapiens
gagcagcagaggaaagauu

SEQ ID NO: 821003 - RNA, 19 nt, Homo sapiens
gguuaauacucuucagaau

SEQ ID NO: 821004 - RNA, 19 nt, Homo sapiens
gagaagaaacauacgaaag

SEQ ID NO: 821005 - RNA, 19 nt, Homo sapiens
gcaacuggccugucugaag

SEQ ID NO: 821006 - RNA, 19 nt, Homo sapiens
cuacugcacuuuguugaga

SEQ ID NO: 821007 - RNA, 19 nt, Homo sapiens
ggagcgaggcaacaacauu

SEQ ID NO: 821008 - RNA, 19 nt, Homo sapiens
aaggagagcuuggccaaug

SEQ ID NO: 821009 - RNA, 19 nt, Homo sapiens
cagugaaucugucagugaa

SEQ ID NO: 821010 - RNA, 19 nt, Homo sapiens
agagcucuguugcuguuua

SEQ ID NO: 821011 - RNA, 19 nt, Homo sapiens
ugaagaugaugaggaagaa

SEQ ID NO: 821012 - RNA, 19 nt, Homo sapiens
caaugaugaugaggauaaa

SEQ ID NO: 821013 - RNA, 19 nt, Homo sapiens
gauacuacccagcuauuca

SEQ ID NO: 821014 - RNA, 19 nt, Homo sapiens
uccaugaacuuucccauca

SEQ ID NO: 821015 - RNA, 19 nt, Homo sapiens
gccagagucuuuccaccuu

SEQ ID NO: 821016 - RNA, 19 nt, Homo sapiens
gagggugguuggccaaagu

SEQ ID NO: 821017 - RNA, 19 nt, Homo sapiens
gauaaagacgaugauguga

SEQ ID NO: 821018 - RNA, 19 nt, Homo sapiens
ggucccaggugccuccauu

SEQ ID NO: 821019 - RNA, 19 nt, Homo sapiens
gcuauucacucccauucuc

SEQ ID NO: 821020 - RNA, 19 nt, Homo sapiens
caagauccagcgagauuug

SEQ ID NO: 821021 - RNA, 19 nt, Homo sapiens
cuuuaaaguucacaucuug

SEQ ID NO: 821022 - RNA, 19 nt, Homo sapiens
cucaacagcuccacagaug

SEQ ID NO: 821023 - RNA, 19 nt, Homo sapiens
gaacuuucccaucaacuac

SEQ ID NO: 821024 - RNA, 19 nt, Homo sapiens
gcacaucaguccccuauac

SEQ ID NO: 821025 - RNA, 19 nt, Homo sapiens
ggaagacaaacgcacauca

SEQ ID NO: 821026 - RNA, 19 nt, Homo sapiens
gaaccgaaaggaucacaag

SEQ ID NO: 821027 - RNA, 19 nt, Homo sapiens
uuacaucuaucgccuugug

SEQ ID NO: 821028 - RNA, 19 nt, Homo sapiens
uggcagaguucaacaugug

SEQ ID NO: 821029 - RNA, 19 nt, Homo sapiens
ccucaauaguucccucuug

SEQ ID NO: 821030 - RNA, 19 nt, Homo sapiens
uaugucggguauaccguua

SEQ ID NO: 821031 - RNA, 19 nt, Homo sapiens
ccaccuggcuguuccuucu

SEQ ID NO: 821032 - RNA, 19 nt, Homo sapiens
guguuuagccagagucuuu

SEQ ID NO: 821033 - RNA, 19 nt, Homo sapiens
cagccucgguucuuuaaag

SEQ ID NO: 821034 - RNA, 19 nt, Homo sapiens
gggcaugucuaucuaucca

SEQ ID NO: 821035 - RNA, 19 nt, Homo sapiens
cgaggauguuugcgccuuu

SEQ ID NO: 821036 - RNA, 19 nt, Homo sapiens
cuagaaaacucucccaaga

SEQ ID NO: 821037 - RNA, 19 nt, Homo sapiens
aggaccuucugacuaauua

SEQ ID NO: 821038 - RNA, 19 nt, Homo sapiens
caacauugucacauaugaa

SEQ ID NO: 821039 - RNA, 19 nt, Homo sapiens
ccucacaggcucugaagaa

SEQ ID NO: 821040 - RNA, 19 nt, Homo sapiens
ccucgguucuuuaaaguuc

SEQ ID NO: 821041 - RNA, 19 nt, Homo sapiens
ugacaacaagccugaagaa

SEQ ID NO: 821042 - RNA, 19 nt, Homo sapiens
gcaguggcuuuggcuguau

SEQ ID NO: 821043 - RNA, 19 nt, Homo sapiens
gaauugaccuugaccauua

SEQ ID NO: 821044 - RNA, 19 nt, Homo sapiens
gcagagagaucuucccaua

SEQ ID NO: 821045 - RNA, 19 nt, Homo sapiens
uaacuuagcuugcacauga

SEQ ID NO: 821046 - RNA, 19 nt, Homo sapiens
caaguggucuguugauaua

SEQ ID NO: 821047 - RNA, 19 nt, Homo sapiens
gaaaucaucuagcaguaaa

SEQ ID NO: 821048 - RNA, 19 nt, Homo sapiens
gacaagugcuguuugauaa

SEQ ID NO: 821049 - RNA, 19 nt, Homo sapiens
gcucgaauaucagcaauua

SEQ ID NO: 821050 - RNA, 19 nt, Homo sapiens
ggacaagugcuguuugaua

SEQ ID NO: 821051 - RNA, 19 nt, Homo sapiens
gaguaaagcuagaaauuuc

SEQ ID NO: 821052 - RNA, 19 nt, Homo sapiens
gaauauaccugugauguag

SEQ ID NO: 821053 - RNA, 19 nt, Homo sapiens
gaaaguauguguugagcau

SEQ ID NO: 821054 - RNA, 19 nt, Homo sapiens
gcaauuagaagacgauaaa

SEQ ID NO: 821055 - RNA, 19 nt, Homo sapiens
cagauuagaugugccaaua

SEQ ID NO: 821056 - RNA, 19 nt, Homo sapiens
uaacccaacuguacuugua

SEQ ID NO: 821057 - RNA, 19 nt, Homo sapiens
cuaaagaacuggaagacaa

SEQ ID NO: 821058 - RNA, 19 nt, Homo sapiens
caaaacagcucgaauauca

SEQ ID NO: 821059 - RNA, 19 nt, Homo sapiens
cagcaucacuaaaccgaua

SEQ ID NO: 821060 - RNA, 19 nt, Homo sapiens
gagagaucuucccauaaua

SEQ ID NO: 821061 - RNA, 19 nt, Homo sapiens
ccaaaguagugguccauaa

SEQ ID NO: 821062 - RNA, 19 nt, Homo sapiens
gggagaguuugaacaauuu

SEQ ID NO: 821063 - RNA, 19 nt, Homo sapiens
ggaguaaagcuagaaauuu

SEQ ID NO: 821064 - RNA, 19 nt, Homo sapiens
gaaagcaccauuggguuua

SEQ ID NO: 821065 - RNA, 19 nt, Homo sapiens
gaggacaagugcuguuuga

SEQ ID NO: 821066 - RNA, 19 nt, Homo sapiens
ccagaacaaucaaccauga

SEQ ID NO: 821067 - RNA, 19 nt, Homo sapiens
caacuguacuuguaucugu

SEQ ID NO: 821068 - RNA, 19 nt, Homo sapiens
agagagaucuucccauaau

SEQ ID NO: 821069 - RNA, 19 nt, Homo sapiens
cuagaaauuuccacaagaa

SEQ ID NO: 821070 - RNA, 19 nt, Homo sapiens
gcuagaaauuuccacaaga

SEQ ID NO: 821071 - RNA, 19 nt, Homo sapiens
agaagcaccucccaagaaa

SEQ ID NO: 821072 - RNA, 19 nt, Homo sapiens
ccagaagaauugaccuuga

SEQ ID NO: 821073 - RNA, 19 nt, Homo sapiens
cggaacaacuuuuacauua

SEQ ID NO: 821074 - RNA, 19 nt, Homo sapiens
gcccaagguucuaaagauu

SEQ ID NO: 821075 - RNA, 19 nt, Homo sapiens
caaaguagugguccauaaa

SEQ ID NO: 821076 - RNA, 19 nt, Homo sapiens
cugaagauaucaccaggua

SEQ ID NO: 821077 - RNA, 19 nt, Homo sapiens
cagaaaucaucuagcagua

SEQ ID NO: 821078 - RNA, 19 nt, Homo sapiens
aagaugaccugaugaaaca

SEQ ID NO: 821079 - RNA, 19 nt, Homo sapiens
gcaaguggucuguugauau

SEQ ID NO: 821080 - RNA, 19 nt, Homo sapiens
aagcagagaugcauuucuu

SEQ ID NO: 821081 - RNA, 19 nt, Homo sapiens
ggacccugcuaaggaaaua

SEQ ID NO: 821082 - RNA, 19 nt, Homo sapiens
guacuuguuucaucugguu

SEQ ID NO: 821083 - RNA, 19 nt, Homo sapiens
uuagaaaccucaacagaca

SEQ ID NO: 821084 - RNA, 19 nt, Homo sapiens
cgggagaguuugaacaauu

SEQ ID NO: 821085 - RNA, 19 nt, Homo sapiens
cuaaaccgauaaugcauga

SEQ ID NO: 821086 - RNA, 19 nt, Homo sapiens
gaaauuuccacaagaagug

SEQ ID NO: 821087 - RNA, 19 nt, Homo sapiens
ccaagaaauuccuaaccuu

SEQ ID NO: 821088 - RNA, 19 nt, Homo sapiens
gaucagaauauaccuguga

SEQ ID NO: 821089 - RNA, 19 nt, Homo sapiens
aaaccguggucucauguaa

SEQ ID NO: 821090 - RNA, 19 nt, Homo sapiens
ggauugaccagaggaauaa

SEQ ID NO: 821091 - RNA, 19 nt, Homo sapiens
gcgauuacauuagugaguu

SEQ ID NO: 821092 - RNA, 19 nt, Homo sapiens
ccaaaaccaucacauauga

SEQ ID NO: 821093 - RNA, 19 nt, Homo sapiens
gaacuggaagacaaaguga

SEQ ID NO: 821094 - RNA, 19 nt, Homo sapiens
ugucagauuuccucagauu

SEQ ID NO: 821095 - RNA, 19 nt, Homo sapiens
gaagauuacccucaaaugc

SEQ ID NO: 821096 - RNA, 19 nt, Homo sapiens
gcagucaugcaaaccguua

SEQ ID NO: 821097 - RNA, 19 nt, Homo sapiens
gagcaucagugaaugaaaa

SEQ ID NO: 821098 - RNA, 19 nt, Homo sapiens
gcucauccagcaaacguua

SEQ ID NO: 821099 - RNA, 19 nt, Homo sapiens
uauaaaccguggucucaug

SEQ ID NO: 821100 - RNA, 19 nt, Homo sapiens
cagaagcaccucccaagaa

SEQ ID NO: 821101 - RNA, 19 nt, Homo sapiens
ccaagguucuaaagauuuc

SEQ ID NO: 821102 - RNA, 19 nt, Homo sapiens
agagaugcauuucuuggaa

SEQ ID NO: 821103 - RNA, 19 nt, Homo sapiens
gggcuuacguaucgagaug

SEQ ID NO: 821104 - RNA, 19 nt, Homo sapiens
ugaacuugcuagagaaaga

SEQ ID NO: 821105 - RNA, 19 nt, Homo sapiens
gauuagaugugccaauaac

SEQ ID NO: 821106 - RNA, 19 nt, Homo sapiens
gacgauaaacuuucucaga

SEQ ID NO: 821107 - RNA, 19 nt, Homo sapiens
aaauuucaguccagaagaa

SEQ ID NO: 821108 - RNA, 19 nt, Homo sapiens
caugaaggauucuaugucu

SEQ ID NO: 821109 - RNA, 19 nt, Homo sapiens
ugaaagcaccauuggguuu

SEQ ID NO: 821110 - RNA, 19 nt, Homo sapiens
gcaccaaaccacacuaaag

SEQ ID NO: 821111 - RNA, 19 nt, Homo sapiens
gaagauaucaccagguacu

SEQ ID NO: 821112 - RNA, 19 nt, Homo sapiens
aaaugaagauuacccucaa

SEQ ID NO: 821113 - RNA, 19 nt, Homo sapiens
auucaugccuuucauaguu

SEQ ID NO: 821114 - RNA, 19 nt, Homo sapiens
gaccuugaccauuaauaaa

SEQ ID NO: 821115 - RNA, 19 nt, Homo sapiens
ggcccaagguucuaaagau

SEQ ID NO: 821116 - RNA, 19 nt, Homo sapiens
ucucagaaaucaucuagca

SEQ ID NO: 821117 - RNA, 19 nt, Homo sapiens
acacugccguaacgaauga

SEQ ID NO: 821118 - RNA, 19 nt, Homo sapiens
gaagaagucacgcccaucu

SEQ ID NO: 821119 - RNA, 19 nt, Homo sapiens
gcccagcaccuuacuuuga

SEQ ID NO: 821120 - RNA, 19 nt, Homo sapiens
gguuccaaguuucguuaua

SEQ ID NO: 821121 - RNA, 19 nt, Homo sapiens
uaaagaacuggaagacaaa

SEQ ID NO: 821122 - RNA, 19 nt, Homo sapiens
caccaaaccacacuaaaga

SEQ ID NO: 821123 - RNA, 19 nt, Homo sapiens
agauuacccucaaaugcua

SEQ ID NO: 821124 - RNA, 19 nt, Homo sapiens
gagaucuucccauaauaaa

SEQ ID NO: 821125 - RNA, 19 nt, Homo sapiens
ugaccuugaccauuaauaa

SEQ ID NO: 821126 - RNA, 19 nt, Homo sapiens
gaucacaccagaagaugga

SEQ ID NO: 821127 - RNA, 19 nt, Homo sapiens
gugcagccauccacauuuc

SEQ ID NO: 821128 - RNA, 19 nt, Homo sapiens
cgcuaaagcuguccuggaa

SEQ ID NO: 821129 - RNA, 19 nt, Homo sapiens
gggaggaggucgcuaaagc

SEQ ID NO: 821130 - RNA, 19 nt, Homo sapiens
ggaguucccucuucuaacc

SEQ ID NO: 821131 - RNA, 19 nt, Homo sapiens
gaucagacucggaauccaa

SEQ ID NO: 821132 - RNA, 19 nt, Homo sapiens
cuaaagcuguccuggaaca

SEQ ID NO: 821133 - RNA, 19 nt, Homo sapiens
guuaggaguuugugcaagu

SEQ ID NO: 821134 - RNA, 19 nt, Homo sapiens
gcuuggcacuuuucauuua

SEQ ID NO: 821135 - RNA, 19 nt, Homo sapiens
agagaucuucccauaauaa

SEQ ID NO: 821136 - RNA, 19 nt, Homo sapiens
caagugcuguuugauaaag

SEQ ID NO: 821137 - RNA, 19 nt, Homo sapiens
uguaaugcuuccaaucuug

SEQ ID NO: 821138 - RNA, 19 nt, Homo sapiens
gagccaggcgugcugauga

SEQ ID NO: 821139 - RNA, 19 nt, Homo sapiens
cacaagagccacagaggaa

SEQ ID NO: 821140 - RNA, 19 nt, Homo sapiens
ugugggagcgauuacauua

SEQ ID NO: 821141 - RNA, 19 nt, Homo sapiens
guuggacccugcuaaggaa

SEQ ID NO: 821142 - RNA, 19 nt, Homo sapiens
cacuugaacuugcuagaga

SEQ ID NO: 821143 - RNA, 19 nt, Homo sapiens
ggacaaaguuggagaauuu

SEQ ID NO: 821144 - RNA, 19 nt, Homo sapiens
gaagcgacauuuagauuua

SEQ ID NO: 821145 - RNA, 19 nt, Homo sapiens
gaagaaagaucaagagcuu

SEQ ID NO: 821146 - RNA, 19 nt, Homo sapiens
gaagcaagauguuauagaa

SEQ ID NO: 821147 - RNA, 19 nt, Homo sapiens
ccaaacacauggaauuuaa

SEQ ID NO: 821148 - RNA, 19 nt, Homo sapiens
gaaacuuguuaccgaauua

SEQ ID NO: 821149 - RNA, 19 nt, Homo sapiens
gcaaacaucuggagcacaa

SEQ ID NO: 821150 - RNA, 19 nt, Homo sapiens
guacucaacugcaugaauu

SEQ ID NO: 821151 - RNA, 19 nt, Homo sapiens
gaaaagagcuaggcaagua

SEQ ID NO: 821152 - RNA, 19 nt, Homo sapiens
gaacggagaguguuugaaa

SEQ ID NO: 821153 - RNA, 19 nt, Homo sapiens
uaaaagagcugguagaaaa

SEQ ID NO: 821154 - RNA, 19 nt, Homo sapiens
ggaugaaauugaugcuuua

SEQ ID NO: 821155 - RNA, 19 nt, Homo sapiens
cuaaauagauguccauuca

SEQ ID NO: 821156 - RNA, 19 nt, Homo sapiens
gaaggaagauaagcuaaga

SEQ ID NO: 821157 - RNA, 19 nt, Homo sapiens
gaagauaagcuaagacaga

SEQ ID NO: 821158 - RNA, 19 nt, Homo sapiens
ucaggaauaugaagaagua

SEQ ID NO: 821159 - RNA, 19 nt, Homo sapiens
aaagaaagguggcuuaauc

SEQ ID NO: 821160 - RNA, 19 nt, Homo sapiens
gaaccaaacacauggaauu

SEQ ID NO: 821161 - RNA, 19 nt, Homo sapiens
gcagugugcuggugaaguu

SEQ ID NO: 821162 - RNA, 19 nt, Homo sapiens
gcacaaagacaaugaacuu

SEQ ID NO: 821163 - RNA, 19 nt, Homo sapiens
cuuaagagccuuuguauuu

SEQ ID NO: 821164 - RNA, 19 nt, Homo sapiens
ucagcaggcuuuaauagua

SEQ ID NO: 821165 - RNA, 19 nt, Homo sapiens
agagaaaguugcagccuua

SEQ ID NO: 821166 - RNA, 19 nt, Homo sapiens
ucacucaaccuucuuaaua

SEQ ID NO: 821167 - RNA, 19 nt, Homo sapiens
caaagacaaugaacuuaga

SEQ ID NO: 821168 - RNA, 19 nt, Homo sapiens
gagaagacacuuagaagaa

SEQ ID NO: 821169 - RNA, 19 nt, Homo sapiens
ggccauggguggaauauga

SEQ ID NO: 821170 - RNA, 19 nt, Homo sapiens
gaauggacccaaucaauga

SEQ ID NO: 821171 - RNA, 19 nt, Homo sapiens
ggacugaauccuacaauug

SEQ ID NO: 821172 - RNA, 19 nt, Homo sapiens
cuacaauuguucaggaaua

SEQ ID NO: 821173 - RNA, 19 nt, Homo sapiens
gaagaacagcuaaaggaaa

SEQ ID NO: 821174 - RNA, 19 nt, Homo sapiens
ccuauaacaugucgaauug

SEQ ID NO: 821175 - RNA, 19 nt, Homo sapiens
gaaaguugcagccuuaaau

SEQ ID NO: 821176 - RNA, 19 nt, Homo sapiens
gaagagaggauguucuaga

SEQ ID NO: 821177 - RNA, 19 nt, Homo sapiens
caaagcaccuucaagaucu

SEQ ID NO: 821178 - RNA, 19 nt, Homo sapiens
cgacagaggagaauaggua

SEQ ID NO: 821179 - RNA, 19 nt, Homo sapiens
gaagggcagauuccuauaa

SEQ ID NO: 821180 - RNA, 19 nt, Homo sapiens
gaacggaagcgacauuuag

SEQ ID NO: 821181 - RNA, 19 nt, Homo sapiens
guucagggcuucuggaaau

SEQ ID NO: 821182 - RNA, 19 nt, Homo sapiens
gaacuaaagaccacggaaa

SEQ ID NO: 821183 - RNA, 19 nt, Homo sapiens
cagcaggcuuuaauaguaa

SEQ ID NO: 821184 - RNA, 19 nt, Homo sapiens
agagggaacuugggaauuu

SEQ ID NO: 821185 - RNA, 19 nt, Homo sapiens
gcaaggaacuuaugaaaag

SEQ ID NO: 821186 - RNA, 19 nt, Homo sapiens
gaacggguaauacaagaaa

SEQ ID NO: 821187 - RNA, 19 nt, Homo sapiens
uaagagccuuuguauuuga

SEQ ID NO: 821188 - RNA, 19 nt, Homo sapiens
gagggaaacucuagagaag

SEQ ID NO: 821189 - RNA, 19 nt, Homo sapiens
ggaauggacccaaucaaug

SEQ ID NO: 821190 - RNA, 19 nt, Homo sapiens
gcagagaagacacuuagaa

SEQ ID NO: 821191 - RNA, 19 nt, Homo sapiens
caaagagguucgugacaau

SEQ ID NO: 821192 - RNA, 19 nt, Homo sapiens
gggaaacucuagagaagga

SEQ ID NO: 821193 - RNA, 19 nt, Homo sapiens
gcagauuccuauaacaugu

SEQ ID NO: 821194 - RNA, 19 nt, Homo sapiens
ggaagcgacauuuagauuu

SEQ ID NO: 821195 - RNA, 19 nt, Homo sapiens
agacagagauuccgugaca

SEQ ID NO: 821196 - RNA, 19 nt, Homo sapiens
gaagaggucagaaaacuua

SEQ ID NO: 821197 - RNA, 19 nt, Homo sapiens
cagaguaguugaugaaauc

SEQ ID NO: 821198 - RNA, 19 nt, Homo sapiens
aaauagauguccauucaga

SEQ ID NO: 821199 - RNA, 19 nt, Homo sapiens
ugaauuaacuccucaucau

SEQ ID NO: 821200 - RNA, 19 nt, Homo sapiens
agagucaaauuucgaagua

SEQ ID NO: 821201 - RNA, 19 nt, Homo sapiens
ucagaggaaugaaagauau

SEQ ID NO: 821202 - RNA, 19 nt, Homo sapiens
gcacuucaggagcuaaaua

SEQ ID NO: 821203 - RNA, 19 nt, Homo sapiens
gagcuaggcaaguauguaa

SEQ ID NO: 821204 - RNA, 19 nt, Homo sapiens
guuuaaagcugauggaaca

SEQ ID NO: 821205 - RNA, 19 nt, Homo sapiens
gcaaacagaagcaagaugu

SEQ ID NO: 821206 - RNA, 19 nt, Homo sapiens
aaacgagcgucacaauuug

SEQ ID NO: 821207 - RNA, 19 nt, Homo sapiens
ucaaagagguucgugacaa

SEQ ID NO: 821208 - RNA, 19 nt, Homo sapiens
gaaggcgaaauaauugaua

SEQ ID NO: 821209 - RNA, 19 nt, Homo sapiens
cacucaaccuucuuaauaa

SEQ ID NO: 821210 - RNA, 19 nt, Homo sapiens
gagaguguuugaaaugguu

SEQ ID NO: 821211 - RNA, 19 nt, Homo sapiens
gaacuaaagggaaagaaag

SEQ ID NO: 821212 - RNA, 19 nt, Homo sapiens
gaagacacuuagaagaaca

SEQ ID NO: 821213 - RNA, 19 nt, Homo sapiens
ggaacuaaagggaaagaaa

SEQ ID NO: 821214 - RNA, 19 nt, Homo sapiens
uggaugaaauugaugcuuu

SEQ ID NO: 821215 - RNA, 19 nt, Homo sapiens
gaaaugcaaggaacuuaug

SEQ ID NO: 821216 - RNA, 19 nt, Homo sapiens
caggauacuugcaaucuug

SEQ ID NO: 821217 - RNA, 19 nt, Homo sapiens
gaaagaauugaacggguaa

SEQ ID NO: 821218 - RNA, 19 nt, Homo sapiens
agacaaagcaccuucaaga

SEQ ID NO: 821219 - RNA, 19 nt, Homo sapiens
gacaaugaacuuagacaaa

SEQ ID NO: 821220 - RNA, 19 nt, Homo sapiens
aagaacagcuaaaggaaau

SEQ ID NO: 821221 - RNA, 19 nt, Homo sapiens
gaguucauaugcagacaaa

SEQ ID NO: 821222 - RNA, 19 nt, Homo sapiens
ugagacggauucaggauga

SEQ ID NO: 821223 - RNA, 19 nt, Homo sapiens
gaaaauaguggaagagaaa

SEQ ID NO: 821224 - RNA, 19 nt, Homo sapiens
uggagaacuuccuaacaua

SEQ ID NO: 821225 - RNA, 19 nt, Homo sapiens
cgaaacuuguuaccgaauu

SEQ ID NO: 821226 - RNA, 19 nt, Homo sapiens
gaaaaggcaacagauauua

SEQ ID NO: 821227 - RNA, 19 nt, Homo sapiens
ggaacaggauacuugcaau

SEQ ID NO: 821228 - RNA, 19 nt, Homo sapiens
ugaaucagaaggaagauaa

SEQ ID NO: 821229 - RNA, 19 nt, Homo sapiens
gaaaaggcauuaugugaag

SEQ ID NO: 821230 - RNA, 19 nt, Homo sapiens
gggacugaauccuacaauu

SEQ ID NO: 821231 - RNA, 19 nt, Homo sapiens
gaauugaacggguaauaca

SEQ ID NO: 821232 - RNA, 19 nt, Homo sapiens
cagaggagaauagguaaua

SEQ ID NO: 821233 - RNA, 19 nt, Homo sapiens
ggagaacuuccuaacauau

SEQ ID NO: 821234 - RNA, 19 nt, Homo sapiens
gaacuucagcaggcuuuaa

SEQ ID NO: 821235 - RNA, 19 nt, Homo sapiens
caccaaagcuccugcaaaa

SEQ ID NO: 821236 - RNA, 19 nt, Homo sapiens
ggaggugaaagaaguguuu

SEQ ID NO: 821237 - RNA, 19 nt, Homo sapiens
guacuucuuugcauauaca

SEQ ID NO: 821238 - RNA, 19 nt, Homo sapiens
aauacugccuguaaagaaa

SEQ ID NO: 821239 - RNA, 19 nt, Homo sapiens
caaacacauuggaugaaau

SEQ ID NO: 821240 - RNA, 19 nt, Homo sapiens
gagcagagaagacacuuag

SEQ ID NO: 821241 - RNA, 19 nt, Homo sapiens
ugaguuaccuuugcuguca

SEQ ID NO: 821242 - RNA, 19 nt, Homo sapiens
ucaagaagauauggagguu

SEQ ID NO: 821243 - RNA, 19 nt, Homo sapiens
ccagaaggcugaauuuauu

SEQ ID NO: 821244 - RNA, 19 nt, Homo sapiens
gacaagggauuaaauguga

SEQ ID NO: 821245 - RNA, 19 nt, Homo sapiens
gaagaguucuaccaccuuu

SEQ ID NO: 821246 - RNA, 19 nt, Homo sapiens
gaggauggcugccuugaga

SEQ ID NO: 821247 - RNA, 19 nt, Homo sapiens
ucaggaugauuguaaguua

SEQ ID NO: 821248 - RNA, 19 nt, Homo sapiens
gaaucacguuuacaaagaa

SEQ ID NO: 821249 - RNA, 19 nt, Homo sapiens
ccacucugcugaagaauau

SEQ ID NO: 821250 - RNA, 19 nt, Homo sapiens
ugaagaagaucaacaagca

SEQ ID NO: 821251 - RNA, 19 nt, Homo sapiens
gcccugagcuuuauucauc

SEQ ID NO: 821252 - RNA, 19 nt, Homo sapiens
aaagaaagauucccaaagg

SEQ ID NO: 821253 - RNA, 19 nt, Homo sapiens
ggagggaauucaucacaga

SEQ ID NO: 821254 - RNA, 19 nt, Homo sapiens
gaccggagcugggugauug

SEQ ID NO: 821255 - RNA, 19 nt, Homo sapiens
ccauuaagcucaucagcaa

SEQ ID NO: 821256 - RNA, 19 nt, Homo sapiens
ugaaucacguuuacaaaga

SEQ ID NO: 821257 - RNA, 19 nt, Homo sapiens
ggaguggccucauuacauc

SEQ ID NO: 821258 - RNA, 19 nt, Homo sapiens
uagccaaccuccaggauuu

SEQ ID NO: 821259 - RNA, 19 nt, Homo sapiens
ccugacaaccuccuaauua

SEQ ID NO: 821260 - RNA, 19 nt, Homo sapiens
gaagaaauggcccaguuga

SEQ ID NO: 821261 - RNA, 19 nt, Homo sapiens
caguaauccugacauauuu

SEQ ID NO: 821262 - RNA, 19 nt, Homo sapiens
gagacugccuggauaaauc

SEQ ID NO: 821263 - RNA, 19 nt, Homo sapiens
gaguugagccuuccaagaa

SEQ ID NO: 821264 - RNA, 19 nt, Homo sapiens
ccaaacugcuccaccagaa

SEQ ID NO: 821265 - RNA, 19 nt, Homo sapiens
agagacagaugauucuauu

SEQ ID NO: 821266 - RNA, 19 nt, Homo sapiens
uagaagaaauggcccaguu

SEQ ID NO: 821267 - RNA, 19 nt, Homo sapiens
aaaugcaccugcucacuuu

SEQ ID NO: 821268 - RNA, 19 nt, Homo sapiens
gauggagcccugagcuuua

SEQ ID NO: 821269 - RNA, 19 nt, Homo sapiens
gcauuauccuguaugaguu

SEQ ID NO: 821270 - RNA, 19 nt, Homo sapiens
ucagaccuguguaauauau

SEQ ID NO: 821271 - RNA, 19 nt, Homo sapiens
ccaccgagcuggcaagaag

SEQ ID NO: 821272 - RNA, 19 nt, Homo sapiens
uggaaugccuggaguuuga

SEQ ID NO: 821273 - RNA, 19 nt, Homo sapiens
gggagucgcugcagaagca

SEQ ID NO: 821274 - RNA, 19 nt, Homo sapiens
ggacaagggauuaaaugug

SEQ ID NO: 821275 - RNA, 19 nt, Homo sapiens
gcccgagacugccuggaua

SEQ ID NO: 821276 - RNA, 19 nt, Homo sapiens
acucagaccuguguaauau

SEQ ID NO: 821277 - RNA, 19 nt, Homo sapiens
gaagcagcacccauucuuu

SEQ ID NO: 821278 - RNA, 19 nt, Homo sapiens
cauggugcgucuauacuuu

SEQ ID NO: 821279 - RNA, 19 nt, Homo sapiens
aagcagcacccauucuuua

SEQ ID NO: 821280 - RNA, 19 nt, Homo sapiens
gcaaggagcaggauguagu

SEQ ID NO: 821281 - RNA, 19 nt, Homo sapiens
gagcguaccagaugaggaa

SEQ ID NO: 821282 - RNA, 19 nt, Homo sapiens
gaaacuggcagcagcacuu

SEQ ID NO: 821283 - RNA, 19 nt, Homo sapiens
ggaaacaagguggccauuu

SEQ ID NO: 821284 - RNA, 19 nt, Homo sapiens
gaaggaggaccauucagau

SEQ ID NO: 821285 - RNA, 19 nt, Homo sapiens
ucaagagaauuuggagaaa

SEQ ID NO: 821286 - RNA, 19 nt, Homo sapiens
uaaaggagcaggagagagu

SEQ ID NO: 821287 - RNA, 19 nt, Homo sapiens
gggaauuccuggacaagca

SEQ ID NO: 821288 - RNA, 19 nt, Homo sapiens
agacagaugauucuauuga

SEQ ID NO: 821289 - RNA, 19 nt, Homo sapiens
ggagcaggauguaguaacu

SEQ ID NO: 821290 - RNA, 19 nt, Homo sapiens
cagcacgucuccuggaaug

SEQ ID NO: 821291 - RNA, 19 nt, Homo sapiens
ucuacgaacuucaagagaa

SEQ ID NO: 821292 - RNA, 19 nt, Homo sapiens
caaaugcaccugcucacuu

SEQ ID NO: 821293 - RNA, 19 nt, Homo sapiens
uaauauaugcuccuggaaa

SEQ ID NO: 821294 - RNA, 19 nt, Homo sapiens
ucaacaaagugaucaaguc

SEQ ID NO: 821295 - RNA, 19 nt, Homo sapiens
ggagaaggaggaccauuca

SEQ ID NO: 821296 - RNA, 19 nt, Homo sapiens
gccagaaggcugaauuuau

SEQ ID NO: 821297 - RNA, 19 nt, Homo sapiens
caucagcaauggcgccuau

SEQ ID NO: 821298 - RNA, 19 nt, Homo sapiens
cuacgaacuucaagagaau

SEQ ID NO: 821299 - RNA, 19 nt, Homo sapiens
gcacuugccgccucugaga

SEQ ID NO: 821300 - RNA, 19 nt, Homo sapiens
gcccaggccuuucccacaa

SEQ ID NO: 821301 - RNA, 19 nt, Homo sapiens
gugccacucugcugaagaa

SEQ ID NO: 821302 - RNA, 19 nt, Homo sapiens
ggagcugucucagucuuug

SEQ ID NO: 821303 - RNA, 19 nt, Homo sapiens
ggagaaacuuuuacaagau

SEQ ID NO: 821304 - RNA, 19 nt, Homo sapiens
acacacagccacagccuuu

SEQ ID NO: 821305 - RNA, 19 nt, Homo sapiens
ucaugagucugacaacgaa

SEQ ID NO: 821306 - RNA, 19 nt, Homo sapiens
caaggagcaggauguagua

SEQ ID NO: 821307 - RNA, 19 nt, Homo sapiens
gaugaaucacguuuacaaa

SEQ ID NO: 821308 - RNA, 19 nt, Homo sapiens
gcuggucuuuggccucuuu

SEQ ID NO: 821309 - RNA, 19 nt, Homo sapiens
uaucugggccugucacuga

SEQ ID NO: 821310 - RNA, 19 nt, Homo sapiens
gacucaagcccuccaauga

SEQ ID NO: 821311 - RNA, 19 nt, Homo sapiens
ggacauggugcgucuauac

SEQ ID NO: 821312 - RNA, 19 nt, Homo sapiens
caaagagggacaagggauu

SEQ ID NO: 821313 - RNA, 19 nt, Homo sapiens
gcaguuguuugccauuucu

SEQ ID NO: 821314 - RNA, 19 nt, Homo sapiens
uggcauugguuccagauga

SEQ ID NO: 821315 - RNA, 19 nt, Homo sapiens
ccagcucucuaucggguaa

SEQ ID NO: 821316 - RNA, 19 nt, Homo sapiens
aaagagggacaagggauua

SEQ ID NO: 821317 - RNA, 19 nt, Homo sapiens
cgacuagcagaguuuauuu

SEQ ID NO: 821318 - RNA, 19 nt, Homo sapiens
gcagaagcaagaagccauu

SEQ ID NO: 821319 - RNA, 19 nt, Homo sapiens
acucugaacuaaagaagga

SEQ ID NO: 821320 - RNA, 19 nt, Homo sapiens
gcaggcagcaucccacugu

SEQ ID NO: 821321 - RNA, 19 nt, Homo sapiens
acagagagcguaccagaug

SEQ ID NO: 821322 - RNA, 19 nt, Homo sapiens
caaguaaccgcaagagcuu

SEQ ID NO: 821323 - RNA, 19 nt, Homo sapiens
gcaucgggauuuggcauug

SEQ ID NO: 821324 - RNA, 19 nt, Homo sapiens
ccaauggucccaagccuau

SEQ ID NO: 821325 - RNA, 19 nt, Homo sapiens
cggcaaggaugggcaagaa

SEQ ID NO: 821326 - RNA, 19 nt, Homo sapiens
gauacuagcuauuuugaca

SEQ ID NO: 821327 - RNA, 19 nt, Homo sapiens
ccaugggcauuauccugua

SEQ ID NO: 821328 - RNA, 19 nt, Homo sapiens
caggaugauuguaaguuau

SEQ ID NO: 821329 - RNA, 19 nt, Homo sapiens
gagaauuuggagaaacuuu

SEQ ID NO: 821330 - RNA, 19 nt, Homo sapiens
ugagucaggaugauuguaa

SEQ ID NO: 821331 - RNA, 19 nt, Homo sapiens
gaguuuauuuccuccaaca

SEQ ID NO: 821332 - RNA, 19 nt, Homo sapiens
gaagagcgacuagcagagu

SEQ ID NO: 821333 - RNA, 19 nt, Homo sapiens
caaagaaagauucccaaag

SEQ ID NO: 821334 - RNA, 19 nt, Homo sapiens
ggaguugagccuuccaaga

SEQ ID NO: 821335 - RNA, 19 nt, Homo sapiens
gcaaggaugggcaagaaag

SEQ ID NO: 821336 - RNA, 19 nt, Homo sapiens
cagagagcguaccagauga

SEQ ID NO: 821337 - RNA, 19 nt, Homo sapiens
uagcaguuguuugccauuu

SEQ ID NO: 821338 - RNA, 19 nt, Homo sapiens
gggaagacacagccaccua

SEQ ID NO: 821339 - RNA, 19 nt, Homo sapiens
gagcaugugguccuggaaa

SEQ ID NO: 821340 - RNA, 19 nt, Homo sapiens
ggaccucaccuccaaacug

SEQ ID NO: 821341 - RNA, 19 nt, Homo sapiens
caagagaauuuggagaaac

SEQ ID NO: 821342 - RNA, 19 nt, Homo sapiens
gagaagaagcuagccacuu

SEQ ID NO: 821343 - RNA, 19 nt, Homo sapiens
caaagcaguuaaaggauuu

SEQ ID NO: 821344 - RNA, 19 nt, Homo sapiens
cgacauggaucucugcaaa

SEQ ID NO: 821345 - RNA, 19 nt, Homo sapiens
gaaagagagcuguucauga

SEQ ID NO: 821346 - RNA, 19 nt, Homo sapiens
ggaaacacaugauuaacca

SEQ ID NO: 821347 - RNA, 19 nt, Homo sapiens
ggaacccgcugcguuuaua

SEQ ID NO: 821348 - RNA, 19 nt, Homo sapiens
gaucucgccuucuuuguug

SEQ ID NO: 821349 - RNA, 19 nt, Homo sapiens
ccaaugaucucgccuucuu

SEQ ID NO: 821350 - RNA, 19 nt, Homo sapiens
aaagagagcuguucaugag

SEQ ID NO: 821351 - RNA, 19 nt, Homo sapiens
ggucaaagcaguuaaagga

SEQ ID NO: 821352 - RNA, 19 nt, Homo sapiens
ucaaagcaguuaaaggauu

SEQ ID NO: 821353 - RNA, 19 nt, Homo sapiens
gaaauaaggcagauaaagg

SEQ ID NO: 821354 - RNA, 19 nt, Homo sapiens
aggaugaacugcaauguuu

SEQ ID NO: 821355 - RNA, 19 nt, Homo sapiens
gugcugaucuacacaaaga

SEQ ID NO: 821356 - RNA, 19 nt, Homo sapiens
ggagauccgugcuacuuuc

SEQ ID NO: 821357 - RNA, 19 nt, Homo sapiens
gaauauaaguguccaugac

SEQ ID NO: 821358 - RNA, 19 nt, Homo sapiens
uaccagaucuccucaugaa

SEQ ID NO: 821359 - RNA, 19 nt, Homo sapiens
gcuaugcagcgaagaaaua

SEQ ID NO: 821360 - RNA, 19 nt, Homo sapiens
gauauucaguuaccagauc

SEQ ID NO: 821361 - RNA, 19 nt, Homo sapiens
ggaaauagggauuaugaca

SEQ ID NO: 821362 - RNA, 19 nt, Homo sapiens
aaagaacaguggaagagaa

SEQ ID NO: 821363 - RNA, 19 nt, Homo sapiens
cauguuaccucccuuaaag

SEQ ID NO: 821364 - RNA, 19 nt, Homo sapiens
uaaggcagauaaaggugua

SEQ ID NO: 821365 - RNA, 19 nt, Homo sapiens
ggaaagagagcuguucaug

SEQ ID NO: 821366 - RNA, 19 nt, Homo sapiens
gcgaugacuuugaucuuug

SEQ ID NO: 821367 - RNA, 19 nt, Homo sapiens
ggaaaacagugaaggacua

SEQ ID NO: 821368 - RNA, 19 nt, Homo sapiens
gcacguccuuccacucaug

SEQ ID NO: 821369 - RNA, 19 nt, Homo sapiens
gaagaggauuuugggauua

SEQ ID NO: 821370 - RNA, 19 nt, Homo sapiens
ucgcuacugugaccuguua

SEQ ID NO: 821371 - RNA, 19 nt, Homo sapiens
guucauugcucgcuacugu

SEQ ID NO: 821372 - RNA, 19 nt, Homo sapiens
ccaauggagugaagaagau

SEQ ID NO: 821373 - RNA, 19 nt, Homo sapiens
gaucaggcccuaccaguca

SEQ ID NO: 821374 - RNA, 19 nt, Homo sapiens
ccaggaagauccagagaag

SEQ ID NO: 821375 - RNA, 19 nt, Homo sapiens
ucagaagugucaucucaga

SEQ ID NO: 821376 - RNA, 19 nt, Homo sapiens
caaagaaauucgagacacu

SEQ ID NO: 821377 - RNA, 19 nt, Homo sapiens
agccauauauccauaacua

SEQ ID NO: 821378 - RNA, 19 nt, Homo sapiens
gcacacuccuuuaguacag

SEQ ID NO: 821379 - RNA, 19 nt, Homo sapiens
gaggaaaucagaccuguag

SEQ ID NO: 821380 - RNA, 19 nt, Homo sapiens
gcagagaaauaaggcagau

SEQ ID NO: 821381 - RNA, 19 nt, Homo sapiens
ggaaaucagaccuguagau

SEQ ID NO: 821382 - RNA, 19 nt, Homo sapiens
ccacggagacgaccaugaa

SEQ ID NO: 821383 - RNA, 19 nt, Homo sapiens
cagaugugcuggccuagga

SEQ ID NO: 821384 - RNA, 19 nt, Homo sapiens
aaugaaaccuaccaucuca

SEQ ID NO: 821385 - RNA, 19 nt, Homo sapiens
agagaaauaaggcagauaa

SEQ ID NO: 821386 - RNA, 19 nt, Homo sapiens
ggaaggcuguggugcugau

SEQ ID NO: 821387 - RNA, 19 nt, Homo sapiens
gggcugugauuguugaugu

SEQ ID NO: 821388 - RNA, 19 nt, Homo sapiens
ugaagcacuuuacugagaa

SEQ ID NO: 821389 - RNA, 19 nt, Homo sapiens
ccacccaccugcucuuuag

SEQ ID NO: 821390 - RNA, 19 nt, Homo sapiens
acugugaccuguuaaaugu

SEQ ID NO: 821391 - RNA, 19 nt, Homo sapiens
agacagcccugcuucaucu

SEQ ID NO: 821392 - RNA, 19 nt, Homo sapiens
ccagucaccuucugcaaag

SEQ ID NO: 821393 - RNA, 19 nt, Homo sapiens
gaagggaggaggacaagag

SEQ ID NO: 821394 - RNA, 19 nt, Homo sapiens
uugaagcacuuuacugaga

SEQ ID NO: 821395 - RNA, 19 nt, Homo sapiens
gacccaaauuucagauuca

SEQ ID NO: 821396 - RNA, 19 nt, Homo sapiens
cagaggagcagcuagagaa

SEQ ID NO: 821397 - RNA, 19 nt, Homo sapiens
acauggaguuuaccuguga

SEQ ID NO: 821398 - RNA, 19 nt, Homo sapiens
gaagaugagcuugcugaug

SEQ ID NO: 821399 - RNA, 19 nt, Homo sapiens
gaggagauccgugcuacuu

SEQ ID NO: 821400 - RNA, 19 nt, Homo sapiens
gaaugaaaccuaccaucuc

SEQ ID NO: 821401 - RNA, 19 nt, Homo sapiens
gagaaauaaggcagauaaa

SEQ ID NO: 821402 - RNA, 19 nt, Homo sapiens
ugugcacacuccuuuagua

SEQ ID NO: 821403 - RNA, 19 nt, Homo sapiens
ucaagcagcugccauucca

SEQ ID NO: 821404 - RNA, 19 nt, Homo sapiens
gagcacguccuuccacuca

SEQ ID NO: 821405 - RNA, 19 nt, Homo sapiens
gaggaugaacugcaauguu

SEQ ID NO: 821406 - RNA, 19 nt, Homo sapiens
agaccgauuugcugaaguu

SEQ ID NO: 821407 - RNA, 19 nt, Homo sapiens
ucccagcacuuugccuuua

SEQ ID NO: 821408 - RNA, 19 nt, Homo sapiens
ggacaagaguguggugacu

SEQ ID NO: 821409 - RNA, 19 nt, Homo sapiens
gacacuuacuaucaacuug

SEQ ID NO: 821410 - RNA, 19 nt, Homo sapiens
gauccgugcuacuuuccuu

SEQ ID NO: 821411 - RNA, 19 nt, Homo sapiens
gcacuuuacugagaagaac

SEQ ID NO: 821412 - RNA, 19 nt, Homo sapiens
gcaucaagcagcugccauu

SEQ ID NO: 821413 - RNA, 19 nt, Homo sapiens
aggagcagcuagagaagaa

SEQ ID NO: 821414 - RNA, 19 nt, Homo sapiens
uuagaagcaucaccgaguu

SEQ ID NO: 821415 - RNA, 19 nt, Homo sapiens
cuucucggccaguuaauua

SEQ ID NO: 821416 - RNA, 19 nt, Homo sapiens
ggucuucucggccaguuaa

SEQ ID NO: 821417 - RNA, 19 nt, Homo sapiens
ucgagacacuuacuaucaa

SEQ ID NO: 821418 - RNA, 19 nt, Homo sapiens
uuugaggccugguaugaaa

SEQ ID NO: 821419 - RNA, 19 nt, Homo sapiens
guuaccagaucuccucaug

SEQ ID NO: 821420 - RNA, 19 nt, Homo sapiens
gagaagcauuuuauggaaa

SEQ ID NO: 821421 - RNA, 19 nt, Homo sapiens
cuaucaacuuguucuguuu

SEQ ID NO: 821422 - RNA, 19 nt, Homo sapiens
gagagcuguucaugaggaa

SEQ ID NO: 821423 - RNA, 19 nt, Homo sapiens
ugaugggugugaugagauu

SEQ ID NO: 821424 - RNA, 19 nt, Homo sapiens
aaacucccuugcuucugua

SEQ ID NO: 821425 - RNA, 19 nt, Homo sapiens
gcccugaaaggauuguaua

SEQ ID NO: 821426 - RNA, 19 nt, Homo sapiens
gcugaguguucccagaaga

SEQ ID NO: 821427 - RNA, 19 nt, Homo sapiens
agacccaaauuucagauuc

SEQ ID NO: 821428 - RNA, 19 nt, Homo sapiens
aaagguguaucauuaucga

SEQ ID NO: 821429 - RNA, 19 nt, Homo sapiens
aaaguauacccuugaauuc

SEQ ID NO: 821430 - RNA, 19 nt, Homo sapiens
gaacaguggaagagaagca

SEQ ID NO: 821431 - RNA, 19 nt, Homo sapiens
acuaucaacuuguucuguu

SEQ ID NO: 821432 - RNA, 19 nt, Homo sapiens
gguagacgccgcagugauc

SEQ ID NO: 821433 - RNA, 19 nt, Homo sapiens
gcugaucuacacaaagaaa

SEQ ID NO: 821434 - RNA, 19 nt, Homo sapiens
caaagaacaguggaagaga

SEQ ID NO: 821435 - RNA, 19 nt, Homo sapiens
caaaguccucucagccaaa

SEQ ID NO: 821436 - RNA, 19 nt, Homo sapiens
auucagaagugucaucuca

SEQ ID NO: 821437 - RNA, 19 nt, Homo sapiens
ugcgaugacuuugaucuuu

SEQ ID NO: 821438 - RNA, 19 nt, Homo sapiens
gaaauucgagacacuuacu

SEQ ID NO: 821439 - RNA, 19 nt, Homo sapiens
ccaguacucccagcacuuu

SEQ ID NO: 821440 - RNA, 19 nt, Homo sapiens
cauaaugugaucaucuuga

SEQ ID NO: 821441 - RNA, 19 nt, Homo sapiens
cccauaaugugaucaucuu

SEQ ID NO: 821442 - RNA, 19 nt, Homo sapiens
auuacuagcagccauguua

SEQ ID NO: 821443 - RNA, 19 nt, Homo sapiens
gaagaugccaggacuuaua

SEQ ID NO: 821444 - RNA, 19 nt, Homo sapiens
gaacgggacucaucuucug

SEQ ID NO: 821445 - RNA, 19 nt, Homo sapiens
gaagagcgcuuugcugagu

SEQ ID NO: 821446 - RNA, 19 nt, Homo sapiens
gagaagaugccaggacuua

SEQ ID NO: 821447 - RNA, 19 nt, Homo sapiens
ccaaggagaagcagaagua

SEQ ID NO: 821448 - RNA, 19 nt, Homo sapiens
gcaaugagcgagauuaaag

SEQ ID NO: 821449 - RNA, 19 nt, Homo sapiens
gggaggcgccuguggaaua

SEQ ID NO: 821450 - RNA, 19 nt, Homo sapiens
gaagaagaccuuugacucu

SEQ ID NO: 821451 - RNA, 19 nt, Homo sapiens
gcaagagacccgaaagugu

SEQ ID NO: 821452 - RNA, 19 nt, Homo sapiens
gugaggacaugacgaguga

SEQ ID NO: 821453 - RNA, 19 nt, Homo sapiens
gaaagaaguccagcucaga

SEQ ID NO: 821454 - RNA, 19 nt, Homo sapiens
cuucagagcuuuucacuuu

SEQ ID NO: 821455 - RNA, 19 nt, Homo sapiens
gaacggcuacacacaguug

SEQ ID NO: 821456 - RNA, 19 nt, Homo sapiens
gaccauggccagcaaauuc

SEQ ID NO: 821457 - RNA, 19 nt, Homo sapiens
ggugucagcuuaguguauu

SEQ ID NO: 821458 - RNA, 19 nt, Homo sapiens
gcugaggcgucuccaaaug

SEQ ID NO: 821459 - RNA, 19 nt, Homo sapiens
caacaaggaccgaaagaag

SEQ ID NO: 821460 - RNA, 19 nt, Homo sapiens
agacagagagugaccauga

SEQ ID NO: 821461 - RNA, 19 nt, Homo sapiens
gcaagaagaggaagaacuc

SEQ ID NO: 821462 - RNA, 19 nt, Homo sapiens
ccaccagaaucaccuaugu

SEQ ID NO: 821463 - RNA, 19 nt, Homo sapiens
gaaacauccugcagacacu

SEQ ID NO: 821464 - RNA, 19 nt, Homo sapiens
gugauccguuccuccuuua

SEQ ID NO: 821465 - RNA, 19 nt, Homo sapiens
gcggagaaguagacaguca

SEQ ID NO: 821466 - RNA, 19 nt, Homo sapiens
cggcagcuguugcucauga

SEQ ID NO: 821467 - RNA, 19 nt, Homo sapiens
ccucugcccucccaacuug

SEQ ID NO: 821468 - RNA, 19 nt, Homo sapiens
gcaggugccaggacugaaa

SEQ ID NO: 821469 - RNA, 19 nt, Homo sapiens
caaacaaggaggagcaaga

SEQ ID NO: 821470 - RNA, 19 nt, Homo sapiens
gaaucacccagguacagua

SEQ ID NO: 821471 - RNA, 19 nt, Homo sapiens
ggagccacaugcccugaga

SEQ ID NO: 821472 - RNA, 19 nt, Homo sapiens
gggcugaggcgucuccaaa

SEQ ID NO: 821473 - RNA, 19 nt, Homo sapiens
ggucaucugugaggaggaa

SEQ ID NO: 821474 - RNA, 19 nt, Homo sapiens
gcaacaaggaccgaaagaa

SEQ ID NO: 821475 - RNA, 19 nt, Homo sapiens
gauuggaaguggugcaaca

SEQ ID NO: 821476 - RNA, 19 nt, Homo sapiens
ggaggcgccuguggaauag

SEQ ID NO: 821477 - RNA, 19 nt, Homo sapiens
gaugccaggacuuauagua

SEQ ID NO: 821478 - RNA, 19 nt, Homo sapiens
ccaacaagcgggagaagga

SEQ ID NO: 821479 - RNA, 19 nt, Homo sapiens
gggccauccugggcucuua

SEQ ID NO: 821480 - RNA, 19 nt, Homo sapiens
ggacuucgaagagcgcuuu

SEQ ID NO: 821481 - RNA, 19 nt, Homo sapiens
ggaaguggugcaacaagga

SEQ ID NO: 821482 - RNA, 19 nt, Homo sapiens
gcuggacucagguuaguuu

SEQ ID NO: 821483 - RNA, 19 nt, Homo sapiens
cgugugaccuucagagcuu

SEQ ID NO: 821484 - RNA, 19 nt, Homo sapiens
cagaacggcuacacacagu

SEQ ID NO: 821485 - RNA, 19 nt, Homo sapiens
gacagagagugaccaugau

SEQ ID NO: 821486 - RNA, 19 nt, Homo sapiens
uacaggaacugacgcagau

SEQ ID NO: 821487 - RNA, 19 nt, Homo sapiens
gagcgagauuaaagcuguu

SEQ ID NO: 821488 - RNA, 19 nt, Homo sapiens
ucaggaccauggcuucuuc

SEQ ID NO: 821489 - RNA, 19 nt, Homo sapiens
caauggauccugccaccuu

SEQ ID NO: 821490 - RNA, 19 nt, Homo sapiens
ugugauccguuccuccuuu

SEQ ID NO: 821491 - RNA, 19 nt, Homo sapiens
gagauccaguugccucuac

SEQ ID NO: 821492 - RNA, 19 nt, Homo sapiens
gaggugcgccagaagauca

SEQ ID NO: 821493 - RNA, 19 nt, Homo sapiens
caagguuugucugcaguug

SEQ ID NO: 821494 - RNA, 19 nt, Homo sapiens
ccaaagcccagucaguuuc

SEQ ID NO: 821495 - RNA, 19 nt, Homo sapiens
caaagccuucuacccagua

SEQ ID NO: 821496 - RNA, 19 nt, Homo sapiens
ccaaggaacgggacucauc

SEQ ID NO: 821497 - RNA, 19 nt, Homo sapiens
ucagugcccuacccaagga

SEQ ID NO: 821498 - RNA, 19 nt, Homo sapiens
gaucaugugcaauauuucu

SEQ ID NO: 821499 - RNA, 19 nt, Homo sapiens
guuaucuccucccggguaa

SEQ ID NO: 821500 - RNA, 19 nt, Homo sapiens
ggauccuccuguagccuuu

SEQ ID NO: 821501 - RNA, 19 nt, Homo sapiens
gugcaauauuucuuacugu

SEQ ID NO: 821502 - RNA, 19 nt, Homo sapiens
ggagcuagaguaugacaag

SEQ ID NO: 821503 - RNA, 19 nt, Homo sapiens
cuggaacagucaccucgua

SEQ ID NO: 821504 - RNA, 19 nt, Homo sapiens
agaagaccuuugacucugu

SEQ ID NO: 821505 - RNA, 19 nt, Homo sapiens
gggcuggacucagguuagu

SEQ ID NO: 821506 - RNA, 19 nt, Homo sapiens
acagugagacagagaguga

SEQ ID NO: 821507 - RNA, 19 nt, Homo sapiens
cggcaccacugacauugau

SEQ ID NO: 821508 - RNA, 19 nt, Homo sapiens
ggaaggggaugaugauguc

SEQ ID NO: 821509 - RNA, 19 nt, Homo sapiens
ggacaugacgagugaugag

SEQ ID NO: 821510 - RNA, 19 nt, Homo sapiens
ucaaggcccacccagauug

SEQ ID NO: 821511 - RNA, 19 nt, Homo sapiens
ggccugcuccucuuguaaa

SEQ ID NO: 821512 - RNA, 19 nt, Homo sapiens
cggagguccugucauaaca

SEQ ID NO: 821513 - RNA, 19 nt, Homo sapiens
ccgcuaugcagacaucuuu

SEQ ID NO: 821514 - RNA, 19 nt, Homo sapiens
ggggacaucuucaccuuug

SEQ ID NO: 821515 - RNA, 19 nt, Homo sapiens
uuccaugaccuacagcuua

SEQ ID NO: 821516 - RNA, 19 nt, Homo sapiens
cucaggacauggacaguau

SEQ ID NO: 821517 - RNA, 19 nt, Homo sapiens
uugcugaguugccugaguu

SEQ ID NO: 821518 - RNA, 19 nt, Homo sapiens
gaggacaugacgagugaug

SEQ ID NO: 821519 - RNA, 19 nt, Homo sapiens
ccgcaaugagcgagauuaa

SEQ ID NO: 821520 - RNA, 19 nt, Homo sapiens
gggacaucuucaccuuuga

SEQ ID NO: 821521 - RNA, 19 nt, Homo sapiens
ggaacgggacucaucuucu

SEQ ID NO: 821522 - RNA, 19 nt, Homo sapiens
gagagugaccaugaugaug

SEQ ID NO: 821523 - RNA, 19 nt, Homo sapiens
gcagccaucgccagcauuc

SEQ ID NO: 821524 - RNA, 19 nt, Homo sapiens
cccaaagcccagucaguuu

SEQ ID NO: 821525 - RNA, 19 nt, Homo sapiens
ugucuggcccugcaucgua

SEQ ID NO: 821526 - RNA, 19 nt, Homo sapiens
ccuggacggcggagaagua

SEQ ID NO: 821527 - RNA, 19 nt, Homo sapiens
cugcuccucuuguaaauac

SEQ ID NO: 821528 - RNA, 19 nt, Homo sapiens
caagccuggucuacacugu

SEQ ID NO: 821529 - RNA, 19 nt, Homo sapiens
gcuuuucacuuuaugcaaa

SEQ ID NO: 821530 - RNA, 19 nt, Homo sapiens
caucuuucccuccaagguu

SEQ ID NO: 821531 - RNA, 19 nt, Homo sapiens
guacuggcaagaaggugaa

SEQ ID NO: 821532 - RNA, 19 nt, Homo sapiens
ggacagugagacagagagu

SEQ ID NO: 821533 - RNA, 19 nt, Homo sapiens
ggaaucacccagguacagu

SEQ ID NO: 821534 - RNA, 19 nt, Homo sapiens
ggacggcggagaaguagac

SEQ ID NO: 821535 - RNA, 19 nt, Homo sapiens
cagagagugaccaugauga

SEQ ID NO: 821536 - RNA, 19 nt, Homo sapiens
ugugcaauauuucuuacug

SEQ ID NO: 821537 - RNA, 19 nt, Homo sapiens
ccccggagguccugucaua

SEQ ID NO: 821538 - RNA, 19 nt, Homo sapiens
caaggaacgggacucaucu

SEQ ID NO: 821539 - RNA, 19 nt, Homo sapiens
ccaccucucagccucagaa

SEQ ID NO: 821540 - RNA, 19 nt, Homo sapiens
cagcggaggaggaaacauc

SEQ ID NO: 821541 - RNA, 19 nt, Homo sapiens
ggacccagagggcaacaag

SEQ ID NO: 821542 - RNA, 19 nt, Homo sapiens
ccucaggacauggacagua

SEQ ID NO: 821543 - RNA, 19 nt, Homo sapiens
gggacuaccuuucuuauaa

SEQ ID NO: 821544 - RNA, 19 nt, Homo sapiens
ggacuaccuuucuuauaaa

SEQ ID NO: 821545 - RNA, 19 nt, Homo sapiens
gaagggacccagagucuuu

SEQ ID NO: 821546 - RNA, 19 nt, Homo sapiens
caaagcaggugacauagau

SEQ ID NO: 821547 - RNA, 19 nt, Homo sapiens
gcccagaucuuuaaaccuu

SEQ ID NO: 821548 - RNA, 19 nt, Homo sapiens
guucaaagcugugcacaug

SEQ ID NO: 821549 - RNA, 19 nt, Homo sapiens
gcuaugcccucauggaguu

SEQ ID NO: 821550 - RNA, 19 nt, Homo sapiens
gcagggacuaccuuucuua

SEQ ID NO: 821551 - RNA, 19 nt, Homo sapiens
caccugagcuugcuugaag

SEQ ID NO: 821552 - RNA, 19 nt, Homo sapiens
gcgcaacccugcacugaag

SEQ ID NO: 821553 - RNA, 19 nt, Homo sapiens
ucacagcccuuuucaauau

SEQ ID NO: 821554 - RNA, 19 nt, Homo sapiens
gcagggaucggcuuggaaa

SEQ ID NO: 821555 - RNA, 19 nt, Homo sapiens
gggaucggcuuggaaauca

SEQ ID NO: 821556 - RNA, 19 nt, Homo sapiens
ugaacaagauucccauucu

SEQ ID NO: 821557 - RNA, 19 nt, Homo sapiens
ucaaagcugugcacaugug

SEQ ID NO: 821558 - RNA, 19 nt, Homo sapiens
ggucagagaagcagaagga

SEQ ID NO: 821559 - RNA, 19 nt, Homo sapiens
gcugaucgaugccgacaca

SEQ ID NO: 821560 - RNA, 19 nt, Homo sapiens
uguggacacucaauaaaug

SEQ ID NO: 821561 - RNA, 19 nt, Homo sapiens
gugcacauguggacacuca

SEQ ID NO: 821562 - RNA, 19 nt, Homo sapiens
guucugugaucgccaaguu

SEQ ID NO: 821563 - RNA, 19 nt, Homo sapiens
ggagggaggaggcaucuuc

SEQ ID NO: 821564 - RNA, 19 nt, Homo sapiens
cuucaucaaugucguguug

SEQ ID NO: 821565 - RNA, 19 nt, Homo sapiens
ugucgugacuucaucaaug

SEQ ID NO: 821566 - RNA, 19 nt, Homo sapiens
aauuugcccugucaucuuu

SEQ ID NO: 821567 - RNA, 19 nt, Homo sapiens
ccagaucuuuaaaccuuug

SEQ ID NO: 821568 - RNA, 19 nt, Homo sapiens
ggcacuaggugucauugug

SEQ ID NO: 821569 - RNA, 19 nt, Homo sapiens
gcaucgcgcugggagaaga

SEQ ID NO: 821570 - RNA, 19 nt, Homo sapiens
gaggaugccagcaaguuug

SEQ ID NO: 821571 - RNA, 19 nt, Homo sapiens
gcacggcuauggcuuugac

SEQ ID NO: 821572 - RNA, 19 nt, Homo sapiens
gaaugacagcgagcaguuu

SEQ ID NO: 821573 - RNA, 19 nt, Homo sapiens
gagcaucgcgcugggagaa

SEQ ID NO: 821574 - RNA, 19 nt, Homo sapiens
ucacaucucuaaugaacac

SEQ ID NO: 821575 - RNA, 19 nt, Homo sapiens
gaccaaggcagucaaagca

SEQ ID NO: 821576 - RNA, 19 nt, Homo sapiens
aaaccuuugugucguguug

SEQ ID NO: 821577 - RNA, 19 nt, Homo sapiens
gguccacguccuuuaaauu

SEQ ID NO: 821578 - RNA, 19 nt, Homo sapiens
ccagguccacguccuuuaa

SEQ ID NO: 821579 - RNA, 19 nt, Homo sapiens
gaaucuggcgugcguggaa

SEQ ID NO: 821580 - RNA, 19 nt, Homo sapiens
ugacauagaugccaaaacu

SEQ ID NO: 821581 - RNA, 19 nt, Homo sapiens
gcacauguggacacucaau

SEQ ID NO: 821582 - RNA, 19 nt, Homo sapiens
ggccauugauaucgcaguu

SEQ ID NO: 821583 - RNA, 19 nt, Homo sapiens
guccacguccuuuaaauug

SEQ ID NO: 821584 - RNA, 19 nt, Homo sapiens
gggcacggcuauggcuuug

SEQ ID NO: 821585 - RNA, 19 nt, Homo sapiens
ggaacaggagggacacuuc

SEQ ID NO: 821586 - RNA, 19 nt, Homo sapiens
ucagugaggauuuccagaa

SEQ ID NO: 821587 - RNA, 19 nt, Homo sapiens
ggacacucaauaaauguuc

SEQ ID NO: 821588 - RNA, 19 nt, Homo sapiens
gcuucuggcugcuaaugug

SEQ ID NO: 821589 - RNA, 19 nt, Homo sapiens
uggcugcccugaccauguu

SEQ ID NO: 821590 - RNA, 19 nt, Homo sapiens
gggcaaggcgagcaucaug

SEQ ID NO: 821591 - RNA, 19 nt, Homo sapiens
cauguggacacucaauaaa

SEQ ID NO: 821592 - RNA, 19 nt, Homo sapiens
ucgcuucugugcaaguauu

SEQ ID NO: 821593 - RNA, 19 nt, Homo sapiens
ugaggaugccagcaaguuu

SEQ ID NO: 821594 - RNA, 19 nt, Homo sapiens
ucaaagcaggugacauaga

SEQ ID NO: 821595 - RNA, 19 nt, Homo sapiens
gcgccaucgugaaguguga

SEQ ID NO: 821596 - RNA, 19 nt, Homo sapiens
gacacucaauaaauguuca

SEQ ID NO: 821597 - RNA, 19 nt, Homo sapiens
ccauugauaucgcaguucu

SEQ ID NO: 821598 - RNA, 19 nt, Homo sapiens
gcacgcauccugggaagca

SEQ ID NO: 821599 - RNA, 19 nt, Homo sapiens
acauguggacacucaauaa

SEQ ID NO: 821600 - RNA, 19 nt, Homo sapiens
gauaucgcaguucuuccua

SEQ ID NO: 821601 - RNA, 19 nt, Homo sapiens
aggcuuaggccauugauau

SEQ ID NO: 821602 - RNA, 19 nt, Homo sapiens
uagcaccucuccagcucuu

SEQ ID NO: 821603 - RNA, 19 nt, Homo sapiens
ccaccugaccguugaagau

SEQ ID NO: 821604 - RNA, 19 nt, Homo sapiens
cccaaguccugaacaagau

SEQ ID NO: 821605 - RNA, 19 nt, Homo sapiens
gucgugacuucaucaaugu

SEQ ID NO: 821606 - RNA, 19 nt, Homo sapiens
cgugaagugugaucucauc

SEQ ID NO: 821607 - RNA, 19 nt, Homo sapiens
gcccaccccucaaguguaa

SEQ ID NO: 821608 - RNA, 19 nt, Homo sapiens
gccgcuccaugauugauga

SEQ ID NO: 821609 - RNA, 19 nt, Homo sapiens
uaauuugcccugucaucuu

SEQ ID NO: 821610 - RNA, 19 nt, Homo sapiens
acacacacacacacucuug

SEQ ID NO: 821611 - RNA, 19 nt, Homo sapiens
gcaccucuccagcucuuca

SEQ ID NO: 821612 - RNA, 19 nt, Homo sapiens
uuaaggagccacagaaggu

SEQ ID NO: 821613 - RNA, 19 nt, Homo sapiens
cagcagggacuaccuuucu

SEQ ID NO: 821614 - RNA, 19 nt, Homo sapiens
uaucgcaguucuuccuauc

SEQ ID NO: 821615 - RNA, 19 nt, Homo sapiens
acagcaggcuuaggccauu

SEQ ID NO: 821616 - RNA, 19 nt, Homo sapiens
caccgugucugcccuaugc

SEQ ID NO: 821617 - RNA, 19 nt, Homo sapiens
gaucuuuaaaccuuugugu

SEQ ID NO: 821618 - RNA, 19 nt, Homo sapiens
ggaucggcuuggaaaucaa

SEQ ID NO: 821619 - RNA, 19 nt, Homo sapiens
ccucgcuucugugcaagua

SEQ ID NO: 821620 - RNA, 19 nt, Homo sapiens
ugucucccaugucgugauu

SEQ ID NO: 821621 - RNA, 19 nt, Homo sapiens
ucaucaaugucguguugug

SEQ ID NO: 821622 - RNA, 19 nt, Homo sapiens
gaccugcugccacaucuuc

SEQ ID NO: 821623 - RNA, 19 nt, Homo sapiens
cgaggaggccaaugaccuu

SEQ ID NO: 821624 - RNA, 19 nt, Homo sapiens
agaaugacagcgagcaguu

SEQ ID NO: 821625 - RNA, 19 nt, Homo sapiens
cacauguggacacucaaua

SEQ ID NO: 821626 - RNA, 19 nt, Homo sapiens
ccacacacacacacacaca

SEQ ID NO: 821627 - RNA, 19 nt, Homo sapiens
ccuuuaaauuggcccuuug

SEQ ID NO: 821628 - RNA, 19 nt, Homo sapiens
gaggaggccaaugaccuuu

SEQ ID NO: 821629 - RNA, 19 nt, Homo sapiens
uccgugaggccaagaauga

SEQ ID NO: 821630 - RNA, 19 nt, Homo sapiens
gggcccagaucuuuaaacc

SEQ ID NO: 821631 - RNA, 19 nt, Homo sapiens
ugcuucacaucucuaauga

SEQ ID NO: 821632 - RNA, 19 nt, Homo sapiens
cagcgcaacccugcacuga

SEQ ID NO: 821633 - RNA, 19 nt, Homo sapiens
cagcaggcuuaggccauug

SEQ ID NO: 821634 - RNA, 19 nt, Homo sapiens
gcaucauggccucggauug

SEQ ID NO: 821635 - RNA, 19 nt, Homo sapiens
ggacaccugagcaucugau

SEQ ID NO: 821636 - RNA, 19 nt, Homo sapiens
gcugccauccucuuccuau

SEQ ID NO: 821637 - RNA, 19 nt, Homo sapiens
ggaggccaaugaccuuucc

SEQ ID NO: 821638 - RNA, 19 nt, Homo sapiens
gacuaccuuucuuauaaac

SEQ ID NO: 821639 - RNA, 19 nt, Homo sapiens
cccagaauccgcauguuuc

SEQ ID NO: 821640 - RNA, 19 nt, Homo sapiens
cccagaucuuuaaaccuuu

SEQ ID NO: 821641 - RNA, 19 nt, Homo sapiens
caucaaugucguguuguga

SEQ ID NO: 821642 - RNA, 19 nt, Homo sapiens
ccacagacaugcuuaacua

SEQ ID NO: 821643 - RNA, 19 nt, Homo sapiens
cugaagagaugaagaauaa

SEQ ID NO: 821644 - RNA, 19 nt, Homo sapiens
gagaugagaugagauaaga

SEQ ID NO: 821645 - RNA, 19 nt, Homo sapiens
ggacauauguacguuggua

SEQ ID NO: 821646 - RNA, 19 nt, Homo sapiens
gaagagagauuuugagaga

SEQ ID NO: 821647 - RNA, 19 nt, Homo sapiens
caccaugccuggcuaauuu

SEQ ID NO: 821648 - RNA, 19 nt, Homo sapiens
ggaggaaauugauuauaga

SEQ ID NO: 821649 - RNA, 19 nt, Homo sapiens
ggagugaggugguacaauc

SEQ ID NO: 821650 - RNA, 19 nt, Homo sapiens
agagagagauguugacuug

SEQ ID NO: 821651 - RNA, 19 nt, Homo sapiens
gaaaaucucaggcaaaaua

SEQ ID NO: 821652 - RNA, 19 nt, Homo sapiens
gaaagcaaauugaacacau

SEQ ID NO: 821653 - RNA, 19 nt, Homo sapiens
caagacacaucagggaaua

SEQ ID NO: 821654 - RNA, 19 nt, Homo sapiens
gaaaagagaugagaugaga

SEQ ID NO: 821655 - RNA, 19 nt, Homo sapiens
aaagaaagcaguacugaaa

SEQ ID NO: 821656 - RNA, 19 nt, Homo sapiens
gauguugacuugagauuuc

SEQ ID NO: 821657 - RNA, 19 nt, Homo sapiens
ggauccauauaauguguua

SEQ ID NO: 821658 - RNA, 19 nt, Homo sapiens
gaugagauaagacuuguuu

SEQ ID NO: 821659 - RNA, 19 nt, Homo sapiens
agucauaaaucaccuguuu

SEQ ID NO: 821660 - RNA, 19 nt, Homo sapiens
ggacuggacuggaaguauc

SEQ ID NO: 821661 - RNA, 19 nt, Homo sapiens
cuaccgagcuguggacaua

SEQ ID NO: 821662 - RNA, 19 nt, Homo sapiens
gcaauucaggaaagacuua

SEQ ID NO: 821663 - RNA, 19 nt, Homo sapiens
uuaaagcacucaugaagga

SEQ ID NO: 821664 - RNA, 19 nt, Homo sapiens
cagacaugcuuaacuauga

SEQ ID NO: 821665 - RNA, 19 nt, Homo sapiens
gcacuucggccacgggaua

SEQ ID NO: 821666 - RNA, 19 nt, Homo sapiens
guucuuugcuccuuuguga

SEQ ID NO: 821667 - RNA, 19 nt, Homo sapiens
gaaguucauggaccuauaa

SEQ ID NO: 821668 - RNA, 19 nt, Homo sapiens
ggaaguaucugggaauggu

SEQ ID NO: 821669 - RNA, 19 nt, Homo sapiens
gaaagaaagcaguacugaa

SEQ ID NO: 821670 - RNA, 19 nt, Homo sapiens
aaagagaugagaugagaua

SEQ ID NO: 821671 - RNA, 19 nt, Homo sapiens
gaaggcacaccgaaagaaa

SEQ ID NO: 821672 - RNA, 19 nt, Homo sapiens
gcaguuacauucaccacau

SEQ ID NO: 821673 - RNA, 19 nt, Homo sapiens
ggauggaauuggauguauu

SEQ ID NO: 821674 - RNA, 19 nt, Homo sapiens
caaaggcacuugcaguuac

SEQ ID NO: 821675 - RNA, 19 nt, Homo sapiens
agccuaagcucucaucaaa

SEQ ID NO: 821676 - RNA, 19 nt, Homo sapiens
uaugagcucuuacuaguca

SEQ ID NO: 821677 - RNA, 19 nt, Homo sapiens
gauggaauuggauguauuu

SEQ ID NO: 821678 - RNA, 19 nt, Homo sapiens
caggaaagacuuaaauaug

SEQ ID NO: 821679 - RNA, 19 nt, Homo sapiens
gaagacggcaggaggaaau

SEQ ID NO: 821680 - RNA, 19 nt, Homo sapiens
gagagauguugacuugaga

SEQ ID NO: 821681 - RNA, 19 nt, Homo sapiens
aaaaggaacuggggaauuu

SEQ ID NO: 821682 - RNA, 19 nt, Homo sapiens
gagaugagauaagacuugu

SEQ ID NO: 821683 - RNA, 19 nt, Homo sapiens
cauuagccauccugaguuu

SEQ ID NO: 821684 - RNA, 19 nt, Homo sapiens
ggaaguggcgauucgaaga

SEQ ID NO: 821685 - RNA, 19 nt, Homo sapiens
gagggaagacuaugaaagu

SEQ ID NO: 821686 - RNA, 19 nt, Homo sapiens
uaacuaugaugcugcuuca

SEQ ID NO: 821687 - RNA, 19 nt, Homo sapiens
uagcuaggauuacagaugu

SEQ ID NO: 821688 - RNA, 19 nt, Homo sapiens
gagcaggugaugccgauuu

SEQ ID NO: 821689 - RNA, 19 nt, Homo sapiens
ggcaggaggaaauugauua

SEQ ID NO: 821690 - RNA, 19 nt, Homo sapiens
gagccugugugcccacuga

SEQ ID NO: 821691 - RNA, 19 nt, Homo sapiens
ugacagcaauucaggaaag

SEQ ID NO: 821692 - RNA, 19 nt, Homo sapiens
caacaagagcccugaagug

SEQ ID NO: 821693 - RNA, 19 nt, Homo sapiens
uaacggagccauugaagca

SEQ ID NO: 821694 - RNA, 19 nt, Homo sapiens
ggaaugguuuagaaguuca

SEQ ID NO: 821695 - RNA, 19 nt, Homo sapiens
gggaaugguuuagaaguuc

SEQ ID NO: 821696 - RNA, 19 nt, Homo sapiens
ccaaagugcugggauuaca

SEQ ID NO: 821697 - RNA, 19 nt, Homo sapiens
gaagugcuccgggcauuug

SEQ ID NO: 821698 - RNA, 19 nt, Homo sapiens
ucagcuuucuguucaguuu

SEQ ID NO: 821699 - RNA, 19 nt, Homo sapiens
ccacugaagagaugaagaa

SEQ ID NO: 821700 - RNA, 19 nt, Homo sapiens
gaugacagcaauucaggaa

SEQ ID NO: 821701 - RNA, 19 nt, Homo sapiens
aggaggaaauugauuauag

SEQ ID NO: 821702 - RNA, 19 nt, Homo sapiens
agaaguucauggaccuaua

SEQ ID NO: 821703 - RNA, 19 nt, Homo sapiens
gaggguagaagagagauuu

SEQ ID NO: 821704 - RNA, 19 nt, Homo sapiens
gaugccgauuuccauuaua

SEQ ID NO: 821705 - RNA, 19 nt, Homo sapiens
gcugguagcugguuaugcu

SEQ ID NO: 821706 - RNA, 19 nt, Homo sapiens
gcacuugcaguuacauuca

SEQ ID NO: 821707 - RNA, 19 nt, Homo sapiens
acaaaggcacuugcaguua

SEQ ID NO: 821708 - RNA, 19 nt, Homo sapiens
aagauggacuggacuggaa

SEQ ID NO: 821709 - RNA, 19 nt, Homo sapiens
gggauggaauuggauguau

SEQ ID NO: 821710 - RNA, 19 nt, Homo sapiens
cgaaagaaagcaguacuga

SEQ ID NO: 821711 - RNA, 19 nt, Homo sapiens
ggaaggcacaccgaaagaa

SEQ ID NO: 821712 - RNA, 19 nt, Homo sapiens
guucauggaccuauaagga

SEQ ID NO: 821713 - RNA, 19 nt, Homo sapiens
gaguggauccauauaaugu

SEQ ID NO: 821714 - RNA, 19 nt, Homo sapiens
ggaguggauccauauaaug

SEQ ID NO: 821715 - RNA, 19 nt, Homo sapiens
gcgauucgaagauuccuuu

SEQ ID NO: 821716 - RNA, 19 nt, Homo sapiens
agucaaagcaauccuguuu

SEQ ID NO: 821717 - RNA, 19 nt, Homo sapiens
ggugguacccagucauaaa

SEQ ID NO: 821718 - RNA, 19 nt, Homo sapiens
uaagauugaugagugugaa

SEQ ID NO: 821719 - RNA, 19 nt, Homo sapiens
gcuccgggcauuugaugua

SEQ ID NO: 821720 - RNA, 19 nt, Homo sapiens
gcaggaggaaauugauuau

SEQ ID NO: 821721 - RNA, 19 nt, Homo sapiens
gaacuggggaauuuauuaa

SEQ ID NO: 821722 - RNA, 19 nt, Homo sapiens
gguacccagucauaaauca

SEQ ID NO: 821723 - RNA, 19 nt, Homo sapiens
gugaugccgauuuccauua

SEQ ID NO: 821724 - RNA, 19 nt, Homo sapiens
caucggguguuuguuauca

SEQ ID NO: 821725 - RNA, 19 nt, Homo sapiens
gcaacaagagcccugaagu

SEQ ID NO: 821726 - RNA, 19 nt, Homo sapiens
cauugaagcauauuggaaa

SEQ ID NO: 821727 - RNA, 19 nt, Homo sapiens
ugggaaugguuuagaaguu

SEQ ID NO: 821728 - RNA, 19 nt, Homo sapiens
uuacaggcaugagccauug

SEQ ID NO: 821729 - RNA, 19 nt, Homo sapiens
gaccaaggcagcacauaca

SEQ ID NO: 821730 - RNA, 19 nt, Homo sapiens
agagagauguugacuugag

SEQ ID NO: 821731 - RNA, 19 nt, Homo sapiens
ggaacuggggaauuuauua

SEQ ID NO: 821732 - RNA, 19 nt, Homo sapiens
uuacuagucaacccuauuu

SEQ ID NO: 821733 - RNA, 19 nt, Homo sapiens
gaaguggcgauucgaagau

SEQ ID NO: 821734 - RNA, 19 nt, Homo sapiens
gaacuccugaccucaagug

SEQ ID NO: 821735 - RNA, 19 nt, Homo sapiens
gacagcaauucaggaaaga

SEQ ID NO: 821736 - RNA, 19 nt, Homo sapiens
caagucuccuucgagcuuu

SEQ ID NO: 821737 - RNA, 19 nt, Homo sapiens
ugaugccgauuuccauuau

SEQ ID NO: 821738 - RNA, 19 nt, Homo sapiens
aaagagggaagacuaugaa

SEQ ID NO: 821739 - RNA, 19 nt, Homo sapiens
aggcccagcucaagucuga

SEQ ID NO: 821740 - RNA, 19 nt, Homo sapiens
uaaaucaccuguuuuggau

SEQ ID NO: 821741 - RNA, 19 nt, Homo sapiens
cauauaggcgguccugaga

SEQ ID NO: 821742 - RNA, 19 nt, Homo sapiens
ugaagaagcuggacaguaa

SEQ ID NO: 821743 - RNA, 19 nt, Homo sapiens
gggaaaggcuucauauuug

SEQ ID NO: 821744 - RNA, 19 nt, Homo sapiens
agaagaaacuggaggauaa

SEQ ID NO: 821745 - RNA, 19 nt, Homo sapiens
agaaagagcugcacgagaa

SEQ ID NO: 821746 - RNA, 19 nt, Homo sapiens
gaagagugcuacacaccua

SEQ ID NO: 821747 - RNA, 19 nt, Homo sapiens
caaacaagguuaugccaaa

SEQ ID NO: 821748 - RNA, 19 nt, Homo sapiens
ggagagaccuucagaaacu

SEQ ID NO: 821749 - RNA, 19 nt, Homo sapiens
gcagaagccagacuaauuu

SEQ ID NO: 821750 - RNA, 19 nt, Homo sapiens
ggauuucucacuucaauua

SEQ ID NO: 821751 - RNA, 19 nt, Homo sapiens
gaaagaagcggagcucaaa

SEQ ID NO: 821752 - RNA, 19 nt, Homo sapiens
gaaauucacgcuuaaacaa

SEQ ID NO: 821753 - RNA, 19 nt, Homo sapiens
gaagauaggcaacaagaug

SEQ ID NO: 821754 - RNA, 19 nt, Homo sapiens
agagugagcuaacaaaguu

SEQ ID NO: 821755 - RNA, 19 nt, Homo sapiens
gaauguagguuugcugugu

SEQ ID NO: 821756 - RNA, 19 nt, Homo sapiens
gcauuuguguacagauuaa

SEQ ID NO: 821757 - RNA, 19 nt, Homo sapiens
caacuuugaugauucuaug

SEQ ID NO: 821758 - RNA, 19 nt, Homo sapiens
gaagagagacaaagagaag

SEQ ID NO: 821759 - RNA, 19 nt, Homo sapiens
gcuguaagcuggaggagau

SEQ ID NO: 821760 - RNA, 19 nt, Homo sapiens
cagaagaacugaagauagg

SEQ ID NO: 821761 - RNA, 19 nt, Homo sapiens
gcaacggaguccagaucua

SEQ ID NO: 821762 - RNA, 19 nt, Homo sapiens
ucccagaaauucacgcuua

SEQ ID NO: 821763 - RNA, 19 nt, Homo sapiens
gcucaaagaggcagagaaa

SEQ ID NO: 821764 - RNA, 19 nt, Homo sapiens
acaagguuaugccaaauuu

SEQ ID NO: 821765 - RNA, 19 nt, Homo sapiens
gggaccagaucaacaaaga

SEQ ID NO: 821766 - RNA, 19 nt, Homo sapiens
gaaacaaaccaacgaccaa

SEQ ID NO: 821767 - RNA, 19 nt, Homo sapiens
ggagacauaugaggccaaa

SEQ ID NO: 821768 - RNA, 19 nt, Homo sapiens
ucaaagaggcagagaaaga

SEQ ID NO: 821769 - RNA, 19 nt, Homo sapiens
cuaaagcucacgaucguua

SEQ ID NO: 821770 - RNA, 19 nt, Homo sapiens
ggcagaagccagacuaauu

SEQ ID NO: 821771 - RNA, 19 nt, Homo sapiens
guguacagauuaacuaguu

SEQ ID NO: 821772 - RNA, 19 nt, Homo sapiens
ggaaaggcuucauauuugc

SEQ ID NO: 821773 - RNA, 19 nt, Homo sapiens
ugggaaaggcuucauauuu

SEQ ID NO: 821774 - RNA, 19 nt, Homo sapiens
ccagcgagcuugucagcaa

SEQ ID NO: 821775 - RNA, 19 nt, Homo sapiens
gagcaaguaugaaggugau

SEQ ID NO: 821776 - RNA, 19 nt, Homo sapiens
gcagaugccauuucgaaga

SEQ ID NO: 821777 - RNA, 19 nt, Homo sapiens
cuacaagccuaucguggaa

SEQ ID NO: 821778 - RNA, 19 nt, Homo sapiens
gcuuggagguagaaacaaa

SEQ ID NO: 821779 - RNA, 19 nt, Homo sapiens
caaagcagaugccauuucg

SEQ ID NO: 821780 - RNA, 19 nt, Homo sapiens
uaacugacagcuuuccuuu

SEQ ID NO: 821781 - RNA, 19 nt, Homo sapiens
ugacaaagcaagaauguag

SEQ ID NO: 821782 - RNA, 19 nt, Homo sapiens
gaucauaauaggaagcaaa

SEQ ID NO: 821783 - RNA, 19 nt, Homo sapiens
gaagaggagaugagacaga

SEQ ID NO: 821784 - RNA, 19 nt, Homo sapiens
gagagaccuucagaaacua

SEQ ID NO: 821785 - RNA, 19 nt, Homo sapiens
aauaauccauggcugugua

SEQ ID NO: 821786 - RNA, 19 nt, Homo sapiens
ccaaagcacaagccaguuu

SEQ ID NO: 821787 - RNA, 19 nt, Homo sapiens
gcacagaagaacugaagau

SEQ ID NO: 821788 - RNA, 19 nt, Homo sapiens
gaauccaugucugcuugua

SEQ ID NO: 821789 - RNA, 19 nt, Homo sapiens
gagagcaacgugaggcuaa

SEQ ID NO: 821790 - RNA, 19 nt, Homo sapiens
ccaaucaguuucacaaagg

SEQ ID NO: 821791 - RNA, 19 nt, Homo sapiens
gauggcagcgaccgauaua

SEQ ID NO: 821792 - RNA, 19 nt, Homo sapiens
gcaggaagagcuaaagauc

SEQ ID NO: 821793 - RNA, 19 nt, Homo sapiens
gaccauaugcuuggaggua

SEQ ID NO: 821794 - RNA, 19 nt, Homo sapiens
ugaaggugaugcugccaaa

SEQ ID NO: 821795 - RNA, 19 nt, Homo sapiens
aagcaagaauguagguuug

SEQ ID NO: 821796 - RNA, 19 nt, Homo sapiens
guccagaucuaucaguuuc

SEQ ID NO: 821797 - RNA, 19 nt, Homo sapiens
ccacacagccuuggagaga

SEQ ID NO: 821798 - RNA, 19 nt, Homo sapiens
gccaguagcucagagagau

SEQ ID NO: 821799 - RNA, 19 nt, Homo sapiens
cuucauauuugcaacuuug

SEQ ID NO: 821800 - RNA, 19 nt, Homo sapiens
guguccagcuccagucuaa

SEQ ID NO: 821801 - RNA, 19 nt, Homo sapiens
aaacauaugcacgcacuuu

SEQ ID NO: 821802 - RNA, 19 nt, Homo sapiens
guccagcuccagucuaaua

SEQ ID NO: 821803 - RNA, 19 nt, Homo sapiens
gaguccagaucuaucaguu

SEQ ID NO: 821804 - RNA, 19 nt, Homo sapiens
cuugagaagcucugaauaa

SEQ ID NO: 821805 - RNA, 19 nt, Homo sapiens
guuuggugcucuauugauu

SEQ ID NO: 821806 - RNA, 19 nt, Homo sapiens
uagguuuggugcucuauug

SEQ ID NO: 821807 - RNA, 19 nt, Homo sapiens
gcuccagucuaauaccuau

SEQ ID NO: 821808 - RNA, 19 nt, Homo sapiens
gaaacuggaggauaagaag

SEQ ID NO: 821809 - RNA, 19 nt, Homo sapiens
caacggaguccagaucuau

SEQ ID NO: 821810 - RNA, 19 nt, Homo sapiens
aaguuacaguggaguauuu

SEQ ID NO: 821811 - RNA, 19 nt, Homo sapiens
ggaaggggauuucucacuu

SEQ ID NO: 821812 - RNA, 19 nt, Homo sapiens
ugaagucucuggaccuagu

SEQ ID NO: 821813 - RNA, 19 nt, Homo sapiens
auucaucgaugcacaauuc

SEQ ID NO: 821814 - RNA, 19 nt, Homo sapiens
ugagaagcucugaauaauu

SEQ ID NO: 821815 - RNA, 19 nt, Homo sapiens
uuaaacaaccaaccgguaa

SEQ ID NO: 821816 - RNA, 19 nt, Homo sapiens
cagagcugcuuucccagaa

SEQ ID NO: 821817 - RNA, 19 nt, Homo sapiens
caccgacccugacagcaaa

SEQ ID NO: 821818 - RNA, 19 nt, Homo sapiens
gaacugaagauaggcaaca

SEQ ID NO: 821819 - RNA, 19 nt, Homo sapiens
gaagagugagcuaacaaag

SEQ ID NO: 821820 - RNA, 19 nt, Homo sapiens
acaguaaggugaacaucau

SEQ ID NO: 821821 - RNA, 19 nt, Homo sapiens
acaagccuaucguggaauu

SEQ ID NO: 821822 - RNA, 19 nt, Homo sapiens
cgaggucccacuucuguuu

SEQ ID NO: 821823 - RNA, 19 nt, Homo sapiens
ggagguagaaacaaaccaa

SEQ ID NO: 821824 - RNA, 19 nt, Homo sapiens
gaccagagcaaguaugaag

SEQ ID NO: 821825 - RNA, 19 nt, Homo sapiens
cgauauaaccuacuuacuc

SEQ ID NO: 821826 - RNA, 19 nt, Homo sapiens
uugagaagcucugaauaau

SEQ ID NO: 821827 - RNA, 19 nt, Homo sapiens
ggugaagguugccgaacug

SEQ ID NO: 821828 - RNA, 19 nt, Homo sapiens
aaagcaagaauguagguuu

SEQ ID NO: 821829 - RNA, 19 nt, Homo sapiens
aaacaagguuaugccaaau

SEQ ID NO: 821830 - RNA, 19 nt, Homo sapiens
gcacacagucaaacaaggu

SEQ ID NO: 821831 - RNA, 19 nt, Homo sapiens
augaugaagugaaugcuuu

SEQ ID NO: 821832 - RNA, 19 nt, Homo sapiens
gaggagaugagacagaugu

SEQ ID NO: 821833 - RNA, 19 nt, Homo sapiens
caugucugcuuguauuuca

SEQ ID NO: 821834 - RNA, 19 nt, Homo sapiens
ggaauucaucgaugcacaa

SEQ ID NO: 821835 - RNA, 19 nt, Homo sapiens
cccagaaauucacgcuuaa

SEQ ID NO: 821836 - RNA, 19 nt, Homo sapiens
guucaacaccaaauucgaa

SEQ ID NO: 821837 - RNA, 19 nt, Homo sapiens
gcacgcacuuuucuuguug

SEQ ID NO: 821838 - RNA, 19 nt, Homo sapiens
ccacuggcacugaccauga

SEQ ID NO: 821839 - RNA, 19 nt, Homo sapiens
caagcucacuucuucuuuu

SEQ ID NO: 821840 - RNA, 19 nt, Homo sapiens
gaaguuugaccgucugaag

SEQ ID NO: 821841 - RNA, 19 nt, Homo sapiens
gauucuauguccagcuuca

SEQ ID NO: 821842 - RNA, 19 nt, Homo sapiens
ugaagaagcuggacaguaa

SEQ ID NO: 821843 - RNA, 19 nt, Homo sapiens
agaagaaacuggaggauaa

SEQ ID NO: 821844 - RNA, 19 nt, Homo sapiens
agaaagagcugcacgagaa

SEQ ID NO: 821845 - RNA, 19 nt, Homo sapiens
gaagagugcuacacaccua

SEQ ID NO: 821846 - RNA, 19 nt, Homo sapiens
gaaagaagcggagcucaaa

SEQ ID NO: 821847 - RNA, 19 nt, Homo sapiens
gaagauaggcaacaagaug

SEQ ID NO: 821848 - RNA, 19 nt, Homo sapiens
agagugagcuaacaaaguu

SEQ ID NO: 821849 - RNA, 19 nt, Homo sapiens
gaagagagacaaagagaag

SEQ ID NO: 821850 - RNA, 19 nt, Homo sapiens
gcuguaagcuggaggagau

SEQ ID NO: 821851 - RNA, 19 nt, Homo sapiens
cagaagaacugaagauagg

SEQ ID NO: 821852 - RNA, 19 nt, Homo sapiens
gcaacggaguccagaucua

SEQ ID NO: 821853 - RNA, 19 nt, Homo sapiens
gcucaaagaggcagagaaa

SEQ ID NO: 821854 - RNA, 19 nt, Homo sapiens
gggaccagaucaacaaaga

SEQ ID NO: 821855 - RNA, 19 nt, Homo sapiens
ggagacauaugaggccaaa

SEQ ID NO: 821856 - RNA, 19 nt, Homo sapiens
ucaaagaggcagagaaaga

SEQ ID NO: 821857 - RNA, 19 nt, Homo sapiens
cuaaagcucacgaucguua

SEQ ID NO: 821858 - RNA, 19 nt, Homo sapiens
ccagcgagcuugucagcaa

SEQ ID NO: 821859 - RNA, 19 nt, Homo sapiens
gcagaugccauuucgaaga

SEQ ID NO: 821860 - RNA, 19 nt, Homo sapiens
cuacaagccuaucguggaa

SEQ ID NO: 821861 - RNA, 19 nt, Homo sapiens
caaagcagaugccauuucg

SEQ ID NO: 821862 - RNA, 19 nt, Homo sapiens
gaagaggagaugagacaga

SEQ ID NO: 821863 - RNA, 19 nt, Homo sapiens
gcacagaagaacugaagau

SEQ ID NO: 821864 - RNA, 19 nt, Homo sapiens
gaauccaugucugcuugua

SEQ ID NO: 821865 - RNA, 19 nt, Homo sapiens
gagagcaacgugaggcuaa

SEQ ID NO: 821866 - RNA, 19 nt, Homo sapiens
cugccaagguuuauagaaa

SEQ ID NO: 821867 - RNA, 19 nt, Homo sapiens
gauggcagcgaccgauaua

SEQ ID NO: 821868 - RNA, 19 nt, Homo sapiens
gcaggaagagcuaaagauc

SEQ ID NO: 821869 - RNA, 19 nt, Homo sapiens
guccagaucuaucaguuuc

SEQ ID NO: 821870 - RNA, 19 nt, Homo sapiens
gaguccagaucuaucaguu

SEQ ID NO: 821871 - RNA, 19 nt, Homo sapiens
guccagcuccagucuaaua

SEQ ID NO: 821872 - RNA, 19 nt, Homo sapiens
guguccagcuccagucuaa

SEQ ID NO: 821873 - RNA, 19 nt, Homo sapiens
uauagaaaccugagaaucu

SEQ ID NO: 821874 - RNA, 19 nt, Homo sapiens
gaaacuggaggauaagaag

SEQ ID NO: 821875 - RNA, 19 nt, Homo sapiens
caacggaguccagaucuau

SEQ ID NO: 821876 - RNA, 19 nt, Homo sapiens
gcuccagucuaauaccuau

SEQ ID NO: 821877 - RNA, 19 nt, Homo sapiens
uaguuucccugagguauuu

SEQ ID NO: 821878 - RNA, 19 nt, Homo sapiens
ugaagucucuggaccuagu

SEQ ID NO: 821879 - RNA, 19 nt, Homo sapiens
auucaucgaugcacaauuc

SEQ ID NO: 821880 - RNA, 19 nt, Homo sapiens
caccgacccugacagcaaa

SEQ ID NO: 821881 - RNA, 19 nt, Homo sapiens
gaacugaagauaggcaaca

SEQ ID NO: 821882 - RNA, 19 nt, Homo sapiens
gaagagugagcuaacaaag

SEQ ID NO: 821883 - RNA, 19 nt, Homo sapiens
acaguaaggugaacaucau

SEQ ID NO: 821884 - RNA, 19 nt, Homo sapiens
acaagccuaucguggaauu

SEQ ID NO: 821885 - RNA, 19 nt, Homo sapiens
ggugaagguugccgaacug

SEQ ID NO: 821886 - RNA, 19 nt, Homo sapiens
gggccucccuuucucuaau

SEQ ID NO: 821887 - RNA, 19 nt, Homo sapiens
gagcugggccucccuuucu

SEQ ID NO: 821888 - RNA, 19 nt, Homo sapiens
augaugaagugaaugcuuu

SEQ ID NO: 821889 - RNA, 19 nt, Homo sapiens
gaggagaugagacagaugu

SEQ ID NO: 821890 - RNA, 19 nt, Homo sapiens
caugucugcuuguauuuca

SEQ ID NO: 821891 - RNA, 19 nt, Homo sapiens
ggaauucaucgaugcacaa

SEQ ID NO: 821892 - RNA, 19 nt, Homo sapiens
gaaguuugaccgucugaag

SEQ ID NO: 821893 - RNA, 19 nt, Homo sapiens
guucaacaccaaauucgaa

SEQ ID NO: 821894 - RNA, 19 nt, Homo sapiens
ucuaucaguuuccuacaga

SEQ ID NO: 821895 - RNA, 19 nt, Homo sapiens
cgaagagugagcuaacaaa

SEQ ID NO: 821896 - RNA, 19 nt, Homo sapiens
gaacaucauccccaucauu

SEQ ID NO: 821897 - RNA, 19 nt, Homo sapiens
caagaagccaacagucaug

SEQ ID NO: 821898 - RNA, 19 nt, Homo sapiens
uaauaccuaugaccuccaa

SEQ ID NO: 821899 - RNA, 19 nt, Homo sapiens
ggccucccuuucucuaauu

SEQ ID NO: 821900 - RNA, 19 nt, Homo sapiens
cacagaagaacugaagaua

SEQ ID NO: 821901 - RNA, 19 nt, Homo sapiens
cagaugccauuucgaagag

SEQ ID NO: 821902 - RNA, 19 nt, Homo sapiens
aagcagaugccauuucgaa

SEQ ID NO: 821903 - RNA, 19 nt, Homo sapiens
gacaguaaggugaacauca

SEQ ID NO: 821904 - RNA, 19 nt, Homo sapiens
ccugaagucucuggaccua

SEQ ID NO: 821905 - RNA, 19 nt, Homo sapiens
ggcuaaagcucacgaucgu

SEQ ID NO: 821906 - RNA, 19 nt, Homo sapiens
aagaagaaacuggaggaua

SEQ ID NO: 821907 - RNA, 19 nt, Homo sapiens
ucaguuuacaggagacaua

SEQ ID NO: 821908 - RNA, 19 nt, Homo sapiens
uguaacacuuucucuuugu

SEQ ID NO: 821909 - RNA, 19 nt, Homo sapiens
ccaaagcagaugccauuuc

SEQ ID NO: 821910 - RNA, 19 nt, Homo sapiens
cuacacaccuaccaugacu

SEQ ID NO: 821911 - RNA, 19 nt, Homo sapiens
gggcccaucugcuacucuu

SEQ ID NO: 821912 - RNA, 19 nt, Homo sapiens
ucuggccgcuggucaagaa

SEQ ID NO: 821913 - RNA, 19 nt, Homo sapiens
gggcaaguccacccucaug

SEQ ID NO: 821914 - RNA, 19 nt, Homo sapiens
caaagaggacagcuacaag

SEQ ID NO: 821915 - RNA, 19 nt, Homo sapiens
gaugaugaagugaaugcuu

SEQ ID NO: 821916 - RNA, 19 nt, Homo sapiens
guuuacaggagacauauga

SEQ ID NO: 821917 - RNA, 19 nt, Homo sapiens
ccacugcgacuuugugaag

SEQ ID NO: 821918 - RNA, 19 nt, Homo sapiens
guaacacuuucucuuuguc

SEQ ID NO: 821919 - RNA, 19 nt, Homo sapiens
gagcuaaagauccgaagag

SEQ ID NO: 821920 - RNA, 19 nt, Homo sapiens
gagagacaaagagaagaaa

SEQ ID NO: 821921 - RNA, 19 nt, Homo sapiens
gagcugcacgagaaguuug

SEQ ID NO: 821922 - RNA, 19 nt, Homo sapiens
caaagaggcagagaaagag

SEQ ID NO: 821923 - RNA, 19 nt, Homo sapiens
gacagcaaacccuucaguu

SEQ ID NO: 821924 - RNA, 19 nt, Homo sapiens
auagaaaccugagaaucug

SEQ ID NO: 821925 - RNA, 19 nt, Homo sapiens
gaagaaacuggaggauaag

SEQ ID NO: 821926 - RNA, 19 nt, Homo sapiens
aagaggagaugagacagau

SEQ ID NO: 821927 - RNA, 19 nt, Homo sapiens
ugccaaagcagaugccauu

SEQ ID NO: 821928 - RNA, 19 nt, Homo sapiens
gucauucccugaagucucu

SEQ ID NO: 821929 - RNA, 19 nt, Homo sapiens
aggccuaccugcaggaaga

SEQ ID NO: 821930 - RNA, 19 nt, Homo sapiens
acaaagaggacagcuacaa

SEQ ID NO: 821931 - RNA, 19 nt, Homo sapiens
gucaagaagccaacaguca

SEQ ID NO: 821932 - RNA, 19 nt, Homo sapiens
gaagaagaaacuggaggau

SEQ ID NO: 821933 - RNA, 19 nt, Homo sapiens
gaaagagcugcacgagaag

SEQ ID NO: 821934 - RNA, 19 nt, Homo sapiens
caccauggcuggguaacca

SEQ ID NO: 821935 - RNA, 19 nt, Homo sapiens
ucaagaagccaacagucau

SEQ ID NO: 821936 - RNA, 19 nt, Homo sapiens
aagaagcggagcucaaaga

SEQ ID NO: 821937 - RNA, 19 nt, Homo sapiens
agaaagaagcggagcucaa

SEQ ID NO: 821938 - RNA, 19 nt, Homo sapiens
ggagaugagacagauguuc

SEQ ID NO: 821939 - RNA, 19 nt, Homo sapiens
gggugaagguugccgaacu

SEQ ID NO: 821940 - RNA, 19 nt, Homo sapiens
aagauaggcaacaagauga

SEQ ID NO: 821941 - RNA, 19 nt, Homo sapiens
agagagacaaagagaagaa

SEQ ID NO: 821942 - RNA, 19 nt, Homo sapiens
ugaagaagcuggacaguaa

SEQ ID NO: 821943 - RNA, 19 nt, Homo sapiens
agaagaaacuggaggauaa

SEQ ID NO: 821944 - RNA, 19 nt, Homo sapiens
agaaagagcugcacgagaa

SEQ ID NO: 821945 - RNA, 19 nt, Homo sapiens
gaagagugcuacacaccua

SEQ ID NO: 821946 - RNA, 19 nt, Homo sapiens
gaaagaagcggagcucaaa

SEQ ID NO: 821947 - RNA, 19 nt, Homo sapiens
gaagauaggcaacaagaug

SEQ ID NO: 821948 - RNA, 19 nt, Homo sapiens
agagugagcuaacaaaguu

SEQ ID NO: 821949 - RNA, 19 nt, Homo sapiens
gaagagagacaaagagaag

SEQ ID NO: 821950 - RNA, 19 nt, Homo sapiens
gcuguaagcuggaggagau

SEQ ID NO: 821951 - RNA, 19 nt, Homo sapiens
cagaagaacugaagauagg

SEQ ID NO: 821952 - RNA, 19 nt, Homo sapiens
gcaacggaguccagaucua

SEQ ID NO: 821953 - RNA, 19 nt, Homo sapiens
gcucaaagaggcagagaaa

SEQ ID NO: 821954 - RNA, 19 nt, Homo sapiens
gggaccagaucaacaaaga

SEQ ID NO: 821955 - RNA, 19 nt, Homo sapiens
ggagacauaugaggccaaa

SEQ ID NO: 821956 - RNA, 19 nt, Homo sapiens
ucaaagaggcagagaaaga

SEQ ID NO: 821957 - RNA, 19 nt, Homo sapiens
cuaaagcucacgaucguua

SEQ ID NO: 821958 - RNA, 19 nt, Homo sapiens
ccagcgagcuugucagcaa

SEQ ID NO: 821959 - RNA, 19 nt, Homo sapiens
gcagaugccauuucgaaga

SEQ ID NO: 821960 - RNA, 19 nt, Homo sapiens
cuacaagccuaucguggaa

SEQ ID NO: 821961 - RNA, 19 nt, Homo sapiens
caaagcagaugccauuucg

SEQ ID NO: 821962 - RNA, 19 nt, Homo sapiens
gaagaggagaugagacaga

SEQ ID NO: 821963 - RNA, 19 nt, Homo sapiens
gcacagaagaacugaagau

SEQ ID NO: 821964 - RNA, 19 nt, Homo sapiens
gaauccaugucugcuugua

SEQ ID NO: 821965 - RNA, 19 nt, Homo sapiens
gagagcaacgugaggcuaa

SEQ ID NO: 821966 - RNA, 19 nt, Homo sapiens
gauggcagcgaccgauaua

SEQ ID NO: 821967 - RNA, 19 nt, Homo sapiens
gcaggaagagcuaaagauc

SEQ ID NO: 821968 - RNA, 19 nt, Homo sapiens
guccagaucuaucaguuuc

SEQ ID NO: 821969 - RNA, 19 nt, Homo sapiens
gaguccagaucuaucaguu

SEQ ID NO: 821970 - RNA, 19 nt, Homo sapiens
guccagcuccagucuaaua

SEQ ID NO: 821971 - RNA, 19 nt, Homo sapiens
guguccagcuccagucuaa

SEQ ID NO: 821972 - RNA, 19 nt, Homo sapiens
gaaacuggaggauaagaag

SEQ ID NO: 821973 - RNA, 19 nt, Homo sapiens
caacggaguccagaucuau

SEQ ID NO: 821974 - RNA, 19 nt, Homo sapiens
gcuccagucuaauaccuau

SEQ ID NO: 821975 - RNA, 19 nt, Homo sapiens
ugaagucucuggaccuagu

SEQ ID NO: 821976 - RNA, 19 nt, Homo sapiens
auucaucgaugcacaauuc

SEQ ID NO: 821977 - RNA, 19 nt, Homo sapiens
caccgacccugacagcaaa

SEQ ID NO: 821978 - RNA, 19 nt, Homo sapiens
gaacugaagauaggcaaca

SEQ ID NO: 821979 - RNA, 19 nt, Homo sapiens
gaagagugagcuaacaaag

SEQ ID NO: 821980 - RNA, 19 nt, Homo sapiens
acaguaaggugaacaucau

SEQ ID NO: 821981 - RNA, 19 nt, Homo sapiens
acaagccuaucguggaauu

SEQ ID NO: 821982 - RNA, 19 nt, Homo sapiens
augaugaagugaaugcuuu

SEQ ID NO: 821983 - RNA, 19 nt, Homo sapiens
gaggagaugagacagaugu

SEQ ID NO: 821984 - RNA, 19 nt, Homo sapiens
ggugaagguugccgaacug

SEQ ID NO: 821985 - RNA, 19 nt, Homo sapiens
caugucugcuuguauuuca

SEQ ID NO: 821986 - RNA, 19 nt, Homo sapiens
ggaauucaucgaugcacaa

SEQ ID NO: 821987 - RNA, 19 nt, Homo sapiens
gaaguuugaccgucugaag

SEQ ID NO: 821988 - RNA, 19 nt, Homo sapiens
guucaacaccaaauucgaa

SEQ ID NO: 821989 - RNA, 19 nt, Homo sapiens
ucuaucaguuuccuacaga

SEQ ID NO: 821990 - RNA, 19 nt, Homo sapiens
cgaagagugagcuaacaaa

SEQ ID NO: 821991 - RNA, 19 nt, Homo sapiens
gaacaucauccccaucauu

SEQ ID NO: 821992 - RNA, 19 nt, Homo sapiens
uaauaccuaugaccuccaa

SEQ ID NO: 821993 - RNA, 19 nt, Homo sapiens
cacagaagaacugaagaua

SEQ ID NO: 821994 - RNA, 19 nt, Homo sapiens
cagaugccauuucgaagag

SEQ ID NO: 821995 - RNA, 19 nt, Homo sapiens
aagcagaugccauuucgaa

SEQ ID NO: 821996 - RNA, 19 nt, Homo sapiens
gacaguaaggugaacauca

SEQ ID NO: 821997 - RNA, 19 nt, Homo sapiens
ccugaagucucuggaccua

SEQ ID NO: 821998 - RNA, 19 nt, Homo sapiens
ggcuaaagcucacgaucgu

SEQ ID NO: 821999 - RNA, 19 nt, Homo sapiens
aagaagaaacuggaggaua

SEQ ID NO: 822000 - RNA, 19 nt, Homo sapiens
ucaguuuacaggagacaua

SEQ ID NO: 822001 - RNA, 19 nt, Homo sapiens
uguaacacuuucucuuugu

SEQ ID NO: 822002 - RNA, 19 nt, Homo sapiens
ccaaagcagaugccauuuc

SEQ ID NO: 822003 - RNA, 19 nt, Homo sapiens
cuacacaccuaccaugacu

SEQ ID NO: 822004 - RNA, 19 nt, Homo sapiens
gggcaaguccacccucaug

SEQ ID NO: 822005 - RNA, 19 nt, Homo sapiens
caaagaggacagcuacaag

SEQ ID NO: 822006 - RNA, 19 nt, Homo sapiens
gaugaugaagugaaugcuu

SEQ ID NO: 822007 - RNA, 19 nt, Homo sapiens
guuuacaggagacauauga

SEQ ID NO: 822008 - RNA, 19 nt, Homo sapiens
ccacugcgacuuugugaag

SEQ ID NO: 822009 - RNA, 19 nt, Homo sapiens
guaacacuuucucuuuguc

SEQ ID NO: 822010 - RNA, 19 nt, Homo sapiens
gagcuaaagauccgaagag

SEQ ID NO: 822011 - RNA, 19 nt, Homo sapiens
gagagacaaagagaagaaa

SEQ ID NO: 822012 - RNA, 19 nt, Homo sapiens
gagcugcacgagaaguuug

SEQ ID NO: 822013 - RNA, 19 nt, Homo sapiens
caaagaggcagagaaagag

SEQ ID NO: 822014 - RNA, 19 nt, Homo sapiens
gacagcaaacccuucaguu

SEQ ID NO: 822015 - RNA, 19 nt, Homo sapiens
gaagaaacuggaggauaag

SEQ ID NO: 822016 - RNA, 19 nt, Homo sapiens
aagaggagaugagacagau

SEQ ID NO: 822017 - RNA, 19 nt, Homo sapiens
ugccaaagcagaugccauu

SEQ ID NO: 822018 - RNA, 19 nt, Homo sapiens
gucauucccugaagucucu

SEQ ID NO: 822019 - RNA, 19 nt, Homo sapiens
aggccuaccugcaggaaga

SEQ ID NO: 822020 - RNA, 19 nt, Homo sapiens
acaaagaggacagcuacaa

SEQ ID NO: 822021 - RNA, 19 nt, Homo sapiens
gaagaagaaacuggaggau

SEQ ID NO: 822022 - RNA, 19 nt, Homo sapiens
gaaagagcugcacgagaag

SEQ ID NO: 822023 - RNA, 19 nt, Homo sapiens
aagaagcggagcucaaaga

SEQ ID NO: 822024 - RNA, 19 nt, Homo sapiens
agaaagaagcggagcucaa

SEQ ID NO: 822025 - RNA, 19 nt, Homo sapiens
ggagaugagacagauguuc

SEQ ID NO: 822026 - RNA, 19 nt, Homo sapiens
gggugaagguugccgaacu

SEQ ID NO: 822027 - RNA, 19 nt, Homo sapiens
aagauaggcaacaagauga

SEQ ID NO: 822028 - RNA, 19 nt, Homo sapiens
agagagacaaagagaagaa

SEQ ID NO: 822029 - RNA, 19 nt, Homo sapiens
ugaagagagacaaagagaa

SEQ ID NO: 822030 - RNA, 19 nt, Homo sapiens
gcgauggcagcgaccgaua

SEQ ID NO: 822031 - RNA, 19 nt, Homo sapiens
auccaugucugcuuguauu

SEQ ID NO: 822032 - RNA, 19 nt, Homo sapiens
ucaacaaagaggacagcua

SEQ ID NO: 822033 - RNA, 19 nt, Homo sapiens
aagaagaggagaugagaca

SEQ ID NO: 822034 - RNA, 19 nt, Homo sapiens
acagaagaacugaagauag

SEQ ID NO: 822035 - RNA, 19 nt, Homo sapiens
ccacgggucauucccugaa

SEQ ID NO: 822036 - RNA, 19 nt, Homo sapiens
cacgaucguuagcacaguu

SEQ ID NO: 822037 - RNA, 19 nt, Homo sapiens
ccuggaugaugaagugaau

SEQ ID NO: 822038 - RNA, 19 nt, Homo sapiens
ccagcgagucaaagagaaa

SEQ ID NO: 822039 - RNA, 19 nt, Homo sapiens
uggaggagaugggcuucaa

SEQ ID NO: 822040 - RNA, 19 nt, Homo sapiens
caucauugccaaagcagau

SEQ ID NO: 822041 - RNA, 19 nt, Homo sapiens
gaagaagcuggacaguaag

SEQ ID NO: 822042 - RNA, 19 nt, Homo sapiens
ugaagaagcuggacaguaa

SEQ ID NO: 822043 - RNA, 19 nt, Homo sapiens
agaagaaacuggaggauaa

SEQ ID NO: 822044 - RNA, 19 nt, Homo sapiens
agaaagagcugcacgagaa

SEQ ID NO: 822045 - RNA, 19 nt, Homo sapiens
gaagagugcuacacaccua

SEQ ID NO: 822046 - RNA, 19 nt, Homo sapiens
gaaagaagcggagcucaaa

SEQ ID NO: 822047 - RNA, 19 nt, Homo sapiens
gaagauaggcaacaagaug

SEQ ID NO: 822048 - RNA, 19 nt, Homo sapiens
agagugagcuaacaaaguu

SEQ ID NO: 822049 - RNA, 19 nt, Homo sapiens
gaagagagacaaagagaag

SEQ ID NO: 822050 - RNA, 19 nt, Homo sapiens
gcuguaagcuggaggagau

SEQ ID NO: 822051 - RNA, 19 nt, Homo sapiens
cagaagaacugaagauagg

SEQ ID NO: 822052 - RNA, 19 nt, Homo sapiens
gcaacggaguccagaucua

SEQ ID NO: 822053 - RNA, 19 nt, Homo sapiens
gcucaaagaggcagagaaa

SEQ ID NO: 822054 - RNA, 19 nt, Homo sapiens
gggaccagaucaacaaaga

SEQ ID NO: 822055 - RNA, 19 nt, Homo sapiens
ggagacauaugaggccaaa

SEQ ID NO: 822056 - RNA, 19 nt, Homo sapiens
ucaaagaggcagagaaaga

SEQ ID NO: 822057 - RNA, 19 nt, Homo sapiens
cuaaagcucacgaucguua

SEQ ID NO: 822058 - RNA, 19 nt, Homo sapiens
ccagcgagcuugucagcaa

SEQ ID NO: 822059 - RNA, 19 nt, Homo sapiens
gcagaugccauuucgaaga

SEQ ID NO: 822060 - RNA, 19 nt, Homo sapiens
cuacaagccuaucguggaa

SEQ ID NO: 822061 - RNA, 19 nt, Homo sapiens
caaagcagaugccauuucg

SEQ ID NO: 822062 - RNA, 19 nt, Homo sapiens
gaagaggagaugagacaga

SEQ ID NO: 822063 - RNA, 19 nt, Homo sapiens
gcacagaagaacugaagau

SEQ ID NO: 822064 - RNA, 19 nt, Homo sapiens
gaauccaugucugcuugua

SEQ ID NO: 822065 - RNA, 19 nt, Homo sapiens
gagagcaacgugaggcuaa

SEQ ID NO: 822066 - RNA, 19 nt, Homo sapiens
gauggcagcgaccgauaua

SEQ ID NO: 822067 - RNA, 19 nt, Homo sapiens
gcaggaagagcuaaagauc

SEQ ID NO: 822068 - RNA, 19 nt, Homo sapiens
guccagaucuaucaguuuc

SEQ ID NO: 822069 - RNA, 19 nt, Homo sapiens
gaguccagaucuaucaguu

SEQ ID NO: 822070 - RNA, 19 nt, Homo sapiens
guccagcuccagucuaaua

SEQ ID NO: 822071 - RNA, 19 nt, Homo sapiens
guguccagcuccagucuaa

SEQ ID NO: 822072 - RNA, 19 nt, Homo sapiens
gaaacuggaggauaagaag

SEQ ID NO: 822073 - RNA, 19 nt, Homo sapiens
caacggaguccagaucuau

SEQ ID NO: 822074 - RNA, 19 nt, Homo sapiens
gcuccagucuaauaccuau

SEQ ID NO: 822075 - RNA, 19 nt, Homo sapiens
ugaagucucuggaccuagu

SEQ ID NO: 822076 - RNA, 19 nt, Homo sapiens
auucaucgaugcacaauuc

SEQ ID NO: 822077 - RNA, 19 nt, Homo sapiens
caccgacccugacagcaaa

SEQ ID NO: 822078 - RNA, 19 nt, Homo sapiens
gaacugaagauaggcaaca

SEQ ID NO: 822079 - RNA, 19 nt, Homo sapiens
gaagagugagcuaacaaag

SEQ ID NO: 822080 - RNA, 19 nt, Homo sapiens
acaguaaggugaacaucau

SEQ ID NO: 822081 - RNA, 19 nt, Homo sapiens
acaagccuaucguggaauu

SEQ ID NO: 822082 - RNA, 19 nt, Homo sapiens
augaugaagugaaugcuuu

SEQ ID NO: 822083 - RNA, 19 nt, Homo sapiens
gaggagaugagacagaugu

SEQ ID NO: 822084 - RNA, 19 nt, Homo sapiens
ggugaagguugccgaacug

SEQ ID NO: 822085 - RNA, 19 nt, Homo sapiens
caugucugcuuguauuuca

SEQ ID NO: 822086 - RNA, 19 nt, Homo sapiens
ggaauucaucgaugcacaa

SEQ ID NO: 822087 - RNA, 19 nt, Homo sapiens
gaaguuugaccgucugaag

SEQ ID NO: 822088 - RNA, 19 nt, Homo sapiens
guucaacaccaaauucgaa

SEQ ID NO: 822089 - RNA, 19 nt, Homo sapiens
ucuaucaguuuccuacaga

SEQ ID NO: 822090 - RNA, 19 nt, Homo sapiens
cgaagagugagcuaacaaa

SEQ ID NO: 822091 - RNA, 19 nt, Homo sapiens
gaacaucauccccaucauu

SEQ ID NO: 822092 - RNA, 19 nt, Homo sapiens
uaauaccuaugaccuccaa

SEQ ID NO: 822093 - RNA, 19 nt, Homo sapiens
cacagaagaacugaagaua

SEQ ID NO: 822094 - RNA, 19 nt, Homo sapiens
cagaugccauuucgaagag

SEQ ID NO: 822095 - RNA, 19 nt, Homo sapiens
aagcagaugccauuucgaa

SEQ ID NO: 822096 - RNA, 19 nt, Homo sapiens
gacaguaaggugaacauca

SEQ ID NO: 822097 - RNA, 19 nt, Homo sapiens
ccugaagucucuggaccua

SEQ ID NO: 822098 - RNA, 19 nt, Homo sapiens
ggcuaaagcucacgaucgu

SEQ ID NO: 822099 - RNA, 19 nt, Homo sapiens
aagaagaaacuggaggaua

SEQ ID NO: 822100 - RNA, 19 nt, Homo sapiens
ucaguuuacaggagacaua

SEQ ID NO: 822101 - RNA, 19 nt, Homo sapiens
uguaacacuuucucuuugu

SEQ ID NO: 822102 - RNA, 19 nt, Homo sapiens
ccaaagcagaugccauuuc

SEQ ID NO: 822103 - RNA, 19 nt, Homo sapiens
cuacacaccuaccaugacu

SEQ ID NO: 822104 - RNA, 19 nt, Homo sapiens
gggcaaguccacccucaug

SEQ ID NO: 822105 - RNA, 19 nt, Homo sapiens
caaagaggacagcuacaag

SEQ ID NO: 822106 - RNA, 19 nt, Homo sapiens
gaugaugaagugaaugcuu

SEQ ID NO: 822107 - RNA, 19 nt, Homo sapiens
guuuacaggagacauauga

SEQ ID NO: 822108 - RNA, 19 nt, Homo sapiens
ccacugcgacuuugugaag

SEQ ID NO: 822109 - RNA, 19 nt, Homo sapiens
guaacacuuucucuuuguc

SEQ ID NO: 822110 - RNA, 19 nt, Homo sapiens
gagcuaaagauccgaagag

SEQ ID NO: 822111 - RNA, 19 nt, Homo sapiens
gagagacaaagagaagaaa

SEQ ID NO: 822112 - RNA, 19 nt, Homo sapiens
gagcugcacgagaaguuug

SEQ ID NO: 822113 - RNA, 19 nt, Homo sapiens
caaagaggcagagaaagag

SEQ ID NO: 822114 - RNA, 19 nt, Homo sapiens
gacagcaaacccuucaguu

SEQ ID NO: 822115 - RNA, 19 nt, Homo sapiens
gaagaaacuggaggauaag

SEQ ID NO: 822116 - RNA, 19 nt, Homo sapiens
aagaggagaugagacagau

SEQ ID NO: 822117 - RNA, 19 nt, Homo sapiens
ugccaaagcagaugccauu

SEQ ID NO: 822118 - RNA, 19 nt, Homo sapiens
gucauucccugaagucucu

SEQ ID NO: 822119 - RNA, 19 nt, Homo sapiens
aggccuaccugcaggaaga

SEQ ID NO: 822120 - RNA, 19 nt, Homo sapiens
acaaagaggacagcuacaa

SEQ ID NO: 822121 - RNA, 19 nt, Homo sapiens
gaagaagaaacuggaggau

SEQ ID NO: 822122 - RNA, 19 nt, Homo sapiens
gaaagagcugcacgagaag

SEQ ID NO: 822123 - RNA, 19 nt, Homo sapiens
aagaagcggagcucaaaga

SEQ ID NO: 822124 - RNA, 19 nt, Homo sapiens
agaaagaagcggagcucaa

SEQ ID NO: 822125 - RNA, 19 nt, Homo sapiens
ggagaugagacagauguuc

SEQ ID NO: 822126 - RNA, 19 nt, Homo sapiens
gggugaagguugccgaacu

SEQ ID NO: 822127 - RNA, 19 nt, Homo sapiens
aagauaggcaacaagauga

SEQ ID NO: 822128 - RNA, 19 nt, Homo sapiens
agagagacaaagagaagaa

SEQ ID NO: 822129 - RNA, 19 nt, Homo sapiens
ugaagagagacaaagagaa

SEQ ID NO: 822130 - RNA, 19 nt, Homo sapiens
gcgauggcagcgaccgaua

SEQ ID NO: 822131 - RNA, 19 nt, Homo sapiens
auccaugucugcuuguauu

SEQ ID NO: 822132 - RNA, 19 nt, Homo sapiens
ucaacaaagaggacagcua

SEQ ID NO: 822133 - RNA, 19 nt, Homo sapiens
aagaagaggagaugagaca

SEQ ID NO: 822134 - RNA, 19 nt, Homo sapiens
acagaagaacugaagauag

SEQ ID NO: 822135 - RNA, 19 nt, Homo sapiens
ccacgggucauucccugaa

SEQ ID NO: 822136 - RNA, 19 nt, Homo sapiens
cacgaucguuagcacaguu

SEQ ID NO: 822137 - RNA, 19 nt, Homo sapiens
ccuggaugaugaagugaau

SEQ ID NO: 822138 - RNA, 19 nt, Homo sapiens
ccagcgagucaaagagaaa

SEQ ID NO: 822139 - RNA, 19 nt, Homo sapiens
uggaggagaugggcuucaa

SEQ ID NO: 822140 - RNA, 19 nt, Homo sapiens
caucauugccaaagcagau

SEQ ID NO: 822141 - RNA, 19 nt, Homo sapiens
gaagaagcuggacaguaag

SEQ ID NO: 822142 - RNA, 19 nt, Homo sapiens
gaacaaagccuacaguaaa

SEQ ID NO: 822143 - RNA, 19 nt, Homo sapiens
caaagcagaugcagaaaua

SEQ ID NO: 822144 - RNA, 19 nt, Homo sapiens
gaaagucucucaagcauau

SEQ ID NO: 822145 - RNA, 19 nt, Homo sapiens
gaaagaugaucaagugaaa

SEQ ID NO: 822146 - RNA, 19 nt, Homo sapiens
gaaauagacuggcaaccuu

SEQ ID NO: 822147 - RNA, 19 nt, Homo sapiens
gaagguaugugacucaaga

SEQ ID NO: 822148 - RNA, 19 nt, Homo sapiens
cagaaaggcucaacagaaa

SEQ ID NO: 822149 - RNA, 19 nt, Homo sapiens
uuagguaacugcagaaaua

SEQ ID NO: 822150 - RNA, 19 nt, Homo sapiens
gaacaagaguagcaggaaa

SEQ ID NO: 822151 - RNA, 19 nt, Homo sapiens
gcuacgagaugaaagauuu

SEQ ID NO: 822152 - RNA, 19 nt, Homo sapiens
gggauuauguccaguauug

SEQ ID NO: 822153 - RNA, 19 nt, Homo sapiens
aagauuaggucaagacaua

SEQ ID NO: 822154 - RNA, 19 nt, Homo sapiens
gcagauacuuugaaucaug

SEQ ID NO: 822155 - RNA, 19 nt, Homo sapiens
uaaggcagcagaagaauua

SEQ ID NO: 822156 - RNA, 19 nt, Homo sapiens
gagaaugguuuaugucuuc

SEQ ID NO: 822157 - RNA, 19 nt, Homo sapiens
gaaccucuccagcaaguua

SEQ ID NO: 822158 - RNA, 19 nt, Homo sapiens
cugcagaaauagcaaauua

SEQ ID NO: 822159 - RNA, 19 nt, Homo sapiens
ggaaaguuaccauaugaua

SEQ ID NO: 822160 - RNA, 19 nt, Homo sapiens
uagaugaccuuucaaaugu

SEQ ID NO: 822161 - RNA, 19 nt, Homo sapiens
gaaauuaggcagacucuuc

SEQ ID NO: 822162 - RNA, 19 nt, Homo sapiens
ucaagcacaucuauucuuu

SEQ ID NO: 822163 - RNA, 19 nt, Homo sapiens
gggcuuaacucaaauacug

SEQ ID NO: 822164 - RNA, 19 nt, Homo sapiens
gcagucaggcaaagaaaua

SEQ ID NO: 822165 - RNA, 19 nt, Homo sapiens
agaacaagaucaugcgaua

SEQ ID NO: 822166 - RNA, 19 nt, Homo sapiens
auaguagucuggaaaguua

SEQ ID NO: 822167 - RNA, 19 nt, Homo sapiens
cagcacaaccaauuaaaua

SEQ ID NO: 822168 - RNA, 19 nt, Homo sapiens
agagaaagaugaucaagug

SEQ ID NO: 822169 - RNA, 19 nt, Homo sapiens
ggauuugugugaggucuua

SEQ ID NO: 822170 - RNA, 19 nt, Homo sapiens
ggucaaagcagaugcagaa

SEQ ID NO: 822171 - RNA, 19 nt, Homo sapiens
gaugaccuuucaaauguuu

SEQ ID NO: 822172 - RNA, 19 nt, Homo sapiens
ggaugacaguggaaggaua

SEQ ID NO: 822173 - RNA, 19 nt, Homo sapiens
gcagaagaauuacaguauc

SEQ ID NO: 822174 - RNA, 19 nt, Homo sapiens
gcuguuccaugcagagaua

SEQ ID NO: 822175 - RNA, 19 nt, Homo sapiens
gaauggcguugguuucuuc

SEQ ID NO: 822176 - RNA, 19 nt, Homo sapiens
gcaagaauggcguugguuu

SEQ ID NO: 822177 - RNA, 19 nt, Homo sapiens
guaaauccacuucgcaauu

SEQ ID NO: 822178 - RNA, 19 nt, Homo sapiens
ccaggacuauuaagauuga

SEQ ID NO: 822179 - RNA, 19 nt, Homo sapiens
gagcuuauuagucauagua

SEQ ID NO: 822180 - RNA, 19 nt, Homo sapiens
ggagaaugguuuaugucuu

SEQ ID NO: 822181 - RNA, 19 nt, Homo sapiens
uuaaaucccuuccugauag

SEQ ID NO: 822182 - RNA, 19 nt, Homo sapiens
gauaaccuuuggacccuuu

SEQ ID NO: 822183 - RNA, 19 nt, Homo sapiens
uggaagaacugccaaauac

SEQ ID NO: 822184 - RNA, 19 nt, Homo sapiens
ugugguggcucucauuuaa

SEQ ID NO: 822185 - RNA, 19 nt, Homo sapiens
cagaugagcugaagcacau

SEQ ID NO: 822186 - RNA, 19 nt, Homo sapiens
gcaagacauaugcauuaua

SEQ ID NO: 822187 - RNA, 19 nt, Homo sapiens
cuaauucuaugacagugua

SEQ ID NO: 822188 - RNA, 19 nt, Homo sapiens
gagcugaagcacauuauug

SEQ ID NO: 822189 - RNA, 19 nt, Homo sapiens
gcagcaaacuggaggucaa

SEQ ID NO: 822190 - RNA, 19 nt, Homo sapiens
ugugugaggucuuacuaua

SEQ ID NO: 822191 - RNA, 19 nt, Homo sapiens
acauacagauuccuaauuc

SEQ ID NO: 822192 - RNA, 19 nt, Homo sapiens
gaaagguauucuucguguu

SEQ ID NO: 822193 - RNA, 19 nt, Homo sapiens
gaugacaauauuccacuua

SEQ ID NO: 822194 - RNA, 19 nt, Homo sapiens
ucaaauguuucuucugaug

SEQ ID NO: 822195 - RNA, 19 nt, Homo sapiens
aaaggcaucuccaagaguu

SEQ ID NO: 822196 - RNA, 19 nt, Homo sapiens
aaacaaacucagagaagua

SEQ ID NO: 822197 - RNA, 19 nt, Homo sapiens
uaaauccacuucgcaauuc

SEQ ID NO: 822198 - RNA, 19 nt, Homo sapiens
gagaacaaagccuacagua

SEQ ID NO: 822199 - RNA, 19 nt, Homo sapiens
acuguuagcuccugaaaug

SEQ ID NO: 822200 - RNA, 19 nt, Homo sapiens
guggaaggauaccggguua

SEQ ID NO: 822201 - RNA, 19 nt, Homo sapiens
ugugaggucuuacuauauu

SEQ ID NO: 822202 - RNA, 19 nt, Homo sapiens
gaagaacugccaaauacau

SEQ ID NO: 822203 - RNA, 19 nt, Homo sapiens
ccaaucaaacacagaauuu

SEQ ID NO: 822204 - RNA, 19 nt, Homo sapiens
acauauggcgauacuauua

SEQ ID NO: 822205 - RNA, 19 nt, Homo sapiens
cuacuucaacagcuuauua

SEQ ID NO: 822206 - RNA, 19 nt, Homo sapiens
ccacuucgcaauucaauga

SEQ ID NO: 822207 - RNA, 19 nt, Homo sapiens
gaauugaugcuacgagaug

SEQ ID NO: 822208 - RNA, 19 nt, Homo sapiens
caacagcagcuagaaguuu

SEQ ID NO: 822209 - RNA, 19 nt, Homo sapiens
gcucuuaggguacucaauu

SEQ ID NO: 822210 - RNA, 19 nt, Homo sapiens
acacaggcguuuguaauga

SEQ ID NO: 822211 - RNA, 19 nt, Homo sapiens
cuacaggaagcauaaauuu

SEQ ID NO: 822212 - RNA, 19 nt, Homo sapiens
cagauacuuugaaucauga

SEQ ID NO: 822213 - RNA, 19 nt, Homo sapiens
caauguugcacuacaauuu

SEQ ID NO: 822214 - RNA, 19 nt, Homo sapiens
gguaugugacucaagaaua

SEQ ID NO: 822215 - RNA, 19 nt, Homo sapiens
uaacagagaaagaugauca

SEQ ID NO: 822216 - RNA, 19 nt, Homo sapiens
ccagcaaguuauccaguuu

SEQ ID NO: 822217 - RNA, 19 nt, Homo sapiens
gagacaacacggaaaggua

SEQ ID NO: 822218 - RNA, 19 nt, Homo sapiens
guuaaaucccuuccugaua

SEQ ID NO: 822219 - RNA, 19 nt, Homo sapiens
gaucauggcaagacauaug

SEQ ID NO: 822220 - RNA, 19 nt, Homo sapiens
ucagacagaaugcacuuua

SEQ ID NO: 822221 - RNA, 19 nt, Homo sapiens
gaguuacuguugaugacua

SEQ ID NO: 822222 - RNA, 19 nt, Homo sapiens
gcagcuagaaguuuuauua

SEQ ID NO: 822223 - RNA, 19 nt, Homo sapiens
ggacagcauucuuguagac

SEQ ID NO: 822224 - RNA, 19 nt, Homo sapiens
uagaagcagucagagauaa

SEQ ID NO: 822225 - RNA, 19 nt, Homo sapiens
gauucuaacugcaacuaug

SEQ ID NO: 822226 - RNA, 19 nt, Homo sapiens
ucagaaaggcucaacagaa

SEQ ID NO: 822227 - RNA, 19 nt, Homo sapiens
guaaacauacagauuccua

SEQ ID NO: 822228 - RNA, 19 nt, Homo sapiens
uggcaagacauaugcauua

SEQ ID NO: 822229 - RNA, 19 nt, Homo sapiens
uagcagauacuuugaauca

SEQ ID NO: 822230 - RNA, 19 nt, Homo sapiens
gagauaaggcagcagaaga

SEQ ID NO: 822231 - RNA, 19 nt, Homo sapiens
gcacgaggaauucuucuuc

SEQ ID NO: 822232 - RNA, 19 nt, Homo sapiens
gaagccaggacuauuaaga

SEQ ID NO: 822233 - RNA, 19 nt, Homo sapiens
acacagaauuugauuggau

SEQ ID NO: 822234 - RNA, 19 nt, Homo sapiens
gagagauuucugugucuua

SEQ ID NO: 822235 - RNA, 19 nt, Homo sapiens
ccaauuaaauaggagaaug

SEQ ID NO: 822236 - RNA, 19 nt, Homo sapiens
gaaggagguuugccgugau

SEQ ID NO: 822237 - RNA, 19 nt, Homo sapiens
gaugaucaagugaaaggua

SEQ ID NO: 822238 - RNA, 19 nt, Homo sapiens
gaugagcugaagcacauua

SEQ ID NO: 822239 - RNA, 19 nt, Homo sapiens
ucagaaagauuaggucaag

SEQ ID NO: 822240 - RNA, 19 nt, Homo sapiens
uaacucaaauacuguugug

SEQ ID NO: 822241 - RNA, 19 nt, Homo sapiens
gcagaugcagaaauauaaa

SEQ ID NO: 822242 - RNA, 19 nt, Homo sapiens
ccaaggagcucccugaaau

SEQ ID NO: 822243 - RNA, 19 nt, Homo sapiens
gagcaacuaucaccuaaug

SEQ ID NO: 822244 - RNA, 19 nt, Homo sapiens
guaagcagcuaucucugua

SEQ ID NO: 822245 - RNA, 19 nt, Homo sapiens
gaacuaugccgaucagauu

SEQ ID NO: 822246 - RNA, 19 nt, Homo sapiens
gaacauccacuacaaguca

SEQ ID NO: 822247 - RNA, 19 nt, Homo sapiens
gaggagaaauucauugagu

SEQ ID NO: 822248 - RNA, 19 nt, Homo sapiens
ugaauguggugaagaauga

SEQ ID NO: 822249 - RNA, 19 nt, Homo sapiens
ggagaaauucauugaguuu

SEQ ID NO: 822250 - RNA, 19 nt, Homo sapiens
ggacgacgcugggaaugga

SEQ ID NO: 822251 - RNA, 19 nt, Homo sapiens
ggugaagaaugaccugauu

SEQ ID NO: 822252 - RNA, 19 nt, Homo sapiens
agaaagagcugcaaaucca

SEQ ID NO: 822253 - RNA, 19 nt, Homo sapiens
gaagaaagagcugcaaauc

SEQ ID NO: 822254 - RNA, 19 nt, Homo sapiens
ccaucaagcugaaggauuc

SEQ ID NO: 822255 - RNA, 19 nt, Homo sapiens
gaccaugacuccacagaag

SEQ ID NO: 822256 - RNA, 19 nt, Homo sapiens
gcagagcgcagucacauca

SEQ ID NO: 822257 - RNA, 19 nt, Homo sapiens
ccaagaccaugcagauaga

SEQ ID NO: 822258 - RNA, 19 nt, Homo sapiens
gcaagguggugaucaucga

SEQ ID NO: 822259 - RNA, 19 nt, Homo sapiens
cgaguggucugauguucaa

SEQ ID NO: 822260 - RNA, 19 nt, Homo sapiens
gcaacuaucaccuaaugga

SEQ ID NO: 822261 - RNA, 19 nt, Homo sapiens
cagaacggcuggcucuaug

SEQ ID NO: 822262 - RNA, 19 nt, Homo sapiens
cagagcacgucuucacuga

SEQ ID NO: 822263 - RNA, 19 nt, Homo sapiens
gaacaaggugcacgucauc

SEQ ID NO: 822264 - RNA, 19 nt, Homo sapiens
aagaugcucuggaacaaga

SEQ ID NO: 822265 - RNA, 19 nt, Homo sapiens
ccacagaggaggccacaga

SEQ ID NO: 822266 - RNA, 19 nt, Homo sapiens
guuugaagaugcucuggaa

SEQ ID NO: 822267 - RNA, 19 nt, Homo sapiens
uacaggacguggacauuga

SEQ ID NO: 822268 - RNA, 19 nt, Homo sapiens
gcugugcgguggacugaga

SEQ ID NO: 822269 - RNA, 19 nt, Homo sapiens
gauguaagcagcuaucucu

SEQ ID NO: 822270 - RNA, 19 nt, Homo sapiens
gagcgggagucggagauga

SEQ ID NO: 822271 - RNA, 19 nt, Homo sapiens
gagaagaaagagcugcaaa

SEQ ID NO: 822272 - RNA, 19 nt, Homo sapiens
ugaagaugcucuggaacaa

SEQ ID NO: 822273 - RNA, 19 nt, Homo sapiens
agucggagaugaagaagga

SEQ ID NO: 822274 - RNA, 19 nt, Homo sapiens
gcacuggcaagcuggguuu

SEQ ID NO: 822275 - RNA, 19 nt, Homo sapiens
gcauggcuguuguguacga

SEQ ID NO: 822276 - RNA, 19 nt, Homo sapiens
gcuggaagaggaacugaaa

SEQ ID NO: 822277 - RNA, 19 nt, Homo sapiens
ccaccucccugaacguguu

SEQ ID NO: 822278 - RNA, 19 nt, Homo sapiens
cuacaucgacuuccgcauu

SEQ ID NO: 822279 - RNA, 19 nt, Homo sapiens
gggaaucugcuacuggaaa

SEQ ID NO: 822280 - RNA, 19 nt, Homo sapiens
gcgaugccgugaaguucuu

SEQ ID NO: 822281 - RNA, 19 nt, Homo sapiens
cugcauggcuguuguguac

SEQ ID NO: 822282 - RNA, 19 nt, Homo sapiens
aagaagaagucgaccaucu

SEQ ID NO: 822283 - RNA, 19 nt, Homo sapiens
ucauggagcggaaccagua

SEQ ID NO: 822284 - RNA, 19 nt, Homo sapiens
ccgacucccuguaccauga

SEQ ID NO: 822285 - RNA, 19 nt, Homo sapiens
ccuugaauguggugaagaa

SEQ ID NO: 822286 - RNA, 19 nt, Homo sapiens
cagagaugauacagaccua

SEQ ID NO: 822287 - RNA, 19 nt, Homo sapiens
caagaacuaugccgaucag

SEQ ID NO: 822288 - RNA, 19 nt, Homo sapiens
acgaggagguggucaagga

SEQ ID NO: 822289 - RNA, 19 nt, Homo sapiens
cugagcaacuaucaccuaa

SEQ ID NO: 822290 - RNA, 19 nt, Homo sapiens
gaacggcuggcucuaugug

SEQ ID NO: 822291 - RNA, 19 nt, Homo sapiens
gaagaggcggaggauguaa

SEQ ID NO: 822292 - RNA, 19 nt, Homo sapiens
ggaaucugcuacuggaaaa

SEQ ID NO: 822293 - RNA, 19 nt, Homo sapiens
gcaaagaaguggggaaucu

SEQ ID NO: 822294 - RNA, 19 nt, Homo sapiens
ggcgugggcuccaagaaca

SEQ ID NO: 822295 - RNA, 19 nt, Homo sapiens
gggagucggagaugaagaa

SEQ ID NO: 822296 - RNA, 19 nt, Homo sapiens
uacaucgacuuccgcauug

SEQ ID NO: 822297 - RNA, 19 nt, Homo sapiens
gaggacacgcggaugaaga

SEQ ID NO: 822298 - RNA, 19 nt, Homo sapiens
gagaugcgcaacgucagua

SEQ ID NO: 822299 - RNA, 19 nt, Homo sapiens
ccagcaagguggugaucau

SEQ ID NO: 822300 - RNA, 19 nt, Homo sapiens
acucacagcuucuggaaac

SEQ ID NO: 822301 - RNA, 19 nt, Homo sapiens
caacaccgacucccuguac

SEQ ID NO: 822302 - RNA, 19 nt, Homo sapiens
aggagaaauucauugaguu

SEQ ID NO: 822303 - RNA, 19 nt, Homo sapiens
agaagaagaaggccaagga

SEQ ID NO: 822304 - RNA, 19 nt, Homo sapiens
gagaaauucauugaguuug

SEQ ID NO: 822305 - RNA, 19 nt, Homo sapiens
aagaagaggcggaggaugu

SEQ ID NO: 822306 - RNA, 19 nt, Homo sapiens
gccgugaacccaaagaaga

SEQ ID NO: 822307 - RNA, 19 nt, Homo sapiens
gcaacggaguggucaucuc

SEQ ID NO: 822308 - RNA, 19 nt, Homo sapiens
agugggaucugagcaacua

SEQ ID NO: 822309 - RNA, 19 nt, Homo sapiens
acaaggagcggcugaugga

SEQ ID NO: 822310 - RNA, 19 nt, Homo sapiens
gaugcgcaacgucaguaua

SEQ ID NO: 822311 - RNA, 19 nt, Homo sapiens
gccagaagcugcggaacgu

SEQ ID NO: 822312 - RNA, 19 nt, Homo sapiens
gccgugaaguucuuugucu

SEQ ID NO: 822313 - RNA, 19 nt, Homo sapiens
gggcaucauccacguguau

SEQ ID NO: 822314 - RNA, 19 nt, Homo sapiens
gcccaagaccaugcagaua

SEQ ID NO: 822315 - RNA, 19 nt, Homo sapiens
gccaaggagcucccugaaa

SEQ ID NO: 822316 - RNA, 19 nt, Homo sapiens
gcugaaggccaagaacuau

SEQ ID NO: 822317 - RNA, 19 nt, Homo sapiens
gagaaggaccccaccauga

SEQ ID NO: 822318 - RNA, 19 nt, Homo sapiens
gcagugacgaguggucuga

SEQ ID NO: 822319 - RNA, 19 nt, Homo sapiens
ccacaggcaccaaguccaa

SEQ ID NO: 822320 - RNA, 19 nt, Homo sapiens
ugaagaaggaguacaaugc

SEQ ID NO: 822321 - RNA, 19 nt, Homo sapiens
gauggccagugggaucuga

SEQ ID NO: 822322 - RNA, 19 nt, Homo sapiens
caaggagcucccugaaaug

SEQ ID NO: 822323 - RNA, 19 nt, Homo sapiens
gacgaguggucugauguuc

SEQ ID NO: 822324 - RNA, 19 nt, Homo sapiens
ggacaugagccaggugaag

SEQ ID NO: 822325 - RNA, 19 nt, Homo sapiens
ggcaggcggaggagaaauu

SEQ ID NO: 822326 - RNA, 19 nt, Homo sapiens
cggugaacauccacuacaa

SEQ ID NO: 822327 - RNA, 19 nt, Homo sapiens
guacaaggagcggcugaug

SEQ ID NO: 822328 - RNA, 19 nt, Homo sapiens
gaaguccgaggccaucauc

SEQ ID NO: 822329 - RNA, 19 nt, Homo sapiens
gcuaagcaggccaaaguca

SEQ ID NO: 822330 - RNA, 19 nt, Homo sapiens
gaacgugcuggagaaccua

SEQ ID NO: 822331 - RNA, 19 nt, Homo sapiens
cgacagccgcaacauggaa

SEQ ID NO: 822332 - RNA, 19 nt, Homo sapiens
ucaugccgcugguggugaa

SEQ ID NO: 822333 - RNA, 19 nt, Homo sapiens
gcgguggacugagaugauc

SEQ ID NO: 822334 - RNA, 19 nt, Homo sapiens
aagcagcuaucucuguaca

SEQ ID NO: 822335 - RNA, 19 nt, Homo sapiens
agaagaggcggaggaugua

SEQ ID NO: 822336 - RNA, 19 nt, Homo sapiens
caaagaagaggcggaggau

SEQ ID NO: 822337 - RNA, 19 nt, Homo sapiens
caccuucuguuucaggaau

SEQ ID NO: 822338 - RNA, 19 nt, Homo sapiens
cggaggagaaauucauuga

SEQ ID NO: 822339 - RNA, 19 nt, Homo sapiens
ggagggcuacaucgacuuc

SEQ ID NO: 822340 - RNA, 19 nt, Homo sapiens
agaacaaggugcacgucau

SEQ ID NO: 822341 - RNA, 19 nt, Homo sapiens
gagccuggugcaugucaaa

SEQ ID NO: 822342 - RNA, 19 nt, Homo sapiens
gcacagacuucuugcauga

SEQ ID NO: 822343 - RNA, 19 nt, Homo sapiens
caucgucgcucucuucaua

SEQ ID NO: 822344 - RNA, 19 nt, Homo sapiens
gcagaaaggugaggagaaa

SEQ ID NO: 822345 - RNA, 19 nt, Homo sapiens
ggugagauccuuagcauua

SEQ ID NO: 822346 - RNA, 19 nt, Homo sapiens
gcgaggcacuggcccauua

SEQ ID NO: 822347 - RNA, 19 nt, Homo sapiens
gaaagaccauuggaaagaa

SEQ ID NO: 822348 - RNA, 19 nt, Homo sapiens
gaacuaugccgaucagauu

SEQ ID NO: 822349 - RNA, 19 nt, Homo sapiens
ggaggaagguggcccagaa

SEQ ID NO: 822350 - RNA, 19 nt, Homo sapiens
guagacagguucuuugaga

SEQ ID NO: 822351 - RNA, 19 nt, Homo sapiens
gcaaucagacugcagaauu

SEQ ID NO: 822352 - RNA, 19 nt, Homo sapiens
gggcuggacuuguuucuga

SEQ ID NO: 822353 - RNA, 19 nt, Homo sapiens
gaacgucagugucuagagu

SEQ ID NO: 822354 - RNA, 19 nt, Homo sapiens
gagcagggauugugguuuc

SEQ ID NO: 822355 - RNA, 19 nt, Homo sapiens
ggaaagaccauuggaaaga

SEQ ID NO: 822356 - RNA, 19 nt, Homo sapiens
cgucugcccuggucacuua

SEQ ID NO: 822357 - RNA, 19 nt, Homo sapiens
ggagugacaugaagagcaa

SEQ ID NO: 822358 - RNA, 19 nt, Homo sapiens
guugagagguuugccuuua

SEQ ID NO: 822359 - RNA, 19 nt, Homo sapiens
gaggagaaauucauugagu

SEQ ID NO: 822360 - RNA, 19 nt, Homo sapiens
ucucagacauuucuacaaa

SEQ ID NO: 822361 - RNA, 19 nt, Homo sapiens
ggaaugaccgcuaagaguu

SEQ ID NO: 822362 - RNA, 19 nt, Homo sapiens
ggagaaauucauugaguuu

SEQ ID NO: 822363 - RNA, 19 nt, Homo sapiens
agaaagagcugcaaaucca

SEQ ID NO: 822364 - RNA, 19 nt, Homo sapiens
caugaugucuuuccuuuca

SEQ ID NO: 822365 - RNA, 19 nt, Homo sapiens
gaagaaagagcugcaaauc

SEQ ID NO: 822366 - RNA, 19 nt, Homo sapiens
gaaugaccgcuaagaguuu

SEQ ID NO: 822367 - RNA, 19 nt, Homo sapiens
ggugaggaaugaccgcuaa

SEQ ID NO: 822368 - RNA, 19 nt, Homo sapiens
caacugagaauagcuacua

SEQ ID NO: 822369 - RNA, 19 nt, Homo sapiens
agaggaaggugugucauuu

SEQ ID NO: 822370 - RNA, 19 nt, Homo sapiens
caaucagacugcagaauuc

SEQ ID NO: 822371 - RNA, 19 nt, Homo sapiens
gguaagugguggcccugua

SEQ ID NO: 822372 - RNA, 19 nt, Homo sapiens
gagguuugccuuuagguaa

SEQ ID NO: 822373 - RNA, 19 nt, Homo sapiens
ggaggaacgucagugucua

SEQ ID NO: 822374 - RNA, 19 nt, Homo sapiens
gcacagccagcccuucuug

SEQ ID NO: 822375 - RNA, 19 nt, Homo sapiens
ccugguagaugaagcagaa

SEQ ID NO: 822376 - RNA, 19 nt, Homo sapiens
uuaggagccugguagauga

SEQ ID NO: 822377 - RNA, 19 nt, Homo sapiens
aaacaguuguggcuacuca

SEQ ID NO: 822378 - RNA, 19 nt, Homo sapiens
ucacuuaaaggccaguaua

SEQ ID NO: 822379 - RNA, 19 nt, Homo sapiens
aagaugcucuggaacaaga

SEQ ID NO: 822380 - RNA, 19 nt, Homo sapiens
gaacgucagcacagacuuc

SEQ ID NO: 822381 - RNA, 19 nt, Homo sapiens
ggucacugcuacacguuga

SEQ ID NO: 822382 - RNA, 19 nt, Homo sapiens
guuugaagaugcucuggaa

SEQ ID NO: 822383 - RNA, 19 nt, Homo sapiens
uaggaaagaccauuggaaa

SEQ ID NO: 822384 - RNA, 19 nt, Homo sapiens
gagcgggagucggagauga

SEQ ID NO: 822385 - RNA, 19 nt, Homo sapiens
gagaagaaagagcugcaaa

SEQ ID NO: 822386 - RNA, 19 nt, Homo sapiens
ugaagaugcucuggaacaa

SEQ ID NO: 822387 - RNA, 19 nt, Homo sapiens
uaccugggcuggacuuguu

SEQ ID NO: 822388 - RNA, 19 nt, Homo sapiens
ugucugaugugcacagcua

SEQ ID NO: 822389 - RNA, 19 nt, Homo sapiens
gaguuuggguucuuucagu

SEQ ID NO: 822390 - RNA, 19 nt, Homo sapiens
uuagugauccucucucaaa

SEQ ID NO: 822391 - RNA, 19 nt, Homo sapiens
agucggagaugaagaagga

SEQ ID NO: 822392 - RNA, 19 nt, Homo sapiens
ggagucaguggccggauaa

SEQ ID NO: 822393 - RNA, 19 nt, Homo sapiens
ccgcauuagucacauagaa

SEQ ID NO: 822394 - RNA, 19 nt, Homo sapiens
gugaucaggucagcuaaga

SEQ ID NO: 822395 - RNA, 19 nt, Homo sapiens
agaaauguguccucugagu

SEQ ID NO: 822396 - RNA, 19 nt, Homo sapiens
ccuccuggguccugaguuu

SEQ ID NO: 822397 - RNA, 19 nt, Homo sapiens
ccaccucccugaacguguu

SEQ ID NO: 822398 - RNA, 19 nt, Homo sapiens
gcuaagacgagaacguuug

SEQ ID NO: 822399 - RNA, 19 nt, Homo sapiens
gucgcucucuucauaaauu

SEQ ID NO: 822400 - RNA, 19 nt, Homo sapiens
ggguugggcugguggaugu

SEQ ID NO: 822401 - RNA, 19 nt, Homo sapiens
cagggauugugguuucuuu

SEQ ID NO: 822402 - RNA, 19 nt, Homo sapiens
uuuaggagguugagagguu

SEQ ID NO: 822403 - RNA, 19 nt, Homo sapiens
gcuacacguugauguuuag

SEQ ID NO: 822404 - RNA, 19 nt, Homo sapiens
cggagucaguggccggaua

SEQ ID NO: 822405 - RNA, 19 nt, Homo sapiens
cucaugaugucuuuccuuu

SEQ ID NO: 822406 - RNA, 19 nt, Homo sapiens
cagagaugauacagaccua

SEQ ID NO: 822407 - RNA, 19 nt, Homo sapiens
caagaacuaugccgaucag

SEQ ID NO: 822408 - RNA, 19 nt, Homo sapiens
acgaggagguggucaagga

SEQ ID NO: 822409 - RNA, 19 nt, Homo sapiens
gcccauaggcaucugaaga

SEQ ID NO: 822410 - RNA, 19 nt, Homo sapiens
gucagaggauguccacaga

SEQ ID NO: 822411 - RNA, 19 nt, Homo sapiens
gcuuagugauccucucuca

SEQ ID NO: 822412 - RNA, 19 nt, Homo sapiens
uagcgagcuuccugaggua

SEQ ID NO: 822413 - RNA, 19 nt, Homo sapiens
gggagucggagaugaagaa

SEQ ID NO: 822414 - RNA, 19 nt, Homo sapiens
aaagaccauuggaaagaau

SEQ ID NO: 822415 - RNA, 19 nt, Homo sapiens
caguaucuuuguuaggaaa

SEQ ID NO: 822416 - RNA, 19 nt, Homo sapiens
gaggcaaagugcaaagcau

SEQ ID NO: 822417 - RNA, 19 nt, Homo sapiens
ugagauccuuagcauuaga

SEQ ID NO: 822418 - RNA, 19 nt, Homo sapiens
aaauguguccucugaguga

SEQ ID NO: 822419 - RNA, 19 nt, Homo sapiens
uaaaggccaguauaaguca

SEQ ID NO: 822420 - RNA, 19 nt, Homo sapiens
ccucggcacugcucaucuu

SEQ ID NO: 822421 - RNA, 19 nt, Homo sapiens
cacauuggguagacagguu

SEQ ID NO: 822422 - RNA, 19 nt, Homo sapiens
aggagaaauucauugaguu

SEQ ID NO: 822423 - RNA, 19 nt, Homo sapiens
ugacaucgucgcucucuuc

SEQ ID NO: 822424 - RNA, 19 nt, Homo sapiens
gagaaauucauugaguuug

SEQ ID NO: 822425 - RNA, 19 nt, Homo sapiens
gcacuggccaugacuucug

SEQ ID NO: 822426 - RNA, 19 nt, Homo sapiens
ugcuacacguugauguuua

SEQ ID NO: 822427 - RNA, 19 nt, Homo sapiens
gcugaaggccaagaacuau

SEQ ID NO: 822428 - RNA, 19 nt, Homo sapiens
cgucagcacagacuucuug

SEQ ID NO: 822429 - RNA, 19 nt, Homo sapiens
ggguagacagguucuuuga

SEQ ID NO: 822430 - RNA, 19 nt, Homo sapiens
gcucucuucauaaauugua

SEQ ID NO: 822431 - RNA, 19 nt, Homo sapiens
ugaagaaggaguacaaugc

SEQ ID NO: 822432 - RNA, 19 nt, Homo sapiens
cagcuaagacgagaacguu

SEQ ID NO: 822433 - RNA, 19 nt, Homo sapiens
ucugaggccuugcacuuuc

SEQ ID NO: 822434 - RNA, 19 nt, Homo sapiens
gguagaugaagcagaaaug

SEQ ID NO: 822435 - RNA, 19 nt, Homo sapiens
gaaacuuaggagccuggua

SEQ ID NO: 822436 - RNA, 19 nt, Homo sapiens
uagaggaaggugugucauu

SEQ ID NO: 822437 - RNA, 19 nt, Homo sapiens
ucuuugcgcuugcucaugu

SEQ ID NO: 822438 - RNA, 19 nt, Homo sapiens
ugguugcgguuucucguaa

SEQ ID NO: 822439 - RNA, 19 nt, Homo sapiens
uguuucgcauuccgcauua

SEQ ID NO: 822440 - RNA, 19 nt, Homo sapiens
ucaguaucuuuguuaggaa

SEQ ID NO: 822441 - RNA, 19 nt, Homo sapiens
agaugaagcagaaaugugu

SEQ ID NO: 822442 - RNA, 19 nt, Homo sapiens
ggacagaacucucuccauu

SEQ ID NO: 822443 - RNA, 19 nt, Homo sapiens
gaaauggaacuuuguguua

SEQ ID NO: 822444 - RNA, 19 nt, Homo sapiens
gggaaugucuguggaauua

SEQ ID NO: 822445 - RNA, 19 nt, Homo sapiens
caacagugcuuguagcuuu

SEQ ID NO: 822446 - RNA, 19 nt, Homo sapiens
gcaaauggcuguacuggau

SEQ ID NO: 822447 - RNA, 19 nt, Homo sapiens
acagaacucucuccauuua

SEQ ID NO: 822448 - RNA, 19 nt, Homo sapiens
gaucacaaauguuacacua

SEQ ID NO: 822449 - RNA, 19 nt, Homo sapiens
ugaaggagcuguuugauca

SEQ ID NO: 822450 - RNA, 19 nt, Homo sapiens
ccaaacugcugcugugaua

SEQ ID NO: 822451 - RNA, 19 nt, Homo sapiens
gaggagaaguccaagcuuu

SEQ ID NO: 822452 - RNA, 19 nt, Homo sapiens
ccagaaaccucaacuguuc

SEQ ID NO: 822453 - RNA, 19 nt, Homo sapiens
gugagaugcugcuucauua

SEQ ID NO: 822454 - RNA, 19 nt, Homo sapiens
acagagagcugaugaagga

SEQ ID NO: 822455 - RNA, 19 nt, Homo sapiens
ggacaaugauaacaguuug

SEQ ID NO: 822456 - RNA, 19 nt, Homo sapiens
ucacaaauguuacacuaga

SEQ ID NO: 822457 - RNA, 19 nt, Homo sapiens
ggacugggaauacauaauu

SEQ ID NO: 822458 - RNA, 19 nt, Homo sapiens
ccaacaagcucaucaaguc

SEQ ID NO: 822459 - RNA, 19 nt, Homo sapiens
gcucuagacauuacaguua

SEQ ID NO: 822460 - RNA, 19 nt, Homo sapiens
gaacacggcucccuuaccu

SEQ ID NO: 822461 - RNA, 19 nt, Homo sapiens
ggacaggccauccuacuga

SEQ ID NO: 822462 - RNA, 19 nt, Homo sapiens
gcugugaucuccaccuuga

SEQ ID NO: 822463 - RNA, 19 nt, Homo sapiens
gaauaaauccaagagcuuu

SEQ ID NO: 822464 - RNA, 19 nt, Homo sapiens
gaacaagaggcggacuuua

SEQ ID NO: 822465 - RNA, 19 nt, Homo sapiens
gaauuacuauguggaaaug

SEQ ID NO: 822466 - RNA, 19 nt, Homo sapiens
caaagacgccuaccacaug

SEQ ID NO: 822467 - RNA, 19 nt, Homo sapiens
ggaaacagucagugcagua

SEQ ID NO: 822468 - RNA, 19 nt, Homo sapiens
uccaagagcuuuccagaga

SEQ ID NO: 822469 - RNA, 19 nt, Homo sapiens
cuaaugugcugcccagaaa

SEQ ID NO: 822470 - RNA, 19 nt, Homo sapiens
ggaaauggaacuuuguguu

SEQ ID NO: 822471 - RNA, 19 nt, Homo sapiens
gaacuggcauacugcaaag

SEQ ID NO: 822472 - RNA, 19 nt, Homo sapiens
gaagagacagggcauagug

SEQ ID NO: 822473 - RNA, 19 nt, Homo sapiens
ccaauccacugaaggagaa

SEQ ID NO: 822474 - RNA, 19 nt, Homo sapiens
uagaggaaguuaacaacaa

SEQ ID NO: 822475 - RNA, 19 nt, Homo sapiens
ccaagucaaugaaagugaa

SEQ ID NO: 822476 - RNA, 19 nt, Homo sapiens
uauuuaaacucgccaguga

SEQ ID NO: 822477 - RNA, 19 nt, Homo sapiens
gaaacagucagugcaguaa

SEQ ID NO: 822478 - RNA, 19 nt, Homo sapiens
ggucaucaacucuuacaaa

SEQ ID NO: 822479 - RNA, 19 nt, Homo sapiens
gaagagagccaguauuucc

SEQ ID NO: 822480 - RNA, 19 nt, Homo sapiens
ggaacuggcauacugcaaa

SEQ ID NO: 822481 - RNA, 19 nt, Homo sapiens
agacugaggacaaugauaa

SEQ ID NO: 822482 - RNA, 19 nt, Homo sapiens
ggcaugaaauaaacugcua

SEQ ID NO: 822483 - RNA, 19 nt, Homo sapiens
gugauaaccucuccuuugg

SEQ ID NO: 822484 - RNA, 19 nt, Homo sapiens
ggaggacugggaauacaua

SEQ ID NO: 822485 - RNA, 19 nt, Homo sapiens
ggaauaaauccaagagcuu

SEQ ID NO: 822486 - RNA, 19 nt, Homo sapiens
ucagugagaugcugcuuca

SEQ ID NO: 822487 - RNA, 19 nt, Homo sapiens
uagaagaggacaagucaaa

SEQ ID NO: 822488 - RNA, 19 nt, Homo sapiens
auaauuggcuucugugauc

SEQ ID NO: 822489 - RNA, 19 nt, Homo sapiens
gggagcagcugagcacaga

SEQ ID NO: 822490 - RNA, 19 nt, Homo sapiens
ccaagcgucugcacacguu

SEQ ID NO: 822491 - RNA, 19 nt, Homo sapiens
ucaaguccauggugaagga

SEQ ID NO: 822492 - RNA, 19 nt, Homo sapiens
ggaauuacuauguggaaau

SEQ ID NO: 822493 - RNA, 19 nt, Homo sapiens
auaaggaacuggcauacug

SEQ ID NO: 822494 - RNA, 19 nt, Homo sapiens
gacagaacucucuccauuu

SEQ ID NO: 822495 - RNA, 19 nt, Homo sapiens
aaagugaagaccaagguua

SEQ ID NO: 822496 - RNA, 19 nt, Homo sapiens
gcugaacacggcucccuua

SEQ ID NO: 822497 - RNA, 19 nt, Homo sapiens
caagaggcggacuuuauuu

SEQ ID NO: 822498 - RNA, 19 nt, Homo sapiens
agguuucacugcuucauua

SEQ ID NO: 822499 - RNA, 19 nt, Homo sapiens
caggcuuccuuauuccuua

SEQ ID NO: 822500 - RNA, 19 nt, Homo sapiens
ggacacgaccaacaguuug

SEQ ID NO: 822501 - RNA, 19 nt, Homo sapiens
gaaugucuguggaauuacu

SEQ ID NO: 822502 - RNA, 19 nt, Homo sapiens
gcagugcccaagucaauga

SEQ ID NO: 822503 - RNA, 19 nt, Homo sapiens
auacauaauuggcuucugu

SEQ ID NO: 822504 - RNA, 19 nt, Homo sapiens
gaaaggaagguggcacaga

SEQ ID NO: 822505 - RNA, 19 nt, Homo sapiens
gaaagugaagaccaagguu

SEQ ID NO: 822506 - RNA, 19 nt, Homo sapiens
guguuaugcucuagacauu

SEQ ID NO: 822507 - RNA, 19 nt, Homo sapiens
acaagaggcggacuuuauu

SEQ ID NO: 822508 - RNA, 19 nt, Homo sapiens
ggacagagagcugaugaag

SEQ ID NO: 822509 - RNA, 19 nt, Homo sapiens
ugaacaagcucagcaaucg

SEQ ID NO: 822510 - RNA, 19 nt, Homo sapiens
gguguuugcuuccuucuac

SEQ ID NO: 822511 - RNA, 19 nt, Homo sapiens
aagaggcggacuuuauuua

SEQ ID NO: 822512 - RNA, 19 nt, Homo sapiens
caaauggcuguacuggaua

SEQ ID NO: 822513 - RNA, 19 nt, Homo sapiens
gaggacaagucaaaaguga

SEQ ID NO: 822514 - RNA, 19 nt, Homo sapiens
uuucacugcuucauuagaa

SEQ ID NO: 822515 - RNA, 19 nt, Homo sapiens
gacugggaauacauaauug

SEQ ID NO: 822516 - RNA, 19 nt, Homo sapiens
caucaacucuuacaaaaca

SEQ ID NO: 822517 - RNA, 19 nt, Homo sapiens
ggaauuuggccucaugaca

SEQ ID NO: 822518 - RNA, 19 nt, Homo sapiens
agaauaaggaacuggcaua

SEQ ID NO: 822519 - RNA, 19 nt, Homo sapiens
ugugacagccuacgauaaa

SEQ ID NO: 822520 - RNA, 19 nt, Homo sapiens
gaagggcaggucaucaaug

SEQ ID NO: 822521 - RNA, 19 nt, Homo sapiens
ggagcuguuugaucagugu

SEQ ID NO: 822522 - RNA, 19 nt, Homo sapiens
cuggaguccuggcucaaua

SEQ ID NO: 822523 - RNA, 19 nt, Homo sapiens
cucaggaucacaaauguua

SEQ ID NO: 822524 - RNA, 19 nt, Homo sapiens
ggcaggacauggaauuugg

SEQ ID NO: 822525 - RNA, 19 nt, Homo sapiens
augaagagagccaguauuu

SEQ ID NO: 822526 - RNA, 19 nt, Homo sapiens
guuaugcucuagacauuac

SEQ ID NO: 822527 - RNA, 19 nt, Homo sapiens
cuaaagagagacugucaug

SEQ ID NO: 822528 - RNA, 19 nt, Homo sapiens
agaagaagcaaagaucaaa

SEQ ID NO: 822529 - RNA, 19 nt, Homo sapiens
gaagaagcaaagaucaaag

SEQ ID NO: 822530 - RNA, 19 nt, Homo sapiens
ugaggacaaugauaacagu

SEQ ID NO: 822531 - RNA, 19 nt, Homo sapiens
caagagcuuuccagagacu

SEQ ID NO: 822532 - RNA, 19 nt, Homo sapiens
uugccaggcuuccuuauuc

SEQ ID NO: 822533 - RNA, 19 nt, Homo sapiens
gagaucgggccacacuuga

SEQ ID NO: 822534 - RNA, 19 nt, Homo sapiens
gcccagaaaccucaacugu

SEQ ID NO: 822535 - RNA, 19 nt, Homo sapiens
ccucuugcuuggcaugaaa

SEQ ID NO: 822536 - RNA, 19 nt, Homo sapiens
ugugauaaccucuccuuug

SEQ ID NO: 822537 - RNA, 19 nt, Homo sapiens
uuauugagcugcuguacag

SEQ ID NO: 822538 - RNA, 19 nt, Homo sapiens
ccaccuggaugcccucgau

SEQ ID NO: 822539 - RNA, 19 nt, Homo sapiens
aacaagaggcggacuuuau

SEQ ID NO: 822540 - RNA, 19 nt, Homo sapiens
gagaugcugcuucauuaca

SEQ ID NO: 822541 - RNA, 19 nt, Homo sapiens
gagcccaggugaacaagcu

SEQ ID NO: 822542 - RNA, 19 nt, Homo sapiens
ggacagaacucucuccauu

SEQ ID NO: 822543 - RNA, 19 nt, Homo sapiens
gaaauggaacuuuguguua

SEQ ID NO: 822544 - RNA, 19 nt, Homo sapiens
gggaaugucuguggaauua

SEQ ID NO: 822545 - RNA, 19 nt, Homo sapiens
caacagugcuuguagcuuu

SEQ ID NO: 822546 - RNA, 19 nt, Homo sapiens
gcaaauggcuguacuggau

SEQ ID NO: 822547 - RNA, 19 nt, Homo sapiens
acagaacucucuccauuua

SEQ ID NO: 822548 - RNA, 19 nt, Homo sapiens
gaucacaaauguuacacua

SEQ ID NO: 822549 - RNA, 19 nt, Homo sapiens
ugaaggagcuguuugauca

SEQ ID NO: 822550 - RNA, 19 nt, Homo sapiens
ccaaacugcugcugugaua

SEQ ID NO: 822551 - RNA, 19 nt, Homo sapiens
gaggagaaguccaagcuuu

SEQ ID NO: 822552 - RNA, 19 nt, Homo sapiens
ccagaaaccucaacuguuc

SEQ ID NO: 822553 - RNA, 19 nt, Homo sapiens
gugagaugcugcuucauua

SEQ ID NO: 822554 - RNA, 19 nt, Homo sapiens
acagagagcugaugaagga

SEQ ID NO: 822555 - RNA, 19 nt, Homo sapiens
ggacaaugauaacaguuug

SEQ ID NO: 822556 - RNA, 19 nt, Homo sapiens
ucacaaauguuacacuaga

SEQ ID NO: 822557 - RNA, 19 nt, Homo sapiens
ggacugggaauacauaauu

SEQ ID NO: 822558 - RNA, 19 nt, Homo sapiens
ccaacaagcucaucaaguc

SEQ ID NO: 822559 - RNA, 19 nt, Homo sapiens
gaggagauuucauaacgaa

SEQ ID NO: 822560 - RNA, 19 nt, Homo sapiens
gcucuagacauuacaguua

SEQ ID NO: 822561 - RNA, 19 nt, Homo sapiens
gaacacggcucccuuaccu

SEQ ID NO: 822562 - RNA, 19 nt, Homo sapiens
ggacaggccauccuacuga

SEQ ID NO: 822563 - RNA, 19 nt, Homo sapiens
gcugugaucuccaccuuga

SEQ ID NO: 822564 - RNA, 19 nt, Homo sapiens
gaauaaauccaagagcuuu

SEQ ID NO: 822565 - RNA, 19 nt, Homo sapiens
gaacaagaggcggacuuua

SEQ ID NO: 822566 - RNA, 19 nt, Homo sapiens
gaauuacuauguggaaaug

SEQ ID NO: 822567 - RNA, 19 nt, Homo sapiens
caaagacgccuaccacaug

SEQ ID NO: 822568 - RNA, 19 nt, Homo sapiens
ggaaacagucagugcagua

SEQ ID NO: 822569 - RNA, 19 nt, Homo sapiens
uccaagagcuuuccagaga

SEQ ID NO: 822570 - RNA, 19 nt, Homo sapiens
cuaaugugcugcccagaaa

SEQ ID NO: 822571 - RNA, 19 nt, Homo sapiens
ggaaauggaacuuuguguu

SEQ ID NO: 822572 - RNA, 19 nt, Homo sapiens
gaacuggcauacugcaaag

SEQ ID NO: 822573 - RNA, 19 nt, Homo sapiens
gaagagacagggcauagug

SEQ ID NO: 822574 - RNA, 19 nt, Homo sapiens
ccaauccacugaaggagaa

SEQ ID NO: 822575 - RNA, 19 nt, Homo sapiens
uagaggaaguuaacaacaa

SEQ ID NO: 822576 - RNA, 19 nt, Homo sapiens
ccaagucaaugaaagugaa

SEQ ID NO: 822577 - RNA, 19 nt, Homo sapiens
uauuuaaacucgccaguga

SEQ ID NO: 822578 - RNA, 19 nt, Homo sapiens
gaaacagucagugcaguaa

SEQ ID NO: 822579 - RNA, 19 nt, Homo sapiens
ggucaucaacucuuacaaa

SEQ ID NO: 822580 - RNA, 19 nt, Homo sapiens
gaagagagccaguauuucc

SEQ ID NO: 822581 - RNA, 19 nt, Homo sapiens
ggaacuggcauacugcaaa

SEQ ID NO: 822582 - RNA, 19 nt, Homo sapiens
agacugaggacaaugauaa

SEQ ID NO: 822583 - RNA, 19 nt, Homo sapiens
ggcaugaaauaaacugcua

SEQ ID NO: 822584 - RNA, 19 nt, Homo sapiens
gugauaaccucuccuuugg

SEQ ID NO: 822585 - RNA, 19 nt, Homo sapiens
ggaggacugggaauacaua

SEQ ID NO: 822586 - RNA, 19 nt, Homo sapiens
gggaggagauuucauaacg

SEQ ID NO: 822587 - RNA, 19 nt, Homo sapiens
ggaauaaauccaagagcuu

SEQ ID NO: 822588 - RNA, 19 nt, Homo sapiens
ucagugagaugcugcuuca

SEQ ID NO: 822589 - RNA, 19 nt, Homo sapiens
auaauuggcuucugugauc

SEQ ID NO: 822590 - RNA, 19 nt, Homo sapiens
uagaagaggacaagucaaa

SEQ ID NO: 822591 - RNA, 19 nt, Homo sapiens
gggagcagcugagcacaga

SEQ ID NO: 822592 - RNA, 19 nt, Homo sapiens
ccaagcgucugcacacguu

SEQ ID NO: 822593 - RNA, 19 nt, Homo sapiens
ggaggagauuucauaacga

SEQ ID NO: 822594 - RNA, 19 nt, Homo sapiens
ucaaguccauggugaagga

SEQ ID NO: 822595 - RNA, 19 nt, Homo sapiens
ggaauuacuauguggaaau

SEQ ID NO: 822596 - RNA, 19 nt, Homo sapiens
auaaggaacuggcauacug

SEQ ID NO: 822597 - RNA, 19 nt, Homo sapiens
gacagaacucucuccauuu

SEQ ID NO: 822598 - RNA, 19 nt, Homo sapiens
gcugaacacggcucccuua

SEQ ID NO: 822599 - RNA, 19 nt, Homo sapiens
caagaggcggacuuuauuu

SEQ ID NO: 822600 - RNA, 19 nt, Homo sapiens
aaagugaagaccaagguua

SEQ ID NO: 822601 - RNA, 19 nt, Homo sapiens
ucaaagucgucucuccaaa

SEQ ID NO: 822602 - RNA, 19 nt, Homo sapiens
agguuucacugcuucauua

SEQ ID NO: 822603 - RNA, 19 nt, Homo sapiens
caggcuuccuuauuccuua

SEQ ID NO: 822604 - RNA, 19 nt, Homo sapiens
ggacacgaccaacaguuug

SEQ ID NO: 822605 - RNA, 19 nt, Homo sapiens
auacauaauuggcuucugu

SEQ ID NO: 822606 - RNA, 19 nt, Homo sapiens
gaaugucuguggaauuacu

SEQ ID NO: 822607 - RNA, 19 nt, Homo sapiens
gcagugcccaagucaauga

SEQ ID NO: 822608 - RNA, 19 nt, Homo sapiens
gaaaggaagguggcacaga

SEQ ID NO: 822609 - RNA, 19 nt, Homo sapiens
gaaagugaagaccaagguu

SEQ ID NO: 822610 - RNA, 19 nt, Homo sapiens
gagauuucauaacgaagug

SEQ ID NO: 822611 - RNA, 19 nt, Homo sapiens
guguuaugcucuagacauu

SEQ ID NO: 822612 - RNA, 19 nt, Homo sapiens
acaagaggcggacuuuauu

SEQ ID NO: 822613 - RNA, 19 nt, Homo sapiens
ggacagagagcugaugaag

SEQ ID NO: 822614 - RNA, 19 nt, Homo sapiens
ugaacaagcucagcaaucg

SEQ ID NO: 822615 - RNA, 19 nt, Homo sapiens
gguguuugcuuccuucuac

SEQ ID NO: 822616 - RNA, 19 nt, Homo sapiens
aagaggcggacuuuauuua

SEQ ID NO: 822617 - RNA, 19 nt, Homo sapiens
aaagucgucucuccaaagu

SEQ ID NO: 822618 - RNA, 19 nt, Homo sapiens
caaauggcuguacuggaua

SEQ ID NO: 822619 - RNA, 19 nt, Homo sapiens
gaggacaagucaaaaguga

SEQ ID NO: 822620 - RNA, 19 nt, Homo sapiens
uuucacugcuucauuagaa

SEQ ID NO: 822621 - RNA, 19 nt, Homo sapiens
gacugggaauacauaauug

SEQ ID NO: 822622 - RNA, 19 nt, Homo sapiens
caucaacucuuacaaaaca

SEQ ID NO: 822623 - RNA, 19 nt, Homo sapiens
ggaauuuggccucaugaca

SEQ ID NO: 822624 - RNA, 19 nt, Homo sapiens
agaauaaggaacuggcaua

SEQ ID NO: 822625 - RNA, 19 nt, Homo sapiens
ugugacagccuacgauaaa

SEQ ID NO: 822626 - RNA, 19 nt, Homo sapiens
gaagggcaggucaucaaug

SEQ ID NO: 822627 - RNA, 19 nt, Homo sapiens
ggagcuguuugaucagugu

SEQ ID NO: 822628 - RNA, 19 nt, Homo sapiens
cuggaguccuggcucaaua

SEQ ID NO: 822629 - RNA, 19 nt, Homo sapiens
cucaggaucacaaauguua

SEQ ID NO: 822630 - RNA, 19 nt, Homo sapiens
ggcaggacauggaauuugg

SEQ ID NO: 822631 - RNA, 19 nt, Homo sapiens
augaagagagccaguauuu

SEQ ID NO: 822632 - RNA, 19 nt, Homo sapiens
guuaugcucuagacauuac

SEQ ID NO: 822633 - RNA, 19 nt, Homo sapiens
ggagauuucauaacgaagu

SEQ ID NO: 822634 - RNA, 19 nt, Homo sapiens
cuaaagagagacugucaug

SEQ ID NO: 822635 - RNA, 19 nt, Homo sapiens
gaacugugggaggagauuu

SEQ ID NO: 822636 - RNA, 19 nt, Homo sapiens
ugaggacaaugauaacagu

SEQ ID NO: 822637 - RNA, 19 nt, Homo sapiens
gaagaagcaaagaucaaag

SEQ ID NO: 822638 - RNA, 19 nt, Homo sapiens
agaagaagcaaagaucaaa

SEQ ID NO: 822639 - RNA, 19 nt, Homo sapiens
caagagcuuuccagagacu

SEQ ID NO: 822640 - RNA, 19 nt, Homo sapiens
uugccaggcuuccuuauuc

SEQ ID NO: 822641 - RNA, 19 nt, Homo sapiens
uuauugagcugcuguacag

SEQ ID NO: 822642 - RNA, 19 nt, Homo sapiens
gaacaaggcugcugcaaag

SEQ ID NO: 822643 - RNA, 19 nt, Homo sapiens
gcauauaccucaaugacuu

SEQ ID NO: 822644 - RNA, 19 nt, Homo sapiens
gaaauuaacagcugucuca

SEQ ID NO: 822645 - RNA, 19 nt, Homo sapiens
ucaagucgcugccugcaua

SEQ ID NO: 822646 - RNA, 19 nt, Homo sapiens
caaaggcugugaugugaaa

SEQ ID NO: 822647 - RNA, 19 nt, Homo sapiens
gcaauggcaucuucuguuc

SEQ ID NO: 822648 - RNA, 19 nt, Homo sapiens
augaugagcucacguauaa

SEQ ID NO: 822649 - RNA, 19 nt, Homo sapiens
ggaagcaaguggugcagaa

SEQ ID NO: 822650 - RNA, 19 nt, Homo sapiens
ggagaucaccgucaccuuu

SEQ ID NO: 822651 - RNA, 19 nt, Homo sapiens
cuacaaggccaacaacaua

SEQ ID NO: 822652 - RNA, 19 nt, Homo sapiens
ggugauggcuucagcuguu

SEQ ID NO: 822653 - RNA, 19 nt, Homo sapiens
ggacugccgcuacgaagua

SEQ ID NO: 822654 - RNA, 19 nt, Homo sapiens
gagaucaccgucaccuuua

SEQ ID NO: 822655 - RNA, 19 nt, Homo sapiens
ggauaagcaugccucauuc

SEQ ID NO: 822656 - RNA, 19 nt, Homo sapiens
gggauaagcaugccucauu

SEQ ID NO: 822657 - RNA, 19 nt, Homo sapiens
gacggaagcugugucugua

SEQ ID NO: 822658 - RNA, 19 nt, Homo sapiens
ggauguggcugaccuccuu

SEQ ID NO: 822659 - RNA, 19 nt, Homo sapiens
ggaccaccgugacaagcua

SEQ ID NO: 822660 - RNA, 19 nt, Homo sapiens
ggaacaaggcugcugcaaa

SEQ ID NO: 822661 - RNA, 19 nt, Homo sapiens
gaggaggacuucccugaca

SEQ ID NO: 822662 - RNA, 19 nt, Homo sapiens
gggcugcucuuacacaugu

SEQ ID NO: 822663 - RNA, 19 nt, Homo sapiens
ggacagauccucgccucua

SEQ ID NO: 822664 - RNA, 19 nt, Homo sapiens
guaccugccugcccgacua

SEQ ID NO: 822665 - RNA, 19 nt, Homo sapiens
gcugcacucuuugggauua

SEQ ID NO: 822666 - RNA, 19 nt, Homo sapiens
gagcugugccaggaaauua

SEQ ID NO: 822667 - RNA, 19 nt, Homo sapiens
aaacaagcauggagagcaa

SEQ ID NO: 822668 - RNA, 19 nt, Homo sapiens
gaugaugagcucacguaua

SEQ ID NO: 822669 - RNA, 19 nt, Homo sapiens
cagcaacucuacuuugugu

SEQ ID NO: 822670 - RNA, 19 nt, Homo sapiens
gaugagcucacguauaaga

SEQ ID NO: 822671 - RNA, 19 nt, Homo sapiens
gagccguccuugcuucauu

SEQ ID NO: 822672 - RNA, 19 nt, Homo sapiens
ggacggaagcugugucugu

SEQ ID NO: 822673 - RNA, 19 nt, Homo sapiens
gugguuagccguaucauug

SEQ ID NO: 822674 - RNA, 19 nt, Homo sapiens
caacuucuccaccuucuau

SEQ ID NO: 822675 - RNA, 19 nt, Homo sapiens
gggcuucgguuacaagauc

SEQ ID NO: 822676 - RNA, 19 nt, Homo sapiens
gguccuggcugugaacauu

SEQ ID NO: 822677 - RNA, 19 nt, Homo sapiens
cagcagacguucaacaucu

SEQ ID NO: 822678 - RNA, 19 nt, Homo sapiens
caaggcugcugcaaagguu

SEQ ID NO: 822679 - RNA, 19 nt, Homo sapiens
caaaggcaauugcagugau

SEQ ID NO: 822680 - RNA, 19 nt, Homo sapiens
ucacagcgggucucucuaa

SEQ ID NO: 822681 - RNA, 19 nt, Homo sapiens
uaggaacaauggucacuug

SEQ ID NO: 822682 - RNA, 19 nt, Homo sapiens
caaggagugugucuacauc

SEQ ID NO: 822683 - RNA, 19 nt, Homo sapiens
ggagcucccggaucagaua

SEQ ID NO: 822684 - RNA, 19 nt, Homo sapiens
cugcugcccugguuucuuu

SEQ ID NO: 822685 - RNA, 19 nt, Homo sapiens
gcagaaggccacacagaca

SEQ ID NO: 822686 - RNA, 19 nt, Homo sapiens
aagcaugccucauucuuca

SEQ ID NO: 822687 - RNA, 19 nt, Homo sapiens
caacugcaccggagugugu

SEQ ID NO: 822688 - RNA, 19 nt, Homo sapiens
gcgauggacugcagugucu

SEQ ID NO: 822689 - RNA, 19 nt, Homo sapiens
gcagcugccgugaggguua

SEQ ID NO: 822690 - RNA, 19 nt, Homo sapiens
gagauucgcaacauuagug

SEQ ID NO: 822691 - RNA, 19 nt, Homo sapiens
gugugaagcuggacaucuu

SEQ ID NO: 822692 - RNA, 19 nt, Homo sapiens
agaugucgcugucuugaug

SEQ ID NO: 822693 - RNA, 19 nt, Homo sapiens
cugcaugcccgcuguguua

SEQ ID NO: 822694 - RNA, 19 nt, Homo sapiens
gcgaggagcagcacaagau

SEQ ID NO: 822695 - RNA, 19 nt, Homo sapiens
gggaagaccagcugugugu

SEQ ID NO: 822696 - RNA, 19 nt, Homo sapiens
cauaggcccuucacaaugc

SEQ ID NO: 822697 - RNA, 19 nt, Homo sapiens
gcgaugggauggugugucu

SEQ ID NO: 822698 - RNA, 19 nt, Homo sapiens
gugauggcuucagcuguua

SEQ ID NO: 822699 - RNA, 19 nt, Homo sapiens
guucaaaggcugugaugug

SEQ ID NO: 822700 - RNA, 19 nt, Homo sapiens
ccacugcacaugccacaaa

SEQ ID NO: 822701 - RNA, 19 nt, Homo sapiens
gugcauggccgcugugaug

SEQ ID NO: 822702 - RNA, 19 nt, Homo sapiens
gaacaccugcagcaucugu

SEQ ID NO: 822703 - RNA, 19 nt, Homo sapiens
cguggaggcugcucagaga

SEQ ID NO: 822704 - RNA, 19 nt, Homo sapiens
ggaggguguugccagaugu

SEQ ID NO: 822705 - RNA, 19 nt, Homo sapiens
gcaacucuacuuugugugu

SEQ ID NO: 822706 - RNA, 19 nt, Homo sapiens
acgcagaucuaaugagcaa

SEQ ID NO: 822707 - RNA, 19 nt, Homo sapiens
caaggacgcugccgaaccu

SEQ ID NO: 822708 - RNA, 19 nt, Homo sapiens
ggaggcugcucagagaaug

SEQ ID NO: 822709 - RNA, 19 nt, Homo sapiens
cagcgggucucucuaaacu

SEQ ID NO: 822710 - RNA, 19 nt, Homo sapiens
ccacguuugucacucaugu

SEQ ID NO: 822711 - RNA, 19 nt, Homo sapiens
gaggagaccacuuuuauug

SEQ ID NO: 822712 - RNA, 19 nt, Homo sapiens
cgagagggagggcagcaua

SEQ ID NO: 822713 - RNA, 19 nt, Homo sapiens
ugggagauucgcaacauua

SEQ ID NO: 822714 - RNA, 19 nt, Homo sapiens
ggacaucauggccuucaau

SEQ ID NO: 822715 - RNA, 19 nt, Homo sapiens
gggaucagcacgugcaaug

SEQ ID NO: 822716 - RNA, 19 nt, Homo sapiens
uuacacaugugccaagaag

SEQ ID NO: 822717 - RNA, 19 nt, Homo sapiens
ggaagugccggaagcaagu

SEQ ID NO: 822718 - RNA, 19 nt, Homo sapiens
gacacaaggacccaacaaa

SEQ ID NO: 822719 - RNA, 19 nt, Homo sapiens
ggacacaaggacccaacaa

SEQ ID NO: 822720 - RNA, 19 nt, Homo sapiens
cuucgucccugucaaugaa

SEQ ID NO: 822721 - RNA, 19 nt, Homo sapiens
ggccucagccucaucauca

SEQ ID NO: 822722 - RNA, 19 nt, Homo sapiens
cagaugccaugugcacuga

SEQ ID NO: 822723 - RNA, 19 nt, Homo sapiens
aggccuggcuguaccauga

SEQ ID NO: 822724 - RNA, 19 nt, Homo sapiens
aaaggcaauugcagugaug

SEQ ID NO: 822725 - RNA, 19 nt, Homo sapiens
gcagaggguagacgugaug

SEQ ID NO: 822726 - RNA, 19 nt, Homo sapiens
acagggaggagaccacuuu

SEQ ID NO: 822727 - RNA, 19 nt, Homo sapiens
caacgccacccuccuaagu

SEQ ID NO: 822728 - RNA, 19 nt, Homo sapiens
gcacugaccagcacuucca

SEQ ID NO: 822729 - RNA, 19 nt, Homo sapiens
gcacugggagccugaugau

SEQ ID NO: 822730 - RNA, 19 nt, Homo sapiens
ggaggaugcagcccauaug

SEQ ID NO: 822731 - RNA, 19 nt, Homo sapiens
ggcaauggcaucuucuguu

SEQ ID NO: 822732 - RNA, 19 nt, Homo sapiens
ggacugcugcccugguuuc

SEQ ID NO: 822733 - RNA, 19 nt, Homo sapiens
gcugggagauucgcaacau

SEQ ID NO: 822734 - RNA, 19 nt, Homo sapiens
ggaaguggccacccugaac

SEQ ID NO: 822735 - RNA, 19 nt, Homo sapiens
gaggagcagcacaagauug

SEQ ID NO: 822736 - RNA, 19 nt, Homo sapiens
ccaaggacccaugcacuga

SEQ ID NO: 822737 - RNA, 19 nt, Homo sapiens
cugcugcccuggucacuau

SEQ ID NO: 822738 - RNA, 19 nt, Homo sapiens
caucugaccugcccaaccu

SEQ ID NO: 822739 - RNA, 19 nt, Homo sapiens
ccauaggcccuucacaaug

SEQ ID NO: 822740 - RNA, 19 nt, Homo sapiens
ggcaggugcuguucaaagg

SEQ ID NO: 822741 - RNA, 19 nt, Homo sapiens
uucaaaggcugugauguga

SEQ ID NO: 822742 - RNA, 19 nt, Homo sapiens
ccagucaucuguaauauaa

SEQ ID NO: 822743 - RNA, 19 nt, Homo sapiens
gaacauauccgcuaucagu

SEQ ID NO: 822744 - RNA, 19 nt, Homo sapiens
gaccgaaacucuuuauaga

SEQ ID NO: 822745 - RNA, 19 nt, Homo sapiens
gaaagugaguuuaugaagu

SEQ ID NO: 822746 - RNA, 19 nt, Homo sapiens
gaagagaucccucccaaau

SEQ ID NO: 822747 - RNA, 19 nt, Homo sapiens
gcaagaaagaaacucauua

SEQ ID NO: 822748 - RNA, 19 nt, Homo sapiens
ggagaucucugaacuugga

SEQ ID NO: 822749 - RNA, 19 nt, Homo sapiens
gagcaagggucaaggcaaa

SEQ ID NO: 822750 - RNA, 19 nt, Homo sapiens
ccauguagaucuguauuua

SEQ ID NO: 822751 - RNA, 19 nt, Homo sapiens
gaagaucuguucaaaguac

SEQ ID NO: 822752 - RNA, 19 nt, Homo sapiens
gaugacaaauccagugaaa

SEQ ID NO: 822753 - RNA, 19 nt, Homo sapiens
gcaaauguuucaagcaugu

SEQ ID NO: 822754 - RNA, 19 nt, Homo sapiens
gaacuuggaagacuacaaa

SEQ ID NO: 822755 - RNA, 19 nt, Homo sapiens
gagaaguguugauuacauu

SEQ ID NO: 822756 - RNA, 19 nt, Homo sapiens
ccagugaggucuacucuga

SEQ ID NO: 822757 - RNA, 19 nt, Homo sapiens
gaagaaacaggccaacaaa

SEQ ID NO: 822758 - RNA, 19 nt, Homo sapiens
gcaaaggaguggugaugga

SEQ ID NO: 822759 - RNA, 19 nt, Homo sapiens
gaaaggaaccaugaagaaa

SEQ ID NO: 822760 - RNA, 19 nt, Homo sapiens
guguaaagcuccaagugua

SEQ ID NO: 822761 - RNA, 19 nt, Homo sapiens
ccaaacaaauccaagauca

SEQ ID NO: 822762 - RNA, 19 nt, Homo sapiens
ggacaaggccaaacaaauc

SEQ ID NO: 822763 - RNA, 19 nt, Homo sapiens
gaagaagacucagcuacug

SEQ ID NO: 822764 - RNA, 19 nt, Homo sapiens
aaguacagcugacuauaua

SEQ ID NO: 822765 - RNA, 19 nt, Homo sapiens
ccagugaccucucagaaga

SEQ ID NO: 822766 - RNA, 19 nt, Homo sapiens
ggucuacucugaugaugaa

SEQ ID NO: 822767 - RNA, 19 nt, Homo sapiens
ggagaaguguugauuacau

SEQ ID NO: 822768 - RNA, 19 nt, Homo sapiens
gcugggaccucuccuauca

SEQ ID NO: 822769 - RNA, 19 nt, Homo sapiens
gagccucagugucgcuuua

SEQ ID NO: 822770 - RNA, 19 nt, Homo sapiens
guacagcugacuauauaua

SEQ ID NO: 822771 - RNA, 19 nt, Homo sapiens
caacagauggaucccuuua

SEQ ID NO: 822772 - RNA, 19 nt, Homo sapiens
auaauucgcuggagucauu

SEQ ID NO: 822773 - RNA, 19 nt, Homo sapiens
gaugaagaguuccaugaug

SEQ ID NO: 822774 - RNA, 19 nt, Homo sapiens
ggaaaucauggacuuguaa

SEQ ID NO: 822775 - RNA, 19 nt, Homo sapiens
ggaagcccauggccaggua

SEQ ID NO: 822776 - RNA, 19 nt, Homo sapiens
gagaagaaaggaaccauga

SEQ ID NO: 822777 - RNA, 19 nt, Homo sapiens
gggaaaucauggacuugua

SEQ ID NO: 822778 - RNA, 19 nt, Homo sapiens
aaagugaguuuaugaagug

SEQ ID NO: 822779 - RNA, 19 nt, Homo sapiens
ggaggaagaggaugacaaa

SEQ ID NO: 822780 - RNA, 19 nt, Homo sapiens
ucaagaaucucagguaaca

SEQ ID NO: 822781 - RNA, 19 nt, Homo sapiens
gaugggaaaucauggacuu

SEQ ID NO: 822782 - RNA, 19 nt, Homo sapiens
ugaggaaggugaaguguca

SEQ ID NO: 822783 - RNA, 19 nt, Homo sapiens
cugcacgcauucaguauua

SEQ ID NO: 822784 - RNA, 19 nt, Homo sapiens
auacgguucuggaguguua

SEQ ID NO: 822785 - RNA, 19 nt, Homo sapiens
cuauagcuguuucagauuu

SEQ ID NO: 822786 - RNA, 19 nt, Homo sapiens
ucagaccgcucaucacgaa

SEQ ID NO: 822787 - RNA, 19 nt, Homo sapiens
gacgaugaguggacauuug

SEQ ID NO: 822788 - RNA, 19 nt, Homo sapiens
ccaaggagaucucugaacu

SEQ ID NO: 822789 - RNA, 19 nt, Homo sapiens
ccaagaacauauccgcuau

SEQ ID NO: 822790 - RNA, 19 nt, Homo sapiens
gcaagaagaggagcaagaa

SEQ ID NO: 822791 - RNA, 19 nt, Homo sapiens
aaacgacgagggcuuauuu

SEQ ID NO: 822792 - RNA, 19 nt, Homo sapiens
cuagaacgcuggugucaca

SEQ ID NO: 822793 - RNA, 19 nt, Homo sapiens
gaagagggagguguugaaa

SEQ ID NO: 822794 - RNA, 19 nt, Homo sapiens
caacuacgcuaugaagaag

SEQ ID NO: 822795 - RNA, 19 nt, Homo sapiens
gaagaaaggaaccaugaag

SEQ ID NO: 822796 - RNA, 19 nt, Homo sapiens
uaacaucccacaacaagga

SEQ ID NO: 822797 - RNA, 19 nt, Homo sapiens
uggaacagaugacagagaa

SEQ ID NO: 822798 - RNA, 19 nt, Homo sapiens
aagcagcaauggaugguuu

SEQ ID NO: 822799 - RNA, 19 nt, Homo sapiens
gauuacggguguuguggaa

SEQ ID NO: 822800 - RNA, 19 nt, Homo sapiens
cacaugcccuucuuugcua

SEQ ID NO: 822801 - RNA, 19 nt, Homo sapiens
caagcgggaugagaaacua

SEQ ID NO: 822802 - RNA, 19 nt, Homo sapiens
cuugguaacuucuggguuu

SEQ ID NO: 822803 - RNA, 19 nt, Homo sapiens
caucugaaacugcaagaaa

SEQ ID NO: 822804 - RNA, 19 nt, Homo sapiens
uaaaccauuugcuguauag

SEQ ID NO: 822805 - RNA, 19 nt, Homo sapiens
aaggagaucucugaacuug

SEQ ID NO: 822806 - RNA, 19 nt, Homo sapiens
ggaacauuguagagucuga

SEQ ID NO: 822807 - RNA, 19 nt, Homo sapiens
agaaagaaagguucagaaa

SEQ ID NO: 822808 - RNA, 19 nt, Homo sapiens
ggacauugaagagauugua

SEQ ID NO: 822809 - RNA, 19 nt, Homo sapiens
aaacaaagggcugcaacua

SEQ ID NO: 822810 - RNA, 19 nt, Homo sapiens
uuccuuaccugaagaauug

SEQ ID NO: 822811 - RNA, 19 nt, Homo sapiens
caaaguacagcugacuaua

SEQ ID NO: 822812 - RNA, 19 nt, Homo sapiens
cagcagagguguguguaug

SEQ ID NO: 822813 - RNA, 19 nt, Homo sapiens
ggacauuugggagcaauaa

SEQ ID NO: 822814 - RNA, 19 nt, Homo sapiens
gaaaagcuccacccaacua

SEQ ID NO: 822815 - RNA, 19 nt, Homo sapiens
gagaaggagccgccuguga

SEQ ID NO: 822816 - RNA, 19 nt, Homo sapiens
gucuauagcuguuucagau

SEQ ID NO: 822817 - RNA, 19 nt, Homo sapiens
gugcaagccuaccaucguu

SEQ ID NO: 822818 - RNA, 19 nt, Homo sapiens
gaaagaaagguucagaaaa

SEQ ID NO: 822819 - RNA, 19 nt, Homo sapiens
gagaaagaaagguucagaa

SEQ ID NO: 822820 - RNA, 19 nt, Homo sapiens
gaaacuagacaagaaaucu

SEQ ID NO: 822821 - RNA, 19 nt, Homo sapiens
gaacagaugacagagaaag

SEQ ID NO: 822822 - RNA, 19 nt, Homo sapiens
gaaaugagcaagggucaag

SEQ ID NO: 822823 - RNA, 19 nt, Homo sapiens
aauccaagaucaacugaau

SEQ ID NO: 822824 - RNA, 19 nt, Homo sapiens
gaaagcgcagugacucuga

SEQ ID NO: 822825 - RNA, 19 nt, Homo sapiens
ccaacuacgcuaugaagaa

SEQ ID NO: 822826 - RNA, 19 nt, Homo sapiens
gaaagagagagagcaagaa

SEQ ID NO: 822827 - RNA, 19 nt, Homo sapiens
cgaaacucuuuauagacua

SEQ ID NO: 822828 - RNA, 19 nt, Homo sapiens
uaaucacucucagguguaa

SEQ ID NO: 822829 - RNA, 19 nt, Homo sapiens
gaaaccccaucucuacuaa

SEQ ID NO: 822830 - RNA, 19 nt, Homo sapiens
ggagggcagugaaugucuu

SEQ ID NO: 822831 - RNA, 19 nt, Homo sapiens
cguguuccguuuagaguuu

SEQ ID NO: 822832 - RNA, 19 nt, Homo sapiens
ccacgagagacuaaucuaa

SEQ ID NO: 822833 - RNA, 19 nt, Homo sapiens
ugaagaaacaggccaacaa

SEQ ID NO: 822834 - RNA, 19 nt, Homo sapiens
gcugaaagucacaacauga

SEQ ID NO: 822835 - RNA, 19 nt, Homo sapiens
aaagaaagguucagaaaag

SEQ ID NO: 822836 - RNA, 19 nt, Homo sapiens
gaugagaaacuagacaaga

SEQ ID NO: 822837 - RNA, 19 nt, Homo sapiens
agaaaggaaccaugaagaa

SEQ ID NO: 822838 - RNA, 19 nt, Homo sapiens
ccgaaacucuuuauagacu

SEQ ID NO: 822839 - RNA, 19 nt, Homo sapiens
acauauccgcuaucaguua

SEQ ID NO: 822840 - RNA, 19 nt, Homo sapiens
ccacccaacuacgcuauga

SEQ ID NO: 822841 - RNA, 19 nt, Homo sapiens
ucaggacauugaagagauu

SEQ ID NO: 822842 - RNA, 19 nt, Homo sapiens
caaaagagcugggaaaaua

SEQ ID NO: 822843 - RNA, 19 nt, Homo sapiens
gauaaacgauguccuaaca

SEQ ID NO: 822844 - RNA, 19 nt, Homo sapiens
aaacugaacuugccaaugu

SEQ ID NO: 822845 - RNA, 19 nt, Homo sapiens
ggacugcucuauuacaaug

SEQ ID NO: 822846 - RNA, 19 nt, Homo sapiens
auaacaagcuggacauuaa

SEQ ID NO: 822847 - RNA, 19 nt, Homo sapiens
gcucaccaauuacagauuu

SEQ ID NO: 822848 - RNA, 19 nt, Homo sapiens
cauuugaucuggaaggaua

SEQ ID NO: 822849 - RNA, 19 nt, Homo sapiens
ggaaggauaugcuuuuauu

SEQ ID NO: 822850 - RNA, 19 nt, Homo sapiens
gcacaaagaaacugaacuu

SEQ ID NO: 822851 - RNA, 19 nt, Homo sapiens
gaaaggcgcucagaguagu

SEQ ID NO: 822852 - RNA, 19 nt, Homo sapiens
gcaaauggugcauacguaa

SEQ ID NO: 822853 - RNA, 19 nt, Homo sapiens
gaaauaaccauuccuuugc

SEQ ID NO: 822854 - RNA, 19 nt, Homo sapiens
gcucugacuuggcauuuga

SEQ ID NO: 822855 - RNA, 19 nt, Homo sapiens
auaguuggcuguauuaaga

SEQ ID NO: 822856 - RNA, 19 nt, Homo sapiens
gcucagaguagucaaguuu

SEQ ID NO: 822857 - RNA, 19 nt, Homo sapiens
gggaaaggcgcucagagua

SEQ ID NO: 822858 - RNA, 19 nt, Homo sapiens
gcaaacagucagaggcuaa

SEQ ID NO: 822859 - RNA, 19 nt, Homo sapiens
caguauaauucugcucuua

SEQ ID NO: 822860 - RNA, 19 nt, Homo sapiens
gaggauugcuucaucugau

SEQ ID NO: 822861 - RNA, 19 nt, Homo sapiens
ggucuuugguggagauuau

SEQ ID NO: 822862 - RNA, 19 nt, Homo sapiens
ccgaaacgcugaccguguu

SEQ ID NO: 822863 - RNA, 19 nt, Homo sapiens
ugaggugucuugauuaugg

SEQ ID NO: 822864 - RNA, 19 nt, Homo sapiens
ggaaaggcgcucagaguag

SEQ ID NO: 822865 - RNA, 19 nt, Homo sapiens
acagaaauguaccucgaaa

SEQ ID NO: 822866 - RNA, 19 nt, Homo sapiens
guauaauucugcucuuaca

SEQ ID NO: 822867 - RNA, 19 nt, Homo sapiens
acaaugcacuguucaugau

SEQ ID NO: 822868 - RNA, 19 nt, Homo sapiens
gacuguauuugcaaugauu

SEQ ID NO: 822869 - RNA, 19 nt, Homo sapiens
ggacuguucagcacaaaga

SEQ ID NO: 822870 - RNA, 19 nt, Homo sapiens
uggacaaacuucauugguu

SEQ ID NO: 822871 - RNA, 19 nt, Homo sapiens
uccacuaccucuacuauau

SEQ ID NO: 822872 - RNA, 19 nt, Homo sapiens
ccaaaucacgggacuguuc

SEQ ID NO: 822873 - RNA, 19 nt, Homo sapiens
cacuaccucuacuauauuu

SEQ ID NO: 822874 - RNA, 19 nt, Homo sapiens
agaaauguaccucgaaaga

SEQ ID NO: 822875 - RNA, 19 nt, Homo sapiens
gcugggagccugguauauu

SEQ ID NO: 822876 - RNA, 19 nt, Homo sapiens
gcucuuacaacuacaauag

SEQ ID NO: 822877 - RNA, 19 nt, Homo sapiens
acaaaaggcuguggaguuu

SEQ ID NO: 822878 - RNA, 19 nt, Homo sapiens
gcugacacccucuuucuuc

SEQ ID NO: 822879 - RNA, 19 nt, Homo sapiens
agauuucccuccucacuau

SEQ ID NO: 822880 - RNA, 19 nt, Homo sapiens
aauaacaagcuggacauua

SEQ ID NO: 822881 - RNA, 19 nt, Homo sapiens
caaauggugcauacguaaa

SEQ ID NO: 822882 - RNA, 19 nt, Homo sapiens
uuccugaccuugacagaaa

SEQ ID NO: 822883 - RNA, 19 nt, Homo sapiens
ugaucgugguggugaauaa

SEQ ID NO: 822884 - RNA, 19 nt, Homo sapiens
gaagagcagcugagcaaac

SEQ ID NO: 822885 - RNA, 19 nt, Homo sapiens
aggauugcuucaucugaua

SEQ ID NO: 822886 - RNA, 19 nt, Homo sapiens
agucagaggcuaauaacaa

SEQ ID NO: 822887 - RNA, 19 nt, Homo sapiens
ggauaugcuuuuauucuga

SEQ ID NO: 822888 - RNA, 19 nt, Homo sapiens
aauguuugcugaaggaguu

SEQ ID NO: 822889 - RNA, 19 nt, Homo sapiens
cauccuguuuacaauguuu

SEQ ID NO: 822890 - RNA, 19 nt, Homo sapiens
gaaacugaacuugccaaug

SEQ ID NO: 822891 - RNA, 19 nt, Homo sapiens
ccacuaccucuacuauauu

SEQ ID NO: 822892 - RNA, 19 nt, Homo sapiens
aagagcagcugagcaaaca

SEQ ID NO: 822893 - RNA, 19 nt, Homo sapiens
gugcauacguaaaacaaaa

SEQ ID NO: 822894 - RNA, 19 nt, Homo sapiens
gauuauuggagccuuugua

SEQ ID NO: 822895 - RNA, 19 nt, Homo sapiens
aaauaaccauuccuuugca

SEQ ID NO: 822896 - RNA, 19 nt, Homo sapiens
ccagaggauugcuucaucu

SEQ ID NO: 822897 - RNA, 19 nt, Homo sapiens
gucagaggcuaauaacaag

SEQ ID NO: 822898 - RNA, 19 nt, Homo sapiens
uacaauguuugcugaagga

SEQ ID NO: 822899 - RNA, 19 nt, Homo sapiens
gaacuugccaauguuuaca

SEQ ID NO: 822900 - RNA, 19 nt, Homo sapiens
ggagccugguauauuccua

SEQ ID NO: 822901 - RNA, 19 nt, Homo sapiens
gugaugggguuuaucuuaa

SEQ ID NO: 822902 - RNA, 19 nt, Homo sapiens
agcaaauggugcauacgua

SEQ ID NO: 822903 - RNA, 19 nt, Homo sapiens
acugaggugucuugauuau

SEQ ID NO: 822904 - RNA, 19 nt, Homo sapiens
cugggagccugguauauuc

SEQ ID NO: 822905 - RNA, 19 nt, Homo sapiens
cuauuacaaugcacuguuc

SEQ ID NO: 822906 - RNA, 19 nt, Homo sapiens
gaaaauauggacugcucua

SEQ ID NO: 822907 - RNA, 19 nt, Homo sapiens
ccauuccuuugcacuugua

SEQ ID NO: 822908 - RNA, 19 nt, Homo sapiens
uacaaugcacuguucauga

SEQ ID NO: 822909 - RNA, 19 nt, Homo sapiens
ucugauaaacgauguccua

SEQ ID NO: 822910 - RNA, 19 nt, Homo sapiens
aaaaggcuguggaguuuga

SEQ ID NO: 822911 - RNA, 19 nt, Homo sapiens
ucagcaugcucggguuaaa

SEQ ID NO: 822912 - RNA, 19 nt, Homo sapiens
gaaauguaccucgaaagac

SEQ ID NO: 822913 - RNA, 19 nt, Homo sapiens
cagauuucccuccucacua

SEQ ID NO: 822914 - RNA, 19 nt, Homo sapiens
cuuaauguacgccacagua

SEQ ID NO: 822915 - RNA, 19 nt, Homo sapiens
gaucuggaaggauaugcuu

SEQ ID NO: 822916 - RNA, 19 nt, Homo sapiens
ugacuuggcauuugaucug

SEQ ID NO: 822917 - RNA, 19 nt, Homo sapiens
gaggugucuugauuaugga

SEQ ID NO: 822918 - RNA, 19 nt, Homo sapiens
caaaucacgggacuguuca

SEQ ID NO: 822919 - RNA, 19 nt, Homo sapiens
gacagaaauguaccucgaa

SEQ ID NO: 822920 - RNA, 19 nt, Homo sapiens
gauacguaggccuaaguuu

SEQ ID NO: 822921 - RNA, 19 nt, Homo sapiens
gagcagcugagcaaacagu

SEQ ID NO: 822922 - RNA, 19 nt, Homo sapiens
cugaagagcagcugagcaa

SEQ ID NO: 822923 - RNA, 19 nt, Homo sapiens
aaugauuauuggagccuuu

SEQ ID NO: 822924 - RNA, 19 nt, Homo sapiens
ccuuugcacuuguacaauc

SEQ ID NO: 822925 - RNA, 19 nt, Homo sapiens
ccuccacacuccgagauga

SEQ ID NO: 822926 - RNA, 19 nt, Homo sapiens
uaauucugcucuuacaacu

SEQ ID NO: 822927 - RNA, 19 nt, Homo sapiens
ggcauuugaucuggaagga

SEQ ID NO: 822928 - RNA, 19 nt, Homo sapiens
gaccuugacagaaauguac

SEQ ID NO: 822929 - RNA, 19 nt, Homo sapiens
aggauugauugcugccuuu

SEQ ID NO: 822930 - RNA, 19 nt, Homo sapiens
aaccauuccuuugcacuug

SEQ ID NO: 822931 - RNA, 19 nt, Homo sapiens
uaaccauuccuuugcacuu

SEQ ID NO: 822932 - RNA, 19 nt, Homo sapiens
cccuggccauugcguauuu

SEQ ID NO: 822933 - RNA, 19 nt, Homo sapiens
ugacuguauuugcaaugau

SEQ ID NO: 822934 - RNA, 19 nt, Homo sapiens
uugccaauguuuacaguuc

SEQ ID NO: 822935 - RNA, 19 nt, Homo sapiens
uuaaucaacucagaacacu

SEQ ID NO: 822936 - RNA, 19 nt, Homo sapiens
aaacagucagaggcuaaua

SEQ ID NO: 822937 - RNA, 19 nt, Homo sapiens
gggcugacacccucuuucu

SEQ ID NO: 822938 - RNA, 19 nt, Homo sapiens
gcagugugaccagaggauu

SEQ ID NO: 822939 - RNA, 19 nt, Homo sapiens
uaacaagcuggacauuaag

SEQ ID NO: 822940 - RNA, 19 nt, Homo sapiens
gguuuaaauaucagcauug

SEQ ID NO: 822941 - RNA, 19 nt, Homo sapiens
ggccauugcguauuucaca

SEQ ID NO: 822942 - RNA, 19 nt, Homo sapiens
uaaaggccaucuucucuua

SEQ ID NO: 822943 - RNA, 19 nt, Homo sapiens
gaagcaauacccagaauuu

SEQ ID NO: 822944 - RNA, 19 nt, Homo sapiens
ggaacgagcugugcuacaa

SEQ ID NO: 822945 - RNA, 19 nt, Homo sapiens
aaugagaacuucagguuaa

SEQ ID NO: 822946 - RNA, 19 nt, Homo sapiens
ggucagagcaggacaguga

SEQ ID NO: 822947 - RNA, 19 nt, Homo sapiens
gcgagaaccugcugacugu

SEQ ID NO: 822948 - RNA, 19 nt, Homo sapiens
ucaacgaccuggaugacua

SEQ ID NO: 822949 - RNA, 19 nt, Homo sapiens
ggaggccaccgucuuguua

SEQ ID NO: 822950 - RNA, 19 nt, Homo sapiens
ugaagcaggugcacuguga

SEQ ID NO: 822951 - RNA, 19 nt, Homo sapiens
gaggagauguggaaguuca

SEQ ID NO: 822952 - RNA, 19 nt, Homo sapiens
guuccuggcugcuguguuu

SEQ ID NO: 822953 - RNA, 19 nt, Homo sapiens
ggaggugacccgagacuuu

SEQ ID NO: 822954 - RNA, 19 nt, Homo sapiens
ggaaaucaguaucugucuu

SEQ ID NO: 822955 - RNA, 19 nt, Homo sapiens
ccaagguuguguccaagua

SEQ ID NO: 822956 - RNA, 19 nt, Homo sapiens
uagcaaagcugcaccugau

SEQ ID NO: 822957 - RNA, 19 nt, Homo sapiens
caucgaaagucccguguug

SEQ ID NO: 822958 - RNA, 19 nt, Homo sapiens
gagaagcaauacccagaau

SEQ ID NO: 822959 - RNA, 19 nt, Homo sapiens
ugucuccucuuugaaauua

SEQ ID NO: 822960 - RNA, 19 nt, Homo sapiens
gaaaucaguaucugucuuc

SEQ ID NO: 822961 - RNA, 19 nt, Homo sapiens
gcaaagcugcaccugauga

SEQ ID NO: 822962 - RNA, 19 nt, Homo sapiens
gaaaaggauuccaaugaga

SEQ ID NO: 822963 - RNA, 19 nt, Homo sapiens
ggacaacggcccagaugga

SEQ ID NO: 822964 - RNA, 19 nt, Homo sapiens
aggagaagcugccacuuga

SEQ ID NO: 822965 - RNA, 19 nt, Homo sapiens
guagcggugucuccucuuu

SEQ ID NO: 822966 - RNA, 19 nt, Homo sapiens
gagaagacgugggaaaggu

SEQ ID NO: 822967 - RNA, 19 nt, Homo sapiens
caaugagaacuucagguua

SEQ ID NO: 822968 - RNA, 19 nt, Homo sapiens
ggagagcuguggacaugca

SEQ ID NO: 822969 - RNA, 19 nt, Homo sapiens
ccaaugagaacuucagguu

SEQ ID NO: 822970 - RNA, 19 nt, Homo sapiens
ggaaguguuugggaucaug

SEQ ID NO: 822971 - RNA, 19 nt, Homo sapiens
guucguguaugauguguuc

SEQ ID NO: 822972 - RNA, 19 nt, Homo sapiens
ccacggcacccuucuucua

SEQ ID NO: 822973 - RNA, 19 nt, Homo sapiens
ucucugcucuuaugcauca

SEQ ID NO: 822974 - RNA, 19 nt, Homo sapiens
gcacagcauccuccucuca

SEQ ID NO: 822975 - RNA, 19 nt, Homo sapiens
ccaagagccugcacagcau

SEQ ID NO: 822976 - RNA, 19 nt, Homo sapiens
gguauaucauggacgaguu

SEQ ID NO: 822977 - RNA, 19 nt, Homo sapiens
ggacagcugaggagaagau

SEQ ID NO: 822978 - RNA, 19 nt, Homo sapiens
gcaaguggaggagguagaa

SEQ ID NO: 822979 - RNA, 19 nt, Homo sapiens
gaagaugccggugugguau

SEQ ID NO: 822980 - RNA, 19 nt, Homo sapiens
uggaggagauguggaaguu

SEQ ID NO: 822981 - RNA, 19 nt, Homo sapiens
ugaugagucuccaguuuag

SEQ ID NO: 822982 - RNA, 19 nt, Homo sapiens
cuaccagggucuacaguca

SEQ ID NO: 822983 - RNA, 19 nt, Homo sapiens
caacuucucacacuucaag

SEQ ID NO: 822984 - RNA, 19 nt, Homo sapiens
agaagaugccgguguggua

SEQ ID NO: 822985 - RNA, 19 nt, Homo sapiens
gagaagcugccacuugaca

SEQ ID NO: 822986 - RNA, 19 nt, Homo sapiens
gcaauaaaggccaucuucu

SEQ ID NO: 822987 - RNA, 19 nt, Homo sapiens
ccagaaccuucaccagcaa

SEQ ID NO: 822988 - RNA, 19 nt, Homo sapiens
cugaugagucuccaguuua

SEQ ID NO: 822989 - RNA, 19 nt, Homo sapiens
cuggagagcuguggacaug

SEQ ID NO: 822990 - RNA, 19 nt, Homo sapiens
ugggaaaggucaaguucga

SEQ ID NO: 822991 - RNA, 19 nt, Homo sapiens
ucucacacuucaaggacua

SEQ ID NO: 822992 - RNA, 19 nt, Homo sapiens
caacagcaucuuccucauc

SEQ ID NO: 822993 - RNA, 19 nt, Homo sapiens
caauaaaggccaucuucuc

SEQ ID NO: 822994 - RNA, 19 nt, Homo sapiens
gaugcugccucuccucucu

SEQ ID NO: 822995 - RNA, 19 nt, Homo sapiens
uaaagucagaugccaccua

SEQ ID NO: 822996 - RNA, 19 nt, Homo sapiens
cauuccagcucacccagaa

SEQ ID NO: 822997 - RNA, 19 nt, Homo sapiens
gacauccucuucaacuucu

SEQ ID NO: 822998 - RNA, 19 nt, Homo sapiens
cgacauccucuucaacuuc

SEQ ID NO: 822999 - RNA, 19 nt, Homo sapiens
cagaaaaggauuccaauga

SEQ ID NO: 823000 - RNA, 19 nt, Homo sapiens
gaggugacccgagacuuug

SEQ ID NO: 823001 - RNA, 19 nt, Homo sapiens
ggaaguucaaccagaccua

SEQ ID NO: 823002 - RNA, 19 nt, Homo sapiens
guggagcgccagacagaaa

SEQ ID NO: 823003 - RNA, 19 nt, Homo sapiens
ggucucugcucuuaugcau

SEQ ID NO: 823004 - RNA, 19 nt, Homo sapiens
cacguuaccugccuugucu

SEQ ID NO: 823005 - RNA, 19 nt, Homo sapiens
gaagcugccacuugacauc

SEQ ID NO: 823006 - RNA, 19 nt, Homo sapiens
ggugucuccucuuugaaau

SEQ ID NO: 823007 - RNA, 19 nt, Homo sapiens
gaacuaugacccggaugug

SEQ ID NO: 823008 - RNA, 19 nt, Homo sapiens
ggauuccaaugagaacuuc

SEQ ID NO: 823009 - RNA, 19 nt, Homo sapiens
caacagggaaaucaguauc

SEQ ID NO: 823010 - RNA, 19 nt, Homo sapiens
uuccuggcauggagaauuu

SEQ ID NO: 823011 - RNA, 19 nt, Homo sapiens
ggugcacugugaagaguuc

SEQ ID NO: 823012 - RNA, 19 nt, Homo sapiens
ggacgccgacauccucuuc

SEQ ID NO: 823013 - RNA, 19 nt, Homo sapiens
gacaacggcccagauggaa

SEQ ID NO: 823014 - RNA, 19 nt, Homo sapiens
gagggcagggcuaggugua

SEQ ID NO: 823015 - RNA, 19 nt, Homo sapiens
ucgaaagucccguguuguu

SEQ ID NO: 823016 - RNA, 19 nt, Homo sapiens
gaacgagcugugcuacaag

SEQ ID NO: 823017 - RNA, 19 nt, Homo sapiens
cuucaaggacuacaggaaa

SEQ ID NO: 823018 - RNA, 19 nt, Homo sapiens
ggucuacagucaaaauguu

SEQ ID NO: 823019 - RNA, 19 nt, Homo sapiens
ccgcauggccaaccugaug

SEQ ID NO: 823020 - RNA, 19 nt, Homo sapiens
cguccaggcugagaucuuc

SEQ ID NO: 823021 - RNA, 19 nt, Homo sapiens
ggacguccaggcugagauc

SEQ ID NO: 823022 - RNA, 19 nt, Homo sapiens
gcaggugcacugugaagag

SEQ ID NO: 823023 - RNA, 19 nt, Homo sapiens
gaggacaaccacuggaucu

SEQ ID NO: 823024 - RNA, 19 nt, Homo sapiens
acggugagcugcccaguac

SEQ ID NO: 823025 - RNA, 19 nt, Homo sapiens
aaggagaagcugccacuug

SEQ ID NO: 823026 - RNA, 19 nt, Homo sapiens
cgaaagucccguguuguuc

SEQ ID NO: 823027 - RNA, 19 nt, Homo sapiens
gcgugcugcugaaccaguu

SEQ ID NO: 823028 - RNA, 19 nt, Homo sapiens
aauaaaggccaucuucucu

SEQ ID NO: 823029 - RNA, 19 nt, Homo sapiens
cuaucuuucuuguagcaaa

SEQ ID NO: 823030 - RNA, 19 nt, Homo sapiens
uacgguuguucguguauga

SEQ ID NO: 823031 - RNA, 19 nt, Homo sapiens
ccgacauccucuucaacuu

SEQ ID NO: 823032 - RNA, 19 nt, Homo sapiens
gagaugggccaggauccuu

SEQ ID NO: 823033 - RNA, 19 nt, Homo sapiens
ugagaagcaauacccagaa

SEQ ID NO: 823034 - RNA, 19 nt, Homo sapiens
gaagcaggugcacugugaa

SEQ ID NO: 823035 - RNA, 19 nt, Homo sapiens
gaaaggucaaguucgacau

SEQ ID NO: 823036 - RNA, 19 nt, Homo sapiens
ccagagccuuccagugcau

SEQ ID NO: 823037 - RNA, 19 nt, Homo sapiens
gaacuucaaccccgacugu

SEQ ID NO: 823038 - RNA, 19 nt, Homo sapiens
gcacuaccaggccauucug

SEQ ID NO: 823039 - RNA, 19 nt, Homo sapiens
ucaguucgugcugcaauaa

SEQ ID NO: 823040 - RNA, 19 nt, Homo sapiens
caaagcugcaccugaugau

SEQ ID NO: 823041 - RNA, 19 nt, Homo sapiens
accagggucuacagucaaa

SEQ ID NO: 823042 - RNA, 19 nt, Homo sapiens
ggaaaugacugucccaaga

SEQ ID NO: 823043 - RNA, 19 nt, Homo sapiens
gaacauacuuaggauauuc

SEQ ID NO: 823044 - RNA, 19 nt, Homo sapiens
gaacggccuucucuucaaa

SEQ ID NO: 823045 - RNA, 19 nt, Homo sapiens
ggaauaagugcuuuaauug

SEQ ID NO: 823046 - RNA, 19 nt, Homo sapiens
uaucagaucugcuacgaaa

SEQ ID NO: 823047 - RNA, 19 nt, Homo sapiens
gacuguagguggauauaua

SEQ ID NO: 823048 - RNA, 19 nt, Homo sapiens
auaaagggcuguaagcuaa

SEQ ID NO: 823049 - RNA, 19 nt, Homo sapiens
ucacggauauguaugaauu

SEQ ID NO: 823050 - RNA, 19 nt, Homo sapiens
gagcauacauaaagugaau

SEQ ID NO: 823051 - RNA, 19 nt, Homo sapiens
ggaagaccauugaagaguu

SEQ ID NO: 823052 - RNA, 19 nt, Homo sapiens
gaauuaccgugguugauga

SEQ ID NO: 823053 - RNA, 19 nt, Homo sapiens
gggauuuacuguacuguuu

SEQ ID NO: 823054 - RNA, 19 nt, Homo sapiens
gcaagucccaaacacauua

SEQ ID NO: 823055 - RNA, 19 nt, Homo sapiens
caaaugcccuuguaauuac

SEQ ID NO: 823056 - RNA, 19 nt, Homo sapiens
gaagaccauugaagaguug

SEQ ID NO: 823057 - RNA, 19 nt, Homo sapiens
uagauuagcagcucaauuu

SEQ ID NO: 823058 - RNA, 19 nt, Homo sapiens
acacuuguaugaugcuuua

SEQ ID NO: 823059 - RNA, 19 nt, Homo sapiens
gaacugggaagaccauuga

SEQ ID NO: 823060 - RNA, 19 nt, Homo sapiens
ggagacaccuagauuagca

SEQ ID NO: 823061 - RNA, 19 nt, Homo sapiens
gcauucagcuucuuacucu

SEQ ID NO: 823062 - RNA, 19 nt, Homo sapiens
ccacuuugcuugucucaug

SEQ ID NO: 823063 - RNA, 19 nt, Homo sapiens
ccaaacacauuacacugaa

SEQ ID NO: 823064 - RNA, 19 nt, Homo sapiens
ggaacgaucucagccaaau

SEQ ID NO: 823065 - RNA, 19 nt, Homo sapiens
ggacacaagcugccagaaa

SEQ ID NO: 823066 - RNA, 19 nt, Homo sapiens
ggcugaagcucauuucuga

SEQ ID NO: 823067 - RNA, 19 nt, Homo sapiens
ccaagaggguguugugaug

SEQ ID NO: 823068 - RNA, 19 nt, Homo sapiens
gcucagagguaacaagaca

SEQ ID NO: 823069 - RNA, 19 nt, Homo sapiens
gguuuguacucgaguguua

SEQ ID NO: 823070 - RNA, 19 nt, Homo sapiens
guaaguagcauaaugagau

SEQ ID NO: 823071 - RNA, 19 nt, Homo sapiens
guauuugaguggaggauuu

SEQ ID NO: 823072 - RNA, 19 nt, Homo sapiens
gagggagacaccuagauua

SEQ ID NO: 823073 - RNA, 19 nt, Homo sapiens
cuugauacguguuaaauga

SEQ ID NO: 823074 - RNA, 19 nt, Homo sapiens
gaaacacuaugucuguaca

SEQ ID NO: 823075 - RNA, 19 nt, Homo sapiens
uacaauaugugaaccacua

SEQ ID NO: 823076 - RNA, 19 nt, Homo sapiens
uaauuguggugucuaguaa

SEQ ID NO: 823077 - RNA, 19 nt, Homo sapiens
cacauuaccuggaauaagu

SEQ ID NO: 823078 - RNA, 19 nt, Homo sapiens
agaaggagaugcugaaugg

SEQ ID NO: 823079 - RNA, 19 nt, Homo sapiens
ggugucgaauguauguuua

SEQ ID NO: 823080 - RNA, 19 nt, Homo sapiens
gauaauccacucauguauu

SEQ ID NO: 823081 - RNA, 19 nt, Homo sapiens
ucucaaagccagcauaauu

SEQ ID NO: 823082 - RNA, 19 nt, Homo sapiens
acacaaucguagcuuauaa

SEQ ID NO: 823083 - RNA, 19 nt, Homo sapiens
ggagacggagucaaacuaa

SEQ ID NO: 823084 - RNA, 19 nt, Homo sapiens
ggaacaaauaucugaauga

SEQ ID NO: 823085 - RNA, 19 nt, Homo sapiens
gccaaucugugaauguaaa

SEQ ID NO: 823086 - RNA, 19 nt, Homo sapiens
cgucaaggcucagagguaa

SEQ ID NO: 823087 - RNA, 19 nt, Homo sapiens
gcagcaaaguaauggagaa

SEQ ID NO: 823088 - RNA, 19 nt, Homo sapiens
gugagaagauggguauuga

SEQ ID NO: 823089 - RNA, 19 nt, Homo sapiens
cagccaaucugugaaugua

SEQ ID NO: 823090 - RNA, 19 nt, Homo sapiens
ggagggagacaccuagauu

SEQ ID NO: 823091 - RNA, 19 nt, Homo sapiens
gcucauuucugacaucauc

SEQ ID NO: 823092 - RNA, 19 nt, Homo sapiens
uaaaguuuguacacaggua

SEQ ID NO: 823093 - RNA, 19 nt, Homo sapiens
caaugccaguuuaggauuu

SEQ ID NO: 823094 - RNA, 19 nt, Homo sapiens
aaacgcacauuaccuggaa

SEQ ID NO: 823095 - RNA, 19 nt, Homo sapiens
cgagaaauuaggaugaaua

SEQ ID NO: 823096 - RNA, 19 nt, Homo sapiens
gggaaacacuaugucugua

SEQ ID NO: 823097 - RNA, 19 nt, Homo sapiens
gaacgaucucagccaaaua

SEQ ID NO: 823098 - RNA, 19 nt, Homo sapiens
gagacggagucaaacuaaa

SEQ ID NO: 823099 - RNA, 19 nt, Homo sapiens
uaggauauucugcacauua

SEQ ID NO: 823100 - RNA, 19 nt, Homo sapiens
acaguuaccuuacauagca

SEQ ID NO: 823101 - RNA, 19 nt, Homo sapiens
gaaaaucugcuuuaacuug

SEQ ID NO: 823102 - RNA, 19 nt, Homo sapiens
gugaaccacuacuuuagaa

SEQ ID NO: 823103 - RNA, 19 nt, Homo sapiens
guugccaugucaaaucuua

SEQ ID NO: 823104 - RNA, 19 nt, Homo sapiens
auuagcagcucaauuugua

SEQ ID NO: 823105 - RNA, 19 nt, Homo sapiens
ucagaauccauuacaguua

SEQ ID NO: 823106 - RNA, 19 nt, Homo sapiens
uguacaagaugucagcuuu

SEQ ID NO: 823107 - RNA, 19 nt, Homo sapiens
gagugaguguguucaaaga

SEQ ID NO: 823108 - RNA, 19 nt, Homo sapiens
uaacuaaacacacaugcaa

SEQ ID NO: 823109 - RNA, 19 nt, Homo sapiens
gagaggcaguucauuagca

SEQ ID NO: 823110 - RNA, 19 nt, Homo sapiens
ucaaagccagcauaauuaa

SEQ ID NO: 823111 - RNA, 19 nt, Homo sapiens
gagauguugucuugucuuc

SEQ ID NO: 823112 - RNA, 19 nt, Homo sapiens
guuggaacuuugcguguuu

SEQ ID NO: 823113 - RNA, 19 nt, Homo sapiens
acauuacacugaagagauu

SEQ ID NO: 823114 - RNA, 19 nt, Homo sapiens
gaaggugucgaauguaugu

SEQ ID NO: 823115 - RNA, 19 nt, Homo sapiens
ggcacauucuucugauuaa

SEQ ID NO: 823116 - RNA, 19 nt, Homo sapiens
gcagaccaguucaagagau

SEQ ID NO: 823117 - RNA, 19 nt, Homo sapiens
gccaggaucuucugcaaag

SEQ ID NO: 823118 - RNA, 19 nt, Homo sapiens
gcuuuaaggugacacuguu

SEQ ID NO: 823119 - RNA, 19 nt, Homo sapiens
uagauaauccacucaugua

SEQ ID NO: 823120 - RNA, 19 nt, Homo sapiens
guaauuaccacucugaagu

SEQ ID NO: 823121 - RNA, 19 nt, Homo sapiens
cuaauuguguucccuagga

SEQ ID NO: 823122 - RNA, 19 nt, Homo sapiens
uaugugaaccacuacuuua

SEQ ID NO: 823123 - RNA, 19 nt, Homo sapiens
ggcaguaacuaaacacaca

SEQ ID NO: 823124 - RNA, 19 nt, Homo sapiens
uaaguagcauaaugagaug

SEQ ID NO: 823125 - RNA, 19 nt, Homo sapiens
agaaugggauuuacuguac

SEQ ID NO: 823126 - RNA, 19 nt, Homo sapiens
gaagucacugggcugauuu

SEQ ID NO: 823127 - RNA, 19 nt, Homo sapiens
gacacaagcugccagaaaa

SEQ ID NO: 823128 - RNA, 19 nt, Homo sapiens
gcagaaaacugacagacau

SEQ ID NO: 823129 - RNA, 19 nt, Homo sapiens
acaugugaauggugguuua

SEQ ID NO: 823130 - RNA, 19 nt, Homo sapiens
ugugagaggcaguucauua

SEQ ID NO: 823131 - RNA, 19 nt, Homo sapiens
gaagcucauuucugacauc

SEQ ID NO: 823132 - RNA, 19 nt, Homo sapiens
acucgaguguuauuucuuu

SEQ ID NO: 823133 - RNA, 19 nt, Homo sapiens
uauaaagggcuguaagcua

SEQ ID NO: 823134 - RNA, 19 nt, Homo sapiens
acacagaaguauacgaaag

SEQ ID NO: 823135 - RNA, 19 nt, Homo sapiens
ggacagagccaggagucaa

SEQ ID NO: 823136 - RNA, 19 nt, Homo sapiens
guaaucucaucacggauau

SEQ ID NO: 823137 - RNA, 19 nt, Homo sapiens
aaacugacagacaucauaa

SEQ ID NO: 823138 - RNA, 19 nt, Homo sapiens
gagaagauggguauugaca

SEQ ID NO: 823139 - RNA, 19 nt, Homo sapiens
ucuaguaaguagcauaaug

SEQ ID NO: 823140 - RNA, 19 nt, Homo sapiens
aaauuugccuccacaguca

SEQ ID NO: 823141 - RNA, 19 nt, Homo sapiens
gcacuugauacguguuaaa

SEQ ID NO: 823142 - RNA, 19 nt, Homo sapiens
gaacuucuuucuaugauga

SEQ ID NO: 823143 - RNA, 19 nt, Homo sapiens
gcaguuaaaugugacaaua

SEQ ID NO: 823144 - RNA, 19 nt, Homo sapiens
gaggagauauaacucauuu

SEQ ID NO: 823145 - RNA, 19 nt, Homo sapiens
ggaaguuguugaaggcuua

SEQ ID NO: 823146 - RNA, 19 nt, Homo sapiens
ggaggaaagacauuuaaua

SEQ ID NO: 823147 - RNA, 19 nt, Homo sapiens
ccaagaagccugauuagaa

SEQ ID NO: 823148 - RNA, 19 nt, Homo sapiens
gaacagaaggagugaguuu

SEQ ID NO: 823149 - RNA, 19 nt, Homo sapiens
agagagggcuuccaacuuu

SEQ ID NO: 823150 - RNA, 19 nt, Homo sapiens
gaggaaacguuuagcauca

SEQ ID NO: 823151 - RNA, 19 nt, Homo sapiens
gcaaauguguuccaguugu

SEQ ID NO: 823152 - RNA, 19 nt, Homo sapiens
gccaugagguuaauacuug

SEQ ID NO: 823153 - RNA, 19 nt, Homo sapiens
ggacugaaguauccuggaa

SEQ ID NO: 823154 - RNA, 19 nt, Homo sapiens
ugacaaagcaguuaaaugu

SEQ ID NO: 823155 - RNA, 19 nt, Homo sapiens
gggaauaauugcaguaugu

SEQ ID NO: 823156 - RNA, 19 nt, Homo sapiens
ccaaauacuucucagaguu

SEQ ID NO: 823157 - RNA, 19 nt, Homo sapiens
ucuacuagcuugauaugua

SEQ ID NO: 823158 - RNA, 19 nt, Homo sapiens
cuacagagccuucuaauag

SEQ ID NO: 823159 - RNA, 19 nt, Homo sapiens
cagcaagacccaccauuua

SEQ ID NO: 823160 - RNA, 19 nt, Homo sapiens
gcacuaucaugccuugaaa

SEQ ID NO: 823161 - RNA, 19 nt, Homo sapiens
caaauacuucucagaguua

SEQ ID NO: 823162 - RNA, 19 nt, Homo sapiens
acaaagcaguuaaauguga

SEQ ID NO: 823163 - RNA, 19 nt, Homo sapiens
gcugugggcucuuccaauu

SEQ ID NO: 823164 - RNA, 19 nt, Homo sapiens
gcacauuuauggucucugu

SEQ ID NO: 823165 - RNA, 19 nt, Homo sapiens
acucagaccucccagauuu

SEQ ID NO: 823166 - RNA, 19 nt, Homo sapiens
caauuccacucacgcuuua

SEQ ID NO: 823167 - RNA, 19 nt, Homo sapiens
ggagugaguuuuauaauga

SEQ ID NO: 823168 - RNA, 19 nt, Homo sapiens
ugacaaggauggagugaug

SEQ ID NO: 823169 - RNA, 19 nt, Homo sapiens
gagagcagguucuucacaa

SEQ ID NO: 823170 - RNA, 19 nt, Homo sapiens
gcaaguaauugaaauccau

SEQ ID NO: 823171 - RNA, 19 nt, Homo sapiens
gaacaaaucagauauaccu

SEQ ID NO: 823172 - RNA, 19 nt, Homo sapiens
gaacugcuuucucagauac

SEQ ID NO: 823173 - RNA, 19 nt, Homo sapiens
ccaaauagaagguauaauc

SEQ ID NO: 823174 - RNA, 19 nt, Homo sapiens
ccaaagugauuaaagaaca

SEQ ID NO: 823175 - RNA, 19 nt, Homo sapiens
ccacugccauuugauuuaa

SEQ ID NO: 823176 - RNA, 19 nt, Homo sapiens
caagaagccugauuagaac

SEQ ID NO: 823177 - RNA, 19 nt, Homo sapiens
aggcagaagugaacaaauu

SEQ ID NO: 823178 - RNA, 19 nt, Homo sapiens
ggacagccaugagguuaau

SEQ ID NO: 823179 - RNA, 19 nt, Homo sapiens
gaauaaggaaguuguugaa

SEQ ID NO: 823180 - RNA, 19 nt, Homo sapiens
cguaguuucuguucuuuaa

SEQ ID NO: 823181 - RNA, 19 nt, Homo sapiens
ggagauauaacucauuuag

SEQ ID NO: 823182 - RNA, 19 nt, Homo sapiens
caaauguguuccaguuguu

SEQ ID NO: 823183 - RNA, 19 nt, Homo sapiens
uuacaccacugccauuuga

SEQ ID NO: 823184 - RNA, 19 nt, Homo sapiens
gagccacucucgcauggaa

SEQ ID NO: 823185 - RNA, 19 nt, Homo sapiens
ccacucacgcuuuagaaua

SEQ ID NO: 823186 - RNA, 19 nt, Homo sapiens
gaaauacuagccagcaaga

SEQ ID NO: 823187 - RNA, 19 nt, Homo sapiens
gaggauaucacucgcuauu

SEQ ID NO: 823188 - RNA, 19 nt, Homo sapiens
ggaacaagaaagaagauug

SEQ ID NO: 823189 - RNA, 19 nt, Homo sapiens
acaaaucacucagaggaaa

SEQ ID NO: 823190 - RNA, 19 nt, Homo sapiens
gcagaagugaacaaauuaa

SEQ ID NO: 823191 - RNA, 19 nt, Homo sapiens
gguuaauacuuggaguuua

SEQ ID NO: 823192 - RNA, 19 nt, Homo sapiens
gcaagacccaccauuuaug

SEQ ID NO: 823193 - RNA, 19 nt, Homo sapiens
ucagauauaccuucucuug

SEQ ID NO: 823194 - RNA, 19 nt, Homo sapiens
caaaucagauauaccuucu

SEQ ID NO: 823195 - RNA, 19 nt, Homo sapiens
caagacccaccauuuauga

SEQ ID NO: 823196 - RNA, 19 nt, Homo sapiens
aaaagaaacucuccaccua

SEQ ID NO: 823197 - RNA, 19 nt, Homo sapiens
ggcagaagugaacaaauua

SEQ ID NO: 823198 - RNA, 19 nt, Homo sapiens
gcgccagugugaauuuauu

SEQ ID NO: 823199 - RNA, 19 nt, Homo sapiens
uaacugccuucccuuugaa

SEQ ID NO: 823200 - RNA, 19 nt, Homo sapiens
ucauuuagaucuucugaca

SEQ ID NO: 823201 - RNA, 19 nt, Homo sapiens
cagcguaguuucuguucuu

SEQ ID NO: 823202 - RNA, 19 nt, Homo sapiens
gcaugacuuugugagauaa

SEQ ID NO: 823203 - RNA, 19 nt, Homo sapiens
uagagacuaagcacaauua

SEQ ID NO: 823204 - RNA, 19 nt, Homo sapiens
ggauacagugugcaaguuu

SEQ ID NO: 823205 - RNA, 19 nt, Homo sapiens
auaaugcacuucaggagaa

SEQ ID NO: 823206 - RNA, 19 nt, Homo sapiens
gcaauacgcagcagcagau

SEQ ID NO: 823207 - RNA, 19 nt, Homo sapiens
uuaacugccuucccuuuga

SEQ ID NO: 823208 - RNA, 19 nt, Homo sapiens
caaauccuaguguuaguuu

SEQ ID NO: 823209 - RNA, 19 nt, Homo sapiens
agacgacagugauuaugaa

SEQ ID NO: 823210 - RNA, 19 nt, Homo sapiens
gaagguauaaucagaggau

SEQ ID NO: 823211 - RNA, 19 nt, Homo sapiens
cugcaaauguguuccaguu

SEQ ID NO: 823212 - RNA, 19 nt, Homo sapiens
ggauacacauuuacucacu

SEQ ID NO: 823213 - RNA, 19 nt, Homo sapiens
guguugcacuggcacauuu

SEQ ID NO: 823214 - RNA, 19 nt, Homo sapiens
cuacuagcuugauauguau

SEQ ID NO: 823215 - RNA, 19 nt, Homo sapiens
caaaucagcaacacagaau

SEQ ID NO: 823216 - RNA, 19 nt, Homo sapiens
gaacaagaaagaagauugc

SEQ ID NO: 823217 - RNA, 19 nt, Homo sapiens
gaagccugauuagaacaaa

SEQ ID NO: 823218 - RNA, 19 nt, Homo sapiens
gauacagugugcaaguuuc

SEQ ID NO: 823219 - RNA, 19 nt, Homo sapiens
gaccaaauagaagguauaa

SEQ ID NO: 823220 - RNA, 19 nt, Homo sapiens
agguuuagcugaguucaua

SEQ ID NO: 823221 - RNA, 19 nt, Homo sapiens
uauggucucuguucuggaa

SEQ ID NO: 823222 - RNA, 19 nt, Homo sapiens
gauauaccuucucuugucu

SEQ ID NO: 823223 - RNA, 19 nt, Homo sapiens
agauauaccuucucuuguc

SEQ ID NO: 823224 - RNA, 19 nt, Homo sapiens
guaaauuuaggcaaaguga

SEQ ID NO: 823225 - RNA, 19 nt, Homo sapiens
ccgcugcucuuuaccuuug

SEQ ID NO: 823226 - RNA, 19 nt, Homo sapiens
ggauaucacucgcuauucc

SEQ ID NO: 823227 - RNA, 19 nt, Homo sapiens
cagcgccagugugaauuua

SEQ ID NO: 823228 - RNA, 19 nt, Homo sapiens
guuaucagcuaccuacuac

SEQ ID NO: 823229 - RNA, 19 nt, Homo sapiens
guagagauacuaauuacca

SEQ ID NO: 823230 - RNA, 19 nt, Homo sapiens
ugcaugacuuugugagaua

SEQ ID NO: 823231 - RNA, 19 nt, Homo sapiens
gugcaaguuucaugacaga

SEQ ID NO: 823232 - RNA, 19 nt, Homo sapiens
ggagaaagaaagucauugg

SEQ ID NO: 823233 - RNA, 19 nt, Homo sapiens
gcagcagccuucaaagaac

SEQ ID NO: 823234 - RNA, 19 nt, Homo sapiens
gcaaguuucaugacagaau

SEQ ID NO: 823235 - RNA, 19 nt, Homo sapiens
cagcaagaguacaaagugu

SEQ ID NO: 823236 - RNA, 19 nt, Homo sapiens
gaucggagaaagaaaguca

SEQ ID NO: 823237 - RNA, 19 nt, Homo sapiens
ggaaacguuuagcaucagu

SEQ ID NO: 823238 - RNA, 19 nt, Homo sapiens
caacgucugaaaccacuaa

SEQ ID NO: 823239 - RNA, 19 nt, Homo sapiens
gacaaauccuaguguuagu

SEQ ID NO: 823240 - RNA, 19 nt, Homo sapiens
gaucuucugacaaauccua

SEQ ID NO: 823241 - RNA, 19 nt, Homo sapiens
caaguuucaugacagaauc

SEQ ID NO: 823242 - RNA, 19 nt, Homo sapiens
ggaaagaguucuaaagugu

SEQ ID NO: 823243 - RNA, 19 nt, Homo sapiens
gaacuugucuugggucuga

SEQ ID NO: 823244 - RNA, 19 nt, Homo sapiens
gaaacacaccucuccuuua

SEQ ID NO: 823245 - RNA, 19 nt, Homo sapiens
gaagacauaucaaaucaca

SEQ ID NO: 823246 - RNA, 19 nt, Homo sapiens
agaaauagaucacgcugua

SEQ ID NO: 823247 - RNA, 19 nt, Homo sapiens
ggaaugccuugcaauauga

SEQ ID NO: 823248 - RNA, 19 nt, Homo sapiens
gaugaaaccuggccagaug

SEQ ID NO: 823249 - RNA, 19 nt, Homo sapiens
gggcauccuuguaauauaa

SEQ ID NO: 823250 - RNA, 19 nt, Homo sapiens
ccucagaccuuauugcuuu

SEQ ID NO: 823251 - RNA, 19 nt, Homo sapiens
aaagguacuucucagauua

SEQ ID NO: 823252 - RNA, 19 nt, Homo sapiens
ggacugcggugacaagaga

SEQ ID NO: 823253 - RNA, 19 nt, Homo sapiens
aaacauugcucaacucuuc

SEQ ID NO: 823254 - RNA, 19 nt, Homo sapiens
gaacaggcucuuaaaggua

SEQ ID NO: 823255 - RNA, 19 nt, Homo sapiens
gaucaucccuuaggaaugu

SEQ ID NO: 823256 - RNA, 19 nt, Homo sapiens
agaaaggacuacagcauuu

SEQ ID NO: 823257 - RNA, 19 nt, Homo sapiens
uaaagguacuucucagauu

SEQ ID NO: 823258 - RNA, 19 nt, Homo sapiens
ucauaccacugacacauua

SEQ ID NO: 823259 - RNA, 19 nt, Homo sapiens
gaagucgggccauguauuu

SEQ ID NO: 823260 - RNA, 19 nt, Homo sapiens
gaggucaagugggcuauua

SEQ ID NO: 823261 - RNA, 19 nt, Homo sapiens
gcaaauggguuuucaguug

SEQ ID NO: 823262 - RNA, 19 nt, Homo sapiens
ggaaacacaccucuccuuu

SEQ ID NO: 823263 - RNA, 19 nt, Homo sapiens
gggaagcacucacccaaug

SEQ ID NO: 823264 - RNA, 19 nt, Homo sapiens
gaagucauuugccauggaa

SEQ ID NO: 823265 - RNA, 19 nt, Homo sapiens
gaagggaugcgacuuguau

SEQ ID NO: 823266 - RNA, 19 nt, Homo sapiens
gguauagacuuugggagua

SEQ ID NO: 823267 - RNA, 19 nt, Homo sapiens
caaagucauugucauuaga

SEQ ID NO: 823268 - RNA, 19 nt, Homo sapiens
gugaagacauaucaaauca

SEQ ID NO: 823269 - RNA, 19 nt, Homo sapiens
gggaaagaguucuaaagug

SEQ ID NO: 823270 - RNA, 19 nt, Homo sapiens
uagcauguauugcaagaaa

SEQ ID NO: 823271 - RNA, 19 nt, Homo sapiens
aaacacaccucuccuuuac

SEQ ID NO: 823272 - RNA, 19 nt, Homo sapiens
agaucacgcuguacacuua

SEQ ID NO: 823273 - RNA, 19 nt, Homo sapiens
uaaagcaguuggagugaug

SEQ ID NO: 823274 - RNA, 19 nt, Homo sapiens
gagaaucuuugaaacuuag

SEQ ID NO: 823275 - RNA, 19 nt, Homo sapiens
cagagugccucagaccuua

SEQ ID NO: 823276 - RNA, 19 nt, Homo sapiens
ggaaagcggucugcucagu

SEQ ID NO: 823277 - RNA, 19 nt, Homo sapiens
aaagcggucugcucaguuu

SEQ ID NO: 823278 - RNA, 19 nt, Homo sapiens
caagaaggugacauuguua

SEQ ID NO: 823279 - RNA, 19 nt, Homo sapiens
gaguaugugugugaaguuu

SEQ ID NO: 823280 - RNA, 19 nt, Homo sapiens
guacagaaaggaagaggaa

SEQ ID NO: 823281 - RNA, 19 nt, Homo sapiens
gaaacauuauccagaagca

SEQ ID NO: 823282 - RNA, 19 nt, Homo sapiens
uauguaggcuugcuagaga

SEQ ID NO: 823283 - RNA, 19 nt, Homo sapiens
ggucagaaauggaaaagaa

SEQ ID NO: 823284 - RNA, 19 nt, Homo sapiens
gaguaaaugugauagugau

SEQ ID NO: 823285 - RNA, 19 nt, Homo sapiens
uggaaugccuugcaauaug

SEQ ID NO: 823286 - RNA, 19 nt, Homo sapiens
ugaacaggcucuuaaaggu

SEQ ID NO: 823287 - RNA, 19 nt, Homo sapiens
ggaauuuuguguacuguaa

SEQ ID NO: 823288 - RNA, 19 nt, Homo sapiens
gaugaagucgggccaugua

SEQ ID NO: 823289 - RNA, 19 nt, Homo sapiens
ggaugcgacuuguauguag

SEQ ID NO: 823290 - RNA, 19 nt, Homo sapiens
uaugugaccuggaguuugu

SEQ ID NO: 823291 - RNA, 19 nt, Homo sapiens
guaggaguguauccaguga

SEQ ID NO: 823292 - RNA, 19 nt, Homo sapiens
ggaaaugagaaucuuugaa

SEQ ID NO: 823293 - RNA, 19 nt, Homo sapiens
cagagaagcgugaaguuug

SEQ ID NO: 823294 - RNA, 19 nt, Homo sapiens
gcacggaaacuuguucaga

SEQ ID NO: 823295 - RNA, 19 nt, Homo sapiens
cauaucaaaucacaaaguc

SEQ ID NO: 823296 - RNA, 19 nt, Homo sapiens
ucugacagguuuauauguu

SEQ ID NO: 823297 - RNA, 19 nt, Homo sapiens
gcacaccuguuuucucauu

SEQ ID NO: 823298 - RNA, 19 nt, Homo sapiens
ugggaaacauuauccagaa

SEQ ID NO: 823299 - RNA, 19 nt, Homo sapiens
gcauguauugcaagaaauu

SEQ ID NO: 823300 - RNA, 19 nt, Homo sapiens
gaaaggacuacagcauuug

SEQ ID NO: 823301 - RNA, 19 nt, Homo sapiens
gaaagcggucugcucaguu

SEQ ID NO: 823302 - RNA, 19 nt, Homo sapiens
ugaauggaaugccuugcaa

SEQ ID NO: 823303 - RNA, 19 nt, Homo sapiens
guauagacuuugggaguau

SEQ ID NO: 823304 - RNA, 19 nt, Homo sapiens
uugggaaccucauuagaaa

SEQ ID NO: 823305 - RNA, 19 nt, Homo sapiens
guugggaaccucauuagaa

SEQ ID NO: 823306 - RNA, 19 nt, Homo sapiens
gacuauagauaagaaagga

SEQ ID NO: 823307 - RNA, 19 nt, Homo sapiens
gaagcaugcccaagcaaau

SEQ ID NO: 823308 - RNA, 19 nt, Homo sapiens
uguauccagugaagacaua

SEQ ID NO: 823309 - RNA, 19 nt, Homo sapiens
acacaccucuccuuuacau

SEQ ID NO: 823310 - RNA, 19 nt, Homo sapiens
uaacguugaguaaauguga

SEQ ID NO: 823311 - RNA, 19 nt, Homo sapiens
gaacccaggaggucaagug

SEQ ID NO: 823312 - RNA, 19 nt, Homo sapiens
ggaagcacucacccaauga

SEQ ID NO: 823313 - RNA, 19 nt, Homo sapiens
aggaaugucugaaucugaa

SEQ ID NO: 823314 - RNA, 19 nt, Homo sapiens
ccagugaagacauaucaaa

SEQ ID NO: 823315 - RNA, 19 nt, Homo sapiens
guaaaugugauagugauga

SEQ ID NO: 823316 - RNA, 19 nt, Homo sapiens
ggucaagugggcuauuaaa

SEQ ID NO: 823317 - RNA, 19 nt, Homo sapiens
gcacaucucaguaccuucu

SEQ ID NO: 823318 - RNA, 19 nt, Homo sapiens
aaauuacucucaucugaag

SEQ ID NO: 823319 - RNA, 19 nt, Homo sapiens
guaccucagugaaugaagu

SEQ ID NO: 823320 - RNA, 19 nt, Homo sapiens
ccacugacacauuauacuu

SEQ ID NO: 823321 - RNA, 19 nt, Homo sapiens
ucagagaagcgugaaguuu

SEQ ID NO: 823322 - RNA, 19 nt, Homo sapiens
ggacuacagcauuugaugu

SEQ ID NO: 823323 - RNA, 19 nt, Homo sapiens
ccagaagcaugcccaagca

SEQ ID NO: 823324 - RNA, 19 nt, Homo sapiens
caagugggcuauuaaaauc

SEQ ID NO: 823325 - RNA, 19 nt, Homo sapiens
uuucugcucugacagguuu

SEQ ID NO: 823326 - RNA, 19 nt, Homo sapiens
ugauguguguccucaagaa

SEQ ID NO: 823327 - RNA, 19 nt, Homo sapiens
ucacuucaugucucaauuu

SEQ ID NO: 823328 - RNA, 19 nt, Homo sapiens
gagaauugggaaacauuau

SEQ ID NO: 823329 - RNA, 19 nt, Homo sapiens
gguguucgguacagagaau

SEQ ID NO: 823330 - RNA, 19 nt, Homo sapiens
aauggaaugccuugcaaua

SEQ ID NO: 823331 - RNA, 19 nt, Homo sapiens
gggaguaugugugugaagu

SEQ ID NO: 823332 - RNA, 19 nt, Homo sapiens
aaucugaacaggcucuuaa

SEQ ID NO: 823333 - RNA, 19 nt, Homo sapiens
gggaugcgacuuguaugua

SEQ ID NO: 823334 - RNA, 19 nt, Homo sapiens
gcuaauuauuuacccuugu

SEQ ID NO: 823335 - RNA, 19 nt, Homo sapiens
gaccucagcugccccauau

SEQ ID NO: 823336 - RNA, 19 nt, Homo sapiens
gcgugaaguuugcacuaug

SEQ ID NO: 823337 - RNA, 19 nt, Homo sapiens
gcucugacagguuuauaug

SEQ ID NO: 823338 - RNA, 19 nt, Homo sapiens
uacuuaaacuugcuuguag

SEQ ID NO: 823339 - RNA, 19 nt, Homo sapiens
gagaguacagaaaggaaga

SEQ ID NO: 823340 - RNA, 19 nt, Homo sapiens
gauggagcacggaaacuug

SEQ ID NO: 823341 - RNA, 19 nt, Homo sapiens
aaagaguucuaaagugucu

SEQ ID NO: 823342 - RNA, 19 nt, Homo sapiens
gcuaaagucuucaauguua

SEQ ID NO: 823343 - RNA, 19 nt, Homo sapiens
gcagaaaguuguuacauuu

SEQ ID NO: 823344 - RNA, 19 nt, Homo sapiens
gcaagagacuccaauaauc

SEQ ID NO: 823345 - RNA, 19 nt, Homo sapiens
gaaacucauuccuugcuua

SEQ ID NO: 823346 - RNA, 19 nt, Homo sapiens
caaacuuccuguccuaaua

SEQ ID NO: 823347 - RNA, 19 nt, Homo sapiens
uaaaggaucuggaccaaga

SEQ ID NO: 823348 - RNA, 19 nt, Homo sapiens
gcaggugacuuccaaagaa

SEQ ID NO: 823349 - RNA, 19 nt, Homo sapiens
gcgggaaccuaucuuguua

SEQ ID NO: 823350 - RNA, 19 nt, Homo sapiens
gaagaauacccuagaauga

SEQ ID NO: 823351 - RNA, 19 nt, Homo sapiens
ugacagaaauguugaaugu

SEQ ID NO: 823352 - RNA, 19 nt, Homo sapiens
gaaguaauggugaugcuua

SEQ ID NO: 823353 - RNA, 19 nt, Homo sapiens
gcaucaaacucgauuuauu

SEQ ID NO: 823354 - RNA, 19 nt, Homo sapiens
ggacuuaaaucuucaaggu

SEQ ID NO: 823355 - RNA, 19 nt, Homo sapiens
gaagagaacuuggagaaac

SEQ ID NO: 823356 - RNA, 19 nt, Homo sapiens
gaagugacggaauuuauuu

SEQ ID NO: 823357 - RNA, 19 nt, Homo sapiens
cagcagaguuugcaaguug

SEQ ID NO: 823358 - RNA, 19 nt, Homo sapiens
gagccaaacuccucugaga

SEQ ID NO: 823359 - RNA, 19 nt, Homo sapiens
guuccuaacuucauagaaa

SEQ ID NO: 823360 - RNA, 19 nt, Homo sapiens
caacagagguuuuaguauu

SEQ ID NO: 823361 - RNA, 19 nt, Homo sapiens
gaauguacccugauguaaa

SEQ ID NO: 823362 - RNA, 19 nt, Homo sapiens
uaaaguagguaccgugaug

SEQ ID NO: 823363 - RNA, 19 nt, Homo sapiens
guauuacaguguugaagua

SEQ ID NO: 823364 - RNA, 19 nt, Homo sapiens
gcaaacagccguccaugga

SEQ ID NO: 823365 - RNA, 19 nt, Homo sapiens
ugacacaacuuugccuuaa

SEQ ID NO: 823366 - RNA, 19 nt, Homo sapiens
cauagaaacuaaagcagaa

SEQ ID NO: 823367 - RNA, 19 nt, Homo sapiens
agacagacauuucaacaau

SEQ ID NO: 823368 - RNA, 19 nt, Homo sapiens
gaugugagcguucaauuug

SEQ ID NO: 823369 - RNA, 19 nt, Homo sapiens
ggauugcacuacagaagaa

SEQ ID NO: 823370 - RNA, 19 nt, Homo sapiens
ccacguaacuauuuugaua

SEQ ID NO: 823371 - RNA, 19 nt, Homo sapiens
gggcaaacuuccuguccua

SEQ ID NO: 823372 - RNA, 19 nt, Homo sapiens
gaacuuggagaaacucauu

SEQ ID NO: 823373 - RNA, 19 nt, Homo sapiens
uaacaucaguaaccaaauc

SEQ ID NO: 823374 - RNA, 19 nt, Homo sapiens
gacuggaccuucucauauu

SEQ ID NO: 823375 - RNA, 19 nt, Homo sapiens
ggcaaucccucccuuucua

SEQ ID NO: 823376 - RNA, 19 nt, Homo sapiens
acagaaauguugaauguuc

SEQ ID NO: 823377 - RNA, 19 nt, Homo sapiens
ggaaugaaagcgucuguug

SEQ ID NO: 823378 - RNA, 19 nt, Homo sapiens
guauuaggcuguguauuga

SEQ ID NO: 823379 - RNA, 19 nt, Homo sapiens
guacacagccaacaccaaa

SEQ ID NO: 823380 - RNA, 19 nt, Homo sapiens
cgacagcgcugaggagaau

SEQ ID NO: 823381 - RNA, 19 nt, Homo sapiens
caagaucacuccaagaacu

SEQ ID NO: 823382 - RNA, 19 nt, Homo sapiens
cgcaacaacuuaauuucua

SEQ ID NO: 823383 - RNA, 19 nt, Homo sapiens
gaagaaaggaauaaaggau

SEQ ID NO: 823384 - RNA, 19 nt, Homo sapiens
ugacagacguguggagauu

SEQ ID NO: 823385 - RNA, 19 nt, Homo sapiens
caucaaacucgauuuauug

SEQ ID NO: 823386 - RNA, 19 nt, Homo sapiens
gaaggaaaauucucccauu

SEQ ID NO: 823387 - RNA, 19 nt, Homo sapiens
ccaagggucugaaugaaag

SEQ ID NO: 823388 - RNA, 19 nt, Homo sapiens
gaguguucauugauguuua

SEQ ID NO: 823389 - RNA, 19 nt, Homo sapiens
ugucagaacucgccuagug

SEQ ID NO: 823390 - RNA, 19 nt, Homo sapiens
ggaccaagaagcagcauga

SEQ ID NO: 823391 - RNA, 19 nt, Homo sapiens
agauagaccugaagggauu

SEQ ID NO: 823392 - RNA, 19 nt, Homo sapiens
acucaacacucgcaauauu

SEQ ID NO: 823393 - RNA, 19 nt, Homo sapiens
ggcuguguauugauaguua

SEQ ID NO: 823394 - RNA, 19 nt, Homo sapiens
gcagaggcuacucgacuua

SEQ ID NO: 823395 - RNA, 19 nt, Homo sapiens
caacagaacguuauuaagc

SEQ ID NO: 823396 - RNA, 19 nt, Homo sapiens
gcaaagaagaagcucaaga

SEQ ID NO: 823397 - RNA, 19 nt, Homo sapiens
ccaagaggcccuuaggaaa

SEQ ID NO: 823398 - RNA, 19 nt, Homo sapiens
gagaaggcuuugguacuga

SEQ ID NO: 823399 - RNA, 19 nt, Homo sapiens
gacacaacuuugccuuaaa

SEQ ID NO: 823400 - RNA, 19 nt, Homo sapiens
ccucugaagugacggaauu

SEQ ID NO: 823401 - RNA, 19 nt, Homo sapiens
gccaggagcucacgcagau

SEQ ID NO: 823402 - RNA, 19 nt, Homo sapiens
guaacaagcccucaucaca

SEQ ID NO: 823403 - RNA, 19 nt, Homo sapiens
ggccaaagguuaacauugc

SEQ ID NO: 823404 - RNA, 19 nt, Homo sapiens
gcaugcaggugacuuccaa

SEQ ID NO: 823405 - RNA, 19 nt, Homo sapiens
gaaaaugucgacuuuguuu

SEQ ID NO: 823406 - RNA, 19 nt, Homo sapiens
gaagucuaguugcuguuga

SEQ ID NO: 823407 - RNA, 19 nt, Homo sapiens
gcaugaaaguggacaagag

SEQ ID NO: 823408 - RNA, 19 nt, Homo sapiens
cuucacagcuucuauugga

SEQ ID NO: 823409 - RNA, 19 nt, Homo sapiens
gaacauacugacccuuuca

SEQ ID NO: 823410 - RNA, 19 nt, Homo sapiens
guacuagacuggaccuucu

SEQ ID NO: 823411 - RNA, 19 nt, Homo sapiens
ucagaagaauacccuagaa

SEQ ID NO: 823412 - RNA, 19 nt, Homo sapiens
ggagacauaaggaaaauua

SEQ ID NO: 823413 - RNA, 19 nt, Homo sapiens
uuaagcagcucuccaugga

SEQ ID NO: 823414 - RNA, 19 nt, Homo sapiens
aaccaaaucuuccucugaa

SEQ ID NO: 823415 - RNA, 19 nt, Homo sapiens
ugaaagccauggguucuga

SEQ ID NO: 823416 - RNA, 19 nt, Homo sapiens
cugaaaguguggucuguuu

SEQ ID NO: 823417 - RNA, 19 nt, Homo sapiens
guaaaucucugcgguucug

SEQ ID NO: 823418 - RNA, 19 nt, Homo sapiens
gaagagcauugccaucacu

SEQ ID NO: 823419 - RNA, 19 nt, Homo sapiens
ggcaacagaacguuauuaa

SEQ ID NO: 823420 - RNA, 19 nt, Homo sapiens
cauauacugugcugguuga

SEQ ID NO: 823421 - RNA, 19 nt, Homo sapiens
acguugaucucuuaaauug

SEQ ID NO: 823422 - RNA, 19 nt, Homo sapiens
gacaaucagccucaugaaa

SEQ ID NO: 823423 - RNA, 19 nt, Homo sapiens
uguauuaggcuguguauug

SEQ ID NO: 823424 - RNA, 19 nt, Homo sapiens
gcuuaucgcuagcggauuc

SEQ ID NO: 823425 - RNA, 19 nt, Homo sapiens
ggacuccacagauugauau

SEQ ID NO: 823426 - RNA, 19 nt, Homo sapiens
gaaacauuccugccucgaa

SEQ ID NO: 823427 - RNA, 19 nt, Homo sapiens
gagaauccauagucgucaa

SEQ ID NO: 823428 - RNA, 19 nt, Homo sapiens
gaacagucagugcaagaga

SEQ ID NO: 823429 - RNA, 19 nt, Homo sapiens
gaucggccaccuccacuuu

SEQ ID NO: 823430 - RNA, 19 nt, Homo sapiens
gagccuuacugaagaagau

SEQ ID NO: 823431 - RNA, 19 nt, Homo sapiens
agacuuagaguguucauug

SEQ ID NO: 823432 - RNA, 19 nt, Homo sapiens
ccaagaagcagcaugaaag

SEQ ID NO: 823433 - RNA, 19 nt, Homo sapiens
gaaagcgucuguuguuacc

SEQ ID NO: 823434 - RNA, 19 nt, Homo sapiens
cacaagaucacuccaagaa

SEQ ID NO: 823435 - RNA, 19 nt, Homo sapiens
aauguacccugauguaaau

SEQ ID NO: 823436 - RNA, 19 nt, Homo sapiens
guaauaguuuggagaaugc

SEQ ID NO: 823437 - RNA, 19 nt, Homo sapiens
gcaaucccucccuuucuaa

SEQ ID NO: 823438 - RNA, 19 nt, Homo sapiens
ugaagugacggaauuuauu

SEQ ID NO: 823439 - RNA, 19 nt, Homo sapiens
acacucaacacucgcaaua

SEQ ID NO: 823440 - RNA, 19 nt, Homo sapiens
guucugaagaggcgaauuu

SEQ ID NO: 823441 - RNA, 19 nt, Homo sapiens
caugaugacugauggucuu

SEQ ID NO: 823442 - RNA, 19 nt, Homo sapiens
gcucaaggcuggaauauuu

SEQ ID NO: 823443 - RNA, 19 nt, Homo sapiens
gaagagagaugacaacaug

SEQ ID NO: 823444 - RNA, 19 nt, Homo sapiens
gcagaacucuuccuaauga

SEQ ID NO: 823445 - RNA, 19 nt, Homo sapiens
gaaagugguugacauagaa

SEQ ID NO: 823446 - RNA, 19 nt, Homo sapiens
uggcaaggcuggcauauua

SEQ ID NO: 823447 - RNA, 19 nt, Homo sapiens
gaacaagccucagacagaa

SEQ ID NO: 823448 - RNA, 19 nt, Homo sapiens
gaacugggaugauaaaguc

SEQ ID NO: 823449 - RNA, 19 nt, Homo sapiens
ggaguugggugcauuugua

SEQ ID NO: 823450 - RNA, 19 nt, Homo sapiens
cagcugauguguauucaua

SEQ ID NO: 823451 - RNA, 19 nt, Homo sapiens
ucgcuaagcuguaccauaa

SEQ ID NO: 823452 - RNA, 19 nt, Homo sapiens
gaucugaggucucugauag

SEQ ID NO: 823453 - RNA, 19 nt, Homo sapiens
ggaaaugaauccuacuuag

SEQ ID NO: 823454 - RNA, 19 nt, Homo sapiens
gaggcuauauucauucuuu

SEQ ID NO: 823455 - RNA, 19 nt, Homo sapiens
guaggagugucuuugaaua

SEQ ID NO: 823456 - RNA, 19 nt, Homo sapiens
ggaagaaacaccacaauca

SEQ ID NO: 823457 - RNA, 19 nt, Homo sapiens
ggagcaagcugugucauau

SEQ ID NO: 823458 - RNA, 19 nt, Homo sapiens
ucaagcagcucuguaguaa

SEQ ID NO: 823459 - RNA, 19 nt, Homo sapiens
gaccacacauuucaaaguu

SEQ ID NO: 823460 - RNA, 19 nt, Homo sapiens
gaaaugcaguuugugaaug

SEQ ID NO: 823461 - RNA, 19 nt, Homo sapiens
uaacugcucugaacuaagu

SEQ ID NO: 823462 - RNA, 19 nt, Homo sapiens
gacaagucaucaaauguuu

SEQ ID NO: 823463 - RNA, 19 nt, Homo sapiens
gaagaaacaccacaaucaa

SEQ ID NO: 823464 - RNA, 19 nt, Homo sapiens
aaacgaagccgacaucuug

SEQ ID NO: 823465 - RNA, 19 nt, Homo sapiens
cauaugaaauugggagaua

SEQ ID NO: 823466 - RNA, 19 nt, Homo sapiens
cagcagaacucuuccuaau

SEQ ID NO: 823467 - RNA, 19 nt, Homo sapiens
gcauauacgaguugguuua

SEQ ID NO: 823468 - RNA, 19 nt, Homo sapiens
gaaagaguccagcccauug

SEQ ID NO: 823469 - RNA, 19 nt, Homo sapiens
gugcuggaaugcuguauuu

SEQ ID NO: 823470 - RNA, 19 nt, Homo sapiens
gagagccacugccaccuuu

SEQ ID NO: 823471 - RNA, 19 nt, Homo sapiens
gagccagaauggauauaaa

SEQ ID NO: 823472 - RNA, 19 nt, Homo sapiens
agacagaaaugcaguuugu

SEQ ID NO: 823473 - RNA, 19 nt, Homo sapiens
acaauuaccagaucagaua

SEQ ID NO: 823474 - RNA, 19 nt, Homo sapiens
gaugaaagacuucucugaa

SEQ ID NO: 823475 - RNA, 19 nt, Homo sapiens
gggcugcacucacgcauau

SEQ ID NO: 823476 - RNA, 19 nt, Homo sapiens
gaacucuuccuaaugauau

SEQ ID NO: 823477 - RNA, 19 nt, Homo sapiens
agacauggauccugaagug

SEQ ID NO: 823478 - RNA, 19 nt, Homo sapiens
gaaaggacagggcagaaga

SEQ ID NO: 823479 - RNA, 19 nt, Homo sapiens
ugauauaccuccauuccaa

SEQ ID NO: 823480 - RNA, 19 nt, Homo sapiens
gaaauugggagauaaugga

SEQ ID NO: 823481 - RNA, 19 nt, Homo sapiens
gaaaugaauccuacuuagu

SEQ ID NO: 823482 - RNA, 19 nt, Homo sapiens
ccucugcgcuuguucacua

SEQ ID NO: 823483 - RNA, 19 nt, Homo sapiens
gcacagagaagugauugaa

SEQ ID NO: 823484 - RNA, 19 nt, Homo sapiens
gggcacauuuccauuauag

SEQ ID NO: 823485 - RNA, 19 nt, Homo sapiens
gaaaagcauuccucaguug

SEQ ID NO: 823486 - RNA, 19 nt, Homo sapiens
ggaggaagauggugguuuu

SEQ ID NO: 823487 - RNA, 19 nt, Homo sapiens
gaagaacccagaaaugcuu

SEQ ID NO: 823488 - RNA, 19 nt, Homo sapiens
gcagaagaacccagaaaug

SEQ ID NO: 823489 - RNA, 19 nt, Homo sapiens
caaaguugcccuauggaaa

SEQ ID NO: 823490 - RNA, 19 nt, Homo sapiens
agaccaacaucucuucgua

SEQ ID NO: 823491 - RNA, 19 nt, Homo sapiens
gagagaaagugguugacau

SEQ ID NO: 823492 - RNA, 19 nt, Homo sapiens
aaaugcaguuugugaauga

SEQ ID NO: 823493 - RNA, 19 nt, Homo sapiens
gaaagucacacucucagau

SEQ ID NO: 823494 - RNA, 19 nt, Homo sapiens
gaaagaaaauccacagagu

SEQ ID NO: 823495 - RNA, 19 nt, Homo sapiens
gggcugacauuucuaagca

SEQ ID NO: 823496 - RNA, 19 nt, Homo sapiens
gacuuucccuguucggaua

SEQ ID NO: 823497 - RNA, 19 nt, Homo sapiens
ggagugucuuugaauagaa

SEQ ID NO: 823498 - RNA, 19 nt, Homo sapiens
aagaagaccuggagaccuu

SEQ ID NO: 823499 - RNA, 19 nt, Homo sapiens
ugaggucucugauagaaau

SEQ ID NO: 823500 - RNA, 19 nt, Homo sapiens
agaaagugguugacauaga

SEQ ID NO: 823501 - RNA, 19 nt, Homo sapiens
uaaaugagaccgaugaaag

SEQ ID NO: 823502 - RNA, 19 nt, Homo sapiens
gaacuuuggcugcgagaau

SEQ ID NO: 823503 - RNA, 19 nt, Homo sapiens
guaaagauugggaguaaau

SEQ ID NO: 823504 - RNA, 19 nt, Homo sapiens
gcgccacucuugcccauga

SEQ ID NO: 823505 - RNA, 19 nt, Homo sapiens
gcagcucuguaguaaagaa

SEQ ID NO: 823506 - RNA, 19 nt, Homo sapiens
ucagaucugugucaaguuc

SEQ ID NO: 823507 - RNA, 19 nt, Homo sapiens
gaaguagucgaccacguuu

SEQ ID NO: 823508 - RNA, 19 nt, Homo sapiens
gagaagugauugaaaagaa

SEQ ID NO: 823509 - RNA, 19 nt, Homo sapiens
guauuuggaccacacauuu

SEQ ID NO: 823510 - RNA, 19 nt, Homo sapiens
aagcagcucuguaguaaag

SEQ ID NO: 823511 - RNA, 19 nt, Homo sapiens
caauaaaugagaccgauga

SEQ ID NO: 823512 - RNA, 19 nt, Homo sapiens
gaggucaugugcuggaaug

SEQ ID NO: 823513 - RNA, 19 nt, Homo sapiens
cgaguugguuuaucuuugu

SEQ ID NO: 823514 - RNA, 19 nt, Homo sapiens
cagccugggugacagagua

SEQ ID NO: 823515 - RNA, 19 nt, Homo sapiens
uaagaaugcgcuuuaucua

SEQ ID NO: 823516 - RNA, 19 nt, Homo sapiens
guucggauaccuucaguaa

SEQ ID NO: 823517 - RNA, 19 nt, Homo sapiens
gcuaagcuguaccauaaag

SEQ ID NO: 823518 - RNA, 19 nt, Homo sapiens
ccaccaggguaaagcauga

SEQ ID NO: 823519 - RNA, 19 nt, Homo sapiens
gauaaugaucaggaaguua

SEQ ID NO: 823520 - RNA, 19 nt, Homo sapiens
augaaagacuucucugaaa

SEQ ID NO: 823521 - RNA, 19 nt, Homo sapiens
agagaaagugguugacaua

SEQ ID NO: 823522 - RNA, 19 nt, Homo sapiens
gagccgagcuugcacuacu

SEQ ID NO: 823523 - RNA, 19 nt, Homo sapiens
gcaaagguucagacgguuu

SEQ ID NO: 823524 - RNA, 19 nt, Homo sapiens
ggacagaacaauuugaaaa

SEQ ID NO: 823525 - RNA, 19 nt, Homo sapiens
agauguauguguuagacua

SEQ ID NO: 823526 - RNA, 19 nt, Homo sapiens
uugcaacgccuuagauuaa

SEQ ID NO: 823527 - RNA, 19 nt, Homo sapiens
caaguaggagugucuuuga

SEQ ID NO: 823528 - RNA, 19 nt, Homo sapiens
gcaaguaggagugucuuug

SEQ ID NO: 823529 - RNA, 19 nt, Homo sapiens
ccgaccagcugauguguau

SEQ ID NO: 823530 - RNA, 19 nt, Homo sapiens
cagcgaaucuucagacacu

SEQ ID NO: 823531 - RNA, 19 nt, Homo sapiens
gaaacacggaugugcaugu

SEQ ID NO: 823532 - RNA, 19 nt, Homo sapiens
aaauggaacgguugaauga

SEQ ID NO: 823533 - RNA, 19 nt, Homo sapiens
ugauuagguuacugugaua

SEQ ID NO: 823534 - RNA, 19 nt, Homo sapiens
gcacauuuccauuauagca

SEQ ID NO: 823535 - RNA, 19 nt, Homo sapiens
gauaaagucaucauuucug

SEQ ID NO: 823536 - RNA, 19 nt, Homo sapiens
caaucaaggaggaaaguaa

SEQ ID NO: 823537 - RNA, 19 nt, Homo sapiens
cacaugugaugaagacaaa

SEQ ID NO: 823538 - RNA, 19 nt, Homo sapiens
gaacuaaguauaagcucau

SEQ ID NO: 823539 - RNA, 19 nt, Homo sapiens
cuccaacgauugaaacauu

SEQ ID NO: 823540 - RNA, 19 nt, Homo sapiens
uggaauuucugagucauuu

SEQ ID NO: 823541 - RNA, 19 nt, Homo sapiens
gcuaggaguugggugcauu

SEQ ID NO: 823542 - RNA, 19 nt, Homo sapiens
gcagccagguccaaucuua

SEQ ID NO: 823543 - RNA, 19 nt, Homo sapiens
ggaaagugaugacgaguau

SEQ ID NO: 823544 - RNA, 19 nt, Homo sapiens
ggaagcaucugaagacaca

SEQ ID NO: 823545 - RNA, 19 nt, Homo sapiens
gaacccaaauaaagaguau

SEQ ID NO: 823546 - RNA, 19 nt, Homo sapiens
gcagaacccugaccuaggu

SEQ ID NO: 823547 - RNA, 19 nt, Homo sapiens
uuacaagucucaagucuuc

SEQ ID NO: 823548 - RNA, 19 nt, Homo sapiens
ccacgcagaucgccuguau

SEQ ID NO: 823549 - RNA, 19 nt, Homo sapiens
gaagaucugcuugacuaua

SEQ ID NO: 823550 - RNA, 19 nt, Homo sapiens
ucaaaucaccuacuaaugu

SEQ ID NO: 823551 - RNA, 19 nt, Homo sapiens
gcaguggcccuccagagua

SEQ ID NO: 823552 - RNA, 19 nt, Homo sapiens
caaaucaccuacuaauguc

SEQ ID NO: 823553 - RNA, 19 nt, Homo sapiens
ggagaacaccccaguuuua

SEQ ID NO: 823554 - RNA, 19 nt, Homo sapiens
agucuucucugcagcuuua

SEQ ID NO: 823555 - RNA, 19 nt, Homo sapiens
gguccaaucuuacaagucu

SEQ ID NO: 823556 - RNA, 19 nt, Homo sapiens
aagaggaaguggaaaguga

SEQ ID NO: 823557 - RNA, 19 nt, Homo sapiens
gcacagagucuagguggaa

SEQ ID NO: 823558 - RNA, 19 nt, Homo sapiens
ggguagaccuggauagcuu

SEQ ID NO: 823559 - RNA, 19 nt, Homo sapiens
augaagaucugcuugacua

SEQ ID NO: 823560 - RNA, 19 nt, Homo sapiens
cagcuuuaccggcaauuua

SEQ ID NO: 823561 - RNA, 19 nt, Homo sapiens
uaaagaguaugaagaucug

SEQ ID NO: 823562 - RNA, 19 nt, Homo sapiens
acacaaaggcccaguccua

SEQ ID NO: 823563 - RNA, 19 nt, Homo sapiens
aaugaauccuuccaaacua

SEQ ID NO: 823564 - RNA, 19 nt, Homo sapiens
ggagccaacuugcaucuac

SEQ ID NO: 823565 - RNA, 19 nt, Homo sapiens
ggaaaccuucaauauacua

SEQ ID NO: 823566 - RNA, 19 nt, Homo sapiens
gcagaucgccuguaugacu

SEQ ID NO: 823567 - RNA, 19 nt, Homo sapiens
gaaaucagaagaggaagug

SEQ ID NO: 823568 - RNA, 19 nt, Homo sapiens
gcgaaggaccggcugacua

SEQ ID NO: 823569 - RNA, 19 nt, Homo sapiens
uacaaugaauccuuccaaa

SEQ ID NO: 823570 - RNA, 19 nt, Homo sapiens
uguauaauguugcagaugu

SEQ ID NO: 823571 - RNA, 19 nt, Homo sapiens
cgaaggaccggcugacuau

SEQ ID NO: 823572 - RNA, 19 nt, Homo sapiens
ccagagagccaagccuuaa

SEQ ID NO: 823573 - RNA, 19 nt, Homo sapiens
ugaauggagggcugaguua

SEQ ID NO: 823574 - RNA, 19 nt, Homo sapiens
guauaauguugcagauguu

SEQ ID NO: 823575 - RNA, 19 nt, Homo sapiens
ggccucagcucccaaagca

SEQ ID NO: 823576 - RNA, 19 nt, Homo sapiens
gaagaggaccagccagagu

SEQ ID NO: 823577 - RNA, 19 nt, Homo sapiens
gcaugggcuuggcaucuug

SEQ ID NO: 823578 - RNA, 19 nt, Homo sapiens
cuggauagcuucucugucu

SEQ ID NO: 823579 - RNA, 19 nt, Homo sapiens
ggggaaaccuucaauauac

SEQ ID NO: 823580 - RNA, 19 nt, Homo sapiens
gacuauacuuacccacuga

SEQ ID NO: 823581 - RNA, 19 nt, Homo sapiens
ggccagugaugccaacaga

SEQ ID NO: 823582 - RNA, 19 nt, Homo sapiens
caaugaauccuuccaaacu

SEQ ID NO: 823583 - RNA, 19 nt, Homo sapiens
ggaacccaaauaaagagua

SEQ ID NO: 823584 - RNA, 19 nt, Homo sapiens
cggagagugucuuacagaa

SEQ ID NO: 823585 - RNA, 19 nt, Homo sapiens
ucugcuggcuguauaaugu

SEQ ID NO: 823586 - RNA, 19 nt, Homo sapiens
guggaaaucagaagaggaa

SEQ ID NO: 823587 - RNA, 19 nt, Homo sapiens
ccagaacaacaacuauuug

SEQ ID NO: 823588 - RNA, 19 nt, Homo sapiens
gggaaagccagguggagaa

SEQ ID NO: 823589 - RNA, 19 nt, Homo sapiens
caacagagagcccguagcu

SEQ ID NO: 823590 - RNA, 19 nt, Homo sapiens
gggaaaccuucaauauacu

SEQ ID NO: 823591 - RNA, 19 nt, Homo sapiens
cuggcuggcugcacccuua

SEQ ID NO: 823592 - RNA, 19 nt, Homo sapiens
acgcagaucgccuguauga

SEQ ID NO: 823593 - RNA, 19 nt, Homo sapiens
caauggcccugggugaaga

SEQ ID NO: 823594 - RNA, 19 nt, Homo sapiens
gaagaggaaguggaaagug

SEQ ID NO: 823595 - RNA, 19 nt, Homo sapiens
caaaggcccaguccuaugg

SEQ ID NO: 823596 - RNA, 19 nt, Homo sapiens
gaaggaccggcugacuaua

SEQ ID NO: 823597 - RNA, 19 nt, Homo sapiens
ccagugaugccaacagaga

SEQ ID NO: 823598 - RNA, 19 nt, Homo sapiens
augaauccuuccaaacuaa

SEQ ID NO: 823599 - RNA, 19 nt, Homo sapiens
ccaaauaaagaguaugaag

SEQ ID NO: 823600 - RNA, 19 nt, Homo sapiens
gagggcugaguuacuauuu

SEQ ID NO: 823601 - RNA, 19 nt, Homo sapiens
gcaagagccauucaacacu

SEQ ID NO: 823602 - RNA, 19 nt, Homo sapiens
cugaucugcuggcuguaua

SEQ ID NO: 823603 - RNA, 19 nt, Homo sapiens
ggcaugggcuuggcaucuu

SEQ ID NO: 823604 - RNA, 19 nt, Homo sapiens
cccagaacaacaacuauuu

SEQ ID NO: 823605 - RNA, 19 nt, Homo sapiens
ggagggcugaguuacuauu

SEQ ID NO: 823606 - RNA, 19 nt, Homo sapiens
ggaaaucagaagaggaagu

SEQ ID NO: 823607 - RNA, 19 nt, Homo sapiens
ccucaaaucaccuacuaau

SEQ ID NO: 823608 - RNA, 19 nt, Homo sapiens
ccucacagcucaggucucu

SEQ ID NO: 823609 - RNA, 19 nt, Homo sapiens
ccagcaagcacccucaaau

SEQ ID NO: 823610 - RNA, 19 nt, Homo sapiens
aagaucugcuugacuauac

SEQ ID NO: 823611 - RNA, 19 nt, Homo sapiens
ugacggagagugucuuaca

SEQ ID NO: 823612 - RNA, 19 nt, Homo sapiens
ccugugugcugccagauuc

SEQ ID NO: 823613 - RNA, 19 nt, Homo sapiens
gggcucaucuccccuguau

SEQ ID NO: 823614 - RNA, 19 nt, Homo sapiens
cagcaagcacccucaaauc

SEQ ID NO: 823615 - RNA, 19 nt, Homo sapiens
guggagaagaccaagcuuu

SEQ ID NO: 823616 - RNA, 19 nt, Homo sapiens
auggagggcugaguuacua

SEQ ID NO: 823617 - RNA, 19 nt, Homo sapiens
gcacccuuaucccugacaa

SEQ ID NO: 823618 - RNA, 19 nt, Homo sapiens
gguaggaagcugaagucuu

SEQ ID NO: 823619 - RNA, 19 nt, Homo sapiens
ggagagugucuuacagaag

SEQ ID NO: 823620 - RNA, 19 nt, Homo sapiens
ccacugcccugccauuuuc

SEQ ID NO: 823621 - RNA, 19 nt, Homo sapiens
gcuguauaauguugcagau

SEQ ID NO: 823622 - RNA, 19 nt, Homo sapiens
gcaagcacccucaaaucac

SEQ ID NO: 823623 - RNA, 19 nt, Homo sapiens
gugguucucuggccaaggu

SEQ ID NO: 823624 - RNA, 19 nt, Homo sapiens
auccaucccuagcagauuu

SEQ ID NO: 823625 - RNA, 19 nt, Homo sapiens
ggcagaagcggaagcaucu

SEQ ID NO: 823626 - RNA, 19 nt, Homo sapiens
gagucuagguggaaaucag

SEQ ID NO: 823627 - RNA, 19 nt, Homo sapiens
gcggaagcaucugaagaca

SEQ ID NO: 823628 - RNA, 19 nt, Homo sapiens
acccucaaaucaccuacua

SEQ ID NO: 823629 - RNA, 19 nt, Homo sapiens
ucccaaagcaccuugauag

SEQ ID NO: 823630 - RNA, 19 nt, Homo sapiens
ucuggaacccaaauaaaga

SEQ ID NO: 823631 - RNA, 19 nt, Homo sapiens
gcagcuuuaccggcaauuu

SEQ ID NO: 823632 - RNA, 19 nt, Homo sapiens
ccuucaauauacuagcuuu

SEQ ID NO: 823633 - RNA, 19 nt, Homo sapiens
gaaaccuucaauauacuag

SEQ ID NO: 823634 - RNA, 19 nt, Homo sapiens
gaaagccagguggagaaga

SEQ ID NO: 823635 - RNA, 19 nt, Homo sapiens
guaugaagaucugcuugac

SEQ ID NO: 823636 - RNA, 19 nt, Homo sapiens
aagagccauucaacacuga

SEQ ID NO: 823637 - RNA, 19 nt, Homo sapiens
uaccggcaauuuaagaaag

SEQ ID NO: 823638 - RNA, 19 nt, Homo sapiens
aaagugaugacgaguaucu

SEQ ID NO: 823639 - RNA, 19 nt, Homo sapiens
uggaaagugaugacgagua

SEQ ID NO: 823640 - RNA, 19 nt, Homo sapiens
cagaagaggaaguggaaag

SEQ ID NO: 823641 - RNA, 19 nt, Homo sapiens
gcuaaggacacgggacaga

SEQ ID NO: 823642 - RNA, 19 nt, Homo sapiens
cagaagaacuggagaaaua

SEQ ID NO: 823643 - RNA, 19 nt, Homo sapiens
gaccaaacgucaucaaauu

SEQ ID NO: 823644 - RNA, 19 nt, Homo sapiens
aaacugagauccugacauu

SEQ ID NO: 823645 - RNA, 19 nt, Homo sapiens
gaagcuggauuguaacauu

SEQ ID NO: 823646 - RNA, 19 nt, Homo sapiens
gaaaguggauuuaauacag

SEQ ID NO: 823647 - RNA, 19 nt, Homo sapiens
caacauuucuuccuuaaag

SEQ ID NO: 823648 - RNA, 19 nt, Homo sapiens
gagaaaguauguuuaaugg

SEQ ID NO: 823649 - RNA, 19 nt, Homo sapiens
gcaaagggcuguguagaca

SEQ ID NO: 823650 - RNA, 19 nt, Homo sapiens
caccaugccuggcuaauuu

SEQ ID NO: 823651 - RNA, 19 nt, Homo sapiens
ggaaugaacacguuugcua

SEQ ID NO: 823652 - RNA, 19 nt, Homo sapiens
ugaacacguuugcuaguua

SEQ ID NO: 823653 - RNA, 19 nt, Homo sapiens
ggagagugaugauccaaau

SEQ ID NO: 823654 - RNA, 19 nt, Homo sapiens
ggaaggaugaggccagaua

SEQ ID NO: 823655 - RNA, 19 nt, Homo sapiens
auuagaagcuggauuguaa

SEQ ID NO: 823656 - RNA, 19 nt, Homo sapiens
cuagugagacacauaauua

SEQ ID NO: 823657 - RNA, 19 nt, Homo sapiens
gagaaggucuuggaggauu

SEQ ID NO: 823658 - RNA, 19 nt, Homo sapiens
ggacugcuguggacaagga

SEQ ID NO: 823659 - RNA, 19 nt, Homo sapiens
acaacucgauuucuaauga

SEQ ID NO: 823660 - RNA, 19 nt, Homo sapiens
gagcagcugucccaguuga

SEQ ID NO: 823661 - RNA, 19 nt, Homo sapiens
gaaucaacauuucuuccuu

SEQ ID NO: 823662 - RNA, 19 nt, Homo sapiens
guaaguauuugucuugauc

SEQ ID NO: 823663 - RNA, 19 nt, Homo sapiens
caagagacauacauucauc

SEQ ID NO: 823664 - RNA, 19 nt, Homo sapiens
caacucacauuugcucuug

SEQ ID NO: 823665 - RNA, 19 nt, Homo sapiens
guggugaaguuuauuaaga

SEQ ID NO: 823666 - RNA, 19 nt, Homo sapiens
uggaaugacugagaaagua

SEQ ID NO: 823667 - RNA, 19 nt, Homo sapiens
agaggaaccuguggcaaua

SEQ ID NO: 823668 - RNA, 19 nt, Homo sapiens
gcaugugguucccuucauu

SEQ ID NO: 823669 - RNA, 19 nt, Homo sapiens
gccuagaccucuucgcuuu

SEQ ID NO: 823670 - RNA, 19 nt, Homo sapiens
gaaccucaaggaacucuuu

SEQ ID NO: 823671 - RNA, 19 nt, Homo sapiens
ggacaccuacucuagauga

SEQ ID NO: 823672 - RNA, 19 nt, Homo sapiens
guagacaacucacauuugc

SEQ ID NO: 823673 - RNA, 19 nt, Homo sapiens
gaacuucggccauuauuuu

SEQ ID NO: 823674 - RNA, 19 nt, Homo sapiens
ggagugaggccacagaguu

SEQ ID NO: 823675 - RNA, 19 nt, Homo sapiens
aaugguggcuguugaggua

SEQ ID NO: 823676 - RNA, 19 nt, Homo sapiens
gcugcuggcuggugaaaga

SEQ ID NO: 823677 - RNA, 19 nt, Homo sapiens
gggcuccgauccagaugua

SEQ ID NO: 823678 - RNA, 19 nt, Homo sapiens
agaagcaucugcaggaaga

SEQ ID NO: 823679 - RNA, 19 nt, Homo sapiens
guauuugucuugaucuguu

SEQ ID NO: 823680 - RNA, 19 nt, Homo sapiens
ggucguguguccuggauga

SEQ ID NO: 823681 - RNA, 19 nt, Homo sapiens
ucaaauuguuccugugcua

SEQ ID NO: 823682 - RNA, 19 nt, Homo sapiens
gauauuaugguucugcaaa

SEQ ID NO: 823683 - RNA, 19 nt, Homo sapiens
cacauuugcucuuggauug

SEQ ID NO: 823684 - RNA, 19 nt, Homo sapiens
gauugaggaucccaaacuu

SEQ ID NO: 823685 - RNA, 19 nt, Homo sapiens
gaacacguuugcuaguuac

SEQ ID NO: 823686 - RNA, 19 nt, Homo sapiens
gagcagcuuucuucaaguc

SEQ ID NO: 823687 - RNA, 19 nt, Homo sapiens
gugcgaaaguggauuuaau

SEQ ID NO: 823688 - RNA, 19 nt, Homo sapiens
acaaggaggugguggugaa

SEQ ID NO: 823689 - RNA, 19 nt, Homo sapiens
ggagaaagcaggucugaac

SEQ ID NO: 823690 - RNA, 19 nt, Homo sapiens
aaugacagcuuccgugaau

SEQ ID NO: 823691 - RNA, 19 nt, Homo sapiens
ugacugagaaaguauguuu

SEQ ID NO: 823692 - RNA, 19 nt, Homo sapiens
ucacucggguaucgaauga

SEQ ID NO: 823693 - RNA, 19 nt, Homo sapiens
gaguaucuguaugagguua

SEQ ID NO: 823694 - RNA, 19 nt, Homo sapiens
gcugcuuucucucauguaa

SEQ ID NO: 823695 - RNA, 19 nt, Homo sapiens
gugguucccuucauuguau

SEQ ID NO: 823696 - RNA, 19 nt, Homo sapiens
guuaaucucucaguacuag

SEQ ID NO: 823697 - RNA, 19 nt, Homo sapiens
ucuguuucgugucuaauua

SEQ ID NO: 823698 - RNA, 19 nt, Homo sapiens
gcagcaagcgacagagaaa

SEQ ID NO: 823699 - RNA, 19 nt, Homo sapiens
caaacgucaucaaauuguu

SEQ ID NO: 823700 - RNA, 19 nt, Homo sapiens
gagaggaaccuguggcaau

SEQ ID NO: 823701 - RNA, 19 nt, Homo sapiens
aaagugagguugggaagga

SEQ ID NO: 823702 - RNA, 19 nt, Homo sapiens
ccaaagugcugggauuaca

SEQ ID NO: 823703 - RNA, 19 nt, Homo sapiens
ccugacagcuguuaauucu

SEQ ID NO: 823704 - RNA, 19 nt, Homo sapiens
ggacaacucgauuucuaau

SEQ ID NO: 823705 - RNA, 19 nt, Homo sapiens
gaaacgguaacucguguug

SEQ ID NO: 823706 - RNA, 19 nt, Homo sapiens
uagggaagccuuguagaua

SEQ ID NO: 823707 - RNA, 19 nt, Homo sapiens
gccaauaucaucaagguau

SEQ ID NO: 823708 - RNA, 19 nt, Homo sapiens
ggagacaggaggcagagaa

SEQ ID NO: 823709 - RNA, 19 nt, Homo sapiens
gcucugacuuggguguuaa

SEQ ID NO: 823710 - RNA, 19 nt, Homo sapiens
gaucccaaggccucuaaua

SEQ ID NO: 823711 - RNA, 19 nt, Homo sapiens
uguugagggucgcuuguua

SEQ ID NO: 823712 - RNA, 19 nt, Homo sapiens
ggugcuggcuugcgagguu

SEQ ID NO: 823713 - RNA, 19 nt, Homo sapiens
gguaacucguguuggguuu

SEQ ID NO: 823714 - RNA, 19 nt, Homo sapiens
cagauacaguccuggaaug

SEQ ID NO: 823715 - RNA, 19 nt, Homo sapiens
cccaaggccucuaauacuu

SEQ ID NO: 823716 - RNA, 19 nt, Homo sapiens
aagcuggauuguaacauuu

SEQ ID NO: 823717 - RNA, 19 nt, Homo sapiens
ccugucagcuccagauuca

SEQ ID NO: 823718 - RNA, 19 nt, Homo sapiens
ggcauugugugaguucuuu

SEQ ID NO: 823719 - RNA, 19 nt, Homo sapiens
gcaccaugccuggcuaauu

SEQ ID NO: 823720 - RNA, 19 nt, Homo sapiens
gagagugaugauccaaaua

SEQ ID NO: 823721 - RNA, 19 nt, Homo sapiens
ggaaugacugagaaaguau

SEQ ID NO: 823722 - RNA, 19 nt, Homo sapiens
ccaggagguugaugugaau

SEQ ID NO: 823723 - RNA, 19 nt, Homo sapiens
gauggcaggccucucguuu

SEQ ID NO: 823724 - RNA, 19 nt, Homo sapiens
gagaugagauccggaagcu

SEQ ID NO: 823725 - RNA, 19 nt, Homo sapiens
ugacuuggguguuaauagg

SEQ ID NO: 823726 - RNA, 19 nt, Homo sapiens
uaaccaagagacauacauu

SEQ ID NO: 823727 - RNA, 19 nt, Homo sapiens
gcuagugagacacauaauu

SEQ ID NO: 823728 - RNA, 19 nt, Homo sapiens
gaggugguggugaaguuua

SEQ ID NO: 823729 - RNA, 19 nt, Homo sapiens
gaaccuguggcaauagaga

SEQ ID NO: 823730 - RNA, 19 nt, Homo sapiens
uaucucagucuguccuuua

SEQ ID NO: 823731 - RNA, 19 nt, Homo sapiens
ggucaccucucucccucuu

SEQ ID NO: 823732 - RNA, 19 nt, Homo sapiens
gggacaacucgauuucuaa

SEQ ID NO: 823733 - RNA, 19 nt, Homo sapiens
gggauuucauggaguagga

SEQ ID NO: 823734 - RNA, 19 nt, Homo sapiens
ucaucaagguauuggauau

SEQ ID NO: 823735 - RNA, 19 nt, Homo sapiens
caaggccucuaauacuuca

SEQ ID NO: 823736 - RNA, 19 nt, Homo sapiens
ccgaguagcugggauuaca

SEQ ID NO: 823737 - RNA, 19 nt, Homo sapiens
gagaaguuaugccgaacca

SEQ ID NO: 823738 - RNA, 19 nt, Homo sapiens
ggcauuagaagcuggauug

SEQ ID NO: 823739 - RNA, 19 nt, Homo sapiens
gugaugauccaaauaggaa

SEQ ID NO: 823740 - RNA, 19 nt, Homo sapiens
gcacgccaauaucaucaag

SEQ ID NO: 823741 - RNA, 19 nt, Homo sapiens
gggacaugauccaacagaa

SEQ ID NO: 823742 - RNA, 19 nt, Homo sapiens
gaacaaacccggaauauga

SEQ ID NO: 823743 - RNA, 19 nt, Homo sapiens
gacaaugacuuuaccuaua

SEQ ID NO: 823744 - RNA, 19 nt, Homo sapiens
ugacugacguugauuauuu

SEQ ID NO: 823745 - RNA, 19 nt, Homo sapiens
ggucaaaucuuaucuguca

SEQ ID NO: 823746 - RNA, 19 nt, Homo sapiens
ggaaggagcuguuuaccau

SEQ ID NO: 823747 - RNA, 19 nt, Homo sapiens
ggaagaucauguucgaaua

SEQ ID NO: 823748 - RNA, 19 nt, Homo sapiens
gucgaaaggucaaaucuua

SEQ ID NO: 823749 - RNA, 19 nt, Homo sapiens
uacagaaacugcuggauua

SEQ ID NO: 823750 - RNA, 19 nt, Homo sapiens
gaaacaggcugcggugauu

SEQ ID NO: 823751 - RNA, 19 nt, Homo sapiens
acaagaagcccaaacuuua

SEQ ID NO: 823752 - RNA, 19 nt, Homo sapiens
gcaaagaacucaaaacuca

SEQ ID NO: 823753 - RNA, 19 nt, Homo sapiens
gcaauugacugacguugau

SEQ ID NO: 823754 - RNA, 19 nt, Homo sapiens
gaagucagcagauauuuau

SEQ ID NO: 823755 - RNA, 19 nt, Homo sapiens
guagacuccugaagaauuu

SEQ ID NO: 823756 - RNA, 19 nt, Homo sapiens
gcagaauuaccaacauuua

SEQ ID NO: 823757 - RNA, 19 nt, Homo sapiens
ggacagcagugugaaagaa

SEQ ID NO: 823758 - RNA, 19 nt, Homo sapiens
gcagauauuuauugaguuc

SEQ ID NO: 823759 - RNA, 19 nt, Homo sapiens
gaagacaccugcauaaucc

SEQ ID NO: 823760 - RNA, 19 nt, Homo sapiens
ugacucauuuggacucuua

SEQ ID NO: 823761 - RNA, 19 nt, Homo sapiens
guaagaagcacuuucagaa

SEQ ID NO: 823762 - RNA, 19 nt, Homo sapiens
gcuaugcccugucauguga

SEQ ID NO: 823763 - RNA, 19 nt, Homo sapiens
caucgaggguggacugaua

SEQ ID NO: 823764 - RNA, 19 nt, Homo sapiens
gcaaucgcuuccauacuaa

SEQ ID NO: 823765 - RNA, 19 nt, Homo sapiens
gaagauggaagccaaaguu

SEQ ID NO: 823766 - RNA, 19 nt, Homo sapiens
gaggaugacuuucucaauc

SEQ ID NO: 823767 - RNA, 19 nt, Homo sapiens
ggaaggaaccucaaaauuu

SEQ ID NO: 823768 - RNA, 19 nt, Homo sapiens
uaugaaaccuguaagauca

SEQ ID NO: 823769 - RNA, 19 nt, Homo sapiens
ucaacaggcugccaauaaa

SEQ ID NO: 823770 - RNA, 19 nt, Homo sapiens
caagaggugucuaaauuca

SEQ ID NO: 823771 - RNA, 19 nt, Homo sapiens
aaagauuucugaacaguga

SEQ ID NO: 823772 - RNA, 19 nt, Homo sapiens
aaacaaauuugcacaaugg

SEQ ID NO: 823773 - RNA, 19 nt, Homo sapiens
gaaugaagacaccugcaua

SEQ ID NO: 823774 - RNA, 19 nt, Homo sapiens
gaauguagacuccugaaga

SEQ ID NO: 823775 - RNA, 19 nt, Homo sapiens
gaauagagaguguccuuug

SEQ ID NO: 823776 - RNA, 19 nt, Homo sapiens
ucucguauauucugaguaa

SEQ ID NO: 823777 - RNA, 19 nt, Homo sapiens
ggagagcuaugcccuguca

SEQ ID NO: 823778 - RNA, 19 nt, Homo sapiens
cagcagauauuuauugagu

SEQ ID NO: 823779 - RNA, 19 nt, Homo sapiens
gaagugauugcccagauaa

SEQ ID NO: 823780 - RNA, 19 nt, Homo sapiens
gagaacuacugaugaagga

SEQ ID NO: 823781 - RNA, 19 nt, Homo sapiens
ugcaaucgcuuccauacua

SEQ ID NO: 823782 - RNA, 19 nt, Homo sapiens
uggagaagcuuguggagaa

SEQ ID NO: 823783 - RNA, 19 nt, Homo sapiens
cucaagaggugucuaaauu

SEQ ID NO: 823784 - RNA, 19 nt, Homo sapiens
gagauuggacuacacauug

SEQ ID NO: 823785 - RNA, 19 nt, Homo sapiens
ucagggaugucuuccuuaa

SEQ ID NO: 823786 - RNA, 19 nt, Homo sapiens
gaagggaauuugaagugau

SEQ ID NO: 823787 - RNA, 19 nt, Homo sapiens
ggaucaacaucgcucauga

SEQ ID NO: 823788 - RNA, 19 nt, Homo sapiens
uuaauacccucaccaaaug

SEQ ID NO: 823789 - RNA, 19 nt, Homo sapiens
gccaccaucucucaguuua

SEQ ID NO: 823790 - RNA, 19 nt, Homo sapiens
gaagaucauguucgaauau

SEQ ID NO: 823791 - RNA, 19 nt, Homo sapiens
gaaauuccaaguagcuaaa

SEQ ID NO: 823792 - RNA, 19 nt, Homo sapiens
cagggaaaguuuagagauu

SEQ ID NO: 823793 - RNA, 19 nt, Homo sapiens
agaagaaacugagaaccua

SEQ ID NO: 823794 - RNA, 19 nt, Homo sapiens
ugaagugauugcccagaua

SEQ ID NO: 823795 - RNA, 19 nt, Homo sapiens
ggacaaugacuuuaccuau

SEQ ID NO: 823796 - RNA, 19 nt, Homo sapiens
gcaucuccaucaucuguuu

SEQ ID NO: 823797 - RNA, 19 nt, Homo sapiens
gaagaacuuucagauaucu

SEQ ID NO: 823798 - RNA, 19 nt, Homo sapiens
gcaucuuucuuucaacgua

SEQ ID NO: 823799 - RNA, 19 nt, Homo sapiens
aagaagcacuuucagaaug

SEQ ID NO: 823800 - RNA, 19 nt, Homo sapiens
gcacauguauuugguaugc

SEQ ID NO: 823801 - RNA, 19 nt, Homo sapiens
ggaagagcauggugaagag

SEQ ID NO: 823802 - RNA, 19 nt, Homo sapiens
ggugaaaccugugggagaa

SEQ ID NO: 823803 - RNA, 19 nt, Homo sapiens
gaaccuagucucguauauu

SEQ ID NO: 823804 - RNA, 19 nt, Homo sapiens
gcaauuaccauccgguguu

SEQ ID NO: 823805 - RNA, 19 nt, Homo sapiens
guucgaauaugggaaguuu

SEQ ID NO: 823806 - RNA, 19 nt, Homo sapiens
ucaugcagguugaaguaua

SEQ ID NO: 823807 - RNA, 19 nt, Homo sapiens
gacacuggcugguggaaga

SEQ ID NO: 823808 - RNA, 19 nt, Homo sapiens
uaaauagccaugugaauuc

SEQ ID NO: 823809 - RNA, 19 nt, Homo sapiens
gaauaugaagugcagauug

SEQ ID NO: 823810 - RNA, 19 nt, Homo sapiens
ggaaagagauggggcugua

SEQ ID NO: 823811 - RNA, 19 nt, Homo sapiens
ggaaucaguccugggaaua

SEQ ID NO: 823812 - RNA, 19 nt, Homo sapiens
gugcaaagcauuaugauag

SEQ ID NO: 823813 - RNA, 19 nt, Homo sapiens
ggcagcagcuccugacaga

SEQ ID NO: 823814 - RNA, 19 nt, Homo sapiens
acacugcccuucaggacua

SEQ ID NO: 823815 - RNA, 19 nt, Homo sapiens
gaaugcugauguuugaaga

SEQ ID NO: 823816 - RNA, 19 nt, Homo sapiens
ggacuggggugaagaggua

SEQ ID NO: 823817 - RNA, 19 nt, Homo sapiens
gggaaaguuuagagauuug

SEQ ID NO: 823818 - RNA, 19 nt, Homo sapiens
ggaauauugacauguguaa

SEQ ID NO: 823819 - RNA, 19 nt, Homo sapiens
cagauggaaucaauaacuu

SEQ ID NO: 823820 - RNA, 19 nt, Homo sapiens
gaucuuaguaccucuuuau

SEQ ID NO: 823821 - RNA, 19 nt, Homo sapiens
cuaugugucuggagucuuu

SEQ ID NO: 823822 - RNA, 19 nt, Homo sapiens
caagaagcccaaacuuuau

SEQ ID NO: 823823 - RNA, 19 nt, Homo sapiens
gccgagaacuacugaugaa

SEQ ID NO: 823824 - RNA, 19 nt, Homo sapiens
acucuuaucugucuuggaa

SEQ ID NO: 823825 - RNA, 19 nt, Homo sapiens
gaaaagaaagcgcaaaaga

SEQ ID NO: 823826 - RNA, 19 nt, Homo sapiens
gacaauaacggcaacaugu

SEQ ID NO: 823827 - RNA, 19 nt, Homo sapiens
ccaaagagcagcccaaguc

SEQ ID NO: 823828 - RNA, 19 nt, Homo sapiens
gagaagggaauuugaagug

SEQ ID NO: 823829 - RNA, 19 nt, Homo sapiens
gauaucuucucagaccaua

SEQ ID NO: 823830 - RNA, 19 nt, Homo sapiens
gauaacagcauccuauuuu

SEQ ID NO: 823831 - RNA, 19 nt, Homo sapiens
gaaauagaagaaacugaga

SEQ ID NO: 823832 - RNA, 19 nt, Homo sapiens
ugaagucagcagauauuua

SEQ ID NO: 823833 - RNA, 19 nt, Homo sapiens
cagagcagcugaccuacau

SEQ ID NO: 823834 - RNA, 19 nt, Homo sapiens
uguaagaucaggaccauaa

SEQ ID NO: 823835 - RNA, 19 nt, Homo sapiens
agaggugucuaaauucaaa

SEQ ID NO: 823836 - RNA, 19 nt, Homo sapiens
gcaaaagaauggugacuca

SEQ ID NO: 823837 - RNA, 19 nt, Homo sapiens
gcagagagccaaaaucauu

SEQ ID NO: 823838 - RNA, 19 nt, Homo sapiens
gguggaagaucauguucga

SEQ ID NO: 823839 - RNA, 19 nt, Homo sapiens
gggagaaccuacucaagag

SEQ ID NO: 823840 - RNA, 19 nt, Homo sapiens
agagggacuuuaugggaua

SEQ ID NO: 823841 - RNA, 19 nt, Homo sapiens
ggacugauaaacuuugaga

SEQ ID NO: 823842 - RNA, 19 nt, Homo sapiens
gaaagcacuuccugaauua

SEQ ID NO: 823843 - RNA, 19 nt, Homo sapiens
gaaugaaccucuacuuaaa

SEQ ID NO: 823844 - RNA, 19 nt, Homo sapiens
uaacaaacgugcuggauuu

SEQ ID NO: 823845 - RNA, 19 nt, Homo sapiens
ccauaaagcugcaguguga

SEQ ID NO: 823846 - RNA, 19 nt, Homo sapiens
gaagugccauuaacaagaa

SEQ ID NO: 823847 - RNA, 19 nt, Homo sapiens
gaagagacguucuguccuu

SEQ ID NO: 823848 - RNA, 19 nt, Homo sapiens
gaagauagcagaguacaaa

SEQ ID NO: 823849 - RNA, 19 nt, Homo sapiens
gaaagugugcuucuauaaa

SEQ ID NO: 823850 - RNA, 19 nt, Homo sapiens
agaaagcacuuccugaauu

SEQ ID NO: 823851 - RNA, 19 nt, Homo sapiens
gaugaacggucuaaguuau

SEQ ID NO: 823852 - RNA, 19 nt, Homo sapiens
ggagaaauaugcgucaguu

SEQ ID NO: 823853 - RNA, 19 nt, Homo sapiens
ggucuaaguuaugguguua

SEQ ID NO: 823854 - RNA, 19 nt, Homo sapiens
ugacaggguucguuuggua

SEQ ID NO: 823855 - RNA, 19 nt, Homo sapiens
ggagagaucuggguaagca

SEQ ID NO: 823856 - RNA, 19 nt, Homo sapiens
caggagagguggcagcuuu

SEQ ID NO: 823857 - RNA, 19 nt, Homo sapiens
caaaccagcugccucacuu

SEQ ID NO: 823858 - RNA, 19 nt, Homo sapiens
ggaaagccgucuacacucu

SEQ ID NO: 823859 - RNA, 19 nt, Homo sapiens
ccaaagcgcccuccacuga

SEQ ID NO: 823860 - RNA, 19 nt, Homo sapiens
cacagacgcuugucagaaa

SEQ ID NO: 823861 - RNA, 19 nt, Homo sapiens
ggagaaacuugagaccauu

SEQ ID NO: 823862 - RNA, 19 nt, Homo sapiens
gcuaauguauguguuguga

SEQ ID NO: 823863 - RNA, 19 nt, Homo sapiens
agaaugaaccucuacuuaa

SEQ ID NO: 823864 - RNA, 19 nt, Homo sapiens
aaacacggaugcugguauu

SEQ ID NO: 823865 - RNA, 19 nt, Homo sapiens
gucaaccacugggauauua

SEQ ID NO: 823866 - RNA, 19 nt, Homo sapiens
ccacauagaucugcauucu

SEQ ID NO: 823867 - RNA, 19 nt, Homo sapiens
caaacgugcuggauuucaa

SEQ ID NO: 823868 - RNA, 19 nt, Homo sapiens
gcacaacacagcccaaauc

SEQ ID NO: 823869 - RNA, 19 nt, Homo sapiens
gggagaaacuugagaccau

SEQ ID NO: 823870 - RNA, 19 nt, Homo sapiens
gcacuuccugaauuauuua

SEQ ID NO: 823871 - RNA, 19 nt, Homo sapiens
gauggagucuggaaagauc

SEQ ID NO: 823872 - RNA, 19 nt, Homo sapiens
gaggagcacccaucuuuga

SEQ ID NO: 823873 - RNA, 19 nt, Homo sapiens
gcacuggucucuccuagcu

SEQ ID NO: 823874 - RNA, 19 nt, Homo sapiens
gcgcucguguuuccgaaua

SEQ ID NO: 823875 - RNA, 19 nt, Homo sapiens
aaagugugcuucuauaaag

SEQ ID NO: 823876 - RNA, 19 nt, Homo sapiens
gccaguuccuuuauugaaa

SEQ ID NO: 823877 - RNA, 19 nt, Homo sapiens
gaaaaguugucaguccuua

SEQ ID NO: 823878 - RNA, 19 nt, Homo sapiens
cagaguggauacugaagaa

SEQ ID NO: 823879 - RNA, 19 nt, Homo sapiens
gcaagcagagaauagaauu

SEQ ID NO: 823880 - RNA, 19 nt, Homo sapiens
aagaaugaaccucuacuua

SEQ ID NO: 823881 - RNA, 19 nt, Homo sapiens
ggagagacaaggaaaggaa

SEQ ID NO: 823882 - RNA, 19 nt, Homo sapiens
gauauuagcgggagugaag

SEQ ID NO: 823883 - RNA, 19 nt, Homo sapiens
gaggucaucuguccuugug

SEQ ID NO: 823884 - RNA, 19 nt, Homo sapiens
acagaucccucucaacaau

SEQ ID NO: 823885 - RNA, 19 nt, Homo sapiens
ucacgaagaauguguuuga

SEQ ID NO: 823886 - RNA, 19 nt, Homo sapiens
cugccuacauugaguauaa

SEQ ID NO: 823887 - RNA, 19 nt, Homo sapiens
ucuccaagcucuucaagga

SEQ ID NO: 823888 - RNA, 19 nt, Homo sapiens
ggaguucgcagacacaaug

SEQ ID NO: 823889 - RNA, 19 nt, Homo sapiens
gggcagcuguggagucuuc

SEQ ID NO: 823890 - RNA, 19 nt, Homo sapiens
gcaugggcauugugaggaa

SEQ ID NO: 823891 - RNA, 19 nt, Homo sapiens
gcagacacaaugcagauga

SEQ ID NO: 823892 - RNA, 19 nt, Homo sapiens
gcacagcguacuauggauu

SEQ ID NO: 823893 - RNA, 19 nt, Homo sapiens
uaacaagcgucaugaacag

SEQ ID NO: 823894 - RNA, 19 nt, Homo sapiens
gggugaaccugucaugugu

SEQ ID NO: 823895 - RNA, 19 nt, Homo sapiens
ggugaugccuggagcuaau

SEQ ID NO: 823896 - RNA, 19 nt, Homo sapiens
gcugaaacauuaacaaacg

SEQ ID NO: 823897 - RNA, 19 nt, Homo sapiens
caaugcagaugacguugug

SEQ ID NO: 823898 - RNA, 19 nt, Homo sapiens
uaauguauguguugugaag

SEQ ID NO: 823899 - RNA, 19 nt, Homo sapiens
gccuggagcuaauguaugu

SEQ ID NO: 823900 - RNA, 19 nt, Homo sapiens
ggacguuggucaggugaug

SEQ ID NO: 823901 - RNA, 19 nt, Homo sapiens
cgaugaacggucuaaguua

SEQ ID NO: 823902 - RNA, 19 nt, Homo sapiens
guugugaaguuagaaggua

SEQ ID NO: 823903 - RNA, 19 nt, Homo sapiens
gaaaagcaguccugucgau

SEQ ID NO: 823904 - RNA, 19 nt, Homo sapiens
gacugggacugccuacauu

SEQ ID NO: 823905 - RNA, 19 nt, Homo sapiens
gaauagugacccugugaug

SEQ ID NO: 823906 - RNA, 19 nt, Homo sapiens
cagaguggcgcucguguuu

SEQ ID NO: 823907 - RNA, 19 nt, Homo sapiens
cgucuacacucucaccuau

SEQ ID NO: 823908 - RNA, 19 nt, Homo sapiens
gcagauggugucccuguga

SEQ ID NO: 823909 - RNA, 19 nt, Homo sapiens
ccgcacagccugccauuga

SEQ ID NO: 823910 - RNA, 19 nt, Homo sapiens
ucacugcgcaugcugauug

SEQ ID NO: 823911 - RNA, 19 nt, Homo sapiens
ggacugccuacauugagua

SEQ ID NO: 823912 - RNA, 19 nt, Homo sapiens
caugaaguuugucuacaga

SEQ ID NO: 823913 - RNA, 19 nt, Homo sapiens
ucuguggcauggcguguua

SEQ ID NO: 823914 - RNA, 19 nt, Homo sapiens
ggacugggacugccuacau

SEQ ID NO: 823915 - RNA, 19 nt, Homo sapiens
gaaucugccaaguacauuu

SEQ ID NO: 823916 - RNA, 19 nt, Homo sapiens
uuacagaucccucucaaca

SEQ ID NO: 823917 - RNA, 19 nt, Homo sapiens
ccaaauacaaagagaggaa

SEQ ID NO: 823918 - RNA, 19 nt, Homo sapiens
gaagauagcaagcguuuuc

SEQ ID NO: 823919 - RNA, 19 nt, Homo sapiens
ugaugaagugggagaaaua

SEQ ID NO: 823920 - RNA, 19 nt, Homo sapiens
gagcuaauguauguguugu

SEQ ID NO: 823921 - RNA, 19 nt, Homo sapiens
gcacguuauauaccgcuua

SEQ ID NO: 823922 - RNA, 19 nt, Homo sapiens
cauccucccugcucacaga

SEQ ID NO: 823923 - RNA, 19 nt, Homo sapiens
gagaaacuugagaccauuu

SEQ ID NO: 823924 - RNA, 19 nt, Homo sapiens
caacuggcacagcguacua

SEQ ID NO: 823925 - RNA, 19 nt, Homo sapiens
gaagcugaaacauuaacaa

SEQ ID NO: 823926 - RNA, 19 nt, Homo sapiens
aaacugacaaguaagaaug

SEQ ID NO: 823927 - RNA, 19 nt, Homo sapiens
gcggcacgaugcacuguau

SEQ ID NO: 823928 - RNA, 19 nt, Homo sapiens
gaauguguuugaggcaguu

SEQ ID NO: 823929 - RNA, 19 nt, Homo sapiens
gaaauaugcgucaguucca

SEQ ID NO: 823930 - RNA, 19 nt, Homo sapiens
ccauagaagugccauuaac

SEQ ID NO: 823931 - RNA, 19 nt, Homo sapiens
guucuguccuugugcauuc

SEQ ID NO: 823932 - RNA, 19 nt, Homo sapiens
ccagcugccucacuucugu

SEQ ID NO: 823933 - RNA, 19 nt, Homo sapiens
uuagaaagcacuuccugaa

SEQ ID NO: 823934 - RNA, 19 nt, Homo sapiens
aagcaguccugucgaugaa

SEQ ID NO: 823935 - RNA, 19 nt, Homo sapiens
gagacguucuguccuugug

SEQ ID NO: 823936 - RNA, 19 nt, Homo sapiens
acuuaaaccuggagacaga

SEQ ID NO: 823937 - RNA, 19 nt, Homo sapiens
cugggaagauagcagagua

SEQ ID NO: 823938 - RNA, 19 nt, Homo sapiens
ucggagggauucacauuuc

SEQ ID NO: 823939 - RNA, 19 nt, Homo sapiens
gaggcaggaucgcuguguu

SEQ ID NO: 823940 - RNA, 19 nt, Homo sapiens
ccacagacgcuugucagaa

SEQ ID NO: 823941 - RNA, 19 nt, Homo sapiens
guuguucucugcuguacug

SEQ ID NO: 823942 - RNA, 19 nt, Homo sapiens
cgacagauccagaauauua

SEQ ID NO: 823943 - RNA, 19 nt, Homo sapiens
caacaaaugcuuccagaua

SEQ ID NO: 823944 - RNA, 19 nt, Homo sapiens
ggaauugguuucagucaaa

SEQ ID NO: 823945 - RNA, 19 nt, Homo sapiens
aaacagugcucucaaagaa

SEQ ID NO: 823946 - RNA, 19 nt, Homo sapiens
aagcaaaguuggaugaaua

SEQ ID NO: 823947 - RNA, 19 nt, Homo sapiens
uagcaagucuggugaaauu

SEQ ID NO: 823948 - RNA, 19 nt, Homo sapiens
gaacaaaucagugguacaa

SEQ ID NO: 823949 - RNA, 19 nt, Homo sapiens
ggaagaagacgaggacuaa

SEQ ID NO: 823950 - RNA, 19 nt, Homo sapiens
gacaaacagugcucucaaa

SEQ ID NO: 823951 - RNA, 19 nt, Homo sapiens
gagcgaggaugaacuggaa

SEQ ID NO: 823952 - RNA, 19 nt, Homo sapiens
ccaauaauggccagaauaa

SEQ ID NO: 823953 - RNA, 19 nt, Homo sapiens
ggacaaucuuggcauguug

SEQ ID NO: 823954 - RNA, 19 nt, Homo sapiens
ggcagaacaugguaaagaa

SEQ ID NO: 823955 - RNA, 19 nt, Homo sapiens
aacaaaugcuuccagauaa

SEQ ID NO: 823956 - RNA, 19 nt, Homo sapiens
gaagcaaaguuggaugaau

SEQ ID NO: 823957 - RNA, 19 nt, Homo sapiens
ccauuaagaugcccgaaga

SEQ ID NO: 823958 - RNA, 19 nt, Homo sapiens
cgacgccgcuucaacauag

SEQ ID NO: 823959 - RNA, 19 nt, Homo sapiens
acaaaugcuuccagauaaa

SEQ ID NO: 823960 - RNA, 19 nt, Homo sapiens
uacaagccaucaggaaaua

SEQ ID NO: 823961 - RNA, 19 nt, Homo sapiens
ccauugacauugagguuga

SEQ ID NO: 823962 - RNA, 19 nt, Homo sapiens
gagcaagccuuuaguuuuc

SEQ ID NO: 823963 - RNA, 19 nt, Homo sapiens
uaagaugcccgaagaggaa

SEQ ID NO: 823964 - RNA, 19 nt, Homo sapiens
guaaagaagagaccaaugg

SEQ ID NO: 823965 - RNA, 19 nt, Homo sapiens
guacaagccaucaggaaau

SEQ ID NO: 823966 - RNA, 19 nt, Homo sapiens
gggacaaucuuggcauguu

SEQ ID NO: 823967 - RNA, 19 nt, Homo sapiens
acaaaucagugguacaagu

SEQ ID NO: 823968 - RNA, 19 nt, Homo sapiens
aacgacagauccagaauau

SEQ ID NO: 823969 - RNA, 19 nt, Homo sapiens
ugagacaacuagacaugga

SEQ ID NO: 823970 - RNA, 19 nt, Homo sapiens
caggaaauauggccgagau

SEQ ID NO: 823971 - RNA, 19 nt, Homo sapiens
aaacgacagauccagaaua

SEQ ID NO: 823972 - RNA, 19 nt, Homo sapiens
caaacagugcucucaaaga

SEQ ID NO: 823973 - RNA, 19 nt, Homo sapiens
caagucuggugaaauuuua

SEQ ID NO: 823974 - RNA, 19 nt, Homo sapiens
ggaggcagaacaugguaaa

SEQ ID NO: 823975 - RNA, 19 nt, Homo sapiens
gacagauccagaauauuaa

SEQ ID NO: 823976 - RNA, 19 nt, Homo sapiens
gggaggagagcgaggauga

SEQ ID NO: 823977 - RNA, 19 nt, Homo sapiens
agacgaggcuccuguucug

SEQ ID NO: 823978 - RNA, 19 nt, Homo sapiens
gacaguuccucaggucaaa

SEQ ID NO: 823979 - RNA, 19 nt, Homo sapiens
gcaagacgcagucaagaac

SEQ ID NO: 823980 - RNA, 19 nt, Homo sapiens
gaaaagucauuggcugauu

SEQ ID NO: 823981 - RNA, 19 nt, Homo sapiens
gaacaugguaaagaagaga

SEQ ID NO: 823982 - RNA, 19 nt, Homo sapiens
gaagaagacgaggacuaaa

SEQ ID NO: 823983 - RNA, 19 nt, Homo sapiens
gcugauuugcccaacuuua

SEQ ID NO: 823984 - RNA, 19 nt, Homo sapiens
uuccagaggucauucagaa

SEQ ID NO: 823985 - RNA, 19 nt, Homo sapiens
gaagauguggaggcuguuu

SEQ ID NO: 823986 - RNA, 19 nt, Homo sapiens
ggaagacgaggcuccuguu

SEQ ID NO: 823987 - RNA, 19 nt, Homo sapiens
caaaucagugguacaagug

SEQ ID NO: 823988 - RNA, 19 nt, Homo sapiens
ggagagcgaggaugaacug

SEQ ID NO: 823989 - RNA, 19 nt, Homo sapiens
ggaugaauacauugccauu

SEQ ID NO: 823990 - RNA, 19 nt, Homo sapiens
ccagaggucauucagaaau

SEQ ID NO: 823991 - RNA, 19 nt, Homo sapiens
uauagcaagucuggugaaa

SEQ ID NO: 823992 - RNA, 19 nt, Homo sapiens
agaggcaaauggaaacaau

SEQ ID NO: 823993 - RNA, 19 nt, Homo sapiens
cagaagcaaaguuggauga

SEQ ID NO: 823994 - RNA, 19 nt, Homo sapiens
gaagacgaggcuccuguuc

SEQ ID NO: 823995 - RNA, 19 nt, Homo sapiens
ggcaagacgcagucaagaa

SEQ ID NO: 823996 - RNA, 19 nt, Homo sapiens
ggaagaggcaaauggaaac

SEQ ID NO: 823997 - RNA, 19 nt, Homo sapiens
ucauagaauccaacaaaug

SEQ ID NO: 823998 - RNA, 19 nt, Homo sapiens
gcugagacaacuagacaug

SEQ ID NO: 823999 - RNA, 19 nt, Homo sapiens
ggaucgccaugcccggaaa

SEQ ID NO: 824000 - RNA, 19 nt, Homo sapiens
acauugccauugccaaaga

SEQ ID NO: 824001 - RNA, 19 nt, Homo sapiens
cagaacaugguaaagaaga

SEQ ID NO: 824002 - RNA, 19 nt, Homo sapiens
aaaacuugaugguggaaua

SEQ ID NO: 824003 - RNA, 19 nt, Homo sapiens
ucaaacgacagauccagaa

SEQ ID NO: 824004 - RNA, 19 nt, Homo sapiens
gaacuggaagaggcaaaug

SEQ ID NO: 824005 - RNA, 19 nt, Homo sapiens
cauagaauccaacaaaugc

SEQ ID NO: 824006 - RNA, 19 nt, Homo sapiens
aguggacuguggaagauaa

SEQ ID NO: 824007 - RNA, 19 nt, Homo sapiens
ugaguggacuguggaagau

SEQ ID NO: 824008 - RNA, 19 nt, Homo sapiens
aaaagucauuggcugauuu

SEQ ID NO: 824009 - RNA, 19 nt, Homo sapiens
gauccagaauauuaaacag

SEQ ID NO: 824010 - RNA, 19 nt, Homo sapiens
uggaagaggcaaauggaaa

SEQ ID NO: 824011 - RNA, 19 nt, Homo sapiens
caauaauggccagaauaaa

SEQ ID NO: 824012 - RNA, 19 nt, Homo sapiens
caaaugcuuccagauaaau

SEQ ID NO: 824013 - RNA, 19 nt, Homo sapiens
gcaagucuggugaaauuuu

SEQ ID NO: 824014 - RNA, 19 nt, Homo sapiens
ggcauaaacauaauaucga

SEQ ID NO: 824015 - RNA, 19 nt, Homo sapiens
caagccaucaggaaauaug

SEQ ID NO: 824016 - RNA, 19 nt, Homo sapiens
caaaguuggaugaauacau

SEQ ID NO: 824017 - RNA, 19 nt, Homo sapiens
gaugaauacauugccauug

SEQ ID NO: 824018 - RNA, 19 nt, Homo sapiens
uggcugauuugcccaacuu

SEQ ID NO: 824019 - RNA, 19 nt, Homo sapiens
agacgugauugggaacaaa

SEQ ID NO: 824020 - RNA, 19 nt, Homo sapiens
cguacaagccaucaggaaa

SEQ ID NO: 824021 - RNA, 19 nt, Homo sapiens
cuaccacggugcugagaca

SEQ ID NO: 824022 - RNA, 19 nt, Homo sapiens
cccaauaauggccagaaua

SEQ ID NO: 824023 - RNA, 19 nt, Homo sapiens
uaucgacgccgcuucaaca

SEQ ID NO: 824024 - RNA, 19 nt, Homo sapiens
acagugcucucaaagaaaa

SEQ ID NO: 824025 - RNA, 19 nt, Homo sapiens
uggaauugguuucagucaa

SEQ ID NO: 824026 - RNA, 19 nt, Homo sapiens
aaggaauguuucuuucuca

SEQ ID NO: 824027 - RNA, 19 nt, Homo sapiens
cgccaugcccggaaacaaa

SEQ ID NO: 824028 - RNA, 19 nt, Homo sapiens
ggacuguggaagauaaagu

SEQ ID NO: 824029 - RNA, 19 nt, Homo sapiens
gcagaacaugguaaagaag

SEQ ID NO: 824030 - RNA, 19 nt, Homo sapiens
aaucagugguacaagugaa

SEQ ID NO: 824031 - RNA, 19 nt, Homo sapiens
auagaaccauaucgacuuc

SEQ ID NO: 824032 - RNA, 19 nt, Homo sapiens
aauagaaccauaucgacuu

SEQ ID NO: 824033 - RNA, 19 nt, Homo sapiens
gucaagaacgggacaaucu

SEQ ID NO: 824034 - RNA, 19 nt, Homo sapiens
acaacuagacauggaauug

SEQ ID NO: 824035 - RNA, 19 nt, Homo sapiens
gagacaacuagacauggaa

SEQ ID NO: 824036 - RNA, 19 nt, Homo sapiens
ggaggcuguuucugccaau

SEQ ID NO: 824037 - RNA, 19 nt, Homo sapiens
aaggaaaccuccaaaagga

SEQ ID NO: 824038 - RNA, 19 nt, Homo sapiens
gaagaggcaaauggaaaca

SEQ ID NO: 824039 - RNA, 19 nt, Homo sapiens
agaccaaugggcccaguaa

SEQ ID NO: 824040 - RNA, 19 nt, Homo sapiens
gguaaagaagagaccaaug

SEQ ID NO: 824041 - RNA, 19 nt, Homo sapiens
gcacguuggacuacagaag

SEQ ID NO: 824042 - RNA, 19 nt, Homo sapiens
gaagaaagaugguaacaaa

SEQ ID NO: 824043 - RNA, 19 nt, Homo sapiens
gauaugagguucugucuga

SEQ ID NO: 824044 - RNA, 19 nt, Homo sapiens
ggagaugacuaaacugaaa

SEQ ID NO: 824045 - RNA, 19 nt, Homo sapiens
gaagggaaauaccaucaaa

SEQ ID NO: 824046 - RNA, 19 nt, Homo sapiens
ggacaucgcuguucuucug

SEQ ID NO: 824047 - RNA, 19 nt, Homo sapiens
ugacuaaacugaaacaaga

SEQ ID NO: 824048 - RNA, 19 nt, Homo sapiens
agacuuagauuuccucaaa

SEQ ID NO: 824049 - RNA, 19 nt, Homo sapiens
ggaaaugcaugaccgaugu

SEQ ID NO: 824050 - RNA, 19 nt, Homo sapiens
uaucaacucugucaugaaa

SEQ ID NO: 824051 - RNA, 19 nt, Homo sapiens
ggaaucggcucuguauuug

SEQ ID NO: 824052 - RNA, 19 nt, Homo sapiens
gacugaagcugacaaagaa

SEQ ID NO: 824053 - RNA, 19 nt, Homo sapiens
ggaaaugugugacaagagu

SEQ ID NO: 824054 - RNA, 19 nt, Homo sapiens
gaaagaugguaacaaagau

SEQ ID NO: 824055 - RNA, 19 nt, Homo sapiens
cuaaagccaugaagaacua

SEQ ID NO: 824056 - RNA, 19 nt, Homo sapiens
ggccugagcugccuaugaa

SEQ ID NO: 824057 - RNA, 19 nt, Homo sapiens
caagcucccucccuucuuu

SEQ ID NO: 824058 - RNA, 19 nt, Homo sapiens
ccacaacucccaaagcaua

SEQ ID NO: 824059 - RNA, 19 nt, Homo sapiens
guauuugccucuagagaaa

SEQ ID NO: 824060 - RNA, 19 nt, Homo sapiens
gguggaagcugccgucaug

SEQ ID NO: 824061 - RNA, 19 nt, Homo sapiens
gaucgccgcuggccucuau

SEQ ID NO: 824062 - RNA, 19 nt, Homo sapiens
ggaccuccguggaaacaaa

SEQ ID NO: 824063 - RNA, 19 nt, Homo sapiens
gaaguacagcuuagagaaa

SEQ ID NO: 824064 - RNA, 19 nt, Homo sapiens
gcacaacuccaaugcuaaa

SEQ ID NO: 824065 - RNA, 19 nt, Homo sapiens
gcaaagauaugagguucug

SEQ ID NO: 824066 - RNA, 19 nt, Homo sapiens
acacugaaguccaucauga

SEQ ID NO: 824067 - RNA, 19 nt, Homo sapiens
ugacuuugaucauugguaa

SEQ ID NO: 824068 - RNA, 19 nt, Homo sapiens
gcaacacagcccuccauua

SEQ ID NO: 824069 - RNA, 19 nt, Homo sapiens
gcaauuauuugggauauac

SEQ ID NO: 824070 - RNA, 19 nt, Homo sapiens
ugaaguccaucaugaagaa

SEQ ID NO: 824071 - RNA, 19 nt, Homo sapiens
gaagucagcgucugcgaaa

SEQ ID NO: 824072 - RNA, 19 nt, Homo sapiens
caacagugaugacaacaag

SEQ ID NO: 824073 - RNA, 19 nt, Homo sapiens
gcucacaccacaaagguua

SEQ ID NO: 824074 - RNA, 19 nt, Homo sapiens
gcuaaagguuggauugugu

SEQ ID NO: 824075 - RNA, 19 nt, Homo sapiens
ugacuggccuggaucacua

SEQ ID NO: 824076 - RNA, 19 nt, Homo sapiens
uuugagaacuugaugcaua

SEQ ID NO: 824077 - RNA, 19 nt, Homo sapiens
agagagagguaugaauuaa

SEQ ID NO: 824078 - RNA, 19 nt, Homo sapiens
gaagggcaccaugcaguua

SEQ ID NO: 824079 - RNA, 19 nt, Homo sapiens
gaagucaaguuacaucaac

SEQ ID NO: 824080 - RNA, 19 nt, Homo sapiens
gaagugccuuagacucuug

SEQ ID NO: 824081 - RNA, 19 nt, Homo sapiens
uauaugaacuugacacagu

SEQ ID NO: 824082 - RNA, 19 nt, Homo sapiens
gagguucauuugauugauu

SEQ ID NO: 824083 - RNA, 19 nt, Homo sapiens
caacacagcccuccauuac

SEQ ID NO: 824084 - RNA, 19 nt, Homo sapiens
ucaaagaagugcggucuau

SEQ ID NO: 824085 - RNA, 19 nt, Homo sapiens
cagccugaauguaagaaua

SEQ ID NO: 824086 - RNA, 19 nt, Homo sapiens
gguccucuauguauuuaaa

SEQ ID NO: 824087 - RNA, 19 nt, Homo sapiens
acacguaacaucaucauuu

SEQ ID NO: 824088 - RNA, 19 nt, Homo sapiens
ggugacagauacugaaugu

SEQ ID NO: 824089 - RNA, 19 nt, Homo sapiens
ccucagagcucagggagaa

SEQ ID NO: 824090 - RNA, 19 nt, Homo sapiens
gagaaggacaugcggauug

SEQ ID NO: 824091 - RNA, 19 nt, Homo sapiens
gaaaagauguugucugcau

SEQ ID NO: 824092 - RNA, 19 nt, Homo sapiens
ucacacuccucaagacaaa

SEQ ID NO: 824093 - RNA, 19 nt, Homo sapiens
guaugcaaauagcccuuua

SEQ ID NO: 824094 - RNA, 19 nt, Homo sapiens
cagagagagguaugaauua

SEQ ID NO: 824095 - RNA, 19 nt, Homo sapiens
ccaccgagguucauuugau

SEQ ID NO: 824096 - RNA, 19 nt, Homo sapiens
gcuguuagaugccgaugug

SEQ ID NO: 824097 - RNA, 19 nt, Homo sapiens
gaaaugcagguucaagaau

SEQ ID NO: 824098 - RNA, 19 nt, Homo sapiens
ggucuuaacuagguagaug

SEQ ID NO: 824099 - RNA, 19 nt, Homo sapiens
ucagagagagguaugaauu

SEQ ID NO: 824100 - RNA, 19 nt, Homo sapiens
ggaggucuguggaaaugug

SEQ ID NO: 824101 - RNA, 19 nt, Homo sapiens
gcaccaugcaguuaauauu

SEQ ID NO: 824102 - RNA, 19 nt, Homo sapiens
aagacaaacuugaaucuca

SEQ ID NO: 824103 - RNA, 19 nt, Homo sapiens
augaauugguggauuguua

SEQ ID NO: 824104 - RNA, 19 nt, Homo sapiens
guuaucaacuagacuuaga

SEQ ID NO: 824105 - RNA, 19 nt, Homo sapiens
gaacuacacguaacaucau

SEQ ID NO: 824106 - RNA, 19 nt, Homo sapiens
gcacugaagagcugaggaa

SEQ ID NO: 824107 - RNA, 19 nt, Homo sapiens
caaagaaauugagcugcaa

SEQ ID NO: 824108 - RNA, 19 nt, Homo sapiens
gcacgcagaggauaaagga

SEQ ID NO: 824109 - RNA, 19 nt, Homo sapiens
cacguaacaucaucauuug

SEQ ID NO: 824110 - RNA, 19 nt, Homo sapiens
gggacuacauagcugcuuu

SEQ ID NO: 824111 - RNA, 19 nt, Homo sapiens
ggaggaggaugaagacacu

SEQ ID NO: 824112 - RNA, 19 nt, Homo sapiens
agaaagaugguaacaaaga

SEQ ID NO: 824113 - RNA, 19 nt, Homo sapiens
ugacugaagcugacaaaga

SEQ ID NO: 824114 - RNA, 19 nt, Homo sapiens
cuuagacucuugccauauu

SEQ ID NO: 824115 - RNA, 19 nt, Homo sapiens
gauuccagcucagaugaaa

SEQ ID NO: 824116 - RNA, 19 nt, Homo sapiens
acacuugucuaagcacuuu

SEQ ID NO: 824117 - RNA, 19 nt, Homo sapiens
ccuaugaauugguggauug

SEQ ID NO: 824118 - RNA, 19 nt, Homo sapiens
caucaacuccaaucucaaa

SEQ ID NO: 824119 - RNA, 19 nt, Homo sapiens
cguaacaucaucauuugua

SEQ ID NO: 824120 - RNA, 19 nt, Homo sapiens
guaugcccaugucaacuuu

SEQ ID NO: 824121 - RNA, 19 nt, Homo sapiens
agagagguaugaauuaagu

SEQ ID NO: 824122 - RNA, 19 nt, Homo sapiens
aaaugcagguucaagaaug

SEQ ID NO: 824123 - RNA, 19 nt, Homo sapiens
caucagcugugaagaccaa

SEQ ID NO: 824124 - RNA, 19 nt, Homo sapiens
gagaaggccgugucaagga

SEQ ID NO: 824125 - RNA, 19 nt, Homo sapiens
aagcauaaccuucauguca

SEQ ID NO: 824126 - RNA, 19 nt, Homo sapiens
gccuuagacucuugccaua

SEQ ID NO: 824127 - RNA, 19 nt, Homo sapiens
caacuccaaugcuaaaggu

SEQ ID NO: 824128 - RNA, 19 nt, Homo sapiens
gcaugcaacuuacugaaaa

SEQ ID NO: 824129 - RNA, 19 nt, Homo sapiens
ucaacuagacuuagauuuc

SEQ ID NO: 824130 - RNA, 19 nt, Homo sapiens
gaaaucagagagagguaug

SEQ ID NO: 824131 - RNA, 19 nt, Homo sapiens
ugaagaagaaagaugguaa

SEQ ID NO: 824132 - RNA, 19 nt, Homo sapiens
agacacugcuggcugagaa

SEQ ID NO: 824133 - RNA, 19 nt, Homo sapiens
uugcacaacuccaaugcua

SEQ ID NO: 824134 - RNA, 19 nt, Homo sapiens
aggaaucggcucuguauuu

SEQ ID NO: 824135 - RNA, 19 nt, Homo sapiens
caccgagguucauuugauu

SEQ ID NO: 824136 - RNA, 19 nt, Homo sapiens
ugaaugccuuugagaacuu

SEQ ID NO: 824137 - RNA, 19 nt, Homo sapiens
gguacgcugucuccaguga

SEQ ID NO: 824138 - RNA, 19 nt, Homo sapiens
cgagacggccacccucaua

SEQ ID NO: 824139 - RNA, 19 nt, Homo sapiens
uggaacaggugcaccaguu

SEQ ID NO: 824140 - RNA, 19 nt, Homo sapiens
gcugggaggucuguggaaa

SEQ ID NO: 824141 - RNA, 19 nt, Homo sapiens
uacaucaacuccaaucuca

SEQ ID NO: 824142 - RNA, 19 nt, Homo sapiens
gaagaaagaugguaacaaa

SEQ ID NO: 824143 - RNA, 19 nt, Homo sapiens
gauaugagguucugucuga

SEQ ID NO: 824144 - RNA, 19 nt, Homo sapiens
ggagaugacuaaacugaaa

SEQ ID NO: 824145 - RNA, 19 nt, Homo sapiens
gaagggaaauaccaucaaa

SEQ ID NO: 824146 - RNA, 19 nt, Homo sapiens
ggacaucgcuguucuucug

SEQ ID NO: 824147 - RNA, 19 nt, Homo sapiens
ugacuaaacugaaacaaga

SEQ ID NO: 824148 - RNA, 19 nt, Homo sapiens
agacuuagauuuccucaaa

SEQ ID NO: 824149 - RNA, 19 nt, Homo sapiens
ggaaaugcaugaccgaugu

SEQ ID NO: 824150 - RNA, 19 nt, Homo sapiens
uaucaacucugucaugaaa

SEQ ID NO: 824151 - RNA, 19 nt, Homo sapiens
ggaaucggcucuguauuug

SEQ ID NO: 824152 - RNA, 19 nt, Homo sapiens
gacugaagcugacaaagaa

SEQ ID NO: 824153 - RNA, 19 nt, Homo sapiens
ggaaaugugugacaagagu

SEQ ID NO: 824154 - RNA, 19 nt, Homo sapiens
gaaagaugguaacaaagau

SEQ ID NO: 824155 - RNA, 19 nt, Homo sapiens
cuaaagccaugaagaacua

SEQ ID NO: 824156 - RNA, 19 nt, Homo sapiens
ggccugagcugccuaugaa

SEQ ID NO: 824157 - RNA, 19 nt, Homo sapiens
caagcucccucccuucuuu

SEQ ID NO: 824158 - RNA, 19 nt, Homo sapiens
ccacaacucccaaagcaua

SEQ ID NO: 824159 - RNA, 19 nt, Homo sapiens
guauuugccucuagagaaa

SEQ ID NO: 824160 - RNA, 19 nt, Homo sapiens
gguggaagcugccgucaug

SEQ ID NO: 824161 - RNA, 19 nt, Homo sapiens
gaucgccgcuggccucuau

SEQ ID NO: 824162 - RNA, 19 nt, Homo sapiens
ggaccuccguggaaacaaa

SEQ ID NO: 824163 - RNA, 19 nt, Homo sapiens
gaaguacagcuuagagaaa

SEQ ID NO: 824164 - RNA, 19 nt, Homo sapiens
gcacaacuccaaugcuaaa

SEQ ID NO: 824165 - RNA, 19 nt, Homo sapiens
gcaaagauaugagguucug

SEQ ID NO: 824166 - RNA, 19 nt, Homo sapiens
acacugaaguccaucauga

SEQ ID NO: 824167 - RNA, 19 nt, Homo sapiens
ugacuuugaucauugguaa

SEQ ID NO: 824168 - RNA, 19 nt, Homo sapiens
gcaacacagcccuccauua

SEQ ID NO: 824169 - RNA, 19 nt, Homo sapiens
gcaauuauuugggauauac

SEQ ID NO: 824170 - RNA, 19 nt, Homo sapiens
ugaaguccaucaugaagaa

SEQ ID NO: 824171 - RNA, 19 nt, Homo sapiens
gaagucagcgucugcgaaa

SEQ ID NO: 824172 - RNA, 19 nt, Homo sapiens
caacagugaugacaacaag

SEQ ID NO: 824173 - RNA, 19 nt, Homo sapiens
gcuaaagguuggauugugu

SEQ ID NO: 824174 - RNA, 19 nt, Homo sapiens
ugacuggccuggaucacua

SEQ ID NO: 824175 - RNA, 19 nt, Homo sapiens
agagagagguaugaauuaa

SEQ ID NO: 824176 - RNA, 19 nt, Homo sapiens
gaagggcaccaugcaguua

SEQ ID NO: 824177 - RNA, 19 nt, Homo sapiens
gaagucaaguuacaucaac

SEQ ID NO: 824178 - RNA, 19 nt, Homo sapiens
gaagugccuuagacucuug

SEQ ID NO: 824179 - RNA, 19 nt, Homo sapiens
uauaugaacuugacacagu

SEQ ID NO: 824180 - RNA, 19 nt, Homo sapiens
gagguucauuugauugauu

SEQ ID NO: 824181 - RNA, 19 nt, Homo sapiens
caacacagcccuccauuac

SEQ ID NO: 824182 - RNA, 19 nt, Homo sapiens
ucaaagaagugcggucuau

SEQ ID NO: 824183 - RNA, 19 nt, Homo sapiens
cagccugaauguaagaaua

SEQ ID NO: 824184 - RNA, 19 nt, Homo sapiens
gguccucuauguauuuaaa

SEQ ID NO: 824185 - RNA, 19 nt, Homo sapiens
acacguaacaucaucauuu

SEQ ID NO: 824186 - RNA, 19 nt, Homo sapiens
ggugacagauacugaaugu

SEQ ID NO: 824187 - RNA, 19 nt, Homo sapiens
ccucagagcucagggagaa

SEQ ID NO: 824188 - RNA, 19 nt, Homo sapiens
gagaaggacaugcggauug

SEQ ID NO: 824189 - RNA, 19 nt, Homo sapiens
gaaaagauguugucugcau

SEQ ID NO: 824190 - RNA, 19 nt, Homo sapiens
ucacacuccucaagacaaa

SEQ ID NO: 824191 - RNA, 19 nt, Homo sapiens
guaugcaaauagcccuuua

SEQ ID NO: 824192 - RNA, 19 nt, Homo sapiens
cagagagagguaugaauua

SEQ ID NO: 824193 - RNA, 19 nt, Homo sapiens
gcaaagcgggagugaagaa

SEQ ID NO: 824194 - RNA, 19 nt, Homo sapiens
ccaccgagguucauuugau

SEQ ID NO: 824195 - RNA, 19 nt, Homo sapiens
gcuguuagaugccgaugug

SEQ ID NO: 824196 - RNA, 19 nt, Homo sapiens
gaaaugcagguucaagaau

SEQ ID NO: 824197 - RNA, 19 nt, Homo sapiens
ggucuuaacuagguagaug

SEQ ID NO: 824198 - RNA, 19 nt, Homo sapiens
ucagagagagguaugaauu

SEQ ID NO: 824199 - RNA, 19 nt, Homo sapiens
gaacacacauuuucagaag

SEQ ID NO: 824200 - RNA, 19 nt, Homo sapiens
gagugaagaacacacauuu

SEQ ID NO: 824201 - RNA, 19 nt, Homo sapiens
ggaggucuguggaaaugug

SEQ ID NO: 824202 - RNA, 19 nt, Homo sapiens
gcaccaugcaguuaauauu

SEQ ID NO: 824203 - RNA, 19 nt, Homo sapiens
aagacaaacuugaaucuca

SEQ ID NO: 824204 - RNA, 19 nt, Homo sapiens
augaauugguggauuguua

SEQ ID NO: 824205 - RNA, 19 nt, Homo sapiens
guuaucaacuagacuuaga

SEQ ID NO: 824206 - RNA, 19 nt, Homo sapiens
gaacuacacguaacaucau

SEQ ID NO: 824207 - RNA, 19 nt, Homo sapiens
gcacugaagagcugaggaa

SEQ ID NO: 824208 - RNA, 19 nt, Homo sapiens
caaagaaauugagcugcaa

SEQ ID NO: 824209 - RNA, 19 nt, Homo sapiens
gcacgcagaggauaaagga

SEQ ID NO: 824210 - RNA, 19 nt, Homo sapiens
cacguaacaucaucauuug

SEQ ID NO: 824211 - RNA, 19 nt, Homo sapiens
gggacuacauagcugcuuu

SEQ ID NO: 824212 - RNA, 19 nt, Homo sapiens
ggaggaggaugaagacacu

SEQ ID NO: 824213 - RNA, 19 nt, Homo sapiens
agaaagaugguaacaaaga

SEQ ID NO: 824214 - RNA, 19 nt, Homo sapiens
ugacugaagcugacaaaga

SEQ ID NO: 824215 - RNA, 19 nt, Homo sapiens
cuuagacucuugccauauu

SEQ ID NO: 824216 - RNA, 19 nt, Homo sapiens
gauuccagcucagaugaaa

SEQ ID NO: 824217 - RNA, 19 nt, Homo sapiens
acacuugucuaagcacuuu

SEQ ID NO: 824218 - RNA, 19 nt, Homo sapiens
ccuaugaauugguggauug

SEQ ID NO: 824219 - RNA, 19 nt, Homo sapiens
caucaacuccaaucucaaa

SEQ ID NO: 824220 - RNA, 19 nt, Homo sapiens
cguaacaucaucauuugua

SEQ ID NO: 824221 - RNA, 19 nt, Homo sapiens
guaugcccaugucaacuuu

SEQ ID NO: 824222 - RNA, 19 nt, Homo sapiens
agagagguaugaauuaagu

SEQ ID NO: 824223 - RNA, 19 nt, Homo sapiens
aaaugcagguucaagaaug

SEQ ID NO: 824224 - RNA, 19 nt, Homo sapiens
caucagcugugaagaccaa

SEQ ID NO: 824225 - RNA, 19 nt, Homo sapiens
gagaaggccgugucaagga

SEQ ID NO: 824226 - RNA, 19 nt, Homo sapiens
aagcauaaccuucauguca

SEQ ID NO: 824227 - RNA, 19 nt, Homo sapiens
agauaccgguuuccuguuu

SEQ ID NO: 824228 - RNA, 19 nt, Homo sapiens
gccuuagacucuugccaua

SEQ ID NO: 824229 - RNA, 19 nt, Homo sapiens
caacuccaaugcuaaaggu

SEQ ID NO: 824230 - RNA, 19 nt, Homo sapiens
gcaugcaacuuacugaaaa

SEQ ID NO: 824231 - RNA, 19 nt, Homo sapiens
gaaaucagagagagguaug

SEQ ID NO: 824232 - RNA, 19 nt, Homo sapiens
ugaagaagaaagaugguaa

SEQ ID NO: 824233 - RNA, 19 nt, Homo sapiens
agacacugcuggcugagaa

SEQ ID NO: 824234 - RNA, 19 nt, Homo sapiens
ucaacuagacuuagauuuc

SEQ ID NO: 824235 - RNA, 19 nt, Homo sapiens
uugcacaacuccaaugcua

SEQ ID NO: 824236 - RNA, 19 nt, Homo sapiens
aggaaucggcucuguauuu

SEQ ID NO: 824237 - RNA, 19 nt, Homo sapiens
caccgagguucauuugauu

SEQ ID NO: 824238 - RNA, 19 nt, Homo sapiens
gguacgcugucuccaguga

SEQ ID NO: 824239 - RNA, 19 nt, Homo sapiens
cgagacggccacccucaua

SEQ ID NO: 824240 - RNA, 19 nt, Homo sapiens
uggaacaggugcaccaguu

SEQ ID NO: 824241 - RNA, 19 nt, Homo sapiens
gcugggaggucuguggaaa

SEQ ID NO: 824242 - RNA, 19 nt, Homo sapiens
gaaaguagcuggcgagguu

SEQ ID NO: 824243 - RNA, 19 nt, Homo sapiens
gaacagugcuuuauccauu

SEQ ID NO: 824244 - RNA, 19 nt, Homo sapiens
gaggagaaaugguacaaua

SEQ ID NO: 824245 - RNA, 19 nt, Homo sapiens
gcaagcaucucauuuaaau

SEQ ID NO: 824246 - RNA, 19 nt, Homo sapiens
caaaguaacugguauguca

SEQ ID NO: 824247 - RNA, 19 nt, Homo sapiens
gaacagagagaaauuaaga

SEQ ID NO: 824248 - RNA, 19 nt, Homo sapiens
gaaagaaaucacaccauua

SEQ ID NO: 824249 - RNA, 19 nt, Homo sapiens
gaagugggacugcuuuaua

SEQ ID NO: 824250 - RNA, 19 nt, Homo sapiens
gagcaucuguuaaguguug

SEQ ID NO: 824251 - RNA, 19 nt, Homo sapiens
gguaaagacauacucauua

SEQ ID NO: 824252 - RNA, 19 nt, Homo sapiens
ggagaccgcuaaacuaaug

SEQ ID NO: 824253 - RNA, 19 nt, Homo sapiens
gaagaacagagagaaauua

SEQ ID NO: 824254 - RNA, 19 nt, Homo sapiens
gagaaaugguacaauacua

SEQ ID NO: 824255 - RNA, 19 nt, Homo sapiens
ggagggaauuuaccaaaga

SEQ ID NO: 824256 - RNA, 19 nt, Homo sapiens
guacuauucuccagaggua

SEQ ID NO: 824257 - RNA, 19 nt, Homo sapiens
cagcaagcaucucauuuaa

SEQ ID NO: 824258 - RNA, 19 nt, Homo sapiens
uccaucagcuucuuauuua

SEQ ID NO: 824259 - RNA, 19 nt, Homo sapiens
ggaaagaaacagagagaaa

SEQ ID NO: 824260 - RNA, 19 nt, Homo sapiens
caacuugguuuaacauguu

SEQ ID NO: 824261 - RNA, 19 nt, Homo sapiens
ucacaaaucuauccuguag

SEQ ID NO: 824262 - RNA, 19 nt, Homo sapiens
ggugugacccuacuaauaa

SEQ ID NO: 824263 - RNA, 19 nt, Homo sapiens
agaaagaaaucacaccauu

SEQ ID NO: 824264 - RNA, 19 nt, Homo sapiens
gguccuaugucucugauuu

SEQ ID NO: 824265 - RNA, 19 nt, Homo sapiens
gaucucagcuuugcaaaca

SEQ ID NO: 824266 - RNA, 19 nt, Homo sapiens
gcaugugacuugucuccua

SEQ ID NO: 824267 - RNA, 19 nt, Homo sapiens
caacagauguagugugaca

SEQ ID NO: 824268 - RNA, 19 nt, Homo sapiens
ccagcaagcaucucauuua

SEQ ID NO: 824269 - RNA, 19 nt, Homo sapiens
gcagugauauuauuuccau

SEQ ID NO: 824270 - RNA, 19 nt, Homo sapiens
ccaacuaaaugccuucuau

SEQ ID NO: 824271 - RNA, 19 nt, Homo sapiens
gaugaacagucuacacaga

SEQ ID NO: 824272 - RNA, 19 nt, Homo sapiens
gcuagguccuugcuuauau

SEQ ID NO: 824273 - RNA, 19 nt, Homo sapiens
gaaagaagcacuguugcaa

SEQ ID NO: 824274 - RNA, 19 nt, Homo sapiens
caaagcugcugccuugcua

SEQ ID NO: 824275 - RNA, 19 nt, Homo sapiens
agagagaaauuaagaagga

SEQ ID NO: 824276 - RNA, 19 nt, Homo sapiens
gguuuaacauguuuacuga

SEQ ID NO: 824277 - RNA, 19 nt, Homo sapiens
gauguagugugacaaguau

SEQ ID NO: 824278 - RNA, 19 nt, Homo sapiens
ggaagaacagagagaaauu

SEQ ID NO: 824279 - RNA, 19 nt, Homo sapiens
gaaaugcagagcuuuguga

SEQ ID NO: 824280 - RNA, 19 nt, Homo sapiens
gcagcaggauccagagcua

SEQ ID NO: 824281 - RNA, 19 nt, Homo sapiens
guaaugggaggaagaaauu

SEQ ID NO: 824282 - RNA, 19 nt, Homo sapiens
gaagcacuguugcaagaau

SEQ ID NO: 824283 - RNA, 19 nt, Homo sapiens
gaagaaaggagagaagaga

SEQ ID NO: 824284 - RNA, 19 nt, Homo sapiens
gaagguguuuaacucagaa

SEQ ID NO: 824285 - RNA, 19 nt, Homo sapiens
ccugaugguucuuccuuua

SEQ ID NO: 824286 - RNA, 19 nt, Homo sapiens
ggaagaugauaaaguuaca

SEQ ID NO: 824287 - RNA, 19 nt, Homo sapiens
caacuaaaugccuucuaua

SEQ ID NO: 824288 - RNA, 19 nt, Homo sapiens
gaacuggaaaccaacuaaa

SEQ ID NO: 824289 - RNA, 19 nt, Homo sapiens
gcagacaaucuuuagguaa

SEQ ID NO: 824290 - RNA, 19 nt, Homo sapiens
uccaguagcuucuucuaaa

SEQ ID NO: 824291 - RNA, 19 nt, Homo sapiens
guuaaggccuuuguucuug

SEQ ID NO: 824292 - RNA, 19 nt, Homo sapiens
gagggaauuuaccaaagaa

SEQ ID NO: 824293 - RNA, 19 nt, Homo sapiens
acaaaucuauccuguagug

SEQ ID NO: 824294 - RNA, 19 nt, Homo sapiens
ggaccuagaguaccuauag

SEQ ID NO: 824295 - RNA, 19 nt, Homo sapiens
gaaauuccacucaacagau

SEQ ID NO: 824296 - RNA, 19 nt, Homo sapiens
aaacaacacuuggaaugga

SEQ ID NO: 824297 - RNA, 19 nt, Homo sapiens
aagaagcacuguugcaaga

SEQ ID NO: 824298 - RNA, 19 nt, Homo sapiens
cgacagaugcauuugcuaa

SEQ ID NO: 824299 - RNA, 19 nt, Homo sapiens
cagagcaaacuuucuauuu

SEQ ID NO: 824300 - RNA, 19 nt, Homo sapiens
gauuaaggacucaagauga

SEQ ID NO: 824301 - RNA, 19 nt, Homo sapiens
ccgcuaaacuaaugauguu

SEQ ID NO: 824302 - RNA, 19 nt, Homo sapiens
gaaagaaacagagagaaag

SEQ ID NO: 824303 - RNA, 19 nt, Homo sapiens
ggagacauuuggaccuugu

SEQ ID NO: 824304 - RNA, 19 nt, Homo sapiens
gaaguuacuggauuuggaa

SEQ ID NO: 824305 - RNA, 19 nt, Homo sapiens
aaagaaugcuggaggaaag

SEQ ID NO: 824306 - RNA, 19 nt, Homo sapiens
aaacaucaguagcaaaugg

SEQ ID NO: 824307 - RNA, 19 nt, Homo sapiens
guaauagcaggaaguguuu

SEQ ID NO: 824308 - RNA, 19 nt, Homo sapiens
gcaucacuuuguuugcaua

SEQ ID NO: 824309 - RNA, 19 nt, Homo sapiens
uaacuagccacucagauga

SEQ ID NO: 824310 - RNA, 19 nt, Homo sapiens
guggagaccgcuaaacuaa

SEQ ID NO: 824311 - RNA, 19 nt, Homo sapiens
uagaguaccuauaggacaa

SEQ ID NO: 824312 - RNA, 19 nt, Homo sapiens
caugugacuugucuccuaa

SEQ ID NO: 824313 - RNA, 19 nt, Homo sapiens
ucugcuagguccuugcuua

SEQ ID NO: 824314 - RNA, 19 nt, Homo sapiens
aaagacaaaggaagaagua

SEQ ID NO: 824315 - RNA, 19 nt, Homo sapiens
ggacauacggaaagacugu

SEQ ID NO: 824316 - RNA, 19 nt, Homo sapiens
gcauaaaguauacgguuug

SEQ ID NO: 824317 - RNA, 19 nt, Homo sapiens
gcgcuucggugguacuguu

SEQ ID NO: 824318 - RNA, 19 nt, Homo sapiens
caaacuuucagcagugaua

SEQ ID NO: 824319 - RNA, 19 nt, Homo sapiens
ggagaagugggacugcuuu

SEQ ID NO: 824320 - RNA, 19 nt, Homo sapiens
ucaagaugauggugaagau

SEQ ID NO: 824321 - RNA, 19 nt, Homo sapiens
gaagaggcaaggcaguuug

SEQ ID NO: 824322 - RNA, 19 nt, Homo sapiens
aaacagagagaaagcagaa

SEQ ID NO: 824323 - RNA, 19 nt, Homo sapiens
gagagaaauuaagaaggaa

SEQ ID NO: 824324 - RNA, 19 nt, Homo sapiens
ucagaaaguucagugucua

SEQ ID NO: 824325 - RNA, 19 nt, Homo sapiens
ggaaguguuucugcagaug

SEQ ID NO: 824326 - RNA, 19 nt, Homo sapiens
gcaaacacauuuucuacau

SEQ ID NO: 824327 - RNA, 19 nt, Homo sapiens
caaguugggaagaugauaa

SEQ ID NO: 824328 - RNA, 19 nt, Homo sapiens
ccaguagcuucuucuaaau

SEQ ID NO: 824329 - RNA, 19 nt, Homo sapiens
guaaagacaggaaauaacu

SEQ ID NO: 824330 - RNA, 19 nt, Homo sapiens
caacuggucuauaaaaugu

SEQ ID NO: 824331 - RNA, 19 nt, Homo sapiens
guucuuccuuuacaaauca

SEQ ID NO: 824332 - RNA, 19 nt, Homo sapiens
ccauccaguuucuuuauug

SEQ ID NO: 824333 - RNA, 19 nt, Homo sapiens
ugacaguguuggcaaggaa

SEQ ID NO: 824334 - RNA, 19 nt, Homo sapiens
gagaagugggacugcuuua

SEQ ID NO: 824335 - RNA, 19 nt, Homo sapiens
gaaaacaacacuuggaaug

SEQ ID NO: 824336 - RNA, 19 nt, Homo sapiens
ggaauuuaccaaagaagau

SEQ ID NO: 824337 - RNA, 19 nt, Homo sapiens
uugggaagaugauaaaguu

SEQ ID NO: 824338 - RNA, 19 nt, Homo sapiens
gaggaaagaaacagagaga

SEQ ID NO: 824339 - RNA, 19 nt, Homo sapiens
gauacaaagucagauacug

SEQ ID NO: 824340 - RNA, 19 nt, Homo sapiens
cauguuacuuuauccguau

SEQ ID NO: 824341 - RNA, 19 nt, Homo sapiens
cucaacagauguaguguga

SEQ ID NO: 824342 - RNA, 19 nt, Homo sapiens
aaauagaacuggcaagaua

SEQ ID NO: 824343 - RNA, 19 nt, Homo sapiens
uuaaaucccuugccaguua

SEQ ID NO: 824344 - RNA, 19 nt, Homo sapiens
gcaaauucaucaacauguu

SEQ ID NO: 824345 - RNA, 19 nt, Homo sapiens
gauuugaccuccauaguug

SEQ ID NO: 824346 - RNA, 19 nt, Homo sapiens
gcacucagcuuuacauggu

SEQ ID NO: 824347 - RNA, 19 nt, Homo sapiens
ggagagacuugaugccaaa

SEQ ID NO: 824348 - RNA, 19 nt, Homo sapiens
gagcagagccugucuuuag

SEQ ID NO: 824349 - RNA, 19 nt, Homo sapiens
ggagagaauucgcaaguuc

SEQ ID NO: 824350 - RNA, 19 nt, Homo sapiens
gaagagcuccuggcagaua

SEQ ID NO: 824351 - RNA, 19 nt, Homo sapiens
ccagaaacaugauggcaaa

SEQ ID NO: 824352 - RNA, 19 nt, Homo sapiens
ugaaggacaucguggagua

SEQ ID NO: 824353 - RNA, 19 nt, Homo sapiens
gaaaauaaaucucgaugga

SEQ ID NO: 824354 - RNA, 19 nt, Homo sapiens
ccaagaauaugcugucaug

SEQ ID NO: 824355 - RNA, 19 nt, Homo sapiens
uaggaacucuugagaauau

SEQ ID NO: 824356 - RNA, 19 nt, Homo sapiens
gaaacaugauggcaaagau

SEQ ID NO: 824357 - RNA, 19 nt, Homo sapiens
ccagauauuugccuauuau

SEQ ID NO: 824358 - RNA, 19 nt, Homo sapiens
caagagcggcuucgacaua

SEQ ID NO: 824359 - RNA, 19 nt, Homo sapiens
cgacagcgcugaagaguac

SEQ ID NO: 824360 - RNA, 19 nt, Homo sapiens
ggacgaguguguggaguuu

SEQ ID NO: 824361 - RNA, 19 nt, Homo sapiens
ucugggagcucaacuauga

SEQ ID NO: 824362 - RNA, 19 nt, Homo sapiens
gaguacggcucuccuggua

SEQ ID NO: 824363 - RNA, 19 nt, Homo sapiens
caagcuagcagaccagaua

SEQ ID NO: 824364 - RNA, 19 nt, Homo sapiens
ggcaugagcccuucaauga

SEQ ID NO: 824365 - RNA, 19 nt, Homo sapiens
gacaucagaucgaaagguu

SEQ ID NO: 824366 - RNA, 19 nt, Homo sapiens
gagaacaggauguauuuga

SEQ ID NO: 824367 - RNA, 19 nt, Homo sapiens
gaacuggcaagauauauca

SEQ ID NO: 824368 - RNA, 19 nt, Homo sapiens
cuucuacacucacuugaua

SEQ ID NO: 824369 - RNA, 19 nt, Homo sapiens
gaucgaaagguuauagaaa

SEQ ID NO: 824370 - RNA, 19 nt, Homo sapiens
gaccagauauuugccuauu

SEQ ID NO: 824371 - RNA, 19 nt, Homo sapiens
gcaaauagaacuggcaaga

SEQ ID NO: 824372 - RNA, 19 nt, Homo sapiens
ggagaaguuugcccuagug

SEQ ID NO: 824373 - RNA, 19 nt, Homo sapiens
ggaggagggccaagaauau

SEQ ID NO: 824374 - RNA, 19 nt, Homo sapiens
uggcaaagaugagauuauu

SEQ ID NO: 824375 - RNA, 19 nt, Homo sapiens
gcacaauccugcaguacgu

SEQ ID NO: 824376 - RNA, 19 nt, Homo sapiens
uuacuggcaucgcaagaua

SEQ ID NO: 824377 - RNA, 19 nt, Homo sapiens
aagaaaaccuugagaagua

SEQ ID NO: 824378 - RNA, 19 nt, Homo sapiens
gaaacuuaauaccagcaaa

SEQ ID NO: 824379 - RNA, 19 nt, Homo sapiens
gaauauuggcugcugauug

SEQ ID NO: 824380 - RNA, 19 nt, Homo sapiens
gauaaacgguuacgaucag

SEQ ID NO: 824381 - RNA, 19 nt, Homo sapiens
gaguggaaaucuacgagaa

SEQ ID NO: 824382 - RNA, 19 nt, Homo sapiens
ggagugccaugcaguuugu

SEQ ID NO: 824383 - RNA, 19 nt, Homo sapiens
aauauuggcugcugauugu

SEQ ID NO: 824384 - RNA, 19 nt, Homo sapiens
ucccacaggugaaauguaa

SEQ ID NO: 824385 - RNA, 19 nt, Homo sapiens
gaucagaaugcaagaauca

SEQ ID NO: 824386 - RNA, 19 nt, Homo sapiens
gauccaaggcuuugaacuu

SEQ ID NO: 824387 - RNA, 19 nt, Homo sapiens
gagauaagcagccuaaugc

SEQ ID NO: 824388 - RNA, 19 nt, Homo sapiens
gcgauuggacgauuugaaa

SEQ ID NO: 824389 - RNA, 19 nt, Homo sapiens
gaccacaugcgcuucauuu

SEQ ID NO: 824390 - RNA, 19 nt, Homo sapiens
caaaagugguuccaagaaa

SEQ ID NO: 824391 - RNA, 19 nt, Homo sapiens
guacggcucuccugguauc

SEQ ID NO: 824392 - RNA, 19 nt, Homo sapiens
gcagaucaauagaccucaa

SEQ ID NO: 824393 - RNA, 19 nt, Homo sapiens
gcuagcagaccagauauuu

SEQ ID NO: 824394 - RNA, 19 nt, Homo sapiens
aaucuaacgugacaucaga

SEQ ID NO: 824395 - RNA, 19 nt, Homo sapiens
gcugcuggguucauucauu

SEQ ID NO: 824396 - RNA, 19 nt, Homo sapiens
gccaucacguuccuacaaa

SEQ ID NO: 824397 - RNA, 19 nt, Homo sapiens
acacugggcuggcuguaug

SEQ ID NO: 824398 - RNA, 19 nt, Homo sapiens
gcacgccaguggagcaugu

SEQ ID NO: 824399 - RNA, 19 nt, Homo sapiens
gcgagcagaugauccagau

SEQ ID NO: 824400 - RNA, 19 nt, Homo sapiens
ucaacaagcaguuccugua

SEQ ID NO: 824401 - RNA, 19 nt, Homo sapiens
agccaaauuucaacacuaa

SEQ ID NO: 824402 - RNA, 19 nt, Homo sapiens
gaagaugguggagagaauu

SEQ ID NO: 824403 - RNA, 19 nt, Homo sapiens
aaagagauaagcagccuaa

SEQ ID NO: 824404 - RNA, 19 nt, Homo sapiens
cagccaaauuucaacacua

SEQ ID NO: 824405 - RNA, 19 nt, Homo sapiens
cagcagccauguauaaguc

SEQ ID NO: 824406 - RNA, 19 nt, Homo sapiens
ggcaggccaucaagaagaa

SEQ ID NO: 824407 - RNA, 19 nt, Homo sapiens
ucaggaagaccguguguga

SEQ ID NO: 824408 - RNA, 19 nt, Homo sapiens
gaaacacaugcuucucaaa

SEQ ID NO: 824409 - RNA, 19 nt, Homo sapiens
caucuugucccacugauug

SEQ ID NO: 824410 - RNA, 19 nt, Homo sapiens
uggaggagcugcugaaggu

SEQ ID NO: 824411 - RNA, 19 nt, Homo sapiens
ucauguacuuccagagaaa

SEQ ID NO: 824412 - RNA, 19 nt, Homo sapiens
ggcaaagaugagauuauua

SEQ ID NO: 824413 - RNA, 19 nt, Homo sapiens
gcaauggggucaugcaugu

SEQ ID NO: 824414 - RNA, 19 nt, Homo sapiens
aacaugaagugcaguguga

SEQ ID NO: 824415 - RNA, 19 nt, Homo sapiens
uaacagaguggaaaucuac

SEQ ID NO: 824416 - RNA, 19 nt, Homo sapiens
cuaacagaguggaaaucua

SEQ ID NO: 824417 - RNA, 19 nt, Homo sapiens
ucuggcagcugugucauaa

SEQ ID NO: 824418 - RNA, 19 nt, Homo sapiens
caguaucucuguaccuguu

SEQ ID NO: 824419 - RNA, 19 nt, Homo sapiens
aauaugcugucaugcugua

SEQ ID NO: 824420 - RNA, 19 nt, Homo sapiens
ucucagcagccauguauaa

SEQ ID NO: 824421 - RNA, 19 nt, Homo sapiens
aagagcggcuucgacauaa

SEQ ID NO: 824422 - RNA, 19 nt, Homo sapiens
gcagagccugucuuuagaa

SEQ ID NO: 824423 - RNA, 19 nt, Homo sapiens
cccuggaccuguacaauga

SEQ ID NO: 824424 - RNA, 19 nt, Homo sapiens
cgacaaguacuucaagcaa

SEQ ID NO: 824425 - RNA, 19 nt, Homo sapiens
gagugucaguaacaucuau

SEQ ID NO: 824426 - RNA, 19 nt, Homo sapiens
ggaacgccauccucuucug

SEQ ID NO: 824427 - RNA, 19 nt, Homo sapiens
ucaggaauuucaaagagau

SEQ ID NO: 824428 - RNA, 19 nt, Homo sapiens
ugagcuggauggccuguug

SEQ ID NO: 824429 - RNA, 19 nt, Homo sapiens
caucagaucgaaagguuau

SEQ ID NO: 824430 - RNA, 19 nt, Homo sapiens
auuaggaacucuugagaau

SEQ ID NO: 824431 - RNA, 19 nt, Homo sapiens
ggauuucugcuaccaucua

SEQ ID NO: 824432 - RNA, 19 nt, Homo sapiens
gaagaacgucauccagagu

SEQ ID NO: 824433 - RNA, 19 nt, Homo sapiens
gauuuggucuguaccugau

SEQ ID NO: 824434 - RNA, 19 nt, Homo sapiens
gaagugcagugugaagaac

SEQ ID NO: 824435 - RNA, 19 nt, Homo sapiens
uggacgagcugaagaacau

SEQ ID NO: 824436 - RNA, 19 nt, Homo sapiens
agaagaugguggagagaau

SEQ ID NO: 824437 - RNA, 19 nt, Homo sapiens
cugcuaccaucuacuuaaa

SEQ ID NO: 824438 - RNA, 19 nt, Homo sapiens
cuaaugcacagccucagua

SEQ ID NO: 824439 - RNA, 19 nt, Homo sapiens
gaagauuugaccuccauag

SEQ ID NO: 824440 - RNA, 19 nt, Homo sapiens
gcagcagcccucaguacaa

SEQ ID NO: 824441 - RNA, 19 nt, Homo sapiens
ccauguuccuggccaauca

SEQ ID NO: 824442 - RNA, 19 nt, Homo sapiens
gaauuaaaguccuguuuga

SEQ ID NO: 824443 - RNA, 19 nt, Homo sapiens
gcugggagcugcaguggua

SEQ ID NO: 824444 - RNA, 19 nt, Homo sapiens
gaaauccugucccuuugaa

SEQ ID NO: 824445 - RNA, 19 nt, Homo sapiens
gacgagaucuugucugaug

SEQ ID NO: 824446 - RNA, 19 nt, Homo sapiens
gauuggagguggacacaaa

SEQ ID NO: 824447 - RNA, 19 nt, Homo sapiens
gaaaaccacuugagucuug

SEQ ID NO: 824448 - RNA, 19 nt, Homo sapiens
caacagcgcccacuacuuc

SEQ ID NO: 824449 - RNA, 19 nt, Homo sapiens
gcaucuagacuuugguuua

SEQ ID NO: 824450 - RNA, 19 nt, Homo sapiens
cauaguguauuuccucgua

SEQ ID NO: 824451 - RNA, 19 nt, Homo sapiens
ggaauuaaaguccuguuug

SEQ ID NO: 824452 - RNA, 19 nt, Homo sapiens
cuacgacacucuccgguuu

SEQ ID NO: 824453 - RNA, 19 nt, Homo sapiens
gaagaugaagacuuugaaa

SEQ ID NO: 824454 - RNA, 19 nt, Homo sapiens
gagcugaggucaccaacag

SEQ ID NO: 824455 - RNA, 19 nt, Homo sapiens
cucagaagaugaagacuuu

SEQ ID NO: 824456 - RNA, 19 nt, Homo sapiens
gaggugcccugcccauguu

SEQ ID NO: 824457 - RNA, 19 nt, Homo sapiens
ccuagauucuucugaugua

SEQ ID NO: 824458 - RNA, 19 nt, Homo sapiens
ccaugccgcugagguguua

SEQ ID NO: 824459 - RNA, 19 nt, Homo sapiens
uugcugaguuugaagauuu

SEQ ID NO: 824460 - RNA, 19 nt, Homo sapiens
gagcugcagugguaaugug

SEQ ID NO: 824461 - RNA, 19 nt, Homo sapiens
ggacaguuacuacuccauu

SEQ ID NO: 824462 - RNA, 19 nt, Homo sapiens
uagagcgacuggaaagauu

SEQ ID NO: 824463 - RNA, 19 nt, Homo sapiens
ggagaaaaguauucaggaa

SEQ ID NO: 824464 - RNA, 19 nt, Homo sapiens
gaaccugucccuagauucu

SEQ ID NO: 824465 - RNA, 19 nt, Homo sapiens
cagcuacucugaccuacga

SEQ ID NO: 824466 - RNA, 19 nt, Homo sapiens
cccaagcauugaagacaua

SEQ ID NO: 824467 - RNA, 19 nt, Homo sapiens
gaggaaaucagaagguugu

SEQ ID NO: 824468 - RNA, 19 nt, Homo sapiens
ggugcgaucuccauuccuu

SEQ ID NO: 824469 - RNA, 19 nt, Homo sapiens
cuacuccauucaccagaua

SEQ ID NO: 824470 - RNA, 19 nt, Homo sapiens
gcauugaagacauagugua

SEQ ID NO: 824471 - RNA, 19 nt, Homo sapiens
gaugaagacuuugaaaucc

SEQ ID NO: 824472 - RNA, 19 nt, Homo sapiens
uuaaaguccuguuugaagu

SEQ ID NO: 824473 - RNA, 19 nt, Homo sapiens
gcagcagccuucacaucug

SEQ ID NO: 824474 - RNA, 19 nt, Homo sapiens
gacaguuacuacuccauuc

SEQ ID NO: 824475 - RNA, 19 nt, Homo sapiens
gaagugggugugugggaaa

SEQ ID NO: 824476 - RNA, 19 nt, Homo sapiens
ugugguugguuuggaauua

SEQ ID NO: 824477 - RNA, 19 nt, Homo sapiens
gcaccuaggccgagauugg

SEQ ID NO: 824478 - RNA, 19 nt, Homo sapiens
aggacgagaucuugucuga

SEQ ID NO: 824479 - RNA, 19 nt, Homo sapiens
guaguauaguuugcaauuc

SEQ ID NO: 824480 - RNA, 19 nt, Homo sapiens
guccuugccuugcugagaa

SEQ ID NO: 824481 - RNA, 19 nt, Homo sapiens
ccucagagcccguuuggau

SEQ ID NO: 824482 - RNA, 19 nt, Homo sapiens
ggagguggacacaaaggaa

SEQ ID NO: 824483 - RNA, 19 nt, Homo sapiens
gaagauggacgcagcuacu

SEQ ID NO: 824484 - RNA, 19 nt, Homo sapiens
ggaaggacaguuacuacuc

SEQ ID NO: 824485 - RNA, 19 nt, Homo sapiens
agacuuugguuuacauaca

SEQ ID NO: 824486 - RNA, 19 nt, Homo sapiens
gugguugguuuggaauuaa

SEQ ID NO: 824487 - RNA, 19 nt, Homo sapiens
cagaagaugaagacuuuga

SEQ ID NO: 824488 - RNA, 19 nt, Homo sapiens
caucuagacuuugguuuac

SEQ ID NO: 824489 - RNA, 19 nt, Homo sapiens
gagcagcagccuucacauc

SEQ ID NO: 824490 - RNA, 19 nt, Homo sapiens
ucuguaagacugaagauga

SEQ ID NO: 824491 - RNA, 19 nt, Homo sapiens
gcugagguguuaggugguu

SEQ ID NO: 824492 - RNA, 19 nt, Homo sapiens
gaggaacgaaggcgagguu

SEQ ID NO: 824493 - RNA, 19 nt, Homo sapiens
uaaaguccuguuugaaguu

SEQ ID NO: 824494 - RNA, 19 nt, Homo sapiens
ggagcuuugucucgugugu

SEQ ID NO: 824495 - RNA, 19 nt, Homo sapiens
uuugaaauccugucccuuu

SEQ ID NO: 824496 - RNA, 19 nt, Homo sapiens
gauguagagcgacuggaaa

SEQ ID NO: 824497 - RNA, 19 nt, Homo sapiens
gagucagagucucagaaga

SEQ ID NO: 824498 - RNA, 19 nt, Homo sapiens
ccgguucugugguugguuu

SEQ ID NO: 824499 - RNA, 19 nt, Homo sapiens
cagacacagacaugaauuu

SEQ ID NO: 824500 - RNA, 19 nt, Homo sapiens
agaugaagacuuugaaauc

SEQ ID NO: 824501 - RNA, 19 nt, Homo sapiens
gaagacauaguguauuucc

SEQ ID NO: 824502 - RNA, 19 nt, Homo sapiens
aaaguccuguuugaaguug

SEQ ID NO: 824503 - RNA, 19 nt, Homo sapiens
guagagcgacuggaaagau

SEQ ID NO: 824504 - RNA, 19 nt, Homo sapiens
gagccugcccucagagugu

SEQ ID NO: 824505 - RNA, 19 nt, Homo sapiens
gcggagccgucuguuagga

SEQ ID NO: 824506 - RNA, 19 nt, Homo sapiens
ugaaauccugucccuuuga

SEQ ID NO: 824507 - RNA, 19 nt, Homo sapiens
cugaaccugucccuagauu

SEQ ID NO: 824508 - RNA, 19 nt, Homo sapiens
cauugaagacauaguguau

SEQ ID NO: 824509 - RNA, 19 nt, Homo sapiens
uugaaauccugucccuuug

SEQ ID NO: 824510 - RNA, 19 nt, Homo sapiens
uggaggaaaucagaagguu

SEQ ID NO: 824511 - RNA, 19 nt, Homo sapiens
ugggacaccuugaccaaag

SEQ ID NO: 824512 - RNA, 19 nt, Homo sapiens
uguauuuccucguauccuu

SEQ ID NO: 824513 - RNA, 19 nt, Homo sapiens
ccagugcuguggcauucug

SEQ ID NO: 824514 - RNA, 19 nt, Homo sapiens
gaaaaguauucaggaagug

SEQ ID NO: 824515 - RNA, 19 nt, Homo sapiens
ggagaugagguuggaggaa

SEQ ID NO: 824516 - RNA, 19 nt, Homo sapiens
guauuuccucguauccuuu

SEQ ID NO: 824517 - RNA, 19 nt, Homo sapiens
gucccuagauucuucugau

SEQ ID NO: 824518 - RNA, 19 nt, Homo sapiens
gcagccagacagcuacuuc

SEQ ID NO: 824519 - RNA, 19 nt, Homo sapiens
gcccucagagugucccuuu

SEQ ID NO: 824520 - RNA, 19 nt, Homo sapiens
cuaccucagugggagauga

SEQ ID NO: 824521 - RNA, 19 nt, Homo sapiens
ucgacaggaaggacaguua

SEQ ID NO: 824522 - RNA, 19 nt, Homo sapiens
gcugcgguguggacagaug

SEQ ID NO: 824523 - RNA, 19 nt, Homo sapiens
ccaccgcuguguccucucu

SEQ ID NO: 824524 - RNA, 19 nt, Homo sapiens
ugugcaggcuggcgugaga

SEQ ID NO: 824525 - RNA, 19 nt, Homo sapiens
ucuccgguuugcugaguuu

SEQ ID NO: 824526 - RNA, 19 nt, Homo sapiens
acaggaaggacaguuacua

SEQ ID NO: 824527 - RNA, 19 nt, Homo sapiens
agcuuugucucguguguuu

SEQ ID NO: 824528 - RNA, 19 nt, Homo sapiens
ccgguuugcugaguuugaa

SEQ ID NO: 824529 - RNA, 19 nt, Homo sapiens
ugagguguuaggugguuua

SEQ ID NO: 824530 - RNA, 19 nt, Homo sapiens
ucagacacagacaugaauu

SEQ ID NO: 824531 - RNA, 19 nt, Homo sapiens
gaaaaggacgagaucuugu

SEQ ID NO: 824532 - RNA, 19 nt, Homo sapiens
ugauguagagcgacuggaa

SEQ ID NO: 824533 - RNA, 19 nt, Homo sapiens
agaggcagccagacagcua

SEQ ID NO: 824534 - RNA, 19 nt, Homo sapiens
agacacagacaugaauuuc

SEQ ID NO: 824535 - RNA, 19 nt, Homo sapiens
gauacuggguagaaaauac

SEQ ID NO: 824536 - RNA, 19 nt, Homo sapiens
acgcauucaucgacaggaa

SEQ ID NO: 824537 - RNA, 19 nt, Homo sapiens
gacuuugguuuacauacag

SEQ ID NO: 824538 - RNA, 19 nt, Homo sapiens
uggaauuaaaguccuguuu

SEQ ID NO: 824539 - RNA, 19 nt, Homo sapiens
agaagaugaagacuuugaa

SEQ ID NO: 824540 - RNA, 19 nt, Homo sapiens
guaagacugaagaugacuu

SEQ ID NO: 824541 - RNA, 19 nt, Homo sapiens
caccagauagcgcaaaugg

SEQ ID NO: 824542 - RNA, 19 nt, Homo sapiens
gcagagaccuggguugaua

SEQ ID NO: 824543 - RNA, 19 nt, Homo sapiens
gaagaucucuauuccuaug

SEQ ID NO: 824544 - RNA, 19 nt, Homo sapiens
uaacaucuauggccuuuau

SEQ ID NO: 824545 - RNA, 19 nt, Homo sapiens
gguaugacauucaaagcua

SEQ ID NO: 824546 - RNA, 19 nt, Homo sapiens
caauauagaugaucaguac

SEQ ID NO: 824547 - RNA, 19 nt, Homo sapiens
cauaucgccucuacaauuu

SEQ ID NO: 824548 - RNA, 19 nt, Homo sapiens
ggaaguggaucagggcuuu

SEQ ID NO: 824549 - RNA, 19 nt, Homo sapiens
gauagaagcaacuuuaaga

SEQ ID NO: 824550 - RNA, 19 nt, Homo sapiens
cagaauguaugaaggauga

SEQ ID NO: 824551 - RNA, 19 nt, Homo sapiens
gauaagaucaagaaccuuu

SEQ ID NO: 824552 - RNA, 19 nt, Homo sapiens
gggcuaacauguucagcua

SEQ ID NO: 824553 - RNA, 19 nt, Homo sapiens
gcaauaugcuagucucaca

SEQ ID NO: 824554 - RNA, 19 nt, Homo sapiens
gcgcaagccuggcaucaau

SEQ ID NO: 824555 - RNA, 19 nt, Homo sapiens
gugacuaccuucaauauag

SEQ ID NO: 824556 - RNA, 19 nt, Homo sapiens
gguacacccucuuauauca

SEQ ID NO: 824557 - RNA, 19 nt, Homo sapiens
uugaagaucucuauuccua

SEQ ID NO: 824558 - RNA, 19 nt, Homo sapiens
ugagaacaguguggaguua

SEQ ID NO: 824559 - RNA, 19 nt, Homo sapiens
gcaucaauguggcaucuga

SEQ ID NO: 824560 - RNA, 19 nt, Homo sapiens
guucagcuaugacaauuau

SEQ ID NO: 824561 - RNA, 19 nt, Homo sapiens
guaccugccuguaacucua

SEQ ID NO: 824562 - RNA, 19 nt, Homo sapiens
gcuaacauguucagcuaug

SEQ ID NO: 824563 - RNA, 19 nt, Homo sapiens
ggauguggguggcuucuuc

SEQ ID NO: 824564 - RNA, 19 nt, Homo sapiens
ccauaucgccucuacaauu

SEQ ID NO: 824565 - RNA, 19 nt, Homo sapiens
guggauagaagcaacuuua

SEQ ID NO: 824566 - RNA, 19 nt, Homo sapiens
ggaugugacuaccuucaau

SEQ ID NO: 824567 - RNA, 19 nt, Homo sapiens
gguaccagaugggugcuua

SEQ ID NO: 824568 - RNA, 19 nt, Homo sapiens
ggaaggcagagaaagauga

SEQ ID NO: 824569 - RNA, 19 nt, Homo sapiens
ugauauaucuuccaacacu

SEQ ID NO: 824570 - RNA, 19 nt, Homo sapiens
cuagaggaccgaagucuuu

SEQ ID NO: 824571 - RNA, 19 nt, Homo sapiens
ugacuaccuucaauauaga

SEQ ID NO: 824572 - RNA, 19 nt, Homo sapiens
gaugugacuaccuucaaua

SEQ ID NO: 824573 - RNA, 19 nt, Homo sapiens
gucagagacuggcaucauu

SEQ ID NO: 824574 - RNA, 19 nt, Homo sapiens
gggauaagaucaagaaccu

SEQ ID NO: 824575 - RNA, 19 nt, Homo sapiens
gguagcauaugggauaaga

SEQ ID NO: 824576 - RNA, 19 nt, Homo sapiens
gaccuggguugauauaucu

SEQ ID NO: 824577 - RNA, 19 nt, Homo sapiens
gcaguacccucaggaugug

SEQ ID NO: 824578 - RNA, 19 nt, Homo sapiens
caucucagcacaaugauau

SEQ ID NO: 824579 - RNA, 19 nt, Homo sapiens
guuaaucucacgcuuggua

SEQ ID NO: 824580 - RNA, 19 nt, Homo sapiens
ggaguauucaccugcgaua

SEQ ID NO: 824581 - RNA, 19 nt, Homo sapiens
gggcacacguucaacuauc

SEQ ID NO: 824582 - RNA, 19 nt, Homo sapiens
ggauggcucugacuaugag

SEQ ID NO: 824583 - RNA, 19 nt, Homo sapiens
gcaucugauuggaguauuc

SEQ ID NO: 824584 - RNA, 19 nt, Homo sapiens
acaaaaggaucuccagaaa

SEQ ID NO: 824585 - RNA, 19 nt, Homo sapiens
ggaggugugguaugacauu

SEQ ID NO: 824586 - RNA, 19 nt, Homo sapiens
ggaagaugauggacuaccu

SEQ ID NO: 824587 - RNA, 19 nt, Homo sapiens
uuuaagaccugugaagaga

SEQ ID NO: 824588 - RNA, 19 nt, Homo sapiens
ggugugguaugacauucaa

SEQ ID NO: 824589 - RNA, 19 nt, Homo sapiens
ucaucuggcuagacauuga

SEQ ID NO: 824590 - RNA, 19 nt, Homo sapiens
gcauaugggauaagaucaa

SEQ ID NO: 824591 - RNA, 19 nt, Homo sapiens
gagccuugcuggacucucu

SEQ ID NO: 824592 - RNA, 19 nt, Homo sapiens
uaagaccugugaagagagu

SEQ ID NO: 824593 - RNA, 19 nt, Homo sapiens
ggugggacuuuccuucugu

SEQ ID NO: 824594 - RNA, 19 nt, Homo sapiens
gggaugcguugcugguuca

SEQ ID NO: 824595 - RNA, 19 nt, Homo sapiens
ucagcacaaugauauaauc

SEQ ID NO: 824596 - RNA, 19 nt, Homo sapiens
gcacauggcgacugcugau

SEQ ID NO: 824597 - RNA, 19 nt, Homo sapiens
gaagcugguggccaucgua

SEQ ID NO: 824598 - RNA, 19 nt, Homo sapiens
ggcacacguucaacuauca

SEQ ID NO: 824599 - RNA, 19 nt, Homo sapiens
gagagcucuuucuggauga

SEQ ID NO: 824600 - RNA, 19 nt, Homo sapiens
uauagaugaucaguacuug

SEQ ID NO: 824601 - RNA, 19 nt, Homo sapiens
caaccucuuugucuggaau

SEQ ID NO: 824602 - RNA, 19 nt, Homo sapiens
uugggaagaugauggacua

SEQ ID NO: 824603 - RNA, 19 nt, Homo sapiens
gagaacaguguggaguuaa

SEQ ID NO: 824604 - RNA, 19 nt, Homo sapiens
gaaggcauuccugucauga

SEQ ID NO: 824605 - RNA, 19 nt, Homo sapiens
uaccaucucagcacaauga

SEQ ID NO: 824606 - RNA, 19 nt, Homo sapiens
agacagauguucgcuggau

SEQ ID NO: 824607 - RNA, 19 nt, Homo sapiens
agaccuggguugauauauc

SEQ ID NO: 824608 - RNA, 19 nt, Homo sapiens
ggagccauaucgccucuac

SEQ ID NO: 824609 - RNA, 19 nt, Homo sapiens
ggauagaagcaacuuuaag

SEQ ID NO: 824610 - RNA, 19 nt, Homo sapiens
ucagcuaugacaauuauga

SEQ ID NO: 824611 - RNA, 19 nt, Homo sapiens
gggauggcucugacuauga

SEQ ID NO: 824612 - RNA, 19 nt, Homo sapiens
ugaaggacacuuugagaca

SEQ ID NO: 824613 - RNA, 19 nt, Homo sapiens
uaagcaguaucccuguguu

SEQ ID NO: 824614 - RNA, 19 nt, Homo sapiens
ggguugauauaucuuccaa

SEQ ID NO: 824615 - RNA, 19 nt, Homo sapiens
cuugguagcauaugggaua

SEQ ID NO: 824616 - RNA, 19 nt, Homo sapiens
gcaagccuggcaucaaugu

SEQ ID NO: 824617 - RNA, 19 nt, Homo sapiens
gagcggguggugauaauag

SEQ ID NO: 824618 - RNA, 19 nt, Homo sapiens
ucacuaaucccacgaugag

SEQ ID NO: 824619 - RNA, 19 nt, Homo sapiens
cagacaaccugaggcugaa

SEQ ID NO: 824620 - RNA, 19 nt, Homo sapiens
ggaccgaagucuuuugcuu

SEQ ID NO: 824621 - RNA, 19 nt, Homo sapiens
ggauugagcggguggugau

SEQ ID NO: 824622 - RNA, 19 nt, Homo sapiens
aggcauuccugucaugaga

SEQ ID NO: 824623 - RNA, 19 nt, Homo sapiens
ucugguacacccucuuaua

SEQ ID NO: 824624 - RNA, 19 nt, Homo sapiens
gaucucuauuccuaugugu

SEQ ID NO: 824625 - RNA, 19 nt, Homo sapiens
gcucagcucccaaccucuu

SEQ ID NO: 824626 - RNA, 19 nt, Homo sapiens
cuugagcgcuuggcuucua

SEQ ID NO: 824627 - RNA, 19 nt, Homo sapiens
gaccgaagucuuuugcuua

SEQ ID NO: 824628 - RNA, 19 nt, Homo sapiens
cgucuuugguacuggcuuu

SEQ ID NO: 824629 - RNA, 19 nt, Homo sapiens
gcaacuuuaagaccuguga

SEQ ID NO: 824630 - RNA, 19 nt, Homo sapiens
uacccugacuucacuaauc

SEQ ID NO: 824631 - RNA, 19 nt, Homo sapiens
gauggcaagcgguauuuca

SEQ ID NO: 824632 - RNA, 19 nt, Homo sapiens
gagccugggaggagacauu

SEQ ID NO: 824633 - RNA, 19 nt, Homo sapiens
ugacucgguucaggauuga

SEQ ID NO: 824634 - RNA, 19 nt, Homo sapiens
guggguggcuucuucaaaa

SEQ ID NO: 824635 - RNA, 19 nt, Homo sapiens
cgggauggcucugacuaug

SEQ ID NO: 824636 - RNA, 19 nt, Homo sapiens
gcugauggcaagcgguauu

SEQ ID NO: 824637 - RNA, 19 nt, Homo sapiens
ucucacgcuugguagcaua

SEQ ID NO: 824638 - RNA, 19 nt, Homo sapiens
caagcgacagagaagcaua

SEQ ID NO: 824639 - RNA, 19 nt, Homo sapiens
gaugaugggcacacguuca

SEQ ID NO: 824640 - RNA, 19 nt, Homo sapiens
ggccagcgauauucuuugc

SEQ ID NO: 824641 - RNA, 19 nt, Homo sapiens
caccagagccguuggaacu

SEQ ID NO: 824642 - RNA, 19 nt, Homo sapiens
cgagugagcugguuuaaua

SEQ ID NO: 824643 - RNA, 19 nt, Homo sapiens
gaaauuccauugcugguuu

SEQ ID NO: 824644 - RNA, 19 nt, Homo sapiens
ggaaacagcucagcagauu

SEQ ID NO: 824645 - RNA, 19 nt, Homo sapiens
ccacacagcccaaagauua

SEQ ID NO: 824646 - RNA, 19 nt, Homo sapiens
caacugcacuccuacugua

SEQ ID NO: 824647 - RNA, 19 nt, Homo sapiens
ccaaaggucucacuaggaa

SEQ ID NO: 824648 - RNA, 19 nt, Homo sapiens
agacaaagcugacuguuca

SEQ ID NO: 824649 - RNA, 19 nt, Homo sapiens
gcagggagauccagagaau

SEQ ID NO: 824650 - RNA, 19 nt, Homo sapiens
gaaauucacuugucuuuug

SEQ ID NO: 824651 - RNA, 19 nt, Homo sapiens
gcugaucgcuguuccuuga

SEQ ID NO: 824652 - RNA, 19 nt, Homo sapiens
gaacugcaccaaacucaaa

SEQ ID NO: 824653 - RNA, 19 nt, Homo sapiens
gagcagagauacccauaca

SEQ ID NO: 824654 - RNA, 19 nt, Homo sapiens
caacccggcuuucuucuga

SEQ ID NO: 824655 - RNA, 19 nt, Homo sapiens
gggaacacauguccucaaa

SEQ ID NO: 824656 - RNA, 19 nt, Homo sapiens
gaccucuucucaucuauuu

SEQ ID NO: 824657 - RNA, 19 nt, Homo sapiens
ucucuaaacugcuucauug

SEQ ID NO: 824658 - RNA, 19 nt, Homo sapiens
acaaauacuuucugcauuc

SEQ ID NO: 824659 - RNA, 19 nt, Homo sapiens
gaagucagauagccagaag

SEQ ID NO: 824660 - RNA, 19 nt, Homo sapiens
gaggauccaucaucagaau

SEQ ID NO: 824661 - RNA, 19 nt, Homo sapiens
ccaaagaaacgaagcaaga

SEQ ID NO: 824662 - RNA, 19 nt, Homo sapiens
uuaggaaucuggccuuuau

SEQ ID NO: 824663 - RNA, 19 nt, Homo sapiens
ccaggagguuucuuucaaa

SEQ ID NO: 824664 - RNA, 19 nt, Homo sapiens
cuaagucacucucuucaau

SEQ ID NO: 824665 - RNA, 19 nt, Homo sapiens
acacaaaccugaacaaagc

SEQ ID NO: 824666 - RNA, 19 nt, Homo sapiens
gcucgagcaucucaucuga

SEQ ID NO: 824667 - RNA, 19 nt, Homo sapiens
cuccagaccuccucucuaa

SEQ ID NO: 824668 - RNA, 19 nt, Homo sapiens
ucaggaugcuccaaaguga

SEQ ID NO: 824669 - RNA, 19 nt, Homo sapiens
uaaacugucuuccaaacau

SEQ ID NO: 824670 - RNA, 19 nt, Homo sapiens
ucauucagauugcauuuga

SEQ ID NO: 824671 - RNA, 19 nt, Homo sapiens
gaacacauguccucaaaag

SEQ ID NO: 824672 - RNA, 19 nt, Homo sapiens
uaccauagcacuuugcaua

SEQ ID NO: 824673 - RNA, 19 nt, Homo sapiens
uggaguaccucgccaagaa

SEQ ID NO: 824674 - RNA, 19 nt, Homo sapiens
caacagaggccaaagaaac

SEQ ID NO: 824675 - RNA, 19 nt, Homo sapiens
cuagaaagccuuaauuuac

SEQ ID NO: 824676 - RNA, 19 nt, Homo sapiens
caccuaaacugucuuccaa

SEQ ID NO: 824677 - RNA, 19 nt, Homo sapiens
caacaaugccagaugaaug

SEQ ID NO: 824678 - RNA, 19 nt, Homo sapiens
gcagagauacccauacaca

SEQ ID NO: 824679 - RNA, 19 nt, Homo sapiens
ccacuaaagcccagaagaa

SEQ ID NO: 824680 - RNA, 19 nt, Homo sapiens
acagaugccucgguucuuu

SEQ ID NO: 824681 - RNA, 19 nt, Homo sapiens
gcaccgacacccacucaaa

SEQ ID NO: 824682 - RNA, 19 nt, Homo sapiens
ucagauagccagaagaaau

SEQ ID NO: 824683 - RNA, 19 nt, Homo sapiens
cacaaauacuuucugcauu

SEQ ID NO: 824684 - RNA, 19 nt, Homo sapiens
ugucgucucuguacacaaa

SEQ ID NO: 824685 - RNA, 19 nt, Homo sapiens
gaugugauuucaggagauu

SEQ ID NO: 824686 - RNA, 19 nt, Homo sapiens
caguuucucuucucacaaa

SEQ ID NO: 824687 - RNA, 19 nt, Homo sapiens
gccaagaacugcaccaaac

SEQ ID NO: 824688 - RNA, 19 nt, Homo sapiens
caaauugccacccugugua

SEQ ID NO: 824689 - RNA, 19 nt, Homo sapiens
cagcgaggauccaucauca

SEQ ID NO: 824690 - RNA, 19 nt, Homo sapiens
caacgaggccgucuuugau

SEQ ID NO: 824691 - RNA, 19 nt, Homo sapiens
cauaccgucuugccaguuu

SEQ ID NO: 824692 - RNA, 19 nt, Homo sapiens
gaaagccacagaguuuaaa

SEQ ID NO: 824693 - RNA, 19 nt, Homo sapiens
gcaaacagcuggggaagga

SEQ ID NO: 824694 - RNA, 19 nt, Homo sapiens
ccgggaagguuauuaggaa

SEQ ID NO: 824695 - RNA, 19 nt, Homo sapiens
uaaauucuguucacucaac

SEQ ID NO: 824696 - RNA, 19 nt, Homo sapiens
gaaggagcaggccagcaua

SEQ ID NO: 824697 - RNA, 19 nt, Homo sapiens
acacugagaugacuuagac

SEQ ID NO: 824698 - RNA, 19 nt, Homo sapiens
ggguuaaguuuguaagugu

SEQ ID NO: 824699 - RNA, 19 nt, Homo sapiens
aaaggcagcucgagcaucu

SEQ ID NO: 824700 - RNA, 19 nt, Homo sapiens
gagauacccauacacagaa

SEQ ID NO: 824701 - RNA, 19 nt, Homo sapiens
gaagcaagacaaacagcaa

SEQ ID NO: 824702 - RNA, 19 nt, Homo sapiens
gaacaauggcaaacaguac

SEQ ID NO: 824703 - RNA, 19 nt, Homo sapiens
gaaacagcucagcagauuu

SEQ ID NO: 824704 - RNA, 19 nt, Homo sapiens
ugaaagccacagaguuuaa

SEQ ID NO: 824705 - RNA, 19 nt, Homo sapiens
cagauagccagaagaaauu

SEQ ID NO: 824706 - RNA, 19 nt, Homo sapiens
ggaaaggaauacuaaaauc

SEQ ID NO: 824707 - RNA, 19 nt, Homo sapiens
ggaagagggaacacacuga

SEQ ID NO: 824708 - RNA, 19 nt, Homo sapiens
aaacgaagcaagacaaaca

SEQ ID NO: 824709 - RNA, 19 nt, Homo sapiens
ccaacgaggccgucuuuga

SEQ ID NO: 824710 - RNA, 19 nt, Homo sapiens
gcucauuguuuguuguugu

SEQ ID NO: 824711 - RNA, 19 nt, Homo sapiens
ggucucacuaggaaauuua

SEQ ID NO: 824712 - RNA, 19 nt, Homo sapiens
cauuugaccucuucucauc

SEQ ID NO: 824713 - RNA, 19 nt, Homo sapiens
ucaauaccauagcacuuug

SEQ ID NO: 824714 - RNA, 19 nt, Homo sapiens
ggaagguuauuaggaaucu

SEQ ID NO: 824715 - RNA, 19 nt, Homo sapiens
gaaguugaaggcagcauuc

SEQ ID NO: 824716 - RNA, 19 nt, Homo sapiens
ccaaucaacaucaucaaau

SEQ ID NO: 824717 - RNA, 19 nt, Homo sapiens
ucacgaaauucacuugucu

SEQ ID NO: 824718 - RNA, 19 nt, Homo sapiens
cagaagaaauuccauugcu

SEQ ID NO: 824719 - RNA, 19 nt, Homo sapiens
acucaacaaugccagauga

SEQ ID NO: 824720 - RNA, 19 nt, Homo sapiens
cagcaucagugcauaaagg

SEQ ID NO: 824721 - RNA, 19 nt, Homo sapiens
gucucaggcuguuacaaua

SEQ ID NO: 824722 - RNA, 19 nt, Homo sapiens
gaaucuaugauggagguua

SEQ ID NO: 824723 - RNA, 19 nt, Homo sapiens
gaucacacgcccacuaaag

SEQ ID NO: 824724 - RNA, 19 nt, Homo sapiens
gcgaggauccaucaucaga

SEQ ID NO: 824725 - RNA, 19 nt, Homo sapiens
cgaacaauggcaaacagua

SEQ ID NO: 824726 - RNA, 19 nt, Homo sapiens
caaaagauguacuuaagca

SEQ ID NO: 824727 - RNA, 19 nt, Homo sapiens
gagacaaagcugacuguuc

SEQ ID NO: 824728 - RNA, 19 nt, Homo sapiens
agugaaagccacagaguuu

SEQ ID NO: 824729 - RNA, 19 nt, Homo sapiens
cuugacaacugcacuccua

SEQ ID NO: 824730 - RNA, 19 nt, Homo sapiens
gcaaacaguacggcaguga

SEQ ID NO: 824731 - RNA, 19 nt, Homo sapiens
gaguucauccggcguugua

SEQ ID NO: 824732 - RNA, 19 nt, Homo sapiens
cuaaagcccagaagaaugu

SEQ ID NO: 824733 - RNA, 19 nt, Homo sapiens
guuacaauaucuccaacga

SEQ ID NO: 824734 - RNA, 19 nt, Homo sapiens
ccaguuaugcugaauuugu

SEQ ID NO: 824735 - RNA, 19 nt, Homo sapiens
gcccaaagauuagcuucau

SEQ ID NO: 824736 - RNA, 19 nt, Homo sapiens
ggucauuuguaggcaguuu

SEQ ID NO: 824737 - RNA, 19 nt, Homo sapiens
gcaacagaggccaaagaaa

SEQ ID NO: 824738 - RNA, 19 nt, Homo sapiens
guacggcagugagggcaaa

SEQ ID NO: 824739 - RNA, 19 nt, Homo sapiens
cccaggagguuucuuucaa

SEQ ID NO: 824740 - RNA, 19 nt, Homo sapiens
ccaagccaguuaugcugaa

SEQ ID NO: 824741 - RNA, 19 nt, Homo sapiens
agaagcaccuuggcauaga

SEQ ID NO: 824742 - RNA, 19 nt, Homo sapiens
gaagagaccuggaagauga

SEQ ID NO: 824743 - RNA, 19 nt, Homo sapiens
ggacaaggauagugaaaua

SEQ ID NO: 824744 - RNA, 19 nt, Homo sapiens
ggacagaucuuaguauauu

SEQ ID NO: 824745 - RNA, 19 nt, Homo sapiens
gaaacuggguuacucauaa

SEQ ID NO: 824746 - RNA, 19 nt, Homo sapiens
ggucauggcuguuaaauug

SEQ ID NO: 824747 - RNA, 19 nt, Homo sapiens
gaaauacccuuguuagaau

SEQ ID NO: 824748 - RNA, 19 nt, Homo sapiens
gaaauuugauggacuuuga

SEQ ID NO: 824749 - RNA, 19 nt, Homo sapiens
gcaauugugucucaacuuu

SEQ ID NO: 824750 - RNA, 19 nt, Homo sapiens
gaaggugucuccugaagaa

SEQ ID NO: 824751 - RNA, 19 nt, Homo sapiens
gcaaagagacucacaaaug

SEQ ID NO: 824752 - RNA, 19 nt, Homo sapiens
ggaaacaucuugauuugau

SEQ ID NO: 824753 - RNA, 19 nt, Homo sapiens
gaaauucaaugcagucgaa

SEQ ID NO: 824754 - RNA, 19 nt, Homo sapiens
gaaauauggugcccucaaa

SEQ ID NO: 824755 - RNA, 19 nt, Homo sapiens
uaagggaucugcugaauug

SEQ ID NO: 824756 - RNA, 19 nt, Homo sapiens
gaaagucauuccauacauu

SEQ ID NO: 824757 - RNA, 19 nt, Homo sapiens
ggagauauaucccgagcua

SEQ ID NO: 824758 - RNA, 19 nt, Homo sapiens
gaaaguguguggucaguau

SEQ ID NO: 824759 - RNA, 19 nt, Homo sapiens
ugaggaagcugacaaacua

SEQ ID NO: 824760 - RNA, 19 nt, Homo sapiens
cagggaagcuugucuuuaa

SEQ ID NO: 824761 - RNA, 19 nt, Homo sapiens
gaaaguggcaccuggauuu

SEQ ID NO: 824762 - RNA, 19 nt, Homo sapiens
gaagugauuuccucuguga

SEQ ID NO: 824763 - RNA, 19 nt, Homo sapiens
guacauagauggaauaggu

SEQ ID NO: 824764 - RNA, 19 nt, Homo sapiens
gaaugaagagcacaaguua

SEQ ID NO: 824765 - RNA, 19 nt, Homo sapiens
uaaagaaguugcagaaguu

SEQ ID NO: 824766 - RNA, 19 nt, Homo sapiens
gcaaaggcuucaggaaaua

SEQ ID NO: 824767 - RNA, 19 nt, Homo sapiens
gagcagaucuaccuguuga

SEQ ID NO: 824768 - RNA, 19 nt, Homo sapiens
ugacauaccugaagugaug

SEQ ID NO: 824769 - RNA, 19 nt, Homo sapiens
ucacagaacuuuauguaga

SEQ ID NO: 824770 - RNA, 19 nt, Homo sapiens
guacacaagucugcuguua

SEQ ID NO: 824771 - RNA, 19 nt, Homo sapiens
ggaaauacccuuguuagaa

SEQ ID NO: 824772 - RNA, 19 nt, Homo sapiens
ugaauaggcuguuggauga

SEQ ID NO: 824773 - RNA, 19 nt, Homo sapiens
gaacagcuccugguuguaa

SEQ ID NO: 824774 - RNA, 19 nt, Homo sapiens
uaaaggaccuggagagaug

SEQ ID NO: 824775 - RNA, 19 nt, Homo sapiens
ggaggaggcugcuagagaa

SEQ ID NO: 824776 - RNA, 19 nt, Homo sapiens
ggagagacaucaguuggua

SEQ ID NO: 824777 - RNA, 19 nt, Homo sapiens
uaacuuggcugcuccagaa

SEQ ID NO: 824778 - RNA, 19 nt, Homo sapiens
uuacagagcuugcccagaa

SEQ ID NO: 824779 - RNA, 19 nt, Homo sapiens
ggaagaaauugacacauca

SEQ ID NO: 824780 - RNA, 19 nt, Homo sapiens
gaaagagucugggaccaaa

SEQ ID NO: 824781 - RNA, 19 nt, Homo sapiens
gaacaagaauacagugcaa

SEQ ID NO: 824782 - RNA, 19 nt, Homo sapiens
gaacagacaaagcccauaa

SEQ ID NO: 824783 - RNA, 19 nt, Homo sapiens
ggacagaauucguaguuuc

SEQ ID NO: 824784 - RNA, 19 nt, Homo sapiens
gaagauuuaugacagaaug

SEQ ID NO: 824785 - RNA, 19 nt, Homo sapiens
gcacaagccgugaagauuu

SEQ ID NO: 824786 - RNA, 19 nt, Homo sapiens
ggaggaaauugaugugauu

SEQ ID NO: 824787 - RNA, 19 nt, Homo sapiens
ggaagauucugaacuuguu

SEQ ID NO: 824788 - RNA, 19 nt, Homo sapiens
ccaaagaauuuauggaaga

SEQ ID NO: 824789 - RNA, 19 nt, Homo sapiens
caaagagacucacaaaugg

SEQ ID NO: 824790 - RNA, 19 nt, Homo sapiens
ccagauaaaugaggagaua

SEQ ID NO: 824791 - RNA, 19 nt, Homo sapiens
ggacaugauuagaaauuug

SEQ ID NO: 824792 - RNA, 19 nt, Homo sapiens
caaacuagaagcaguguua

SEQ ID NO: 824793 - RNA, 19 nt, Homo sapiens
gaaagaagaguccaaagug

SEQ ID NO: 824794 - RNA, 19 nt, Homo sapiens
caaggaagccgaugaagaa

SEQ ID NO: 824795 - RNA, 19 nt, Homo sapiens
caaagaggauccugauuca

SEQ ID NO: 824796 - RNA, 19 nt, Homo sapiens
ggagauaagucaccucauc

SEQ ID NO: 824797 - RNA, 19 nt, Homo sapiens
gagcacaaguuaucauuuc

SEQ ID NO: 824798 - RNA, 19 nt, Homo sapiens
gauucuaucuuggacauua

SEQ ID NO: 824799 - RNA, 19 nt, Homo sapiens
gaaagaagccgagagucua

SEQ ID NO: 824800 - RNA, 19 nt, Homo sapiens
uaacauggcuaucucuuca

SEQ ID NO: 824801 - RNA, 19 nt, Homo sapiens
gaaccagacuauuucguau

SEQ ID NO: 824802 - RNA, 19 nt, Homo sapiens
gaaugaaggccaaagaauu

SEQ ID NO: 824803 - RNA, 19 nt, Homo sapiens
gcggaaacaucuugauuug

SEQ ID NO: 824804 - RNA, 19 nt, Homo sapiens
uaagucaccucaucucauu

SEQ ID NO: 824805 - RNA, 19 nt, Homo sapiens
gaugagacguacauucuga

SEQ ID NO: 824806 - RNA, 19 nt, Homo sapiens
agaaggagcugcaguacuu

SEQ ID NO: 824807 - RNA, 19 nt, Homo sapiens
ucauacagcucaucaauuc

SEQ ID NO: 824808 - RNA, 19 nt, Homo sapiens
ggagaacacugaccaagca

SEQ ID NO: 824809 - RNA, 19 nt, Homo sapiens
ggacagcccugagugaaga

SEQ ID NO: 824810 - RNA, 19 nt, Homo sapiens
gaucaucagucauaaucuu

SEQ ID NO: 824811 - RNA, 19 nt, Homo sapiens
cacaagccgugaagauuua

SEQ ID NO: 824812 - RNA, 19 nt, Homo sapiens
ggaaucgguuuguggaauu

SEQ ID NO: 824813 - RNA, 19 nt, Homo sapiens
gcucaucugucaacacauu

SEQ ID NO: 824814 - RNA, 19 nt, Homo sapiens
caaagaagacuuacagguu

SEQ ID NO: 824815 - RNA, 19 nt, Homo sapiens
gcggagaccuggauaaaca

SEQ ID NO: 824816 - RNA, 19 nt, Homo sapiens
gaacuuagaagaaagaaag

SEQ ID NO: 824817 - RNA, 19 nt, Homo sapiens
gauauccuguccuggguua

SEQ ID NO: 824818 - RNA, 19 nt, Homo sapiens
guaauaggauugcccauag

SEQ ID NO: 824819 - RNA, 19 nt, Homo sapiens
gaaacaggaucaccuuugg

SEQ ID NO: 824820 - RNA, 19 nt, Homo sapiens
gggaguacaagcucaauua

SEQ ID NO: 824821 - RNA, 19 nt, Homo sapiens
caagauugcucaguuucua

SEQ ID NO: 824822 - RNA, 19 nt, Homo sapiens
gacaggagcuggagagaca

SEQ ID NO: 824823 - RNA, 19 nt, Homo sapiens
ugaagaagguggagagaau

SEQ ID NO: 824824 - RNA, 19 nt, Homo sapiens
ggaagaacagccugacuuu

SEQ ID NO: 824825 - RNA, 19 nt, Homo sapiens
acaggacacucuuuaaauu

SEQ ID NO: 824826 - RNA, 19 nt, Homo sapiens
ccaaauugaucaugaagug

SEQ ID NO: 824827 - RNA, 19 nt, Homo sapiens
acacggauauucaggagua

SEQ ID NO: 824828 - RNA, 19 nt, Homo sapiens
gcccauagcuuugacaguu

SEQ ID NO: 824829 - RNA, 19 nt, Homo sapiens
aaaccaagauugcucaguu

SEQ ID NO: 824830 - RNA, 19 nt, Homo sapiens
gagaauccuuuggagauaa

SEQ ID NO: 824831 - RNA, 19 nt, Homo sapiens
ggaggaagaagacaauaaa

SEQ ID NO: 824832 - RNA, 19 nt, Homo sapiens
ggaggaagaugaggaggaa

SEQ ID NO: 824833 - RNA, 19 nt, Homo sapiens
gaagaugacaaacagauga

SEQ ID NO: 824834 - RNA, 19 nt, Homo sapiens
gaaagcggccuguauagau

SEQ ID NO: 824835 - RNA, 19 nt, Homo sapiens
ucaauuacgucaaggaaga

SEQ ID NO: 824836 - RNA, 19 nt, Homo sapiens
gaacaggagcuggcccuua

SEQ ID NO: 824837 - RNA, 19 nt, Homo sapiens
aaagaagaguccaaaguga

SEQ ID NO: 824838 - RNA, 19 nt, Homo sapiens
ugaggaagauucugaacuu

SEQ ID NO: 824839 - RNA, 19 nt, Homo sapiens
agaagaggaugaugagaaa

SEQ ID NO: 824840 - RNA, 19 nt, Homo sapiens
gaaagucuggaauauguaa

SEQ ID NO: 824841 - RNA, 19 nt, Homo sapiens
gaagaaacaggccuuuaga

SEQ ID NO: 824842 - RNA, 19 nt, Homo sapiens
gaaagugccuugaauaaug

SEQ ID NO: 824843 - RNA, 19 nt, Homo sapiens
ccaaagaacuuaagucaaa

SEQ ID NO: 824844 - RNA, 19 nt, Homo sapiens
gaacagacuuccaccagaa

SEQ ID NO: 824845 - RNA, 19 nt, Homo sapiens
gccaauaucugaugcauga

SEQ ID NO: 824846 - RNA, 19 nt, Homo sapiens
gaacagaugacaaaguuau

SEQ ID NO: 824847 - RNA, 19 nt, Homo sapiens
gcuaucagcucucuucaug

SEQ ID NO: 824848 - RNA, 19 nt, Homo sapiens
cagaagaaguggccaaaga

SEQ ID NO: 824849 - RNA, 19 nt, Homo sapiens
uagaacagaugacaaaguu

SEQ ID NO: 824850 - RNA, 19 nt, Homo sapiens
gacgaagggugaaaucaaa

SEQ ID NO: 824851 - RNA, 19 nt, Homo sapiens
agagagcaauuggauauua

SEQ ID NO: 824852 - RNA, 19 nt, Homo sapiens
gaacagcuacagcaacauu

SEQ ID NO: 824853 - RNA, 19 nt, Homo sapiens
ggacaccucugacuuggau

SEQ ID NO: 824854 - RNA, 19 nt, Homo sapiens
gaaaagaccccacucauug

SEQ ID NO: 824855 - RNA, 19 nt, Homo sapiens
gacaagaaccgcaggauga

SEQ ID NO: 824856 - RNA, 19 nt, Homo sapiens
gaaucgaaguccucugcua

SEQ ID NO: 824857 - RNA, 19 nt, Homo sapiens
gagagcaauuggauauuau

SEQ ID NO: 824858 - RNA, 19 nt, Homo sapiens
uaagagagcaauuggauau

SEQ ID NO: 824859 - RNA, 19 nt, Homo sapiens
ucaaagccguugcugacua

SEQ ID NO: 824860 - RNA, 19 nt, Homo sapiens
gaucuggcuuccuuucauu

SEQ ID NO: 824861 - RNA, 19 nt, Homo sapiens
gaaguccucugcuaugucu

SEQ ID NO: 824862 - RNA, 19 nt, Homo sapiens
gaguagacauggccuuguu

SEQ ID NO: 824863 - RNA, 19 nt, Homo sapiens
cuaguaagccuaugucauu

SEQ ID NO: 824864 - RNA, 19 nt, Homo sapiens
ccaagcaacuggaccugaa

SEQ ID NO: 824865 - RNA, 19 nt, Homo sapiens
aaagugccuugaauaauga

SEQ ID NO: 824866 - RNA, 19 nt, Homo sapiens
caaagccguugcugacuau

SEQ ID NO: 824867 - RNA, 19 nt, Homo sapiens
gacauggccuuguuugcaa

SEQ ID NO: 824868 - RNA, 19 nt, Homo sapiens
gcagaaagcagaaagaaaa

SEQ ID NO: 824869 - RNA, 19 nt, Homo sapiens
cagaacagcuacagcaaca

SEQ ID NO: 824870 - RNA, 19 nt, Homo sapiens
gcacugugguuggccauug

SEQ ID NO: 824871 - RNA, 19 nt, Homo sapiens
gcaauuggauauuauucag

SEQ ID NO: 824872 - RNA, 19 nt, Homo sapiens
uaaaugcacuaaguacaga

SEQ ID NO: 824873 - RNA, 19 nt, Homo sapiens
gaacuuaagucaaaaucug

SEQ ID NO: 824874 - RNA, 19 nt, Homo sapiens
gauuagaacauuuggaaga

SEQ ID NO: 824875 - RNA, 19 nt, Homo sapiens
caccagugaucauuaaaga

SEQ ID NO: 824876 - RNA, 19 nt, Homo sapiens
guaagccuaugucauuuca

SEQ ID NO: 824877 - RNA, 19 nt, Homo sapiens
ugccauagcuaaagauguu

SEQ ID NO: 824878 - RNA, 19 nt, Homo sapiens
ccacuagccucacuaaagg

SEQ ID NO: 824879 - RNA, 19 nt, Homo sapiens
ugacggagcagaacagcua

SEQ ID NO: 824880 - RNA, 19 nt, Homo sapiens
gggaggcaaacuagaaaua

SEQ ID NO: 824881 - RNA, 19 nt, Homo sapiens
gggcagaccuccuuaugcu

SEQ ID NO: 824882 - RNA, 19 nt, Homo sapiens
guaaggcgguagaggacaa

SEQ ID NO: 824883 - RNA, 19 nt, Homo sapiens
ggaaaagucucaccacaag

SEQ ID NO: 824884 - RNA, 19 nt, Homo sapiens
ugaucaggcugccaaggua

SEQ ID NO: 824885 - RNA, 19 nt, Homo sapiens
gcauguuccuccucagaug

SEQ ID NO: 824886 - RNA, 19 nt, Homo sapiens
gggcggaguccaaccuaua

SEQ ID NO: 824887 - RNA, 19 nt, Homo sapiens
gccagcaccucucacuuug

SEQ ID NO: 824888 - RNA, 19 nt, Homo sapiens
gaguuuacuugguccagaa

SEQ ID NO: 824889 - RNA, 19 nt, Homo sapiens
ggaaaagaccccacucauu

SEQ ID NO: 824890 - RNA, 19 nt, Homo sapiens
ggaacugguugaagcucuu

SEQ ID NO: 824891 - RNA, 19 nt, Homo sapiens
gaagccagaugggcacugu

SEQ ID NO: 824892 - RNA, 19 nt, Homo sapiens
ggaagcacacgccgcugua

SEQ ID NO: 824893 - RNA, 19 nt, Homo sapiens
ccagugaucauuaaagaau

SEQ ID NO: 824894 - RNA, 19 nt, Homo sapiens
aaacugagagacuugcuuu

SEQ ID NO: 824895 - RNA, 19 nt, Homo sapiens
cagcaacauuccucacgaa

SEQ ID NO: 824896 - RNA, 19 nt, Homo sapiens
cagcaccucucacuuugga

SEQ ID NO: 824897 - RNA, 19 nt, Homo sapiens
agaaugggcagcuuacaaa

SEQ ID NO: 824898 - RNA, 19 nt, Homo sapiens
agaccucucugcaagcaaa

SEQ ID NO: 824899 - RNA, 19 nt, Homo sapiens
ggccaaagaacuuaaguca

SEQ ID NO: 824900 - RNA, 19 nt, Homo sapiens
uaucagcucucuucaugag

SEQ ID NO: 824901 - RNA, 19 nt, Homo sapiens
uuaaagaaugggcagcuua

SEQ ID NO: 824902 - RNA, 19 nt, Homo sapiens
cagcuggucuugccaccuu

SEQ ID NO: 824903 - RNA, 19 nt, Homo sapiens
guaugacucugauuaugca

SEQ ID NO: 824904 - RNA, 19 nt, Homo sapiens
gugauuagaacauuuggaa

SEQ ID NO: 824905 - RNA, 19 nt, Homo sapiens
ggaguccuguuuaguuugg

SEQ ID NO: 824906 - RNA, 19 nt, Homo sapiens
gcauugaggaucaccauca

SEQ ID NO: 824907 - RNA, 19 nt, Homo sapiens
cugaaagugccuugaauaa

SEQ ID NO: 824908 - RNA, 19 nt, Homo sapiens
gcguaugacucugauuaug

SEQ ID NO: 824909 - RNA, 19 nt, Homo sapiens
gcaggcgucuguggcuuug

SEQ ID NO: 824910 - RNA, 19 nt, Homo sapiens
caccugcccugcccuucua

SEQ ID NO: 824911 - RNA, 19 nt, Homo sapiens
acggaguccuguuuaguuu

SEQ ID NO: 824912 - RNA, 19 nt, Homo sapiens
aagauuggcugggagaaga

SEQ ID NO: 824913 - RNA, 19 nt, Homo sapiens
cauaucagcgggaacaaga

SEQ ID NO: 824914 - RNA, 19 nt, Homo sapiens
cauuucauccaccacauua

SEQ ID NO: 824915 - RNA, 19 nt, Homo sapiens
ugacuuggaugccauagcu

SEQ ID NO: 824916 - RNA, 19 nt, Homo sapiens
gaagagguggaagguacua

SEQ ID NO: 824917 - RNA, 19 nt, Homo sapiens
ucagggaggcaaacuagaa

SEQ ID NO: 824918 - RNA, 19 nt, Homo sapiens
uaguaagccuaugucauuu

SEQ ID NO: 824919 - RNA, 19 nt, Homo sapiens
ucugaaagugccuugaaua

SEQ ID NO: 824920 - RNA, 19 nt, Homo sapiens
ugacgaagggugaaaucaa

SEQ ID NO: 824921 - RNA, 19 nt, Homo sapiens
ccucagaugcucaacauuc

SEQ ID NO: 824922 - RNA, 19 nt, Homo sapiens
ggaccugaauccaaaucgu

SEQ ID NO: 824923 - RNA, 19 nt, Homo sapiens
ugaaagugccuugaauaau

SEQ ID NO: 824924 - RNA, 19 nt, Homo sapiens
agaagaaguggccaaagaa

SEQ ID NO: 824925 - RNA, 19 nt, Homo sapiens
ggaggcaaacuagaaauag

SEQ ID NO: 824926 - RNA, 19 nt, Homo sapiens
gauauuauucagcgacuag

SEQ ID NO: 824927 - RNA, 19 nt, Homo sapiens
ggauauuauucagcgacua

SEQ ID NO: 824928 - RNA, 19 nt, Homo sapiens
gaccugaauccaaaucguu

SEQ ID NO: 824929 - RNA, 19 nt, Homo sapiens
caacauccccuacuauuuc

SEQ ID NO: 824930 - RNA, 19 nt, Homo sapiens
gaagaaguggccaaagaac

SEQ ID NO: 824931 - RNA, 19 nt, Homo sapiens
ccaguucgucaguauguuu

SEQ ID NO: 824932 - RNA, 19 nt, Homo sapiens
cacagagcauugaggauca

SEQ ID NO: 824933 - RNA, 19 nt, Homo sapiens
gagcaauuggauauuauuc

SEQ ID NO: 824934 - RNA, 19 nt, Homo sapiens
uugcugcucucuuaggaaa

SEQ ID NO: 824935 - RNA, 19 nt, Homo sapiens
ggugcucugcugcgucuua

SEQ ID NO: 824936 - RNA, 19 nt, Homo sapiens
ggcagaaagcagaaagaaa

SEQ ID NO: 824937 - RNA, 19 nt, Homo sapiens
cuacuucccuggcucuucu

SEQ ID NO: 824938 - RNA, 19 nt, Homo sapiens
ucauccaccacauuacuua

SEQ ID NO: 824939 - RNA, 19 nt, Homo sapiens
ccagugauuagaacauuug

SEQ ID NO: 824940 - RNA, 19 nt, Homo sapiens
gaggcaaacuagaaauagc

SEQ ID NO: 824941 - RNA, 19 nt, Homo sapiens
guagacauggccuuguuug

SEQ ID NO: 824942 - RNA, 19 nt, Homo sapiens
gaagucagcugccagaaua

SEQ ID NO: 824943 - RNA, 19 nt, Homo sapiens
ggauaacacuugucucuua

SEQ ID NO: 824944 - RNA, 19 nt, Homo sapiens
gaagaaaucuaguguacuu

SEQ ID NO: 824945 - RNA, 19 nt, Homo sapiens
gauaauaguuguucaguga

SEQ ID NO: 824946 - RNA, 19 nt, Homo sapiens
ggaccuaacugacgaauga

SEQ ID NO: 824947 - RNA, 19 nt, Homo sapiens
gaacucaccuuuacacaca

SEQ ID NO: 824948 - RNA, 19 nt, Homo sapiens
gaacauagaggcugcugua

SEQ ID NO: 824949 - RNA, 19 nt, Homo sapiens
cacaaaggcuguauaugua

SEQ ID NO: 824950 - RNA, 19 nt, Homo sapiens
gauaacacuugucucuuaa

SEQ ID NO: 824951 - RNA, 19 nt, Homo sapiens
cgacugaaguuguagauug

SEQ ID NO: 824952 - RNA, 19 nt, Homo sapiens
ggagucaguugaauauuug

SEQ ID NO: 824953 - RNA, 19 nt, Homo sapiens
ggacauuguuucauuuaug

SEQ ID NO: 824954 - RNA, 19 nt, Homo sapiens
cagcauaacuggaacauag

SEQ ID NO: 824955 - RNA, 19 nt, Homo sapiens
ccacagaaauuaacuugga

SEQ ID NO: 824956 - RNA, 19 nt, Homo sapiens
gaaccuagaaccuucaauu

SEQ ID NO: 824957 - RNA, 19 nt, Homo sapiens
caagagagagaaauucaua

SEQ ID NO: 824958 - RNA, 19 nt, Homo sapiens
gaaugaggcugacauaggu

SEQ ID NO: 824959 - RNA, 19 nt, Homo sapiens
ccacaaaggcuguauaugu

SEQ ID NO: 824960 - RNA, 19 nt, Homo sapiens
gcacgcaccuuccagugaa

SEQ ID NO: 824961 - RNA, 19 nt, Homo sapiens
aaagacugcugcauccuua

SEQ ID NO: 824962 - RNA, 19 nt, Homo sapiens
caaacaaaccugagggaua

SEQ ID NO: 824963 - RNA, 19 nt, Homo sapiens
ggaaauccauccacaaagg

SEQ ID NO: 824964 - RNA, 19 nt, Homo sapiens
ccagugaucugcaagcauu

SEQ ID NO: 824965 - RNA, 19 nt, Homo sapiens
caacauaaagccuaacuug

SEQ ID NO: 824966 - RNA, 19 nt, Homo sapiens
ggagaaagaaagaaagaaa

SEQ ID NO: 824967 - RNA, 19 nt, Homo sapiens
gaauaaccaugggaaguga

SEQ ID NO: 824968 - RNA, 19 nt, Homo sapiens
agacuuaccuggugucaga

SEQ ID NO: 824969 - RNA, 19 nt, Homo sapiens
ccacaucaccucugggaua

SEQ ID NO: 824970 - RNA, 19 nt, Homo sapiens
aagcagagauguuccuuga

SEQ ID NO: 824971 - RNA, 19 nt, Homo sapiens
caucaccucugggauauuu

SEQ ID NO: 824972 - RNA, 19 nt, Homo sapiens
ugacaaguauuccaaagug

SEQ ID NO: 824973 - RNA, 19 nt, Homo sapiens
caaaggcuguauauguaaa

SEQ ID NO: 824974 - RNA, 19 nt, Homo sapiens
caauugagcaguugugaaa

SEQ ID NO: 824975 - RNA, 19 nt, Homo sapiens
gguagcaauuauaugguua

SEQ ID NO: 824976 - RNA, 19 nt, Homo sapiens
ggcuguauauguaaagaua

SEQ ID NO: 824977 - RNA, 19 nt, Homo sapiens
gaggaaaucuggguuugug

SEQ ID NO: 824978 - RNA, 19 nt, Homo sapiens
uggagucaguugaauauuu

SEQ ID NO: 824979 - RNA, 19 nt, Homo sapiens
gcacacaggaggguauuaa

SEQ ID NO: 824980 - RNA, 19 nt, Homo sapiens
aggauaaccuuacgugaaa

SEQ ID NO: 824981 - RNA, 19 nt, Homo sapiens
aaacaaaccugagggauac

SEQ ID NO: 824982 - RNA, 19 nt, Homo sapiens
ugacaaccaugcagaggaa

SEQ ID NO: 824983 - RNA, 19 nt, Homo sapiens
gcgcaagguuagcaacaaa

SEQ ID NO: 824984 - RNA, 19 nt, Homo sapiens
gagcugaccaggagaaaga

SEQ ID NO: 824985 - RNA, 19 nt, Homo sapiens
caguggaaguguauuauug

SEQ ID NO: 824986 - RNA, 19 nt, Homo sapiens
gagcagagaagcagagaug

SEQ ID NO: 824987 - RNA, 19 nt, Homo sapiens
gacugaaguuguagauuga

SEQ ID NO: 824988 - RNA, 19 nt, Homo sapiens
ggguucagaucaacauaaa

SEQ ID NO: 824989 - RNA, 19 nt, Homo sapiens
gaagggagccaagacagaa

SEQ ID NO: 824990 - RNA, 19 nt, Homo sapiens
ggucuagucccauuugaaa

SEQ ID NO: 824991 - RNA, 19 nt, Homo sapiens
guuguagucucaaggcuuu

SEQ ID NO: 824992 - RNA, 19 nt, Homo sapiens
gauagcagcucuucauucc

SEQ ID NO: 824993 - RNA, 19 nt, Homo sapiens
gaaaccaugcugcccguaa

SEQ ID NO: 824994 - RNA, 19 nt, Homo sapiens
gagagaacaccuauccauu

SEQ ID NO: 824995 - RNA, 19 nt, Homo sapiens
ucacuggcaucgaaucuau

SEQ ID NO: 824996 - RNA, 19 nt, Homo sapiens
cuacagcuauguugucuca

SEQ ID NO: 824997 - RNA, 19 nt, Homo sapiens
gaacacagcaacggaaauc

SEQ ID NO: 824998 - RNA, 19 nt, Homo sapiens
guacaggacagauugaaug

SEQ ID NO: 824999 - RNA, 19 nt, Homo sapiens
uugaaacaguucugcuuua

SEQ ID NO: 825000 - RNA, 19 nt, Homo sapiens
ggccauguauuaacagaug

SEQ ID NO: 825001 - RNA, 19 nt, Homo sapiens
ccagagaggucauucuuuu

SEQ ID NO: 825002 - RNA, 19 nt, Homo sapiens
ggcaugcucuacaaacaaa

SEQ ID NO: 825003 - RNA, 19 nt, Homo sapiens
gaacaccaucucuaggaaa

SEQ ID NO: 825004 - RNA, 19 nt, Homo sapiens
cuauugcuauguugaagua

SEQ ID NO: 825005 - RNA, 19 nt, Homo sapiens
gaacucccagccuguguaa

SEQ ID NO: 825006 - RNA, 19 nt, Homo sapiens
gccaguacaaucuguguua

SEQ ID NO: 825007 - RNA, 19 nt, Homo sapiens
uggcauagcugucuagaac

SEQ ID NO: 825008 - RNA, 19 nt, Homo sapiens
ggaucucacuggcaucgaa

SEQ ID NO: 825009 - RNA, 19 nt, Homo sapiens
uaacaguaauccacgacuu

SEQ ID NO: 825010 - RNA, 19 nt, Homo sapiens
guacugcgccugaauaguc

SEQ ID NO: 825011 - RNA, 19 nt, Homo sapiens
ugacugagaaggagcgaua

SEQ ID NO: 825012 - RNA, 19 nt, Homo sapiens
caagagggcguaccuagug

SEQ ID NO: 825013 - RNA, 19 nt, Homo sapiens
gcugacauagguauauaua

SEQ ID NO: 825014 - RNA, 19 nt, Homo sapiens
ggaaugaggcugacauagg

SEQ ID NO: 825015 - RNA, 19 nt, Homo sapiens
gcagagaagcagagauguu

SEQ ID NO: 825016 - RNA, 19 nt, Homo sapiens
ggaagagagggaagagaaa

SEQ ID NO: 825017 - RNA, 19 nt, Homo sapiens
gggaagagagggaagagaa

SEQ ID NO: 825018 - RNA, 19 nt, Homo sapiens
gcaaagacacucgauugga

SEQ ID NO: 825019 - RNA, 19 nt, Homo sapiens
caaucuguguuacuccuaa

SEQ ID NO: 825020 - RNA, 19 nt, Homo sapiens
gggcacacccugucuucua

SEQ ID NO: 825021 - RNA, 19 nt, Homo sapiens
ccugaauagucaugugaua

SEQ ID NO: 825022 - RNA, 19 nt, Homo sapiens
cgacugacguuacuguagu

SEQ ID NO: 825023 - RNA, 19 nt, Homo sapiens
guaaugaccaaaggaauga

SEQ ID NO: 825024 - RNA, 19 nt, Homo sapiens
gagagacgauuccacuuuu

SEQ ID NO: 825025 - RNA, 19 nt, Homo sapiens
ucacaggcuuuacgagaga

SEQ ID NO: 825026 - RNA, 19 nt, Homo sapiens
agagauggccagaggauaa

SEQ ID NO: 825027 - RNA, 19 nt, Homo sapiens
ucucaaggcuuucucucuu

SEQ ID NO: 825028 - RNA, 19 nt, Homo sapiens
gugguugaguuuaugguaa

SEQ ID NO: 825029 - RNA, 19 nt, Homo sapiens
ggaaagcccagaaaaguuu

SEQ ID NO: 825030 - RNA, 19 nt, Homo sapiens
gauuggagucaguugaaua

SEQ ID NO: 825031 - RNA, 19 nt, Homo sapiens
gcccacaaguuuucaauaa

SEQ ID NO: 825032 - RNA, 19 nt, Homo sapiens
ggccagaggauaacacuug

SEQ ID NO: 825033 - RNA, 19 nt, Homo sapiens
ggaagugaccaagcaaaga

SEQ ID NO: 825034 - RNA, 19 nt, Homo sapiens
ggccuucccauuuacuuua

SEQ ID NO: 825035 - RNA, 19 nt, Homo sapiens
uuggagagccugagaaauu

SEQ ID NO: 825036 - RNA, 19 nt, Homo sapiens
ggcuuucucucuugcuuaa

SEQ ID NO: 825037 - RNA, 19 nt, Homo sapiens
ggaggcagcuuuuauccuu

SEQ ID NO: 825038 - RNA, 19 nt, Homo sapiens
gaaggcacauuuucauuuc

SEQ ID NO: 825039 - RNA, 19 nt, Homo sapiens
gggaggaaaucuggguuug

SEQ ID NO: 825040 - RNA, 19 nt, Homo sapiens
ggacucagccacacagaag

SEQ ID NO: 825041 - RNA, 19 nt, Homo sapiens
gcuagaaggccucauucaa

SEQ ID NO: 825042 - RNA, 19 nt, Homo sapiens
gcacacagcuucccuggua

SEQ ID NO: 825043 - RNA, 19 nt, Homo sapiens
gaauaaguuuggacaguuu

SEQ ID NO: 825044 - RNA, 19 nt, Homo sapiens
gagagucgcuucuaagaug

SEQ ID NO: 825045 - RNA, 19 nt, Homo sapiens
ugacugaccugcccacgua

SEQ ID NO: 825046 - RNA, 19 nt, Homo sapiens
gaaauaccuuaguggaauu

SEQ ID NO: 825047 - RNA, 19 nt, Homo sapiens
gagcuggcaucuuucuuaa

SEQ ID NO: 825048 - RNA, 19 nt, Homo sapiens
gagaggugcugcauuccua

SEQ ID NO: 825049 - RNA, 19 nt, Homo sapiens
cgaaauaccuuaguggaau

SEQ ID NO: 825050 - RNA, 19 nt, Homo sapiens
cagcuucccugguaauaaa

SEQ ID NO: 825051 - RNA, 19 nt, Homo sapiens
gcuaacagaugaagaaguc

SEQ ID NO: 825052 - RNA, 19 nt, Homo sapiens
gaaagagacauguccaaug

SEQ ID NO: 825053 - RNA, 19 nt, Homo sapiens
caagagacaccaccaugua

SEQ ID NO: 825054 - RNA, 19 nt, Homo sapiens
cagcaaagaugaaauucug

SEQ ID NO: 825055 - RNA, 19 nt, Homo sapiens
gaagcgaaauaccuuagug

SEQ ID NO: 825056 - RNA, 19 nt, Homo sapiens
ggauggcgguccaguuuga

SEQ ID NO: 825057 - RNA, 19 nt, Homo sapiens
aaagcugucugguuguaua

SEQ ID NO: 825058 - RNA, 19 nt, Homo sapiens
agacgcagcugacaucaau

SEQ ID NO: 825059 - RNA, 19 nt, Homo sapiens
caagacagguucgagaaau

SEQ ID NO: 825060 - RNA, 19 nt, Homo sapiens
cgagauaugaagcgaaaua

SEQ ID NO: 825061 - RNA, 19 nt, Homo sapiens
aaaguaaccacauuggaua

SEQ ID NO: 825062 - RNA, 19 nt, Homo sapiens
aaaccaaaguaaccacauu

SEQ ID NO: 825063 - RNA, 19 nt, Homo sapiens
gcgcagaggccguggauau

SEQ ID NO: 825064 - RNA, 19 nt, Homo sapiens
ggacacggugguugccuua

SEQ ID NO: 825065 - RNA, 19 nt, Homo sapiens
uaccaggacucaccucuga

SEQ ID NO: 825066 - RNA, 19 nt, Homo sapiens
agaccgcccugucgaguaa

SEQ ID NO: 825067 - RNA, 19 nt, Homo sapiens
caaaguaaccacauuggau

SEQ ID NO: 825068 - RNA, 19 nt, Homo sapiens
gaaaugguagaaaucauca

SEQ ID NO: 825069 - RNA, 19 nt, Homo sapiens
cagaggccguggauauuga

SEQ ID NO: 825070 - RNA, 19 nt, Homo sapiens
gcguacagacgguuuagua

SEQ ID NO: 825071 - RNA, 19 nt, Homo sapiens
gcggauggcgguccaguuu

SEQ ID NO: 825072 - RNA, 19 nt, Homo sapiens
ugacagcaaagaugaaauu

SEQ ID NO: 825073 - RNA, 19 nt, Homo sapiens
guagaaaucaucacaaagg

SEQ ID NO: 825074 - RNA, 19 nt, Homo sapiens
agcaaaggcugaccuauca

SEQ ID NO: 825075 - RNA, 19 nt, Homo sapiens
gcagaggccguggauauug

SEQ ID NO: 825076 - RNA, 19 nt, Homo sapiens
agaauaaguuuggacaguu

SEQ ID NO: 825077 - RNA, 19 nt, Homo sapiens
ugguagaaaucaucacaaa

SEQ ID NO: 825078 - RNA, 19 nt, Homo sapiens
gagaaaugguagaaaucau

SEQ ID NO: 825079 - RNA, 19 nt, Homo sapiens
cggaagaugugaagagagu

SEQ ID NO: 825080 - RNA, 19 nt, Homo sapiens
ggaguacccaagccuguuu

SEQ ID NO: 825081 - RNA, 19 nt, Homo sapiens
cagaauaaguuuggacagu

SEQ ID NO: 825082 - RNA, 19 nt, Homo sapiens
gcuggcaucuuucuuaaaa

SEQ ID NO: 825083 - RNA, 19 nt, Homo sapiens
uagaaaucaucacaaagga

SEQ ID NO: 825084 - RNA, 19 nt, Homo sapiens
gcgaaauaccuuaguggaa

SEQ ID NO: 825085 - RNA, 19 nt, Homo sapiens
agagcuggcaucuuucuua

SEQ ID NO: 825086 - RNA, 19 nt, Homo sapiens
ccaggaagcaggugaagug

SEQ ID NO: 825087 - RNA, 19 nt, Homo sapiens
aggcaccacuggauguaua

SEQ ID NO: 825088 - RNA, 19 nt, Homo sapiens
gaacucaaugugccgauca

SEQ ID NO: 825089 - RNA, 19 nt, Homo sapiens
uacagacgguuuaguagug

SEQ ID NO: 825090 - RNA, 19 nt, Homo sapiens
ggccguggauauugacaga

SEQ ID NO: 825091 - RNA, 19 nt, Homo sapiens
caguuggccuccaccguuu

SEQ ID NO: 825092 - RNA, 19 nt, Homo sapiens
gccggaagaugugaagaga

SEQ ID NO: 825093 - RNA, 19 nt, Homo sapiens
caguaggaauucuuaucaa

SEQ ID NO: 825094 - RNA, 19 nt, Homo sapiens
guacagacgguuuaguagu

SEQ ID NO: 825095 - RNA, 19 nt, Homo sapiens
cuuacuggcugaugugguu

SEQ ID NO: 825096 - RNA, 19 nt, Homo sapiens
cgagaaaugguagaaauca

SEQ ID NO: 825097 - RNA, 19 nt, Homo sapiens
ccaagacagguucgagaaa

SEQ ID NO: 825098 - RNA, 19 nt, Homo sapiens
ccacgcgguuugcauucuu

SEQ ID NO: 825099 - RNA, 19 nt, Homo sapiens
ccaagacgcagcugacauc

SEQ ID NO: 825100 - RNA, 19 nt, Homo sapiens
aagaugaaauucugcuuac

SEQ ID NO: 825101 - RNA, 19 nt, Homo sapiens
ucaauucaggaucgagaua

SEQ ID NO: 825102 - RNA, 19 nt, Homo sapiens
cgcguggcaucucagaaua

SEQ ID NO: 825103 - RNA, 19 nt, Homo sapiens
acacuggccuccuuugcau

SEQ ID NO: 825104 - RNA, 19 nt, Homo sapiens
uugccaagcuagaaagaga

SEQ ID NO: 825105 - RNA, 19 nt, Homo sapiens
uggcaucucagaauaaguu

SEQ ID NO: 825106 - RNA, 19 nt, Homo sapiens
gggauugccaagcuagaaa

SEQ ID NO: 825107 - RNA, 19 nt, Homo sapiens
aagacagguucgagaaaug

SEQ ID NO: 825108 - RNA, 19 nt, Homo sapiens
gguggugccuaucccaaca

SEQ ID NO: 825109 - RNA, 19 nt, Homo sapiens
caccauguaugcugugucu

SEQ ID NO: 825110 - RNA, 19 nt, Homo sapiens
gaugaaauucugcuuacgu

SEQ ID NO: 825111 - RNA, 19 nt, Homo sapiens
gauaugaagcgaaauaccu

SEQ ID NO: 825112 - RNA, 19 nt, Homo sapiens
gaugaagaagucgagauga

SEQ ID NO: 825113 - RNA, 19 nt, Homo sapiens
ugccagacaucaagagaca

SEQ ID NO: 825114 - RNA, 19 nt, Homo sapiens
aaauucugcuuacguugga

SEQ ID NO: 825115 - RNA, 19 nt, Homo sapiens
gaaaccaaaguaaccacau

SEQ ID NO: 825116 - RNA, 19 nt, Homo sapiens
gacaagcaggagaagguaa

SEQ ID NO: 825117 - RNA, 19 nt, Homo sapiens
uacaguugauggacaggaa

SEQ ID NO: 825118 - RNA, 19 nt, Homo sapiens
caagcuagaaagagacaug

SEQ ID NO: 825119 - RNA, 19 nt, Homo sapiens
augaaauucugcuuacguu

SEQ ID NO: 825120 - RNA, 19 nt, Homo sapiens
acaguaggaauucuuauca

SEQ ID NO: 825121 - RNA, 19 nt, Homo sapiens
gcuguucgcggcugagguu

SEQ ID NO: 825122 - RNA, 19 nt, Homo sapiens
ucaagagacaccaccaugu

SEQ ID NO: 825123 - RNA, 19 nt, Homo sapiens
ggacaguuuuguacaguag

SEQ ID NO: 825124 - RNA, 19 nt, Homo sapiens
uaugaagcgaaauaccuua

SEQ ID NO: 825125 - RNA, 19 nt, Homo sapiens
ugacaagcaggagaaggua

SEQ ID NO: 825126 - RNA, 19 nt, Homo sapiens
gccgaucaguggagucagu

SEQ ID NO: 825127 - RNA, 19 nt, Homo sapiens
uuaguuuggacacgaauuu

SEQ ID NO: 825128 - RNA, 19 nt, Homo sapiens
aagagagucgcuucuaaga

SEQ ID NO: 825129 - RNA, 19 nt, Homo sapiens
gccacucgcuccagaaagc

SEQ ID NO: 825130 - RNA, 19 nt, Homo sapiens
caucacaaaggaguuuauu

SEQ ID NO: 825131 - RNA, 19 nt, Homo sapiens
gcguggcaucucagaauaa

SEQ ID NO: 825132 - RNA, 19 nt, Homo sapiens
ggacugugcccggaaguac

SEQ ID NO: 825133 - RNA, 19 nt, Homo sapiens
uaugcugugucugcugaua

SEQ ID NO: 825134 - RNA, 19 nt, Homo sapiens
uguacaguaggaauucuua

SEQ ID NO: 825135 - RNA, 19 nt, Homo sapiens
uguauaacgcgaccuccua

SEQ ID NO: 825136 - RNA, 19 nt, Homo sapiens
cagaaaacguagcaaagau

SEQ ID NO: 825137 - RNA, 19 nt, Homo sapiens
gcaacgugaagccggaaga

SEQ ID NO: 825138 - RNA, 19 nt, Homo sapiens
agaaaugguagaaaucauc

SEQ ID NO: 825139 - RNA, 19 nt, Homo sapiens
uucgagaaaugguagaaau

SEQ ID NO: 825140 - RNA, 19 nt, Homo sapiens
ucuccaggcucuaccucaa

SEQ ID NO: 825141 - RNA, 19 nt, Homo sapiens
gaaaacguagcaaagauca

SEQ ID NO: 825142 - RNA, 19 nt, Homo sapiens
gugcaaagcuuagcaauuu

SEQ ID NO: 825143 - RNA, 19 nt, Homo sapiens
cagcaaagauuccaugaaa

SEQ ID NO: 825144 - RNA, 19 nt, Homo sapiens
ggaaguagcucuuuguucu

SEQ ID NO: 825145 - RNA, 19 nt, Homo sapiens
ggacagcagucuucuaugu

SEQ ID NO: 825146 - RNA, 19 nt, Homo sapiens
gcaaagauuccaugaaauu

SEQ ID NO: 825147 - RNA, 19 nt, Homo sapiens
guaggaaacuuugaucuuu

SEQ ID NO: 825148 - RNA, 19 nt, Homo sapiens
ggacaacucauuaguguuu

SEQ ID NO: 825149 - RNA, 19 nt, Homo sapiens
gaacaguggugcccauugu

SEQ ID NO: 825150 - RNA, 19 nt, Homo sapiens
gaagagaccaauuaagauu

SEQ ID NO: 825151 - RNA, 19 nt, Homo sapiens
gaauauagagaccaaguuu

SEQ ID NO: 825152 - RNA, 19 nt, Homo sapiens
guauaucugucccuauuaa

SEQ ID NO: 825153 - RNA, 19 nt, Homo sapiens
cuugguagcuagaaauuua

SEQ ID NO: 825154 - RNA, 19 nt, Homo sapiens
aaacgccucuucacacuaa

SEQ ID NO: 825155 - RNA, 19 nt, Homo sapiens
ggacuaaaccaacauggaa

SEQ ID NO: 825156 - RNA, 19 nt, Homo sapiens
aaaccaacauggaaucauu

SEQ ID NO: 825157 - RNA, 19 nt, Homo sapiens
gcugauggcugauaaaguc

SEQ ID NO: 825158 - RNA, 19 nt, Homo sapiens
ggaaagcuucuuauaauca

SEQ ID NO: 825159 - RNA, 19 nt, Homo sapiens
aaauaagccugucuuccua

SEQ ID NO: 825160 - RNA, 19 nt, Homo sapiens
cgaaguuaguaaauccuua

SEQ ID NO: 825161 - RNA, 19 nt, Homo sapiens
ggaacaauucuuaaacuga

SEQ ID NO: 825162 - RNA, 19 nt, Homo sapiens
ccuaagauguacuucauga

SEQ ID NO: 825163 - RNA, 19 nt, Homo sapiens
ggauaauuguucaucuuug

SEQ ID NO: 825164 - RNA, 19 nt, Homo sapiens
aagugaaucuggauaauug

SEQ ID NO: 825165 - RNA, 19 nt, Homo sapiens
ggaaacgccucuucacacu

SEQ ID NO: 825166 - RNA, 19 nt, Homo sapiens
cagcagucuucuauguuua

SEQ ID NO: 825167 - RNA, 19 nt, Homo sapiens
acagcagucuucuauguuu

SEQ ID NO: 825168 - RNA, 19 nt, Homo sapiens
ucuaugacuuucacucuaa

SEQ ID NO: 825169 - RNA, 19 nt, Homo sapiens
gaagaguccccaugaaaua

SEQ ID NO: 825170 - RNA, 19 nt, Homo sapiens
uaagauucauuccucauuc

SEQ ID NO: 825171 - RNA, 19 nt, Homo sapiens
gcauacauauucuacugau

SEQ ID NO: 825172 - RNA, 19 nt, Homo sapiens
gagcagacuugaggugaug

SEQ ID NO: 825173 - RNA, 19 nt, Homo sapiens
uacaguagguuaagacuca

SEQ ID NO: 825174 - RNA, 19 nt, Homo sapiens
gcaauuuguaggaaacuuu

SEQ ID NO: 825175 - RNA, 19 nt, Homo sapiens
gggaaccguuucugcugua

SEQ ID NO: 825176 - RNA, 19 nt, Homo sapiens
gugcuuggcugacuaccuu

SEQ ID NO: 825177 - RNA, 19 nt, Homo sapiens
gggaacaauucuuaaacug

SEQ ID NO: 825178 - RNA, 19 nt, Homo sapiens
ggucuacaaagauuucaua

SEQ ID NO: 825179 - RNA, 19 nt, Homo sapiens
uagcuuagauaccauguag

SEQ ID NO: 825180 - RNA, 19 nt, Homo sapiens
gaaucuggauaauuguuca

SEQ ID NO: 825181 - RNA, 19 nt, Homo sapiens
uggugaaccuugcccuuua

SEQ ID NO: 825182 - RNA, 19 nt, Homo sapiens
acucugcccuuaguuaaua

SEQ ID NO: 825183 - RNA, 19 nt, Homo sapiens
gagguggccugcgcuugua

SEQ ID NO: 825184 - RNA, 19 nt, Homo sapiens
uuauugcacugauguugua

SEQ ID NO: 825185 - RNA, 19 nt, Homo sapiens
caucuuugcuuuagcuuag

SEQ ID NO: 825186 - RNA, 19 nt, Homo sapiens
gaagaacagcugcaaggau

SEQ ID NO: 825187 - RNA, 19 nt, Homo sapiens
gugcauacauauucuacug

SEQ ID NO: 825188 - RNA, 19 nt, Homo sapiens
gauaauuguucaucuuugc

SEQ ID NO: 825189 - RNA, 19 nt, Homo sapiens
caagagggagauaaacaaa

SEQ ID NO: 825190 - RNA, 19 nt, Homo sapiens
ccucuggucuacaaagauu

SEQ ID NO: 825191 - RNA, 19 nt, Homo sapiens
gaaccuugcccuuuaguac

SEQ ID NO: 825192 - RNA, 19 nt, Homo sapiens
gcccuuaguuaauagaaau

SEQ ID NO: 825193 - RNA, 19 nt, Homo sapiens
ugguauaucugucccuauu

SEQ ID NO: 825194 - RNA, 19 nt, Homo sapiens
ucaugggugugguuucuuu

SEQ ID NO: 825195 - RNA, 19 nt, Homo sapiens
cugauuccaugcacuagua

SEQ ID NO: 825196 - RNA, 19 nt, Homo sapiens
ugucugacuucgugaauau

SEQ ID NO: 825197 - RNA, 19 nt, Homo sapiens
cauuguagcauauguuuga

SEQ ID NO: 825198 - RNA, 19 nt, Homo sapiens
ucuuugguguuucugauua

SEQ ID NO: 825199 - RNA, 19 nt, Homo sapiens
cugaugaagagaccaauua

SEQ ID NO: 825200 - RNA, 19 nt, Homo sapiens
caagugaaucuggauaauu

SEQ ID NO: 825201 - RNA, 19 nt, Homo sapiens
cuucauggacaacucauua

SEQ ID NO: 825202 - RNA, 19 nt, Homo sapiens
gaaacgccucuucacacua

SEQ ID NO: 825203 - RNA, 19 nt, Homo sapiens
uaaauggaccacugaacaa

SEQ ID NO: 825204 - RNA, 19 nt, Homo sapiens
gacuugaggugaugauagu

SEQ ID NO: 825205 - RNA, 19 nt, Homo sapiens
cugauuaucuacuaucuag

SEQ ID NO: 825206 - RNA, 19 nt, Homo sapiens
aaacugauuccaugcacua

SEQ ID NO: 825207 - RNA, 19 nt, Homo sapiens
aaguaaggcuucgugcaua

SEQ ID NO: 825208 - RNA, 19 nt, Homo sapiens
ugacuaccuuguucccauu

SEQ ID NO: 825209 - RNA, 19 nt, Homo sapiens
gagaccagaauaagccuuu

SEQ ID NO: 825210 - RNA, 19 nt, Homo sapiens
gcauuuaggauuucuagca

SEQ ID NO: 825211 - RNA, 19 nt, Homo sapiens
uaaauaagccugucuuccu

SEQ ID NO: 825212 - RNA, 19 nt, Homo sapiens
gguauaucugucccuauua

SEQ ID NO: 825213 - RNA, 19 nt, Homo sapiens
gaauuuauugcacugaugu

SEQ ID NO: 825214 - RNA, 19 nt, Homo sapiens
uuacggaaguagcucuuug

SEQ ID NO: 825215 - RNA, 19 nt, Homo sapiens
ccaauaaauggaccacuga

SEQ ID NO: 825216 - RNA, 19 nt, Homo sapiens
agagaccaauuaagauuca

SEQ ID NO: 825217 - RNA, 19 nt, Homo sapiens
ccaagagggagauaaacaa

SEQ ID NO: 825218 - RNA, 19 nt, Homo sapiens
cuuggaaagcuucuuauaa

SEQ ID NO: 825219 - RNA, 19 nt, Homo sapiens
gcugacauuagcuauagua

SEQ ID NO: 825220 - RNA, 19 nt, Homo sapiens
guuuaccacuucugaugaa

SEQ ID NO: 825221 - RNA, 19 nt, Homo sapiens
ucaagugaaucuggauaau

SEQ ID NO: 825222 - RNA, 19 nt, Homo sapiens
caaguaaggcuucgugcau

SEQ ID NO: 825223 - RNA, 19 nt, Homo sapiens
caacauggaaucauuuuga

SEQ ID NO: 825224 - RNA, 19 nt, Homo sapiens
gacgggaacaauucuuaaa

SEQ ID NO: 825225 - RNA, 19 nt, Homo sapiens
ugacugacgggaacaauuc

SEQ ID NO: 825226 - RNA, 19 nt, Homo sapiens
uggaaagcuucuuauaauc

SEQ ID NO: 825227 - RNA, 19 nt, Homo sapiens
cugcaagucuggaagaaca

SEQ ID NO: 825228 - RNA, 19 nt, Homo sapiens
ggagaagaguccccaugaa

SEQ ID NO: 825229 - RNA, 19 nt, Homo sapiens
augaagagaccaauuaaga

SEQ ID NO: 825230 - RNA, 19 nt, Homo sapiens
ggaagaacagcugcaagga

SEQ ID NO: 825231 - RNA, 19 nt, Homo sapiens
ucacucugcccuuaguuaa

SEQ ID NO: 825232 - RNA, 19 nt, Homo sapiens
ugaauuuauugcacugaug

SEQ ID NO: 825233 - RNA, 19 nt, Homo sapiens
gagaagaguccccaugaaa

SEQ ID NO: 825234 - RNA, 19 nt, Homo sapiens
gcuuagauaccauguagug

SEQ ID NO: 825235 - RNA, 19 nt, Homo sapiens
ggugaaccuugcccuuuag

SEQ ID NO: 825236 - RNA, 19 nt, Homo sapiens
agagggagauaaacaaacu

SEQ ID NO: 825237 - RNA, 19 nt, Homo sapiens
gucuaugacuuucacucua

SEQ ID NO: 825238 - RNA, 19 nt, Homo sapiens
gcuuagcaauuuguaggaa

SEQ ID NO: 825239 - RNA, 19 nt, Homo sapiens
ugaagagaccaauuaagau

SEQ ID NO: 825240 - RNA, 19 nt, Homo sapiens
caucaugggugugguuucu

SEQ ID NO: 825241 - RNA, 19 nt, Homo sapiens
aauucagacucgccaagua

SEQ ID NO: 825242 - RNA, 19 nt, Homo sapiens
caaacaagauggccaaugu

SEQ ID NO: 825243 - RNA, 19 nt, Homo sapiens
uaaaggcagucgugauaua

SEQ ID NO: 825244 - RNA, 19 nt, Homo sapiens
caacugacuugaugcuuaa

SEQ ID NO: 825245 - RNA, 19 nt, Homo sapiens
ccaacugacuugaugcuua

SEQ ID NO: 825246 - RNA, 19 nt, Homo sapiens
ggagagagauggcugauac

SEQ ID NO: 825247 - RNA, 19 nt, Homo sapiens
cgaaagggcugauaauuuu

SEQ ID NO: 825248 - RNA, 19 nt, Homo sapiens
gcacagcacuggcucuaca

SEQ ID NO: 825249 - RNA, 19 nt, Homo sapiens
ggaaacaguugccacaucu

SEQ ID NO: 825250 - RNA, 19 nt, Homo sapiens
gccaguacaucgcuuauga

SEQ ID NO: 825251 - RNA, 19 nt, Homo sapiens
uaaagaaccuccuccaaac

SEQ ID NO: 825252 - RNA, 19 nt, Homo sapiens
gaacgaaagggcugauaau

SEQ ID NO: 825253 - RNA, 19 nt, Homo sapiens
guacaaagguaucauugac

SEQ ID NO: 825254 - RNA, 19 nt, Homo sapiens
gaaguacaaagguaucauu

SEQ ID NO: 825255 - RNA, 19 nt, Homo sapiens
cagagaaggugaauaaugc

SEQ ID NO: 825256 - RNA, 19 nt, Homo sapiens
guacagcucaggcaaguug

SEQ ID NO: 825257 - RNA, 19 nt, Homo sapiens
gacuuacucuggaaucuug

SEQ ID NO: 825258 - RNA, 19 nt, Homo sapiens
caacaauagcugacaauuc

SEQ ID NO: 825259 - RNA, 19 nt, Homo sapiens
gcacugggauuugccaagu

SEQ ID NO: 825260 - RNA, 19 nt, Homo sapiens
gggcaucgccgacccuauu

SEQ ID NO: 825261 - RNA, 19 nt, Homo sapiens
gaagaucuggaaacaguug

SEQ ID NO: 825262 - RNA, 19 nt, Homo sapiens
agcacuggcucuacauuua

SEQ ID NO: 825263 - RNA, 19 nt, Homo sapiens
ucuaaaggcagucgugaua

SEQ ID NO: 825264 - RNA, 19 nt, Homo sapiens
gaacauggaggacaagacu

SEQ ID NO: 825265 - RNA, 19 nt, Homo sapiens
acgaggcccuggauaagua

SEQ ID NO: 825266 - RNA, 19 nt, Homo sapiens
auaaagaaccuccuccaaa

SEQ ID NO: 825267 - RNA, 19 nt, Homo sapiens
cugaagaucuggaaacagu

SEQ ID NO: 825268 - RNA, 19 nt, Homo sapiens
ccacccacaugccaacuga

SEQ ID NO: 825269 - RNA, 19 nt, Homo sapiens
acgaaagggcugauaauuu

SEQ ID NO: 825270 - RNA, 19 nt, Homo sapiens
aaacaguugccacaucuaa

SEQ ID NO: 825271 - RNA, 19 nt, Homo sapiens
ccagagaaggugaauaaug

SEQ ID NO: 825272 - RNA, 19 nt, Homo sapiens
ggucuuacgccaacaauag

SEQ ID NO: 825273 - RNA, 19 nt, Homo sapiens
aggcagucgugauauauaa

SEQ ID NO: 825274 - RNA, 19 nt, Homo sapiens
cugauaaucugacugaaca

SEQ ID NO: 825275 - RNA, 19 nt, Homo sapiens
gcugcuagcucacauacag

SEQ ID NO: 825276 - RNA, 19 nt, Homo sapiens
gcaauucuggagcuggaua

SEQ ID NO: 825277 - RNA, 19 nt, Homo sapiens
ggcagccacucuccaaaga

SEQ ID NO: 825278 - RNA, 19 nt, Homo sapiens
gcaacgccaugcucauugg

SEQ ID NO: 825279 - RNA, 19 nt, Homo sapiens
gaaugaagugccugaggaa

SEQ ID NO: 825280 - RNA, 19 nt, Homo sapiens
caagauggccaauguguac

SEQ ID NO: 825281 - RNA, 19 nt, Homo sapiens
uguccgagaucauagagaa

SEQ ID NO: 825282 - RNA, 19 nt, Homo sapiens
caucgucacuggcaucuac

SEQ ID NO: 825283 - RNA, 19 nt, Homo sapiens
gcagugggcacaguauuug

SEQ ID NO: 825284 - RNA, 19 nt, Homo sapiens
gggaacacaucuccuacuc

SEQ ID NO: 825285 - RNA, 19 nt, Homo sapiens
gcugcugccuguuugauuc

SEQ ID NO: 825286 - RNA, 19 nt, Homo sapiens
ugccagagaaggugaauaa

SEQ ID NO: 825287 - RNA, 19 nt, Homo sapiens
cugacuugaugcuuaauaa

SEQ ID NO: 825288 - RNA, 19 nt, Homo sapiens
gaccugacuuacucuggaa

SEQ ID NO: 825289 - RNA, 19 nt, Homo sapiens
gaaaagcaaucagucacaa

SEQ ID NO: 825290 - RNA, 19 nt, Homo sapiens
ugagcugucuucaguggaa

SEQ ID NO: 825291 - RNA, 19 nt, Homo sapiens
ccagaggccugccaguaca

SEQ ID NO: 825292 - RNA, 19 nt, Homo sapiens
gccgauggcuuccucuaca

SEQ ID NO: 825293 - RNA, 19 nt, Homo sapiens
gaugcugagucaagacaau

SEQ ID NO: 825294 - RNA, 19 nt, Homo sapiens
gaaccuccuccaaacaaga

SEQ ID NO: 825295 - RNA, 19 nt, Homo sapiens
ggacaagugggaacacauc

SEQ ID NO: 825296 - RNA, 19 nt, Homo sapiens
ccacaugccaacugacuug

SEQ ID NO: 825297 - RNA, 19 nt, Homo sapiens
aacaauagcugacaauucc

SEQ ID NO: 825298 - RNA, 19 nt, Homo sapiens
caugccaacugacuugaug

SEQ ID NO: 825299 - RNA, 19 nt, Homo sapiens
gugaggaccacccaagaaa

SEQ ID NO: 825300 - RNA, 19 nt, Homo sapiens
agacugauaaucugacuga

SEQ ID NO: 825301 - RNA, 19 nt, Homo sapiens
ccucaaagaauuaaucauc

SEQ ID NO: 825302 - RNA, 19 nt, Homo sapiens
uguacacgauggaggaauu

SEQ ID NO: 825303 - RNA, 19 nt, Homo sapiens
gaaacaguugccacaucua

SEQ ID NO: 825304 - RNA, 19 nt, Homo sapiens
ggcagugggcacaguauuu

SEQ ID NO: 825305 - RNA, 19 nt, Homo sapiens
gcccacagcuucccuacac

SEQ ID NO: 825306 - RNA, 19 nt, Homo sapiens
cuacauuuaccaggucuua

SEQ ID NO: 825307 - RNA, 19 nt, Homo sapiens
gcagaugccacgcaauucu

SEQ ID NO: 825308 - RNA, 19 nt, Homo sapiens
uuggagaaguacaaaggua

SEQ ID NO: 825309 - RNA, 19 nt, Homo sapiens
ccaaagagucccugaacca

SEQ ID NO: 825310 - RNA, 19 nt, Homo sapiens
caaccagugcugugugcua

SEQ ID NO: 825311 - RNA, 19 nt, Homo sapiens
cgacccuauuauuccauua

SEQ ID NO: 825312 - RNA, 19 nt, Homo sapiens
cagcacuggcucuacauuu

SEQ ID NO: 825313 - RNA, 19 nt, Homo sapiens
ccaugucggugaccuugga

SEQ ID NO: 825314 - RNA, 19 nt, Homo sapiens
uagcugacaauuccaagaa

SEQ ID NO: 825315 - RNA, 19 nt, Homo sapiens
cggcaggacaugauuguga

SEQ ID NO: 825316 - RNA, 19 nt, Homo sapiens
agaacgaaagggcugauaa

SEQ ID NO: 825317 - RNA, 19 nt, Homo sapiens
gaucauagagaagaaggau

SEQ ID NO: 825318 - RNA, 19 nt, Homo sapiens
ccaugcugcucaccuugaa

SEQ ID NO: 825319 - RNA, 19 nt, Homo sapiens
gcgccaaugucaucauggu

SEQ ID NO: 825320 - RNA, 19 nt, Homo sapiens
gcacuggcucuacauuuac

SEQ ID NO: 825321 - RNA, 19 nt, Homo sapiens
ucuacgaggcccuggauaa

SEQ ID NO: 825322 - RNA, 19 nt, Homo sapiens
uggaaacaguugccacauc

SEQ ID NO: 825323 - RNA, 19 nt, Homo sapiens
agaagcagcuggaaaagau

SEQ ID NO: 825324 - RNA, 19 nt, Homo sapiens
caucgccgacccuauuauu

SEQ ID NO: 825325 - RNA, 19 nt, Homo sapiens
ggcaucgccgacccuauua

SEQ ID NO: 825326 - RNA, 19 nt, Homo sapiens
cuagcgaccugacuuacuc

SEQ ID NO: 825327 - RNA, 19 nt, Homo sapiens
ugccaagucuguuagaucu

SEQ ID NO: 825328 - RNA, 19 nt, Homo sapiens
gcauuucugccaagucugu

SEQ ID NO: 825329 - RNA, 19 nt, Homo sapiens
ggagaaguacaaagguauc

SEQ ID NO: 825330 - RNA, 19 nt, Homo sapiens
cauuucggguggagaguug

SEQ ID NO: 825331 - RNA, 19 nt, Homo sapiens
cacaguguccgagaucaua

SEQ ID NO: 825332 - RNA, 19 nt, Homo sapiens
ccaccacaguguccgagau

SEQ ID NO: 825333 - RNA, 19 nt, Homo sapiens
gcagagacacagcacuucu

SEQ ID NO: 825334 - RNA, 19 nt, Homo sapiens
uggaaaagauccugaagau

SEQ ID NO: 825335 - RNA, 19 nt, Homo sapiens
ugaagcaggcccacagugu

SEQ ID NO: 825336 - RNA, 19 nt, Homo sapiens
caccuagcgaccugacuua

SEQ ID NO: 825337 - RNA, 19 nt, Homo sapiens
ucacaguuuuggagaagua

SEQ ID NO: 825338 - RNA, 19 nt, Homo sapiens
gccuaugccugcaguuucu

SEQ ID NO: 825339 - RNA, 19 nt, Homo sapiens
acaagauggccaaugugua

SEQ ID NO: 825340 - RNA, 19 nt, Homo sapiens
uauaaagaaccuccuccaa

SEQ ID NO: 825341 - RNA, 19 nt, Homo sapiens
ccaacaauagcugacaauu

SEQ ID NO: 825342 - RNA, 19 nt, Homo sapiens
gaacuaaggagcccuauua

SEQ ID NO: 825343 - RNA, 19 nt, Homo sapiens
gcaaggcgcuagaaucuuu

SEQ ID NO: 825344 - RNA, 19 nt, Homo sapiens
ucagagguuugaagaauua

SEQ ID NO: 825345 - RNA, 19 nt, Homo sapiens
ggacagugcucuagaugug

SEQ ID NO: 825346 - RNA, 19 nt, Homo sapiens
caauagagguugagagaga

SEQ ID NO: 825347 - RNA, 19 nt, Homo sapiens
gcuaucagcucuucugcua

SEQ ID NO: 825348 - RNA, 19 nt, Homo sapiens
gaaagcgcauugccaagaa

SEQ ID NO: 825349 - RNA, 19 nt, Homo sapiens
gcacagacuccauggauaa

SEQ ID NO: 825350 - RNA, 19 nt, Homo sapiens
caaagaacacccuauauga

SEQ ID NO: 825351 - RNA, 19 nt, Homo sapiens
gcacagagaauacaucaga

SEQ ID NO: 825352 - RNA, 19 nt, Homo sapiens
gaucaguucuuagcaauga

SEQ ID NO: 825353 - RNA, 19 nt, Homo sapiens
uagcuuagauguuguaaug

SEQ ID NO: 825354 - RNA, 19 nt, Homo sapiens
gacuuuggcuuucacauuu

SEQ ID NO: 825355 - RNA, 19 nt, Homo sapiens
gagcgcagcugacaacuag

SEQ ID NO: 825356 - RNA, 19 nt, Homo sapiens
gaauuacacuggccuuugu

SEQ ID NO: 825357 - RNA, 19 nt, Homo sapiens
gaacaucacuuuuaaccuu

SEQ ID NO: 825358 - RNA, 19 nt, Homo sapiens
ugacgaaacuccaucucua

SEQ ID NO: 825359 - RNA, 19 nt, Homo sapiens
ucaagucucuuuacuccua

SEQ ID NO: 825360 - RNA, 19 nt, Homo sapiens
gagaauacaucagacuuau

SEQ ID NO: 825361 - RNA, 19 nt, Homo sapiens
ggaaugccuucuccuaaga

SEQ ID NO: 825362 - RNA, 19 nt, Homo sapiens
gaauaacgcaggucccuuu

SEQ ID NO: 825363 - RNA, 19 nt, Homo sapiens
gaaacuccaucucuaucaa

SEQ ID NO: 825364 - RNA, 19 nt, Homo sapiens
uaaguuggauucuuucaga

SEQ ID NO: 825365 - RNA, 19 nt, Homo sapiens
gcagaucaguucuuagcaa

SEQ ID NO: 825366 - RNA, 19 nt, Homo sapiens
ccacaaagaacacccuaua

SEQ ID NO: 825367 - RNA, 19 nt, Homo sapiens
gaacccaccauacaaguuu

SEQ ID NO: 825368 - RNA, 19 nt, Homo sapiens
ggagaaagaggaauugaga

SEQ ID NO: 825369 - RNA, 19 nt, Homo sapiens
aaagaggaauugagaaaug

SEQ ID NO: 825370 - RNA, 19 nt, Homo sapiens
gaucuuguauagaccaauu

SEQ ID NO: 825371 - RNA, 19 nt, Homo sapiens
caaauucagcuauaggaua

SEQ ID NO: 825372 - RNA, 19 nt, Homo sapiens
ucaaaggcaucagcauaua

SEQ ID NO: 825373 - RNA, 19 nt, Homo sapiens
ggaauggucacuucugauu

SEQ ID NO: 825374 - RNA, 19 nt, Homo sapiens
caucagaacuuggauuuua

SEQ ID NO: 825375 - RNA, 19 nt, Homo sapiens
ccaaguagcugggauuaca

SEQ ID NO: 825376 - RNA, 19 nt, Homo sapiens
gcucaaaggcaucagcaua

SEQ ID NO: 825377 - RNA, 19 nt, Homo sapiens
uggcugagaucaccaauau

SEQ ID NO: 825378 - RNA, 19 nt, Homo sapiens
caucagagguuugaagaau

SEQ ID NO: 825379 - RNA, 19 nt, Homo sapiens
ugacagccauuucuugguu

SEQ ID NO: 825380 - RNA, 19 nt, Homo sapiens
cauagaagaacaucacuuu

SEQ ID NO: 825381 - RNA, 19 nt, Homo sapiens
uaaacuagguaaacuugga

SEQ ID NO: 825382 - RNA, 19 nt, Homo sapiens
aaaggaauauccagaagug

SEQ ID NO: 825383 - RNA, 19 nt, Homo sapiens
cuaaggagcccuauuacaa

SEQ ID NO: 825384 - RNA, 19 nt, Homo sapiens
cgaccuagcuuugaugugu

SEQ ID NO: 825385 - RNA, 19 nt, Homo sapiens
uuccagagcuaacugauaa

SEQ ID NO: 825386 - RNA, 19 nt, Homo sapiens
cagcaucuuucugggauua

SEQ ID NO: 825387 - RNA, 19 nt, Homo sapiens
gaaagaaagacaagagagu

SEQ ID NO: 825388 - RNA, 19 nt, Homo sapiens
gaccauccuuccugacaaa

SEQ ID NO: 825389 - RNA, 19 nt, Homo sapiens
gagauagucuggucuuugc

SEQ ID NO: 825390 - RNA, 19 nt, Homo sapiens
gaucuugcuuucaguguuc

SEQ ID NO: 825391 - RNA, 19 nt, Homo sapiens
gaaugaagauaaguuggau

SEQ ID NO: 825392 - RNA, 19 nt, Homo sapiens
uagcaacagccucugauua

SEQ ID NO: 825393 - RNA, 19 nt, Homo sapiens
uuauaucucugcucuuuga

SEQ ID NO: 825394 - RNA, 19 nt, Homo sapiens
guucuucucuccucuaauc

SEQ ID NO: 825395 - RNA, 19 nt, Homo sapiens
ucaccggucucucagguaa

SEQ ID NO: 825396 - RNA, 19 nt, Homo sapiens
cagccaagauggacauguu

SEQ ID NO: 825397 - RNA, 19 nt, Homo sapiens
gguuagcuuugcuucauaa

SEQ ID NO: 825398 - RNA, 19 nt, Homo sapiens
gagguuagcuuugcuucau

SEQ ID NO: 825399 - RNA, 19 nt, Homo sapiens
uaucagcucuucugcuaug

SEQ ID NO: 825400 - RNA, 19 nt, Homo sapiens
caauguaaccauauacuug

SEQ ID NO: 825401 - RNA, 19 nt, Homo sapiens
caugaucccucuccaaagu

SEQ ID NO: 825402 - RNA, 19 nt, Homo sapiens
gagcaauucugagcaguca

SEQ ID NO: 825403 - RNA, 19 nt, Homo sapiens
ggaugcaauucuucuucua

SEQ ID NO: 825404 - RNA, 19 nt, Homo sapiens
ggaacuacaggaugcaauu

SEQ ID NO: 825405 - RNA, 19 nt, Homo sapiens
aaaacgagcugcauaauuc

SEQ ID NO: 825406 - RNA, 19 nt, Homo sapiens
ccagagcugucucaccauu

SEQ ID NO: 825407 - RNA, 19 nt, Homo sapiens
gcaguaagccaagaaacaa

SEQ ID NO: 825408 - RNA, 19 nt, Homo sapiens
ggaaagaccccuauaaauc

SEQ ID NO: 825409 - RNA, 19 nt, Homo sapiens
ggagugcaauggugagauc

SEQ ID NO: 825410 - RNA, 19 nt, Homo sapiens
ccauuuccuuguagcuuua

SEQ ID NO: 825411 - RNA, 19 nt, Homo sapiens
ggcacagacuccauggaua

SEQ ID NO: 825412 - RNA, 19 nt, Homo sapiens
gcaagccuguggccaagug

SEQ ID NO: 825413 - RNA, 19 nt, Homo sapiens
guaaugagguuagcuuugc

SEQ ID NO: 825414 - RNA, 19 nt, Homo sapiens
gacaucagaacuuggauuu

SEQ ID NO: 825415 - RNA, 19 nt, Homo sapiens
gaaagaggaauugagaaau

SEQ ID NO: 825416 - RNA, 19 nt, Homo sapiens
gcgcuagaaucuuuuauuu

SEQ ID NO: 825417 - RNA, 19 nt, Homo sapiens
ccucaaagccagacacuug

SEQ ID NO: 825418 - RNA, 19 nt, Homo sapiens
ccacuagucucuguccuau

SEQ ID NO: 825419 - RNA, 19 nt, Homo sapiens
gaauucaagucucuuuacu

SEQ ID NO: 825420 - RNA, 19 nt, Homo sapiens
gaagucaucagagguuuga

SEQ ID NO: 825421 - RNA, 19 nt, Homo sapiens
ucuuauaucucugcucuuu

SEQ ID NO: 825422 - RNA, 19 nt, Homo sapiens
ccauauacuugcaugucua

SEQ ID NO: 825423 - RNA, 19 nt, Homo sapiens
gacgagaccuucaccuucu

SEQ ID NO: 825424 - RNA, 19 nt, Homo sapiens
aaggucacuuuaugaguua

SEQ ID NO: 825425 - RNA, 19 nt, Homo sapiens
gaauggucacuucugauuu

SEQ ID NO: 825426 - RNA, 19 nt, Homo sapiens
aagagucaguugaaagaaa

SEQ ID NO: 825427 - RNA, 19 nt, Homo sapiens
ccuuguagcuuuauuccuu

SEQ ID NO: 825428 - RNA, 19 nt, Homo sapiens
gauuagaauucaagucucu

SEQ ID NO: 825429 - RNA, 19 nt, Homo sapiens
ccaaagugcugggauuaca

SEQ ID NO: 825430 - RNA, 19 nt, Homo sapiens
gaccacagcugcagaucag

SEQ ID NO: 825431 - RNA, 19 nt, Homo sapiens
acaaagaacacccuauaug

SEQ ID NO: 825432 - RNA, 19 nt, Homo sapiens
guacuaauccuguucuucu

SEQ ID NO: 825433 - RNA, 19 nt, Homo sapiens
ggauaucaccggucucuca

SEQ ID NO: 825434 - RNA, 19 nt, Homo sapiens
gccagacacuugccgaaga

SEQ ID NO: 825435 - RNA, 19 nt, Homo sapiens
gacauugcccucaccauga

SEQ ID NO: 825436 - RNA, 19 nt, Homo sapiens
agagucacaucuuagcuuu

SEQ ID NO: 825437 - RNA, 19 nt, Homo sapiens
ggagauagucuggucuuug

SEQ ID NO: 825438 - RNA, 19 nt, Homo sapiens
gaauacaucagacuuaugc

SEQ ID NO: 825439 - RNA, 19 nt, Homo sapiens
agaaagaggaauugagaaa

SEQ ID NO: 825440 - RNA, 19 nt, Homo sapiens
ccaggugucucugucauau

SEQ ID NO: 825441 - RNA, 19 nt, Homo sapiens
agaggaggaugucaugcua

SEQ ID NO: 825442 - RNA, 19 nt, Homo sapiens
gagaggagcuggccuauga

SEQ ID NO: 825443 - RNA, 19 nt, Homo sapiens
gaacguggaugacucaguu

SEQ ID NO: 825444 - RNA, 19 nt, Homo sapiens
uuaauacgcuugagcaaua

SEQ ID NO: 825445 - RNA, 19 nt, Homo sapiens
ccagagagcucaaguuuca

SEQ ID NO: 825446 - RNA, 19 nt, Homo sapiens
ggaaugcuguuacuuugau

SEQ ID NO: 825447 - RNA, 19 nt, Homo sapiens
gcaauaaacaucaacuuca

SEQ ID NO: 825448 - RNA, 19 nt, Homo sapiens
gaccagagagcucaaguuu

SEQ ID NO: 825449 - RNA, 19 nt, Homo sapiens
ggcuugcacuuucuuauuu

SEQ ID NO: 825450 - RNA, 19 nt, Homo sapiens
gagaagacaugaacguuuu

SEQ ID NO: 825451 - RNA, 19 nt, Homo sapiens
ggcaguaaauccacaguga

SEQ ID NO: 825452 - RNA, 19 nt, Homo sapiens
acacguggcuguacauuca

SEQ ID NO: 825453 - RNA, 19 nt, Homo sapiens
ugaaggaguucgacaagga

SEQ ID NO: 825454 - RNA, 19 nt, Homo sapiens
ggucagagcccaggaauuc

SEQ ID NO: 825455 - RNA, 19 nt, Homo sapiens
guggagauguuuaaggauu

SEQ ID NO: 825456 - RNA, 19 nt, Homo sapiens
gaggaacgccaaugugauu

SEQ ID NO: 825457 - RNA, 19 nt, Homo sapiens
caaugugauucccaacuuu

SEQ ID NO: 825458 - RNA, 19 nt, Homo sapiens
cggcugagauggauuacuu

SEQ ID NO: 825459 - RNA, 19 nt, Homo sapiens
gaaugcuguuacuuugaua

SEQ ID NO: 825460 - RNA, 19 nt, Homo sapiens
ccaaugugauucccaacuu

SEQ ID NO: 825461 - RNA, 19 nt, Homo sapiens
cuacuuagacccagucauu

SEQ ID NO: 825462 - RNA, 19 nt, Homo sapiens
guucacagccucuggauau

SEQ ID NO: 825463 - RNA, 19 nt, Homo sapiens
uggagauguuuaaggauua

SEQ ID NO: 825464 - RNA, 19 nt, Homo sapiens
caagugccauugccaguca

SEQ ID NO: 825465 - RNA, 19 nt, Homo sapiens
gagaauaacacuggcuuug

SEQ ID NO: 825466 - RNA, 19 nt, Homo sapiens
gaugcaaacuaguccugaa

SEQ ID NO: 825467 - RNA, 19 nt, Homo sapiens
acaguugggugugagaaua

SEQ ID NO: 825468 - RNA, 19 nt, Homo sapiens
guaaauccacagugaguug

SEQ ID NO: 825469 - RNA, 19 nt, Homo sapiens
gaggaggacugcaagaaaa

SEQ ID NO: 825470 - RNA, 19 nt, Homo sapiens
ccaccucccugcagcuuug

SEQ ID NO: 825471 - RNA, 19 nt, Homo sapiens
ggucuucucugugcugaug

SEQ ID NO: 825472 - RNA, 19 nt, Homo sapiens
gcagcggucuucuccaucu

SEQ ID NO: 825473 - RNA, 19 nt, Homo sapiens
gcacugucaugcccagcuu

SEQ ID NO: 825474 - RNA, 19 nt, Homo sapiens
gcacugucaugcccagcuu

SEQ ID NO: 825475 - RNA, 19 nt, Homo sapiens
caucagcaauaaacaucaa

SEQ ID NO: 825476 - RNA, 19 nt, Homo sapiens
ugagaagacaugaacguuu

SEQ ID NO: 825477 - RNA, 19 nt, Homo sapiens
gggcagcggucuucuccau

SEQ ID NO: 825478 - RNA, 19 nt, Homo sapiens
gagaaucguggagauguuu

SEQ ID NO: 825479 - RNA, 19 nt, Homo sapiens
gaacccaucagcaauaaac

SEQ ID NO: 825480 - RNA, 19 nt, Homo sapiens
uaauacgcuugagcaauaa

SEQ ID NO: 825481 - RNA, 19 nt, Homo sapiens
ugcccugucucccuacuua

SEQ ID NO: 825482 - RNA, 19 nt, Homo sapiens
accacuacguguuuaauuu

SEQ ID NO: 825483 - RNA, 19 nt, Homo sapiens
ggauuacccgccagccaua

SEQ ID NO: 825484 - RNA, 19 nt, Homo sapiens
cgaggaggacugcaagaaa

SEQ ID NO: 825485 - RNA, 19 nt, Homo sapiens
ccacuacguguuuaauuug

SEQ ID NO: 825486 - RNA, 19 nt, Homo sapiens
cuuccucccuccacgcuua

SEQ ID NO: 825487 - RNA, 19 nt, Homo sapiens
caggacagaucaggucaga

SEQ ID NO: 825488 - RNA, 19 nt, Homo sapiens
gaaucguggagauguuuaa

SEQ ID NO: 825489 - RNA, 19 nt, Homo sapiens
ugagaaucguggagauguu

SEQ ID NO: 825490 - RNA, 19 nt, Homo sapiens
cuaguggccugcuuuccaa

SEQ ID NO: 825491 - RNA, 19 nt, Homo sapiens
gaccacuacguguuuaauu

SEQ ID NO: 825492 - RNA, 19 nt, Homo sapiens
gaucugagaagacaugaac

SEQ ID NO: 825493 - RNA, 19 nt, Homo sapiens
cuggaaugcuguuacuuug

SEQ ID NO: 825494 - RNA, 19 nt, Homo sapiens
gcccugagcuacugcuucu

SEQ ID NO: 825495 - RNA, 19 nt, Homo sapiens
gauccuaguggccugcuuu

SEQ ID NO: 825496 - RNA, 19 nt, Homo sapiens
gguaaucgcaggcaucucu

SEQ ID NO: 825497 - RNA, 19 nt, Homo sapiens
aaacuggaaugcuguuacu

SEQ ID NO: 825498 - RNA, 19 nt, Homo sapiens
gaguggcucccgugucgua

SEQ ID NO: 825499 - RNA, 19 nt, Homo sapiens
gaaacuggaaugcuguuac

SEQ ID NO: 825500 - RNA, 19 nt, Homo sapiens
ggaguucgacaaggagaaa

SEQ ID NO: 825501 - RNA, 19 nt, Homo sapiens
ucguggagauguuuaagga

SEQ ID NO: 825502 - RNA, 19 nt, Homo sapiens
ccaacauucuggacgaagu

SEQ ID NO: 825503 - RNA, 19 nt, Homo sapiens
cuacguguuuaauuugguu

SEQ ID NO: 825504 - RNA, 19 nt, Homo sapiens
gcucggguccugaaaucuu

SEQ ID NO: 825505 - RNA, 19 nt, Homo sapiens
ggaggaacgccaaugugau

SEQ ID NO: 825506 - RNA, 19 nt, Homo sapiens
caauaaacgcugacuugca

SEQ ID NO: 825507 - RNA, 19 nt, Homo sapiens
gcgggcugaugucuucuug

SEQ ID NO: 825508 - RNA, 19 nt, Homo sapiens
ccugagcuacugcuucuaa

SEQ ID NO: 825509 - RNA, 19 nt, Homo sapiens
ggagauguuuaaggauuac

SEQ ID NO: 825510 - RNA, 19 nt, Homo sapiens
gacaaguggaaucauuauu

SEQ ID NO: 825511 - RNA, 19 nt, Homo sapiens
ggugacacguggcuguaca

SEQ ID NO: 825512 - RNA, 19 nt, Homo sapiens
uaucugucauucagcauca

SEQ ID NO: 825513 - RNA, 19 nt, Homo sapiens
cucggguccugaaaucuua

SEQ ID NO: 825514 - RNA, 19 nt, Homo sapiens
uuaggcacuuggaacguuu

SEQ ID NO: 825515 - RNA, 19 nt, Homo sapiens
ugacaaguggaaucauuau

SEQ ID NO: 825516 - RNA, 19 nt, Homo sapiens
ugacagcgccaacauucug

SEQ ID NO: 825517 - RNA, 19 nt, Homo sapiens
gcgaggaggacugcaagaa

SEQ ID NO: 825518 - RNA, 19 nt, Homo sapiens
ccaggaauucucacagguu

SEQ ID NO: 825519 - RNA, 19 nt, Homo sapiens
uuccuaggguaguuuaauu

SEQ ID NO: 825520 - RNA, 19 nt, Homo sapiens
uuacucagucgucgaggua

SEQ ID NO: 825521 - RNA, 19 nt, Homo sapiens
cccaugggcugcuggaaag

SEQ ID NO: 825522 - RNA, 19 nt, Homo sapiens
gagccgucguggugcaaau

SEQ ID NO: 825523 - RNA, 19 nt, Homo sapiens
caaguuugcugagcuuuug

SEQ ID NO: 825524 - RNA, 19 nt, Homo sapiens
aaagaagggcuccaugucu

SEQ ID NO: 825525 - RNA, 19 nt, Homo sapiens
aguuucagagucagaauua

SEQ ID NO: 825526 - RNA, 19 nt, Homo sapiens
cauccaaggcuuuguaaac

SEQ ID NO: 825527 - RNA, 19 nt, Homo sapiens
cguccugggugcugucaug

SEQ ID NO: 825528 - RNA, 19 nt, Homo sapiens
ucacgucuccgcugcuguu

SEQ ID NO: 825529 - RNA, 19 nt, Homo sapiens
ccucggcaauugugagcuu

SEQ ID NO: 825530 - RNA, 19 nt, Homo sapiens
uaauuugguuuggaugcaa

SEQ ID NO: 825531 - RNA, 19 nt, Homo sapiens
ugugaccacuacguguuua

SEQ ID NO: 825532 - RNA, 19 nt, Homo sapiens
gcugugaccacuacguguu

SEQ ID NO: 825533 - RNA, 19 nt, Homo sapiens
gaccugcagcugucgaaga

SEQ ID NO: 825534 - RNA, 19 nt, Homo sapiens
acuggaaugcuguuacuuu

SEQ ID NO: 825535 - RNA, 19 nt, Homo sapiens
cuggauaucugucauucag

SEQ ID NO: 825536 - RNA, 19 nt, Homo sapiens
auucccaacuuucagauau

SEQ ID NO: 825537 - RNA, 19 nt, Homo sapiens
gauucccaacuuucagaua

SEQ ID NO: 825538 - RNA, 19 nt, Homo sapiens
cugccaagauaccuucaug

SEQ ID NO: 825539 - RNA, 19 nt, Homo sapiens
gcugagcuuuuguuucauu

SEQ ID NO: 825540 - RNA, 19 nt, Homo sapiens
cagggacaguuggguguga

SEQ ID NO: 825541 - RNA, 19 nt, Homo sapiens
gggcugcauccaaggcuuu

SEQ ID NO: 825542 - RNA, 19 nt, Homo sapiens
gagaggagcuggccuauga

SEQ ID NO: 825543 - RNA, 19 nt, Homo sapiens
gaacguggaugacucaguu

SEQ ID NO: 825544 - RNA, 19 nt, Homo sapiens
uuaauacgcuugagcaaua

SEQ ID NO: 825545 - RNA, 19 nt, Homo sapiens
ccagagagcucaaguuuca

SEQ ID NO: 825546 - RNA, 19 nt, Homo sapiens
ggacgaaguugccgaugga

SEQ ID NO: 825547 - RNA, 19 nt, Homo sapiens
ggaaugcuguuacuuugau

SEQ ID NO: 825548 - RNA, 19 nt, Homo sapiens
gcaauaaacaucaacuuca

SEQ ID NO: 825549 - RNA, 19 nt, Homo sapiens
gaccagagagcucaaguuu

SEQ ID NO: 825550 - RNA, 19 nt, Homo sapiens
ggcuugcacuuucuuauuu

SEQ ID NO: 825551 - RNA, 19 nt, Homo sapiens
gagaagacaugaacguuuu

SEQ ID NO: 825552 - RNA, 19 nt, Homo sapiens
ggcaguaaauccacaguga

SEQ ID NO: 825553 - RNA, 19 nt, Homo sapiens
acacguggcuguacauuca

SEQ ID NO: 825554 - RNA, 19 nt, Homo sapiens
ugaaggaguucgacaagga

SEQ ID NO: 825555 - RNA, 19 nt, Homo sapiens
ggucagagcccaggaauuc

SEQ ID NO: 825556 - RNA, 19 nt, Homo sapiens
guggagauguuuaaggauu

SEQ ID NO: 825557 - RNA, 19 nt, Homo sapiens
gaggaacgccaaugugauu

SEQ ID NO: 825558 - RNA, 19 nt, Homo sapiens
caaugugauucccaacuuu

SEQ ID NO: 825559 - RNA, 19 nt, Homo sapiens
cggcugagauggauuacuu

SEQ ID NO: 825560 - RNA, 19 nt, Homo sapiens
gaaugcuguuacuuugaua

SEQ ID NO: 825561 - RNA, 19 nt, Homo sapiens
ccaaugugauucccaacuu

SEQ ID NO: 825562 - RNA, 19 nt, Homo sapiens
cuacuuagacccagucauu

SEQ ID NO: 825563 - RNA, 19 nt, Homo sapiens
guucacagccucuggauau

SEQ ID NO: 825564 - RNA, 19 nt, Homo sapiens
uggagauguuuaaggauua

SEQ ID NO: 825565 - RNA, 19 nt, Homo sapiens
caagugccauugccaguca

SEQ ID NO: 825566 - RNA, 19 nt, Homo sapiens
gaacccagacuauucagau

SEQ ID NO: 825567 - RNA, 19 nt, Homo sapiens
gagaauaacacuggcuuug

SEQ ID NO: 825568 - RNA, 19 nt, Homo sapiens
gaugcaaacuaguccugaa

SEQ ID NO: 825569 - RNA, 19 nt, Homo sapiens
acaguugggugugagaaua

SEQ ID NO: 825570 - RNA, 19 nt, Homo sapiens
guaaauccacagugaguug

SEQ ID NO: 825571 - RNA, 19 nt, Homo sapiens
gaggaggacugcaagaaaa

SEQ ID NO: 825572 - RNA, 19 nt, Homo sapiens
uguagaaucucacccugaa

SEQ ID NO: 825573 - RNA, 19 nt, Homo sapiens
ccaccucccugcagcuuug

SEQ ID NO: 825574 - RNA, 19 nt, Homo sapiens
ggucuucucugugcugaug

SEQ ID NO: 825575 - RNA, 19 nt, Homo sapiens
gcagcggucuucuccaucu

SEQ ID NO: 825576 - RNA, 19 nt, Homo sapiens
gcacugucaugcccagcuu

SEQ ID NO: 825577 - RNA, 19 nt, Homo sapiens
gggcccagauggaucaaug

SEQ ID NO: 825578 - RNA, 19 nt, Homo sapiens
gcacugucaugcccagcuu

SEQ ID NO: 825579 - RNA, 19 nt, Homo sapiens
caucagcaauaaacaucaa

SEQ ID NO: 825580 - RNA, 19 nt, Homo sapiens
ugagaagacaugaacguuu

SEQ ID NO: 825581 - RNA, 19 nt, Homo sapiens
gggcagcggucuucuccau

SEQ ID NO: 825582 - RNA, 19 nt, Homo sapiens
gagaaucguggagauguuu

SEQ ID NO: 825583 - RNA, 19 nt, Homo sapiens
gaacccaucagcaauaaac

SEQ ID NO: 825584 - RNA, 19 nt, Homo sapiens
uaauacgcuugagcaauaa

SEQ ID NO: 825585 - RNA, 19 nt, Homo sapiens
ugcccugucucccuacuua

SEQ ID NO: 825586 - RNA, 19 nt, Homo sapiens
accacuacguguuuaauuu

SEQ ID NO: 825587 - RNA, 19 nt, Homo sapiens
ggauuacccgccagccaua

SEQ ID NO: 825588 - RNA, 19 nt, Homo sapiens
cgaggaggacugcaagaaa

SEQ ID NO: 825589 - RNA, 19 nt, Homo sapiens
ccacuacguguuuaauuug

SEQ ID NO: 825590 - RNA, 19 nt, Homo sapiens
cuuccucccuccacgcuua

SEQ ID NO: 825591 - RNA, 19 nt, Homo sapiens
cccagacuauucagauaaa

SEQ ID NO: 825592 - RNA, 19 nt, Homo sapiens
caggacagaucaggucaga

SEQ ID NO: 825593 - RNA, 19 nt, Homo sapiens
cgaaguugccgauggaugu

SEQ ID NO: 825594 - RNA, 19 nt, Homo sapiens
gaaucguggagauguuuaa

SEQ ID NO: 825595 - RNA, 19 nt, Homo sapiens
ugagaaucguggagauguu

SEQ ID NO: 825596 - RNA, 19 nt, Homo sapiens
cuaguggccugcuuuccaa

SEQ ID NO: 825597 - RNA, 19 nt, Homo sapiens
gaccacuacguguuuaauu

SEQ ID NO: 825598 - RNA, 19 nt, Homo sapiens
gcauuuaaaguguagaauc

SEQ ID NO: 825599 - RNA, 19 nt, Homo sapiens
gaucugagaagacaugaac

SEQ ID NO: 825600 - RNA, 19 nt, Homo sapiens
cuggaaugcuguuacuuug

SEQ ID NO: 825601 - RNA, 19 nt, Homo sapiens
gcccugagcuacugcuucu

SEQ ID NO: 825602 - RNA, 19 nt, Homo sapiens
gauccuaguggccugcuuu

SEQ ID NO: 825603 - RNA, 19 nt, Homo sapiens
gguaaucgcaggcaucucu

SEQ ID NO: 825604 - RNA, 19 nt, Homo sapiens
aaacuggaaugcuguuacu

SEQ ID NO: 825605 - RNA, 19 nt, Homo sapiens
gaguggcucccgugucgua

SEQ ID NO: 825606 - RNA, 19 nt, Homo sapiens
aacccagacuauucagaua

SEQ ID NO: 825607 - RNA, 19 nt, Homo sapiens
ggagggcccagauggauca

SEQ ID NO: 825608 - RNA, 19 nt, Homo sapiens
gaaacuggaaugcuguuac

SEQ ID NO: 825609 - RNA, 19 nt, Homo sapiens
ggaguucgacaaggagaaa

SEQ ID NO: 825610 - RNA, 19 nt, Homo sapiens
ucguggagauguuuaagga

SEQ ID NO: 825611 - RNA, 19 nt, Homo sapiens
ggcgugauguguucaugga

SEQ ID NO: 825612 - RNA, 19 nt, Homo sapiens
ccaacauucuggacgaagu

SEQ ID NO: 825613 - RNA, 19 nt, Homo sapiens
cuacguguuuaauuugguu

SEQ ID NO: 825614 - RNA, 19 nt, Homo sapiens
gcuaccaauuggagcaguu

SEQ ID NO: 825615 - RNA, 19 nt, Homo sapiens
gcucggguccugaaaucuu

SEQ ID NO: 825616 - RNA, 19 nt, Homo sapiens
ggaggaacgccaaugugau

SEQ ID NO: 825617 - RNA, 19 nt, Homo sapiens
caauaaacgcugacuugca

SEQ ID NO: 825618 - RNA, 19 nt, Homo sapiens
gcgggcugaugucuucuug

SEQ ID NO: 825619 - RNA, 19 nt, Homo sapiens
ccugagcuacugcuucuaa

SEQ ID NO: 825620 - RNA, 19 nt, Homo sapiens
ggagauguuuaaggauuac

SEQ ID NO: 825621 - RNA, 19 nt, Homo sapiens
gacaaguggaaucauuauu

SEQ ID NO: 825622 - RNA, 19 nt, Homo sapiens
uaucugucauucagcauca

SEQ ID NO: 825623 - RNA, 19 nt, Homo sapiens
ggugacacguggcuguaca

SEQ ID NO: 825624 - RNA, 19 nt, Homo sapiens
cucggguccugaaaucuua

SEQ ID NO: 825625 - RNA, 19 nt, Homo sapiens
ugacaaguggaaucauuau

SEQ ID NO: 825626 - RNA, 19 nt, Homo sapiens
ugacagcgccaacauucug

SEQ ID NO: 825627 - RNA, 19 nt, Homo sapiens
gcgaggaggacugcaagaa

SEQ ID NO: 825628 - RNA, 19 nt, Homo sapiens
ccaggaauucucacagguu

SEQ ID NO: 825629 - RNA, 19 nt, Homo sapiens
uuccuaggguaguuuaauu

SEQ ID NO: 825630 - RNA, 19 nt, Homo sapiens
gaaguugccgauggauguu

SEQ ID NO: 825631 - RNA, 19 nt, Homo sapiens
uuacucagucgucgaggua

SEQ ID NO: 825632 - RNA, 19 nt, Homo sapiens
cccaugggcugcuggaaag

SEQ ID NO: 825633 - RNA, 19 nt, Homo sapiens
gagccgucguggugcaaau

SEQ ID NO: 825634 - RNA, 19 nt, Homo sapiens
aaagaagggcuccaugucu

SEQ ID NO: 825635 - RNA, 19 nt, Homo sapiens
uuaggcacuuggagcguuu

SEQ ID NO: 825636 - RNA, 19 nt, Homo sapiens
aguuucagagucagaauua

SEQ ID NO: 825637 - RNA, 19 nt, Homo sapiens
cuauucagauaaagaacug

SEQ ID NO: 825638 - RNA, 19 nt, Homo sapiens
cauccaaggcuuuguaaac

SEQ ID NO: 825639 - RNA, 19 nt, Homo sapiens
cguccugggugcugucaug

SEQ ID NO: 825640 - RNA, 19 nt, Homo sapiens
ucacgucuccgcugcuguu

SEQ ID NO: 825641 - RNA, 19 nt, Homo sapiens
uaauuugguuuggaugcaa

SEQ ID NO: 825642 - RNA, 19 nt, Homo sapiens
ggaaauaucggaaccagaa

SEQ ID NO: 825643 - RNA, 19 nt, Homo sapiens
gaacugggauucacaucga

SEQ ID NO: 825644 - RNA, 19 nt, Homo sapiens
gguccaagcuccuaucuuc

SEQ ID NO: 825645 - RNA, 19 nt, Homo sapiens
gaaggaaacuuuuggaaga

SEQ ID NO: 825646 - RNA, 19 nt, Homo sapiens
ggauaacgauggcuacuca

SEQ ID NO: 825647 - RNA, 19 nt, Homo sapiens
ggagagcacucgagaugau

SEQ ID NO: 825648 - RNA, 19 nt, Homo sapiens
ucaaggaaaugguauagga

SEQ ID NO: 825649 - RNA, 19 nt, Homo sapiens
gaccaaaguuaucaaggaa

SEQ ID NO: 825650 - RNA, 19 nt, Homo sapiens
cuaaugggauguuggguaa

SEQ ID NO: 825651 - RNA, 19 nt, Homo sapiens
ccagggaacucaucaaagu

SEQ ID NO: 825652 - RNA, 19 nt, Homo sapiens
guucugugcugucucauug

SEQ ID NO: 825653 - RNA, 19 nt, Homo sapiens
gcuccuaucuucggucaaa

SEQ ID NO: 825654 - RNA, 19 nt, Homo sapiens
ccaaaguuaucaaggaaau

SEQ ID NO: 825655 - RNA, 19 nt, Homo sapiens
gaagcuauuaccugguuua

SEQ ID NO: 825656 - RNA, 19 nt, Homo sapiens
gugaaacacugaagcuaau

SEQ ID NO: 825657 - RNA, 19 nt, Homo sapiens
caacuucccugugguaugg

SEQ ID NO: 825658 - RNA, 19 nt, Homo sapiens
caaagugacccgagacgaa

SEQ ID NO: 825659 - RNA, 19 nt, Homo sapiens
cagugaagaugaagaugaa

SEQ ID NO: 825660 - RNA, 19 nt, Homo sapiens
ggaugucgguaaggaguuu

SEQ ID NO: 825661 - RNA, 19 nt, Homo sapiens
agaccaaaguuaucaagga

SEQ ID NO: 825662 - RNA, 19 nt, Homo sapiens
ggaggcugguggcauguug

SEQ ID NO: 825663 - RNA, 19 nt, Homo sapiens
caaccuggccaccugaauu

SEQ ID NO: 825664 - RNA, 19 nt, Homo sapiens
ggacccggcacaacuacua

SEQ ID NO: 825665 - RNA, 19 nt, Homo sapiens
cagcaagacgaagcuauua

SEQ ID NO: 825666 - RNA, 19 nt, Homo sapiens
gcuacucagugaagaugaa

SEQ ID NO: 825667 - RNA, 19 nt, Homo sapiens
ccuuacaggugguuuguga

SEQ ID NO: 825668 - RNA, 19 nt, Homo sapiens
ggucugcgcaggagaaaug

SEQ ID NO: 825669 - RNA, 19 nt, Homo sapiens
cuucuccucugucuucuuu

SEQ ID NO: 825670 - RNA, 19 nt, Homo sapiens
ucacggaugucgguaagga

SEQ ID NO: 825671 - RNA, 19 nt, Homo sapiens
acuacaaggugccaaaguu

SEQ ID NO: 825672 - RNA, 19 nt, Homo sapiens
cuacaaggugccaaaguuu

SEQ ID NO: 825673 - RNA, 19 nt, Homo sapiens
ucuguuaccucacggaugu

SEQ ID NO: 825674 - RNA, 19 nt, Homo sapiens
gauguuggguaagaagguu

SEQ ID NO: 825675 - RNA, 19 nt, Homo sapiens
aacgauggcuacucaguga

SEQ ID NO: 825676 - RNA, 19 nt, Homo sapiens
uguaacgucuugugucugu

SEQ ID NO: 825677 - RNA, 19 nt, Homo sapiens
ugaggugcuuucagcguaa

SEQ ID NO: 825678 - RNA, 19 nt, Homo sapiens
guucaaguguggugaggau

SEQ ID NO: 825679 - RNA, 19 nt, Homo sapiens
ucaaguguggugaggauaa

SEQ ID NO: 825680 - RNA, 19 nt, Homo sapiens
uaagagggagaccaaaguu

SEQ ID NO: 825681 - RNA, 19 nt, Homo sapiens
guaagagggagaccaaagu

SEQ ID NO: 825682 - RNA, 19 nt, Homo sapiens
ccagcaagacgaagcuauu

SEQ ID NO: 825683 - RNA, 19 nt, Homo sapiens
ucagugaagaugaagauga

SEQ ID NO: 825684 - RNA, 19 nt, Homo sapiens
acgaagcuauuaccugguu

SEQ ID NO: 825685 - RNA, 19 nt, Homo sapiens
gagagcacucgagaugaua

SEQ ID NO: 825686 - RNA, 19 nt, Homo sapiens
ucaaggacucgcuggauug

SEQ ID NO: 825687 - RNA, 19 nt, Homo sapiens
cagacucgguugaccuuca

SEQ ID NO: 825688 - RNA, 19 nt, Homo sapiens
agagggagaccaaaguuau

SEQ ID NO: 825689 - RNA, 19 nt, Homo sapiens
gagaugauaguccccuuua

SEQ ID NO: 825690 - RNA, 19 nt, Homo sapiens
cucaaggacucgcuggauu

SEQ ID NO: 825691 - RNA, 19 nt, Homo sapiens
gaagaugaagaugaaauac

SEQ ID NO: 825692 - RNA, 19 nt, Homo sapiens
acucaguucucgcaucuuc

SEQ ID NO: 825693 - RNA, 19 nt, Homo sapiens
gguaugaaagaccuuacaa

SEQ ID NO: 825694 - RNA, 19 nt, Homo sapiens
aagagggagaccaaaguua

SEQ ID NO: 825695 - RNA, 19 nt, Homo sapiens
cugaugaccuuuuccagua

SEQ ID NO: 825696 - RNA, 19 nt, Homo sapiens
ugacagcagcuauggugaa

SEQ ID NO: 825697 - RNA, 19 nt, Homo sapiens
aaugggauguuggguaaga

SEQ ID NO: 825698 - RNA, 19 nt, Homo sapiens
gaaacacugaagcuaaugg

SEQ ID NO: 825699 - RNA, 19 nt, Homo sapiens
ucuccucugucuucuuuga

SEQ ID NO: 825700 - RNA, 19 nt, Homo sapiens
ucaggaguccacagggaua

SEQ ID NO: 825701 - RNA, 19 nt, Homo sapiens
gguauaggauuuugaagca

SEQ ID NO: 825702 - RNA, 19 nt, Homo sapiens
gguaagagggagaccaaag

SEQ ID NO: 825703 - RNA, 19 nt, Homo sapiens
ccucugucuucuuugaauu

SEQ ID NO: 825704 - RNA, 19 nt, Homo sapiens
gguggcauguuguccucaa

SEQ ID NO: 825705 - RNA, 19 nt, Homo sapiens
gauggcuacucagugaaga

SEQ ID NO: 825706 - RNA, 19 nt, Homo sapiens
ggaaacuuuuggaagacua

SEQ ID NO: 825707 - RNA, 19 nt, Homo sapiens
ggcagggugugauccuugu

SEQ ID NO: 825708 - RNA, 19 nt, Homo sapiens
gagggagaccaaaguuauc

SEQ ID NO: 825709 - RNA, 19 nt, Homo sapiens
cuggccaccugaauucaaa

SEQ ID NO: 825710 - RNA, 19 nt, Homo sapiens
ugccuggaaugccuuaguu

SEQ ID NO: 825711 - RNA, 19 nt, Homo sapiens
cagcagcuauggugaacac

SEQ ID NO: 825712 - RNA, 19 nt, Homo sapiens
gacagcagcuauggugaac

SEQ ID NO: 825713 - RNA, 19 nt, Homo sapiens
gugaagaugaagaugaaau

SEQ ID NO: 825714 - RNA, 19 nt, Homo sapiens
ucugugcugucucauugaa

SEQ ID NO: 825715 - RNA, 19 nt, Homo sapiens
caaggaaaugguauaggau

SEQ ID NO: 825716 - RNA, 19 nt, Homo sapiens
ggagaccaaaguuaucaag

SEQ ID NO: 825717 - RNA, 19 nt, Homo sapiens
cgaaggagggaaccagcaa

SEQ ID NO: 825718 - RNA, 19 nt, Homo sapiens
caagcgcuggugccuguuu

SEQ ID NO: 825719 - RNA, 19 nt, Homo sapiens
ugucuucuuugaauuugga

SEQ ID NO: 825720 - RNA, 19 nt, Homo sapiens
cgacagcuccagcgacucu

SEQ ID NO: 825721 - RNA, 19 nt, Homo sapiens
aaggaaaugguauaggauu

SEQ ID NO: 825722 - RNA, 19 nt, Homo sapiens
ggcauguuguccucaaucu

SEQ ID NO: 825723 - RNA, 19 nt, Homo sapiens
cgaagcuauuaccugguuu

SEQ ID NO: 825724 - RNA, 19 nt, Homo sapiens
cagggugugauccuuguaa

SEQ ID NO: 825725 - RNA, 19 nt, Homo sapiens
aaaccgagccagucaacca

SEQ ID NO: 825726 - RNA, 19 nt, Homo sapiens
aagguucugugcugucuca

SEQ ID NO: 825727 - RNA, 19 nt, Homo sapiens
ugaagcuaaugggauguug

SEQ ID NO: 825728 - RNA, 19 nt, Homo sapiens
cgucagacuccgacucaga

SEQ ID NO: 825729 - RNA, 19 nt, Homo sapiens
guauggcacaagacgguaa

SEQ ID NO: 825730 - RNA, 19 nt, Homo sapiens
ucaaaccccuggaaaucuu

SEQ ID NO: 825731 - RNA, 19 nt, Homo sapiens
gaaauaucggaaccagaag

SEQ ID NO: 825732 - RNA, 19 nt, Homo sapiens
ccucacggaugucgguaag

SEQ ID NO: 825733 - RNA, 19 nt, Homo sapiens
uuacaggugguuugugaug

SEQ ID NO: 825734 - RNA, 19 nt, Homo sapiens
gaaccacaagagcaagaag

SEQ ID NO: 825735 - RNA, 19 nt, Homo sapiens
gcagggugugauccuugua

SEQ ID NO: 825736 - RNA, 19 nt, Homo sapiens
caaguguggugaggauaac

SEQ ID NO: 825737 - RNA, 19 nt, Homo sapiens
uaccuucuccucugucuuc

SEQ ID NO: 825738 - RNA, 19 nt, Homo sapiens
gcucaaggacucgcuggau

SEQ ID NO: 825739 - RNA, 19 nt, Homo sapiens
cuuguaacgucuugugucu

SEQ ID NO: 825740 - RNA, 19 nt, Homo sapiens
gauuggacccggcacaacu

SEQ ID NO: 825741 - RNA, 19 nt, Homo sapiens
caucuucugcuccuaccuu

SEQ ID NO: 825742 - RNA, 19 nt, Homo sapiens
gaaagaggaggaaguaaua

SEQ ID NO: 825743 - RNA, 19 nt, Homo sapiens
agacuuagauugacguaua

SEQ ID NO: 825744 - RNA, 19 nt, Homo sapiens
caaggacuaugaauacuaa

SEQ ID NO: 825745 - RNA, 19 nt, Homo sapiens
guuaaguucuaggcaauua

SEQ ID NO: 825746 - RNA, 19 nt, Homo sapiens
ggaaagaggaggaaguaau

SEQ ID NO: 825747 - RNA, 19 nt, Homo sapiens
cguauauguuucugcauua

SEQ ID NO: 825748 - RNA, 19 nt, Homo sapiens
ugacuagggccaccaauaa

SEQ ID NO: 825749 - RNA, 19 nt, Homo sapiens
aaaccaaggacuaugaaua

SEQ ID NO: 825750 - RNA, 19 nt, Homo sapiens
gaggaaagaggaggaagua

SEQ ID NO: 825751 - RNA, 19 nt, Homo sapiens
ggacuaugaauacuaaaug

SEQ ID NO: 825752 - RNA, 19 nt, Homo sapiens
ggacuuugcagccgagaaa

SEQ ID NO: 825753 - RNA, 19 nt, Homo sapiens
gcaagugacuguuuuaaag

SEQ ID NO: 825754 - RNA, 19 nt, Homo sapiens
ggacugcacaaauuaaugu

SEQ ID NO: 825755 - RNA, 19 nt, Homo sapiens
ggacccgucuguaaaccaa

SEQ ID NO: 825756 - RNA, 19 nt, Homo sapiens
gaggaggaaguaauaguuu

SEQ ID NO: 825757 - RNA, 19 nt, Homo sapiens
caagaaaguauguaagugu

SEQ ID NO: 825758 - RNA, 19 nt, Homo sapiens
guguuggacugcacaaauu

SEQ ID NO: 825759 - RNA, 19 nt, Homo sapiens
ggacgaggcagagaaguug

SEQ ID NO: 825760 - RNA, 19 nt, Homo sapiens
gaauugaauaggcaaguga

SEQ ID NO: 825761 - RNA, 19 nt, Homo sapiens
ggauugcccuuccgucaag

SEQ ID NO: 825762 - RNA, 19 nt, Homo sapiens
caagaagccucagcuggau

SEQ ID NO: 825763 - RNA, 19 nt, Homo sapiens
ccaaagaauggcugauuga

SEQ ID NO: 825764 - RNA, 19 nt, Homo sapiens
ggacgacaccaaagaaugg

SEQ ID NO: 825765 - RNA, 19 nt, Homo sapiens
acacgcaacugcucaucaa

SEQ ID NO: 825766 - RNA, 19 nt, Homo sapiens
gcaucacggugcacaagga

SEQ ID NO: 825767 - RNA, 19 nt, Homo sapiens
aggaaaggguggccaagaa

SEQ ID NO: 825768 - RNA, 19 nt, Homo sapiens
gaugucuuaucuaguguga

SEQ ID NO: 825769 - RNA, 19 nt, Homo sapiens
ccgagacuuuggagauuaa

SEQ ID NO: 825770 - RNA, 19 nt, Homo sapiens
ccaaggacuaugaauacua

SEQ ID NO: 825771 - RNA, 19 nt, Homo sapiens
uuucagagacuuagauuga

SEQ ID NO: 825772 - RNA, 19 nt, Homo sapiens
caaccgagacuuuggagau

SEQ ID NO: 825773 - RNA, 19 nt, Homo sapiens
ucaagaaaguauguaagug

SEQ ID NO: 825774 - RNA, 19 nt, Homo sapiens
gacuuagauugacguauau

SEQ ID NO: 825775 - RNA, 19 nt, Homo sapiens
gagguagaguuggccauau

SEQ ID NO: 825776 - RNA, 19 nt, Homo sapiens
ggauucaggccaagaagga

SEQ ID NO: 825777 - RNA, 19 nt, Homo sapiens
ggaaagaaaacaaacaguu

SEQ ID NO: 825778 - RNA, 19 nt, Homo sapiens
gguagaguuggccauauuu

SEQ ID NO: 825779 - RNA, 19 nt, Homo sapiens
gccagaagggcaagagaaa

SEQ ID NO: 825780 - RNA, 19 nt, Homo sapiens
ggaaaccgggaaugaguuc

SEQ ID NO: 825781 - RNA, 19 nt, Homo sapiens
gugacuagggccaccaaua

SEQ ID NO: 825782 - RNA, 19 nt, Homo sapiens
ggagcugcuucgugucaug

SEQ ID NO: 825783 - RNA, 19 nt, Homo sapiens
ccuggccgcugccuucauu

SEQ ID NO: 825784 - RNA, 19 nt, Homo sapiens
guaaaccaaggacuaugaa

SEQ ID NO: 825785 - RNA, 19 nt, Homo sapiens
cuuuggagauuaagaacuu

SEQ ID NO: 825786 - RNA, 19 nt, Homo sapiens
gcccuuccgucaagaaagu

SEQ ID NO: 825787 - RNA, 19 nt, Homo sapiens
ggauauacggcgagguaga

SEQ ID NO: 825788 - RNA, 19 nt, Homo sapiens
acguauauguuucugcauu

SEQ ID NO: 825789 - RNA, 19 nt, Homo sapiens
ggccauauuucagagacuu

SEQ ID NO: 825790 - RNA, 19 nt, Homo sapiens
cgagguagaguuggccaua

SEQ ID NO: 825791 - RNA, 19 nt, Homo sapiens
agguagaguuggccauauu

SEQ ID NO: 825792 - RNA, 19 nt, Homo sapiens
accaaagaauggcugauug

SEQ ID NO: 825793 - RNA, 19 nt, Homo sapiens
ggaggaaagaggaggaagu

SEQ ID NO: 825794 - RNA, 19 nt, Homo sapiens
ugaauaggcaagugacugu

SEQ ID NO: 825795 - RNA, 19 nt, Homo sapiens
gggacgacaccaaagaaug

SEQ ID NO: 825796 - RNA, 19 nt, Homo sapiens
uguaaaccaaggacuauga

SEQ ID NO: 825797 - RNA, 19 nt, Homo sapiens
gaggaaguaauaguuucua

SEQ ID NO: 825798 - RNA, 19 nt, Homo sapiens
gaguuggccauauuucaga

SEQ ID NO: 825799 - RNA, 19 nt, Homo sapiens
ugucggacccgucuguaaa

SEQ ID NO: 825800 - RNA, 19 nt, Homo sapiens
caccaaagaauggcugauu

SEQ ID NO: 825801 - RNA, 19 nt, Homo sapiens
ggaggaaaaugagccagaa

SEQ ID NO: 825802 - RNA, 19 nt, Homo sapiens
ugucuuaucuagugugacu

SEQ ID NO: 825803 - RNA, 19 nt, Homo sapiens
accgagacuuuggagauua

SEQ ID NO: 825804 - RNA, 19 nt, Homo sapiens
aaccgagacuuuggagauu

SEQ ID NO: 825805 - RNA, 19 nt, Homo sapiens
ggaaguaauaguuucuaac

SEQ ID NO: 825806 - RNA, 19 nt, Homo sapiens
cuaccggacaccagaguaa

SEQ ID NO: 825807 - RNA, 19 nt, Homo sapiens
ggaaaggguggccaagaac

SEQ ID NO: 825808 - RNA, 19 nt, Homo sapiens
aaaccgggaaugaguucua

SEQ ID NO: 825809 - RNA, 19 nt, Homo sapiens
agacuuuggagauuaagaa

SEQ ID NO: 825810 - RNA, 19 nt, Homo sapiens
gucaagaaaguauguaagu

SEQ ID NO: 825811 - RNA, 19 nt, Homo sapiens
ggaggaaguaauaguuucu

SEQ ID NO: 825812 - RNA, 19 nt, Homo sapiens
agaggaggaaguaauaguu

SEQ ID NO: 825813 - RNA, 19 nt, Homo sapiens
agauugacguauauguuuc

SEQ ID NO: 825814 - RNA, 19 nt, Homo sapiens
ccacaaccgagacuuugga

SEQ ID NO: 825815 - RNA, 19 nt, Homo sapiens
gagaaguugcaacgcauca

SEQ ID NO: 825816 - RNA, 19 nt, Homo sapiens
gcaggacgaggcagagaag

SEQ ID NO: 825817 - RNA, 19 nt, Homo sapiens
ccgcugccuucauugaguu

SEQ ID NO: 825818 - RNA, 19 nt, Homo sapiens
gccaagaggaggaaaauga

SEQ ID NO: 825819 - RNA, 19 nt, Homo sapiens
aauaggcaagugacuguuu

SEQ ID NO: 825820 - RNA, 19 nt, Homo sapiens
agaauugaauaggcaagug

SEQ ID NO: 825821 - RNA, 19 nt, Homo sapiens
gauauacggcgagguagag

SEQ ID NO: 825822 - RNA, 19 nt, Homo sapiens
guuggacugcacaaauuaa

SEQ ID NO: 825823 - RNA, 19 nt, Homo sapiens
guuuaaagggacaggauug

SEQ ID NO: 825824 - RNA, 19 nt, Homo sapiens
cugccuucauugaguuuaa

SEQ ID NO: 825825 - RNA, 19 nt, Homo sapiens
aggaggaaguaauaguuuc

SEQ ID NO: 825826 - RNA, 19 nt, Homo sapiens
gagcugcuucgugucauga

SEQ ID NO: 825827 - RNA, 19 nt, Homo sapiens
gaauaggcaagugacuguu

SEQ ID NO: 825828 - RNA, 19 nt, Homo sapiens
gccauauuucagagacuua

SEQ ID NO: 825829 - RNA, 19 nt, Homo sapiens
guagaguuggccauauuuc

SEQ ID NO: 825830 - RNA, 19 nt, Homo sapiens
guggaaaccgggaaugagu

SEQ ID NO: 825831 - RNA, 19 nt, Homo sapiens
uguuggacugcacaaauua

SEQ ID NO: 825832 - RNA, 19 nt, Homo sapiens
aaccaaggacuaugaauac

SEQ ID NO: 825833 - RNA, 19 nt, Homo sapiens
cagaagggcaagagaaagg

SEQ ID NO: 825834 - RNA, 19 nt, Homo sapiens
uuggauauacggcgaggua

SEQ ID NO: 825835 - RNA, 19 nt, Homo sapiens
ccaugcaaguggccaaggu

SEQ ID NO: 825836 - RNA, 19 nt, Homo sapiens
gcgcguggaagaggcgaua

SEQ ID NO: 825837 - RNA, 19 nt, Homo sapiens
uagaguuggccauauuuca

SEQ ID NO: 825838 - RNA, 19 nt, Homo sapiens
gagcaggacgaggcagaga

SEQ ID NO: 825839 - RNA, 19 nt, Homo sapiens
ggaggcaagaugaauucug

SEQ ID NO: 825840 - RNA, 19 nt, Homo sapiens
gccgcugccuucauugagu

SEQ ID NO: 825841 - RNA, 19 nt, Homo sapiens
gaacagaggucauauuuaa

SEQ ID NO: 825842 - RNA, 19 nt, Homo sapiens
ggacaucgcuaaacaguua

SEQ ID NO: 825843 - RNA, 19 nt, Homo sapiens
gcaaguagauucuuacgaa

SEQ ID NO: 825844 - RNA, 19 nt, Homo sapiens
gaaauuacucccugucuua

SEQ ID NO: 825845 - RNA, 19 nt, Homo sapiens
caacagauacugcugcuua

SEQ ID NO: 825846 - RNA, 19 nt, Homo sapiens
aaaggaaacuuaugaggua

SEQ ID NO: 825847 - RNA, 19 nt, Homo sapiens
cgagguugcuucaugauua

SEQ ID NO: 825848 - RNA, 19 nt, Homo sapiens
gaagcucgauuaugaagaa

SEQ ID NO: 825849 - RNA, 19 nt, Homo sapiens
gcacagagacgccucauga

SEQ ID NO: 825850 - RNA, 19 nt, Homo sapiens
guuacaagcuuaugaaguu

SEQ ID NO: 825851 - RNA, 19 nt, Homo sapiens
caaaggaugugccauacaa

SEQ ID NO: 825852 - RNA, 19 nt, Homo sapiens
cagcagauaugaagauuau

SEQ ID NO: 825853 - RNA, 19 nt, Homo sapiens
caggacagcuaucgcuuua

SEQ ID NO: 825854 - RNA, 19 nt, Homo sapiens
aagaagaacuuaucgauuc

SEQ ID NO: 825855 - RNA, 19 nt, Homo sapiens
gcugagcaauuccaccuua

SEQ ID NO: 825856 - RNA, 19 nt, Homo sapiens
cuaaacaguuacaagcuua

SEQ ID NO: 825857 - RNA, 19 nt, Homo sapiens
gaccaucaaucagguauuu

SEQ ID NO: 825858 - RNA, 19 nt, Homo sapiens
ggacagcuaucgcuuuaca

SEQ ID NO: 825859 - RNA, 19 nt, Homo sapiens
gcaaacagcagccaaagga

SEQ ID NO: 825860 - RNA, 19 nt, Homo sapiens
gccugaagcucgauuauga

SEQ ID NO: 825861 - RNA, 19 nt, Homo sapiens
gaggugaaaucuggaaauu

SEQ ID NO: 825862 - RNA, 19 nt, Homo sapiens
gggaacagaggucauauuu

SEQ ID NO: 825863 - RNA, 19 nt, Homo sapiens
gcagauauuccuccgagua

SEQ ID NO: 825864 - RNA, 19 nt, Homo sapiens
ggaacagaggucauauuua

SEQ ID NO: 825865 - RNA, 19 nt, Homo sapiens
gcucgauuaugaagaaauu

SEQ ID NO: 825866 - RNA, 19 nt, Homo sapiens
gccagcaaguagauucuua

SEQ ID NO: 825867 - RNA, 19 nt, Homo sapiens
gcuaaacaguuacaagcuu

SEQ ID NO: 825868 - RNA, 19 nt, Homo sapiens
gcaaaaggcuauucuucaa

SEQ ID NO: 825869 - RNA, 19 nt, Homo sapiens
gcagauaugaagauuauuc

SEQ ID NO: 825870 - RNA, 19 nt, Homo sapiens
gccagagucuuugauauga

SEQ ID NO: 825871 - RNA, 19 nt, Homo sapiens
gcucaaguuucugauguuu

SEQ ID NO: 825872 - RNA, 19 nt, Homo sapiens
gagcaaacacccugaguca

SEQ ID NO: 825873 - RNA, 19 nt, Homo sapiens
gcaaaugguaggauccaaa

SEQ ID NO: 825874 - RNA, 19 nt, Homo sapiens
caacagcagcuuacgcaaa

SEQ ID NO: 825875 - RNA, 19 nt, Homo sapiens
caagaagaacuuaucgauu

SEQ ID NO: 825876 - RNA, 19 nt, Homo sapiens
gaaaccauaguugacuuua

SEQ ID NO: 825877 - RNA, 19 nt, Homo sapiens
ggaaacuuaugagguauca

SEQ ID NO: 825878 - RNA, 19 nt, Homo sapiens
cagagucuuugauaugauu

SEQ ID NO: 825879 - RNA, 19 nt, Homo sapiens
gcuuagcacuccaggaaga

SEQ ID NO: 825880 - RNA, 19 nt, Homo sapiens
gcguggacgugaauaaaug

SEQ ID NO: 825881 - RNA, 19 nt, Homo sapiens
cuggauagcucccugucua

SEQ ID NO: 825882 - RNA, 19 nt, Homo sapiens
ccagaggccugcaggaaca

SEQ ID NO: 825883 - RNA, 19 nt, Homo sapiens
guccaggccuuaacugaga

SEQ ID NO: 825884 - RNA, 19 nt, Homo sapiens
ggccagacaugauuauuuu

SEQ ID NO: 825885 - RNA, 19 nt, Homo sapiens
gaaccaguuugugaagaug

SEQ ID NO: 825886 - RNA, 19 nt, Homo sapiens
gcaaacacccugagucacu

SEQ ID NO: 825887 - RNA, 19 nt, Homo sapiens
gauagcucccugucuagua

SEQ ID NO: 825888 - RNA, 19 nt, Homo sapiens
gcaggacagcuaucgcuuu

SEQ ID NO: 825889 - RNA, 19 nt, Homo sapiens
gaaccuugaccuccuugaa

SEQ ID NO: 825890 - RNA, 19 nt, Homo sapiens
aaauggacaucgcuaaaca

SEQ ID NO: 825891 - RNA, 19 nt, Homo sapiens
agagucaucucccagaaga

SEQ ID NO: 825892 - RNA, 19 nt, Homo sapiens
gcagugagagcaagcugaa

SEQ ID NO: 825893 - RNA, 19 nt, Homo sapiens
gcuaucgcuuuacaacauu

SEQ ID NO: 825894 - RNA, 19 nt, Homo sapiens
ggaugugccauacaaagaa

SEQ ID NO: 825895 - RNA, 19 nt, Homo sapiens
cccacgaucuccuuuagaa

SEQ ID NO: 825896 - RNA, 19 nt, Homo sapiens
gugaagacccggaggcauu

SEQ ID NO: 825897 - RNA, 19 nt, Homo sapiens
gaacuccaacuugcaauuc

SEQ ID NO: 825898 - RNA, 19 nt, Homo sapiens
guagccagagucuuugaua

SEQ ID NO: 825899 - RNA, 19 nt, Homo sapiens
gggcgaaccuuuccuacac

SEQ ID NO: 825900 - RNA, 19 nt, Homo sapiens
caaagagccaucugugugu

SEQ ID NO: 825901 - RNA, 19 nt, Homo sapiens
caaacacccugagucacuu

SEQ ID NO: 825902 - RNA, 19 nt, Homo sapiens
ucugagagcuccuuuaagc

SEQ ID NO: 825903 - RNA, 19 nt, Homo sapiens
ugaaauggacaucgcuaaa

SEQ ID NO: 825904 - RNA, 19 nt, Homo sapiens
ggaagaggcguuuaaaaug

SEQ ID NO: 825905 - RNA, 19 nt, Homo sapiens
gcauuuugcuucuucauau

SEQ ID NO: 825906 - RNA, 19 nt, Homo sapiens
guacacaguagcuuuagau

SEQ ID NO: 825907 - RNA, 19 nt, Homo sapiens
gaagaggcguuuaaaaugc

SEQ ID NO: 825908 - RNA, 19 nt, Homo sapiens
cagcaugcgauucuuauug

SEQ ID NO: 825909 - RNA, 19 nt, Homo sapiens
cagcagcaugcgauucuua

SEQ ID NO: 825910 - RNA, 19 nt, Homo sapiens
gaucuuuaacagagucuuu

SEQ ID NO: 825911 - RNA, 19 nt, Homo sapiens
agaaauuacucccugucuu

SEQ ID NO: 825912 - RNA, 19 nt, Homo sapiens
gccauaagcccuugauucu

SEQ ID NO: 825913 - RNA, 19 nt, Homo sapiens
gccaaggucucagcuuugu

SEQ ID NO: 825914 - RNA, 19 nt, Homo sapiens
gcaggaacacuccaucagu

SEQ ID NO: 825915 - RNA, 19 nt, Homo sapiens
gaaauggacaucgcuaaac

SEQ ID NO: 825916 - RNA, 19 nt, Homo sapiens
ucgcaaaggaaacuuauga

SEQ ID NO: 825917 - RNA, 19 nt, Homo sapiens
uaacugagagggacagaag

SEQ ID NO: 825918 - RNA, 19 nt, Homo sapiens
ggccaugcuuaccuuagaa

SEQ ID NO: 825919 - RNA, 19 nt, Homo sapiens
gaaaaccaacagcagcuua

SEQ ID NO: 825920 - RNA, 19 nt, Homo sapiens
ucaagaagaacuuaucgau

SEQ ID NO: 825921 - RNA, 19 nt, Homo sapiens
uaaguaacaccagcaaaga

SEQ ID NO: 825922 - RNA, 19 nt, Homo sapiens
uagaaaccauaguugacuu

SEQ ID NO: 825923 - RNA, 19 nt, Homo sapiens
ucucgagguugcuucauga

SEQ ID NO: 825924 - RNA, 19 nt, Homo sapiens
gacaaccaaagaauggaua

SEQ ID NO: 825925 - RNA, 19 nt, Homo sapiens
guaccacguccuucaagaa

SEQ ID NO: 825926 - RNA, 19 nt, Homo sapiens
uagccagagucuuugauau

SEQ ID NO: 825927 - RNA, 19 nt, Homo sapiens
uguaccagcucucgagguu

SEQ ID NO: 825928 - RNA, 19 nt, Homo sapiens
ugaccuccuugaacaguug

SEQ ID NO: 825929 - RNA, 19 nt, Homo sapiens
ccaggaaccuccacaaccu

SEQ ID NO: 825930 - RNA, 19 nt, Homo sapiens
aaaccuagaaaccauaguu

SEQ ID NO: 825931 - RNA, 19 nt, Homo sapiens
ucagggaacagaggucaua

SEQ ID NO: 825932 - RNA, 19 nt, Homo sapiens
gugaggaagaggcguuuaa

SEQ ID NO: 825933 - RNA, 19 nt, Homo sapiens
agcaugcgauucuuauuga

SEQ ID NO: 825934 - RNA, 19 nt, Homo sapiens
guaacuacagugugggaaa

SEQ ID NO: 825935 - RNA, 19 nt, Homo sapiens
cagauacugcugcuuagaa

SEQ ID NO: 825936 - RNA, 19 nt, Homo sapiens
gagguugcuucaugauuac

SEQ ID NO: 825937 - RNA, 19 nt, Homo sapiens
caaggucucagcuuuguag

SEQ ID NO: 825938 - RNA, 19 nt, Homo sapiens
uugccaaggucucagcuuu

SEQ ID NO: 825939 - RNA, 19 nt, Homo sapiens
auacuucucugcccagcuu

SEQ ID NO: 825940 - RNA, 19 nt, Homo sapiens
cucccugucuaguacauua

SEQ ID NO: 825941 - RNA, 19 nt, Homo sapiens
gaacacaacuuaaacuuga

SEQ ID NO: 825942 - RNA, 19 nt, Homo sapiens
gaaggagccucuacaauau

SEQ ID NO: 825943 - RNA, 19 nt, Homo sapiens
ucaacgagcucaugaagua

SEQ ID NO: 825944 - RNA, 19 nt, Homo sapiens
gaucagauguggugaguga

SEQ ID NO: 825945 - RNA, 19 nt, Homo sapiens
ggaaagugcuguaggaaau

SEQ ID NO: 825946 - RNA, 19 nt, Homo sapiens
aaacaaggcugucacuauu

SEQ ID NO: 825947 - RNA, 19 nt, Homo sapiens
gagaacauccucagcuuua

SEQ ID NO: 825948 - RNA, 19 nt, Homo sapiens
gagcuuaacaccuguauaa

SEQ ID NO: 825949 - RNA, 19 nt, Homo sapiens
gaaaguaaauuggaaugug

SEQ ID NO: 825950 - RNA, 19 nt, Homo sapiens
guagcuaucugacuguuaa

SEQ ID NO: 825951 - RNA, 19 nt, Homo sapiens
caggaaaggugauugauga

SEQ ID NO: 825952 - RNA, 19 nt, Homo sapiens
gcacugguauugaucuuga

SEQ ID NO: 825953 - RNA, 19 nt, Homo sapiens
gaaacaaggcugucacuau

SEQ ID NO: 825954 - RNA, 19 nt, Homo sapiens
agaaggagccucuacaaua

SEQ ID NO: 825955 - RNA, 19 nt, Homo sapiens
gaaaggugauugaugagau

SEQ ID NO: 825956 - RNA, 19 nt, Homo sapiens
gaaacaaguuaaagcacaa

SEQ ID NO: 825957 - RNA, 19 nt, Homo sapiens
gaacuuacccagcuguuau

SEQ ID NO: 825958 - RNA, 19 nt, Homo sapiens
gcacauacauacguaagga

SEQ ID NO: 825959 - RNA, 19 nt, Homo sapiens
gaucauaggugaacaaaau

SEQ ID NO: 825960 - RNA, 19 nt, Homo sapiens
gggaauuguucauccauuu

SEQ ID NO: 825961 - RNA, 19 nt, Homo sapiens
gacaagagguuaccaaacu

SEQ ID NO: 825962 - RNA, 19 nt, Homo sapiens
gaaauuaccaggaucagau

SEQ ID NO: 825963 - RNA, 19 nt, Homo sapiens
gacacuaucuugguucuuu

SEQ ID NO: 825964 - RNA, 19 nt, Homo sapiens
gcaacauggugucccuuaa

SEQ ID NO: 825965 - RNA, 19 nt, Homo sapiens
gaacaagagacuauuaaag

SEQ ID NO: 825966 - RNA, 19 nt, Homo sapiens
cauagacucucuuaggaaa

SEQ ID NO: 825967 - RNA, 19 nt, Homo sapiens
gcaauggaguacuuugaug

SEQ ID NO: 825968 - RNA, 19 nt, Homo sapiens
gaaguaauggguaacuaaa

SEQ ID NO: 825969 - RNA, 19 nt, Homo sapiens
gaucuuaaacccagucuug

SEQ ID NO: 825970 - RNA, 19 nt, Homo sapiens
acaaggcugucacuauuaa

SEQ ID NO: 825971 - RNA, 19 nt, Homo sapiens
caaauuguguacagugguu

SEQ ID NO: 825972 - RNA, 19 nt, Homo sapiens
aaccagaccuguucuauca

SEQ ID NO: 825973 - RNA, 19 nt, Homo sapiens
caaugcagcucuucuccaa

SEQ ID NO: 825974 - RNA, 19 nt, Homo sapiens
ucaaggcucuuucuaucaa

SEQ ID NO: 825975 - RNA, 19 nt, Homo sapiens
guauugaaguaauggguaa

SEQ ID NO: 825976 - RNA, 19 nt, Homo sapiens
gaccuguucuaucauguuu

SEQ ID NO: 825977 - RNA, 19 nt, Homo sapiens
agauuaaccucaccaaaug

SEQ ID NO: 825978 - RNA, 19 nt, Homo sapiens
ggaacaagagacuauuaaa

SEQ ID NO: 825979 - RNA, 19 nt, Homo sapiens
ugagauaugucaauucuac

SEQ ID NO: 825980 - RNA, 19 nt, Homo sapiens
ggagagguaccauaaucua

SEQ ID NO: 825981 - RNA, 19 nt, Homo sapiens
gacauucaauuaucacugu

SEQ ID NO: 825982 - RNA, 19 nt, Homo sapiens
gcagauaauguugaaagua

SEQ ID NO: 825983 - RNA, 19 nt, Homo sapiens
gaacugaugcacagaaucu

SEQ ID NO: 825984 - RNA, 19 nt, Homo sapiens
uaacaacaaugcagcucuu

SEQ ID NO: 825985 - RNA, 19 nt, Homo sapiens
aaggagaaaccauucauua

SEQ ID NO: 825986 - RNA, 19 nt, Homo sapiens
uaaaguaacauccaagugu

SEQ ID NO: 825987 - RNA, 19 nt, Homo sapiens
cgacggcgguuccucuuug

SEQ ID NO: 825988 - RNA, 19 nt, Homo sapiens
gagaaaccauucauuagcu

SEQ ID NO: 825989 - RNA, 19 nt, Homo sapiens
gggcuucaguuauuuaaag

SEQ ID NO: 825990 - RNA, 19 nt, Homo sapiens
gagcuaauacuccucuuug

SEQ ID NO: 825991 - RNA, 19 nt, Homo sapiens
gccauagacucucuuagga

SEQ ID NO: 825992 - RNA, 19 nt, Homo sapiens
gagcagacccagaucauag

SEQ ID NO: 825993 - RNA, 19 nt, Homo sapiens
cuucaagaauuaagggaua

SEQ ID NO: 825994 - RNA, 19 nt, Homo sapiens
gaugagauuuaucgugugu

SEQ ID NO: 825995 - RNA, 19 nt, Homo sapiens
guacuaaccagaccuguuc

SEQ ID NO: 825996 - RNA, 19 nt, Homo sapiens
ucaauucuaugucugacuu

SEQ ID NO: 825997 - RNA, 19 nt, Homo sapiens
ggaacuuacccagcuguua

SEQ ID NO: 825998 - RNA, 19 nt, Homo sapiens
gccagagaauguugaauca

SEQ ID NO: 825999 - RNA, 19 nt, Homo sapiens
ggaagacacagcuuaguag

SEQ ID NO: 826000 - RNA, 19 nt, Homo sapiens
gaagccauagacucucuua

SEQ ID NO: 826001 - RNA, 19 nt, Homo sapiens
gaacauccucagcuuuaug

SEQ ID NO: 826002 - RNA, 19 nt, Homo sapiens
ccaaguguuucaugguuug

SEQ ID NO: 826003 - RNA, 19 nt, Homo sapiens
gaacgcaaacuacgagaag

SEQ ID NO: 826004 - RNA, 19 nt, Homo sapiens
guggagagguaccauaauc

SEQ ID NO: 826005 - RNA, 19 nt, Homo sapiens
ugagauuuaucguguguug

SEQ ID NO: 826006 - RNA, 19 nt, Homo sapiens
cagacuagaaguuaaguuu

SEQ ID NO: 826007 - RNA, 19 nt, Homo sapiens
cggaauagaaaguaaauug

SEQ ID NO: 826008 - RNA, 19 nt, Homo sapiens
aaaggugauugaugagauu

SEQ ID NO: 826009 - RNA, 19 nt, Homo sapiens
aagcaugucuugcacuguu

SEQ ID NO: 826010 - RNA, 19 nt, Homo sapiens
gaaaauguccuguucacuu

SEQ ID NO: 826011 - RNA, 19 nt, Homo sapiens
caaacuacgagaaguaaug

SEQ ID NO: 826012 - RNA, 19 nt, Homo sapiens
gcaaaauccuucaagacaa

SEQ ID NO: 826013 - RNA, 19 nt, Homo sapiens
gaaaggagaaaccauucau

SEQ ID NO: 826014 - RNA, 19 nt, Homo sapiens
gaauaaaagcacaagguua

SEQ ID NO: 826015 - RNA, 19 nt, Homo sapiens
gcaauagauuuguacuaac

SEQ ID NO: 826016 - RNA, 19 nt, Homo sapiens
cuuaagcaguuaugcauau

SEQ ID NO: 826017 - RNA, 19 nt, Homo sapiens
gaaagugcuguaggaaauu

SEQ ID NO: 826018 - RNA, 19 nt, Homo sapiens
ggugauugaugagauuuau

SEQ ID NO: 826019 - RNA, 19 nt, Homo sapiens
uagauuaaccucaccaaau

SEQ ID NO: 826020 - RNA, 19 nt, Homo sapiens
gaggaaaauuguaccauga

SEQ ID NO: 826021 - RNA, 19 nt, Homo sapiens
ugaaguaauggguaacuaa

SEQ ID NO: 826022 - RNA, 19 nt, Homo sapiens
ccagaccuguucuaucaug

SEQ ID NO: 826023 - RNA, 19 nt, Homo sapiens
gcuuucagaacacaacuua

SEQ ID NO: 826024 - RNA, 19 nt, Homo sapiens
cagaggaagacacagcuua

SEQ ID NO: 826025 - RNA, 19 nt, Homo sapiens
cuaaacgucuucggaauag

SEQ ID NO: 826026 - RNA, 19 nt, Homo sapiens
ucagaaaggagaaaccauu

SEQ ID NO: 826027 - RNA, 19 nt, Homo sapiens
ccaaggagagagucagaaa

SEQ ID NO: 826028 - RNA, 19 nt, Homo sapiens
gguuaugcauccuuuagau

SEQ ID NO: 826029 - RNA, 19 nt, Homo sapiens
cccuacaacuuuaaacaaa

SEQ ID NO: 826030 - RNA, 19 nt, Homo sapiens
ggaauuguucauccauuug

SEQ ID NO: 826031 - RNA, 19 nt, Homo sapiens
uaggaaaucuaaacgucuu

SEQ ID NO: 826032 - RNA, 19 nt, Homo sapiens
gagcggcgucuuaguuuau

SEQ ID NO: 826033 - RNA, 19 nt, Homo sapiens
ggaaaauuguaccaugaaa

SEQ ID NO: 826034 - RNA, 19 nt, Homo sapiens
gcaaaguucauugaggaaa

SEQ ID NO: 826035 - RNA, 19 nt, Homo sapiens
uuacccagcuguuauacau

SEQ ID NO: 826036 - RNA, 19 nt, Homo sapiens
aguauugacuguagaagga

SEQ ID NO: 826037 - RNA, 19 nt, Homo sapiens
ggagaaaccauucauuagc

SEQ ID NO: 826038 - RNA, 19 nt, Homo sapiens
ucuaaacgucuucggaaua

SEQ ID NO: 826039 - RNA, 19 nt, Homo sapiens
caugggcucuccuccaguu

SEQ ID NO: 826040 - RNA, 19 nt, Homo sapiens
uuuaacaaccuccaaauug

SEQ ID NO: 826041 - RNA, 19 nt, Homo sapiens
ggucauggauucauaaaua

SEQ ID NO: 826042 - RNA, 19 nt, Homo sapiens
gaaccuagcucuuuaaacu

SEQ ID NO: 826043 - RNA, 19 nt, Homo sapiens
ggacuugaguguugcauuu

SEQ ID NO: 826044 - RNA, 19 nt, Homo sapiens
ggauugagcuaaccugaaa

SEQ ID NO: 826045 - RNA, 19 nt, Homo sapiens
gaagagcccuggcauuuua

SEQ ID NO: 826046 - RNA, 19 nt, Homo sapiens
ccaggaaccuagcucuuua

SEQ ID NO: 826047 - RNA, 19 nt, Homo sapiens
gagcuaaccugaaacaaag

SEQ ID NO: 826048 - RNA, 19 nt, Homo sapiens
ggacacagccuuauuacug

SEQ ID NO: 826049 - RNA, 19 nt, Homo sapiens
gaacgagcgugaccucaug

SEQ ID NO: 826050 - RNA, 19 nt, Homo sapiens
caucaaaccuaaugaaauc

SEQ ID NO: 826051 - RNA, 19 nt, Homo sapiens
ggaaaggacucggcacuuc

SEQ ID NO: 826052 - RNA, 19 nt, Homo sapiens
cuagagggcuggugauuga

SEQ ID NO: 826053 - RNA, 19 nt, Homo sapiens
ggaaggagcgugagaagga

SEQ ID NO: 826054 - RNA, 19 nt, Homo sapiens
gcgaagagcccuggcauuu

SEQ ID NO: 826055 - RNA, 19 nt, Homo sapiens
guaguggugucccguuuaa

SEQ ID NO: 826056 - RNA, 19 nt, Homo sapiens
augaggaggugaagauuua

SEQ ID NO: 826057 - RNA, 19 nt, Homo sapiens
ugacauggauuaugaaagg

SEQ ID NO: 826058 - RNA, 19 nt, Homo sapiens
ccaauucccuccaccaugu

SEQ ID NO: 826059 - RNA, 19 nt, Homo sapiens
cgaacacucuguccucuau

SEQ ID NO: 826060 - RNA, 19 nt, Homo sapiens
ugaaggaggaagaucauua

SEQ ID NO: 826061 - RNA, 19 nt, Homo sapiens
cagaagauccucucaccua

SEQ ID NO: 826062 - RNA, 19 nt, Homo sapiens
ggagucgccuuaccugaga

SEQ ID NO: 826063 - RNA, 19 nt, Homo sapiens
gcucacauuucuauaaaca

SEQ ID NO: 826064 - RNA, 19 nt, Homo sapiens
caaguucuaugaccuguuc

SEQ ID NO: 826065 - RNA, 19 nt, Homo sapiens
ugagagcccuagagucaaa

SEQ ID NO: 826066 - RNA, 19 nt, Homo sapiens
guucugugcuucuccauug

SEQ ID NO: 826067 - RNA, 19 nt, Homo sapiens
gaggguggagcucuucuua

SEQ ID NO: 826068 - RNA, 19 nt, Homo sapiens
ggacucggcacuucucuga

SEQ ID NO: 826069 - RNA, 19 nt, Homo sapiens
gaagucaggguagaaauug

SEQ ID NO: 826070 - RNA, 19 nt, Homo sapiens
gagcucaggagucgccuua

SEQ ID NO: 826071 - RNA, 19 nt, Homo sapiens
aggaagagauggcagaaga

SEQ ID NO: 826072 - RNA, 19 nt, Homo sapiens
cauccgagcugcacucauc

SEQ ID NO: 826073 - RNA, 19 nt, Homo sapiens
gaccgucgcuuugcuuaug

SEQ ID NO: 826074 - RNA, 19 nt, Homo sapiens
gguuaaauccucaucaaga

SEQ ID NO: 826075 - RNA, 19 nt, Homo sapiens
ugagagagauguucuagcu

SEQ ID NO: 826076 - RNA, 19 nt, Homo sapiens
ggagaaggaaguaggaaug

SEQ ID NO: 826077 - RNA, 19 nt, Homo sapiens
gaucugauguggugguucu

SEQ ID NO: 826078 - RNA, 19 nt, Homo sapiens
acaggacacagccuuauua

SEQ ID NO: 826079 - RNA, 19 nt, Homo sapiens
gaugaggaggugaagauuu

SEQ ID NO: 826080 - RNA, 19 nt, Homo sapiens
ggcguuggcucuucuggaa

SEQ ID NO: 826081 - RNA, 19 nt, Homo sapiens
ccgagcaccugucaucuug

SEQ ID NO: 826082 - RNA, 19 nt, Homo sapiens
aaacugaaaccgaaacgaa

SEQ ID NO: 826083 - RNA, 19 nt, Homo sapiens
ccaaugacaaccaaacuga

SEQ ID NO: 826084 - RNA, 19 nt, Homo sapiens
ucacagagcaguacacagu

SEQ ID NO: 826085 - RNA, 19 nt, Homo sapiens
gcaccagacucuugcuuuu

SEQ ID NO: 826086 - RNA, 19 nt, Homo sapiens
gaagauuuagguugcagaa

SEQ ID NO: 826087 - RNA, 19 nt, Homo sapiens
ggagaagucaggguagaaa

SEQ ID NO: 826088 - RNA, 19 nt, Homo sapiens
auucugacauggauuauga

SEQ ID NO: 826089 - RNA, 19 nt, Homo sapiens
ugagcuaaccugaaacaaa

SEQ ID NO: 826090 - RNA, 19 nt, Homo sapiens
ggaaggagaagagggagaa

SEQ ID NO: 826091 - RNA, 19 nt, Homo sapiens
uuuaauggauucugacaug

SEQ ID NO: 826092 - RNA, 19 nt, Homo sapiens
gaaggaaguaggaaugagu

SEQ ID NO: 826093 - RNA, 19 nt, Homo sapiens
guuaaauccucaucaagag

SEQ ID NO: 826094 - RNA, 19 nt, Homo sapiens
gagaaggaaguaggaauga

SEQ ID NO: 826095 - RNA, 19 nt, Homo sapiens
uuaauuuggucauggauuc

SEQ ID NO: 826096 - RNA, 19 nt, Homo sapiens
gaaggaggaagaucauuac

SEQ ID NO: 826097 - RNA, 19 nt, Homo sapiens
caacggaacaggguaccua

SEQ ID NO: 826098 - RNA, 19 nt, Homo sapiens
ggagagugaccacgggauu

SEQ ID NO: 826099 - RNA, 19 nt, Homo sapiens
ggagucggauucaggaaac

SEQ ID NO: 826100 - RNA, 19 nt, Homo sapiens
ccucugcucuuccgcauca

SEQ ID NO: 826101 - RNA, 19 nt, Homo sapiens
cagaaaaccaggaguauuu

SEQ ID NO: 826102 - RNA, 19 nt, Homo sapiens
cgaccuggaugacaugaag

SEQ ID NO: 826103 - RNA, 19 nt, Homo sapiens
aagcagaguuggucuagag

SEQ ID NO: 826104 - RNA, 19 nt, Homo sapiens
acagagcaguacacaguga

SEQ ID NO: 826105 - RNA, 19 nt, Homo sapiens
ggccaacauucucaacaau

SEQ ID NO: 826106 - RNA, 19 nt, Homo sapiens
gaagagauggcagaagauc

SEQ ID NO: 826107 - RNA, 19 nt, Homo sapiens
gaauggagcaggaggaaaa

SEQ ID NO: 826108 - RNA, 19 nt, Homo sapiens
ccgacggacuugaguguug

SEQ ID NO: 826109 - RNA, 19 nt, Homo sapiens
gauggaagcgacccagaug

SEQ ID NO: 826110 - RNA, 19 nt, Homo sapiens
cccgagacgugguagauga

SEQ ID NO: 826111 - RNA, 19 nt, Homo sapiens
ggacaacgccguggguaag

SEQ ID NO: 826112 - RNA, 19 nt, Homo sapiens
gaaaggacucggcacuucu

SEQ ID NO: 826113 - RNA, 19 nt, Homo sapiens
cuagcucacauuucuauaa

SEQ ID NO: 826114 - RNA, 19 nt, Homo sapiens
caacgugugccgcaaguuc

SEQ ID NO: 826115 - RNA, 19 nt, Homo sapiens
gcacauugcccacauugcu

SEQ ID NO: 826116 - RNA, 19 nt, Homo sapiens
gagcaccugucaucuuggu

SEQ ID NO: 826117 - RNA, 19 nt, Homo sapiens
gguaagaccaggcucaucu

SEQ ID NO: 826118 - RNA, 19 nt, Homo sapiens
ccuaaugaccagagguuaa

SEQ ID NO: 826119 - RNA, 19 nt, Homo sapiens
ccaggaguauuucgagaag

SEQ ID NO: 826120 - RNA, 19 nt, Homo sapiens
cuacaaaucccggcugaug

SEQ ID NO: 826121 - RNA, 19 nt, Homo sapiens
caccagcgacgggaucuua

SEQ ID NO: 826122 - RNA, 19 nt, Homo sapiens
ggagcaggcaggagagaga

SEQ ID NO: 826123 - RNA, 19 nt, Homo sapiens
aagauccucucaccuacaa

SEQ ID NO: 826124 - RNA, 19 nt, Homo sapiens
cuacaagucuaugcuacug

SEQ ID NO: 826125 - RNA, 19 nt, Homo sapiens
cuaaugaccagagguuaaa

SEQ ID NO: 826126 - RNA, 19 nt, Homo sapiens
cuccagggcuucucugugu

SEQ ID NO: 826127 - RNA, 19 nt, Homo sapiens
gcaugaugguggccaacau

SEQ ID NO: 826128 - RNA, 19 nt, Homo sapiens
gaagauccucucaccuaca

SEQ ID NO: 826129 - RNA, 19 nt, Homo sapiens
gcgcaucuuugcccacaag

SEQ ID NO: 826130 - RNA, 19 nt, Homo sapiens
gagaauggagcaggaggaa

SEQ ID NO: 826131 - RNA, 19 nt, Homo sapiens
ugggacagguggagaagga

SEQ ID NO: 826132 - RNA, 19 nt, Homo sapiens
gguagaaauugagccuuca

SEQ ID NO: 826133 - RNA, 19 nt, Homo sapiens
gaggugguguuucccuaca

SEQ ID NO: 826134 - RNA, 19 nt, Homo sapiens
ccaucaaaccuaaugaaau

SEQ ID NO: 826135 - RNA, 19 nt, Homo sapiens
gagacgugguagaugaugu

SEQ ID NO: 826136 - RNA, 19 nt, Homo sapiens
cugccuagcucacauuucu

SEQ ID NO: 826137 - RNA, 19 nt, Homo sapiens
agaagucaggguagaaauu

SEQ ID NO: 826138 - RNA, 19 nt, Homo sapiens
ucucagaugugaccuucau

SEQ ID NO: 826139 - RNA, 19 nt, Homo sapiens
uggccaacauucucaacaa

SEQ ID NO: 826140 - RNA, 19 nt, Homo sapiens
gagaucugauguggugguu

SEQ ID NO: 826141 - RNA, 19 nt, Homo sapiens
gcaacaagauggaggaaga

SEQ ID NO: 826142 - RNA, 19 nt, Homo sapiens
gugaagagcugcagugaga

SEQ ID NO: 826143 - RNA, 19 nt, Homo sapiens
gggcaaaggugacagcauu

SEQ ID NO: 826144 - RNA, 19 nt, Homo sapiens
gcagugaauucauguuuga

SEQ ID NO: 826145 - RNA, 19 nt, Homo sapiens
guacuucgcugcucugaug

SEQ ID NO: 826146 - RNA, 19 nt, Homo sapiens
gcacaaggccuacagaugu

SEQ ID NO: 826147 - RNA, 19 nt, Homo sapiens
ggaaggagacggagacuga

SEQ ID NO: 826148 - RNA, 19 nt, Homo sapiens
gaccagauguagaauaaau

SEQ ID NO: 826149 - RNA, 19 nt, Homo sapiens
gaacuuaccucaccaucac

SEQ ID NO: 826150 - RNA, 19 nt, Homo sapiens
gugaccagauguagaauaa

SEQ ID NO: 826151 - RNA, 19 nt, Homo sapiens
gcagcacaguggaaucuaa

SEQ ID NO: 826152 - RNA, 19 nt, Homo sapiens
gcugugaaguuacauaaug

SEQ ID NO: 826153 - RNA, 19 nt, Homo sapiens
ugacgaagcugccaucagu

SEQ ID NO: 826154 - RNA, 19 nt, Homo sapiens
ucucagaaguccuggauuu

SEQ ID NO: 826155 - RNA, 19 nt, Homo sapiens
gcggugaccugccuccuuu

SEQ ID NO: 826156 - RNA, 19 nt, Homo sapiens
ggagaaagcccacaucaac

SEQ ID NO: 826157 - RNA, 19 nt, Homo sapiens
gcacaaacgucaccuucag

SEQ ID NO: 826158 - RNA, 19 nt, Homo sapiens
ccuggaagccggucauuua

SEQ ID NO: 826159 - RNA, 19 nt, Homo sapiens
ccaaagccuucauggauau

SEQ ID NO: 826160 - RNA, 19 nt, Homo sapiens
agagauggcugacccaaug

SEQ ID NO: 826161 - RNA, 19 nt, Homo sapiens
gcucucagcugaacacaag

SEQ ID NO: 826162 - RNA, 19 nt, Homo sapiens
caaauggaaucacccuuca

SEQ ID NO: 826163 - RNA, 19 nt, Homo sapiens
ucacggcccuguacgacua

SEQ ID NO: 826164 - RNA, 19 nt, Homo sapiens
gggcuuggcucucagaagu

SEQ ID NO: 826165 - RNA, 19 nt, Homo sapiens
gggcugcggugaccaguau

SEQ ID NO: 826166 - RNA, 19 nt, Homo sapiens
caagggcagugaauucaug

SEQ ID NO: 826167 - RNA, 19 nt, Homo sapiens
uggaaaccaucagaacuua

SEQ ID NO: 826168 - RNA, 19 nt, Homo sapiens
caacucggcugcccacaag

SEQ ID NO: 826169 - RNA, 19 nt, Homo sapiens
gaaucacccuucagagaca

SEQ ID NO: 826170 - RNA, 19 nt, Homo sapiens
ggagaucugugcuguucug

SEQ ID NO: 826171 - RNA, 19 nt, Homo sapiens
ugggugagauuuacuguga

SEQ ID NO: 826172 - RNA, 19 nt, Homo sapiens
uugggaagcuuucagauga

SEQ ID NO: 826173 - RNA, 19 nt, Homo sapiens
ggaagaaggaccacagcuu

SEQ ID NO: 826174 - RNA, 19 nt, Homo sapiens
guucaucacugcccucauc

SEQ ID NO: 826175 - RNA, 19 nt, Homo sapiens
ggugaacagucuccuggaa

SEQ ID NO: 826176 - RNA, 19 nt, Homo sapiens
ggaagaggaaggugccaaa

SEQ ID NO: 826177 - RNA, 19 nt, Homo sapiens
ggaagccggucauuuaagc

SEQ ID NO: 826178 - RNA, 19 nt, Homo sapiens
aaggugaugugaagaagaa

SEQ ID NO: 826179 - RNA, 19 nt, Homo sapiens
caagauggaggaagaggaa

SEQ ID NO: 826180 - RNA, 19 nt, Homo sapiens
aaacgucaccuucagcaaa

SEQ ID NO: 826181 - RNA, 19 nt, Homo sapiens
gauuuacugugaccagaug

SEQ ID NO: 826182 - RNA, 19 nt, Homo sapiens
gugagucgcuuugccaaga

SEQ ID NO: 826183 - RNA, 19 nt, Homo sapiens
ggcagugaauucauguuug

SEQ ID NO: 826184 - RNA, 19 nt, Homo sapiens
gggcagugaauucauguuu

SEQ ID NO: 826185 - RNA, 19 nt, Homo sapiens
agucgaugcugugaaguua

SEQ ID NO: 826186 - RNA, 19 nt, Homo sapiens
ggcuuaaggucauggagaa

SEQ ID NO: 826187 - RNA, 19 nt, Homo sapiens
aggcgaagaugaagagaug

SEQ ID NO: 826188 - RNA, 19 nt, Homo sapiens
gcaaaggugacagcauuga

SEQ ID NO: 826189 - RNA, 19 nt, Homo sapiens
caaguucauccgcaaguuu

SEQ ID NO: 826190 - RNA, 19 nt, Homo sapiens
ggacucaggaugacuugga

SEQ ID NO: 826191 - RNA, 19 nt, Homo sapiens
ugacagcauugaggagauu

SEQ ID NO: 826192 - RNA, 19 nt, Homo sapiens
ugaagugccuccuacacau

SEQ ID NO: 826193 - RNA, 19 nt, Homo sapiens
gcuggaggcucuggcauuc

SEQ ID NO: 826194 - RNA, 19 nt, Homo sapiens
ggaggaggagcuggagaua

SEQ ID NO: 826195 - RNA, 19 nt, Homo sapiens
gauuugagcuggugaaaag

SEQ ID NO: 826196 - RNA, 19 nt, Homo sapiens
aagaggcccugcagugcua

SEQ ID NO: 826197 - RNA, 19 nt, Homo sapiens
agacggagacugaguacuu

SEQ ID NO: 826198 - RNA, 19 nt, Homo sapiens
gaagcucaagcaccagaaa

SEQ ID NO: 826199 - RNA, 19 nt, Homo sapiens
ccagcccugugcuuauuaa

SEQ ID NO: 826200 - RNA, 19 nt, Homo sapiens
caggaugacuuggaacuag

SEQ ID NO: 826201 - RNA, 19 nt, Homo sapiens
gcaugaagcuucggaaccu

SEQ ID NO: 826202 - RNA, 19 nt, Homo sapiens
ccugccagcucugacuuua

SEQ ID NO: 826203 - RNA, 19 nt, Homo sapiens
cuaacacccugaagagcaa

SEQ ID NO: 826204 - RNA, 19 nt, Homo sapiens
cugaggagacucuggauuu

SEQ ID NO: 826205 - RNA, 19 nt, Homo sapiens
aaggagaucugugcuguuc

SEQ ID NO: 826206 - RNA, 19 nt, Homo sapiens
gcccugugguccagucuga

SEQ ID NO: 826207 - RNA, 19 nt, Homo sapiens
gcaccuggccaaacaugug

SEQ ID NO: 826208 - RNA, 19 nt, Homo sapiens
cagcugaacacaaggaguu

SEQ ID NO: 826209 - RNA, 19 nt, Homo sapiens
uugaagcgcuggaagaaag

SEQ ID NO: 826210 - RNA, 19 nt, Homo sapiens
gggcugugcuggaaaccau

SEQ ID NO: 826211 - RNA, 19 nt, Homo sapiens
gaggagggccugacguaca

SEQ ID NO: 826212 - RNA, 19 nt, Homo sapiens
gagcucaacgcccagauca

SEQ ID NO: 826213 - RNA, 19 nt, Homo sapiens
cggaaggccuggugaagag

SEQ ID NO: 826214 - RNA, 19 nt, Homo sapiens
ugaggagacucuggauuuc

SEQ ID NO: 826215 - RNA, 19 nt, Homo sapiens
cagugagaaugauuuacaa

SEQ ID NO: 826216 - RNA, 19 nt, Homo sapiens
gaucaucacggcccuguac

SEQ ID NO: 826217 - RNA, 19 nt, Homo sapiens
gacggagacugaguacuuc

SEQ ID NO: 826218 - RNA, 19 nt, Homo sapiens
ccaaguucauccgcaaguu

SEQ ID NO: 826219 - RNA, 19 nt, Homo sapiens
ccgagaccauguucaggaa

SEQ ID NO: 826220 - RNA, 19 nt, Homo sapiens
ccagugagaaugauuuaca

SEQ ID NO: 826221 - RNA, 19 nt, Homo sapiens
guucugagcguguuucuac

SEQ ID NO: 826222 - RNA, 19 nt, Homo sapiens
gcaggaagaagaugaagcu

SEQ ID NO: 826223 - RNA, 19 nt, Homo sapiens
gaauacaaggccaagaaag

SEQ ID NO: 826224 - RNA, 19 nt, Homo sapiens
ugaauacaaggccaagaaa

SEQ ID NO: 826225 - RNA, 19 nt, Homo sapiens
caaaggcgaagaugaagag

SEQ ID NO: 826226 - RNA, 19 nt, Homo sapiens
gaagcuuucagaugacaug

SEQ ID NO: 826227 - RNA, 19 nt, Homo sapiens
gggccaugcuuuccuaagg

SEQ ID NO: 826228 - RNA, 19 nt, Homo sapiens
gcugugccuuuggaaauug

SEQ ID NO: 826229 - RNA, 19 nt, Homo sapiens
gcucaacgcccagaucauc

SEQ ID NO: 826230 - RNA, 19 nt, Homo sapiens
caugaggcaccuuugcuuu

SEQ ID NO: 826231 - RNA, 19 nt, Homo sapiens
ggaggcagacggcaacaag

SEQ ID NO: 826232 - RNA, 19 nt, Homo sapiens
gccaugcuuuccuaagguu

SEQ ID NO: 826233 - RNA, 19 nt, Homo sapiens
ugaccgugcugaagugagu

SEQ ID NO: 826234 - RNA, 19 nt, Homo sapiens
caggaaacgcgacuugguu

SEQ ID NO: 826235 - RNA, 19 nt, Homo sapiens
gagaccauguucaggaaac

SEQ ID NO: 826236 - RNA, 19 nt, Homo sapiens
ggcugugccuuuggaaauu

SEQ ID NO: 826237 - RNA, 19 nt, Homo sapiens
gacucaggaugacuuggaa

SEQ ID NO: 826238 - RNA, 19 nt, Homo sapiens
ggacaaugaggaggaggaa

SEQ ID NO: 826239 - RNA, 19 nt, Homo sapiens
gcccugacccaccuccuuu

SEQ ID NO: 826240 - RNA, 19 nt, Homo sapiens
gcgcacggaagaacgcuuu

SEQ ID NO: 826241 - RNA, 19 nt, Homo sapiens
gcagaaauguguaguauua

SEQ ID NO: 826242 - RNA, 19 nt, Homo sapiens
gaagagacauuuacaagaa

SEQ ID NO: 826243 - RNA, 19 nt, Homo sapiens
gaacuuaacugacguuuca

SEQ ID NO: 826244 - RNA, 19 nt, Homo sapiens
uaaaugagcuggauucuga

SEQ ID NO: 826245 - RNA, 19 nt, Homo sapiens
gaauggaaauggacuauaa

SEQ ID NO: 826246 - RNA, 19 nt, Homo sapiens
gcacaaaugucuugaauca

SEQ ID NO: 826247 - RNA, 19 nt, Homo sapiens
ugaaauaccucuugaauug

SEQ ID NO: 826248 - RNA, 19 nt, Homo sapiens
gauaugagcuuuaaagaug

SEQ ID NO: 826249 - RNA, 19 nt, Homo sapiens
gaagcaacaucaacaauuu

SEQ ID NO: 826250 - RNA, 19 nt, Homo sapiens
gaagaccugucaauaauuu

SEQ ID NO: 826251 - RNA, 19 nt, Homo sapiens
gaagaaagcucaguuaaag

SEQ ID NO: 826252 - RNA, 19 nt, Homo sapiens
ggaauuggauugaaugaaa

SEQ ID NO: 826253 - RNA, 19 nt, Homo sapiens
ggaagaacauggcaaauau

SEQ ID NO: 826254 - RNA, 19 nt, Homo sapiens
gaagagaaauggaaaggaa

SEQ ID NO: 826255 - RNA, 19 nt, Homo sapiens
gaaaugugcuuccgagauu

SEQ ID NO: 826256 - RNA, 19 nt, Homo sapiens
uaaaggagcugcagcauga

SEQ ID NO: 826257 - RNA, 19 nt, Homo sapiens
gaaauuauauacccaguug

SEQ ID NO: 826258 - RNA, 19 nt, Homo sapiens
gaagauauguuacaaaugg

SEQ ID NO: 826259 - RNA, 19 nt, Homo sapiens
gaacagaccagaauuuauu

SEQ ID NO: 826260 - RNA, 19 nt, Homo sapiens
gaaaaugacugaaguagua

SEQ ID NO: 826261 - RNA, 19 nt, Homo sapiens
gaacaaacagaaugucuua

SEQ ID NO: 826262 - RNA, 19 nt, Homo sapiens
caaggaaagucuuaaagua

SEQ ID NO: 826263 - RNA, 19 nt, Homo sapiens
gaagagaaaugccaaaaua

SEQ ID NO: 826264 - RNA, 19 nt, Homo sapiens
gaacaacucuuugaaggaa

SEQ ID NO: 826265 - RNA, 19 nt, Homo sapiens
gaagaaagcauuauggaaa

SEQ ID NO: 826266 - RNA, 19 nt, Homo sapiens
uagaagagcuuauggauga

SEQ ID NO: 826267 - RNA, 19 nt, Homo sapiens
ugaaugggaugaagaaaua

SEQ ID NO: 826268 - RNA, 19 nt, Homo sapiens
ggaggaggcugacaguaua

SEQ ID NO: 826269 - RNA, 19 nt, Homo sapiens
gcagcaacaucuacaguua

SEQ ID NO: 826270 - RNA, 19 nt, Homo sapiens
gagaaaggcugaaggaaga

SEQ ID NO: 826271 - RNA, 19 nt, Homo sapiens
gaaaauacguugacaguaa

SEQ ID NO: 826272 - RNA, 19 nt, Homo sapiens
agaaggaacuugaaucaua

SEQ ID NO: 826273 - RNA, 19 nt, Homo sapiens
gaacugagaaggcugaaua

SEQ ID NO: 826274 - RNA, 19 nt, Homo sapiens
gcaagugucccaagauuua

SEQ ID NO: 826275 - RNA, 19 nt, Homo sapiens
cacaggagcuucacaauaa

SEQ ID NO: 826276 - RNA, 19 nt, Homo sapiens
ggacaaugcucauaacuca

SEQ ID NO: 826277 - RNA, 19 nt, Homo sapiens
ugaaggagcuuaucaguug

SEQ ID NO: 826278 - RNA, 19 nt, Homo sapiens
gaaaugaaccugccacuga

SEQ ID NO: 826279 - RNA, 19 nt, Homo sapiens
ucaaacagccuucucauua

SEQ ID NO: 826280 - RNA, 19 nt, Homo sapiens
ccacagagcuccaaaguag

SEQ ID NO: 826281 - RNA, 19 nt, Homo sapiens
guaugaagcugcagaguuu

SEQ ID NO: 826282 - RNA, 19 nt, Homo sapiens
ggacaacacacuccauuua

SEQ ID NO: 826283 - RNA, 19 nt, Homo sapiens
gaacagaagcacaaucuuu

SEQ ID NO: 826284 - RNA, 19 nt, Homo sapiens
gaauuuggcuggagaaugu

SEQ ID NO: 826285 - RNA, 19 nt, Homo sapiens
uuacaacccucaugaauaa

SEQ ID NO: 826286 - RNA, 19 nt, Homo sapiens
cuaagaaaccgaucaauua

SEQ ID NO: 826287 - RNA, 19 nt, Homo sapiens
gaaagcagaugcauauaca

SEQ ID NO: 826288 - RNA, 19 nt, Homo sapiens
gaccagagcuuuaaugauc

SEQ ID NO: 826289 - RNA, 19 nt, Homo sapiens
ucaagaagcuaaagagaaa

SEQ ID NO: 826290 - RNA, 19 nt, Homo sapiens
caaacagccuucucauuaa

SEQ ID NO: 826291 - RNA, 19 nt, Homo sapiens
ccaggagguuuacaaauua

SEQ ID NO: 826292 - RNA, 19 nt, Homo sapiens
uaacagagauugagcacaa

SEQ ID NO: 826293 - RNA, 19 nt, Homo sapiens
gauuagcaaugaagucuua

SEQ ID NO: 826294 - RNA, 19 nt, Homo sapiens
gcagaaagguaucuugaga

SEQ ID NO: 826295 - RNA, 19 nt, Homo sapiens
caagaaagcccaagauuug

SEQ ID NO: 826296 - RNA, 19 nt, Homo sapiens
ugaaauauguaaccgcuua

SEQ ID NO: 826297 - RNA, 19 nt, Homo sapiens
gaaggaacuugaaucauau

SEQ ID NO: 826298 - RNA, 19 nt, Homo sapiens
ggcaauaucugcaucauga

SEQ ID NO: 826299 - RNA, 19 nt, Homo sapiens
ggacaauuguggagcauuu

SEQ ID NO: 826300 - RNA, 19 nt, Homo sapiens
gagaaucuguggaauuauu

SEQ ID NO: 826301 - RNA, 19 nt, Homo sapiens
gcaaaugucugcaagaaag

SEQ ID NO: 826302 - RNA, 19 nt, Homo sapiens
gaaagaacuucaaacuaug

SEQ ID NO: 826303 - RNA, 19 nt, Homo sapiens
gaagaacucccugaaauuu

SEQ ID NO: 826304 - RNA, 19 nt, Homo sapiens
ggaaucagcuacaguggaa

SEQ ID NO: 826305 - RNA, 19 nt, Homo sapiens
caacugggcuucaggcaaa

SEQ ID NO: 826306 - RNA, 19 nt, Homo sapiens
caacagauaugucaguaga

SEQ ID NO: 826307 - RNA, 19 nt, Homo sapiens
ggaagaaauuaaagaggua

SEQ ID NO: 826308 - RNA, 19 nt, Homo sapiens
gauauaaucuccauugagu

SEQ ID NO: 826309 - RNA, 19 nt, Homo sapiens
gcagaugggugaccaguug

SEQ ID NO: 826310 - RNA, 19 nt, Homo sapiens
gaggaagacugggaaauaa

SEQ ID NO: 826311 - RNA, 19 nt, Homo sapiens
guggauagauggcuugaua

SEQ ID NO: 826312 - RNA, 19 nt, Homo sapiens
uggcagaacuaguugauua

SEQ ID NO: 826313 - RNA, 19 nt, Homo sapiens
gcagugagcuucagggaau

SEQ ID NO: 826314 - RNA, 19 nt, Homo sapiens
gaaacaaccuggcagagau

SEQ ID NO: 826315 - RNA, 19 nt, Homo sapiens
uaacucaacuuccagauau

SEQ ID NO: 826316 - RNA, 19 nt, Homo sapiens
cagcagccauuacuuauaa

SEQ ID NO: 826317 - RNA, 19 nt, Homo sapiens
gaaaggagaaccugaagaa

SEQ ID NO: 826318 - RNA, 19 nt, Homo sapiens
uauaaaggcuggagagaaa

SEQ ID NO: 826319 - RNA, 19 nt, Homo sapiens
gaaaugcucuaaagugcaa

SEQ ID NO: 826320 - RNA, 19 nt, Homo sapiens
guaccuagcucugcucuuu

SEQ ID NO: 826321 - RNA, 19 nt, Homo sapiens
gcucacaacugaccugaaa

SEQ ID NO: 826322 - RNA, 19 nt, Homo sapiens
ccagagggcugcuuauuug

SEQ ID NO: 826323 - RNA, 19 nt, Homo sapiens
gaaauggacuauaaacagu

SEQ ID NO: 826324 - RNA, 19 nt, Homo sapiens
gaagaaaguuccgugaaga

SEQ ID NO: 826325 - RNA, 19 nt, Homo sapiens
ggaagugguugacuaauca

SEQ ID NO: 826326 - RNA, 19 nt, Homo sapiens
gacagaagauuacuaugaa

SEQ ID NO: 826327 - RNA, 19 nt, Homo sapiens
gaugacaccuccugugaaa

SEQ ID NO: 826328 - RNA, 19 nt, Homo sapiens
caaggaagcacuaauaauu

SEQ ID NO: 826329 - RNA, 19 nt, Homo sapiens
gaaccucacaguugaauaa

SEQ ID NO: 826330 - RNA, 19 nt, Homo sapiens
gagcaucacuucccucgaa

SEQ ID NO: 826331 - RNA, 19 nt, Homo sapiens
ggcagaagauuauuaaaga

SEQ ID NO: 826332 - RNA, 19 nt, Homo sapiens
gcacaggagcuucacaaua

SEQ ID NO: 826333 - RNA, 19 nt, Homo sapiens
uccaugagcugaagaauaa

SEQ ID NO: 826334 - RNA, 19 nt, Homo sapiens
gaacgagaggcaauuauuu

SEQ ID NO: 826335 - RNA, 19 nt, Homo sapiens
caacaacauucucaaauca

SEQ ID NO: 826336 - RNA, 19 nt, Homo sapiens
acucagauguuucucauua

SEQ ID NO: 826337 - RNA, 19 nt, Homo sapiens
gaacgaaggcaaacaguug

SEQ ID NO: 826338 - RNA, 19 nt, Homo sapiens
ccaaggaauuugucaguuu

SEQ ID NO: 826339 - RNA, 19 nt, Homo sapiens
uuaaugaucuugcacauga

SEQ ID NO: 826340 - RNA, 19 nt, Homo sapiens
ggugaaaucugauguuugu

SEQ ID NO: 826341 - RNA, 19 nt, Homo sapiens
ggaaaggauuguccaguua

SEQ ID NO: 826342 - RNA, 19 nt, Homo sapiens
gcaaggugcuucuagguua

SEQ ID NO: 826343 - RNA, 19 nt, Homo sapiens
gaacaucccugcugcauuc

SEQ ID NO: 826344 - RNA, 19 nt, Homo sapiens
gaagugcucuuuagaaguu

SEQ ID NO: 826345 - RNA, 19 nt, Homo sapiens
gaacaaagcagccgcauga

SEQ ID NO: 826346 - RNA, 19 nt, Homo sapiens
caauaaagcuggacagaga

SEQ ID NO: 826347 - RNA, 19 nt, Homo sapiens
gcucaacccugaaauagaa

SEQ ID NO: 826348 - RNA, 19 nt, Homo sapiens
ggaagacagugaaggcaua

SEQ ID NO: 826349 - RNA, 19 nt, Homo sapiens
ggagaaggcugccaagcaa

SEQ ID NO: 826350 - RNA, 19 nt, Homo sapiens
gcauauuacuugagcuuaa

SEQ ID NO: 826351 - RNA, 19 nt, Homo sapiens
cagaagaggugaccaucua

SEQ ID NO: 826352 - RNA, 19 nt, Homo sapiens
gcacaaagacccaguguca

SEQ ID NO: 826353 - RNA, 19 nt, Homo sapiens
ggucgaaccuggauaccua

SEQ ID NO: 826354 - RNA, 19 nt, Homo sapiens
gaaccuccauucacuacaa

SEQ ID NO: 826355 - RNA, 19 nt, Homo sapiens
gggaaaggauuguccaguu

SEQ ID NO: 826356 - RNA, 19 nt, Homo sapiens
gcaacaaggucuauguauc

SEQ ID NO: 826357 - RNA, 19 nt, Homo sapiens
guaaauaggagccuuucua

SEQ ID NO: 826358 - RNA, 19 nt, Homo sapiens
auauaaagcugcagacaaa

SEQ ID NO: 826359 - RNA, 19 nt, Homo sapiens
ggacagcggucaugaucau

SEQ ID NO: 826360 - RNA, 19 nt, Homo sapiens
gaaaucaccaucgaaguuu

SEQ ID NO: 826361 - RNA, 19 nt, Homo sapiens
aauugugccuugcauauua

SEQ ID NO: 826362 - RNA, 19 nt, Homo sapiens
ggaagcaccugagcaugaa

SEQ ID NO: 826363 - RNA, 19 nt, Homo sapiens
gaaauucacaucccgauca

SEQ ID NO: 826364 - RNA, 19 nt, Homo sapiens
gacaacauccgaauugaaa

SEQ ID NO: 826365 - RNA, 19 nt, Homo sapiens
guacaucccuccuucuuac

SEQ ID NO: 826366 - RNA, 19 nt, Homo sapiens
gaucauagccuaccacacu

SEQ ID NO: 826367 - RNA, 19 nt, Homo sapiens
uaacagagacgacuuugug

SEQ ID NO: 826368 - RNA, 19 nt, Homo sapiens
aaaagaagcugcacgguuu

SEQ ID NO: 826369 - RNA, 19 nt, Homo sapiens
gagccuuucuacugguuua

SEQ ID NO: 826370 - RNA, 19 nt, Homo sapiens
uaaugucgcccaacucaua

SEQ ID NO: 826371 - RNA, 19 nt, Homo sapiens
gauggcagcaggagucaua

SEQ ID NO: 826372 - RNA, 19 nt, Homo sapiens
gcuacagccuccaaaguga

SEQ ID NO: 826373 - RNA, 19 nt, Homo sapiens
gaccuucacuguccacuuc

SEQ ID NO: 826374 - RNA, 19 nt, Homo sapiens
ucgcccaacucauauauaa

SEQ ID NO: 826375 - RNA, 19 nt, Homo sapiens
cugcaagugugaccaauaa

SEQ ID NO: 826376 - RNA, 19 nt, Homo sapiens
ugaaauagaagcagaacaa

SEQ ID NO: 826377 - RNA, 19 nt, Homo sapiens
gcaguuagaagugcucuuu

SEQ ID NO: 826378 - RNA, 19 nt, Homo sapiens
ccacaucucccaaugcauu

SEQ ID NO: 826379 - RNA, 19 nt, Homo sapiens
cgaccaggcugaaauccuu

SEQ ID NO: 826380 - RNA, 19 nt, Homo sapiens
cagaagcucuaaccugaga

SEQ ID NO: 826381 - RNA, 19 nt, Homo sapiens
ggcuggaccuggcugcuua

SEQ ID NO: 826382 - RNA, 19 nt, Homo sapiens
gagaugaagguguauguga

SEQ ID NO: 826383 - RNA, 19 nt, Homo sapiens
gacaucggguucaguguga

SEQ ID NO: 826384 - RNA, 19 nt, Homo sapiens
ggaaugaccgugaccuuca

SEQ ID NO: 826385 - RNA, 19 nt, Homo sapiens
guaaagguauccccuguuu

SEQ ID NO: 826386 - RNA, 19 nt, Homo sapiens
gaaauagaagcagaacaaa

SEQ ID NO: 826387 - RNA, 19 nt, Homo sapiens
guggaucccuccucuguug

SEQ ID NO: 826388 - RNA, 19 nt, Homo sapiens
gaagaauugugccuugcau

SEQ ID NO: 826389 - RNA, 19 nt, Homo sapiens
cauuguugcuguaaaggua

SEQ ID NO: 826390 - RNA, 19 nt, Homo sapiens
caacaaggucuauguaucu

SEQ ID NO: 826391 - RNA, 19 nt, Homo sapiens
gaagaucaggcaagggaaa

SEQ ID NO: 826392 - RNA, 19 nt, Homo sapiens
acaaagacccagugucauu

SEQ ID NO: 826393 - RNA, 19 nt, Homo sapiens
gaggagcaaugggacauga

SEQ ID NO: 826394 - RNA, 19 nt, Homo sapiens
ccaggaggcugucuacaag

SEQ ID NO: 826395 - RNA, 19 nt, Homo sapiens
gaaguugucugugggugau

SEQ ID NO: 826396 - RNA, 19 nt, Homo sapiens
uagaagugcucuuuagaag

SEQ ID NO: 826397 - RNA, 19 nt, Homo sapiens
caaccaaaccaucauuguu

SEQ ID NO: 826398 - RNA, 19 nt, Homo sapiens
ugaaaucaccaucgaaguu

SEQ ID NO: 826399 - RNA, 19 nt, Homo sapiens
gcagaacccacuccauuuc

SEQ ID NO: 826400 - RNA, 19 nt, Homo sapiens
gaauguacgcccugcagaa

SEQ ID NO: 826401 - RNA, 19 nt, Homo sapiens
caaccuggauguaaauagg

SEQ ID NO: 826402 - RNA, 19 nt, Homo sapiens
caaagacccagugucauuu

SEQ ID NO: 826403 - RNA, 19 nt, Homo sapiens
ggacaucccacgugugauc

SEQ ID NO: 826404 - RNA, 19 nt, Homo sapiens
caacuacaccaucacauuc

SEQ ID NO: 826405 - RNA, 19 nt, Homo sapiens
gugcagaacccacuccauu

SEQ ID NO: 826406 - RNA, 19 nt, Homo sapiens
gccuaucaguacacaauaa

SEQ ID NO: 826407 - RNA, 19 nt, Homo sapiens
ggagaaaggaagaauugug

SEQ ID NO: 826408 - RNA, 19 nt, Homo sapiens
gggaggagacccuuggaaa

SEQ ID NO: 826409 - RNA, 19 nt, Homo sapiens
gcaugguugucuaggguuu

SEQ ID NO: 826410 - RNA, 19 nt, Homo sapiens
gaauugugccuugcauauu

SEQ ID NO: 826411 - RNA, 19 nt, Homo sapiens
caagcucccuucaguccuu

SEQ ID NO: 826412 - RNA, 19 nt, Homo sapiens
cauaagccguugagacauc

SEQ ID NO: 826413 - RNA, 19 nt, Homo sapiens
ggauuguccaguuacuuua

SEQ ID NO: 826414 - RNA, 19 nt, Homo sapiens
caacuuugccacuaacaga

SEQ ID NO: 826415 - RNA, 19 nt, Homo sapiens
ggacauccaccaucgaagu

SEQ ID NO: 826416 - RNA, 19 nt, Homo sapiens
cuauuucgcugccucauca

SEQ ID NO: 826417 - RNA, 19 nt, Homo sapiens
acaacagauugaagucuuu

SEQ ID NO: 826418 - RNA, 19 nt, Homo sapiens
augaagcccuugacaacua

SEQ ID NO: 826419 - RNA, 19 nt, Homo sapiens
ccacgcuucuugugagcua

SEQ ID NO: 826420 - RNA, 19 nt, Homo sapiens
ucggugagaugaaggugua

SEQ ID NO: 826421 - RNA, 19 nt, Homo sapiens
guacaacuuugccaugaac

SEQ ID NO: 826422 - RNA, 19 nt, Homo sapiens
cacaacagauugaagucuu

SEQ ID NO: 826423 - RNA, 19 nt, Homo sapiens
caucauuguugcuguaaag

SEQ ID NO: 826424 - RNA, 19 nt, Homo sapiens
caguacaacuuugccauga

SEQ ID NO: 826425 - RNA, 19 nt, Homo sapiens
gcaagguggucaucaucuc

SEQ ID NO: 826426 - RNA, 19 nt, Homo sapiens
uuacauugguggcccuuga

SEQ ID NO: 826427 - RNA, 19 nt, Homo sapiens
gaggcugucuacaagaaug

SEQ ID NO: 826428 - RNA, 19 nt, Homo sapiens
ggcagcaggagucauauuu

SEQ ID NO: 826429 - RNA, 19 nt, Homo sapiens
gaacaagccccuccagaug

SEQ ID NO: 826430 - RNA, 19 nt, Homo sapiens
ccaaauacuuccccuuuau

SEQ ID NO: 826431 - RNA, 19 nt, Homo sapiens
ccgcagauguugucaaggu

SEQ ID NO: 826432 - RNA, 19 nt, Homo sapiens
gagacgacuuugugcagau

SEQ ID NO: 826433 - RNA, 19 nt, Homo sapiens
gcaagugugaccaauaaag

SEQ ID NO: 826434 - RNA, 19 nt, Homo sapiens
cugacaaccuggauguaaa

SEQ ID NO: 826435 - RNA, 19 nt, Homo sapiens
gauccaaguccagguguuu

SEQ ID NO: 826436 - RNA, 19 nt, Homo sapiens
aauaggagccuuucuacug

SEQ ID NO: 826437 - RNA, 19 nt, Homo sapiens
gcgagaggcuggagaacac

SEQ ID NO: 826438 - RNA, 19 nt, Homo sapiens
ggacuucugaggagcaaug

SEQ ID NO: 826439 - RNA, 19 nt, Homo sapiens
ccacuacccugaccuucuc

SEQ ID NO: 826440 - RNA, 19 nt, Homo sapiens
cggaagcaccugagcauga

SEQ ID NO: 826441 - RNA, 19 nt, Homo sapiens
caaagaagcuguccucaaa

SEQ ID NO: 826442 - RNA, 19 nt, Homo sapiens
gaaaugugguugccaaauu

SEQ ID NO: 826443 - RNA, 19 nt, Homo sapiens
gaaguaguguucacauuaa

SEQ ID NO: 826444 - RNA, 19 nt, Homo sapiens
caacuggaauagcuaauua

SEQ ID NO: 826445 - RNA, 19 nt, Homo sapiens
ggaaauaagccuugaaauu

SEQ ID NO: 826446 - RNA, 19 nt, Homo sapiens
ggacugcgguaccuaauuu

SEQ ID NO: 826447 - RNA, 19 nt, Homo sapiens
gaagauacaugccgaguca

SEQ ID NO: 826448 - RNA, 19 nt, Homo sapiens
gaaacguaccuaaguauua

SEQ ID NO: 826449 - RNA, 19 nt, Homo sapiens
gaaaaccacuguuccauua

SEQ ID NO: 826450 - RNA, 19 nt, Homo sapiens
caagagcacuggaaauuga

SEQ ID NO: 826451 - RNA, 19 nt, Homo sapiens
guacuagaccugaaauuua

SEQ ID NO: 826452 - RNA, 19 nt, Homo sapiens
ggauuggauugucaaauua

SEQ ID NO: 826453 - RNA, 19 nt, Homo sapiens
gaaggcaaauaaacucuuu

SEQ ID NO: 826454 - RNA, 19 nt, Homo sapiens
gcacaugcuucuuuauuug

SEQ ID NO: 826455 - RNA, 19 nt, Homo sapiens
ggaauuccaugaacacuug

SEQ ID NO: 826456 - RNA, 19 nt, Homo sapiens
gaauaugcaucuuugagaa

SEQ ID NO: 826457 - RNA, 19 nt, Homo sapiens
gcaaaucaguucaguucaa

SEQ ID NO: 826458 - RNA, 19 nt, Homo sapiens
cgaugaaacuggagaauga

SEQ ID NO: 826459 - RNA, 19 nt, Homo sapiens
guaaagaacugucugaacu

SEQ ID NO: 826460 - RNA, 19 nt, Homo sapiens
gagcuuaaguucaaagaau

SEQ ID NO: 826461 - RNA, 19 nt, Homo sapiens
gaaauggauuggauuguca

SEQ ID NO: 826462 - RNA, 19 nt, Homo sapiens
gaaagauuauucacucuag

SEQ ID NO: 826463 - RNA, 19 nt, Homo sapiens
gaagaaauccagggaauau

SEQ ID NO: 826464 - RNA, 19 nt, Homo sapiens
ggaagaauuuauugagguu

SEQ ID NO: 826465 - RNA, 19 nt, Homo sapiens
ggacauauaacucugugua

SEQ ID NO: 826466 - RNA, 19 nt, Homo sapiens
guagauaaccuuggacaua

SEQ ID NO: 826467 - RNA, 19 nt, Homo sapiens
uaacaugaauccucaagau

SEQ ID NO: 826468 - RNA, 19 nt, Homo sapiens
gaaaguagccaagauaaca

SEQ ID NO: 826469 - RNA, 19 nt, Homo sapiens
acaaagacauucuaacuca

SEQ ID NO: 826470 - RNA, 19 nt, Homo sapiens
guaaugcugugcaauguau

SEQ ID NO: 826471 - RNA, 19 nt, Homo sapiens
ucaccugacuguuauauau

SEQ ID NO: 826472 - RNA, 19 nt, Homo sapiens
gcacauggguagagaugau

SEQ ID NO: 826473 - RNA, 19 nt, Homo sapiens
gaagcucccuggcugaaga

SEQ ID NO: 826474 - RNA, 19 nt, Homo sapiens
gaacggaaacuguggcuau

SEQ ID NO: 826475 - RNA, 19 nt, Homo sapiens
gagacaagcucuauacaac

SEQ ID NO: 826476 - RNA, 19 nt, Homo sapiens
guaccgaggucacaaagga

SEQ ID NO: 826477 - RNA, 19 nt, Homo sapiens
ggagagccaucgaggagaa

SEQ ID NO: 826478 - RNA, 19 nt, Homo sapiens
caaaucaguucaguucaaa

SEQ ID NO: 826479 - RNA, 19 nt, Homo sapiens
ggacaaugaaccuguaauu

SEQ ID NO: 826480 - RNA, 19 nt, Homo sapiens
aagaaggucugucaggaua

SEQ ID NO: 826481 - RNA, 19 nt, Homo sapiens
caaggaagguuugaaggaa

SEQ ID NO: 826482 - RNA, 19 nt, Homo sapiens
ugagaacacuguggauuaa

SEQ ID NO: 826483 - RNA, 19 nt, Homo sapiens
guacacaauucccuuugaa

SEQ ID NO: 826484 - RNA, 19 nt, Homo sapiens
uagacggguucacuaauua

SEQ ID NO: 826485 - RNA, 19 nt, Homo sapiens
gaucguacauugucagaag

SEQ ID NO: 826486 - RNA, 19 nt, Homo sapiens
aagccaagauugacauuaa

SEQ ID NO: 826487 - RNA, 19 nt, Homo sapiens
gcugagccauaauuacuaa

SEQ ID NO: 826488 - RNA, 19 nt, Homo sapiens
ggaaauggauuggauuguc

SEQ ID NO: 826489 - RNA, 19 nt, Homo sapiens
gcuuugcacucacuaauga

SEQ ID NO: 826490 - RNA, 19 nt, Homo sapiens
guagucagaugggacauuu

SEQ ID NO: 826491 - RNA, 19 nt, Homo sapiens
cguaacaacuuaugacaug

SEQ ID NO: 826492 - RNA, 19 nt, Homo sapiens
caauggagcugcagggaau

SEQ ID NO: 826493 - RNA, 19 nt, Homo sapiens
ccaauaaugugccugugaa

SEQ ID NO: 826494 - RNA, 19 nt, Homo sapiens
gcagugucauugauauuau

SEQ ID NO: 826495 - RNA, 19 nt, Homo sapiens
ggaaauugaugguacaaaa

SEQ ID NO: 826496 - RNA, 19 nt, Homo sapiens
uggauuggauugucaaauu

SEQ ID NO: 826497 - RNA, 19 nt, Homo sapiens
gggaagaaauccagggaau

SEQ ID NO: 826498 - RNA, 19 nt, Homo sapiens
gaagucuguuccuuuaaug

SEQ ID NO: 826499 - RNA, 19 nt, Homo sapiens
ccucuuaucuuguguuuag

SEQ ID NO: 826500 - RNA, 19 nt, Homo sapiens
aaaugcagaugcuguauau

SEQ ID NO: 826501 - RNA, 19 nt, Homo sapiens
ggaagaaauccagggaaua

SEQ ID NO: 826502 - RNA, 19 nt, Homo sapiens
ugccaaaggugauguggua

SEQ ID NO: 826503 - RNA, 19 nt, Homo sapiens
gaacauggagcaacccaau

SEQ ID NO: 826504 - RNA, 19 nt, Homo sapiens
aagaagcuguccucaaauu

SEQ ID NO: 826505 - RNA, 19 nt, Homo sapiens
ggauauauucgagcucuua

SEQ ID NO: 826506 - RNA, 19 nt, Homo sapiens
ggucacaaaggaagaauuu

SEQ ID NO: 826507 - RNA, 19 nt, Homo sapiens
gcaaacaucuggguuacag

SEQ ID NO: 826508 - RNA, 19 nt, Homo sapiens
uggaauagcuaauuacagu

SEQ ID NO: 826509 - RNA, 19 nt, Homo sapiens
ggaauaugcaucuuugaga

SEQ ID NO: 826510 - RNA, 19 nt, Homo sapiens
caaaggaucaggugccaaa

SEQ ID NO: 826511 - RNA, 19 nt, Homo sapiens
cgacaucacaggauauauu

SEQ ID NO: 826512 - RNA, 19 nt, Homo sapiens
uagauaaccuuggacauau

SEQ ID NO: 826513 - RNA, 19 nt, Homo sapiens
cgucauauauggagagaau

SEQ ID NO: 826514 - RNA, 19 nt, Homo sapiens
agcuuuaccuggaauauua

SEQ ID NO: 826515 - RNA, 19 nt, Homo sapiens
ugaagaagaucguaacaac

SEQ ID NO: 826516 - RNA, 19 nt, Homo sapiens
gcaaagaagcuguccucaa

SEQ ID NO: 826517 - RNA, 19 nt, Homo sapiens
cagccaaucuggaaacaau

SEQ ID NO: 826518 - RNA, 19 nt, Homo sapiens
ggucucaccucaacuucuu

SEQ ID NO: 826519 - RNA, 19 nt, Homo sapiens
aaaccacuguuccauuaaa

SEQ ID NO: 826520 - RNA, 19 nt, Homo sapiens
gaaggucugucaggauaug

SEQ ID NO: 826521 - RNA, 19 nt, Homo sapiens
gaggaaauaagccuugaaa

SEQ ID NO: 826522 - RNA, 19 nt, Homo sapiens
caagauaacaugaggacuu

SEQ ID NO: 826523 - RNA, 19 nt, Homo sapiens
ggaaacguaccuaaguauu

SEQ ID NO: 826524 - RNA, 19 nt, Homo sapiens
gagccauaauuacuaaaga

SEQ ID NO: 826525 - RNA, 19 nt, Homo sapiens
gaaauaugcuaagaaugag

SEQ ID NO: 826526 - RNA, 19 nt, Homo sapiens
cgggaaacguaccuaagua

SEQ ID NO: 826527 - RNA, 19 nt, Homo sapiens
gacaagcucuauacaacau

SEQ ID NO: 826528 - RNA, 19 nt, Homo sapiens
ggagacaagcucuauacaa

SEQ ID NO: 826529 - RNA, 19 nt, Homo sapiens
uggagaaccugaaacaaau

SEQ ID NO: 826530 - RNA, 19 nt, Homo sapiens
agaagaucguaacaacuua

SEQ ID NO: 826531 - RNA, 19 nt, Homo sapiens
gacaaugaaccuguaauuu

SEQ ID NO: 826532 - RNA, 19 nt, Homo sapiens
guaccuaauuucuuaugga

SEQ ID NO: 826533 - RNA, 19 nt, Homo sapiens
ugcgguaccuaauuucuua

SEQ ID NO: 826534 - RNA, 19 nt, Homo sapiens
guaccuaaguauuauugga

SEQ ID NO: 826535 - RNA, 19 nt, Homo sapiens
gcacaacuggaauagcuaa

SEQ ID NO: 826536 - RNA, 19 nt, Homo sapiens
uggaugagguauucaagaa

SEQ ID NO: 826537 - RNA, 19 nt, Homo sapiens
ucaaagaauuucagauguc

SEQ ID NO: 826538 - RNA, 19 nt, Homo sapiens
ugaggaaucuuaucuacca

SEQ ID NO: 826539 - RNA, 19 nt, Homo sapiens
caccaugaccucucagaua

SEQ ID NO: 826540 - RNA, 19 nt, Homo sapiens
gcaauaaagaauuccuuga

SEQ ID NO: 826541 - RNA, 19 nt, Homo sapiens
gagaagcacuguugaaauu

SEQ ID NO: 826542 - RNA, 19 nt, Homo sapiens
gcauugacauggauaaaua

SEQ ID NO: 826543 - RNA, 19 nt, Homo sapiens
gaagcacuguugaaauuua

SEQ ID NO: 826544 - RNA, 19 nt, Homo sapiens
ggagagacauccuguacua

SEQ ID NO: 826545 - RNA, 19 nt, Homo sapiens
cagcauagcuagcauguuu

SEQ ID NO: 826546 - RNA, 19 nt, Homo sapiens
caagagaguucuaacaauu

SEQ ID NO: 826547 - RNA, 19 nt, Homo sapiens
gaagggacauguucaguga

SEQ ID NO: 826548 - RNA, 19 nt, Homo sapiens
ggaaucaaauuacaagcua

SEQ ID NO: 826549 - RNA, 19 nt, Homo sapiens
gaacaagcuuucuuacuca

SEQ ID NO: 826550 - RNA, 19 nt, Homo sapiens
caagauggauucuggauau

SEQ ID NO: 826551 - RNA, 19 nt, Homo sapiens
ggaaagagauagccuugau

SEQ ID NO: 826552 - RNA, 19 nt, Homo sapiens
gcucagggcuuucagagaa

SEQ ID NO: 826553 - RNA, 19 nt, Homo sapiens
gcagugaucucuacagcaa

SEQ ID NO: 826554 - RNA, 19 nt, Homo sapiens
uggcugagcuccuaaagua

SEQ ID NO: 826555 - RNA, 19 nt, Homo sapiens
ggauagaccuugaacaaca

SEQ ID NO: 826556 - RNA, 19 nt, Homo sapiens
gcaaguaucccuuacaguu

SEQ ID NO: 826557 - RNA, 19 nt, Homo sapiens
gaacagggaugggaaugga

SEQ ID NO: 826558 - RNA, 19 nt, Homo sapiens
ucaaacaagugucaaaguu

SEQ ID NO: 826559 - RNA, 19 nt, Homo sapiens
ggauaaauaugagguaguu

SEQ ID NO: 826560 - RNA, 19 nt, Homo sapiens
caaaagaucugaacuggaa

SEQ ID NO: 826561 - RNA, 19 nt, Homo sapiens
caaggagacugaggagaua

SEQ ID NO: 826562 - RNA, 19 nt, Homo sapiens
gaaguugacauuucuauuc

SEQ ID NO: 826563 - RNA, 19 nt, Homo sapiens
gagaaacaguauaacaaug

SEQ ID NO: 826564 - RNA, 19 nt, Homo sapiens
ugagagaccuggagaaaca

SEQ ID NO: 826565 - RNA, 19 nt, Homo sapiens
gaagaaugccuuuaagcuu

SEQ ID NO: 826566 - RNA, 19 nt, Homo sapiens
ucaagcaccucaaggauau

SEQ ID NO: 826567 - RNA, 19 nt, Homo sapiens
guaaugacacaaagccuua

SEQ ID NO: 826568 - RNA, 19 nt, Homo sapiens
gcaagggaguaucagacua

SEQ ID NO: 826569 - RNA, 19 nt, Homo sapiens
gggaaaaucuaacuucuuu

SEQ ID NO: 826570 - RNA, 19 nt, Homo sapiens
cgauagauguguuuguauu

SEQ ID NO: 826571 - RNA, 19 nt, Homo sapiens
gcaacagugacuuugauua

SEQ ID NO: 826572 - RNA, 19 nt, Homo sapiens
ugacuaggcccucucauuu

SEQ ID NO: 826573 - RNA, 19 nt, Homo sapiens
ucagcuaccuucaaauuau

SEQ ID NO: 826574 - RNA, 19 nt, Homo sapiens
ccaagaagcuggaggaaaa

SEQ ID NO: 826575 - RNA, 19 nt, Homo sapiens
gaugaacucugcugugaag

SEQ ID NO: 826576 - RNA, 19 nt, Homo sapiens
acacagagacccuugagua

SEQ ID NO: 826577 - RNA, 19 nt, Homo sapiens
gaagagaagggacauguuc

SEQ ID NO: 826578 - RNA, 19 nt, Homo sapiens
gaagagagcgagcaagcuu

SEQ ID NO: 826579 - RNA, 19 nt, Homo sapiens
cacaugaccuaacuacgua

SEQ ID NO: 826580 - RNA, 19 nt, Homo sapiens
caacauggccucgcuguga

SEQ ID NO: 826581 - RNA, 19 nt, Homo sapiens
aaucuucccuggcuucuuu

SEQ ID NO: 826582 - RNA, 19 nt, Homo sapiens
ccaaugacuuccaaacaug

SEQ ID NO: 826583 - RNA, 19 nt, Homo sapiens
gcacugagcgucacuacau

SEQ ID NO: 826584 - RNA, 19 nt, Homo sapiens
ggaagcagagguugagauu

SEQ ID NO: 826585 - RNA, 19 nt, Homo sapiens
ggagaaacaguauaacaau

SEQ ID NO: 826586 - RNA, 19 nt, Homo sapiens
gauagaccuugaacaacaa

SEQ ID NO: 826587 - RNA, 19 nt, Homo sapiens
uggcagagaugaugacuuc

SEQ ID NO: 826588 - RNA, 19 nt, Homo sapiens
gcugagcuccuaaaguaua

SEQ ID NO: 826589 - RNA, 19 nt, Homo sapiens
gcucugcauuugccaguuu

SEQ ID NO: 826590 - RNA, 19 nt, Homo sapiens
gcacuucuccucuacugaa

SEQ ID NO: 826591 - RNA, 19 nt, Homo sapiens
ucagggauauuacuucuca

SEQ ID NO: 826592 - RNA, 19 nt, Homo sapiens
gaagagguaccaaugacuu

SEQ ID NO: 826593 - RNA, 19 nt, Homo sapiens
ccuuuaagcuucacaacaa

SEQ ID NO: 826594 - RNA, 19 nt, Homo sapiens
aaacccagcccuucucuaa

SEQ ID NO: 826595 - RNA, 19 nt, Homo sapiens
gaucagggauauuacuucu

SEQ ID NO: 826596 - RNA, 19 nt, Homo sapiens
gagcccaccugaucaagau

SEQ ID NO: 826597 - RNA, 19 nt, Homo sapiens
caagcgacguuuagagaau

SEQ ID NO: 826598 - RNA, 19 nt, Homo sapiens
uaaaguauacugcccaaga

SEQ ID NO: 826599 - RNA, 19 nt, Homo sapiens
gaucugcaaguaucccuua

SEQ ID NO: 826600 - RNA, 19 nt, Homo sapiens
gaacauugaagauaucuac

SEQ ID NO: 826601 - RNA, 19 nt, Homo sapiens
gugucaaaguuguguguua

SEQ ID NO: 826602 - RNA, 19 nt, Homo sapiens
gcacaugaccuaacuacgu

SEQ ID NO: 826603 - RNA, 19 nt, Homo sapiens
ggaugggaauggaaagaga

SEQ ID NO: 826604 - RNA, 19 nt, Homo sapiens
uaacaauucuagugugaag

SEQ ID NO: 826605 - RNA, 19 nt, Homo sapiens
caucagcuaccuucaaauu

SEQ ID NO: 826606 - RNA, 19 nt, Homo sapiens
uacgauagauguguuugua

SEQ ID NO: 826607 - RNA, 19 nt, Homo sapiens
caacugaagguaaucuuug

SEQ ID NO: 826608 - RNA, 19 nt, Homo sapiens
gcaacugaagguaaucuuu

SEQ ID NO: 826609 - RNA, 19 nt, Homo sapiens
gagaugaugacuucaaugu

SEQ ID NO: 826610 - RNA, 19 nt, Homo sapiens
ugucaaaguuguguguuaa

SEQ ID NO: 826611 - RNA, 19 nt, Homo sapiens
caguaauucuguaauguug

SEQ ID NO: 826612 - RNA, 19 nt, Homo sapiens
ugacaggacuucagcuuac

SEQ ID NO: 826613 - RNA, 19 nt, Homo sapiens
gauguuggaguaccuguuu

SEQ ID NO: 826614 - RNA, 19 nt, Homo sapiens
gaggcaggcuuccuaugga

SEQ ID NO: 826615 - RNA, 19 nt, Homo sapiens
gguccaagucugauaguaa

SEQ ID NO: 826616 - RNA, 19 nt, Homo sapiens
cagcuaccuucaaauuauu

SEQ ID NO: 826617 - RNA, 19 nt, Homo sapiens
ucacugccuugucauuauu

SEQ ID NO: 826618 - RNA, 19 nt, Homo sapiens
ggagaagcacuguugaaau

SEQ ID NO: 826619 - RNA, 19 nt, Homo sapiens
caaacaagugucaaaguug

SEQ ID NO: 826620 - RNA, 19 nt, Homo sapiens
gggcaacagugacuuugau

SEQ ID NO: 826621 - RNA, 19 nt, Homo sapiens
uauaagaacagcaacaaga

SEQ ID NO: 826622 - RNA, 19 nt, Homo sapiens
aagcagagguugagauucu

SEQ ID NO: 826623 - RNA, 19 nt, Homo sapiens
aacaugugauuccgucuua

SEQ ID NO: 826624 - RNA, 19 nt, Homo sapiens
gaaaagucccuaagcaaaa

SEQ ID NO: 826625 - RNA, 19 nt, Homo sapiens
gaaaugugacucagcagau

SEQ ID NO: 826626 - RNA, 19 nt, Homo sapiens
gguaaucuuugggaacauu

SEQ ID NO: 826627 - RNA, 19 nt, Homo sapiens
gaagccaaauagugaucuu

SEQ ID NO: 826628 - RNA, 19 nt, Homo sapiens
uuaaauaccuggguucagu

SEQ ID NO: 826629 - RNA, 19 nt, Homo sapiens
caccugaugccacuaauuu

SEQ ID NO: 826630 - RNA, 19 nt, Homo sapiens
agacagagcccaccugauc

SEQ ID NO: 826631 - RNA, 19 nt, Homo sapiens
ggaagugaaauaugugguu

SEQ ID NO: 826632 - RNA, 19 nt, Homo sapiens
gcagagaugaugacuucaa

SEQ ID NO: 826633 - RNA, 19 nt, Homo sapiens
gagaauauugacaagauug

SEQ ID NO: 826634 - RNA, 19 nt, Homo sapiens
gaaagagagagaaagaaca

SEQ ID NO: 826635 - RNA, 19 nt, Homo sapiens
acacaaagccuuaugaaaa

SEQ ID NO: 826636 - RNA, 19 nt, Homo sapiens
acaagagaguucuaacaau

SEQ ID NO: 826637 - RNA, 19 nt, Homo sapiens
caacaagagaguucuaaca

SEQ ID NO: 826638 - RNA, 19 nt, Homo sapiens
agacuucucccauuguuaa

SEQ ID NO: 826639 - RNA, 19 nt, Homo sapiens
ugacauggauaaauaugag

SEQ ID NO: 826640 - RNA, 19 nt, Homo sapiens
ucuaacaauucuaguguga

SEQ ID NO: 826641 - RNA, 19 nt, Homo sapiens
gcacaucaaucaucauuua

SEQ ID NO: 826642 - RNA, 19 nt, Homo sapiens
gaaauuaucuuccagcauu

SEQ ID NO: 826643 - RNA, 19 nt, Homo sapiens
cauagaagcugaaccuuua

SEQ ID NO: 826644 - RNA, 19 nt, Homo sapiens
caaaggagaugucauuaaa

SEQ ID NO: 826645 - RNA, 19 nt, Homo sapiens
gaaagcauccaccuaauua

SEQ ID NO: 826646 - RNA, 19 nt, Homo sapiens
aaagaaagcuggauacaaa

SEQ ID NO: 826647 - RNA, 19 nt, Homo sapiens
gaagagaagccaugaauaa

SEQ ID NO: 826648 - RNA, 19 nt, Homo sapiens
ggauagagcuuaugauuca

SEQ ID NO: 826649 - RNA, 19 nt, Homo sapiens
gcaauuggcuauagugaaa

SEQ ID NO: 826650 - RNA, 19 nt, Homo sapiens
uaacagaccuuaugacaga

SEQ ID NO: 826651 - RNA, 19 nt, Homo sapiens
gaauggcacuggauauuaa

SEQ ID NO: 826652 - RNA, 19 nt, Homo sapiens
gaaagcaacuccucgaaug

SEQ ID NO: 826653 - RNA, 19 nt, Homo sapiens
gaaauaaacgcaaagcuaa

SEQ ID NO: 826654 - RNA, 19 nt, Homo sapiens
ucacgugccuuacuaguua

SEQ ID NO: 826655 - RNA, 19 nt, Homo sapiens
agaaauggaucucagguua

SEQ ID NO: 826656 - RNA, 19 nt, Homo sapiens
gaugagaacuaucaaaugu

SEQ ID NO: 826657 - RNA, 19 nt, Homo sapiens
ggagaaaguuuaaguaugg

SEQ ID NO: 826658 - RNA, 19 nt, Homo sapiens
gcccauauguccauuuaua

SEQ ID NO: 826659 - RNA, 19 nt, Homo sapiens
gcagauguauguacucauu

SEQ ID NO: 826660 - RNA, 19 nt, Homo sapiens
aaacaaagcccaagaagaa

SEQ ID NO: 826661 - RNA, 19 nt, Homo sapiens
ccacaguauuucaguauua

SEQ ID NO: 826662 - RNA, 19 nt, Homo sapiens
gaaguuagagagagaauuu

SEQ ID NO: 826663 - RNA, 19 nt, Homo sapiens
gcagacaacugaucaauac

SEQ ID NO: 826664 - RNA, 19 nt, Homo sapiens
gcaaagcuaaggaauauaa

SEQ ID NO: 826665 - RNA, 19 nt, Homo sapiens
ccaaggguauuuaaaguaa

SEQ ID NO: 826666 - RNA, 19 nt, Homo sapiens
guacaaagcagacggaauu

SEQ ID NO: 826667 - RNA, 19 nt, Homo sapiens
uaacaucucuaucagugua

SEQ ID NO: 826668 - RNA, 19 nt, Homo sapiens
agucagaucuaaaccauua

SEQ ID NO: 826669 - RNA, 19 nt, Homo sapiens
gaaaucuucuuccuuacaa

SEQ ID NO: 826670 - RNA, 19 nt, Homo sapiens
ggcaauauaugguaugaaa

SEQ ID NO: 826671 - RNA, 19 nt, Homo sapiens
gacuggaaaucaaauguua

SEQ ID NO: 826672 - RNA, 19 nt, Homo sapiens
uguaauagcucuacgaaga

SEQ ID NO: 826673 - RNA, 19 nt, Homo sapiens
ggaacugccucaccugaaa

SEQ ID NO: 826674 - RNA, 19 nt, Homo sapiens
uaauaaaucugcacuguca

SEQ ID NO: 826675 - RNA, 19 nt, Homo sapiens
cuauacagaucucgauuua

SEQ ID NO: 826676 - RNA, 19 nt, Homo sapiens
ggaaaguuaccucuuauuu

SEQ ID NO: 826677 - RNA, 19 nt, Homo sapiens
ucccagauaucacguauua

SEQ ID NO: 826678 - RNA, 19 nt, Homo sapiens
uaacacaucugcacaucaa

SEQ ID NO: 826679 - RNA, 19 nt, Homo sapiens
gcaagaaguagccuauaua

SEQ ID NO: 826680 - RNA, 19 nt, Homo sapiens
ggaauugacuuugaagaga

SEQ ID NO: 826681 - RNA, 19 nt, Homo sapiens
caauaaagcugagugaaau

SEQ ID NO: 826682 - RNA, 19 nt, Homo sapiens
gaugaugccuauagauuug

SEQ ID NO: 826683 - RNA, 19 nt, Homo sapiens
uaaaggaucuagcaccauu

SEQ ID NO: 826684 - RNA, 19 nt, Homo sapiens
cuaaagguuucaccaguua

SEQ ID NO: 826685 - RNA, 19 nt, Homo sapiens
gaaaauaauuccucucuug

SEQ ID NO: 826686 - RNA, 19 nt, Homo sapiens
uauggaaaguuaccucuua

SEQ ID NO: 826687 - RNA, 19 nt, Homo sapiens
gcaaggacagugaauagua

SEQ ID NO: 826688 - RNA, 19 nt, Homo sapiens
gcagcuacauuccucuuaa

SEQ ID NO: 826689 - RNA, 19 nt, Homo sapiens
caacuuaugguaacugaua

SEQ ID NO: 826690 - RNA, 19 nt, Homo sapiens
caaauguggucuuguaaug

SEQ ID NO: 826691 - RNA, 19 nt, Homo sapiens
ucagugaagugggaaauua

SEQ ID NO: 826692 - RNA, 19 nt, Homo sapiens
gaauguacccgacuugaaa

SEQ ID NO: 826693 - RNA, 19 nt, Homo sapiens
ucaaaugugugaaggaauu

SEQ ID NO: 826694 - RNA, 19 nt, Homo sapiens
gcaaauaccauauaucagu

SEQ ID NO: 826695 - RNA, 19 nt, Homo sapiens
caaaggaguuccagaaugg

SEQ ID NO: 826696 - RNA, 19 nt, Homo sapiens
gcacaaaggaguuccagaa

SEQ ID NO: 826697 - RNA, 19 nt, Homo sapiens
ggaauugauugaaagcauu

SEQ ID NO: 826698 - RNA, 19 nt, Homo sapiens
agaagaagcuaaagauuca

SEQ ID NO: 826699 - RNA, 19 nt, Homo sapiens
ucauggagcuguuaaaugu

SEQ ID NO: 826700 - RNA, 19 nt, Homo sapiens
caucacagauuucacagaa

SEQ ID NO: 826701 - RNA, 19 nt, Homo sapiens
gaucuuggguuuaucuaug

SEQ ID NO: 826702 - RNA, 19 nt, Homo sapiens
gaucuacuccugccauuaa

SEQ ID NO: 826703 - RNA, 19 nt, Homo sapiens
gagggcauccaacauauua

SEQ ID NO: 826704 - RNA, 19 nt, Homo sapiens
ugaaagaguucugcuuaaa

SEQ ID NO: 826705 - RNA, 19 nt, Homo sapiens
gaacaucacagauuucaca

SEQ ID NO: 826706 - RNA, 19 nt, Homo sapiens
gaugaugagucagaucuaa

SEQ ID NO: 826707 - RNA, 19 nt, Homo sapiens
cagguuagaucuuggguuu

SEQ ID NO: 826708 - RNA, 19 nt, Homo sapiens
auaaauggcucucucuuga

SEQ ID NO: 826709 - RNA, 19 nt, Homo sapiens
ucaacuggauguaccauuu

SEQ ID NO: 826710 - RNA, 19 nt, Homo sapiens
gaugaagacuaccaacaga

SEQ ID NO: 826711 - RNA, 19 nt, Homo sapiens
gagaagaagcuaaagauuc

SEQ ID NO: 826712 - RNA, 19 nt, Homo sapiens
gaagauccaaggguauuua

SEQ ID NO: 826713 - RNA, 19 nt, Homo sapiens
uccgaaaucuucuuccuua

SEQ ID NO: 826714 - RNA, 19 nt, Homo sapiens
ggacuuacuauuucuguuu

SEQ ID NO: 826715 - RNA, 19 nt, Homo sapiens
guagaucaaucacaaguca

SEQ ID NO: 826716 - RNA, 19 nt, Homo sapiens
ggaaaagacugauuuagau

SEQ ID NO: 826717 - RNA, 19 nt, Homo sapiens
gaaaugcgacuauacagau

SEQ ID NO: 826718 - RNA, 19 nt, Homo sapiens
ggucuacuguauauuauug

SEQ ID NO: 826719 - RNA, 19 nt, Homo sapiens
caaggacagugaauaguau

SEQ ID NO: 826720 - RNA, 19 nt, Homo sapiens
ggucacauagguaaucuua

SEQ ID NO: 826721 - RNA, 19 nt, Homo sapiens
gagaagccaugaauaagca

SEQ ID NO: 826722 - RNA, 19 nt, Homo sapiens
caaagucggucaccaugga

SEQ ID NO: 826723 - RNA, 19 nt, Homo sapiens
gaaacaaagcccaagaaga

SEQ ID NO: 826724 - RNA, 19 nt, Homo sapiens
gaaguaagaaggucacaau

SEQ ID NO: 826725 - RNA, 19 nt, Homo sapiens
ggaguucccuaauaaaucu

SEQ ID NO: 826726 - RNA, 19 nt, Homo sapiens
aaaugaugcuccugcuuua

SEQ ID NO: 826727 - RNA, 19 nt, Homo sapiens
gugcaaacauggacugcua

SEQ ID NO: 826728 - RNA, 19 nt, Homo sapiens
gaagauaucauuacuuugc

SEQ ID NO: 826729 - RNA, 19 nt, Homo sapiens
gaaacaaggugaggccaau

SEQ ID NO: 826730 - RNA, 19 nt, Homo sapiens
uuucugggcuuuaauguaa

SEQ ID NO: 826731 - RNA, 19 nt, Homo sapiens
caaugaagauggaguuauc

SEQ ID NO: 826732 - RNA, 19 nt, Homo sapiens
gcaguggcauuacaagaug

SEQ ID NO: 826733 - RNA, 19 nt, Homo sapiens
gagugaagauccucccaaa

SEQ ID NO: 826734 - RNA, 19 nt, Homo sapiens
gugaaggaauugacuuuga

SEQ ID NO: 826735 - RNA, 19 nt, Homo sapiens
guaagaaggucacaauucg

SEQ ID NO: 826736 - RNA, 19 nt, Homo sapiens
guacagcugcuuuacagua

SEQ ID NO: 826737 - RNA, 19 nt, Homo sapiens
ugacaaaacuggaagaauu

SEQ ID NO: 826738 - RNA, 19 nt, Homo sapiens
gcaaagaccaggagcacaa

SEQ ID NO: 826739 - RNA, 19 nt, Homo sapiens
gaagcaauauaaagaacug

SEQ ID NO: 826740 - RNA, 19 nt, Homo sapiens
ggaauggcacuaggacuua

SEQ ID NO: 826741 - RNA, 19 nt, Homo sapiens
gcacaucaaucaucauuua

SEQ ID NO: 826742 - RNA, 19 nt, Homo sapiens
gaaauuaucuuccagcauu

SEQ ID NO: 826743 - RNA, 19 nt, Homo sapiens
cauagaagcugaaccuuua

SEQ ID NO: 826744 - RNA, 19 nt, Homo sapiens
caaaggagaugucauuaaa

SEQ ID NO: 826745 - RNA, 19 nt, Homo sapiens
gaaagcauccaccuaauua

SEQ ID NO: 826746 - RNA, 19 nt, Homo sapiens
aaagaaagcuggauacaaa

SEQ ID NO: 826747 - RNA, 19 nt, Homo sapiens
gaagagaagccaugaauaa

SEQ ID NO: 826748 - RNA, 19 nt, Homo sapiens
ggauagagcuuaugauuca

SEQ ID NO: 826749 - RNA, 19 nt, Homo sapiens
gcaauuggcuauagugaaa

SEQ ID NO: 826750 - RNA, 19 nt, Homo sapiens
uaacagaccuuaugacaga

SEQ ID NO: 826751 - RNA, 19 nt, Homo sapiens
gaauggcacuggauauuaa

SEQ ID NO: 826752 - RNA, 19 nt, Homo sapiens
gaaagcaacuccucgaaug

SEQ ID NO: 826753 - RNA, 19 nt, Homo sapiens
gaaauaaacgcaaagcuaa

SEQ ID NO: 826754 - RNA, 19 nt, Homo sapiens
gguaagaaaucaaacauug

SEQ ID NO: 826755 - RNA, 19 nt, Homo sapiens
ucacgugccuuacuaguua

SEQ ID NO: 826756 - RNA, 19 nt, Homo sapiens
gagaaugaauguaugauug

SEQ ID NO: 826757 - RNA, 19 nt, Homo sapiens
gacagucccucucauauaa

SEQ ID NO: 826758 - RNA, 19 nt, Homo sapiens
agaaauggaucucagguua

SEQ ID NO: 826759 - RNA, 19 nt, Homo sapiens
gaugagaacuaucaaaugu

SEQ ID NO: 826760 - RNA, 19 nt, Homo sapiens
ggagaaaguuuaaguaugg

SEQ ID NO: 826761 - RNA, 19 nt, Homo sapiens
gcagauguauguacucauu

SEQ ID NO: 826762 - RNA, 19 nt, Homo sapiens
aaacaaagcccaagaagaa

SEQ ID NO: 826763 - RNA, 19 nt, Homo sapiens
gcaggauccuauuuaguua

SEQ ID NO: 826764 - RNA, 19 nt, Homo sapiens
ccacaguauuucaguauua

SEQ ID NO: 826765 - RNA, 19 nt, Homo sapiens
gaaguuagagagagaauuu

SEQ ID NO: 826766 - RNA, 19 nt, Homo sapiens
gcagacaacugaucaauac

SEQ ID NO: 826767 - RNA, 19 nt, Homo sapiens
gcaaagcuaaggaauauaa

SEQ ID NO: 826768 - RNA, 19 nt, Homo sapiens
ccaaggguauuuaaaguaa

SEQ ID NO: 826769 - RNA, 19 nt, Homo sapiens
guacaaagcagacggaauu

SEQ ID NO: 826770 - RNA, 19 nt, Homo sapiens
uaacaucucuaucagugua

SEQ ID NO: 826771 - RNA, 19 nt, Homo sapiens
gauuacagcuccuagacua

SEQ ID NO: 826772 - RNA, 19 nt, Homo sapiens
ucacagaaaucaucagcua

SEQ ID NO: 826773 - RNA, 19 nt, Homo sapiens
gaaaucuucuuccuuacaa

SEQ ID NO: 826774 - RNA, 19 nt, Homo sapiens
ggcaauauaugguaugaaa

SEQ ID NO: 826775 - RNA, 19 nt, Homo sapiens
ggaagcauauuacagaaau

SEQ ID NO: 826776 - RNA, 19 nt, Homo sapiens
gggagaagauugcgcauug

SEQ ID NO: 826777 - RNA, 19 nt, Homo sapiens
gacuggaaaucaaauguua

SEQ ID NO: 826778 - RNA, 19 nt, Homo sapiens
uguaauagcucuacgaaga

SEQ ID NO: 826779 - RNA, 19 nt, Homo sapiens
ggaacugccucaccugaaa

SEQ ID NO: 826780 - RNA, 19 nt, Homo sapiens
uaauaaaucugcacuguca

SEQ ID NO: 826781 - RNA, 19 nt, Homo sapiens
cuauacagaucucgauuua

SEQ ID NO: 826782 - RNA, 19 nt, Homo sapiens
ggaaaguuaccucuuauuu

SEQ ID NO: 826783 - RNA, 19 nt, Homo sapiens
ucccagauaucacguauua

SEQ ID NO: 826784 - RNA, 19 nt, Homo sapiens
uaacacaucugcacaucaa

SEQ ID NO: 826785 - RNA, 19 nt, Homo sapiens
gcaagaaguagccuauaua

SEQ ID NO: 826786 - RNA, 19 nt, Homo sapiens
ggaauugacuuugaagaga

SEQ ID NO: 826787 - RNA, 19 nt, Homo sapiens
caauaaagcugagugaaau

SEQ ID NO: 826788 - RNA, 19 nt, Homo sapiens
gaugaugccuauagauuug

SEQ ID NO: 826789 - RNA, 19 nt, Homo sapiens
uaaaggaucuagcaccauu

SEQ ID NO: 826790 - RNA, 19 nt, Homo sapiens
cuaaagguuucaccaguua

SEQ ID NO: 826791 - RNA, 19 nt, Homo sapiens
gaaaauaauuccucucuug

SEQ ID NO: 826792 - RNA, 19 nt, Homo sapiens
uauggaaaguuaccucuua

SEQ ID NO: 826793 - RNA, 19 nt, Homo sapiens
gcaaggacagugaauagua

SEQ ID NO: 826794 - RNA, 19 nt, Homo sapiens
gcagcuacauuccucuuaa

SEQ ID NO: 826795 - RNA, 19 nt, Homo sapiens
caacuuaugguaacugaua

SEQ ID NO: 826796 - RNA, 19 nt, Homo sapiens
caaauguggucuuguaaug

SEQ ID NO: 826797 - RNA, 19 nt, Homo sapiens
ucagugaagugggaaauua

SEQ ID NO: 826798 - RNA, 19 nt, Homo sapiens
gaauguacccgacuugaaa

SEQ ID NO: 826799 - RNA, 19 nt, Homo sapiens
ggagccaaguuuaauguuu

SEQ ID NO: 826800 - RNA, 19 nt, Homo sapiens
ucaaaugugugaaggaauu

SEQ ID NO: 826801 - RNA, 19 nt, Homo sapiens
gcaaauaccauauaucagu

SEQ ID NO: 826802 - RNA, 19 nt, Homo sapiens
caaaggaguuccagaaugg

SEQ ID NO: 826803 - RNA, 19 nt, Homo sapiens
gcacaaaggaguuccagaa

SEQ ID NO: 826804 - RNA, 19 nt, Homo sapiens
uaagagaacucgcacaaag

SEQ ID NO: 826805 - RNA, 19 nt, Homo sapiens
ggaauugauugaaagcauu

SEQ ID NO: 826806 - RNA, 19 nt, Homo sapiens
caucagcuauacauuagua

SEQ ID NO: 826807 - RNA, 19 nt, Homo sapiens
caugagaucuacuugguuu

SEQ ID NO: 826808 - RNA, 19 nt, Homo sapiens
agaagaagcuaaagauuca

SEQ ID NO: 826809 - RNA, 19 nt, Homo sapiens
ucauggagcuguuaaaugu

SEQ ID NO: 826810 - RNA, 19 nt, Homo sapiens
caucacagauuucacagaa

SEQ ID NO: 826811 - RNA, 19 nt, Homo sapiens
uaaacagcaugcuauauug

SEQ ID NO: 826812 - RNA, 19 nt, Homo sapiens
gaacuuugguggugguuuc

SEQ ID NO: 826813 - RNA, 19 nt, Homo sapiens
gaucuuggguuuaucuaug

SEQ ID NO: 826814 - RNA, 19 nt, Homo sapiens
gaucuacuccugccauuaa

SEQ ID NO: 826815 - RNA, 19 nt, Homo sapiens
caagaucuuugcaccuuaa

SEQ ID NO: 826816 - RNA, 19 nt, Homo sapiens
ugaaagaguucugcuuaaa

SEQ ID NO: 826817 - RNA, 19 nt, Homo sapiens
gaacaucacagauuucaca

SEQ ID NO: 826818 - RNA, 19 nt, Homo sapiens
cagguuagaucuuggguuu

SEQ ID NO: 826819 - RNA, 19 nt, Homo sapiens
auaaauggcucucucuuga

SEQ ID NO: 826820 - RNA, 19 nt, Homo sapiens
ucaacuggauguaccauuu

SEQ ID NO: 826821 - RNA, 19 nt, Homo sapiens
gaccaaaucuacuaaaugc

SEQ ID NO: 826822 - RNA, 19 nt, Homo sapiens
caaaugagagucacgcuuu

SEQ ID NO: 826823 - RNA, 19 nt, Homo sapiens
gaugaagacuaccaacaga

SEQ ID NO: 826824 - RNA, 19 nt, Homo sapiens
gagaagaagcuaaagauuc

SEQ ID NO: 826825 - RNA, 19 nt, Homo sapiens
gaagauccaaggguauuua

SEQ ID NO: 826826 - RNA, 19 nt, Homo sapiens
uccgaaaucuucuuccuua

SEQ ID NO: 826827 - RNA, 19 nt, Homo sapiens
ggacuuacuauuucuguuu

SEQ ID NO: 826828 - RNA, 19 nt, Homo sapiens
guagaucaaucacaaguca

SEQ ID NO: 826829 - RNA, 19 nt, Homo sapiens
ggaaaagacugauuuagau

SEQ ID NO: 826830 - RNA, 19 nt, Homo sapiens
gaaaugcgacuauacagau

SEQ ID NO: 826831 - RNA, 19 nt, Homo sapiens
ggucuacuguauauuauug

SEQ ID NO: 826832 - RNA, 19 nt, Homo sapiens
caaggacagugaauaguau

SEQ ID NO: 826833 - RNA, 19 nt, Homo sapiens
ggucacauagguaaucuua

SEQ ID NO: 826834 - RNA, 19 nt, Homo sapiens
ccaaagagccauucauugu

SEQ ID NO: 826835 - RNA, 19 nt, Homo sapiens
gagaagccaugaauaagca

SEQ ID NO: 826836 - RNA, 19 nt, Homo sapiens
caaagucggucaccaugga

SEQ ID NO: 826837 - RNA, 19 nt, Homo sapiens
gaaacaaagcccaagaaga

SEQ ID NO: 826838 - RNA, 19 nt, Homo sapiens
gaaguaagaaggucacaau

SEQ ID NO: 826839 - RNA, 19 nt, Homo sapiens
ggaguucccuaauaaaucu

SEQ ID NO: 826840 - RNA, 19 nt, Homo sapiens
aaaugaugcuccugcuuua

SEQ ID NO: 826841 - RNA, 19 nt, Homo sapiens
ccacauacuucccaguuua

SEQ ID NO: 826842 - RNA, 19 nt, Homo sapiens
caauucagcucuugagaaa

SEQ ID NO: 826843 - RNA, 19 nt, Homo sapiens
aagaagagcuggcugauau

SEQ ID NO: 826844 - RNA, 19 nt, Homo sapiens
gcaaaguacugcaaaucuu

SEQ ID NO: 826845 - RNA, 19 nt, Homo sapiens
acacagaacucuuaucuag

SEQ ID NO: 826846 - RNA, 19 nt, Homo sapiens
gugcgugucuguuagaaua

SEQ ID NO: 826847 - RNA, 19 nt, Homo sapiens
gaagagcuggcugauauua

SEQ ID NO: 826848 - RNA, 19 nt, Homo sapiens
ggagaggucccauccuaua

SEQ ID NO: 826849 - RNA, 19 nt, Homo sapiens
gaacccaggauaaggaaua

SEQ ID NO: 826850 - RNA, 19 nt, Homo sapiens
gaaagcacuugacauugug

SEQ ID NO: 826851 - RNA, 19 nt, Homo sapiens
gaaaagacauacaaagguu

SEQ ID NO: 826852 - RNA, 19 nt, Homo sapiens
ggaacuugguggugacauu

SEQ ID NO: 826853 - RNA, 19 nt, Homo sapiens
agaaagcacuugacauugu

SEQ ID NO: 826854 - RNA, 19 nt, Homo sapiens
guccuuagguguaaauuga

SEQ ID NO: 826855 - RNA, 19 nt, Homo sapiens
gaagcaaaguacugcaaau

SEQ ID NO: 826856 - RNA, 19 nt, Homo sapiens
gaagaagagcuggcugaua

SEQ ID NO: 826857 - RNA, 19 nt, Homo sapiens
ggacagcuaucuuccacau

SEQ ID NO: 826858 - RNA, 19 nt, Homo sapiens
uagaggacauucaagcuuu

SEQ ID NO: 826859 - RNA, 19 nt, Homo sapiens
acagaacucuuaucuagga

SEQ ID NO: 826860 - RNA, 19 nt, Homo sapiens
aaagaugaaugcaaggaaa

SEQ ID NO: 826861 - RNA, 19 nt, Homo sapiens
gaacucuuaucuaggaugu

SEQ ID NO: 826862 - RNA, 19 nt, Homo sapiens
cugcaaaucuuccaaagga

SEQ ID NO: 826863 - RNA, 19 nt, Homo sapiens
gaauagauccucucuucau

SEQ ID NO: 826864 - RNA, 19 nt, Homo sapiens
cuagaaagcacuugacauu

SEQ ID NO: 826865 - RNA, 19 nt, Homo sapiens
auacaaagguucggaagaa

SEQ ID NO: 826866 - RNA, 19 nt, Homo sapiens
guacagguguuaaauuacu

SEQ ID NO: 826867 - RNA, 19 nt, Homo sapiens
caguuuacauuuggucuua

SEQ ID NO: 826868 - RNA, 19 nt, Homo sapiens
aaucugcucucaagaaaga

SEQ ID NO: 826869 - RNA, 19 nt, Homo sapiens
gucaaagaaucgaaacaaa

SEQ ID NO: 826870 - RNA, 19 nt, Homo sapiens
gcgaugugcgugucuguua

SEQ ID NO: 826871 - RNA, 19 nt, Homo sapiens
gguguuaaauuacuucaag

SEQ ID NO: 826872 - RNA, 19 nt, Homo sapiens
gaacuugguggugacauuu

SEQ ID NO: 826873 - RNA, 19 nt, Homo sapiens
caaccugaucuuaguauuu

SEQ ID NO: 826874 - RNA, 19 nt, Homo sapiens
uugaauagauccucucuuc

SEQ ID NO: 826875 - RNA, 19 nt, Homo sapiens
ccggagaggucccauccua

SEQ ID NO: 826876 - RNA, 19 nt, Homo sapiens
cagaaucucucaaccugau

SEQ ID NO: 826877 - RNA, 19 nt, Homo sapiens
ggaagaggccaaagaagca

SEQ ID NO: 826878 - RNA, 19 nt, Homo sapiens
gagaggucccauccuauaa

SEQ ID NO: 826879 - RNA, 19 nt, Homo sapiens
agagagcaguguacgauga

SEQ ID NO: 826880 - RNA, 19 nt, Homo sapiens
aagcagaaaugagcagaaa

SEQ ID NO: 826881 - RNA, 19 nt, Homo sapiens
guacacagaacucuuaucu

SEQ ID NO: 826882 - RNA, 19 nt, Homo sapiens
gaggucccauccuauaaug

SEQ ID NO: 826883 - RNA, 19 nt, Homo sapiens
ugacagcacuugccuccau

SEQ ID NO: 826884 - RNA, 19 nt, Homo sapiens
ggaagcaaaguacugcaaa

SEQ ID NO: 826885 - RNA, 19 nt, Homo sapiens
ggccaaagaagcagaaaug

SEQ ID NO: 826886 - RNA, 19 nt, Homo sapiens
gauguacagguguuaaauu

SEQ ID NO: 826887 - RNA, 19 nt, Homo sapiens
aauagauccucucuucauu

SEQ ID NO: 826888 - RNA, 19 nt, Homo sapiens
gaucuuaguauuuccuaga

SEQ ID NO: 826889 - RNA, 19 nt, Homo sapiens
gcaaggugcaggcaggauu

SEQ ID NO: 826890 - RNA, 19 nt, Homo sapiens
gagaacagagagcagugua

SEQ ID NO: 826891 - RNA, 19 nt, Homo sapiens
caaaguacugcaaaucuuc

SEQ ID NO: 826892 - RNA, 19 nt, Homo sapiens
gaucauggagucugugcuu

SEQ ID NO: 826893 - RNA, 19 nt, Homo sapiens
gaaaggaguuggggcuuga

SEQ ID NO: 826894 - RNA, 19 nt, Homo sapiens
gcagaaaugagcagaaagg

SEQ ID NO: 826895 - RNA, 19 nt, Homo sapiens
ucuauuccguucucaguga

SEQ ID NO: 826896 - RNA, 19 nt, Homo sapiens
ggucucaccugaaggaacu

SEQ ID NO: 826897 - RNA, 19 nt, Homo sapiens
gaggaacccaggauaagga

SEQ ID NO: 826898 - RNA, 19 nt, Homo sapiens
uggcucagauggaagcaaa

SEQ ID NO: 826899 - RNA, 19 nt, Homo sapiens
ggacuucaagggugacaug

SEQ ID NO: 826900 - RNA, 19 nt, Homo sapiens
ucaggaagaggccaaagaa

SEQ ID NO: 826901 - RNA, 19 nt, Homo sapiens
acagcuaucuuccacauac

SEQ ID NO: 826902 - RNA, 19 nt, Homo sapiens
ggaugugguucuguucaug

SEQ ID NO: 826903 - RNA, 19 nt, Homo sapiens
caaggugucccugcaggua

SEQ ID NO: 826904 - RNA, 19 nt, Homo sapiens
caaggugcaggcaggauuu

SEQ ID NO: 826905 - RNA, 19 nt, Homo sapiens
guacugcaaaucuuccaaa

SEQ ID NO: 826906 - RNA, 19 nt, Homo sapiens
gagacugggaggcguauug

SEQ ID NO: 826907 - RNA, 19 nt, Homo sapiens
aaccugaucuuaguauuuc

SEQ ID NO: 826908 - RNA, 19 nt, Homo sapiens
acagaggaacccaggauaa

SEQ ID NO: 826909 - RNA, 19 nt, Homo sapiens
ucuaggaugugguucuguu

SEQ ID NO: 826910 - RNA, 19 nt, Homo sapiens
ggagggaggcaguguccuu

SEQ ID NO: 826911 - RNA, 19 nt, Homo sapiens
gaagcagaaaugagcagaa

SEQ ID NO: 826912 - RNA, 19 nt, Homo sapiens
agagcuggcugauauuaag

SEQ ID NO: 826913 - RNA, 19 nt, Homo sapiens
ccauggaucuucuguacac

SEQ ID NO: 826914 - RNA, 19 nt, Homo sapiens
aaaaucugcucucaagaaa

SEQ ID NO: 826915 - RNA, 19 nt, Homo sapiens
ucaaccugaucuuaguauu

SEQ ID NO: 826916 - RNA, 19 nt, Homo sapiens
cuucaagggugacauggau

SEQ ID NO: 826917 - RNA, 19 nt, Homo sapiens
aaagucaauucagcucuug

SEQ ID NO: 826918 - RNA, 19 nt, Homo sapiens
gcaggccuaucuggacuuc

SEQ ID NO: 826919 - RNA, 19 nt, Homo sapiens
uagauccucucuucauuuu

SEQ ID NO: 826920 - RNA, 19 nt, Homo sapiens
ccaaagaagcagaaaugag

SEQ ID NO: 826921 - RNA, 19 nt, Homo sapiens
aaaggagggcucaggaaga

SEQ ID NO: 826922 - RNA, 19 nt, Homo sapiens
gcuggaccuuugcgaggaa

SEQ ID NO: 826923 - RNA, 19 nt, Homo sapiens
uauuggcggcuacucuuua

SEQ ID NO: 826924 - RNA, 19 nt, Homo sapiens
auacuucccaguuuacauu

SEQ ID NO: 826925 - RNA, 19 nt, Homo sapiens
cuagaacaccuuccagaca

SEQ ID NO: 826926 - RNA, 19 nt, Homo sapiens
ggaagaagagcuggcugau

SEQ ID NO: 826927 - RNA, 19 nt, Homo sapiens
aggccuaucuggacuucaa

SEQ ID NO: 826928 - RNA, 19 nt, Homo sapiens
gaacaccuuccagacacuu

SEQ ID NO: 826929 - RNA, 19 nt, Homo sapiens
guauuggcggcuacucuuu

SEQ ID NO: 826930 - RNA, 19 nt, Homo sapiens
gaaaaggagggcucaggaa

SEQ ID NO: 826931 - RNA, 19 nt, Homo sapiens
gauccucucuucauuuuac

SEQ ID NO: 826932 - RNA, 19 nt, Homo sapiens
uagaaagcacuugacauug

SEQ ID NO: 826933 - RNA, 19 nt, Homo sapiens
acaaagguucggaagaaga

SEQ ID NO: 826934 - RNA, 19 nt, Homo sapiens
gccaaagaagcagaaauga

SEQ ID NO: 826935 - RNA, 19 nt, Homo sapiens
auagauccucucuucauuu

SEQ ID NO: 826936 - RNA, 19 nt, Homo sapiens
uccacauacuucccaguuu

SEQ ID NO: 826937 - RNA, 19 nt, Homo sapiens
gaugugcgugucuguuaga

SEQ ID NO: 826938 - RNA, 19 nt, Homo sapiens
caaagguucggaagaagag

SEQ ID NO: 826939 - RNA, 19 nt, Homo sapiens
ucauucagcaagcuauuga

SEQ ID NO: 826940 - RNA, 19 nt, Homo sapiens
cgaugugcgugucuguuag

SEQ ID NO: 826941 - RNA, 19 nt, Homo sapiens
caacagaaaucguuuguga

SEQ ID NO: 826942 - RNA, 19 nt, Homo sapiens
ccacugaccuuaucaaaga

SEQ ID NO: 826943 - RNA, 19 nt, Homo sapiens
gcaauuggcugcuuugaca

SEQ ID NO: 826944 - RNA, 19 nt, Homo sapiens
gaagauaacagaagcuaaa

SEQ ID NO: 826945 - RNA, 19 nt, Homo sapiens
gaacaucucccauuugaau

SEQ ID NO: 826946 - RNA, 19 nt, Homo sapiens
gagaauagcaguuuaugaa

SEQ ID NO: 826947 - RNA, 19 nt, Homo sapiens
ggaccuggcuaugcaaaua

SEQ ID NO: 826948 - RNA, 19 nt, Homo sapiens
gaauagcaguuuaugaaga

SEQ ID NO: 826949 - RNA, 19 nt, Homo sapiens
gaagaaaucacacaaguca

SEQ ID NO: 826950 - RNA, 19 nt, Homo sapiens
gaaaugaaagaccugguua

SEQ ID NO: 826951 - RNA, 19 nt, Homo sapiens
gaaaggaaccagccucuga

SEQ ID NO: 826952 - RNA, 19 nt, Homo sapiens
gcaagaauaccaagacaaa

SEQ ID NO: 826953 - RNA, 19 nt, Homo sapiens
caaaugagguuuucaguuu

SEQ ID NO: 826954 - RNA, 19 nt, Homo sapiens
gaugaugauucaacuauug

SEQ ID NO: 826955 - RNA, 19 nt, Homo sapiens
gaaacuggauuugaaugaa

SEQ ID NO: 826956 - RNA, 19 nt, Homo sapiens
gaacagagagcuaagcaau

SEQ ID NO: 826957 - RNA, 19 nt, Homo sapiens
gcacuuaauuuccagacaa

SEQ ID NO: 826958 - RNA, 19 nt, Homo sapiens
ugaaagaccugguuaagag

SEQ ID NO: 826959 - RNA, 19 nt, Homo sapiens
gugaacaucucccauuuga

SEQ ID NO: 826960 - RNA, 19 nt, Homo sapiens
gaaugcagguugucagaug

SEQ ID NO: 826961 - RNA, 19 nt, Homo sapiens
gaacacguguggauucauc

SEQ ID NO: 826962 - RNA, 19 nt, Homo sapiens
gcuggaaacuccucuguug

SEQ ID NO: 826963 - RNA, 19 nt, Homo sapiens
gaggagacaucccaggaaa

SEQ ID NO: 826964 - RNA, 19 nt, Homo sapiens
gaagcuaaauccaaagaca

SEQ ID NO: 826965 - RNA, 19 nt, Homo sapiens
ggaaauacgucagcagauc

SEQ ID NO: 826966 - RNA, 19 nt, Homo sapiens
caaaguaaacggcaagaaa

SEQ ID NO: 826967 - RNA, 19 nt, Homo sapiens
gagaacgacuccagcagaa

SEQ ID NO: 826968 - RNA, 19 nt, Homo sapiens
ugucuaaucuggugaacua

SEQ ID NO: 826969 - RNA, 19 nt, Homo sapiens
gaagcgagaacauauuaaa

SEQ ID NO: 826970 - RNA, 19 nt, Homo sapiens
agaaggagguaaauucauu

SEQ ID NO: 826971 - RNA, 19 nt, Homo sapiens
cagaagaaaugucuaaucu

SEQ ID NO: 826972 - RNA, 19 nt, Homo sapiens
gaucaugguucaucaacga

SEQ ID NO: 826973 - RNA, 19 nt, Homo sapiens
gaacacacuaccaaguaua

SEQ ID NO: 826974 - RNA, 19 nt, Homo sapiens
caagugggaugaugauuca

SEQ ID NO: 826975 - RNA, 19 nt, Homo sapiens
gaacuaaagcaacagaaau

SEQ ID NO: 826976 - RNA, 19 nt, Homo sapiens
acagagagcuaagcaauug

SEQ ID NO: 826977 - RNA, 19 nt, Homo sapiens
caucgaagcuuuaucaaac

SEQ ID NO: 826978 - RNA, 19 nt, Homo sapiens
gaagaaggagguaaauuca

SEQ ID NO: 826979 - RNA, 19 nt, Homo sapiens
ccaaggaaaugcugugaau

SEQ ID NO: 826980 - RNA, 19 nt, Homo sapiens
ggucauauauccaggaagu

SEQ ID NO: 826981 - RNA, 19 nt, Homo sapiens
gaagaguggcuacagauug

SEQ ID NO: 826982 - RNA, 19 nt, Homo sapiens
ucaaagaaaucugugagaa

SEQ ID NO: 826983 - RNA, 19 nt, Homo sapiens
gcagaagagugucagaaca

SEQ ID NO: 826984 - RNA, 19 nt, Homo sapiens
caagaacaguauuauagug

SEQ ID NO: 826985 - RNA, 19 nt, Homo sapiens
ggaagaugaagaagaagua

SEQ ID NO: 826986 - RNA, 19 nt, Homo sapiens
gaagaagaaccuauugugu

SEQ ID NO: 826987 - RNA, 19 nt, Homo sapiens
gcaccaaauucgucaagug

SEQ ID NO: 826988 - RNA, 19 nt, Homo sapiens
caaagaaaucugugagaaa

SEQ ID NO: 826989 - RNA, 19 nt, Homo sapiens
cagaagcgagaacauauua

SEQ ID NO: 826990 - RNA, 19 nt, Homo sapiens
cagaaugacuacuugagaa

SEQ ID NO: 826991 - RNA, 19 nt, Homo sapiens
ccagaaguguacagaguuu

SEQ ID NO: 826992 - RNA, 19 nt, Homo sapiens
uaagagacaccacaagaaa

SEQ ID NO: 826993 - RNA, 19 nt, Homo sapiens
caugacaacugaaauaucu

SEQ ID NO: 826994 - RNA, 19 nt, Homo sapiens
gcacaacaccuaccucaca

SEQ ID NO: 826995 - RNA, 19 nt, Homo sapiens
uaacagaagcuaaauccaa

SEQ ID NO: 826996 - RNA, 19 nt, Homo sapiens
agacagagcuacuggaucu

SEQ ID NO: 826997 - RNA, 19 nt, Homo sapiens
caucagaggcuccaaguga

SEQ ID NO: 826998 - RNA, 19 nt, Homo sapiens
ggaaggcauuuaagaccaa

SEQ ID NO: 826999 - RNA, 19 nt, Homo sapiens
ccaaaggacuugaacaacu

SEQ ID NO: 827000 - RNA, 19 nt, Homo sapiens
ggauuugaaugaagacaug

SEQ ID NO: 827001 - RNA, 19 nt, Homo sapiens
aaccauaucuuaccguuga

SEQ ID NO: 827002 - RNA, 19 nt, Homo sapiens
gaccugaaauugauaacau

SEQ ID NO: 827003 - RNA, 19 nt, Homo sapiens
ggaugaugauucaacuauu

SEQ ID NO: 827004 - RNA, 19 nt, Homo sapiens
ugucaaagaugccagaugu

SEQ ID NO: 827005 - RNA, 19 nt, Homo sapiens
uagaagaagcgcaaaguaa

SEQ ID NO: 827006 - RNA, 19 nt, Homo sapiens
ggaagaagaaccuauugug

SEQ ID NO: 827007 - RNA, 19 nt, Homo sapiens
ucucguggcuuuccaagaa

SEQ ID NO: 827008 - RNA, 19 nt, Homo sapiens
aaagaaaucugugagaaag

SEQ ID NO: 827009 - RNA, 19 nt, Homo sapiens
ugacggaugucgcagaaga

SEQ ID NO: 827010 - RNA, 19 nt, Homo sapiens
gaaaugacccaaaaguuaa

SEQ ID NO: 827011 - RNA, 19 nt, Homo sapiens
gccaaggaauggacaaaug

SEQ ID NO: 827012 - RNA, 19 nt, Homo sapiens
acauagaagugaaagacua

SEQ ID NO: 827013 - RNA, 19 nt, Homo sapiens
ccacagaagaaaugucuaa

SEQ ID NO: 827014 - RNA, 19 nt, Homo sapiens
ucaagaagggcaccaaauu

SEQ ID NO: 827015 - RNA, 19 nt, Homo sapiens
gaaacacuacaaagaaaug

SEQ ID NO: 827016 - RNA, 19 nt, Homo sapiens
ggaaguagauauguuuggu

SEQ ID NO: 827017 - RNA, 19 nt, Homo sapiens
caguggaauuuguagaaua

SEQ ID NO: 827018 - RNA, 19 nt, Homo sapiens
aaacuccucuguugagaug

SEQ ID NO: 827019 - RNA, 19 nt, Homo sapiens
ggaaacuccucuguugaga

SEQ ID NO: 827020 - RNA, 19 nt, Homo sapiens
gcaaguccaaguauugauu

SEQ ID NO: 827021 - RNA, 19 nt, Homo sapiens
gagcaagaauaccaagaca

SEQ ID NO: 827022 - RNA, 19 nt, Homo sapiens
cacuauaucugucuaagga

SEQ ID NO: 827023 - RNA, 19 nt, Homo sapiens
ccucagcucuucuggaaug

SEQ ID NO: 827024 - RNA, 19 nt, Homo sapiens
caaaggacuugaacaacuc

SEQ ID NO: 827025 - RNA, 19 nt, Homo sapiens
cgacgacgaugaugaugau

SEQ ID NO: 827026 - RNA, 19 nt, Homo sapiens
cugagaaacuggauuugaa

SEQ ID NO: 827027 - RNA, 19 nt, Homo sapiens
ggaaagaucagugaagaca

SEQ ID NO: 827028 - RNA, 19 nt, Homo sapiens
aacagaagcuaaauccaaa

SEQ ID NO: 827029 - RNA, 19 nt, Homo sapiens
agaaaucugugagaaagaa

SEQ ID NO: 827030 - RNA, 19 nt, Homo sapiens
ggcaagaacaguauuauag

SEQ ID NO: 827031 - RNA, 19 nt, Homo sapiens
gaaaaccacugaccuuauc

SEQ ID NO: 827032 - RNA, 19 nt, Homo sapiens
acagaaaucguuugugaaa

SEQ ID NO: 827033 - RNA, 19 nt, Homo sapiens
caaggaggaaggcauuuaa

SEQ ID NO: 827034 - RNA, 19 nt, Homo sapiens
aagaguggcuacagauuga

SEQ ID NO: 827035 - RNA, 19 nt, Homo sapiens
gaaaggaaagaucagugaa

SEQ ID NO: 827036 - RNA, 19 nt, Homo sapiens
agaagaagcgcaaaguaaa

SEQ ID NO: 827037 - RNA, 19 nt, Homo sapiens
gcgagaacauauuaaacug

SEQ ID NO: 827038 - RNA, 19 nt, Homo sapiens
gcaagaacaguauuauagu

SEQ ID NO: 827039 - RNA, 19 nt, Homo sapiens
ugaaaugacccaaaaguua

SEQ ID NO: 827040 - RNA, 19 nt, Homo sapiens
ugaagaaggagguaaauuc

SEQ ID NO: 827041 - RNA, 19 nt, Homo sapiens
gcauggaggugcaggauga

SEQ ID NO: 827042 - RNA, 19 nt, Homo sapiens
gacaacaggucucaagguu

SEQ ID NO: 827043 - RNA, 19 nt, Homo sapiens
gcacauaagccauaaccaa

SEQ ID NO: 827044 - RNA, 19 nt, Homo sapiens
aggaggagaucauccagua

SEQ ID NO: 827045 - RNA, 19 nt, Homo sapiens
ccacacagaccaggccuua

SEQ ID NO: 827046 - RNA, 19 nt, Homo sapiens
acacagaccaggccuuaaa

SEQ ID NO: 827047 - RNA, 19 nt, Homo sapiens
cagcagagcagaccugaug

SEQ ID NO: 827048 - RNA, 19 nt, Homo sapiens
ggguggaguucaagaagga

SEQ ID NO: 827049 - RNA, 19 nt, Homo sapiens
ucgcagcgcuggaagaagu

SEQ ID NO: 827050 - RNA, 19 nt, Homo sapiens
aagcagggcuccgugaaga

SEQ ID NO: 827051 - RNA, 19 nt, Homo sapiens
ucgggaagcuggagagcaa

SEQ ID NO: 827052 - RNA, 19 nt, Homo sapiens
ugagccaccuagaggagua

SEQ ID NO: 827053 - RNA, 19 nt, Homo sapiens
gcucaggguucaucguucu

SEQ ID NO: 827054 - RNA, 19 nt, Homo sapiens
agcccaagcucaagcguuu

SEQ ID NO: 827055 - RNA, 19 nt, Homo sapiens
gauccagaaucacaugaac

SEQ ID NO: 827056 - RNA, 19 nt, Homo sapiens
ugucccagauccagaauca

SEQ ID NO: 827057 - RNA, 19 nt, Homo sapiens
cacauaagccauaaccaau

SEQ ID NO: 827058 - RNA, 19 nt, Homo sapiens
acuagcgucugcagccuaa

SEQ ID NO: 827059 - RNA, 19 nt, Homo sapiens
gagcaccugcgcacagaug

SEQ ID NO: 827060 - RNA, 19 nt, Homo sapiens
gucucaagguucccacaaa

SEQ ID NO: 827061 - RNA, 19 nt, Homo sapiens
ccaacgugauccugcagau

SEQ ID NO: 827062 - RNA, 19 nt, Homo sapiens
cagaccaggccuuaaaugu

SEQ ID NO: 827063 - RNA, 19 nt, Homo sapiens
ucucaagguucccacaaag

SEQ ID NO: 827064 - RNA, 19 nt, Homo sapiens
cauaagccauaaccaaucc

SEQ ID NO: 827065 - RNA, 19 nt, Homo sapiens
ccaccuagaggaguacuug

SEQ ID NO: 827066 - RNA, 19 nt, Homo sapiens
guucaucguucugccuugu

SEQ ID NO: 827067 - RNA, 19 nt, Homo sapiens
ggacgaggaggagaucauc

SEQ ID NO: 827068 - RNA, 19 nt, Homo sapiens
ggugcuggcucaggguuca

SEQ ID NO: 827069 - RNA, 19 nt, Homo sapiens
caggaaggacaucccagaa

SEQ ID NO: 827070 - RNA, 19 nt, Homo sapiens
ccucagcuccagugauuca

SEQ ID NO: 827071 - RNA, 19 nt, Homo sapiens
gcagagcagaccugauguc

SEQ ID NO: 827072 - RNA, 19 nt, Homo sapiens
uggccgagguguccaagca

SEQ ID NO: 827073 - RNA, 19 nt, Homo sapiens
ucaagguucccacaaaguc

SEQ ID NO: 827074 - RNA, 19 nt, Homo sapiens
ccaagaaguggugggaguu

SEQ ID NO: 827075 - RNA, 19 nt, Homo sapiens
agaccaggccuuaaauguc

SEQ ID NO: 827076 - RNA, 19 nt, Homo sapiens
ugacaacaggucucaaggu

SEQ ID NO: 827077 - RNA, 19 nt, Homo sapiens
caagaaguggugggaguuc

SEQ ID NO: 827078 - RNA, 19 nt, Homo sapiens
gaauuucacuggcccuuua

SEQ ID NO: 827079 - RNA, 19 nt, Homo sapiens
gcaaguaccugucaagaau

SEQ ID NO: 827080 - RNA, 19 nt, Homo sapiens
ggacauaccuuucguagag

SEQ ID NO: 827081 - RNA, 19 nt, Homo sapiens
guaagaagcugguguauac

SEQ ID NO: 827082 - RNA, 19 nt, Homo sapiens
uaaagcagaugccgaaauu

SEQ ID NO: 827083 - RNA, 19 nt, Homo sapiens
ugaauagucucccacaaua

SEQ ID NO: 827084 - RNA, 19 nt, Homo sapiens
gaauuucgcuucacucuca

SEQ ID NO: 827085 - RNA, 19 nt, Homo sapiens
gaucacaacucucagucua

SEQ ID NO: 827086 - RNA, 19 nt, Homo sapiens
ggagcaggaugaucaagua

SEQ ID NO: 827087 - RNA, 19 nt, Homo sapiens
ugaagaagguggacacaaa

SEQ ID NO: 827088 - RNA, 19 nt, Homo sapiens
gaauaggaaugcaaauuuc

SEQ ID NO: 827089 - RNA, 19 nt, Homo sapiens
gcaaagcgauguguaugaa

SEQ ID NO: 827090 - RNA, 19 nt, Homo sapiens
caauaccucuacagauuua

SEQ ID NO: 827091 - RNA, 19 nt, Homo sapiens
gcaagaagauccuuauagg

SEQ ID NO: 827092 - RNA, 19 nt, Homo sapiens
gcacaaaugcucaguguau

SEQ ID NO: 827093 - RNA, 19 nt, Homo sapiens
gaaagacaguaagcaaauu

SEQ ID NO: 827094 - RNA, 19 nt, Homo sapiens
ggaaggauuuggagcaaga

SEQ ID NO: 827095 - RNA, 19 nt, Homo sapiens
gcacugauaugcagaugau

SEQ ID NO: 827096 - RNA, 19 nt, Homo sapiens
ccaaacacaucccgcgaua

SEQ ID NO: 827097 - RNA, 19 nt, Homo sapiens
ggucugagcugagcaguga

SEQ ID NO: 827098 - RNA, 19 nt, Homo sapiens
ugaaguagaucauugugaa

SEQ ID NO: 827099 - RNA, 19 nt, Homo sapiens
gagaacacaucaggacuuu

SEQ ID NO: 827100 - RNA, 19 nt, Homo sapiens
gaauuuaacccuucccaaa

SEQ ID NO: 827101 - RNA, 19 nt, Homo sapiens
gaagaaauguguggacaag

SEQ ID NO: 827102 - RNA, 19 nt, Homo sapiens
ccaagaaacucaccucagu

SEQ ID NO: 827103 - RNA, 19 nt, Homo sapiens
gcacuagggagguuuguaa

SEQ ID NO: 827104 - RNA, 19 nt, Homo sapiens
acacaaagccuucuucaga

SEQ ID NO: 827105 - RNA, 19 nt, Homo sapiens
gaaacuugcuguuaaagac

SEQ ID NO: 827106 - RNA, 19 nt, Homo sapiens
cgaauaggaaugcaaauuu

SEQ ID NO: 827107 - RNA, 19 nt, Homo sapiens
ccacagguguugaagaaga

SEQ ID NO: 827108 - RNA, 19 nt, Homo sapiens
gcaaguggcauaaauguca

SEQ ID NO: 827109 - RNA, 19 nt, Homo sapiens
gaaaauugcugccccauca

SEQ ID NO: 827110 - RNA, 19 nt, Homo sapiens
gcccacagguguugaagaa

SEQ ID NO: 827111 - RNA, 19 nt, Homo sapiens
ccuugaaucuuucucauaa

SEQ ID NO: 827112 - RNA, 19 nt, Homo sapiens
ggguauaacugccaagguu

SEQ ID NO: 827113 - RNA, 19 nt, Homo sapiens
agaaauguguggacaaguu

SEQ ID NO: 827114 - RNA, 19 nt, Homo sapiens
ggaaagcacuagggagguu

SEQ ID NO: 827115 - RNA, 19 nt, Homo sapiens
gaaaaggguuggcguaguu

SEQ ID NO: 827116 - RNA, 19 nt, Homo sapiens
ugaccguaguguuguauua

SEQ ID NO: 827117 - RNA, 19 nt, Homo sapiens
cauuggaauugaacgauua

SEQ ID NO: 827118 - RNA, 19 nt, Homo sapiens
gcaggaugaucaaguacuu

SEQ ID NO: 827119 - RNA, 19 nt, Homo sapiens
gcaauaccucuacagauuu

SEQ ID NO: 827120 - RNA, 19 nt, Homo sapiens
ugcaauaccucuacagauu

SEQ ID NO: 827121 - RNA, 19 nt, Homo sapiens
ggacaugccaguuucauca

SEQ ID NO: 827122 - RNA, 19 nt, Homo sapiens
gaauaaagaggcuuguguu

SEQ ID NO: 827123 - RNA, 19 nt, Homo sapiens
agacagacuuuauugauca

SEQ ID NO: 827124 - RNA, 19 nt, Homo sapiens
ccagaagccugagaagaaa

SEQ ID NO: 827125 - RNA, 19 nt, Homo sapiens
aaaguuaccucacucauac

SEQ ID NO: 827126 - RNA, 19 nt, Homo sapiens
ccauaaaucuauucaccaa

SEQ ID NO: 827127 - RNA, 19 nt, Homo sapiens
gaacacaucaggacuuugg

SEQ ID NO: 827128 - RNA, 19 nt, Homo sapiens
uaaagaggcuuguguuuug

SEQ ID NO: 827129 - RNA, 19 nt, Homo sapiens
gcaaauuucccacugucua

SEQ ID NO: 827130 - RNA, 19 nt, Homo sapiens
gaacauguagaaagaacaa

SEQ ID NO: 827131 - RNA, 19 nt, Homo sapiens
gaagaaauccaaggaguca

SEQ ID NO: 827132 - RNA, 19 nt, Homo sapiens
gacaaguucugcuccgauu

SEQ ID NO: 827133 - RNA, 19 nt, Homo sapiens
cuaaggaaacugacauuaa

SEQ ID NO: 827134 - RNA, 19 nt, Homo sapiens
gaagaaaacacacugaaaa

SEQ ID NO: 827135 - RNA, 19 nt, Homo sapiens
uauuggaccucuuccuaua

SEQ ID NO: 827136 - RNA, 19 nt, Homo sapiens
ccaagcacauguuaaagau

SEQ ID NO: 827137 - RNA, 19 nt, Homo sapiens
ggagaccaagcacauguua

SEQ ID NO: 827138 - RNA, 19 nt, Homo sapiens
cgaaauugcaagcaguuua

SEQ ID NO: 827139 - RNA, 19 nt, Homo sapiens
caacccaguuucacauaga

SEQ ID NO: 827140 - RNA, 19 nt, Homo sapiens
gaagacauguuuucugaga

SEQ ID NO: 827141 - RNA, 19 nt, Homo sapiens
gauucgaggugcuggauug

SEQ ID NO: 827142 - RNA, 19 nt, Homo sapiens
gagcaagagaguuauuaaa

SEQ ID NO: 827143 - RNA, 19 nt, Homo sapiens
gagccuggccucauguuaa

SEQ ID NO: 827144 - RNA, 19 nt, Homo sapiens
ggagacaguguuucacaaa

SEQ ID NO: 827145 - RNA, 19 nt, Homo sapiens
gagcaagaagauccuuaua

SEQ ID NO: 827146 - RNA, 19 nt, Homo sapiens
gaaaaccauuuaccaagaa

SEQ ID NO: 827147 - RNA, 19 nt, Homo sapiens
ggagcaagagaguuauuaa

SEQ ID NO: 827148 - RNA, 19 nt, Homo sapiens
ggacuuuggucaauauggu

SEQ ID NO: 827149 - RNA, 19 nt, Homo sapiens
gaggcucacuccgauuuaa

SEQ ID NO: 827150 - RNA, 19 nt, Homo sapiens
gcagaugauuaauuucaca

SEQ ID NO: 827151 - RNA, 19 nt, Homo sapiens
gcaaucccaugaccgugaa

SEQ ID NO: 827152 - RNA, 19 nt, Homo sapiens
gaaucuuucucauaacauc

SEQ ID NO: 827153 - RNA, 19 nt, Homo sapiens
gaggacauuugcacugaug

SEQ ID NO: 827154 - RNA, 19 nt, Homo sapiens
acaaaugcucaguguauua

SEQ ID NO: 827155 - RNA, 19 nt, Homo sapiens
aaacaaugguccuauggau

SEQ ID NO: 827156 - RNA, 19 nt, Homo sapiens
gaacgauuacaaugccuuu

SEQ ID NO: 827157 - RNA, 19 nt, Homo sapiens
agagagaggcagaagguua

SEQ ID NO: 827158 - RNA, 19 nt, Homo sapiens
cagccagacuugccagaaa

SEQ ID NO: 827159 - RNA, 19 nt, Homo sapiens
gaacuuucucgauacauau

SEQ ID NO: 827160 - RNA, 19 nt, Homo sapiens
caagaaacucaccucagua

SEQ ID NO: 827161 - RNA, 19 nt, Homo sapiens
ccaagaaacuaccugaaaa

SEQ ID NO: 827162 - RNA, 19 nt, Homo sapiens
gaagaccuccaagaaacua

SEQ ID NO: 827163 - RNA, 19 nt, Homo sapiens
ucaguaauccuucuucaga

SEQ ID NO: 827164 - RNA, 19 nt, Homo sapiens
uguguucacuccagacuuu

SEQ ID NO: 827165 - RNA, 19 nt, Homo sapiens
aagcacauguuaaagauuc

SEQ ID NO: 827166 - RNA, 19 nt, Homo sapiens
caucaggacuuuggucaau

SEQ ID NO: 827167 - RNA, 19 nt, Homo sapiens
cggcgugccuugugugauu

SEQ ID NO: 827168 - RNA, 19 nt, Homo sapiens
gcugagcagugacaucaau

SEQ ID NO: 827169 - RNA, 19 nt, Homo sapiens
gaaguagaucauugugaaa

SEQ ID NO: 827170 - RNA, 19 nt, Homo sapiens
gaaacuaccugaaaaccau

SEQ ID NO: 827171 - RNA, 19 nt, Homo sapiens
gcuggauugucaucaguuu

SEQ ID NO: 827172 - RNA, 19 nt, Homo sapiens
ugacaugauuggcguggaa

SEQ ID NO: 827173 - RNA, 19 nt, Homo sapiens
gagucagaguccuuuguuu

SEQ ID NO: 827174 - RNA, 19 nt, Homo sapiens
agucgaacauguagaaaga

SEQ ID NO: 827175 - RNA, 19 nt, Homo sapiens
cgggagcucuguccacuga

SEQ ID NO: 827176 - RNA, 19 nt, Homo sapiens
uuuaauagccuuccaacaa

SEQ ID NO: 827177 - RNA, 19 nt, Homo sapiens
ggacugccguagacaacug

SEQ ID NO: 827178 - RNA, 19 nt, Homo sapiens
gaacgacgcugcacucaaa

SEQ ID NO: 827179 - RNA, 19 nt, Homo sapiens
gaacccaucuuguacauuu

SEQ ID NO: 827180 - RNA, 19 nt, Homo sapiens
gaagaagaccuauuaauug

SEQ ID NO: 827181 - RNA, 19 nt, Homo sapiens
ggagugaaauuucucguuu

SEQ ID NO: 827182 - RNA, 19 nt, Homo sapiens
gugcaaagcuuauuucaug

SEQ ID NO: 827183 - RNA, 19 nt, Homo sapiens
ggagggagcuggacaggaa

SEQ ID NO: 827184 - RNA, 19 nt, Homo sapiens
gaacguuucuaaagauuga

SEQ ID NO: 827185 - RNA, 19 nt, Homo sapiens
caaauuggauugcuaccua

SEQ ID NO: 827186 - RNA, 19 nt, Homo sapiens
caacaucucucuccucuca

SEQ ID NO: 827187 - RNA, 19 nt, Homo sapiens
gcagggagcuggucaaugg

SEQ ID NO: 827188 - RNA, 19 nt, Homo sapiens
ggacagaccugcugcuauc

SEQ ID NO: 827189 - RNA, 19 nt, Homo sapiens
ggaaaggaguacauuaaau

SEQ ID NO: 827190 - RNA, 19 nt, Homo sapiens
gaacagaggccagagaauu

SEQ ID NO: 827191 - RNA, 19 nt, Homo sapiens
aaacaaaccuucagcuuuc

SEQ ID NO: 827192 - RNA, 19 nt, Homo sapiens
cagaaagacucauuuauca

SEQ ID NO: 827193 - RNA, 19 nt, Homo sapiens
gggaaaagcuacagacuua

SEQ ID NO: 827194 - RNA, 19 nt, Homo sapiens
gauaauccauucauacaug

SEQ ID NO: 827195 - RNA, 19 nt, Homo sapiens
gcuaauacaggaacauuua

SEQ ID NO: 827196 - RNA, 19 nt, Homo sapiens
uaaggaacguuucuaaaga

SEQ ID NO: 827197 - RNA, 19 nt, Homo sapiens
gaaaugaaacagacaguau

SEQ ID NO: 827198 - RNA, 19 nt, Homo sapiens
gaaagacucauuuaucaga

SEQ ID NO: 827199 - RNA, 19 nt, Homo sapiens
cacauaacaugcuaacaua

SEQ ID NO: 827200 - RNA, 19 nt, Homo sapiens
ggaaaguccucugcuagaa

SEQ ID NO: 827201 - RNA, 19 nt, Homo sapiens
ggaaagcaaagcacaagua

SEQ ID NO: 827202 - RNA, 19 nt, Homo sapiens
ggaauuaagccaaaguaaa

SEQ ID NO: 827203 - RNA, 19 nt, Homo sapiens
gaguacagcucuucaagug

SEQ ID NO: 827204 - RNA, 19 nt, Homo sapiens
gagagaggaauguuuauaa

SEQ ID NO: 827205 - RNA, 19 nt, Homo sapiens
aaagugaccucaugugcua

SEQ ID NO: 827206 - RNA, 19 nt, Homo sapiens
uggcagaaaucacuaaauu

SEQ ID NO: 827207 - RNA, 19 nt, Homo sapiens
gcacagggcucggaaaguc

SEQ ID NO: 827208 - RNA, 19 nt, Homo sapiens
gaaaggaguacauuaaauc

SEQ ID NO: 827209 - RNA, 19 nt, Homo sapiens
ggacauuucuagaauucuu

SEQ ID NO: 827210 - RNA, 19 nt, Homo sapiens
gcugguugguuucuuguua

SEQ ID NO: 827211 - RNA, 19 nt, Homo sapiens
gaagaaugcagacuccuuu

SEQ ID NO: 827212 - RNA, 19 nt, Homo sapiens
aaagagagaggaauguuua

SEQ ID NO: 827213 - RNA, 19 nt, Homo sapiens
gcagaaaucacuaaauugu

SEQ ID NO: 827214 - RNA, 19 nt, Homo sapiens
ggacauagucaccaaauca

SEQ ID NO: 827215 - RNA, 19 nt, Homo sapiens
gcuaugaacccaucuugua

SEQ ID NO: 827216 - RNA, 19 nt, Homo sapiens
gauagacaauugccauaga

SEQ ID NO: 827217 - RNA, 19 nt, Homo sapiens
gaggugggaugcagaggua

SEQ ID NO: 827218 - RNA, 19 nt, Homo sapiens
gcuagauaauccauucaua

SEQ ID NO: 827219 - RNA, 19 nt, Homo sapiens
ccagauggcuucacuccuu

SEQ ID NO: 827220 - RNA, 19 nt, Homo sapiens
gugcugauuucuucacaua

SEQ ID NO: 827221 - RNA, 19 nt, Homo sapiens
agucagagaugcgauguua

SEQ ID NO: 827222 - RNA, 19 nt, Homo sapiens
guaugugacugcuugaauu

SEQ ID NO: 827223 - RNA, 19 nt, Homo sapiens
aaacuaagagcaagcauuu

SEQ ID NO: 827224 - RNA, 19 nt, Homo sapiens
uauaacggcuugaaaggaa

SEQ ID NO: 827225 - RNA, 19 nt, Homo sapiens
aggcugagcuuaugaaguu

SEQ ID NO: 827226 - RNA, 19 nt, Homo sapiens
acacagggaugaaggacua

SEQ ID NO: 827227 - RNA, 19 nt, Homo sapiens
gcauaaaucuggugguuuu

SEQ ID NO: 827228 - RNA, 19 nt, Homo sapiens
cagaacaaacugucaauaa

SEQ ID NO: 827229 - RNA, 19 nt, Homo sapiens
cagaaacccaccuguaaua

SEQ ID NO: 827230 - RNA, 19 nt, Homo sapiens
ccagagguauguagccuuu

SEQ ID NO: 827231 - RNA, 19 nt, Homo sapiens
gggccaaaguucuuacaaa

SEQ ID NO: 827232 - RNA, 19 nt, Homo sapiens
gaaacuuugugacugcauu

SEQ ID NO: 827233 - RNA, 19 nt, Homo sapiens
gcacauacgacuaucauca

SEQ ID NO: 827234 - RNA, 19 nt, Homo sapiens
ccaagugucugguccaaau

SEQ ID NO: 827235 - RNA, 19 nt, Homo sapiens
cuagaacucugaaacuuug

SEQ ID NO: 827236 - RNA, 19 nt, Homo sapiens
aaauugacaugugcuguua

SEQ ID NO: 827237 - RNA, 19 nt, Homo sapiens
gaagacagcuaugaaacag

SEQ ID NO: 827238 - RNA, 19 nt, Homo sapiens
ugaugaagaagaccuauua

SEQ ID NO: 827239 - RNA, 19 nt, Homo sapiens
gcacacacaucuccaacca

SEQ ID NO: 827240 - RNA, 19 nt, Homo sapiens
gaauuaagccaaaguaaac

SEQ ID NO: 827241 - RNA, 19 nt, Homo sapiens
caacacaugcagccugaua

SEQ ID NO: 827242 - RNA, 19 nt, Homo sapiens
caacaaugcugggucuuuc

SEQ ID NO: 827243 - RNA, 19 nt, Homo sapiens
gacaacagcaguacaguga

SEQ ID NO: 827244 - RNA, 19 nt, Homo sapiens
gcagacggguugacaucuu

SEQ ID NO: 827245 - RNA, 19 nt, Homo sapiens
caaccaagcacaguucuaa

SEQ ID NO: 827246 - RNA, 19 nt, Homo sapiens
gacaugugcuguuaagugu

SEQ ID NO: 827247 - RNA, 19 nt, Homo sapiens
caauaaggaacguuucuaa

SEQ ID NO: 827248 - RNA, 19 nt, Homo sapiens
gaauuugacugucccuagu

SEQ ID NO: 827249 - RNA, 19 nt, Homo sapiens
caugugcuguuaaguguaa

SEQ ID NO: 827250 - RNA, 19 nt, Homo sapiens
gaugggaguuaguaaggaa

SEQ ID NO: 827251 - RNA, 19 nt, Homo sapiens
gggcauaaaucuggugguu

SEQ ID NO: 827252 - RNA, 19 nt, Homo sapiens
gaacaaacugucaauaagg

SEQ ID NO: 827253 - RNA, 19 nt, Homo sapiens
uugcagaacuugaugaaga

SEQ ID NO: 827254 - RNA, 19 nt, Homo sapiens
gauggaggcugagcuuaug

SEQ ID NO: 827255 - RNA, 19 nt, Homo sapiens
ucuauaggguuuccuuaaa

SEQ ID NO: 827256 - RNA, 19 nt, Homo sapiens
cuacauagacuuaaugauc

SEQ ID NO: 827257 - RNA, 19 nt, Homo sapiens
gcauggauguguguuucua

SEQ ID NO: 827258 - RNA, 19 nt, Homo sapiens
uagcucauguccacucuuu

SEQ ID NO: 827259 - RNA, 19 nt, Homo sapiens
caaagagagaggaauguuu

SEQ ID NO: 827260 - RNA, 19 nt, Homo sapiens
ggaaaugaaacagacagua

SEQ ID NO: 827261 - RNA, 19 nt, Homo sapiens
gaagaacguccagccagua

SEQ ID NO: 827262 - RNA, 19 nt, Homo sapiens
gaugcgauguuacgacaga

SEQ ID NO: 827263 - RNA, 19 nt, Homo sapiens
gaaaaggacagcaacgaua

SEQ ID NO: 827264 - RNA, 19 nt, Homo sapiens
cagacaaccuaaaugcaaa

SEQ ID NO: 827265 - RNA, 19 nt, Homo sapiens
guaaacauagagucuguaa

SEQ ID NO: 827266 - RNA, 19 nt, Homo sapiens
ccaccaaggguaggaauua

SEQ ID NO: 827267 - RNA, 19 nt, Homo sapiens
guacaacagugacaacaac

SEQ ID NO: 827268 - RNA, 19 nt, Homo sapiens
gggcagcucuguagucucu

SEQ ID NO: 827269 - RNA, 19 nt, Homo sapiens
ggccaaaguucuuacaaag

SEQ ID NO: 827270 - RNA, 19 nt, Homo sapiens
cagguuuacuuuaagcuaa

SEQ ID NO: 827271 - RNA, 19 nt, Homo sapiens
gaaacccaccuguaauaug

SEQ ID NO: 827272 - RNA, 19 nt, Homo sapiens
ggaagacagcuaugaaaca

SEQ ID NO: 827273 - RNA, 19 nt, Homo sapiens
gacauauacuccacacaug

SEQ ID NO: 827274 - RNA, 19 nt, Homo sapiens
ugaaagcugugugugguuu

SEQ ID NO: 827275 - RNA, 19 nt, Homo sapiens
guagaggagugaaauuucu

SEQ ID NO: 827276 - RNA, 19 nt, Homo sapiens
gauuagcagugauggaaau

SEQ ID NO: 827277 - RNA, 19 nt, Homo sapiens
caaaaugucuucccugugu

SEQ ID NO: 827278 - RNA, 19 nt, Homo sapiens
cgaaggaucucacagaaua

SEQ ID NO: 827279 - RNA, 19 nt, Homo sapiens
gauaaacgguggcgaguaa

SEQ ID NO: 827280 - RNA, 19 nt, Homo sapiens
gaacauguauuugaucuga

SEQ ID NO: 827281 - RNA, 19 nt, Homo sapiens
ggaaggaaacccuauguua

SEQ ID NO: 827282 - RNA, 19 nt, Homo sapiens
gaacagcauugacgacaaa

SEQ ID NO: 827283 - RNA, 19 nt, Homo sapiens
ugaaagaucugcuaaugaa

SEQ ID NO: 827284 - RNA, 19 nt, Homo sapiens
aaaggaagcugcagagaaa

SEQ ID NO: 827285 - RNA, 19 nt, Homo sapiens
gcacgacaauguuuacuga

SEQ ID NO: 827286 - RNA, 19 nt, Homo sapiens
gaagagcgauuagcuguug

SEQ ID NO: 827287 - RNA, 19 nt, Homo sapiens
gcaauuaaacuucugguaa

SEQ ID NO: 827288 - RNA, 19 nt, Homo sapiens
gggaauacauuaagcagaa

SEQ ID NO: 827289 - RNA, 19 nt, Homo sapiens
gaaauagcccggaaacuug

SEQ ID NO: 827290 - RNA, 19 nt, Homo sapiens
gaguaucuaugcauaagua

SEQ ID NO: 827291 - RNA, 19 nt, Homo sapiens
gcaaagcccuagcagaaug

SEQ ID NO: 827292 - RNA, 19 nt, Homo sapiens
gagcuaaagucauaacaug

SEQ ID NO: 827293 - RNA, 19 nt, Homo sapiens
gcagagaacaucaaguuaa

SEQ ID NO: 827294 - RNA, 19 nt, Homo sapiens
ggacaaacuucugcauauu

SEQ ID NO: 827295 - RNA, 19 nt, Homo sapiens
gaacaauggauaccaauga

SEQ ID NO: 827296 - RNA, 19 nt, Homo sapiens
uaaagacuguccagcauuu

SEQ ID NO: 827297 - RNA, 19 nt, Homo sapiens
ggaggaacaugaaauuugu

SEQ ID NO: 827298 - RNA, 19 nt, Homo sapiens
aaacuuggauucacaaaug

SEQ ID NO: 827299 - RNA, 19 nt, Homo sapiens
uaacuguucugccauguuu

SEQ ID NO: 827300 - RNA, 19 nt, Homo sapiens
caaauugacuuacaaaggu

SEQ ID NO: 827301 - RNA, 19 nt, Homo sapiens
uagcuuggguuaaaucaua

SEQ ID NO: 827302 - RNA, 19 nt, Homo sapiens
gagugaaguuugagaguaa

SEQ ID NO: 827303 - RNA, 19 nt, Homo sapiens
ugaagaagauggcagagaa

SEQ ID NO: 827304 - RNA, 19 nt, Homo sapiens
ggaagcagguaaugccaaa

SEQ ID NO: 827305 - RNA, 19 nt, Homo sapiens
gacaagaguacuucuguua

SEQ ID NO: 827306 - RNA, 19 nt, Homo sapiens
uaagugcacuagugaaauu

SEQ ID NO: 827307 - RNA, 19 nt, Homo sapiens
gaaaggaagcugcagagaa

SEQ ID NO: 827308 - RNA, 19 nt, Homo sapiens
ccacuagccuugcaucuug

SEQ ID NO: 827309 - RNA, 19 nt, Homo sapiens
ucagacaacuugauuccua

SEQ ID NO: 827310 - RNA, 19 nt, Homo sapiens
ggaaagaacacuggauaaa

SEQ ID NO: 827311 - RNA, 19 nt, Homo sapiens
gcgauuagcuguuguucga

SEQ ID NO: 827312 - RNA, 19 nt, Homo sapiens
uuauugggcuccauucuua

SEQ ID NO: 827313 - RNA, 19 nt, Homo sapiens
ccauauacuucccaugaua

SEQ ID NO: 827314 - RNA, 19 nt, Homo sapiens
caucacaguuuacuagauu

SEQ ID NO: 827315 - RNA, 19 nt, Homo sapiens
acugaaagauggguaauua

SEQ ID NO: 827316 - RNA, 19 nt, Homo sapiens
gcaaagguacaggcaauua

SEQ ID NO: 827317 - RNA, 19 nt, Homo sapiens
gagaaagucagcuggauaa

SEQ ID NO: 827318 - RNA, 19 nt, Homo sapiens
gccaggaauucccauguua

SEQ ID NO: 827319 - RNA, 19 nt, Homo sapiens
gagacuggaagcaauauua

SEQ ID NO: 827320 - RNA, 19 nt, Homo sapiens
gaaauacugucuucauggu

SEQ ID NO: 827321 - RNA, 19 nt, Homo sapiens
uaacaucugcuuugaauug

SEQ ID NO: 827322 - RNA, 19 nt, Homo sapiens
agaaccaucugcaucaaua

SEQ ID NO: 827323 - RNA, 19 nt, Homo sapiens
gccaaagccugcuggagua

SEQ ID NO: 827324 - RNA, 19 nt, Homo sapiens
gaaggaaacccuauguuag

SEQ ID NO: 827325 - RNA, 19 nt, Homo sapiens
uaagguggcuguuggguau

SEQ ID NO: 827326 - RNA, 19 nt, Homo sapiens
guccacaguuuaauagaua

SEQ ID NO: 827327 - RNA, 19 nt, Homo sapiens
gaucaggacucagaagaug

SEQ ID NO: 827328 - RNA, 19 nt, Homo sapiens
gcagauauuugcucagaag

SEQ ID NO: 827329 - RNA, 19 nt, Homo sapiens
cagauacgaucgaccuuaa

SEQ ID NO: 827330 - RNA, 19 nt, Homo sapiens
caaagaguccacaguuuaa

SEQ ID NO: 827331 - RNA, 19 nt, Homo sapiens
acaaagaguccacaguuua

SEQ ID NO: 827332 - RNA, 19 nt, Homo sapiens
gcagaaccuuguaauuugu

SEQ ID NO: 827333 - RNA, 19 nt, Homo sapiens
uggcucagcuuuauaagaa

SEQ ID NO: 827334 - RNA, 19 nt, Homo sapiens
ggaccuggccuuaguaaau

SEQ ID NO: 827335 - RNA, 19 nt, Homo sapiens
uaccaaguguuacaucaua

SEQ ID NO: 827336 - RNA, 19 nt, Homo sapiens
cacccaaacugcaagauuu

SEQ ID NO: 827337 - RNA, 19 nt, Homo sapiens
gcgauuagcugcugguagu

SEQ ID NO: 827338 - RNA, 19 nt, Homo sapiens
guuugaagcuucuuguauu

SEQ ID NO: 827339 - RNA, 19 nt, Homo sapiens
ucacuuacguuucucauag

SEQ ID NO: 827340 - RNA, 19 nt, Homo sapiens
cuaaagagacuauuacuuc

SEQ ID NO: 827341 - RNA, 19 nt, Homo sapiens
ucacaaaugucccugaaca

SEQ ID NO: 827342 - RNA, 19 nt, Homo sapiens
ugcuauagauccucauuua

SEQ ID NO: 827343 - RNA, 19 nt, Homo sapiens
caacuugauuccuaagguu

SEQ ID NO: 827344 - RNA, 19 nt, Homo sapiens
caguagguguguucuauuu

SEQ ID NO: 827345 - RNA, 19 nt, Homo sapiens
gaaaacuguugcaucaaua

SEQ ID NO: 827346 - RNA, 19 nt, Homo sapiens
ggaaauaaguguuuugcuu

SEQ ID NO: 827347 - RNA, 19 nt, Homo sapiens
gugaaaaccuuuauggaua

SEQ ID NO: 827348 - RNA, 19 nt, Homo sapiens
ggucucaguuggaguuauu

SEQ ID NO: 827349 - RNA, 19 nt, Homo sapiens
gaucaacaauagccacaau

SEQ ID NO: 827350 - RNA, 19 nt, Homo sapiens
gaagcagaaccuuguaauu

SEQ ID NO: 827351 - RNA, 19 nt, Homo sapiens
aaacaacaagccagaauuu

SEQ ID NO: 827352 - RNA, 19 nt, Homo sapiens
ucagagaacuacaacacaa

SEQ ID NO: 827353 - RNA, 19 nt, Homo sapiens
gaaccuuguuaccaugaaa

SEQ ID NO: 827354 - RNA, 19 nt, Homo sapiens
gaaaaucuuugcucaguau

SEQ ID NO: 827355 - RNA, 19 nt, Homo sapiens
gaaauuugccagucauugu

SEQ ID NO: 827356 - RNA, 19 nt, Homo sapiens
caauuaaacuucugguaag

SEQ ID NO: 827357 - RNA, 19 nt, Homo sapiens
gacaaacuucugcauauuu

SEQ ID NO: 827358 - RNA, 19 nt, Homo sapiens
caaaugcacaugcuagauu

SEQ ID NO: 827359 - RNA, 19 nt, Homo sapiens
gcauugugcuauuuggaaa

SEQ ID NO: 827360 - RNA, 19 nt, Homo sapiens
caaguaaggcagauauuug

SEQ ID NO: 827361 - RNA, 19 nt, Homo sapiens
ggaucucacagaauauuua

SEQ ID NO: 827362 - RNA, 19 nt, Homo sapiens
gagauuagaaagugugaaa

SEQ ID NO: 827363 - RNA, 19 nt, Homo sapiens
aaagagcaaugauggagaa

SEQ ID NO: 827364 - RNA, 19 nt, Homo sapiens
cauauaacaucugcuuuga

SEQ ID NO: 827365 - RNA, 19 nt, Homo sapiens
aagcagaaccuuguaauuu

SEQ ID NO: 827366 - RNA, 19 nt, Homo sapiens
aaaugucccugaacagaaa

SEQ ID NO: 827367 - RNA, 19 nt, Homo sapiens
gcagagaauauccaacaaa

SEQ ID NO: 827368 - RNA, 19 nt, Homo sapiens
ugaaaucuguaguagcaaa

SEQ ID NO: 827369 - RNA, 19 nt, Homo sapiens
cauggaaggugauggaguu

SEQ ID NO: 827370 - RNA, 19 nt, Homo sapiens
cauagaugaucaagaguug

SEQ ID NO: 827371 - RNA, 19 nt, Homo sapiens
caaguccucugauggaaau

SEQ ID NO: 827372 - RNA, 19 nt, Homo sapiens
gaccacaaguccucugaug

SEQ ID NO: 827373 - RNA, 19 nt, Homo sapiens
caauagccaugccuuuaug

SEQ ID NO: 827374 - RNA, 19 nt, Homo sapiens
ucugugcacuuguuauuaa

SEQ ID NO: 827375 - RNA, 19 nt, Homo sapiens
aaagucagcuggauaaagg

SEQ ID NO: 827376 - RNA, 19 nt, Homo sapiens
gagcaaugauggagaagag

SEQ ID NO: 827377 - RNA, 19 nt, Homo sapiens
uacaaagaguccacaguuu

SEQ ID NO: 827378 - RNA, 19 nt, Homo sapiens
caacaaggcagaagaaaua

SEQ ID NO: 827379 - RNA, 19 nt, Homo sapiens
gaaaguggaugaauacaca

SEQ ID NO: 827380 - RNA, 19 nt, Homo sapiens
ggacaucuccgacugguua

SEQ ID NO: 827381 - RNA, 19 nt, Homo sapiens
agaaauagcugacaagauc

SEQ ID NO: 827382 - RNA, 19 nt, Homo sapiens
gagagaugcuacaugguua

SEQ ID NO: 827383 - RNA, 19 nt, Homo sapiens
aaacucagcugacauucua

SEQ ID NO: 827384 - RNA, 19 nt, Homo sapiens
gcagcaggcuucacuaaug

SEQ ID NO: 827385 - RNA, 19 nt, Homo sapiens
gcacagaagccacucauga

SEQ ID NO: 827386 - RNA, 19 nt, Homo sapiens
cuacaacucucacuaugaa

SEQ ID NO: 827387 - RNA, 19 nt, Homo sapiens
ucaaugaccugcugucuuc

SEQ ID NO: 827388 - RNA, 19 nt, Homo sapiens
ccucaaaccugacuccaaa

SEQ ID NO: 827389 - RNA, 19 nt, Homo sapiens
ggccaagucuuccagauga

SEQ ID NO: 827390 - RNA, 19 nt, Homo sapiens
ugacugcucugauggcuuu

SEQ ID NO: 827391 - RNA, 19 nt, Homo sapiens
ggacaaaggacgacagaug

SEQ ID NO: 827392 - RNA, 19 nt, Homo sapiens
cagccaagcuuucccugua

SEQ ID NO: 827393 - RNA, 19 nt, Homo sapiens
gaaacagugcccuaucuuu

SEQ ID NO: 827394 - RNA, 19 nt, Homo sapiens
gaaccaaggccaagucuuc

SEQ ID NO: 827395 - RNA, 19 nt, Homo sapiens
caaacuggcuccugaugga

SEQ ID NO: 827396 - RNA, 19 nt, Homo sapiens
gaggaagcaugggucuuua

SEQ ID NO: 827397 - RNA, 19 nt, Homo sapiens
ucacuaauguucucaagau

SEQ ID NO: 827398 - RNA, 19 nt, Homo sapiens
ggagagaugcuacaugguu

SEQ ID NO: 827399 - RNA, 19 nt, Homo sapiens
ggaagacccugcagauguc

SEQ ID NO: 827400 - RNA, 19 nt, Homo sapiens
aagagaagguggacuuuga

SEQ ID NO: 827401 - RNA, 19 nt, Homo sapiens
gcagauggccuacaacaca

SEQ ID NO: 827402 - RNA, 19 nt, Homo sapiens
gaagagcgcaagcacagaa

SEQ ID NO: 827403 - RNA, 19 nt, Homo sapiens
gaacaagacagcccugaca

SEQ ID NO: 827404 - RNA, 19 nt, Homo sapiens
aagcgaugcuguccacaua

SEQ ID NO: 827405 - RNA, 19 nt, Homo sapiens
gaaggugacucugcaugug

SEQ ID NO: 827406 - RNA, 19 nt, Homo sapiens
ggaugggccuagcagauga

SEQ ID NO: 827407 - RNA, 19 nt, Homo sapiens
caaggucuccgacuauauu

SEQ ID NO: 827408 - RNA, 19 nt, Homo sapiens
ccaucuaccugucaccuuu

SEQ ID NO: 827409 - RNA, 19 nt, Homo sapiens
agaaggagcucaaguccau

SEQ ID NO: 827410 - RNA, 19 nt, Homo sapiens
aaaccugacuccaaauuca

SEQ ID NO: 827411 - RNA, 19 nt, Homo sapiens
ggacagagaccuuuguaac

SEQ ID NO: 827412 - RNA, 19 nt, Homo sapiens
gaagaaauagcugacaaga

SEQ ID NO: 827413 - RNA, 19 nt, Homo sapiens
gggcugcacucgcaacuuc

SEQ ID NO: 827414 - RNA, 19 nt, Homo sapiens
aagcaugggucuuuaagga

SEQ ID NO: 827415 - RNA, 19 nt, Homo sapiens
cagaagaaauagcugacaa

SEQ ID NO: 827416 - RNA, 19 nt, Homo sapiens
ccacauacuuugaaaccau

SEQ ID NO: 827417 - RNA, 19 nt, Homo sapiens
gcucagaggcagacgauga

SEQ ID NO: 827418 - RNA, 19 nt, Homo sapiens
gggaggcacucagagcuaa

SEQ ID NO: 827419 - RNA, 19 nt, Homo sapiens
gcaagaaggagcucaaguc

SEQ ID NO: 827420 - RNA, 19 nt, Homo sapiens
gaguuuugcugaugacuua

SEQ ID NO: 827421 - RNA, 19 nt, Homo sapiens
gcuuaaugcucucagaugu

SEQ ID NO: 827422 - RNA, 19 nt, Homo sapiens
ggcauugacugcucugaug

SEQ ID NO: 827423 - RNA, 19 nt, Homo sapiens
gaagguggacuuugagaag

SEQ ID NO: 827424 - RNA, 19 nt, Homo sapiens
caacugcucacuggagaua

SEQ ID NO: 827425 - RNA, 19 nt, Homo sapiens
gagugcagcugucaugaag

SEQ ID NO: 827426 - RNA, 19 nt, Homo sapiens
ggaaggaagcucugaggau

SEQ ID NO: 827427 - RNA, 19 nt, Homo sapiens
gagaagauggugucaaugg

SEQ ID NO: 827428 - RNA, 19 nt, Homo sapiens
gacuccaaauucaaugaua

SEQ ID NO: 827429 - RNA, 19 nt, Homo sapiens
guacuguggucuccuugga

SEQ ID NO: 827430 - RNA, 19 nt, Homo sapiens
cagcaggcuucacuaaugu

SEQ ID NO: 827431 - RNA, 19 nt, Homo sapiens
gcaagccccugaaaagauu

SEQ ID NO: 827432 - RNA, 19 nt, Homo sapiens
gaagagaagguggacuuug

SEQ ID NO: 827433 - RNA, 19 nt, Homo sapiens
gcaggccuguccaugcauu

SEQ ID NO: 827434 - RNA, 19 nt, Homo sapiens
acuauauucugcagcauaa

SEQ ID NO: 827435 - RNA, 19 nt, Homo sapiens
gcgguugcguggaggagua

SEQ ID NO: 827436 - RNA, 19 nt, Homo sapiens
ggagcuaccuggacaucuc

SEQ ID NO: 827437 - RNA, 19 nt, Homo sapiens
agagugcacugaugaguuc

SEQ ID NO: 827438 - RNA, 19 nt, Homo sapiens
ccaagacaauggcacaaag

SEQ ID NO: 827439 - RNA, 19 nt, Homo sapiens
gauggaaaauccugcuuaa

SEQ ID NO: 827440 - RNA, 19 nt, Homo sapiens
gagaagaaaggaggaauca

SEQ ID NO: 827441 - RNA, 19 nt, Homo sapiens
gcuggacauuauugaguuu

SEQ ID NO: 827442 - RNA, 19 nt, Homo sapiens
uaagaaaguggaugaauac

SEQ ID NO: 827443 - RNA, 19 nt, Homo sapiens
ggagaacaacuucaucaag

SEQ ID NO: 827444 - RNA, 19 nt, Homo sapiens
ggagagugcagcugucaug

SEQ ID NO: 827445 - RNA, 19 nt, Homo sapiens
ggaccucuguggacaaagg

SEQ ID NO: 827446 - RNA, 19 nt, Homo sapiens
ggaaacagugcccuaucuu

SEQ ID NO: 827447 - RNA, 19 nt, Homo sapiens
cgggagagcuuccguucau

SEQ ID NO: 827448 - RNA, 19 nt, Homo sapiens
ggacauuauugaguuugug

SEQ ID NO: 827449 - RNA, 19 nt, Homo sapiens
aggagaagauggugucaau

SEQ ID NO: 827450 - RNA, 19 nt, Homo sapiens
gcaggcauggugugguaua

SEQ ID NO: 827451 - RNA, 19 nt, Homo sapiens
ccacuacaacucucacuau

SEQ ID NO: 827452 - RNA, 19 nt, Homo sapiens
ggaagagaagguggacuuu

SEQ ID NO: 827453 - RNA, 19 nt, Homo sapiens
gcagcuucguggugaguga

SEQ ID NO: 827454 - RNA, 19 nt, Homo sapiens
ugaggaagcaugggucuuu

SEQ ID NO: 827455 - RNA, 19 nt, Homo sapiens
ccgacggucucuacaaguu

SEQ ID NO: 827456 - RNA, 19 nt, Homo sapiens
ggagaggucccugaaguca

SEQ ID NO: 827457 - RNA, 19 nt, Homo sapiens
gggaagagaagguggacuu

SEQ ID NO: 827458 - RNA, 19 nt, Homo sapiens
ugacugcucucggaacaau

SEQ ID NO: 827459 - RNA, 19 nt, Homo sapiens
gaaaagauucucaggucua

SEQ ID NO: 827460 - RNA, 19 nt, Homo sapiens
agacagcccugacacugau

SEQ ID NO: 827461 - RNA, 19 nt, Homo sapiens
gccacacucugcuuucuuc

SEQ ID NO: 827462 - RNA, 19 nt, Homo sapiens
cccagaugcugucagauga

SEQ ID NO: 827463 - RNA, 19 nt, Homo sapiens
agaacaacuucaucaagga

SEQ ID NO: 827464 - RNA, 19 nt, Homo sapiens
ggaaaauccugcuuaaugc

SEQ ID NO: 827465 - RNA, 19 nt, Homo sapiens
gaugcuguccacauacuuu

SEQ ID NO: 827466 - RNA, 19 nt, Homo sapiens
gccaagcuuucccuguauu

SEQ ID NO: 827467 - RNA, 19 nt, Homo sapiens
uaaggacuucucucucuuu

SEQ ID NO: 827468 - RNA, 19 nt, Homo sapiens
gaaacucagcugacauucu

SEQ ID NO: 827469 - RNA, 19 nt, Homo sapiens
cugcaggcaugguguggua

SEQ ID NO: 827470 - RNA, 19 nt, Homo sapiens
ugacaacaaggcagaagaa

SEQ ID NO: 827471 - RNA, 19 nt, Homo sapiens
gacuauauucugcagcaua

SEQ ID NO: 827472 - RNA, 19 nt, Homo sapiens
cuggagauaucagguauga

SEQ ID NO: 827473 - RNA, 19 nt, Homo sapiens
uacaauggguacacaagug

SEQ ID NO: 827474 - RNA, 19 nt, Homo sapiens
gaugcuacaugguuacaac

SEQ ID NO: 827475 - RNA, 19 nt, Homo sapiens
cggaagacccugcagaugu

SEQ ID NO: 827476 - RNA, 19 nt, Homo sapiens
ccaagcuuucccuguauua

SEQ ID NO: 827477 - RNA, 19 nt, Homo sapiens
acagagaccuuuguaacca

SEQ ID NO: 827478 - RNA, 19 nt, Homo sapiens
gccaggagcucaccaagaa

SEQ ID NO: 827479 - RNA, 19 nt, Homo sapiens
gaagucaacagagccuuua

SEQ ID NO: 827480 - RNA, 19 nt, Homo sapiens
gguuugaccuggaucuuuc

SEQ ID NO: 827481 - RNA, 19 nt, Homo sapiens
gauggacgauccugacuac

SEQ ID NO: 827482 - RNA, 19 nt, Homo sapiens
ggacggagcccuugaugac

SEQ ID NO: 827483 - RNA, 19 nt, Homo sapiens
gcaagcuggugugguuuga

SEQ ID NO: 827484 - RNA, 19 nt, Homo sapiens
ugaagaguguggccuggaa

SEQ ID NO: 827485 - RNA, 19 nt, Homo sapiens
ucucaggccuggaagauuc

SEQ ID NO: 827486 - RNA, 19 nt, Homo sapiens
auagcaagcuggugugguu

SEQ ID NO: 827487 - RNA, 19 nt, Homo sapiens
gcaagaugagggugaaugu

SEQ ID NO: 827488 - RNA, 19 nt, Homo sapiens
gcugcagaguggccaguuu

SEQ ID NO: 827489 - RNA, 19 nt, Homo sapiens
ggagugguacgaugacuuc

SEQ ID NO: 827490 - RNA, 19 nt, Homo sapiens
gaagauuccggcagugaca

SEQ ID NO: 827491 - RNA, 19 nt, Homo sapiens
cagugaggaugaugacgaa

SEQ ID NO: 827492 - RNA, 19 nt, Homo sapiens
cauacaggaugcugagaca

SEQ ID NO: 827493 - RNA, 19 nt, Homo sapiens
caagaugagggugaaugua

SEQ ID NO: 827494 - RNA, 19 nt, Homo sapiens
ccacggcagcgcaagauga

SEQ ID NO: 827495 - RNA, 19 nt, Homo sapiens
ggacgacggcagugucauc

SEQ ID NO: 827496 - RNA, 19 nt, Homo sapiens
ccaccaagccauacaggau

SEQ ID NO: 827497 - RNA, 19 nt, Homo sapiens
ugagccggcugucgacuuc

SEQ ID NO: 827498 - RNA, 19 nt, Homo sapiens
ugacagcagugaggaugau

SEQ ID NO: 827499 - RNA, 19 nt, Homo sapiens
gguguacaaugaccuucug

SEQ ID NO: 827500 - RNA, 19 nt, Homo sapiens
gcugagacaccacaagaag

SEQ ID NO: 827501 - RNA, 19 nt, Homo sapiens
agaugagggugaauguaga

SEQ ID NO: 827502 - RNA, 19 nt, Homo sapiens
ugaagucaacagagccuuu

SEQ ID NO: 827503 - RNA, 19 nt, Homo sapiens
ggaacacggugggcaacgu

SEQ ID NO: 827504 - RNA, 19 nt, Homo sapiens
gaggaggacauccggaaca

SEQ ID NO: 827505 - RNA, 19 nt, Homo sapiens
gcggaggacagcucugaug

SEQ ID NO: 827506 - RNA, 19 nt, Homo sapiens
gagaggacggagcccuuga

SEQ ID NO: 827507 - RNA, 19 nt, Homo sapiens
aagaugagggugaauguag

SEQ ID NO: 827508 - RNA, 19 nt, Homo sapiens
gcgcugccuugaccuguac

SEQ ID NO: 827509 - RNA, 19 nt, Homo sapiens
gaggacggagcccuugaug

SEQ ID NO: 827510 - RNA, 19 nt, Homo sapiens
ggugugguuugaccuggau

SEQ ID NO: 827511 - RNA, 19 nt, Homo sapiens
cggaggacagcucugauga

SEQ ID NO: 827512 - RNA, 19 nt, Homo sapiens
acucggugcugcugcugaa

SEQ ID NO: 827513 - RNA, 19 nt, Homo sapiens
ggaggacagcucugaugag

SEQ ID NO: 827514 - RNA, 19 nt, Homo sapiens
agaagcugaugcccaacug

SEQ ID NO: 827515 - RNA, 19 nt, Homo sapiens
gggccacagugaccuuguc

SEQ ID NO: 827516 - RNA, 19 nt, Homo sapiens
uaacauaccugaucaagaa

SEQ ID NO: 827517 - RNA, 19 nt, Homo sapiens
gaagcgaucucaaauuaaa

SEQ ID NO: 827518 - RNA, 19 nt, Homo sapiens
gagaauagcacaacugaua

SEQ ID NO: 827519 - RNA, 19 nt, Homo sapiens
gcaaggagaugaaagagaa

SEQ ID NO: 827520 - RNA, 19 nt, Homo sapiens
gaagauuccugccauacua

SEQ ID NO: 827521 - RNA, 19 nt, Homo sapiens
gaaagacucucucaucugu

SEQ ID NO: 827522 - RNA, 19 nt, Homo sapiens
gcacagagauauaguaaag

SEQ ID NO: 827523 - RNA, 19 nt, Homo sapiens
gcaagugagucccucuuua

SEQ ID NO: 827524 - RNA, 19 nt, Homo sapiens
ccagaaaguucaaguguaa

SEQ ID NO: 827525 - RNA, 19 nt, Homo sapiens
caaacauucuuguggauua

SEQ ID NO: 827526 - RNA, 19 nt, Homo sapiens
caagguagcuuauuaacug

SEQ ID NO: 827527 - RNA, 19 nt, Homo sapiens
gaagagagcaaucaaggua

SEQ ID NO: 827528 - RNA, 19 nt, Homo sapiens
gaacaugaauccuuaacau

SEQ ID NO: 827529 - RNA, 19 nt, Homo sapiens
gcaugaagcuugcaauguu

SEQ ID NO: 827530 - RNA, 19 nt, Homo sapiens
caaucaagguagcuuauua

SEQ ID NO: 827531 - RNA, 19 nt, Homo sapiens
gcaaacaucagaaagauuu

SEQ ID NO: 827532 - RNA, 19 nt, Homo sapiens
gaugauaggcauauucuua

SEQ ID NO: 827533 - RNA, 19 nt, Homo sapiens
ggagaugccuguugauaga

SEQ ID NO: 827534 - RNA, 19 nt, Homo sapiens
cgaagaggcucaaucugua

SEQ ID NO: 827535 - RNA, 19 nt, Homo sapiens
caaauacaauggcaaauca

SEQ ID NO: 827536 - RNA, 19 nt, Homo sapiens
ccaaaucccucaaagaaug

SEQ ID NO: 827537 - RNA, 19 nt, Homo sapiens
gcagaggaguguggaauuu

SEQ ID NO: 827538 - RNA, 19 nt, Homo sapiens
gaugaaaguuacacagauu

SEQ ID NO: 827539 - RNA, 19 nt, Homo sapiens
uagaugagauucagccaua

SEQ ID NO: 827540 - RNA, 19 nt, Homo sapiens
gcagucaacucaaccagaa

SEQ ID NO: 827541 - RNA, 19 nt, Homo sapiens
ggacuagauuguucagaaa

SEQ ID NO: 827542 - RNA, 19 nt, Homo sapiens
aaacagaaaggcaaaguua

SEQ ID NO: 827543 - RNA, 19 nt, Homo sapiens
gagcagauguuaacacaca

SEQ ID NO: 827544 - RNA, 19 nt, Homo sapiens
gaagaaagaguaaagacaa

SEQ ID NO: 827545 - RNA, 19 nt, Homo sapiens
ugaauugacuccuauauag

SEQ ID NO: 827546 - RNA, 19 nt, Homo sapiens
gacuuuaucugcccaaauu

SEQ ID NO: 827547 - RNA, 19 nt, Homo sapiens
aaacaggucuccuagauca

SEQ ID NO: 827548 - RNA, 19 nt, Homo sapiens
gaucauaguccaacauuug

SEQ ID NO: 827549 - RNA, 19 nt, Homo sapiens
guaaauccuucuaguguug

SEQ ID NO: 827550 - RNA, 19 nt, Homo sapiens
aaacagauggcacuucuua

SEQ ID NO: 827551 - RNA, 19 nt, Homo sapiens
uuacagagcugcaagaaca

SEQ ID NO: 827552 - RNA, 19 nt, Homo sapiens
ugacagcacuauucaagaa

SEQ ID NO: 827553 - RNA, 19 nt, Homo sapiens
cagauaagccuaaaccuaa

SEQ ID NO: 827554 - RNA, 19 nt, Homo sapiens
uacaagauguggaugauaa

SEQ ID NO: 827555 - RNA, 19 nt, Homo sapiens
caaagaugaugaugaugaa

SEQ ID NO: 827556 - RNA, 19 nt, Homo sapiens
cgacagaaagauaaaguua

SEQ ID NO: 827557 - RNA, 19 nt, Homo sapiens
gcaagaacauuggcaaauc

SEQ ID NO: 827558 - RNA, 19 nt, Homo sapiens
gcagauaagccuaaaccua

SEQ ID NO: 827559 - RNA, 19 nt, Homo sapiens
gaaaagagguuagugaaug

SEQ ID NO: 827560 - RNA, 19 nt, Homo sapiens
uauggaacaugaauccuua

SEQ ID NO: 827561 - RNA, 19 nt, Homo sapiens
gggcaaaugugaaugugaa

SEQ ID NO: 827562 - RNA, 19 nt, Homo sapiens
aaaggaagcuggaaauaag

SEQ ID NO: 827563 - RNA, 19 nt, Homo sapiens
gaagugaugugagcaagga

SEQ ID NO: 827564 - RNA, 19 nt, Homo sapiens
gcaaauuacuguguagugu

SEQ ID NO: 827565 - RNA, 19 nt, Homo sapiens
uagcaugccuucugucauu

SEQ ID NO: 827566 - RNA, 19 nt, Homo sapiens
cuaaagaugcuguaaguaa

SEQ ID NO: 827567 - RNA, 19 nt, Homo sapiens
ucaaagaguucagaaguga

SEQ ID NO: 827568 - RNA, 19 nt, Homo sapiens
caucuagggucuuauauuc

SEQ ID NO: 827569 - RNA, 19 nt, Homo sapiens
guucaaagaugaugaugau

SEQ ID NO: 827570 - RNA, 19 nt, Homo sapiens
gaaagaagguccagaaaag

SEQ ID NO: 827571 - RNA, 19 nt, Homo sapiens
gggagagacuuauaucuuc

SEQ ID NO: 827572 - RNA, 19 nt, Homo sapiens
uaacgacgacuuugaauug

SEQ ID NO: 827573 - RNA, 19 nt, Homo sapiens
caagaacauuggcaaauca

SEQ ID NO: 827574 - RNA, 19 nt, Homo sapiens
aaacauacccacagauaaa

SEQ ID NO: 827575 - RNA, 19 nt, Homo sapiens
guaaaucucccaaacauuc

SEQ ID NO: 827576 - RNA, 19 nt, Homo sapiens
agacugaacugccaggaaa

SEQ ID NO: 827577 - RNA, 19 nt, Homo sapiens
gaaaccauauggaagaaag

SEQ ID NO: 827578 - RNA, 19 nt, Homo sapiens
gaacuuacuaggucaaaga

SEQ ID NO: 827579 - RNA, 19 nt, Homo sapiens
uaggaaacaugacaaagaa

SEQ ID NO: 827580 - RNA, 19 nt, Homo sapiens
aaucaaacacugccauuua

SEQ ID NO: 827581 - RNA, 19 nt, Homo sapiens
aaacgcaaauuacugugua

SEQ ID NO: 827582 - RNA, 19 nt, Homo sapiens
caaacagacuuucaacauc

SEQ ID NO: 827583 - RNA, 19 nt, Homo sapiens
gcaaacagacuuucaacau

SEQ ID NO: 827584 - RNA, 19 nt, Homo sapiens
gaggagaugugaaacaagu

SEQ ID NO: 827585 - RNA, 19 nt, Homo sapiens
gaagaugacgauccucaaa

SEQ ID NO: 827586 - RNA, 19 nt, Homo sapiens
ugucauauguugcuaauca

SEQ ID NO: 827587 - RNA, 19 nt, Homo sapiens
agaagugacugaugcauau

SEQ ID NO: 827588 - RNA, 19 nt, Homo sapiens
ggagaugugaaacaaguua

SEQ ID NO: 827589 - RNA, 19 nt, Homo sapiens
gaaaucucaucaagaauac

SEQ ID NO: 827590 - RNA, 19 nt, Homo sapiens
gaaaacauacccacagaua

SEQ ID NO: 827591 - RNA, 19 nt, Homo sapiens
aaaugaaccugaagcagaa

SEQ ID NO: 827592 - RNA, 19 nt, Homo sapiens
ggacauacucagagaaaga

SEQ ID NO: 827593 - RNA, 19 nt, Homo sapiens
uaaaugcuguccagagguu

SEQ ID NO: 827594 - RNA, 19 nt, Homo sapiens
uaggugugauucugauuua

SEQ ID NO: 827595 - RNA, 19 nt, Homo sapiens
caaacaauaucagaagaga

SEQ ID NO: 827596 - RNA, 19 nt, Homo sapiens
ccaaacaauuccaaacaau

SEQ ID NO: 827597 - RNA, 19 nt, Homo sapiens
gaaacaaccuaaagaugcu

SEQ ID NO: 827598 - RNA, 19 nt, Homo sapiens
ccuuaaagaccuagaaaua

SEQ ID NO: 827599 - RNA, 19 nt, Homo sapiens
gaggaacgagacaagauua

SEQ ID NO: 827600 - RNA, 19 nt, Homo sapiens
gccagaaaguucaagugua

SEQ ID NO: 827601 - RNA, 19 nt, Homo sapiens
gaguuggaguugcuacuaa

SEQ ID NO: 827602 - RNA, 19 nt, Homo sapiens
gauauuacgauguugcuaa

SEQ ID NO: 827603 - RNA, 19 nt, Homo sapiens
ucaguacuaugacgaauau

SEQ ID NO: 827604 - RNA, 19 nt, Homo sapiens
gccaugaaguugagaauag

SEQ ID NO: 827605 - RNA, 19 nt, Homo sapiens
cauagaaguucgaagaugu

SEQ ID NO: 827606 - RNA, 19 nt, Homo sapiens
gaagucaucuuuuguuuca

SEQ ID NO: 827607 - RNA, 19 nt, Homo sapiens
gcaaaucaaagcaaacaga

SEQ ID NO: 827608 - RNA, 19 nt, Homo sapiens
guaugacucugacuuuaug

SEQ ID NO: 827609 - RNA, 19 nt, Homo sapiens
guaaguaacagaucacaau

SEQ ID NO: 827610 - RNA, 19 nt, Homo sapiens
guaauaaagcacaacauga

SEQ ID NO: 827611 - RNA, 19 nt, Homo sapiens
ccaaacacauacaggaaga

SEQ ID NO: 827612 - RNA, 19 nt, Homo sapiens
gaaccaagagcuaaagcaa

SEQ ID NO: 827613 - RNA, 19 nt, Homo sapiens
guagagaaaccauauggaa

SEQ ID NO: 827614 - RNA, 19 nt, Homo sapiens
gaagaggcucaaucuguaa

SEQ ID NO: 827615 - RNA, 19 nt, Homo sapiens
gagaggugccuuuaucuga

SEQ ID NO: 827616 - RNA, 19 nt, Homo sapiens
gaaguaaacuggaagauau

SEQ ID NO: 827617 - RNA, 19 nt, Homo sapiens
auaaggagcuuguuucaua

SEQ ID NO: 827618 - RNA, 19 nt, Homo sapiens
gaagaaccuuacuaugaua

SEQ ID NO: 827619 - RNA, 19 nt, Homo sapiens
gcaacuacauugaauauca

SEQ ID NO: 827620 - RNA, 19 nt, Homo sapiens
gaaacuggaugacuauaga

SEQ ID NO: 827621 - RNA, 19 nt, Homo sapiens
uaacuccgguugauaaauu

SEQ ID NO: 827622 - RNA, 19 nt, Homo sapiens
cagaagaaccuuacuauga

SEQ ID NO: 827623 - RNA, 19 nt, Homo sapiens
gcaacuccuuuacaucaua

SEQ ID NO: 827624 - RNA, 19 nt, Homo sapiens
uauggaagguacucauuua

SEQ ID NO: 827625 - RNA, 19 nt, Homo sapiens
caaugugccucauauuaaa

SEQ ID NO: 827626 - RNA, 19 nt, Homo sapiens
gaaacaaggcaaacacauu

SEQ ID NO: 827627 - RNA, 19 nt, Homo sapiens
aaacuacucuggauaaauc

SEQ ID NO: 827628 - RNA, 19 nt, Homo sapiens
gaauacaggaucacaguuu

SEQ ID NO: 827629 - RNA, 19 nt, Homo sapiens
gaugaaccuuaauccuuua

SEQ ID NO: 827630 - RNA, 19 nt, Homo sapiens
uauaaucucuccucugcua

SEQ ID NO: 827631 - RNA, 19 nt, Homo sapiens
ugaagcguauguugaauuu

SEQ ID NO: 827632 - RNA, 19 nt, Homo sapiens
gaaccuuaauccuuuacaa

SEQ ID NO: 827633 - RNA, 19 nt, Homo sapiens
gaaucuuguugacuacaua

SEQ ID NO: 827634 - RNA, 19 nt, Homo sapiens
gacaauaccgcuaagcuaa

SEQ ID NO: 827635 - RNA, 19 nt, Homo sapiens
ggaauguggauaaauguaa

SEQ ID NO: 827636 - RNA, 19 nt, Homo sapiens
aaacaaggcaaacacauuu

SEQ ID NO: 827637 - RNA, 19 nt, Homo sapiens
ggaggcaacuacauugaau

SEQ ID NO: 827638 - RNA, 19 nt, Homo sapiens
gaugaaggagccauaagua

SEQ ID NO: 827639 - RNA, 19 nt, Homo sapiens
gacaagaaacuucgagaaa

SEQ ID NO: 827640 - RNA, 19 nt, Homo sapiens
ggaagaugauauguuugua

SEQ ID NO: 827641 - RNA, 19 nt, Homo sapiens
agaagaaccuuacuaugau

SEQ ID NO: 827642 - RNA, 19 nt, Homo sapiens
agaugaaccuuaauccuuu

SEQ ID NO: 827643 - RNA, 19 nt, Homo sapiens
gagaugaaccuuaauccuu

SEQ ID NO: 827644 - RNA, 19 nt, Homo sapiens
gaacauauaaaggcaagaa

SEQ ID NO: 827645 - RNA, 19 nt, Homo sapiens
gaugaggucaaacgacuua

SEQ ID NO: 827646 - RNA, 19 nt, Homo sapiens
uaaguaugcuuucugacaa

SEQ ID NO: 827647 - RNA, 19 nt, Homo sapiens
ucaaugugccucauauuaa

SEQ ID NO: 827648 - RNA, 19 nt, Homo sapiens
caucagcuguuaguucuuu

SEQ ID NO: 827649 - RNA, 19 nt, Homo sapiens
aaacaggguuaauuuggaa

SEQ ID NO: 827650 - RNA, 19 nt, Homo sapiens
uaaacaggguuaauuugga

SEQ ID NO: 827651 - RNA, 19 nt, Homo sapiens
cagaaucaguucagcaaga

SEQ ID NO: 827652 - RNA, 19 nt, Homo sapiens
ugacagauuuggccaagau

SEQ ID NO: 827653 - RNA, 19 nt, Homo sapiens
ggacaaaaguaacacagaa

SEQ ID NO: 827654 - RNA, 19 nt, Homo sapiens
gagguuguuucuuaucuau

SEQ ID NO: 827655 - RNA, 19 nt, Homo sapiens
gcaaacacauuuuauaugg

SEQ ID NO: 827656 - RNA, 19 nt, Homo sapiens
uuauggagaugaagucaaa

SEQ ID NO: 827657 - RNA, 19 nt, Homo sapiens
gaagaugaaggagccauaa

SEQ ID NO: 827658 - RNA, 19 nt, Homo sapiens
ggaaauggaaacuguuaug

SEQ ID NO: 827659 - RNA, 19 nt, Homo sapiens
gccaggaucuucgaaauca

SEQ ID NO: 827660 - RNA, 19 nt, Homo sapiens
augcagagaugaaccuuaa

SEQ ID NO: 827661 - RNA, 19 nt, Homo sapiens
aaacauagauuuggcaacu

SEQ ID NO: 827662 - RNA, 19 nt, Homo sapiens
uauguuuccuucucuguaa

SEQ ID NO: 827663 - RNA, 19 nt, Homo sapiens
gcaauauguuuccuucucu

SEQ ID NO: 827664 - RNA, 19 nt, Homo sapiens
caucauacuuggacauauc

SEQ ID NO: 827665 - RNA, 19 nt, Homo sapiens
ugacagaaacauagauuug

SEQ ID NO: 827666 - RNA, 19 nt, Homo sapiens
gaaacuagacaagaaacuu

SEQ ID NO: 827667 - RNA, 19 nt, Homo sapiens
acacggaaauggaaacugu

SEQ ID NO: 827668 - RNA, 19 nt, Homo sapiens
gccauuaacaggccagaua

SEQ ID NO: 827669 - RNA, 19 nt, Homo sapiens
gaaccuuacuaugauaauc

SEQ ID NO: 827670 - RNA, 19 nt, Homo sapiens
cagugaaacuagacaagaa

SEQ ID NO: 827671 - RNA, 19 nt, Homo sapiens
uaaggagcuuguuucauau

SEQ ID NO: 827672 - RNA, 19 nt, Homo sapiens
ugccagaacuccuugagaa

SEQ ID NO: 827673 - RNA, 19 nt, Homo sapiens
ggaagaugaaggagccaua

SEQ ID NO: 827674 - RNA, 19 nt, Homo sapiens
aaacuguuauggacacuau

SEQ ID NO: 827675 - RNA, 19 nt, Homo sapiens
gagauccuauuccagaugu

SEQ ID NO: 827676 - RNA, 19 nt, Homo sapiens
gcucaguucccagaaauaa

SEQ ID NO: 827677 - RNA, 19 nt, Homo sapiens
gcaaaacuacucuggauaa

SEQ ID NO: 827678 - RNA, 19 nt, Homo sapiens
acaggaagaugaggucaaa

SEQ ID NO: 827679 - RNA, 19 nt, Homo sapiens
ggaggaggcaacuacauug

SEQ ID NO: 827680 - RNA, 19 nt, Homo sapiens
gcaagaaaauuggauguau

SEQ ID NO: 827681 - RNA, 19 nt, Homo sapiens
gauaaucuacuuggaaugu

SEQ ID NO: 827682 - RNA, 19 nt, Homo sapiens
gcaggaacuccagaagaua

SEQ ID NO: 827683 - RNA, 19 nt, Homo sapiens
ggacauaucaagcauuggu

SEQ ID NO: 827684 - RNA, 19 nt, Homo sapiens
gcagaaaugguagcaguga

SEQ ID NO: 827685 - RNA, 19 nt, Homo sapiens
uaacacaaguagccaaggu

SEQ ID NO: 827686 - RNA, 19 nt, Homo sapiens
gaauaucagaaucuuguug

SEQ ID NO: 827687 - RNA, 19 nt, Homo sapiens
ucuaagagaugcaagaaac

SEQ ID NO: 827688 - RNA, 19 nt, Homo sapiens
cuacuuggaauguggauaa

SEQ ID NO: 827689 - RNA, 19 nt, Homo sapiens
gggaggaggcaacuacauu

SEQ ID NO: 827690 - RNA, 19 nt, Homo sapiens
aggcugauuuggagcaaua

SEQ ID NO: 827691 - RNA, 19 nt, Homo sapiens
caagaaacuucgagaaaau

SEQ ID NO: 827692 - RNA, 19 nt, Homo sapiens
agaaguaaacuggaagaua

SEQ ID NO: 827693 - RNA, 19 nt, Homo sapiens
cagauuuggccaagauaua

SEQ ID NO: 827694 - RNA, 19 nt, Homo sapiens
gcacuaccacuaaaccaau

SEQ ID NO: 827695 - RNA, 19 nt, Homo sapiens
gcagagaugaaccuuaauc

SEQ ID NO: 827696 - RNA, 19 nt, Homo sapiens
caggaacuccagaagauaa

SEQ ID NO: 827697 - RNA, 19 nt, Homo sapiens
uggaagauauugcaaaugc

SEQ ID NO: 827698 - RNA, 19 nt, Homo sapiens
uaacugaugcagagaugaa

SEQ ID NO: 827699 - RNA, 19 nt, Homo sapiens
ugacaauaccgcuaagcua

SEQ ID NO: 827700 - RNA, 19 nt, Homo sapiens
guauggaagguacucauuu

SEQ ID NO: 827701 - RNA, 19 nt, Homo sapiens
gcagugaaacuagacaaga

SEQ ID NO: 827702 - RNA, 19 nt, Homo sapiens
uuucauaucgugccauuaa

SEQ ID NO: 827703 - RNA, 19 nt, Homo sapiens
gaucuucgaaaucaacuau

SEQ ID NO: 827704 - RNA, 19 nt, Homo sapiens
gcaguauacuuuguaaugc

SEQ ID NO: 827705 - RNA, 19 nt, Homo sapiens
guaacaguguccuaacagu

SEQ ID NO: 827706 - RNA, 19 nt, Homo sapiens
cagcacaggagaaccagua

SEQ ID NO: 827707 - RNA, 19 nt, Homo sapiens
gagcaaaacuacucuggau

SEQ ID NO: 827708 - RNA, 19 nt, Homo sapiens
cccagaaguugcagaauca

SEQ ID NO: 827709 - RNA, 19 nt, Homo sapiens
uaacaggccagauaucaca

SEQ ID NO: 827710 - RNA, 19 nt, Homo sapiens
guuagaagagcaauauguu

SEQ ID NO: 827711 - RNA, 19 nt, Homo sapiens
cagcucaguucccagaaau

SEQ ID NO: 827712 - RNA, 19 nt, Homo sapiens
cuggaugacuauagauauu

SEQ ID NO: 827713 - RNA, 19 nt, Homo sapiens
agaaucaguucagcaagaa

SEQ ID NO: 827714 - RNA, 19 nt, Homo sapiens
gaaguccauucccagaagu

SEQ ID NO: 827715 - RNA, 19 nt, Homo sapiens
ucacagacacggaaaugga

SEQ ID NO: 827716 - RNA, 19 nt, Homo sapiens
gaaguaaacuggaagauau

SEQ ID NO: 827717 - RNA, 19 nt, Homo sapiens
auaaggagcuuguuucaua

SEQ ID NO: 827718 - RNA, 19 nt, Homo sapiens
gaagaaccuuacuaugaua

SEQ ID NO: 827719 - RNA, 19 nt, Homo sapiens
gcaacuacauugaauauca

SEQ ID NO: 827720 - RNA, 19 nt, Homo sapiens
uaacuccgguugauaaauu

SEQ ID NO: 827721 - RNA, 19 nt, Homo sapiens
cagaagaaccuuacuauga

SEQ ID NO: 827722 - RNA, 19 nt, Homo sapiens
gcaacuccuuuacaucaua

SEQ ID NO: 827723 - RNA, 19 nt, Homo sapiens
uauggaagguacucauuua

SEQ ID NO: 827724 - RNA, 19 nt, Homo sapiens
caaugugccucauauuaaa

SEQ ID NO: 827725 - RNA, 19 nt, Homo sapiens
gaaacaaggcaaacacauu

SEQ ID NO: 827726 - RNA, 19 nt, Homo sapiens
aaacuacucuggauaaauc

SEQ ID NO: 827727 - RNA, 19 nt, Homo sapiens
gaauacaggaucacaguuu

SEQ ID NO: 827728 - RNA, 19 nt, Homo sapiens
gaagauaacaugagguugu

SEQ ID NO: 827729 - RNA, 19 nt, Homo sapiens
uauaaucucuccucugcua

SEQ ID NO: 827730 - RNA, 19 nt, Homo sapiens
ugaagcguauguugaauuu

SEQ ID NO: 827731 - RNA, 19 nt, Homo sapiens
gaaucuuguugacuacaua

SEQ ID NO: 827732 - RNA, 19 nt, Homo sapiens
gacaauaccgcuaagcuaa

SEQ ID NO: 827733 - RNA, 19 nt, Homo sapiens
ggaauguggauaaauguaa

SEQ ID NO: 827734 - RNA, 19 nt, Homo sapiens
aaacaaggcaaacacauuu

SEQ ID NO: 827735 - RNA, 19 nt, Homo sapiens
ggaggcaacuacauugaau

SEQ ID NO: 827736 - RNA, 19 nt, Homo sapiens
gaugaaggagccauaagua

SEQ ID NO: 827737 - RNA, 19 nt, Homo sapiens
gacaagaaacuucgagaaa

SEQ ID NO: 827738 - RNA, 19 nt, Homo sapiens
ggaagaugauauguuugua

SEQ ID NO: 827739 - RNA, 19 nt, Homo sapiens
agaagaaccuuacuaugau

SEQ ID NO: 827740 - RNA, 19 nt, Homo sapiens
gaacauauaaaggcaagaa

SEQ ID NO: 827741 - RNA, 19 nt, Homo sapiens
gaugaggucaaacgacuua

SEQ ID NO: 827742 - RNA, 19 nt, Homo sapiens
ucaaugugccucauauuaa

SEQ ID NO: 827743 - RNA, 19 nt, Homo sapiens
uaaguaugcuuucugacaa

SEQ ID NO: 827744 - RNA, 19 nt, Homo sapiens
caucagcuguuaguucuuu

SEQ ID NO: 827745 - RNA, 19 nt, Homo sapiens
aaacaggguuaauuuggaa

SEQ ID NO: 827746 - RNA, 19 nt, Homo sapiens
uaaacaggguuaauuugga

SEQ ID NO: 827747 - RNA, 19 nt, Homo sapiens
cagaaucaguucagcaaga

SEQ ID NO: 827748 - RNA, 19 nt, Homo sapiens
cgaaacugaugacuauaga

SEQ ID NO: 827749 - RNA, 19 nt, Homo sapiens
ugacagauuuggccaagau

SEQ ID NO: 827750 - RNA, 19 nt, Homo sapiens
ggacaaaaguaacacagaa

SEQ ID NO: 827751 - RNA, 19 nt, Homo sapiens
gagguuguuucuuaucuau

SEQ ID NO: 827752 - RNA, 19 nt, Homo sapiens
gcaaacacauuuuauaugg

SEQ ID NO: 827753 - RNA, 19 nt, Homo sapiens
uuauggagaugaagucaaa

SEQ ID NO: 827754 - RNA, 19 nt, Homo sapiens
gaagaugaaggagccauaa

SEQ ID NO: 827755 - RNA, 19 nt, Homo sapiens
ggaaauggaaacuguuaug

SEQ ID NO: 827756 - RNA, 19 nt, Homo sapiens
gccaggaucuucgaaauca

SEQ ID NO: 827757 - RNA, 19 nt, Homo sapiens
aaacauagauuuggcaacu

SEQ ID NO: 827758 - RNA, 19 nt, Homo sapiens
uauguuuccuucucuguaa

SEQ ID NO: 827759 - RNA, 19 nt, Homo sapiens
gcaauauguuuccuucucu

SEQ ID NO: 827760 - RNA, 19 nt, Homo sapiens
caucauacuuggacauauc

SEQ ID NO: 827761 - RNA, 19 nt, Homo sapiens
ugacagaaacauagauuug

SEQ ID NO: 827762 - RNA, 19 nt, Homo sapiens
gaaacuagacaagaaacuu

SEQ ID NO: 827763 - RNA, 19 nt, Homo sapiens
acacggaaauggaaacugu

SEQ ID NO: 827764 - RNA, 19 nt, Homo sapiens
gccauuaacaggccagaua

SEQ ID NO: 827765 - RNA, 19 nt, Homo sapiens
gaaccuuacuaugauaauc

SEQ ID NO: 827766 - RNA, 19 nt, Homo sapiens
cagugaaacuagacaagaa

SEQ ID NO: 827767 - RNA, 19 nt, Homo sapiens
uaaggagcuuguuucauau

SEQ ID NO: 827768 - RNA, 19 nt, Homo sapiens
ugccagaacuccuugagaa

SEQ ID NO: 827769 - RNA, 19 nt, Homo sapiens
ggaagaugaaggagccaua

SEQ ID NO: 827770 - RNA, 19 nt, Homo sapiens
aaacuguuauggacacuau

SEQ ID NO: 827771 - RNA, 19 nt, Homo sapiens
gagauccuauuccagaugu

SEQ ID NO: 827772 - RNA, 19 nt, Homo sapiens
gcucaguucccagaaauaa

SEQ ID NO: 827773 - RNA, 19 nt, Homo sapiens
gcaaaacuacucuggauaa

SEQ ID NO: 827774 - RNA, 19 nt, Homo sapiens
acaggaagaugaggucaaa

SEQ ID NO: 827775 - RNA, 19 nt, Homo sapiens
ggaggaggcaacuacauug

SEQ ID NO: 827776 - RNA, 19 nt, Homo sapiens
gcaagaaaauuggauguau

SEQ ID NO: 827777 - RNA, 19 nt, Homo sapiens
gauaaucuacuuggaaugu

SEQ ID NO: 827778 - RNA, 19 nt, Homo sapiens
gcaggaacuccagaagaua

SEQ ID NO: 827779 - RNA, 19 nt, Homo sapiens
ggacauaucaagcauuggu

SEQ ID NO: 827780 - RNA, 19 nt, Homo sapiens
gcagaaaugguagcaguga

SEQ ID NO: 827781 - RNA, 19 nt, Homo sapiens
uaacacaaguagccaaggu

SEQ ID NO: 827782 - RNA, 19 nt, Homo sapiens
gaauaucagaaucuuguug

SEQ ID NO: 827783 - RNA, 19 nt, Homo sapiens
ucuaagagaugcaagaaac

SEQ ID NO: 827784 - RNA, 19 nt, Homo sapiens
cagauuuggccaagauaua

SEQ ID NO: 827785 - RNA, 19 nt, Homo sapiens
cuacuuggaauguggauaa

SEQ ID NO: 827786 - RNA, 19 nt, Homo sapiens
gggaggaggcaacuacauu

SEQ ID NO: 827787 - RNA, 19 nt, Homo sapiens
aggcugauuuggagcaaua

SEQ ID NO: 827788 - RNA, 19 nt, Homo sapiens
caagaaacuucgagaaaau

SEQ ID NO: 827789 - RNA, 19 nt, Homo sapiens
agaaguaaacuggaagaua

SEQ ID NO: 827790 - RNA, 19 nt, Homo sapiens
gcacuaccacuaaaccaau

SEQ ID NO: 827791 - RNA, 19 nt, Homo sapiens
caggaacuccagaagauaa

SEQ ID NO: 827792 - RNA, 19 nt, Homo sapiens
uggaagauauugcaaaugc

SEQ ID NO: 827793 - RNA, 19 nt, Homo sapiens
guauggaagguacucauuu

SEQ ID NO: 827794 - RNA, 19 nt, Homo sapiens
ugacaauaccgcuaagcua

SEQ ID NO: 827795 - RNA, 19 nt, Homo sapiens
gcagugaaacuagacaaga

SEQ ID NO: 827796 - RNA, 19 nt, Homo sapiens
uuucauaucgugccauuaa

SEQ ID NO: 827797 - RNA, 19 nt, Homo sapiens
gaucuucgaaaucaacuau

SEQ ID NO: 827798 - RNA, 19 nt, Homo sapiens
gcaguauacuuuguaaugc

SEQ ID NO: 827799 - RNA, 19 nt, Homo sapiens
guaacaguguccuaacagu

SEQ ID NO: 827800 - RNA, 19 nt, Homo sapiens
gagcaaaacuacucuggau

SEQ ID NO: 827801 - RNA, 19 nt, Homo sapiens
cagcacaggagaaccagua

SEQ ID NO: 827802 - RNA, 19 nt, Homo sapiens
cccagaaguugcagaauca

SEQ ID NO: 827803 - RNA, 19 nt, Homo sapiens
uaacaggccagauaucaca

SEQ ID NO: 827804 - RNA, 19 nt, Homo sapiens
guuagaagagcaauauguu

SEQ ID NO: 827805 - RNA, 19 nt, Homo sapiens
cagcucaguucccagaaau

SEQ ID NO: 827806 - RNA, 19 nt, Homo sapiens
cagaagauaacaugagguu

SEQ ID NO: 827807 - RNA, 19 nt, Homo sapiens
agaaucaguucagcaagaa

SEQ ID NO: 827808 - RNA, 19 nt, Homo sapiens
gaaguccauucccagaagu

SEQ ID NO: 827809 - RNA, 19 nt, Homo sapiens
ucacagacacggaaaugga

SEQ ID NO: 827810 - RNA, 19 nt, Homo sapiens
uagaagagcaauauguuuc

SEQ ID NO: 827811 - RNA, 19 nt, Homo sapiens
cuuggaauguggauaaaug

SEQ ID NO: 827812 - RNA, 19 nt, Homo sapiens
gggaaucacucugcaucug

SEQ ID NO: 827813 - RNA, 19 nt, Homo sapiens
ugagguuguuucuuaucua

SEQ ID NO: 827814 - RNA, 19 nt, Homo sapiens
caauaccgcuaagcuaaca

SEQ ID NO: 827815 - RNA, 19 nt, Homo sapiens
ugaaggagcuaagagacau

SEQ ID NO: 827816 - RNA, 19 nt, Homo sapiens
gaacggaucuccuuauuua

SEQ ID NO: 827817 - RNA, 19 nt, Homo sapiens
gaaguaagauacccuguua

SEQ ID NO: 827818 - RNA, 19 nt, Homo sapiens
gaagaacgcuuucauguug

SEQ ID NO: 827819 - RNA, 19 nt, Homo sapiens
gcauuuauguguucacuua

SEQ ID NO: 827820 - RNA, 19 nt, Homo sapiens
guacugauguuaagguuua

SEQ ID NO: 827821 - RNA, 19 nt, Homo sapiens
ugacauauaugcugcaaua

SEQ ID NO: 827822 - RNA, 19 nt, Homo sapiens
caucagauauucagcuuua

SEQ ID NO: 827823 - RNA, 19 nt, Homo sapiens
gauccuaaaucaucagaua

SEQ ID NO: 827824 - RNA, 19 nt, Homo sapiens
gaacuuagaugugucauag

SEQ ID NO: 827825 - RNA, 19 nt, Homo sapiens
uaacuucacugucuuugua

SEQ ID NO: 827826 - RNA, 19 nt, Homo sapiens
gcuuaaagauugagcauuu

SEQ ID NO: 827827 - RNA, 19 nt, Homo sapiens
guaaggaacuguugucaug

SEQ ID NO: 827828 - RNA, 19 nt, Homo sapiens
gaaacgagcuauggauuau

SEQ ID NO: 827829 - RNA, 19 nt, Homo sapiens
ggagagaaguauauaguau

SEQ ID NO: 827830 - RNA, 19 nt, Homo sapiens
ggaagaucauguagaagua

SEQ ID NO: 827831 - RNA, 19 nt, Homo sapiens
gcaaugauaucuaagaaca

SEQ ID NO: 827832 - RNA, 19 nt, Homo sapiens
gaagaccugugauaaaguu

SEQ ID NO: 827833 - RNA, 19 nt, Homo sapiens
guucuuauguuucuccuua

SEQ ID NO: 827834 - RNA, 19 nt, Homo sapiens
gcaaguggaugaauuucuu

SEQ ID NO: 827835 - RNA, 19 nt, Homo sapiens
gaaauuuccucuacagcuu

SEQ ID NO: 827836 - RNA, 19 nt, Homo sapiens
ggaaacgagcuauggauua

SEQ ID NO: 827837 - RNA, 19 nt, Homo sapiens
gaagauaucccaauuguac

SEQ ID NO: 827838 - RNA, 19 nt, Homo sapiens
ggacaaagcgguugccuau

SEQ ID NO: 827839 - RNA, 19 nt, Homo sapiens
gaacagaagcagaauccua

SEQ ID NO: 827840 - RNA, 19 nt, Homo sapiens
ggaagacggcuacaaauga

SEQ ID NO: 827841 - RNA, 19 nt, Homo sapiens
caaauaaucccaaagaaug

SEQ ID NO: 827842 - RNA, 19 nt, Homo sapiens
ccaaagagauuucauuaac

SEQ ID NO: 827843 - RNA, 19 nt, Homo sapiens
caccuaaccuacaggauua

SEQ ID NO: 827844 - RNA, 19 nt, Homo sapiens
ucaaugagcucaacuacau

SEQ ID NO: 827845 - RNA, 19 nt, Homo sapiens
gaagauugcuguaucaacu

SEQ ID NO: 827846 - RNA, 19 nt, Homo sapiens
ggaagcauuucucuuauca

SEQ ID NO: 827847 - RNA, 19 nt, Homo sapiens
cuacagacaugaccucaaa

SEQ ID NO: 827848 - RNA, 19 nt, Homo sapiens
cagaagaucacaauguuua

SEQ ID NO: 827849 - RNA, 19 nt, Homo sapiens
gcaaagaaauccaaaucca

SEQ ID NO: 827850 - RNA, 19 nt, Homo sapiens
gaagggauauugaaaucau

SEQ ID NO: 827851 - RNA, 19 nt, Homo sapiens
uaaagcaaguggaugaauu

SEQ ID NO: 827852 - RNA, 19 nt, Homo sapiens
gaacuaugauggaacuuag

SEQ ID NO: 827853 - RNA, 19 nt, Homo sapiens
gaagacggcuacaaaugau

SEQ ID NO: 827854 - RNA, 19 nt, Homo sapiens
guacuccucugguuagaaa

SEQ ID NO: 827855 - RNA, 19 nt, Homo sapiens
gcauaaugguuccuugaaa

SEQ ID NO: 827856 - RNA, 19 nt, Homo sapiens
guaagaagauugcuguauc

SEQ ID NO: 827857 - RNA, 19 nt, Homo sapiens
guaaacaguugaauguaug

SEQ ID NO: 827858 - RNA, 19 nt, Homo sapiens
gauugcaucuuagcuguua

SEQ ID NO: 827859 - RNA, 19 nt, Homo sapiens
gagcugugauauuguuuaa

SEQ ID NO: 827860 - RNA, 19 nt, Homo sapiens
caacugaagucucuugaca

SEQ ID NO: 827861 - RNA, 19 nt, Homo sapiens
cauaaugcccuaucuuuaa

SEQ ID NO: 827862 - RNA, 19 nt, Homo sapiens
gaagcagaauccuacugua

SEQ ID NO: 827863 - RNA, 19 nt, Homo sapiens
ggcaaggcuucaugaaaua

SEQ ID NO: 827864 - RNA, 19 nt, Homo sapiens
cgagagaaauuaauugcuu

SEQ ID NO: 827865 - RNA, 19 nt, Homo sapiens
caaaugggacaaucugaua

SEQ ID NO: 827866 - RNA, 19 nt, Homo sapiens
gacaugaccucaaaauaua

SEQ ID NO: 827867 - RNA, 19 nt, Homo sapiens
gcuaauauauggagaaugc

SEQ ID NO: 827868 - RNA, 19 nt, Homo sapiens
caacaaugaagcaaugaua

SEQ ID NO: 827869 - RNA, 19 nt, Homo sapiens
gggacaaucugauaagaau

SEQ ID NO: 827870 - RNA, 19 nt, Homo sapiens
guaccuggcugcauuauac

SEQ ID NO: 827871 - RNA, 19 nt, Homo sapiens
agaacuugcuccacaauuu

SEQ ID NO: 827872 - RNA, 19 nt, Homo sapiens
cuaaagaagucaguucaaa

SEQ ID NO: 827873 - RNA, 19 nt, Homo sapiens
gaauaucuuucccaauugu

SEQ ID NO: 827874 - RNA, 19 nt, Homo sapiens
gagauuucauuaaccguuu

SEQ ID NO: 827875 - RNA, 19 nt, Homo sapiens
ggaagauccuaaaucauca

SEQ ID NO: 827876 - RNA, 19 nt, Homo sapiens
gaaguauuaugaugacugu

SEQ ID NO: 827877 - RNA, 19 nt, Homo sapiens
gggaacaaaucacuucuuc

SEQ ID NO: 827878 - RNA, 19 nt, Homo sapiens
gaauaaaucguaagguuca

SEQ ID NO: 827879 - RNA, 19 nt, Homo sapiens
ugaagucucuugacaaaca

SEQ ID NO: 827880 - RNA, 19 nt, Homo sapiens
caagaaagcaguaacuuca

SEQ ID NO: 827881 - RNA, 19 nt, Homo sapiens
gaagaccgcugaaauuucc

SEQ ID NO: 827882 - RNA, 19 nt, Homo sapiens
gcaccuaaccuacaggauu

SEQ ID NO: 827883 - RNA, 19 nt, Homo sapiens
gaagugagacaucagaaau

SEQ ID NO: 827884 - RNA, 19 nt, Homo sapiens
gaagaggcgugacggagau

SEQ ID NO: 827885 - RNA, 19 nt, Homo sapiens
gaugaugacacuguaaaua

SEQ ID NO: 827886 - RNA, 19 nt, Homo sapiens
gauauucagcuuuaccaua

SEQ ID NO: 827887 - RNA, 19 nt, Homo sapiens
ggauauaaaucagggaaau

SEQ ID NO: 827888 - RNA, 19 nt, Homo sapiens
uaagaagauugcuguauca

SEQ ID NO: 827889 - RNA, 19 nt, Homo sapiens
gaacucuuguggaacagaa

SEQ ID NO: 827890 - RNA, 19 nt, Homo sapiens
caacagucaucauaauauc

SEQ ID NO: 827891 - RNA, 19 nt, Homo sapiens
gcuuucacauccaguauuu

SEQ ID NO: 827892 - RNA, 19 nt, Homo sapiens
uaucagagccaauucauau

SEQ ID NO: 827893 - RNA, 19 nt, Homo sapiens
cauaaugguuccuugaaau

SEQ ID NO: 827894 - RNA, 19 nt, Homo sapiens
gagcuuacacccauucuug

SEQ ID NO: 827895 - RNA, 19 nt, Homo sapiens
gguccaggcugaagaacuu

SEQ ID NO: 827896 - RNA, 19 nt, Homo sapiens
ggaacuaugauggaacuua

SEQ ID NO: 827897 - RNA, 19 nt, Homo sapiens
gaagcaaugauaucuaaga

SEQ ID NO: 827898 - RNA, 19 nt, Homo sapiens
cagccaggguuacauauug

SEQ ID NO: 827899 - RNA, 19 nt, Homo sapiens
gucaugaucuggaaauguu

SEQ ID NO: 827900 - RNA, 19 nt, Homo sapiens
caggagaccuuuuaaaauu

SEQ ID NO: 827901 - RNA, 19 nt, Homo sapiens
aauggaagauccuaaauca

SEQ ID NO: 827902 - RNA, 19 nt, Homo sapiens
aaucagacaucgaauggaa

SEQ ID NO: 827903 - RNA, 19 nt, Homo sapiens
uggaauaaaucguaagguu

SEQ ID NO: 827904 - RNA, 19 nt, Homo sapiens
ugucauagcuguuauacgu

SEQ ID NO: 827905 - RNA, 19 nt, Homo sapiens
gacuuaaacuguaauccaa

SEQ ID NO: 827906 - RNA, 19 nt, Homo sapiens
gcugugauuucaucuguga

SEQ ID NO: 827907 - RNA, 19 nt, Homo sapiens
guugacaaguguauaaaug

SEQ ID NO: 827908 - RNA, 19 nt, Homo sapiens
guauacaccugcaaagauc

SEQ ID NO: 827909 - RNA, 19 nt, Homo sapiens
uagaaacucuucauaaugc

SEQ ID NO: 827910 - RNA, 19 nt, Homo sapiens
gcaaugaaucaaaggauga

SEQ ID NO: 827911 - RNA, 19 nt, Homo sapiens
caaagucacagcaguaaug

SEQ ID NO: 827912 - RNA, 19 nt, Homo sapiens
gaacuguugucaugaucug

SEQ ID NO: 827913 - RNA, 19 nt, Homo sapiens
gugaagaccugugauaaag

SEQ ID NO: 827914 - RNA, 19 nt, Homo sapiens
gcaaauaugaacggucuuu

SEQ ID NO: 827915 - RNA, 19 nt, Homo sapiens
ccaaaccaaugaaggaaau

SEQ ID NO: 827916 - RNA, 19 nt, Homo sapiens
aaacagagcugcccaauga

SEQ ID NO: 827917 - RNA, 19 nt, Homo sapiens
cgacaucgcuuucaaauuc

SEQ ID NO: 827918 - RNA, 19 nt, Homo sapiens
ucaaggaaaugcugaaaua

SEQ ID NO: 827919 - RNA, 19 nt, Homo sapiens
caacaggccuucacaacaa

SEQ ID NO: 827920 - RNA, 19 nt, Homo sapiens
gcacggccaucgaaaguuu

SEQ ID NO: 827921 - RNA, 19 nt, Homo sapiens
gaagggagaugcuaagaag

SEQ ID NO: 827922 - RNA, 19 nt, Homo sapiens
ugaaggagcuggccagguu

SEQ ID NO: 827923 - RNA, 19 nt, Homo sapiens
ucaagaagcuggaagaaag

SEQ ID NO: 827924 - RNA, 19 nt, Homo sapiens
gagaugacuuuaagaugaa

SEQ ID NO: 827925 - RNA, 19 nt, Homo sapiens
agagaugacuuuaagauga

SEQ ID NO: 827926 - RNA, 19 nt, Homo sapiens
caauagagaugacuuuaag

SEQ ID NO: 827927 - RNA, 19 nt, Homo sapiens
agagaaagcuggaccacaa

SEQ ID NO: 827928 - RNA, 19 nt, Homo sapiens
caagaaggauguuuuguuu

SEQ ID NO: 827929 - RNA, 19 nt, Homo sapiens
ggaccgagcuggcugaaac

SEQ ID NO: 827930 - RNA, 19 nt, Homo sapiens
gagaaguacugucagaaca

SEQ ID NO: 827931 - RNA, 19 nt, Homo sapiens
gcaagaagagggaggagaa

SEQ ID NO: 827932 - RNA, 19 nt, Homo sapiens
gggcaaagcaucagcagaa

SEQ ID NO: 827933 - RNA, 19 nt, Homo sapiens
gcaacagccuggcgcaugu

SEQ ID NO: 827934 - RNA, 19 nt, Homo sapiens
acaaggaguuccagaaugu

SEQ ID NO: 827935 - RNA, 19 nt, Homo sapiens
gacaaggaguuccagaaug

SEQ ID NO: 827936 - RNA, 19 nt, Homo sapiens
gaaggugccggucauaaug

SEQ ID NO: 827937 - RNA, 19 nt, Homo sapiens
ggacaaggaguuccagaau

SEQ ID NO: 827938 - RNA, 19 nt, Homo sapiens
uggagaggauggaagauuu

SEQ ID NO: 827939 - RNA, 19 nt, Homo sapiens
gcaccucugugaccaguuc

SEQ ID NO: 827940 - RNA, 19 nt, Homo sapiens
ucaaaggucagaaagguaa

SEQ ID NO: 827941 - RNA, 19 nt, Homo sapiens
gcuacaagcaguccuuaaa

SEQ ID NO: 827942 - RNA, 19 nt, Homo sapiens
gcugcaggcuuguagagaa

SEQ ID NO: 827943 - RNA, 19 nt, Homo sapiens
aaacauggaggaaaucuau

SEQ ID NO: 827944 - RNA, 19 nt, Homo sapiens
ucaacgcgauuuacaagga

SEQ ID NO: 827945 - RNA, 19 nt, Homo sapiens
agaggaaacucaaggaaca

SEQ ID NO: 827946 - RNA, 19 nt, Homo sapiens
ucagggagcuggaaaacua

SEQ ID NO: 827947 - RNA, 19 nt, Homo sapiens
caaggaacaucaagaagcu

SEQ ID NO: 827948 - RNA, 19 nt, Homo sapiens
gaaguacugucagaacaag

SEQ ID NO: 827949 - RNA, 19 nt, Homo sapiens
gaagcccgguuaucaccuu

SEQ ID NO: 827950 - RNA, 19 nt, Homo sapiens
caacgcgauuuacaaggaa

SEQ ID NO: 827951 - RNA, 19 nt, Homo sapiens
uaccagacuuacacgguua

SEQ ID NO: 827952 - RNA, 19 nt, Homo sapiens
gcuaagaaguucgagaucu

SEQ ID NO: 827953 - RNA, 19 nt, Homo sapiens
ggaggaaaucuaucacuuc

SEQ ID NO: 827954 - RNA, 19 nt, Homo sapiens
ugcagaggaucaccaagua

SEQ ID NO: 827955 - RNA, 19 nt, Homo sapiens
gaaacauggaggaaaucua

SEQ ID NO: 827956 - RNA, 19 nt, Homo sapiens
gaaacagagcugcccaaug

SEQ ID NO: 827957 - RNA, 19 nt, Homo sapiens
gaagcuggaagaaaggaaa

SEQ ID NO: 827958 - RNA, 19 nt, Homo sapiens
uaugagaaguacugucaga

SEQ ID NO: 827959 - RNA, 19 nt, Homo sapiens
ugagggaccuggccagcuu

SEQ ID NO: 827960 - RNA, 19 nt, Homo sapiens
gcucugugcugccgacauc

SEQ ID NO: 827961 - RNA, 19 nt, Homo sapiens
cuaagaaguucgagaucug

SEQ ID NO: 827962 - RNA, 19 nt, Homo sapiens
ggcaaagcaucagcagaaa

SEQ ID NO: 827963 - RNA, 19 nt, Homo sapiens
gagcuccguaccagacuua

SEQ ID NO: 827964 - RNA, 19 nt, Homo sapiens
ccaugcaccucaucgcuau

SEQ ID NO: 827965 - RNA, 19 nt, Homo sapiens
uuacacgguuacaucgaua

SEQ ID NO: 827966 - RNA, 19 nt, Homo sapiens
cagcaucuuucccggcaaa

SEQ ID NO: 827967 - RNA, 19 nt, Homo sapiens
caaauggaccuccgugaag

SEQ ID NO: 827968 - RNA, 19 nt, Homo sapiens
gcgaggaggucuacaucgu

SEQ ID NO: 827969 - RNA, 19 nt, Homo sapiens
ccucaaaggucagaaaggu

SEQ ID NO: 827970 - RNA, 19 nt, Homo sapiens
gaaacucaaggaacaucaa

SEQ ID NO: 827971 - RNA, 19 nt, Homo sapiens
cgccaacuccugagauuaa

SEQ ID NO: 827972 - RNA, 19 nt, Homo sapiens
caagcaguccuuaaacaug

SEQ ID NO: 827973 - RNA, 19 nt, Homo sapiens
uacaagcaguccuuaaaca

SEQ ID NO: 827974 - RNA, 19 nt, Homo sapiens
ugcgaaaggucuuccagaa

SEQ ID NO: 827975 - RNA, 19 nt, Homo sapiens
ucagcgagauuccggacaa

SEQ ID NO: 827976 - RNA, 19 nt, Homo sapiens
gaacaucaagaagcuggaa

SEQ ID NO: 827977 - RNA, 19 nt, Homo sapiens
caagaggaaacucaaggaa

SEQ ID NO: 827978 - RNA, 19 nt, Homo sapiens
ugaccuaccucaccagcau

SEQ ID NO: 827979 - RNA, 19 nt, Homo sapiens
ccgcgugggugaaugaaau

SEQ ID NO: 827980 - RNA, 19 nt, Homo sapiens
uggaggaaaucuaucacuu

SEQ ID NO: 827981 - RNA, 19 nt, Homo sapiens
uccaggaaaucgagaaguu

SEQ ID NO: 827982 - RNA, 19 nt, Homo sapiens
gcgcaucgcagcaucuuuc

SEQ ID NO: 827983 - RNA, 19 nt, Homo sapiens
cagcaccagucccucaaga

SEQ ID NO: 827984 - RNA, 19 nt, Homo sapiens
ggaggucaaagccaucuug

SEQ ID NO: 827985 - RNA, 19 nt, Homo sapiens
acacagagaagaaggacaa

SEQ ID NO: 827986 - RNA, 19 nt, Homo sapiens
gaagcagacggcucagaug

SEQ ID NO: 827987 - RNA, 19 nt, Homo sapiens
gacggaagcccgguuauca

SEQ ID NO: 827988 - RNA, 19 nt, Homo sapiens
caaauucaauagagaugac

SEQ ID NO: 827989 - RNA, 19 nt, Homo sapiens
uccagaaugucaugaccua

SEQ ID NO: 827990 - RNA, 19 nt, Homo sapiens
ggucagaaagguaaaagua

SEQ ID NO: 827991 - RNA, 19 nt, Homo sapiens
gggagaugcuaagaaguuc

SEQ ID NO: 827992 - RNA, 19 nt, Homo sapiens
caaagcaucagcagaaacu

SEQ ID NO: 827993 - RNA, 19 nt, Homo sapiens
acaaggcgaaggaggauuu

SEQ ID NO: 827994 - RNA, 19 nt, Homo sapiens
aaaggacucucuccgacau

SEQ ID NO: 827995 - RNA, 19 nt, Homo sapiens
ggcgccaacuccugagauu

SEQ ID NO: 827996 - RNA, 19 nt, Homo sapiens
ccaagagugagaugaguga

SEQ ID NO: 827997 - RNA, 19 nt, Homo sapiens
gagcucaacgcgauuuaca

SEQ ID NO: 827998 - RNA, 19 nt, Homo sapiens
gacaucgcuuucaaauuca

SEQ ID NO: 827999 - RNA, 19 nt, Homo sapiens
acaaauggaccuccgugaa

SEQ ID NO: 828000 - RNA, 19 nt, Homo sapiens
gauucauccuggugauaga

SEQ ID NO: 828001 - RNA, 19 nt, Homo sapiens
gccaacuccugagauuaaa

SEQ ID NO: 828002 - RNA, 19 nt, Homo sapiens
cgacauccaggaccagcua

SEQ ID NO: 828003 - RNA, 19 nt, Homo sapiens
ccagaucuaugagaaguac

SEQ ID NO: 828004 - RNA, 19 nt, Homo sapiens
guuaucaccuucccugacu

SEQ ID NO: 828005 - RNA, 19 nt, Homo sapiens
ggagaggauggaagauuuc

SEQ ID NO: 828006 - RNA, 19 nt, Homo sapiens
ucacuuccacaacaggaua

SEQ ID NO: 828007 - RNA, 19 nt, Homo sapiens
gcgagcuccuggacacaga

SEQ ID NO: 828008 - RNA, 19 nt, Homo sapiens
gcucaacgcgauuuacaag

SEQ ID NO: 828009 - RNA, 19 nt, Homo sapiens
gauuugaggcuggcacuga

SEQ ID NO: 828010 - RNA, 19 nt, Homo sapiens
gcuuucaaauucaauagag

SEQ ID NO: 828011 - RNA, 19 nt, Homo sapiens
ccgaggcacuggcaaaguc

SEQ ID NO: 828012 - RNA, 19 nt, Homo sapiens
ucacagacaucggcaacag

SEQ ID NO: 828013 - RNA, 19 nt, Homo sapiens
ugaaggugccggucauaau

SEQ ID NO: 828014 - RNA, 19 nt, Homo sapiens
gcgccaacuccugagauua

SEQ ID NO: 828015 - RNA, 19 nt, Homo sapiens
gaugcuuucuggagaggau

SEQ ID NO: 828016 - RNA, 19 nt, Homo sapiens
gaaagaaggugauuuguau

SEQ ID NO: 828017 - RNA, 19 nt, Homo sapiens
gcaaagacaugauuaacaa

SEQ ID NO: 828018 - RNA, 19 nt, Homo sapiens
aaucauaccucuagucaua

SEQ ID NO: 828019 - RNA, 19 nt, Homo sapiens
ggaaagaaggugauuugua

SEQ ID NO: 828020 - RNA, 19 nt, Homo sapiens
uaaagaauuuggccagaaa

SEQ ID NO: 828021 - RNA, 19 nt, Homo sapiens
ggauucaaguccagaguuu

SEQ ID NO: 828022 - RNA, 19 nt, Homo sapiens
cauaaggucuaguaucuug

SEQ ID NO: 828023 - RNA, 19 nt, Homo sapiens
gaaggugauuuguauuugu

SEQ ID NO: 828024 - RNA, 19 nt, Homo sapiens
agucauagcauaccauuua

SEQ ID NO: 828025 - RNA, 19 nt, Homo sapiens
acacuguacuggccacuua

SEQ ID NO: 828026 - RNA, 19 nt, Homo sapiens
gaugaucuuuggagcuuaa

SEQ ID NO: 828027 - RNA, 19 nt, Homo sapiens
uaugagggcuaaagauaaa

SEQ ID NO: 828028 - RNA, 19 nt, Homo sapiens
gggaugcgauggucucuga

SEQ ID NO: 828029 - RNA, 19 nt, Homo sapiens
ccacugccauccauucgua

SEQ ID NO: 828030 - RNA, 19 nt, Homo sapiens
gcucgucccucucgucuga

SEQ ID NO: 828031 - RNA, 19 nt, Homo sapiens
ccacggcucuccugguuga

SEQ ID NO: 828032 - RNA, 19 nt, Homo sapiens
gagaucugcuuugacagua

SEQ ID NO: 828033 - RNA, 19 nt, Homo sapiens
ucagggaacuucuaaugga

SEQ ID NO: 828034 - RNA, 19 nt, Homo sapiens
gaucagggaacuucuaaug

SEQ ID NO: 828035 - RNA, 19 nt, Homo sapiens
ggacuacgcggacaucaug

SEQ ID NO: 828036 - RNA, 19 nt, Homo sapiens
gaucugcuuugacaguaaa

SEQ ID NO: 828037 - RNA, 19 nt, Homo sapiens
gcugggcaguaaucaauuu

SEQ ID NO: 828038 - RNA, 19 nt, Homo sapiens
acaaggaccucaaguacug

SEQ ID NO: 828039 - RNA, 19 nt, Homo sapiens
gcccaaccuuuccugauaa

SEQ ID NO: 828040 - RNA, 19 nt, Homo sapiens
gaaacuugcuucccuuagc

SEQ ID NO: 828041 - RNA, 19 nt, Homo sapiens
gggcaguaaucaauuuaau

SEQ ID NO: 828042 - RNA, 19 nt, Homo sapiens
aggcagagcugggaugaaa

SEQ ID NO: 828043 - RNA, 19 nt, Homo sapiens
gcagaugaaguuuguaugu

SEQ ID NO: 828044 - RNA, 19 nt, Homo sapiens
agaaagggcugcaguucau

SEQ ID NO: 828045 - RNA, 19 nt, Homo sapiens
gcaguaaucaauuuaaugg

SEQ ID NO: 828046 - RNA, 19 nt, Homo sapiens
agaagaauaugaggccuuu

SEQ ID NO: 828047 - RNA, 19 nt, Homo sapiens
gggcuaaagauaaagaauu

SEQ ID NO: 828048 - RNA, 19 nt, Homo sapiens
uaacuucugucugcuccua

SEQ ID NO: 828049 - RNA, 19 nt, Homo sapiens
gcuucagccuccagcuuua

SEQ ID NO: 828050 - RNA, 19 nt, Homo sapiens
uuaacaagcaggacuguaa

SEQ ID NO: 828051 - RNA, 19 nt, Homo sapiens
gggaacuucuaauggauug

SEQ ID NO: 828052 - RNA, 19 nt, Homo sapiens
ugcccaaccuuuccugaua

SEQ ID NO: 828053 - RNA, 19 nt, Homo sapiens
caaaucaggacacaacaga

SEQ ID NO: 828054 - RNA, 19 nt, Homo sapiens
gaacagcaacagcaagaag

SEQ ID NO: 828055 - RNA, 19 nt, Homo sapiens
gcaagaacagcaacagcaa

SEQ ID NO: 828056 - RNA, 19 nt, Homo sapiens
cagcagaccuaugacaugu

SEQ ID NO: 828057 - RNA, 19 nt, Homo sapiens
gagaaagggcugcaguuca

SEQ ID NO: 828058 - RNA, 19 nt, Homo sapiens
ucaccagccuuguuucuag

SEQ ID NO: 828059 - RNA, 19 nt, Homo sapiens
gagcucaggaucuguguga

SEQ ID NO: 828060 - RNA, 19 nt, Homo sapiens
gcagaucagggaacuucua

SEQ ID NO: 828061 - RNA, 19 nt, Homo sapiens
ggcacgcgcucucaaugaa

SEQ ID NO: 828062 - RNA, 19 nt, Homo sapiens
ccaugggccuguaugagaa

SEQ ID NO: 828063 - RNA, 19 nt, Homo sapiens
ggaaggcggacaucgagaa

SEQ ID NO: 828064 - RNA, 19 nt, Homo sapiens
gaaaagaacaggauucaag

SEQ ID NO: 828065 - RNA, 19 nt, Homo sapiens
guaaucauaccucuaguca

SEQ ID NO: 828066 - RNA, 19 nt, Homo sapiens
gaaggcggacaucgagaaa

SEQ ID NO: 828067 - RNA, 19 nt, Homo sapiens
acccagacauacaguuaua

SEQ ID NO: 828068 - RNA, 19 nt, Homo sapiens
gggaggaggugggcuagau

SEQ ID NO: 828069 - RNA, 19 nt, Homo sapiens
gaacaagauccuggacaug

SEQ ID NO: 828070 - RNA, 19 nt, Homo sapiens
ccucagagccuucagagau

SEQ ID NO: 828071 - RNA, 19 nt, Homo sapiens
ccagaaggccugauagaag

SEQ ID NO: 828072 - RNA, 19 nt, Homo sapiens
cagcaguacucaggcauga

SEQ ID NO: 828073 - RNA, 19 nt, Homo sapiens
gcaagcugcaugucaauag

SEQ ID NO: 828074 - RNA, 19 nt, Homo sapiens
guucaggagucuaagaagu

SEQ ID NO: 828075 - RNA, 19 nt, Homo sapiens
gcaccgacagccuggauga

SEQ ID NO: 828076 - RNA, 19 nt, Homo sapiens
gggcuggaaaugaaaguaa

SEQ ID NO: 828077 - RNA, 19 nt, Homo sapiens
caaggaaucacuuuuauga

SEQ ID NO: 828078 - RNA, 19 nt, Homo sapiens
augcauauauacacaggua

SEQ ID NO: 828079 - RNA, 19 nt, Homo sapiens
ggaaggaaccagggauuag

SEQ ID NO: 828080 - RNA, 19 nt, Homo sapiens
gauccaccgugcccugguu

SEQ ID NO: 828081 - RNA, 19 nt, Homo sapiens
gggagaagcagauccagau

SEQ ID NO: 828082 - RNA, 19 nt, Homo sapiens
gcagcagaccuaugacaug

SEQ ID NO: 828083 - RNA, 19 nt, Homo sapiens
ccuacuaccugugcaaaga

SEQ ID NO: 828084 - RNA, 19 nt, Homo sapiens
ggcuggaaaugaaaguaaa

SEQ ID NO: 828085 - RNA, 19 nt, Homo sapiens
agaaggugauuuguauuug

SEQ ID NO: 828086 - RNA, 19 nt, Homo sapiens
cagccauccuugugugauu

SEQ ID NO: 828087 - RNA, 19 nt, Homo sapiens
gacaugcgcucugggaaag

SEQ ID NO: 828088 - RNA, 19 nt, Homo sapiens
gaccucaaguacuguagug

SEQ ID NO: 828089 - RNA, 19 nt, Homo sapiens
cagaugaaguuuguaugug

SEQ ID NO: 828090 - RNA, 19 nt, Homo sapiens
ccuuugaccugcagaugaa

SEQ ID NO: 828091 - RNA, 19 nt, Homo sapiens
gugagggccuugagcacaa

SEQ ID NO: 828092 - RNA, 19 nt, Homo sapiens
cagccuggaugacuucuca

SEQ ID NO: 828093 - RNA, 19 nt, Homo sapiens
ugagggcaaugaucuguuc

SEQ ID NO: 828094 - RNA, 19 nt, Homo sapiens
uuucucagcugggcaguaa

SEQ ID NO: 828095 - RNA, 19 nt, Homo sapiens
agacccagacauacaguua

SEQ ID NO: 828096 - RNA, 19 nt, Homo sapiens
gggcugcaguucauucagu

SEQ ID NO: 828097 - RNA, 19 nt, Homo sapiens
guaacuucccacagcaaua

SEQ ID NO: 828098 - RNA, 19 nt, Homo sapiens
ucccuuagccuuuguucua

SEQ ID NO: 828099 - RNA, 19 nt, Homo sapiens
ccgagaagcacaaggagaa

SEQ ID NO: 828100 - RNA, 19 nt, Homo sapiens
agaacaagauccuggacau

SEQ ID NO: 828101 - RNA, 19 nt, Homo sapiens
auaaagaauuuggccagaa

SEQ ID NO: 828102 - RNA, 19 nt, Homo sapiens
gcagagggcaggacaccau

SEQ ID NO: 828103 - RNA, 19 nt, Homo sapiens
ggaguagggccagguguug

SEQ ID NO: 828104 - RNA, 19 nt, Homo sapiens
ugacaaggaccucaaguac

SEQ ID NO: 828105 - RNA, 19 nt, Homo sapiens
ccaccucccucaaguacuc

SEQ ID NO: 828106 - RNA, 19 nt, Homo sapiens
cggcgugccuagugaguug

SEQ ID NO: 828107 - RNA, 19 nt, Homo sapiens
ggagugcucagggaaagaa

SEQ ID NO: 828108 - RNA, 19 nt, Homo sapiens
ccuaaagcaagaagaauau

SEQ ID NO: 828109 - RNA, 19 nt, Homo sapiens
ugacaugcgcucugggaaa

SEQ ID NO: 828110 - RNA, 19 nt, Homo sapiens
gggagaaggacuauaagca

SEQ ID NO: 828111 - RNA, 19 nt, Homo sapiens
gaggaggugggcuagauga

SEQ ID NO: 828112 - RNA, 19 nt, Homo sapiens
gcacauccaguccgagaag

SEQ ID NO: 828113 - RNA, 19 nt, Homo sapiens
ggccgcaagugccaauaug

SEQ ID NO: 828114 - RNA, 19 nt, Homo sapiens
ggacaggaagacccuuuua

SEQ ID NO: 828115 - RNA, 19 nt, Homo sapiens
uaacguaaucauaccucua

SEQ ID NO: 828116 - RNA, 19 nt, Homo sapiens
gaaaggagcuguucuucaa

SEQ ID NO: 828117 - RNA, 19 nt, Homo sapiens
gguuaaaggugacugauua

SEQ ID NO: 828118 - RNA, 19 nt, Homo sapiens
gaacauggugucuaucuua

SEQ ID NO: 828119 - RNA, 19 nt, Homo sapiens
ggacagacuuggacacaaa

SEQ ID NO: 828120 - RNA, 19 nt, Homo sapiens
caaauugucuccaguugaa

SEQ ID NO: 828121 - RNA, 19 nt, Homo sapiens
gaacgucuacuaccagaua

SEQ ID NO: 828122 - RNA, 19 nt, Homo sapiens
gcaggauggugaaguagua

SEQ ID NO: 828123 - RNA, 19 nt, Homo sapiens
gcagcaggauggugaagua

SEQ ID NO: 828124 - RNA, 19 nt, Homo sapiens
gaucauaaacuacguauuc

SEQ ID NO: 828125 - RNA, 19 nt, Homo sapiens
ggagaagucugaacugauc

SEQ ID NO: 828126 - RNA, 19 nt, Homo sapiens
gcagcaaugucaccuugua

SEQ ID NO: 828127 - RNA, 19 nt, Homo sapiens
gcaaggagcggcagauuau

SEQ ID NO: 828128 - RNA, 19 nt, Homo sapiens
ccaagaacccggagaagua

SEQ ID NO: 828129 - RNA, 19 nt, Homo sapiens
ggaaggccuuuaucagauu

SEQ ID NO: 828130 - RNA, 19 nt, Homo sapiens
aaagcaaacuucauccuaa

SEQ ID NO: 828131 - RNA, 19 nt, Homo sapiens
ccaaagcgcuggaggacuu

SEQ ID NO: 828132 - RNA, 19 nt, Homo sapiens
ggacuugggucuucagauc

SEQ ID NO: 828133 - RNA, 19 nt, Homo sapiens
gaaagcaaacuucauccua

SEQ ID NO: 828134 - RNA, 19 nt, Homo sapiens
ggacgagauugaagacuga

SEQ ID NO: 828135 - RNA, 19 nt, Homo sapiens
gcgaccagcucacuaagaa

SEQ ID NO: 828136 - RNA, 19 nt, Homo sapiens
cagacaacaucaagaauga

SEQ ID NO: 828137 - RNA, 19 nt, Homo sapiens
cagguaggcuggaagagua

SEQ ID NO: 828138 - RNA, 19 nt, Homo sapiens
agaaggagcauuuccauaa

SEQ ID NO: 828139 - RNA, 19 nt, Homo sapiens
agaaggcaguggaguauuu

SEQ ID NO: 828140 - RNA, 19 nt, Homo sapiens
cuaagaacauggugucuau

SEQ ID NO: 828141 - RNA, 19 nt, Homo sapiens
ccagaccuguuucuucuaa

SEQ ID NO: 828142 - RNA, 19 nt, Homo sapiens
gaaggagcauuuccauaag

SEQ ID NO: 828143 - RNA, 19 nt, Homo sapiens
gcucugugcuugugugcua

SEQ ID NO: 828144 - RNA, 19 nt, Homo sapiens
caaccaagauuucaugaac

SEQ ID NO: 828145 - RNA, 19 nt, Homo sapiens
ggacaaggaguacaacaug

SEQ ID NO: 828146 - RNA, 19 nt, Homo sapiens
gaauuucgcagccugauga

SEQ ID NO: 828147 - RNA, 19 nt, Homo sapiens
caggguggcuuaauucaga

SEQ ID NO: 828148 - RNA, 19 nt, Homo sapiens
gcaccuauaucuguaaagu

SEQ ID NO: 828149 - RNA, 19 nt, Homo sapiens
gcagacaacaucaagaaug

SEQ ID NO: 828150 - RNA, 19 nt, Homo sapiens
gcccggaacucaacaaagu

SEQ ID NO: 828151 - RNA, 19 nt, Homo sapiens
ccugauggcuucugaaaca

SEQ ID NO: 828152 - RNA, 19 nt, Homo sapiens
cuaagcaccuauaucugua

SEQ ID NO: 828153 - RNA, 19 nt, Homo sapiens
gcacaacaacuacaauuac

SEQ ID NO: 828154 - RNA, 19 nt, Homo sapiens
gaccuucgacucccugaua

SEQ ID NO: 828155 - RNA, 19 nt, Homo sapiens
uuuaagggcuucaaugaug

SEQ ID NO: 828156 - RNA, 19 nt, Homo sapiens
ggaaagacacaccuaccaa

SEQ ID NO: 828157 - RNA, 19 nt, Homo sapiens
gaucccagcugccaagucu

SEQ ID NO: 828158 - RNA, 19 nt, Homo sapiens
agaagaaucuaccuguguu

SEQ ID NO: 828159 - RNA, 19 nt, Homo sapiens
aaaggugacugauuacauc

SEQ ID NO: 828160 - RNA, 19 nt, Homo sapiens
gcuaagcaccuauaucugu

SEQ ID NO: 828161 - RNA, 19 nt, Homo sapiens
ggacuucgcagacaacauc

SEQ ID NO: 828162 - RNA, 19 nt, Homo sapiens
gcaggagaauguugagaag

SEQ ID NO: 828163 - RNA, 19 nt, Homo sapiens
ggaaaggagcuguucuuca

SEQ ID NO: 828164 - RNA, 19 nt, Homo sapiens
ggagauggguuuauuucac

SEQ ID NO: 828165 - RNA, 19 nt, Homo sapiens
acaauuacauccucaaguc

SEQ ID NO: 828166 - RNA, 19 nt, Homo sapiens
cagaaggccugggcuauuc

SEQ ID NO: 828167 - RNA, 19 nt, Homo sapiens
gagaagaaucuaccugugu

SEQ ID NO: 828168 - RNA, 19 nt, Homo sapiens
agaccaagccugaguuuga

SEQ ID NO: 828169 - RNA, 19 nt, Homo sapiens
ggagaccaaugccuacauc

SEQ ID NO: 828170 - RNA, 19 nt, Homo sapiens
caggccagcuucucuguga

SEQ ID NO: 828171 - RNA, 19 nt, Homo sapiens
ggcaaggagcggcagauua

SEQ ID NO: 828172 - RNA, 19 nt, Homo sapiens
ucaagucccuggagaaguc

SEQ ID NO: 828173 - RNA, 19 nt, Homo sapiens
cauggugucuaucuuauca

SEQ ID NO: 828174 - RNA, 19 nt, Homo sapiens
uggaugggcugaugcuuga

SEQ ID NO: 828175 - RNA, 19 nt, Homo sapiens
aagugaaacugcucuuuga

SEQ ID NO: 828176 - RNA, 19 nt, Homo sapiens
ccacauacacgaggaagaa

SEQ ID NO: 828177 - RNA, 19 nt, Homo sapiens
ggacagauaaaccaguguu

SEQ ID NO: 828178 - RNA, 19 nt, Homo sapiens
agaagaccauugucaagga

SEQ ID NO: 828179 - RNA, 19 nt, Homo sapiens
gugcucaucuuggaucuga

SEQ ID NO: 828180 - RNA, 19 nt, Homo sapiens
gagacagccuggagaagag

SEQ ID NO: 828181 - RNA, 19 nt, Homo sapiens
cgagguaucucagcagcaa

SEQ ID NO: 828182 - RNA, 19 nt, Homo sapiens
ggacaauggggaaaaguua

SEQ ID NO: 828183 - RNA, 19 nt, Homo sapiens
gaaggccuuuaucagauuc

SEQ ID NO: 828184 - RNA, 19 nt, Homo sapiens
agagagcgaugauggacuu

SEQ ID NO: 828185 - RNA, 19 nt, Homo sapiens
gagcagagggacaggauuc

SEQ ID NO: 828186 - RNA, 19 nt, Homo sapiens
uuugagagccgccuuauga

SEQ ID NO: 828187 - RNA, 19 nt, Homo sapiens
caacaacuacaauuacauc

SEQ ID NO: 828188 - RNA, 19 nt, Homo sapiens
cacaacaacuacaauuaca

SEQ ID NO: 828189 - RNA, 19 nt, Homo sapiens
ggaacucaacaaagugaaa

SEQ ID NO: 828190 - RNA, 19 nt, Homo sapiens
guggauaugagaacuauga

SEQ ID NO: 828191 - RNA, 19 nt, Homo sapiens
gcagaccaagccugaguuu

SEQ ID NO: 828192 - RNA, 19 nt, Homo sapiens
ggacuugagcgccguguuc

SEQ ID NO: 828193 - RNA, 19 nt, Homo sapiens
agaaugacccggacaagga

SEQ ID NO: 828194 - RNA, 19 nt, Homo sapiens
gucuucagaucauaaacua

SEQ ID NO: 828195 - RNA, 19 nt, Homo sapiens
uguaucgcuuccuuucuua

SEQ ID NO: 828196 - RNA, 19 nt, Homo sapiens
ggcgggagauugaggacaa

SEQ ID NO: 828197 - RNA, 19 nt, Homo sapiens
gacaugaucgaucgccuuu

SEQ ID NO: 828198 - RNA, 19 nt, Homo sapiens
agacacaccuaccaagaag

SEQ ID NO: 828199 - RNA, 19 nt, Homo sapiens
gauaaaccaguguuagcuu

SEQ ID NO: 828200 - RNA, 19 nt, Homo sapiens
gacagauaaaccaguguua

SEQ ID NO: 828201 - RNA, 19 nt, Homo sapiens
cugauuacaucgcagagaa

SEQ ID NO: 828202 - RNA, 19 nt, Homo sapiens
caagcugccuggccucauc

SEQ ID NO: 828203 - RNA, 19 nt, Homo sapiens
ggaagcauggccaagauuc

SEQ ID NO: 828204 - RNA, 19 nt, Homo sapiens
gaaccaggaaggagagauc

SEQ ID NO: 828205 - RNA, 19 nt, Homo sapiens
cggagaaguacaucaagua

SEQ ID NO: 828206 - RNA, 19 nt, Homo sapiens
uacacgagcucaccagcaa

SEQ ID NO: 828207 - RNA, 19 nt, Homo sapiens
ggaauauggccgcaaccaa

SEQ ID NO: 828208 - RNA, 19 nt, Homo sapiens
uuaugaagcuggagaacuc

SEQ ID NO: 828209 - RNA, 19 nt, Homo sapiens
gagcaccaccagaagaaga

SEQ ID NO: 828210 - RNA, 19 nt, Homo sapiens
cagaaggagcauuuccaua

SEQ ID NO: 828211 - RNA, 19 nt, Homo sapiens
gcaaccaagauuucaugaa

SEQ ID NO: 828212 - RNA, 19 nt, Homo sapiens
gagcgaugauggacuugag

SEQ ID NO: 828213 - RNA, 19 nt, Homo sapiens
cgagacagccuggagaaga

SEQ ID NO: 828214 - RNA, 19 nt, Homo sapiens
gcucuucggccaccagcua

SEQ ID NO: 828215 - RNA, 19 nt, Homo sapiens
caucaucccugugcacaag

SEQ ID NO: 828216 - RNA, 19 nt, Homo sapiens
ggaaugggcuugcaaaguu

SEQ ID NO: 828217 - RNA, 19 nt, Homo sapiens
ccacaggccuuauuucaua

SEQ ID NO: 828218 - RNA, 19 nt, Homo sapiens
gagauucugugaagcauua

SEQ ID NO: 828219 - RNA, 19 nt, Homo sapiens
ggaaacauaugaauucuuc

SEQ ID NO: 828220 - RNA, 19 nt, Homo sapiens
gcacaagggugacuauaau

SEQ ID NO: 828221 - RNA, 19 nt, Homo sapiens
ggcaagaacucaauugauu

SEQ ID NO: 828222 - RNA, 19 nt, Homo sapiens
ggagagauauucugcauca

SEQ ID NO: 828223 - RNA, 19 nt, Homo sapiens
gaacugaaaccuagugaaa

SEQ ID NO: 828224 - RNA, 19 nt, Homo sapiens
cagagcagcuuuaccauuu

SEQ ID NO: 828225 - RNA, 19 nt, Homo sapiens
gaacuaugaugggauauug

SEQ ID NO: 828226 - RNA, 19 nt, Homo sapiens
gaaagaacgaggaauauug

SEQ ID NO: 828227 - RNA, 19 nt, Homo sapiens
agaagaauguggaaugaua

SEQ ID NO: 828228 - RNA, 19 nt, Homo sapiens
cgaggaauauugugaaauu

SEQ ID NO: 828229 - RNA, 19 nt, Homo sapiens
ggacaaaugcagcugguua

SEQ ID NO: 828230 - RNA, 19 nt, Homo sapiens
ccaaugaacuggcuaaaca

SEQ ID NO: 828231 - RNA, 19 nt, Homo sapiens
gcaaauaccgucaaacaga

SEQ ID NO: 828232 - RNA, 19 nt, Homo sapiens
ggacagauccaagacuuua

SEQ ID NO: 828233 - RNA, 19 nt, Homo sapiens
gauguaaguucuucaguga

SEQ ID NO: 828234 - RNA, 19 nt, Homo sapiens
gcaagaacucaauugauua

SEQ ID NO: 828235 - RNA, 19 nt, Homo sapiens
gaacagaacaauggaauga

SEQ ID NO: 828236 - RNA, 19 nt, Homo sapiens
gagcagcccugacauggaa

SEQ ID NO: 828237 - RNA, 19 nt, Homo sapiens
ggaaugauacugugagaaa

SEQ ID NO: 828238 - RNA, 19 nt, Homo sapiens
acagggaaauugcauauaa

SEQ ID NO: 828239 - RNA, 19 nt, Homo sapiens
gcagccaccuaaccaauuu

SEQ ID NO: 828240 - RNA, 19 nt, Homo sapiens
ugaugaagcugggcauuua

SEQ ID NO: 828241 - RNA, 19 nt, Homo sapiens
cagcugcuauugacuauaa

SEQ ID NO: 828242 - RNA, 19 nt, Homo sapiens
gcaagcugguugacacuaa

SEQ ID NO: 828243 - RNA, 19 nt, Homo sapiens
caagagauaaccaacuuua

SEQ ID NO: 828244 - RNA, 19 nt, Homo sapiens
caaauaccgucaaacagaa

SEQ ID NO: 828245 - RNA, 19 nt, Homo sapiens
ugaaucagcuggcucagaa

SEQ ID NO: 828246 - RNA, 19 nt, Homo sapiens
agaaggagauguuagagaa

SEQ ID NO: 828247 - RNA, 19 nt, Homo sapiens
uggcauaucucuucacuau

SEQ ID NO: 828248 - RNA, 19 nt, Homo sapiens
acagaacaauggaaugaua

SEQ ID NO: 828249 - RNA, 19 nt, Homo sapiens
ggacucaccauguauauau

SEQ ID NO: 828250 - RNA, 19 nt, Homo sapiens
gaacauacaaauaccuuga

SEQ ID NO: 828251 - RNA, 19 nt, Homo sapiens
aaagaaagaacgaggaaua

SEQ ID NO: 828252 - RNA, 19 nt, Homo sapiens
cgacaaacgugccgcauca

SEQ ID NO: 828253 - RNA, 19 nt, Homo sapiens
ggccuuauuucauauguuu

SEQ ID NO: 828254 - RNA, 19 nt, Homo sapiens
gagauauucugcaucaguu

SEQ ID NO: 828255 - RNA, 19 nt, Homo sapiens
uaagaagaauguggaauga

SEQ ID NO: 828256 - RNA, 19 nt, Homo sapiens
ccacaugcgaguauuaaua

SEQ ID NO: 828257 - RNA, 19 nt, Homo sapiens
gauauucucuggaguuugg

SEQ ID NO: 828258 - RNA, 19 nt, Homo sapiens
gcacaaaagugaugaaauc

SEQ ID NO: 828259 - RNA, 19 nt, Homo sapiens
gcagcagucugugaacuaa

SEQ ID NO: 828260 - RNA, 19 nt, Homo sapiens
caauagcacuucaacacuu

SEQ ID NO: 828261 - RNA, 19 nt, Homo sapiens
uaagagcuauggaacagaa

SEQ ID NO: 828262 - RNA, 19 nt, Homo sapiens
cauauaaacuuccaaaucg

SEQ ID NO: 828263 - RNA, 19 nt, Homo sapiens
cgaagucugugguuuauca

SEQ ID NO: 828264 - RNA, 19 nt, Homo sapiens
cgagggaacugacagcuau

SEQ ID NO: 828265 - RNA, 19 nt, Homo sapiens
gaacucgaggcaccacuua

SEQ ID NO: 828266 - RNA, 19 nt, Homo sapiens
ccuguuaccuucauuauuc

SEQ ID NO: 828267 - RNA, 19 nt, Homo sapiens
gaacgaccaugcccuaagg

SEQ ID NO: 828268 - RNA, 19 nt, Homo sapiens
gaucaauaauggugucuuc

SEQ ID NO: 828269 - RNA, 19 nt, Homo sapiens
gcagcucuaccuaauguua

SEQ ID NO: 828270 - RNA, 19 nt, Homo sapiens
agauggcguucaugaauua

SEQ ID NO: 828271 - RNA, 19 nt, Homo sapiens
gggauaaaguggccucaga

SEQ ID NO: 828272 - RNA, 19 nt, Homo sapiens
caugauaccucaccauaca

SEQ ID NO: 828273 - RNA, 19 nt, Homo sapiens
uuaaagggaucaauaaugg

SEQ ID NO: 828274 - RNA, 19 nt, Homo sapiens
ggagcuccaucacaaagaa

SEQ ID NO: 828275 - RNA, 19 nt, Homo sapiens
gcucuucugugucuucuug

SEQ ID NO: 828276 - RNA, 19 nt, Homo sapiens
agagaacuaugaugggaua

SEQ ID NO: 828277 - RNA, 19 nt, Homo sapiens
ggaacugccucauaucucu

SEQ ID NO: 828278 - RNA, 19 nt, Homo sapiens
gacuugaggacuagaauua

SEQ ID NO: 828279 - RNA, 19 nt, Homo sapiens
gaacgaggaauauugugaa

SEQ ID NO: 828280 - RNA, 19 nt, Homo sapiens
gaaugggcuugcaaaguug

SEQ ID NO: 828281 - RNA, 19 nt, Homo sapiens
ggacggaugacaagauuug

SEQ ID NO: 828282 - RNA, 19 nt, Homo sapiens
ggaguccucuaugugguua

SEQ ID NO: 828283 - RNA, 19 nt, Homo sapiens
guacuggauuuguggugua

SEQ ID NO: 828284 - RNA, 19 nt, Homo sapiens
gaaagcaauuguggacuca

SEQ ID NO: 828285 - RNA, 19 nt, Homo sapiens
gguuacaagucuuuaauca

SEQ ID NO: 828286 - RNA, 19 nt, Homo sapiens
aauagcacuucaacacuua

SEQ ID NO: 828287 - RNA, 19 nt, Homo sapiens
aaauuugacuugaggacua

SEQ ID NO: 828288 - RNA, 19 nt, Homo sapiens
gcgaggccauaauuaacua

SEQ ID NO: 828289 - RNA, 19 nt, Homo sapiens
caaauuuacuguaccuuac

SEQ ID NO: 828290 - RNA, 19 nt, Homo sapiens
acacagagucguauaagaa

SEQ ID NO: 828291 - RNA, 19 nt, Homo sapiens
aaacagaacagcaggaaug

SEQ ID NO: 828292 - RNA, 19 nt, Homo sapiens
gaacaagcacauacugcaa

SEQ ID NO: 828293 - RNA, 19 nt, Homo sapiens
ggagggcuacggaaacuaa

SEQ ID NO: 828294 - RNA, 19 nt, Homo sapiens
caacgugggagacuguaua

SEQ ID NO: 828295 - RNA, 19 nt, Homo sapiens
ugauggugcugucuucuuu

SEQ ID NO: 828296 - RNA, 19 nt, Homo sapiens
caaauaccuugaaguccaa

SEQ ID NO: 828297 - RNA, 19 nt, Homo sapiens
guguccaacugaaauauaa

SEQ ID NO: 828298 - RNA, 19 nt, Homo sapiens
gugcagcucuaccuaaugu

SEQ ID NO: 828299 - RNA, 19 nt, Homo sapiens
cagggaaauugcauauaaa

SEQ ID NO: 828300 - RNA, 19 nt, Homo sapiens
caaccaguaucaguauauu

SEQ ID NO: 828301 - RNA, 19 nt, Homo sapiens
uuagccagcugaauccaua

SEQ ID NO: 828302 - RNA, 19 nt, Homo sapiens
gggcauuuauaacuagauu

SEQ ID NO: 828303 - RNA, 19 nt, Homo sapiens
gcacuucaacacuuaauca

SEQ ID NO: 828304 - RNA, 19 nt, Homo sapiens
caaacuuucuagugaacaa

SEQ ID NO: 828305 - RNA, 19 nt, Homo sapiens
gcucuugguugcacauguu

SEQ ID NO: 828306 - RNA, 19 nt, Homo sapiens
cagugaagaugaugcuauu

SEQ ID NO: 828307 - RNA, 19 nt, Homo sapiens
cuacagagugaccgaaaua

SEQ ID NO: 828308 - RNA, 19 nt, Homo sapiens
ucugagaccugaagcuuug

SEQ ID NO: 828309 - RNA, 19 nt, Homo sapiens
cugcuagucuugccaauga

SEQ ID NO: 828310 - RNA, 19 nt, Homo sapiens
ucaagacaaugaaagugaa

SEQ ID NO: 828311 - RNA, 19 nt, Homo sapiens
gaagguuauucuauagauc

SEQ ID NO: 828312 - RNA, 19 nt, Homo sapiens
gaauuauccugugaagguu

SEQ ID NO: 828313 - RNA, 19 nt, Homo sapiens
gcagagcagcuuuaccauu

SEQ ID NO: 828314 - RNA, 19 nt, Homo sapiens
gcccugacauggaagaaga

SEQ ID NO: 828315 - RNA, 19 nt, Homo sapiens
acaagcaugcccaaucuua

SEQ ID NO: 828316 - RNA, 19 nt, Homo sapiens
gaaagaaccugcaggauca

SEQ ID NO: 828317 - RNA, 19 nt, Homo sapiens
ggaacuaucuguagacgua

SEQ ID NO: 828318 - RNA, 19 nt, Homo sapiens
gaagagauauuucuggaau

SEQ ID NO: 828319 - RNA, 19 nt, Homo sapiens
guaaguaccaguagaauuu

SEQ ID NO: 828320 - RNA, 19 nt, Homo sapiens
ggagugaccuuuauaugug

SEQ ID NO: 828321 - RNA, 19 nt, Homo sapiens
gcuaaucucuguccuguga

SEQ ID NO: 828322 - RNA, 19 nt, Homo sapiens
ugagguacaugaucaauuu

SEQ ID NO: 828323 - RNA, 19 nt, Homo sapiens
gagagaaagguuaugauua

SEQ ID NO: 828324 - RNA, 19 nt, Homo sapiens
cgacagaauugcagagauu

SEQ ID NO: 828325 - RNA, 19 nt, Homo sapiens
auacgacucuguugucuua

SEQ ID NO: 828326 - RNA, 19 nt, Homo sapiens
ugacugagguaauagauga

SEQ ID NO: 828327 - RNA, 19 nt, Homo sapiens
ugauugggcuucauacuuu

SEQ ID NO: 828328 - RNA, 19 nt, Homo sapiens
cgucaaggcuuaguuauga

SEQ ID NO: 828329 - RNA, 19 nt, Homo sapiens
caauuuaagugguucugua

SEQ ID NO: 828330 - RNA, 19 nt, Homo sapiens
gaaguuucauuauccagaa

SEQ ID NO: 828331 - RNA, 19 nt, Homo sapiens
guucauauauggcucuauu

SEQ ID NO: 828332 - RNA, 19 nt, Homo sapiens
gaagauuaaugguauaugc

SEQ ID NO: 828333 - RNA, 19 nt, Homo sapiens
uaagcuaccugaggguuua

SEQ ID NO: 828334 - RNA, 19 nt, Homo sapiens
guaugaagccugugcuaua

SEQ ID NO: 828335 - RNA, 19 nt, Homo sapiens
gcgcagaaguuucauuauc

SEQ ID NO: 828336 - RNA, 19 nt, Homo sapiens
caagaguugucaaacguaa

SEQ ID NO: 828337 - RNA, 19 nt, Homo sapiens
gaauuucucugucaaacuc

SEQ ID NO: 828338 - RNA, 19 nt, Homo sapiens
ggccaucgaucaagaguug

SEQ ID NO: 828339 - RNA, 19 nt, Homo sapiens
gauauuucuugcccuagua

SEQ ID NO: 828340 - RNA, 19 nt, Homo sapiens
ccacagccuucuagaauuc

SEQ ID NO: 828341 - RNA, 19 nt, Homo sapiens
ucuguugucuuacuugaua

SEQ ID NO: 828342 - RNA, 19 nt, Homo sapiens
uggaaaggcucacaggaaa

SEQ ID NO: 828343 - RNA, 19 nt, Homo sapiens
ggacagugaugccgucaag

SEQ ID NO: 828344 - RNA, 19 nt, Homo sapiens
caucugcuuucucuucaua

SEQ ID NO: 828345 - RNA, 19 nt, Homo sapiens
uaaagaccauccaccauca

SEQ ID NO: 828346 - RNA, 19 nt, Homo sapiens
uuucucagcuucugcauuu

SEQ ID NO: 828347 - RNA, 19 nt, Homo sapiens
gguucuaaaucuucaguaa

SEQ ID NO: 828348 - RNA, 19 nt, Homo sapiens
ggagaacuguggcccaauc

SEQ ID NO: 828349 - RNA, 19 nt, Homo sapiens
gugaugccgucaaggcuua

SEQ ID NO: 828350 - RNA, 19 nt, Homo sapiens
gauugggcuucauacuuua

SEQ ID NO: 828351 - RNA, 19 nt, Homo sapiens
guaggucacucuucuccuu

SEQ ID NO: 828352 - RNA, 19 nt, Homo sapiens
uaaaugggcuccagaucuc

SEQ ID NO: 828353 - RNA, 19 nt, Homo sapiens
gguaauagaugaaaagugu

SEQ ID NO: 828354 - RNA, 19 nt, Homo sapiens
gaccacagccuucuagaau

SEQ ID NO: 828355 - RNA, 19 nt, Homo sapiens
gaaaggcucacaggaaaga

SEQ ID NO: 828356 - RNA, 19 nt, Homo sapiens
uugagaagcuggaaagaga

SEQ ID NO: 828357 - RNA, 19 nt, Homo sapiens
gaugggcaguaauauguga

SEQ ID NO: 828358 - RNA, 19 nt, Homo sapiens
guaagcuauuuggguauua

SEQ ID NO: 828359 - RNA, 19 nt, Homo sapiens
uaacugauugggcuucaua

SEQ ID NO: 828360 - RNA, 19 nt, Homo sapiens
cagcgcagaaguuucauua

SEQ ID NO: 828361 - RNA, 19 nt, Homo sapiens
gcuuauaauugacaacaug

SEQ ID NO: 828362 - RNA, 19 nt, Homo sapiens
ugaauucaccaguagauuu

SEQ ID NO: 828363 - RNA, 19 nt, Homo sapiens
gaugaaaaguguucuaugu

SEQ ID NO: 828364 - RNA, 19 nt, Homo sapiens
gcauuguguuaacauguuu

SEQ ID NO: 828365 - RNA, 19 nt, Homo sapiens
gaucaagaguugucaaacg

SEQ ID NO: 828366 - RNA, 19 nt, Homo sapiens
gguaagcuauuuggguauu

SEQ ID NO: 828367 - RNA, 19 nt, Homo sapiens
ucaagugcauggccuucua

SEQ ID NO: 828368 - RNA, 19 nt, Homo sapiens
ucaauuauccuaggaguga

SEQ ID NO: 828369 - RNA, 19 nt, Homo sapiens
gaagaucuccagccuccuu

SEQ ID NO: 828370 - RNA, 19 nt, Homo sapiens
cgcagucccuuccagcuua

SEQ ID NO: 828371 - RNA, 19 nt, Homo sapiens
gguauaugcuccuuauguc

SEQ ID NO: 828372 - RNA, 19 nt, Homo sapiens
gauauaguguaccauacug

SEQ ID NO: 828373 - RNA, 19 nt, Homo sapiens
agauauuucuggaauguga

SEQ ID NO: 828374 - RNA, 19 nt, Homo sapiens
ccaccaggaugggcaguaa

SEQ ID NO: 828375 - RNA, 19 nt, Homo sapiens
ccauuuccuuucucuguuu

SEQ ID NO: 828376 - RNA, 19 nt, Homo sapiens
uguggaagauuaaugguau

SEQ ID NO: 828377 - RNA, 19 nt, Homo sapiens
aaacaaaacuggcaaagca

SEQ ID NO: 828378 - RNA, 19 nt, Homo sapiens
gggcauugaggaagagaua

SEQ ID NO: 828379 - RNA, 19 nt, Homo sapiens
uaacauguuucaagugcau

SEQ ID NO: 828380 - RNA, 19 nt, Homo sapiens
uagcaaggucugaaaguuu

SEQ ID NO: 828381 - RNA, 19 nt, Homo sapiens
gaucaguggccaagaugaa

SEQ ID NO: 828382 - RNA, 19 nt, Homo sapiens
guccuugaauucaccagua

SEQ ID NO: 828383 - RNA, 19 nt, Homo sapiens
uuaguuauaggcaguguua

SEQ ID NO: 828384 - RNA, 19 nt, Homo sapiens
gcagaaguuucauuaucca

SEQ ID NO: 828385 - RNA, 19 nt, Homo sapiens
augaagacaugcugaggua

SEQ ID NO: 828386 - RNA, 19 nt, Homo sapiens
uuauagcuaugucuuguga

SEQ ID NO: 828387 - RNA, 19 nt, Homo sapiens
gaaugugaucuuucaauag

SEQ ID NO: 828388 - RNA, 19 nt, Homo sapiens
caaaggcaaccaaaacuua

SEQ ID NO: 828389 - RNA, 19 nt, Homo sapiens
gcauugaggaagagauauu

SEQ ID NO: 828390 - RNA, 19 nt, Homo sapiens
gcaacuucuuuaggcauuu

SEQ ID NO: 828391 - RNA, 19 nt, Homo sapiens
aggcgugacugagguaaua

SEQ ID NO: 828392 - RNA, 19 nt, Homo sapiens
gaagacaugcugagguaca

SEQ ID NO: 828393 - RNA, 19 nt, Homo sapiens
ccuaacaaaugaagaagca

SEQ ID NO: 828394 - RNA, 19 nt, Homo sapiens
guaccauacugccuuucuu

SEQ ID NO: 828395 - RNA, 19 nt, Homo sapiens
ccugauacccauguacuua

SEQ ID NO: 828396 - RNA, 19 nt, Homo sapiens
uugcaagauuguuggcuua

SEQ ID NO: 828397 - RNA, 19 nt, Homo sapiens
ccaacagcaugcagucuuc

SEQ ID NO: 828398 - RNA, 19 nt, Homo sapiens
uugcagagauuaucaaagg

SEQ ID NO: 828399 - RNA, 19 nt, Homo sapiens
guggaagauuaaugguaua

SEQ ID NO: 828400 - RNA, 19 nt, Homo sapiens
uaggaggucugaacacaca

SEQ ID NO: 828401 - RNA, 19 nt, Homo sapiens
ucacggacaaguuccagua

SEQ ID NO: 828402 - RNA, 19 nt, Homo sapiens
agagauauuucuggaaugu

SEQ ID NO: 828403 - RNA, 19 nt, Homo sapiens
gacaaaaguugccagaguu

SEQ ID NO: 828404 - RNA, 19 nt, Homo sapiens
gccaacaaaccauccuuaa

SEQ ID NO: 828405 - RNA, 19 nt, Homo sapiens
uaugaagccugugcuauag

SEQ ID NO: 828406 - RNA, 19 nt, Homo sapiens
gcuuggacccuaucuguga

SEQ ID NO: 828407 - RNA, 19 nt, Homo sapiens
aaaccuguguauuucuuga

SEQ ID NO: 828408 - RNA, 19 nt, Homo sapiens
gaucucuuauugcccuuau

SEQ ID NO: 828409 - RNA, 19 nt, Homo sapiens
agagagaaagguuaugauu

SEQ ID NO: 828410 - RNA, 19 nt, Homo sapiens
uccagaauaucccagguuu

SEQ ID NO: 828411 - RNA, 19 nt, Homo sapiens
uggaaugugagacuuguua

SEQ ID NO: 828412 - RNA, 19 nt, Homo sapiens
ggaagagauauuucuggaa

SEQ ID NO: 828413 - RNA, 19 nt, Homo sapiens
ggaauucgaggcccaccaa

SEQ ID NO: 828414 - RNA, 19 nt, Homo sapiens
gacagaauugcagagauua

SEQ ID NO: 828415 - RNA, 19 nt, Homo sapiens
auagcuaugucuugugaaa

SEQ ID NO: 828416 - RNA, 19 nt, Homo sapiens
gaaguaacauggagaguuu

SEQ ID NO: 828417 - RNA, 19 nt, Homo sapiens
caaacuaccugagaaauua

SEQ ID NO: 828418 - RNA, 19 nt, Homo sapiens
gcaaauaaaugucaggauu

SEQ ID NO: 828419 - RNA, 19 nt, Homo sapiens
gaacagcaauucaacagaa

SEQ ID NO: 828420 - RNA, 19 nt, Homo sapiens
gaugaaaucucacauauag

SEQ ID NO: 828421 - RNA, 19 nt, Homo sapiens
gaaggguccugcucaaaua

SEQ ID NO: 828422 - RNA, 19 nt, Homo sapiens
caacaaagccuuaggauug

SEQ ID NO: 828423 - RNA, 19 nt, Homo sapiens
guuagaaccugaaguauuu

SEQ ID NO: 828424 - RNA, 19 nt, Homo sapiens
gaaccuagaagcauaguua

SEQ ID NO: 828425 - RNA, 19 nt, Homo sapiens
caaaggcguugaacaauuu

SEQ ID NO: 828426 - RNA, 19 nt, Homo sapiens
gaaaguccacuguaaauuu

SEQ ID NO: 828427 - RNA, 19 nt, Homo sapiens
ucaagaugcuuuccaguua

SEQ ID NO: 828428 - RNA, 19 nt, Homo sapiens
gaaauacauuggaaacuga

SEQ ID NO: 828429 - RNA, 19 nt, Homo sapiens
ccaguaagcugcauaauuc

SEQ ID NO: 828430 - RNA, 19 nt, Homo sapiens
gagcaugccagauguauua

SEQ ID NO: 828431 - RNA, 19 nt, Homo sapiens
ggacuuaacuguaguaugc

SEQ ID NO: 828432 - RNA, 19 nt, Homo sapiens
gaacauggauuucguagac

SEQ ID NO: 828433 - RNA, 19 nt, Homo sapiens
caacagaacaagauucaua

SEQ ID NO: 828434 - RNA, 19 nt, Homo sapiens
gaagaaacaucugguugaa

SEQ ID NO: 828435 - RNA, 19 nt, Homo sapiens
gcacuuauaucaucuuaca

SEQ ID NO: 828436 - RNA, 19 nt, Homo sapiens
gaacugugccugguaaaua

SEQ ID NO: 828437 - RNA, 19 nt, Homo sapiens
guacuuaggcuucaaauug

SEQ ID NO: 828438 - RNA, 19 nt, Homo sapiens
gcaauguuguguuaaacua

SEQ ID NO: 828439 - RNA, 19 nt, Homo sapiens
agacuuaccuugauucuga

SEQ ID NO: 828440 - RNA, 19 nt, Homo sapiens
aaagauaggcuucuguuua

SEQ ID NO: 828441 - RNA, 19 nt, Homo sapiens
ucaagaaccuagaagcaua

SEQ ID NO: 828442 - RNA, 19 nt, Homo sapiens
gaggauaugucucuggauu

SEQ ID NO: 828443 - RNA, 19 nt, Homo sapiens
gaacuaggcagauugaaug

SEQ ID NO: 828444 - RNA, 19 nt, Homo sapiens
gggaugaaaucucacauau

SEQ ID NO: 828445 - RNA, 19 nt, Homo sapiens
gaaggagccuaaacugaau

SEQ ID NO: 828446 - RNA, 19 nt, Homo sapiens
gaagaagaaaugaauggua

SEQ ID NO: 828447 - RNA, 19 nt, Homo sapiens
aaccagcucuuucaaauuu

SEQ ID NO: 828448 - RNA, 19 nt, Homo sapiens
guacuugaauuaucucaug

SEQ ID NO: 828449 - RNA, 19 nt, Homo sapiens
gagguggucuuaguaguaa

SEQ ID NO: 828450 - RNA, 19 nt, Homo sapiens
uaacagugcaguuucauuu

SEQ ID NO: 828451 - RNA, 19 nt, Homo sapiens
cucgauaccucaagauuua

SEQ ID NO: 828452 - RNA, 19 nt, Homo sapiens
agaaacaucugguugaaau

SEQ ID NO: 828453 - RNA, 19 nt, Homo sapiens
gcacugaugaugccuauga

SEQ ID NO: 828454 - RNA, 19 nt, Homo sapiens
gcucuuagauacugaagga

SEQ ID NO: 828455 - RNA, 19 nt, Homo sapiens
uaaaggaacuaggcagauu

SEQ ID NO: 828456 - RNA, 19 nt, Homo sapiens
acucagagcuuauuacuag

SEQ ID NO: 828457 - RNA, 19 nt, Homo sapiens
guacaguggugcaaucuca

SEQ ID NO: 828458 - RNA, 19 nt, Homo sapiens
gaaaacauaucgcuuagga

SEQ ID NO: 828459 - RNA, 19 nt, Homo sapiens
aagauaggcuucuguuuau

SEQ ID NO: 828460 - RNA, 19 nt, Homo sapiens
ucucuaaugucaccugaua

SEQ ID NO: 828461 - RNA, 19 nt, Homo sapiens
caaauuaggcaauacagaa

SEQ ID NO: 828462 - RNA, 19 nt, Homo sapiens
ggaaaggcaugucauacca

SEQ ID NO: 828463 - RNA, 19 nt, Homo sapiens
guagaugguuugcaugaga

SEQ ID NO: 828464 - RNA, 19 nt, Homo sapiens
uuaguccacuuucagauua

SEQ ID NO: 828465 - RNA, 19 nt, Homo sapiens
gaguauugaucaucugaaa

SEQ ID NO: 828466 - RNA, 19 nt, Homo sapiens
gacuugcaauguuguguua

SEQ ID NO: 828467 - RNA, 19 nt, Homo sapiens
gaaagagaccaaaggauca

SEQ ID NO: 828468 - RNA, 19 nt, Homo sapiens
gcagucagcucuuuuagaa

SEQ ID NO: 828469 - RNA, 19 nt, Homo sapiens
gaauuggauugccuuauca

SEQ ID NO: 828470 - RNA, 19 nt, Homo sapiens
ucgaaaugcuccagaauug

SEQ ID NO: 828471 - RNA, 19 nt, Homo sapiens
gaaugucuaucagaagaaa

SEQ ID NO: 828472 - RNA, 19 nt, Homo sapiens
gaccauaagcuacauuuga

SEQ ID NO: 828473 - RNA, 19 nt, Homo sapiens
cagaaaugcuuguacuaga

SEQ ID NO: 828474 - RNA, 19 nt, Homo sapiens
ucaagucagucucaagaaa

SEQ ID NO: 828475 - RNA, 19 nt, Homo sapiens
gcaaucgucuccugaugug

SEQ ID NO: 828476 - RNA, 19 nt, Homo sapiens
ugaaagauaccaacucuga

SEQ ID NO: 828477 - RNA, 19 nt, Homo sapiens
aaaccaucaugaucuguua

SEQ ID NO: 828478 - RNA, 19 nt, Homo sapiens
gauugagguuucucuguuu

SEQ ID NO: 828479 - RNA, 19 nt, Homo sapiens
ucaaccagcucuuucaaau

SEQ ID NO: 828480 - RNA, 19 nt, Homo sapiens
ggauagagucaaagaauug

SEQ ID NO: 828481 - RNA, 19 nt, Homo sapiens
acucaagacuccauaacua

SEQ ID NO: 828482 - RNA, 19 nt, Homo sapiens
ggagaaggcccugaaauca

SEQ ID NO: 828483 - RNA, 19 nt, Homo sapiens
gaacaaguacagcauuuua

SEQ ID NO: 828484 - RNA, 19 nt, Homo sapiens
gaacuuuggcacuuuagaa

SEQ ID NO: 828485 - RNA, 19 nt, Homo sapiens
ggagagaacagcaauucaa

SEQ ID NO: 828486 - RNA, 19 nt, Homo sapiens
ggaugaaaucucacauaua

SEQ ID NO: 828487 - RNA, 19 nt, Homo sapiens
gaaacugauuccaauuaca

SEQ ID NO: 828488 - RNA, 19 nt, Homo sapiens
uccauaggcuguuuaauug

SEQ ID NO: 828489 - RNA, 19 nt, Homo sapiens
cauuauaucuggaaagcaa

SEQ ID NO: 828490 - RNA, 19 nt, Homo sapiens
guguaucaguuaccuauuu

SEQ ID NO: 828491 - RNA, 19 nt, Homo sapiens
agacaagaauuggaaguaa

SEQ ID NO: 828492 - RNA, 19 nt, Homo sapiens
ggaauguauugcagccuuu

SEQ ID NO: 828493 - RNA, 19 nt, Homo sapiens
auacuuagguccaaaugaa

SEQ ID NO: 828494 - RNA, 19 nt, Homo sapiens
cuacauuucuucacguauu

SEQ ID NO: 828495 - RNA, 19 nt, Homo sapiens
uagaacaaguacagcauuu

SEQ ID NO: 828496 - RNA, 19 nt, Homo sapiens
ggauaugucucuggauuca

SEQ ID NO: 828497 - RNA, 19 nt, Homo sapiens
ccaguuagaaccugaagua

SEQ ID NO: 828498 - RNA, 19 nt, Homo sapiens
ggcuuuaacugaaguagaa

SEQ ID NO: 828499 - RNA, 19 nt, Homo sapiens
guacuagaccaccucauuu

SEQ ID NO: 828500 - RNA, 19 nt, Homo sapiens
gcaggagacuacuuuccaa

SEQ ID NO: 828501 - RNA, 19 nt, Homo sapiens
gagaaggagccuaaacuga

SEQ ID NO: 828502 - RNA, 19 nt, Homo sapiens
uaacagagaagaacaucaa

SEQ ID NO: 828503 - RNA, 19 nt, Homo sapiens
gcaacgacacauagucuuu

SEQ ID NO: 828504 - RNA, 19 nt, Homo sapiens
gaaacauggugagaaacaa

SEQ ID NO: 828505 - RNA, 19 nt, Homo sapiens
gaagagacugaaauacauu

SEQ ID NO: 828506 - RNA, 19 nt, Homo sapiens
ugaagagacugaaauacau

SEQ ID NO: 828507 - RNA, 19 nt, Homo sapiens
gaggaaggacuuaacugua

SEQ ID NO: 828508 - RNA, 19 nt, Homo sapiens
gcaacgccagacuauauua

SEQ ID NO: 828509 - RNA, 19 nt, Homo sapiens
guauuucaguuccuaaguu

SEQ ID NO: 828510 - RNA, 19 nt, Homo sapiens
acagaacuuuggcacuuua

SEQ ID NO: 828511 - RNA, 19 nt, Homo sapiens
ggaaguauaaugggaauau

SEQ ID NO: 828512 - RNA, 19 nt, Homo sapiens
gauauaguaugcucugaag

SEQ ID NO: 828513 - RNA, 19 nt, Homo sapiens
caagaugcuuuccaguuau

SEQ ID NO: 828514 - RNA, 19 nt, Homo sapiens
gcauuccacuucggcuuua

SEQ ID NO: 828515 - RNA, 19 nt, Homo sapiens
gaaacaaacaccagacaca

SEQ ID NO: 828516 - RNA, 19 nt, Homo sapiens
gacgguaucuucuguauga

SEQ ID NO: 828517 - RNA, 19 nt, Homo sapiens
gcacagaauuccuccauag

SEQ ID NO: 828518 - RNA, 19 nt, Homo sapiens
gaagggaccugggaagaga

SEQ ID NO: 828519 - RNA, 19 nt, Homo sapiens
gggcugaaguuaauuguuc

SEQ ID NO: 828520 - RNA, 19 nt, Homo sapiens
aaaggaauaugaagagcua

SEQ ID NO: 828521 - RNA, 19 nt, Homo sapiens
gggaaagaauacugggaua

SEQ ID NO: 828522 - RNA, 19 nt, Homo sapiens
ggacggaggcguugcgauu

SEQ ID NO: 828523 - RNA, 19 nt, Homo sapiens
ggaugaagaugaaggucaa

SEQ ID NO: 828524 - RNA, 19 nt, Homo sapiens
ccacagaugccgucagaaa

SEQ ID NO: 828525 - RNA, 19 nt, Homo sapiens
gcgcagggaugucuauauc

SEQ ID NO: 828526 - RNA, 19 nt, Homo sapiens
gaucuuccaagucucaaua

SEQ ID NO: 828527 - RNA, 19 nt, Homo sapiens
caggaggacuggaugaaga

SEQ ID NO: 828528 - RNA, 19 nt, Homo sapiens
ggccacagaugccgucaga

SEQ ID NO: 828529 - RNA, 19 nt, Homo sapiens
cuaaacgucuccugucugu

SEQ ID NO: 828530 - RNA, 19 nt, Homo sapiens
ggucauuuccauacuguuu

SEQ ID NO: 828531 - RNA, 19 nt, Homo sapiens
ggaguccaccugagaagaa

SEQ ID NO: 828532 - RNA, 19 nt, Homo sapiens
agacagagccgagaaccua

SEQ ID NO: 828533 - RNA, 19 nt, Homo sapiens
uagcuggccucgucucaga

SEQ ID NO: 828534 - RNA, 19 nt, Homo sapiens
auagcaggcuguuggcaua

SEQ ID NO: 828535 - RNA, 19 nt, Homo sapiens
gaagauccgcagccucaug

SEQ ID NO: 828536 - RNA, 19 nt, Homo sapiens
cgaccacuauggagggaaa

SEQ ID NO: 828537 - RNA, 19 nt, Homo sapiens
ugaagacucugcugaagac

SEQ ID NO: 828538 - RNA, 19 nt, Homo sapiens
guacuacagaggaugguuu

SEQ ID NO: 828539 - RNA, 19 nt, Homo sapiens
guauugaucagcuccugua

SEQ ID NO: 828540 - RNA, 19 nt, Homo sapiens
ucacaguggucauuuccau

SEQ ID NO: 828541 - RNA, 19 nt, Homo sapiens
gacggaggcguugcgauua

SEQ ID NO: 828542 - RNA, 19 nt, Homo sapiens
ucagaaaggaauaugaaga

SEQ ID NO: 828543 - RNA, 19 nt, Homo sapiens
gcagauggucgccuguguu

SEQ ID NO: 828544 - RNA, 19 nt, Homo sapiens
uuuacguccugcaaaguua

SEQ ID NO: 828545 - RNA, 19 nt, Homo sapiens
gaaucuggugggcccuuua

SEQ ID NO: 828546 - RNA, 19 nt, Homo sapiens
gaguccaccugagaagaaa

SEQ ID NO: 828547 - RNA, 19 nt, Homo sapiens
ucccugggcugaaguuaau

SEQ ID NO: 828548 - RNA, 19 nt, Homo sapiens
ccaaguacucggugucaga

SEQ ID NO: 828549 - RNA, 19 nt, Homo sapiens
gacaggauguacccagucu

SEQ ID NO: 828550 - RNA, 19 nt, Homo sapiens
uacccgagauggugagguu

SEQ ID NO: 828551 - RNA, 19 nt, Homo sapiens
cgucagaaaggaauaugaa

SEQ ID NO: 828552 - RNA, 19 nt, Homo sapiens
ggaggugggagacgaguuc

SEQ ID NO: 828553 - RNA, 19 nt, Homo sapiens
gaggaugguuuugggguua

SEQ ID NO: 828554 - RNA, 19 nt, Homo sapiens
gcagagggguggaaagaag

SEQ ID NO: 828555 - RNA, 19 nt, Homo sapiens
ggacaagcacgaguacuac

SEQ ID NO: 828556 - RNA, 19 nt, Homo sapiens
cggauucccuggucugagu

SEQ ID NO: 828557 - RNA, 19 nt, Homo sapiens
guucuucugucccaaguac

SEQ ID NO: 828558 - RNA, 19 nt, Homo sapiens
caucgaguaugagcaguuc

SEQ ID NO: 828559 - RNA, 19 nt, Homo sapiens
cagaaaggaauaugaagag

SEQ ID NO: 828560 - RNA, 19 nt, Homo sapiens
ggaaagaauacugggauac

SEQ ID NO: 828561 - RNA, 19 nt, Homo sapiens
gagccgagaaccuacuuca

SEQ ID NO: 828562 - RNA, 19 nt, Homo sapiens
cagaugccgucagaaagga

SEQ ID NO: 828563 - RNA, 19 nt, Homo sapiens
caagcacgaguacuacaga

SEQ ID NO: 828564 - RNA, 19 nt, Homo sapiens
gcaguucaucgcagaaucu

SEQ ID NO: 828565 - RNA, 19 nt, Homo sapiens
gaggacuggaugaagauga

SEQ ID NO: 828566 - RNA, 19 nt, Homo sapiens
ggaggcguugcgauuauug

SEQ ID NO: 828567 - RNA, 19 nt, Homo sapiens
aggacuggaugaagaugaa

SEQ ID NO: 828568 - RNA, 19 nt, Homo sapiens
aggacaagcacgaguacua

SEQ ID NO: 828569 - RNA, 19 nt, Homo sapiens
cggaggcguugcgauuauu

SEQ ID NO: 828570 - RNA, 19 nt, Homo sapiens
gaaagaauacugggauacc

SEQ ID NO: 828571 - RNA, 19 nt, Homo sapiens
uugaucagcuccuguacuc

SEQ ID NO: 828572 - RNA, 19 nt, Homo sapiens
ugcacagaauuccuccaua

SEQ ID NO: 828573 - RNA, 19 nt, Homo sapiens
guggucauuuccauacugu

SEQ ID NO: 828574 - RNA, 19 nt, Homo sapiens
ccgagauggugagguuuga

SEQ ID NO: 828575 - RNA, 19 nt, Homo sapiens
cagauggucgccuguguuc

SEQ ID NO: 828576 - RNA, 19 nt, Homo sapiens
acggaggcguugcgauuau

SEQ ID NO: 828577 - RNA, 19 nt, Homo sapiens
cuggugggcccuuuauuga

SEQ ID NO: 828578 - RNA, 19 nt, Homo sapiens
guuuacguccugcaaaguu

SEQ ID NO: 828579 - RNA, 19 nt, Homo sapiens
ucuggugggcccuuuauug

SEQ ID NO: 828580 - RNA, 19 nt, Homo sapiens
gcaucugguucaguguuuc

SEQ ID NO: 828581 - RNA, 19 nt, Homo sapiens
gagcaguucaucgcagaau

SEQ ID NO: 828582 - RNA, 19 nt, Homo sapiens
ccugaagacucugcugaag

SEQ ID NO: 828583 - RNA, 19 nt, Homo sapiens
gcccuuuauugaccagguu

SEQ ID NO: 828584 - RNA, 19 nt, Homo sapiens
cacaguggucauuuccaua

SEQ ID NO: 828585 - RNA, 19 nt, Homo sapiens
acuauggagggaaagaaua

SEQ ID NO: 828586 - RNA, 19 nt, Homo sapiens
aaucgccucucuccugaag

SEQ ID NO: 828587 - RNA, 19 nt, Homo sapiens
aagauccgcagccucauga

SEQ ID NO: 828588 - RNA, 19 nt, Homo sapiens
gucuaaacgucuccugucu

SEQ ID NO: 828589 - RNA, 19 nt, Homo sapiens
agaaucuggugggcccuuu

SEQ ID NO: 828590 - RNA, 19 nt, Homo sapiens
ggacagcucugcacugauu

SEQ ID NO: 828591 - RNA, 19 nt, Homo sapiens
gcaagucccucuccucuuu

SEQ ID NO: 828592 - RNA, 19 nt, Homo sapiens
ggagggaucugccuuugua

SEQ ID NO: 828593 - RNA, 19 nt, Homo sapiens
ggauuuaccuuuauuagug

SEQ ID NO: 828594 - RNA, 19 nt, Homo sapiens
gagagaaacuggacuggaa

SEQ ID NO: 828595 - RNA, 19 nt, Homo sapiens
gaaacccugucuuuacuaa

SEQ ID NO: 828596 - RNA, 19 nt, Homo sapiens
ggaaauguguauuauggaa

SEQ ID NO: 828597 - RNA, 19 nt, Homo sapiens
ggacuggaaauguguauua

SEQ ID NO: 828598 - RNA, 19 nt, Homo sapiens
acauugagcuuccuugaua

SEQ ID NO: 828599 - RNA, 19 nt, Homo sapiens
ccacuucucugcuuauauu

SEQ ID NO: 828600 - RNA, 19 nt, Homo sapiens
gagaacggcuucacccaaa

SEQ ID NO: 828601 - RNA, 19 nt, Homo sapiens
gauaaggacuggaaaugug

SEQ ID NO: 828602 - RNA, 19 nt, Homo sapiens
ggugacagguggcauguuu

SEQ ID NO: 828603 - RNA, 19 nt, Homo sapiens
gggaagaggugggauuaaa

SEQ ID NO: 828604 - RNA, 19 nt, Homo sapiens
gggcaccucuuaauucauu

SEQ ID NO: 828605 - RNA, 19 nt, Homo sapiens
gcucugcacugauugcuuu

SEQ ID NO: 828606 - RNA, 19 nt, Homo sapiens
gggaugagcugaaugucaa

SEQ ID NO: 828607 - RNA, 19 nt, Homo sapiens
ccaccuaguugauaguuaa

SEQ ID NO: 828608 - RNA, 19 nt, Homo sapiens
guugauaugucacucagua

SEQ ID NO: 828609 - RNA, 19 nt, Homo sapiens
uaaauuacaggcuaccuua

SEQ ID NO: 828610 - RNA, 19 nt, Homo sapiens
ggaaaguucucuggguauu

SEQ ID NO: 828611 - RNA, 19 nt, Homo sapiens
gaggugggauuaaaguuga

SEQ ID NO: 828612 - RNA, 19 nt, Homo sapiens
cagguggcauguuucauua

SEQ ID NO: 828613 - RNA, 19 nt, Homo sapiens
guauuuccaugcuauguuu

SEQ ID NO: 828614 - RNA, 19 nt, Homo sapiens
gagcaugaauagcaagaga

SEQ ID NO: 828615 - RNA, 19 nt, Homo sapiens
gaagugggauuagaagaca

SEQ ID NO: 828616 - RNA, 19 nt, Homo sapiens
cagccucgaucccguauuu

SEQ ID NO: 828617 - RNA, 19 nt, Homo sapiens
ugaauaagaagugggauua

SEQ ID NO: 828618 - RNA, 19 nt, Homo sapiens
ggauagugaucaugucuag

SEQ ID NO: 828619 - RNA, 19 nt, Homo sapiens
gaagaauaaggaggauuua

SEQ ID NO: 828620 - RNA, 19 nt, Homo sapiens
ucacuucucuucugacauc

SEQ ID NO: 828621 - RNA, 19 nt, Homo sapiens
gacauucuguggaucaguu

SEQ ID NO: 828622 - RNA, 19 nt, Homo sapiens
gaucuucccacaauacuug

SEQ ID NO: 828623 - RNA, 19 nt, Homo sapiens
caggacagcucugcacuga

SEQ ID NO: 828624 - RNA, 19 nt, Homo sapiens
caagcaggaugagauugua

SEQ ID NO: 828625 - RNA, 19 nt, Homo sapiens
ccacaauacuugccuaagg

SEQ ID NO: 828626 - RNA, 19 nt, Homo sapiens
gugaucaugucuaguaaau

SEQ ID NO: 828627 - RNA, 19 nt, Homo sapiens
ggaggauuuaccuuuauua

SEQ ID NO: 828628 - RNA, 19 nt, Homo sapiens
ugaagaauaaggaggauuu

SEQ ID NO: 828629 - RNA, 19 nt, Homo sapiens
caugcuauguuuacaaaug

SEQ ID NO: 828630 - RNA, 19 nt, Homo sapiens
gggccaaguugauauguca

SEQ ID NO: 828631 - RNA, 19 nt, Homo sapiens
gagagaugccgucccauga

SEQ ID NO: 828632 - RNA, 19 nt, Homo sapiens
uaguuaaucucaugcaguu

SEQ ID NO: 828633 - RNA, 19 nt, Homo sapiens
guugauaguuaaucucaug

SEQ ID NO: 828634 - RNA, 19 nt, Homo sapiens
cgacgugacccucaagauu

SEQ ID NO: 828635 - RNA, 19 nt, Homo sapiens
gaagaggugggauuaaagu

SEQ ID NO: 828636 - RNA, 19 nt, Homo sapiens
gacaggagcacauagguau

SEQ ID NO: 828637 - RNA, 19 nt, Homo sapiens
gcagggagaauugcuuaaa

SEQ ID NO: 828638 - RNA, 19 nt, Homo sapiens
gaucugcccucccaagaac

SEQ ID NO: 828639 - RNA, 19 nt, Homo sapiens
gauauaugccuaauguugu

SEQ ID NO: 828640 - RNA, 19 nt, Homo sapiens
cuugauauaugccuaaugu

SEQ ID NO: 828641 - RNA, 19 nt, Homo sapiens
gacgugacccucaagauug

SEQ ID NO: 828642 - RNA, 19 nt, Homo sapiens
uguggaaguuguguuguua

SEQ ID NO: 828643 - RNA, 19 nt, Homo sapiens
gaaggauagugaucauguc

SEQ ID NO: 828644 - RNA, 19 nt, Homo sapiens
gaaacuugaagaauaagga

SEQ ID NO: 828645 - RNA, 19 nt, Homo sapiens
gcccgaacauacacacuga

SEQ ID NO: 828646 - RNA, 19 nt, Homo sapiens
gcaagcaggaugagauugu

SEQ ID NO: 828647 - RNA, 19 nt, Homo sapiens
ccacuuccuugcuuugaug

SEQ ID NO: 828648 - RNA, 19 nt, Homo sapiens
cggaggagcuggaggaucu

SEQ ID NO: 828649 - RNA, 19 nt, Homo sapiens
gguggcauguuucauuaug

SEQ ID NO: 828650 - RNA, 19 nt, Homo sapiens
gagaugccgucccaugaca

SEQ ID NO: 828651 - RNA, 19 nt, Homo sapiens
aaagggacauucuguggau

SEQ ID NO: 828652 - RNA, 19 nt, Homo sapiens
ccauagaccuuucuuacac

SEQ ID NO: 828653 - RNA, 19 nt, Homo sapiens
ugauauaugccuaauguug

SEQ ID NO: 828654 - RNA, 19 nt, Homo sapiens
aauaagaagugggauuaga

SEQ ID NO: 828655 - RNA, 19 nt, Homo sapiens
aaacuggacuggaacuucu

SEQ ID NO: 828656 - RNA, 19 nt, Homo sapiens
ggaaguuguguuguuauuu

SEQ ID NO: 828657 - RNA, 19 nt, Homo sapiens
ugaacgggcuucucuaugc

SEQ ID NO: 828658 - RNA, 19 nt, Homo sapiens
gaucaacuuugccuacaac

SEQ ID NO: 828659 - RNA, 19 nt, Homo sapiens
uaugguggcucacgccuau

SEQ ID NO: 828660 - RNA, 19 nt, Homo sapiens
gagcuuccuugauauaugc

SEQ ID NO: 828661 - RNA, 19 nt, Homo sapiens
gaaacuggacuggaacuuc

SEQ ID NO: 828662 - RNA, 19 nt, Homo sapiens
gcuaaggcagggagaauug

SEQ ID NO: 828663 - RNA, 19 nt, Homo sapiens
gugaaacccugucuuuacu

SEQ ID NO: 828664 - RNA, 19 nt, Homo sapiens
ggugaaacccugucuuuac

SEQ ID NO: 828665 - RNA, 19 nt, Homo sapiens
gugacauccugccaucuuu

SEQ ID NO: 828666 - RNA, 19 nt, Homo sapiens
gcagucagcuguccuuccu

SEQ ID NO: 828667 - RNA, 19 nt, Homo sapiens
ggaugagauuguaaugcaa

SEQ ID NO: 828668 - RNA, 19 nt, Homo sapiens
auagugaucaugucuagua

SEQ ID NO: 828669 - RNA, 19 nt, Homo sapiens
aaacguuccuagucacuuc

SEQ ID NO: 828670 - RNA, 19 nt, Homo sapiens
gagaccaguucacaaagca

SEQ ID NO: 828671 - RNA, 19 nt, Homo sapiens
gugcguugcugccacaaau

SEQ ID NO: 828672 - RNA, 19 nt, Homo sapiens
ccuauaaucccagcacuuu

SEQ ID NO: 828673 - RNA, 19 nt, Homo sapiens
ucacaaagcaucggaguag

SEQ ID NO: 828674 - RNA, 19 nt, Homo sapiens
uggaggaucuggugcacuu

SEQ ID NO: 828675 - RNA, 19 nt, Homo sapiens
cugcuuauauugucugaau

SEQ ID NO: 828676 - RNA, 19 nt, Homo sapiens
ugaaugugguggaaguguu

SEQ ID NO: 828677 - RNA, 19 nt, Homo sapiens
ccaguuugcugagacaaug

SEQ ID NO: 828678 - RNA, 19 nt, Homo sapiens
cuuccuugcuuugauguua

SEQ ID NO: 828679 - RNA, 19 nt, Homo sapiens
guuuacaaaugacaugaug

SEQ ID NO: 828680 - RNA, 19 nt, Homo sapiens
uggaaguuguguuguuauu

SEQ ID NO: 828681 - RNA, 19 nt, Homo sapiens
uggaggcucugaucaacuu

SEQ ID NO: 828682 - RNA, 19 nt, Homo sapiens
gguagcagcaagccaggua

SEQ ID NO: 828683 - RNA, 19 nt, Homo sapiens
ccagaaggauagugaucau

SEQ ID NO: 828684 - RNA, 19 nt, Homo sapiens
gagauuguaaugcaaggaa

SEQ ID NO: 828685 - RNA, 19 nt, Homo sapiens
ggaagaggugggauuaaag

SEQ ID NO: 828686 - RNA, 19 nt, Homo sapiens
cuggaaauguguauuaugg

SEQ ID NO: 828687 - RNA, 19 nt, Homo sapiens
gacuggaaauguguauuau

SEQ ID NO: 828688 - RNA, 19 nt, Homo sapiens
ccaguuccuuucagacaga

SEQ ID NO: 828689 - RNA, 19 nt, Homo sapiens
cuagucacuucucuucuga

SEQ ID NO: 828690 - RNA, 19 nt, Homo sapiens
gcacgguggugguggauua

SEQ ID NO: 828691 - RNA, 19 nt, Homo sapiens
gcacagguaccuccucuuu

SEQ ID NO: 828692 - RNA, 19 nt, Homo sapiens
gagaugggcugcuggacaa

SEQ ID NO: 828693 - RNA, 19 nt, Homo sapiens
caugauggcugcugcuuug

SEQ ID NO: 828694 - RNA, 19 nt, Homo sapiens
ccaacaccauccaggaaua

SEQ ID NO: 828695 - RNA, 19 nt, Homo sapiens
acagguaccuccucuuuau

SEQ ID NO: 828696 - RNA, 19 nt, Homo sapiens
gcaagaccguggugucaca

SEQ ID NO: 828697 - RNA, 19 nt, Homo sapiens
gagaaagggccauauucaa

SEQ ID NO: 828698 - RNA, 19 nt, Homo sapiens
agaccaagaugcagauguu

SEQ ID NO: 828699 - RNA, 19 nt, Homo sapiens
caagaacuacuuugacuuc

SEQ ID NO: 828700 - RNA, 19 nt, Homo sapiens
ggaacaacaucuucuucag

SEQ ID NO: 828701 - RNA, 19 nt, Homo sapiens
ccaagaagcggaauaagag

SEQ ID NO: 828702 - RNA, 19 nt, Homo sapiens
uuacggaucccgggaguua

SEQ ID NO: 828703 - RNA, 19 nt, Homo sapiens
ccaaggaaagcuccgagua

SEQ ID NO: 828704 - RNA, 19 nt, Homo sapiens
gccaggaggccaagaacua

SEQ ID NO: 828705 - RNA, 19 nt, Homo sapiens
cgagaaagggccauauuca

SEQ ID NO: 828706 - RNA, 19 nt, Homo sapiens
gccaagaacuacuuugacu

SEQ ID NO: 828707 - RNA, 19 nt, Homo sapiens
caggagcucuggaagaaca

SEQ ID NO: 828708 - RNA, 19 nt, Homo sapiens
ggauuucucaggucauuug

SEQ ID NO: 828709 - RNA, 19 nt, Homo sapiens
cagcaccgccuucgacauu

SEQ ID NO: 828710 - RNA, 19 nt, Homo sapiens
cagcauggccagcgucuug

SEQ ID NO: 828711 - RNA, 19 nt, Homo sapiens
ccgacgagcuggucuccaa

SEQ ID NO: 828712 - RNA, 19 nt, Homo sapiens
ggccugcggucugaaugua

SEQ ID NO: 828713 - RNA, 19 nt, Homo sapiens
gggcccagccugucugaaa

SEQ ID NO: 828714 - RNA, 19 nt, Homo sapiens
uuucucaggucauuuguau

SEQ ID NO: 828715 - RNA, 19 nt, Homo sapiens
gagcagcugaacgucauua

SEQ ID NO: 828716 - RNA, 19 nt, Homo sapiens
gcagaaggcggugcugaug

SEQ ID NO: 828717 - RNA, 19 nt, Homo sapiens
acgcagaggcccugaguaa

SEQ ID NO: 828718 - RNA, 19 nt, Homo sapiens
ugaauggcguccgcacgua

SEQ ID NO: 828719 - RNA, 19 nt, Homo sapiens
ccucggaugccuuccauuu

SEQ ID NO: 828720 - RNA, 19 nt, Homo sapiens
gacgugaugucgcuucucu

SEQ ID NO: 828721 - RNA, 19 nt, Homo sapiens
uaacggcauccucuucauu

SEQ ID NO: 828722 - RNA, 19 nt, Homo sapiens
ggagcugccucgcaagaac

SEQ ID NO: 828723 - RNA, 19 nt, Homo sapiens
gcgcagacgggauuucuca

SEQ ID NO: 828724 - RNA, 19 nt, Homo sapiens
cuucaauccugacaucuuc

SEQ ID NO: 828725 - RNA, 19 nt, Homo sapiens
ggauguggccacccugaga

SEQ ID NO: 828726 - RNA, 19 nt, Homo sapiens
gacaggaggcgggaaguga

SEQ ID NO: 828727 - RNA, 19 nt, Homo sapiens
agaaagggccauauucaag

SEQ ID NO: 828728 - RNA, 19 nt, Homo sapiens
ccagcuggaccacgucuuu

SEQ ID NO: 828729 - RNA, 19 nt, Homo sapiens
gguaccuccucuuuaugaa

SEQ ID NO: 828730 - RNA, 19 nt, Homo sapiens
caaggaaagcuccgaguac

SEQ ID NO: 828731 - RNA, 19 nt, Homo sapiens
acaugcaccuggcccugua

SEQ ID NO: 828732 - RNA, 19 nt, Homo sapiens
gcaccaugaacgagaucua

SEQ ID NO: 828733 - RNA, 19 nt, Homo sapiens
ggagggcugugagcucauc

SEQ ID NO: 828734 - RNA, 19 nt, Homo sapiens
cgggagaucucgcugaaaa

SEQ ID NO: 828735 - RNA, 19 nt, Homo sapiens
cacagguaccuccucuuua

SEQ ID NO: 828736 - RNA, 19 nt, Homo sapiens
gcgaggagaccaagaugca

SEQ ID NO: 828737 - RNA, 19 nt, Homo sapiens
caugagaagaccaaggaaa

SEQ ID NO: 828738 - RNA, 19 nt, Homo sapiens
gcuggaccacgucuuuaaa

SEQ ID NO: 828739 - RNA, 19 nt, Homo sapiens
aaccaucacguccucauuu

SEQ ID NO: 828740 - RNA, 19 nt, Homo sapiens
gaggaggacgugcucaaca

SEQ ID NO: 828741 - RNA, 19 nt, Homo sapiens
ggaguacagcuucgacagu

SEQ ID NO: 828742 - RNA, 19 nt, Homo sapiens
ggagcugccugaggaaugc

SEQ ID NO: 828743 - RNA, 19 nt, Homo sapiens
gguuacaccaucuacaaga

SEQ ID NO: 828744 - RNA, 19 nt, Homo sapiens
ggacgugcucaacaucuuc

SEQ ID NO: 828745 - RNA, 19 nt, Homo sapiens
uccaagaagcggaauaaga

SEQ ID NO: 828746 - RNA, 19 nt, Homo sapiens
guccagacaccuuguuuca

SEQ ID NO: 828747 - RNA, 19 nt, Homo sapiens
cgggauuucucaggucauu

SEQ ID NO: 828748 - RNA, 19 nt, Homo sapiens
gagcgugcagggauagaga

SEQ ID NO: 828749 - RNA, 19 nt, Homo sapiens
agaaggcggugcugaugag

SEQ ID NO: 828750 - RNA, 19 nt, Homo sapiens
cagaaggcggugcugauga

SEQ ID NO: 828751 - RNA, 19 nt, Homo sapiens
ucggaugccuuccauuucu

SEQ ID NO: 828752 - RNA, 19 nt, Homo sapiens
ccuacggccugcagaagau

SEQ ID NO: 828753 - RNA, 19 nt, Homo sapiens
ggaggccaagaacuacuuu

SEQ ID NO: 828754 - RNA, 19 nt, Homo sapiens
gcagaggcccugaguaacc

SEQ ID NO: 828755 - RNA, 19 nt, Homo sapiens
ccaagaacuacuuugacuu

SEQ ID NO: 828756 - RNA, 19 nt, Homo sapiens
cagcuggaccacgucuuua

SEQ ID NO: 828757 - RNA, 19 nt, Homo sapiens
agaacuacuuugacuucga

SEQ ID NO: 828758 - RNA, 19 nt, Homo sapiens
aaagggccauauucaaggu

SEQ ID NO: 828759 - RNA, 19 nt, Homo sapiens
ggcccagccugucugaaag

SEQ ID NO: 828760 - RNA, 19 nt, Homo sapiens
cgagagcaaagcugaguuc

SEQ ID NO: 828761 - RNA, 19 nt, Homo sapiens
uggagcagcugaacgucau

SEQ ID NO: 828762 - RNA, 19 nt, Homo sapiens
gggcgaggaccaugagaag

SEQ ID NO: 828763 - RNA, 19 nt, Homo sapiens
ucgcuucaauccugacauc

SEQ ID NO: 828764 - RNA, 19 nt, Homo sapiens
gcaccgccuucgacauucg

SEQ ID NO: 828765 - RNA, 19 nt, Homo sapiens
ccgagaaagggccauauuc

SEQ ID NO: 828766 - RNA, 19 nt, Homo sapiens
cgagugcaagggcaucauu

SEQ ID NO: 828767 - RNA, 19 nt, Homo sapiens
gcgaggaccaugagaagac

SEQ ID NO: 828768 - RNA, 19 nt, Homo sapiens
ggaggacgugcucaacauc

SEQ ID NO: 828769 - RNA, 19 nt, Homo sapiens
ucucaggucauuuguaugg

SEQ ID NO: 828770 - RNA, 19 nt, Homo sapiens
gccagcagaaacagggaua

SEQ ID NO: 828771 - RNA, 19 nt, Homo sapiens
cagaggcccugaguaacca

SEQ ID NO: 828772 - RNA, 19 nt, Homo sapiens
gccacuuccugaacugcuu

SEQ ID NO: 828773 - RNA, 19 nt, Homo sapiens
uaaaaucggcauuggagaa

SEQ ID NO: 828774 - RNA, 19 nt, Homo sapiens
gcuucaauccugacaucuu

SEQ ID NO: 828775 - RNA, 19 nt, Homo sapiens
cagcagaaacagggauaga

SEQ ID NO: 828776 - RNA, 19 nt, Homo sapiens
caggaggccagcagaaaca

SEQ ID NO: 828777 - RNA, 19 nt, Homo sapiens
ccaagaugcagauguucau

SEQ ID NO: 828778 - RNA, 19 nt, Homo sapiens
cagcugaacgucauuaacg

SEQ ID NO: 828779 - RNA, 19 nt, Homo sapiens
cggaugccuuccauuucuu

SEQ ID NO: 828780 - RNA, 19 nt, Homo sapiens
aggaggacgugcucaacau

SEQ ID NO: 828781 - RNA, 19 nt, Homo sapiens
caaggugcacagcgacuuc

SEQ ID NO: 828782 - RNA, 19 nt, Homo sapiens
ucuccaagaagcggaauaa

SEQ ID NO: 828783 - RNA, 19 nt, Homo sapiens
gaccacgucuuuaaaaucg

SEQ ID NO: 828784 - RNA, 19 nt, Homo sapiens
cuacggcuccaucgacuuc

SEQ ID NO: 828785 - RNA, 19 nt, Homo sapiens
guccucauuucacauugga

SEQ ID NO: 828786 - RNA, 19 nt, Homo sapiens
ucauuuguauggucgacau

SEQ ID NO: 828787 - RNA, 19 nt, Homo sapiens
gaugagcgagcgggugaug

SEQ ID NO: 828788 - RNA, 19 nt, Homo sapiens
gagaccaagaugcagaugu

SEQ ID NO: 828789 - RNA, 19 nt, Homo sapiens
ucaaugaggcccugaaccu

SEQ ID NO: 828790 - RNA, 19 nt, Homo sapiens
cgaaacauguuacuucaaa

SEQ ID NO: 828791 - RNA, 19 nt, Homo sapiens
ggacaaugcugccagugaa

SEQ ID NO: 828792 - RNA, 19 nt, Homo sapiens
gaaggcagcuuugaucaug

SEQ ID NO: 828793 - RNA, 19 nt, Homo sapiens
ggacauuccuccucugaug

SEQ ID NO: 828794 - RNA, 19 nt, Homo sapiens
ccaggaagcucgaaacaug

SEQ ID NO: 828795 - RNA, 19 nt, Homo sapiens
gcaagaggauuggagauga

SEQ ID NO: 828796 - RNA, 19 nt, Homo sapiens
caaagaauaagcagcaaua

SEQ ID NO: 828797 - RNA, 19 nt, Homo sapiens
cauggaaacugaggucuua

SEQ ID NO: 828798 - RNA, 19 nt, Homo sapiens
ccuagaaccuaaucuuauu

SEQ ID NO: 828799 - RNA, 19 nt, Homo sapiens
gaacaaauccagaaaucca

SEQ ID NO: 828800 - RNA, 19 nt, Homo sapiens
ggaaucaugucgaguuugg

SEQ ID NO: 828801 - RNA, 19 nt, Homo sapiens
ugaagcaucuacaguaugu

SEQ ID NO: 828802 - RNA, 19 nt, Homo sapiens
gcagggagcaggcauacaa

SEQ ID NO: 828803 - RNA, 19 nt, Homo sapiens
ggagaucccagacugcuaa

SEQ ID NO: 828804 - RNA, 19 nt, Homo sapiens
gugcgucuguucacuuuaa

SEQ ID NO: 828805 - RNA, 19 nt, Homo sapiens
gcuguagucucaaauuuua

SEQ ID NO: 828806 - RNA, 19 nt, Homo sapiens
gaagccagccuagcaguuu

SEQ ID NO: 828807 - RNA, 19 nt, Homo sapiens
gaccuaauguucugcugaa

SEQ ID NO: 828808 - RNA, 19 nt, Homo sapiens
gcacaaguagugaugagaa

SEQ ID NO: 828809 - RNA, 19 nt, Homo sapiens
gaucccagacugcuaauug

SEQ ID NO: 828810 - RNA, 19 nt, Homo sapiens
ggagaaggcagcuuugauc

SEQ ID NO: 828811 - RNA, 19 nt, Homo sapiens
gaagaccugugaaggacau

SEQ ID NO: 828812 - RNA, 19 nt, Homo sapiens
gaaaauauuuggcuguagu

SEQ ID NO: 828813 - RNA, 19 nt, Homo sapiens
uaaaggaacaaauccagaa

SEQ ID NO: 828814 - RNA, 19 nt, Homo sapiens
gugcagaugucagauccua

SEQ ID NO: 828815 - RNA, 19 nt, Homo sapiens
gcucgaaacauguuacuuc

SEQ ID NO: 828816 - RNA, 19 nt, Homo sapiens
agaauaaggaggaguuaaa

SEQ ID NO: 828817 - RNA, 19 nt, Homo sapiens
gcagaugucagauccuaga

SEQ ID NO: 828818 - RNA, 19 nt, Homo sapiens
gcagauguuugagcugaug

SEQ ID NO: 828819 - RNA, 19 nt, Homo sapiens
aaacugcucauaaagacua

SEQ ID NO: 828820 - RNA, 19 nt, Homo sapiens
gguccuggucccauuaaua

SEQ ID NO: 828821 - RNA, 19 nt, Homo sapiens
gcuauggcuucugcgaaua

SEQ ID NO: 828822 - RNA, 19 nt, Homo sapiens
acuaaaaguugaccuguua

SEQ ID NO: 828823 - RNA, 19 nt, Homo sapiens
gaaacugaggucuuagaga

SEQ ID NO: 828824 - RNA, 19 nt, Homo sapiens
gaaguggagcccagagguu

SEQ ID NO: 828825 - RNA, 19 nt, Homo sapiens
aagcaucuacaguauguua

SEQ ID NO: 828826 - RNA, 19 nt, Homo sapiens
gaaaacugcucauaaagac

SEQ ID NO: 828827 - RNA, 19 nt, Homo sapiens
uggcuguagucucaaauuu

SEQ ID NO: 828828 - RNA, 19 nt, Homo sapiens
ggagacucgugccauggaa

SEQ ID NO: 828829 - RNA, 19 nt, Homo sapiens
uauugaagcaucuacagua

SEQ ID NO: 828830 - RNA, 19 nt, Homo sapiens
ccaggucacuccacaggau

SEQ ID NO: 828831 - RNA, 19 nt, Homo sapiens
ggagguugguucuguuguc

SEQ ID NO: 828832 - RNA, 19 nt, Homo sapiens
ggagaccugugcgauggaa

SEQ ID NO: 828833 - RNA, 19 nt, Homo sapiens
ccacuggagcgucuugaaa

SEQ ID NO: 828834 - RNA, 19 nt, Homo sapiens
gagaaggcagcuuugauca

SEQ ID NO: 828835 - RNA, 19 nt, Homo sapiens
gccaauaccagcugcaguu

SEQ ID NO: 828836 - RNA, 19 nt, Homo sapiens
gagcugaugaagcagauga

SEQ ID NO: 828837 - RNA, 19 nt, Homo sapiens
cagaguauccugauuuuaa

SEQ ID NO: 828838 - RNA, 19 nt, Homo sapiens
cugcagcgcccauuauuga

SEQ ID NO: 828839 - RNA, 19 nt, Homo sapiens
ggcuauggcuucugcgaau

SEQ ID NO: 828840 - RNA, 19 nt, Homo sapiens
auauuuggcuguagucuca

SEQ ID NO: 828841 - RNA, 19 nt, Homo sapiens
ggagcgucuugaaagguuu

SEQ ID NO: 828842 - RNA, 19 nt, Homo sapiens
ugagagacccggcaaugga

SEQ ID NO: 828843 - RNA, 19 nt, Homo sapiens
ccggaaucaugucgaguuu

SEQ ID NO: 828844 - RNA, 19 nt, Homo sapiens
agacaggucccaggcauuu

SEQ ID NO: 828845 - RNA, 19 nt, Homo sapiens
gauccuagagcuccuauac

SEQ ID NO: 828846 - RNA, 19 nt, Homo sapiens
gaauaaggaggaguuaaag

SEQ ID NO: 828847 - RNA, 19 nt, Homo sapiens
gagguugguucuguuguca

SEQ ID NO: 828848 - RNA, 19 nt, Homo sapiens
aggaacaaauccagaaauc

SEQ ID NO: 828849 - RNA, 19 nt, Homo sapiens
gaucaugcagguucuucaa

SEQ ID NO: 828850 - RNA, 19 nt, Homo sapiens
caagaggauuggagaugag

SEQ ID NO: 828851 - RNA, 19 nt, Homo sapiens
cuagaagaccugugaagga

SEQ ID NO: 828852 - RNA, 19 nt, Homo sapiens
ggaagcucgaaacauguua

SEQ ID NO: 828853 - RNA, 19 nt, Homo sapiens
uguuugagcugaugaagca

SEQ ID NO: 828854 - RNA, 19 nt, Homo sapiens
ggagggagugcgucuguuc

SEQ ID NO: 828855 - RNA, 19 nt, Homo sapiens
gagcaaaggcagaguaucc

SEQ ID NO: 828856 - RNA, 19 nt, Homo sapiens
acaaggaggagguauacaa

SEQ ID NO: 828857 - RNA, 19 nt, Homo sapiens
ggagggacuuugcuuucag

SEQ ID NO: 828858 - RNA, 19 nt, Homo sapiens
ccacugaucccaggcaaau

SEQ ID NO: 828859 - RNA, 19 nt, Homo sapiens
ggaagccagccuagcaguu

SEQ ID NO: 828860 - RNA, 19 nt, Homo sapiens
gguacaggcauacaaggaa

SEQ ID NO: 828861 - RNA, 19 nt, Homo sapiens
guccuggucccauuaauau

SEQ ID NO: 828862 - RNA, 19 nt, Homo sapiens
ggagggccauuaggagauc

SEQ ID NO: 828863 - RNA, 19 nt, Homo sapiens
aggaggagguauacaagga

SEQ ID NO: 828864 - RNA, 19 nt, Homo sapiens
cccuaugacugguggaauu

SEQ ID NO: 828865 - RNA, 19 nt, Homo sapiens
gaucaaaggggucuaccua

SEQ ID NO: 828866 - RNA, 19 nt, Homo sapiens
ggguuucccuccuccuaga

SEQ ID NO: 828867 - RNA, 19 nt, Homo sapiens
acacuuggauuaggguuuc

SEQ ID NO: 828868 - RNA, 19 nt, Homo sapiens
gagggacuuugcuuucagu

SEQ ID NO: 828869 - RNA, 19 nt, Homo sapiens
auacaugucacaccacuga

SEQ ID NO: 828870 - RNA, 19 nt, Homo sapiens
cacaaguagugaugagaau

SEQ ID NO: 828871 - RNA, 19 nt, Homo sapiens
ucccaucgauccagaagau

SEQ ID NO: 828872 - RNA, 19 nt, Homo sapiens
guaauggagaggagaggaa

SEQ ID NO: 828873 - RNA, 19 nt, Homo sapiens
uggagcgucuugaaagguu

SEQ ID NO: 828874 - RNA, 19 nt, Homo sapiens
caaggagucaguauacaag

SEQ ID NO: 828875 - RNA, 19 nt, Homo sapiens
gguagaggugguagagauu

SEQ ID NO: 828876 - RNA, 19 nt, Homo sapiens
gcaggcacaaguagugaug

SEQ ID NO: 828877 - RNA, 19 nt, Homo sapiens
gaggagggagugcgucugu

SEQ ID NO: 828878 - RNA, 19 nt, Homo sapiens
aaaggaacaaauccagaaa

SEQ ID NO: 828879 - RNA, 19 nt, Homo sapiens
aggcagaguauccugauuu

SEQ ID NO: 828880 - RNA, 19 nt, Homo sapiens
gcaggguacaggcauacaa

SEQ ID NO: 828881 - RNA, 19 nt, Homo sapiens
caggagaccgcgcuuagug

SEQ ID NO: 828882 - RNA, 19 nt, Homo sapiens
uugguucuguugucaguuu

SEQ ID NO: 828883 - RNA, 19 nt, Homo sapiens
cgaggacuguuaggagaug

SEQ ID NO: 828884 - RNA, 19 nt, Homo sapiens
aaagaauaaggaggaguua

SEQ ID NO: 828885 - RNA, 19 nt, Homo sapiens
acaaggagucaguauacaa

SEQ ID NO: 828886 - RNA, 19 nt, Homo sapiens
cugaggagcaguuaaagga

SEQ ID NO: 828887 - RNA, 19 nt, Homo sapiens
ugguagaggugguagagau

SEQ ID NO: 828888 - RNA, 19 nt, Homo sapiens
gaucacugcguuccguguu

SEQ ID NO: 828889 - RNA, 19 nt, Homo sapiens
ccucagcauuuggcuagaa

SEQ ID NO: 828890 - RNA, 19 nt, Homo sapiens
gcaaauaccuuaaagcaaa

SEQ ID NO: 828891 - RNA, 19 nt, Homo sapiens
caacuuggguccuuauuua

SEQ ID NO: 828892 - RNA, 19 nt, Homo sapiens
gaaauucacucccucguaa

SEQ ID NO: 828893 - RNA, 19 nt, Homo sapiens
gcucuuagcuccaauaauu

SEQ ID NO: 828894 - RNA, 19 nt, Homo sapiens
gcagagagcuauccuguga

SEQ ID NO: 828895 - RNA, 19 nt, Homo sapiens
ugaacaagcuggugaauaa

SEQ ID NO: 828896 - RNA, 19 nt, Homo sapiens
gaaaucaugugguuuaaga

SEQ ID NO: 828897 - RNA, 19 nt, Homo sapiens
ggagaaagauaacugcuaa

SEQ ID NO: 828898 - RNA, 19 nt, Homo sapiens
ggacaaguuucauacauuu

SEQ ID NO: 828899 - RNA, 19 nt, Homo sapiens
ccagaugccuauaagauua

SEQ ID NO: 828900 - RNA, 19 nt, Homo sapiens
ccaacuauaucccuucuua

SEQ ID NO: 828901 - RNA, 19 nt, Homo sapiens
ugaaacagcugccaacauu

SEQ ID NO: 828902 - RNA, 19 nt, Homo sapiens
gauguacccuuuccuaauu

SEQ ID NO: 828903 - RNA, 19 nt, Homo sapiens
gaacaugggauacugcaua

SEQ ID NO: 828904 - RNA, 19 nt, Homo sapiens
gauauaagcagugguaaua

SEQ ID NO: 828905 - RNA, 19 nt, Homo sapiens
guaaccaccuaacaaauuu

SEQ ID NO: 828906 - RNA, 19 nt, Homo sapiens
ccagcaacuuugauaauua

SEQ ID NO: 828907 - RNA, 19 nt, Homo sapiens
gaacugauacccugacuga

SEQ ID NO: 828908 - RNA, 19 nt, Homo sapiens
gagcacagaaggaaacuua

SEQ ID NO: 828909 - RNA, 19 nt, Homo sapiens
gcacaggauuuguagugua

SEQ ID NO: 828910 - RNA, 19 nt, Homo sapiens
ggacucauguauauuaaug

SEQ ID NO: 828911 - RNA, 19 nt, Homo sapiens
gagcuucgcuguccaggaa

SEQ ID NO: 828912 - RNA, 19 nt, Homo sapiens
gagcaaaguuuccuuccuu

SEQ ID NO: 828913 - RNA, 19 nt, Homo sapiens
ggaacucacucccaacuau

SEQ ID NO: 828914 - RNA, 19 nt, Homo sapiens
gaaagacccucuguuaaag

SEQ ID NO: 828915 - RNA, 19 nt, Homo sapiens
gcaaguuugucuaccagua

SEQ ID NO: 828916 - RNA, 19 nt, Homo sapiens
gauggagacuucauuaugu

SEQ ID NO: 828917 - RNA, 19 nt, Homo sapiens
cagcagugauggauuuaua

SEQ ID NO: 828918 - RNA, 19 nt, Homo sapiens
gaccguggcuauaaccaua

SEQ ID NO: 828919 - RNA, 19 nt, Homo sapiens
cgagaaaucaugugguuua

SEQ ID NO: 828920 - RNA, 19 nt, Homo sapiens
cuagaaagacccucuguua

SEQ ID NO: 828921 - RNA, 19 nt, Homo sapiens
ggucaaaucuguauaugag

SEQ ID NO: 828922 - RNA, 19 nt, Homo sapiens
gcaauggucgagacaguua

SEQ ID NO: 828923 - RNA, 19 nt, Homo sapiens
gagaauauccgauguuauc

SEQ ID NO: 828924 - RNA, 19 nt, Homo sapiens
uauagaagaugacacagaa

SEQ ID NO: 828925 - RNA, 19 nt, Homo sapiens
uccaucagcugcauacuua

SEQ ID NO: 828926 - RNA, 19 nt, Homo sapiens
caauucaccuugacucuga

SEQ ID NO: 828927 - RNA, 19 nt, Homo sapiens
gguaaucuaugcaacagaa

SEQ ID NO: 828928 - RNA, 19 nt, Homo sapiens
gaagaugacacagaaauug

SEQ ID NO: 828929 - RNA, 19 nt, Homo sapiens
ggaguaaagcuaaacauug

SEQ ID NO: 828930 - RNA, 19 nt, Homo sapiens
ucagagucuuccuuuauua

SEQ ID NO: 828931 - RNA, 19 nt, Homo sapiens
guugaaaucuggugaaaca

SEQ ID NO: 828932 - RNA, 19 nt, Homo sapiens
gagaaugggcuauggguaa

SEQ ID NO: 828933 - RNA, 19 nt, Homo sapiens
aaucaucagucuuggaaua

SEQ ID NO: 828934 - RNA, 19 nt, Homo sapiens
gaagagcaaauuaagguuu

SEQ ID NO: 828935 - RNA, 19 nt, Homo sapiens
gugcuggucuugcaaguuu

SEQ ID NO: 828936 - RNA, 19 nt, Homo sapiens
ccaauugccugugcuguuu

SEQ ID NO: 828937 - RNA, 19 nt, Homo sapiens
gggcacgucuguuguaaug

SEQ ID NO: 828938 - RNA, 19 nt, Homo sapiens
gaauuugaguccuguuaau

SEQ ID NO: 828939 - RNA, 19 nt, Homo sapiens
ggaaaugccugcgaacaca

SEQ ID NO: 828940 - RNA, 19 nt, Homo sapiens
gagaaaucaugugguuuaa

SEQ ID NO: 828941 - RNA, 19 nt, Homo sapiens
agaaagacccucuguuaaa

SEQ ID NO: 828942 - RNA, 19 nt, Homo sapiens
ucucaaagaugcaauaaca

SEQ ID NO: 828943 - RNA, 19 nt, Homo sapiens
gaacucacucccaacuaua

SEQ ID NO: 828944 - RNA, 19 nt, Homo sapiens
cuagagagcuggcugaaca

SEQ ID NO: 828945 - RNA, 19 nt, Homo sapiens
aaaggugucuauagaacua

SEQ ID NO: 828946 - RNA, 19 nt, Homo sapiens
ggaaugacacgguucgaaa

SEQ ID NO: 828947 - RNA, 19 nt, Homo sapiens
ggaagaagaaaccggagua

SEQ ID NO: 828948 - RNA, 19 nt, Homo sapiens
gcauuggaaggucaaauua

SEQ ID NO: 828949 - RNA, 19 nt, Homo sapiens
gauacuagcauugcacaua

SEQ ID NO: 828950 - RNA, 19 nt, Homo sapiens
ccgaagauguuuacuacaa

SEQ ID NO: 828951 - RNA, 19 nt, Homo sapiens
acaggaaucugaugaacaa

SEQ ID NO: 828952 - RNA, 19 nt, Homo sapiens
caacagagagcccuacaga

SEQ ID NO: 828953 - RNA, 19 nt, Homo sapiens
ccacaaaucauucuguuau

SEQ ID NO: 828954 - RNA, 19 nt, Homo sapiens
uccaaugccuuuaugauuu

SEQ ID NO: 828955 - RNA, 19 nt, Homo sapiens
guugagcaauuucuaugua

SEQ ID NO: 828956 - RNA, 19 nt, Homo sapiens
gaugaugccaccucguuua

SEQ ID NO: 828957 - RNA, 19 nt, Homo sapiens
gauaacagacccuucauca

SEQ ID NO: 828958 - RNA, 19 nt, Homo sapiens
cauauagucugcuuucugu

SEQ ID NO: 828959 - RNA, 19 nt, Homo sapiens
cgaagauguuuacuacaaa

SEQ ID NO: 828960 - RNA, 19 nt, Homo sapiens
gaguaaagcuaaacauugc

SEQ ID NO: 828961 - RNA, 19 nt, Homo sapiens
gccuaucucuucaccauuu

SEQ ID NO: 828962 - RNA, 19 nt, Homo sapiens
gcucuucucugccuauuag

SEQ ID NO: 828963 - RNA, 19 nt, Homo sapiens
uaacagacccuucaucaag

SEQ ID NO: 828964 - RNA, 19 nt, Homo sapiens
guaacaccauccacaagaa

SEQ ID NO: 828965 - RNA, 19 nt, Homo sapiens
ccugugguauuuacuguua

SEQ ID NO: 828966 - RNA, 19 nt, Homo sapiens
gggacaaccuacuuuaugu

SEQ ID NO: 828967 - RNA, 19 nt, Homo sapiens
gaaggaacaugggauacug

SEQ ID NO: 828968 - RNA, 19 nt, Homo sapiens
ccaggaacauaguaaaguu

SEQ ID NO: 828969 - RNA, 19 nt, Homo sapiens
ggaaauucacucccucgua

SEQ ID NO: 828970 - RNA, 19 nt, Homo sapiens
gaacaggaaucugaugaac

SEQ ID NO: 828971 - RNA, 19 nt, Homo sapiens
gcacaucauggacaaguuu

SEQ ID NO: 828972 - RNA, 19 nt, Homo sapiens
ccaaugccuuuaugauuug

SEQ ID NO: 828973 - RNA, 19 nt, Homo sapiens
gcacauauagucugcuuuc

SEQ ID NO: 828974 - RNA, 19 nt, Homo sapiens
ggaaucugaugcuccuuug

SEQ ID NO: 828975 - RNA, 19 nt, Homo sapiens
gcgaauaccugagcaacug

SEQ ID NO: 828976 - RNA, 19 nt, Homo sapiens
gaacauucacguaggaaau

SEQ ID NO: 828977 - RNA, 19 nt, Homo sapiens
cuauagguguaucaacuua

SEQ ID NO: 828978 - RNA, 19 nt, Homo sapiens
agaagaaaccggaguacua

SEQ ID NO: 828979 - RNA, 19 nt, Homo sapiens
caaccuacuuuauguaugg

SEQ ID NO: 828980 - RNA, 19 nt, Homo sapiens
ggacaaccuacuuuaugua

SEQ ID NO: 828981 - RNA, 19 nt, Homo sapiens
ugacuguucugaguugaua

SEQ ID NO: 828982 - RNA, 19 nt, Homo sapiens
caaccgaacugaccaacca

SEQ ID NO: 828983 - RNA, 19 nt, Homo sapiens
gaagaccaacuacaaccua

SEQ ID NO: 828984 - RNA, 19 nt, Homo sapiens
uggagaauauccgauguua

SEQ ID NO: 828985 - RNA, 19 nt, Homo sapiens
uggcaggacugaugacaaa

SEQ ID NO: 828986 - RNA, 19 nt, Homo sapiens
ggauauugguguuucuguu

SEQ ID NO: 828987 - RNA, 19 nt, Homo sapiens
gacacuagcuaugauucua

SEQ ID NO: 828988 - RNA, 19 nt, Homo sapiens
gcacgucuguuguaaugca

SEQ ID NO: 828989 - RNA, 19 nt, Homo sapiens
cggcagcagugauggauuu

SEQ ID NO: 828990 - RNA, 19 nt, Homo sapiens
gaacauaucuucuaaagga

SEQ ID NO: 828991 - RNA, 19 nt, Homo sapiens
gaacauaucugccauuuca

SEQ ID NO: 828992 - RNA, 19 nt, Homo sapiens
ggaaagauguguuauguga

SEQ ID NO: 828993 - RNA, 19 nt, Homo sapiens
gaaucaagcugcaaaguaa

SEQ ID NO: 828994 - RNA, 19 nt, Homo sapiens
cgaauuacauugcagaaua

SEQ ID NO: 828995 - RNA, 19 nt, Homo sapiens
caaaggugguucacaaaua

SEQ ID NO: 828996 - RNA, 19 nt, Homo sapiens
gaaaugaaguaacucaaga

SEQ ID NO: 828997 - RNA, 19 nt, Homo sapiens
guacauggauuucuauaga

SEQ ID NO: 828998 - RNA, 19 nt, Homo sapiens
ccaggaagcuugagagaaa

SEQ ID NO: 828999 - RNA, 19 nt, Homo sapiens
ggaaauaggaguacaaaga

SEQ ID NO: 829000 - RNA, 19 nt, Homo sapiens
aaucaucgcuguucuuuaa

SEQ ID NO: 829001 - RNA, 19 nt, Homo sapiens
ggacugacauuuguuacua

SEQ ID NO: 829002 - RNA, 19 nt, Homo sapiens
uaucauagaucguguggua

SEQ ID NO: 829003 - RNA, 19 nt, Homo sapiens
gaaugaagaugaccuagau

SEQ ID NO: 829004 - RNA, 19 nt, Homo sapiens
ggaguaaaggcuagaauua

SEQ ID NO: 829005 - RNA, 19 nt, Homo sapiens
gaauaucucaugagcaaua

SEQ ID NO: 829006 - RNA, 19 nt, Homo sapiens
ugaaguggaugacguagua

SEQ ID NO: 829007 - RNA, 19 nt, Homo sapiens
ccacuuaugucuuggauga

SEQ ID NO: 829008 - RNA, 19 nt, Homo sapiens
gaaauaggaguacaaagaa

SEQ ID NO: 829009 - RNA, 19 nt, Homo sapiens
uaacuagcccuaccacuua

SEQ ID NO: 829010 - RNA, 19 nt, Homo sapiens
uaaaggagaugaaggugaa

SEQ ID NO: 829011 - RNA, 19 nt, Homo sapiens
gaauauuccuucucaaaca

SEQ ID NO: 829012 - RNA, 19 nt, Homo sapiens
gaaaggaacguuggaauau

SEQ ID NO: 829013 - RNA, 19 nt, Homo sapiens
ggguagauauugcagauaa

SEQ ID NO: 829014 - RNA, 19 nt, Homo sapiens
gaauauaacccugaauuug

SEQ ID NO: 829015 - RNA, 19 nt, Homo sapiens
gaaguguguucagaauaua

SEQ ID NO: 829016 - RNA, 19 nt, Homo sapiens
gaagaugaccuagaucaaa

SEQ ID NO: 829017 - RNA, 19 nt, Homo sapiens
caacgaugauauugaugua

SEQ ID NO: 829018 - RNA, 19 nt, Homo sapiens
gcuuaucacuauccauaua

SEQ ID NO: 829019 - RNA, 19 nt, Homo sapiens
agaaaggccuuauggugua

SEQ ID NO: 829020 - RNA, 19 nt, Homo sapiens
ccaguuugguuucaagaua

SEQ ID NO: 829021 - RNA, 19 nt, Homo sapiens
gaaccucgauuccuugaag

SEQ ID NO: 829022 - RNA, 19 nt, Homo sapiens
gaaaucaucgcuguucuuu

SEQ ID NO: 829023 - RNA, 19 nt, Homo sapiens
ccaacagucaguuuaauua

SEQ ID NO: 829024 - RNA, 19 nt, Homo sapiens
gaacugaagaugaugaaga

SEQ ID NO: 829025 - RNA, 19 nt, Homo sapiens
aaacgaaacugagaaugaa

SEQ ID NO: 829026 - RNA, 19 nt, Homo sapiens
ugaguuagauauugaguug

SEQ ID NO: 829027 - RNA, 19 nt, Homo sapiens
gaucuucaaacuacacuua

SEQ ID NO: 829028 - RNA, 19 nt, Homo sapiens
cuacuuugcuuaucacuau

SEQ ID NO: 829029 - RNA, 19 nt, Homo sapiens
guggaaauguucuguuuga

SEQ ID NO: 829030 - RNA, 19 nt, Homo sapiens
gaaaugacagccaaagguu

SEQ ID NO: 829031 - RNA, 19 nt, Homo sapiens
auacaaggguuuacagauu

SEQ ID NO: 829032 - RNA, 19 nt, Homo sapiens
ccgauuaucugcaauuaug

SEQ ID NO: 829033 - RNA, 19 nt, Homo sapiens
gaagauacugagucaaauu

SEQ ID NO: 829034 - RNA, 19 nt, Homo sapiens
ugacaacgaugauauugau

SEQ ID NO: 829035 - RNA, 19 nt, Homo sapiens
cagcuuaccuccugaagug

SEQ ID NO: 829036 - RNA, 19 nt, Homo sapiens
gaacaagcaucgguugaag

SEQ ID NO: 829037 - RNA, 19 nt, Homo sapiens
agaaaucgcccuuacguuu

SEQ ID NO: 829038 - RNA, 19 nt, Homo sapiens
gugaaacccugucuggaaa

SEQ ID NO: 829039 - RNA, 19 nt, Homo sapiens
guauucaacuuuacagaug

SEQ ID NO: 829040 - RNA, 19 nt, Homo sapiens
caaaagaucuucaaacuac

SEQ ID NO: 829041 - RNA, 19 nt, Homo sapiens
ugaaaggaacguuggaaua

SEQ ID NO: 829042 - RNA, 19 nt, Homo sapiens
aaaggugguucacaaauau

SEQ ID NO: 829043 - RNA, 19 nt, Homo sapiens
gauauugaguuggcugaaa

SEQ ID NO: 829044 - RNA, 19 nt, Homo sapiens
ggaguacaaagaaguuaua

SEQ ID NO: 829045 - RNA, 19 nt, Homo sapiens
uggaauaucucaugagcaa

SEQ ID NO: 829046 - RNA, 19 nt, Homo sapiens
ccgcugccaucucuuguua

SEQ ID NO: 829047 - RNA, 19 nt, Homo sapiens
gacauaaacagcaaucauu

SEQ ID NO: 829048 - RNA, 19 nt, Homo sapiens
ucccugagcuuguugauga

SEQ ID NO: 829049 - RNA, 19 nt, Homo sapiens
gaaccgggacgaacaauag

SEQ ID NO: 829050 - RNA, 19 nt, Homo sapiens
aaacugagaaugaagauga

SEQ ID NO: 829051 - RNA, 19 nt, Homo sapiens
gcagaaucaucgcuugguu

SEQ ID NO: 829052 - RNA, 19 nt, Homo sapiens
gaguaaaggcuagaauuaa

SEQ ID NO: 829053 - RNA, 19 nt, Homo sapiens
ugaagaaguugauuacagu

SEQ ID NO: 829054 - RNA, 19 nt, Homo sapiens
caaguuggguuaugaaagg

SEQ ID NO: 829055 - RNA, 19 nt, Homo sapiens
gaugauguuugcuacuuug

SEQ ID NO: 829056 - RNA, 19 nt, Homo sapiens
gaaaggcuaauacaucaga

SEQ ID NO: 829057 - RNA, 19 nt, Homo sapiens
uggcuuaucccgauuauuu

SEQ ID NO: 829058 - RNA, 19 nt, Homo sapiens
caugauaaccggcauagaa

SEQ ID NO: 829059 - RNA, 19 nt, Homo sapiens
gcuuacagguuuaacauca

SEQ ID NO: 829060 - RNA, 19 nt, Homo sapiens
gacacugcccgauauguua

SEQ ID NO: 829061 - RNA, 19 nt, Homo sapiens
ggacuuaaugguacagauu

SEQ ID NO: 829062 - RNA, 19 nt, Homo sapiens
gggaaucugcgcaaaguaa

SEQ ID NO: 829063 - RNA, 19 nt, Homo sapiens
uaacccaaauuacaccauu

SEQ ID NO: 829064 - RNA, 19 nt, Homo sapiens
cagaggauauguccaagug

SEQ ID NO: 829065 - RNA, 19 nt, Homo sapiens
gaauuccagucuuauaaag

SEQ ID NO: 829066 - RNA, 19 nt, Homo sapiens
caaagguucuacaggaaug

SEQ ID NO: 829067 - RNA, 19 nt, Homo sapiens
gaucaaugcugagccuuca

SEQ ID NO: 829068 - RNA, 19 nt, Homo sapiens
gagggaacaucugggaauu

SEQ ID NO: 829069 - RNA, 19 nt, Homo sapiens
guacagauucauucuauuc

SEQ ID NO: 829070 - RNA, 19 nt, Homo sapiens
gaaauucugcugucaacau

SEQ ID NO: 829071 - RNA, 19 nt, Homo sapiens
guaacuagcccuaccacuu

SEQ ID NO: 829072 - RNA, 19 nt, Homo sapiens
ccauauacguauucaacuu

SEQ ID NO: 829073 - RNA, 19 nt, Homo sapiens
acccagaccucuauauuga

SEQ ID NO: 829074 - RNA, 19 nt, Homo sapiens
auacagagcugacucaaaa

SEQ ID NO: 829075 - RNA, 19 nt, Homo sapiens
ugaaucaagcugcaaagua

SEQ ID NO: 829076 - RNA, 19 nt, Homo sapiens
guacaaagaaguuauacca

SEQ ID NO: 829077 - RNA, 19 nt, Homo sapiens
gcuaaagcauguccacaca

SEQ ID NO: 829078 - RNA, 19 nt, Homo sapiens
ugaauuuggucaagcagaa

SEQ ID NO: 829079 - RNA, 19 nt, Homo sapiens
cagauucauucuauucuug

SEQ ID NO: 829080 - RNA, 19 nt, Homo sapiens
cuaaggggcuguugcaaua

SEQ ID NO: 829081 - RNA, 19 nt, Homo sapiens
gcacacaauccucagcaaa

SEQ ID NO: 829082 - RNA, 19 nt, Homo sapiens
gcaauugccuguuauuccu

SEQ ID NO: 829083 - RNA, 19 nt, Homo sapiens
gccaaagguucuacaggaa

SEQ ID NO: 829084 - RNA, 19 nt, Homo sapiens
guuuagaaguggguagaua

SEQ ID NO: 829085 - RNA, 19 nt, Homo sapiens
caguuugguuucaagauaa

SEQ ID NO: 829086 - RNA, 19 nt, Homo sapiens
agacugaccucuccauugg

SEQ ID NO: 829087 - RNA, 19 nt, Homo sapiens
ccuaagauacugagccaua

SEQ ID NO: 829088 - RNA, 19 nt, Homo sapiens
ggacauugccuaagauacu

SEQ ID NO: 829089 - RNA, 19 nt, Homo sapiens
caaagagccuauuuuagaa

SEQ ID NO: 829090 - RNA, 19 nt, Homo sapiens
gaacgaugauaccuacuua

SEQ ID NO: 829091 - RNA, 19 nt, Homo sapiens
ccagcaagcuccaagaauu

SEQ ID NO: 829092 - RNA, 19 nt, Homo sapiens
gagaagaaacuaaguguga

SEQ ID NO: 829093 - RNA, 19 nt, Homo sapiens
ugagagaccugaaggaaga

SEQ ID NO: 829094 - RNA, 19 nt, Homo sapiens
ugacgagauuauugaguua

SEQ ID NO: 829095 - RNA, 19 nt, Homo sapiens
acagacaccuucagaguga

SEQ ID NO: 829096 - RNA, 19 nt, Homo sapiens
gagaggagauucagacacu

SEQ ID NO: 829097 - RNA, 19 nt, Homo sapiens
cgacuggaaagauaauuua

SEQ ID NO: 829098 - RNA, 19 nt, Homo sapiens
gaggagauucagacacuua

SEQ ID NO: 829099 - RNA, 19 nt, Homo sapiens
ggaaggaccggcagauaga

SEQ ID NO: 829100 - RNA, 19 nt, Homo sapiens
gcagugcccuccugagcuu

SEQ ID NO: 829101 - RNA, 19 nt, Homo sapiens
ggacacgagucaccuuauc

SEQ ID NO: 829102 - RNA, 19 nt, Homo sapiens
gaaagaagagaaagaggau

SEQ ID NO: 829103 - RNA, 19 nt, Homo sapiens
ggaucgccauggagacaua

SEQ ID NO: 829104 - RNA, 19 nt, Homo sapiens
gcaaagccaggaagucuga

SEQ ID NO: 829105 - RNA, 19 nt, Homo sapiens
ugcaagaaaugaagaaaga

SEQ ID NO: 829106 - RNA, 19 nt, Homo sapiens
gaugccaguugggucauua

SEQ ID NO: 829107 - RNA, 19 nt, Homo sapiens
aaccacgacuggaaagaua

SEQ ID NO: 829108 - RNA, 19 nt, Homo sapiens
gaagaaagaagagaaagag

SEQ ID NO: 829109 - RNA, 19 nt, Homo sapiens
gagaggagguuuugagaga

SEQ ID NO: 829110 - RNA, 19 nt, Homo sapiens
ggacaucucacgcggacaa

SEQ ID NO: 829111 - RNA, 19 nt, Homo sapiens
gaagaaacuaagugugaug

SEQ ID NO: 829112 - RNA, 19 nt, Homo sapiens
ggacggcaccaucagcaaa

SEQ ID NO: 829113 - RNA, 19 nt, Homo sapiens
agauauguaugacgagauu

SEQ ID NO: 829114 - RNA, 19 nt, Homo sapiens
gaaaugaagaaagaagaga

SEQ ID NO: 829115 - RNA, 19 nt, Homo sapiens
cgagucaccuuaucucucu

SEQ ID NO: 829116 - RNA, 19 nt, Homo sapiens
gacgucaacuccgaugauu

SEQ ID NO: 829117 - RNA, 19 nt, Homo sapiens
gcaaagcacauggcucaga

SEQ ID NO: 829118 - RNA, 19 nt, Homo sapiens
uccaggagcucacggaaga

SEQ ID NO: 829119 - RNA, 19 nt, Homo sapiens
gugaagaggccacaucuca

SEQ ID NO: 829120 - RNA, 19 nt, Homo sapiens
cuaccaaccuggaagagau

SEQ ID NO: 829121 - RNA, 19 nt, Homo sapiens
gagaaggacggcaccauca

SEQ ID NO: 829122 - RNA, 19 nt, Homo sapiens
guuaggagaagaacgauga

SEQ ID NO: 829123 - RNA, 19 nt, Homo sapiens
acaaagcucuuagcaagca

SEQ ID NO: 829124 - RNA, 19 nt, Homo sapiens
gcaaacuccagaccgauau

SEQ ID NO: 829125 - RNA, 19 nt, Homo sapiens
ccaagaauugcaagaaaug

SEQ ID NO: 829126 - RNA, 19 nt, Homo sapiens
gaaccacgacuggaaagau

SEQ ID NO: 829127 - RNA, 19 nt, Homo sapiens
agagagauuuggaggugaa

SEQ ID NO: 829128 - RNA, 19 nt, Homo sapiens
gagcuggagaagaaacuaa

SEQ ID NO: 829129 - RNA, 19 nt, Homo sapiens
gaagacuaccaaccuggaa

SEQ ID NO: 829130 - RNA, 19 nt, Homo sapiens
cagcaagcuccaagaauug

SEQ ID NO: 829131 - RNA, 19 nt, Homo sapiens
uuguggagcuggagaagaa

SEQ ID NO: 829132 - RNA, 19 nt, Homo sapiens
ggaggaggccaucgucauc

SEQ ID NO: 829133 - RNA, 19 nt, Homo sapiens
cuccaagaauugcaagaaa

SEQ ID NO: 829134 - RNA, 19 nt, Homo sapiens
ugacagacaccuucagagu

SEQ ID NO: 829135 - RNA, 19 nt, Homo sapiens
gcucuuagcaagcaaagca

SEQ ID NO: 829136 - RNA, 19 nt, Homo sapiens
ugaagaaagaagagaaaga

SEQ ID NO: 829137 - RNA, 19 nt, Homo sapiens
gcaagaaaugaagaaagaa

SEQ ID NO: 829138 - RNA, 19 nt, Homo sapiens
agaccgauaugaagacuac

SEQ ID NO: 829139 - RNA, 19 nt, Homo sapiens
agaagaacgaugauaccua

SEQ ID NO: 829140 - RNA, 19 nt, Homo sapiens
aagaagagaaagaggauug

SEQ ID NO: 829141 - RNA, 19 nt, Homo sapiens
caagaaaugaagaaagaag

SEQ ID NO: 829142 - RNA, 19 nt, Homo sapiens
uccaagaauugcaagaaau

SEQ ID NO: 829143 - RNA, 19 nt, Homo sapiens
gaauugcaagaaaugaaga

SEQ ID NO: 829144 - RNA, 19 nt, Homo sapiens
guucugaaaccaccggaaa

SEQ ID NO: 829145 - RNA, 19 nt, Homo sapiens
caggaaggaccggcagaua

SEQ ID NO: 829146 - RNA, 19 nt, Homo sapiens
gacguggaccugaugagaa

SEQ ID NO: 829147 - RNA, 19 nt, Homo sapiens
aaaaggcuguucuggauga

SEQ ID NO: 829148 - RNA, 19 nt, Homo sapiens
caagaauugcaagaaauga

SEQ ID NO: 829149 - RNA, 19 nt, Homo sapiens
augacgagauuauugaguu

SEQ ID NO: 829150 - RNA, 19 nt, Homo sapiens
agaagaaacuaagugugau

SEQ ID NO: 829151 - RNA, 19 nt, Homo sapiens
acgaugauaccuacuuaaa

SEQ ID NO: 829152 - RNA, 19 nt, Homo sapiens
ccgcagagccagucagauc

SEQ ID NO: 829153 - RNA, 19 nt, Homo sapiens
gaggauugcccggaaguuc

SEQ ID NO: 829154 - RNA, 19 nt, Homo sapiens
gcuccaagaauugcaagaa

SEQ ID NO: 829155 - RNA, 19 nt, Homo sapiens
uguaugacgagauuauuga

SEQ ID NO: 829156 - RNA, 19 nt, Homo sapiens
ucuccaagacacaggguua

SEQ ID NO: 829157 - RNA, 19 nt, Homo sapiens
ugaaaccaccggaaagaag

SEQ ID NO: 829158 - RNA, 19 nt, Homo sapiens
gguguacaagcacaagaaa

SEQ ID NO: 829159 - RNA, 19 nt, Homo sapiens
aguggaagguguacaagca

SEQ ID NO: 829160 - RNA, 19 nt, Homo sapiens
aggccgaccuggagaagga

SEQ ID NO: 829161 - RNA, 19 nt, Homo sapiens
ccaagacacaggguuaugu

SEQ ID NO: 829162 - RNA, 19 nt, Homo sapiens
cgacguggaccugaugaga

SEQ ID NO: 829163 - RNA, 19 nt, Homo sapiens
cgaugauuccgacgauauu

SEQ ID NO: 829164 - RNA, 19 nt, Homo sapiens
gacgagauuauugaguuaa

SEQ ID NO: 829165 - RNA, 19 nt, Homo sapiens
cgagauuauugaguuaaag

SEQ ID NO: 829166 - RNA, 19 nt, Homo sapiens
gaugauuccgacgauauug

SEQ ID NO: 829167 - RNA, 19 nt, Homo sapiens
ggaagguguacaagcacaa

SEQ ID NO: 829168 - RNA, 19 nt, Homo sapiens
gagcgacguggaccugaug

SEQ ID NO: 829169 - RNA, 19 nt, Homo sapiens
gagagaggagauucagaca

SEQ ID NO: 829170 - RNA, 19 nt, Homo sapiens
ccaaaaggcagaagaagau

SEQ ID NO: 829171 - RNA, 19 nt, Homo sapiens
ugaagcagaggauccugaa

SEQ ID NO: 829172 - RNA, 19 nt, Homo sapiens
ggaaccacgacuggaaaga

SEQ ID NO: 829173 - RNA, 19 nt, Homo sapiens
cgacgauauugucauugca

SEQ ID NO: 829174 - RNA, 19 nt, Homo sapiens
ccgaugauuccgacgauau

SEQ ID NO: 829175 - RNA, 19 nt, Homo sapiens
gaggaggccaucgucauca

SEQ ID NO: 829176 - RNA, 19 nt, Homo sapiens
gcgaggaggagaggagaga

SEQ ID NO: 829177 - RNA, 19 nt, Homo sapiens
gagauuuggaggugaagca

SEQ ID NO: 829178 - RNA, 19 nt, Homo sapiens
gauauguaugacgagauua

SEQ ID NO: 829179 - RNA, 19 nt, Homo sapiens
ccauggagacauacuacga

SEQ ID NO: 829180 - RNA, 19 nt, Homo sapiens
uaggaaccacgacuggaaa

SEQ ID NO: 829181 - RNA, 19 nt, Homo sapiens
ccgacgauauugucauugc

SEQ ID NO: 829182 - RNA, 19 nt, Homo sapiens
uuccgacgauauugucauu

SEQ ID NO: 829183 - RNA, 19 nt, Homo sapiens
ugaggcggcuguggugcuu

SEQ ID NO: 829184 - RNA, 19 nt, Homo sapiens
gagauucagacacuuacca

SEQ ID NO: 829185 - RNA, 19 nt, Homo sapiens
ggagcuggagaagaaacua

SEQ ID NO: 829186 - RNA, 19 nt, Homo sapiens
gcaggaaggaccggcagau

SEQ ID NO: 829187 - RNA, 19 nt, Homo sapiens
agaacgaugauaccuacuu

SEQ ID NO: 829188 - RNA, 19 nt, Homo sapiens
uaggagaagaacgaugaua

SEQ ID NO: 829189 - RNA, 19 nt, Homo sapiens
gagugaagaggccacaucu

SEQ ID NO: 829190 - RNA, 19 nt, Homo sapiens
caauaaaccuccauucaua

SEQ ID NO: 829191 - RNA, 19 nt, Homo sapiens
gcacuuugguuugauauua

SEQ ID NO: 829192 - RNA, 19 nt, Homo sapiens
guaaaggugucuacuguuu

SEQ ID NO: 829193 - RNA, 19 nt, Homo sapiens
gcacugggauagucuaauu

SEQ ID NO: 829194 - RNA, 19 nt, Homo sapiens
gaagcacacucuacuacua

SEQ ID NO: 829195 - RNA, 19 nt, Homo sapiens
gagaagacuuggccucuaa

SEQ ID NO: 829196 - RNA, 19 nt, Homo sapiens
gcagacaaccuuugaauug

SEQ ID NO: 829197 - RNA, 19 nt, Homo sapiens
gaucaaggaaugucaauaa

SEQ ID NO: 829198 - RNA, 19 nt, Homo sapiens
gugcuugccuccuaauuua

SEQ ID NO: 829199 - RNA, 19 nt, Homo sapiens
guaacuggcucuucagauu

SEQ ID NO: 829200 - RNA, 19 nt, Homo sapiens
agagguaccuuaaacauuu

SEQ ID NO: 829201 - RNA, 19 nt, Homo sapiens
gaugauggccuuugaauau

SEQ ID NO: 829202 - RNA, 19 nt, Homo sapiens
cagccuaacucuucaagua

SEQ ID NO: 829203 - RNA, 19 nt, Homo sapiens
gcacauugguggaacauuc

SEQ ID NO: 829204 - RNA, 19 nt, Homo sapiens
guuaguggaucaucagaua

SEQ ID NO: 829205 - RNA, 19 nt, Homo sapiens
agacuuggccucuaauuua

SEQ ID NO: 829206 - RNA, 19 nt, Homo sapiens
guucacagcugaguuauga

SEQ ID NO: 829207 - RNA, 19 nt, Homo sapiens
ccaguaaauugcuaaguaa

SEQ ID NO: 829208 - RNA, 19 nt, Homo sapiens
cgacauuucucaccucuga

SEQ ID NO: 829209 - RNA, 19 nt, Homo sapiens
ugucagaugucuccagaua

SEQ ID NO: 829210 - RNA, 19 nt, Homo sapiens
gaaacagcauucuucuuca

SEQ ID NO: 829211 - RNA, 19 nt, Homo sapiens
gagcaaggcuuagaucaca

SEQ ID NO: 829212 - RNA, 19 nt, Homo sapiens
gaaauaagaaggcccuguu

SEQ ID NO: 829213 - RNA, 19 nt, Homo sapiens
ugaauguggugccuguuua

SEQ ID NO: 829214 - RNA, 19 nt, Homo sapiens
gaaggaaugcuuuggaaga

SEQ ID NO: 829215 - RNA, 19 nt, Homo sapiens
ccaaccaucuccugauauu

SEQ ID NO: 829216 - RNA, 19 nt, Homo sapiens
caaagcagccuaacucuuc

SEQ ID NO: 829217 - RNA, 19 nt, Homo sapiens
ugaaucagaucaaguggaa

SEQ ID NO: 829218 - RNA, 19 nt, Homo sapiens
gauaaguaauggaacauca

SEQ ID NO: 829219 - RNA, 19 nt, Homo sapiens
gugaaguucuuaacacauu

SEQ ID NO: 829220 - RNA, 19 nt, Homo sapiens
gaacauacacuuacaucuc

SEQ ID NO: 829221 - RNA, 19 nt, Homo sapiens
gagcugguauguaaagaau

SEQ ID NO: 829222 - RNA, 19 nt, Homo sapiens
ggacuuuauuaccgcuuua

SEQ ID NO: 829223 - RNA, 19 nt, Homo sapiens
uguggaaugugcuuaauaa

SEQ ID NO: 829224 - RNA, 19 nt, Homo sapiens
gcauguagauauaauguac

SEQ ID NO: 829225 - RNA, 19 nt, Homo sapiens
ccaaacaccuacccagaau

SEQ ID NO: 829226 - RNA, 19 nt, Homo sapiens
agagggacaugaagaauug

SEQ ID NO: 829227 - RNA, 19 nt, Homo sapiens
gagcaccugugaauuuguu

SEQ ID NO: 829228 - RNA, 19 nt, Homo sapiens
uaaacagccuccuauaaag

SEQ ID NO: 829229 - RNA, 19 nt, Homo sapiens
gaacaucuuauuucacgaa

SEQ ID NO: 829230 - RNA, 19 nt, Homo sapiens
gccauacucuggacuuuau

SEQ ID NO: 829231 - RNA, 19 nt, Homo sapiens
guggucaccucccauagua

SEQ ID NO: 829232 - RNA, 19 nt, Homo sapiens
caauagagagguaccuuaa

SEQ ID NO: 829233 - RNA, 19 nt, Homo sapiens
caucuuauuucacgaaugu

SEQ ID NO: 829234 - RNA, 19 nt, Homo sapiens
gauuauacuuccuuucugu

SEQ ID NO: 829235 - RNA, 19 nt, Homo sapiens
gcucugggauauugaaugu

SEQ ID NO: 829236 - RNA, 19 nt, Homo sapiens
cagaaggaaugcuuuggaa

SEQ ID NO: 829237 - RNA, 19 nt, Homo sapiens
caccuaaucuggcuucaug

SEQ ID NO: 829238 - RNA, 19 nt, Homo sapiens
uccaguaaauugcuaagua

SEQ ID NO: 829239 - RNA, 19 nt, Homo sapiens
guauucgcauguagauaua

SEQ ID NO: 829240 - RNA, 19 nt, Homo sapiens
gaauuuguggaacaucuua

SEQ ID NO: 829241 - RNA, 19 nt, Homo sapiens
guguguaugugauuuguuu

SEQ ID NO: 829242 - RNA, 19 nt, Homo sapiens
auaaacagccuccuauaaa

SEQ ID NO: 829243 - RNA, 19 nt, Homo sapiens
ccugauauuugguagagua

SEQ ID NO: 829244 - RNA, 19 nt, Homo sapiens
acagauggcccuccaaauu

SEQ ID NO: 829245 - RNA, 19 nt, Homo sapiens
cgagugaucucagaaggaa

SEQ ID NO: 829246 - RNA, 19 nt, Homo sapiens
gauauuugguagaguaaca

SEQ ID NO: 829247 - RNA, 19 nt, Homo sapiens
ccaucgagcucauguguuc

SEQ ID NO: 829248 - RNA, 19 nt, Homo sapiens
gaagcugauugaacgaaug

SEQ ID NO: 829249 - RNA, 19 nt, Homo sapiens
gggagaugauggccuuuga

SEQ ID NO: 829250 - RNA, 19 nt, Homo sapiens
uaugaauucugacuuguug

SEQ ID NO: 829251 - RNA, 19 nt, Homo sapiens
ccagauaaguaauggaaca

SEQ ID NO: 829252 - RNA, 19 nt, Homo sapiens
gcaaggcuuagaucacaua

SEQ ID NO: 829253 - RNA, 19 nt, Homo sapiens
gucaauaaaucgaguaugg

SEQ ID NO: 829254 - RNA, 19 nt, Homo sapiens
caauaaacagccuccuaua

SEQ ID NO: 829255 - RNA, 19 nt, Homo sapiens
gagagguaccuuaaacauu

SEQ ID NO: 829256 - RNA, 19 nt, Homo sapiens
ugauguggauuaccuagaa

SEQ ID NO: 829257 - RNA, 19 nt, Homo sapiens
ucagaugucuccagauaag

SEQ ID NO: 829258 - RNA, 19 nt, Homo sapiens
cauuaugaauucugacuug

SEQ ID NO: 829259 - RNA, 19 nt, Homo sapiens
gacuuggccucuaauuuau

SEQ ID NO: 829260 - RNA, 19 nt, Homo sapiens
gcacuuacgcuucagcaau

SEQ ID NO: 829261 - RNA, 19 nt, Homo sapiens
aauaaacagccuccuauaa

SEQ ID NO: 829262 - RNA, 19 nt, Homo sapiens
ccaaaugccuaagggaguu

SEQ ID NO: 829263 - RNA, 19 nt, Homo sapiens
aaccauaacugagcaaaug

SEQ ID NO: 829264 - RNA, 19 nt, Homo sapiens
gaaaggacguuggcaucca

SEQ ID NO: 829265 - RNA, 19 nt, Homo sapiens
gcucugaaguggagugaag

SEQ ID NO: 829266 - RNA, 19 nt, Homo sapiens
gugaucgucuccagaaaga

SEQ ID NO: 829267 - RNA, 19 nt, Homo sapiens
cauaacaguuuaaccucaa

SEQ ID NO: 829268 - RNA, 19 nt, Homo sapiens
gcuccaguuugaugaguuu

SEQ ID NO: 829269 - RNA, 19 nt, Homo sapiens
gaauguggugccuguuuaa

SEQ ID NO: 829270 - RNA, 19 nt, Homo sapiens
uaucagcauggacauauua

SEQ ID NO: 829271 - RNA, 19 nt, Homo sapiens
aauggaacaucaucuguga

SEQ ID NO: 829272 - RNA, 19 nt, Homo sapiens
cccaaggaguucugacuuu

SEQ ID NO: 829273 - RNA, 19 nt, Homo sapiens
ccaauaaacagccuccuau

SEQ ID NO: 829274 - RNA, 19 nt, Homo sapiens
aaaggaacauagaaucugu

SEQ ID NO: 829275 - RNA, 19 nt, Homo sapiens
gcagagggugggaucagua

SEQ ID NO: 829276 - RNA, 19 nt, Homo sapiens
gagagcaugugcgcacuga

SEQ ID NO: 829277 - RNA, 19 nt, Homo sapiens
caaagccaauacucuuaau

SEQ ID NO: 829278 - RNA, 19 nt, Homo sapiens
guaaaucgaccgucaagag

SEQ ID NO: 829279 - RNA, 19 nt, Homo sapiens
guauugcacuuacgcuuca

SEQ ID NO: 829280 - RNA, 19 nt, Homo sapiens
cagaucaaguggaauuugu

SEQ ID NO: 829281 - RNA, 19 nt, Homo sapiens
caaguggucaccucccaua

SEQ ID NO: 829282 - RNA, 19 nt, Homo sapiens
gauuccggcucuccuuuga

SEQ ID NO: 829283 - RNA, 19 nt, Homo sapiens
cgaugcauccgguuugaua

SEQ ID NO: 829284 - RNA, 19 nt, Homo sapiens
ccauuaggcucugggauau

SEQ ID NO: 829285 - RNA, 19 nt, Homo sapiens
cacgagcaccugugaauuu

SEQ ID NO: 829286 - RNA, 19 nt, Homo sapiens
gcauggacauauuaacucu

SEQ ID NO: 829287 - RNA, 19 nt, Homo sapiens
guucugacuuucugggauu

SEQ ID NO: 829288 - RNA, 19 nt, Homo sapiens
gcaaagcagccuaacucuu

SEQ ID NO: 829289 - RNA, 19 nt, Homo sapiens
gauaacagucugcacuuuc

SEQ ID NO: 829290 - RNA, 19 nt, Homo sapiens
caauaaaccuccauucaua

SEQ ID NO: 829291 - RNA, 19 nt, Homo sapiens
gcacuuugguuugauauua

SEQ ID NO: 829292 - RNA, 19 nt, Homo sapiens
guaaaggugucuacuguuu

SEQ ID NO: 829293 - RNA, 19 nt, Homo sapiens
gcacugggauagucuaauu

SEQ ID NO: 829294 - RNA, 19 nt, Homo sapiens
gaagcacacucuacuacua

SEQ ID NO: 829295 - RNA, 19 nt, Homo sapiens
gagaagacuuggccucuaa

SEQ ID NO: 829296 - RNA, 19 nt, Homo sapiens
gcagacaaccuuugaauug

SEQ ID NO: 829297 - RNA, 19 nt, Homo sapiens
gaucaaggaaugucaauaa

SEQ ID NO: 829298 - RNA, 19 nt, Homo sapiens
gugcuugccuccuaauuua

SEQ ID NO: 829299 - RNA, 19 nt, Homo sapiens
guaacuggcucuucagauu

SEQ ID NO: 829300 - RNA, 19 nt, Homo sapiens
agagguaccuuaaacauuu

SEQ ID NO: 829301 - RNA, 19 nt, Homo sapiens
gaugauggccuuugaauau

SEQ ID NO: 829302 - RNA, 19 nt, Homo sapiens
cagccuaacucuucaagua

SEQ ID NO: 829303 - RNA, 19 nt, Homo sapiens
gcacauugguggaacauuc

SEQ ID NO: 829304 - RNA, 19 nt, Homo sapiens
guuaguggaucaucagaua

SEQ ID NO: 829305 - RNA, 19 nt, Homo sapiens
agacuuggccucuaauuua

SEQ ID NO: 829306 - RNA, 19 nt, Homo sapiens
guucacagcugaguuauga

SEQ ID NO: 829307 - RNA, 19 nt, Homo sapiens
ccaguaaauugcuaaguaa

SEQ ID NO: 829308 - RNA, 19 nt, Homo sapiens
cgacauuucucaccucuga

SEQ ID NO: 829309 - RNA, 19 nt, Homo sapiens
gcagauaaguaauggaaca

SEQ ID NO: 829310 - RNA, 19 nt, Homo sapiens
gaaacagcauucuucuuca

SEQ ID NO: 829311 - RNA, 19 nt, Homo sapiens
gagcaaggcuuagaucaca

SEQ ID NO: 829312 - RNA, 19 nt, Homo sapiens
gaaauaagaaggcccuguu

SEQ ID NO: 829313 - RNA, 19 nt, Homo sapiens
ugaauguggugccuguuua

SEQ ID NO: 829314 - RNA, 19 nt, Homo sapiens
gaaggaaugcuuuggaaga

SEQ ID NO: 829315 - RNA, 19 nt, Homo sapiens
ccaaccaucuccugauauu

SEQ ID NO: 829316 - RNA, 19 nt, Homo sapiens
caaagcagccuaacucuuc

SEQ ID NO: 829317 - RNA, 19 nt, Homo sapiens
ugaaucagaucaaguggaa

SEQ ID NO: 829318 - RNA, 19 nt, Homo sapiens
gauaaguaauggaacauca

SEQ ID NO: 829319 - RNA, 19 nt, Homo sapiens
gugaaguucuuaacacauu

SEQ ID NO: 829320 - RNA, 19 nt, Homo sapiens
gaacauacacuuacaucuc

SEQ ID NO: 829321 - RNA, 19 nt, Homo sapiens
gagcugguauguaaagaau

SEQ ID NO: 829322 - RNA, 19 nt, Homo sapiens
ggacuuuauuaccgcuuua

SEQ ID NO: 829323 - RNA, 19 nt, Homo sapiens
uguggaaugugcuuaauaa

SEQ ID NO: 829324 - RNA, 19 nt, Homo sapiens
gcauguagauauaauguac

SEQ ID NO: 829325 - RNA, 19 nt, Homo sapiens
ccaaacaccuacccagaau

SEQ ID NO: 829326 - RNA, 19 nt, Homo sapiens
agagggacaugaagaauug

SEQ ID NO: 829327 - RNA, 19 nt, Homo sapiens
gagcaccugugaauuuguu

SEQ ID NO: 829328 - RNA, 19 nt, Homo sapiens
uaaacagccuccuauaaag

SEQ ID NO: 829329 - RNA, 19 nt, Homo sapiens
gaacaucuuauuucacgaa

SEQ ID NO: 829330 - RNA, 19 nt, Homo sapiens
gccauacucuggacuuuau

SEQ ID NO: 829331 - RNA, 19 nt, Homo sapiens
guggucaccucccauagua

SEQ ID NO: 829332 - RNA, 19 nt, Homo sapiens
caauagagagguaccuuaa

SEQ ID NO: 829333 - RNA, 19 nt, Homo sapiens
caucuuauuucacgaaugu

SEQ ID NO: 829334 - RNA, 19 nt, Homo sapiens
gauuauacuuccuuucugu

SEQ ID NO: 829335 - RNA, 19 nt, Homo sapiens
gcucugggauauugaaugu

SEQ ID NO: 829336 - RNA, 19 nt, Homo sapiens
cagaaggaaugcuuuggaa

SEQ ID NO: 829337 - RNA, 19 nt, Homo sapiens
caccuaaucuggcuucaug

SEQ ID NO: 829338 - RNA, 19 nt, Homo sapiens
uccaguaaauugcuaagua

SEQ ID NO: 829339 - RNA, 19 nt, Homo sapiens
guauucgcauguagauaua

SEQ ID NO: 829340 - RNA, 19 nt, Homo sapiens
gaauuuguggaacaucuua

SEQ ID NO: 829341 - RNA, 19 nt, Homo sapiens
guguguaugugauuuguuu

SEQ ID NO: 829342 - RNA, 19 nt, Homo sapiens
auaaacagccuccuauaaa

SEQ ID NO: 829343 - RNA, 19 nt, Homo sapiens
ccugauauuugguagagua

SEQ ID NO: 829344 - RNA, 19 nt, Homo sapiens
acagauggcccuccaaauu

SEQ ID NO: 829345 - RNA, 19 nt, Homo sapiens
cgagugaucucagaaggaa

SEQ ID NO: 829346 - RNA, 19 nt, Homo sapiens
gaagaugaguccccaaaga

SEQ ID NO: 829347 - RNA, 19 nt, Homo sapiens
gaacacuucaguuauggaa

SEQ ID NO: 829348 - RNA, 19 nt, Homo sapiens
gauauuugguagaguaaca

SEQ ID NO: 829349 - RNA, 19 nt, Homo sapiens
gaagcugauugaacgaaug

SEQ ID NO: 829350 - RNA, 19 nt, Homo sapiens
gggagaugauggccuuuga

SEQ ID NO: 829351 - RNA, 19 nt, Homo sapiens
uaugaauucugacuuguug

SEQ ID NO: 829352 - RNA, 19 nt, Homo sapiens
gcaaggcuuagaucacaua

SEQ ID NO: 829353 - RNA, 19 nt, Homo sapiens
gucaauaaaucgaguaugg

SEQ ID NO: 829354 - RNA, 19 nt, Homo sapiens
caauaaacagccuccuaua

SEQ ID NO: 829355 - RNA, 19 nt, Homo sapiens
gagagguaccuuaaacauu

SEQ ID NO: 829356 - RNA, 19 nt, Homo sapiens
ugauguggauuaccuagaa

SEQ ID NO: 829357 - RNA, 19 nt, Homo sapiens
cauuaugaauucugacuug

SEQ ID NO: 829358 - RNA, 19 nt, Homo sapiens
gacuuggccucuaauuuau

SEQ ID NO: 829359 - RNA, 19 nt, Homo sapiens
gcacuuacgcuucagcaau

SEQ ID NO: 829360 - RNA, 19 nt, Homo sapiens
aauaaacagccuccuauaa

SEQ ID NO: 829361 - RNA, 19 nt, Homo sapiens
ccaaaugccuaagggaguu

SEQ ID NO: 829362 - RNA, 19 nt, Homo sapiens
aaccauaacugagcaaaug

SEQ ID NO: 829363 - RNA, 19 nt, Homo sapiens
gaaaggacguuggcaucca

SEQ ID NO: 829364 - RNA, 19 nt, Homo sapiens
gcucugaaguggagugaag

SEQ ID NO: 829365 - RNA, 19 nt, Homo sapiens
cauaacaguuuaaccucaa

SEQ ID NO: 829366 - RNA, 19 nt, Homo sapiens
gcuccaguuugaugaguuu

SEQ ID NO: 829367 - RNA, 19 nt, Homo sapiens
gaauguggugccuguuuaa

SEQ ID NO: 829368 - RNA, 19 nt, Homo sapiens
gugaucgucuccagaaaga

SEQ ID NO: 829369 - RNA, 19 nt, Homo sapiens
uaucagcauggacauauua

SEQ ID NO: 829370 - RNA, 19 nt, Homo sapiens
cccaaggaguucugacuuu

SEQ ID NO: 829371 - RNA, 19 nt, Homo sapiens
ccaauaaacagccuccuau

SEQ ID NO: 829372 - RNA, 19 nt, Homo sapiens
aaaggaacauagaaucugu

SEQ ID NO: 829373 - RNA, 19 nt, Homo sapiens
gcagagggugggaucagua

SEQ ID NO: 829374 - RNA, 19 nt, Homo sapiens
aauggaacaucaucuguga

SEQ ID NO: 829375 - RNA, 19 nt, Homo sapiens
caaagccaauacucuuaau

SEQ ID NO: 829376 - RNA, 19 nt, Homo sapiens
guaaaucgaccgucaagag

SEQ ID NO: 829377 - RNA, 19 nt, Homo sapiens
guauugcacuuacgcuuca

SEQ ID NO: 829378 - RNA, 19 nt, Homo sapiens
cagaucaaguggaauuugu

SEQ ID NO: 829379 - RNA, 19 nt, Homo sapiens
caaguggucaccucccaua

SEQ ID NO: 829380 - RNA, 19 nt, Homo sapiens
gauuccggcucuccuuuga

SEQ ID NO: 829381 - RNA, 19 nt, Homo sapiens
cgaugcauccgguuugaua

SEQ ID NO: 829382 - RNA, 19 nt, Homo sapiens
ccauuaggcucugggauau

SEQ ID NO: 829383 - RNA, 19 nt, Homo sapiens
cacgagcaccugugaauuu

SEQ ID NO: 829384 - RNA, 19 nt, Homo sapiens
gcauggacauauuaacucu

SEQ ID NO: 829385 - RNA, 19 nt, Homo sapiens
ccagaaagaggccaucaga

SEQ ID NO: 829386 - RNA, 19 nt, Homo sapiens
guucugacuuucugggauu

SEQ ID NO: 829387 - RNA, 19 nt, Homo sapiens
gcaaagcagccuaacucuu

SEQ ID NO: 829388 - RNA, 19 nt, Homo sapiens
gauaacagucugcacuuuc

SEQ ID NO: 829389 - RNA, 19 nt, Homo sapiens
ggaauguuugaaaguguua

SEQ ID NO: 829390 - RNA, 19 nt, Homo sapiens
caauaaaccuccauucaua

SEQ ID NO: 829391 - RNA, 19 nt, Homo sapiens
gcacuuugguuugauauua

SEQ ID NO: 829392 - RNA, 19 nt, Homo sapiens
guaaaggugucuacuguuu

SEQ ID NO: 829393 - RNA, 19 nt, Homo sapiens
gcacugggauagucuaauu

SEQ ID NO: 829394 - RNA, 19 nt, Homo sapiens
gaagcacacucuacuacua

SEQ ID NO: 829395 - RNA, 19 nt, Homo sapiens
gagaagacuuggccucuaa

SEQ ID NO: 829396 - RNA, 19 nt, Homo sapiens
gcagacaaccuuugaauug

SEQ ID NO: 829397 - RNA, 19 nt, Homo sapiens
gaucaaggaaugucaauaa

SEQ ID NO: 829398 - RNA, 19 nt, Homo sapiens
gugcuugccuccuaauuua

SEQ ID NO: 829399 - RNA, 19 nt, Homo sapiens
guaacuggcucuucagauu

SEQ ID NO: 829400 - RNA, 19 nt, Homo sapiens
agagguaccuuaaacauuu

SEQ ID NO: 829401 - RNA, 19 nt, Homo sapiens
gaugauggccuuugaauau

SEQ ID NO: 829402 - RNA, 19 nt, Homo sapiens
cagccuaacucuucaagua

SEQ ID NO: 829403 - RNA, 19 nt, Homo sapiens
gcacauugguggaacauuc

SEQ ID NO: 829404 - RNA, 19 nt, Homo sapiens
guuaguggaucaucagaua

SEQ ID NO: 829405 - RNA, 19 nt, Homo sapiens
agacuuggccucuaauuua

SEQ ID NO: 829406 - RNA, 19 nt, Homo sapiens
guucacagcugaguuauga

SEQ ID NO: 829407 - RNA, 19 nt, Homo sapiens
ccaguaaauugcuaaguaa

SEQ ID NO: 829408 - RNA, 19 nt, Homo sapiens
cgacauuucucaccucuga

SEQ ID NO: 829409 - RNA, 19 nt, Homo sapiens
gaaacagcauucuucuuca

SEQ ID NO: 829410 - RNA, 19 nt, Homo sapiens
gagcaaggcuuagaucaca

SEQ ID NO: 829411 - RNA, 19 nt, Homo sapiens
gaaauaagaaggcccuguu

SEQ ID NO: 829412 - RNA, 19 nt, Homo sapiens
ugaauguggugccuguuua

SEQ ID NO: 829413 - RNA, 19 nt, Homo sapiens
gaaggaaugcuuuggaaga

SEQ ID NO: 829414 - RNA, 19 nt, Homo sapiens
ccaaccaucuccugauauu

SEQ ID NO: 829415 - RNA, 19 nt, Homo sapiens
caaagcagccuaacucuuc

SEQ ID NO: 829416 - RNA, 19 nt, Homo sapiens
gauaaguaauggaacauca

SEQ ID NO: 829417 - RNA, 19 nt, Homo sapiens
ugaaucagaucaaguggaa

SEQ ID NO: 829418 - RNA, 19 nt, Homo sapiens
gugaaguucuuaacacauu

SEQ ID NO: 829419 - RNA, 19 nt, Homo sapiens
gaacauacacuuacaucuc

SEQ ID NO: 829420 - RNA, 19 nt, Homo sapiens
gagcugguauguaaagaau

SEQ ID NO: 829421 - RNA, 19 nt, Homo sapiens
ggacuuuauuaccgcuuua

SEQ ID NO: 829422 - RNA, 19 nt, Homo sapiens
uguggaaugugcuuaauaa

SEQ ID NO: 829423 - RNA, 19 nt, Homo sapiens
gcauguagauauaauguac

SEQ ID NO: 829424 - RNA, 19 nt, Homo sapiens
ccaaacaccuacccagaau

SEQ ID NO: 829425 - RNA, 19 nt, Homo sapiens
agagggacaugaagaauug

SEQ ID NO: 829426 - RNA, 19 nt, Homo sapiens
gagcaccugugaauuuguu

SEQ ID NO: 829427 - RNA, 19 nt, Homo sapiens
uaaacagccuccuauaaag

SEQ ID NO: 829428 - RNA, 19 nt, Homo sapiens
gaacaucuuauuucacgaa

SEQ ID NO: 829429 - RNA, 19 nt, Homo sapiens
gccauacucuggacuuuau

SEQ ID NO: 829430 - RNA, 19 nt, Homo sapiens
guggucaccucccauagua

SEQ ID NO: 829431 - RNA, 19 nt, Homo sapiens
caauagagagguaccuuaa

SEQ ID NO: 829432 - RNA, 19 nt, Homo sapiens
caucuuauuucacgaaugu

SEQ ID NO: 829433 - RNA, 19 nt, Homo sapiens
gaccaucgagcucaugaua

SEQ ID NO: 829434 - RNA, 19 nt, Homo sapiens
gauuauacuuccuuucugu

SEQ ID NO: 829435 - RNA, 19 nt, Homo sapiens
gcucugggauauugaaugu

SEQ ID NO: 829436 - RNA, 19 nt, Homo sapiens
cagaaggaaugcuuuggaa

SEQ ID NO: 829437 - RNA, 19 nt, Homo sapiens
caccuaaucuggcuucaug

SEQ ID NO: 829438 - RNA, 19 nt, Homo sapiens
uccaguaaauugcuaagua

SEQ ID NO: 829439 - RNA, 19 nt, Homo sapiens
guauucgcauguagauaua

SEQ ID NO: 829440 - RNA, 19 nt, Homo sapiens
gaauuuguggaacaucuua

SEQ ID NO: 829441 - RNA, 19 nt, Homo sapiens
guguguaugugauuuguuu

SEQ ID NO: 829442 - RNA, 19 nt, Homo sapiens
auaaacagccuccuauaaa

SEQ ID NO: 829443 - RNA, 19 nt, Homo sapiens
ccugauauuugguagagua

SEQ ID NO: 829444 - RNA, 19 nt, Homo sapiens
acagauggcccuccaaauu

SEQ ID NO: 829445 - RNA, 19 nt, Homo sapiens
cgagugaucucagaaggaa

SEQ ID NO: 829446 - RNA, 19 nt, Homo sapiens
gauauuugguagaguaaca

SEQ ID NO: 829447 - RNA, 19 nt, Homo sapiens
gaagcugauugaacgaaug

SEQ ID NO: 829448 - RNA, 19 nt, Homo sapiens
gggagaugauggccuuuga

SEQ ID NO: 829449 - RNA, 19 nt, Homo sapiens
uaugaauucugacuuguug

SEQ ID NO: 829450 - RNA, 19 nt, Homo sapiens
gcaaggcuuagaucacaua

SEQ ID NO: 829451 - RNA, 19 nt, Homo sapiens
gucaauaaaucgaguaugg

SEQ ID NO: 829452 - RNA, 19 nt, Homo sapiens
caauaaacagccuccuaua

SEQ ID NO: 829453 - RNA, 19 nt, Homo sapiens
gagagguaccuuaaacauu

SEQ ID NO: 829454 - RNA, 19 nt, Homo sapiens
ugauguggauuaccuagaa

SEQ ID NO: 829455 - RNA, 19 nt, Homo sapiens
cauuaugaauucugacuug

SEQ ID NO: 829456 - RNA, 19 nt, Homo sapiens
gacuuggccucuaauuuau

SEQ ID NO: 829457 - RNA, 19 nt, Homo sapiens
gcacuuacgcuucagcaau

SEQ ID NO: 829458 - RNA, 19 nt, Homo sapiens
aauaaacagccuccuauaa

SEQ ID NO: 829459 - RNA, 19 nt, Homo sapiens
ccaaaugccuaagggaguu

SEQ ID NO: 829460 - RNA, 19 nt, Homo sapiens
aaccauaacugagcaaaug

SEQ ID NO: 829461 - RNA, 19 nt, Homo sapiens
gaaaggacguuggcaucca

SEQ ID NO: 829462 - RNA, 19 nt, Homo sapiens
gcucugaaguggagugaag

SEQ ID NO: 829463 - RNA, 19 nt, Homo sapiens
cauaacaguuuaaccucaa

SEQ ID NO: 829464 - RNA, 19 nt, Homo sapiens
gcuccaguuugaugaguuu

SEQ ID NO: 829465 - RNA, 19 nt, Homo sapiens
gaauguggugccuguuuaa

SEQ ID NO: 829466 - RNA, 19 nt, Homo sapiens
gugaucgucuccagaaaga

SEQ ID NO: 829467 - RNA, 19 nt, Homo sapiens
uaucagcauggacauauua

SEQ ID NO: 829468 - RNA, 19 nt, Homo sapiens
cccaaggaguucugacuuu

SEQ ID NO: 829469 - RNA, 19 nt, Homo sapiens
ccaauaaacagccuccuau

SEQ ID NO: 829470 - RNA, 19 nt, Homo sapiens
aaaggaacauagaaucugu

SEQ ID NO: 829471 - RNA, 19 nt, Homo sapiens
aauggaacaucaucuguga

SEQ ID NO: 829472 - RNA, 19 nt, Homo sapiens
gcagagggugggaucagua

SEQ ID NO: 829473 - RNA, 19 nt, Homo sapiens
caaagccaauacucuuaau

SEQ ID NO: 829474 - RNA, 19 nt, Homo sapiens
guaaaucgaccgucaagag

SEQ ID NO: 829475 - RNA, 19 nt, Homo sapiens
guauugcacuuacgcuuca

SEQ ID NO: 829476 - RNA, 19 nt, Homo sapiens
cagaucaaguggaauuugu

SEQ ID NO: 829477 - RNA, 19 nt, Homo sapiens
caugauaaguaauggaaca

SEQ ID NO: 829478 - RNA, 19 nt, Homo sapiens
caaguggucaccucccaua

SEQ ID NO: 829479 - RNA, 19 nt, Homo sapiens
gcauggacauauuaacucu

SEQ ID NO: 829480 - RNA, 19 nt, Homo sapiens
gauuccggcucuccuuuga

SEQ ID NO: 829481 - RNA, 19 nt, Homo sapiens
ccaucgagcucaugauaag

SEQ ID NO: 829482 - RNA, 19 nt, Homo sapiens
cgaugcauccgguuugaua

SEQ ID NO: 829483 - RNA, 19 nt, Homo sapiens
ccauuaggcucugggauau

SEQ ID NO: 829484 - RNA, 19 nt, Homo sapiens
cacgagcaccugugaauuu

SEQ ID NO: 829485 - RNA, 19 nt, Homo sapiens
guucugacuuucugggauu

SEQ ID NO: 829486 - RNA, 19 nt, Homo sapiens
gcaaagcagccuaacucuu

SEQ ID NO: 829487 - RNA, 19 nt, Homo sapiens
gauaacagucugcacuuuc

SEQ ID NO: 829488 - RNA, 19 nt, Homo sapiens
ccagaaagaggccaucaga

SEQ ID NO: 829489 - RNA, 19 nt, Homo sapiens
ggaauguuugaaaguguua

SEQ ID NO: 829490 - RNA, 19 nt, Homo sapiens
gaagagacauuuagaaaga

SEQ ID NO: 829491 - RNA, 19 nt, Homo sapiens
gaacacgacuggaagauga

SEQ ID NO: 829492 - RNA, 19 nt, Homo sapiens
ucacagugcugaaguauuu

SEQ ID NO: 829493 - RNA, 19 nt, Homo sapiens
gguagugacuucuuugaua

SEQ ID NO: 829494 - RNA, 19 nt, Homo sapiens
gauauugaguucucugaua

SEQ ID NO: 829495 - RNA, 19 nt, Homo sapiens
ggacaagaauccuuuccua

SEQ ID NO: 829496 - RNA, 19 nt, Homo sapiens
gcacauugcucccaagaau

SEQ ID NO: 829497 - RNA, 19 nt, Homo sapiens
gaagcaacaugaggaauuu

SEQ ID NO: 829498 - RNA, 19 nt, Homo sapiens
ggucgacgcuggcugauuu

SEQ ID NO: 829499 - RNA, 19 nt, Homo sapiens
gagcuggccugacggauaa

SEQ ID NO: 829500 - RNA, 19 nt, Homo sapiens
gcaaugaacucgaauccau

SEQ ID NO: 829501 - RNA, 19 nt, Homo sapiens
gcaaggaacugaacaacca

SEQ ID NO: 829502 - RNA, 19 nt, Homo sapiens
guacacagcccguuaaaga

SEQ ID NO: 829503 - RNA, 19 nt, Homo sapiens
gcucaggcaucuuacuaua

SEQ ID NO: 829504 - RNA, 19 nt, Homo sapiens
aaacaauccugaucagaaa

SEQ ID NO: 829505 - RNA, 19 nt, Homo sapiens
gaucugcccucgcauguug

SEQ ID NO: 829506 - RNA, 19 nt, Homo sapiens
gaacuuucccucucuacua

SEQ ID NO: 829507 - RNA, 19 nt, Homo sapiens
gaaccucugucgugaaugu

SEQ ID NO: 829508 - RNA, 19 nt, Homo sapiens
gaagauggcgcaacucaga

SEQ ID NO: 829509 - RNA, 19 nt, Homo sapiens
gcuauaacccucuacagua

SEQ ID NO: 829510 - RNA, 19 nt, Homo sapiens
ucagaaaccugcucuaaag

SEQ ID NO: 829511 - RNA, 19 nt, Homo sapiens
ugaugagccugauggauua

SEQ ID NO: 829512 - RNA, 19 nt, Homo sapiens
ggauugggauggagacauu

SEQ ID NO: 829513 - RNA, 19 nt, Homo sapiens
uaugagcgcuguauucuau

SEQ ID NO: 829514 - RNA, 19 nt, Homo sapiens
ggaggaaguugcgaauaaa

SEQ ID NO: 829515 - RNA, 19 nt, Homo sapiens
ugaaggcgcucacaaggaa

SEQ ID NO: 829516 - RNA, 19 nt, Homo sapiens
gaagucagcccuacaucuu

SEQ ID NO: 829517 - RNA, 19 nt, Homo sapiens
cagaagccaugaacaaaga

SEQ ID NO: 829518 - RNA, 19 nt, Homo sapiens
gagaaaacaugaaggaauu

SEQ ID NO: 829519 - RNA, 19 nt, Homo sapiens
gaucagaaaccugcucuaa

SEQ ID NO: 829520 - RNA, 19 nt, Homo sapiens
caaacaauccugaucagaa

SEQ ID NO: 829521 - RNA, 19 nt, Homo sapiens
gaaaggaagagacauuuag

SEQ ID NO: 829522 - RNA, 19 nt, Homo sapiens
gugaggaguucaaagauga

SEQ ID NO: 829523 - RNA, 19 nt, Homo sapiens
gcaaagacaaggcuaagga

SEQ ID NO: 829524 - RNA, 19 nt, Homo sapiens
ccagugauacagcgaauua

SEQ ID NO: 829525 - RNA, 19 nt, Homo sapiens
guucagaguuuccgucaga

SEQ ID NO: 829526 - RNA, 19 nt, Homo sapiens
ggaggaggauguggugauu

SEQ ID NO: 829527 - RNA, 19 nt, Homo sapiens
ggagugaggaguucaaaga

SEQ ID NO: 829528 - RNA, 19 nt, Homo sapiens
aaggagauauugcuaggua

SEQ ID NO: 829529 - RNA, 19 nt, Homo sapiens
gcccagcgaugcaugauau

SEQ ID NO: 829530 - RNA, 19 nt, Homo sapiens
gaaaaccagugcuaaagaa

SEQ ID NO: 829531 - RNA, 19 nt, Homo sapiens
guccugaucuggaaaucua

SEQ ID NO: 829532 - RNA, 19 nt, Homo sapiens
ggacacugaugaugaaguc

SEQ ID NO: 829533 - RNA, 19 nt, Homo sapiens
gaggaaagccugacaaagg

SEQ ID NO: 829534 - RNA, 19 nt, Homo sapiens
gaugaccucacccuucuua

SEQ ID NO: 829535 - RNA, 19 nt, Homo sapiens
ggucguggcauucugauuu

SEQ ID NO: 829536 - RNA, 19 nt, Homo sapiens
aggaggaaguugcgaauaa

SEQ ID NO: 829537 - RNA, 19 nt, Homo sapiens
gcauguugcuguggaugua

SEQ ID NO: 829538 - RNA, 19 nt, Homo sapiens
ggaaagcacgcaguuggua

SEQ ID NO: 829539 - RNA, 19 nt, Homo sapiens
ugagcgcuguauucuauua

SEQ ID NO: 829540 - RNA, 19 nt, Homo sapiens
guagugacuucuuugauag

SEQ ID NO: 829541 - RNA, 19 nt, Homo sapiens
ggagcuggccugacggaua

SEQ ID NO: 829542 - RNA, 19 nt, Homo sapiens
gaacccaagucggcuucua

SEQ ID NO: 829543 - RNA, 19 nt, Homo sapiens
ggaaggauucugagcaaga

SEQ ID NO: 829544 - RNA, 19 nt, Homo sapiens
cgagauugcucugcuguug

SEQ ID NO: 829545 - RNA, 19 nt, Homo sapiens
ugaaaucacaguucccuuu

SEQ ID NO: 829546 - RNA, 19 nt, Homo sapiens
gaccagccguggcaaugaa

SEQ ID NO: 829547 - RNA, 19 nt, Homo sapiens
caagaggaucguagucuaa

SEQ ID NO: 829548 - RNA, 19 nt, Homo sapiens
gaccggaaccugcguguga

SEQ ID NO: 829549 - RNA, 19 nt, Homo sapiens
ucaaggaguuccagguguu

SEQ ID NO: 829550 - RNA, 19 nt, Homo sapiens
acaagaggaucguagucua

SEQ ID NO: 829551 - RNA, 19 nt, Homo sapiens
cagcuuaugaccaucaaua

SEQ ID NO: 829552 - RNA, 19 nt, Homo sapiens
ugaggaaccugcagcaaca

SEQ ID NO: 829553 - RNA, 19 nt, Homo sapiens
gaaaccugcucuaaagacu

SEQ ID NO: 829554 - RNA, 19 nt, Homo sapiens
gaauaucgaggcacucuuc

SEQ ID NO: 829555 - RNA, 19 nt, Homo sapiens
gcagaaugguccuauagac

SEQ ID NO: 829556 - RNA, 19 nt, Homo sapiens
gauugaagacuuugaggaa

SEQ ID NO: 829557 - RNA, 19 nt, Homo sapiens
acaaggacccggaugauga

SEQ ID NO: 829558 - RNA, 19 nt, Homo sapiens
aaagguucauccucaguuu

SEQ ID NO: 829559 - RNA, 19 nt, Homo sapiens
gacgcugucuauuacuaua

SEQ ID NO: 829560 - RNA, 19 nt, Homo sapiens
ggaagagacauuuagaaag

SEQ ID NO: 829561 - RNA, 19 nt, Homo sapiens
gaggcuuccuuaccaagaa

SEQ ID NO: 829562 - RNA, 19 nt, Homo sapiens
acaguucccuuucaucuuc

SEQ ID NO: 829563 - RNA, 19 nt, Homo sapiens
gcagauggagcucgaaauc

SEQ ID NO: 829564 - RNA, 19 nt, Homo sapiens
gaggagugccgcucuguga

SEQ ID NO: 829565 - RNA, 19 nt, Homo sapiens
ugacuucuuugauaguuug

SEQ ID NO: 829566 - RNA, 19 nt, Homo sapiens
ggaugaggguagugacuuc

SEQ ID NO: 829567 - RNA, 19 nt, Homo sapiens
gcagacuguuagcaaagaa

SEQ ID NO: 829568 - RNA, 19 nt, Homo sapiens
uuaaagaugucugcaagga

SEQ ID NO: 829569 - RNA, 19 nt, Homo sapiens
gcugauuucuguaacauac

SEQ ID NO: 829570 - RNA, 19 nt, Homo sapiens
gagaagauggcgcaacuca

SEQ ID NO: 829571 - RNA, 19 nt, Homo sapiens
cacccuaucugucaauuca

SEQ ID NO: 829572 - RNA, 19 nt, Homo sapiens
aaaccagugcuaaagaaua

SEQ ID NO: 829573 - RNA, 19 nt, Homo sapiens
gagccaaggccaguaguuu

SEQ ID NO: 829574 - RNA, 19 nt, Homo sapiens
caagaaugaguuccugaaa

SEQ ID NO: 829575 - RNA, 19 nt, Homo sapiens
ggacagucaugagucuaga

SEQ ID NO: 829576 - RNA, 19 nt, Homo sapiens
ucaagaggcuuugguuaag

SEQ ID NO: 829577 - RNA, 19 nt, Homo sapiens
gggcagggguucagaguuu

SEQ ID NO: 829578 - RNA, 19 nt, Homo sapiens
agacaaggcuaaggacuuc

SEQ ID NO: 829579 - RNA, 19 nt, Homo sapiens
gacgcuggcugauuucugu

SEQ ID NO: 829580 - RNA, 19 nt, Homo sapiens
ggaccaggaugaccaagac

SEQ ID NO: 829581 - RNA, 19 nt, Homo sapiens
gcucugggcuuggccaugu

SEQ ID NO: 829582 - RNA, 19 nt, Homo sapiens
aaccagugcuaaagaauau

SEQ ID NO: 829583 - RNA, 19 nt, Homo sapiens
cagagacaaggacaacuua

SEQ ID NO: 829584 - RNA, 19 nt, Homo sapiens
gaaggauucugagcaagag

SEQ ID NO: 829585 - RNA, 19 nt, Homo sapiens
cagaacagauggaaaagaa

SEQ ID NO: 829586 - RNA, 19 nt, Homo sapiens
gcacucuucgugucacuuu

SEQ ID NO: 829587 - RNA, 19 nt, Homo sapiens
agaaaggaagagacauuua

SEQ ID NO: 829588 - RNA, 19 nt, Homo sapiens
caggagaaguucagaaagg

SEQ ID NO: 829589 - RNA, 19 nt, Homo sapiens
gagcagaaugguccuauag

SEQ ID NO: 829590 - RNA, 19 nt, Homo sapiens
gcaaggagcugucacacua

SEQ ID NO: 829591 - RNA, 19 nt, Homo sapiens
ugaaggagaucaaccagaa

SEQ ID NO: 829592 - RNA, 19 nt, Homo sapiens
agacggagcugaagcaguu

SEQ ID NO: 829593 - RNA, 19 nt, Homo sapiens
gaaggaagggcaaccuaaa

SEQ ID NO: 829594 - RNA, 19 nt, Homo sapiens
caacgggccugagaucuug

SEQ ID NO: 829595 - RNA, 19 nt, Homo sapiens
ugaugaagcugcgcaauga

SEQ ID NO: 829596 - RNA, 19 nt, Homo sapiens
gcaaguaugagaaugagaa

SEQ ID NO: 829597 - RNA, 19 nt, Homo sapiens
gugaggagcuggccaaucu

SEQ ID NO: 829598 - RNA, 19 nt, Homo sapiens
ggaaggaagggcaaccuaa

SEQ ID NO: 829599 - RNA, 19 nt, Homo sapiens
uuacacagcuggaugagau

SEQ ID NO: 829600 - RNA, 19 nt, Homo sapiens
agaaggagcuaaagaaggu

SEQ ID NO: 829601 - RNA, 19 nt, Homo sapiens
gaagagcaaguaugagaau

SEQ ID NO: 829602 - RNA, 19 nt, Homo sapiens
gaacaucuacaaccugauc

SEQ ID NO: 829603 - RNA, 19 nt, Homo sapiens
acaccgagccuguagagua

SEQ ID NO: 829604 - RNA, 19 nt, Homo sapiens
agacagcccuggacaacga

SEQ ID NO: 829605 - RNA, 19 nt, Homo sapiens
ucagugagcucaacaucuc

SEQ ID NO: 829606 - RNA, 19 nt, Homo sapiens
agaaccagguggaguuuga

SEQ ID NO: 829607 - RNA, 19 nt, Homo sapiens
gcauggccauccagcagaa

SEQ ID NO: 829608 - RNA, 19 nt, Homo sapiens
caucaaggaguacaaauuc

SEQ ID NO: 829609 - RNA, 19 nt, Homo sapiens
gccaggcacucacggagaa

SEQ ID NO: 829610 - RNA, 19 nt, Homo sapiens
gcaccaagcgggagcagau

SEQ ID NO: 829611 - RNA, 19 nt, Homo sapiens
aggaugagcuggugaccuu

SEQ ID NO: 829612 - RNA, 19 nt, Homo sapiens
gggagcccaugaacaucua

SEQ ID NO: 829613 - RNA, 19 nt, Homo sapiens
ggagaaggagcuaaagaag

SEQ ID NO: 829614 - RNA, 19 nt, Homo sapiens
gcaauguccucaccaacac

SEQ ID NO: 829615 - RNA, 19 nt, Homo sapiens
ggacaaggaagcgcuuaug

SEQ ID NO: 829616 - RNA, 19 nt, Homo sapiens
ucuacaaccugaucgcuau

SEQ ID NO: 829617 - RNA, 19 nt, Homo sapiens
cccaggagcugaaggagau

SEQ ID NO: 829618 - RNA, 19 nt, Homo sapiens
gcacacacaaaccacaaga

SEQ ID NO: 829619 - RNA, 19 nt, Homo sapiens
gagcaaguaugagaaugag

SEQ ID NO: 829620 - RNA, 19 nt, Homo sapiens
agacggagcgcgaacagaa

SEQ ID NO: 829621 - RNA, 19 nt, Homo sapiens
gacagaaccagguggaguu

SEQ ID NO: 829622 - RNA, 19 nt, Homo sapiens
gaacaucagccugcagaag

SEQ ID NO: 829623 - RNA, 19 nt, Homo sapiens
uaucauccgugaccagauc

SEQ ID NO: 829624 - RNA, 19 nt, Homo sapiens
caccgagccuguagaguag

SEQ ID NO: 829625 - RNA, 19 nt, Homo sapiens
ugaagcaguugcgcaaugu

SEQ ID NO: 829626 - RNA, 19 nt, Homo sapiens
ccaaggagcaguacuacgu

SEQ ID NO: 829627 - RNA, 19 nt, Homo sapiens
aaugagaaggccaugguua

SEQ ID NO: 829628 - RNA, 19 nt, Homo sapiens
ucuccgaccuacucaguga

SEQ ID NO: 829629 - RNA, 19 nt, Homo sapiens
acacaaaccacaagaaggu

SEQ ID NO: 829630 - RNA, 19 nt, Homo sapiens
ggauaugccacugcaauuc

SEQ ID NO: 829631 - RNA, 19 nt, Homo sapiens
ugacccgccucacagagaa

SEQ ID NO: 829632 - RNA, 19 nt, Homo sapiens
acacgcagucggagaauga

SEQ ID NO: 829633 - RNA, 19 nt, Homo sapiens
gaaugagaaggccaugguu

SEQ ID NO: 829634 - RNA, 19 nt, Homo sapiens
caaccuaaaagcccacuua

SEQ ID NO: 829635 - RNA, 19 nt, Homo sapiens
ucaccacgcugcgcacugu

SEQ ID NO: 829636 - RNA, 19 nt, Homo sapiens
gaaggucucccugcuagag

SEQ ID NO: 829637 - RNA, 19 nt, Homo sapiens
cagaacagcaggagaaggu

SEQ ID NO: 829638 - RNA, 19 nt, Homo sapiens
ugucagaacagcaggagaa

SEQ ID NO: 829639 - RNA, 19 nt, Homo sapiens
ggagcugucacacuacaug

SEQ ID NO: 829640 - RNA, 19 nt, Homo sapiens
caaccagaauguggagauc

SEQ ID NO: 829641 - RNA, 19 nt, Homo sapiens
ccaacacgcagucggagaa

SEQ ID NO: 829642 - RNA, 19 nt, Homo sapiens
gauaugccacugcaauucu

SEQ ID NO: 829643 - RNA, 19 nt, Homo sapiens
gagaagaagacgcugaacu

SEQ ID NO: 829644 - RNA, 19 nt, Homo sapiens
gugucaugcuggacuacua

SEQ ID NO: 829645 - RNA, 19 nt, Homo sapiens
uggagaaggagcuaaagaa

SEQ ID NO: 829646 - RNA, 19 nt, Homo sapiens
gcagacagcccuggacaac

SEQ ID NO: 829647 - RNA, 19 nt, Homo sapiens
cugaagcaguugcgcaaug

SEQ ID NO: 829648 - RNA, 19 nt, Homo sapiens
gaaggagaucaaccagaau

SEQ ID NO: 829649 - RNA, 19 nt, Homo sapiens
uggcggugcucgaggagaa

SEQ ID NO: 829650 - RNA, 19 nt, Homo sapiens
uuaccgagaccaugaugaa

SEQ ID NO: 829651 - RNA, 19 nt, Homo sapiens
cugaagagcaaguaugaga

SEQ ID NO: 829652 - RNA, 19 nt, Homo sapiens
gcaucaaugacuccuucua

SEQ ID NO: 829653 - RNA, 19 nt, Homo sapiens
cgucggaggaggaggagua

SEQ ID NO: 829654 - RNA, 19 nt, Homo sapiens
ggagaucaaccagaaugug

SEQ ID NO: 829655 - RNA, 19 nt, Homo sapiens
ggaggccuuuggacaagca

SEQ ID NO: 829656 - RNA, 19 nt, Homo sapiens
gcgcucacccauccuccua

SEQ ID NO: 829657 - RNA, 19 nt, Homo sapiens
gacaucaacgggccugaga

SEQ ID NO: 829658 - RNA, 19 nt, Homo sapiens
caaguucagugacgaugcu

SEQ ID NO: 829659 - RNA, 19 nt, Homo sapiens
agaagaagacgcugaacuc

SEQ ID NO: 829660 - RNA, 19 nt, Homo sapiens
ucaacgggccugagaucuu

SEQ ID NO: 829661 - RNA, 19 nt, Homo sapiens
ugacaucaaggaguacaaa

SEQ ID NO: 829662 - RNA, 19 nt, Homo sapiens
ugaagagcaaguaugagaa

SEQ ID NO: 829663 - RNA, 19 nt, Homo sapiens
acaaggaagcgcuuaugga

SEQ ID NO: 829664 - RNA, 19 nt, Homo sapiens
ggagcuggccaaucucuac

SEQ ID NO: 829665 - RNA, 19 nt, Homo sapiens
gagcugucacacuacauga

SEQ ID NO: 829666 - RNA, 19 nt, Homo sapiens
gacaagcacacacaaacca

SEQ ID NO: 829667 - RNA, 19 nt, Homo sapiens
agagcaaguaugagaauga

SEQ ID NO: 829668 - RNA, 19 nt, Homo sapiens
acuacgagguggacaucaa

SEQ ID NO: 829669 - RNA, 19 nt, Homo sapiens
uggaggaggagaccgagua

SEQ ID NO: 829670 - RNA, 19 nt, Homo sapiens
acaucaaggaguacaaauu

SEQ ID NO: 829671 - RNA, 19 nt, Homo sapiens
gacaaggaagcgcuuaugg

SEQ ID NO: 829672 - RNA, 19 nt, Homo sapiens
gccgggagcccaugaacau

SEQ ID NO: 829673 - RNA, 19 nt, Homo sapiens
ccacugcaauucuuuucaa

SEQ ID NO: 829674 - RNA, 19 nt, Homo sapiens
aaagcccacuuagaaacuu

SEQ ID NO: 829675 - RNA, 19 nt, Homo sapiens
acacacaaaccacaagaag

SEQ ID NO: 829676 - RNA, 19 nt, Homo sapiens
ugcucgagcuggaccauga

SEQ ID NO: 829677 - RNA, 19 nt, Homo sapiens
gcugaggacgagaagaaga

SEQ ID NO: 829678 - RNA, 19 nt, Homo sapiens
ccaugaacaucuacaaccu

SEQ ID NO: 829679 - RNA, 19 nt, Homo sapiens
caucaaugacuccuucuac

SEQ ID NO: 829680 - RNA, 19 nt, Homo sapiens
agaacagccugcgcaagga

SEQ ID NO: 829681 - RNA, 19 nt, Homo sapiens
gaagacggagcgcgaacag

SEQ ID NO: 829682 - RNA, 19 nt, Homo sapiens
aagcccacuuagaaacuuu

SEQ ID NO: 829683 - RNA, 19 nt, Homo sapiens
caaccugaagagcaaguau

SEQ ID NO: 829684 - RNA, 19 nt, Homo sapiens
gccagcgcauugccucuca

SEQ ID NO: 829685 - RNA, 19 nt, Homo sapiens
gaugagcuggugaccuuca

SEQ ID NO: 829686 - RNA, 19 nt, Homo sapiens
caucaacgggccugagauc

SEQ ID NO: 829687 - RNA, 19 nt, Homo sapiens
cugcugaggacgagaagaa

SEQ ID NO: 829688 - RNA, 19 nt, Homo sapiens
gaccacgcgugagaagauc

SEQ ID NO: 829689 - RNA, 19 nt, Homo sapiens
ggagaagcaccagcucaag

SEQ ID NO: 829690 - RNA, 19 nt, Homo sapiens
ggagugcaaucuacaauua

SEQ ID NO: 829691 - RNA, 19 nt, Homo sapiens
gaacagcacugcagucuca

SEQ ID NO: 829692 - RNA, 19 nt, Homo sapiens
gaaaugagcaggaaucuug

SEQ ID NO: 829693 - RNA, 19 nt, Homo sapiens
acuagaagcuucagaaaua

SEQ ID NO: 829694 - RNA, 19 nt, Homo sapiens
aaucaucacugccuuaaua

SEQ ID NO: 829695 - RNA, 19 nt, Homo sapiens
gcacaugccuguauuacug

SEQ ID NO: 829696 - RNA, 19 nt, Homo sapiens
gggaaauucuaacuucuua

SEQ ID NO: 829697 - RNA, 19 nt, Homo sapiens
ugagaaaucugcaccaauu

SEQ ID NO: 829698 - RNA, 19 nt, Homo sapiens
aaauauaccugcucuagaa

SEQ ID NO: 829699 - RNA, 19 nt, Homo sapiens
cauaaagccuuaacuuaga

SEQ ID NO: 829700 - RNA, 19 nt, Homo sapiens
gaaaucugcaccaauuaua

SEQ ID NO: 829701 - RNA, 19 nt, Homo sapiens
gcagagacaguaacucaua

SEQ ID NO: 829702 - RNA, 19 nt, Homo sapiens
gaacagggaguuauggaaa

SEQ ID NO: 829703 - RNA, 19 nt, Homo sapiens
ucacagaacaugacagaua

SEQ ID NO: 829704 - RNA, 19 nt, Homo sapiens
agaaugagccuaagacuuu

SEQ ID NO: 829705 - RNA, 19 nt, Homo sapiens
guaggagcaugaucaagua

SEQ ID NO: 829706 - RNA, 19 nt, Homo sapiens
guacaaacuucucaaaucu

SEQ ID NO: 829707 - RNA, 19 nt, Homo sapiens
cauagucaauccaacaaua

SEQ ID NO: 829708 - RNA, 19 nt, Homo sapiens
gaaugagccuaagacuuua

SEQ ID NO: 829709 - RNA, 19 nt, Homo sapiens
gcagugaucuauggcuuaa

SEQ ID NO: 829710 - RNA, 19 nt, Homo sapiens
gcaggaaucuuguagugau

SEQ ID NO: 829711 - RNA, 19 nt, Homo sapiens
gacugaaggucuagaaauu

SEQ ID NO: 829712 - RNA, 19 nt, Homo sapiens
guaaugaaguaaugagaga

SEQ ID NO: 829713 - RNA, 19 nt, Homo sapiens
aaggagaaaugcauguuua

SEQ ID NO: 829714 - RNA, 19 nt, Homo sapiens
cacaagagguuuauugaug

SEQ ID NO: 829715 - RNA, 19 nt, Homo sapiens
gguacaaacuucucaaauc

SEQ ID NO: 829716 - RNA, 19 nt, Homo sapiens
ggacccaccuaguaagaaa

SEQ ID NO: 829717 - RNA, 19 nt, Homo sapiens
gagcaggaaucuuguagug

SEQ ID NO: 829718 - RNA, 19 nt, Homo sapiens
gcaucucccuggaauguaa

SEQ ID NO: 829719 - RNA, 19 nt, Homo sapiens
gcaacaagcacguagugua

SEQ ID NO: 829720 - RNA, 19 nt, Homo sapiens
gaccgugucucuggaauuu

SEQ ID NO: 829721 - RNA, 19 nt, Homo sapiens
cgagauauccucagaaguu

SEQ ID NO: 829722 - RNA, 19 nt, Homo sapiens
gaucgaagcuauacuugag

SEQ ID NO: 829723 - RNA, 19 nt, Homo sapiens
gaauguggcugaugaugca

SEQ ID NO: 829724 - RNA, 19 nt, Homo sapiens
ggaacacgauggagucuca

SEQ ID NO: 829725 - RNA, 19 nt, Homo sapiens
gaccaugaguucuggguuu

SEQ ID NO: 829726 - RNA, 19 nt, Homo sapiens
cacagaacaugacagauaa

SEQ ID NO: 829727 - RNA, 19 nt, Homo sapiens
gagaagaagcacaaaugua

SEQ ID NO: 829728 - RNA, 19 nt, Homo sapiens
gauugaggcuaaugacaaa

SEQ ID NO: 829729 - RNA, 19 nt, Homo sapiens
ucaaauauccagacucaaa

SEQ ID NO: 829730 - RNA, 19 nt, Homo sapiens
ggacaccuguuuccaguca

SEQ ID NO: 829731 - RNA, 19 nt, Homo sapiens
gaacuagaagcuucagaaa

SEQ ID NO: 829732 - RNA, 19 nt, Homo sapiens
caacaagaccauugaauca

SEQ ID NO: 829733 - RNA, 19 nt, Homo sapiens
caagagguuuauugaugua

SEQ ID NO: 829734 - RNA, 19 nt, Homo sapiens
gauugaauguggcugauga

SEQ ID NO: 829735 - RNA, 19 nt, Homo sapiens
gcaauuauaggauagauuc

SEQ ID NO: 829736 - RNA, 19 nt, Homo sapiens
ucaagugucucuucccauu

SEQ ID NO: 829737 - RNA, 19 nt, Homo sapiens
gcagaggacuguggcaaga

SEQ ID NO: 829738 - RNA, 19 nt, Homo sapiens
gaaaggugaaucugauaaa

SEQ ID NO: 829739 - RNA, 19 nt, Homo sapiens
gacccaaaccauagauuua

SEQ ID NO: 829740 - RNA, 19 nt, Homo sapiens
gaauagcauuucuucaauc

SEQ ID NO: 829741 - RNA, 19 nt, Homo sapiens
gagcuucacugacgaugug

SEQ ID NO: 829742 - RNA, 19 nt, Homo sapiens
uaaaugcagugaucuaugg

SEQ ID NO: 829743 - RNA, 19 nt, Homo sapiens
ggcaagacccuaucucaaa

SEQ ID NO: 829744 - RNA, 19 nt, Homo sapiens
gcaguugcuuagcuucuuu

SEQ ID NO: 829745 - RNA, 19 nt, Homo sapiens
cagaugagcucaaccuagu

SEQ ID NO: 829746 - RNA, 19 nt, Homo sapiens
gaggaucacucgaggagau

SEQ ID NO: 829747 - RNA, 19 nt, Homo sapiens
guauagcacuuuacacaca

SEQ ID NO: 829748 - RNA, 19 nt, Homo sapiens
gaaagcaaaguucaguuga

SEQ ID NO: 829749 - RNA, 19 nt, Homo sapiens
acacagagacccaaacuga

SEQ ID NO: 829750 - RNA, 19 nt, Homo sapiens
ccucaaauauccagacuca

SEQ ID NO: 829751 - RNA, 19 nt, Homo sapiens
gcucuaagguaacuucauc

SEQ ID NO: 829752 - RNA, 19 nt, Homo sapiens
caucuaauccuuuacaaga

SEQ ID NO: 829753 - RNA, 19 nt, Homo sapiens
caagaccauugaaucauug

SEQ ID NO: 829754 - RNA, 19 nt, Homo sapiens
acaagaccauugaaucauu

SEQ ID NO: 829755 - RNA, 19 nt, Homo sapiens
caagaaugcuuuguguguu

SEQ ID NO: 829756 - RNA, 19 nt, Homo sapiens
gagaaaucugcaccaauua

SEQ ID NO: 829757 - RNA, 19 nt, Homo sapiens
gaacacagggacccaccua

SEQ ID NO: 829758 - RNA, 19 nt, Homo sapiens
auaaaucucugcccaugaa

SEQ ID NO: 829759 - RNA, 19 nt, Homo sapiens
uuuagagucuugcuuagua

SEQ ID NO: 829760 - RNA, 19 nt, Homo sapiens
gacgauguguuugaaauga

SEQ ID NO: 829761 - RNA, 19 nt, Homo sapiens
ugagaaaggugaaucugau

SEQ ID NO: 829762 - RNA, 19 nt, Homo sapiens
gcaacagaagauacaaaua

SEQ ID NO: 829763 - RNA, 19 nt, Homo sapiens
gcacuucuacuaagcuuga

SEQ ID NO: 829764 - RNA, 19 nt, Homo sapiens
ggacaacaguauuaauucg

SEQ ID NO: 829765 - RNA, 19 nt, Homo sapiens
gagauauccucagaaguug

SEQ ID NO: 829766 - RNA, 19 nt, Homo sapiens
gcacugcagucucacaucu

SEQ ID NO: 829767 - RNA, 19 nt, Homo sapiens
guaaauugacuaagaggaa

SEQ ID NO: 829768 - RNA, 19 nt, Homo sapiens
gauauuacuugugccuuga

SEQ ID NO: 829769 - RNA, 19 nt, Homo sapiens
acagacagacuuaaacuuu

SEQ ID NO: 829770 - RNA, 19 nt, Homo sapiens
gaaguaaugagagaagaaa

SEQ ID NO: 829771 - RNA, 19 nt, Homo sapiens
gagaaaggugaaucugaua

SEQ ID NO: 829772 - RNA, 19 nt, Homo sapiens
aagaaugcuuuguguguuu

SEQ ID NO: 829773 - RNA, 19 nt, Homo sapiens
aggugaaucugauaaagua

SEQ ID NO: 829774 - RNA, 19 nt, Homo sapiens
gcacugcuuguuagaaauu

SEQ ID NO: 829775 - RNA, 19 nt, Homo sapiens
uugcuuagcuucuuugugu

SEQ ID NO: 829776 - RNA, 19 nt, Homo sapiens
ggaugaccauguacagaug

SEQ ID NO: 829777 - RNA, 19 nt, Homo sapiens
ccaccgagauauccucaga

SEQ ID NO: 829778 - RNA, 19 nt, Homo sapiens
uguaguaagugcagcaauu

SEQ ID NO: 829779 - RNA, 19 nt, Homo sapiens
uuaaagagaagccagaauu

SEQ ID NO: 829780 - RNA, 19 nt, Homo sapiens
gagaaaugcauguuuaugg

SEQ ID NO: 829781 - RNA, 19 nt, Homo sapiens
ucaagcaucuauuuaaguc

SEQ ID NO: 829782 - RNA, 19 nt, Homo sapiens
ucaauacuuugcacuucua

SEQ ID NO: 829783 - RNA, 19 nt, Homo sapiens
gcaagacccuaucucaaaa

SEQ ID NO: 829784 - RNA, 19 nt, Homo sapiens
cuacaacugucuuuagcuu

SEQ ID NO: 829785 - RNA, 19 nt, Homo sapiens
guucaaggguacaaacuuc

SEQ ID NO: 829786 - RNA, 19 nt, Homo sapiens
aaacacagaccaugaguuc

SEQ ID NO: 829787 - RNA, 19 nt, Homo sapiens
gaacaugacagauaaucag

SEQ ID NO: 829788 - RNA, 19 nt, Homo sapiens
gagccuaccucuuuucaaa

SEQ ID NO: 829789 - RNA, 19 nt, Homo sapiens
caagcagacucuuacaaca

SEQ ID NO: 829790 - RNA, 19 nt, Homo sapiens
gaaagaaucucucccaaca

SEQ ID NO: 829791 - RNA, 19 nt, Homo sapiens
gagaugaacuuacuaacuu

SEQ ID NO: 829792 - RNA, 19 nt, Homo sapiens
ggagaucccugaaggcuuu

SEQ ID NO: 829793 - RNA, 19 nt, Homo sapiens
gaagaugaagugcuuaaua

SEQ ID NO: 829794 - RNA, 19 nt, Homo sapiens
aaacucaacuucagucuuu

SEQ ID NO: 829795 - RNA, 19 nt, Homo sapiens
gaaaagaucucucuacuuc

SEQ ID NO: 829796 - RNA, 19 nt, Homo sapiens
gaacacagaagaagaagaa

SEQ ID NO: 829797 - RNA, 19 nt, Homo sapiens
aagaagagaugcagccuua

SEQ ID NO: 829798 - RNA, 19 nt, Homo sapiens
uauuaaagcugcuguauug

SEQ ID NO: 829799 - RNA, 19 nt, Homo sapiens
ggaugacucuguauuugua

SEQ ID NO: 829800 - RNA, 19 nt, Homo sapiens
ggauaugucuccacccuuu

SEQ ID NO: 829801 - RNA, 19 nt, Homo sapiens
gagcuuaucaacaaacuua

SEQ ID NO: 829802 - RNA, 19 nt, Homo sapiens
gcaaauaugcguucagcua

SEQ ID NO: 829803 - RNA, 19 nt, Homo sapiens
gaaacagggagaagacuua

SEQ ID NO: 829804 - RNA, 19 nt, Homo sapiens
gcaggaaugguuuauguua

SEQ ID NO: 829805 - RNA, 19 nt, Homo sapiens
ggagaaaugguuuaucuuu

SEQ ID NO: 829806 - RNA, 19 nt, Homo sapiens
ggagagcucuugcuacuag

SEQ ID NO: 829807 - RNA, 19 nt, Homo sapiens
caauuuagaugacuucgaa

SEQ ID NO: 829808 - RNA, 19 nt, Homo sapiens
ggaauaagcacaauaccaa

SEQ ID NO: 829809 - RNA, 19 nt, Homo sapiens
gguaaauccuguucaagaa

SEQ ID NO: 829810 - RNA, 19 nt, Homo sapiens
gcaucaauaugaaacagua

SEQ ID NO: 829811 - RNA, 19 nt, Homo sapiens
gcgaacagcuucugcuaga

SEQ ID NO: 829812 - RNA, 19 nt, Homo sapiens
ugaagaagcuccuagaagu

SEQ ID NO: 829813 - RNA, 19 nt, Homo sapiens
cagcaucgauuguuaucua

SEQ ID NO: 829814 - RNA, 19 nt, Homo sapiens
gcuauaaucccuuuaaaga

SEQ ID NO: 829815 - RNA, 19 nt, Homo sapiens
uaacagcuauaaucccuuu

SEQ ID NO: 829816 - RNA, 19 nt, Homo sapiens
cugaagagcuuaucaacaa

SEQ ID NO: 829817 - RNA, 19 nt, Homo sapiens
gcauaaagcaagcaaauau

SEQ ID NO: 829818 - RNA, 19 nt, Homo sapiens
gaaauguguucuucaguag

SEQ ID NO: 829819 - RNA, 19 nt, Homo sapiens
gaagaagaauuggaugaau

SEQ ID NO: 829820 - RNA, 19 nt, Homo sapiens
gaaacagcuucaccuagaa

SEQ ID NO: 829821 - RNA, 19 nt, Homo sapiens
gaacagagugaaccaagaa

SEQ ID NO: 829822 - RNA, 19 nt, Homo sapiens
cgaagaagauaaugaagau

SEQ ID NO: 829823 - RNA, 19 nt, Homo sapiens
ugaaaucacuguaacacuu

SEQ ID NO: 829824 - RNA, 19 nt, Homo sapiens
gaucauauccaaucuacuu

SEQ ID NO: 829825 - RNA, 19 nt, Homo sapiens
gaagagaugcagccuuaaa

SEQ ID NO: 829826 - RNA, 19 nt, Homo sapiens
caacuccuccuccaaauaa

SEQ ID NO: 829827 - RNA, 19 nt, Homo sapiens
gaaaaggcagcuaaaauua

SEQ ID NO: 829828 - RNA, 19 nt, Homo sapiens
gaaaggaaaugaggagaag

SEQ ID NO: 829829 - RNA, 19 nt, Homo sapiens
agacugaugucaaguuaaa

SEQ ID NO: 829830 - RNA, 19 nt, Homo sapiens
gcagaaaaguugaaagaaa

SEQ ID NO: 829831 - RNA, 19 nt, Homo sapiens
cagaagaaccuaucacuga

SEQ ID NO: 829832 - RNA, 19 nt, Homo sapiens
agacauacaugcaaaguuc

SEQ ID NO: 829833 - RNA, 19 nt, Homo sapiens
gaagcaggccgaagaagaa

SEQ ID NO: 829834 - RNA, 19 nt, Homo sapiens
gagaauagaccagagauga

SEQ ID NO: 829835 - RNA, 19 nt, Homo sapiens
cagaagaucuccggacuga

SEQ ID NO: 829836 - RNA, 19 nt, Homo sapiens
guaguaacuuggagaaaga

SEQ ID NO: 829837 - RNA, 19 nt, Homo sapiens
gaaaucacuguaacacuuu

SEQ ID NO: 829838 - RNA, 19 nt, Homo sapiens
uaaagcugcuguauugcua

SEQ ID NO: 829839 - RNA, 19 nt, Homo sapiens
aagaaucucucccaacauu

SEQ ID NO: 829840 - RNA, 19 nt, Homo sapiens
ugucagaacuucccagcua

SEQ ID NO: 829841 - RNA, 19 nt, Homo sapiens
ggaaccuucugauauggua

SEQ ID NO: 829842 - RNA, 19 nt, Homo sapiens
cagcuuagaugaagaucaa

SEQ ID NO: 829843 - RNA, 19 nt, Homo sapiens
caucauggcuucaguuugg

SEQ ID NO: 829844 - RNA, 19 nt, Homo sapiens
ggaugggacuaauugauau

SEQ ID NO: 829845 - RNA, 19 nt, Homo sapiens
gcugauagaaccacuuuaa

SEQ ID NO: 829846 - RNA, 19 nt, Homo sapiens
gaccagauuuaauugacua

SEQ ID NO: 829847 - RNA, 19 nt, Homo sapiens
gaaauggcaaccagauaaa

SEQ ID NO: 829848 - RNA, 19 nt, Homo sapiens
uaacauagccagaaacaag

SEQ ID NO: 829849 - RNA, 19 nt, Homo sapiens
acagacaccuugugaguga

SEQ ID NO: 829850 - RNA, 19 nt, Homo sapiens
gauagaaccacuuuaaauc

SEQ ID NO: 829851 - RNA, 19 nt, Homo sapiens
ugagauagauuugcacaga

SEQ ID NO: 829852 - RNA, 19 nt, Homo sapiens
gaagauacaaagaaaggaa

SEQ ID NO: 829853 - RNA, 19 nt, Homo sapiens
gaauagaccagagaugaaa

SEQ ID NO: 829854 - RNA, 19 nt, Homo sapiens
gaagcucgaucuggaguga

SEQ ID NO: 829855 - RNA, 19 nt, Homo sapiens
aagaagaacuuaaggaaag

SEQ ID NO: 829856 - RNA, 19 nt, Homo sapiens
gcacauauaaaguuggaaa

SEQ ID NO: 829857 - RNA, 19 nt, Homo sapiens
caagaugacugcauaaagc

SEQ ID NO: 829858 - RNA, 19 nt, Homo sapiens
ucacguauaucauaguguu

SEQ ID NO: 829859 - RNA, 19 nt, Homo sapiens
gcguuucacuguaaggaua

SEQ ID NO: 829860 - RNA, 19 nt, Homo sapiens
agaagaagaugagcauuug

SEQ ID NO: 829861 - RNA, 19 nt, Homo sapiens
acaggaagauacaaagaaa

SEQ ID NO: 829862 - RNA, 19 nt, Homo sapiens
caaagauucuacagucaga

SEQ ID NO: 829863 - RNA, 19 nt, Homo sapiens
gaagaagcuccuagaaguu

SEQ ID NO: 829864 - RNA, 19 nt, Homo sapiens
agacaucgguaguaacuug

SEQ ID NO: 829865 - RNA, 19 nt, Homo sapiens
cagacucauuguugauuua

SEQ ID NO: 829866 - RNA, 19 nt, Homo sapiens
gaacagcuucugcuagaug

SEQ ID NO: 829867 - RNA, 19 nt, Homo sapiens
gauccagaaucuccuauca

SEQ ID NO: 829868 - RNA, 19 nt, Homo sapiens
ccugauaaacugacuguua

SEQ ID NO: 829869 - RNA, 19 nt, Homo sapiens
uauaagaccuguggauaug

SEQ ID NO: 829870 - RNA, 19 nt, Homo sapiens
caaauaugcguucagcuaa

SEQ ID NO: 829871 - RNA, 19 nt, Homo sapiens
cacgaaugcuguuaauauu

SEQ ID NO: 829872 - RNA, 19 nt, Homo sapiens
ucacgaaugcuguuaauau

SEQ ID NO: 829873 - RNA, 19 nt, Homo sapiens
uaauugauaugcaccaguu

SEQ ID NO: 829874 - RNA, 19 nt, Homo sapiens
gcagagaucaauacaggaa

SEQ ID NO: 829875 - RNA, 19 nt, Homo sapiens
gauuagagcccuccagaau

SEQ ID NO: 829876 - RNA, 19 nt, Homo sapiens
gcaacaggcagcuaaguga

SEQ ID NO: 829877 - RNA, 19 nt, Homo sapiens
ccagaauacccaucauaua

SEQ ID NO: 829878 - RNA, 19 nt, Homo sapiens
gaacuacaacagccuauca

SEQ ID NO: 829879 - RNA, 19 nt, Homo sapiens
gaaauccugugagauagau

SEQ ID NO: 829880 - RNA, 19 nt, Homo sapiens
gcagcuaagugaucagcaa

SEQ ID NO: 829881 - RNA, 19 nt, Homo sapiens
ggaaagagcaagaguucug

SEQ ID NO: 829882 - RNA, 19 nt, Homo sapiens
ucaagaaacuguucgaaaa

SEQ ID NO: 829883 - RNA, 19 nt, Homo sapiens
gcaagauggccaagaaaga

SEQ ID NO: 829884 - RNA, 19 nt, Homo sapiens
gaaggaacacagaagaaga

SEQ ID NO: 829885 - RNA, 19 nt, Homo sapiens
ucuccggacugaacgauua

SEQ ID NO: 829886 - RNA, 19 nt, Homo sapiens
uaagugaucagcaagauga

SEQ ID NO: 829887 - RNA, 19 nt, Homo sapiens
gcaauauuacaccacuuua

SEQ ID NO: 829888 - RNA, 19 nt, Homo sapiens
caaaugcuagucagucuuu

SEQ ID NO: 829889 - RNA, 19 nt, Homo sapiens
gaugaagacaugcaaaguu

SEQ ID NO: 829890 - RNA, 19 nt, Homo sapiens
gcgaagaguucacauauaa

SEQ ID NO: 829891 - RNA, 19 nt, Homo sapiens
gagagaagcuaauuacauu

SEQ ID NO: 829892 - RNA, 19 nt, Homo sapiens
gaagaggcauugcuacuuu

SEQ ID NO: 829893 - RNA, 19 nt, Homo sapiens
gauaaaugcuuccuuguga

SEQ ID NO: 829894 - RNA, 19 nt, Homo sapiens
guacuuggaucaacaauug

SEQ ID NO: 829895 - RNA, 19 nt, Homo sapiens
gcaggaaucugggacuuua

SEQ ID NO: 829896 - RNA, 19 nt, Homo sapiens
ggaugaaucugucaaagaa

SEQ ID NO: 829897 - RNA, 19 nt, Homo sapiens
ugaaugagcuucuggugua

SEQ ID NO: 829898 - RNA, 19 nt, Homo sapiens
gaauaucucuucagucuuc

SEQ ID NO: 829899 - RNA, 19 nt, Homo sapiens
ggaagaaucugagaagcua

SEQ ID NO: 829900 - RNA, 19 nt, Homo sapiens
gcaaacaagguuauucuua

SEQ ID NO: 829901 - RNA, 19 nt, Homo sapiens
gaacggagcugggaaugug

SEQ ID NO: 829902 - RNA, 19 nt, Homo sapiens
cgacaaaccugccaaagug

SEQ ID NO: 829903 - RNA, 19 nt, Homo sapiens
gaaagagugugaagaagau

SEQ ID NO: 829904 - RNA, 19 nt, Homo sapiens
gaagaacaccagaacauuu

SEQ ID NO: 829905 - RNA, 19 nt, Homo sapiens
gaaagucucuuauguuugc

SEQ ID NO: 829906 - RNA, 19 nt, Homo sapiens
caaagacucuaaugacuug

SEQ ID NO: 829907 - RNA, 19 nt, Homo sapiens
ggaagaacgggaagcauua

SEQ ID NO: 829908 - RNA, 19 nt, Homo sapiens
gauuucagcucucaggaua

SEQ ID NO: 829909 - RNA, 19 nt, Homo sapiens
aagcgaggcucucuucuua

SEQ ID NO: 829910 - RNA, 19 nt, Homo sapiens
gccagaggcuuauguauga

SEQ ID NO: 829911 - RNA, 19 nt, Homo sapiens
ggauuuagcuggcagugaa

SEQ ID NO: 829912 - RNA, 19 nt, Homo sapiens
ggaaggcucugguucucua

SEQ ID NO: 829913 - RNA, 19 nt, Homo sapiens
ccacuaaugucuuaaccua

SEQ ID NO: 829914 - RNA, 19 nt, Homo sapiens
gcagggcgaugaaugcuuu

SEQ ID NO: 829915 - RNA, 19 nt, Homo sapiens
ggacuuaaaugcugaugau

SEQ ID NO: 829916 - RNA, 19 nt, Homo sapiens
uaacaucaccgaagacuuu

SEQ ID NO: 829917 - RNA, 19 nt, Homo sapiens
gagaagcaacguugaauaa

SEQ ID NO: 829918 - RNA, 19 nt, Homo sapiens
gagaugcgguugacccuaa

SEQ ID NO: 829919 - RNA, 19 nt, Homo sapiens
ugaagaagauaacccagua

SEQ ID NO: 829920 - RNA, 19 nt, Homo sapiens
gaagcaacguugaauaaca

SEQ ID NO: 829921 - RNA, 19 nt, Homo sapiens
gagagaauauccugcagaa

SEQ ID NO: 829922 - RNA, 19 nt, Homo sapiens
gagaaucugugucaauguu

SEQ ID NO: 829923 - RNA, 19 nt, Homo sapiens
gagaauauccugcagaaug

SEQ ID NO: 829924 - RNA, 19 nt, Homo sapiens
gaacagaguuuuaaaguag

SEQ ID NO: 829925 - RNA, 19 nt, Homo sapiens
uggaaagucucuuauguuu

SEQ ID NO: 829926 - RNA, 19 nt, Homo sapiens
aaacuggugugcaugguua

SEQ ID NO: 829927 - RNA, 19 nt, Homo sapiens
ggagugaagugaccaggaa

SEQ ID NO: 829928 - RNA, 19 nt, Homo sapiens
cuaccaggaucgagauuua

SEQ ID NO: 829929 - RNA, 19 nt, Homo sapiens
guaauacgaucauacuuca

SEQ ID NO: 829930 - RNA, 19 nt, Homo sapiens
accaacagcuucucaauaa

SEQ ID NO: 829931 - RNA, 19 nt, Homo sapiens
gaagauaacccaguaauac

SEQ ID NO: 829932 - RNA, 19 nt, Homo sapiens
guaaaugggucaucugucu

SEQ ID NO: 829933 - RNA, 19 nt, Homo sapiens
gcaaugaguuuucuguuaa

SEQ ID NO: 829934 - RNA, 19 nt, Homo sapiens
gaacuaaaccaccuguaau

SEQ ID NO: 829935 - RNA, 19 nt, Homo sapiens
ggaucgagauuuagagaga

SEQ ID NO: 829936 - RNA, 19 nt, Homo sapiens
ggaaagagugugaagaaga

SEQ ID NO: 829937 - RNA, 19 nt, Homo sapiens
gcugauaacuaugaugaaa

SEQ ID NO: 829938 - RNA, 19 nt, Homo sapiens
uggaacagcuucucuaugu

SEQ ID NO: 829939 - RNA, 19 nt, Homo sapiens
aaacgggcguggugagaua

SEQ ID NO: 829940 - RNA, 19 nt, Homo sapiens
caacugguguuacgcaaga

SEQ ID NO: 829941 - RNA, 19 nt, Homo sapiens
acacauuccuguuauauuc

SEQ ID NO: 829942 - RNA, 19 nt, Homo sapiens
gaauguauacugucuguug

SEQ ID NO: 829943 - RNA, 19 nt, Homo sapiens
ggaagaauguauacugucu

SEQ ID NO: 829944 - RNA, 19 nt, Homo sapiens
gaaggucuuugggucauuu

SEQ ID NO: 829945 - RNA, 19 nt, Homo sapiens
cagcaacgcuuaagacagu

SEQ ID NO: 829946 - RNA, 19 nt, Homo sapiens
aaugaaaucuccagagcua

SEQ ID NO: 829947 - RNA, 19 nt, Homo sapiens
aaacaacgcuguggugaau

SEQ ID NO: 829948 - RNA, 19 nt, Homo sapiens
gauauugagucguugaugu

SEQ ID NO: 829949 - RNA, 19 nt, Homo sapiens
gccacaagcuacaaggaua

SEQ ID NO: 829950 - RNA, 19 nt, Homo sapiens
gaaguguccuacauggaaa

SEQ ID NO: 829951 - RNA, 19 nt, Homo sapiens
gaaaguggcggugcggaua

SEQ ID NO: 829952 - RNA, 19 nt, Homo sapiens
gaaugagaauggugaauac

SEQ ID NO: 829953 - RNA, 19 nt, Homo sapiens
ucaccuggcugcucaaaga

SEQ ID NO: 829954 - RNA, 19 nt, Homo sapiens
uguccuacauggaaauuua

SEQ ID NO: 829955 - RNA, 19 nt, Homo sapiens
ccaagauacugacccauug

SEQ ID NO: 829956 - RNA, 19 nt, Homo sapiens
acagaaggcuuggaaugua

SEQ ID NO: 829957 - RNA, 19 nt, Homo sapiens
caaacgugcugauccauuc

SEQ ID NO: 829958 - RNA, 19 nt, Homo sapiens
gaggcucucuucuuaguga

SEQ ID NO: 829959 - RNA, 19 nt, Homo sapiens
agaaacagcuugagagucu

SEQ ID NO: 829960 - RNA, 19 nt, Homo sapiens
ugaccaaccuggauuaauc

SEQ ID NO: 829961 - RNA, 19 nt, Homo sapiens
guaugcaggucaagauauu

SEQ ID NO: 829962 - RNA, 19 nt, Homo sapiens
ugacuuugauucugugauu

SEQ ID NO: 829963 - RNA, 19 nt, Homo sapiens
cacaguggccuuacucuua

SEQ ID NO: 829964 - RNA, 19 nt, Homo sapiens
gagacacacauuccuguua

SEQ ID NO: 829965 - RNA, 19 nt, Homo sapiens
ccaaaugugugguggaugu

SEQ ID NO: 829966 - RNA, 19 nt, Homo sapiens
gaccaacagcuucucaaua

SEQ ID NO: 829967 - RNA, 19 nt, Homo sapiens
ggacuaaugucagcuugug

SEQ ID NO: 829968 - RNA, 19 nt, Homo sapiens
gauugucgcuccugaagug

SEQ ID NO: 829969 - RNA, 19 nt, Homo sapiens
gaucauuguuucuggucua

SEQ ID NO: 829970 - RNA, 19 nt, Homo sapiens
gaacagcuucucuaugugu

SEQ ID NO: 829971 - RNA, 19 nt, Homo sapiens
aggcauugcuacuuuauuu

SEQ ID NO: 829972 - RNA, 19 nt, Homo sapiens
uaacuuggaugagagcaaa

SEQ ID NO: 829973 - RNA, 19 nt, Homo sapiens
gaaggaagggagcaacauu

SEQ ID NO: 829974 - RNA, 19 nt, Homo sapiens
acaaggauauugagucguu

SEQ ID NO: 829975 - RNA, 19 nt, Homo sapiens
cuaccaagguucaacaaga

SEQ ID NO: 829976 - RNA, 19 nt, Homo sapiens
ggacgugugugucgugcuu

SEQ ID NO: 829977 - RNA, 19 nt, Homo sapiens
gcagggagugugcugguua

SEQ ID NO: 829978 - RNA, 19 nt, Homo sapiens
ccugaacacuguauuauag

SEQ ID NO: 829979 - RNA, 19 nt, Homo sapiens
cagcacagcggcuuucuuu

SEQ ID NO: 829980 - RNA, 19 nt, Homo sapiens
uagaaaaccuccugacuuu

SEQ ID NO: 829981 - RNA, 19 nt, Homo sapiens
gaggagaaauuaaggaaaa

SEQ ID NO: 829982 - RNA, 19 nt, Homo sapiens
ggagugugcugguuagucu

SEQ ID NO: 829983 - RNA, 19 nt, Homo sapiens
acaguggccuuacucuuaa

SEQ ID NO: 829984 - RNA, 19 nt, Homo sapiens
gcaaggagccgcacugcau

SEQ ID NO: 829985 - RNA, 19 nt, Homo sapiens
gcugauccauucuaugaug

SEQ ID NO: 829986 - RNA, 19 nt, Homo sapiens
caaaguuacccuacagauu

SEQ ID NO: 829987 - RNA, 19 nt, Homo sapiens
ccagcgagguguccaguga

SEQ ID NO: 829988 - RNA, 19 nt, Homo sapiens
caaagcagaggcaaugaaa

SEQ ID NO: 829989 - RNA, 19 nt, Homo sapiens
gagccaagcacauuguaaa

SEQ ID NO: 829990 - RNA, 19 nt, Homo sapiens
gaacaaagacaauucguua

SEQ ID NO: 829991 - RNA, 19 nt, Homo sapiens
gaaguguucugcuuuauuu

SEQ ID NO: 829992 - RNA, 19 nt, Homo sapiens
gaagaaaguacuccuaaua

SEQ ID NO: 829993 - RNA, 19 nt, Homo sapiens
gcagaacaauacucuaaua

SEQ ID NO: 829994 - RNA, 19 nt, Homo sapiens
ugaaagagaugcuauaaga

SEQ ID NO: 829995 - RNA, 19 nt, Homo sapiens
ggaagugccuugaaagaaa

SEQ ID NO: 829996 - RNA, 19 nt, Homo sapiens
caagaaaccuggauuaaca

SEQ ID NO: 829997 - RNA, 19 nt, Homo sapiens
gagaucaacuguauuauca

SEQ ID NO: 829998 - RNA, 19 nt, Homo sapiens
caaaggguguuacauuuaa

SEQ ID NO: 829999 - RNA, 19 nt, Homo sapiens
caacugaccucacuagaga

SEQ ID NO: 830000 - RNA, 19 nt, Homo sapiens
gaacuuaacaccucugaaa

SEQ ID NO: 830001 - RNA, 19 nt, Homo sapiens
gaaagaggguccuuacugu

SEQ ID NO: 830002 - RNA, 19 nt, Homo sapiens
ucacagagaucaucgauau

SEQ ID NO: 830003 - RNA, 19 nt, Homo sapiens
gaacuuagcccacccaugu

SEQ ID NO: 830004 - RNA, 19 nt, Homo sapiens
gcaaagagcgauucaagaa

SEQ ID NO: 830005 - RNA, 19 nt, Homo sapiens
aaagugaaguggcauauaa

SEQ ID NO: 830006 - RNA, 19 nt, Homo sapiens
ucagaaagcuguuaacugu

SEQ ID NO: 830007 - RNA, 19 nt, Homo sapiens
gaacuuccaugcauauuag

SEQ ID NO: 830008 - RNA, 19 nt, Homo sapiens
gcaaaggguguuacauuua

SEQ ID NO: 830009 - RNA, 19 nt, Homo sapiens
guucugagauuacccauaa

SEQ ID NO: 830010 - RNA, 19 nt, Homo sapiens
caagaaaugucucgcugua

SEQ ID NO: 830011 - RNA, 19 nt, Homo sapiens
aaacaaaccuucucaucuu

SEQ ID NO: 830012 - RNA, 19 nt, Homo sapiens
gcagucagaugucauguug

SEQ ID NO: 830013 - RNA, 19 nt, Homo sapiens
aaucgaagcuuacaagaaa

SEQ ID NO: 830014 - RNA, 19 nt, Homo sapiens
gcuuagugauuccaaauua

SEQ ID NO: 830015 - RNA, 19 nt, Homo sapiens
gcuguuaacuguacacaaa

SEQ ID NO: 830016 - RNA, 19 nt, Homo sapiens
guucagagaucaacuguau

SEQ ID NO: 830017 - RNA, 19 nt, Homo sapiens
gcaagaaguuaaaguggaa

SEQ ID NO: 830018 - RNA, 19 nt, Homo sapiens
ugacaaggauguaguaaug

SEQ ID NO: 830019 - RNA, 19 nt, Homo sapiens
caacagagauuacgcuuac

SEQ ID NO: 830020 - RNA, 19 nt, Homo sapiens
gcauuuagcccacuaugua

SEQ ID NO: 830021 - RNA, 19 nt, Homo sapiens
gaaaguacuccuaauaaug

SEQ ID NO: 830022 - RNA, 19 nt, Homo sapiens
gaacagccaaucacacuaa

SEQ ID NO: 830023 - RNA, 19 nt, Homo sapiens
gaaaguuggugccguaaca

SEQ ID NO: 830024 - RNA, 19 nt, Homo sapiens
ggaagagcauguaguaaca

SEQ ID NO: 830025 - RNA, 19 nt, Homo sapiens
ugugaaugcuugaguaaua

SEQ ID NO: 830026 - RNA, 19 nt, Homo sapiens
ucagagaucaacuguauua

SEQ ID NO: 830027 - RNA, 19 nt, Homo sapiens
ggaguuugcuggaauguuc

SEQ ID NO: 830028 - RNA, 19 nt, Homo sapiens
gauuacagcagccucauua

SEQ ID NO: 830029 - RNA, 19 nt, Homo sapiens
ugucagagcuggaaucaug

SEQ ID NO: 830030 - RNA, 19 nt, Homo sapiens
gaaguggcauauaaauuuc

SEQ ID NO: 830031 - RNA, 19 nt, Homo sapiens
gagcuggaaucaugccuuu

SEQ ID NO: 830032 - RNA, 19 nt, Homo sapiens
gaagaagaaucagcaguuc

SEQ ID NO: 830033 - RNA, 19 nt, Homo sapiens
aauaaugccucuacaaaga

SEQ ID NO: 830034 - RNA, 19 nt, Homo sapiens
aaagagcgauucaagaaga

SEQ ID NO: 830035 - RNA, 19 nt, Homo sapiens
gaaaggugcuaggagugua

SEQ ID NO: 830036 - RNA, 19 nt, Homo sapiens
gaacagcgaaggcaacaga

SEQ ID NO: 830037 - RNA, 19 nt, Homo sapiens
gaguguauaucaucaguug

SEQ ID NO: 830038 - RNA, 19 nt, Homo sapiens
ccaauggaaugguaccuuu

SEQ ID NO: 830039 - RNA, 19 nt, Homo sapiens
gguaaaugcuacagaugaa

SEQ ID NO: 830040 - RNA, 19 nt, Homo sapiens
gaaauggguucucucuagu

SEQ ID NO: 830041 - RNA, 19 nt, Homo sapiens
gaagugccuugaaagaaau

SEQ ID NO: 830042 - RNA, 19 nt, Homo sapiens
gggaauggauccaauuaca

SEQ ID NO: 830043 - RNA, 19 nt, Homo sapiens
gaucauggcucagaugucu

SEQ ID NO: 830044 - RNA, 19 nt, Homo sapiens
gcaaugggcuguggaacau

SEQ ID NO: 830045 - RNA, 19 nt, Homo sapiens
ccaaguacaugccggaaug

SEQ ID NO: 830046 - RNA, 19 nt, Homo sapiens
gaaacuauuugcuguucga

SEQ ID NO: 830047 - RNA, 19 nt, Homo sapiens
gacaacauauugaaaugga

SEQ ID NO: 830048 - RNA, 19 nt, Homo sapiens
ucaaguugguuuacaagaa

SEQ ID NO: 830049 - RNA, 19 nt, Homo sapiens
ccaagagaaucuaacaaau

SEQ ID NO: 830050 - RNA, 19 nt, Homo sapiens
ugaauugccagcagauuua

SEQ ID NO: 830051 - RNA, 19 nt, Homo sapiens
ggaaagaggguccuuacug

SEQ ID NO: 830052 - RNA, 19 nt, Homo sapiens
ggcauugacuggcaacauu

SEQ ID NO: 830053 - RNA, 19 nt, Homo sapiens
gcauuacaguuucuuagga

SEQ ID NO: 830054 - RNA, 19 nt, Homo sapiens
gcaagcaacugaccucacu

SEQ ID NO: 830055 - RNA, 19 nt, Homo sapiens
gagauuauccaucaguuga

SEQ ID NO: 830056 - RNA, 19 nt, Homo sapiens
ccucuuagaugucuuguuc

SEQ ID NO: 830057 - RNA, 19 nt, Homo sapiens
gacauucaguggaaacuau

SEQ ID NO: 830058 - RNA, 19 nt, Homo sapiens
cagaugagcugaggcagaa

SEQ ID NO: 830059 - RNA, 19 nt, Homo sapiens
caaagccacucaaaguuca

SEQ ID NO: 830060 - RNA, 19 nt, Homo sapiens
gaaagaauuuugagugaug

SEQ ID NO: 830061 - RNA, 19 nt, Homo sapiens
gacaauucguuacauguau

SEQ ID NO: 830062 - RNA, 19 nt, Homo sapiens
ggauaugccuggucagagu

SEQ ID NO: 830063 - RNA, 19 nt, Homo sapiens
gacgugagauguuugacaa

SEQ ID NO: 830064 - RNA, 19 nt, Homo sapiens
ccacucaaaguucaaguua

SEQ ID NO: 830065 - RNA, 19 nt, Homo sapiens
ucacaccuaugaacaaguu

SEQ ID NO: 830066 - RNA, 19 nt, Homo sapiens
gcuauuacguuucgguaug

SEQ ID NO: 830067 - RNA, 19 nt, Homo sapiens
gcuauaagauauccaagag

SEQ ID NO: 830068 - RNA, 19 nt, Homo sapiens
ccugaaguguucugcuuua

SEQ ID NO: 830069 - RNA, 19 nt, Homo sapiens
gcuccuaccucuaagugaa

SEQ ID NO: 830070 - RNA, 19 nt, Homo sapiens
ggacuggugugcuucagau

SEQ ID NO: 830071 - RNA, 19 nt, Homo sapiens
ugcaaaggguguuacauuu

SEQ ID NO: 830072 - RNA, 19 nt, Homo sapiens
cagcagaacaauacucuaa

SEQ ID NO: 830073 - RNA, 19 nt, Homo sapiens
gcguaggucuguucgauau

SEQ ID NO: 830074 - RNA, 19 nt, Homo sapiens
gguaugcaguagaaauauu

SEQ ID NO: 830075 - RNA, 19 nt, Homo sapiens
ugaugaagauaaaccauug

SEQ ID NO: 830076 - RNA, 19 nt, Homo sapiens
ccaaucacacuaagcauuu

SEQ ID NO: 830077 - RNA, 19 nt, Homo sapiens
gcaaacaaaccuucucauc

SEQ ID NO: 830078 - RNA, 19 nt, Homo sapiens
ucaagaagauucagaagcu

SEQ ID NO: 830079 - RNA, 19 nt, Homo sapiens
gaucuuacuuaccucaugu

SEQ ID NO: 830080 - RNA, 19 nt, Homo sapiens
caucacuggugccuaauga

SEQ ID NO: 830081 - RNA, 19 nt, Homo sapiens
gcauggcacuacaagaaga

SEQ ID NO: 830082 - RNA, 19 nt, Homo sapiens
gagagauuauccaucaguu

SEQ ID NO: 830083 - RNA, 19 nt, Homo sapiens
gcuuugaacuuuaucagau

SEQ ID NO: 830084 - RNA, 19 nt, Homo sapiens
gauagaacacccucuuaga

SEQ ID NO: 830085 - RNA, 19 nt, Homo sapiens
gauacuguguuucccaaga

SEQ ID NO: 830086 - RNA, 19 nt, Homo sapiens
caaguaggacaacauauug

SEQ ID NO: 830087 - RNA, 19 nt, Homo sapiens
acuauuugcuguucgauuu

SEQ ID NO: 830088 - RNA, 19 nt, Homo sapiens
uaacaccucugaaauugag

SEQ ID NO: 830089 - RNA, 19 nt, Homo sapiens
gcaacagagauuacgcuua

SEQ ID NO: 830090 - RNA, 19 nt, Homo sapiens
gggaugaacucuucuuuaa

SEQ ID NO: 830091 - RNA, 19 nt, Homo sapiens
ccacuucccugcaaucaua

SEQ ID NO: 830092 - RNA, 19 nt, Homo sapiens
uagaagagcuuuacucaau

SEQ ID NO: 830093 - RNA, 19 nt, Homo sapiens
guaaugaacugucuagcaa

SEQ ID NO: 830094 - RNA, 19 nt, Homo sapiens
ggaaaguucuucucagugu

SEQ ID NO: 830095 - RNA, 19 nt, Homo sapiens
gaccugagcugagagagua

SEQ ID NO: 830096 - RNA, 19 nt, Homo sapiens
caaaggagagggagagaua

SEQ ID NO: 830097 - RNA, 19 nt, Homo sapiens
gaagaagcccugaaagaga

SEQ ID NO: 830098 - RNA, 19 nt, Homo sapiens
caaauaaggaucugaagaa

SEQ ID NO: 830099 - RNA, 19 nt, Homo sapiens
gaacugucuagcaauauua

SEQ ID NO: 830100 - RNA, 19 nt, Homo sapiens
gaaaguucuucucagugua

SEQ ID NO: 830101 - RNA, 19 nt, Homo sapiens
ggaacgugguggcugauuu

SEQ ID NO: 830102 - RNA, 19 nt, Homo sapiens
cgacagggcugaauuucug

SEQ ID NO: 830103 - RNA, 19 nt, Homo sapiens
gcacggcgaucugugauug

SEQ ID NO: 830104 - RNA, 19 nt, Homo sapiens
uaucacaaauggcaaugua

SEQ ID NO: 830105 - RNA, 19 nt, Homo sapiens
uaagagaccugagcugaga

SEQ ID NO: 830106 - RNA, 19 nt, Homo sapiens
gaagagaggaauugaagga

SEQ ID NO: 830107 - RNA, 19 nt, Homo sapiens
ggaguggaaucaucaggaa

SEQ ID NO: 830108 - RNA, 19 nt, Homo sapiens
gcucuagggugccagguuu

SEQ ID NO: 830109 - RNA, 19 nt, Homo sapiens
gaccaaauguguucaaagg

SEQ ID NO: 830110 - RNA, 19 nt, Homo sapiens
gcacaaauaaggaucugaa

SEQ ID NO: 830111 - RNA, 19 nt, Homo sapiens
ucacauccauucugacaug

SEQ ID NO: 830112 - RNA, 19 nt, Homo sapiens
aaugaacugucuagcaaua

SEQ ID NO: 830113 - RNA, 19 nt, Homo sapiens
gaugaccucuccauugugu

SEQ ID NO: 830114 - RNA, 19 nt, Homo sapiens
ggacuucuccagcacaauu

SEQ ID NO: 830115 - RNA, 19 nt, Homo sapiens
gaagaaagccauuuuggaa

SEQ ID NO: 830116 - RNA, 19 nt, Homo sapiens
gagaggaauugaaggaaca

SEQ ID NO: 830117 - RNA, 19 nt, Homo sapiens
gcugagagaguacuucaaa

SEQ ID NO: 830118 - RNA, 19 nt, Homo sapiens
gaagauauggugagguuag

SEQ ID NO: 830119 - RNA, 19 nt, Homo sapiens
ugaacugucuagcaauauu

SEQ ID NO: 830120 - RNA, 19 nt, Homo sapiens
gcaggaacucuuaaaauua

SEQ ID NO: 830121 - RNA, 19 nt, Homo sapiens
ccaccacccucgugaguau

SEQ ID NO: 830122 - RNA, 19 nt, Homo sapiens
ugacacagcugaaaaugaa

SEQ ID NO: 830123 - RNA, 19 nt, Homo sapiens
gaaggaacauaugcagauc

SEQ ID NO: 830124 - RNA, 19 nt, Homo sapiens
uggaagauauggugagguu

SEQ ID NO: 830125 - RNA, 19 nt, Homo sapiens
ggcaggaacucuuaaaauu

SEQ ID NO: 830126 - RNA, 19 nt, Homo sapiens
gcuauccgcuacaucauca

SEQ ID NO: 830127 - RNA, 19 nt, Homo sapiens
ugagcuaggugacuuggaa

SEQ ID NO: 830128 - RNA, 19 nt, Homo sapiens
gcucguugauguugaggaa

SEQ ID NO: 830129 - RNA, 19 nt, Homo sapiens
uaucugggaugaacucuuc

SEQ ID NO: 830130 - RNA, 19 nt, Homo sapiens
gaacuacugggccugcaaa

SEQ ID NO: 830131 - RNA, 19 nt, Homo sapiens
ucacaaauggcaauguaaa

SEQ ID NO: 830132 - RNA, 19 nt, Homo sapiens
gacauguucucaguucaaa

SEQ ID NO: 830133 - RNA, 19 nt, Homo sapiens
ccauucacauccauucuga

SEQ ID NO: 830134 - RNA, 19 nt, Homo sapiens
ggaauugaaggaacauaug

SEQ ID NO: 830135 - RNA, 19 nt, Homo sapiens
ccgagaagauugagaacau

SEQ ID NO: 830136 - RNA, 19 nt, Homo sapiens
gagcuggccugcuacacau

SEQ ID NO: 830137 - RNA, 19 nt, Homo sapiens
gggaaugggcccugucuug

SEQ ID NO: 830138 - RNA, 19 nt, Homo sapiens
gaacgugguggcugauuuc

SEQ ID NO: 830139 - RNA, 19 nt, Homo sapiens
caacaguucugggauuucu

SEQ ID NO: 830140 - RNA, 19 nt, Homo sapiens
gcaaacacaccauuaaagc

SEQ ID NO: 830141 - RNA, 19 nt, Homo sapiens
ggugcagucugucgucuau

SEQ ID NO: 830142 - RNA, 19 nt, Homo sapiens
gaugcagucagaagaagua

SEQ ID NO: 830143 - RNA, 19 nt, Homo sapiens
cgugguggcugauuucuca

SEQ ID NO: 830144 - RNA, 19 nt, Homo sapiens
uaaacuugcucagggagaa

SEQ ID NO: 830145 - RNA, 19 nt, Homo sapiens
gaagagcuuuacucaaucc

SEQ ID NO: 830146 - RNA, 19 nt, Homo sapiens
gagaggaccaaauguguuc

SEQ ID NO: 830147 - RNA, 19 nt, Homo sapiens
caccaacaguucugggauu

SEQ ID NO: 830148 - RNA, 19 nt, Homo sapiens
cugaugaccucuccauugu

SEQ ID NO: 830149 - RNA, 19 nt, Homo sapiens
ggaggacuguggccaagag

SEQ ID NO: 830150 - RNA, 19 nt, Homo sapiens
gaugaugcccggaccaugu

SEQ ID NO: 830151 - RNA, 19 nt, Homo sapiens
ccaggcaaacacaccauua

SEQ ID NO: 830152 - RNA, 19 nt, Homo sapiens
gccuuuagcacacauguuu

SEQ ID NO: 830153 - RNA, 19 nt, Homo sapiens
auaaggaucugaagaaagc

SEQ ID NO: 830154 - RNA, 19 nt, Homo sapiens
uggagaagaugcagacaca

SEQ ID NO: 830155 - RNA, 19 nt, Homo sapiens
ggacuguggccaagagaau

SEQ ID NO: 830156 - RNA, 19 nt, Homo sapiens
cuacugggccugcaaagga

SEQ ID NO: 830157 - RNA, 19 nt, Homo sapiens
gguuaaagccauucacauc

SEQ ID NO: 830158 - RNA, 19 nt, Homo sapiens
gcucagggagaauauguug

SEQ ID NO: 830159 - RNA, 19 nt, Homo sapiens
cgaagaagcccugaaagag

SEQ ID NO: 830160 - RNA, 19 nt, Homo sapiens
uagagcauguggagaggaa

SEQ ID NO: 830161 - RNA, 19 nt, Homo sapiens
aaggaaaguucuucucagu

SEQ ID NO: 830162 - RNA, 19 nt, Homo sapiens
cagaagagaggaauugaag

SEQ ID NO: 830163 - RNA, 19 nt, Homo sapiens
ggaugaacucuucuuuaau

SEQ ID NO: 830164 - RNA, 19 nt, Homo sapiens
gcacgacagggaacccaaa

SEQ ID NO: 830165 - RNA, 19 nt, Homo sapiens
aaaguucuucucaguguaa

SEQ ID NO: 830166 - RNA, 19 nt, Homo sapiens
cauccauucugacauguuc

SEQ ID NO: 830167 - RNA, 19 nt, Homo sapiens
gaucugaagaaagccauuu

SEQ ID NO: 830168 - RNA, 19 nt, Homo sapiens
ugaaggaacauaugcagau

SEQ ID NO: 830169 - RNA, 19 nt, Homo sapiens
ccagguuuaugaagguuau

SEQ ID NO: 830170 - RNA, 19 nt, Homo sapiens
ucaaggaaaguucuucuca

SEQ ID NO: 830171 - RNA, 19 nt, Homo sapiens
gauauggugagguuaggaa

SEQ ID NO: 830172 - RNA, 19 nt, Homo sapiens
uugaggaacugaacuacug

SEQ ID NO: 830173 - RNA, 19 nt, Homo sapiens
caggcaaacacaccauuaa

SEQ ID NO: 830174 - RNA, 19 nt, Homo sapiens
ucgaagaagcccugaaaga

SEQ ID NO: 830175 - RNA, 19 nt, Homo sapiens
ggagcuggccugcuacaca

SEQ ID NO: 830176 - RNA, 19 nt, Homo sapiens
gggcuucuggguagaguuu

SEQ ID NO: 830177 - RNA, 19 nt, Homo sapiens
gaguuuguccucucacuuc

SEQ ID NO: 830178 - RNA, 19 nt, Homo sapiens
gagcugagagaguacuuca

SEQ ID NO: 830179 - RNA, 19 nt, Homo sapiens
uaggugacuuggaacaguu

SEQ ID NO: 830180 - RNA, 19 nt, Homo sapiens
ugggaugaacucuucuuua

SEQ ID NO: 830181 - RNA, 19 nt, Homo sapiens
uguaaagcaugcacugauc

SEQ ID NO: 830182 - RNA, 19 nt, Homo sapiens
caucugauuuuaugacuga

SEQ ID NO: 830183 - RNA, 19 nt, Homo sapiens
acaaauaaggaucugaaga

SEQ ID NO: 830184 - RNA, 19 nt, Homo sapiens
gcagucagaagaaguagag

SEQ ID NO: 830185 - RNA, 19 nt, Homo sapiens
ugcagucugucgucuauug

SEQ ID NO: 830186 - RNA, 19 nt, Homo sapiens
ccugaugaccucuccauug

SEQ ID NO: 830187 - RNA, 19 nt, Homo sapiens
guaaagcaugcacugauca

SEQ ID NO: 830188 - RNA, 19 nt, Homo sapiens
cagcacaauuguaaagcau

SEQ ID NO: 830189 - RNA, 19 nt, Homo sapiens
cuacuuacccacuacuaug

SEQ ID NO: 830190 - RNA, 19 nt, Homo sapiens
ggacagggcuuccaugaga

SEQ ID NO: 830191 - RNA, 19 nt, Homo sapiens
ggaaugaggcccuuucaaa

SEQ ID NO: 830192 - RNA, 19 nt, Homo sapiens
gaacauuggcugcugcaua

SEQ ID NO: 830193 - RNA, 19 nt, Homo sapiens
cagaacagcuccuuggaaa

SEQ ID NO: 830194 - RNA, 19 nt, Homo sapiens
gagacaagaucacagagaa

SEQ ID NO: 830195 - RNA, 19 nt, Homo sapiens
gagcucaccuucacgugua

SEQ ID NO: 830196 - RNA, 19 nt, Homo sapiens
gaaggaagccguuuugauu

SEQ ID NO: 830197 - RNA, 19 nt, Homo sapiens
gaaugacaccgucuucuug

SEQ ID NO: 830198 - RNA, 19 nt, Homo sapiens
gaaccgagcccugauguca

SEQ ID NO: 830199 - RNA, 19 nt, Homo sapiens
cgaaggguguuugguuuaa

SEQ ID NO: 830200 - RNA, 19 nt, Homo sapiens
gaaggguguuugguuuaaa

SEQ ID NO: 830201 - RNA, 19 nt, Homo sapiens
ggaccaggcucugcagaau

SEQ ID NO: 830202 - RNA, 19 nt, Homo sapiens
gcaaaccagugagucgaaa

SEQ ID NO: 830203 - RNA, 19 nt, Homo sapiens
ggagagagagacaagauca

SEQ ID NO: 830204 - RNA, 19 nt, Homo sapiens
cagcugcgcuugcccugaa

SEQ ID NO: 830205 - RNA, 19 nt, Homo sapiens
ggaaaugacaucggagaga

SEQ ID NO: 830206 - RNA, 19 nt, Homo sapiens
gaaugaggcccuuucaaaa

SEQ ID NO: 830207 - RNA, 19 nt, Homo sapiens
gcauguggcagcaaacuuc

SEQ ID NO: 830208 - RNA, 19 nt, Homo sapiens
gaccgaaggguguuugguu

SEQ ID NO: 830209 - RNA, 19 nt, Homo sapiens
aacauuggcugcugcauag

SEQ ID NO: 830210 - RNA, 19 nt, Homo sapiens
ggaagucagagcgauggua

SEQ ID NO: 830211 - RNA, 19 nt, Homo sapiens
accaggcucugcagaauga

SEQ ID NO: 830212 - RNA, 19 nt, Homo sapiens
aacguguacuggaucaaua

SEQ ID NO: 830213 - RNA, 19 nt, Homo sapiens
ccgaaggguguuugguuua

SEQ ID NO: 830214 - RNA, 19 nt, Homo sapiens
gcagaaugacaccgucuuc

SEQ ID NO: 830215 - RNA, 19 nt, Homo sapiens
ggaagccguuuugauuuaa

SEQ ID NO: 830216 - RNA, 19 nt, Homo sapiens
ucaauaagacggacaacag

SEQ ID NO: 830217 - RNA, 19 nt, Homo sapiens
cgaaaaccguggugaccua

SEQ ID NO: 830218 - RNA, 19 nt, Homo sapiens
uauauuggcaaaccaguga

SEQ ID NO: 830219 - RNA, 19 nt, Homo sapiens
gagcauggacucccagacu

SEQ ID NO: 830220 - RNA, 19 nt, Homo sapiens
gacaagaucacagagaauc

SEQ ID NO: 830221 - RNA, 19 nt, Homo sapiens
gacaccgucuucuugaaca

SEQ ID NO: 830222 - RNA, 19 nt, Homo sapiens
aggaagccguuuugauuua

SEQ ID NO: 830223 - RNA, 19 nt, Homo sapiens
ucacguguacauccauaaa

SEQ ID NO: 830224 - RNA, 19 nt, Homo sapiens
accgaaggguguuugguuu

SEQ ID NO: 830225 - RNA, 19 nt, Homo sapiens
gcucacuggccacguuuga

SEQ ID NO: 830226 - RNA, 19 nt, Homo sapiens
agagcucacuggccacguu

SEQ ID NO: 830227 - RNA, 19 nt, Homo sapiens
caacguguacuggaucaau

SEQ ID NO: 830228 - RNA, 19 nt, Homo sapiens
ccacaccaaaggcaaaugu

SEQ ID NO: 830229 - RNA, 19 nt, Homo sapiens
agagagacaagaucacaga

SEQ ID NO: 830230 - RNA, 19 nt, Homo sapiens
cuucacguguacauccaua

SEQ ID NO: 830231 - RNA, 19 nt, Homo sapiens
cagagaauccagucaguac

SEQ ID NO: 830232 - RNA, 19 nt, Homo sapiens
gagcucuucugcccugaac

SEQ ID NO: 830233 - RNA, 19 nt, Homo sapiens
gaagccguuuugauuuaaa

SEQ ID NO: 830234 - RNA, 19 nt, Homo sapiens
ggugaugggcugucucuac

SEQ ID NO: 830235 - RNA, 19 nt, Homo sapiens
ggcccaacguguacuggau

SEQ ID NO: 830236 - RNA, 19 nt, Homo sapiens
ccuaccacaucccacagaa

SEQ ID NO: 830237 - RNA, 19 nt, Homo sapiens
gagcucacuggccacguuu

SEQ ID NO: 830238 - RNA, 19 nt, Homo sapiens
gaccgaugccuccaacaca

SEQ ID NO: 830239 - RNA, 19 nt, Homo sapiens
cacagagaauccagucagu

SEQ ID NO: 830240 - RNA, 19 nt, Homo sapiens
ccaggacgagcagaaguuu

SEQ ID NO: 830241 - RNA, 19 nt, Homo sapiens
uggcugugauccuggaaug

SEQ ID NO: 830242 - RNA, 19 nt, Homo sapiens
acagagaauccagucagua

SEQ ID NO: 830243 - RNA, 19 nt, Homo sapiens
gaccaggcucugcagaaug

SEQ ID NO: 830244 - RNA, 19 nt, Homo sapiens
acagaacagcuccuuggaa

SEQ ID NO: 830245 - RNA, 19 nt, Homo sapiens
gaacagcuccuuggaaaac

SEQ ID NO: 830246 - RNA, 19 nt, Homo sapiens
ggucacaggagcucuucug

SEQ ID NO: 830247 - RNA, 19 nt, Homo sapiens
guuuacguauauuggcaaa

SEQ ID NO: 830248 - RNA, 19 nt, Homo sapiens
ggaucaauaagacggacaa

SEQ ID NO: 830249 - RNA, 19 nt, Homo sapiens
ggcaaaccagugagucgaa

SEQ ID NO: 830250 - RNA, 19 nt, Homo sapiens
caccaggcucuucccagua

SEQ ID NO: 830251 - RNA, 19 nt, Homo sapiens
uaccacaucccacagaaca

SEQ ID NO: 830252 - RNA, 19 nt, Homo sapiens
aaugacaccgucuucuuga

SEQ ID NO: 830253 - RNA, 19 nt, Homo sapiens
aggaugagcucaccuucac

SEQ ID NO: 830254 - RNA, 19 nt, Homo sapiens
ccagacaggaaaugacauc

SEQ ID NO: 830255 - RNA, 19 nt, Homo sapiens
gagaagaacuuuguugaua

SEQ ID NO: 830256 - RNA, 19 nt, Homo sapiens
gaacagcuauuucugauga

SEQ ID NO: 830257 - RNA, 19 nt, Homo sapiens
caacucagcuguuagaauu

SEQ ID NO: 830258 - RNA, 19 nt, Homo sapiens
gaagauggcucccacauuc

SEQ ID NO: 830259 - RNA, 19 nt, Homo sapiens
acacauagaugguucuuua

SEQ ID NO: 830260 - RNA, 19 nt, Homo sapiens
gaaacaaccucuuagaaau

SEQ ID NO: 830261 - RNA, 19 nt, Homo sapiens
gaagcaugcugucaaauuu

SEQ ID NO: 830262 - RNA, 19 nt, Homo sapiens
ggagaaguguuuaauauug

SEQ ID NO: 830263 - RNA, 19 nt, Homo sapiens
gaugcaagcucucuuagua

SEQ ID NO: 830264 - RNA, 19 nt, Homo sapiens
gcaaggaaauuauuagaug

SEQ ID NO: 830265 - RNA, 19 nt, Homo sapiens
ggacucagacaauaaauua

SEQ ID NO: 830266 - RNA, 19 nt, Homo sapiens
gaugaucucuaaacacaua

SEQ ID NO: 830267 - RNA, 19 nt, Homo sapiens
caucuuagcucccacagua

SEQ ID NO: 830268 - RNA, 19 nt, Homo sapiens
ggaaaucaguuuacaggaa

SEQ ID NO: 830269 - RNA, 19 nt, Homo sapiens
gaacauuggcuacagguua

SEQ ID NO: 830270 - RNA, 19 nt, Homo sapiens
gaacaaugaugccuuagau

SEQ ID NO: 830271 - RNA, 19 nt, Homo sapiens
gggcauaaauucucauaaa

SEQ ID NO: 830272 - RNA, 19 nt, Homo sapiens
cgacaucucucucgaacua

SEQ ID NO: 830273 - RNA, 19 nt, Homo sapiens
gaacaaacaauucaucuug

SEQ ID NO: 830274 - RNA, 19 nt, Homo sapiens
gauaauagcaguacaguga

SEQ ID NO: 830275 - RNA, 19 nt, Homo sapiens
caucaaauccuaaaccuua

SEQ ID NO: 830276 - RNA, 19 nt, Homo sapiens
gauaagaguugcucaggaa

SEQ ID NO: 830277 - RNA, 19 nt, Homo sapiens
guacugagcuugaugaaag

SEQ ID NO: 830278 - RNA, 19 nt, Homo sapiens
ccacagauauuccaaaugu

SEQ ID NO: 830279 - RNA, 19 nt, Homo sapiens
gguaagagaugggauauug

SEQ ID NO: 830280 - RNA, 19 nt, Homo sapiens
uaacaucccuaacagaauu

SEQ ID NO: 830281 - RNA, 19 nt, Homo sapiens
ugaagaagaugaugccuuu

SEQ ID NO: 830282 - RNA, 19 nt, Homo sapiens
ugacaucgcugccuccuuu

SEQ ID NO: 830283 - RNA, 19 nt, Homo sapiens
caagauacauccuacagaa

SEQ ID NO: 830284 - RNA, 19 nt, Homo sapiens
gcgaauaucuucauguaug

SEQ ID NO: 830285 - RNA, 19 nt, Homo sapiens
gagaaggacagcaauaaua

SEQ ID NO: 830286 - RNA, 19 nt, Homo sapiens
ucuauugacuccugaauua

SEQ ID NO: 830287 - RNA, 19 nt, Homo sapiens
gaagguaacauaaagguuu

SEQ ID NO: 830288 - RNA, 19 nt, Homo sapiens
ggaaacagccucauucaug

SEQ ID NO: 830289 - RNA, 19 nt, Homo sapiens
gcccaugacucagcuauua

SEQ ID NO: 830290 - RNA, 19 nt, Homo sapiens
gaaaucaguuuacaggaau

SEQ ID NO: 830291 - RNA, 19 nt, Homo sapiens
caagaucauucgaccuuua

SEQ ID NO: 830292 - RNA, 19 nt, Homo sapiens
guacaagcauguuuagcua

SEQ ID NO: 830293 - RNA, 19 nt, Homo sapiens
caaaugcaaucuacaguga

SEQ ID NO: 830294 - RNA, 19 nt, Homo sapiens
gagaugauauucuggaaga

SEQ ID NO: 830295 - RNA, 19 nt, Homo sapiens
gacaacaacugauucuauu

SEQ ID NO: 830296 - RNA, 19 nt, Homo sapiens
gcacacacuucauucacua

SEQ ID NO: 830297 - RNA, 19 nt, Homo sapiens
gaagagauacauuagauga

SEQ ID NO: 830298 - RNA, 19 nt, Homo sapiens
gaauaagaauccugauaug

SEQ ID NO: 830299 - RNA, 19 nt, Homo sapiens
gaggucaucuguucuugua

SEQ ID NO: 830300 - RNA, 19 nt, Homo sapiens
gagcagauguuccuuguag

SEQ ID NO: 830301 - RNA, 19 nt, Homo sapiens
cgaccuggcugcauuauug

SEQ ID NO: 830302 - RNA, 19 nt, Homo sapiens
cugaguaucuggcaaguua

SEQ ID NO: 830303 - RNA, 19 nt, Homo sapiens
gcaaagccauuucuuccuu

SEQ ID NO: 830304 - RNA, 19 nt, Homo sapiens
ccagaaaccucuccuagug

SEQ ID NO: 830305 - RNA, 19 nt, Homo sapiens
gaugguaccuuucuagugu

SEQ ID NO: 830306 - RNA, 19 nt, Homo sapiens
ggaauaagaauccugauau

SEQ ID NO: 830307 - RNA, 19 nt, Homo sapiens
uaaccaaacugcaucaaau

SEQ ID NO: 830308 - RNA, 19 nt, Homo sapiens
uaaagauccuuaugacuga

SEQ ID NO: 830309 - RNA, 19 nt, Homo sapiens
uaaggaaucugauaugauc

SEQ ID NO: 830310 - RNA, 19 nt, Homo sapiens
gaaagaugccauagaggua

SEQ ID NO: 830311 - RNA, 19 nt, Homo sapiens
cguaggagauuuaacauga

SEQ ID NO: 830312 - RNA, 19 nt, Homo sapiens
agacgaugcuguugguuua

SEQ ID NO: 830313 - RNA, 19 nt, Homo sapiens
ucaagaugguggcuuauuu

SEQ ID NO: 830314 - RNA, 19 nt, Homo sapiens
gaaaggacacgucugcauu

SEQ ID NO: 830315 - RNA, 19 nt, Homo sapiens
ggaaauugcugccuugcau

SEQ ID NO: 830316 - RNA, 19 nt, Homo sapiens
aaacaacgcuuugaacaau

SEQ ID NO: 830317 - RNA, 19 nt, Homo sapiens
cuacagaauuucagaagaa

SEQ ID NO: 830318 - RNA, 19 nt, Homo sapiens
gcugggcucuucuacauuu

SEQ ID NO: 830319 - RNA, 19 nt, Homo sapiens
ccaguggucugaauuaaga

SEQ ID NO: 830320 - RNA, 19 nt, Homo sapiens
gcuguuagcuguucauaca

SEQ ID NO: 830321 - RNA, 19 nt, Homo sapiens
caauaggaccuuugucaua

SEQ ID NO: 830322 - RNA, 19 nt, Homo sapiens
cgaaacaaccucuuagaaa

SEQ ID NO: 830323 - RNA, 19 nt, Homo sapiens
gcugauaagucugccuuua

SEQ ID NO: 830324 - RNA, 19 nt, Homo sapiens
guacacauaugaacaucuu

SEQ ID NO: 830325 - RNA, 19 nt, Homo sapiens
aaaguuggaugcccuguuu

SEQ ID NO: 830326 - RNA, 19 nt, Homo sapiens
gaacaucaaguuaucauca

SEQ ID NO: 830327 - RNA, 19 nt, Homo sapiens
caacggaugauauugauuu

SEQ ID NO: 830328 - RNA, 19 nt, Homo sapiens
gauacauccuacagaauuu

SEQ ID NO: 830329 - RNA, 19 nt, Homo sapiens
gugcgaauaucuucaugua

SEQ ID NO: 830330 - RNA, 19 nt, Homo sapiens
ggaagaggaggaagaaauu

SEQ ID NO: 830331 - RNA, 19 nt, Homo sapiens
gaacuuaguaugugggauu

SEQ ID NO: 830332 - RNA, 19 nt, Homo sapiens
gaagauagauggcgaaaag

SEQ ID NO: 830333 - RNA, 19 nt, Homo sapiens
ggaagcaugcugucaaauu

SEQ ID NO: 830334 - RNA, 19 nt, Homo sapiens
gaguagcugucaucacuuu

SEQ ID NO: 830335 - RNA, 19 nt, Homo sapiens
gaaggauagcuauucuuua

SEQ ID NO: 830336 - RNA, 19 nt, Homo sapiens
ggacagaaagcauugaaga

SEQ ID NO: 830337 - RNA, 19 nt, Homo sapiens
agucauagcuacagucaaa

SEQ ID NO: 830338 - RNA, 19 nt, Homo sapiens
cuaauaugcuggcaagaaa

SEQ ID NO: 830339 - RNA, 19 nt, Homo sapiens
gaacgggguuuacauauga

SEQ ID NO: 830340 - RNA, 19 nt, Homo sapiens
gacaauacaccauuugaaa

SEQ ID NO: 830341 - RNA, 19 nt, Homo sapiens
ggacggcaguguacgaaug

SEQ ID NO: 830342 - RNA, 19 nt, Homo sapiens
guucagaugauguugauua

SEQ ID NO: 830343 - RNA, 19 nt, Homo sapiens
ucacauccaugauauacuu

SEQ ID NO: 830344 - RNA, 19 nt, Homo sapiens
gauaaacaaucagaucaga

SEQ ID NO: 830345 - RNA, 19 nt, Homo sapiens
gaugaaugaugaaggagaa

SEQ ID NO: 830346 - RNA, 19 nt, Homo sapiens
uggaagagauggccuuuga

SEQ ID NO: 830347 - RNA, 19 nt, Homo sapiens
aaaguacgcuucuggaaau

SEQ ID NO: 830348 - RNA, 19 nt, Homo sapiens
gaaguucaaagacacauuu

SEQ ID NO: 830349 - RNA, 19 nt, Homo sapiens
gaauacagcaugcucuuga

SEQ ID NO: 830350 - RNA, 19 nt, Homo sapiens
caaacugcaucaaauccua

SEQ ID NO: 830351 - RNA, 19 nt, Homo sapiens
gagcuagugugcuuaugaa

SEQ ID NO: 830352 - RNA, 19 nt, Homo sapiens
gaacacgcaacaccaaauu

SEQ ID NO: 830353 - RNA, 19 nt, Homo sapiens
caacaggaaacuacaguaa

SEQ ID NO: 830354 - RNA, 19 nt, Homo sapiens
gcuaagcaguccauauuuc

SEQ ID NO: 830355 - RNA, 19 nt, Homo sapiens
ccaggaagauuuacauuua

SEQ ID NO: 830356 - RNA, 19 nt, Homo sapiens
uaacagaaaugcuuuggua

SEQ ID NO: 830357 - RNA, 19 nt, Homo sapiens
caaauaggaugucauguuu

SEQ ID NO: 830358 - RNA, 19 nt, Homo sapiens
gaaacaggauucaugugua

SEQ ID NO: 830359 - RNA, 19 nt, Homo sapiens
ggacagagagccauaagua

SEQ ID NO: 830360 - RNA, 19 nt, Homo sapiens
ggaaagugcugcugauaug

SEQ ID NO: 830361 - RNA, 19 nt, Homo sapiens
gaaagcaaguguuaccaaa

SEQ ID NO: 830362 - RNA, 19 nt, Homo sapiens
gaacggcaccuaugaguuu

SEQ ID NO: 830363 - RNA, 19 nt, Homo sapiens
cagaaaugcuuugguaaua

SEQ ID NO: 830364 - RNA, 19 nt, Homo sapiens
ggaguuaacuggaauagca

SEQ ID NO: 830365 - RNA, 19 nt, Homo sapiens
ggauacauaugugcauuua

SEQ ID NO: 830366 - RNA, 19 nt, Homo sapiens
gaaauacagugauggacaa

SEQ ID NO: 830367 - RNA, 19 nt, Homo sapiens
gaaauaggcagcacucuga

SEQ ID NO: 830368 - RNA, 19 nt, Homo sapiens
gcaaauaaauacuccagau

SEQ ID NO: 830369 - RNA, 19 nt, Homo sapiens
ccuuagaacuguacuauaa

SEQ ID NO: 830370 - RNA, 19 nt, Homo sapiens
gaaggagaauucauguuga

SEQ ID NO: 830371 - RNA, 19 nt, Homo sapiens
gacaagcaguuucugauuu

SEQ ID NO: 830372 - RNA, 19 nt, Homo sapiens
gcaaauuucucaaccuuuc

SEQ ID NO: 830373 - RNA, 19 nt, Homo sapiens
gaacuaaacaagucccuaa

SEQ ID NO: 830374 - RNA, 19 nt, Homo sapiens
gaaagcaccuuagaacugu

SEQ ID NO: 830375 - RNA, 19 nt, Homo sapiens
aaaggcaugugauugauua

SEQ ID NO: 830376 - RNA, 19 nt, Homo sapiens
gauauauucucgucauuug

SEQ ID NO: 830377 - RNA, 19 nt, Homo sapiens
caacacagccuuaaacuca

SEQ ID NO: 830378 - RNA, 19 nt, Homo sapiens
gagaauguaugaaagcuau

SEQ ID NO: 830379 - RNA, 19 nt, Homo sapiens
gaaacuaagugcccaucaa

SEQ ID NO: 830380 - RNA, 19 nt, Homo sapiens
ugaagacacuguuuccuaa

SEQ ID NO: 830381 - RNA, 19 nt, Homo sapiens
gaaugacggugguggcuuu

SEQ ID NO: 830382 - RNA, 19 nt, Homo sapiens
cuacaaaucaugaugcuua

SEQ ID NO: 830383 - RNA, 19 nt, Homo sapiens
ggaauguucugucaucaau

SEQ ID NO: 830384 - RNA, 19 nt, Homo sapiens
cuagauaucucaauaguag

SEQ ID NO: 830385 - RNA, 19 nt, Homo sapiens
caagaaaguuagucauguu

SEQ ID NO: 830386 - RNA, 19 nt, Homo sapiens
ggaaggagaauucauguug

SEQ ID NO: 830387 - RNA, 19 nt, Homo sapiens
guacaagaaucccaagguu

SEQ ID NO: 830388 - RNA, 19 nt, Homo sapiens
gcaguacacuagcaaguau

SEQ ID NO: 830389 - RNA, 19 nt, Homo sapiens
caaccaaugugugcagaua

SEQ ID NO: 830390 - RNA, 19 nt, Homo sapiens
ggaaugugauggaauuuua

SEQ ID NO: 830391 - RNA, 19 nt, Homo sapiens
gcacaggaguggccguuau

SEQ ID NO: 830392 - RNA, 19 nt, Homo sapiens
aauguugacugccuauuua

SEQ ID NO: 830393 - RNA, 19 nt, Homo sapiens
guauuacucuugugacauu

SEQ ID NO: 830394 - RNA, 19 nt, Homo sapiens
caaaucaaacagacacuua

SEQ ID NO: 830395 - RNA, 19 nt, Homo sapiens
ggaaaugggcaguuuaaug

SEQ ID NO: 830396 - RNA, 19 nt, Homo sapiens
ggucaacuauggccucaaa

SEQ ID NO: 830397 - RNA, 19 nt, Homo sapiens
cuacauacguaccacagua

SEQ ID NO: 830398 - RNA, 19 nt, Homo sapiens
gaaaucuaguauugccaua

SEQ ID NO: 830399 - RNA, 19 nt, Homo sapiens
guacuaacguucugcacaa

SEQ ID NO: 830400 - RNA, 19 nt, Homo sapiens
gcaugugauugauuaauga

SEQ ID NO: 830401 - RNA, 19 nt, Homo sapiens
gcagaaagcugugaaaaga

SEQ ID NO: 830402 - RNA, 19 nt, Homo sapiens
gcaagagugugcugcuuau

SEQ ID NO: 830403 - RNA, 19 nt, Homo sapiens
gaugggaaauuuaagacaa

SEQ ID NO: 830404 - RNA, 19 nt, Homo sapiens
ccagaagacuuuaaaugug

SEQ ID NO: 830405 - RNA, 19 nt, Homo sapiens
ucaagccuauguaugaaua

SEQ ID NO: 830406 - RNA, 19 nt, Homo sapiens
cuaaacaagucccuaaguu

SEQ ID NO: 830407 - RNA, 19 nt, Homo sapiens
ccaaaguuguguuaucuug

SEQ ID NO: 830408 - RNA, 19 nt, Homo sapiens
ggugaacuuuccaagguua

SEQ ID NO: 830409 - RNA, 19 nt, Homo sapiens
gaaggaaaugggcaguuua

SEQ ID NO: 830410 - RNA, 19 nt, Homo sapiens
guacagcacuuccauuaac

SEQ ID NO: 830411 - RNA, 19 nt, Homo sapiens
ggucuaggauggccaguga

SEQ ID NO: 830412 - RNA, 19 nt, Homo sapiens
ggcacaaacuggaaugaaa

SEQ ID NO: 830413 - RNA, 19 nt, Homo sapiens
gcacauuccuuuacuaagc

SEQ ID NO: 830414 - RNA, 19 nt, Homo sapiens
ggaauguaaucaagaaagu

SEQ ID NO: 830415 - RNA, 19 nt, Homo sapiens
gcacuggaauguaaucaag

SEQ ID NO: 830416 - RNA, 19 nt, Homo sapiens
gaaaugggcaguuuaaugc

SEQ ID NO: 830417 - RNA, 19 nt, Homo sapiens
ggcauguuaugguuauuua

SEQ ID NO: 830418 - RNA, 19 nt, Homo sapiens
guaagggcauguuaugguu

SEQ ID NO: 830419 - RNA, 19 nt, Homo sapiens
aaacaggauucauguguau

SEQ ID NO: 830420 - RNA, 19 nt, Homo sapiens
ucaauggaguguauucuug

SEQ ID NO: 830421 - RNA, 19 nt, Homo sapiens
uaaauuggcuauguuguuc

SEQ ID NO: 830422 - RNA, 19 nt, Homo sapiens
guaaagguauucguuaauc

SEQ ID NO: 830423 - RNA, 19 nt, Homo sapiens
gaaauagauucugcucuuc

SEQ ID NO: 830424 - RNA, 19 nt, Homo sapiens
gauauuaauugcagacagu

SEQ ID NO: 830425 - RNA, 19 nt, Homo sapiens
ggaggaaguaguaaauaaa

SEQ ID NO: 830426 - RNA, 19 nt, Homo sapiens
uggaggaaguaguaaauaa

SEQ ID NO: 830427 - RNA, 19 nt, Homo sapiens
agaaauacaugacuacaag

SEQ ID NO: 830428 - RNA, 19 nt, Homo sapiens
caggcuagauaucucaaua

SEQ ID NO: 830429 - RNA, 19 nt, Homo sapiens
ccaaauaggaugucauguu

SEQ ID NO: 830430 - RNA, 19 nt, Homo sapiens
gcuggaugcugucaacaaa

SEQ ID NO: 830431 - RNA, 19 nt, Homo sapiens
gccuuaaacucaaugcuuu

SEQ ID NO: 830432 - RNA, 19 nt, Homo sapiens
aauaggaugucauguuuga

SEQ ID NO: 830433 - RNA, 19 nt, Homo sapiens
uauuucaccuuuaggguua

SEQ ID NO: 830434 - RNA, 19 nt, Homo sapiens
ggaauuggaggucaacuau

SEQ ID NO: 830435 - RNA, 19 nt, Homo sapiens
gaaagcaacacagccuuaa

SEQ ID NO: 830436 - RNA, 19 nt, Homo sapiens
uauagaaccugucauacau

SEQ ID NO: 830437 - RNA, 19 nt, Homo sapiens
gaagggaaaucuagcuacu

SEQ ID NO: 830438 - RNA, 19 nt, Homo sapiens
gcaaacaaaguacuucuuc

SEQ ID NO: 830439 - RNA, 19 nt, Homo sapiens
gcaguggauucaaauggaa

SEQ ID NO: 830440 - RNA, 19 nt, Homo sapiens
ugacauucauuccaccuuu

SEQ ID NO: 830441 - RNA, 19 nt, Homo sapiens
ggacaccaguauccuagga

SEQ ID NO: 830442 - RNA, 19 nt, Homo sapiens
gcuauuucaugcaaacauu

SEQ ID NO: 830443 - RNA, 19 nt, Homo sapiens
gggcuaccauuauuguuug

SEQ ID NO: 830444 - RNA, 19 nt, Homo sapiens
ucucugacauugauacuga

SEQ ID NO: 830445 - RNA, 19 nt, Homo sapiens
aacaagacaucuccaggua

SEQ ID NO: 830446 - RNA, 19 nt, Homo sapiens
acaagcaguuucugauuug

SEQ ID NO: 830447 - RNA, 19 nt, Homo sapiens
caaacaaaguacuucuuca

SEQ ID NO: 830448 - RNA, 19 nt, Homo sapiens
ggaauggauuucucaaugc

SEQ ID NO: 830449 - RNA, 19 nt, Homo sapiens
agaaggaaaugggcaguuu

SEQ ID NO: 830450 - RNA, 19 nt, Homo sapiens
ggagaaacaggauucaugu

SEQ ID NO: 830451 - RNA, 19 nt, Homo sapiens
gaaagugguaauacuguug

SEQ ID NO: 830452 - RNA, 19 nt, Homo sapiens
ccuuagcacugacggguua

SEQ ID NO: 830453 - RNA, 19 nt, Homo sapiens
gaauagcaguacacuagca

SEQ ID NO: 830454 - RNA, 19 nt, Homo sapiens
aaccagccaucauaucaua

SEQ ID NO: 830455 - RNA, 19 nt, Homo sapiens
gcaaagcccuuaauaaaua

SEQ ID NO: 830456 - RNA, 19 nt, Homo sapiens
ggagacagcauucuauuua

SEQ ID NO: 830457 - RNA, 19 nt, Homo sapiens
gagcgacccuauacauuua

SEQ ID NO: 830458 - RNA, 19 nt, Homo sapiens
gcagaaauaugacuacuuc

SEQ ID NO: 830459 - RNA, 19 nt, Homo sapiens
gaggguaccugcacaguuu

SEQ ID NO: 830460 - RNA, 19 nt, Homo sapiens
gaaaggaaucacaccauua

SEQ ID NO: 830461 - RNA, 19 nt, Homo sapiens
gaaggcacuuuauguacua

SEQ ID NO: 830462 - RNA, 19 nt, Homo sapiens
gaacgacccugcuguccuu

SEQ ID NO: 830463 - RNA, 19 nt, Homo sapiens
gaaauaauggucacaaaug

SEQ ID NO: 830464 - RNA, 19 nt, Homo sapiens
gaauaucgcuggagacucu

SEQ ID NO: 830465 - RNA, 19 nt, Homo sapiens
gauuaaagaugucucaugu

SEQ ID NO: 830466 - RNA, 19 nt, Homo sapiens
ugacuuaccuccauaugaa

SEQ ID NO: 830467 - RNA, 19 nt, Homo sapiens
gaaagcagauaacccugaa

SEQ ID NO: 830468 - RNA, 19 nt, Homo sapiens
gcucuuagaugguuucuuc

SEQ ID NO: 830469 - RNA, 19 nt, Homo sapiens
gaucauaacacaaagacua

SEQ ID NO: 830470 - RNA, 19 nt, Homo sapiens
guaaaugaguugucuaaag

SEQ ID NO: 830471 - RNA, 19 nt, Homo sapiens
agucauaagucucgaguua

SEQ ID NO: 830472 - RNA, 19 nt, Homo sapiens
gaaucuggcugcuggugua

SEQ ID NO: 830473 - RNA, 19 nt, Homo sapiens
ucacagaacuacuuccuau

SEQ ID NO: 830474 - RNA, 19 nt, Homo sapiens
agagaaaggucuugacuau

SEQ ID NO: 830475 - RNA, 19 nt, Homo sapiens
uaaagaaaccugcugauau

SEQ ID NO: 830476 - RNA, 19 nt, Homo sapiens
aaagaugucucauguacuu

SEQ ID NO: 830477 - RNA, 19 nt, Homo sapiens
ugaaauggauccuggagaa

SEQ ID NO: 830478 - RNA, 19 nt, Homo sapiens
aaagaaaccugcugauauc

SEQ ID NO: 830479 - RNA, 19 nt, Homo sapiens
gaagaguccuaucggagaa

SEQ ID NO: 830480 - RNA, 19 nt, Homo sapiens
guacauaugcggucaaaga

SEQ ID NO: 830481 - RNA, 19 nt, Homo sapiens
gagcauggaugggaaguug

SEQ ID NO: 830482 - RNA, 19 nt, Homo sapiens
ggagcgacccuauacauuu

SEQ ID NO: 830483 - RNA, 19 nt, Homo sapiens
uaaaugaguugucuaaagg

SEQ ID NO: 830484 - RNA, 19 nt, Homo sapiens
gaacuacuuccuauugauu

SEQ ID NO: 830485 - RNA, 19 nt, Homo sapiens
gggaauauaucgacuuagu

SEQ ID NO: 830486 - RNA, 19 nt, Homo sapiens
gaauagagaacuugcuuug

SEQ ID NO: 830487 - RNA, 19 nt, Homo sapiens
ccucuugugugcuagauua

SEQ ID NO: 830488 - RNA, 19 nt, Homo sapiens
ccaauagguuugaaaugaa

SEQ ID NO: 830489 - RNA, 19 nt, Homo sapiens
guagcuaaauaaccaguuu

SEQ ID NO: 830490 - RNA, 19 nt, Homo sapiens
gaauggauuugccgaacuu

SEQ ID NO: 830491 - RNA, 19 nt, Homo sapiens
ccagagaauuuaagcagaa

SEQ ID NO: 830492 - RNA, 19 nt, Homo sapiens
gcacaucagcgaagacuug

SEQ ID NO: 830493 - RNA, 19 nt, Homo sapiens
guaaaugcaccaauucuga

SEQ ID NO: 830494 - RNA, 19 nt, Homo sapiens
ugaaaggaaucacaccauu

SEQ ID NO: 830495 - RNA, 19 nt, Homo sapiens
cucaacagguauaguauua

SEQ ID NO: 830496 - RNA, 19 nt, Homo sapiens
gcucacacaugcuuuaauc

SEQ ID NO: 830497 - RNA, 19 nt, Homo sapiens
gaagaaaacuuuggacaga

SEQ ID NO: 830498 - RNA, 19 nt, Homo sapiens
gaaugguucuucuuacugu

SEQ ID NO: 830499 - RNA, 19 nt, Homo sapiens
ggaagguugugguuguaaa

SEQ ID NO: 830500 - RNA, 19 nt, Homo sapiens
ugaaugacauggaaucugu

SEQ ID NO: 830501 - RNA, 19 nt, Homo sapiens
agaaaggucuugacuaugg

SEQ ID NO: 830502 - RNA, 19 nt, Homo sapiens
gaagauccacguuugaaau

SEQ ID NO: 830503 - RNA, 19 nt, Homo sapiens
cuacucaacuacaaagauu

SEQ ID NO: 830504 - RNA, 19 nt, Homo sapiens
cccaauagguuugaaauga

SEQ ID NO: 830505 - RNA, 19 nt, Homo sapiens
ggugcaauaucuaucaauu

SEQ ID NO: 830506 - RNA, 19 nt, Homo sapiens
gcagaauugucgugcuuug

SEQ ID NO: 830507 - RNA, 19 nt, Homo sapiens
guacguagcggaugagaau

SEQ ID NO: 830508 - RNA, 19 nt, Homo sapiens
gcaggcaaagcccuuaaua

SEQ ID NO: 830509 - RNA, 19 nt, Homo sapiens
gacaauaacaucagacaga

SEQ ID NO: 830510 - RNA, 19 nt, Homo sapiens
guauuacgacucauguuua

SEQ ID NO: 830511 - RNA, 19 nt, Homo sapiens
gguauaguauuacgacuca

SEQ ID NO: 830512 - RNA, 19 nt, Homo sapiens
aagggaauauaucgacuua

SEQ ID NO: 830513 - RNA, 19 nt, Homo sapiens
cagaaauaauggucacaaa

SEQ ID NO: 830514 - RNA, 19 nt, Homo sapiens
gggaagcucuuagaugguu

SEQ ID NO: 830515 - RNA, 19 nt, Homo sapiens
gaaauuuccaguacauaug

SEQ ID NO: 830516 - RNA, 19 nt, Homo sapiens
aaauggaggucaagaugaa

SEQ ID NO: 830517 - RNA, 19 nt, Homo sapiens
ggucauaucugguuuuguu

SEQ ID NO: 830518 - RNA, 19 nt, Homo sapiens
caggaggacuuaaugcuau

SEQ ID NO: 830519 - RNA, 19 nt, Homo sapiens
gaaaagaccagauguccua

SEQ ID NO: 830520 - RNA, 19 nt, Homo sapiens
gaucagccacaaacaguaa

SEQ ID NO: 830521 - RNA, 19 nt, Homo sapiens
ugagagaauuguaacauag

SEQ ID NO: 830522 - RNA, 19 nt, Homo sapiens
aggcaaagcccuuaauaaa

SEQ ID NO: 830523 - RNA, 19 nt, Homo sapiens
ggacaucgcgaguaccuau

SEQ ID NO: 830524 - RNA, 19 nt, Homo sapiens
cagaacuacuuccuauuga

SEQ ID NO: 830525 - RNA, 19 nt, Homo sapiens
gcagaugaacgccuucuug

SEQ ID NO: 830526 - RNA, 19 nt, Homo sapiens
agacauaucaaguggauuu

SEQ ID NO: 830527 - RNA, 19 nt, Homo sapiens
ggagaauuauguccgugaa

SEQ ID NO: 830528 - RNA, 19 nt, Homo sapiens
ggaagaaagaauucacuug

SEQ ID NO: 830529 - RNA, 19 nt, Homo sapiens
gauccacguuugaaauuuc

SEQ ID NO: 830530 - RNA, 19 nt, Homo sapiens
gcacagaccaagccugaug

SEQ ID NO: 830531 - RNA, 19 nt, Homo sapiens
guaaacccaucuaaucaca

SEQ ID NO: 830532 - RNA, 19 nt, Homo sapiens
gcuacaggcugagagaauu

SEQ ID NO: 830533 - RNA, 19 nt, Homo sapiens
uuaaagaugucucauguac

SEQ ID NO: 830534 - RNA, 19 nt, Homo sapiens
ucacucaacagguauagua

SEQ ID NO: 830535 - RNA, 19 nt, Homo sapiens
gaucauuuguccuacuuca

SEQ ID NO: 830536 - RNA, 19 nt, Homo sapiens
gaggucuguuuguuacaua

SEQ ID NO: 830537 - RNA, 19 nt, Homo sapiens
cugcacaguuugauucuuu

SEQ ID NO: 830538 - RNA, 19 nt, Homo sapiens
gacagagacuugacuugau

SEQ ID NO: 830539 - RNA, 19 nt, Homo sapiens
gaauugucgugcuuugaga

SEQ ID NO: 830540 - RNA, 19 nt, Homo sapiens
gaaguaauuacauguguuc

SEQ ID NO: 830541 - RNA, 19 nt, Homo sapiens
cugagagaauuguaacaua

SEQ ID NO: 830542 - RNA, 19 nt, Homo sapiens
auuaaucacucaacaggua

SEQ ID NO: 830543 - RNA, 19 nt, Homo sapiens
ggacuuaaugcuauuuaug

SEQ ID NO: 830544 - RNA, 19 nt, Homo sapiens
guugauguguacacuaauu

SEQ ID NO: 830545 - RNA, 19 nt, Homo sapiens
cugcagaacccagcuauua

SEQ ID NO: 830546 - RNA, 19 nt, Homo sapiens
ggagaccauuucagaggaa

SEQ ID NO: 830547 - RNA, 19 nt, Homo sapiens
ccucagcuguuuacaauag

SEQ ID NO: 830548 - RNA, 19 nt, Homo sapiens
gacuguggauugaguuuga

SEQ ID NO: 830549 - RNA, 19 nt, Homo sapiens
ggaagauccacguuugaaa

SEQ ID NO: 830550 - RNA, 19 nt, Homo sapiens
ccacagccaucaccuuaca

SEQ ID NO: 830551 - RNA, 19 nt, Homo sapiens
gacaaguacuuugagagaa

SEQ ID NO: 830552 - RNA, 19 nt, Homo sapiens
ggcaaagcccuuaauaaau

SEQ ID NO: 830553 - RNA, 19 nt, Homo sapiens
guccucagcuguuuacaau

SEQ ID NO: 830554 - RNA, 19 nt, Homo sapiens
gacauggaaucuguggaua

SEQ ID NO: 830555 - RNA, 19 nt, Homo sapiens
gaaaccaguugggcaauua

SEQ ID NO: 830556 - RNA, 19 nt, Homo sapiens
gaaaggagauaucaucgau

SEQ ID NO: 830557 - RNA, 19 nt, Homo sapiens
gaagaagccucccaguuuc

SEQ ID NO: 830558 - RNA, 19 nt, Homo sapiens
cgaagaagccucccaguuu

SEQ ID NO: 830559 - RNA, 19 nt, Homo sapiens
guacaaagaagucaucaaa

SEQ ID NO: 830560 - RNA, 19 nt, Homo sapiens
ccucagaaauugacaacua

SEQ ID NO: 830561 - RNA, 19 nt, Homo sapiens
caauggauaugaagauuug

SEQ ID NO: 830562 - RNA, 19 nt, Homo sapiens
gcagagaacgccuugcuaa

SEQ ID NO: 830563 - RNA, 19 nt, Homo sapiens
ugaaagagacgaugagaaa

SEQ ID NO: 830564 - RNA, 19 nt, Homo sapiens
caucaucucuggacgugua

SEQ ID NO: 830565 - RNA, 19 nt, Homo sapiens
acaaagaagucaucaaauc

SEQ ID NO: 830566 - RNA, 19 nt, Homo sapiens
gaggagccguauucugaua

SEQ ID NO: 830567 - RNA, 19 nt, Homo sapiens
ugagaaaccucccgaagau

SEQ ID NO: 830568 - RNA, 19 nt, Homo sapiens
caaaguaacagacucaaga

SEQ ID NO: 830569 - RNA, 19 nt, Homo sapiens
ggaagacuuggaugaguua

SEQ ID NO: 830570 - RNA, 19 nt, Homo sapiens
gaggagagacacauaagaa

SEQ ID NO: 830571 - RNA, 19 nt, Homo sapiens
aaacugcaauucaagagaa

SEQ ID NO: 830572 - RNA, 19 nt, Homo sapiens
gaaaagaugaucacaauug

SEQ ID NO: 830573 - RNA, 19 nt, Homo sapiens
uugcuaggcucaaggaaua

SEQ ID NO: 830574 - RNA, 19 nt, Homo sapiens
caguggagcuguuacaaga

SEQ ID NO: 830575 - RNA, 19 nt, Homo sapiens
caaagaagucaucaaauca

SEQ ID NO: 830576 - RNA, 19 nt, Homo sapiens
ggauucagcuaaugaugau

SEQ ID NO: 830577 - RNA, 19 nt, Homo sapiens
ggaugggccugcugaacaa

SEQ ID NO: 830578 - RNA, 19 nt, Homo sapiens
caagagaacaaucggauga

SEQ ID NO: 830579 - RNA, 19 nt, Homo sapiens
ggacacgaguuugaaggaa

SEQ ID NO: 830580 - RNA, 19 nt, Homo sapiens
gaaggagacuuuguguaca

SEQ ID NO: 830581 - RNA, 19 nt, Homo sapiens
gggaggagcacguguuuga

SEQ ID NO: 830582 - RNA, 19 nt, Homo sapiens
gacaagagccacccuuuca

SEQ ID NO: 830583 - RNA, 19 nt, Homo sapiens
uaauaauucugacccaaug

SEQ ID NO: 830584 - RNA, 19 nt, Homo sapiens
gagcccagcuugaagucuu

SEQ ID NO: 830585 - RNA, 19 nt, Homo sapiens
caagaaaggagauaucauc

SEQ ID NO: 830586 - RNA, 19 nt, Homo sapiens
guagaaagucuucgcaguu

SEQ ID NO: 830587 - RNA, 19 nt, Homo sapiens
ugagaaagagaaugucuaa

SEQ ID NO: 830588 - RNA, 19 nt, Homo sapiens
gaagucaucaaaucaccua

SEQ ID NO: 830589 - RNA, 19 nt, Homo sapiens
gagcacguguuugagaauu

SEQ ID NO: 830590 - RNA, 19 nt, Homo sapiens
aggagaagcugcucguuga

SEQ ID NO: 830591 - RNA, 19 nt, Homo sapiens
gaagauuuggacaccuuua

SEQ ID NO: 830592 - RNA, 19 nt, Homo sapiens
uaauuaggguggaagaaau

SEQ ID NO: 830593 - RNA, 19 nt, Homo sapiens
gaaacuaauuaggguggaa

SEQ ID NO: 830594 - RNA, 19 nt, Homo sapiens
gacaagacaagcacuuauu

SEQ ID NO: 830595 - RNA, 19 nt, Homo sapiens
ccaagugccuucucugucu

SEQ ID NO: 830596 - RNA, 19 nt, Homo sapiens
cagauuggcucauuuccau

SEQ ID NO: 830597 - RNA, 19 nt, Homo sapiens
ucggaaagcuagccuccua

SEQ ID NO: 830598 - RNA, 19 nt, Homo sapiens
uaaugaugauggucaaaga

SEQ ID NO: 830599 - RNA, 19 nt, Homo sapiens
ccacuuuccuguucaaugg

SEQ ID NO: 830600 - RNA, 19 nt, Homo sapiens
gagaacaaucggaugauga

SEQ ID NO: 830601 - RNA, 19 nt, Homo sapiens
cggaggagccguauucuga

SEQ ID NO: 830602 - RNA, 19 nt, Homo sapiens
ucgcaucucucuugggaaa

SEQ ID NO: 830603 - RNA, 19 nt, Homo sapiens
ccaaacagcgugaaaccuu

SEQ ID NO: 830604 - RNA, 19 nt, Homo sapiens
uagaaacgcucacugaaaa

SEQ ID NO: 830605 - RNA, 19 nt, Homo sapiens
gaaaaggacacgaguuuga

SEQ ID NO: 830606 - RNA, 19 nt, Homo sapiens
aggagucggugaaguuuaa

SEQ ID NO: 830607 - RNA, 19 nt, Homo sapiens
uuagugcgguucucuuuga

SEQ ID NO: 830608 - RNA, 19 nt, Homo sapiens
agacuuggaugaguuaaau

SEQ ID NO: 830609 - RNA, 19 nt, Homo sapiens
uagaccagauccagaagaa

SEQ ID NO: 830610 - RNA, 19 nt, Homo sapiens
uacccaacauugccuuuaa

SEQ ID NO: 830611 - RNA, 19 nt, Homo sapiens
gaggaagacuuggaugagu

SEQ ID NO: 830612 - RNA, 19 nt, Homo sapiens
uuacugaccacgcucauuu

SEQ ID NO: 830613 - RNA, 19 nt, Homo sapiens
gagcggauucagcuaauga

SEQ ID NO: 830614 - RNA, 19 nt, Homo sapiens
ggacaagagccacccuuuc

SEQ ID NO: 830615 - RNA, 19 nt, Homo sapiens
gaggagcggauucagcuaa

SEQ ID NO: 830616 - RNA, 19 nt, Homo sapiens
uagaaagucuucgcaguuc

SEQ ID NO: 830617 - RNA, 19 nt, Homo sapiens
gggagaaccugcaguuuug

SEQ ID NO: 830618 - RNA, 19 nt, Homo sapiens
ucacggaaaucugccgaaa

SEQ ID NO: 830619 - RNA, 19 nt, Homo sapiens
cuagaaacgcucacugaaa

SEQ ID NO: 830620 - RNA, 19 nt, Homo sapiens
aagagcacaugcccacuuu

SEQ ID NO: 830621 - RNA, 19 nt, Homo sapiens
aaagagacgaugagaaaga

SEQ ID NO: 830622 - RNA, 19 nt, Homo sapiens
ggagagacacauaagaaag

SEQ ID NO: 830623 - RNA, 19 nt, Homo sapiens
ccuccuaucugccaaguca

SEQ ID NO: 830624 - RNA, 19 nt, Homo sapiens
gaaucgcucucugcacguu

SEQ ID NO: 830625 - RNA, 19 nt, Homo sapiens
acaagacaagcacuuauuu

SEQ ID NO: 830626 - RNA, 19 nt, Homo sapiens
guucuuacccaacguuuga

SEQ ID NO: 830627 - RNA, 19 nt, Homo sapiens
ucaucaaacugcaauucaa

SEQ ID NO: 830628 - RNA, 19 nt, Homo sapiens
ggugaaguuuaagagguua

SEQ ID NO: 830629 - RNA, 19 nt, Homo sapiens
gggcuuagcuaggccaaag

SEQ ID NO: 830630 - RNA, 19 nt, Homo sapiens
ccaucggucugcccaugua

SEQ ID NO: 830631 - RNA, 19 nt, Homo sapiens
gagauacgcagaggacuug

SEQ ID NO: 830632 - RNA, 19 nt, Homo sapiens
gaggagcacguguuugaga

SEQ ID NO: 830633 - RNA, 19 nt, Homo sapiens
uacaagaguaugacaguaa

SEQ ID NO: 830634 - RNA, 19 nt, Homo sapiens
uuacaagaguaugacagua

SEQ ID NO: 830635 - RNA, 19 nt, Homo sapiens
gaccagauccagaagaaag

SEQ ID NO: 830636 - RNA, 19 nt, Homo sapiens
gaaacuggagggcucaauc

SEQ ID NO: 830637 - RNA, 19 nt, Homo sapiens
cucagaaauugacaacuaa

SEQ ID NO: 830638 - RNA, 19 nt, Homo sapiens
gaugaucacaauugaggaa

SEQ ID NO: 830639 - RNA, 19 nt, Homo sapiens
gaucacaauugaggaagca

SEQ ID NO: 830640 - RNA, 19 nt, Homo sapiens
ccaagucuguggaggaucu

SEQ ID NO: 830641 - RNA, 19 nt, Homo sapiens
guaauaauucugacccaau

SEQ ID NO: 830642 - RNA, 19 nt, Homo sapiens
agaaaccucccgaagauga

SEQ ID NO: 830643 - RNA, 19 nt, Homo sapiens
ucgaggaaauaaauuagug

SEQ ID NO: 830644 - RNA, 19 nt, Homo sapiens
gggaguggaucuagaaacg

SEQ ID NO: 830645 - RNA, 19 nt, Homo sapiens
gaggagucggugaaguuua

SEQ ID NO: 830646 - RNA, 19 nt, Homo sapiens
ggugugacugguuugaaua

SEQ ID NO: 830647 - RNA, 19 nt, Homo sapiens
gugguggacucacggaaau

SEQ ID NO: 830648 - RNA, 19 nt, Homo sapiens
cuacugacccaaagcaaga

SEQ ID NO: 830649 - RNA, 19 nt, Homo sapiens
cacguuggcaguaauaauu

SEQ ID NO: 830650 - RNA, 19 nt, Homo sapiens
uacacaagcugguaaacuc

SEQ ID NO: 830651 - RNA, 19 nt, Homo sapiens
auaugaugcugaugcaauu

SEQ ID NO: 830652 - RNA, 19 nt, Homo sapiens
cauaagaaagcuccuaucu

SEQ ID NO: 830653 - RNA, 19 nt, Homo sapiens
agacucugcugucgacaau

SEQ ID NO: 830654 - RNA, 19 nt, Homo sapiens
uaccugaagugccgcagaa

SEQ ID NO: 830655 - RNA, 19 nt, Homo sapiens
caacaaagaugaagaagaa

SEQ ID NO: 830656 - RNA, 19 nt, Homo sapiens
ggaaagggagcacauauuu

SEQ ID NO: 830657 - RNA, 19 nt, Homo sapiens
ggaccagccucucuuuaaa

SEQ ID NO: 830658 - RNA, 19 nt, Homo sapiens
cagcaacaaugcaauaauu

SEQ ID NO: 830659 - RNA, 19 nt, Homo sapiens
ugacggagcuccaccgaaa

SEQ ID NO: 830660 - RNA, 19 nt, Homo sapiens
ugacgagccuguucaguaa

SEQ ID NO: 830661 - RNA, 19 nt, Homo sapiens
gaacucugcucugcaaaug

SEQ ID NO: 830662 - RNA, 19 nt, Homo sapiens
agaagaauaugaaggguuu

SEQ ID NO: 830663 - RNA, 19 nt, Homo sapiens
cgacauagacaaacugaaa

SEQ ID NO: 830664 - RNA, 19 nt, Homo sapiens
ggagugacguuaagcugaa

SEQ ID NO: 830665 - RNA, 19 nt, Homo sapiens
gggcaggaauugugaaguu

SEQ ID NO: 830666 - RNA, 19 nt, Homo sapiens
ugacuccguuuccuuauaa

SEQ ID NO: 830667 - RNA, 19 nt, Homo sapiens
aaacagcgcuuccauucug

SEQ ID NO: 830668 - RNA, 19 nt, Homo sapiens
gaagagaagaugaggcaaa

SEQ ID NO: 830669 - RNA, 19 nt, Homo sapiens
gaacuaugcaauugugauu

SEQ ID NO: 830670 - RNA, 19 nt, Homo sapiens
gcaucagccuuguuugaaa

SEQ ID NO: 830671 - RNA, 19 nt, Homo sapiens
ggaaggaaagguugaaaug

SEQ ID NO: 830672 - RNA, 19 nt, Homo sapiens
gcuaagagguauauaugca

SEQ ID NO: 830673 - RNA, 19 nt, Homo sapiens
acaggaggcucauggaauu

SEQ ID NO: 830674 - RNA, 19 nt, Homo sapiens
uggauaagcuugaacugaa

SEQ ID NO: 830675 - RNA, 19 nt, Homo sapiens
gaaggaaagguugaaauga

SEQ ID NO: 830676 - RNA, 19 nt, Homo sapiens
ggugggauauaugaaauuu

SEQ ID NO: 830677 - RNA, 19 nt, Homo sapiens
caaggugaguuccggauau

SEQ ID NO: 830678 - RNA, 19 nt, Homo sapiens
cagccucucuuuaaacuga

SEQ ID NO: 830679 - RNA, 19 nt, Homo sapiens
gcagugagacagagaguga

SEQ ID NO: 830680 - RNA, 19 nt, Homo sapiens
gcacagaaacggacaguac

SEQ ID NO: 830681 - RNA, 19 nt, Homo sapiens
caggugagcaagaguaaua

SEQ ID NO: 830682 - RNA, 19 nt, Homo sapiens
uugaagagaugaacaacaa

SEQ ID NO: 830683 - RNA, 19 nt, Homo sapiens
uguaauaucucagcaacaa

SEQ ID NO: 830684 - RNA, 19 nt, Homo sapiens
caucagcacuccaaauucu

SEQ ID NO: 830685 - RNA, 19 nt, Homo sapiens
gacgggaccuccucucuuc

SEQ ID NO: 830686 - RNA, 19 nt, Homo sapiens
gaaguuucaugaacacuac

SEQ ID NO: 830687 - RNA, 19 nt, Homo sapiens
gcugcaggcuaucuguaua

SEQ ID NO: 830688 - RNA, 19 nt, Homo sapiens
caaccaaacuugaauuuuc

SEQ ID NO: 830689 - RNA, 19 nt, Homo sapiens
cuacacacuucaccaaaug

SEQ ID NO: 830690 - RNA, 19 nt, Homo sapiens
aagggaagcuccuccaaug

SEQ ID NO: 830691 - RNA, 19 nt, Homo sapiens
caucauggaccagcaauuu

SEQ ID NO: 830692 - RNA, 19 nt, Homo sapiens
cuacaaacucucccucuuu

SEQ ID NO: 830693 - RNA, 19 nt, Homo sapiens
ugaaacagcgcuuccauuc

SEQ ID NO: 830694 - RNA, 19 nt, Homo sapiens
gacacagagucaucucauu

SEQ ID NO: 830695 - RNA, 19 nt, Homo sapiens
cgugaaaucccaagaagaa

SEQ ID NO: 830696 - RNA, 19 nt, Homo sapiens
gcaacaaagaugaagaaga

SEQ ID NO: 830697 - RNA, 19 nt, Homo sapiens
aaaugacuccguuuccuua

SEQ ID NO: 830698 - RNA, 19 nt, Homo sapiens
gcaacaaugcaauaauuca

SEQ ID NO: 830699 - RNA, 19 nt, Homo sapiens
caacugggccgaagagaag

SEQ ID NO: 830700 - RNA, 19 nt, Homo sapiens
gcaggacgaugccagugau

SEQ ID NO: 830701 - RNA, 19 nt, Homo sapiens
gaagggaagcuccuccaau

SEQ ID NO: 830702 - RNA, 19 nt, Homo sapiens
gagaugaacaacaaacuca

SEQ ID NO: 830703 - RNA, 19 nt, Homo sapiens
gcccaacaccagcuuuaua

SEQ ID NO: 830704 - RNA, 19 nt, Homo sapiens
gaccagcaauuugaagaga

SEQ ID NO: 830705 - RNA, 19 nt, Homo sapiens
uaucaaguuuggaaggaaa

SEQ ID NO: 830706 - RNA, 19 nt, Homo sapiens
ccacagggccaaugaagau

SEQ ID NO: 830707 - RNA, 19 nt, Homo sapiens
guauauaugcaguaccuuu

SEQ ID NO: 830708 - RNA, 19 nt, Homo sapiens
uccauaaccugaagauguu

SEQ ID NO: 830709 - RNA, 19 nt, Homo sapiens
ggaagcuccuccaaugagu

SEQ ID NO: 830710 - RNA, 19 nt, Homo sapiens
aaaugcaacuuugugcuuu

SEQ ID NO: 830711 - RNA, 19 nt, Homo sapiens
gcaacugggccgaagagaa

SEQ ID NO: 830712 - RNA, 19 nt, Homo sapiens
gcacauauuuugcuaagag

SEQ ID NO: 830713 - RNA, 19 nt, Homo sapiens
gaggaaagggagcacauau

SEQ ID NO: 830714 - RNA, 19 nt, Homo sapiens
agcagacgcucccgacaua

SEQ ID NO: 830715 - RNA, 19 nt, Homo sapiens
aaacuagcaagcucagaua

SEQ ID NO: 830716 - RNA, 19 nt, Homo sapiens
gggcaucagccuuguuuga

SEQ ID NO: 830717 - RNA, 19 nt, Homo sapiens
ggcaggaauugugaaguuu

SEQ ID NO: 830718 - RNA, 19 nt, Homo sapiens
ggauaagcuugaacugaag

SEQ ID NO: 830719 - RNA, 19 nt, Homo sapiens
cacaagaguuagcccagaa

SEQ ID NO: 830720 - RNA, 19 nt, Homo sapiens
gaagcuccuccaaugagua

SEQ ID NO: 830721 - RNA, 19 nt, Homo sapiens
ucuuagagaugguaaaugg

SEQ ID NO: 830722 - RNA, 19 nt, Homo sapiens
guccauaaccugaagaugu

SEQ ID NO: 830723 - RNA, 19 nt, Homo sapiens
caagaguaauaacccugaa

SEQ ID NO: 830724 - RNA, 19 nt, Homo sapiens
acacagagucaucucauug

SEQ ID NO: 830725 - RNA, 19 nt, Homo sapiens
gaggacggcaggaccauga

SEQ ID NO: 830726 - RNA, 19 nt, Homo sapiens
ccagcaauuugaagagaug

SEQ ID NO: 830727 - RNA, 19 nt, Homo sapiens
uaacucuuauccaggcauu

SEQ ID NO: 830728 - RNA, 19 nt, Homo sapiens
cacacacacugguggcuuu

SEQ ID NO: 830729 - RNA, 19 nt, Homo sapiens
aaagggauguccucagucu

SEQ ID NO: 830730 - RNA, 19 nt, Homo sapiens
caaaagggauguccucagu

SEQ ID NO: 830731 - RNA, 19 nt, Homo sapiens
uccaaauucuccagugaaa

SEQ ID NO: 830732 - RNA, 19 nt, Homo sapiens
ccacccacaucuccuggaa

SEQ ID NO: 830733 - RNA, 19 nt, Homo sapiens
gcugagcacggacuacaaa

SEQ ID NO: 830734 - RNA, 19 nt, Homo sapiens
gaacacuaccugggugaga

SEQ ID NO: 830735 - RNA, 19 nt, Homo sapiens
uuagaacuaugcaauugug

SEQ ID NO: 830736 - RNA, 19 nt, Homo sapiens
uuacagcgcucacauuucc

SEQ ID NO: 830737 - RNA, 19 nt, Homo sapiens
aaggugaguuccggauaua

SEQ ID NO: 830738 - RNA, 19 nt, Homo sapiens
gcccuuggguuaccagcaa

SEQ ID NO: 830739 - RNA, 19 nt, Homo sapiens
guucauccaugccuucuac

SEQ ID NO: 830740 - RNA, 19 nt, Homo sapiens
ggacgggaccuccucucuu

SEQ ID NO: 830741 - RNA, 19 nt, Homo sapiens
gaagagaugaacaacaaac

SEQ ID NO: 830742 - RNA, 19 nt, Homo sapiens
uaauaucucagcaacaaug

SEQ ID NO: 830743 - RNA, 19 nt, Homo sapiens
caauuuuggucucaugaua

SEQ ID NO: 830744 - RNA, 19 nt, Homo sapiens
guacaggaggcucauggaa

SEQ ID NO: 830745 - RNA, 19 nt, Homo sapiens
ggacggacaagggcauuug

SEQ ID NO: 830746 - RNA, 19 nt, Homo sapiens
ccuguucucucccaucaga

SEQ ID NO: 830747 - RNA, 19 nt, Homo sapiens
gaaagggagcacauauuuu

SEQ ID NO: 830748 - RNA, 19 nt, Homo sapiens
ccuacacacuucaccaaau

SEQ ID NO: 830749 - RNA, 19 nt, Homo sapiens
gggaguggauaagcuugaa

SEQ ID NO: 830750 - RNA, 19 nt, Homo sapiens
gaaacagcgcuuccauucu

SEQ ID NO: 830751 - RNA, 19 nt, Homo sapiens
gaaggaggagggaguggau

SEQ ID NO: 830752 - RNA, 19 nt, Homo sapiens
cgacaaacaggacaacaag

SEQ ID NO: 830753 - RNA, 19 nt, Homo sapiens
ccuccaagcccuuugcaaa

SEQ ID NO: 830754 - RNA, 19 nt, Homo sapiens
gcagcgcaaugccauguac

SEQ ID NO: 830755 - RNA, 19 nt, Homo sapiens
cagagaaacugaaguguua

SEQ ID NO: 830756 - RNA, 19 nt, Homo sapiens
gaaguucacugacugcuuu

SEQ ID NO: 830757 - RNA, 19 nt, Homo sapiens
gaaugucacuguuccuuga

SEQ ID NO: 830758 - RNA, 19 nt, Homo sapiens
ggacaucacugcuggacau

SEQ ID NO: 830759 - RNA, 19 nt, Homo sapiens
ggucuucacuucccacuug

SEQ ID NO: 830760 - RNA, 19 nt, Homo sapiens
gcuccuaccuggacucuga

SEQ ID NO: 830761 - RNA, 19 nt, Homo sapiens
gaucaaaguucuccuaagc

SEQ ID NO: 830762 - RNA, 19 nt, Homo sapiens
gagggaagcagcagagaaa

SEQ ID NO: 830763 - RNA, 19 nt, Homo sapiens
gcagagaaacugaaguguu

SEQ ID NO: 830764 - RNA, 19 nt, Homo sapiens
caacagccaugcucuucga

SEQ ID NO: 830765 - RNA, 19 nt, Homo sapiens
gcagcaauaugugcaguau

SEQ ID NO: 830766 - RNA, 19 nt, Homo sapiens
ggacuggaccacugaaugu

SEQ ID NO: 830767 - RNA, 19 nt, Homo sapiens
gcccagaacacaacgagua

SEQ ID NO: 830768 - RNA, 19 nt, Homo sapiens
cagcuggacugcuuccuau

SEQ ID NO: 830769 - RNA, 19 nt, Homo sapiens
gaaagacgucucugacagu

SEQ ID NO: 830770 - RNA, 19 nt, Homo sapiens
gaugacaccuggguuccaa

SEQ ID NO: 830771 - RNA, 19 nt, Homo sapiens
gagcuccucugccugaauc

SEQ ID NO: 830772 - RNA, 19 nt, Homo sapiens
ccagagcugucgccauuuc

SEQ ID NO: 830773 - RNA, 19 nt, Homo sapiens
ggccauggcuauccuugga

SEQ ID NO: 830774 - RNA, 19 nt, Homo sapiens
cgagagcccuucccaguac

SEQ ID NO: 830775 - RNA, 19 nt, Homo sapiens
uuaaugagguggguucaga

SEQ ID NO: 830776 - RNA, 19 nt, Homo sapiens
uggcuuuccugcagcaaua

SEQ ID NO: 830777 - RNA, 19 nt, Homo sapiens
ggcacuggcuucucaaugg

SEQ ID NO: 830778 - RNA, 19 nt, Homo sapiens
gguagagucucgggaguuc

SEQ ID NO: 830779 - RNA, 19 nt, Homo sapiens
uggcagagcuggaggaacu

SEQ ID NO: 830780 - RNA, 19 nt, Homo sapiens
caggaugacuuugaugugu

SEQ ID NO: 830781 - RNA, 19 nt, Homo sapiens
acaacuacguggcugauca

SEQ ID NO: 830782 - RNA, 19 nt, Homo sapiens
ccagggcuguuacuucugu

SEQ ID NO: 830783 - RNA, 19 nt, Homo sapiens
ggacugaccagcccuucug

SEQ ID NO: 830784 - RNA, 19 nt, Homo sapiens
gaacucaguaccugguugu

SEQ ID NO: 830785 - RNA, 19 nt, Homo sapiens
cgccagcucuuaccacaug

SEQ ID NO: 830786 - RNA, 19 nt, Homo sapiens
gcuaccaccucaccaccuu

SEQ ID NO: 830787 - RNA, 19 nt, Homo sapiens
gaaacugaaguguuagaca

SEQ ID NO: 830788 - RNA, 19 nt, Homo sapiens
gcucuccgguaaccaccua

SEQ ID NO: 830789 - RNA, 19 nt, Homo sapiens
agcacuagcucuccgguaa

SEQ ID NO: 830790 - RNA, 19 nt, Homo sapiens
uuacagagacauaugacaa

SEQ ID NO: 830791 - RNA, 19 nt, Homo sapiens
ggaagcagcagagaaacug

SEQ ID NO: 830792 - RNA, 19 nt, Homo sapiens
ggagggaagcagcagagaa

SEQ ID NO: 830793 - RNA, 19 nt, Homo sapiens
gaaccgcccuccccaaaca

SEQ ID NO: 830794 - RNA, 19 nt, Homo sapiens
cuggguuucucauccuuua

SEQ ID NO: 830795 - RNA, 19 nt, Homo sapiens
uaccagagccugaucaaag

SEQ ID NO: 830796 - RNA, 19 nt, Homo sapiens
cccaccagcuauacaacua

SEQ ID NO: 830797 - RNA, 19 nt, Homo sapiens
gagaaacugaaguguuaga

SEQ ID NO: 830798 - RNA, 19 nt, Homo sapiens
ucccagcucugccuuugaa

SEQ ID NO: 830799 - RNA, 19 nt, Homo sapiens
ucaugggccuaccagauug

SEQ ID NO: 830800 - RNA, 19 nt, Homo sapiens
guucagcuaugacuuccau

SEQ ID NO: 830801 - RNA, 19 nt, Homo sapiens
acagagacauaugacaaug

SEQ ID NO: 830802 - RNA, 19 nt, Homo sapiens
cagcagagaaacugaagug

SEQ ID NO: 830803 - RNA, 19 nt, Homo sapiens
ggaugacuuugaugugucu

SEQ ID NO: 830804 - RNA, 19 nt, Homo sapiens
acaccaggaugacuuugau

SEQ ID NO: 830805 - RNA, 19 nt, Homo sapiens
caggcucacugcugacaug

SEQ ID NO: 830806 - RNA, 19 nt, Homo sapiens
agcaauaugugcaguaucu

SEQ ID NO: 830807 - RNA, 19 nt, Homo sapiens
gaagcagcagagaaacuga

SEQ ID NO: 830808 - RNA, 19 nt, Homo sapiens
ccgagagcccuucccagua

SEQ ID NO: 830809 - RNA, 19 nt, Homo sapiens
guaccugguugugcugaau

SEQ ID NO: 830810 - RNA, 19 nt, Homo sapiens
gggcaucauccucauggaa

SEQ ID NO: 830811 - RNA, 19 nt, Homo sapiens
ccauuacagagacauauga

SEQ ID NO: 830812 - RNA, 19 nt, Homo sapiens
ccacugaaugucacuguuc

SEQ ID NO: 830813 - RNA, 19 nt, Homo sapiens
ggacucccacuuaggaaag

SEQ ID NO: 830814 - RNA, 19 nt, Homo sapiens
gacaccaggaugacuuuga

SEQ ID NO: 830815 - RNA, 19 nt, Homo sapiens
ggcaggcugucaacucaca

SEQ ID NO: 830816 - RNA, 19 nt, Homo sapiens
caccaucccauuacagaga

SEQ ID NO: 830817 - RNA, 19 nt, Homo sapiens
uucagaagcucucccaucu

SEQ ID NO: 830818 - RNA, 19 nt, Homo sapiens
ugagguggguucagaagcu

SEQ ID NO: 830819 - RNA, 19 nt, Homo sapiens
guuucuggacucccacuua

SEQ ID NO: 830820 - RNA, 19 nt, Homo sapiens
ugucucugcuugucuguca

SEQ ID NO: 830821 - RNA, 19 nt, Homo sapiens
ccccagagcugucgccauu

SEQ ID NO: 830822 - RNA, 19 nt, Homo sapiens
ucucccaucuucacagcaa

SEQ ID NO: 830823 - RNA, 19 nt, Homo sapiens
aaucccagcucugccuuug

SEQ ID NO: 830824 - RNA, 19 nt, Homo sapiens
ugacugcuuugugcuagug

SEQ ID NO: 830825 - RNA, 19 nt, Homo sapiens
ccagcuggacugcuuccua

SEQ ID NO: 830826 - RNA, 19 nt, Homo sapiens
gguuucucauccuuuaaug

SEQ ID NO: 830827 - RNA, 19 nt, Homo sapiens
aaacacccacagccacuga

SEQ ID NO: 830828 - RNA, 19 nt, Homo sapiens
gaagcaguccaugccaaau

SEQ ID NO: 830829 - RNA, 19 nt, Homo sapiens
agaagcaguccaugccaaa

SEQ ID NO: 830830 - RNA, 19 nt, Homo sapiens
ggccucagggcuuauucua

SEQ ID NO: 830831 - RNA, 19 nt, Homo sapiens
guaccagagccugaucaaa

SEQ ID NO: 830832 - RNA, 19 nt, Homo sapiens
acucacagcuguccaugcu

SEQ ID NO: 830833 - RNA, 19 nt, Homo sapiens
ggcuguuacuucuguguca

SEQ ID NO: 830834 - RNA, 19 nt, Homo sapiens
caucacugcuggacauucc

SEQ ID NO: 830835 - RNA, 19 nt, Homo sapiens
uuaggaaagacgucucuga

SEQ ID NO: 830836 - RNA, 19 nt, Homo sapiens
gcaucauccucauggaacu

SEQ ID NO: 830837 - RNA, 19 nt, Homo sapiens
gcuuugugcuaguguuucu

SEQ ID NO: 830838 - RNA, 19 nt, Homo sapiens
gcuguuacuucugugucaa

SEQ ID NO: 830839 - RNA, 19 nt, Homo sapiens
accagagccugaucaaagu

SEQ ID NO: 830840 - RNA, 19 nt, Homo sapiens
uggaccggcuccucuguuc

SEQ ID NO: 830841 - RNA, 19 nt, Homo sapiens
guucacacaggguggcaaa

SEQ ID NO: 830842 - RNA, 19 nt, Homo sapiens
aaucaugggccuaccagau

SEQ ID NO: 830843 - RNA, 19 nt, Homo sapiens
ccuggagucugucaucaac

SEQ ID NO: 830844 - RNA, 19 nt, Homo sapiens
cccaacuggucuccaccua

SEQ ID NO: 830845 - RNA, 19 nt, Homo sapiens
gagagcccuucccaguaca

SEQ ID NO: 830846 - RNA, 19 nt, Homo sapiens
uuucuggacucccacuuag

SEQ ID NO: 830847 - RNA, 19 nt, Homo sapiens
gagcugucgccauuuccaa

SEQ ID NO: 830848 - RNA, 19 nt, Homo sapiens
ggaggccucagggcuuauu

SEQ ID NO: 830849 - RNA, 19 nt, Homo sapiens
ccaccuuucugcgacacuu

SEQ ID NO: 830850 - RNA, 19 nt, Homo sapiens
ucacacaggguggcaaaca

SEQ ID NO: 830851 - RNA, 19 nt, Homo sapiens
cacuguuccuugaaucaug

SEQ ID NO: 830852 - RNA, 19 nt, Homo sapiens
ugaucaaaguucuccuaag

SEQ ID NO: 830853 - RNA, 19 nt, Homo sapiens
guccaugccaaauccauug

SEQ ID NO: 830854 - RNA, 19 nt, Homo sapiens
cuuaccacaugaagccauu

SEQ ID NO: 830855 - RNA, 19 nt, Homo sapiens
uaacaaaccuugaucugua

SEQ ID NO: 830856 - RNA, 19 nt, Homo sapiens
gaucaucucuuucauaaug

SEQ ID NO: 830857 - RNA, 19 nt, Homo sapiens
gcaaugacaacuucuauua

SEQ ID NO: 830858 - RNA, 19 nt, Homo sapiens
ggacguggguucacuguuu

SEQ ID NO: 830859 - RNA, 19 nt, Homo sapiens
gaagauggaagcauaguua

SEQ ID NO: 830860 - RNA, 19 nt, Homo sapiens
ggacgauguuugaugauua

SEQ ID NO: 830861 - RNA, 19 nt, Homo sapiens
guacauagaccacgucaua

SEQ ID NO: 830862 - RNA, 19 nt, Homo sapiens
acaaagaccuauacaguuu

SEQ ID NO: 830863 - RNA, 19 nt, Homo sapiens
ggucaucucuaacuacuaa

SEQ ID NO: 830864 - RNA, 19 nt, Homo sapiens
gcacauggacgacuuguuu

SEQ ID NO: 830865 - RNA, 19 nt, Homo sapiens
gcucaucucuugcuuaaau

SEQ ID NO: 830866 - RNA, 19 nt, Homo sapiens
gaagcaagcuaccgcuauu

SEQ ID NO: 830867 - RNA, 19 nt, Homo sapiens
ggaagaaagugauccugaa

SEQ ID NO: 830868 - RNA, 19 nt, Homo sapiens
uaugugggcucucgauuua

SEQ ID NO: 830869 - RNA, 19 nt, Homo sapiens
ggaaauuacucaauccaau

SEQ ID NO: 830870 - RNA, 19 nt, Homo sapiens
gaauaucgguccagcaaau

SEQ ID NO: 830871 - RNA, 19 nt, Homo sapiens
cuagaccacuuucuucuua

SEQ ID NO: 830872 - RNA, 19 nt, Homo sapiens
ccacgaagguugagaacaa

SEQ ID NO: 830873 - RNA, 19 nt, Homo sapiens
gcaagaggcauuugauaaa

SEQ ID NO: 830874 - RNA, 19 nt, Homo sapiens
gguaaacucugcauuguca

SEQ ID NO: 830875 - RNA, 19 nt, Homo sapiens
agacauauguggcuucauu

SEQ ID NO: 830876 - RNA, 19 nt, Homo sapiens
gcguacaccuuuaauguuu

SEQ ID NO: 830877 - RNA, 19 nt, Homo sapiens
aaggaaagcuaauaaggua

SEQ ID NO: 830878 - RNA, 19 nt, Homo sapiens
ggugauugcuaggaaauua

SEQ ID NO: 830879 - RNA, 19 nt, Homo sapiens
gaacagccauugaucugau

SEQ ID NO: 830880 - RNA, 19 nt, Homo sapiens
gauaacagcaguugagauu

SEQ ID NO: 830881 - RNA, 19 nt, Homo sapiens
gaaggcaguugaaaauuua

SEQ ID NO: 830882 - RNA, 19 nt, Homo sapiens
cugaaggucuggauuguua

SEQ ID NO: 830883 - RNA, 19 nt, Homo sapiens
cagcaucaaucacuuguuu

SEQ ID NO: 830884 - RNA, 19 nt, Homo sapiens
cuagagaaauguaagguaa

SEQ ID NO: 830885 - RNA, 19 nt, Homo sapiens
cagauaaagucaucauuug

SEQ ID NO: 830886 - RNA, 19 nt, Homo sapiens
acuaauaucugcauucuug

SEQ ID NO: 830887 - RNA, 19 nt, Homo sapiens
gaagaaacaaagaccuaua

SEQ ID NO: 830888 - RNA, 19 nt, Homo sapiens
ggaagagcaugaccuuguu

SEQ ID NO: 830889 - RNA, 19 nt, Homo sapiens
gcaauaaagacaaaccuaa

SEQ ID NO: 830890 - RNA, 19 nt, Homo sapiens
ucuggaagguugaauauuu

SEQ ID NO: 830891 - RNA, 19 nt, Homo sapiens
cuugaaggaucuuuaguua

SEQ ID NO: 830892 - RNA, 19 nt, Homo sapiens
gcagauguauugaauuuac

SEQ ID NO: 830893 - RNA, 19 nt, Homo sapiens
uggcauagcuagagaaaug

SEQ ID NO: 830894 - RNA, 19 nt, Homo sapiens
uacaaacccuugcaacuaa

SEQ ID NO: 830895 - RNA, 19 nt, Homo sapiens
guaaugaaccucuuaaagu

SEQ ID NO: 830896 - RNA, 19 nt, Homo sapiens
gcagagaauauuuccauaa

SEQ ID NO: 830897 - RNA, 19 nt, Homo sapiens
gacuuugucucaucagaua

SEQ ID NO: 830898 - RNA, 19 nt, Homo sapiens
uggcagauguauugaauuu

SEQ ID NO: 830899 - RNA, 19 nt, Homo sapiens
gaaacaacuugccaacauc

SEQ ID NO: 830900 - RNA, 19 nt, Homo sapiens
gcaaggcacugacguuucu

SEQ ID NO: 830901 - RNA, 19 nt, Homo sapiens
ccucgaagcucuagccaaa

SEQ ID NO: 830902 - RNA, 19 nt, Homo sapiens
uuacauaccuguuucuuag

SEQ ID NO: 830903 - RNA, 19 nt, Homo sapiens
agaaagugauccugaauau

SEQ ID NO: 830904 - RNA, 19 nt, Homo sapiens
gaagaagggcuggcaauga

SEQ ID NO: 830905 - RNA, 19 nt, Homo sapiens
ggaaggcaguugaaaauuu

SEQ ID NO: 830906 - RNA, 19 nt, Homo sapiens
guucaggaguguauauaaa

SEQ ID NO: 830907 - RNA, 19 nt, Homo sapiens
ccaaagagguacacagaca

SEQ ID NO: 830908 - RNA, 19 nt, Homo sapiens
ucuaaacgcuugugaugaa

SEQ ID NO: 830909 - RNA, 19 nt, Homo sapiens
gcaggauacugagccaaua

SEQ ID NO: 830910 - RNA, 19 nt, Homo sapiens
gcacuguuguuuggucaua

SEQ ID NO: 830911 - RNA, 19 nt, Homo sapiens
ugaaagaaacgaucaaaga

SEQ ID NO: 830912 - RNA, 19 nt, Homo sapiens
gcaguucucuuccaacaag

SEQ ID NO: 830913 - RNA, 19 nt, Homo sapiens
ggaggaauccaaaccaauu

SEQ ID NO: 830914 - RNA, 19 nt, Homo sapiens
uaccagccuugaaguauua

SEQ ID NO: 830915 - RNA, 19 nt, Homo sapiens
gcauacaguucuaccaguu

SEQ ID NO: 830916 - RNA, 19 nt, Homo sapiens
gauggcagauguauugaau

SEQ ID NO: 830917 - RNA, 19 nt, Homo sapiens
caaacuucaucccagcuua

SEQ ID NO: 830918 - RNA, 19 nt, Homo sapiens
ugaacgugcuguuguguuu

SEQ ID NO: 830919 - RNA, 19 nt, Homo sapiens
gugcucaucucuugcuuaa

SEQ ID NO: 830920 - RNA, 19 nt, Homo sapiens
ugaaugaaguacuggauga

SEQ ID NO: 830921 - RNA, 19 nt, Homo sapiens
ugaaacauaucuucugugu

SEQ ID NO: 830922 - RNA, 19 nt, Homo sapiens
guacagcgagugaauuaaa

SEQ ID NO: 830923 - RNA, 19 nt, Homo sapiens
gguggacgauguuugauga

SEQ ID NO: 830924 - RNA, 19 nt, Homo sapiens
ggaaugaugagguaaaugu

SEQ ID NO: 830925 - RNA, 19 nt, Homo sapiens
gaaaagcgcccacacauug

SEQ ID NO: 830926 - RNA, 19 nt, Homo sapiens
gcuaccaccuucuuuauca

SEQ ID NO: 830927 - RNA, 19 nt, Homo sapiens
gcuaggaaauuacucaauc

SEQ ID NO: 830928 - RNA, 19 nt, Homo sapiens
gaaauuauugcccuuugaa

SEQ ID NO: 830929 - RNA, 19 nt, Homo sapiens
ugccugggcuccuuacuua

SEQ ID NO: 830930 - RNA, 19 nt, Homo sapiens
gaaaaugggcaaaguuaua

SEQ ID NO: 830931 - RNA, 19 nt, Homo sapiens
ccuaugaucuaguuaaugu

SEQ ID NO: 830932 - RNA, 19 nt, Homo sapiens
gggcaaaguuauauuuaca

SEQ ID NO: 830933 - RNA, 19 nt, Homo sapiens
ccuauacaguuuagacuuu

SEQ ID NO: 830934 - RNA, 19 nt, Homo sapiens
cggcaaaucuauacuguuc

SEQ ID NO: 830935 - RNA, 19 nt, Homo sapiens
aagaaacgaucaaagagaa

SEQ ID NO: 830936 - RNA, 19 nt, Homo sapiens
gauggaagcauaguuauug

SEQ ID NO: 830937 - RNA, 19 nt, Homo sapiens
ugauugaacucccugugua

SEQ ID NO: 830938 - RNA, 19 nt, Homo sapiens
gagguaaacucugcauugu

SEQ ID NO: 830939 - RNA, 19 nt, Homo sapiens
guaaauguauaccuuagca

SEQ ID NO: 830940 - RNA, 19 nt, Homo sapiens
gguucuagcucauaauaau

SEQ ID NO: 830941 - RNA, 19 nt, Homo sapiens
uaauucagccuucaaacua

SEQ ID NO: 830942 - RNA, 19 nt, Homo sapiens
gaaagaaacgaucaaagag

SEQ ID NO: 830943 - RNA, 19 nt, Homo sapiens
aaacaaagaccuauacagu

SEQ ID NO: 830944 - RNA, 19 nt, Homo sapiens
aaaguaggaucaaagucua

SEQ ID NO: 830945 - RNA, 19 nt, Homo sapiens
ucaagugucccacaaauga

SEQ ID NO: 830946 - RNA, 19 nt, Homo sapiens
uaacagacccggacauaca

SEQ ID NO: 830947 - RNA, 19 nt, Homo sapiens
ccugaugguucaagcaaua

SEQ ID NO: 830948 - RNA, 19 nt, Homo sapiens
uaacagcaguugagauucu

SEQ ID NO: 830949 - RNA, 19 nt, Homo sapiens
gaacacaugcucagaagag

SEQ ID NO: 830950 - RNA, 19 nt, Homo sapiens
caacagcuaaccaauuuga

SEQ ID NO: 830951 - RNA, 19 nt, Homo sapiens
agaaacaacuugccaacau

SEQ ID NO: 830952 - RNA, 19 nt, Homo sapiens
agacacagcugauaaacag

SEQ ID NO: 830953 - RNA, 19 nt, Homo sapiens
ccacggacauuacccugaa

SEQ ID NO: 830954 - RNA, 19 nt, Homo sapiens
gaccuguccuuguauaugu

SEQ ID NO: 830955 - RNA, 19 nt, Homo sapiens
uaacaaaccuugaucugua

SEQ ID NO: 830956 - RNA, 19 nt, Homo sapiens
gaucaucucuuucauaaug

SEQ ID NO: 830957 - RNA, 19 nt, Homo sapiens
gcaaugacaacuucuauua

SEQ ID NO: 830958 - RNA, 19 nt, Homo sapiens
ggacguggguucacuguuu

SEQ ID NO: 830959 - RNA, 19 nt, Homo sapiens
gaagauggaagcauaguua

SEQ ID NO: 830960 - RNA, 19 nt, Homo sapiens
ggacgauguuugaugauua

SEQ ID NO: 830961 - RNA, 19 nt, Homo sapiens
guacauagaccacgucaua

SEQ ID NO: 830962 - RNA, 19 nt, Homo sapiens
acaaagaccuauacaguuu

SEQ ID NO: 830963 - RNA, 19 nt, Homo sapiens
ggucaucucuaacuacuaa

SEQ ID NO: 830964 - RNA, 19 nt, Homo sapiens
gcacauggacgacuuguuu

SEQ ID NO: 830965 - RNA, 19 nt, Homo sapiens
gcucaucucuugcuuaaau

SEQ ID NO: 830966 - RNA, 19 nt, Homo sapiens
gaagcaagcuaccgcuauu

SEQ ID NO: 830967 - RNA, 19 nt, Homo sapiens
ggaagaaagugauccugaa

SEQ ID NO: 830968 - RNA, 19 nt, Homo sapiens
uaugugggcucucgauuua

SEQ ID NO: 830969 - RNA, 19 nt, Homo sapiens
ggaaauuacucaauccaau

SEQ ID NO: 830970 - RNA, 19 nt, Homo sapiens
gaauaucgguccagcaaau

SEQ ID NO: 830971 - RNA, 19 nt, Homo sapiens
cuagaccacuuucuucuua

SEQ ID NO: 830972 - RNA, 19 nt, Homo sapiens
ccacgaagguugagaacaa

SEQ ID NO: 830973 - RNA, 19 nt, Homo sapiens
gcaagaggcauuugauaaa

SEQ ID NO: 830974 - RNA, 19 nt, Homo sapiens
gguaaacucugcauuguca

SEQ ID NO: 830975 - RNA, 19 nt, Homo sapiens
agacauauguggcuucauu

SEQ ID NO: 830976 - RNA, 19 nt, Homo sapiens
gcguacaccuuuaauguuu

SEQ ID NO: 830977 - RNA, 19 nt, Homo sapiens
aaggaaagcuaauaaggua

SEQ ID NO: 830978 - RNA, 19 nt, Homo sapiens
ggugauugcuaggaaauua

SEQ ID NO: 830979 - RNA, 19 nt, Homo sapiens
gaacagccauugaucugau

SEQ ID NO: 830980 - RNA, 19 nt, Homo sapiens
gauaacagcaguugagauu

SEQ ID NO: 830981 - RNA, 19 nt, Homo sapiens
gaaggcaguugaaaauuua

SEQ ID NO: 830982 - RNA, 19 nt, Homo sapiens
cugaaggucuggauuguua

SEQ ID NO: 830983 - RNA, 19 nt, Homo sapiens
cagcaucaaucacuuguuu

SEQ ID NO: 830984 - RNA, 19 nt, Homo sapiens
cuagagaaauguaagguaa

SEQ ID NO: 830985 - RNA, 19 nt, Homo sapiens
cagauaaagucaucauuug

SEQ ID NO: 830986 - RNA, 19 nt, Homo sapiens
acuaauaucugcauucuug

SEQ ID NO: 830987 - RNA, 19 nt, Homo sapiens
gaagaaacaaagaccuaua

SEQ ID NO: 830988 - RNA, 19 nt, Homo sapiens
ggaagagcaugaccuuguu

SEQ ID NO: 830989 - RNA, 19 nt, Homo sapiens
gcaauaaagacaaaccuaa

SEQ ID NO: 830990 - RNA, 19 nt, Homo sapiens
ucuggaagguugaauauuu

SEQ ID NO: 830991 - RNA, 19 nt, Homo sapiens
cuugaaggaucuuuaguua

SEQ ID NO: 830992 - RNA, 19 nt, Homo sapiens
gcagauguauugaauuuac

SEQ ID NO: 830993 - RNA, 19 nt, Homo sapiens
uggcauagcuagagaaaug

SEQ ID NO: 830994 - RNA, 19 nt, Homo sapiens
uacaaacccuugcaacuaa

SEQ ID NO: 830995 - RNA, 19 nt, Homo sapiens
guaaugaaccucuuaaagu

SEQ ID NO: 830996 - RNA, 19 nt, Homo sapiens
gcagagaauauuuccauaa

SEQ ID NO: 830997 - RNA, 19 nt, Homo sapiens
gacuuugucucaucagaua

SEQ ID NO: 830998 - RNA, 19 nt, Homo sapiens
uggcagauguauugaauuu

SEQ ID NO: 830999 - RNA, 19 nt, Homo sapiens
gaaacaacuugccaacauc

SEQ ID NO: 831000 - RNA, 19 nt, Homo sapiens
gcaaggcacugacguuucu

SEQ ID NO: 831001 - RNA, 19 nt, Homo sapiens
ccucgaagcucuagccaaa

SEQ ID NO: 831002 - RNA, 19 nt, Homo sapiens
agaaagugauccugaauau

SEQ ID NO: 831003 - RNA, 19 nt, Homo sapiens
gaagaagggcuggcaauga

SEQ ID NO: 831004 - RNA, 19 nt, Homo sapiens
ggaaggcaguugaaaauuu

SEQ ID NO: 831005 - RNA, 19 nt, Homo sapiens
guucaggaguguauauaaa

SEQ ID NO: 831006 - RNA, 19 nt, Homo sapiens
ccaaagagguacacagaca

SEQ ID NO: 831007 - RNA, 19 nt, Homo sapiens
ucuaaacgcuugugaugaa

SEQ ID NO: 831008 - RNA, 19 nt, Homo sapiens
gcaggauacugagccaaua

SEQ ID NO: 831009 - RNA, 19 nt, Homo sapiens
gcacuguuguuuggucaua

SEQ ID NO: 831010 - RNA, 19 nt, Homo sapiens
ugaaagaaacgaucaaaga

SEQ ID NO: 831011 - RNA, 19 nt, Homo sapiens
gcaguucucuuccaacaag

SEQ ID NO: 831012 - RNA, 19 nt, Homo sapiens
ggaggaauccaaaccaauu

SEQ ID NO: 831013 - RNA, 19 nt, Homo sapiens
uaccagccuugaaguauua

SEQ ID NO: 831014 - RNA, 19 nt, Homo sapiens
gcauacaguucuaccaguu

SEQ ID NO: 831015 - RNA, 19 nt, Homo sapiens
gauggcagauguauugaau

SEQ ID NO: 831016 - RNA, 19 nt, Homo sapiens
caaacuucaucccagcuua

SEQ ID NO: 831017 - RNA, 19 nt, Homo sapiens
ugaacgugcuguuguguuu

SEQ ID NO: 831018 - RNA, 19 nt, Homo sapiens
gugcucaucucuugcuuaa

SEQ ID NO: 831019 - RNA, 19 nt, Homo sapiens
ugaaugaaguacuggauga

SEQ ID NO: 831020 - RNA, 19 nt, Homo sapiens
ugaaacauaucuucugugu

SEQ ID NO: 831021 - RNA, 19 nt, Homo sapiens
guacagcgagugaauuaaa

SEQ ID NO: 831022 - RNA, 19 nt, Homo sapiens
gguggacgauguuugauga

SEQ ID NO: 831023 - RNA, 19 nt, Homo sapiens
ggaaugaugagguaaaugu

SEQ ID NO: 831024 - RNA, 19 nt, Homo sapiens
gaaaagcgcccacacauug

SEQ ID NO: 831025 - RNA, 19 nt, Homo sapiens
gcuaccaccuucuuuauca

SEQ ID NO: 831026 - RNA, 19 nt, Homo sapiens
gcuaggaaauuacucaauc

SEQ ID NO: 831027 - RNA, 19 nt, Homo sapiens
gaaauuauugcccuuugaa

SEQ ID NO: 831028 - RNA, 19 nt, Homo sapiens
ugccugggcuccuuacuua

SEQ ID NO: 831029 - RNA, 19 nt, Homo sapiens
gaaaaugggcaaaguuaua

SEQ ID NO: 831030 - RNA, 19 nt, Homo sapiens
ccuaugaucuaguuaaugu

SEQ ID NO: 831031 - RNA, 19 nt, Homo sapiens
gggcaaaguuauauuuaca

SEQ ID NO: 831032 - RNA, 19 nt, Homo sapiens
ccuauacaguuuagacuuu

SEQ ID NO: 831033 - RNA, 19 nt, Homo sapiens
cggcaaaucuauacuguuc

SEQ ID NO: 831034 - RNA, 19 nt, Homo sapiens
aagaaacgaucaaagagaa

SEQ ID NO: 831035 - RNA, 19 nt, Homo sapiens
gauggaagcauaguuauug

SEQ ID NO: 831036 - RNA, 19 nt, Homo sapiens
ugauugaacucccugugua

SEQ ID NO: 831037 - RNA, 19 nt, Homo sapiens
gagguaaacucugcauugu

SEQ ID NO: 831038 - RNA, 19 nt, Homo sapiens
guaaauguauaccuuagca

SEQ ID NO: 831039 - RNA, 19 nt, Homo sapiens
gguucuagcucauaauaau

SEQ ID NO: 831040 - RNA, 19 nt, Homo sapiens
uaauucagccuucaaacua

SEQ ID NO: 831041 - RNA, 19 nt, Homo sapiens
gaaagaaacgaucaaagag

SEQ ID NO: 831042 - RNA, 19 nt, Homo sapiens
aaacaaagaccuauacagu

SEQ ID NO: 831043 - RNA, 19 nt, Homo sapiens
aaaguaggaucaaagucua

SEQ ID NO: 831044 - RNA, 19 nt, Homo sapiens
ucaagugucccacaaauga

SEQ ID NO: 831045 - RNA, 19 nt, Homo sapiens
uaacagacccggacauaca

SEQ ID NO: 831046 - RNA, 19 nt, Homo sapiens
ccugaugguucaagcaaua

SEQ ID NO: 831047 - RNA, 19 nt, Homo sapiens
uaacagcaguugagauucu

SEQ ID NO: 831048 - RNA, 19 nt, Homo sapiens
gaacacaugcucagaagag

SEQ ID NO: 831049 - RNA, 19 nt, Homo sapiens
caacagcuaaccaauuuga

SEQ ID NO: 831050 - RNA, 19 nt, Homo sapiens
agaaacaacuugccaacau

SEQ ID NO: 831051 - RNA, 19 nt, Homo sapiens
agacacagcugauaaacag

SEQ ID NO: 831052 - RNA, 19 nt, Homo sapiens
ccacggacauuacccugaa

SEQ ID NO: 831053 - RNA, 19 nt, Homo sapiens
gaccuguccuuguauaugu

SEQ ID NO: 831054 - RNA, 19 nt, Homo sapiens
gagguuauggacaucauua

SEQ ID NO: 831055 - RNA, 19 nt, Homo sapiens
ggaaauaucuuggaucuua

SEQ ID NO: 831056 - RNA, 19 nt, Homo sapiens
gaaagaaaguugauuggaa

SEQ ID NO: 831057 - RNA, 19 nt, Homo sapiens
cagcacagcuuucaagaua

SEQ ID NO: 831058 - RNA, 19 nt, Homo sapiens
gaaauaggcagacuguuua

SEQ ID NO: 831059 - RNA, 19 nt, Homo sapiens
gaacaaagccagaagagaa

SEQ ID NO: 831060 - RNA, 19 nt, Homo sapiens
ggaggugacugcuuuguaa

SEQ ID NO: 831061 - RNA, 19 nt, Homo sapiens
ccaaaggccuuaacuuauu

SEQ ID NO: 831062 - RNA, 19 nt, Homo sapiens
ggaaauaggcagacuguuu

SEQ ID NO: 831063 - RNA, 19 nt, Homo sapiens
gaaagaaacagaccagaaa

SEQ ID NO: 831064 - RNA, 19 nt, Homo sapiens
ggaggaagguuauggagaa

SEQ ID NO: 831065 - RNA, 19 nt, Homo sapiens
ggacugagcgaaugucaua

SEQ ID NO: 831066 - RNA, 19 nt, Homo sapiens
caaaugaacuagugauugu

SEQ ID NO: 831067 - RNA, 19 nt, Homo sapiens
ggagaugaauuucuauguu

SEQ ID NO: 831068 - RNA, 19 nt, Homo sapiens
gcucaagggugaaagauga

SEQ ID NO: 831069 - RNA, 19 nt, Homo sapiens
gcucggcacuguauucuaa

SEQ ID NO: 831070 - RNA, 19 nt, Homo sapiens
ggugaaagaugaauacaau

SEQ ID NO: 831071 - RNA, 19 nt, Homo sapiens
gcaaggauauuaaggaagu

SEQ ID NO: 831072 - RNA, 19 nt, Homo sapiens
gcuguagucuguugugaua

SEQ ID NO: 831073 - RNA, 19 nt, Homo sapiens
ccguaaagguuuccaguua

SEQ ID NO: 831074 - RNA, 19 nt, Homo sapiens
gggaagaauugacaaaguu

SEQ ID NO: 831075 - RNA, 19 nt, Homo sapiens
ccaguuaauucaugccuua

SEQ ID NO: 831076 - RNA, 19 nt, Homo sapiens
caaaggccuuaacuuauuu

SEQ ID NO: 831077 - RNA, 19 nt, Homo sapiens
gcucaugacuuguaaaugg

SEQ ID NO: 831078 - RNA, 19 nt, Homo sapiens
ggcacuaggucauuaagua

SEQ ID NO: 831079 - RNA, 19 nt, Homo sapiens
ggaaaugucacaagaaugu

SEQ ID NO: 831080 - RNA, 19 nt, Homo sapiens
ggaaggaacuggauaucuc

SEQ ID NO: 831081 - RNA, 19 nt, Homo sapiens
gaaaguugcccuccucuau

SEQ ID NO: 831082 - RNA, 19 nt, Homo sapiens
gagcaggccauguuugaua

SEQ ID NO: 831083 - RNA, 19 nt, Homo sapiens
gcaaggcgauuccaugaca

SEQ ID NO: 831084 - RNA, 19 nt, Homo sapiens
gaugugaacagguaauuaa

SEQ ID NO: 831085 - RNA, 19 nt, Homo sapiens
guauggaggugacugcuuu

SEQ ID NO: 831086 - RNA, 19 nt, Homo sapiens
agacauggcuugcaucugu

SEQ ID NO: 831087 - RNA, 19 nt, Homo sapiens
gagcaaaggucgucaacgu

SEQ ID NO: 831088 - RNA, 19 nt, Homo sapiens
ggaagaauugacaaaguua

SEQ ID NO: 831089 - RNA, 19 nt, Homo sapiens
ugacaaaguuagauaagga

SEQ ID NO: 831090 - RNA, 19 nt, Homo sapiens
gcaaggagcaggccauguu

SEQ ID NO: 831091 - RNA, 19 nt, Homo sapiens
gcaaagaugaggccaguga

SEQ ID NO: 831092 - RNA, 19 nt, Homo sapiens
gaaagcacacggucaaaug

SEQ ID NO: 831093 - RNA, 19 nt, Homo sapiens
agacagagaugugcugauu

SEQ ID NO: 831094 - RNA, 19 nt, Homo sapiens
gaagucaacgucucacaaa

SEQ ID NO: 831095 - RNA, 19 nt, Homo sapiens
agaaaguaauccagagaua

SEQ ID NO: 831096 - RNA, 19 nt, Homo sapiens
gagcgaaugucauaugaag

SEQ ID NO: 831097 - RNA, 19 nt, Homo sapiens
gaaacaaauccuaucacua

SEQ ID NO: 831098 - RNA, 19 nt, Homo sapiens
gagcaugcuucauuggauu

SEQ ID NO: 831099 - RNA, 19 nt, Homo sapiens
guaaagguuuccaguuaau

SEQ ID NO: 831100 - RNA, 19 nt, Homo sapiens
caagcuccauguccuuuaa

SEQ ID NO: 831101 - RNA, 19 nt, Homo sapiens
gcuagcuucuuucacauaa

SEQ ID NO: 831102 - RNA, 19 nt, Homo sapiens
ggucuucccucucagauuc

SEQ ID NO: 831103 - RNA, 19 nt, Homo sapiens
ggaauaacagucugagcua

SEQ ID NO: 831104 - RNA, 19 nt, Homo sapiens
gcacccaaacauuuaauuu

SEQ ID NO: 831105 - RNA, 19 nt, Homo sapiens
gagcuaaauucaucuuaag

SEQ ID NO: 831106 - RNA, 19 nt, Homo sapiens
uggaggagcccgugaguua

SEQ ID NO: 831107 - RNA, 19 nt, Homo sapiens
cguaaagguuuccaguuaa

SEQ ID NO: 831108 - RNA, 19 nt, Homo sapiens
ggucggugauuucagauga

SEQ ID NO: 831109 - RNA, 19 nt, Homo sapiens
gaaaacaucguuaccagua

SEQ ID NO: 831110 - RNA, 19 nt, Homo sapiens
gaagcgagacagagagaaa

SEQ ID NO: 831111 - RNA, 19 nt, Homo sapiens
aagcugaugugaacaggua

SEQ ID NO: 831112 - RNA, 19 nt, Homo sapiens
gcgcuucucugcaccuuau

SEQ ID NO: 831113 - RNA, 19 nt, Homo sapiens
gaggaggaauccaccauca

SEQ ID NO: 831114 - RNA, 19 nt, Homo sapiens
caagagaaaucaacuucgu

SEQ ID NO: 831115 - RNA, 19 nt, Homo sapiens
ggcagacuguuuauguuaa

SEQ ID NO: 831116 - RNA, 19 nt, Homo sapiens
aaaggucggugauuucaga

SEQ ID NO: 831117 - RNA, 19 nt, Homo sapiens
aaaccaacgucagaacuuu

SEQ ID NO: 831118 - RNA, 19 nt, Homo sapiens
ugucugggcucaugacuug

SEQ ID NO: 831119 - RNA, 19 nt, Homo sapiens
uguaaaguguagcaucaua

SEQ ID NO: 831120 - RNA, 19 nt, Homo sapiens
ggaaagaacaagcuagaag

SEQ ID NO: 831121 - RNA, 19 nt, Homo sapiens
agagagaggugccgauuag

SEQ ID NO: 831122 - RNA, 19 nt, Homo sapiens
gagagagaggugccgauua

SEQ ID NO: 831123 - RNA, 19 nt, Homo sapiens
ugaagacaaugaagagaau

SEQ ID NO: 831124 - RNA, 19 nt, Homo sapiens
gacagaaaccguagcagaa

SEQ ID NO: 831125 - RNA, 19 nt, Homo sapiens
ggagaaggcuaaggagaag

SEQ ID NO: 831126 - RNA, 19 nt, Homo sapiens
ugacugcuuuguaagguuu

SEQ ID NO: 831127 - RNA, 19 nt, Homo sapiens
gcacagcuuucaagauacu

SEQ ID NO: 831128 - RNA, 19 nt, Homo sapiens
gauaggcaccaccgaguuu

SEQ ID NO: 831129 - RNA, 19 nt, Homo sapiens
gaagaccggccucaguuug

SEQ ID NO: 831130 - RNA, 19 nt, Homo sapiens
gcaguuggugugagcuuua

SEQ ID NO: 831131 - RNA, 19 nt, Homo sapiens
uuacaaguauggacucaug

SEQ ID NO: 831132 - RNA, 19 nt, Homo sapiens
ccacuucuauuuacuuugg

SEQ ID NO: 831133 - RNA, 19 nt, Homo sapiens
aaacaugccgucagaauuc

SEQ ID NO: 831134 - RNA, 19 nt, Homo sapiens
gaacccacagucauugaaa

SEQ ID NO: 831135 - RNA, 19 nt, Homo sapiens
ccaagcagccucaggagaa

SEQ ID NO: 831136 - RNA, 19 nt, Homo sapiens
gagaaagccagcagaugaa

SEQ ID NO: 831137 - RNA, 19 nt, Homo sapiens
agagaaagccagcagauga

SEQ ID NO: 831138 - RNA, 19 nt, Homo sapiens
ucagcuguauuuccaguaa

SEQ ID NO: 831139 - RNA, 19 nt, Homo sapiens
caucuuaagacuugaauga

SEQ ID NO: 831140 - RNA, 19 nt, Homo sapiens
gccgauuagucuagaagua

SEQ ID NO: 831141 - RNA, 19 nt, Homo sapiens
ugauuggaauggcaaguuu

SEQ ID NO: 831142 - RNA, 19 nt, Homo sapiens
caggcuagcuucuuucaca

SEQ ID NO: 831143 - RNA, 19 nt, Homo sapiens
ucacagacauggcuugcau

SEQ ID NO: 831144 - RNA, 19 nt, Homo sapiens
gaaaguaauccagagauag

SEQ ID NO: 831145 - RNA, 19 nt, Homo sapiens
ggagagacgcggacaguag

SEQ ID NO: 831146 - RNA, 19 nt, Homo sapiens
uuaaggaggaggaagguua

SEQ ID NO: 831147 - RNA, 19 nt, Homo sapiens
aagcaaggauauuaaggaa

SEQ ID NO: 831148 - RNA, 19 nt, Homo sapiens
gccagcagaugaaggagaa

SEQ ID NO: 831149 - RNA, 19 nt, Homo sapiens
cagaaaccauccgaacaaa

SEQ ID NO: 831150 - RNA, 19 nt, Homo sapiens
cugcaaguuucaagaagua

SEQ ID NO: 831151 - RNA, 19 nt, Homo sapiens
gcacugguaggguagauga

SEQ ID NO: 831152 - RNA, 19 nt, Homo sapiens
cauggucaauuuccuuuau

SEQ ID NO: 831153 - RNA, 19 nt, Homo sapiens
uaaaauaccccacgaauuc

SEQ ID NO: 831154 - RNA, 19 nt, Homo sapiens
gaaggaggacacagaagga

SEQ ID NO: 831155 - RNA, 19 nt, Homo sapiens
ggaaauaucuuggaucuua

SEQ ID NO: 831156 - RNA, 19 nt, Homo sapiens
gaaaugacaucggguguua

SEQ ID NO: 831157 - RNA, 19 nt, Homo sapiens
gaaagaaaguugauuggaa

SEQ ID NO: 831158 - RNA, 19 nt, Homo sapiens
cagcacagcuuucaagaua

SEQ ID NO: 831159 - RNA, 19 nt, Homo sapiens
gaaauaggcagacuguuua

SEQ ID NO: 831160 - RNA, 19 nt, Homo sapiens
gaacaaagccagaagagaa

SEQ ID NO: 831161 - RNA, 19 nt, Homo sapiens
ggaaaccucugaacacauu

SEQ ID NO: 831162 - RNA, 19 nt, Homo sapiens
ggaggugacugcuuuguaa

SEQ ID NO: 831163 - RNA, 19 nt, Homo sapiens
ccaaaggccuuaacuuauu

SEQ ID NO: 831164 - RNA, 19 nt, Homo sapiens
ggaaauaggcagacuguuu

SEQ ID NO: 831165 - RNA, 19 nt, Homo sapiens
gaaagaaacagaccagaaa

SEQ ID NO: 831166 - RNA, 19 nt, Homo sapiens
ggaggaagguuauggagaa

SEQ ID NO: 831167 - RNA, 19 nt, Homo sapiens
ggacugagcgaaugucaua

SEQ ID NO: 831168 - RNA, 19 nt, Homo sapiens
caaaugaacuagugauugu

SEQ ID NO: 831169 - RNA, 19 nt, Homo sapiens
ggagaugaauuucuauguu

SEQ ID NO: 831170 - RNA, 19 nt, Homo sapiens
gcucaagggugaaagauga

SEQ ID NO: 831171 - RNA, 19 nt, Homo sapiens
gcucggcacuguauucuaa

SEQ ID NO: 831172 - RNA, 19 nt, Homo sapiens
ggugaaagaugaauacaau

SEQ ID NO: 831173 - RNA, 19 nt, Homo sapiens
gcaaggauauuaaggaagu

SEQ ID NO: 831174 - RNA, 19 nt, Homo sapiens
gcuguagucuguugugaua

SEQ ID NO: 831175 - RNA, 19 nt, Homo sapiens
ccguaaagguuuccaguua

SEQ ID NO: 831176 - RNA, 19 nt, Homo sapiens
gggaagaauugacaaaguu

SEQ ID NO: 831177 - RNA, 19 nt, Homo sapiens
ccaguuaauucaugccuua

SEQ ID NO: 831178 - RNA, 19 nt, Homo sapiens
caaaggccuuaacuuauuu

SEQ ID NO: 831179 - RNA, 19 nt, Homo sapiens
gcucaugacuuguaaaugg

SEQ ID NO: 831180 - RNA, 19 nt, Homo sapiens
ggcacuaggucauuaagua

SEQ ID NO: 831181 - RNA, 19 nt, Homo sapiens
ggaaaugucacaagaaugu

SEQ ID NO: 831182 - RNA, 19 nt, Homo sapiens
ggaaggaacuggauaucuc

SEQ ID NO: 831183 - RNA, 19 nt, Homo sapiens
gaaaguugcccuccucuau

SEQ ID NO: 831184 - RNA, 19 nt, Homo sapiens
gacaaaccguuaugacuga

SEQ ID NO: 831185 - RNA, 19 nt, Homo sapiens
gagcaggccauguuugaua

SEQ ID NO: 831186 - RNA, 19 nt, Homo sapiens
gcaaggcgauuccaugaca

SEQ ID NO: 831187 - RNA, 19 nt, Homo sapiens
gaugugaacagguaauuaa

SEQ ID NO: 831188 - RNA, 19 nt, Homo sapiens
guauggaggugacugcuuu

SEQ ID NO: 831189 - RNA, 19 nt, Homo sapiens
agacauggcuugcaucugu

SEQ ID NO: 831190 - RNA, 19 nt, Homo sapiens
ggagagggcucagcagaug

SEQ ID NO: 831191 - RNA, 19 nt, Homo sapiens
guucacagcuccacuuuca

SEQ ID NO: 831192 - RNA, 19 nt, Homo sapiens
gagcaaaggucgucaacgu

SEQ ID NO: 831193 - RNA, 19 nt, Homo sapiens
ggaagaauugacaaaguua

SEQ ID NO: 831194 - RNA, 19 nt, Homo sapiens
gguguuagcagauccuuua

SEQ ID NO: 831195 - RNA, 19 nt, Homo sapiens
cagggaagguuggugauua

SEQ ID NO: 831196 - RNA, 19 nt, Homo sapiens
ugacaaaguuagauaagga

SEQ ID NO: 831197 - RNA, 19 nt, Homo sapiens
gcaaggagcaggccauguu

SEQ ID NO: 831198 - RNA, 19 nt, Homo sapiens
gcaaagaugaggccaguga

SEQ ID NO: 831199 - RNA, 19 nt, Homo sapiens
gaaagcacacggucaaaug

SEQ ID NO: 831200 - RNA, 19 nt, Homo sapiens
agacagagaugugcugauu

SEQ ID NO: 831201 - RNA, 19 nt, Homo sapiens
gaagucaacgucucacaaa

SEQ ID NO: 831202 - RNA, 19 nt, Homo sapiens
agaaaguaauccagagaua

SEQ ID NO: 831203 - RNA, 19 nt, Homo sapiens
gagcgaaugucauaugaag

SEQ ID NO: 831204 - RNA, 19 nt, Homo sapiens
gaaacaaauccuaucacua

SEQ ID NO: 831205 - RNA, 19 nt, Homo sapiens
gagcaugcuucauuggauu

SEQ ID NO: 831206 - RNA, 19 nt, Homo sapiens
guaaagguuuccaguuaau

SEQ ID NO: 831207 - RNA, 19 nt, Homo sapiens
gaaaagagcaccuuccaaa

SEQ ID NO: 831208 - RNA, 19 nt, Homo sapiens
caagcuccauguccuuuaa

SEQ ID NO: 831209 - RNA, 19 nt, Homo sapiens
gcuagcuucuuucacauaa

SEQ ID NO: 831210 - RNA, 19 nt, Homo sapiens
ggucuucccucucagauuc

SEQ ID NO: 831211 - RNA, 19 nt, Homo sapiens
ggaauaacagucugagcua

SEQ ID NO: 831212 - RNA, 19 nt, Homo sapiens
gcacccaaacauuuaauuu

SEQ ID NO: 831213 - RNA, 19 nt, Homo sapiens
gagcuaaauucaucuuaag

SEQ ID NO: 831214 - RNA, 19 nt, Homo sapiens
uggaggagcccgugaguua

SEQ ID NO: 831215 - RNA, 19 nt, Homo sapiens
cguaaagguuuccaguuaa

SEQ ID NO: 831216 - RNA, 19 nt, Homo sapiens
gaagguuggugauuauuuu

SEQ ID NO: 831217 - RNA, 19 nt, Homo sapiens
ggucggugauuucagauga

SEQ ID NO: 831218 - RNA, 19 nt, Homo sapiens
gaaaacaucguuaccagua

SEQ ID NO: 831219 - RNA, 19 nt, Homo sapiens
gaagcgagacagagagaaa

SEQ ID NO: 831220 - RNA, 19 nt, Homo sapiens
aagcugaugugaacaggua

SEQ ID NO: 831221 - RNA, 19 nt, Homo sapiens
gcgcuucucugcaccuuau

SEQ ID NO: 831222 - RNA, 19 nt, Homo sapiens
ggaagguuggugauuauuu

SEQ ID NO: 831223 - RNA, 19 nt, Homo sapiens
gaggaggaauccaccauca

SEQ ID NO: 831224 - RNA, 19 nt, Homo sapiens
caagagaaaucaacuucgu

SEQ ID NO: 831225 - RNA, 19 nt, Homo sapiens
ggcagacuguuuauguuaa

SEQ ID NO: 831226 - RNA, 19 nt, Homo sapiens
aaaggucggugauuucaga

SEQ ID NO: 831227 - RNA, 19 nt, Homo sapiens
aaaccaacgucagaacuuu

SEQ ID NO: 831228 - RNA, 19 nt, Homo sapiens
ugucugggcucaugacuug

SEQ ID NO: 831229 - RNA, 19 nt, Homo sapiens
uguaaaguguagcaucaua

SEQ ID NO: 831230 - RNA, 19 nt, Homo sapiens
ccacccagcagauaguuua

SEQ ID NO: 831231 - RNA, 19 nt, Homo sapiens
ggaaagaacaagcuagaag

SEQ ID NO: 831232 - RNA, 19 nt, Homo sapiens
agagagaggugccgauuag

SEQ ID NO: 831233 - RNA, 19 nt, Homo sapiens
gagagagaggugccgauua

SEQ ID NO: 831234 - RNA, 19 nt, Homo sapiens
ugaagacaaugaagagaau

SEQ ID NO: 831235 - RNA, 19 nt, Homo sapiens
gacagaaaccguagcagaa

SEQ ID NO: 831236 - RNA, 19 nt, Homo sapiens
ggagaaggcuaaggagaag

SEQ ID NO: 831237 - RNA, 19 nt, Homo sapiens
ugacugcuuuguaagguuu

SEQ ID NO: 831238 - RNA, 19 nt, Homo sapiens
gcacagcuuucaagauacu

SEQ ID NO: 831239 - RNA, 19 nt, Homo sapiens
gauaggcaccaccgaguuu

SEQ ID NO: 831240 - RNA, 19 nt, Homo sapiens
gcaguuggugugagcuuua

SEQ ID NO: 831241 - RNA, 19 nt, Homo sapiens
gaagaccggccucaguuug

SEQ ID NO: 831242 - RNA, 19 nt, Homo sapiens
uuacaaguauggacucaug

SEQ ID NO: 831243 - RNA, 19 nt, Homo sapiens
ccacuucuauuuacuuugg

SEQ ID NO: 831244 - RNA, 19 nt, Homo sapiens
gcaccagggcccaaagaaa

SEQ ID NO: 831245 - RNA, 19 nt, Homo sapiens
gaacccacagucauugaaa

SEQ ID NO: 831246 - RNA, 19 nt, Homo sapiens
ccaagcagccucaggagaa

SEQ ID NO: 831247 - RNA, 19 nt, Homo sapiens
aaacaugccgucagaauuc

SEQ ID NO: 831248 - RNA, 19 nt, Homo sapiens
gagaaagccagcagaugaa

SEQ ID NO: 831249 - RNA, 19 nt, Homo sapiens
agagaaagccagcagauga

SEQ ID NO: 831250 - RNA, 19 nt, Homo sapiens
ucagcuguauuuccaguaa

SEQ ID NO: 831251 - RNA, 19 nt, Homo sapiens
caucuuaagacuugaauga

SEQ ID NO: 831252 - RNA, 19 nt, Homo sapiens
gccgauuagucuagaagua

SEQ ID NO: 831253 - RNA, 19 nt, Homo sapiens
gaaaguaauccagagauag

SEQ ID NO: 831254 - RNA, 19 nt, Homo sapiens
ugauuggaauggcaaguuu

SEQ ID NO: 831255 - RNA, 19 nt, Homo sapiens
guaaugagcccacaucuga

SEQ ID NO: 831256 - RNA, 19 nt, Homo sapiens
ggaaaugcggacuauauua

SEQ ID NO: 831257 - RNA, 19 nt, Homo sapiens
ggagcaagauggaagagaa

SEQ ID NO: 831258 - RNA, 19 nt, Homo sapiens
guacuggccuccuaacuca

SEQ ID NO: 831259 - RNA, 19 nt, Homo sapiens
ucaccaagaucucgcauau

SEQ ID NO: 831260 - RNA, 19 nt, Homo sapiens
gagauggucuucugugaca

SEQ ID NO: 831261 - RNA, 19 nt, Homo sapiens
gcaacgagauggucuucug

SEQ ID NO: 831262 - RNA, 19 nt, Homo sapiens
gaaaugcggacuauauuag

SEQ ID NO: 831263 - RNA, 19 nt, Homo sapiens
gaaacacgccaucugcaaa

SEQ ID NO: 831264 - RNA, 19 nt, Homo sapiens
ugacucagauguccaagug

SEQ ID NO: 831265 - RNA, 19 nt, Homo sapiens
gauggcaccuucuucaaca

SEQ ID NO: 831266 - RNA, 19 nt, Homo sapiens
gaacgaaacacgccaucug

SEQ ID NO: 831267 - RNA, 19 nt, Homo sapiens
gcaccugcauccaguguuc

SEQ ID NO: 831268 - RNA, 19 nt, Homo sapiens
ccaaggaaguauaauaaac

SEQ ID NO: 831269 - RNA, 19 nt, Homo sapiens
caagcaagguggacaagag

SEQ ID NO: 831270 - RNA, 19 nt, Homo sapiens
gcagaugaaacuuauugaa

SEQ ID NO: 831271 - RNA, 19 nt, Homo sapiens
uggacgagcugacauuaga

SEQ ID NO: 831272 - RNA, 19 nt, Homo sapiens
gugcuggccuaggacauua

SEQ ID NO: 831273 - RNA, 19 nt, Homo sapiens
cagcaagcccuaagccuuu

SEQ ID NO: 831274 - RNA, 19 nt, Homo sapiens
gaagaucccggacucauac

SEQ ID NO: 831275 - RNA, 19 nt, Homo sapiens
ucggacaucuucucacuug

SEQ ID NO: 831276 - RNA, 19 nt, Homo sapiens
caagguaacccggagauug

SEQ ID NO: 831277 - RNA, 19 nt, Homo sapiens
acuggaagcugaagaggaa

SEQ ID NO: 831278 - RNA, 19 nt, Homo sapiens
auucuacacuguugucuuu

SEQ ID NO: 831279 - RNA, 19 nt, Homo sapiens
gaucacagcagagaacaug

SEQ ID NO: 831280 - RNA, 19 nt, Homo sapiens
gaaacuuauugaacaggau

SEQ ID NO: 831281 - RNA, 19 nt, Homo sapiens
ugaagaucccggacucaua

SEQ ID NO: 831282 - RNA, 19 nt, Homo sapiens
acucggagcuuaaggagau

SEQ ID NO: 831283 - RNA, 19 nt, Homo sapiens
gaugaaacuuauugaacag

SEQ ID NO: 831284 - RNA, 19 nt, Homo sapiens
gcuaugacuuggacgagau

SEQ ID NO: 831285 - RNA, 19 nt, Homo sapiens
gacugucguuugggcauua

SEQ ID NO: 831286 - RNA, 19 nt, Homo sapiens
uuagaaaucugugcuacau

SEQ ID NO: 831287 - RNA, 19 nt, Homo sapiens
gauggcuacuucucugaug

SEQ ID NO: 831288 - RNA, 19 nt, Homo sapiens
caucagcagugacaacucu

SEQ ID NO: 831289 - RNA, 19 nt, Homo sapiens
caucgcaguuggaggcuau

SEQ ID NO: 831290 - RNA, 19 nt, Homo sapiens
acgaugaggucaaguucaa

SEQ ID NO: 831291 - RNA, 19 nt, Homo sapiens
uauauuagcagacaacgau

SEQ ID NO: 831292 - RNA, 19 nt, Homo sapiens
ggacuauauuagcagacaa

SEQ ID NO: 831293 - RNA, 19 nt, Homo sapiens
gggcagccgcuaugacuug

SEQ ID NO: 831294 - RNA, 19 nt, Homo sapiens
cuagagaggguuagaaauc

SEQ ID NO: 831295 - RNA, 19 nt, Homo sapiens
ccucugugcuggccuagga

SEQ ID NO: 831296 - RNA, 19 nt, Homo sapiens
caugucagcugugcccuau

SEQ ID NO: 831297 - RNA, 19 nt, Homo sapiens
cuccagggcugcugucaga

SEQ ID NO: 831298 - RNA, 19 nt, Homo sapiens
cgacaggaaugggagaaag

SEQ ID NO: 831299 - RNA, 19 nt, Homo sapiens
ugagacugauggcuacuuc

SEQ ID NO: 831300 - RNA, 19 nt, Homo sapiens
gaagagaagaggcgaaaau

SEQ ID NO: 831301 - RNA, 19 nt, Homo sapiens
cgaaacacgccaucugcaa

SEQ ID NO: 831302 - RNA, 19 nt, Homo sapiens
agacaacgaugaggucaag

SEQ ID NO: 831303 - RNA, 19 nt, Homo sapiens
gcuacgggauccucaaggu

SEQ ID NO: 831304 - RNA, 19 nt, Homo sapiens
caccugcagaugaaacuua

SEQ ID NO: 831305 - RNA, 19 nt, Homo sapiens
ggaccaagugggugcaugu

SEQ ID NO: 831306 - RNA, 19 nt, Homo sapiens
ggcuggagcucaucaacuc

SEQ ID NO: 831307 - RNA, 19 nt, Homo sapiens
gagagaguuuugaauucua

SEQ ID NO: 831308 - RNA, 19 nt, Homo sapiens
gcagaucacagcagagaac

SEQ ID NO: 831309 - RNA, 19 nt, Homo sapiens
uagagaggguuagaaaucu

SEQ ID NO: 831310 - RNA, 19 nt, Homo sapiens
caacgaugaggucaaguuc

SEQ ID NO: 831311 - RNA, 19 nt, Homo sapiens
gcuggacgagcugacauua

SEQ ID NO: 831312 - RNA, 19 nt, Homo sapiens
ggaaagccaaugccaacca

SEQ ID NO: 831313 - RNA, 19 nt, Homo sapiens
gaggucaaguucaagucau

SEQ ID NO: 831314 - RNA, 19 nt, Homo sapiens
cagcugugcccuauggauu

SEQ ID NO: 831315 - RNA, 19 nt, Homo sapiens
cucaucaacucggagcuua

SEQ ID NO: 831316 - RNA, 19 nt, Homo sapiens
gagcgacucagauguagag

SEQ ID NO: 831317 - RNA, 19 nt, Homo sapiens
uggaaaugcggacuauauu

SEQ ID NO: 831318 - RNA, 19 nt, Homo sapiens
guuugggcauuauuucaug

SEQ ID NO: 831319 - RNA, 19 nt, Homo sapiens
ggacgacuccagacaaagc

SEQ ID NO: 831320 - RNA, 19 nt, Homo sapiens
acggacgacuccagacaaa

SEQ ID NO: 831321 - RNA, 19 nt, Homo sapiens
gcacuggucgacuucaucu

SEQ ID NO: 831322 - RNA, 19 nt, Homo sapiens
cuggaaaugcggacuauau

SEQ ID NO: 831323 - RNA, 19 nt, Homo sapiens
ugucagcugugcccuaugg

SEQ ID NO: 831324 - RNA, 19 nt, Homo sapiens
acgagauggucuucuguga

SEQ ID NO: 831325 - RNA, 19 nt, Homo sapiens
gcaagguaacccggagauu

SEQ ID NO: 831326 - RNA, 19 nt, Homo sapiens
cagaugaaacuuauugaac

SEQ ID NO: 831327 - RNA, 19 nt, Homo sapiens
gaguagcguccauggaguu

SEQ ID NO: 831328 - RNA, 19 nt, Homo sapiens
gauccucccaccacuggaa

SEQ ID NO: 831329 - RNA, 19 nt, Homo sapiens
caaggaaguauaauaaacg

SEQ ID NO: 831330 - RNA, 19 nt, Homo sapiens
gcaagcaagguggacaaga

SEQ ID NO: 831331 - RNA, 19 nt, Homo sapiens
acuguugucuuuccucugu

SEQ ID NO: 831332 - RNA, 19 nt, Homo sapiens
gauauuccaccugcagaug

SEQ ID NO: 831333 - RNA, 19 nt, Homo sapiens
auacccagccagagucuaa

SEQ ID NO: 831334 - RNA, 19 nt, Homo sapiens
ccaaggucagccugcauuu

SEQ ID NO: 831335 - RNA, 19 nt, Homo sapiens
ggucaagggccaccuacca

SEQ ID NO: 831336 - RNA, 19 nt, Homo sapiens
gugcagaucacagcagaga

SEQ ID NO: 831337 - RNA, 19 nt, Homo sapiens
ugacaaggcgcgagagaac

SEQ ID NO: 831338 - RNA, 19 nt, Homo sapiens
gaugaggucaaguucaagu

SEQ ID NO: 831339 - RNA, 19 nt, Homo sapiens
uccagucucugcugagugu

SEQ ID NO: 831340 - RNA, 19 nt, Homo sapiens
gggcguacuggccuccuaa

SEQ ID NO: 831341 - RNA, 19 nt, Homo sapiens
gcucagcccggaugacuac

SEQ ID NO: 831342 - RNA, 19 nt, Homo sapiens
cgucggacaucuucucacu

SEQ ID NO: 831343 - RNA, 19 nt, Homo sapiens
aggagacacugcucagcuu

SEQ ID NO: 831344 - RNA, 19 nt, Homo sapiens
cugcagaugaaacuuauug

SEQ ID NO: 831345 - RNA, 19 nt, Homo sapiens
ggaccuagagaggguuaga

SEQ ID NO: 831346 - RNA, 19 nt, Homo sapiens
uuugaauucuacacuguug

SEQ ID NO: 831347 - RNA, 19 nt, Homo sapiens
uauuccaccugcagaugaa

SEQ ID NO: 831348 - RNA, 19 nt, Homo sapiens
cugaggcacuggucgacuu

SEQ ID NO: 831349 - RNA, 19 nt, Homo sapiens
gcagcuagaggaggacuuc

SEQ ID NO: 831350 - RNA, 19 nt, Homo sapiens
accaagaucucgcauaucc

SEQ ID NO: 831351 - RNA, 19 nt, Homo sapiens
gcgaggaggagccuugaag

SEQ ID NO: 831352 - RNA, 19 nt, Homo sapiens
ugacaagugcaacgucugu

SEQ ID NO: 831353 - RNA, 19 nt, Homo sapiens
caacgagauggucuucugu

SEQ ID NO: 831354 - RNA, 19 nt, Homo sapiens
guacgacgaggauguuguc

SEQ ID NO: 831355 - RNA, 19 nt, Homo sapiens
gguauuagcuuaugccaaa

SEQ ID NO: 831356 - RNA, 19 nt, Homo sapiens
cgacaaggauccagauaaa

SEQ ID NO: 831357 - RNA, 19 nt, Homo sapiens
guacuuggauucaucagaa

SEQ ID NO: 831358 - RNA, 19 nt, Homo sapiens
gccacuggaucuuacauua

SEQ ID NO: 831359 - RNA, 19 nt, Homo sapiens
gaacuuaaucugguacuuu

SEQ ID NO: 831360 - RNA, 19 nt, Homo sapiens
gcuagagguugaagucuuu

SEQ ID NO: 831361 - RNA, 19 nt, Homo sapiens
gccaagagcuagagguuga

SEQ ID NO: 831362 - RNA, 19 nt, Homo sapiens
gaccugagcuggcuguuuc

SEQ ID NO: 831363 - RNA, 19 nt, Homo sapiens
gguaugaccugauggacaa

SEQ ID NO: 831364 - RNA, 19 nt, Homo sapiens
gccagucucuugucacuuu

SEQ ID NO: 831365 - RNA, 19 nt, Homo sapiens
ccaagcaccucagcccuua

SEQ ID NO: 831366 - RNA, 19 nt, Homo sapiens
ugaccaaccugcuggauau

SEQ ID NO: 831367 - RNA, 19 nt, Homo sapiens
ccucaacccuguccugaaa

SEQ ID NO: 831368 - RNA, 19 nt, Homo sapiens
gcugcuaacucacugacua

SEQ ID NO: 831369 - RNA, 19 nt, Homo sapiens
gacccugaguccugaauuu

SEQ ID NO: 831370 - RNA, 19 nt, Homo sapiens
uagcagugguauuagcuua

SEQ ID NO: 831371 - RNA, 19 nt, Homo sapiens
cccgucagcugccaucuua

SEQ ID NO: 831372 - RNA, 19 nt, Homo sapiens
guacuacagugaagaacga

SEQ ID NO: 831373 - RNA, 19 nt, Homo sapiens
ggaugagagugccuccuuu

SEQ ID NO: 831374 - RNA, 19 nt, Homo sapiens
cugaauggcucaauaagau

SEQ ID NO: 831375 - RNA, 19 nt, Homo sapiens
ggacagggaugaccaaccu

SEQ ID NO: 831376 - RNA, 19 nt, Homo sapiens
gaaaagccauugcgcauca

SEQ ID NO: 831377 - RNA, 19 nt, Homo sapiens
ccaaagagaagaaccguau

SEQ ID NO: 831378 - RNA, 19 nt, Homo sapiens
cacuggaucuuacauuaaa

SEQ ID NO: 831379 - RNA, 19 nt, Homo sapiens
aaauacagcuuuggaagga

SEQ ID NO: 831380 - RNA, 19 nt, Homo sapiens
cuucagcccuuucaccuaa

SEQ ID NO: 831381 - RNA, 19 nt, Homo sapiens
gcagauugauguggaagug

SEQ ID NO: 831382 - RNA, 19 nt, Homo sapiens
gcccugcuauccaucuaua

SEQ ID NO: 831383 - RNA, 19 nt, Homo sapiens
ggaugucucugucaagucu

SEQ ID NO: 831384 - RNA, 19 nt, Homo sapiens
gcagugguauuagcuuaug

SEQ ID NO: 831385 - RNA, 19 nt, Homo sapiens
uaggugaugugcagauuga

SEQ ID NO: 831386 - RNA, 19 nt, Homo sapiens
gcaggugaauaguuugauc

SEQ ID NO: 831387 - RNA, 19 nt, Homo sapiens
gguccaaacuccagacucu

SEQ ID NO: 831388 - RNA, 19 nt, Homo sapiens
uagaauggcugucacuuuu

SEQ ID NO: 831389 - RNA, 19 nt, Homo sapiens
ucccacugcugcugaguua

SEQ ID NO: 831390 - RNA, 19 nt, Homo sapiens
gaugauugguucccucuac

SEQ ID NO: 831391 - RNA, 19 nt, Homo sapiens
acaaggauccagauaaaga

SEQ ID NO: 831392 - RNA, 19 nt, Homo sapiens
ccacuggaucuuacauuaa

SEQ ID NO: 831393 - RNA, 19 nt, Homo sapiens
ggacaaggaugauuuucug

SEQ ID NO: 831394 - RNA, 19 nt, Homo sapiens
uuaacuagauggucaccuu

SEQ ID NO: 831395 - RNA, 19 nt, Homo sapiens
ggauguagggaagguguua

SEQ ID NO: 831396 - RNA, 19 nt, Homo sapiens
ggacguggacagugagaau

SEQ ID NO: 831397 - RNA, 19 nt, Homo sapiens
gggcaagucagacccauau

SEQ ID NO: 831398 - RNA, 19 nt, Homo sapiens
aacaguggcuuccuugaug

SEQ ID NO: 831399 - RNA, 19 nt, Homo sapiens
ccaagacuauuucgcaaac

SEQ ID NO: 831400 - RNA, 19 nt, Homo sapiens
uggcggugcugacuucauu

SEQ ID NO: 831401 - RNA, 19 nt, Homo sapiens
ucaugaggauccuguacuu

SEQ ID NO: 831402 - RNA, 19 nt, Homo sapiens
cagcagcucugguccaaac

SEQ ID NO: 831403 - RNA, 19 nt, Homo sapiens
ggagcucgaugugcaagug

SEQ ID NO: 831404 - RNA, 19 nt, Homo sapiens
acaaggaacccaacccuau

SEQ ID NO: 831405 - RNA, 19 nt, Homo sapiens
ucccagagguggcacaaug

SEQ ID NO: 831406 - RNA, 19 nt, Homo sapiens
gaagaacucaacccacagu

SEQ ID NO: 831407 - RNA, 19 nt, Homo sapiens
ugaguuccaaggacaaaua

SEQ ID NO: 831408 - RNA, 19 nt, Homo sapiens
ggacuugaacaucagcuau

SEQ ID NO: 831409 - RNA, 19 nt, Homo sapiens
ccaagugccuaggcugcua

SEQ ID NO: 831410 - RNA, 19 nt, Homo sapiens
gcuccuagcuggugauacg

SEQ ID NO: 831411 - RNA, 19 nt, Homo sapiens
ucuaauuccuccuucaugu

SEQ ID NO: 831412 - RNA, 19 nt, Homo sapiens
gcugaauggcucaauaaga

SEQ ID NO: 831413 - RNA, 19 nt, Homo sapiens
gcacggccuuuauccuucu

SEQ ID NO: 831414 - RNA, 19 nt, Homo sapiens
ggaacccaacccuauggua

SEQ ID NO: 831415 - RNA, 19 nt, Homo sapiens
gaaacuggagcagguucua

SEQ ID NO: 831416 - RNA, 19 nt, Homo sapiens
gccaagccacuggaucuua

SEQ ID NO: 831417 - RNA, 19 nt, Homo sapiens
ugaaacugacucuguggua

SEQ ID NO: 831418 - RNA, 19 nt, Homo sapiens
cuagaauggcugucacuuu

SEQ ID NO: 831419 - RNA, 19 nt, Homo sapiens
ugccugaccuucaagaugu

SEQ ID NO: 831420 - RNA, 19 nt, Homo sapiens
gauacuggagccacucauu

SEQ ID NO: 831421 - RNA, 19 nt, Homo sapiens
gcgcaucauuggagucaag

SEQ ID NO: 831422 - RNA, 19 nt, Homo sapiens
ucaaugugaugagccuaaa

SEQ ID NO: 831423 - RNA, 19 nt, Homo sapiens
gaugaggcccagagacgaa

SEQ ID NO: 831424 - RNA, 19 nt, Homo sapiens
ccugaguccugaauuuaau

SEQ ID NO: 831425 - RNA, 19 nt, Homo sapiens
cggcagcgccuaacacaug

SEQ ID NO: 831426 - RNA, 19 nt, Homo sapiens
caccucagcccuuaugcua

SEQ ID NO: 831427 - RNA, 19 nt, Homo sapiens
ccaaacuccagacucuaua

SEQ ID NO: 831428 - RNA, 19 nt, Homo sapiens
caaggaacccaacccuaug

SEQ ID NO: 831429 - RNA, 19 nt, Homo sapiens
auguggaagugaagaaaua

SEQ ID NO: 831430 - RNA, 19 nt, Homo sapiens
ccaagccacuggaucuuac

SEQ ID NO: 831431 - RNA, 19 nt, Homo sapiens
ugccuaggcugcuaacuca

SEQ ID NO: 831432 - RNA, 19 nt, Homo sapiens
gcagaaugaagcuggaugu

SEQ ID NO: 831433 - RNA, 19 nt, Homo sapiens
cugcuggacuugaacauca

SEQ ID NO: 831434 - RNA, 19 nt, Homo sapiens
acuagaacuuaaucuggua

SEQ ID NO: 831435 - RNA, 19 nt, Homo sapiens
gaaagaacggagccuucga

SEQ ID NO: 831436 - RNA, 19 nt, Homo sapiens
gcaaagccagacccagguu

SEQ ID NO: 831437 - RNA, 19 nt, Homo sapiens
ugguacaacugucaauuca

SEQ ID NO: 831438 - RNA, 19 nt, Homo sapiens
cagcugccaucuuaguugu

SEQ ID NO: 831439 - RNA, 19 nt, Homo sapiens
gcagcuacauggcguuuug

SEQ ID NO: 831440 - RNA, 19 nt, Homo sapiens
gaggacgcguggauucuac

SEQ ID NO: 831441 - RNA, 19 nt, Homo sapiens
ggaccugagcuggcuguuu

SEQ ID NO: 831442 - RNA, 19 nt, Homo sapiens
ucaccuaacaggcccauau

SEQ ID NO: 831443 - RNA, 19 nt, Homo sapiens
gaaagcuggaugucucugu

SEQ ID NO: 831444 - RNA, 19 nt, Homo sapiens
ggucagcauuguucauggu

SEQ ID NO: 831445 - RNA, 19 nt, Homo sapiens
acacugagagccuagaguu

SEQ ID NO: 831446 - RNA, 19 nt, Homo sapiens
agauugauguggaagugaa

SEQ ID NO: 831447 - RNA, 19 nt, Homo sapiens
aaggcugaauggcucaaua

SEQ ID NO: 831448 - RNA, 19 nt, Homo sapiens
gccaguauauggagaagcu

SEQ ID NO: 831449 - RNA, 19 nt, Homo sapiens
gcugugagccucuuagacu

SEQ ID NO: 831450 - RNA, 19 nt, Homo sapiens
gaauuuaaugaacgguuug

SEQ ID NO: 831451 - RNA, 19 nt, Homo sapiens
gaccgcugguuuacacuca

SEQ ID NO: 831452 - RNA, 19 nt, Homo sapiens
gaugagagugccuccuuuc

SEQ ID NO: 831453 - RNA, 19 nt, Homo sapiens
cgaaaacucucuauaugag

SEQ ID NO: 831454 - RNA, 19 nt, Homo sapiens
ccacugcugcugaguuaga

SEQ ID NO: 831455 - RNA, 19 nt, Homo sapiens
gaugauaucuccauucuua

SEQ ID NO: 831456 - RNA, 19 nt, Homo sapiens
gcaaauaggugaaagauug

SEQ ID NO: 831457 - RNA, 19 nt, Homo sapiens
gaaaggagcuuacagaaau

SEQ ID NO: 831458 - RNA, 19 nt, Homo sapiens
gaagaaaucugguuugaga

SEQ ID NO: 831459 - RNA, 19 nt, Homo sapiens
ggaauuagaugcagcagua

SEQ ID NO: 831460 - RNA, 19 nt, Homo sapiens
ggaaaugucugaagaaaug

SEQ ID NO: 831461 - RNA, 19 nt, Homo sapiens
cagcauggcuccagauuua

SEQ ID NO: 831462 - RNA, 19 nt, Homo sapiens
gaagaacguuuauuuguug

SEQ ID NO: 831463 - RNA, 19 nt, Homo sapiens
ucacaugguuggacaauua

SEQ ID NO: 831464 - RNA, 19 nt, Homo sapiens
gaaaguaagcguagugaua

SEQ ID NO: 831465 - RNA, 19 nt, Homo sapiens
ggagagugcuggcuaagua

SEQ ID NO: 831466 - RNA, 19 nt, Homo sapiens
cauaugaucuugacuguaa

SEQ ID NO: 831467 - RNA, 19 nt, Homo sapiens
gcagaucgcuucuuugaau

SEQ ID NO: 831468 - RNA, 19 nt, Homo sapiens
ccaaagaaauugacaguga

SEQ ID NO: 831469 - RNA, 19 nt, Homo sapiens
gaagacgucucuagcauug

SEQ ID NO: 831470 - RNA, 19 nt, Homo sapiens
gaaauugucccuauugauu

SEQ ID NO: 831471 - RNA, 19 nt, Homo sapiens
ggaaagauaccauaagaaa

SEQ ID NO: 831472 - RNA, 19 nt, Homo sapiens
gaaaucaucuguucugagu

SEQ ID NO: 831473 - RNA, 19 nt, Homo sapiens
uaaaugagcuuggauauag

SEQ ID NO: 831474 - RNA, 19 nt, Homo sapiens
gcaaagcccuggaugauag

SEQ ID NO: 831475 - RNA, 19 nt, Homo sapiens
gaagugcaguucaaagaaa

SEQ ID NO: 831476 - RNA, 19 nt, Homo sapiens
ggauauagguuacccuuga

SEQ ID NO: 831477 - RNA, 19 nt, Homo sapiens
gagaggagauucuaauuca

SEQ ID NO: 831478 - RNA, 19 nt, Homo sapiens
uaaagaaugugaucaguga

SEQ ID NO: 831479 - RNA, 19 nt, Homo sapiens
ccacauggauucaagauug

SEQ ID NO: 831480 - RNA, 19 nt, Homo sapiens
ggacugaccugcuaaccaa

SEQ ID NO: 831481 - RNA, 19 nt, Homo sapiens
gaagagacguggcgauugu

SEQ ID NO: 831482 - RNA, 19 nt, Homo sapiens
gagcagaaguuguaugaug

SEQ ID NO: 831483 - RNA, 19 nt, Homo sapiens
acagagagauugaggauaa

SEQ ID NO: 831484 - RNA, 19 nt, Homo sapiens
guaaggaccuccaaaguuc

SEQ ID NO: 831485 - RNA, 19 nt, Homo sapiens
ggagagcgauguugaccua

SEQ ID NO: 831486 - RNA, 19 nt, Homo sapiens
gcaaacagcagacuucauu

SEQ ID NO: 831487 - RNA, 19 nt, Homo sapiens
ccaaagacauuaaggaaau

SEQ ID NO: 831488 - RNA, 19 nt, Homo sapiens
gcaagaugcugacgaugaa

SEQ ID NO: 831489 - RNA, 19 nt, Homo sapiens
gaaauacagagaaagcuua

SEQ ID NO: 831490 - RNA, 19 nt, Homo sapiens
ccaaacggcuggugugauu

SEQ ID NO: 831491 - RNA, 19 nt, Homo sapiens
ggugaaagauugaaugaau

SEQ ID NO: 831492 - RNA, 19 nt, Homo sapiens
gcacuaaggagauugagua

SEQ ID NO: 831493 - RNA, 19 nt, Homo sapiens
acaaacagcuuaugcaaau

SEQ ID NO: 831494 - RNA, 19 nt, Homo sapiens
aguggaagcugaagaaaua

SEQ ID NO: 831495 - RNA, 19 nt, Homo sapiens
ggaauaacuugcuggaaga

SEQ ID NO: 831496 - RNA, 19 nt, Homo sapiens
gcaggaagcugugguacaa

SEQ ID NO: 831497 - RNA, 19 nt, Homo sapiens
caaggacccucuuugauga

SEQ ID NO: 831498 - RNA, 19 nt, Homo sapiens
gauaaacaguuaccucaug

SEQ ID NO: 831499 - RNA, 19 nt, Homo sapiens
ggaaacgacuucugauauc

SEQ ID NO: 831500 - RNA, 19 nt, Homo sapiens
gcagagagcacacgaguug

SEQ ID NO: 831501 - RNA, 19 nt, Homo sapiens
gaauggacuugcuuugauu

SEQ ID NO: 831502 - RNA, 19 nt, Homo sapiens
gaaaucggcucaaacuucu

SEQ ID NO: 831503 - RNA, 19 nt, Homo sapiens
gaugauagccgcuuucaga

SEQ ID NO: 831504 - RNA, 19 nt, Homo sapiens
gcagauaauugcccaagga

SEQ ID NO: 831505 - RNA, 19 nt, Homo sapiens
uagagaagcucaagaagga

SEQ ID NO: 831506 - RNA, 19 nt, Homo sapiens
ggagugggaucacgacuau

SEQ ID NO: 831507 - RNA, 19 nt, Homo sapiens
gagaacagcugauagaaaa

SEQ ID NO: 831508 - RNA, 19 nt, Homo sapiens
gaagauggacucaaagaau

SEQ ID NO: 831509 - RNA, 19 nt, Homo sapiens
cgggaaaccuggagaaauu

SEQ ID NO: 831510 - RNA, 19 nt, Homo sapiens
cauaagcaaucccaaacua

SEQ ID NO: 831511 - RNA, 19 nt, Homo sapiens
ggagaaacauuugugcuau

SEQ ID NO: 831512 - RNA, 19 nt, Homo sapiens
ggaaauugcuauugcucaa

SEQ ID NO: 831513 - RNA, 19 nt, Homo sapiens
gcaaggacccucuuugaug

SEQ ID NO: 831514 - RNA, 19 nt, Homo sapiens
ggaaaggagcuuacagaaa

SEQ ID NO: 831515 - RNA, 19 nt, Homo sapiens
agaaagacuucagcaaaua

SEQ ID NO: 831516 - RNA, 19 nt, Homo sapiens
gcaggucgcugucacacuu

SEQ ID NO: 831517 - RNA, 19 nt, Homo sapiens
gagcagaucgcuucuuuga

SEQ ID NO: 831518 - RNA, 19 nt, Homo sapiens
ggaaaucggcucaaacuuc

SEQ ID NO: 831519 - RNA, 19 nt, Homo sapiens
caagaaggauuaucaagag

SEQ ID NO: 831520 - RNA, 19 nt, Homo sapiens
aaacuagccuucuuguuga

SEQ ID NO: 831521 - RNA, 19 nt, Homo sapiens
caacuuggagcaaugaaua

SEQ ID NO: 831522 - RNA, 19 nt, Homo sapiens
gaccagauaucaaagugaa

SEQ ID NO: 831523 - RNA, 19 nt, Homo sapiens
gaucugcagcucacuaaua

SEQ ID NO: 831524 - RNA, 19 nt, Homo sapiens
gaaaggauggaagaacuua

SEQ ID NO: 831525 - RNA, 19 nt, Homo sapiens
gacagaaacucuuaccaau

SEQ ID NO: 831526 - RNA, 19 nt, Homo sapiens
gcccguagcagaacaaaua

SEQ ID NO: 831527 - RNA, 19 nt, Homo sapiens
gaacagcacaggagaagga

SEQ ID NO: 831528 - RNA, 19 nt, Homo sapiens
agagagcccugcaugauaa

SEQ ID NO: 831529 - RNA, 19 nt, Homo sapiens
ggaugugguugccagcuua

SEQ ID NO: 831530 - RNA, 19 nt, Homo sapiens
gaacaaacagacaacaaga

SEQ ID NO: 831531 - RNA, 19 nt, Homo sapiens
uaaccuugaugcagagaua

SEQ ID NO: 831532 - RNA, 19 nt, Homo sapiens
gcaaggaguugaggaugaa

SEQ ID NO: 831533 - RNA, 19 nt, Homo sapiens
gaaagaagucaacaugaga

SEQ ID NO: 831534 - RNA, 19 nt, Homo sapiens
cagaaacucuuaccaauac

SEQ ID NO: 831535 - RNA, 19 nt, Homo sapiens
ggccaaaccugggcaaauu

SEQ ID NO: 831536 - RNA, 19 nt, Homo sapiens
gaucugaaagugcuguuua

SEQ ID NO: 831537 - RNA, 19 nt, Homo sapiens
gaggagaaguugaaugauc

SEQ ID NO: 831538 - RNA, 19 nt, Homo sapiens
gagcgaauguccaccauca

SEQ ID NO: 831539 - RNA, 19 nt, Homo sapiens
cuacaaaggcuacaugaaa

SEQ ID NO: 831540 - RNA, 19 nt, Homo sapiens
aaauacagcuccaacaaau

SEQ ID NO: 831541 - RNA, 19 nt, Homo sapiens
gaaggauuaucaagaggaa

SEQ ID NO: 831542 - RNA, 19 nt, Homo sapiens
ggacagauguuaaaauuca

SEQ ID NO: 831543 - RNA, 19 nt, Homo sapiens
gcaacgaccuccucaaagg

SEQ ID NO: 831544 - RNA, 19 nt, Homo sapiens
ggacuugcuuugauucaga

SEQ ID NO: 831545 - RNA, 19 nt, Homo sapiens
gaacuucacagacuggaaa

SEQ ID NO: 831546 - RNA, 19 nt, Homo sapiens
ggugguggcuuuaucagaa

SEQ ID NO: 831547 - RNA, 19 nt, Homo sapiens
gguggaagauaaacaguga

SEQ ID NO: 831548 - RNA, 19 nt, Homo sapiens
gcauguagccucaaacaga

SEQ ID NO: 831549 - RNA, 19 nt, Homo sapiens
gauacucucuuucccgauu

SEQ ID NO: 831550 - RNA, 19 nt, Homo sapiens
gcaaagaggcagaguauac

SEQ ID NO: 831551 - RNA, 19 nt, Homo sapiens
caacaucacauuuagaaga

SEQ ID NO: 831552 - RNA, 19 nt, Homo sapiens
guggaaagauaccauaaga

SEQ ID NO: 831553 - RNA, 19 nt, Homo sapiens
guaaaugguugguugaagu

SEQ ID NO: 831554 - RNA, 19 nt, Homo sapiens
gagagcaacugaagcaaca

SEQ ID NO: 831555 - RNA, 19 nt, Homo sapiens
gaugauaucuccauucuua

SEQ ID NO: 831556 - RNA, 19 nt, Homo sapiens
gaacaggccuugagaagua

SEQ ID NO: 831557 - RNA, 19 nt, Homo sapiens
gaacgagucugauuugaua

SEQ ID NO: 831558 - RNA, 19 nt, Homo sapiens
gcaaauaggugaaagauug

SEQ ID NO: 831559 - RNA, 19 nt, Homo sapiens
gaaaggagcuuacagaaau

SEQ ID NO: 831560 - RNA, 19 nt, Homo sapiens
ggaaacagauugaacauuu

SEQ ID NO: 831561 - RNA, 19 nt, Homo sapiens
gcaagaggaugaugaaaua

SEQ ID NO: 831562 - RNA, 19 nt, Homo sapiens
gaaaucagcuguaucuaaa

SEQ ID NO: 831563 - RNA, 19 nt, Homo sapiens
gaagaaaucugguuugaga

SEQ ID NO: 831564 - RNA, 19 nt, Homo sapiens
ggaauuagaugcagcagua

SEQ ID NO: 831565 - RNA, 19 nt, Homo sapiens
gaaaggagauucaugauca

SEQ ID NO: 831566 - RNA, 19 nt, Homo sapiens
ggaaaugucugaagaaaug

SEQ ID NO: 831567 - RNA, 19 nt, Homo sapiens
gcaaaggaauucucagaua

SEQ ID NO: 831568 - RNA, 19 nt, Homo sapiens
gaaaguggcuucucuggaa

SEQ ID NO: 831569 - RNA, 19 nt, Homo sapiens
gaacaugguuucacaaguu

SEQ ID NO: 831570 - RNA, 19 nt, Homo sapiens
cagcauggcuccagauuua

SEQ ID NO: 831571 - RNA, 19 nt, Homo sapiens
aaaggaagcuucagagaua

SEQ ID NO: 831572 - RNA, 19 nt, Homo sapiens
gaagaacguuuauuuguug

SEQ ID NO: 831573 - RNA, 19 nt, Homo sapiens
gaagagaaccuuagaaaga

SEQ ID NO: 831574 - RNA, 19 nt, Homo sapiens
ucacaugguuggacaauua

SEQ ID NO: 831575 - RNA, 19 nt, Homo sapiens
gaaaguaagcguagugaua

SEQ ID NO: 831576 - RNA, 19 nt, Homo sapiens
ggagagugcuggcuaagua

SEQ ID NO: 831577 - RNA, 19 nt, Homo sapiens
gaagacagauaauguaguu

SEQ ID NO: 831578 - RNA, 19 nt, Homo sapiens
gggaagagguuauugaauu

SEQ ID NO: 831579 - RNA, 19 nt, Homo sapiens
caaacuaccucugagauua

SEQ ID NO: 831580 - RNA, 19 nt, Homo sapiens
gcagaucgcuucuuugaau

SEQ ID NO: 831581 - RNA, 19 nt, Homo sapiens
ggagaaaggucacaguuug

SEQ ID NO: 831582 - RNA, 19 nt, Homo sapiens
gcacaaaggacaagagaua

SEQ ID NO: 831583 - RNA, 19 nt, Homo sapiens
ggauugauguggaccauua

SEQ ID NO: 831584 - RNA, 19 nt, Homo sapiens
gaacacggaugaggagaua

SEQ ID NO: 831585 - RNA, 19 nt, Homo sapiens
gaugagagauggagagauu

SEQ ID NO: 831586 - RNA, 19 nt, Homo sapiens
ccaaagaaauugacaguga

SEQ ID NO: 831587 - RNA, 19 nt, Homo sapiens
caaaggaauucucagauaa

SEQ ID NO: 831588 - RNA, 19 nt, Homo sapiens
caaaguagauacaguaaug

SEQ ID NO: 831589 - RNA, 19 nt, Homo sapiens
gaacaauccugggacauuu

SEQ ID NO: 831590 - RNA, 19 nt, Homo sapiens
gaagacgucucuagcauug

SEQ ID NO: 831591 - RNA, 19 nt, Homo sapiens
ugaaaucgcuuauaaagga

SEQ ID NO: 831592 - RNA, 19 nt, Homo sapiens
gaaguuaaguugaauaugg

SEQ ID NO: 831593 - RNA, 19 nt, Homo sapiens
gaaauugucccuauugauu

SEQ ID NO: 831594 - RNA, 19 nt, Homo sapiens
ggaaagauaccauaagaaa

SEQ ID NO: 831595 - RNA, 19 nt, Homo sapiens
gaaaucaucuguucugagu

SEQ ID NO: 831596 - RNA, 19 nt, Homo sapiens
uaaaugagcuuggauauag

SEQ ID NO: 831597 - RNA, 19 nt, Homo sapiens
gcaaagcccuggaugauag

SEQ ID NO: 831598 - RNA, 19 nt, Homo sapiens
gaagugcaguucaaagaaa

SEQ ID NO: 831599 - RNA, 19 nt, Homo sapiens
ggauauagguuacccuuga

SEQ ID NO: 831600 - RNA, 19 nt, Homo sapiens
gagaggagauucuaauuca

SEQ ID NO: 831601 - RNA, 19 nt, Homo sapiens
uaaagaaugugaucaguga

SEQ ID NO: 831602 - RNA, 19 nt, Homo sapiens
gaaugaacuuugucgauuu

SEQ ID NO: 831603 - RNA, 19 nt, Homo sapiens
ccacauggauucaagauug

SEQ ID NO: 831604 - RNA, 19 nt, Homo sapiens
ggacugaccugcuaaccaa

SEQ ID NO: 831605 - RNA, 19 nt, Homo sapiens
cauaugaucuugacugaaa

SEQ ID NO: 831606 - RNA, 19 nt, Homo sapiens
cuaaagaccucacaacuau

SEQ ID NO: 831607 - RNA, 19 nt, Homo sapiens
gaacucagccggcaaauuc

SEQ ID NO: 831608 - RNA, 19 nt, Homo sapiens
auacacaacuggcuaaaua

SEQ ID NO: 831609 - RNA, 19 nt, Homo sapiens
gaaaggcaaugauggaaga

SEQ ID NO: 831610 - RNA, 19 nt, Homo sapiens
gaagagacguggcgauugu

SEQ ID NO: 831611 - RNA, 19 nt, Homo sapiens
gagcagaaguuguaugaug

SEQ ID NO: 831612 - RNA, 19 nt, Homo sapiens
acagagagauugaggauaa

SEQ ID NO: 831613 - RNA, 19 nt, Homo sapiens
guaaggaccuccaaaguuc

SEQ ID NO: 831614 - RNA, 19 nt, Homo sapiens
ggagagcgauguugaccua

SEQ ID NO: 831615 - RNA, 19 nt, Homo sapiens
caagauaaguuaccuggaa

SEQ ID NO: 831616 - RNA, 19 nt, Homo sapiens
gaggaucaguuccauagua

SEQ ID NO: 831617 - RNA, 19 nt, Homo sapiens
gcaaacagcagacuucauu

SEQ ID NO: 831618 - RNA, 19 nt, Homo sapiens
gaaaguuggugaagcaaga

SEQ ID NO: 831619 - RNA, 19 nt, Homo sapiens
gcucuuaacucuucuugaa

SEQ ID NO: 831620 - RNA, 19 nt, Homo sapiens
ggaagagguuauugaauug

SEQ ID NO: 831621 - RNA, 19 nt, Homo sapiens
gaaaucaaccuaaugaaug

SEQ ID NO: 831622 - RNA, 19 nt, Homo sapiens
gaaaguaugcuauugaaga

SEQ ID NO: 831623 - RNA, 19 nt, Homo sapiens
gcagagagguuaagaaagg

SEQ ID NO: 831624 - RNA, 19 nt, Homo sapiens
gaauguggcuaccaagauu

SEQ ID NO: 831625 - RNA, 19 nt, Homo sapiens
gaauuugagucugaaguua

SEQ ID NO: 831626 - RNA, 19 nt, Homo sapiens
gcaggaagcuguucgaaag

SEQ ID NO: 831627 - RNA, 19 nt, Homo sapiens
ggaagaagcugagaaugug

SEQ ID NO: 831628 - RNA, 19 nt, Homo sapiens
caugaaagaugguguuaaa

SEQ ID NO: 831629 - RNA, 19 nt, Homo sapiens
ccaaagacauuaaggaaau

SEQ ID NO: 831630 - RNA, 19 nt, Homo sapiens
gcaagaugcugacgaugaa

SEQ ID NO: 831631 - RNA, 19 nt, Homo sapiens
gauagagcaucugaauuua

SEQ ID NO: 831632 - RNA, 19 nt, Homo sapiens
gcacagcaguuacuucuuc

SEQ ID NO: 831633 - RNA, 19 nt, Homo sapiens
gaacaaggacgccggauga

SEQ ID NO: 831634 - RNA, 19 nt, Homo sapiens
gaaauacagagaaagcuua

SEQ ID NO: 831635 - RNA, 19 nt, Homo sapiens
agaaauagaugcucaacuu

SEQ ID NO: 831636 - RNA, 19 nt, Homo sapiens
gaacagaggguuagcuuau

SEQ ID NO: 831637 - RNA, 19 nt, Homo sapiens
ugaacaaucuccagaauau

SEQ ID NO: 831638 - RNA, 19 nt, Homo sapiens
gagaaaguaugcuauugaa

SEQ ID NO: 831639 - RNA, 19 nt, Homo sapiens
ggaagaaauugaagacguu

SEQ ID NO: 831640 - RNA, 19 nt, Homo sapiens
gcucgaggcucuauuauca

SEQ ID NO: 831641 - RNA, 19 nt, Homo sapiens
ggaggaaucucucaguaga

SEQ ID NO: 831642 - RNA, 19 nt, Homo sapiens
ccaaacggcuggugugauu

SEQ ID NO: 831643 - RNA, 19 nt, Homo sapiens
ggugaaagauugaaugaau

SEQ ID NO: 831644 - RNA, 19 nt, Homo sapiens
ucaaagguauuaucaggua

SEQ ID NO: 831645 - RNA, 19 nt, Homo sapiens
gagagagggcuguuaaaua

SEQ ID NO: 831646 - RNA, 19 nt, Homo sapiens
guacacaaguggagaaguu

SEQ ID NO: 831647 - RNA, 19 nt, Homo sapiens
gcuagaagaugaauugaau

SEQ ID NO: 831648 - RNA, 19 nt, Homo sapiens
gcacuaaggagauugagua

SEQ ID NO: 831649 - RNA, 19 nt, Homo sapiens
acaaacagcuuaugcaaau

SEQ ID NO: 831650 - RNA, 19 nt, Homo sapiens
aguggaagcugaagaaaua

SEQ ID NO: 831651 - RNA, 19 nt, Homo sapiens
ggaauaacuugcuggaaga

SEQ ID NO: 831652 - RNA, 19 nt, Homo sapiens
gaacugggcagaccauauu

SEQ ID NO: 831653 - RNA, 19 nt, Homo sapiens
ggucagugcuguggacuua

SEQ ID NO: 831654 - RNA, 19 nt, Homo sapiens
gagaugagcuggcaaaauu

SEQ ID NO: 831655 - RNA, 19 nt, Homo sapiens
gaagaaaucugguuugaga

SEQ ID NO: 831656 - RNA, 19 nt, Homo sapiens
gaaauugucccuauugauu

SEQ ID NO: 831657 - RNA, 19 nt, Homo sapiens
ggaaagauaccauaagaaa

SEQ ID NO: 831658 - RNA, 19 nt, Homo sapiens
gcaaagcccuggaugauag

SEQ ID NO: 831659 - RNA, 19 nt, Homo sapiens
gaagagacguggcgauugu

SEQ ID NO: 831660 - RNA, 19 nt, Homo sapiens
guaaggaccuccaaaguuc

SEQ ID NO: 831661 - RNA, 19 nt, Homo sapiens
gaaauacagagaaagcuua

SEQ ID NO: 831662 - RNA, 19 nt, Homo sapiens
ccaaacggcuggugugauu

SEQ ID NO: 831663 - RNA, 19 nt, Homo sapiens
gcacuaaggagauugagua

SEQ ID NO: 831664 - RNA, 19 nt, Homo sapiens
acaaacagcuuaugcaaau

SEQ ID NO: 831665 - RNA, 19 nt, Homo sapiens
gaaaucggcucaaacuucu

SEQ ID NO: 831666 - RNA, 19 nt, Homo sapiens
gaugauagccgcuuucaga

SEQ ID NO: 831667 - RNA, 19 nt, Homo sapiens
gcagauaauugcccaagga

SEQ ID NO: 831668 - RNA, 19 nt, Homo sapiens
ggagugggaucacgacuau

SEQ ID NO: 831669 - RNA, 19 nt, Homo sapiens
gagaacagcugauagaaaa

SEQ ID NO: 831670 - RNA, 19 nt, Homo sapiens
cauaagcaaucccaaacua

SEQ ID NO: 831671 - RNA, 19 nt, Homo sapiens
ggagaaacauuugugcuau

SEQ ID NO: 831672 - RNA, 19 nt, Homo sapiens
ggaaauugcuauugcucaa

SEQ ID NO: 831673 - RNA, 19 nt, Homo sapiens
ggaaaucggcucaaacuuc

SEQ ID NO: 831674 - RNA, 19 nt, Homo sapiens
gagagaaacugaaagaaaa

SEQ ID NO: 831675 - RNA, 19 nt, Homo sapiens
gaucugcagcucacuaaua

SEQ ID NO: 831676 - RNA, 19 nt, Homo sapiens
gaacaaacagacaacaaga

SEQ ID NO: 831677 - RNA, 19 nt, Homo sapiens
uaaccuugaugcagagaua

SEQ ID NO: 831678 - RNA, 19 nt, Homo sapiens
gcaaggaguugaggaugaa

SEQ ID NO: 831679 - RNA, 19 nt, Homo sapiens
cuacaaaggcuacaugaaa

SEQ ID NO: 831680 - RNA, 19 nt, Homo sapiens
aaauacagcuccaacaaau

SEQ ID NO: 831681 - RNA, 19 nt, Homo sapiens
gguggaagauaaacaguga

SEQ ID NO: 831682 - RNA, 19 nt, Homo sapiens
gcauguagccucaaacaga

SEQ ID NO: 831683 - RNA, 19 nt, Homo sapiens
guggaaagauaccauaaga

SEQ ID NO: 831684 - RNA, 19 nt, Homo sapiens
gcacaagcuguaaaucuaa

SEQ ID NO: 831685 - RNA, 19 nt, Homo sapiens
caagaagguuuggaagaaa

SEQ ID NO: 831686 - RNA, 19 nt, Homo sapiens
gaccacagauaggaauuaa

SEQ ID NO: 831687 - RNA, 19 nt, Homo sapiens
caaggaagaacuaaagaaa

SEQ ID NO: 831688 - RNA, 19 nt, Homo sapiens
gaacauugacagaaggaaa

SEQ ID NO: 831689 - RNA, 19 nt, Homo sapiens
ggagaacagcugauagaaa

SEQ ID NO: 831690 - RNA, 19 nt, Homo sapiens
gauaauugcccaaggagaa

SEQ ID NO: 831691 - RNA, 19 nt, Homo sapiens
acaagaagguuuggaagaa

SEQ ID NO: 831692 - RNA, 19 nt, Homo sapiens
uaaggaggaucgggucaua

SEQ ID NO: 831693 - RNA, 19 nt, Homo sapiens
gcacugacauccagaccau

SEQ ID NO: 831694 - RNA, 19 nt, Homo sapiens
gauagccgcuuucagauac

SEQ ID NO: 831695 - RNA, 19 nt, Homo sapiens
uaaagccacuagagagaaa

SEQ ID NO: 831696 - RNA, 19 nt, Homo sapiens
ccacagauaggaauuaaga

SEQ ID NO: 831697 - RNA, 19 nt, Homo sapiens
gcagcucacuaauauugaa

SEQ ID NO: 831698 - RNA, 19 nt, Homo sapiens
ucaaggagcuccagaaagc

SEQ ID NO: 831699 - RNA, 19 nt, Homo sapiens
cgaaugcaguagcaguaua

SEQ ID NO: 831700 - RNA, 19 nt, Homo sapiens
gagaaacauuugugcuaug

SEQ ID NO: 831701 - RNA, 19 nt, Homo sapiens
cggaagaaauacagagaaa

SEQ ID NO: 831702 - RNA, 19 nt, Homo sapiens
cuaaggagauugaguaagg

SEQ ID NO: 831703 - RNA, 19 nt, Homo sapiens
ccacauagcagguccacaa

SEQ ID NO: 831704 - RNA, 19 nt, Homo sapiens
gcuguugccuuaucagaug

SEQ ID NO: 831705 - RNA, 19 nt, Homo sapiens
gaaagcaaagcaucugaga

SEQ ID NO: 831706 - RNA, 19 nt, Homo sapiens
caaguagucagcaggauuu

SEQ ID NO: 831707 - RNA, 19 nt, Homo sapiens
ggaccuggcucgcucacau

SEQ ID NO: 831708 - RNA, 19 nt, Homo sapiens
ugaagagacuggagcacaa

SEQ ID NO: 831709 - RNA, 19 nt, Homo sapiens
ucacugaaccacaauaaga

SEQ ID NO: 831710 - RNA, 19 nt, Homo sapiens
ggugaaugcugaaggaaca

SEQ ID NO: 831711 - RNA, 19 nt, Homo sapiens
caaacagcuuaugcaaaua

SEQ ID NO: 831712 - RNA, 19 nt, Homo sapiens
gaccaucacaaacagcuua

SEQ ID NO: 831713 - RNA, 19 nt, Homo sapiens
gagaacgacuugcuaaagc

SEQ ID NO: 831714 - RNA, 19 nt, Homo sapiens
gaucauggaaggcuuuaug

SEQ ID NO: 831715 - RNA, 19 nt, Homo sapiens
ggaggucagucgucauauc

SEQ ID NO: 831716 - RNA, 19 nt, Homo sapiens
cgaaagcccugaggccuau

SEQ ID NO: 831717 - RNA, 19 nt, Homo sapiens
uaaaugacccucccaagca

SEQ ID NO: 831718 - RNA, 19 nt, Homo sapiens
agaaguggcagcaguuuaa

SEQ ID NO: 831719 - RNA, 19 nt, Homo sapiens
ugcagcagcuugauaagaa

SEQ ID NO: 831720 - RNA, 19 nt, Homo sapiens
gcuaaagccagccaugaaa

SEQ ID NO: 831721 - RNA, 19 nt, Homo sapiens
gcugugcccucuccaacaa

SEQ ID NO: 831722 - RNA, 19 nt, Homo sapiens
agccaugguuugcuucuua

SEQ ID NO: 831723 - RNA, 19 nt, Homo sapiens
ccaaggagaacagcugaua

SEQ ID NO: 831724 - RNA, 19 nt, Homo sapiens
agagagaaacugaaagaaa

SEQ ID NO: 831725 - RNA, 19 nt, Homo sapiens
cauggaaggcuuuauguga

SEQ ID NO: 831726 - RNA, 19 nt, Homo sapiens
ccaaccaucagauaaauga

SEQ ID NO: 831727 - RNA, 19 nt, Homo sapiens
ggacuucaguagaccaucu

SEQ ID NO: 831728 - RNA, 19 nt, Homo sapiens
gaaguuauuagacguguca

SEQ ID NO: 831729 - RNA, 19 nt, Homo sapiens
gaaaugagccaugguuugc

SEQ ID NO: 831730 - RNA, 19 nt, Homo sapiens
ugacgcagcuggaacugau

SEQ ID NO: 831731 - RNA, 19 nt, Homo sapiens
gaagaaauacagagaaagc

SEQ ID NO: 831732 - RNA, 19 nt, Homo sapiens
aaccagugcugaagagauu

SEQ ID NO: 831733 - RNA, 19 nt, Homo sapiens
uggaagaaaucugguuuga

SEQ ID NO: 831734 - RNA, 19 nt, Homo sapiens
ccaucgagcuccagaucaa

SEQ ID NO: 831735 - RNA, 19 nt, Homo sapiens
ggaacaaacagacaacaag

SEQ ID NO: 831736 - RNA, 19 nt, Homo sapiens
gaucaucgaggaggaacua

SEQ ID NO: 831737 - RNA, 19 nt, Homo sapiens
ggucauaagcaaucccaaa

SEQ ID NO: 831738 - RNA, 19 nt, Homo sapiens
gaagagacuggagcacaaa

SEQ ID NO: 831739 - RNA, 19 nt, Homo sapiens
ccacagugcccuagaguca

SEQ ID NO: 831740 - RNA, 19 nt, Homo sapiens
gcuccaaccaucagauaaa

SEQ ID NO: 831741 - RNA, 19 nt, Homo sapiens
gguaaagccacuagagaga

SEQ ID NO: 831742 - RNA, 19 nt, Homo sapiens
gggcuugccugccuuguac

SEQ ID NO: 831743 - RNA, 19 nt, Homo sapiens
aaauaaagcaugagcuguu

SEQ ID NO: 831744 - RNA, 19 nt, Homo sapiens
gaauuaagaguuuccugau

SEQ ID NO: 831745 - RNA, 19 nt, Homo sapiens
agcacaagcuguaaaucua

SEQ ID NO: 831746 - RNA, 19 nt, Homo sapiens
gaucgcuugucgcagauga

SEQ ID NO: 831747 - RNA, 19 nt, Homo sapiens
gaagcacaguacagguguu

SEQ ID NO: 831748 - RNA, 19 nt, Homo sapiens
uggaaggcuuuaugugaaa

SEQ ID NO: 831749 - RNA, 19 nt, Homo sapiens
cacaagcuguaaaucuaaa

SEQ ID NO: 831750 - RNA, 19 nt, Homo sapiens
caaaugggagaacgacuug

SEQ ID NO: 831751 - RNA, 19 nt, Homo sapiens
ggagaacgacuugcuaaag

SEQ ID NO: 831752 - RNA, 19 nt, Homo sapiens
ggcaaagcccuggaugaua

SEQ ID NO: 831753 - RNA, 19 nt, Homo sapiens
aaauugcuauugcucaaga

SEQ ID NO: 831754 - RNA, 19 nt, Homo sapiens
gaaauuucuggaugacuau

SEQ ID NO: 831755 - RNA, 19 nt, Homo sapiens
gcacagagcuuguuuguua

SEQ ID NO: 831756 - RNA, 19 nt, Homo sapiens
gcaauaagcuauccaauga

SEQ ID NO: 831757 - RNA, 19 nt, Homo sapiens
gaacaaggcuucaacaucu

SEQ ID NO: 831758 - RNA, 19 nt, Homo sapiens
ccaaaggccuauauuaaua

SEQ ID NO: 831759 - RNA, 19 nt, Homo sapiens
guaagaaggugcacauauu

SEQ ID NO: 831760 - RNA, 19 nt, Homo sapiens
ccaaucaccuuuacguuua

SEQ ID NO: 831761 - RNA, 19 nt, Homo sapiens
caucugaacuuauggauuu

SEQ ID NO: 831762 - RNA, 19 nt, Homo sapiens
gaaccaaaggccuauauua

SEQ ID NO: 831763 - RNA, 19 nt, Homo sapiens
gaagagggaugucguugaa

SEQ ID NO: 831764 - RNA, 19 nt, Homo sapiens
gaacugaccauuguaauuu

SEQ ID NO: 831765 - RNA, 19 nt, Homo sapiens
cuaaggaucuggauucuaa

SEQ ID NO: 831766 - RNA, 19 nt, Homo sapiens
gaaauuaaauggguagaug

SEQ ID NO: 831767 - RNA, 19 nt, Homo sapiens
cacaugggcuuaugcauua

SEQ ID NO: 831768 - RNA, 19 nt, Homo sapiens
ggaauuaugugagcuuaaa

SEQ ID NO: 831769 - RNA, 19 nt, Homo sapiens
gcagaguaguguuagaaua

SEQ ID NO: 831770 - RNA, 19 nt, Homo sapiens
ggacacgcuuucucuauuu

SEQ ID NO: 831771 - RNA, 19 nt, Homo sapiens
ucaagaaccugcugauaaa

SEQ ID NO: 831772 - RNA, 19 nt, Homo sapiens
ggagauguauacagucuuu

SEQ ID NO: 831773 - RNA, 19 nt, Homo sapiens
ccucagacuucccuaauua

SEQ ID NO: 831774 - RNA, 19 nt, Homo sapiens
gaagauuucugccgauuuc

SEQ ID NO: 831775 - RNA, 19 nt, Homo sapiens
gaacaaaguggucaaguug

SEQ ID NO: 831776 - RNA, 19 nt, Homo sapiens
cuacaaauguugaaccuuu

SEQ ID NO: 831777 - RNA, 19 nt, Homo sapiens
gaauggugguguacuuuaa

SEQ ID NO: 831778 - RNA, 19 nt, Homo sapiens
caucauacauucccacaaa

SEQ ID NO: 831779 - RNA, 19 nt, Homo sapiens
gaagugaagucauuugaag

SEQ ID NO: 831780 - RNA, 19 nt, Homo sapiens
uaacagacuuucuauagga

SEQ ID NO: 831781 - RNA, 19 nt, Homo sapiens
uaaaguaccuuaagagucu

SEQ ID NO: 831782 - RNA, 19 nt, Homo sapiens
gauaagcaccaacaaagua

SEQ ID NO: 831783 - RNA, 19 nt, Homo sapiens
gcaauucccuggauaagca

SEQ ID NO: 831784 - RNA, 19 nt, Homo sapiens
ucaagcagaucaacaacua

SEQ ID NO: 831785 - RNA, 19 nt, Homo sapiens
ggaaaccguuguaaauaug

SEQ ID NO: 831786 - RNA, 19 nt, Homo sapiens
gcaaggacauuguuuaagg

SEQ ID NO: 831787 - RNA, 19 nt, Homo sapiens
ucacgaagaugaugaacaa

SEQ ID NO: 831788 - RNA, 19 nt, Homo sapiens
caacauugcuacugagguu

SEQ ID NO: 831789 - RNA, 19 nt, Homo sapiens
gaacugaccaaauccauga

SEQ ID NO: 831790 - RNA, 19 nt, Homo sapiens
ucacugcccugcuguaauu

SEQ ID NO: 831791 - RNA, 19 nt, Homo sapiens
aaacagauguggagggauu

SEQ ID NO: 831792 - RNA, 19 nt, Homo sapiens
ggacauaauccucucauga

SEQ ID NO: 831793 - RNA, 19 nt, Homo sapiens
ggacuugcuuugucauuug

SEQ ID NO: 831794 - RNA, 19 nt, Homo sapiens
gccgacaucuacaaacuua

SEQ ID NO: 831795 - RNA, 19 nt, Homo sapiens
uaaagagcaugucugauga

SEQ ID NO: 831796 - RNA, 19 nt, Homo sapiens
uaagggaacugaccauugu

SEQ ID NO: 831797 - RNA, 19 nt, Homo sapiens
guaaacgaacgucugauua

SEQ ID NO: 831798 - RNA, 19 nt, Homo sapiens
ggaaaggaguauauuuaca

SEQ ID NO: 831799 - RNA, 19 nt, Homo sapiens
gaagagcaauucccuggau

SEQ ID NO: 831800 - RNA, 19 nt, Homo sapiens
gguaacagccuuccagaaa

SEQ ID NO: 831801 - RNA, 19 nt, Homo sapiens
gaagaaggacccacuacaa

SEQ ID NO: 831802 - RNA, 19 nt, Homo sapiens
gaacaacuuugauuacacu

SEQ ID NO: 831803 - RNA, 19 nt, Homo sapiens
ggucaaugcuggcccacua

SEQ ID NO: 831804 - RNA, 19 nt, Homo sapiens
acacaucacucagaaguuu

SEQ ID NO: 831805 - RNA, 19 nt, Homo sapiens
cacuugaggucauauguua

SEQ ID NO: 831806 - RNA, 19 nt, Homo sapiens
gaaaagaucuccaaagaac

SEQ ID NO: 831807 - RNA, 19 nt, Homo sapiens
ggcgauggauccuauaauu

SEQ ID NO: 831808 - RNA, 19 nt, Homo sapiens
cagcuugacuacucauuaa

SEQ ID NO: 831809 - RNA, 19 nt, Homo sapiens
acucagaaguuucgagaua

SEQ ID NO: 831810 - RNA, 19 nt, Homo sapiens
guugaaccuuucuuuguua

SEQ ID NO: 831811 - RNA, 19 nt, Homo sapiens
ggauaaauuugguucugaa

SEQ ID NO: 831812 - RNA, 19 nt, Homo sapiens
cgaacaaaguggucaaguu

SEQ ID NO: 831813 - RNA, 19 nt, Homo sapiens
gcgauauccugacaauaaa

SEQ ID NO: 831814 - RNA, 19 nt, Homo sapiens
gcagcaaggacauuguuua

SEQ ID NO: 831815 - RNA, 19 nt, Homo sapiens
uaaacgaacgucugauuaa

SEQ ID NO: 831816 - RNA, 19 nt, Homo sapiens
ggucaagccuuagcgguaa

SEQ ID NO: 831817 - RNA, 19 nt, Homo sapiens
cgaauucccuucacaucuu

SEQ ID NO: 831818 - RNA, 19 nt, Homo sapiens
aaacgaacgucugauuaaa

SEQ ID NO: 831819 - RNA, 19 nt, Homo sapiens
ggaucaauauuucuggauu

SEQ ID NO: 831820 - RNA, 19 nt, Homo sapiens
ggaacugaccauuguaauu

SEQ ID NO: 831821 - RNA, 19 nt, Homo sapiens
ggaaauaaagaacaacguu

SEQ ID NO: 831822 - RNA, 19 nt, Homo sapiens
ggaucuggauucuaaguau

SEQ ID NO: 831823 - RNA, 19 nt, Homo sapiens
gacacgcuuucucuauuua

SEQ ID NO: 831824 - RNA, 19 nt, Homo sapiens
gcaugacugugaaggauga

SEQ ID NO: 831825 - RNA, 19 nt, Homo sapiens
ucacaccgcugucggaaau

SEQ ID NO: 831826 - RNA, 19 nt, Homo sapiens
gcagcgcaauaccaguuua

SEQ ID NO: 831827 - RNA, 19 nt, Homo sapiens
gagauuuccugcauccuau

SEQ ID NO: 831828 - RNA, 19 nt, Homo sapiens
gaaggacccacuacaaaug

SEQ ID NO: 831829 - RNA, 19 nt, Homo sapiens
gacauaauccucucaugaa

SEQ ID NO: 831830 - RNA, 19 nt, Homo sapiens
ggaugcaucuggaaaucuu

SEQ ID NO: 831831 - RNA, 19 nt, Homo sapiens
caagugcaaugauuuaucu

SEQ ID NO: 831832 - RNA, 19 nt, Homo sapiens
uaagaaggugcacauauuu

SEQ ID NO: 831833 - RNA, 19 nt, Homo sapiens
gugcaaccaugaacauuau

SEQ ID NO: 831834 - RNA, 19 nt, Homo sapiens
gaagucauuugaagagaag

SEQ ID NO: 831835 - RNA, 19 nt, Homo sapiens
gauggauccuauaauuuga

SEQ ID NO: 831836 - RNA, 19 nt, Homo sapiens
gcaaagccaaagcuaauug

SEQ ID NO: 831837 - RNA, 19 nt, Homo sapiens
gagcuggacuuagauuuua

SEQ ID NO: 831838 - RNA, 19 nt, Homo sapiens
cggcauugcuucuccauau

SEQ ID NO: 831839 - RNA, 19 nt, Homo sapiens
uggaaaccguuguaaauau

SEQ ID NO: 831840 - RNA, 19 nt, Homo sapiens
ccacucaucugguuucuac

SEQ ID NO: 831841 - RNA, 19 nt, Homo sapiens
gaucaauauuucuggauuc

SEQ ID NO: 831842 - RNA, 19 nt, Homo sapiens
gaauagauggccuacagaa

SEQ ID NO: 831843 - RNA, 19 nt, Homo sapiens
uaacaaaggugugguagac

SEQ ID NO: 831844 - RNA, 19 nt, Homo sapiens
ggagagaaaggaaauaaag

SEQ ID NO: 831845 - RNA, 19 nt, Homo sapiens
gcgcaucccugucauguac

SEQ ID NO: 831846 - RNA, 19 nt, Homo sapiens
caacgaggaugugcugaug

SEQ ID NO: 831847 - RNA, 19 nt, Homo sapiens
ugaggaacaacuuugauua

SEQ ID NO: 831848 - RNA, 19 nt, Homo sapiens
ccaacaaaguagcacauug

SEQ ID NO: 831849 - RNA, 19 nt, Homo sapiens
ucuaagaacgcgaaucaua

SEQ ID NO: 831850 - RNA, 19 nt, Homo sapiens
gcucagcauuugauagaga

SEQ ID NO: 831851 - RNA, 19 nt, Homo sapiens
caaagcaaauuggaagguu

SEQ ID NO: 831852 - RNA, 19 nt, Homo sapiens
ggaagaauggaucacaauu

SEQ ID NO: 831853 - RNA, 19 nt, Homo sapiens
gauggaaaggaguauauuu

SEQ ID NO: 831854 - RNA, 19 nt, Homo sapiens
gcugauagcagacguuguu

SEQ ID NO: 831855 - RNA, 19 nt, Homo sapiens
gcaaagaguuguuggaaua

SEQ ID NO: 831856 - RNA, 19 nt, Homo sapiens
gcaauaaacucugcacuuu

SEQ ID NO: 831857 - RNA, 19 nt, Homo sapiens
ggaccaagcugaucgauga

SEQ ID NO: 831858 - RNA, 19 nt, Homo sapiens
gaaguaccguucuguuaua

SEQ ID NO: 831859 - RNA, 19 nt, Homo sapiens
caaagaagaugacuaugaa

SEQ ID NO: 831860 - RNA, 19 nt, Homo sapiens
ucaaaucacugcuggaaua

SEQ ID NO: 831861 - RNA, 19 nt, Homo sapiens
gaaccucucugcuaaauuc

SEQ ID NO: 831862 - RNA, 19 nt, Homo sapiens
ggacaaagauggacucaag

SEQ ID NO: 831863 - RNA, 19 nt, Homo sapiens
gaucacagcucgcuccauu

SEQ ID NO: 831864 - RNA, 19 nt, Homo sapiens
caacauccaugacaucaaa

SEQ ID NO: 831865 - RNA, 19 nt, Homo sapiens
gcugugagcuucucuugua

SEQ ID NO: 831866 - RNA, 19 nt, Homo sapiens
gcaaagagggcaaggauuu

SEQ ID NO: 831867 - RNA, 19 nt, Homo sapiens
gaacaaauuugccgauaag

SEQ ID NO: 831868 - RNA, 19 nt, Homo sapiens
ucaagaagcugcuagaaga

SEQ ID NO: 831869 - RNA, 19 nt, Homo sapiens
gcaaagauccugaguuguu

SEQ ID NO: 831870 - RNA, 19 nt, Homo sapiens
gcuaauuccuucuucauaa

SEQ ID NO: 831871 - RNA, 19 nt, Homo sapiens
guacugugcugaauggaua

SEQ ID NO: 831872 - RNA, 19 nt, Homo sapiens
ccacaaggaucaugagauu

SEQ ID NO: 831873 - RNA, 19 nt, Homo sapiens
gaacguggcuagucuucaa

SEQ ID NO: 831874 - RNA, 19 nt, Homo sapiens
caaguagccugcaguauga

SEQ ID NO: 831875 - RNA, 19 nt, Homo sapiens
gcaagcagauuccagcaaa

SEQ ID NO: 831876 - RNA, 19 nt, Homo sapiens
caacauggaugcucagaug

SEQ ID NO: 831877 - RNA, 19 nt, Homo sapiens
agacagaggugaagauuga

SEQ ID NO: 831878 - RNA, 19 nt, Homo sapiens
ggagauugcuguaguuuca

SEQ ID NO: 831879 - RNA, 19 nt, Homo sapiens
gaacuggcauccaccacua

SEQ ID NO: 831880 - RNA, 19 nt, Homo sapiens
cuacgaagcugccgacaaa

SEQ ID NO: 831881 - RNA, 19 nt, Homo sapiens
gagcaaagcugugcagugu

SEQ ID NO: 831882 - RNA, 19 nt, Homo sapiens
cauaaugccugcaacagua

SEQ ID NO: 831883 - RNA, 19 nt, Homo sapiens
agaagaagaugaagaagaa

SEQ ID NO: 831884 - RNA, 19 nt, Homo sapiens
ccaucaaccuguauuauaa

SEQ ID NO: 831885 - RNA, 19 nt, Homo sapiens
ccaccaggcugacagauaa

SEQ ID NO: 831886 - RNA, 19 nt, Homo sapiens
gcauggagcuucuagugaa

SEQ ID NO: 831887 - RNA, 19 nt, Homo sapiens
ugaaccagcugaacaaauu

SEQ ID NO: 831888 - RNA, 19 nt, Homo sapiens
ggacaacccuggagguguu

SEQ ID NO: 831889 - RNA, 19 nt, Homo sapiens
gaaagcaugugaugaucuu

SEQ ID NO: 831890 - RNA, 19 nt, Homo sapiens
gaaagccugugcagagauu

SEQ ID NO: 831891 - RNA, 19 nt, Homo sapiens
ccaaugaauuucccaauau

SEQ ID NO: 831892 - RNA, 19 nt, Homo sapiens
ucaaggagguggacaaaga

SEQ ID NO: 831893 - RNA, 19 nt, Homo sapiens
ccugugcccuucaauauua

SEQ ID NO: 831894 - RNA, 19 nt, Homo sapiens
agaaaugucucgaaaucua

SEQ ID NO: 831895 - RNA, 19 nt, Homo sapiens
uaaacaagcucuaauucga

SEQ ID NO: 831896 - RNA, 19 nt, Homo sapiens
gaaacuccaugcauccaaa

SEQ ID NO: 831897 - RNA, 19 nt, Homo sapiens
ggaaggagauugcuguagu

SEQ ID NO: 831898 - RNA, 19 nt, Homo sapiens
cgacacugguucagaauuu

SEQ ID NO: 831899 - RNA, 19 nt, Homo sapiens
caaagguccugggcauuua

SEQ ID NO: 831900 - RNA, 19 nt, Homo sapiens
gcaaguagccugcaguaug

SEQ ID NO: 831901 - RNA, 19 nt, Homo sapiens
gaagaugacuaugaaagug

SEQ ID NO: 831902 - RNA, 19 nt, Homo sapiens
gcuacaaucuggaugacua

SEQ ID NO: 831903 - RNA, 19 nt, Homo sapiens
gaaggagauugcuguaguu

SEQ ID NO: 831904 - RNA, 19 nt, Homo sapiens
gaagagaagcccaagaaga

SEQ ID NO: 831905 - RNA, 19 nt, Homo sapiens
guaaagcuauggaggaguu

SEQ ID NO: 831906 - RNA, 19 nt, Homo sapiens
caacaucaauaccaaugaa

SEQ ID NO: 831907 - RNA, 19 nt, Homo sapiens
ggaacaacaucaauaccaa

SEQ ID NO: 831908 - RNA, 19 nt, Homo sapiens
cagaaugccuuaaaguuug

SEQ ID NO: 831909 - RNA, 19 nt, Homo sapiens
gaguguaucucuuucagaa

SEQ ID NO: 831910 - RNA, 19 nt, Homo sapiens
gaucaagccucagcuauca

SEQ ID NO: 831911 - RNA, 19 nt, Homo sapiens
agaagaaguugaaggagua

SEQ ID NO: 831912 - RNA, 19 nt, Homo sapiens
cuacagaaauuccagcaaa

SEQ ID NO: 831913 - RNA, 19 nt, Homo sapiens
guuugaaccugccauauuu

SEQ ID NO: 831914 - RNA, 19 nt, Homo sapiens
gcaguuggcucaggaguau

SEQ ID NO: 831915 - RNA, 19 nt, Homo sapiens
caagcugucuuccauuaaa

SEQ ID NO: 831916 - RNA, 19 nt, Homo sapiens
caucaaagccgugugguua

SEQ ID NO: 831917 - RNA, 19 nt, Homo sapiens
gaauuccacuggcauguau

SEQ ID NO: 831918 - RNA, 19 nt, Homo sapiens
gcugaugguucccaccuua

SEQ ID NO: 831919 - RNA, 19 nt, Homo sapiens
gaaacuaucugaguguauc

SEQ ID NO: 831920 - RNA, 19 nt, Homo sapiens
ccagaaaugucucgaaauc

SEQ ID NO: 831921 - RNA, 19 nt, Homo sapiens
uccgggagcucuuugauua

SEQ ID NO: 831922 - RNA, 19 nt, Homo sapiens
ggaagcagccacuaaauca

SEQ ID NO: 831923 - RNA, 19 nt, Homo sapiens
guucuuggcucguguuuau

SEQ ID NO: 831924 - RNA, 19 nt, Homo sapiens
cgucugagauuaccaagaa

SEQ ID NO: 831925 - RNA, 19 nt, Homo sapiens
ugaaugaccugauuauugg

SEQ ID NO: 831926 - RNA, 19 nt, Homo sapiens
gcacaaagccaagaagguu

SEQ ID NO: 831927 - RNA, 19 nt, Homo sapiens
gaaugaaguccaucuggua

SEQ ID NO: 831928 - RNA, 19 nt, Homo sapiens
caacacaucuagcaaagag

SEQ ID NO: 831929 - RNA, 19 nt, Homo sapiens
cgacagaucucauccuucu

SEQ ID NO: 831930 - RNA, 19 nt, Homo sapiens
ccaaagaagaugacuauga

SEQ ID NO: 831931 - RNA, 19 nt, Homo sapiens
ugaagucacugaguucuuu

SEQ ID NO: 831932 - RNA, 19 nt, Homo sapiens
ggaagaaggcuguauccaa

SEQ ID NO: 831933 - RNA, 19 nt, Homo sapiens
gcagauccaucaacuacga

SEQ ID NO: 831934 - RNA, 19 nt, Homo sapiens
ucgcaaagauccugaguug

SEQ ID NO: 831935 - RNA, 19 nt, Homo sapiens
acacuuaccuccaggaaug

SEQ ID NO: 831936 - RNA, 19 nt, Homo sapiens
ggaaguaccguucuguuau

SEQ ID NO: 831937 - RNA, 19 nt, Homo sapiens
gaaggaguauucacagaag

SEQ ID NO: 831938 - RNA, 19 nt, Homo sapiens
gcaaagcugugcagugucu

SEQ ID NO: 831939 - RNA, 19 nt, Homo sapiens
ucacuaauguguuggaaau

SEQ ID NO: 831940 - RNA, 19 nt, Homo sapiens
cugccaagcucaaagauaa

SEQ ID NO: 831941 - RNA, 19 nt, Homo sapiens
gaacuuguacagaucauga

SEQ ID NO: 831942 - RNA, 19 nt, Homo sapiens
ccagaaugccuuaaaguuu

SEQ ID NO: 831943 - RNA, 19 nt, Homo sapiens
gagcagguguccagugaug

SEQ ID NO: 831944 - RNA, 19 nt, Homo sapiens
gaccacagguacagaauca

SEQ ID NO: 831945 - RNA, 19 nt, Homo sapiens
ugaacaaauuugccgauaa

SEQ ID NO: 831946 - RNA, 19 nt, Homo sapiens
gcacaugguccgucuaaug

SEQ ID NO: 831947 - RNA, 19 nt, Homo sapiens
ccugugagcuggauuguau

SEQ ID NO: 831948 - RNA, 19 nt, Homo sapiens
ggugagcacuaucagaauu

SEQ ID NO: 831949 - RNA, 19 nt, Homo sapiens
ccacagaggaguucauuga

SEQ ID NO: 831950 - RNA, 19 nt, Homo sapiens
gcaagaagaacaaggaugu

SEQ ID NO: 831951 - RNA, 19 nt, Homo sapiens
ggaaccaacuucagucagu

SEQ ID NO: 831952 - RNA, 19 nt, Homo sapiens
guagcucagugaaauauga

SEQ ID NO: 831953 - RNA, 19 nt, Homo sapiens
gcagcagccuguaaaguuc

SEQ ID NO: 831954 - RNA, 19 nt, Homo sapiens
cagaaauccugcaccauga

SEQ ID NO: 831955 - RNA, 19 nt, Homo sapiens
ccacagaccugguguaauu

SEQ ID NO: 831956 - RNA, 19 nt, Homo sapiens
gaagguaucuggacaggaa

SEQ ID NO: 831957 - RNA, 19 nt, Homo sapiens
gcagaugcuugauagauua

SEQ ID NO: 831958 - RNA, 19 nt, Homo sapiens
gcaaauacccauauccuuu

SEQ ID NO: 831959 - RNA, 19 nt, Homo sapiens
ggaaauaccauaucaugaa

SEQ ID NO: 831960 - RNA, 19 nt, Homo sapiens
gaaaugggguuuuaaauug

SEQ ID NO: 831961 - RNA, 19 nt, Homo sapiens
caaauacccauauccuuua

SEQ ID NO: 831962 - RNA, 19 nt, Homo sapiens
gaccuaagcugauucucuu

SEQ ID NO: 831963 - RNA, 19 nt, Homo sapiens
ccaugcaucuagaaacuua

SEQ ID NO: 831964 - RNA, 19 nt, Homo sapiens
ccacacaucucccuaaguc

SEQ ID NO: 831965 - RNA, 19 nt, Homo sapiens
ucacucugaugucuuauaa

SEQ ID NO: 831966 - RNA, 19 nt, Homo sapiens
gcccagaggucacuacaau

SEQ ID NO: 831967 - RNA, 19 nt, Homo sapiens
uaaauucugucccugauuc

SEQ ID NO: 831968 - RNA, 19 nt, Homo sapiens
guauuuagcucaggccaaa

SEQ ID NO: 831969 - RNA, 19 nt, Homo sapiens
gcggaaguuugaacccuua

SEQ ID NO: 831970 - RNA, 19 nt, Homo sapiens
aaacuuagauccaagaaac

SEQ ID NO: 831971 - RNA, 19 nt, Homo sapiens
ucagagcucuaucuacauu

SEQ ID NO: 831972 - RNA, 19 nt, Homo sapiens
ggcagaugcuugauagauu

SEQ ID NO: 831973 - RNA, 19 nt, Homo sapiens
gcuacaagccuaccagauu

SEQ ID NO: 831974 - RNA, 19 nt, Homo sapiens
gcccaucacuguucucuuc

SEQ ID NO: 831975 - RNA, 19 nt, Homo sapiens
uagccucuguguuucauua

SEQ ID NO: 831976 - RNA, 19 nt, Homo sapiens
gcagagggcagaugcuuga

SEQ ID NO: 831977 - RNA, 19 nt, Homo sapiens
gcauugugcugcugcauuc

SEQ ID NO: 831978 - RNA, 19 nt, Homo sapiens
guagugguaugagguuuaa

SEQ ID NO: 831979 - RNA, 19 nt, Homo sapiens
gagacuuccugcuacguuu

SEQ ID NO: 831980 - RNA, 19 nt, Homo sapiens
gagggcagaugcuugauag

SEQ ID NO: 831981 - RNA, 19 nt, Homo sapiens
gaggaggacuggguguaaa

SEQ ID NO: 831982 - RNA, 19 nt, Homo sapiens
gaucagagagacgcaagua

SEQ ID NO: 831983 - RNA, 19 nt, Homo sapiens
cuacaagccuaccagauuc

SEQ ID NO: 831984 - RNA, 19 nt, Homo sapiens
gaaccuggaugagccuuuc

SEQ ID NO: 831985 - RNA, 19 nt, Homo sapiens
gcugcugcauucaugguua

SEQ ID NO: 831986 - RNA, 19 nt, Homo sapiens
gaagacaguggucaagaga

SEQ ID NO: 831987 - RNA, 19 nt, Homo sapiens
ucauguauguguccucuug

SEQ ID NO: 831988 - RNA, 19 nt, Homo sapiens
gaugagccuuucccugaga

SEQ ID NO: 831989 - RNA, 19 nt, Homo sapiens
gaaguuugaacccuuaugu

SEQ ID NO: 831990 - RNA, 19 nt, Homo sapiens
gaucagagacuguggaaaa

SEQ ID NO: 831991 - RNA, 19 nt, Homo sapiens
gaaugacaguagauuacau

SEQ ID NO: 831992 - RNA, 19 nt, Homo sapiens
ggaacuaucgcuucgugaa

SEQ ID NO: 831993 - RNA, 19 nt, Homo sapiens
ccucucagaugcuuucuuc

SEQ ID NO: 831994 - RNA, 19 nt, Homo sapiens
gagggaggcggaaguuuga

SEQ ID NO: 831995 - RNA, 19 nt, Homo sapiens
ccagguagagggcgacuuu

SEQ ID NO: 831996 - RNA, 19 nt, Homo sapiens
gcacugggacccugauauc

SEQ ID NO: 831997 - RNA, 19 nt, Homo sapiens
uaugggaguucuugauuuc

SEQ ID NO: 831998 - RNA, 19 nt, Homo sapiens
ggucgucucucccuucucu

SEQ ID NO: 831999 - RNA, 19 nt, Homo sapiens
gaaaugcagcuuuaaaaug

SEQ ID NO: 832000 - RNA, 19 nt, Homo sapiens
gauuggcucuguccagcaa

SEQ ID NO: 832001 - RNA, 19 nt, Homo sapiens
gguagugguaugagguuua

SEQ ID NO: 832002 - RNA, 19 nt, Homo sapiens
gaaacuuagauccaagaaa

SEQ ID NO: 832003 - RNA, 19 nt, Homo sapiens
uggcacuucugauggauaa

SEQ ID NO: 832004 - RNA, 19 nt, Homo sapiens
gggaguucuugauuucauu

SEQ ID NO: 832005 - RNA, 19 nt, Homo sapiens
gcuuggagcuacuuaaucg

SEQ ID NO: 832006 - RNA, 19 nt, Homo sapiens
cugcaugccuuaaucuuuc

SEQ ID NO: 832007 - RNA, 19 nt, Homo sapiens
uggcaguacuugcggauug

SEQ ID NO: 832008 - RNA, 19 nt, Homo sapiens
guucuugauuucauugguu

SEQ ID NO: 832009 - RNA, 19 nt, Homo sapiens
uuaugggaguucuugauuu

SEQ ID NO: 832010 - RNA, 19 nt, Homo sapiens
gaaggagugacagauacua

SEQ ID NO: 832011 - RNA, 19 nt, Homo sapiens
ucagagagacgcaaguaug

SEQ ID NO: 832012 - RNA, 19 nt, Homo sapiens
gauaaugugggcuuagugu

SEQ ID NO: 832013 - RNA, 19 nt, Homo sapiens
ggaacccucucugcgaaug

SEQ ID NO: 832014 - RNA, 19 nt, Homo sapiens
ccagacauccucaauugga

SEQ ID NO: 832015 - RNA, 19 nt, Homo sapiens
acucugaugucuuauaaca

SEQ ID NO: 832016 - RNA, 19 nt, Homo sapiens
aaagugaaaugggguuuua

SEQ ID NO: 832017 - RNA, 19 nt, Homo sapiens
gaaagccaaagacccaguu

SEQ ID NO: 832018 - RNA, 19 nt, Homo sapiens
caaaacugguccaagaauu

SEQ ID NO: 832019 - RNA, 19 nt, Homo sapiens
cugaagaccuaagcugauu

SEQ ID NO: 832020 - RNA, 19 nt, Homo sapiens
ccucugaccaguccacuuu

SEQ ID NO: 832021 - RNA, 19 nt, Homo sapiens
uuuccuugcuuucuuguuu

SEQ ID NO: 832022 - RNA, 19 nt, Homo sapiens
caagguggccagacuguca

SEQ ID NO: 832023 - RNA, 19 nt, Homo sapiens
cagaugcuuucuucacaug

SEQ ID NO: 832024 - RNA, 19 nt, Homo sapiens
caggugcucucaacugcaa

SEQ ID NO: 832025 - RNA, 19 nt, Homo sapiens
ugaagacaguggucaagag

SEQ ID NO: 832026 - RNA, 19 nt, Homo sapiens
gggcuaggguagugguaug

SEQ ID NO: 832027 - RNA, 19 nt, Homo sapiens
ccaaguaccuauguaugag

SEQ ID NO: 832028 - RNA, 19 nt, Homo sapiens
gggcugagucuguccuuga

SEQ ID NO: 832029 - RNA, 19 nt, Homo sapiens
uaaugugggcuuaguguug

SEQ ID NO: 832030 - RNA, 19 nt, Homo sapiens
gugcuagcccuguggagua

SEQ ID NO: 832031 - RNA, 19 nt, Homo sapiens
cagacauccucaauuggaa

SEQ ID NO: 832032 - RNA, 19 nt, Homo sapiens
gaaauuuuguggcgagaau

SEQ ID NO: 832033 - RNA, 19 nt, Homo sapiens
guggaaauaccauaucaug

SEQ ID NO: 832034 - RNA, 19 nt, Homo sapiens
caguggaaauaccauauca

SEQ ID NO: 832035 - RNA, 19 nt, Homo sapiens
ucaccugcaugccuuaauc

SEQ ID NO: 832036 - RNA, 19 nt, Homo sapiens
cuacccaaguaccuaugua

SEQ ID NO: 832037 - RNA, 19 nt, Homo sapiens
gggauaaugugggcuuagu

SEQ ID NO: 832038 - RNA, 19 nt, Homo sapiens
ugaugggcuuuaccuguuu

SEQ ID NO: 832039 - RNA, 19 nt, Homo sapiens
auccagacauccucaauug

SEQ ID NO: 832040 - RNA, 19 nt, Homo sapiens
aguucacucugaugucuua

SEQ ID NO: 832041 - RNA, 19 nt, Homo sapiens
gguccaagaauuugaagug

SEQ ID NO: 832042 - RNA, 19 nt, Homo sapiens
uagaaaacccugguauuua

SEQ ID NO: 832043 - RNA, 19 nt, Homo sapiens
ggaaugacaguagauuaca

SEQ ID NO: 832044 - RNA, 19 nt, Homo sapiens
gguguuggccuggagcaua

SEQ ID NO: 832045 - RNA, 19 nt, Homo sapiens
gaccugguguaauuucaca

SEQ ID NO: 832046 - RNA, 19 nt, Homo sapiens
guuaugggaguucuugauu

SEQ ID NO: 832047 - RNA, 19 nt, Homo sapiens
gguucuagggaauuuauuu

SEQ ID NO: 832048 - RNA, 19 nt, Homo sapiens
ugagggaggcggaaguuug

SEQ ID NO: 832049 - RNA, 19 nt, Homo sapiens
gcugaguccugugagaaug

SEQ ID NO: 832050 - RNA, 19 nt, Homo sapiens
gucaguauauacccacuuc

SEQ ID NO: 832051 - RNA, 19 nt, Homo sapiens
ucaccucucuacaacuuca

SEQ ID NO: 832052 - RNA, 19 nt, Homo sapiens
cagaaggccugggacaagu

SEQ ID NO: 832053 - RNA, 19 nt, Homo sapiens
gggcagaugcuugauagau

SEQ ID NO: 832054 - RNA, 19 nt, Homo sapiens
agaaaacccugguauuuag

SEQ ID NO: 832055 - RNA, 19 nt, Homo sapiens
gaagagagauggagaagaa

SEQ ID NO: 832056 - RNA, 19 nt, Homo sapiens
gcaaauacccugacaagua

SEQ ID NO: 832057 - RNA, 19 nt, Homo sapiens
gaaacuaccuuaaacgaaa

SEQ ID NO: 832058 - RNA, 19 nt, Homo sapiens
gaggaaagcuacagaaauu

SEQ ID NO: 832059 - RNA, 19 nt, Homo sapiens
ggaaguaaaugaaggaauu

SEQ ID NO: 832060 - RNA, 19 nt, Homo sapiens
caaauacccugacaaguaa

SEQ ID NO: 832061 - RNA, 19 nt, Homo sapiens
gcaaagggaugaggugauu

SEQ ID NO: 832062 - RNA, 19 nt, Homo sapiens
gaaauaaacgccacuccua

SEQ ID NO: 832063 - RNA, 19 nt, Homo sapiens
guacagggauuacagcauu

SEQ ID NO: 832064 - RNA, 19 nt, Homo sapiens
gaaugagccugcagucaaa

SEQ ID NO: 832065 - RNA, 19 nt, Homo sapiens
aaacagaccuugaaagaca

SEQ ID NO: 832066 - RNA, 19 nt, Homo sapiens
ggagaucgaugccauaaca

SEQ ID NO: 832067 - RNA, 19 nt, Homo sapiens
gagcaaggcugaagagaag

SEQ ID NO: 832068 - RNA, 19 nt, Homo sapiens
caagacacucuauguauua

SEQ ID NO: 832069 - RNA, 19 nt, Homo sapiens
gaauugagaugggcgauug

SEQ ID NO: 832070 - RNA, 19 nt, Homo sapiens
caacugauauugauaguac

SEQ ID NO: 832071 - RNA, 19 nt, Homo sapiens
gggcaagaguguaugcaua

SEQ ID NO: 832072 - RNA, 19 nt, Homo sapiens
ggggagaucuuauaaauuu

SEQ ID NO: 832073 - RNA, 19 nt, Homo sapiens
gaaaauggcuccaaacaca

SEQ ID NO: 832074 - RNA, 19 nt, Homo sapiens
ggaaucaacugcacagaag

SEQ ID NO: 832075 - RNA, 19 nt, Homo sapiens
caacaagacacucuaugua

SEQ ID NO: 832076 - RNA, 19 nt, Homo sapiens
ggaaagacaaggcaaagaa

SEQ ID NO: 832077 - RNA, 19 nt, Homo sapiens
ggagccaguuucagaagua

SEQ ID NO: 832078 - RNA, 19 nt, Homo sapiens
ggaacagacuccacccaaa

SEQ ID NO: 832079 - RNA, 19 nt, Homo sapiens
gcagcaacaucuacccuuu

SEQ ID NO: 832080 - RNA, 19 nt, Homo sapiens
gaauucagauaaagagaug

SEQ ID NO: 832081 - RNA, 19 nt, Homo sapiens
ggaauacacaaacaaauga

SEQ ID NO: 832082 - RNA, 19 nt, Homo sapiens
aaauucaccuccuuucuuu

SEQ ID NO: 832083 - RNA, 19 nt, Homo sapiens
caccugcaauuaugaguua

SEQ ID NO: 832084 - RNA, 19 nt, Homo sapiens
ggaaugagccugcagucaa

SEQ ID NO: 832085 - RNA, 19 nt, Homo sapiens
caucagacaauaccaguua

SEQ ID NO: 832086 - RNA, 19 nt, Homo sapiens
gaagcaacaacaauaguaa

SEQ ID NO: 832087 - RNA, 19 nt, Homo sapiens
ucaaguauguggcaguaaa

SEQ ID NO: 832088 - RNA, 19 nt, Homo sapiens
gaacaagugcaauucagaa

SEQ ID NO: 832089 - RNA, 19 nt, Homo sapiens
ggaauugucugaagcuuuu

SEQ ID NO: 832090 - RNA, 19 nt, Homo sapiens
gaagaggacaauucuaguu

SEQ ID NO: 832091 - RNA, 19 nt, Homo sapiens
ccaaacagaccuugaaaga

SEQ ID NO: 832092 - RNA, 19 nt, Homo sapiens
ggaauaaagaggaaagcua

SEQ ID NO: 832093 - RNA, 19 nt, Homo sapiens
acaagacacucuauguauu

SEQ ID NO: 832094 - RNA, 19 nt, Homo sapiens
guagaggacucccugacaa

SEQ ID NO: 832095 - RNA, 19 nt, Homo sapiens
gggaugaggugauuggaau

SEQ ID NO: 832096 - RNA, 19 nt, Homo sapiens
gaucauagacgguauuucu

SEQ ID NO: 832097 - RNA, 19 nt, Homo sapiens
auaaagagauggaaguaga

SEQ ID NO: 832098 - RNA, 19 nt, Homo sapiens
gauggaaugcguaggcuua

SEQ ID NO: 832099 - RNA, 19 nt, Homo sapiens
gacaauccaucuccaacuu

SEQ ID NO: 832100 - RNA, 19 nt, Homo sapiens
guaaagccacaggaaauua

SEQ ID NO: 832101 - RNA, 19 nt, Homo sapiens
agaagaagcaacaacaaua

SEQ ID NO: 832102 - RNA, 19 nt, Homo sapiens
agaaacaaguacaacagua

SEQ ID NO: 832103 - RNA, 19 nt, Homo sapiens
gaauucaggcucucucaaa

SEQ ID NO: 832104 - RNA, 19 nt, Homo sapiens
gcaauaugauacucagugu

SEQ ID NO: 832105 - RNA, 19 nt, Homo sapiens
ccaaagagacaaauggaaa

SEQ ID NO: 832106 - RNA, 19 nt, Homo sapiens
uggcaaacuuagcauguua

SEQ ID NO: 832107 - RNA, 19 nt, Homo sapiens
gcacagaagcgaauugaag

SEQ ID NO: 832108 - RNA, 19 nt, Homo sapiens
gcagucaaauuaccuugga

SEQ ID NO: 832109 - RNA, 19 nt, Homo sapiens
caacaggaauuggacauca

SEQ ID NO: 832110 - RNA, 19 nt, Homo sapiens
gaagaagcaacaacaauag

SEQ ID NO: 832111 - RNA, 19 nt, Homo sapiens
ccacacagguacagggauu

SEQ ID NO: 832112 - RNA, 19 nt, Homo sapiens
caucuacccuuucuucuuc

SEQ ID NO: 832113 - RNA, 19 nt, Homo sapiens
gaggaucuuugcaguguug

SEQ ID NO: 832114 - RNA, 19 nt, Homo sapiens
guauaacacuucuguagag

SEQ ID NO: 832115 - RNA, 19 nt, Homo sapiens
guauuaaccucaucagucu

SEQ ID NO: 832116 - RNA, 19 nt, Homo sapiens
gaaggaaagacaaggcaaa

SEQ ID NO: 832117 - RNA, 19 nt, Homo sapiens
gacacucuauguauuaaug

SEQ ID NO: 832118 - RNA, 19 nt, Homo sapiens
gaguaguucucauaaguuc

SEQ ID NO: 832119 - RNA, 19 nt, Homo sapiens
gcagagagaaaugcuaauu

SEQ ID NO: 832120 - RNA, 19 nt, Homo sapiens
caaagaagaguaagaccaa

SEQ ID NO: 832121 - RNA, 19 nt, Homo sapiens
ucaaguuucuucuucauca

SEQ ID NO: 832122 - RNA, 19 nt, Homo sapiens
gaagaaagccaagcacaag

SEQ ID NO: 832123 - RNA, 19 nt, Homo sapiens
ggaaacuaccuuaaacgaa

SEQ ID NO: 832124 - RNA, 19 nt, Homo sapiens
gcugcuugcuccuuuauug

SEQ ID NO: 832125 - RNA, 19 nt, Homo sapiens
caacaucuacccuuucuuc

SEQ ID NO: 832126 - RNA, 19 nt, Homo sapiens
ugaccaugcugccuuuauu

SEQ ID NO: 832127 - RNA, 19 nt, Homo sapiens
gaaggaaaauggcuccaaa

SEQ ID NO: 832128 - RNA, 19 nt, Homo sapiens
ggaugcagcagaacaacua

SEQ ID NO: 832129 - RNA, 19 nt, Homo sapiens
gaagaagagagauggagaa

SEQ ID NO: 832130 - RNA, 19 nt, Homo sapiens
uagaguaguucucauaagu

SEQ ID NO: 832131 - RNA, 19 nt, Homo sapiens
ggacccuccuucagucaaa

SEQ ID NO: 832132 - RNA, 19 nt, Homo sapiens
gaaacaaguacaacaguag

SEQ ID NO: 832133 - RNA, 19 nt, Homo sapiens
cuaaaggaauaaagaggaa

SEQ ID NO: 832134 - RNA, 19 nt, Homo sapiens
ccacagguucucuuuguaa

SEQ ID NO: 832135 - RNA, 19 nt, Homo sapiens
gacgguauuucuauguaaa

SEQ ID NO: 832136 - RNA, 19 nt, Homo sapiens
caaguaaauucgaguuucu

SEQ ID NO: 832137 - RNA, 19 nt, Homo sapiens
gaugagaauucagauaaag

SEQ ID NO: 832138 - RNA, 19 nt, Homo sapiens
ggaaagcuacagaaauuag

SEQ ID NO: 832139 - RNA, 19 nt, Homo sapiens
gaaagccaagcacaagaaa

SEQ ID NO: 832140 - RNA, 19 nt, Homo sapiens
ggaaggggcucuuaaugga

SEQ ID NO: 832141 - RNA, 19 nt, Homo sapiens
guaaagaggagccaguuuc

SEQ ID NO: 832142 - RNA, 19 nt, Homo sapiens
ggaggaagaggaacaagau

SEQ ID NO: 832143 - RNA, 19 nt, Homo sapiens
ggagguuccuagaguuguu

SEQ ID NO: 832144 - RNA, 19 nt, Homo sapiens
ggacgacucgccuucagaa

SEQ ID NO: 832145 - RNA, 19 nt, Homo sapiens
ggcaguaaauacaacaaga

SEQ ID NO: 832146 - RNA, 19 nt, Homo sapiens
gcugauagauggccacacu

SEQ ID NO: 832147 - RNA, 19 nt, Homo sapiens
gcucaugaguauaacacuu

SEQ ID NO: 832148 - RNA, 19 nt, Homo sapiens
ugcguaggcuuaugucuaa

SEQ ID NO: 832149 - RNA, 19 nt, Homo sapiens
uagcauguuagguguauua

SEQ ID NO: 832150 - RNA, 19 nt, Homo sapiens
ugaagaggaucgggaauca

SEQ ID NO: 832151 - RNA, 19 nt, Homo sapiens
gccuaccgcuaccauuaua

SEQ ID NO: 832152 - RNA, 19 nt, Homo sapiens
gaagaagaacaggauuuga

SEQ ID NO: 832153 - RNA, 19 nt, Homo sapiens
cccaauaucuugccacaca

SEQ ID NO: 832154 - RNA, 19 nt, Homo sapiens
cacgggauguuauuauuau

SEQ ID NO: 832155 - RNA, 19 nt, Homo sapiens
gcuaauagaucauuggaua

SEQ ID NO: 832156 - RNA, 19 nt, Homo sapiens
caaguuaucugucuuucua

SEQ ID NO: 832157 - RNA, 19 nt, Homo sapiens
gagaaugucuucauagaga

SEQ ID NO: 832158 - RNA, 19 nt, Homo sapiens
caacugaagucacaugaaa

SEQ ID NO: 832159 - RNA, 19 nt, Homo sapiens
caacuaaccuugugaaucu

SEQ ID NO: 832160 - RNA, 19 nt, Homo sapiens
gaaucuaguugcuccaaua

SEQ ID NO: 832161 - RNA, 19 nt, Homo sapiens
gaaccaaaguggcauccua

SEQ ID NO: 832162 - RNA, 19 nt, Homo sapiens
ggagaaagcuaacggaaca

SEQ ID NO: 832163 - RNA, 19 nt, Homo sapiens
gagaguauauauaguggua

SEQ ID NO: 832164 - RNA, 19 nt, Homo sapiens
gcaaucggcucucagaaga

SEQ ID NO: 832165 - RNA, 19 nt, Homo sapiens
gaacaacgaauuuagcaaa

SEQ ID NO: 832166 - RNA, 19 nt, Homo sapiens
gggcauagcucccuguaau

SEQ ID NO: 832167 - RNA, 19 nt, Homo sapiens
gagagaaugucuucauaga

SEQ ID NO: 832168 - RNA, 19 nt, Homo sapiens
agaaaggagugaaaguuua

SEQ ID NO: 832169 - RNA, 19 nt, Homo sapiens
caaacuaguugcagaagaa

SEQ ID NO: 832170 - RNA, 19 nt, Homo sapiens
gucaugagcugcacucuuu

SEQ ID NO: 832171 - RNA, 19 nt, Homo sapiens
ucucagcagugucuaauua

SEQ ID NO: 832172 - RNA, 19 nt, Homo sapiens
gguaauccgugaauauauu

SEQ ID NO: 832173 - RNA, 19 nt, Homo sapiens
ucucaaagcaucuaaguua

SEQ ID NO: 832174 - RNA, 19 nt, Homo sapiens
gcaguugcuuucuuuguaa

SEQ ID NO: 832175 - RNA, 19 nt, Homo sapiens
ccaaggacgucgaugagua

SEQ ID NO: 832176 - RNA, 19 nt, Homo sapiens
ucacucagguauuucuuua

SEQ ID NO: 832177 - RNA, 19 nt, Homo sapiens
caacgaauuuagcaaacua

SEQ ID NO: 832178 - RNA, 19 nt, Homo sapiens
ucacagaaguuuagcuuug

SEQ ID NO: 832179 - RNA, 19 nt, Homo sapiens
guaccuugcuacaguauuu

SEQ ID NO: 832180 - RNA, 19 nt, Homo sapiens
gaaacucuguaaucccuaa

SEQ ID NO: 832181 - RNA, 19 nt, Homo sapiens
ggacgucgaugaguacaaa

SEQ ID NO: 832182 - RNA, 19 nt, Homo sapiens
gcaguggucuuguggcaaa

SEQ ID NO: 832183 - RNA, 19 nt, Homo sapiens
gaucgugauuucagaauga

SEQ ID NO: 832184 - RNA, 19 nt, Homo sapiens
aaagauugauacccaguua

SEQ ID NO: 832185 - RNA, 19 nt, Homo sapiens
gaaauguagucccuggauu

SEQ ID NO: 832186 - RNA, 19 nt, Homo sapiens
gagaaaggagugaaaguuu

SEQ ID NO: 832187 - RNA, 19 nt, Homo sapiens
cuacucaacuuucuccuaa

SEQ ID NO: 832188 - RNA, 19 nt, Homo sapiens
cagagagaaugucuucaua

SEQ ID NO: 832189 - RNA, 19 nt, Homo sapiens
aaaguaagcugaagcagau

SEQ ID NO: 832190 - RNA, 19 nt, Homo sapiens
gaaaugcaaggguggauaa

SEQ ID NO: 832191 - RNA, 19 nt, Homo sapiens
gaauuuagcaaacuaguug

SEQ ID NO: 832192 - RNA, 19 nt, Homo sapiens
guaaagaucugggaaggau

SEQ ID NO: 832193 - RNA, 19 nt, Homo sapiens
ccaaagaccaucagucgua

SEQ ID NO: 832194 - RNA, 19 nt, Homo sapiens
gggagaaacucaagaacga

SEQ ID NO: 832195 - RNA, 19 nt, Homo sapiens
gaucaaaucaucacagaau

SEQ ID NO: 832196 - RNA, 19 nt, Homo sapiens
ggagccaccucucuucauu

SEQ ID NO: 832197 - RNA, 19 nt, Homo sapiens
ggaagaaaauugacguuaa

SEQ ID NO: 832198 - RNA, 19 nt, Homo sapiens
aaagugacaugaggaauuu

SEQ ID NO: 832199 - RNA, 19 nt, Homo sapiens
ugucugggauuccucauua

SEQ ID NO: 832200 - RNA, 19 nt, Homo sapiens
cagaagaaauugaggaugu

SEQ ID NO: 832201 - RNA, 19 nt, Homo sapiens
gaaaguaguagucagaaug

SEQ ID NO: 832202 - RNA, 19 nt, Homo sapiens
aaacguagcugcaguuguc

SEQ ID NO: 832203 - RNA, 19 nt, Homo sapiens
caaagcaucuaaguuauuc

SEQ ID NO: 832204 - RNA, 19 nt, Homo sapiens
gcagaguccuuacuuuauc

SEQ ID NO: 832205 - RNA, 19 nt, Homo sapiens
gaaggaggccaagaguuua

SEQ ID NO: 832206 - RNA, 19 nt, Homo sapiens
guaaaugcaucagugugua

SEQ ID NO: 832207 - RNA, 19 nt, Homo sapiens
guguguaucuguaguauug

SEQ ID NO: 832208 - RNA, 19 nt, Homo sapiens
caucuuacaugaucaaauc

SEQ ID NO: 832209 - RNA, 19 nt, Homo sapiens
caacuguuauccuaaucua

SEQ ID NO: 832210 - RNA, 19 nt, Homo sapiens
gagcuucaguaacuaaaga

SEQ ID NO: 832211 - RNA, 19 nt, Homo sapiens
cagcugcucuacaggaaua

SEQ ID NO: 832212 - RNA, 19 nt, Homo sapiens
cgugauagauuauugauag

SEQ ID NO: 832213 - RNA, 19 nt, Homo sapiens
uggcacaacuucagaacua

SEQ ID NO: 832214 - RNA, 19 nt, Homo sapiens
ccacuucacucugcuacua

SEQ ID NO: 832215 - RNA, 19 nt, Homo sapiens
agaaauccaucaucucuau

SEQ ID NO: 832216 - RNA, 19 nt, Homo sapiens
ucacugauuugccuagauu

SEQ ID NO: 832217 - RNA, 19 nt, Homo sapiens
ugaaggaggccaagaguuu

SEQ ID NO: 832218 - RNA, 19 nt, Homo sapiens
ggaaggaggcaaagagcua

SEQ ID NO: 832219 - RNA, 19 nt, Homo sapiens
guacugaggagaaagcuaa

SEQ ID NO: 832220 - RNA, 19 nt, Homo sapiens
gcauagcucccuguaauuu

SEQ ID NO: 832221 - RNA, 19 nt, Homo sapiens
guacaaaaguggauucuug

SEQ ID NO: 832222 - RNA, 19 nt, Homo sapiens
gaagucacaugaaaguaag

SEQ ID NO: 832223 - RNA, 19 nt, Homo sapiens
gaaaaucucaguaauggua

SEQ ID NO: 832224 - RNA, 19 nt, Homo sapiens
ccugaagucuaguuuauga

SEQ ID NO: 832225 - RNA, 19 nt, Homo sapiens
gaugcagaguccuuacuuu

SEQ ID NO: 832226 - RNA, 19 nt, Homo sapiens
gagaaaaccugcuguaaag

SEQ ID NO: 832227 - RNA, 19 nt, Homo sapiens
cacauuagcuugcuugaag

SEQ ID NO: 832228 - RNA, 19 nt, Homo sapiens
ucuaguugcuccaauauga

SEQ ID NO: 832229 - RNA, 19 nt, Homo sapiens
ccacugcucugccacaugu

SEQ ID NO: 832230 - RNA, 19 nt, Homo sapiens
gagcugcacucuuuucuuu

SEQ ID NO: 832231 - RNA, 19 nt, Homo sapiens
uuaacucucugccuuguuu

SEQ ID NO: 832232 - RNA, 19 nt, Homo sapiens
ucuguaaucccuaaaguua

SEQ ID NO: 832233 - RNA, 19 nt, Homo sapiens
gauggauauugguucuuua

SEQ ID NO: 832234 - RNA, 19 nt, Homo sapiens
gcuuagcacuuguuguuga

SEQ ID NO: 832235 - RNA, 19 nt, Homo sapiens
gaaaaggccuugucugaag

SEQ ID NO: 832236 - RNA, 19 nt, Homo sapiens
uggauuauguguaaccuuu

SEQ ID NO: 832237 - RNA, 19 nt, Homo sapiens
gccaagaguuuaugcuaug

SEQ ID NO: 832238 - RNA, 19 nt, Homo sapiens
caaagaaucagcugcucua

SEQ ID NO: 832239 - RNA, 19 nt, Homo sapiens
acacuuaacuggacaaacu

SEQ ID NO: 832240 - RNA, 19 nt, Homo sapiens
ugaaagcucuguacaacuc

SEQ ID NO: 832241 - RNA, 19 nt, Homo sapiens
ccaaggaucugcugaaagc

SEQ ID NO: 832242 - RNA, 19 nt, Homo sapiens
guucauccuuuguaauuug

SEQ ID NO: 832243 - RNA, 19 nt, Homo sapiens
acagguggcccauguauaa

SEQ ID NO: 832244 - RNA, 19 nt, Homo sapiens
gggacuuccuuccauauga

SEQ ID NO: 832245 - RNA, 19 nt, Homo sapiens
gcaugguuccagugaauua

SEQ ID NO: 832246 - RNA, 19 nt, Homo sapiens
gaacuuagggaagcacauu

SEQ ID NO: 832247 - RNA, 19 nt, Homo sapiens
uucaagaucuuucugguaa

SEQ ID NO: 832248 - RNA, 19 nt, Homo sapiens
ccugaaacaccaagcauua

SEQ ID NO: 832249 - RNA, 19 nt, Homo sapiens
ggacauuccucaugaucca

SEQ ID NO: 832250 - RNA, 19 nt, Homo sapiens
acaacucaaucaagaauga

SEQ ID NO: 832251 - RNA, 19 nt, Homo sapiens
guaugucagucaucaaaga

SEQ ID NO: 832252 - RNA, 19 nt, Homo sapiens
cagaaaaucuugacagcua

SEQ ID NO: 832253 - RNA, 19 nt, Homo sapiens
gcccauagccaaccacauu

SEQ ID NO: 832254 - RNA, 19 nt, Homo sapiens
gaagguugcugucugucau

SEQ ID NO: 832255 - RNA, 19 nt, Homo sapiens
gaucaaaucucgucagaaa

SEQ ID NO: 832256 - RNA, 19 nt, Homo sapiens
gcuaugaaguggcaaauua

SEQ ID NO: 832257 - RNA, 19 nt, Homo sapiens
gaaagagccucgaaauuug

SEQ ID NO: 832258 - RNA, 19 nt, Homo sapiens
uuaagaagcuuguagguua

SEQ ID NO: 832259 - RNA, 19 nt, Homo sapiens
ccaaagugcuguaauuuaa

SEQ ID NO: 832260 - RNA, 19 nt, Homo sapiens
gaaccgaaauuguaacuau

SEQ ID NO: 832261 - RNA, 19 nt, Homo sapiens
gaccauagcucuaguacuu

SEQ ID NO: 832262 - RNA, 19 nt, Homo sapiens
ggaauuagaugcagucugu

SEQ ID NO: 832263 - RNA, 19 nt, Homo sapiens
gaaccaagcaugugacuuu

SEQ ID NO: 832264 - RNA, 19 nt, Homo sapiens
agacagagauuugggauua

SEQ ID NO: 832265 - RNA, 19 nt, Homo sapiens
gagaacuccuucaauuaua

SEQ ID NO: 832266 - RNA, 19 nt, Homo sapiens
ggaggaaugugaaguagaa

SEQ ID NO: 832267 - RNA, 19 nt, Homo sapiens
ggacugaccuuggcugaaa

SEQ ID NO: 832268 - RNA, 19 nt, Homo sapiens
gagaagaccugagcucauu

SEQ ID NO: 832269 - RNA, 19 nt, Homo sapiens
gaacaaagaaauaccugua

SEQ ID NO: 832270 - RNA, 19 nt, Homo sapiens
ucagacaucuuccugcuua

SEQ ID NO: 832271 - RNA, 19 nt, Homo sapiens
gaagugaccugcugugaca

SEQ ID NO: 832272 - RNA, 19 nt, Homo sapiens
gauagaggcugaccuugaa

SEQ ID NO: 832273 - RNA, 19 nt, Homo sapiens
gaaaugagaccucuguuau

SEQ ID NO: 832274 - RNA, 19 nt, Homo sapiens
gacaggaagugauuaauga

SEQ ID NO: 832275 - RNA, 19 nt, Homo sapiens
caaauuacauguagagugu

SEQ ID NO: 832276 - RNA, 19 nt, Homo sapiens
ggaguacauucauaagaua

SEQ ID NO: 832277 - RNA, 19 nt, Homo sapiens
gaaacuauuugauccuuga

SEQ ID NO: 832278 - RNA, 19 nt, Homo sapiens
ggacauaugcccuuuagaa

SEQ ID NO: 832279 - RNA, 19 nt, Homo sapiens
gcagaucacugucgucaga

SEQ ID NO: 832280 - RNA, 19 nt, Homo sapiens
ugaaagagccucgaaauuu

SEQ ID NO: 832281 - RNA, 19 nt, Homo sapiens
agaaauaccuguaccauuc

SEQ ID NO: 832282 - RNA, 19 nt, Homo sapiens
gaagaaagcugcagaucac

SEQ ID NO: 832283 - RNA, 19 nt, Homo sapiens
gaggagaaauugaaacaug

SEQ ID NO: 832284 - RNA, 19 nt, Homo sapiens
ugaaagagcucauguucga

SEQ ID NO: 832285 - RNA, 19 nt, Homo sapiens
ugaaaugucugcagaucua

SEQ ID NO: 832286 - RNA, 19 nt, Homo sapiens
gcaagcaccucuucucugu

SEQ ID NO: 832287 - RNA, 19 nt, Homo sapiens
ggaggaaaguuacaccauu

SEQ ID NO: 832288 - RNA, 19 nt, Homo sapiens
gaaggugaauagagauaaa

SEQ ID NO: 832289 - RNA, 19 nt, Homo sapiens
gcucaggaauuuggauuua

SEQ ID NO: 832290 - RNA, 19 nt, Homo sapiens
ccauguaguuucacaauuu

SEQ ID NO: 832291 - RNA, 19 nt, Homo sapiens
gaaaucuacuucccugcua

SEQ ID NO: 832292 - RNA, 19 nt, Homo sapiens
gaggguaaguuucagaauu

SEQ ID NO: 832293 - RNA, 19 nt, Homo sapiens
gcaaagaggucaggaugga

SEQ ID NO: 832294 - RNA, 19 nt, Homo sapiens
gcaagaugcugaaaguaau

SEQ ID NO: 832295 - RNA, 19 nt, Homo sapiens
ggaagugauuaaugaauug

SEQ ID NO: 832296 - RNA, 19 nt, Homo sapiens
acagauagcuccuccaaga

SEQ ID NO: 832297 - RNA, 19 nt, Homo sapiens
aaacaccacugcaacuuaa

SEQ ID NO: 832298 - RNA, 19 nt, Homo sapiens
caaaggcacuuagaagauu

SEQ ID NO: 832299 - RNA, 19 nt, Homo sapiens
guagagagguuaagaagag

SEQ ID NO: 832300 - RNA, 19 nt, Homo sapiens
ccagaaagaugacaaugga

SEQ ID NO: 832301 - RNA, 19 nt, Homo sapiens
gagaguagauccgagauau

SEQ ID NO: 832302 - RNA, 19 nt, Homo sapiens
gaucagcccucacagacaa

SEQ ID NO: 832303 - RNA, 19 nt, Homo sapiens
cgaaggagauaaugaugaa

SEQ ID NO: 832304 - RNA, 19 nt, Homo sapiens
ccacuucuguuggauaaua

SEQ ID NO: 832305 - RNA, 19 nt, Homo sapiens
cgagauauauggucuuguu

SEQ ID NO: 832306 - RNA, 19 nt, Homo sapiens
gaaguuggguagagagguu

SEQ ID NO: 832307 - RNA, 19 nt, Homo sapiens
caacagauaacaaagcuuu

SEQ ID NO: 832308 - RNA, 19 nt, Homo sapiens
gagcagaagaugaugauuu

SEQ ID NO: 832309 - RNA, 19 nt, Homo sapiens
ccacagguacugcugauua

SEQ ID NO: 832310 - RNA, 19 nt, Homo sapiens
uaaagaagguggaggaaag

SEQ ID NO: 832311 - RNA, 19 nt, Homo sapiens
uugaagagcucaggaauuu

SEQ ID NO: 832312 - RNA, 19 nt, Homo sapiens
gaaagaugacaauggauuu

SEQ ID NO: 832313 - RNA, 19 nt, Homo sapiens
ucagaaggcucgcuuacuu

SEQ ID NO: 832314 - RNA, 19 nt, Homo sapiens
gaccucaucuauaaauuga

SEQ ID NO: 832315 - RNA, 19 nt, Homo sapiens
gguaagggaugcccaccua

SEQ ID NO: 832316 - RNA, 19 nt, Homo sapiens
ggaucaaccacaauuaaua

SEQ ID NO: 832317 - RNA, 19 nt, Homo sapiens
ccacaaagccaauuccauu

SEQ ID NO: 832318 - RNA, 19 nt, Homo sapiens
aaucaaaucugguuccuau

SEQ ID NO: 832319 - RNA, 19 nt, Homo sapiens
gcagaaaguugagcgcauu

SEQ ID NO: 832320 - RNA, 19 nt, Homo sapiens
gagaauuuaucuagaggaa

SEQ ID NO: 832321 - RNA, 19 nt, Homo sapiens
caaaucugguuccuaugua

SEQ ID NO: 832322 - RNA, 19 nt, Homo sapiens
gaauuguucuacacugaaa

SEQ ID NO: 832323 - RNA, 19 nt, Homo sapiens
gaacucuggugacucauuc

SEQ ID NO: 832324 - RNA, 19 nt, Homo sapiens
guaauuaugcuuccuguga

SEQ ID NO: 832325 - RNA, 19 nt, Homo sapiens
gaugaagucuaauucugaa

SEQ ID NO: 832326 - RNA, 19 nt, Homo sapiens
gggaguggguaaagaguuu

SEQ ID NO: 832327 - RNA, 19 nt, Homo sapiens
gcaccuugcuucacuauac

SEQ ID NO: 832328 - RNA, 19 nt, Homo sapiens
gacaauggcgcucagauuu

SEQ ID NO: 832329 - RNA, 19 nt, Homo sapiens
ugaagucgauauaugguuu

SEQ ID NO: 832330 - RNA, 19 nt, Homo sapiens
gaacuuucuguaucucuua

SEQ ID NO: 832331 - RNA, 19 nt, Homo sapiens
caaccacaauuaauaggaa

SEQ ID NO: 832332 - RNA, 19 nt, Homo sapiens
gaggaaaguuacaccauuc

SEQ ID NO: 832333 - RNA, 19 nt, Homo sapiens
gaacaugaacagaucaaug

SEQ ID NO: 832334 - RNA, 19 nt, Homo sapiens
gaacaccugcccaaagauu

SEQ ID NO: 832335 - RNA, 19 nt, Homo sapiens
ccacugguauugaggguuu

SEQ ID NO: 832336 - RNA, 19 nt, Homo sapiens
gcucuaguacuuccaaaua

SEQ ID NO: 832337 - RNA, 19 nt, Homo sapiens
cagcugcacuaaucuguuu

SEQ ID NO: 832338 - RNA, 19 nt, Homo sapiens
caggaagacuggcaacauu

SEQ ID NO: 832339 - RNA, 19 nt, Homo sapiens
gauaagaagcagaaaguug

SEQ ID NO: 832340 - RNA, 19 nt, Homo sapiens
ccagagcauugaauuacua

SEQ ID NO: 832341 - RNA, 19 nt, Homo sapiens
gcucuaggaugaauaguag

SEQ ID NO: 832342 - RNA, 19 nt, Homo sapiens
gauggaguaugcagaaguu

SEQ ID NO: 832343 - RNA, 19 nt, Homo sapiens
ggcaacauuucccaagaua

SEQ ID NO: 832344 - RNA, 19 nt, Homo sapiens
gggaagauuugcugacaug

SEQ ID NO: 832345 - RNA, 19 nt, Homo sapiens
caacagauaagaagcagaa

SEQ ID NO: 832346 - RNA, 19 nt, Homo sapiens
gcagagagagugugacaga

SEQ ID NO: 832347 - RNA, 19 nt, Homo sapiens
agagguacgugaucuguuu

SEQ ID NO: 832348 - RNA, 19 nt, Homo sapiens
ggaggaggaaugugaagua

SEQ ID NO: 832349 - RNA, 19 nt, Homo sapiens
uagagugucuccuuccuuu

SEQ ID NO: 832350 - RNA, 19 nt, Homo sapiens
caaagggcccugagucaaa

SEQ ID NO: 832351 - RNA, 19 nt, Homo sapiens
gacauuggcacuuguguaa

SEQ ID NO: 832352 - RNA, 19 nt, Homo sapiens
gagagucaccaacagauaa

SEQ ID NO: 832353 - RNA, 19 nt, Homo sapiens
uaaaggaaguuggagaaga

SEQ ID NO: 832354 - RNA, 19 nt, Homo sapiens
auacauaucugguggaaca

SEQ ID NO: 832355 - RNA, 19 nt, Homo sapiens
gaaagacuauugaaagaug

SEQ ID NO: 832356 - RNA, 19 nt, Homo sapiens
gcaccgagcuuuacagugu

SEQ ID NO: 832357 - RNA, 19 nt, Homo sapiens
caacaucaccuacuacuuu

SEQ ID NO: 832358 - RNA, 19 nt, Homo sapiens
ggagaucguugaugagaaa

SEQ ID NO: 832359 - RNA, 19 nt, Homo sapiens
caacugcccugaauuuguu

SEQ ID NO: 832360 - RNA, 19 nt, Homo sapiens
caaagaaggcuacagauau

SEQ ID NO: 832361 - RNA, 19 nt, Homo sapiens
gcccacaccuggagagaua

SEQ ID NO: 832362 - RNA, 19 nt, Homo sapiens
gagggcagcuguuccuaaa

SEQ ID NO: 832363 - RNA, 19 nt, Homo sapiens
gagaagggagugauaguaa

SEQ ID NO: 832364 - RNA, 19 nt, Homo sapiens
ccaaagaaggcuacagaua

SEQ ID NO: 832365 - RNA, 19 nt, Homo sapiens
gaagaagaaaggaaacaaa

SEQ ID NO: 832366 - RNA, 19 nt, Homo sapiens
cagcaagguuggugacuuu

SEQ ID NO: 832367 - RNA, 19 nt, Homo sapiens
aagaauaccucggcaaauu

SEQ ID NO: 832368 - RNA, 19 nt, Homo sapiens
aaagaaggcuacagauaug

SEQ ID NO: 832369 - RNA, 19 nt, Homo sapiens
ugaacaacaucaccuacua

SEQ ID NO: 832370 - RNA, 19 nt, Homo sapiens
ggacaggccuggaguuacu

SEQ ID NO: 832371 - RNA, 19 nt, Homo sapiens
gcaagaauaccucggcaaa

SEQ ID NO: 832372 - RNA, 19 nt, Homo sapiens
gaaaauggcuucacacaac

SEQ ID NO: 832373 - RNA, 19 nt, Homo sapiens
gaagggacgccuacaguug

SEQ ID NO: 832374 - RNA, 19 nt, Homo sapiens
gaacuggauugaagugaag

SEQ ID NO: 832375 - RNA, 19 nt, Homo sapiens
caacacgucuaccauaagu

SEQ ID NO: 832376 - RNA, 19 nt, Homo sapiens
gaacuggccaaggucauua

SEQ ID NO: 832377 - RNA, 19 nt, Homo sapiens
cacaacacgucuaccauaa

SEQ ID NO: 832378 - RNA, 19 nt, Homo sapiens
ccaaguacaugaacaacau

SEQ ID NO: 832379 - RNA, 19 nt, Homo sapiens
gaaauauuccaaagccaaa

SEQ ID NO: 832380 - RNA, 19 nt, Homo sapiens
ggaacuggauuuucuguuu

SEQ ID NO: 832381 - RNA, 19 nt, Homo sapiens
caaguggguuccauuacaa

SEQ ID NO: 832382 - RNA, 19 nt, Homo sapiens
ggacaagccagcacucgaa

SEQ ID NO: 832383 - RNA, 19 nt, Homo sapiens
uguaugggcuggagaaguu

SEQ ID NO: 832384 - RNA, 19 nt, Homo sapiens
ggacaccacagcucaaaga

SEQ ID NO: 832385 - RNA, 19 nt, Homo sapiens
ggauugaagugaagaagag

SEQ ID NO: 832386 - RNA, 19 nt, Homo sapiens
gaucguugaugagaaaguu

SEQ ID NO: 832387 - RNA, 19 nt, Homo sapiens
gaaaggaaacaaacacaag

SEQ ID NO: 832388 - RNA, 19 nt, Homo sapiens
ggagaagggagugauagua

SEQ ID NO: 832389 - RNA, 19 nt, Homo sapiens
gaaggaaaccaaaggaucu

SEQ ID NO: 832390 - RNA, 19 nt, Homo sapiens
gcucaaagacuacaucaag

SEQ ID NO: 832391 - RNA, 19 nt, Homo sapiens
caucgagugugaagaguga

SEQ ID NO: 832392 - RNA, 19 nt, Homo sapiens
gcccagcacugucucauag

SEQ ID NO: 832393 - RNA, 19 nt, Homo sapiens
cggaaacgcuugggcauug

SEQ ID NO: 832394 - RNA, 19 nt, Homo sapiens
cauccuagcuucuucuaag

SEQ ID NO: 832395 - RNA, 19 nt, Homo sapiens
gaaaauggaugcugauggu

SEQ ID NO: 832396 - RNA, 19 nt, Homo sapiens
ggagagauagcccacaaga

SEQ ID NO: 832397 - RNA, 19 nt, Homo sapiens
gggagaagccauugccauu

SEQ ID NO: 832398 - RNA, 19 nt, Homo sapiens
acacaaguggguuccauua

SEQ ID NO: 832399 - RNA, 19 nt, Homo sapiens
aggaaagacuauugaaaga

SEQ ID NO: 832400 - RNA, 19 nt, Homo sapiens
guucugggccuucuugaaa

SEQ ID NO: 832401 - RNA, 19 nt, Homo sapiens
cgagaucacuucaacaaaa

SEQ ID NO: 832402 - RNA, 19 nt, Homo sapiens
cagcaacccugaacacucu

SEQ ID NO: 832403 - RNA, 19 nt, Homo sapiens
ugacauuucacucaucuuu

SEQ ID NO: 832404 - RNA, 19 nt, Homo sapiens
auagaaggcucugguggua

SEQ ID NO: 832405 - RNA, 19 nt, Homo sapiens
gaagaugccaaauggacaa

SEQ ID NO: 832406 - RNA, 19 nt, Homo sapiens
acacaacacgucuaccaua

SEQ ID NO: 832407 - RNA, 19 nt, Homo sapiens
gaucaaagggucugagucu

SEQ ID NO: 832408 - RNA, 19 nt, Homo sapiens
gaauggagaugaggauugc

SEQ ID NO: 832409 - RNA, 19 nt, Homo sapiens
gcagcaagguuggugacuu

SEQ ID NO: 832410 - RNA, 19 nt, Homo sapiens
ugaggaaucugacuaugag

SEQ ID NO: 832411 - RNA, 19 nt, Homo sapiens
gaugagaaaguucguagga

SEQ ID NO: 832412 - RNA, 19 nt, Homo sapiens
agaaggacaugaaggaaca

SEQ ID NO: 832413 - RNA, 19 nt, Homo sapiens
ccaagaaggacaugaagga

SEQ ID NO: 832414 - RNA, 19 nt, Homo sapiens
ggaaaccaaaggaucuaaa

SEQ ID NO: 832415 - RNA, 19 nt, Homo sapiens
caagguuggugacuuugga

SEQ ID NO: 832416 - RNA, 19 nt, Homo sapiens
cuaugaagcuggccaacug

SEQ ID NO: 832417 - RNA, 19 nt, Homo sapiens
cccaugaacugcucaagga

SEQ ID NO: 832418 - RNA, 19 nt, Homo sapiens
gacacuggaugccaagaug

SEQ ID NO: 832419 - RNA, 19 nt, Homo sapiens
gauggccucuucuacuaug

SEQ ID NO: 832420 - RNA, 19 nt, Homo sapiens
ugccugaccuggauucuga

SEQ ID NO: 832421 - RNA, 19 nt, Homo sapiens
aggaaacggugaaggacua

SEQ ID NO: 832422 - RNA, 19 nt, Homo sapiens
gaacuggauuuucuguuug

SEQ ID NO: 832423 - RNA, 19 nt, Homo sapiens
acaaguggguuccauuaca

SEQ ID NO: 832424 - RNA, 19 nt, Homo sapiens
ccagcacugucucauagaa

SEQ ID NO: 832425 - RNA, 19 nt, Homo sapiens
acacacagacuuugggaaa

SEQ ID NO: 832426 - RNA, 19 nt, Homo sapiens
gaaagacaagacacaguuc

SEQ ID NO: 832427 - RNA, 19 nt, Homo sapiens
ucugagaacuggauugaag

SEQ ID NO: 832428 - RNA, 19 nt, Homo sapiens
ccacugacauuucacucau

SEQ ID NO: 832429 - RNA, 19 nt, Homo sapiens
ccuggucacuccaugcuuu

SEQ ID NO: 832430 - RNA, 19 nt, Homo sapiens
gcgcaaaggcagcaagguu

SEQ ID NO: 832431 - RNA, 19 nt, Homo sapiens
agagauagcccacaagagu

SEQ ID NO: 832432 - RNA, 19 nt, Homo sapiens
gaaguuccggcuggacaua

SEQ ID NO: 832433 - RNA, 19 nt, Homo sapiens
ccaagaggcucccauaccu

SEQ ID NO: 832434 - RNA, 19 nt, Homo sapiens
acagggaugucaacaagau

SEQ ID NO: 832435 - RNA, 19 nt, Homo sapiens
aaacagaggaggucagcaa

SEQ ID NO: 832436 - RNA, 19 nt, Homo sapiens
ggaugcugaugguuuccua

SEQ ID NO: 832437 - RNA, 19 nt, Homo sapiens
guaaacugccacccaagaa

SEQ ID NO: 832438 - RNA, 19 nt, Homo sapiens
ggaaagacuauugaaagau

SEQ ID NO: 832439 - RNA, 19 nt, Homo sapiens
ccaggaaagacuauugaaa

SEQ ID NO: 832440 - RNA, 19 nt, Homo sapiens
ggagaaggaaaccaaagga

SEQ ID NO: 832441 - RNA, 19 nt, Homo sapiens
ugauaguucaucuggauua

SEQ ID NO: 832442 - RNA, 19 nt, Homo sapiens
aaagauguaugaggaguuc

SEQ ID NO: 832443 - RNA, 19 nt, Homo sapiens
ucacccagacaccacauua

SEQ ID NO: 832444 - RNA, 19 nt, Homo sapiens
gaugaggaaucugacuaug

SEQ ID NO: 832445 - RNA, 19 nt, Homo sapiens
ggucugaugaggaaucuga

SEQ ID NO: 832446 - RNA, 19 nt, Homo sapiens
caggaaagacuauugaaag

SEQ ID NO: 832447 - RNA, 19 nt, Homo sapiens
gaagcuggccaacuguaug

SEQ ID NO: 832448 - RNA, 19 nt, Homo sapiens
cuacaguuauggccuggaa

SEQ ID NO: 832449 - RNA, 19 nt, Homo sapiens
ggagaugaacacacucuuc

SEQ ID NO: 832450 - RNA, 19 nt, Homo sapiens
ucaccaaacuaccgcaaca

SEQ ID NO: 832451 - RNA, 19 nt, Homo sapiens
agaacuggauugaagugaa

SEQ ID NO: 832452 - RNA, 19 nt, Homo sapiens
ucucaacugcccugaauuu

SEQ ID NO: 832453 - RNA, 19 nt, Homo sapiens
gaacaacaucaccuacuac

SEQ ID NO: 832454 - RNA, 19 nt, Homo sapiens
ggucugagucugccaccua

SEQ ID NO: 832455 - RNA, 19 nt, Homo sapiens
gcacacagcgccuuaaaua

SEQ ID NO: 832456 - RNA, 19 nt, Homo sapiens
gaaacaaccugucgagaug

SEQ ID NO: 832457 - RNA, 19 nt, Homo sapiens
gaacaaagguguggcguau

SEQ ID NO: 832458 - RNA, 19 nt, Homo sapiens
ccaaauaaauacccacuuu

SEQ ID NO: 832459 - RNA, 19 nt, Homo sapiens
gagauaaacguacugaaua

SEQ ID NO: 832460 - RNA, 19 nt, Homo sapiens
gagcaacaaugaacagauu

SEQ ID NO: 832461 - RNA, 19 nt, Homo sapiens
ccacaccaccuaagaauua

SEQ ID NO: 832462 - RNA, 19 nt, Homo sapiens
ugaauggguuccagucuua

SEQ ID NO: 832463 - RNA, 19 nt, Homo sapiens
caaucugucugcugaaaua

SEQ ID NO: 832464 - RNA, 19 nt, Homo sapiens
ucucagagcuccaagauau

SEQ ID NO: 832465 - RNA, 19 nt, Homo sapiens
gcacugcgcugccucuugu

SEQ ID NO: 832466 - RNA, 19 nt, Homo sapiens
gaaacuggccaacauuaaa

SEQ ID NO: 832467 - RNA, 19 nt, Homo sapiens
guguaaaugugcacaauaa

SEQ ID NO: 832468 - RNA, 19 nt, Homo sapiens
ccgaugauauuaacuguuu

SEQ ID NO: 832469 - RNA, 19 nt, Homo sapiens
cgaacuauguuggaaauuu

SEQ ID NO: 832470 - RNA, 19 nt, Homo sapiens
caaaggagccucuguaugg

SEQ ID NO: 832471 - RNA, 19 nt, Homo sapiens
aaauguaccuggagauaaa

SEQ ID NO: 832472 - RNA, 19 nt, Homo sapiens
cagaaggaacucuuaaaua

SEQ ID NO: 832473 - RNA, 19 nt, Homo sapiens
gcaacgaacucagagaaau

SEQ ID NO: 832474 - RNA, 19 nt, Homo sapiens
gaauucaaguuccauauac

SEQ ID NO: 832475 - RNA, 19 nt, Homo sapiens
uaacagaaguuccuauaac

SEQ ID NO: 832476 - RNA, 19 nt, Homo sapiens
ugaaguuccugcuggauuu

SEQ ID NO: 832477 - RNA, 19 nt, Homo sapiens
ggagauaaacguacugaau

SEQ ID NO: 832478 - RNA, 19 nt, Homo sapiens
gggagagccucagcauaua

SEQ ID NO: 832479 - RNA, 19 nt, Homo sapiens
uuaaagcaguguaugguaa

SEQ ID NO: 832480 - RNA, 19 nt, Homo sapiens
ggaaacuggccaacauuaa

SEQ ID NO: 832481 - RNA, 19 nt, Homo sapiens
gauggaaacuggccaacau

SEQ ID NO: 832482 - RNA, 19 nt, Homo sapiens
gaacagcguuuacauuuuc

SEQ ID NO: 832483 - RNA, 19 nt, Homo sapiens
cagaagcucuuacugacuu

SEQ ID NO: 832484 - RNA, 19 nt, Homo sapiens
caaauccgcuaaugaugga

SEQ ID NO: 832485 - RNA, 19 nt, Homo sapiens
ggaaacaaccugucgagau

SEQ ID NO: 832486 - RNA, 19 nt, Homo sapiens
uaaauaagcgcaacaugga

SEQ ID NO: 832487 - RNA, 19 nt, Homo sapiens
gcagaaggaacucuuaaau

SEQ ID NO: 832488 - RNA, 19 nt, Homo sapiens
gaaauugaaagaacgaguu

SEQ ID NO: 832489 - RNA, 19 nt, Homo sapiens
ggagaguggugccgccauu

SEQ ID NO: 832490 - RNA, 19 nt, Homo sapiens
gaacgucccauacccuuug

SEQ ID NO: 832491 - RNA, 19 nt, Homo sapiens
gcagacagcguccacaaug

SEQ ID NO: 832492 - RNA, 19 nt, Homo sapiens
gaacagauuuuaacagaag

SEQ ID NO: 832493 - RNA, 19 nt, Homo sapiens
gcaauuggaagauuuaaag

SEQ ID NO: 832494 - RNA, 19 nt, Homo sapiens
gaugaugccgaugauauua

SEQ ID NO: 832495 - RNA, 19 nt, Homo sapiens
ggacacucauccuuucuca

SEQ ID NO: 832496 - RNA, 19 nt, Homo sapiens
gggcugagaguccgguuua

SEQ ID NO: 832497 - RNA, 19 nt, Homo sapiens
gaagaaaauucgugcaaug

SEQ ID NO: 832498 - RNA, 19 nt, Homo sapiens
aaacagaauucuagcucuu

SEQ ID NO: 832499 - RNA, 19 nt, Homo sapiens
caacuuaaccaggaacaaa

SEQ ID NO: 832500 - RNA, 19 nt, Homo sapiens
gaacaagguggccgucaga

SEQ ID NO: 832501 - RNA, 19 nt, Homo sapiens
gagggaagaagugaaauuu

SEQ ID NO: 832502 - RNA, 19 nt, Homo sapiens
gucgagauguuguagaauu

SEQ ID NO: 832503 - RNA, 19 nt, Homo sapiens
gaaguacagacugcaauuu

SEQ ID NO: 832504 - RNA, 19 nt, Homo sapiens
agacagaagcucuuacuga

SEQ ID NO: 832505 - RNA, 19 nt, Homo sapiens
ggccuuuccuggcugauaa

SEQ ID NO: 832506 - RNA, 19 nt, Homo sapiens
guaccaagaacuacagauu

SEQ ID NO: 832507 - RNA, 19 nt, Homo sapiens
ggaaguacagacugcaauu

SEQ ID NO: 832508 - RNA, 19 nt, Homo sapiens
caacagcagcagauugaaa

SEQ ID NO: 832509 - RNA, 19 nt, Homo sapiens
gaauccacguguugaacuu

SEQ ID NO: 832510 - RNA, 19 nt, Homo sapiens
caaugugaauccuacaguu

SEQ ID NO: 832511 - RNA, 19 nt, Homo sapiens
gaagauccaaauccgcuaa

SEQ ID NO: 832512 - RNA, 19 nt, Homo sapiens
caagaacuacagauucgua

SEQ ID NO: 832513 - RNA, 19 nt, Homo sapiens
gaaaauucgugcaaugaga

SEQ ID NO: 832514 - RNA, 19 nt, Homo sapiens
ccagcaagcccaacgauga

SEQ ID NO: 832515 - RNA, 19 nt, Homo sapiens
gcagcagucuauuucugaa

SEQ ID NO: 832516 - RNA, 19 nt, Homo sapiens
gagcaacgaacucagagaa

SEQ ID NO: 832517 - RNA, 19 nt, Homo sapiens
gauccaaauccgcuaauga

SEQ ID NO: 832518 - RNA, 19 nt, Homo sapiens
gcagcagaaggaacucuua

SEQ ID NO: 832519 - RNA, 19 nt, Homo sapiens
ggagggaagaagugaaauu

SEQ ID NO: 832520 - RNA, 19 nt, Homo sapiens
ggaaaugaacgucccauac

SEQ ID NO: 832521 - RNA, 19 nt, Homo sapiens
ccauuaagaagucccauaa

SEQ ID NO: 832522 - RNA, 19 nt, Homo sapiens
ugccaaugauaaugaguua

SEQ ID NO: 832523 - RNA, 19 nt, Homo sapiens
ucgacaagcucccuggaaa

SEQ ID NO: 832524 - RNA, 19 nt, Homo sapiens
ggaacagcguuuacauuuu

SEQ ID NO: 832525 - RNA, 19 nt, Homo sapiens
gaacucagagaaauguaau

SEQ ID NO: 832526 - RNA, 19 nt, Homo sapiens
cagaaaguacugagaaaga

SEQ ID NO: 832527 - RNA, 19 nt, Homo sapiens
gcgaugaugccgaugauau

SEQ ID NO: 832528 - RNA, 19 nt, Homo sapiens
ggagccacuuaagagauua

SEQ ID NO: 832529 - RNA, 19 nt, Homo sapiens
caacgugaaugcugcugau

SEQ ID NO: 832530 - RNA, 19 nt, Homo sapiens
gcaucgagauugguaaagu

SEQ ID NO: 832531 - RNA, 19 nt, Homo sapiens
ucgagauguuguagaauuu

SEQ ID NO: 832532 - RNA, 19 nt, Homo sapiens
ggcaacagcagcagauuga

SEQ ID NO: 832533 - RNA, 19 nt, Homo sapiens
ggaaggagaguucgaucug

SEQ ID NO: 832534 - RNA, 19 nt, Homo sapiens
aaacaccaaugccaaugga

SEQ ID NO: 832535 - RNA, 19 nt, Homo sapiens
gaacgucucuaugggaaaa

SEQ ID NO: 832536 - RNA, 19 nt, Homo sapiens
uaaauguaccuggagauaa

SEQ ID NO: 832537 - RNA, 19 nt, Homo sapiens
caagagcaacgaacucaga

SEQ ID NO: 832538 - RNA, 19 nt, Homo sapiens
cccauacccuuugaucaua

SEQ ID NO: 832539 - RNA, 19 nt, Homo sapiens
gaaugcugcugauagugau

SEQ ID NO: 832540 - RNA, 19 nt, Homo sapiens
cgaacaagcggaccaacuu

SEQ ID NO: 832541 - RNA, 19 nt, Homo sapiens
uaaccaacuuaaccaggaa

SEQ ID NO: 832542 - RNA, 19 nt, Homo sapiens
aggaacagcguuuacauuu

SEQ ID NO: 832543 - RNA, 19 nt, Homo sapiens
caacgaacucagagaaaug

SEQ ID NO: 832544 - RNA, 19 nt, Homo sapiens
guaugagucguguguaauu

SEQ ID NO: 832545 - RNA, 19 nt, Homo sapiens
ggcaaucugucugcugaaa

SEQ ID NO: 832546 - RNA, 19 nt, Homo sapiens
agaacaagcugaagaaaau

SEQ ID NO: 832547 - RNA, 19 nt, Homo sapiens
ccacuuaagagauuauugu

SEQ ID NO: 832548 - RNA, 19 nt, Homo sapiens
uacauaguguggugaagaa

SEQ ID NO: 832549 - RNA, 19 nt, Homo sapiens
ugagucguguguaauuuau

SEQ ID NO: 832550 - RNA, 19 nt, Homo sapiens
ugggagagccucagcauau

SEQ ID NO: 832551 - RNA, 19 nt, Homo sapiens
ugagaacagugaacaaggu

SEQ ID NO: 832552 - RNA, 19 nt, Homo sapiens
gucagcaauuggaagauuu

SEQ ID NO: 832553 - RNA, 19 nt, Homo sapiens
guacauaguguggugaaga

SEQ ID NO: 832554 - RNA, 19 nt, Homo sapiens
uaugagucguguguaauuu

SEQ ID NO: 832555 - RNA, 19 nt, Homo sapiens
gagcaaaucuguaugauaa

SEQ ID NO: 832556 - RNA, 19 nt, Homo sapiens
gcacuaaucugcaaucuaa

SEQ ID NO: 832557 - RNA, 19 nt, Homo sapiens
gaucaaagcugucauguug

SEQ ID NO: 832558 - RNA, 19 nt, Homo sapiens
gaacagaccuuaccuaucu

SEQ ID NO: 832559 - RNA, 19 nt, Homo sapiens
gcaagcagccuaucaauua

SEQ ID NO: 832560 - RNA, 19 nt, Homo sapiens
ggacugagauauuugguua

SEQ ID NO: 832561 - RNA, 19 nt, Homo sapiens
aaacacaacucaacuauga

SEQ ID NO: 832562 - RNA, 19 nt, Homo sapiens
guaacacgauguacauuua

SEQ ID NO: 832563 - RNA, 19 nt, Homo sapiens
ugagagagcuuuacugauu

SEQ ID NO: 832564 - RNA, 19 nt, Homo sapiens
gaggaaguguugagcuuua

SEQ ID NO: 832565 - RNA, 19 nt, Homo sapiens
gagaaagaguggaaauuug

SEQ ID NO: 832566 - RNA, 19 nt, Homo sapiens
gaagaacuccaccaacaua

SEQ ID NO: 832567 - RNA, 19 nt, Homo sapiens
gcaacuauguuauacagaa

SEQ ID NO: 832568 - RNA, 19 nt, Homo sapiens
ggaagcaguucuuugacua

SEQ ID NO: 832569 - RNA, 19 nt, Homo sapiens
ccaauuaagugcacuaaau

SEQ ID NO: 832570 - RNA, 19 nt, Homo sapiens
acuaauagcucccagagua

SEQ ID NO: 832571 - RNA, 19 nt, Homo sapiens
cuagagaucugcagaagaa

SEQ ID NO: 832572 - RNA, 19 nt, Homo sapiens
ggcauuaucucugcaauuu

SEQ ID NO: 832573 - RNA, 19 nt, Homo sapiens
caaauggaaugcuguaaau

SEQ ID NO: 832574 - RNA, 19 nt, Homo sapiens
gaccuuaccuaucuuagaa

SEQ ID NO: 832575 - RNA, 19 nt, Homo sapiens
acauauagcugguguauuc

SEQ ID NO: 832576 - RNA, 19 nt, Homo sapiens
gaauuuggaucacuuucaa

SEQ ID NO: 832577 - RNA, 19 nt, Homo sapiens
ccagaguaguucuuuauuu

SEQ ID NO: 832578 - RNA, 19 nt, Homo sapiens
ggaacaaguuggucuggaa

SEQ ID NO: 832579 - RNA, 19 nt, Homo sapiens
gaccucacauuacuacuuu

SEQ ID NO: 832580 - RNA, 19 nt, Homo sapiens
gaaagauaaucaugcacaa

SEQ ID NO: 832581 - RNA, 19 nt, Homo sapiens
cagcacaaauggucuguuu

SEQ ID NO: 832582 - RNA, 19 nt, Homo sapiens
gguaauggcuuuccugucu

SEQ ID NO: 832583 - RNA, 19 nt, Homo sapiens
ggagauugguaauggcuuu

SEQ ID NO: 832584 - RNA, 19 nt, Homo sapiens
uuugauagcucagcauuua

SEQ ID NO: 832585 - RNA, 19 nt, Homo sapiens
guauuggacugagauauuu

SEQ ID NO: 832586 - RNA, 19 nt, Homo sapiens
aaacuaaacccucuucuug

SEQ ID NO: 832587 - RNA, 19 nt, Homo sapiens
uaaagugguuugagaugaa

SEQ ID NO: 832588 - RNA, 19 nt, Homo sapiens
gcaaauaacgaguaaguag

SEQ ID NO: 832589 - RNA, 19 nt, Homo sapiens
caagcagccuaucaauuaa

SEQ ID NO: 832590 - RNA, 19 nt, Homo sapiens
gagaugaugaugauucuaa

SEQ ID NO: 832591 - RNA, 19 nt, Homo sapiens
aggcaaggcuucuccauuu

SEQ ID NO: 832592 - RNA, 19 nt, Homo sapiens
cauguuugguguugaguua

SEQ ID NO: 832593 - RNA, 19 nt, Homo sapiens
ucaaaugugugaaagauca

SEQ ID NO: 832594 - RNA, 19 nt, Homo sapiens
gcaugguucuagauucaua

SEQ ID NO: 832595 - RNA, 19 nt, Homo sapiens
gcuaauaaaccacuuguug

SEQ ID NO: 832596 - RNA, 19 nt, Homo sapiens
gaugaugaauggagagaga

SEQ ID NO: 832597 - RNA, 19 nt, Homo sapiens
caaagccgcugucucacuu

SEQ ID NO: 832598 - RNA, 19 nt, Homo sapiens
gaaacaaccgcuucccaaa

SEQ ID NO: 832599 - RNA, 19 nt, Homo sapiens
gaaauaaaccuggucuugu

SEQ ID NO: 832600 - RNA, 19 nt, Homo sapiens
gcucagcauuuaagcauga

SEQ ID NO: 832601 - RNA, 19 nt, Homo sapiens
ggaaccagauagagaugaa

SEQ ID NO: 832602 - RNA, 19 nt, Homo sapiens
uuacagacauguugaggaa

SEQ ID NO: 832603 - RNA, 19 nt, Homo sapiens
agaauaaagugguuugaga

SEQ ID NO: 832604 - RNA, 19 nt, Homo sapiens
uagaagaacuccaccaaca

SEQ ID NO: 832605 - RNA, 19 nt, Homo sapiens
ggauuugguucaucaguug

SEQ ID NO: 832606 - RNA, 19 nt, Homo sapiens
gcaguucuuugacuaauag

SEQ ID NO: 832607 - RNA, 19 nt, Homo sapiens
gcaaaucuguaugauaaca

SEQ ID NO: 832608 - RNA, 19 nt, Homo sapiens
gagagagcuuuacugauug

SEQ ID NO: 832609 - RNA, 19 nt, Homo sapiens
ccuuauggcugcagaguaa

SEQ ID NO: 832610 - RNA, 19 nt, Homo sapiens
ucacuacaguucaucauug

SEQ ID NO: 832611 - RNA, 19 nt, Homo sapiens
gcaggucagcguccucuua

SEQ ID NO: 832612 - RNA, 19 nt, Homo sapiens
aaauaaaccuggucuugug

SEQ ID NO: 832613 - RNA, 19 nt, Homo sapiens
aaaaguaccuguucuugua

SEQ ID NO: 832614 - RNA, 19 nt, Homo sapiens
gacauaagacauaacagua

SEQ ID NO: 832615 - RNA, 19 nt, Homo sapiens
gaaagaguggaaauuugua

SEQ ID NO: 832616 - RNA, 19 nt, Homo sapiens
gacagaugguauuuaauga

SEQ ID NO: 832617 - RNA, 19 nt, Homo sapiens
gaaucuggaugccauggaa

SEQ ID NO: 832618 - RNA, 19 nt, Homo sapiens
cauuguguguguaguaaua

SEQ ID NO: 832619 - RNA, 19 nt, Homo sapiens
gaaaguaggaaccagauag

SEQ ID NO: 832620 - RNA, 19 nt, Homo sapiens
aaaugucucuggcaaugua

SEQ ID NO: 832621 - RNA, 19 nt, Homo sapiens
cacaacagguuuauagaga

SEQ ID NO: 832622 - RNA, 19 nt, Homo sapiens
cagaaugccuguauaugau

SEQ ID NO: 832623 - RNA, 19 nt, Homo sapiens
guggagaccuaucagauug

SEQ ID NO: 832624 - RNA, 19 nt, Homo sapiens
ugaaagaucagaauggaaa

SEQ ID NO: 832625 - RNA, 19 nt, Homo sapiens
uaccuaggcuuuacucuug

SEQ ID NO: 832626 - RNA, 19 nt, Homo sapiens
uuacgucccugcccucuuu

SEQ ID NO: 832627 - RNA, 19 nt, Homo sapiens
gaaguguugagcuuuauuu

SEQ ID NO: 832628 - RNA, 19 nt, Homo sapiens
caacagguuuauagagaug

SEQ ID NO: 832629 - RNA, 19 nt, Homo sapiens
gcucaaaugugugaaagau

SEQ ID NO: 832630 - RNA, 19 nt, Homo sapiens
cgacagaugguauuuaaug

SEQ ID NO: 832631 - RNA, 19 nt, Homo sapiens
agacuugauuggacauaua

SEQ ID NO: 832632 - RNA, 19 nt, Homo sapiens
gaaacuaaacccucuucuu

SEQ ID NO: 832633 - RNA, 19 nt, Homo sapiens
acacaaagccgcugucuca

SEQ ID NO: 832634 - RNA, 19 nt, Homo sapiens
gagguuugcugccagaaug

SEQ ID NO: 832635 - RNA, 19 nt, Homo sapiens
ggaacacggucgaccugaa

SEQ ID NO: 832636 - RNA, 19 nt, Homo sapiens
gcagcaauaugcauuagca

SEQ ID NO: 832637 - RNA, 19 nt, Homo sapiens
ggacauaagacauaacagu

SEQ ID NO: 832638 - RNA, 19 nt, Homo sapiens
ucagaggacuaaugcacua

SEQ ID NO: 832639 - RNA, 19 nt, Homo sapiens
acaaggagaugaugaugau

SEQ ID NO: 832640 - RNA, 19 nt, Homo sapiens
gagcaugguagaauaugua

SEQ ID NO: 832641 - RNA, 19 nt, Homo sapiens
uuaguaaguuggcaugaaa

SEQ ID NO: 832642 - RNA, 19 nt, Homo sapiens
ucuuugaccuggcaauaua

SEQ ID NO: 832643 - RNA, 19 nt, Homo sapiens
gcaaugagaaagaguggaa

SEQ ID NO: 832644 - RNA, 19 nt, Homo sapiens
guaaucagguaccaaugga

SEQ ID NO: 832645 - RNA, 19 nt, Homo sapiens
ugagaaagaguggaaauuu

SEQ ID NO: 832646 - RNA, 19 nt, Homo sapiens
gaaaccauguuguacaaaa

SEQ ID NO: 832647 - RNA, 19 nt, Homo sapiens
cagcaugguucuagauuca

SEQ ID NO: 832648 - RNA, 19 nt, Homo sapiens
guacaucucuuggcuuugg

SEQ ID NO: 832649 - RNA, 19 nt, Homo sapiens
ucaaagcugucauguugga

SEQ ID NO: 832650 - RNA, 19 nt, Homo sapiens
gcagcaacgccuuguguuu

SEQ ID NO: 832651 - RNA, 19 nt, Homo sapiens
acauaguuguugacuguua

SEQ ID NO: 832652 - RNA, 19 nt, Homo sapiens
guaugaaccagcuuucuuu

SEQ ID NO: 832653 - RNA, 19 nt, Homo sapiens
gaaaaggggccacugaaaa

SEQ ID NO: 832654 - RNA, 19 nt, Homo sapiens
ucagaaagcauuagaaucu

SEQ ID NO: 832655 - RNA, 19 nt, Homo sapiens
ggaauuaugucauccagaa

SEQ ID NO: 832656 - RNA, 19 nt, Homo sapiens
gcacagagccuccuagaga

SEQ ID NO: 832657 - RNA, 19 nt, Homo sapiens
ggagcugucugaaaucaua

SEQ ID NO: 832658 - RNA, 19 nt, Homo sapiens
ggagugagauugagucaga

SEQ ID NO: 832659 - RNA, 19 nt, Homo sapiens
ggacagaccuugcuuugag

SEQ ID NO: 832660 - RNA, 19 nt, Homo sapiens
caagagcgguugagcauga

SEQ ID NO: 832661 - RNA, 19 nt, Homo sapiens
ucagggcgcuugaaagaua

SEQ ID NO: 832662 - RNA, 19 nt, Homo sapiens
guacauuccuguucuguug

SEQ ID NO: 832663 - RNA, 19 nt, Homo sapiens
gcagacagcugaugacucu

SEQ ID NO: 832664 - RNA, 19 nt, Homo sapiens
gggagaaguucaaggaauu

SEQ ID NO: 832665 - RNA, 19 nt, Homo sapiens
ccagggagcugucugaaau

SEQ ID NO: 832666 - RNA, 19 nt, Homo sapiens
ugaaagauauccuggcuau

SEQ ID NO: 832667 - RNA, 19 nt, Homo sapiens
ccacgcagguucaccauga

SEQ ID NO: 832668 - RNA, 19 nt, Homo sapiens
gcacacgucuuugucaguu

SEQ ID NO: 832669 - RNA, 19 nt, Homo sapiens
gcacugaggacuaugaaga

SEQ ID NO: 832670 - RNA, 19 nt, Homo sapiens
gaucagaaauacgucuuug

SEQ ID NO: 832671 - RNA, 19 nt, Homo sapiens
gaucaacuccgagcuguuu

SEQ ID NO: 832672 - RNA, 19 nt, Homo sapiens
gacgucaucuucuucuaaa

SEQ ID NO: 832673 - RNA, 19 nt, Homo sapiens
gcagugaccggaauuaugu

SEQ ID NO: 832674 - RNA, 19 nt, Homo sapiens
ggccggagauguaugaaau

SEQ ID NO: 832675 - RNA, 19 nt, Homo sapiens
gaucagcgccuccuugcaa

SEQ ID NO: 832676 - RNA, 19 nt, Homo sapiens
caauaaacguguccgagau

SEQ ID NO: 832677 - RNA, 19 nt, Homo sapiens
ggagaaagggcccauguca

SEQ ID NO: 832678 - RNA, 19 nt, Homo sapiens
gaaacuccaucaggaagug

SEQ ID NO: 832679 - RNA, 19 nt, Homo sapiens
ggaggacgccagcaaagaa

SEQ ID NO: 832680 - RNA, 19 nt, Homo sapiens
ugaagccgauucugcguuu

SEQ ID NO: 832681 - RNA, 19 nt, Homo sapiens
gaacuuaagaccugauucu

SEQ ID NO: 832682 - RNA, 19 nt, Homo sapiens
gaauggcaguuucaagaag

SEQ ID NO: 832683 - RNA, 19 nt, Homo sapiens
cacaacgcauaaccaaaua

SEQ ID NO: 832684 - RNA, 19 nt, Homo sapiens
guaugacggucucucagaa

SEQ ID NO: 832685 - RNA, 19 nt, Homo sapiens
ggacgcaacucggaccaau

SEQ ID NO: 832686 - RNA, 19 nt, Homo sapiens
caucagggcgcuugaaaga

SEQ ID NO: 832687 - RNA, 19 nt, Homo sapiens
ccaaacaccgaguccauuu

SEQ ID NO: 832688 - RNA, 19 nt, Homo sapiens
ccuccgagaugccacaauu

SEQ ID NO: 832689 - RNA, 19 nt, Homo sapiens
gcacuccugugacgcugaa

SEQ ID NO: 832690 - RNA, 19 nt, Homo sapiens
aaagcgauguuucugauca

SEQ ID NO: 832691 - RNA, 19 nt, Homo sapiens
agaccugauucuagcaaua

SEQ ID NO: 832692 - RNA, 19 nt, Homo sapiens
gaaauacgucuuugcuucu

SEQ ID NO: 832693 - RNA, 19 nt, Homo sapiens
gaagcugacuguacauucc

SEQ ID NO: 832694 - RNA, 19 nt, Homo sapiens
ccaaacagcccggacuuga

SEQ ID NO: 832695 - RNA, 19 nt, Homo sapiens
gaaaauggggagagaauga

SEQ ID NO: 832696 - RNA, 19 nt, Homo sapiens
gaccugauucuagcaauaa

SEQ ID NO: 832697 - RNA, 19 nt, Homo sapiens
uaucggagcacuuuacaga

SEQ ID NO: 832698 - RNA, 19 nt, Homo sapiens
ggaagcccaucgugaaagg

SEQ ID NO: 832699 - RNA, 19 nt, Homo sapiens
agaauccacuucccaaaca

SEQ ID NO: 832700 - RNA, 19 nt, Homo sapiens
cacagagccuccuagagaa

SEQ ID NO: 832701 - RNA, 19 nt, Homo sapiens
acacaacgcauaaccaaau

SEQ ID NO: 832702 - RNA, 19 nt, Homo sapiens
ggagaaguucaaggaauuu

SEQ ID NO: 832703 - RNA, 19 nt, Homo sapiens
ggagggcagugaccggaau

SEQ ID NO: 832704 - RNA, 19 nt, Homo sapiens
gagaaagggcccaugucaa

SEQ ID NO: 832705 - RNA, 19 nt, Homo sapiens
gcagaauccacuucccaaa

SEQ ID NO: 832706 - RNA, 19 nt, Homo sapiens
gacagaccuugcuuugaga

SEQ ID NO: 832707 - RNA, 19 nt, Homo sapiens
caaacagcccggacuugaa

SEQ ID NO: 832708 - RNA, 19 nt, Homo sapiens
gaagauggaccugaagucu

SEQ ID NO: 832709 - RNA, 19 nt, Homo sapiens
ggagaucgcagggaagaug

SEQ ID NO: 832710 - RNA, 19 nt, Homo sapiens
caaggaggacgccagcaaa

SEQ ID NO: 832711 - RNA, 19 nt, Homo sapiens
caagaaaauuggcaacuuc

SEQ ID NO: 832712 - RNA, 19 nt, Homo sapiens
gaucugcacacgucuuugu

SEQ ID NO: 832713 - RNA, 19 nt, Homo sapiens
aagaauggcaguuucaaga

SEQ ID NO: 832714 - RNA, 19 nt, Homo sapiens
agaaagggcccaugucaag

SEQ ID NO: 832715 - RNA, 19 nt, Homo sapiens
ugagggaaguggccaacga

SEQ ID NO: 832716 - RNA, 19 nt, Homo sapiens
acaaugaagcuguuaguca

SEQ ID NO: 832717 - RNA, 19 nt, Homo sapiens
ggccgugacucaaggaaag

SEQ ID NO: 832718 - RNA, 19 nt, Homo sapiens
ggaccaaucacaggagaga

SEQ ID NO: 832719 - RNA, 19 nt, Homo sapiens
cagcaaagaagacgucauc

SEQ ID NO: 832720 - RNA, 19 nt, Homo sapiens
cccgucaucucguuacaaa

SEQ ID NO: 832721 - RNA, 19 nt, Homo sapiens
ucacaggagagauggauga

SEQ ID NO: 832722 - RNA, 19 nt, Homo sapiens
caccaagaauggcaguuuc

SEQ ID NO: 832723 - RNA, 19 nt, Homo sapiens
ccacgagacuccgggacuu

SEQ ID NO: 832724 - RNA, 19 nt, Homo sapiens
ucgagcaaauguuccuauu

SEQ ID NO: 832725 - RNA, 19 nt, Homo sapiens
gaaguucaaggaauuucug

SEQ ID NO: 832726 - RNA, 19 nt, Homo sapiens
ccaccaagaauggcaguuu

SEQ ID NO: 832727 - RNA, 19 nt, Homo sapiens
gggagagaaugaaagaaaa

SEQ ID NO: 832728 - RNA, 19 nt, Homo sapiens
gaauuaugucauccagaaa

SEQ ID NO: 832729 - RNA, 19 nt, Homo sapiens
agacgucaucuucuucuaa

SEQ ID NO: 832730 - RNA, 19 nt, Homo sapiens
gcucagugacagugacauu

SEQ ID NO: 832731 - RNA, 19 nt, Homo sapiens
ggcagaggcacuccuguga

SEQ ID NO: 832732 - RNA, 19 nt, Homo sapiens
uccgagggcuucucucuca

SEQ ID NO: 832733 - RNA, 19 nt, Homo sapiens
gguaugacggucucucaga

SEQ ID NO: 832734 - RNA, 19 nt, Homo sapiens
gcauucuccugguuacaca

SEQ ID NO: 832735 - RNA, 19 nt, Homo sapiens
ugacccgcuuuagaacuua

SEQ ID NO: 832736 - RNA, 19 nt, Homo sapiens
gggaucugcacacgucuuu

SEQ ID NO: 832737 - RNA, 19 nt, Homo sapiens
gacagucgagcaaauguuc

SEQ ID NO: 832738 - RNA, 19 nt, Homo sapiens
caggacagaccuugcuuug

SEQ ID NO: 832739 - RNA, 19 nt, Homo sapiens
gagcugaggacaggacaga

SEQ ID NO: 832740 - RNA, 19 nt, Homo sapiens
gagcgcaucauccagaaca

SEQ ID NO: 832741 - RNA, 19 nt, Homo sapiens
gagugcauucuccugguua

SEQ ID NO: 832742 - RNA, 19 nt, Homo sapiens
gacccgcuuuagaacuuaa

SEQ ID NO: 832743 - RNA, 19 nt, Homo sapiens
agucaccugcuaauuauuu

SEQ ID NO: 832744 - RNA, 19 nt, Homo sapiens
cgagaugccacaauuccuu

SEQ ID NO: 832745 - RNA, 19 nt, Homo sapiens
ucggagcacuuuacagaag

SEQ ID NO: 832746 - RNA, 19 nt, Homo sapiens
ggugagauccauccacgau

SEQ ID NO: 832747 - RNA, 19 nt, Homo sapiens
ccaaggaggacgccagcaa

SEQ ID NO: 832748 - RNA, 19 nt, Homo sapiens
aauggcaguuucaagaaga

SEQ ID NO: 832749 - RNA, 19 nt, Homo sapiens
ucccuuacaucuccaaaca

SEQ ID NO: 832750 - RNA, 19 nt, Homo sapiens
gugacaagguccugagaac

SEQ ID NO: 832751 - RNA, 19 nt, Homo sapiens
acaguggagccaaggguua

SEQ ID NO: 832752 - RNA, 19 nt, Homo sapiens
gcaacucggaccaaucaca

SEQ ID NO: 832753 - RNA, 19 nt, Homo sapiens
ggcagugaccggaauuaug

SEQ ID NO: 832754 - RNA, 19 nt, Homo sapiens
ggaaacuccaucaggaagu

SEQ ID NO: 832755 - RNA, 19 nt, Homo sapiens
gaagaaaccuccagucugu

SEQ ID NO: 832756 - RNA, 19 nt, Homo sapiens
gagcagagauucagaguag

SEQ ID NO: 832757 - RNA, 19 nt, Homo sapiens
caaaggcgaugucauggua

SEQ ID NO: 832758 - RNA, 19 nt, Homo sapiens
ccaaagcaaugucaaguuu

SEQ ID NO: 832759 - RNA, 19 nt, Homo sapiens
gcaaagauccucuggaaga

SEQ ID NO: 832760 - RNA, 19 nt, Homo sapiens
gaggagcaguucccaguua

SEQ ID NO: 832761 - RNA, 19 nt, Homo sapiens
gaaugugugucaccucuuu

SEQ ID NO: 832762 - RNA, 19 nt, Homo sapiens
cagcaaagauccucuggaa

SEQ ID NO: 832763 - RNA, 19 nt, Homo sapiens
cuacacaucuggagucuau

SEQ ID NO: 832764 - RNA, 19 nt, Homo sapiens
aagaugaccuugcauguga

SEQ ID NO: 832765 - RNA, 19 nt, Homo sapiens
gagaaagcacccucccuua

SEQ ID NO: 832766 - RNA, 19 nt, Homo sapiens
caagagagccaaagcaaug

SEQ ID NO: 832767 - RNA, 19 nt, Homo sapiens
ggacagucauucauuccaa

SEQ ID NO: 832768 - RNA, 19 nt, Homo sapiens
ggacaggcccacaagauga

SEQ ID NO: 832769 - RNA, 19 nt, Homo sapiens
gaacagcagcccucucuuc

SEQ ID NO: 832770 - RNA, 19 nt, Homo sapiens
acaaguaccugcucuucaa

SEQ ID NO: 832771 - RNA, 19 nt, Homo sapiens
gcauuacacugacggacaa

SEQ ID NO: 832772 - RNA, 19 nt, Homo sapiens
ggagaagggugggcaagug

SEQ ID NO: 832773 - RNA, 19 nt, Homo sapiens
gaacagcugguccgccauu

SEQ ID NO: 832774 - RNA, 19 nt, Homo sapiens
gacgaggccuggacugaug

SEQ ID NO: 832775 - RNA, 19 nt, Homo sapiens
ccaagcaccgggacaagua

SEQ ID NO: 832776 - RNA, 19 nt, Homo sapiens
uaccugcucuucaaccuuu

SEQ ID NO: 832777 - RNA, 19 nt, Homo sapiens
gaggaggcaucagcaguug

SEQ ID NO: 832778 - RNA, 19 nt, Homo sapiens
gaaagcacccucccuuagg

SEQ ID NO: 832779 - RNA, 19 nt, Homo sapiens
aaagcaaugucaaguuugu

SEQ ID NO: 832780 - RNA, 19 nt, Homo sapiens
gaucagggacagucauuca

SEQ ID NO: 832781 - RNA, 19 nt, Homo sapiens
ggacuccuaugagaacuuc

SEQ ID NO: 832782 - RNA, 19 nt, Homo sapiens
ggacaagguggccacagaa

SEQ ID NO: 832783 - RNA, 19 nt, Homo sapiens
agaguaggaucacaugaau

SEQ ID NO: 832784 - RNA, 19 nt, Homo sapiens
gaagacucccaggccauua

SEQ ID NO: 832785 - RNA, 19 nt, Homo sapiens
ccucagagcucaccuacac

SEQ ID NO: 832786 - RNA, 19 nt, Homo sapiens
ggagagggaggcuggagaa

SEQ ID NO: 832787 - RNA, 19 nt, Homo sapiens
caucguuucugccuacaug

SEQ ID NO: 832788 - RNA, 19 nt, Homo sapiens
gcacguggucguacuauac

SEQ ID NO: 832789 - RNA, 19 nt, Homo sapiens
gcagagauucagaguagga

SEQ ID NO: 832790 - RNA, 19 nt, Homo sapiens
ccauugcccugcugaagga

SEQ ID NO: 832791 - RNA, 19 nt, Homo sapiens
gagaagggugggcaaguga

SEQ ID NO: 832792 - RNA, 19 nt, Homo sapiens
gacaagcugugcuccaucu

SEQ ID NO: 832793 - RNA, 19 nt, Homo sapiens
ccagugagcccuacuuugg

SEQ ID NO: 832794 - RNA, 19 nt, Homo sapiens
ccucaaaggcgaugucaug

SEQ ID NO: 832795 - RNA, 19 nt, Homo sapiens
ggacaaguaccugcucuuc

SEQ ID NO: 832796 - RNA, 19 nt, Homo sapiens
aaagcacccucccuuagga

SEQ ID NO: 832797 - RNA, 19 nt, Homo sapiens
cagaguaggaucacaugaa

SEQ ID NO: 832798 - RNA, 19 nt, Homo sapiens
ccuccacgcugaccacaga

SEQ ID NO: 832799 - RNA, 19 nt, Homo sapiens
uauguaaggugaccaucga

SEQ ID NO: 832800 - RNA, 19 nt, Homo sapiens
caucgagacugggcccaaa

SEQ ID NO: 832801 - RNA, 19 nt, Homo sapiens
cagggacagucauucauuc

SEQ ID NO: 832802 - RNA, 19 nt, Homo sapiens
caccugggauccaccaaau

SEQ ID NO: 832803 - RNA, 19 nt, Homo sapiens
ugaccucaguggagacaga

SEQ ID NO: 832804 - RNA, 19 nt, Homo sapiens
gcccagagcaggcaucauc

SEQ ID NO: 832805 - RNA, 19 nt, Homo sapiens
acccugcccuggugacaua

SEQ ID NO: 832806 - RNA, 19 nt, Homo sapiens
cgauauaucagcuacuuca

SEQ ID NO: 832807 - RNA, 19 nt, Homo sapiens
gcaccugggauccaccaaa

SEQ ID NO: 832808 - RNA, 19 nt, Homo sapiens
gaguaggaucacaugaaua

SEQ ID NO: 832809 - RNA, 19 nt, Homo sapiens
gggaccaccuccaagaucu

SEQ ID NO: 832810 - RNA, 19 nt, Homo sapiens
ccaaaggggugaagaucaa

SEQ ID NO: 832811 - RNA, 19 nt, Homo sapiens
gaaauucugcgaggacaag

SEQ ID NO: 832812 - RNA, 19 nt, Homo sapiens
gagauucagaguaggauca

SEQ ID NO: 832813 - RNA, 19 nt, Homo sapiens
cauccaaguucugguacaa

SEQ ID NO: 832814 - RNA, 19 nt, Homo sapiens
cacccucccuuaggaauga

SEQ ID NO: 832815 - RNA, 19 nt, Homo sapiens
caccagcuguuguccacuu

SEQ ID NO: 832816 - RNA, 19 nt, Homo sapiens
ucuggagucuaucacauug

SEQ ID NO: 832817 - RNA, 19 nt, Homo sapiens
caagguggccacagaacug

SEQ ID NO: 832818 - RNA, 19 nt, Homo sapiens
uacaugcacuacagcaaga

SEQ ID NO: 832819 - RNA, 19 nt, Homo sapiens
ccagugcccaccaacauga

SEQ ID NO: 832820 - RNA, 19 nt, Homo sapiens
ucagggacagucauucauu

SEQ ID NO: 832821 - RNA, 19 nt, Homo sapiens
cagcuugucuacacaucug

SEQ ID NO: 832822 - RNA, 19 nt, Homo sapiens
gucgauauaucagcuacuu

SEQ ID NO: 832823 - RNA, 19 nt, Homo sapiens
gcacuggccacucuuacca

SEQ ID NO: 832824 - RNA, 19 nt, Homo sapiens
ugacggacaaccaaaggaa

SEQ ID NO: 832825 - RNA, 19 nt, Homo sapiens
gccaaagcaaugucaaguu

SEQ ID NO: 832826 - RNA, 19 nt, Homo sapiens
gcagugcuucgucagaguu

SEQ ID NO: 832827 - RNA, 19 nt, Homo sapiens
cacgagggcugcuccuaca

SEQ ID NO: 832828 - RNA, 19 nt, Homo sapiens
caucuggagucuaucacau

SEQ ID NO: 832829 - RNA, 19 nt, Homo sapiens
cuacuucagugggcugcua

SEQ ID NO: 832830 - RNA, 19 nt, Homo sapiens
gcagcgugcucuacuugac

SEQ ID NO: 832831 - RNA, 19 nt, Homo sapiens
gagaagguuuuccggaaga

SEQ ID NO: 832832 - RNA, 19 nt, Homo sapiens
ccaugcagcuugucuacac

SEQ ID NO: 832833 - RNA, 19 nt, Homo sapiens
ucuucaaccuuucagagaa

SEQ ID NO: 832834 - RNA, 19 nt, Homo sapiens
gacaaguaccugcucuuca

SEQ ID NO: 832835 - RNA, 19 nt, Homo sapiens
ugaggaggcaucagcaguu

SEQ ID NO: 832836 - RNA, 19 nt, Homo sapiens
agaaagcacccucccuuag

SEQ ID NO: 832837 - RNA, 19 nt, Homo sapiens
gaccaccuccaagaucuuu

SEQ ID NO: 832838 - RNA, 19 nt, Homo sapiens
cagaaaaugugaagcaaag

SEQ ID NO: 832839 - RNA, 19 nt, Homo sapiens
gguccgccauuuccucauc

SEQ ID NO: 832840 - RNA, 19 nt, Homo sapiens
ucaaguuuguccaggauac

SEQ ID NO: 832841 - RNA, 19 nt, Homo sapiens
cacaagagagccaaagcaa

SEQ ID NO: 832842 - RNA, 19 nt, Homo sapiens
ugacuggccucaggaaagg

SEQ ID NO: 832843 - RNA, 19 nt, Homo sapiens
ggaggagcaguucccaguu

SEQ ID NO: 832844 - RNA, 19 nt, Homo sapiens
gacgggaaguuggccaugu

SEQ ID NO: 832845 - RNA, 19 nt, Homo sapiens
gcuuccagcccuuccuuaa

SEQ ID NO: 832846 - RNA, 19 nt, Homo sapiens
auacauccaaguucuggua

SEQ ID NO: 832847 - RNA, 19 nt, Homo sapiens
ccaccucccucccuugacu

SEQ ID NO: 832848 - RNA, 19 nt, Homo sapiens
aggacaagguggccacaga

SEQ ID NO: 832849 - RNA, 19 nt, Homo sapiens
gacgggaccaccuccaaga

SEQ ID NO: 832850 - RNA, 19 nt, Homo sapiens
gcgagacggccauccuaga

SEQ ID NO: 832851 - RNA, 19 nt, Homo sapiens
aguaggaucacaugaauag

SEQ ID NO: 832852 - RNA, 19 nt, Homo sapiens
ccaggagacccaggagaaa

SEQ ID NO: 832853 - RNA, 19 nt, Homo sapiens
cagcuguuguccacuucaa

SEQ ID NO: 832854 - RNA, 19 nt, Homo sapiens
cccagagccuccuacacaa

SEQ ID NO: 832855 - RNA, 19 nt, Homo sapiens
gaagaaaccuccagucugu

SEQ ID NO: 832856 - RNA, 19 nt, Homo sapiens
gagcagagauucagaguag

SEQ ID NO: 832857 - RNA, 19 nt, Homo sapiens
caaaggcgaugucauggua

SEQ ID NO: 832858 - RNA, 19 nt, Homo sapiens
ccaaagcaaugucaaguuu

SEQ ID NO: 832859 - RNA, 19 nt, Homo sapiens
gcaaagauccucuggaaga

SEQ ID NO: 832860 - RNA, 19 nt, Homo sapiens
gaggagcaguucccaguua

SEQ ID NO: 832861 - RNA, 19 nt, Homo sapiens
gaaugugugucaccucuuu

SEQ ID NO: 832862 - RNA, 19 nt, Homo sapiens
cagcaaagauccucuggaa

SEQ ID NO: 832863 - RNA, 19 nt, Homo sapiens
cuacacaucuggagucuau

SEQ ID NO: 832864 - RNA, 19 nt, Homo sapiens
aagaugaccuugcauguga

SEQ ID NO: 832865 - RNA, 19 nt, Homo sapiens
gagaaagcacccucccuua

SEQ ID NO: 832866 - RNA, 19 nt, Homo sapiens
caagagagccaaagcaaug

SEQ ID NO: 832867 - RNA, 19 nt, Homo sapiens
ggacagucauucauuccaa

SEQ ID NO: 832868 - RNA, 19 nt, Homo sapiens
ggacaggcccacaagauga

SEQ ID NO: 832869 - RNA, 19 nt, Homo sapiens
gaacagcagcccucucuuc

SEQ ID NO: 832870 - RNA, 19 nt, Homo sapiens
acaaguaccugcucuucaa

SEQ ID NO: 832871 - RNA, 19 nt, Homo sapiens
gcauuacacugacggacaa

SEQ ID NO: 832872 - RNA, 19 nt, Homo sapiens
ggagaagggugggcaagug

SEQ ID NO: 832873 - RNA, 19 nt, Homo sapiens
gaacagcugguccgccauu

SEQ ID NO: 832874 - RNA, 19 nt, Homo sapiens
gacgaggccuggacugaug

SEQ ID NO: 832875 - RNA, 19 nt, Homo sapiens
ccaagcaccgggacaagua

SEQ ID NO: 832876 - RNA, 19 nt, Homo sapiens
uaccugcucuucaaccuuu

SEQ ID NO: 832877 - RNA, 19 nt, Homo sapiens
gaggaggcaucagcaguug

SEQ ID NO: 832878 - RNA, 19 nt, Homo sapiens
gaaagcacccucccuuagg

SEQ ID NO: 832879 - RNA, 19 nt, Homo sapiens
aaagcaaugucaaguuugu

SEQ ID NO: 832880 - RNA, 19 nt, Homo sapiens
gaucagggacagucauuca

SEQ ID NO: 832881 - RNA, 19 nt, Homo sapiens
ggacuccuaugagaacuuc

SEQ ID NO: 832882 - RNA, 19 nt, Homo sapiens
ggacaagguggccacagaa

SEQ ID NO: 832883 - RNA, 19 nt, Homo sapiens
agaguaggaucacaugaau

SEQ ID NO: 832884 - RNA, 19 nt, Homo sapiens
ccucagagcucaccuacac

SEQ ID NO: 832885 - RNA, 19 nt, Homo sapiens
gcaagcaggccuaggaaag

SEQ ID NO: 832886 - RNA, 19 nt, Homo sapiens
ggagagggaggcuggagaa

SEQ ID NO: 832887 - RNA, 19 nt, Homo sapiens
caucguuucugccuacaug

SEQ ID NO: 832888 - RNA, 19 nt, Homo sapiens
gcacguggucguacuauac

SEQ ID NO: 832889 - RNA, 19 nt, Homo sapiens
gcagagauucagaguagga

SEQ ID NO: 832890 - RNA, 19 nt, Homo sapiens
ccauugcccugcugaagga

SEQ ID NO: 832891 - RNA, 19 nt, Homo sapiens
gagaagggugggcaaguga

SEQ ID NO: 832892 - RNA, 19 nt, Homo sapiens
gacaagcugugcuccaucu

SEQ ID NO: 832893 - RNA, 19 nt, Homo sapiens
ccagugagcccuacuuugg

SEQ ID NO: 832894 - RNA, 19 nt, Homo sapiens
ccucaaaggcgaugucaug

SEQ ID NO: 832895 - RNA, 19 nt, Homo sapiens
ggacaaguaccugcucuuc

SEQ ID NO: 832896 - RNA, 19 nt, Homo sapiens
aaagcacccucccuuagga

SEQ ID NO: 832897 - RNA, 19 nt, Homo sapiens
cagaguaggaucacaugaa

SEQ ID NO: 832898 - RNA, 19 nt, Homo sapiens
ccuccacgcugaccacaga

SEQ ID NO: 832899 - RNA, 19 nt, Homo sapiens
uauguaaggugaccaucga

SEQ ID NO: 832900 - RNA, 19 nt, Homo sapiens
caucgagacugggcccaaa

SEQ ID NO: 832901 - RNA, 19 nt, Homo sapiens
cagggacagucauucauuc

SEQ ID NO: 832902 - RNA, 19 nt, Homo sapiens
caccugggauccaccaaau

SEQ ID NO: 832903 - RNA, 19 nt, Homo sapiens
ugaccucaguggagacaga

SEQ ID NO: 832904 - RNA, 19 nt, Homo sapiens
gcccagagcaggcaucauc

SEQ ID NO: 832905 - RNA, 19 nt, Homo sapiens
acccugcccuggugacaua

SEQ ID NO: 832906 - RNA, 19 nt, Homo sapiens
cgauauaucagcuacuuca

SEQ ID NO: 832907 - RNA, 19 nt, Homo sapiens
gcaccugggauccaccaaa

SEQ ID NO: 832908 - RNA, 19 nt, Homo sapiens
gaguaggaucacaugaaua

SEQ ID NO: 832909 - RNA, 19 nt, Homo sapiens
gggaccaccuccaagaucu

SEQ ID NO: 832910 - RNA, 19 nt, Homo sapiens
ccaaaggggugaagaucaa

SEQ ID NO: 832911 - RNA, 19 nt, Homo sapiens
gaaauucugcgaggacaag

SEQ ID NO: 832912 - RNA, 19 nt, Homo sapiens
gagauucagaguaggauca

SEQ ID NO: 832913 - RNA, 19 nt, Homo sapiens
cauccaaguucugguacaa

SEQ ID NO: 832914 - RNA, 19 nt, Homo sapiens
cacccucccuuaggaauga

SEQ ID NO: 832915 - RNA, 19 nt, Homo sapiens
caccagcuguuguccacuu

SEQ ID NO: 832916 - RNA, 19 nt, Homo sapiens
ucuggagucuaucacauug

SEQ ID NO: 832917 - RNA, 19 nt, Homo sapiens
caagguggccacagaacug

SEQ ID NO: 832918 - RNA, 19 nt, Homo sapiens
uacaugcacuacagcaaga

SEQ ID NO: 832919 - RNA, 19 nt, Homo sapiens
ccagugcccaccaacauga

SEQ ID NO: 832920 - RNA, 19 nt, Homo sapiens
ucagggacagucauucauu

SEQ ID NO: 832921 - RNA, 19 nt, Homo sapiens
cagcuugucuacacaucug

SEQ ID NO: 832922 - RNA, 19 nt, Homo sapiens
gucgauauaucagcuacuu

SEQ ID NO: 832923 - RNA, 19 nt, Homo sapiens
gcacuggccacucuuacca

SEQ ID NO: 832924 - RNA, 19 nt, Homo sapiens
ugacggacaaccaaaggaa

SEQ ID NO: 832925 - RNA, 19 nt, Homo sapiens
gccaaagcaaugucaaguu

SEQ ID NO: 832926 - RNA, 19 nt, Homo sapiens
gcagugcuucgucagaguu

SEQ ID NO: 832927 - RNA, 19 nt, Homo sapiens
cacgagggcugcuccuaca

SEQ ID NO: 832928 - RNA, 19 nt, Homo sapiens
caucuggagucuaucacau

SEQ ID NO: 832929 - RNA, 19 nt, Homo sapiens
cuacuucagugggcugcua

SEQ ID NO: 832930 - RNA, 19 nt, Homo sapiens
gcagcgugcucuacuugac

SEQ ID NO: 832931 - RNA, 19 nt, Homo sapiens
gagaagguuuuccggaaga

SEQ ID NO: 832932 - RNA, 19 nt, Homo sapiens
ccaugcagcuugucuacac

SEQ ID NO: 832933 - RNA, 19 nt, Homo sapiens
ucuucaaccuuucagagaa

SEQ ID NO: 832934 - RNA, 19 nt, Homo sapiens
gacaaguaccugcucuuca

SEQ ID NO: 832935 - RNA, 19 nt, Homo sapiens
ugaggaggcaucagcaguu

SEQ ID NO: 832936 - RNA, 19 nt, Homo sapiens
agaaagcacccucccuuag

SEQ ID NO: 832937 - RNA, 19 nt, Homo sapiens
gaccaccuccaagaucuuu

SEQ ID NO: 832938 - RNA, 19 nt, Homo sapiens
cagaaaaugugaagcaaag

SEQ ID NO: 832939 - RNA, 19 nt, Homo sapiens
gguccgccauuuccucauc

SEQ ID NO: 832940 - RNA, 19 nt, Homo sapiens
ucaaguuuguccaggauac

SEQ ID NO: 832941 - RNA, 19 nt, Homo sapiens
cacaagagagccaaagcaa

SEQ ID NO: 832942 - RNA, 19 nt, Homo sapiens
ugacuggccucaggaaagg

SEQ ID NO: 832943 - RNA, 19 nt, Homo sapiens
ggaggagcaguucccaguu

SEQ ID NO: 832944 - RNA, 19 nt, Homo sapiens
gcuuccagcccuuccuuaa

SEQ ID NO: 832945 - RNA, 19 nt, Homo sapiens
auacauccaaguucuggua

SEQ ID NO: 832946 - RNA, 19 nt, Homo sapiens
aggacaagguggccacaga

SEQ ID NO: 832947 - RNA, 19 nt, Homo sapiens
gacgggaccaccuccaaga

SEQ ID NO: 832948 - RNA, 19 nt, Homo sapiens
gcgagacggccauccuaga

SEQ ID NO: 832949 - RNA, 19 nt, Homo sapiens
aguaggaucacaugaauag

SEQ ID NO: 832950 - RNA, 19 nt, Homo sapiens
ccaggagacccaggagaaa

SEQ ID NO: 832951 - RNA, 19 nt, Homo sapiens
cccaugugcugcaauccaa

SEQ ID NO: 832952 - RNA, 19 nt, Homo sapiens
cagcuguuguccacuucaa

SEQ ID NO: 832953 - RNA, 19 nt, Homo sapiens
cccagagccuccuacacaa

SEQ ID NO: 832954 - RNA, 19 nt, Homo sapiens
cgagacggccauccuagau

SEQ ID NO: 832955 - RNA, 19 nt, Homo sapiens
gacaccagcuggagaagga

SEQ ID NO: 832956 - RNA, 19 nt, Homo sapiens
gaagaucgcgcugcacaau

SEQ ID NO: 832957 - RNA, 19 nt, Homo sapiens
gaacaauccgcggaaauuc

SEQ ID NO: 832958 - RNA, 19 nt, Homo sapiens
gcagacgcaaagugaaaua

SEQ ID NO: 832959 - RNA, 19 nt, Homo sapiens
ucgaggaggucaugaagga

SEQ ID NO: 832960 - RNA, 19 nt, Homo sapiens
gggcagacgcaaagugaaa

SEQ ID NO: 832961 - RNA, 19 nt, Homo sapiens
cgaacaauccgcggaaauu

SEQ ID NO: 832962 - RNA, 19 nt, Homo sapiens
gaaauucagcgagaagauc

SEQ ID NO: 832963 - RNA, 19 nt, Homo sapiens
uggaagagaccacaucaga

SEQ ID NO: 832964 - RNA, 19 nt, Homo sapiens
cggccgagcuugugauucu

SEQ ID NO: 832965 - RNA, 19 nt, Homo sapiens
ggaaauucagcgagaagau

SEQ ID NO: 832966 - RNA, 19 nt, Homo sapiens
gacgcaaagugaaauaaac

SEQ ID NO: 832967 - RNA, 19 nt, Homo sapiens
guggucagguagagaguga

SEQ ID NO: 832968 - RNA, 19 nt, Homo sapiens
gcuccacacucaacuacuc

SEQ ID NO: 832969 - RNA, 19 nt, Homo sapiens
agaucgcgcugcacaauca

SEQ ID NO: 832970 - RNA, 19 nt, Homo sapiens
gauggcgacuucgaacaau

SEQ ID NO: 832971 - RNA, 19 nt, Homo sapiens
gaauggaagagaccacauc

SEQ ID NO: 832972 - RNA, 19 nt, Homo sapiens
gaaaucccaguaccugcaa

SEQ ID NO: 832973 - RNA, 19 nt, Homo sapiens
cuggagcaguucaacauga

SEQ ID NO: 832974 - RNA, 19 nt, Homo sapiens
gcaugggacaccaagaaga

SEQ ID NO: 832975 - RNA, 19 nt, Homo sapiens
ccacgcagccagaauccuu

SEQ ID NO: 832976 - RNA, 19 nt, Homo sapiens
agacgcaaagugaaauaaa

SEQ ID NO: 832977 - RNA, 19 nt, Homo sapiens
guuaacagucccaggaaug

SEQ ID NO: 832978 - RNA, 19 nt, Homo sapiens
cagccucucuaaagaacug

SEQ ID NO: 832979 - RNA, 19 nt, Homo sapiens
cccaggacgugcaccagaa

SEQ ID NO: 832980 - RNA, 19 nt, Homo sapiens
uaagaugcgggaaguguca

SEQ ID NO: 832981 - RNA, 19 nt, Homo sapiens
aagcaugggacaccaagaa

SEQ ID NO: 832982 - RNA, 19 nt, Homo sapiens
cagccagaauccuuuagca

SEQ ID NO: 832983 - RNA, 19 nt, Homo sapiens
gcggacaccagcuggagaa

SEQ ID NO: 832984 - RNA, 19 nt, Homo sapiens
ggcuccagcuccagaaauc

SEQ ID NO: 832985 - RNA, 19 nt, Homo sapiens
ugugggccguggcgcauuu

SEQ ID NO: 832986 - RNA, 19 nt, Homo sapiens
ccucgccagucuccaauca

SEQ ID NO: 832987 - RNA, 19 nt, Homo sapiens
ccacaucagaggcagacaa

SEQ ID NO: 832988 - RNA, 19 nt, Homo sapiens
cacaucagaggcagacaaa

SEQ ID NO: 832989 - RNA, 19 nt, Homo sapiens
ccaacaucauccucacagu

SEQ ID NO: 832990 - RNA, 19 nt, Homo sapiens
uggagcaguucaacaugau

SEQ ID NO: 832991 - RNA, 19 nt, Homo sapiens
ccuguaagaugcgggaagu

SEQ ID NO: 832992 - RNA, 19 nt, Homo sapiens
ccaccucgccagucuccaa

SEQ ID NO: 832993 - RNA, 19 nt, Homo sapiens
ccaggacgugcaccagaaa

SEQ ID NO: 832994 - RNA, 19 nt, Homo sapiens
acccaucacucaggcugua

SEQ ID NO: 832995 - RNA, 19 nt, Homo sapiens
gcuggagaaggaccaauuc

SEQ ID NO: 832996 - RNA, 19 nt, Homo sapiens
cagacgcaaagugaaauaa

SEQ ID NO: 832997 - RNA, 19 nt, Homo sapiens
cagaagaggucaaugauaa

SEQ ID NO: 832998 - RNA, 19 nt, Homo sapiens
gaacuuucuucauccauua

SEQ ID NO: 832999 - RNA, 19 nt, Homo sapiens
gaauggcuaucuagaauuu

SEQ ID NO: 833000 - RNA, 19 nt, Homo sapiens
guaaagagcuucaagaacu

SEQ ID NO: 833001 - RNA, 19 nt, Homo sapiens
aaacaaaucuccacuuuag

SEQ ID NO: 833002 - RNA, 19 nt, Homo sapiens
gcagaagcuugugauauua

SEQ ID NO: 833003 - RNA, 19 nt, Homo sapiens
ggaacuugcugaguacuua

SEQ ID NO: 833004 - RNA, 19 nt, Homo sapiens
gaacauggguugauauugc

SEQ ID NO: 833005 - RNA, 19 nt, Homo sapiens
guaaagaaaugagagauga

SEQ ID NO: 833006 - RNA, 19 nt, Homo sapiens
gagaacacaugcaauuuau

SEQ ID NO: 833007 - RNA, 19 nt, Homo sapiens
caaaguagcucuuacaaaa

SEQ ID NO: 833008 - RNA, 19 nt, Homo sapiens
gagcggaacugcauugaga

SEQ ID NO: 833009 - RNA, 19 nt, Homo sapiens
ugaaacaaaucuccacuuu

SEQ ID NO: 833010 - RNA, 19 nt, Homo sapiens
gaaacaaaucuccacuuua

SEQ ID NO: 833011 - RNA, 19 nt, Homo sapiens
gauaggaacgcaacauuaa

SEQ ID NO: 833012 - RNA, 19 nt, Homo sapiens
gagcauagaagacuuuauu

SEQ ID NO: 833013 - RNA, 19 nt, Homo sapiens
ccaguaagcauaagucaua

SEQ ID NO: 833014 - RNA, 19 nt, Homo sapiens
ugaagaugcugccauauug

SEQ ID NO: 833015 - RNA, 19 nt, Homo sapiens
cuucuuagcuucggauuua

SEQ ID NO: 833016 - RNA, 19 nt, Homo sapiens
cuacagcugugaauucuuu

SEQ ID NO: 833017 - RNA, 19 nt, Homo sapiens
cagcugcucugucacauaa

SEQ ID NO: 833018 - RNA, 19 nt, Homo sapiens
uaaagcagcuagucaguca

SEQ ID NO: 833019 - RNA, 19 nt, Homo sapiens
ggacauauugaucuugaua

SEQ ID NO: 833020 - RNA, 19 nt, Homo sapiens
gauaaauccucuguaauca

SEQ ID NO: 833021 - RNA, 19 nt, Homo sapiens
gcugugaauucuuugauuu

SEQ ID NO: 833022 - RNA, 19 nt, Homo sapiens
gguaaaguaucaagguuug

SEQ ID NO: 833023 - RNA, 19 nt, Homo sapiens
gaagaagaucugaaacaaa

SEQ ID NO: 833024 - RNA, 19 nt, Homo sapiens
ggccucaacuguagucuuu

SEQ ID NO: 833025 - RNA, 19 nt, Homo sapiens
aggaugagauugaagauuu

SEQ ID NO: 833026 - RNA, 19 nt, Homo sapiens
cagaauggcuaucuagaau

SEQ ID NO: 833027 - RNA, 19 nt, Homo sapiens
ggauaaagcuguguuuguc

SEQ ID NO: 833028 - RNA, 19 nt, Homo sapiens
gcaacaacuuacuuacuau

SEQ ID NO: 833029 - RNA, 19 nt, Homo sapiens
uaaagaccuuguucucaaa

SEQ ID NO: 833030 - RNA, 19 nt, Homo sapiens
ggaagcaucaguagaagaa

SEQ ID NO: 833031 - RNA, 19 nt, Homo sapiens
ggacuauucagugcuauua

SEQ ID NO: 833032 - RNA, 19 nt, Homo sapiens
gcagaagaggucaaugaua

SEQ ID NO: 833033 - RNA, 19 nt, Homo sapiens
gaaagcacuucaaaacuaa

SEQ ID NO: 833034 - RNA, 19 nt, Homo sapiens
uuaaagaccuuguucucaa

SEQ ID NO: 833035 - RNA, 19 nt, Homo sapiens
gaaagaagaagccagagau

SEQ ID NO: 833036 - RNA, 19 nt, Homo sapiens
ugaagaagaucugaaacaa

SEQ ID NO: 833037 - RNA, 19 nt, Homo sapiens
gggaaggauucauuuguug

SEQ ID NO: 833038 - RNA, 19 nt, Homo sapiens
guacuuggguggauuccuu

SEQ ID NO: 833039 - RNA, 19 nt, Homo sapiens
gcugcucugucacauaaua

SEQ ID NO: 833040 - RNA, 19 nt, Homo sapiens
ggugguacguucaguauuc

SEQ ID NO: 833041 - RNA, 19 nt, Homo sapiens
gaacugcauugagauuguu

SEQ ID NO: 833042 - RNA, 19 nt, Homo sapiens
ggaaaggaauacauuacuc

SEQ ID NO: 833043 - RNA, 19 nt, Homo sapiens
ggaacgcaacauuaaauuu

SEQ ID NO: 833044 - RNA, 19 nt, Homo sapiens
gcgagugccaguauacuua

SEQ ID NO: 833045 - RNA, 19 nt, Homo sapiens
ggaacugcauugagauugu

SEQ ID NO: 833046 - RNA, 19 nt, Homo sapiens
ccagaaagcugaaaaggaa

SEQ ID NO: 833047 - RNA, 19 nt, Homo sapiens
uaaauccucuguaaucaca

SEQ ID NO: 833048 - RNA, 19 nt, Homo sapiens
ucacaucaguccuguuguu

SEQ ID NO: 833049 - RNA, 19 nt, Homo sapiens
gacaagcacuggcugaaca

SEQ ID NO: 833050 - RNA, 19 nt, Homo sapiens
gcagaauggcuaucuagaa

SEQ ID NO: 833051 - RNA, 19 nt, Homo sapiens
gauggaaaggaauacauua

SEQ ID NO: 833052 - RNA, 19 nt, Homo sapiens
agagaacacaugcaauuua

SEQ ID NO: 833053 - RNA, 19 nt, Homo sapiens
gaaaccaaaguagcucuua

SEQ ID NO: 833054 - RNA, 19 nt, Homo sapiens
uuacguagcugauuuugua

SEQ ID NO: 833055 - RNA, 19 nt, Homo sapiens
gaucuacaacagguaauua

SEQ ID NO: 833056 - RNA, 19 nt, Homo sapiens
uaaagagcuucaagaacuu

SEQ ID NO: 833057 - RNA, 19 nt, Homo sapiens
gaagauguugccaguacua

SEQ ID NO: 833058 - RNA, 19 nt, Homo sapiens
uaucaagguuugguuguaa

SEQ ID NO: 833059 - RNA, 19 nt, Homo sapiens
agcagaagcuugugauauu

SEQ ID NO: 833060 - RNA, 19 nt, Homo sapiens
gaaaagaugaugauaguga

SEQ ID NO: 833061 - RNA, 19 nt, Homo sapiens
ucagaaacagcuagaagua

SEQ ID NO: 833062 - RNA, 19 nt, Homo sapiens
ucaagcaacaacuuacuua

SEQ ID NO: 833063 - RNA, 19 nt, Homo sapiens
aaacagauaggaugccuuu

SEQ ID NO: 833064 - RNA, 19 nt, Homo sapiens
ucuaggaaaucaucuguga

SEQ ID NO: 833065 - RNA, 19 nt, Homo sapiens
ugauaucacuaaccucauu

SEQ ID NO: 833066 - RNA, 19 nt, Homo sapiens
uuucggaacuugcugagua

SEQ ID NO: 833067 - RNA, 19 nt, Homo sapiens
gaaagcguuaguacaagua

SEQ ID NO: 833068 - RNA, 19 nt, Homo sapiens
aaagaucagucuaccucua

SEQ ID NO: 833069 - RNA, 19 nt, Homo sapiens
aaagaguuccuuagaguaa

SEQ ID NO: 833070 - RNA, 19 nt, Homo sapiens
ggagauuaucccuugaaua

SEQ ID NO: 833071 - RNA, 19 nt, Homo sapiens
caucaguccuguuguuuca

SEQ ID NO: 833072 - RNA, 19 nt, Homo sapiens
gaagaaggaaagcaacaga

SEQ ID NO: 833073 - RNA, 19 nt, Homo sapiens
gaugagggcauucagcaaa

SEQ ID NO: 833074 - RNA, 19 nt, Homo sapiens
agaaaagcauguucaguua

SEQ ID NO: 833075 - RNA, 19 nt, Homo sapiens
agcaacaacuuacuuacua

SEQ ID NO: 833076 - RNA, 19 nt, Homo sapiens
gagagaacacaugcaauuu

SEQ ID NO: 833077 - RNA, 19 nt, Homo sapiens
gcauugcuguguucucuuc

SEQ ID NO: 833078 - RNA, 19 nt, Homo sapiens
gccaguauacuuaaaugua

SEQ ID NO: 833079 - RNA, 19 nt, Homo sapiens
guaucaagguuugguugua

SEQ ID NO: 833080 - RNA, 19 nt, Homo sapiens
uugaggaacuuguuaauag

SEQ ID NO: 833081 - RNA, 19 nt, Homo sapiens
ugggacaacugauagauga

SEQ ID NO: 833082 - RNA, 19 nt, Homo sapiens
ggaaagaagaagccagaga

SEQ ID NO: 833083 - RNA, 19 nt, Homo sapiens
gcuacccacuucuuuauca

SEQ ID NO: 833084 - RNA, 19 nt, Homo sapiens
gguaggagcaucuguaagu

SEQ ID NO: 833085 - RNA, 19 nt, Homo sapiens
agaaagcacuucaaaacua

SEQ ID NO: 833086 - RNA, 19 nt, Homo sapiens
gcauagaagacuuuauuuc

SEQ ID NO: 833087 - RNA, 19 nt, Homo sapiens
guauucaugucuucaacaa

SEQ ID NO: 833088 - RNA, 19 nt, Homo sapiens
gauauaagacuacacaacu

SEQ ID NO: 833089 - RNA, 19 nt, Homo sapiens
ugauaggaacgcaacauua

SEQ ID NO: 833090 - RNA, 19 nt, Homo sapiens
ucucaaaucuaggaaauca

SEQ ID NO: 833091 - RNA, 19 nt, Homo sapiens
guacugauaucacuaaccu

SEQ ID NO: 833092 - RNA, 19 nt, Homo sapiens
uuagaaagcguuaguacaa

SEQ ID NO: 833093 - RNA, 19 nt, Homo sapiens
agaaacagcuagaaguagu

SEQ ID NO: 833094 - RNA, 19 nt, Homo sapiens
ugauaaauccucuguaauc

SEQ ID NO: 833095 - RNA, 19 nt, Homo sapiens
cagcuagucagucaaagua

SEQ ID NO: 833096 - RNA, 19 nt, Homo sapiens
ccauaacucucugaaugaa

SEQ ID NO: 833097 - RNA, 19 nt, Homo sapiens
caacagccauuucuucuug

SEQ ID NO: 833098 - RNA, 19 nt, Homo sapiens
gaagauguaagaacaaguu

SEQ ID NO: 833099 - RNA, 19 nt, Homo sapiens
gaagaagaaaugccacaaa

SEQ ID NO: 833100 - RNA, 19 nt, Homo sapiens
ggaagaaagggaagaagaa

SEQ ID NO: 833101 - RNA, 19 nt, Homo sapiens
gaagaaagggaagaagaaa

SEQ ID NO: 833102 - RNA, 19 nt, Homo sapiens
gaaccaacaucagggacuu

SEQ ID NO: 833103 - RNA, 19 nt, Homo sapiens
gaagaaaugccacaaacag

SEQ ID NO: 833104 - RNA, 19 nt, Homo sapiens
ggaggcagaucucaaacuc

SEQ ID NO: 833105 - RNA, 19 nt, Homo sapiens
ccaaggaccugaccaacag

SEQ ID NO: 833106 - RNA, 19 nt, Homo sapiens
aagagaagauguaagaaca

SEQ ID NO: 833107 - RNA, 19 nt, Homo sapiens
gcucagacuugcucuacug

SEQ ID NO: 833108 - RNA, 19 nt, Homo sapiens
gauguaagaacaaguuuca

SEQ ID NO: 833109 - RNA, 19 nt, Homo sapiens
gagaagauguaagaacaag

SEQ ID NO: 833110 - RNA, 19 nt, Homo sapiens
caaaugauccaccaaagca

SEQ ID NO: 833111 - RNA, 19 nt, Homo sapiens
gaaguagaaaggaagaaga

SEQ ID NO: 833112 - RNA, 19 nt, Homo sapiens
ucagaacugugaagacugu

SEQ ID NO: 833113 - RNA, 19 nt, Homo sapiens
gcucagaacugugaagacu

SEQ ID NO: 833114 - RNA, 19 nt, Homo sapiens
gcccaaggcucagcuuuca

SEQ ID NO: 833115 - RNA, 19 nt, Homo sapiens
caacaucagggacuuccua

SEQ ID NO: 833116 - RNA, 19 nt, Homo sapiens
gaagaaguagaaaggaaga

SEQ ID NO: 833117 - RNA, 19 nt, Homo sapiens
ggggcuagcuaaacaauaa

SEQ ID NO: 833118 - RNA, 19 nt, Homo sapiens
cgauuucgcuaccucaaug

SEQ ID NO: 833119 - RNA, 19 nt, Homo sapiens
gaggacaaagugugauaaa

SEQ ID NO: 833120 - RNA, 19 nt, Homo sapiens
ggaggcaaauagaguacug

SEQ ID NO: 833121 - RNA, 19 nt, Homo sapiens
ccagaaacaugccccuaua

SEQ ID NO: 833122 - RNA, 19 nt, Homo sapiens
guagaaaggaagaagaaau

SEQ ID NO: 833123 - RNA, 19 nt, Homo sapiens
gggaagaagaaaugucaaa

SEQ ID NO: 833124 - RNA, 19 nt, Homo sapiens
cuaccucaaugaacaguug

SEQ ID NO: 833125 - RNA, 19 nt, Homo sapiens
gggaagaaagggaagaaga

SEQ ID NO: 833126 - RNA, 19 nt, Homo sapiens
gaacugugaagacuguuuc

SEQ ID NO: 833127 - RNA, 19 nt, Homo sapiens
agaaagggaagaagaaaug

SEQ ID NO: 833128 - RNA, 19 nt, Homo sapiens
gaggaaaggaagaagaaau

SEQ ID NO: 833129 - RNA, 19 nt, Homo sapiens
gguggacccugaggacaaa

SEQ ID NO: 833130 - RNA, 19 nt, Homo sapiens
uagaaaggaagaagaaaug

SEQ ID NO: 833131 - RNA, 19 nt, Homo sapiens
gcagugacucugaggaaga

SEQ ID NO: 833132 - RNA, 19 nt, Homo sapiens
cagugccucugcugaagua

SEQ ID NO: 833133 - RNA, 19 nt, Homo sapiens
cuacaaaugauccaccaaa

SEQ ID NO: 833134 - RNA, 19 nt, Homo sapiens
aaacaugccccuauaaauu

SEQ ID NO: 833135 - RNA, 19 nt, Homo sapiens
ucaagauugucuccaagga

SEQ ID NO: 833136 - RNA, 19 nt, Homo sapiens
gcuucaagauugucuccaa

SEQ ID NO: 833137 - RNA, 19 nt, Homo sapiens
ggaacccugugcauugcuu

SEQ ID NO: 833138 - RNA, 19 nt, Homo sapiens
ggaagacccugaggcuuuu

SEQ ID NO: 833139 - RNA, 19 nt, Homo sapiens
gaccaacagccauuucuuc

SEQ ID NO: 833140 - RNA, 19 nt, Homo sapiens
ggaugagucuguggaugug

SEQ ID NO: 833141 - RNA, 19 nt, Homo sapiens
gaaagaggaaaugccagaa

SEQ ID NO: 833142 - RNA, 19 nt, Homo sapiens
aagaagaaaugccacaaac

SEQ ID NO: 833143 - RNA, 19 nt, Homo sapiens
aggaagaaguagaaaggaa

SEQ ID NO: 833144 - RNA, 19 nt, Homo sapiens
ugaggauguucgaaccuuu

SEQ ID NO: 833145 - RNA, 19 nt, Homo sapiens
aggaagacccugaggcuuu

SEQ ID NO: 833146 - RNA, 19 nt, Homo sapiens
aaacagggcccaccuugca

SEQ ID NO: 833147 - RNA, 19 nt, Homo sapiens
uaagaugcauaaagucacu

SEQ ID NO: 833148 - RNA, 19 nt, Homo sapiens
gaaagggaagaagaaaugu

SEQ ID NO: 833149 - RNA, 19 nt, Homo sapiens
gaggucagcagccgcuuug

SEQ ID NO: 833150 - RNA, 19 nt, Homo sapiens
gaaacaugccccuauaaau

SEQ ID NO: 833151 - RNA, 19 nt, Homo sapiens
aaagaggaaaugccagaaa

SEQ ID NO: 833152 - RNA, 19 nt, Homo sapiens
gccauuucuucuuguuuga

SEQ ID NO: 833153 - RNA, 19 nt, Homo sapiens
gcaaaagaauaagagaaga

SEQ ID NO: 833154 - RNA, 19 nt, Homo sapiens
cagugacucugcugaagau

SEQ ID NO: 833155 - RNA, 19 nt, Homo sapiens
ggaagaagaaaugccacaa

SEQ ID NO: 833156 - RNA, 19 nt, Homo sapiens
cagacuugcucuacugaag

SEQ ID NO: 833157 - RNA, 19 nt, Homo sapiens
gaggaggaaaggaagaaga

SEQ ID NO: 833158 - RNA, 19 nt, Homo sapiens
ucaaugaacaguuguacuc

SEQ ID NO: 833159 - RNA, 19 nt, Homo sapiens
aagaagaaaugccccaaaa

SEQ ID NO: 833160 - RNA, 19 nt, Homo sapiens
ggaggaaaggaagaagaaa

SEQ ID NO: 833161 - RNA, 19 nt, Homo sapiens
cagugacucugaggaagaa

SEQ ID NO: 833162 - RNA, 19 nt, Homo sapiens
gaccugaccaacagccauu

SEQ ID NO: 833163 - RNA, 19 nt, Homo sapiens
agaggaggcaaauagagua

SEQ ID NO: 833164 - RNA, 19 nt, Homo sapiens
caucagggacuuccuagag

SEQ ID NO: 833165 - RNA, 19 nt, Homo sapiens
uaagagaagauguaagaac

SEQ ID NO: 833166 - RNA, 19 nt, Homo sapiens
cucuggaucuuccuugaaa

SEQ ID NO: 833167 - RNA, 19 nt, Homo sapiens
uacaaaugauccaccaaag

SEQ ID NO: 833168 - RNA, 19 nt, Homo sapiens
gaggaaaugccagaaacau

SEQ ID NO: 833169 - RNA, 19 nt, Homo sapiens
ugacucugcugaagaugag

SEQ ID NO: 833170 - RNA, 19 nt, Homo sapiens
gauugccgcuuggcuucaa

SEQ ID NO: 833171 - RNA, 19 nt, Homo sapiens
aagaggaaaugccagaaac

SEQ ID NO: 833172 - RNA, 19 nt, Homo sapiens
ugacucugaggaagaagua

SEQ ID NO: 833173 - RNA, 19 nt, Homo sapiens
uuucaggccugcagcuuca

SEQ ID NO: 833174 - RNA, 19 nt, Homo sapiens
agccauuucuucuuguuug

SEQ ID NO: 833175 - RNA, 19 nt, Homo sapiens
ggacaaagugugauaaaac

SEQ ID NO: 833176 - RNA, 19 nt, Homo sapiens
gaacccugugcauugcuuu

SEQ ID NO: 833177 - RNA, 19 nt, Homo sapiens
gaagaugagaaaagaaaga

SEQ ID NO: 833178 - RNA, 19 nt, Homo sapiens
aggaaaggaagaagaaaug

SEQ ID NO: 833179 - RNA, 19 nt, Homo sapiens
gaggauguucgaaccuuuc

SEQ ID NO: 833180 - RNA, 19 nt, Homo sapiens
ggaaccggcaaaagaauaa

SEQ ID NO: 833181 - RNA, 19 nt, Homo sapiens
gcagccgcuuugaggaugu

SEQ ID NO: 833182 - RNA, 19 nt, Homo sapiens
agagccaagugaagaagug

SEQ ID NO: 833183 - RNA, 19 nt, Homo sapiens
gaagaagaaaugccccaaa

SEQ ID NO: 833184 - RNA, 19 nt, Homo sapiens
ugaggaagaaguagaaagg

SEQ ID NO: 833185 - RNA, 19 nt, Homo sapiens
gagaaaagaaagaggaaau

SEQ ID NO: 833186 - RNA, 19 nt, Homo sapiens
gcgcugugcacguggagaa

SEQ ID NO: 833187 - RNA, 19 nt, Homo sapiens
ggaagaagaaaugucaaaa

SEQ ID NO: 833188 - RNA, 19 nt, Homo sapiens
ccaacagccauuucuucuu

SEQ ID NO: 833189 - RNA, 19 nt, Homo sapiens
ucacugaugggaaccaaca

SEQ ID NO: 833190 - RNA, 19 nt, Homo sapiens
gcuuugacuuggcuucucu

SEQ ID NO: 833191 - RNA, 19 nt, Homo sapiens
ccuggacaauguugaccaa

SEQ ID NO: 833192 - RNA, 19 nt, Homo sapiens
gaggaagaaguagaaagga

SEQ ID NO: 833193 - RNA, 19 nt, Homo sapiens
ccagcucuuggccacauua

SEQ ID NO: 833194 - RNA, 19 nt, Homo sapiens
gaauaagagaagauguaag

SEQ ID NO: 833195 - RNA, 19 nt, Homo sapiens
cgacccucauguucgaaga

SEQ ID NO: 833196 - RNA, 19 nt, Homo sapiens
uagaggaggcaaauagagu

SEQ ID NO: 833197 - RNA, 19 nt, Homo sapiens
ggagaaagguauacuauga

SEQ ID NO: 833198 - RNA, 19 nt, Homo sapiens
gagcagagaucaugaauag

SEQ ID NO: 833199 - RNA, 19 nt, Homo sapiens
ggaaauugguugauacuga

SEQ ID NO: 833200 - RNA, 19 nt, Homo sapiens
ggaaggaaauugguugaua

SEQ ID NO: 833201 - RNA, 19 nt, Homo sapiens
gaaacagacucggaaauga

SEQ ID NO: 833202 - RNA, 19 nt, Homo sapiens
gaaacugucuccuggcaaa

SEQ ID NO: 833203 - RNA, 19 nt, Homo sapiens
ggaacaggcucaugagaga

SEQ ID NO: 833204 - RNA, 19 nt, Homo sapiens
gaucagacuuggaagauau

SEQ ID NO: 833205 - RNA, 19 nt, Homo sapiens
gcgcagagcucucaaaguc

SEQ ID NO: 833206 - RNA, 19 nt, Homo sapiens
ugaauuagcuggcguagau

SEQ ID NO: 833207 - RNA, 19 nt, Homo sapiens
gaaagugcuuggauuagga

SEQ ID NO: 833208 - RNA, 19 nt, Homo sapiens
gaaguuauccagcuuauca

SEQ ID NO: 833209 - RNA, 19 nt, Homo sapiens
ggacauggcucuucguaac

SEQ ID NO: 833210 - RNA, 19 nt, Homo sapiens
gaggaaagugcuuggauua

SEQ ID NO: 833211 - RNA, 19 nt, Homo sapiens
ccacagacgcuuuaacuuu

SEQ ID NO: 833212 - RNA, 19 nt, Homo sapiens
gggaagagcuggguaauac

SEQ ID NO: 833213 - RNA, 19 nt, Homo sapiens
caaggaaccuguggagaaa

SEQ ID NO: 833214 - RNA, 19 nt, Homo sapiens
gaaggaaauugguugauac

SEQ ID NO: 833215 - RNA, 19 nt, Homo sapiens
gucaguagcuccucagauu

SEQ ID NO: 833216 - RNA, 19 nt, Homo sapiens
ccacaggccuugcgucaau

SEQ ID NO: 833217 - RNA, 19 nt, Homo sapiens
caacaaaacugcuuaucaa

SEQ ID NO: 833218 - RNA, 19 nt, Homo sapiens
gagacuaaagcaucacuua

SEQ ID NO: 833219 - RNA, 19 nt, Homo sapiens
gcagaugccuggacucucu

SEQ ID NO: 833220 - RNA, 19 nt, Homo sapiens
gaucagaggcucccgauuc

SEQ ID NO: 833221 - RNA, 19 nt, Homo sapiens
gggcacagauggcauguca

SEQ ID NO: 833222 - RNA, 19 nt, Homo sapiens
gcaguacagugcagccauu

SEQ ID NO: 833223 - RNA, 19 nt, Homo sapiens
ggaauggguucuuggaucu

SEQ ID NO: 833224 - RNA, 19 nt, Homo sapiens
cacagacgcuuuaacuuug

SEQ ID NO: 833225 - RNA, 19 nt, Homo sapiens
cagcaucuccuucucuaua

SEQ ID NO: 833226 - RNA, 19 nt, Homo sapiens
caaaaguccuccacacuaa

SEQ ID NO: 833227 - RNA, 19 nt, Homo sapiens
cgaggaaagugcuuggauu

SEQ ID NO: 833228 - RNA, 19 nt, Homo sapiens
gcaccugguugcugguauu

SEQ ID NO: 833229 - RNA, 19 nt, Homo sapiens
ggaaagugcuuggauuagg

SEQ ID NO: 833230 - RNA, 19 nt, Homo sapiens
gcagcgagcccgaagcaaa

SEQ ID NO: 833231 - RNA, 19 nt, Homo sapiens
ccaaggaaccuguggagaa

SEQ ID NO: 833232 - RNA, 19 nt, Homo sapiens
caaguacuauaauguggaa

SEQ ID NO: 833233 - RNA, 19 nt, Homo sapiens
caaaacugcuuaucaagaa

SEQ ID NO: 833234 - RNA, 19 nt, Homo sapiens
ucaaggauguucuggacuu

SEQ ID NO: 833235 - RNA, 19 nt, Homo sapiens
cgacuugaccucauccuuu

SEQ ID NO: 833236 - RNA, 19 nt, Homo sapiens
gacaguggcucugacaaga

SEQ ID NO: 833237 - RNA, 19 nt, Homo sapiens
gcagaaagagccguaaguu

SEQ ID NO: 833238 - RNA, 19 nt, Homo sapiens
gcaggcagcaaguacuaua

SEQ ID NO: 833239 - RNA, 19 nt, Homo sapiens
caaaguuggugaugacagu

SEQ ID NO: 833240 - RNA, 19 nt, Homo sapiens
gacuugaccucauccuuug

SEQ ID NO: 833241 - RNA, 19 nt, Homo sapiens
gguauacuaugaaguuauc

SEQ ID NO: 833242 - RNA, 19 nt, Homo sapiens
uggcagagacugagacuaa

SEQ ID NO: 833243 - RNA, 19 nt, Homo sapiens
uggaagauauggaggaaga

SEQ ID NO: 833244 - RNA, 19 nt, Homo sapiens
cuagugaacuuuauguauc

SEQ ID NO: 833245 - RNA, 19 nt, Homo sapiens
ucaagcggcuguaugacaa

SEQ ID NO: 833246 - RNA, 19 nt, Homo sapiens
agucagaaguguccuuuga

SEQ ID NO: 833247 - RNA, 19 nt, Homo sapiens
ggacgcuccugucggaaug

SEQ ID NO: 833248 - RNA, 19 nt, Homo sapiens
gagaaagguauacuaugaa

SEQ ID NO: 833249 - RNA, 19 nt, Homo sapiens
gaucacccauccuccuuuc

SEQ ID NO: 833250 - RNA, 19 nt, Homo sapiens
ggaaccgccugucuguguu

SEQ ID NO: 833251 - RNA, 19 nt, Homo sapiens
gagcaggauccaagcagua

SEQ ID NO: 833252 - RNA, 19 nt, Homo sapiens
gucaucaucugccuuaugu

SEQ ID NO: 833253 - RNA, 19 nt, Homo sapiens
gcagagaucaugaauagcu

SEQ ID NO: 833254 - RNA, 19 nt, Homo sapiens
agacauggcucagcuacga

SEQ ID NO: 833255 - RNA, 19 nt, Homo sapiens
ggacucaagccaugacuca

SEQ ID NO: 833256 - RNA, 19 nt, Homo sapiens
gaaguauucaaaccagaaa

SEQ ID NO: 833257 - RNA, 19 nt, Homo sapiens
gacuaaagcaucacuuaau

SEQ ID NO: 833258 - RNA, 19 nt, Homo sapiens
aaacagacucggaaaugaa

SEQ ID NO: 833259 - RNA, 19 nt, Homo sapiens
gaccuucucaucuuucaaa

SEQ ID NO: 833260 - RNA, 19 nt, Homo sapiens
gauggcaugucaccgaugu

SEQ ID NO: 833261 - RNA, 19 nt, Homo sapiens
ccuugaagcugcucaguca

SEQ ID NO: 833262 - RNA, 19 nt, Homo sapiens
agaaagaggugggaaagag

SEQ ID NO: 833263 - RNA, 19 nt, Homo sapiens
ugaccugagugaaggcuuu

SEQ ID NO: 833264 - RNA, 19 nt, Homo sapiens
gcuagugaacuuuauguau

SEQ ID NO: 833265 - RNA, 19 nt, Homo sapiens
aaagguugcuagugaacuu

SEQ ID NO: 833266 - RNA, 19 nt, Homo sapiens
uggaagccauguauugcua

SEQ ID NO: 833267 - RNA, 19 nt, Homo sapiens
ggagcagagaucaugaaua

SEQ ID NO: 833268 - RNA, 19 nt, Homo sapiens
cgaucagacuuggaagaua

SEQ ID NO: 833269 - RNA, 19 nt, Homo sapiens
gcagcuccguggacucaga

SEQ ID NO: 833270 - RNA, 19 nt, Homo sapiens
gcaaaaguccuccacacua

SEQ ID NO: 833271 - RNA, 19 nt, Homo sapiens
gagcugcuguggagaaagg

SEQ ID NO: 833272 - RNA, 19 nt, Homo sapiens
guacauucgcugccagaaa

SEQ ID NO: 833273 - RNA, 19 nt, Homo sapiens
gcagcaaguacuauaaugu

SEQ ID NO: 833274 - RNA, 19 nt, Homo sapiens
gaauagcucagggcaguga

SEQ ID NO: 833275 - RNA, 19 nt, Homo sapiens
uggauuugcugaagaagga

SEQ ID NO: 833276 - RNA, 19 nt, Homo sapiens
ucacuggaauggguucuug

SEQ ID NO: 833277 - RNA, 19 nt, Homo sapiens
gauccuagacagcugcaaa

SEQ ID NO: 833278 - RNA, 19 nt, Homo sapiens
aaaggaaacagguacauuc

SEQ ID NO: 833279 - RNA, 19 nt, Homo sapiens
guaccuggaggcagaguuu

SEQ ID NO: 833280 - RNA, 19 nt, Homo sapiens
gaggacauggcucuucgua

SEQ ID NO: 833281 - RNA, 19 nt, Homo sapiens
ugaaacagacucggaaaug

SEQ ID NO: 833282 - RNA, 19 nt, Homo sapiens
gaaagagccguaaguucuc

SEQ ID NO: 833283 - RNA, 19 nt, Homo sapiens
ggcagcaaguacuauaaug

SEQ ID NO: 833284 - RNA, 19 nt, Homo sapiens
gcugcuagccgagagauuu

SEQ ID NO: 833285 - RNA, 19 nt, Homo sapiens
uacaagcaguggaaggaaa

SEQ ID NO: 833286 - RNA, 19 nt, Homo sapiens
cuucucaucuuucaaaugg

SEQ ID NO: 833287 - RNA, 19 nt, Homo sapiens
agacuaaagcaucacuuaa

SEQ ID NO: 833288 - RNA, 19 nt, Homo sapiens
ggcagagacugagacuaaa

SEQ ID NO: 833289 - RNA, 19 nt, Homo sapiens
ccuggacucucuauaagau

SEQ ID NO: 833290 - RNA, 19 nt, Homo sapiens
ccagagugauggcacagau

SEQ ID NO: 833291 - RNA, 19 nt, Homo sapiens
caacugaagaagugugaga

SEQ ID NO: 833292 - RNA, 19 nt, Homo sapiens
cuaccaagcccugucagua

SEQ ID NO: 833293 - RNA, 19 nt, Homo sapiens
agaaagguauacuaugaag

SEQ ID NO: 833294 - RNA, 19 nt, Homo sapiens
gaagaggcaggaugcagau

SEQ ID NO: 833295 - RNA, 19 nt, Homo sapiens
uacauucgcugccagaaag

SEQ ID NO: 833296 - RNA, 19 nt, Homo sapiens
cagcuuuggucauuucauc

SEQ ID NO: 833297 - RNA, 19 nt, Homo sapiens
gaagagagcucaaggagaa

SEQ ID NO: 833298 - RNA, 19 nt, Homo sapiens
ugacagagcugacagauga

SEQ ID NO: 833299 - RNA, 19 nt, Homo sapiens
ggacuucucugcuggcaua

SEQ ID NO: 833300 - RNA, 19 nt, Homo sapiens
ccaagaagauggaugagua

SEQ ID NO: 833301 - RNA, 19 nt, Homo sapiens
gauuuaaccucuuccauuu

SEQ ID NO: 833302 - RNA, 19 nt, Homo sapiens
ggaugugccuccauuauuu

SEQ ID NO: 833303 - RNA, 19 nt, Homo sapiens
caaugaaucugugcuaaua

SEQ ID NO: 833304 - RNA, 19 nt, Homo sapiens
guauuuggguucuaucuua

SEQ ID NO: 833305 - RNA, 19 nt, Homo sapiens
aagaauagcugcaucguuu

SEQ ID NO: 833306 - RNA, 19 nt, Homo sapiens
caacaaacgucccaccaaa

SEQ ID NO: 833307 - RNA, 19 nt, Homo sapiens
ugaaauugcugaacaagaa

SEQ ID NO: 833308 - RNA, 19 nt, Homo sapiens
gaaggcuacuuaucucuuu

SEQ ID NO: 833309 - RNA, 19 nt, Homo sapiens
gaaagaaggcuacuuaucu

SEQ ID NO: 833310 - RNA, 19 nt, Homo sapiens
ggaauaacacuucuaaaga

SEQ ID NO: 833311 - RNA, 19 nt, Homo sapiens
ccacaagccucccaaguau

SEQ ID NO: 833312 - RNA, 19 nt, Homo sapiens
guugaaaucuggucauuau

SEQ ID NO: 833313 - RNA, 19 nt, Homo sapiens
gaaggaguguuauuuaugg

SEQ ID NO: 833314 - RNA, 19 nt, Homo sapiens
gagaugaaauuguaaacug

SEQ ID NO: 833315 - RNA, 19 nt, Homo sapiens
ucucaaagcuagucugaaa

SEQ ID NO: 833316 - RNA, 19 nt, Homo sapiens
gaucagcaauaaugacuau

SEQ ID NO: 833317 - RNA, 19 nt, Homo sapiens
gaauuaacauggccagugu

SEQ ID NO: 833318 - RNA, 19 nt, Homo sapiens
cuaaacagaucugauauug

SEQ ID NO: 833319 - RNA, 19 nt, Homo sapiens
gaagauggaugaguaugug

SEQ ID NO: 833320 - RNA, 19 nt, Homo sapiens
gaucuuacccacuggauuu

SEQ ID NO: 833321 - RNA, 19 nt, Homo sapiens
cuacuuaucucuuuguaug

SEQ ID NO: 833322 - RNA, 19 nt, Homo sapiens
uaaguuagguugccagugu

SEQ ID NO: 833323 - RNA, 19 nt, Homo sapiens
ggaaggccauugcaguuug

SEQ ID NO: 833324 - RNA, 19 nt, Homo sapiens
ggacuccuuucuuccauuu

SEQ ID NO: 833325 - RNA, 19 nt, Homo sapiens
gaagcaagaauucaacaaa

SEQ ID NO: 833326 - RNA, 19 nt, Homo sapiens
ccuccaaccucuuaccuua

SEQ ID NO: 833327 - RNA, 19 nt, Homo sapiens
gaagagacccacuccaaau

SEQ ID NO: 833328 - RNA, 19 nt, Homo sapiens
gauggucucuagccuauug

SEQ ID NO: 833329 - RNA, 19 nt, Homo sapiens
uaaggaagaucauaaaugc

SEQ ID NO: 833330 - RNA, 19 nt, Homo sapiens
ggaagaucauaaaugcuaa

SEQ ID NO: 833331 - RNA, 19 nt, Homo sapiens
ggacgaagagaaauugaaa

SEQ ID NO: 833332 - RNA, 19 nt, Homo sapiens
gggauaggcuuuggaaaug

SEQ ID NO: 833333 - RNA, 19 nt, Homo sapiens
ucacugccuucuuuauaua

SEQ ID NO: 833334 - RNA, 19 nt, Homo sapiens
ugauagagcuuuacaaugc

SEQ ID NO: 833335 - RNA, 19 nt, Homo sapiens
caaacaugaucuuggauga

SEQ ID NO: 833336 - RNA, 19 nt, Homo sapiens
gcaagggauucagaucuuu

SEQ ID NO: 833337 - RNA, 19 nt, Homo sapiens
caaguggacauuguuauua

SEQ ID NO: 833338 - RNA, 19 nt, Homo sapiens
aaacagaucugauauugcu

SEQ ID NO: 833339 - RNA, 19 nt, Homo sapiens
ccauaugucucagcaagua

SEQ ID NO: 833340 - RNA, 19 nt, Homo sapiens
ugaaguggcugcugcucua

SEQ ID NO: 833341 - RNA, 19 nt, Homo sapiens
uguccaggcucacgaguua

SEQ ID NO: 833342 - RNA, 19 nt, Homo sapiens
cagcaauaaugacuaugua

SEQ ID NO: 833343 - RNA, 19 nt, Homo sapiens
gagacccacuccaaauaaa

SEQ ID NO: 833344 - RNA, 19 nt, Homo sapiens
uaauaaggaaggaguguua

SEQ ID NO: 833345 - RNA, 19 nt, Homo sapiens
ggucucaggcauuucauua

SEQ ID NO: 833346 - RNA, 19 nt, Homo sapiens
gaaacacugcuuccugaaa

SEQ ID NO: 833347 - RNA, 19 nt, Homo sapiens
aaggagagcuuguugugaa

SEQ ID NO: 833348 - RNA, 19 nt, Homo sapiens
gcagugacuucuguguuaa

SEQ ID NO: 833349 - RNA, 19 nt, Homo sapiens
gaaggccauugcaguuuga

SEQ ID NO: 833350 - RNA, 19 nt, Homo sapiens
ggaaaugggacaggucuuu

SEQ ID NO: 833351 - RNA, 19 nt, Homo sapiens
ggaaggaguguuauuuaug

SEQ ID NO: 833352 - RNA, 19 nt, Homo sapiens
gaagggagagucagaagau

SEQ ID NO: 833353 - RNA, 19 nt, Homo sapiens
gugaggccguuuggaauua

SEQ ID NO: 833354 - RNA, 19 nt, Homo sapiens
gaaguucuuggaaaucuuu

SEQ ID NO: 833355 - RNA, 19 nt, Homo sapiens
agacaggguuucacuaugu

SEQ ID NO: 833356 - RNA, 19 nt, Homo sapiens
ggaaagaaggcuacuuauc

SEQ ID NO: 833357 - RNA, 19 nt, Homo sapiens
acacggggcuucuaaguua

SEQ ID NO: 833358 - RNA, 19 nt, Homo sapiens
ccacuaagccauucaguuc

SEQ ID NO: 833359 - RNA, 19 nt, Homo sapiens
guaaggaagaucauaaaug

SEQ ID NO: 833360 - RNA, 19 nt, Homo sapiens
gcaaguacugguuauauuc

SEQ ID NO: 833361 - RNA, 19 nt, Homo sapiens
gcaacaccagcaaauuaua

SEQ ID NO: 833362 - RNA, 19 nt, Homo sapiens
guauguggcuccagucugu

SEQ ID NO: 833363 - RNA, 19 nt, Homo sapiens
cagaugaacaggccaagua

SEQ ID NO: 833364 - RNA, 19 nt, Homo sapiens
gugcucacccuguguguua

SEQ ID NO: 833365 - RNA, 19 nt, Homo sapiens
gcuauaagcaggaugucua

SEQ ID NO: 833366 - RNA, 19 nt, Homo sapiens
gaaaggaauaacacuucua

SEQ ID NO: 833367 - RNA, 19 nt, Homo sapiens
agagcaaugugucuucuuu

SEQ ID NO: 833368 - RNA, 19 nt, Homo sapiens
ucaagaagcagauccaguu

SEQ ID NO: 833369 - RNA, 19 nt, Homo sapiens
uaaggaaggaguguuauuu

SEQ ID NO: 833370 - RNA, 19 nt, Homo sapiens
gagacaggguuucacuaug

SEQ ID NO: 833371 - RNA, 19 nt, Homo sapiens
gccauucaguucuuccuuu

SEQ ID NO: 833372 - RNA, 19 nt, Homo sapiens
guggaacuuugguaaauga

SEQ ID NO: 833373 - RNA, 19 nt, Homo sapiens
agaccaaggugacucaaga

SEQ ID NO: 833374 - RNA, 19 nt, Homo sapiens
cacuaucacugccuucuuu

SEQ ID NO: 833375 - RNA, 19 nt, Homo sapiens
gaaaaucaagggcauagua

SEQ ID NO: 833376 - RNA, 19 nt, Homo sapiens
agcagugacuucuguguua

SEQ ID NO: 833377 - RNA, 19 nt, Homo sapiens
cuguuugccucauuuaaua

SEQ ID NO: 833378 - RNA, 19 nt, Homo sapiens
caaggugacucaagauaac

SEQ ID NO: 833379 - RNA, 19 nt, Homo sapiens
cagauugguucuaagaguu

SEQ ID NO: 833380 - RNA, 19 nt, Homo sapiens
cgucagacauucauuccuu

SEQ ID NO: 833381 - RNA, 19 nt, Homo sapiens
ggacagguucuaaacucua

SEQ ID NO: 833382 - RNA, 19 nt, Homo sapiens
caacaccagcaaauuauau

SEQ ID NO: 833383 - RNA, 19 nt, Homo sapiens
ccaaggugacucaagauaa

SEQ ID NO: 833384 - RNA, 19 nt, Homo sapiens
guaaacuguauccagauua

SEQ ID NO: 833385 - RNA, 19 nt, Homo sapiens
uaucacugccuucuuuaua

SEQ ID NO: 833386 - RNA, 19 nt, Homo sapiens
gaagaauagcugcaucguu

SEQ ID NO: 833387 - RNA, 19 nt, Homo sapiens
gugcugugcugcccugaaa

SEQ ID NO: 833388 - RNA, 19 nt, Homo sapiens
ucucuaaacagaucugaua

SEQ ID NO: 833389 - RNA, 19 nt, Homo sapiens
guuauuugccucugaguuu

SEQ ID NO: 833390 - RNA, 19 nt, Homo sapiens
ccaggggucuccuuucuua

SEQ ID NO: 833391 - RNA, 19 nt, Homo sapiens
guaacucaaaccagaauuu

SEQ ID NO: 833392 - RNA, 19 nt, Homo sapiens
gacagguucuaaacucuau

SEQ ID NO: 833393 - RNA, 19 nt, Homo sapiens
ugggaaagaaggcuacuua

SEQ ID NO: 833394 - RNA, 19 nt, Homo sapiens
gcugagggauacagagaug

SEQ ID NO: 833395 - RNA, 19 nt, Homo sapiens
ccacagugccuacauuugu

SEQ ID NO: 833396 - RNA, 19 nt, Homo sapiens
guacagguaacaagaaugu

SEQ ID NO: 833397 - RNA, 19 nt, Homo sapiens
gcaaagagcuugaguugau

SEQ ID NO: 833398 - RNA, 19 nt, Homo sapiens
gagagccgcuggaaagaua

SEQ ID NO: 833399 - RNA, 19 nt, Homo sapiens
ccacuuauguuguacagua

SEQ ID NO: 833400 - RNA, 19 nt, Homo sapiens
gcaccaaccuucccacuau

SEQ ID NO: 833401 - RNA, 19 nt, Homo sapiens
acaaggaucuguaugagua

SEQ ID NO: 833402 - RNA, 19 nt, Homo sapiens
gcaaugguuuggcuuauga

SEQ ID NO: 833403 - RNA, 19 nt, Homo sapiens
caaguaaagucccaaguga

SEQ ID NO: 833404 - RNA, 19 nt, Homo sapiens
gcagagaaauacaguggaa

SEQ ID NO: 833405 - RNA, 19 nt, Homo sapiens
caaagcaccuucagcauca

SEQ ID NO: 833406 - RNA, 19 nt, Homo sapiens
gcccucagauggcacauua

SEQ ID NO: 833407 - RNA, 19 nt, Homo sapiens
gaagaggaccugaacuuug

SEQ ID NO: 833408 - RNA, 19 nt, Homo sapiens
aaauacaacugggacauua

SEQ ID NO: 833409 - RNA, 19 nt, Homo sapiens
caacgccacucaucagauu

SEQ ID NO: 833410 - RNA, 19 nt, Homo sapiens
ggacacaaccacuaauuug

SEQ ID NO: 833411 - RNA, 19 nt, Homo sapiens
gaaacucaguggagaggaa

SEQ ID NO: 833412 - RNA, 19 nt, Homo sapiens
ggaauucgcugggcaaugg

SEQ ID NO: 833413 - RNA, 19 nt, Homo sapiens
gaacuucauuagagcuuug

SEQ ID NO: 833414 - RNA, 19 nt, Homo sapiens
aaagagacagggagaaaua

SEQ ID NO: 833415 - RNA, 19 nt, Homo sapiens
gcuaaagccuauaaauaca

SEQ ID NO: 833416 - RNA, 19 nt, Homo sapiens
gauuaaagccaacaacuca

SEQ ID NO: 833417 - RNA, 19 nt, Homo sapiens
guacagugcccaaaugaug

SEQ ID NO: 833418 - RNA, 19 nt, Homo sapiens
ggacagguggccuuaagaa

SEQ ID NO: 833419 - RNA, 19 nt, Homo sapiens
agacagggagaaauaaaua

SEQ ID NO: 833420 - RNA, 19 nt, Homo sapiens
ggccuugucuccugccuuu

SEQ ID NO: 833421 - RNA, 19 nt, Homo sapiens
ccaaggcccuggcagaugu

SEQ ID NO: 833422 - RNA, 19 nt, Homo sapiens
cuuaagaacuucauuagag

SEQ ID NO: 833423 - RNA, 19 nt, Homo sapiens
ggaaggacauaaaagguuu

SEQ ID NO: 833424 - RNA, 19 nt, Homo sapiens
cgacacugcugagaacauu

SEQ ID NO: 833425 - RNA, 19 nt, Homo sapiens
caucuucccugcagcgauu

SEQ ID NO: 833426 - RNA, 19 nt, Homo sapiens
cagcaaagagcuugaguug

SEQ ID NO: 833427 - RNA, 19 nt, Homo sapiens
aagaggaccugaacuuugu

SEQ ID NO: 833428 - RNA, 19 nt, Homo sapiens
gggagaaccagccgaauug

SEQ ID NO: 833429 - RNA, 19 nt, Homo sapiens
ugccaaagcugauguccuu

SEQ ID NO: 833430 - RNA, 19 nt, Homo sapiens
gcugggacgugcucuguau

SEQ ID NO: 833431 - RNA, 19 nt, Homo sapiens
ggaaccagguggaggaucu

SEQ ID NO: 833432 - RNA, 19 nt, Homo sapiens
ugucauguuugucuucuuu

SEQ ID NO: 833433 - RNA, 19 nt, Homo sapiens
gcaaugucauguuugucuu

SEQ ID NO: 833434 - RNA, 19 nt, Homo sapiens
cagaauggcucagcaccaa

SEQ ID NO: 833435 - RNA, 19 nt, Homo sapiens
cagauugggauuaacauaa

SEQ ID NO: 833436 - RNA, 19 nt, Homo sapiens
ucuauggguuccugauuaa

SEQ ID NO: 833437 - RNA, 19 nt, Homo sapiens
gcucgaggauggucuacga

SEQ ID NO: 833438 - RNA, 19 nt, Homo sapiens
gcaguggcuuccuuuguca

SEQ ID NO: 833439 - RNA, 19 nt, Homo sapiens
cggcgcagcuccauccaaa

SEQ ID NO: 833440 - RNA, 19 nt, Homo sapiens
gcuucuugcuccuguuuaa

SEQ ID NO: 833441 - RNA, 19 nt, Homo sapiens
aaaccaaagucaucaagca

SEQ ID NO: 833442 - RNA, 19 nt, Homo sapiens
gcguucuacugcacgauua

SEQ ID NO: 833443 - RNA, 19 nt, Homo sapiens
cagguggccuuaagaacuu

SEQ ID NO: 833444 - RNA, 19 nt, Homo sapiens
gcaaguuucccgugcaguu

SEQ ID NO: 833445 - RNA, 19 nt, Homo sapiens
cgaggauggucuacgauau

SEQ ID NO: 833446 - RNA, 19 nt, Homo sapiens
ggagcaugcuaaagccuau

SEQ ID NO: 833447 - RNA, 19 nt, Homo sapiens
ccacagagacggugucagu

SEQ ID NO: 833448 - RNA, 19 nt, Homo sapiens
guuagagaauguugacuca

SEQ ID NO: 833449 - RNA, 19 nt, Homo sapiens
aaugauggguuugguguuu

SEQ ID NO: 833450 - RNA, 19 nt, Homo sapiens
gggacacaaccacuaauuu

SEQ ID NO: 833451 - RNA, 19 nt, Homo sapiens
ugacgggccucuucaacau

SEQ ID NO: 833452 - RNA, 19 nt, Homo sapiens
caaguuucccgugcaguua

SEQ ID NO: 833453 - RNA, 19 nt, Homo sapiens
ccacagugcucaguuguac

SEQ ID NO: 833454 - RNA, 19 nt, Homo sapiens
ugucucagauugggauuaa

SEQ ID NO: 833455 - RNA, 19 nt, Homo sapiens
ggccuuaagaacuucauua

SEQ ID NO: 833456 - RNA, 19 nt, Homo sapiens
guggagaggaagauauaua

SEQ ID NO: 833457 - RNA, 19 nt, Homo sapiens
ggcugccagucuucaauua

SEQ ID NO: 833458 - RNA, 19 nt, Homo sapiens
cuaguuacccacccuaauu

SEQ ID NO: 833459 - RNA, 19 nt, Homo sapiens
gaccugaacuuuguaacag

SEQ ID NO: 833460 - RNA, 19 nt, Homo sapiens
acacaugcaugcugucauc

SEQ ID NO: 833461 - RNA, 19 nt, Homo sapiens
gaccuacaguggguauuga

SEQ ID NO: 833462 - RNA, 19 nt, Homo sapiens
gccaggagcugugucauac

SEQ ID NO: 833463 - RNA, 19 nt, Homo sapiens
aaacaaggaucuguaugag

SEQ ID NO: 833464 - RNA, 19 nt, Homo sapiens
cucuauggguuccugauua

SEQ ID NO: 833465 - RNA, 19 nt, Homo sapiens
ggaccugaacuuuguaaca

SEQ ID NO: 833466 - RNA, 19 nt, Homo sapiens
ccagggauuuaauggagaa

SEQ ID NO: 833467 - RNA, 19 nt, Homo sapiens
gacagggagaaauaaauaa

SEQ ID NO: 833468 - RNA, 19 nt, Homo sapiens
acgggccucuucaacauua

SEQ ID NO: 833469 - RNA, 19 nt, Homo sapiens
ggacugagagccgcuggaa

SEQ ID NO: 833470 - RNA, 19 nt, Homo sapiens
gagcucuacugaauacucu

SEQ ID NO: 833471 - RNA, 19 nt, Homo sapiens
gugccaggauccaaguaaa

SEQ ID NO: 833472 - RNA, 19 nt, Homo sapiens
ugaagaggaccugaacuuu

SEQ ID NO: 833473 - RNA, 19 nt, Homo sapiens
gaggauggucuacgauaug

SEQ ID NO: 833474 - RNA, 19 nt, Homo sapiens
gaaagaggaggaccuacag

SEQ ID NO: 833475 - RNA, 19 nt, Homo sapiens
gagacagggagaaauaaau

SEQ ID NO: 833476 - RNA, 19 nt, Homo sapiens
ccaccaacaccacuuaugu

SEQ ID NO: 833477 - RNA, 19 nt, Homo sapiens
cauuagagcuuuggaugca

SEQ ID NO: 833478 - RNA, 19 nt, Homo sapiens
gcuggauagucguuccuuu

SEQ ID NO: 833479 - RNA, 19 nt, Homo sapiens
gggcaaugguuuggcuuau

SEQ ID NO: 833480 - RNA, 19 nt, Homo sapiens
aggcuucucuccuagugua

SEQ ID NO: 833481 - RNA, 19 nt, Homo sapiens
ggaccuacaguggguauug

SEQ ID NO: 833482 - RNA, 19 nt, Homo sapiens
caguggagaggaagauaua

SEQ ID NO: 833483 - RNA, 19 nt, Homo sapiens
ugacugggaaggacauaaa

SEQ ID NO: 833484 - RNA, 19 nt, Homo sapiens
guggagcucuacugaauac

SEQ ID NO: 833485 - RNA, 19 nt, Homo sapiens
ccaaguaaagucccaagug

SEQ ID NO: 833486 - RNA, 19 nt, Homo sapiens
acucaugguuccagucuau

SEQ ID NO: 833487 - RNA, 19 nt, Homo sapiens
uaaauacaacugggacauu

SEQ ID NO: 833488 - RNA, 19 nt, Homo sapiens
agagaaauacaguggaauu

SEQ ID NO: 833489 - RNA, 19 nt, Homo sapiens
uagagaggccgcuaacaga

SEQ ID NO: 833490 - RNA, 19 nt, Homo sapiens
aguaaagucccaagugaaa

SEQ ID NO: 833491 - RNA, 19 nt, Homo sapiens
aaugugagcuaucccgaau

SEQ ID NO: 833492 - RNA, 19 nt, Homo sapiens
gagaaauacaguggaauuc

SEQ ID NO: 833493 - RNA, 19 nt, Homo sapiens
caaagagcuugaguugauc

SEQ ID NO: 833494 - RNA, 19 nt, Homo sapiens
gaaaaugaaaccaaaguca

SEQ ID NO: 833495 - RNA, 19 nt, Homo sapiens
caggagcugugucauacug

SEQ ID NO: 833496 - RNA, 19 nt, Homo sapiens
ggcaaugguuuggcuuaug

SEQ ID NO: 833497 - RNA, 19 nt, Homo sapiens
gcagaauucuugucaucua

SEQ ID NO: 833498 - RNA, 19 nt, Homo sapiens
gagcuuuccugccuaauga

SEQ ID NO: 833499 - RNA, 19 nt, Homo sapiens
gcaggaacuugaagagaaa

SEQ ID NO: 833500 - RNA, 19 nt, Homo sapiens
gagaggauaucccagcaaa

SEQ ID NO: 833501 - RNA, 19 nt, Homo sapiens
gagaaagacuugucauuuu

SEQ ID NO: 833502 - RNA, 19 nt, Homo sapiens
guaaguuugugguuuguuu

SEQ ID NO: 833503 - RNA, 19 nt, Homo sapiens
gagaguaaguuugugguuu

SEQ ID NO: 833504 - RNA, 19 nt, Homo sapiens
gcacaccacugucccacaa

SEQ ID NO: 833505 - RNA, 19 nt, Homo sapiens
gcaaaccaauaucuaggaa

SEQ ID NO: 833506 - RNA, 19 nt, Homo sapiens
gagcagaauucuugucauc

SEQ ID NO: 833507 - RNA, 19 nt, Homo sapiens
ggcaggaacuugaagagaa

SEQ ID NO: 833508 - RNA, 19 nt, Homo sapiens
gaggauaucccagcaaauu

SEQ ID NO: 833509 - RNA, 19 nt, Homo sapiens
gagugaagguguuugaaau

SEQ ID NO: 833510 - RNA, 19 nt, Homo sapiens
gaagaaaggaagaggaaga

SEQ ID NO: 833511 - RNA, 19 nt, Homo sapiens
caagagcuuuccugccuaa

SEQ ID NO: 833512 - RNA, 19 nt, Homo sapiens
gagaagcuuugaccuugaa

SEQ ID NO: 833513 - RNA, 19 nt, Homo sapiens
aggcgaagcugaagucauu

SEQ ID NO: 833514 - RNA, 19 nt, Homo sapiens
gagaagagcccaucgacau

SEQ ID NO: 833515 - RNA, 19 nt, Homo sapiens
gguguugguuugcaauaaa

SEQ ID NO: 833516 - RNA, 19 nt, Homo sapiens
ccauugagguccuaggauu

SEQ ID NO: 833517 - RNA, 19 nt, Homo sapiens
ugagaaagacuugucauuu

SEQ ID NO: 833518 - RNA, 19 nt, Homo sapiens
gaacuuauggcccaaucuu

SEQ ID NO: 833519 - RNA, 19 nt, Homo sapiens
gagaugcccugcaccuugu

SEQ ID NO: 833520 - RNA, 19 nt, Homo sapiens
caccacaacugaaccagaa

SEQ ID NO: 833521 - RNA, 19 nt, Homo sapiens
ggacuugcucgucuuguuu

SEQ ID NO: 833522 - RNA, 19 nt, Homo sapiens
gggauaguauuggguauug

SEQ ID NO: 833523 - RNA, 19 nt, Homo sapiens
ucccugcccugcuuuaaua

SEQ ID NO: 833524 - RNA, 19 nt, Homo sapiens
gaagagcccaucgacauug

SEQ ID NO: 833525 - RNA, 19 nt, Homo sapiens
agaguaaguuugugguuug

SEQ ID NO: 833526 - RNA, 19 nt, Homo sapiens
ggcccaaucuuaccuguuc

SEQ ID NO: 833527 - RNA, 19 nt, Homo sapiens
uccaugagaugcugaagaa

SEQ ID NO: 833528 - RNA, 19 nt, Homo sapiens
gaucaacacugagaguucu

SEQ ID NO: 833529 - RNA, 19 nt, Homo sapiens
ggucacaggacuauacuga

SEQ ID NO: 833530 - RNA, 19 nt, Homo sapiens
gaaaugcaggagaggauau

SEQ ID NO: 833531 - RNA, 19 nt, Homo sapiens
uggacaggcuuaccuuuga

SEQ ID NO: 833532 - RNA, 19 nt, Homo sapiens
gcaaggugggcgaguauug

SEQ ID NO: 833533 - RNA, 19 nt, Homo sapiens
gaaggagccagucccaguu

SEQ ID NO: 833534 - RNA, 19 nt, Homo sapiens
ugacugagggauaguauug

SEQ ID NO: 833535 - RNA, 19 nt, Homo sapiens
caccggcacuguccauuug

SEQ ID NO: 833536 - RNA, 19 nt, Homo sapiens
gcaaagacgagauuaugag

SEQ ID NO: 833537 - RNA, 19 nt, Homo sapiens
gaccacagcauguccauca

SEQ ID NO: 833538 - RNA, 19 nt, Homo sapiens
gggacuugcucgucuuguu

SEQ ID NO: 833539 - RNA, 19 nt, Homo sapiens
gaagagaaaaucagaagaa

SEQ ID NO: 833540 - RNA, 19 nt, Homo sapiens
gaagagaaggcaggaacuu

SEQ ID NO: 833541 - RNA, 19 nt, Homo sapiens
cagcugagguccgaggaaa

SEQ ID NO: 833542 - RNA, 19 nt, Homo sapiens
gaucaucacaggagagcaa

SEQ ID NO: 833543 - RNA, 19 nt, Homo sapiens
ccacauggcccgucaggau

SEQ ID NO: 833544 - RNA, 19 nt, Homo sapiens
aagggaagcucacccacaa

SEQ ID NO: 833545 - RNA, 19 nt, Homo sapiens
gaagaggccaagacugugu

SEQ ID NO: 833546 - RNA, 19 nt, Homo sapiens
cagaauucuugucaucuau

SEQ ID NO: 833547 - RNA, 19 nt, Homo sapiens
gugguuuguuucugguuua

SEQ ID NO: 833548 - RNA, 19 nt, Homo sapiens
gcauucacguggucuucuu

SEQ ID NO: 833549 - RNA, 19 nt, Homo sapiens
gagcugaaaguccaugaga

SEQ ID NO: 833550 - RNA, 19 nt, Homo sapiens
cccacaagaucaacacuga

SEQ ID NO: 833551 - RNA, 19 nt, Homo sapiens
ugagaagcuuugaccuuga

SEQ ID NO: 833552 - RNA, 19 nt, Homo sapiens
cuucuuggcucccugcauu

SEQ ID NO: 833553 - RNA, 19 nt, Homo sapiens
gcugaaaguccaugagaug

SEQ ID NO: 833554 - RNA, 19 nt, Homo sapiens
gaaugugagagucuuguug

SEQ ID NO: 833555 - RNA, 19 nt, Homo sapiens
gcacggccagcaagaauca

SEQ ID NO: 833556 - RNA, 19 nt, Homo sapiens
caaagacgagauuaugaga

SEQ ID NO: 833557 - RNA, 19 nt, Homo sapiens
ugaagucauugaagugugu

SEQ ID NO: 833558 - RNA, 19 nt, Homo sapiens
guugggauguggaguuguu

SEQ ID NO: 833559 - RNA, 19 nt, Homo sapiens
gaagcucacccacaagauc

SEQ ID NO: 833560 - RNA, 19 nt, Homo sapiens
gaaggcaggaacuugaaga

SEQ ID NO: 833561 - RNA, 19 nt, Homo sapiens
gagaaggcaggaacuugaa

SEQ ID NO: 833562 - RNA, 19 nt, Homo sapiens
aaauugggaucacaugcuu

SEQ ID NO: 833563 - RNA, 19 nt, Homo sapiens
ugagcaaggugggcgagua

SEQ ID NO: 833564 - RNA, 19 nt, Homo sapiens
cagaagaaaggaagaggaa

SEQ ID NO: 833565 - RNA, 19 nt, Homo sapiens
gcccugcaccuuguuauuu

SEQ ID NO: 833566 - RNA, 19 nt, Homo sapiens
gugaugcaguggugugaga

SEQ ID NO: 833567 - RNA, 19 nt, Homo sapiens
aagacgagauuaugagaca

SEQ ID NO: 833568 - RNA, 19 nt, Homo sapiens
ugagagucuuguugucuga

SEQ ID NO: 833569 - RNA, 19 nt, Homo sapiens
gagcaaaaggcccuagaua

SEQ ID NO: 833570 - RNA, 19 nt, Homo sapiens
aagcugaagucauugaagu

SEQ ID NO: 833571 - RNA, 19 nt, Homo sapiens
gagcaaggugggcgaguau

SEQ ID NO: 833572 - RNA, 19 nt, Homo sapiens
gggaagcucacccacaaga

SEQ ID NO: 833573 - RNA, 19 nt, Homo sapiens
cauggugacuaguguuugu

SEQ ID NO: 833574 - RNA, 19 nt, Homo sapiens
gagagucauucacuuccau

SEQ ID NO: 833575 - RNA, 19 nt, Homo sapiens
ucuccucucuucucuauag

SEQ ID NO: 833576 - RNA, 19 nt, Homo sapiens
ugucuccucucuucucuau

SEQ ID NO: 833577 - RNA, 19 nt, Homo sapiens
ugacaccccuuguaagaaa

SEQ ID NO: 833578 - RNA, 19 nt, Homo sapiens
gugcaaagacgagauuaug

SEQ ID NO: 833579 - RNA, 19 nt, Homo sapiens
ggugcacggugucaaagug

SEQ ID NO: 833580 - RNA, 19 nt, Homo sapiens
gggcucagguccagaugca

SEQ ID NO: 833581 - RNA, 19 nt, Homo sapiens
gcucucugcuugcuguugu

SEQ ID NO: 833582 - RNA, 19 nt, Homo sapiens
gcuccuugguguugguuug

SEQ ID NO: 833583 - RNA, 19 nt, Homo sapiens
gaacagccacuugcaucug

SEQ ID NO: 833584 - RNA, 19 nt, Homo sapiens
ggagacuggagcccuguuu

SEQ ID NO: 833585 - RNA, 19 nt, Homo sapiens
ugagugaagguguuugaaa

SEQ ID NO: 833586 - RNA, 19 nt, Homo sapiens
gacuugcucgucuuguuua

SEQ ID NO: 833587 - RNA, 19 nt, Homo sapiens
ccaucgacauugacaagau

SEQ ID NO: 833588 - RNA, 19 nt, Homo sapiens
agagucuuguugucugaua

SEQ ID NO: 833589 - RNA, 19 nt, Homo sapiens
ugcacacucucuauggaua

SEQ ID NO: 833590 - RNA, 19 nt, Homo sapiens
ccauuugccugucugucaa

SEQ ID NO: 833591 - RNA, 19 nt, Homo sapiens
ggaggagaccacagcaugu

SEQ ID NO: 833592 - RNA, 19 nt, Homo sapiens
acagagccaugagcugaaa

SEQ ID NO: 833593 - RNA, 19 nt, Homo sapiens
agagaaggcaggaacuuga

SEQ ID NO: 833594 - RNA, 19 nt, Homo sapiens
gaagggaaagcaggucuca

SEQ ID NO: 833595 - RNA, 19 nt, Homo sapiens
ggagaguaaguuugugguu

SEQ ID NO: 833596 - RNA, 19 nt, Homo sapiens
gaccuugcuuugguucuug

SEQ ID NO: 833597 - RNA, 19 nt, Homo sapiens
gaaauaaacaggaaggaaa

SEQ ID NO: 833598 - RNA, 19 nt, Homo sapiens
gaacagcgacgaugcuuau

SEQ ID NO: 833599 - RNA, 19 nt, Homo sapiens
ccaaauugcccuuguguuu

SEQ ID NO: 833600 - RNA, 19 nt, Homo sapiens
cagcgacgaugcuuaugua

SEQ ID NO: 833601 - RNA, 19 nt, Homo sapiens
ccaaggaaauaaacaggaa

SEQ ID NO: 833602 - RNA, 19 nt, Homo sapiens
ugacagagcgccaggcuuu

SEQ ID NO: 833603 - RNA, 19 nt, Homo sapiens
cagcagagagccugucaua

SEQ ID NO: 833604 - RNA, 19 nt, Homo sapiens
auagggaacugcauggaua

SEQ ID NO: 833605 - RNA, 19 nt, Homo sapiens
gcagagagccugucauagg

SEQ ID NO: 833606 - RNA, 19 nt, Homo sapiens
gcgccaggcuuuaucuuau

SEQ ID NO: 833607 - RNA, 19 nt, Homo sapiens
gacaguaagaguucaagua

SEQ ID NO: 833608 - RNA, 19 nt, Homo sapiens
ugacagcccucugcucuug

SEQ ID NO: 833609 - RNA, 19 nt, Homo sapiens
ggaaauaaacaggaaggaa

SEQ ID NO: 833610 - RNA, 19 nt, Homo sapiens
guguacagcuugggaauga

SEQ ID NO: 833611 - RNA, 19 nt, Homo sapiens
gcagcguugugccaaauug

SEQ ID NO: 833612 - RNA, 19 nt, Homo sapiens
ggaacugcauggauagaag

SEQ ID NO: 833613 - RNA, 19 nt, Homo sapiens
gaccaaagguugccaugac

SEQ ID NO: 833614 - RNA, 19 nt, Homo sapiens
ccaagucaccaaggaaaua

SEQ ID NO: 833615 - RNA, 19 nt, Homo sapiens
gcaggcguguaacaagaaa

SEQ ID NO: 833616 - RNA, 19 nt, Homo sapiens
ggagcaggcaggcguguaa

SEQ ID NO: 833617 - RNA, 19 nt, Homo sapiens
caguggagcugccggauca

SEQ ID NO: 833618 - RNA, 19 nt, Homo sapiens
cgacgaugcuuauguacag

SEQ ID NO: 833619 - RNA, 19 nt, Homo sapiens
aaggauggcuuccaagaca

SEQ ID NO: 833620 - RNA, 19 nt, Homo sapiens
caaaucagggcacaagaau

SEQ ID NO: 833621 - RNA, 19 nt, Homo sapiens
gaccaagucaccaaggaaa

SEQ ID NO: 833622 - RNA, 19 nt, Homo sapiens
cagcugcuuuccucacauu

SEQ ID NO: 833623 - RNA, 19 nt, Homo sapiens
gauuguaaacccacaguau

SEQ ID NO: 833624 - RNA, 19 nt, Homo sapiens
guacagcuugggaaugaaa

SEQ ID NO: 833625 - RNA, 19 nt, Homo sapiens
caagucaccaaggaaauaa

SEQ ID NO: 833626 - RNA, 19 nt, Homo sapiens
aguaagaguucaaguacau

SEQ ID NO: 833627 - RNA, 19 nt, Homo sapiens
gcaagaauaccaggaacug

SEQ ID NO: 833628 - RNA, 19 nt, Homo sapiens
gaguuugcacagcucauua

SEQ ID NO: 833629 - RNA, 19 nt, Homo sapiens
caaguacauugaccaaagg

SEQ ID NO: 833630 - RNA, 19 nt, Homo sapiens
ucaaaaugcugacucuuau

SEQ ID NO: 833631 - RNA, 19 nt, Homo sapiens
aaucagggcacaagaaugu

SEQ ID NO: 833632 - RNA, 19 nt, Homo sapiens
cagcagccgccacacuaua

SEQ ID NO: 833633 - RNA, 19 nt, Homo sapiens
caaauugcccuuguguuuc

SEQ ID NO: 833634 - RNA, 19 nt, Homo sapiens
aaauugcccuuguguuucu

SEQ ID NO: 833635 - RNA, 19 nt, Homo sapiens
gugcagaggcucacagcuu

SEQ ID NO: 833636 - RNA, 19 nt, Homo sapiens
ccaaggauggcuuccaaga

SEQ ID NO: 833637 - RNA, 19 nt, Homo sapiens
guguuucucuccacccaaa

SEQ ID NO: 833638 - RNA, 19 nt, Homo sapiens
ggaaugaaaagguugauug

SEQ ID NO: 833639 - RNA, 19 nt, Homo sapiens
gaacugcauggauagaagu

SEQ ID NO: 833640 - RNA, 19 nt, Homo sapiens
gcuaggaacugugagucau

SEQ ID NO: 833641 - RNA, 19 nt, Homo sapiens
gagucaugcccaagaauug

SEQ ID NO: 833642 - RNA, 19 nt, Homo sapiens
cggaugcaguucucaguca

SEQ ID NO: 833643 - RNA, 19 nt, Homo sapiens
uaagaguucaaguacauug

SEQ ID NO: 833644 - RNA, 19 nt, Homo sapiens
acaaaucagggcacaagaa

SEQ ID NO: 833645 - RNA, 19 nt, Homo sapiens
guucauccgugugcuguuc

SEQ ID NO: 833646 - RNA, 19 nt, Homo sapiens
gcaggcaggcguguaacaa

SEQ ID NO: 833647 - RNA, 19 nt, Homo sapiens
aaacuccucuugcuaucca

SEQ ID NO: 833648 - RNA, 19 nt, Homo sapiens
uaacuugccaggaaugagu

SEQ ID NO: 833649 - RNA, 19 nt, Homo sapiens
aagaauaccaggaacuguu

SEQ ID NO: 833650 - RNA, 19 nt, Homo sapiens
uaacaagaaacagagaguu

SEQ ID NO: 833651 - RNA, 19 nt, Homo sapiens
gcaguucucagucagucuu

SEQ ID NO: 833652 - RNA, 19 nt, Homo sapiens
caggcuuuaucuuaucaaa

SEQ ID NO: 833653 - RNA, 19 nt, Homo sapiens
gccaggcuuuaucuuauca

SEQ ID NO: 833654 - RNA, 19 nt, Homo sapiens
gcagcaacagcaagaauac

SEQ ID NO: 833655 - RNA, 19 nt, Homo sapiens
aggcaggcguguaacaaga

SEQ ID NO: 833656 - RNA, 19 nt, Homo sapiens
gcagccagcauuuaaacuc

SEQ ID NO: 833657 - RNA, 19 nt, Homo sapiens
gauaacuugccaggaauga

SEQ ID NO: 833658 - RNA, 19 nt, Homo sapiens
ugagucaugcccaagaauu

SEQ ID NO: 833659 - RNA, 19 nt, Homo sapiens
uagcagcguugugccaaau

SEQ ID NO: 833660 - RNA, 19 nt, Homo sapiens
guaaacccacaguaucuag

SEQ ID NO: 833661 - RNA, 19 nt, Homo sapiens
cauuuaaacuccucuugcu

SEQ ID NO: 833662 - RNA, 19 nt, Homo sapiens
auguacagcuggauaacuu

SEQ ID NO: 833663 - RNA, 19 nt, Homo sapiens
gacagagcgccaggcuuua

SEQ ID NO: 833664 - RNA, 19 nt, Homo sapiens
ucccuccacuugaccaauu

SEQ ID NO: 833665 - RNA, 19 nt, Homo sapiens
gaugucggaugcaguucuc

SEQ ID NO: 833666 - RNA, 19 nt, Homo sapiens
gcuuauguacagcuggaua

SEQ ID NO: 833667 - RNA, 19 nt, Homo sapiens
gcagaggcucacagcuuga

SEQ ID NO: 833668 - RNA, 19 nt, Homo sapiens
caacccaagcccugaaagu

SEQ ID NO: 833669 - RNA, 19 nt, Homo sapiens
guaacaagaaacagagagu

SEQ ID NO: 833670 - RNA, 19 nt, Homo sapiens
uuaaacuccucuugcuauc

SEQ ID NO: 833671 - RNA, 19 nt, Homo sapiens
ggagcugccggaucacaau

SEQ ID NO: 833672 - RNA, 19 nt, Homo sapiens
caguaagaguucaaguaca

SEQ ID NO: 833673 - RNA, 19 nt, Homo sapiens
ccaagacaguaagaguuca

SEQ ID NO: 833674 - RNA, 19 nt, Homo sapiens
uuuaaacuccucuugcuau

SEQ ID NO: 833675 - RNA, 19 nt, Homo sapiens
gauggccacccucagcuau

SEQ ID NO: 833676 - RNA, 19 nt, Homo sapiens
ugugagucaugcccaagaa

SEQ ID NO: 833677 - RNA, 19 nt, Homo sapiens
cuagcagcguugugccaaa

SEQ ID NO: 833678 - RNA, 19 nt, Homo sapiens
uacaagacaccagcaggua

SEQ ID NO: 833679 - RNA, 19 nt, Homo sapiens
ggauaacuugccaggaaug

SEQ ID NO: 833680 - RNA, 19 nt, Homo sapiens
uggauaacuugccaggaau

SEQ ID NO: 833681 - RNA, 19 nt, Homo sapiens
gcaccguaccaaccugaug

SEQ ID NO: 833682 - RNA, 19 nt, Homo sapiens
gcccucugcucuugaguac

SEQ ID NO: 833683 - RNA, 19 nt, Homo sapiens
caagacaguaagaguucaa

SEQ ID NO: 833684 - RNA, 19 nt, Homo sapiens
gcaacagcagcaacagcaa

SEQ ID NO: 833685 - RNA, 19 nt, Homo sapiens
gggaacugcauggauagaa

SEQ ID NO: 833686 - RNA, 19 nt, Homo sapiens
cuacgaccaggcgcauuua

SEQ ID NO: 833687 - RNA, 19 nt, Homo sapiens
ggacccugaaucuuugcua

SEQ ID NO: 833688 - RNA, 19 nt, Homo sapiens
cacagcugcuuuccucaca

SEQ ID NO: 833689 - RNA, 19 nt, Homo sapiens
aaauaucacagcugcuuuc

SEQ ID NO: 833690 - RNA, 19 nt, Homo sapiens
gugccaaauugcccuugug

SEQ ID NO: 833691 - RNA, 19 nt, Homo sapiens
ucucguggcugggaaagca

SEQ ID NO: 833692 - RNA, 19 nt, Homo sapiens
agaacagcgacgaugcuua

SEQ ID NO: 833693 - RNA, 19 nt, Homo sapiens
auacaucccuauggucauc

SEQ ID NO: 833694 - RNA, 19 nt, Homo sapiens
guaagaguucaaguacauu

SEQ ID NO: 833695 - RNA, 19 nt, Homo sapiens
acaguaagaguucaaguac

SEQ ID NO: 833696 - RNA, 19 nt, Homo sapiens
gcguguaacaagaaacaga

SEQ ID NO: 833697 - RNA, 19 nt, Homo sapiens
gcaaaugccucuacuguaa

SEQ ID NO: 833698 - RNA, 19 nt, Homo sapiens
gaacaacuauggagucaaa

SEQ ID NO: 833699 - RNA, 19 nt, Homo sapiens
caacaugacugauggagua

SEQ ID NO: 833700 - RNA, 19 nt, Homo sapiens
gaagaagaauccaaugaaa

SEQ ID NO: 833701 - RNA, 19 nt, Homo sapiens
gcacaucacuuacgagaga

SEQ ID NO: 833702 - RNA, 19 nt, Homo sapiens
ccaauaagcuggugacuca

SEQ ID NO: 833703 - RNA, 19 nt, Homo sapiens
gaaacuauguuccaacuuc

SEQ ID NO: 833704 - RNA, 19 nt, Homo sapiens
gacaauaccugcgaaauga

SEQ ID NO: 833705 - RNA, 19 nt, Homo sapiens
gaacauguacugaagguaa

SEQ ID NO: 833706 - RNA, 19 nt, Homo sapiens
gcacacaaauguagugguu

SEQ ID NO: 833707 - RNA, 19 nt, Homo sapiens
guacaagccuggcguguug

SEQ ID NO: 833708 - RNA, 19 nt, Homo sapiens
gaagcuagcagccaguuua

SEQ ID NO: 833709 - RNA, 19 nt, Homo sapiens
uaacauccaucuccuggua

SEQ ID NO: 833710 - RNA, 19 nt, Homo sapiens
ggucagaugucuuugagaa

SEQ ID NO: 833711 - RNA, 19 nt, Homo sapiens
caacaaucuuggcaguuua

SEQ ID NO: 833712 - RNA, 19 nt, Homo sapiens
caugguggauucauuuaua

SEQ ID NO: 833713 - RNA, 19 nt, Homo sapiens
ucuggacucucuuguauua

SEQ ID NO: 833714 - RNA, 19 nt, Homo sapiens
gcacauaaccuuguacaau

SEQ ID NO: 833715 - RNA, 19 nt, Homo sapiens
cgaagaccaugaacguaua

SEQ ID NO: 833716 - RNA, 19 nt, Homo sapiens
ggaagaagaauccaaugaa

SEQ ID NO: 833717 - RNA, 19 nt, Homo sapiens
cgagagaggcaccaaguua

SEQ ID NO: 833718 - RNA, 19 nt, Homo sapiens
guaacuacauacaaucuga

SEQ ID NO: 833719 - RNA, 19 nt, Homo sapiens
gagauccucuuuaugaaau

SEQ ID NO: 833720 - RNA, 19 nt, Homo sapiens
guaauaaacgcucuaucua

SEQ ID NO: 833721 - RNA, 19 nt, Homo sapiens
cagauugaguggcagaaua

SEQ ID NO: 833722 - RNA, 19 nt, Homo sapiens
gaagaugauuccuaugaag

SEQ ID NO: 833723 - RNA, 19 nt, Homo sapiens
ugacagacacgguaacuaa

SEQ ID NO: 833724 - RNA, 19 nt, Homo sapiens
gagagcaguugaaauggaa

SEQ ID NO: 833725 - RNA, 19 nt, Homo sapiens
ggacaauaccugcgaaaug

SEQ ID NO: 833726 - RNA, 19 nt, Homo sapiens
caaccaaacuaaugcacaa

SEQ ID NO: 833727 - RNA, 19 nt, Homo sapiens
ggagagaaauugagaagcu

SEQ ID NO: 833728 - RNA, 19 nt, Homo sapiens
cuacuguaaucgcuauuua

SEQ ID NO: 833729 - RNA, 19 nt, Homo sapiens
cugcagcgcuuguccauuu

SEQ ID NO: 833730 - RNA, 19 nt, Homo sapiens
ucaacaaucuuggcaguuu

SEQ ID NO: 833731 - RNA, 19 nt, Homo sapiens
cugcaaagcugucuucuca

SEQ ID NO: 833732 - RNA, 19 nt, Homo sapiens
caguugaaauggaagaaua

SEQ ID NO: 833733 - RNA, 19 nt, Homo sapiens
gaacucugaucuccagugu

SEQ ID NO: 833734 - RNA, 19 nt, Homo sapiens
cagcuuagccggaguuaaa

SEQ ID NO: 833735 - RNA, 19 nt, Homo sapiens
gaagcgcacuuacgagcaa

SEQ ID NO: 833736 - RNA, 19 nt, Homo sapiens
uaccaaagccuaacuuaaa

SEQ ID NO: 833737 - RNA, 19 nt, Homo sapiens
uaagcaggcugacagugua

SEQ ID NO: 833738 - RNA, 19 nt, Homo sapiens
gaagaugcaaggagcagua

SEQ ID NO: 833739 - RNA, 19 nt, Homo sapiens
gaagaaguguguccgugau

SEQ ID NO: 833740 - RNA, 19 nt, Homo sapiens
ugacaucgcuucccauuuu

SEQ ID NO: 833741 - RNA, 19 nt, Homo sapiens
gaagaaugcaucugagaau

SEQ ID NO: 833742 - RNA, 19 nt, Homo sapiens
gaauauccuugacauuaca

SEQ ID NO: 833743 - RNA, 19 nt, Homo sapiens
gcaaagcugucuucucacu

SEQ ID NO: 833744 - RNA, 19 nt, Homo sapiens
ucacauugaugaagagaug

SEQ ID NO: 833745 - RNA, 19 nt, Homo sapiens
gcuaaugccucuucucucu

SEQ ID NO: 833746 - RNA, 19 nt, Homo sapiens
ggaaauguccggucuuuac

SEQ ID NO: 833747 - RNA, 19 nt, Homo sapiens
uaucuggacucucuuguau

SEQ ID NO: 833748 - RNA, 19 nt, Homo sapiens
ugaagagccuguuguuuua

SEQ ID NO: 833749 - RNA, 19 nt, Homo sapiens
uagagcaagcuguuuauua

SEQ ID NO: 833750 - RNA, 19 nt, Homo sapiens
ggaauacuguaaagaacau

SEQ ID NO: 833751 - RNA, 19 nt, Homo sapiens
gagagaaauugagaagcua

SEQ ID NO: 833752 - RNA, 19 nt, Homo sapiens
gcucaaccauauguuaauu

SEQ ID NO: 833753 - RNA, 19 nt, Homo sapiens
ucaggucacugccaugauu

SEQ ID NO: 833754 - RNA, 19 nt, Homo sapiens
uggacucucuuguauuaua

SEQ ID NO: 833755 - RNA, 19 nt, Homo sapiens
gaaaagcagagguuuauuu

SEQ ID NO: 833756 - RNA, 19 nt, Homo sapiens
ccuaaaaucucuaacgaua

SEQ ID NO: 833757 - RNA, 19 nt, Homo sapiens
cugaauauccuugacauua

SEQ ID NO: 833758 - RNA, 19 nt, Homo sapiens
cacauaaccuuguacaauc

SEQ ID NO: 833759 - RNA, 19 nt, Homo sapiens
cauacaagcuaccagucua

SEQ ID NO: 833760 - RNA, 19 nt, Homo sapiens
gaaaugauuggucagaugu

SEQ ID NO: 833761 - RNA, 19 nt, Homo sapiens
ggaagaaugcaucugagaa

SEQ ID NO: 833762 - RNA, 19 nt, Homo sapiens
aaacgaaaguuagaugaug

SEQ ID NO: 833763 - RNA, 19 nt, Homo sapiens
ucaacaaucucagucugua

SEQ ID NO: 833764 - RNA, 19 nt, Homo sapiens
gcucaaaacugcgcuagua

SEQ ID NO: 833765 - RNA, 19 nt, Homo sapiens
ggaacaguuugacaacaug

SEQ ID NO: 833766 - RNA, 19 nt, Homo sapiens
gaugagcgcuuaucuaacc

SEQ ID NO: 833767 - RNA, 19 nt, Homo sapiens
ugaagaugauuccuaugaa

SEQ ID NO: 833768 - RNA, 19 nt, Homo sapiens
uuaccgagauccucuuuau

SEQ ID NO: 833769 - RNA, 19 nt, Homo sapiens
ugaaaugauuggucagaug

SEQ ID NO: 833770 - RNA, 19 nt, Homo sapiens
acucugaucuccaguguga

SEQ ID NO: 833771 - RNA, 19 nt, Homo sapiens
cagaauagcacaauugaca

SEQ ID NO: 833772 - RNA, 19 nt, Homo sapiens
acagagagcaguugaaaug

SEQ ID NO: 833773 - RNA, 19 nt, Homo sapiens
aauaaacgcucuaucuagu

SEQ ID NO: 833774 - RNA, 19 nt, Homo sapiens
gggaacaguuugacaacau

SEQ ID NO: 833775 - RNA, 19 nt, Homo sapiens
ugagaaugaugagcgcuua

SEQ ID NO: 833776 - RNA, 19 nt, Homo sapiens
gaaugcaucugagaaugau

SEQ ID NO: 833777 - RNA, 19 nt, Homo sapiens
gaugacaguuccucagaca

SEQ ID NO: 833778 - RNA, 19 nt, Homo sapiens
ggaaggaagaugacaguuc

SEQ ID NO: 833779 - RNA, 19 nt, Homo sapiens
uaguaagacugcugacaaa

SEQ ID NO: 833780 - RNA, 19 nt, Homo sapiens
aagcugcagugcccuauaa

SEQ ID NO: 833781 - RNA, 19 nt, Homo sapiens
uaauucacaugguagugua

SEQ ID NO: 833782 - RNA, 19 nt, Homo sapiens
gcuggugacucaugaauac

SEQ ID NO: 833783 - RNA, 19 nt, Homo sapiens
ggaaccaaccaaacuaaug

SEQ ID NO: 833784 - RNA, 19 nt, Homo sapiens
gcagccaguuuaugguuau

SEQ ID NO: 833785 - RNA, 19 nt, Homo sapiens
gaacauaaagcugagaaag

SEQ ID NO: 833786 - RNA, 19 nt, Homo sapiens
gauggugaaucgacucuca

SEQ ID NO: 833787 - RNA, 19 nt, Homo sapiens
gcaagcuguuuauuacugu

SEQ ID NO: 833788 - RNA, 19 nt, Homo sapiens
gcacaaugcaucugauagu

SEQ ID NO: 833789 - RNA, 19 nt, Homo sapiens
ugagaaagucccagcagua

SEQ ID NO: 833790 - RNA, 19 nt, Homo sapiens
ucacaggcauccagagugu

SEQ ID NO: 833791 - RNA, 19 nt, Homo sapiens
uccaaacccuugaugcuaa

SEQ ID NO: 833792 - RNA, 19 nt, Homo sapiens
gagaagagaguaguauuca

SEQ ID NO: 833793 - RNA, 19 nt, Homo sapiens
agaauugacuuugcagcua

SEQ ID NO: 833794 - RNA, 19 nt, Homo sapiens
gaggaaccaaccaaacuaa

SEQ ID NO: 833795 - RNA, 19 nt, Homo sapiens
agagcaagcuguuuauuac

SEQ ID NO: 833796 - RNA, 19 nt, Homo sapiens
ggacucucuuguauuauag

SEQ ID NO: 833797 - RNA, 19 nt, Homo sapiens
gaaaggauguugagaaaug

SEQ ID NO: 833798 - RNA, 19 nt, Homo sapiens
caauaaagcuuguggcaaa

SEQ ID NO: 833799 - RNA, 19 nt, Homo sapiens
gaacaggccuccaaaauuu

SEQ ID NO: 833800 - RNA, 19 nt, Homo sapiens
gaacugcccucaucaacuu

SEQ ID NO: 833801 - RNA, 19 nt, Homo sapiens
gagcaaagguggaacagaa

SEQ ID NO: 833802 - RNA, 19 nt, Homo sapiens
aaacagugcuugccaauga

SEQ ID NO: 833803 - RNA, 19 nt, Homo sapiens
ccacaaaguuggacacaaa

SEQ ID NO: 833804 - RNA, 19 nt, Homo sapiens
ggaaauaacuacguguuug

SEQ ID NO: 833805 - RNA, 19 nt, Homo sapiens
ggaggucccugucguuauu

SEQ ID NO: 833806 - RNA, 19 nt, Homo sapiens
gcaguuaacagaugacuuu

SEQ ID NO: 833807 - RNA, 19 nt, Homo sapiens
acaaaugucuugacuguug

SEQ ID NO: 833808 - RNA, 19 nt, Homo sapiens
gcacagcucucugaaggaa

SEQ ID NO: 833809 - RNA, 19 nt, Homo sapiens
ggaaauggcucugccuuag

SEQ ID NO: 833810 - RNA, 19 nt, Homo sapiens
acacagcaguggccgauua

SEQ ID NO: 833811 - RNA, 19 nt, Homo sapiens
gguagugaauggucucuuu

SEQ ID NO: 833812 - RNA, 19 nt, Homo sapiens
gggcaaaggagaaauauga

SEQ ID NO: 833813 - RNA, 19 nt, Homo sapiens
gaccuaagccacugauuaa

SEQ ID NO: 833814 - RNA, 19 nt, Homo sapiens
uaugugaagucagcaauua

SEQ ID NO: 833815 - RNA, 19 nt, Homo sapiens
gacaguaucuacagagaga

SEQ ID NO: 833816 - RNA, 19 nt, Homo sapiens
aagaaaggauguugagaaa

SEQ ID NO: 833817 - RNA, 19 nt, Homo sapiens
ggccaggaauggacucaua

SEQ ID NO: 833818 - RNA, 19 nt, Homo sapiens
cuaagccacugauuaauau

SEQ ID NO: 833819 - RNA, 19 nt, Homo sapiens
ggagaaauaugagcuacug

SEQ ID NO: 833820 - RNA, 19 nt, Homo sapiens
ggacgaagcaucaagaagu

SEQ ID NO: 833821 - RNA, 19 nt, Homo sapiens
ggaaggcucucuggauuca

SEQ ID NO: 833822 - RNA, 19 nt, Homo sapiens
caccuggacuucacauuaa

SEQ ID NO: 833823 - RNA, 19 nt, Homo sapiens
ccaaugagcagguggauga

SEQ ID NO: 833824 - RNA, 19 nt, Homo sapiens
cuacguguuugccagauua

SEQ ID NO: 833825 - RNA, 19 nt, Homo sapiens
gaaucuacauccacaaagu

SEQ ID NO: 833826 - RNA, 19 nt, Homo sapiens
acagaggacuucucacuga

SEQ ID NO: 833827 - RNA, 19 nt, Homo sapiens
caacgacuguggaccuuga

SEQ ID NO: 833828 - RNA, 19 nt, Homo sapiens
gaagaugaguaaguccaaa

SEQ ID NO: 833829 - RNA, 19 nt, Homo sapiens
cugaaagacuggcugauuu

SEQ ID NO: 833830 - RNA, 19 nt, Homo sapiens
gacaagugauaaacugaaa

SEQ ID NO: 833831 - RNA, 19 nt, Homo sapiens
caagaaaggauguugagaa

SEQ ID NO: 833832 - RNA, 19 nt, Homo sapiens
uauguuaucugaugccauu

SEQ ID NO: 833833 - RNA, 19 nt, Homo sapiens
gaguauacauugcagacaa

SEQ ID NO: 833834 - RNA, 19 nt, Homo sapiens
gauccagaccuacagauaa

SEQ ID NO: 833835 - RNA, 19 nt, Homo sapiens
ggccuacucugaagucauu

SEQ ID NO: 833836 - RNA, 19 nt, Homo sapiens
ggacuucacauuaaagguu

SEQ ID NO: 833837 - RNA, 19 nt, Homo sapiens
ccaccuggacuucacauua

SEQ ID NO: 833838 - RNA, 19 nt, Homo sapiens
gaggacuucucacugaauu

SEQ ID NO: 833839 - RNA, 19 nt, Homo sapiens
gacaaccgcuuaugcaaag

SEQ ID NO: 833840 - RNA, 19 nt, Homo sapiens
gagaguaauucccggaugu

SEQ ID NO: 833841 - RNA, 19 nt, Homo sapiens
uaaccaauauguggaaaug

SEQ ID NO: 833842 - RNA, 19 nt, Homo sapiens
gcaguucugaucaacaaua

SEQ ID NO: 833843 - RNA, 19 nt, Homo sapiens
ugaccuaagccacugauua

SEQ ID NO: 833844 - RNA, 19 nt, Homo sapiens
guggagacgugacaaguga

SEQ ID NO: 833845 - RNA, 19 nt, Homo sapiens
uggcagaccuuccagaaug

SEQ ID NO: 833846 - RNA, 19 nt, Homo sapiens
ccuaagccacugauuaaua

SEQ ID NO: 833847 - RNA, 19 nt, Homo sapiens
gaagucagcaauuaagugu

SEQ ID NO: 833848 - RNA, 19 nt, Homo sapiens
ggacacagggaucuucuga

SEQ ID NO: 833849 - RNA, 19 nt, Homo sapiens
ccacgaauuuguucuucaa

SEQ ID NO: 833850 - RNA, 19 nt, Homo sapiens
cucagacaaugguuuauua

SEQ ID NO: 833851 - RNA, 19 nt, Homo sapiens
caaaguuggacacaaagua

SEQ ID NO: 833852 - RNA, 19 nt, Homo sapiens
ccagaaugguauggaauaa

SEQ ID NO: 833853 - RNA, 19 nt, Homo sapiens
gggaaauggcucugccuua

SEQ ID NO: 833854 - RNA, 19 nt, Homo sapiens
ugacaacucgguuuauuga

SEQ ID NO: 833855 - RNA, 19 nt, Homo sapiens
cagcugggauagggaaaua

SEQ ID NO: 833856 - RNA, 19 nt, Homo sapiens
guucagcaguuaacagaug

SEQ ID NO: 833857 - RNA, 19 nt, Homo sapiens
ugaaguagccucacaugug

SEQ ID NO: 833858 - RNA, 19 nt, Homo sapiens
ggaugccuguggauuugua

SEQ ID NO: 833859 - RNA, 19 nt, Homo sapiens
caagggagcagccaagaga

SEQ ID NO: 833860 - RNA, 19 nt, Homo sapiens
agaaguaccucagacaaug

SEQ ID NO: 833861 - RNA, 19 nt, Homo sapiens
gugagcagauccagaccua

SEQ ID NO: 833862 - RNA, 19 nt, Homo sapiens
gauuuacuccggcuuauga

SEQ ID NO: 833863 - RNA, 19 nt, Homo sapiens
acaauuugcuguguaguga

SEQ ID NO: 833864 - RNA, 19 nt, Homo sapiens
gaggaagucauuuaggaaa

SEQ ID NO: 833865 - RNA, 19 nt, Homo sapiens
gcaaugugccagccacuug

SEQ ID NO: 833866 - RNA, 19 nt, Homo sapiens
gggagaagaugaguaaguc

SEQ ID NO: 833867 - RNA, 19 nt, Homo sapiens
gacaaugguuuauuaagac

SEQ ID NO: 833868 - RNA, 19 nt, Homo sapiens
ggacucaguaucucuuuau

SEQ ID NO: 833869 - RNA, 19 nt, Homo sapiens
ucauaccauuggcacauua

SEQ ID NO: 833870 - RNA, 19 nt, Homo sapiens
caaaugucuugacuguuga

SEQ ID NO: 833871 - RNA, 19 nt, Homo sapiens
ggagacgugacaagugaua

SEQ ID NO: 833872 - RNA, 19 nt, Homo sapiens
gggagaaucuagccauuuu

SEQ ID NO: 833873 - RNA, 19 nt, Homo sapiens
gggaaauaacuacguguuu

SEQ ID NO: 833874 - RNA, 19 nt, Homo sapiens
gagaaaugguggcaucaac

SEQ ID NO: 833875 - RNA, 19 nt, Homo sapiens
ggaaagaacaugccgucau

SEQ ID NO: 833876 - RNA, 19 nt, Homo sapiens
uguaauggcugugaacaug

SEQ ID NO: 833877 - RNA, 19 nt, Homo sapiens
ugccagaaaucuauauaug

SEQ ID NO: 833878 - RNA, 19 nt, Homo sapiens
gaagauggccaggaaugga

SEQ ID NO: 833879 - RNA, 19 nt, Homo sapiens
caacaucgcgucuuucacu

SEQ ID NO: 833880 - RNA, 19 nt, Homo sapiens
aaaguuggacacaaaguaa

SEQ ID NO: 833881 - RNA, 19 nt, Homo sapiens
gcacgguuccagaagauga

SEQ ID NO: 833882 - RNA, 19 nt, Homo sapiens
gaaaugguggcaucaacga

SEQ ID NO: 833883 - RNA, 19 nt, Homo sapiens
ggacaaaagaguauacauu

SEQ ID NO: 833884 - RNA, 19 nt, Homo sapiens
gaaaguggacaaaagagua

SEQ ID NO: 833885 - RNA, 19 nt, Homo sapiens
ucccuuggguauacaauuu

SEQ ID NO: 833886 - RNA, 19 nt, Homo sapiens
gaagcucugugcccacuac

SEQ ID NO: 833887 - RNA, 19 nt, Homo sapiens
gagacagacacgauggaua

SEQ ID NO: 833888 - RNA, 19 nt, Homo sapiens
gacgaagcaucaagaaguc

SEQ ID NO: 833889 - RNA, 19 nt, Homo sapiens
caguucugaucaacaauaa

SEQ ID NO: 833890 - RNA, 19 nt, Homo sapiens
caagaacuccgucaucucu

SEQ ID NO: 833891 - RNA, 19 nt, Homo sapiens
gaggugacgugggagaaga

SEQ ID NO: 833892 - RNA, 19 nt, Homo sapiens
caagugauaaacugaaaga

SEQ ID NO: 833893 - RNA, 19 nt, Homo sapiens
gagcagauccagaccuaca

SEQ ID NO: 833894 - RNA, 19 nt, Homo sapiens
gaaguggaucucacagguu

SEQ ID NO: 833895 - RNA, 19 nt, Homo sapiens
caaagguggaacagaagua

SEQ ID NO: 833896 - RNA, 19 nt, Homo sapiens
gccuaaagguggagaacga

SEQ ID NO: 833897 - RNA, 19 nt, Homo sapiens
gaacauuacuccaccugua

SEQ ID NO: 833898 - RNA, 19 nt, Homo sapiens
gauuagacaucacaacaua

SEQ ID NO: 833899 - RNA, 19 nt, Homo sapiens
gaaauugacuuugaagaug

SEQ ID NO: 833900 - RNA, 19 nt, Homo sapiens
gaagacagcagccucauuu

SEQ ID NO: 833901 - RNA, 19 nt, Homo sapiens
uaugaaaccuggagaauau

SEQ ID NO: 833902 - RNA, 19 nt, Homo sapiens
ggaaggcgccucucaauau

SEQ ID NO: 833903 - RNA, 19 nt, Homo sapiens
gaaggcgccucucaauauu

SEQ ID NO: 833904 - RNA, 19 nt, Homo sapiens
caacgugccuguuuguuug

SEQ ID NO: 833905 - RNA, 19 nt, Homo sapiens
uaagaagaaugaccaggua

SEQ ID NO: 833906 - RNA, 19 nt, Homo sapiens
gcaggaggcccaucccuua

SEQ ID NO: 833907 - RNA, 19 nt, Homo sapiens
gaaauucacuaugccaaga

SEQ ID NO: 833908 - RNA, 19 nt, Homo sapiens
gaacauaaacaaccucaau

SEQ ID NO: 833909 - RNA, 19 nt, Homo sapiens
ugacucaccucgcuuauug

SEQ ID NO: 833910 - RNA, 19 nt, Homo sapiens
ugacagcgcucuccggaaa

SEQ ID NO: 833911 - RNA, 19 nt, Homo sapiens
guagacaaguuuaagaaga

SEQ ID NO: 833912 - RNA, 19 nt, Homo sapiens
ugacaucaaugcugaaguu

SEQ ID NO: 833913 - RNA, 19 nt, Homo sapiens
aaacaaaggcugcuacuau

SEQ ID NO: 833914 - RNA, 19 nt, Homo sapiens
gaagaaugaccagguauuu

SEQ ID NO: 833915 - RNA, 19 nt, Homo sapiens
ggguagagacugagcauua

SEQ ID NO: 833916 - RNA, 19 nt, Homo sapiens
agaguuagguuguguagaa

SEQ ID NO: 833917 - RNA, 19 nt, Homo sapiens
guacuauucuggauugaga

SEQ ID NO: 833918 - RNA, 19 nt, Homo sapiens
gaagugaacugcuguuucc

SEQ ID NO: 833919 - RNA, 19 nt, Homo sapiens
uaacgacaccuccaacuuu

SEQ ID NO: 833920 - RNA, 19 nt, Homo sapiens
ugagauugaucccauguuu

SEQ ID NO: 833921 - RNA, 19 nt, Homo sapiens
ugucagagauucuuaaaca

SEQ ID NO: 833922 - RNA, 19 nt, Homo sapiens
gcaggaguauugacauuuc

SEQ ID NO: 833923 - RNA, 19 nt, Homo sapiens
ggaccucucugauguucuu

SEQ ID NO: 833924 - RNA, 19 nt, Homo sapiens
acucugaccucucaccuua

SEQ ID NO: 833925 - RNA, 19 nt, Homo sapiens
gaucggaagugugagauug

SEQ ID NO: 833926 - RNA, 19 nt, Homo sapiens
gaagaagcacuuacacaga

SEQ ID NO: 833927 - RNA, 19 nt, Homo sapiens
guaucaaacuguccacuga

SEQ ID NO: 833928 - RNA, 19 nt, Homo sapiens
cuacagauuucaacuacaa

SEQ ID NO: 833929 - RNA, 19 nt, Homo sapiens
ccuaauccauguacauaaa

SEQ ID NO: 833930 - RNA, 19 nt, Homo sapiens
gagauugaguucacuaugg

SEQ ID NO: 833931 - RNA, 19 nt, Homo sapiens
ccggaucacuggcgcuuua

SEQ ID NO: 833932 - RNA, 19 nt, Homo sapiens
gagaaaaccuauauccauu

SEQ ID NO: 833933 - RNA, 19 nt, Homo sapiens
gcccaucccuuacucaguu

SEQ ID NO: 833934 - RNA, 19 nt, Homo sapiens
gcaaggagauugaguucac

SEQ ID NO: 833935 - RNA, 19 nt, Homo sapiens
aagaagcacuuacacagaa

SEQ ID NO: 833936 - RNA, 19 nt, Homo sapiens
gguuugcacuugauugauu

SEQ ID NO: 833937 - RNA, 19 nt, Homo sapiens
gcacuuacacagaacuauu

SEQ ID NO: 833938 - RNA, 19 nt, Homo sapiens
uccagaagcccaaggauua

SEQ ID NO: 833939 - RNA, 19 nt, Homo sapiens
ugacagugaugaugaagau

SEQ ID NO: 833940 - RNA, 19 nt, Homo sapiens
aacaaaggcugcuacuauu

SEQ ID NO: 833941 - RNA, 19 nt, Homo sapiens
gcucaacugauuaaacuuu

SEQ ID NO: 833942 - RNA, 19 nt, Homo sapiens
gguagagacugagcauuau

SEQ ID NO: 833943 - RNA, 19 nt, Homo sapiens
gaucccauguuucagaaga

SEQ ID NO: 833944 - RNA, 19 nt, Homo sapiens
gcuccgugcucaacugauu

SEQ ID NO: 833945 - RNA, 19 nt, Homo sapiens
gaaccaaccaacuuuaaag

SEQ ID NO: 833946 - RNA, 19 nt, Homo sapiens
cagcaggaguauugacauu

SEQ ID NO: 833947 - RNA, 19 nt, Homo sapiens
gcacugccagccacaauga

SEQ ID NO: 833948 - RNA, 19 nt, Homo sapiens
agacugagcauuaugaaga

SEQ ID NO: 833949 - RNA, 19 nt, Homo sapiens
ccaggcaccagguuacuua

SEQ ID NO: 833950 - RNA, 19 nt, Homo sapiens
caaagaagaagcacuuaca

SEQ ID NO: 833951 - RNA, 19 nt, Homo sapiens
cuccuaaauugaucuguua

SEQ ID NO: 833952 - RNA, 19 nt, Homo sapiens
uaagacagcacaacagaau

SEQ ID NO: 833953 - RNA, 19 nt, Homo sapiens
gaaguagaaggccauguug

SEQ ID NO: 833954 - RNA, 19 nt, Homo sapiens
aaacuuuacugcccuaugg

SEQ ID NO: 833955 - RNA, 19 nt, Homo sapiens
gcucagaaccucuccauac

SEQ ID NO: 833956 - RNA, 19 nt, Homo sapiens
agaaguggcugacgagaag

SEQ ID NO: 833957 - RNA, 19 nt, Homo sapiens
gcaccagguuacuuaagau

SEQ ID NO: 833958 - RNA, 19 nt, Homo sapiens
acagaacuauugagcagaa

SEQ ID NO: 833959 - RNA, 19 nt, Homo sapiens
ggcaccagguuacuuaaga

SEQ ID NO: 833960 - RNA, 19 nt, Homo sapiens
agaaugaccagguauuuga

SEQ ID NO: 833961 - RNA, 19 nt, Homo sapiens
gaacuuccuaauccaugua

SEQ ID NO: 833962 - RNA, 19 nt, Homo sapiens
uccaaacuauucucuugua

SEQ ID NO: 833963 - RNA, 19 nt, Homo sapiens
gaagcuccgugcucaacug

SEQ ID NO: 833964 - RNA, 19 nt, Homo sapiens
ccaacgugccuguuuguuu

SEQ ID NO: 833965 - RNA, 19 nt, Homo sapiens
caagaaugcuuuugguuug

SEQ ID NO: 833966 - RNA, 19 nt, Homo sapiens
gccauaggguagagacuga

SEQ ID NO: 833967 - RNA, 19 nt, Homo sapiens
gaccagguauuugacauca

SEQ ID NO: 833968 - RNA, 19 nt, Homo sapiens
gcucgagggucuuugaucu

SEQ ID NO: 833969 - RNA, 19 nt, Homo sapiens
gugcucaacugauuaaacu

SEQ ID NO: 833970 - RNA, 19 nt, Homo sapiens
gacugagcauuaugaagaa

SEQ ID NO: 833971 - RNA, 19 nt, Homo sapiens
cgaagacuuuccucagaau

SEQ ID NO: 833972 - RNA, 19 nt, Homo sapiens
gcagcagugugcagaagau

SEQ ID NO: 833973 - RNA, 19 nt, Homo sapiens
uggaagugcuacugaaaug

SEQ ID NO: 833974 - RNA, 19 nt, Homo sapiens
gauggaagugcuacugaaa

SEQ ID NO: 833975 - RNA, 19 nt, Homo sapiens
cagggaagcuggaaaagaa

SEQ ID NO: 833976 - RNA, 19 nt, Homo sapiens
gcccaaggauuagacauca

SEQ ID NO: 833977 - RNA, 19 nt, Homo sapiens
cgaagcagaucggaagugu

SEQ ID NO: 833978 - RNA, 19 nt, Homo sapiens
gaagaugccaugggcuuau

SEQ ID NO: 833979 - RNA, 19 nt, Homo sapiens
ucgaagacuuuccucagaa

SEQ ID NO: 833980 - RNA, 19 nt, Homo sapiens
cuaccacccuuccuacaga

SEQ ID NO: 833981 - RNA, 19 nt, Homo sapiens
ugaaacacauaaugagucu

SEQ ID NO: 833982 - RNA, 19 nt, Homo sapiens
cuauugagcagaacauaaa

SEQ ID NO: 833983 - RNA, 19 nt, Homo sapiens
acacgcagauuacggaaca

SEQ ID NO: 833984 - RNA, 19 nt, Homo sapiens
aagcagaucggaaguguga

SEQ ID NO: 833985 - RNA, 19 nt, Homo sapiens
gaaaugggaacaaccaaaa

SEQ ID NO: 833986 - RNA, 19 nt, Homo sapiens
cuaccaacgugccuguuug

SEQ ID NO: 833987 - RNA, 19 nt, Homo sapiens
guuagguuguguagaaaug

SEQ ID NO: 833988 - RNA, 19 nt, Homo sapiens
gaguuagguuguguagaaa

SEQ ID NO: 833989 - RNA, 19 nt, Homo sapiens
ugaagacuaugauuacaac

SEQ ID NO: 833990 - RNA, 19 nt, Homo sapiens
gacagcagccucauuugau

SEQ ID NO: 833991 - RNA, 19 nt, Homo sapiens
ucagagauucuuaaacaga

SEQ ID NO: 833992 - RNA, 19 nt, Homo sapiens
cuacuauucugaccaaguc

SEQ ID NO: 833993 - RNA, 19 nt, Homo sapiens
gagugacuguggagacuuc

SEQ ID NO: 833994 - RNA, 19 nt, Homo sapiens
gcagaucggaagugugaga

SEQ ID NO: 833995 - RNA, 19 nt, Homo sapiens
gcuguaaagccaaagaaga

SEQ ID NO: 833996 - RNA, 19 nt, Homo sapiens
cgaaccaaccaacuuuaaa

SEQ ID NO: 833997 - RNA, 19 nt, Homo sapiens
gaaaugaaagcuucugaaa

SEQ ID NO: 833998 - RNA, 19 nt, Homo sapiens
gaagguugaugcuguaaga

SEQ ID NO: 833999 - RNA, 19 nt, Homo sapiens
gcaguuacaugcauagaga

SEQ ID NO: 834000 - RNA, 19 nt, Homo sapiens
gaggagaauuugaagauga

SEQ ID NO: 834001 - RNA, 19 nt, Homo sapiens
cagcagaaaugguuauuau

SEQ ID NO: 834002 - RNA, 19 nt, Homo sapiens
ggagaagguugaugcugua

SEQ ID NO: 834003 - RNA, 19 nt, Homo sapiens
gcuuaggacuugcugaaua

SEQ ID NO: 834004 - RNA, 19 nt, Homo sapiens
gguugaugcuguaagauua

SEQ ID NO: 834005 - RNA, 19 nt, Homo sapiens
guagugaacuuugacauga

SEQ ID NO: 834006 - RNA, 19 nt, Homo sapiens
cgccuuggcuugauaauaa

SEQ ID NO: 834007 - RNA, 19 nt, Homo sapiens
ggacugggccuccucauga

SEQ ID NO: 834008 - RNA, 19 nt, Homo sapiens
gaggaaagucuuagaguuu

SEQ ID NO: 834009 - RNA, 19 nt, Homo sapiens
caaugaagguguuugaugu

SEQ ID NO: 834010 - RNA, 19 nt, Homo sapiens
gaagguguuugauguagug

SEQ ID NO: 834011 - RNA, 19 nt, Homo sapiens
gcgcuggguuggaccuuua

SEQ ID NO: 834012 - RNA, 19 nt, Homo sapiens
ugaaggaccuaaacgaguu

SEQ ID NO: 834013 - RNA, 19 nt, Homo sapiens
cuccauacaucaccucuua

SEQ ID NO: 834014 - RNA, 19 nt, Homo sapiens
gagcgcaguuacaugcaua

SEQ ID NO: 834015 - RNA, 19 nt, Homo sapiens
aaacagauaagcccuauga

SEQ ID NO: 834016 - RNA, 19 nt, Homo sapiens
ggaaagucuuagaguuuga

SEQ ID NO: 834017 - RNA, 19 nt, Homo sapiens
gauaaccagccacuucaua

SEQ ID NO: 834018 - RNA, 19 nt, Homo sapiens
ggagauaaccagccacuuc

SEQ ID NO: 834019 - RNA, 19 nt, Homo sapiens
gaucauguuucaaagauac

SEQ ID NO: 834020 - RNA, 19 nt, Homo sapiens
aaacagaacucagcgaaag

SEQ ID NO: 834021 - RNA, 19 nt, Homo sapiens
aaugugaacugggaauaua

SEQ ID NO: 834022 - RNA, 19 nt, Homo sapiens
gaugcaauuucuucaguug

SEQ ID NO: 834023 - RNA, 19 nt, Homo sapiens
gcaaugaagguguuugaug

SEQ ID NO: 834024 - RNA, 19 nt, Homo sapiens
uuaggaagcuuaggacuug

SEQ ID NO: 834025 - RNA, 19 nt, Homo sapiens
gaauuuggccgacgaaugg

SEQ ID NO: 834026 - RNA, 19 nt, Homo sapiens
ugaugaaacuggacacuuc

SEQ ID NO: 834027 - RNA, 19 nt, Homo sapiens
uuacugaacugcaacagau

SEQ ID NO: 834028 - RNA, 19 nt, Homo sapiens
gacauucacaccaaacuuu

SEQ ID NO: 834029 - RNA, 19 nt, Homo sapiens
ggaggagaauuugaagaug

SEQ ID NO: 834030 - RNA, 19 nt, Homo sapiens
gaagaagucauggcagcua

SEQ ID NO: 834031 - RNA, 19 nt, Homo sapiens
cagaucauguuucaaagau

SEQ ID NO: 834032 - RNA, 19 nt, Homo sapiens
auuaagggcuuuaugauuc

SEQ ID NO: 834033 - RNA, 19 nt, Homo sapiens
ggaaagugguagcgauuuu

SEQ ID NO: 834034 - RNA, 19 nt, Homo sapiens
agaggaaagucuuagaguu

SEQ ID NO: 834035 - RNA, 19 nt, Homo sapiens
gaggaucuccaacgucaaa

SEQ ID NO: 834036 - RNA, 19 nt, Homo sapiens
uaaaggaauggaaguugua

SEQ ID NO: 834037 - RNA, 19 nt, Homo sapiens
cgaaagagagcuggcagua

SEQ ID NO: 834038 - RNA, 19 nt, Homo sapiens
ucacuaagcauguuuacug

SEQ ID NO: 834039 - RNA, 19 nt, Homo sapiens
ggaugcaauuucuucaguu

SEQ ID NO: 834040 - RNA, 19 nt, Homo sapiens
cuaaaggaauggaaguugu

SEQ ID NO: 834041 - RNA, 19 nt, Homo sapiens
gaaucacuaagcauguuua

SEQ ID NO: 834042 - RNA, 19 nt, Homo sapiens
uauaugaauuugccaagug

SEQ ID NO: 834043 - RNA, 19 nt, Homo sapiens
gagauguuaucacccaugu

SEQ ID NO: 834044 - RNA, 19 nt, Homo sapiens
aggcaacacuggccaagaa

SEQ ID NO: 834045 - RNA, 19 nt, Homo sapiens
gcugggcauuaaaguuaua

SEQ ID NO: 834046 - RNA, 19 nt, Homo sapiens
caucaccucuuacucagau

SEQ ID NO: 834047 - RNA, 19 nt, Homo sapiens
gcuaacgcgggaucaaaua

SEQ ID NO: 834048 - RNA, 19 nt, Homo sapiens
ggaauuuggccgacgaaug

SEQ ID NO: 834049 - RNA, 19 nt, Homo sapiens
ggagaacgaugaggagaac

SEQ ID NO: 834050 - RNA, 19 nt, Homo sapiens
gagauaaccagccacuuca

SEQ ID NO: 834051 - RNA, 19 nt, Homo sapiens
gggaugcaauuucuucagu

SEQ ID NO: 834052 - RNA, 19 nt, Homo sapiens
gagggagcauuguucuguu

SEQ ID NO: 834053 - RNA, 19 nt, Homo sapiens
ggaguuauugagaguauug

SEQ ID NO: 834054 - RNA, 19 nt, Homo sapiens
gauccaacagguacuggua

SEQ ID NO: 834055 - RNA, 19 nt, Homo sapiens
guucacagcagaaaugguu

SEQ ID NO: 834056 - RNA, 19 nt, Homo sapiens
gggagacauucacaccaaa

SEQ ID NO: 834057 - RNA, 19 nt, Homo sapiens
acaauagucuguacaucau

SEQ ID NO: 834058 - RNA, 19 nt, Homo sapiens
caacaauagucuguacauc

SEQ ID NO: 834059 - RNA, 19 nt, Homo sapiens
guagucaccugggaguuau

SEQ ID NO: 834060 - RNA, 19 nt, Homo sapiens
ggacgagugacuaaaggaa

SEQ ID NO: 834061 - RNA, 19 nt, Homo sapiens
caaacgagaaccagaagau

SEQ ID NO: 834062 - RNA, 19 nt, Homo sapiens
caacagaugaggcaacagu

SEQ ID NO: 834063 - RNA, 19 nt, Homo sapiens
acaaagcaguagugucuuc

SEQ ID NO: 834064 - RNA, 19 nt, Homo sapiens
ugacaaacuccauacauca

SEQ ID NO: 834065 - RNA, 19 nt, Homo sapiens
ugauggacaugucaaguuc

SEQ ID NO: 834066 - RNA, 19 nt, Homo sapiens
cuuaggacuugcugaauau

SEQ ID NO: 834067 - RNA, 19 nt, Homo sapiens
gggaucaaauacuaaugga

SEQ ID NO: 834068 - RNA, 19 nt, Homo sapiens
gggaggagaauuugaagau

SEQ ID NO: 834069 - RNA, 19 nt, Homo sapiens
gcaacuacuauagaaauga

SEQ ID NO: 834070 - RNA, 19 nt, Homo sapiens
acagaugaggcaacaguua

SEQ ID NO: 834071 - RNA, 19 nt, Homo sapiens
caugagagucuuugaugaa

SEQ ID NO: 834072 - RNA, 19 nt, Homo sapiens
uaugauggccgaggagaua

SEQ ID NO: 834073 - RNA, 19 nt, Homo sapiens
gagcauuguucuguucugu

SEQ ID NO: 834074 - RNA, 19 nt, Homo sapiens
uuacaaagcaguagugucu

SEQ ID NO: 834075 - RNA, 19 nt, Homo sapiens
gcugaaacuuggcuauuuu

SEQ ID NO: 834076 - RNA, 19 nt, Homo sapiens
auaaagcaaugaagguguu

SEQ ID NO: 834077 - RNA, 19 nt, Homo sapiens
aaacgagaaccagaagaua

SEQ ID NO: 834078 - RNA, 19 nt, Homo sapiens
caagcugacccaacaauag

SEQ ID NO: 834079 - RNA, 19 nt, Homo sapiens
uaaccagccacuucauauu

SEQ ID NO: 834080 - RNA, 19 nt, Homo sapiens
uaccagacauggaauuugg

SEQ ID NO: 834081 - RNA, 19 nt, Homo sapiens
cacuaagcauguuuacuga

SEQ ID NO: 834082 - RNA, 19 nt, Homo sapiens
gcuacuauugguucugaua

SEQ ID NO: 834083 - RNA, 19 nt, Homo sapiens
aagcaguagugucuucuga

SEQ ID NO: 834084 - RNA, 19 nt, Homo sapiens
gaaagagagcuggcaguag

SEQ ID NO: 834085 - RNA, 19 nt, Homo sapiens
uagcuacuauugguucuga

SEQ ID NO: 834086 - RNA, 19 nt, Homo sapiens
ggccuccucaugaauauaa

SEQ ID NO: 834087 - RNA, 19 nt, Homo sapiens
guauugcaguuagcucuga

SEQ ID NO: 834088 - RNA, 19 nt, Homo sapiens
caaagucaaucccaaaaca

SEQ ID NO: 834089 - RNA, 19 nt, Homo sapiens
gacugggccuccucaugaa

SEQ ID NO: 834090 - RNA, 19 nt, Homo sapiens
ucaagcugacccaacaaua

SEQ ID NO: 834091 - RNA, 19 nt, Homo sapiens
cauguuuacugaacugcaa

SEQ ID NO: 834092 - RNA, 19 nt, Homo sapiens
ucagauuuguaacuggaaa

SEQ ID NO: 834093 - RNA, 19 nt, Homo sapiens
auacaucaccucuuacuca

SEQ ID NO: 834094 - RNA, 19 nt, Homo sapiens
aaccagccacuucauauuu

SEQ ID NO: 834095 - RNA, 19 nt, Homo sapiens
cgaaaagaguacaggaaaa

SEQ ID NO: 834096 - RNA, 19 nt, Homo sapiens
gaaagucuuagaguuugaa

SEQ ID NO: 834097 - RNA, 19 nt, Homo sapiens
guaccaaacuguucgauau

SEQ ID NO: 834098 - RNA, 19 nt, Homo sapiens
gaagcagccucacucuuaa

SEQ ID NO: 834099 - RNA, 19 nt, Homo sapiens
cagauaaacuggacaauag

SEQ ID NO: 834100 - RNA, 19 nt, Homo sapiens
ugaagcagccucacucuua

SEQ ID NO: 834101 - RNA, 19 nt, Homo sapiens
caagucagcuuuguuguga

SEQ ID NO: 834102 - RNA, 19 nt, Homo sapiens
gcacugcacuuuggaguug

SEQ ID NO: 834103 - RNA, 19 nt, Homo sapiens
gcagauaaacuggacaaua

SEQ ID NO: 834104 - RNA, 19 nt, Homo sapiens
ccaggaggcucaaagagaa

SEQ ID NO: 834105 - RNA, 19 nt, Homo sapiens
gacaauagcagaagcauuc

SEQ ID NO: 834106 - RNA, 19 nt, Homo sapiens
gguacgagcuggugguguu

SEQ ID NO: 834107 - RNA, 19 nt, Homo sapiens
uaaccagcuuugugucuuu

SEQ ID NO: 834108 - RNA, 19 nt, Homo sapiens
cagcaagcauggagaucua

SEQ ID NO: 834109 - RNA, 19 nt, Homo sapiens
gccgaaaccuucaccaaca

SEQ ID NO: 834110 - RNA, 19 nt, Homo sapiens
caaacuguucgauaugaua

SEQ ID NO: 834111 - RNA, 19 nt, Homo sapiens
ucaaagagaagccaaguca

SEQ ID NO: 834112 - RNA, 19 nt, Homo sapiens
agacagcacugcacuuugg

SEQ ID NO: 834113 - RNA, 19 nt, Homo sapiens
cagccucacucuuaacuuc

SEQ ID NO: 834114 - RNA, 19 nt, Homo sapiens
guaaccagcuuugugucuu

SEQ ID NO: 834115 - RNA, 19 nt, Homo sapiens
gagagccgaaucaguguuu

SEQ ID NO: 834116 - RNA, 19 nt, Homo sapiens
cucuggagcuucuucauuu

SEQ ID NO: 834117 - RNA, 19 nt, Homo sapiens
gaaucaguguuugugaaga

SEQ ID NO: 834118 - RNA, 19 nt, Homo sapiens
ccgaaucaguguuugugaa

SEQ ID NO: 834119 - RNA, 19 nt, Homo sapiens
ucuggagcuucuucauuua

SEQ ID NO: 834120 - RNA, 19 nt, Homo sapiens
cgacacagcccuucucaac

SEQ ID NO: 834121 - RNA, 19 nt, Homo sapiens
gaucuggaugagacacuua

SEQ ID NO: 834122 - RNA, 19 nt, Homo sapiens
ggacaauagcagaagcauu

SEQ ID NO: 834123 - RNA, 19 nt, Homo sapiens
gagucuggauggacacaug

SEQ ID NO: 834124 - RNA, 19 nt, Homo sapiens
caggagccauccagacaau

SEQ ID NO: 834125 - RNA, 19 nt, Homo sapiens
uaagaggagauauuacaga

SEQ ID NO: 834126 - RNA, 19 nt, Homo sapiens
gaugagacacuuauucacu

SEQ ID NO: 834127 - RNA, 19 nt, Homo sapiens
gcuuuguugugauuugauu

SEQ ID NO: 834128 - RNA, 19 nt, Homo sapiens
ggccagagugacagacaua

SEQ ID NO: 834129 - RNA, 19 nt, Homo sapiens
gaugcccuguccaauguga

SEQ ID NO: 834130 - RNA, 19 nt, Homo sapiens
cugaugcccuguccaaugu

SEQ ID NO: 834131 - RNA, 19 nt, Homo sapiens
gcagauccgcacgguaauu

SEQ ID NO: 834132 - RNA, 19 nt, Homo sapiens
gauccaggaggcucaaaga

SEQ ID NO: 834133 - RNA, 19 nt, Homo sapiens
aggcagauccgcacgguaa

SEQ ID NO: 834134 - RNA, 19 nt, Homo sapiens
ccaaacuguucgauaugau

SEQ ID NO: 834135 - RNA, 19 nt, Homo sapiens
agucagcuuuguugugauu

SEQ ID NO: 834136 - RNA, 19 nt, Homo sapiens
ugacagacauacggugauc

SEQ ID NO: 834137 - RNA, 19 nt, Homo sapiens
uagcccaggugaagaggaa

SEQ ID NO: 834138 - RNA, 19 nt, Homo sapiens
acagugaccucuccagcau

SEQ ID NO: 834139 - RNA, 19 nt, Homo sapiens
ucaaggugguaauagacaa

SEQ ID NO: 834140 - RNA, 19 nt, Homo sapiens
gcaggacuggccagaguga

SEQ ID NO: 834141 - RNA, 19 nt, Homo sapiens
caucaaauccugguucagu

SEQ ID NO: 834142 - RNA, 19 nt, Homo sapiens
acagacagcacugcacuuu

SEQ ID NO: 834143 - RNA, 19 nt, Homo sapiens
ccuuuacucucccucuauu

SEQ ID NO: 834144 - RNA, 19 nt, Homo sapiens
cagcuuuguugugauuuga

SEQ ID NO: 834145 - RNA, 19 nt, Homo sapiens
gagccgaaaccuucaccaa

SEQ ID NO: 834146 - RNA, 19 nt, Homo sapiens
guucaccgcugauguucgu

SEQ ID NO: 834147 - RNA, 19 nt, Homo sapiens
acacagcccuucucaaccu

SEQ ID NO: 834148 - RNA, 19 nt, Homo sapiens
ucaaauccugguucaguga

SEQ ID NO: 834149 - RNA, 19 nt, Homo sapiens
ggaucuggaugagacacuu

SEQ ID NO: 834150 - RNA, 19 nt, Homo sapiens
ucagcuuuguugugauuug

SEQ ID NO: 834151 - RNA, 19 nt, Homo sapiens
gaguugggcagcuacauca

SEQ ID NO: 834152 - RNA, 19 nt, Homo sapiens
aaacuggacaauagcagaa

SEQ ID NO: 834153 - RNA, 19 nt, Homo sapiens
caaggugguaauagacaaa

SEQ ID NO: 834154 - RNA, 19 nt, Homo sapiens
ccaagucagcuuuguugug

SEQ ID NO: 834155 - RNA, 19 nt, Homo sapiens
acucuuaacuucguguuca

SEQ ID NO: 834156 - RNA, 19 nt, Homo sapiens
agugaccucuccagcauug

SEQ ID NO: 834157 - RNA, 19 nt, Homo sapiens
ggaguugggcagcuacauc

SEQ ID NO: 834158 - RNA, 19 nt, Homo sapiens
gauaaacuggacaauagca

SEQ ID NO: 834159 - RNA, 19 nt, Homo sapiens
accaaacuguucgauauga

SEQ ID NO: 834160 - RNA, 19 nt, Homo sapiens
gcaagcauggagaucuaug

SEQ ID NO: 834161 - RNA, 19 nt, Homo sapiens
ccgaaaccuucaccaacau

SEQ ID NO: 834162 - RNA, 19 nt, Homo sapiens
cagguucaccgcugauguu

SEQ ID NO: 834163 - RNA, 19 nt, Homo sapiens
cuuaagaggagauauuaca

SEQ ID NO: 834164 - RNA, 19 nt, Homo sapiens
aggcaggacuggccagagu

SEQ ID NO: 834165 - RNA, 19 nt, Homo sapiens
aaucaguguuugugaagag

SEQ ID NO: 834166 - RNA, 19 nt, Homo sapiens
uggaugagacacuuauuca

SEQ ID NO: 834167 - RNA, 19 nt, Homo sapiens
gguaauagacaaacauccu

SEQ ID NO: 834168 - RNA, 19 nt, Homo sapiens
ggagagccgaaucaguguu

SEQ ID NO: 834169 - RNA, 19 nt, Homo sapiens
ucagaccuguaaccagcuu

SEQ ID NO: 834170 - RNA, 19 nt, Homo sapiens
cgaaucaguguuugugaag

SEQ ID NO: 834171 - RNA, 19 nt, Homo sapiens
gagcuucuucauuuaccuu

SEQ ID NO: 834172 - RNA, 19 nt, Homo sapiens
guacgccuccugacuucau

SEQ ID NO: 834173 - RNA, 19 nt, Homo sapiens
cauccucaaggugguaaua

SEQ ID NO: 834174 - RNA, 19 nt, Homo sapiens
guuccgugcugagccgaaa

SEQ ID NO: 834175 - RNA, 19 nt, Homo sapiens
ccuguaaccagcuuugugu

SEQ ID NO: 834176 - RNA, 19 nt, Homo sapiens
ccacuggauuuucccuaaa

SEQ ID NO: 834177 - RNA, 19 nt, Homo sapiens
gccacuggauuuucccuaa

SEQ ID NO: 834178 - RNA, 19 nt, Homo sapiens
ucugaugcccuguccaaug

SEQ ID NO: 834179 - RNA, 19 nt, Homo sapiens
cccaucaaauccugguuca

SEQ ID NO: 834180 - RNA, 19 nt, Homo sapiens
guacgagcuggugguguuu

SEQ ID NO: 834181 - RNA, 19 nt, Homo sapiens
gagggugccuggaaggaua

SEQ ID NO: 834182 - RNA, 19 nt, Homo sapiens
uaagggacauggucaaguu

SEQ ID NO: 834183 - RNA, 19 nt, Homo sapiens
cagacaaccugcccaacua

SEQ ID NO: 834184 - RNA, 19 nt, Homo sapiens
gcgagugcauggugaauga

SEQ ID NO: 834185 - RNA, 19 nt, Homo sapiens
gcauaccggucaaguccua

SEQ ID NO: 834186 - RNA, 19 nt, Homo sapiens
gcaagccacugcccacugu

SEQ ID NO: 834187 - RNA, 19 nt, Homo sapiens
gaaacacucguuaucgaaa

SEQ ID NO: 834188 - RNA, 19 nt, Homo sapiens
aagcaaagccagacucuaa

SEQ ID NO: 834189 - RNA, 19 nt, Homo sapiens
gaaaccgggugccucugaa

SEQ ID NO: 834190 - RNA, 19 nt, Homo sapiens
gggaagcguugacuacugu

SEQ ID NO: 834191 - RNA, 19 nt, Homo sapiens
uacagaagcuucaguacug

SEQ ID NO: 834192 - RNA, 19 nt, Homo sapiens
gacgauagggacaucaaua

SEQ ID NO: 834193 - RNA, 19 nt, Homo sapiens
gcuguucccuugacacuuc

SEQ ID NO: 834194 - RNA, 19 nt, Homo sapiens
guacaagaccagaaagcaa

SEQ ID NO: 834195 - RNA, 19 nt, Homo sapiens
gauagggacaucaauagau

SEQ ID NO: 834196 - RNA, 19 nt, Homo sapiens
ccgcagacaacgccaguua

SEQ ID NO: 834197 - RNA, 19 nt, Homo sapiens
gagggacacuguggaagga

SEQ ID NO: 834198 - RNA, 19 nt, Homo sapiens
gcagacaacgccaguuauc

SEQ ID NO: 834199 - RNA, 19 nt, Homo sapiens
gaccauggccgcucuugug

SEQ ID NO: 834200 - RNA, 19 nt, Homo sapiens
ccgaaacacucguuaucga

SEQ ID NO: 834201 - RNA, 19 nt, Homo sapiens
gcccgaggccuacgucaaa

SEQ ID NO: 834202 - RNA, 19 nt, Homo sapiens
cgaaauaagagacaaagag

SEQ ID NO: 834203 - RNA, 19 nt, Homo sapiens
aaacacucguuaucgaaau

SEQ ID NO: 834204 - RNA, 19 nt, Homo sapiens
ucaguggucucacccuuca

SEQ ID NO: 834205 - RNA, 19 nt, Homo sapiens
ggacuccagugagcuagug

SEQ ID NO: 834206 - RNA, 19 nt, Homo sapiens
ccuggcagcucuucacugu

SEQ ID NO: 834207 - RNA, 19 nt, Homo sapiens
gagcauggccaguauugag

SEQ ID NO: 834208 - RNA, 19 nt, Homo sapiens
gaaagcaaagccagacucu

SEQ ID NO: 834209 - RNA, 19 nt, Homo sapiens
cgaaacacucguuaucgaa

SEQ ID NO: 834210 - RNA, 19 nt, Homo sapiens
gggcccaccuuugguauca

SEQ ID NO: 834211 - RNA, 19 nt, Homo sapiens
ccucagugcugcugucagu

SEQ ID NO: 834212 - RNA, 19 nt, Homo sapiens
gcccaccuuugguaucauu

SEQ ID NO: 834213 - RNA, 19 nt, Homo sapiens
uacaagaccagaaagcaaa

SEQ ID NO: 834214 - RNA, 19 nt, Homo sapiens
ccaucugccugucgcugua

SEQ ID NO: 834215 - RNA, 19 nt, Homo sapiens
ggagggucaucggcuauca

SEQ ID NO: 834216 - RNA, 19 nt, Homo sapiens
ugaagaugguggagucuac

SEQ ID NO: 834217 - RNA, 19 nt, Homo sapiens
cugugcaucuuccucauuu

SEQ ID NO: 834218 - RNA, 19 nt, Homo sapiens
gagacaaagaggauaguuc

SEQ ID NO: 834219 - RNA, 19 nt, Homo sapiens
gaacaccguggucuucucu

SEQ ID NO: 834220 - RNA, 19 nt, Homo sapiens
ccucgagcauggccaguau

SEQ ID NO: 834221 - RNA, 19 nt, Homo sapiens
ccaagcugcugcccaaggu

SEQ ID NO: 834222 - RNA, 19 nt, Homo sapiens
cgaaaccgggugccucuga

SEQ ID NO: 834223 - RNA, 19 nt, Homo sapiens
aacacucguuaucgaaaua

SEQ ID NO: 834224 - RNA, 19 nt, Homo sapiens
cccagaugcugcagagcua

SEQ ID NO: 834225 - RNA, 19 nt, Homo sapiens
auagggacaucaauagauc

SEQ ID NO: 834226 - RNA, 19 nt, Homo sapiens
gcacugaaccccuacuaug

SEQ ID NO: 834227 - RNA, 19 nt, Homo sapiens
ccucagcuccucaguuuca

SEQ ID NO: 834228 - RNA, 19 nt, Homo sapiens
guucaucuccguccugauc

SEQ ID NO: 834229 - RNA, 19 nt, Homo sapiens
gcugguguguuucgacaag

SEQ ID NO: 834230 - RNA, 19 nt, Homo sapiens
gcgggacccucaucuugca

SEQ ID NO: 834231 - RNA, 19 nt, Homo sapiens
uaagagacaaagaggauag

SEQ ID NO: 834232 - RNA, 19 nt, Homo sapiens
uguagcaaauaaagucaug

SEQ ID NO: 834233 - RNA, 19 nt, Homo sapiens
gcugucaguguagcaaaua

SEQ ID NO: 834234 - RNA, 19 nt, Homo sapiens
aauaagagacaaagaggau

SEQ ID NO: 834235 - RNA, 19 nt, Homo sapiens
gguccagggcacugucuuu

SEQ ID NO: 834236 - RNA, 19 nt, Homo sapiens
cgauagggacaucaauaga

SEQ ID NO: 834237 - RNA, 19 nt, Homo sapiens
uguacagccugacccaguu

SEQ ID NO: 834238 - RNA, 19 nt, Homo sapiens
ggucuuggcagugaugaga

SEQ ID NO: 834239 - RNA, 19 nt, Homo sapiens
uauaaacacagcaugaagu

SEQ ID NO: 834240 - RNA, 19 nt, Homo sapiens
gcccuacugugcagagaca

SEQ ID NO: 834241 - RNA, 19 nt, Homo sapiens
gcaaagccagacucuaagg

SEQ ID NO: 834242 - RNA, 19 nt, Homo sapiens
cgagaacaccguggucuuc

SEQ ID NO: 834243 - RNA, 19 nt, Homo sapiens
ccaccgacuucgcccagau

SEQ ID NO: 834244 - RNA, 19 nt, Homo sapiens
ggacggcuuagacgugaug

SEQ ID NO: 834245 - RNA, 19 nt, Homo sapiens
auaaacacagcaugaaguu

SEQ ID NO: 834246 - RNA, 19 nt, Homo sapiens
cagugcugcugucagugua

SEQ ID NO: 834247 - RNA, 19 nt, Homo sapiens
ucuacacgaucaacaccaa

SEQ ID NO: 834248 - RNA, 19 nt, Homo sapiens
cuacugaagccgcagacaa

SEQ ID NO: 834249 - RNA, 19 nt, Homo sapiens
cagaugcugcagagcuaua

SEQ ID NO: 834250 - RNA, 19 nt, Homo sapiens
agacagugcccaccgacuu

SEQ ID NO: 834251 - RNA, 19 nt, Homo sapiens
uaugggacccugacgauag

SEQ ID NO: 834252 - RNA, 19 nt, Homo sapiens
gacgagggacacuguggaa

SEQ ID NO: 834253 - RNA, 19 nt, Homo sapiens
guuuguggcugcccucucu

SEQ ID NO: 834254 - RNA, 19 nt, Homo sapiens
gguacgcccugugcaucuu

SEQ ID NO: 834255 - RNA, 19 nt, Homo sapiens
ccccucagcuccucaguuu

SEQ ID NO: 834256 - RNA, 19 nt, Homo sapiens
agagccggcugcagacuca

SEQ ID NO: 834257 - RNA, 19 nt, Homo sapiens
agcgggugcugcgguauua

SEQ ID NO: 834258 - RNA, 19 nt, Homo sapiens
ccaggagcaucugaucauc

SEQ ID NO: 834259 - RNA, 19 nt, Homo sapiens
gaggcagcccagcaacuga

SEQ ID NO: 834260 - RNA, 19 nt, Homo sapiens
gacagugcccaccgacuuc

SEQ ID NO: 834261 - RNA, 19 nt, Homo sapiens
ccagacaaccugcccaacu

SEQ ID NO: 834262 - RNA, 19 nt, Homo sapiens
ucacugaggacggcuuaga

SEQ ID NO: 834263 - RNA, 19 nt, Homo sapiens
agacgggcacccucacuga

SEQ ID NO: 834264 - RNA, 19 nt, Homo sapiens
gggugccucugaaugagau

SEQ ID NO: 834265 - RNA, 19 nt, Homo sapiens
gcauuccagugcugaagac

SEQ ID NO: 834266 - RNA, 19 nt, Homo sapiens
acccaggucuuggcaguga

SEQ ID NO: 834267 - RNA, 19 nt, Homo sapiens
ccucugaaugagauuguaa

SEQ ID NO: 834268 - RNA, 19 nt, Homo sapiens
gccugucgcuguacaagac

SEQ ID NO: 834269 - RNA, 19 nt, Homo sapiens
uugcugcucuuccguugga

SEQ ID NO: 834270 - RNA, 19 nt, Homo sapiens
cuacagaagcuucaguacu

SEQ ID NO: 834271 - RNA, 19 nt, Homo sapiens
gucaugaggaaccuacuga

SEQ ID NO: 834272 - RNA, 19 nt, Homo sapiens
gagguuggcgacugucuac

SEQ ID NO: 834273 - RNA, 19 nt, Homo sapiens
ccuuugguaucauugugaa

SEQ ID NO: 834274 - RNA, 19 nt, Homo sapiens
ggaccauggccgcucuugu

SEQ ID NO: 834275 - RNA, 19 nt, Homo sapiens
agacaacgccaguuaucca

SEQ ID NO: 834276 - RNA, 19 nt, Homo sapiens
ggagagaggugaagaauuu

SEQ ID NO: 834277 - RNA, 19 nt, Homo sapiens
ggagaguucuuuccuguuu

SEQ ID NO: 834278 - RNA, 19 nt, Homo sapiens
uaagguagcuaaaccaauu

SEQ ID NO: 834279 - RNA, 19 nt, Homo sapiens
gaaucgcgauggcuuuaua

SEQ ID NO: 834280 - RNA, 19 nt, Homo sapiens
gaugugaacuccaauuaag

SEQ ID NO: 834281 - RNA, 19 nt, Homo sapiens
gagaugugaacuccaauua

SEQ ID NO: 834282 - RNA, 19 nt, Homo sapiens
agauguagcuauugaugua

SEQ ID NO: 834283 - RNA, 19 nt, Homo sapiens
gagcuuggauuguuuaagg

SEQ ID NO: 834284 - RNA, 19 nt, Homo sapiens
caacggagugucugaaauu

SEQ ID NO: 834285 - RNA, 19 nt, Homo sapiens
uaaacgaucucuugagucu

SEQ ID NO: 834286 - RNA, 19 nt, Homo sapiens
uaacgacacgcauacauuu

SEQ ID NO: 834287 - RNA, 19 nt, Homo sapiens
cauaaacgaucucuugagu

SEQ ID NO: 834288 - RNA, 19 nt, Homo sapiens
aauguggacuuguaaauga

SEQ ID NO: 834289 - RNA, 19 nt, Homo sapiens
cuacuugcaucgacuugua

SEQ ID NO: 834290 - RNA, 19 nt, Homo sapiens
gcaacggagugucugaaau

SEQ ID NO: 834291 - RNA, 19 nt, Homo sapiens
cgggaaaccucaucaagga

SEQ ID NO: 834292 - RNA, 19 nt, Homo sapiens
ggugggagauuuggauuug

SEQ ID NO: 834293 - RNA, 19 nt, Homo sapiens
ggagaagaauguaaaaguu

SEQ ID NO: 834294 - RNA, 19 nt, Homo sapiens
cagaaacagucauaaacga

SEQ ID NO: 834295 - RNA, 19 nt, Homo sapiens
gaacuauggcagcuacuug

SEQ ID NO: 834296 - RNA, 19 nt, Homo sapiens
cgcgauggcuuuauaacaa

SEQ ID NO: 834297 - RNA, 19 nt, Homo sapiens
gaauguggacuuguaaaug

SEQ ID NO: 834298 - RNA, 19 nt, Homo sapiens
ggauuugaauguggacuug

SEQ ID NO: 834299 - RNA, 19 nt, Homo sapiens
guaaguggugcuacaauug

SEQ ID NO: 834300 - RNA, 19 nt, Homo sapiens
ccaaggaccugggauaaac

SEQ ID NO: 834301 - RNA, 19 nt, Homo sapiens
ggauaaacugggagaacua

SEQ ID NO: 834302 - RNA, 19 nt, Homo sapiens
gcgauggcuuuauaacaau

SEQ ID NO: 834303 - RNA, 19 nt, Homo sapiens
guggugguccugauuuaua

SEQ ID NO: 834304 - RNA, 19 nt, Homo sapiens
gagagacccuggacguuuu

SEQ ID NO: 834305 - RNA, 19 nt, Homo sapiens
cgauggcuuuauaacaaua

SEQ ID NO: 834306 - RNA, 19 nt, Homo sapiens
gagcccuguuggugcuuua

SEQ ID NO: 834307 - RNA, 19 nt, Homo sapiens
cggagugucugaaauugug

SEQ ID NO: 834308 - RNA, 19 nt, Homo sapiens
gagauuuggauuugaaugu

SEQ ID NO: 834309 - RNA, 19 nt, Homo sapiens
aguaaguggugcuacaauu

SEQ ID NO: 834310 - RNA, 19 nt, Homo sapiens
ugagagacccuggacguuu

SEQ ID NO: 834311 - RNA, 19 nt, Homo sapiens
gggauaaacugggagaacu

SEQ ID NO: 834312 - RNA, 19 nt, Homo sapiens
aaacuuaagcguggagaaa

SEQ ID NO: 834313 - RNA, 19 nt, Homo sapiens
caacagcguccaguuccua

SEQ ID NO: 834314 - RNA, 19 nt, Homo sapiens
aagauucaauggcuuguuc

SEQ ID NO: 834315 - RNA, 19 nt, Homo sapiens
gucgugagcuuggauuguu

SEQ ID NO: 834316 - RNA, 19 nt, Homo sapiens
gcuccucacccucacaauu

SEQ ID NO: 834317 - RNA, 19 nt, Homo sapiens
ggacguguagggagaguuc

SEQ ID NO: 834318 - RNA, 19 nt, Homo sapiens
ugggagauuuggauuugaa

SEQ ID NO: 834319 - RNA, 19 nt, Homo sapiens
agucauaaacgaucucuug

SEQ ID NO: 834320 - RNA, 19 nt, Homo sapiens
gacuugaccuugccaucug

SEQ ID NO: 834321 - RNA, 19 nt, Homo sapiens
gauaaacugggagaacuau

SEQ ID NO: 834322 - RNA, 19 nt, Homo sapiens
cuccagauguagcuauuga

SEQ ID NO: 834323 - RNA, 19 nt, Homo sapiens
ucucagaaacagucauaaa

SEQ ID NO: 834324 - RNA, 19 nt, Homo sapiens
cuaacgacacgcauacauu

SEQ ID NO: 834325 - RNA, 19 nt, Homo sapiens
aaacagucauaaacgaucu

SEQ ID NO: 834326 - RNA, 19 nt, Homo sapiens
ggacacaaacaggcagaga

SEQ ID NO: 834327 - RNA, 19 nt, Homo sapiens
ccagauguagcuauugaug

SEQ ID NO: 834328 - RNA, 19 nt, Homo sapiens
gaaggugggagaugugaac

SEQ ID NO: 834329 - RNA, 19 nt, Homo sapiens
caaacuuuaagguagcuaa

SEQ ID NO: 834330 - RNA, 19 nt, Homo sapiens
gaccuugccaucuguguuc

SEQ ID NO: 834331 - RNA, 19 nt, Homo sapiens
gcaggugggagauuuggau

SEQ ID NO: 834332 - RNA, 19 nt, Homo sapiens
uccucacccucacaauuua

SEQ ID NO: 834333 - RNA, 19 nt, Homo sapiens
gagggaggaggaagaggaa

SEQ ID NO: 834334 - RNA, 19 nt, Homo sapiens
gcugaauaaauuuggcuuu

SEQ ID NO: 834335 - RNA, 19 nt, Homo sapiens
ucucuugagucucuuucuu

SEQ ID NO: 834336 - RNA, 19 nt, Homo sapiens
ugaauguggacuuguaaau

SEQ ID NO: 834337 - RNA, 19 nt, Homo sapiens
cuccucacccucacaauuu

SEQ ID NO: 834338 - RNA, 19 nt, Homo sapiens
ggagauuuggauuugaaug

SEQ ID NO: 834339 - RNA, 19 nt, Homo sapiens
agaugugaacuccaauuaa

SEQ ID NO: 834340 - RNA, 19 nt, Homo sapiens
uaaacugggagaacuaugg

SEQ ID NO: 834341 - RNA, 19 nt, Homo sapiens
ucuggugucuauaggaaug

SEQ ID NO: 834342 - RNA, 19 nt, Homo sapiens
uuucuggugucuauaggaa

SEQ ID NO: 834343 - RNA, 19 nt, Homo sapiens
cgacuuguaccucacuuag

SEQ ID NO: 834344 - RNA, 19 nt, Homo sapiens
ugacggcgcuuuuguaagg

SEQ ID NO: 834345 - RNA, 19 nt, Homo sapiens
ggacuuguaaaugacuuga

SEQ ID NO: 834346 - RNA, 19 nt, Homo sapiens
cagcguccaguuccuacua

SEQ ID NO: 834347 - RNA, 19 nt, Homo sapiens
aaacuaacgacacgcauac

SEQ ID NO: 834348 - RNA, 19 nt, Homo sapiens
uuguggugguccugauuua

SEQ ID NO: 834349 - RNA, 19 nt, Homo sapiens
gcugagcuuucuuauucca

SEQ ID NO: 834350 - RNA, 19 nt, Homo sapiens
aacgaucucuugagucucu

SEQ ID NO: 834351 - RNA, 19 nt, Homo sapiens
caagaagagcccuguuggu

SEQ ID NO: 834352 - RNA, 19 nt, Homo sapiens
auuugaauguggacuugua

SEQ ID NO: 834353 - RNA, 19 nt, Homo sapiens
acuuaagcguggagaaaug

SEQ ID NO: 834354 - RNA, 19 nt, Homo sapiens
cuacuaacucugagcugaa

SEQ ID NO: 834355 - RNA, 19 nt, Homo sapiens
gggaaaccucaucaaggaa

SEQ ID NO: 834356 - RNA, 19 nt, Homo sapiens
gaaacuugacggcgcuuuu

SEQ ID NO: 834357 - RNA, 19 nt, Homo sapiens
gucauaaacgaucucuuga

SEQ ID NO: 834358 - RNA, 19 nt, Homo sapiens
aggcagagagggacgugua

SEQ ID NO: 834359 - RNA, 19 nt, Homo sapiens
ggcuuuauaacaauacuug

SEQ ID NO: 834360 - RNA, 19 nt, Homo sapiens
gccgcuggcuguaugaaac

SEQ ID NO: 834361 - RNA, 19 nt, Homo sapiens
gagaguucuuuccuguuuu

SEQ ID NO: 834362 - RNA, 19 nt, Homo sapiens
uguucaaggucacgguuug

SEQ ID NO: 834363 - RNA, 19 nt, Homo sapiens
agauuuggauuugaaugug

SEQ ID NO: 834364 - RNA, 19 nt, Homo sapiens
cgugagcuuggauuguuua

SEQ ID NO: 834365 - RNA, 19 nt, Homo sapiens
agaaacagucauaaacgau

SEQ ID NO: 834366 - RNA, 19 nt, Homo sapiens
gugggagauuuggauuuga

SEQ ID NO: 834367 - RNA, 19 nt, Homo sapiens
ggaaucgcgauggcuuuau

SEQ ID NO: 834368 - RNA, 19 nt, Homo sapiens
uauaggaaugcaugagaga

SEQ ID NO: 834369 - RNA, 19 nt, Homo sapiens
ucuugagucucuuucuugu

SEQ ID NO: 834370 - RNA, 19 nt, Homo sapiens
ucgugagcuuggauuguuu

SEQ ID NO: 834371 - RNA, 19 nt, Homo sapiens
gagauccgcuucaagauuc

SEQ ID NO: 834372 - RNA, 19 nt, Homo sapiens
ggacuucggauuugcauuu

SEQ ID NO: 834373 - RNA, 19 nt, Homo sapiens
cuagaugguuuggcuauua

SEQ ID NO: 834374 - RNA, 19 nt, Homo sapiens
gcucucaccucucuaggaa

SEQ ID NO: 834375 - RNA, 19 nt, Homo sapiens
gggcagggacuucggauuu

SEQ ID NO: 834376 - RNA, 19 nt, Homo sapiens
cgacagcucucaccucucu

SEQ ID NO: 834377 - RNA, 19 nt, Homo sapiens
uguggcaucugaccaauuu

SEQ ID NO: 834378 - RNA, 19 nt, Homo sapiens
gacaguccauuucuagaug

SEQ ID NO: 834379 - RNA, 19 nt, Homo sapiens
ggacguuccuacuggaugu

SEQ ID NO: 834380 - RNA, 19 nt, Homo sapiens
gagcuguuauuucccaaga

SEQ ID NO: 834381 - RNA, 19 nt, Homo sapiens
uagaugguuuggcuauuaa

SEQ ID NO: 834382 - RNA, 19 nt, Homo sapiens
gaugauccgugcaaacagu

SEQ ID NO: 834383 - RNA, 19 nt, Homo sapiens
ucucaccucucuaggaauu

SEQ ID NO: 834384 - RNA, 19 nt, Homo sapiens
cuagagauccgcuucaaga

SEQ ID NO: 834385 - RNA, 19 nt, Homo sapiens
gagcagacggcagcuaauu

SEQ ID NO: 834386 - RNA, 19 nt, Homo sapiens
cuaccagucucuccucuuc

SEQ ID NO: 834387 - RNA, 19 nt, Homo sapiens
caggugggaucuggcauuu

SEQ ID NO: 834388 - RNA, 19 nt, Homo sapiens
gaauugguccuuuucuaua

SEQ ID NO: 834389 - RNA, 19 nt, Homo sapiens
gggagcagacggcagcuaa

SEQ ID NO: 834390 - RNA, 19 nt, Homo sapiens
gccugggccuccacgauaa

SEQ ID NO: 834391 - RNA, 19 nt, Homo sapiens
ggcagggacuucggauuug

SEQ ID NO: 834392 - RNA, 19 nt, Homo sapiens
ugguuuggcuauuaaagaa

SEQ ID NO: 834393 - RNA, 19 nt, Homo sapiens
gcuguuauuucccaagaag

SEQ ID NO: 834394 - RNA, 19 nt, Homo sapiens
ucgcacgacuuccuagaga

SEQ ID NO: 834395 - RNA, 19 nt, Homo sapiens
aaacagugccgcaagagau

SEQ ID NO: 834396 - RNA, 19 nt, Homo sapiens
uuaagaauccuuuggucaa

SEQ ID NO: 834397 - RNA, 19 nt, Homo sapiens
cuccucccguuauuauuua

SEQ ID NO: 834398 - RNA, 19 nt, Homo sapiens
gcgaugauccgugcaaaca

SEQ ID NO: 834399 - RNA, 19 nt, Homo sapiens
gcagacggcagcuaauuuu

SEQ ID NO: 834400 - RNA, 19 nt, Homo sapiens
ccuccucccguuauuauuu

SEQ ID NO: 834401 - RNA, 19 nt, Homo sapiens
uuuaucagcaucucacuuu

SEQ ID NO: 834402 - RNA, 19 nt, Homo sapiens
gcacgacuuccuagagauc

SEQ ID NO: 834403 - RNA, 19 nt, Homo sapiens
agagauccgcuucaagauu

SEQ ID NO: 834404 - RNA, 19 nt, Homo sapiens
caaacagugccgcaagaga

SEQ ID NO: 834405 - RNA, 19 nt, Homo sapiens
uugcauuucuggguuguuu

SEQ ID NO: 834406 - RNA, 19 nt, Homo sapiens
uuaugacaguccauuucua

SEQ ID NO: 834407 - RNA, 19 nt, Homo sapiens
ucacuuucuucuccauuca

SEQ ID NO: 834408 - RNA, 19 nt, Homo sapiens
uaagaauccuuuggucaac

SEQ ID NO: 834409 - RNA, 19 nt, Homo sapiens
gcaccugccaccacuucaa

SEQ ID NO: 834410 - RNA, 19 nt, Homo sapiens
ugacaguccauuucuagau

SEQ ID NO: 834411 - RNA, 19 nt, Homo sapiens
caaccaggaccuugauuuu

SEQ ID NO: 834412 - RNA, 19 nt, Homo sapiens
gcagggacuucggauuugc

SEQ ID NO: 834413 - RNA, 19 nt, Homo sapiens
ugcaaacagugccgcaaga

SEQ ID NO: 834414 - RNA, 19 nt, Homo sapiens
ucuagcguguggcaucuga

SEQ ID NO: 834415 - RNA, 19 nt, Homo sapiens
ccagccacauguuuucuuu

SEQ ID NO: 834416 - RNA, 19 nt, Homo sapiens
ugcuugauccuguugauuu

SEQ ID NO: 834417 - RNA, 19 nt, Homo sapiens
aacagugccgcaagagaua

SEQ ID NO: 834418 - RNA, 19 nt, Homo sapiens
guuuggcuauuaaagaagu

SEQ ID NO: 834419 - RNA, 19 nt, Homo sapiens
uaugacaguccauuucuag

SEQ ID NO: 834420 - RNA, 19 nt, Homo sapiens
gcacgugcuggucaagauc

SEQ ID NO: 834421 - RNA, 19 nt, Homo sapiens
gcaaacagugccgcaagag

SEQ ID NO: 834422 - RNA, 19 nt, Homo sapiens
gcuugauccuguugauuuu

SEQ ID NO: 834423 - RNA, 19 nt, Homo sapiens
cagcaucucacuuucuucu

SEQ ID NO: 834424 - RNA, 19 nt, Homo sapiens
gacuucggauuugcauuuc

SEQ ID NO: 834425 - RNA, 19 nt, Homo sapiens
gggcaucaucgaggcguuu

SEQ ID NO: 834426 - RNA, 19 nt, Homo sapiens
ggagcagacggcagcuaau

SEQ ID NO: 834427 - RNA, 19 nt, Homo sapiens
gggaggaagggaagugaag

SEQ ID NO: 834428 - RNA, 19 nt, Homo sapiens
gaaguaguguggagcauua

SEQ ID NO: 834429 - RNA, 19 nt, Homo sapiens
gaaugcagcugguaaaguu

SEQ ID NO: 834430 - RNA, 19 nt, Homo sapiens
ucacagagguucaacagaa

SEQ ID NO: 834431 - RNA, 19 nt, Homo sapiens
gaacguauaugggagaaga

SEQ ID NO: 834432 - RNA, 19 nt, Homo sapiens
cuuguaagaugcugaauua

SEQ ID NO: 834433 - RNA, 19 nt, Homo sapiens
ugacggagcugucucuuug

SEQ ID NO: 834434 - RNA, 19 nt, Homo sapiens
gagagugacuuguaagaug

SEQ ID NO: 834435 - RNA, 19 nt, Homo sapiens
gaauaaaguuaaccaagca

SEQ ID NO: 834436 - RNA, 19 nt, Homo sapiens
guacucagauaaacaugaa

SEQ ID NO: 834437 - RNA, 19 nt, Homo sapiens
ggaauaauauggagaaucc

SEQ ID NO: 834438 - RNA, 19 nt, Homo sapiens
ggaauaguuucagcucuuu

SEQ ID NO: 834439 - RNA, 19 nt, Homo sapiens
gagacuguguuucaaagaa

SEQ ID NO: 834440 - RNA, 19 nt, Homo sapiens
gaaacacgccagaggcuuu

SEQ ID NO: 834441 - RNA, 19 nt, Homo sapiens
gaagaugagcuugcaauga

SEQ ID NO: 834442 - RNA, 19 nt, Homo sapiens
uaaacaaguugaucugugu

SEQ ID NO: 834443 - RNA, 19 nt, Homo sapiens
gauaauacagugaauguuc

SEQ ID NO: 834444 - RNA, 19 nt, Homo sapiens
caucuuaaagccagaaaua

SEQ ID NO: 834445 - RNA, 19 nt, Homo sapiens
gaggagagcugaggagaag

SEQ ID NO: 834446 - RNA, 19 nt, Homo sapiens
gggaauaguuucagcucuu

SEQ ID NO: 834447 - RNA, 19 nt, Homo sapiens
cagauacauuggugaagua

SEQ ID NO: 834448 - RNA, 19 nt, Homo sapiens
gcacaguguuacagucgaa

SEQ ID NO: 834449 - RNA, 19 nt, Homo sapiens
ugguaaaguuggaagaaua

SEQ ID NO: 834450 - RNA, 19 nt, Homo sapiens
gaagagaagcucauugcau

SEQ ID NO: 834451 - RNA, 19 nt, Homo sapiens
gguaaaguuggaagaauaa

SEQ ID NO: 834452 - RNA, 19 nt, Homo sapiens
gggcucccauccuggaaua

SEQ ID NO: 834453 - RNA, 19 nt, Homo sapiens
ugaaguaggagacaucgua

SEQ ID NO: 834454 - RNA, 19 nt, Homo sapiens
ccagaguucucgcugaaga

SEQ ID NO: 834455 - RNA, 19 nt, Homo sapiens
gagcugaaaucgcguacca

SEQ ID NO: 834456 - RNA, 19 nt, Homo sapiens
ccuauaaucccagcacuua

SEQ ID NO: 834457 - RNA, 19 nt, Homo sapiens
cgaggagccugaaauaugg

SEQ ID NO: 834458 - RNA, 19 nt, Homo sapiens
ggagagaguaaacaaguug

SEQ ID NO: 834459 - RNA, 19 nt, Homo sapiens
gcacgggacuguggaccuu

SEQ ID NO: 834460 - RNA, 19 nt, Homo sapiens
gguggaagguggagaccaa

SEQ ID NO: 834461 - RNA, 19 nt, Homo sapiens
gagcgagacuguguuucaa

SEQ ID NO: 834462 - RNA, 19 nt, Homo sapiens
gaaauaauggaggagauug

SEQ ID NO: 834463 - RNA, 19 nt, Homo sapiens
aagcaucccuuccacauca

SEQ ID NO: 834464 - RNA, 19 nt, Homo sapiens
ccucagugauucucgguaa

SEQ ID NO: 834465 - RNA, 19 nt, Homo sapiens
uguggaugauucagaguua

SEQ ID NO: 834466 - RNA, 19 nt, Homo sapiens
agcauuaacuuguggauga

SEQ ID NO: 834467 - RNA, 19 nt, Homo sapiens
cagcugagucccgguauua

SEQ ID NO: 834468 - RNA, 19 nt, Homo sapiens
agaggaugaugcuguauga

SEQ ID NO: 834469 - RNA, 19 nt, Homo sapiens
gcaaugagagguuucuuac

SEQ ID NO: 834470 - RNA, 19 nt, Homo sapiens
aagaugagcuugcaaugag

SEQ ID NO: 834471 - RNA, 19 nt, Homo sapiens
gaagcucauugcaucuguu

SEQ ID NO: 834472 - RNA, 19 nt, Homo sapiens
gcacaaagaagaggaagca

SEQ ID NO: 834473 - RNA, 19 nt, Homo sapiens
acacgaggagccugaaaua

SEQ ID NO: 834474 - RNA, 19 nt, Homo sapiens
acaccgggcugccuuaauc

SEQ ID NO: 834475 - RNA, 19 nt, Homo sapiens
gaaaccccaucucuacuaa

SEQ ID NO: 834476 - RNA, 19 nt, Homo sapiens
gcaaagacucgagagauca

SEQ ID NO: 834477 - RNA, 19 nt, Homo sapiens
cagaagacccacuuucaug

SEQ ID NO: 834478 - RNA, 19 nt, Homo sapiens
cgagagaucaucccuuugu

SEQ ID NO: 834479 - RNA, 19 nt, Homo sapiens
gcagaagacccacuuucau

SEQ ID NO: 834480 - RNA, 19 nt, Homo sapiens
ccagauacauuggugaagu

SEQ ID NO: 834481 - RNA, 19 nt, Homo sapiens
uggaggagauugugaugga

SEQ ID NO: 834482 - RNA, 19 nt, Homo sapiens
ggagaagaucugcagaaga

SEQ ID NO: 834483 - RNA, 19 nt, Homo sapiens
gaggagaagaucugcagaa

SEQ ID NO: 834484 - RNA, 19 nt, Homo sapiens
auacauuggugaaguagga

SEQ ID NO: 834485 - RNA, 19 nt, Homo sapiens
gcgagacuguguuucaaag

SEQ ID NO: 834486 - RNA, 19 nt, Homo sapiens
cucgagagaucaucccuuu

SEQ ID NO: 834487 - RNA, 19 nt, Homo sapiens
gagaagagaagcucauugc

SEQ ID NO: 834488 - RNA, 19 nt, Homo sapiens
agacccacuuucaugauuu

SEQ ID NO: 834489 - RNA, 19 nt, Homo sapiens
gaagacccacuuucaugau

SEQ ID NO: 834490 - RNA, 19 nt, Homo sapiens
gagaauccuuugucuucca

SEQ ID NO: 834491 - RNA, 19 nt, Homo sapiens
ggaacaggagggauaagga

SEQ ID NO: 834492 - RNA, 19 nt, Homo sapiens
ggaggagauugugauggaa

SEQ ID NO: 834493 - RNA, 19 nt, Homo sapiens
caacaccugagcacaaaga

SEQ ID NO: 834494 - RNA, 19 nt, Homo sapiens
gacccacuuucaugauuug

SEQ ID NO: 834495 - RNA, 19 nt, Homo sapiens
aaugagagguuucuuacag

SEQ ID NO: 834496 - RNA, 19 nt, Homo sapiens
caaguugaucugugugaaa

SEQ ID NO: 834497 - RNA, 19 nt, Homo sapiens
aagcaaagcuguuuucauc

SEQ ID NO: 834498 - RNA, 19 nt, Homo sapiens
ggagaagagaagcucauug

SEQ ID NO: 834499 - RNA, 19 nt, Homo sapiens
ccauuccuauauccuuuaa

SEQ ID NO: 834500 - RNA, 19 nt, Homo sapiens
ucaucucgcugguaacuca

SEQ ID NO: 834501 - RNA, 19 nt, Homo sapiens
ugcaucaucucgcugguaa

SEQ ID NO: 834502 - RNA, 19 nt, Homo sapiens
gccuuaaucuguccugcuu

SEQ ID NO: 834503 - RNA, 19 nt, Homo sapiens
gaggagauugugauggaaa

SEQ ID NO: 834504 - RNA, 19 nt, Homo sapiens
aggaugaugcuguaugaua

SEQ ID NO: 834505 - RNA, 19 nt, Homo sapiens
caccugagcacaaagaaga

SEQ ID NO: 834506 - RNA, 19 nt, Homo sapiens
ggaggagagcugaggagaa

SEQ ID NO: 834507 - RNA, 19 nt, Homo sapiens
uggcaucccugaccuccaa

SEQ ID NO: 834508 - RNA, 19 nt, Homo sapiens
cagaaauaauggaggagau

SEQ ID NO: 834509 - RNA, 19 nt, Homo sapiens
ggcagaagacccacuuuca

SEQ ID NO: 834510 - RNA, 19 nt, Homo sapiens
gcuuggagagugacuugua

SEQ ID NO: 834511 - RNA, 19 nt, Homo sapiens
ggaagaauaaaguuaacca

SEQ ID NO: 834512 - RNA, 19 nt, Homo sapiens
uuaaaugacugagaaugca

SEQ ID NO: 834513 - RNA, 19 nt, Homo sapiens
cccaacaccugagcacaaa

SEQ ID NO: 834514 - RNA, 19 nt, Homo sapiens
agaagacccacuuucauga

SEQ ID NO: 834515 - RNA, 19 nt, Homo sapiens
ccugaaauauggaaaacua

SEQ ID NO: 834516 - RNA, 19 nt, Homo sapiens
cuuggagagugacuuguaa

SEQ ID NO: 834517 - RNA, 19 nt, Homo sapiens
ggugggagaaucacuugaa

SEQ ID NO: 834518 - RNA, 19 nt, Homo sapiens
cacgguggcucacgccuau

SEQ ID NO: 834519 - RNA, 19 nt, Homo sapiens
uggagaauccuuugucuuc

SEQ ID NO: 834520 - RNA, 19 nt, Homo sapiens
gagugaagacugugaugug

SEQ ID NO: 834521 - RNA, 19 nt, Homo sapiens
cuucggaacugcaucaucu

SEQ ID NO: 834522 - RNA, 19 nt, Homo sapiens
aagacccacuuucaugauu

SEQ ID NO: 834523 - RNA, 19 nt, Homo sapiens
ggagagcugaggagaagau

SEQ ID NO: 834524 - RNA, 19 nt, Homo sapiens
uugcugcucucguccauga

SEQ ID NO: 834525 - RNA, 19 nt, Homo sapiens
gcauuaacuuguggaugau

SEQ ID NO: 834526 - RNA, 19 nt, Homo sapiens
gagagaucaucccuuuguc

SEQ ID NO: 834527 - RNA, 19 nt, Homo sapiens
acgaggagccugaaauaug

SEQ ID NO: 834528 - RNA, 19 nt, Homo sapiens
ggaaagagacuguuaaaua

SEQ ID NO: 834529 - RNA, 19 nt, Homo sapiens
caaauuaggugacuuguuu

SEQ ID NO: 834530 - RNA, 19 nt, Homo sapiens
acagagaucucaaacauua

SEQ ID NO: 834531 - RNA, 19 nt, Homo sapiens
ccaaguaaaucuccaauaa

SEQ ID NO: 834532 - RNA, 19 nt, Homo sapiens
gggaaagucugcagaauaa

SEQ ID NO: 834533 - RNA, 19 nt, Homo sapiens
gcacccaucucuaauuaua

SEQ ID NO: 834534 - RNA, 19 nt, Homo sapiens
gcagaggugucucauauuu

SEQ ID NO: 834535 - RNA, 19 nt, Homo sapiens
gaagaagucugguuucaug

SEQ ID NO: 834536 - RNA, 19 nt, Homo sapiens
uaaaguagcuggaaugaug

SEQ ID NO: 834537 - RNA, 19 nt, Homo sapiens
gaacuuagaaucagcauuu

SEQ ID NO: 834538 - RNA, 19 nt, Homo sapiens
gagcagaggugucucauau

SEQ ID NO: 834539 - RNA, 19 nt, Homo sapiens
ggaagaggcugacuaugaa

SEQ ID NO: 834540 - RNA, 19 nt, Homo sapiens
cuaaagagcuguccuauca

SEQ ID NO: 834541 - RNA, 19 nt, Homo sapiens
uagcaaagcuguugaagaa

SEQ ID NO: 834542 - RNA, 19 nt, Homo sapiens
gagcagagcccuucuauug

SEQ ID NO: 834543 - RNA, 19 nt, Homo sapiens
gcgauaaacugccguaauu

SEQ ID NO: 834544 - RNA, 19 nt, Homo sapiens
gaaguaaauuucuggcuuu

SEQ ID NO: 834545 - RNA, 19 nt, Homo sapiens
gaaaagaucuugagaaaca

SEQ ID NO: 834546 - RNA, 19 nt, Homo sapiens
gcacuagaauuuaaaccua

SEQ ID NO: 834547 - RNA, 19 nt, Homo sapiens
gauccuauguucaaucuaa

SEQ ID NO: 834548 - RNA, 19 nt, Homo sapiens
gaauaucgauccuauguuc

SEQ ID NO: 834549 - RNA, 19 nt, Homo sapiens
gcaaagcuguugaagaaga

SEQ ID NO: 834550 - RNA, 19 nt, Homo sapiens
uaacaaggcuggaugugaa

SEQ ID NO: 834551 - RNA, 19 nt, Homo sapiens
uguaagauaugaccaguua

SEQ ID NO: 834552 - RNA, 19 nt, Homo sapiens
caggauagauaacagaaua

SEQ ID NO: 834553 - RNA, 19 nt, Homo sapiens
gggcacccaucucuaauua

SEQ ID NO: 834554 - RNA, 19 nt, Homo sapiens
uaccaaagcugugcuguua

SEQ ID NO: 834555 - RNA, 19 nt, Homo sapiens
gaaagaagaggauauugaa

SEQ ID NO: 834556 - RNA, 19 nt, Homo sapiens
cagcaaaucuuucaucuca

SEQ ID NO: 834557 - RNA, 19 nt, Homo sapiens
ccaauuaacucaccucuuc

SEQ ID NO: 834558 - RNA, 19 nt, Homo sapiens
gaaaugugauccagaggaa

SEQ ID NO: 834559 - RNA, 19 nt, Homo sapiens
gaagacauuuauugcagua

SEQ ID NO: 834560 - RNA, 19 nt, Homo sapiens
gaauaugguuguuugaaga

SEQ ID NO: 834561 - RNA, 19 nt, Homo sapiens
caagagugcuuuaaugaug

SEQ ID NO: 834562 - RNA, 19 nt, Homo sapiens
caauggcaguuaugauuua

SEQ ID NO: 834563 - RNA, 19 nt, Homo sapiens
gagaauugcuugaaaugga

SEQ ID NO: 834564 - RNA, 19 nt, Homo sapiens
aaaggaagcuggcaaacaa

SEQ ID NO: 834565 - RNA, 19 nt, Homo sapiens
gcaaaucuuucaucucaau

SEQ ID NO: 834566 - RNA, 19 nt, Homo sapiens
ccaauaaacugcuaucaca

SEQ ID NO: 834567 - RNA, 19 nt, Homo sapiens
uuacaagacuucaccagua

SEQ ID NO: 834568 - RNA, 19 nt, Homo sapiens
agaagaggguguugauaua

SEQ ID NO: 834569 - RNA, 19 nt, Homo sapiens
caaauuuccuucuaccauu

SEQ ID NO: 834570 - RNA, 19 nt, Homo sapiens
caagauguauguuugauca

SEQ ID NO: 834571 - RNA, 19 nt, Homo sapiens
uagauacugugcuagauua

SEQ ID NO: 834572 - RNA, 19 nt, Homo sapiens
ccaagcaccuuuaugaaga

SEQ ID NO: 834573 - RNA, 19 nt, Homo sapiens
gcaguugucuuaaacagau

SEQ ID NO: 834574 - RNA, 19 nt, Homo sapiens
uguaggcacucuucacuua

SEQ ID NO: 834575 - RNA, 19 nt, Homo sapiens
ugagacagcgugauacuua

SEQ ID NO: 834576 - RNA, 19 nt, Homo sapiens
ucacaagagugcuuuaaug

SEQ ID NO: 834577 - RNA, 19 nt, Homo sapiens
uaaccaagcaccuuuauga

SEQ ID NO: 834578 - RNA, 19 nt, Homo sapiens
gaaucagccucgcaacaaa

SEQ ID NO: 834579 - RNA, 19 nt, Homo sapiens
aagcagcucuggaucauaa

SEQ ID NO: 834580 - RNA, 19 nt, Homo sapiens
caacauaccaguagagguu

SEQ ID NO: 834581 - RNA, 19 nt, Homo sapiens
ccaccaagauguauguuug

SEQ ID NO: 834582 - RNA, 19 nt, Homo sapiens
gcaaccaacuaccucauau

SEQ ID NO: 834583 - RNA, 19 nt, Homo sapiens
cagcagaucuuacagcaau

SEQ ID NO: 834584 - RNA, 19 nt, Homo sapiens
gaagucugguuucauguug

SEQ ID NO: 834585 - RNA, 19 nt, Homo sapiens
guaaaugcaucuuggacaa

SEQ ID NO: 834586 - RNA, 19 nt, Homo sapiens
ugucagcucugcuuucuaa

SEQ ID NO: 834587 - RNA, 19 nt, Homo sapiens
gaaggcagaauuuaaaguu

SEQ ID NO: 834588 - RNA, 19 nt, Homo sapiens
ugaagaagaugacuuugug

SEQ ID NO: 834589 - RNA, 19 nt, Homo sapiens
gcacaugauucugaacuug

SEQ ID NO: 834590 - RNA, 19 nt, Homo sapiens
gaagaaaacugugguguug

SEQ ID NO: 834591 - RNA, 19 nt, Homo sapiens
gaaggaagaggcugacuau

SEQ ID NO: 834592 - RNA, 19 nt, Homo sapiens
cugcagaaauuccuuauga

SEQ ID NO: 834593 - RNA, 19 nt, Homo sapiens
cacagcaccuuuacccuua

SEQ ID NO: 834594 - RNA, 19 nt, Homo sapiens
gcaaacuggaugaggauua

SEQ ID NO: 834595 - RNA, 19 nt, Homo sapiens
gaccugaucagcccuguua

SEQ ID NO: 834596 - RNA, 19 nt, Homo sapiens
gcaacuuggugguucguuu

SEQ ID NO: 834597 - RNA, 19 nt, Homo sapiens
gguaagagaacuacagaaa

SEQ ID NO: 834598 - RNA, 19 nt, Homo sapiens
acacagagaucucaaacau

SEQ ID NO: 834599 - RNA, 19 nt, Homo sapiens
uuaaugccgugaaaguuua

SEQ ID NO: 834600 - RNA, 19 nt, Homo sapiens
ggaauaugguuguuugaag

SEQ ID NO: 834601 - RNA, 19 nt, Homo sapiens
gggacuaacugcuuccauu

SEQ ID NO: 834602 - RNA, 19 nt, Homo sapiens
gaaagaaacacuggaugaa

SEQ ID NO: 834603 - RNA, 19 nt, Homo sapiens
gauaguaagggacagauuu

SEQ ID NO: 834604 - RNA, 19 nt, Homo sapiens
caaacacaaucuuaucuuc

SEQ ID NO: 834605 - RNA, 19 nt, Homo sapiens
ucaggaacauaucagauuu

SEQ ID NO: 834606 - RNA, 19 nt, Homo sapiens
acacagcaguugucuuaaa

SEQ ID NO: 834607 - RNA, 19 nt, Homo sapiens
uuaaauaccucaguucuuc

SEQ ID NO: 834608 - RNA, 19 nt, Homo sapiens
gcucauuauuuccaucuuu

SEQ ID NO: 834609 - RNA, 19 nt, Homo sapiens
ccaaagcugugcuguuaau

SEQ ID NO: 834610 - RNA, 19 nt, Homo sapiens
gcaguuaugauuuagcuaa

SEQ ID NO: 834611 - RNA, 19 nt, Homo sapiens
ccaaugagcuguguacgau

SEQ ID NO: 834612 - RNA, 19 nt, Homo sapiens
gaagagguacuuaggaaau

SEQ ID NO: 834613 - RNA, 19 nt, Homo sapiens
auacacagcaguugucuua

SEQ ID NO: 834614 - RNA, 19 nt, Homo sapiens
caagaagcaauucaugaua

SEQ ID NO: 834615 - RNA, 19 nt, Homo sapiens
uauaaugccugcaaugugu

SEQ ID NO: 834616 - RNA, 19 nt, Homo sapiens
guugauaacaggauagaua

SEQ ID NO: 834617 - RNA, 19 nt, Homo sapiens
accagaaacugccaaauuu

SEQ ID NO: 834618 - RNA, 19 nt, Homo sapiens
cgaacuggaugaccauuug

SEQ ID NO: 834619 - RNA, 19 nt, Homo sapiens
ugaugaggaugaagaaauu

SEQ ID NO: 834620 - RNA, 19 nt, Homo sapiens
aagaggagcugcacaggaa

SEQ ID NO: 834621 - RNA, 19 nt, Homo sapiens
ggaauuagaagaagcacuu

SEQ ID NO: 834622 - RNA, 19 nt, Homo sapiens
aaagacugcugauggaauu

SEQ ID NO: 834623 - RNA, 19 nt, Homo sapiens
ggacuaacugcuuccauuu

SEQ ID NO: 834624 - RNA, 19 nt, Homo sapiens
cauauacucgcacaacuua

SEQ ID NO: 834625 - RNA, 19 nt, Homo sapiens
gccaggagcuuagggcuuu

SEQ ID NO: 834626 - RNA, 19 nt, Homo sapiens
ggucgaaguuacaggauug

SEQ ID NO: 834627 - RNA, 19 nt, Homo sapiens
cagagucacuguggaagua

SEQ ID NO: 834628 - RNA, 19 nt, Homo sapiens
gaagaaaucuguacuguau

SEQ ID NO: 834629 - RNA, 19 nt, Homo sapiens
ggaaggagcuggaggaaga

SEQ ID NO: 834630 - RNA, 19 nt, Homo sapiens
gaauuucgcuaaggaguuu

SEQ ID NO: 834631 - RNA, 19 nt, Homo sapiens
ggaggaagauuucaucaag

SEQ ID NO: 834632 - RNA, 19 nt, Homo sapiens
ccaccaagaucgacaaaga

SEQ ID NO: 834633 - RNA, 19 nt, Homo sapiens
ugaaggaggucguacagaa

SEQ ID NO: 834634 - RNA, 19 nt, Homo sapiens
guauugggauuguaaagaa

SEQ ID NO: 834635 - RNA, 19 nt, Homo sapiens
gagauuggcuugguucuuc

SEQ ID NO: 834636 - RNA, 19 nt, Homo sapiens
gacgaggucugccuaguga

SEQ ID NO: 834637 - RNA, 19 nt, Homo sapiens
agaaaucuguacuguauug

SEQ ID NO: 834638 - RNA, 19 nt, Homo sapiens
ggaagaaaucuguacugua

SEQ ID NO: 834639 - RNA, 19 nt, Homo sapiens
gaccgaaauuuccuuguga

SEQ ID NO: 834640 - RNA, 19 nt, Homo sapiens
cauggaaccucuuucuuug

SEQ ID NO: 834641 - RNA, 19 nt, Homo sapiens
gaggaagauuucaucaaga

SEQ ID NO: 834642 - RNA, 19 nt, Homo sapiens
gggaagaaaucuguacugu

SEQ ID NO: 834643 - RNA, 19 nt, Homo sapiens
gagcaagagguccaaguuu

SEQ ID NO: 834644 - RNA, 19 nt, Homo sapiens
ucagacaguuuacagaaau

SEQ ID NO: 834645 - RNA, 19 nt, Homo sapiens
caugagcacauuugauaua

SEQ ID NO: 834646 - RNA, 19 nt, Homo sapiens
gaaccucuuucuuugaucu

SEQ ID NO: 834647 - RNA, 19 nt, Homo sapiens
acacguccauucccuacua

SEQ ID NO: 834648 - RNA, 19 nt, Homo sapiens
ucauggaaccucuuucuuu

SEQ ID NO: 834649 - RNA, 19 nt, Homo sapiens
acaagacccuggugaagga

SEQ ID NO: 834650 - RNA, 19 nt, Homo sapiens
cagacaguuuacagaaaua

SEQ ID NO: 834651 - RNA, 19 nt, Homo sapiens
gcuaaggaguuugugauca

SEQ ID NO: 834652 - RNA, 19 nt, Homo sapiens
caaagcgacaagaucguua

SEQ ID NO: 834653 - RNA, 19 nt, Homo sapiens
guacagaauuucgcuaagg

SEQ ID NO: 834654 - RNA, 19 nt, Homo sapiens
gaaggaggucguacagaau

SEQ ID NO: 834655 - RNA, 19 nt, Homo sapiens
gagcacauuugauauagcu

SEQ ID NO: 834656 - RNA, 19 nt, Homo sapiens
gguccugccugccaucaga

SEQ ID NO: 834657 - RNA, 19 nt, Homo sapiens
ugaccgaaauuuccuugug

SEQ ID NO: 834658 - RNA, 19 nt, Homo sapiens
gagaagggcaaaggucuga

SEQ ID NO: 834659 - RNA, 19 nt, Homo sapiens
agcaagagguccaaguuug

SEQ ID NO: 834660 - RNA, 19 nt, Homo sapiens
guacuguauugggauugua

SEQ ID NO: 834661 - RNA, 19 nt, Homo sapiens
caagaucguuagggagaga

SEQ ID NO: 834662 - RNA, 19 nt, Homo sapiens
ggucugaaaccaccuguuc

SEQ ID NO: 834663 - RNA, 19 nt, Homo sapiens
gacugaauaagaagagaua

SEQ ID NO: 834664 - RNA, 19 nt, Homo sapiens
ggacaagacccuggugaag

SEQ ID NO: 834665 - RNA, 19 nt, Homo sapiens
gaugacguccgguuguuug

SEQ ID NO: 834666 - RNA, 19 nt, Homo sapiens
uucaugagcacauuugaua

SEQ ID NO: 834667 - RNA, 19 nt, Homo sapiens
gcugugagcugagcaaagc

SEQ ID NO: 834668 - RNA, 19 nt, Homo sapiens
cagaugacguccgguuguu

SEQ ID NO: 834669 - RNA, 19 nt, Homo sapiens
uacagaauuucgcuaagga

SEQ ID NO: 834670 - RNA, 19 nt, Homo sapiens
uaaagaaaggugagauugg

SEQ ID NO: 834671 - RNA, 19 nt, Homo sapiens
uggaaccucuuucuuugau

SEQ ID NO: 834672 - RNA, 19 nt, Homo sapiens
gcacucagacaguuuacag

SEQ ID NO: 834673 - RNA, 19 nt, Homo sapiens
gagaaaagaagccaugaga

SEQ ID NO: 834674 - RNA, 19 nt, Homo sapiens
cuaaggaguuugugaucag

SEQ ID NO: 834675 - RNA, 19 nt, Homo sapiens
guugacggagggaguauuu

SEQ ID NO: 834676 - RNA, 19 nt, Homo sapiens
gguggggacugggaauuua

SEQ ID NO: 834677 - RNA, 19 nt, Homo sapiens
gggaguauuucaggguuca

SEQ ID NO: 834678 - RNA, 19 nt, Homo sapiens
caccuucccgcuucccuua

SEQ ID NO: 834679 - RNA, 19 nt, Homo sapiens
uuaaagaaaggugagauug

SEQ ID NO: 834680 - RNA, 19 nt, Homo sapiens
ggagcuggaggaagauuuc

SEQ ID NO: 834681 - RNA, 19 nt, Homo sapiens
cucagacaguuuacagaaa

SEQ ID NO: 834682 - RNA, 19 nt, Homo sapiens
ggaacggaucccuuagguu

SEQ ID NO: 834683 - RNA, 19 nt, Homo sapiens
ccaaagcgacaagaucguu

SEQ ID NO: 834684 - RNA, 19 nt, Homo sapiens
gcucgguggugagaagguu

SEQ ID NO: 834685 - RNA, 19 nt, Homo sapiens
gagcggaguaccagcacuu

SEQ ID NO: 834686 - RNA, 19 nt, Homo sapiens
aggaagauuucaucaagag

SEQ ID NO: 834687 - RNA, 19 nt, Homo sapiens
ugacggagggaguauuuca

SEQ ID NO: 834688 - RNA, 19 nt, Homo sapiens
ugagcaagagguccaaguu

SEQ ID NO: 834689 - RNA, 19 nt, Homo sapiens
gcucauggaaccucuuucu

SEQ ID NO: 834690 - RNA, 19 nt, Homo sapiens
gccguguccuaucucauga

SEQ ID NO: 834691 - RNA, 19 nt, Homo sapiens
cgacgaggucugccuagug

SEQ ID NO: 834692 - RNA, 19 nt, Homo sapiens
ucaagagcgagcugaagaa

SEQ ID NO: 834693 - RNA, 19 nt, Homo sapiens
ggaguaccagcacuucauc

SEQ ID NO: 834694 - RNA, 19 nt, Homo sapiens
gaccucacguugcuuucca

SEQ ID NO: 834695 - RNA, 19 nt, Homo sapiens
aaggaggucguacagaauu

SEQ ID NO: 834696 - RNA, 19 nt, Homo sapiens
caugaccucacguugcuuu

SEQ ID NO: 834697 - RNA, 19 nt, Homo sapiens
ggaaccucuuucuuugauc

SEQ ID NO: 834698 - RNA, 19 nt, Homo sapiens
gguccaaguuugcccucau

SEQ ID NO: 834699 - RNA, 19 nt, Homo sapiens
aggaggucguacagaauuu

SEQ ID NO: 834700 - RNA, 19 nt, Homo sapiens
gaacccugccguguccuau

SEQ ID NO: 834701 - RNA, 19 nt, Homo sapiens
uuuccuugcucauuucguu

SEQ ID NO: 834702 - RNA, 19 nt, Homo sapiens
cgaggucugccuagugaga

SEQ ID NO: 834703 - RNA, 19 nt, Homo sapiens
aggaguuugugaucaguga

SEQ ID NO: 834704 - RNA, 19 nt, Homo sapiens
acucagacaguuuacagaa

SEQ ID NO: 834705 - RNA, 19 nt, Homo sapiens
gggaugccaugagcaagag

SEQ ID NO: 834706 - RNA, 19 nt, Homo sapiens
cacguccauucccuacuaa

SEQ ID NO: 834707 - RNA, 19 nt, Homo sapiens
uaagcacacacguccauuc

SEQ ID NO: 834708 - RNA, 19 nt, Homo sapiens
gcgacgaggucugccuagu

SEQ ID NO: 834709 - RNA, 19 nt, Homo sapiens
uaaggaguuugugaucagu

SEQ ID NO: 834710 - RNA, 19 nt, Homo sapiens
guccaaguuugcccucauc

SEQ ID NO: 834711 - RNA, 19 nt, Homo sapiens
cauaagcacacacguccau

SEQ ID NO: 834712 - RNA, 19 nt, Homo sapiens
ccugcagccuucauaagca

SEQ ID NO: 834713 - RNA, 19 nt, Homo sapiens
ggaggucguacagaauuuc

SEQ ID NO: 834714 - RNA, 19 nt, Homo sapiens
ggagauccaugguagcuua

SEQ ID NO: 834715 - RNA, 19 nt, Homo sapiens
gcaaagagcacccacauuc

SEQ ID NO: 834716 - RNA, 19 nt, Homo sapiens
ccaaguaaauggaaauguu

SEQ ID NO: 834717 - RNA, 19 nt, Homo sapiens
gaggagaaauggucuuaug

SEQ ID NO: 834718 - RNA, 19 nt, Homo sapiens
cagaggagcuggagguuau

SEQ ID NO: 834719 - RNA, 19 nt, Homo sapiens
guucaaguauggcagauuu

SEQ ID NO: 834720 - RNA, 19 nt, Homo sapiens
gaugcgaccucuccagauu

SEQ ID NO: 834721 - RNA, 19 nt, Homo sapiens
ggacacagcgccucuagga

SEQ ID NO: 834722 - RNA, 19 nt, Homo sapiens
gauccaugguagcuuauuu

SEQ ID NO: 834723 - RNA, 19 nt, Homo sapiens
cauuagaacuacagacaaa

SEQ ID NO: 834724 - RNA, 19 nt, Homo sapiens
gagacaaccaucuucauuu

SEQ ID NO: 834725 - RNA, 19 nt, Homo sapiens
gcacauagucaucaucuca

SEQ ID NO: 834726 - RNA, 19 nt, Homo sapiens
ggagacaaccaucuucauu

SEQ ID NO: 834727 - RNA, 19 nt, Homo sapiens
gaaaccagauuugccugaa

SEQ ID NO: 834728 - RNA, 19 nt, Homo sapiens
gcccuugccugucaugaaa

SEQ ID NO: 834729 - RNA, 19 nt, Homo sapiens
aaaucacacucuacaguaa

SEQ ID NO: 834730 - RNA, 19 nt, Homo sapiens
gaacugaaacgugagguau

SEQ ID NO: 834731 - RNA, 19 nt, Homo sapiens
ccacugugauuuaugucua

SEQ ID NO: 834732 - RNA, 19 nt, Homo sapiens
ugauguguaugguugguua

SEQ ID NO: 834733 - RNA, 19 nt, Homo sapiens
guggugagcugaguacuga

SEQ ID NO: 834734 - RNA, 19 nt, Homo sapiens
gaguuguggcugagaauua

SEQ ID NO: 834735 - RNA, 19 nt, Homo sapiens
guacccagcagccauguuu

SEQ ID NO: 834736 - RNA, 19 nt, Homo sapiens
gaaagcagccguggagaca

SEQ ID NO: 834737 - RNA, 19 nt, Homo sapiens
ugagguaucuuugaugugu

SEQ ID NO: 834738 - RNA, 19 nt, Homo sapiens
aaaccuggauccugccauu

SEQ ID NO: 834739 - RNA, 19 nt, Homo sapiens
gaaccuggaacucaagaug

SEQ ID NO: 834740 - RNA, 19 nt, Homo sapiens
gcaaagcacauagucauca

SEQ ID NO: 834741 - RNA, 19 nt, Homo sapiens
gcugaguacugaacaaucu

SEQ ID NO: 834742 - RNA, 19 nt, Homo sapiens
gaucaaauuagaagucugu

SEQ ID NO: 834743 - RNA, 19 nt, Homo sapiens
uggaggagguugacagaga

SEQ ID NO: 834744 - RNA, 19 nt, Homo sapiens
gcaaggcuggcaccaagaa

SEQ ID NO: 834745 - RNA, 19 nt, Homo sapiens
aaaccagauuugccugaaa

SEQ ID NO: 834746 - RNA, 19 nt, Homo sapiens
gcacuuccucuguggugua

SEQ ID NO: 834747 - RNA, 19 nt, Homo sapiens
gcucgcccacugugauuua

SEQ ID NO: 834748 - RNA, 19 nt, Homo sapiens
cagcaucccaguugagaaa

SEQ ID NO: 834749 - RNA, 19 nt, Homo sapiens
caaagagcacccacauuca

SEQ ID NO: 834750 - RNA, 19 nt, Homo sapiens
gagguaucuuugaugugua

SEQ ID NO: 834751 - RNA, 19 nt, Homo sapiens
gaaacgugagguaucuuug

SEQ ID NO: 834752 - RNA, 19 nt, Homo sapiens
ggaagaaagaaauuacagu

SEQ ID NO: 834753 - RNA, 19 nt, Homo sapiens
caaagcacauagucaucau

SEQ ID NO: 834754 - RNA, 19 nt, Homo sapiens
agacaaccaucuucauuuu

SEQ ID NO: 834755 - RNA, 19 nt, Homo sapiens
cagaggagaaauggucuua

SEQ ID NO: 834756 - RNA, 19 nt, Homo sapiens
uccaauuuguccagcuuua

SEQ ID NO: 834757 - RNA, 19 nt, Homo sapiens
aaagagcacccacauucaa

SEQ ID NO: 834758 - RNA, 19 nt, Homo sapiens
caguauaucuaagaacuag

SEQ ID NO: 834759 - RNA, 19 nt, Homo sapiens
cugaagcccuugccuguca

SEQ ID NO: 834760 - RNA, 19 nt, Homo sapiens
auauugaugucuccagauu

SEQ ID NO: 834761 - RNA, 19 nt, Homo sapiens
gcucggccaaguucaagua

SEQ ID NO: 834762 - RNA, 19 nt, Homo sapiens
cgauugauuucccagcuau

SEQ ID NO: 834763 - RNA, 19 nt, Homo sapiens
cgugagguaucuuugaugu

SEQ ID NO: 834764 - RNA, 19 nt, Homo sapiens
ugaaacgugagguaucuuu

SEQ ID NO: 834765 - RNA, 19 nt, Homo sapiens
acgaacagauucagguuuc

SEQ ID NO: 834766 - RNA, 19 nt, Homo sapiens
gucuccagauucaaauaua

SEQ ID NO: 834767 - RNA, 19 nt, Homo sapiens
aaacgugagguaucuuuga

SEQ ID NO: 834768 - RNA, 19 nt, Homo sapiens
gcuggagguuauuggagaa

SEQ ID NO: 834769 - RNA, 19 nt, Homo sapiens
aaagugguguuccgaccuu

SEQ ID NO: 834770 - RNA, 19 nt, Homo sapiens
aaacccuacuauucugauu

SEQ ID NO: 834771 - RNA, 19 nt, Homo sapiens
gggcccaaguaaauggaaa

SEQ ID NO: 834772 - RNA, 19 nt, Homo sapiens
gcauuagaacuacagacaa

SEQ ID NO: 834773 - RNA, 19 nt, Homo sapiens
gcacaaguuuuaguggaaa

SEQ ID NO: 834774 - RNA, 19 nt, Homo sapiens
gggcaaaguagaagucaag

SEQ ID NO: 834775 - RNA, 19 nt, Homo sapiens
gaacagauucagguuucau

SEQ ID NO: 834776 - RNA, 19 nt, Homo sapiens
gagcucgcccacugugauu

SEQ ID NO: 834777 - RNA, 19 nt, Homo sapiens
cucaggagcugguguuagu

SEQ ID NO: 834778 - RNA, 19 nt, Homo sapiens
ugauuucccagcuauauug

SEQ ID NO: 834779 - RNA, 19 nt, Homo sapiens
cacagcgccucuaggagaa

SEQ ID NO: 834780 - RNA, 19 nt, Homo sapiens
cggccaaguucaaguaugg

SEQ ID NO: 834781 - RNA, 19 nt, Homo sapiens
ccacacgaaaccagauuug

SEQ ID NO: 834782 - RNA, 19 nt, Homo sapiens
ucagaggagcuggagguua

SEQ ID NO: 834783 - RNA, 19 nt, Homo sapiens
gcuauauuguggccugaag

SEQ ID NO: 834784 - RNA, 19 nt, Homo sapiens
gagaauuacaagaguccaa

SEQ ID NO: 834785 - RNA, 19 nt, Homo sapiens
gccucaagcauuagaacua

SEQ ID NO: 834786 - RNA, 19 nt, Homo sapiens
ugucccaagucgauugauu

SEQ ID NO: 834787 - RNA, 19 nt, Homo sapiens
auugaugucuccagauuca

SEQ ID NO: 834788 - RNA, 19 nt, Homo sapiens
ggucaucacccagaacauc

SEQ ID NO: 834789 - RNA, 19 nt, Homo sapiens
ucgauugauuucccagcua

SEQ ID NO: 834790 - RNA, 19 nt, Homo sapiens
gucccaagucgauugauuu

SEQ ID NO: 834791 - RNA, 19 nt, Homo sapiens
guuuagaaguagcaaagag

SEQ ID NO: 834792 - RNA, 19 nt, Homo sapiens
gagcugaguacugaacaau

SEQ ID NO: 834793 - RNA, 19 nt, Homo sapiens
ggaguuguggcugagaauu

SEQ ID NO: 834794 - RNA, 19 nt, Homo sapiens
guggaguuguggcugagaa

SEQ ID NO: 834795 - RNA, 19 nt, Homo sapiens
ucacccagaacaucgauga

SEQ ID NO: 834796 - RNA, 19 nt, Homo sapiens
cagauugucccaagucgau

SEQ ID NO: 834797 - RNA, 19 nt, Homo sapiens
ugaugucuccagauucaaa

SEQ ID NO: 834798 - RNA, 19 nt, Homo sapiens
ugaguacugaacaaucuaa

SEQ ID NO: 834799 - RNA, 19 nt, Homo sapiens
acagauucagguuucauuu

SEQ ID NO: 834800 - RNA, 19 nt, Homo sapiens
caauuuguccagcuuuauc

SEQ ID NO: 834801 - RNA, 19 nt, Homo sapiens
ggagcuggagguuauugga

SEQ ID NO: 834802 - RNA, 19 nt, Homo sapiens
ccucaagcauuagaacuac

SEQ ID NO: 834803 - RNA, 19 nt, Homo sapiens
guguaugguugguuauugg

SEQ ID NO: 834804 - RNA, 19 nt, Homo sapiens
uguguaugguugguuauug

SEQ ID NO: 834805 - RNA, 19 nt, Homo sapiens
ugaacugaaacgugaggua

SEQ ID NO: 834806 - RNA, 19 nt, Homo sapiens
aagagcacccacauucaaa

SEQ ID NO: 834807 - RNA, 19 nt, Homo sapiens
guccagcuuuaucaggaaa

SEQ ID NO: 834808 - RNA, 19 nt, Homo sapiens
aagcaaagcacauagucau

SEQ ID NO: 834809 - RNA, 19 nt, Homo sapiens
cuacagacaaacccugaug

SEQ ID NO: 834810 - RNA, 19 nt, Homo sapiens
gcacccacauucaaaaguc

SEQ ID NO: 834811 - RNA, 19 nt, Homo sapiens
ugagcugaguacugaacaa

SEQ ID NO: 834812 - RNA, 19 nt, Homo sapiens
cagauucagguuucauuuc

SEQ ID NO: 834813 - RNA, 19 nt, Homo sapiens
cgaacagauucagguuuca

SEQ ID NO: 834814 - RNA, 19 nt, Homo sapiens
ggaauaauguucucugcua

SEQ ID NO: 834815 - RNA, 19 nt, Homo sapiens
gaaagaaacugaacuuggu

SEQ ID NO: 834816 - RNA, 19 nt, Homo sapiens
ggagauccaugguagcuua

SEQ ID NO: 834817 - RNA, 19 nt, Homo sapiens
ugacagaggugaauaguug

SEQ ID NO: 834818 - RNA, 19 nt, Homo sapiens
caucaaagcugacauuuag

SEQ ID NO: 834819 - RNA, 19 nt, Homo sapiens
acacagagcuuaacaaugg

SEQ ID NO: 834820 - RNA, 19 nt, Homo sapiens
ccacaggaauguauuucua

SEQ ID NO: 834821 - RNA, 19 nt, Homo sapiens
gaacagauucagucauuug

SEQ ID NO: 834822 - RNA, 19 nt, Homo sapiens
guucuaaucuagugacaaa

SEQ ID NO: 834823 - RNA, 19 nt, Homo sapiens
cagaggagcuggagguuau

SEQ ID NO: 834824 - RNA, 19 nt, Homo sapiens
guucaaguauggcagauuu

SEQ ID NO: 834825 - RNA, 19 nt, Homo sapiens
gaugcgaccucuccagauu

SEQ ID NO: 834826 - RNA, 19 nt, Homo sapiens
ggauuuggaucucacaaga

SEQ ID NO: 834827 - RNA, 19 nt, Homo sapiens
aggaguaacugaucaauga

SEQ ID NO: 834828 - RNA, 19 nt, Homo sapiens
cuagaaugcugccuauauu

SEQ ID NO: 834829 - RNA, 19 nt, Homo sapiens
gauccaugguagcuuauuu

SEQ ID NO: 834830 - RNA, 19 nt, Homo sapiens
cauuagaacuacagacaaa

SEQ ID NO: 834831 - RNA, 19 nt, Homo sapiens
gagacaaccaucuucauuu

SEQ ID NO: 834832 - RNA, 19 nt, Homo sapiens
gcacauagucaucaucuca

SEQ ID NO: 834833 - RNA, 19 nt, Homo sapiens
ggagacaaccaucuucauu

SEQ ID NO: 834834 - RNA, 19 nt, Homo sapiens
caauaaacccuaggcauuu

SEQ ID NO: 834835 - RNA, 19 nt, Homo sapiens
ccaauaaacccuaggcauu

SEQ ID NO: 834836 - RNA, 19 nt, Homo sapiens
ccaccuguaucuguaaaua

SEQ ID NO: 834837 - RNA, 19 nt, Homo sapiens
caauugagaggacuguuua

SEQ ID NO: 834838 - RNA, 19 nt, Homo sapiens
gaaaccagauuugccugaa

SEQ ID NO: 834839 - RNA, 19 nt, Homo sapiens
ugacaaaggcauagaauuc

SEQ ID NO: 834840 - RNA, 19 nt, Homo sapiens
gcaauugagaggacuguuu

SEQ ID NO: 834841 - RNA, 19 nt, Homo sapiens
gagagauucuuggcaugua

SEQ ID NO: 834842 - RNA, 19 nt, Homo sapiens
caauuuggcaagcuacuua

SEQ ID NO: 834843 - RNA, 19 nt, Homo sapiens
gcaagaaaaugcagauaga

SEQ ID NO: 834844 - RNA, 19 nt, Homo sapiens
gcuagaaugcugccuauau

SEQ ID NO: 834845 - RNA, 19 nt, Homo sapiens
ccacugugauuuaugucua

SEQ ID NO: 834846 - RNA, 19 nt, Homo sapiens
uaaauaggcagcuagaaug

SEQ ID NO: 834847 - RNA, 19 nt, Homo sapiens
gcuuaacaauggcagaauu

SEQ ID NO: 834848 - RNA, 19 nt, Homo sapiens
gaucucacaagacaccuua

SEQ ID NO: 834849 - RNA, 19 nt, Homo sapiens
gcuacuugcuaguuagaaa

SEQ ID NO: 834850 - RNA, 19 nt, Homo sapiens
acgaacagauucagucauu

SEQ ID NO: 834851 - RNA, 19 nt, Homo sapiens
gaguuguggcugagaauua

SEQ ID NO: 834852 - RNA, 19 nt, Homo sapiens
gaagagaugcuggugauag

SEQ ID NO: 834853 - RNA, 19 nt, Homo sapiens
gaaagcagccguggagaca

SEQ ID NO: 834854 - RNA, 19 nt, Homo sapiens
uagaagagaugcuggugau

SEQ ID NO: 834855 - RNA, 19 nt, Homo sapiens
caaccagacugaccacaag

SEQ ID NO: 834856 - RNA, 19 nt, Homo sapiens
guacccagcagccauguuu

SEQ ID NO: 834857 - RNA, 19 nt, Homo sapiens
acaggcuacuugcuaguua

SEQ ID NO: 834858 - RNA, 19 nt, Homo sapiens
guaaauaagguuucauugg

SEQ ID NO: 834859 - RNA, 19 nt, Homo sapiens
caucucauccuacucaauu

SEQ ID NO: 834860 - RNA, 19 nt, Homo sapiens
aaaccuggauccugccauu

SEQ ID NO: 834861 - RNA, 19 nt, Homo sapiens
gaaccuggaacucaagaug

SEQ ID NO: 834862 - RNA, 19 nt, Homo sapiens
gcaaagcacauagucauca

SEQ ID NO: 834863 - RNA, 19 nt, Homo sapiens
gaucaaauuagaagucugu

SEQ ID NO: 834864 - RNA, 19 nt, Homo sapiens
cauguccgaugcuuauauu

SEQ ID NO: 834865 - RNA, 19 nt, Homo sapiens
aaccaacccuggagcaauu

SEQ ID NO: 834866 - RNA, 19 nt, Homo sapiens
gcaagcuacuuaucaacca

SEQ ID NO: 834867 - RNA, 19 nt, Homo sapiens
acaaacaggcuacuugcua

SEQ ID NO: 834868 - RNA, 19 nt, Homo sapiens
uggaggagguugacagaga

SEQ ID NO: 834869 - RNA, 19 nt, Homo sapiens
uuguauaucucgugcuuaa

SEQ ID NO: 834870 - RNA, 19 nt, Homo sapiens
aaacacagagcuuaacaau

SEQ ID NO: 834871 - RNA, 19 nt, Homo sapiens
cuaaauaggcagcuagaau

SEQ ID NO: 834872 - RNA, 19 nt, Homo sapiens
ggugaauaguugcaacaga

SEQ ID NO: 834873 - RNA, 19 nt, Homo sapiens
ucaaagcugacauuuagaa

SEQ ID NO: 834874 - RNA, 19 nt, Homo sapiens
cagauucagucauuugauc

SEQ ID NO: 834875 - RNA, 19 nt, Homo sapiens
gcaaggcuggcaccaagaa

SEQ ID NO: 834876 - RNA, 19 nt, Homo sapiens
aaaccagauuugccugaaa

SEQ ID NO: 834877 - RNA, 19 nt, Homo sapiens
ucaucaaagcugacauuua

SEQ ID NO: 834878 - RNA, 19 nt, Homo sapiens
gcacuuccucuguggugua

SEQ ID NO: 834879 - RNA, 19 nt, Homo sapiens
gcucgcccacugugauuua

SEQ ID NO: 834880 - RNA, 19 nt, Homo sapiens
cagcaucccaguugagaaa

SEQ ID NO: 834881 - RNA, 19 nt, Homo sapiens
ccaguaaauggaaauguuu

SEQ ID NO: 834882 - RNA, 19 nt, Homo sapiens
gaugauuucugauaaaccu

SEQ ID NO: 834883 - RNA, 19 nt, Homo sapiens
aaccuaugauugucucuaa

SEQ ID NO: 834884 - RNA, 19 nt, Homo sapiens
cccaguaaauggaaauguu

SEQ ID NO: 834885 - RNA, 19 nt, Homo sapiens
gaaugcugccuauauuuua

SEQ ID NO: 834886 - RNA, 19 nt, Homo sapiens
guguggcccuuuacagaaa

SEQ ID NO: 834887 - RNA, 19 nt, Homo sapiens
agagauucuuggcauguaa

SEQ ID NO: 834888 - RNA, 19 nt, Homo sapiens
cgaacagauucagucauuu

SEQ ID NO: 834889 - RNA, 19 nt, Homo sapiens
agacaaccaucuucauuuu

SEQ ID NO: 834890 - RNA, 19 nt, Homo sapiens
caaagcacauagucaucau

SEQ ID NO: 834891 - RNA, 19 nt, Homo sapiens
cugauaaaccugacuauuc

SEQ ID NO: 834892 - RNA, 19 nt, Homo sapiens
caagucaucauuguagaaa

SEQ ID NO: 834893 - RNA, 19 nt, Homo sapiens
ugauaaaccugacuauucc

SEQ ID NO: 834894 - RNA, 19 nt, Homo sapiens
caaguuguucagauucuuu

SEQ ID NO: 834895 - RNA, 19 nt, Homo sapiens
guggccauauguuuguaua

SEQ ID NO: 834896 - RNA, 19 nt, Homo sapiens
uccaauuuguccagcuuua

SEQ ID NO: 834897 - RNA, 19 nt, Homo sapiens
uagaaugcugccuauauuu

SEQ ID NO: 834898 - RNA, 19 nt, Homo sapiens
auauugaugucuccagauu

SEQ ID NO: 834899 - RNA, 19 nt, Homo sapiens
aagcugacauuuagaagag

SEQ ID NO: 834900 - RNA, 19 nt, Homo sapiens
gaaacugaacuuggugguu

SEQ ID NO: 834901 - RNA, 19 nt, Homo sapiens
cgauugauuucccagcuau

SEQ ID NO: 834902 - RNA, 19 nt, Homo sapiens
gcucggccaaguucaagua

SEQ ID NO: 834903 - RNA, 19 nt, Homo sapiens
guauaucucgugcuuaaca

SEQ ID NO: 834904 - RNA, 19 nt, Homo sapiens
gaaaccaacccuggagcaa

SEQ ID NO: 834905 - RNA, 19 nt, Homo sapiens
caucaucaaagcugacauu

SEQ ID NO: 834906 - RNA, 19 nt, Homo sapiens
cuaacaaacaggcuacuug

SEQ ID NO: 834907 - RNA, 19 nt, Homo sapiens
uaucacugcucaagucaag

SEQ ID NO: 834908 - RNA, 19 nt, Homo sapiens
gucuccagauucaaauaua

SEQ ID NO: 834909 - RNA, 19 nt, Homo sapiens
uccaucucaucucuaauua

SEQ ID NO: 834910 - RNA, 19 nt, Homo sapiens
guccgaugcuuauauugga

SEQ ID NO: 834911 - RNA, 19 nt, Homo sapiens
cagcuguggccauauguuu

SEQ ID NO: 834912 - RNA, 19 nt, Homo sapiens
ugauagucaucucauccua

SEQ ID NO: 834913 - RNA, 19 nt, Homo sapiens
ucaagguguuaauuaguuc

SEQ ID NO: 834914 - RNA, 19 nt, Homo sapiens
guaaaugccuucucaaaug

SEQ ID NO: 834915 - RNA, 19 nt, Homo sapiens
gaacagggacuuucacuug

SEQ ID NO: 834916 - RNA, 19 nt, Homo sapiens
gaucauccuugcagguaua

SEQ ID NO: 834917 - RNA, 19 nt, Homo sapiens
uaaaugccuucucaaauga

SEQ ID NO: 834918 - RNA, 19 nt, Homo sapiens
gcaggaaucuccaccgaau

SEQ ID NO: 834919 - RNA, 19 nt, Homo sapiens
gaaagccuccauuggguua

SEQ ID NO: 834920 - RNA, 19 nt, Homo sapiens
gaaucuugcugcuaaaugu

SEQ ID NO: 834921 - RNA, 19 nt, Homo sapiens
gaaacugaauucucguugu

SEQ ID NO: 834922 - RNA, 19 nt, Homo sapiens
gagaagaagcucccgauug

SEQ ID NO: 834923 - RNA, 19 nt, Homo sapiens
gcaagagcguuuccaaguc

SEQ ID NO: 834924 - RNA, 19 nt, Homo sapiens
ucggaaagcuguacugguu

SEQ ID NO: 834925 - RNA, 19 nt, Homo sapiens
gcacaagcguguaaaagaa

SEQ ID NO: 834926 - RNA, 19 nt, Homo sapiens
gagaguugcugccuuugau

SEQ ID NO: 834927 - RNA, 19 nt, Homo sapiens
gcacugacaaaguauagaa

SEQ ID NO: 834928 - RNA, 19 nt, Homo sapiens
guggagaguugcugccuuu

SEQ ID NO: 834929 - RNA, 19 nt, Homo sapiens
agaagaagcucccgauugc

SEQ ID NO: 834930 - RNA, 19 nt, Homo sapiens
aagaugagcuuugcguuga

SEQ ID NO: 834931 - RNA, 19 nt, Homo sapiens
gaagguucuagguaucuua

SEQ ID NO: 834932 - RNA, 19 nt, Homo sapiens
gaaugaagaugagcuuugc

SEQ ID NO: 834933 - RNA, 19 nt, Homo sapiens
gaagcucccgauugcaaua

SEQ ID NO: 834934 - RNA, 19 nt, Homo sapiens
aaauguaaaugccuucuca

SEQ ID NO: 834935 - RNA, 19 nt, Homo sapiens
aaacugaauucucguugug

SEQ ID NO: 834936 - RNA, 19 nt, Homo sapiens
ugagaaggucaaagaguua

SEQ ID NO: 834937 - RNA, 19 nt, Homo sapiens
ugacuuggcgugucugaaa

SEQ ID NO: 834938 - RNA, 19 nt, Homo sapiens
cugagaaggucaaagaguu

SEQ ID NO: 834939 - RNA, 19 nt, Homo sapiens
gagcaaguccggagcuuuc

SEQ ID NO: 834940 - RNA, 19 nt, Homo sapiens
gguucuagguaucuuaaug

SEQ ID NO: 834941 - RNA, 19 nt, Homo sapiens
guagagcugugagagaaug

SEQ ID NO: 834942 - RNA, 19 nt, Homo sapiens
agggugcacugacaaagua

SEQ ID NO: 834943 - RNA, 19 nt, Homo sapiens
ggagaguugcugccuuuga

SEQ ID NO: 834944 - RNA, 19 nt, Homo sapiens
caaaugacagauuccaguu

SEQ ID NO: 834945 - RNA, 19 nt, Homo sapiens
ccguagagcugugagagaa

SEQ ID NO: 834946 - RNA, 19 nt, Homo sapiens
acuugaaucuugcugcuaa

SEQ ID NO: 834947 - RNA, 19 nt, Homo sapiens
guacugggcgagaaacuuc

SEQ ID NO: 834948 - RNA, 19 nt, Homo sapiens
aacagggacuuucacuuga

SEQ ID NO: 834949 - RNA, 19 nt, Homo sapiens
gggagaaacucggaaagcu

SEQ ID NO: 834950 - RNA, 19 nt, Homo sapiens
gcagguauacucugguuac

SEQ ID NO: 834951 - RNA, 19 nt, Homo sapiens
uggcgugucugaaacugaa

SEQ ID NO: 834952 - RNA, 19 nt, Homo sapiens
ugugagagaaugaagauga

SEQ ID NO: 834953 - RNA, 19 nt, Homo sapiens
caucacccuuuccaagaga

SEQ ID NO: 834954 - RNA, 19 nt, Homo sapiens
ggaacagggacuuucacuu

SEQ ID NO: 834955 - RNA, 19 nt, Homo sapiens
ugacaaaguauagaagguu

SEQ ID NO: 834956 - RNA, 19 nt, Homo sapiens
agaguagggugcacugaca

SEQ ID NO: 834957 - RNA, 19 nt, Homo sapiens
cuucucaaaugacagauuc

SEQ ID NO: 834958 - RNA, 19 nt, Homo sapiens
uguaaaugccuucucaaau

SEQ ID NO: 834959 - RNA, 19 nt, Homo sapiens
caauguggaggccaucuga

SEQ ID NO: 834960 - RNA, 19 nt, Homo sapiens
ccaguucccauucaacaga

SEQ ID NO: 834961 - RNA, 19 nt, Homo sapiens
auacucugguuacagguuu

SEQ ID NO: 834962 - RNA, 19 nt, Homo sapiens
cuuaauguguggauauucu

SEQ ID NO: 834963 - RNA, 19 nt, Homo sapiens
agaaugaagaugagcuuug

SEQ ID NO: 834964 - RNA, 19 nt, Homo sapiens
gaccacagccugauauucc

SEQ ID NO: 834965 - RNA, 19 nt, Homo sapiens
gagaaugaagaugagcuuu

SEQ ID NO: 834966 - RNA, 19 nt, Homo sapiens
ggagcaaguccggagcuuu

SEQ ID NO: 834967 - RNA, 19 nt, Homo sapiens
gauuccaguucccauucaa

SEQ ID NO: 834968 - RNA, 19 nt, Homo sapiens
gcucgaaagccuccauugg

SEQ ID NO: 834969 - RNA, 19 nt, Homo sapiens
gugagagaaugaagaugag

SEQ ID NO: 834970 - RNA, 19 nt, Homo sapiens
aagaagcucccgauugcaa

SEQ ID NO: 834971 - RNA, 19 nt, Homo sapiens
guucuagguaucuuaaugu

SEQ ID NO: 834972 - RNA, 19 nt, Homo sapiens
gcugugagagaaugaagau

SEQ ID NO: 834973 - RNA, 19 nt, Homo sapiens
cccaaaauguggaugcuuu

SEQ ID NO: 834974 - RNA, 19 nt, Homo sapiens
gauggugacgucuuucucu

SEQ ID NO: 834975 - RNA, 19 nt, Homo sapiens
agaagccgacucccucuug

SEQ ID NO: 834976 - RNA, 19 nt, Homo sapiens
ccagacuacaggucagaaa

SEQ ID NO: 834977 - RNA, 19 nt, Homo sapiens
cgauugcaauacugaacau

SEQ ID NO: 834978 - RNA, 19 nt, Homo sapiens
gaguuacagcgcuucauca

SEQ ID NO: 834979 - RNA, 19 nt, Homo sapiens
cagcgguacugggcgagaa

SEQ ID NO: 834980 - RNA, 19 nt, Homo sapiens
ccacacggucggaugacuu

SEQ ID NO: 834981 - RNA, 19 nt, Homo sapiens
gucccaaccugcguucaau

SEQ ID NO: 834982 - RNA, 19 nt, Homo sapiens
ggucccaaccugcguucaa

SEQ ID NO: 834983 - RNA, 19 nt, Homo sapiens
ucaucacccuuuccaagag

SEQ ID NO: 834984 - RNA, 19 nt, Homo sapiens
ugcaagagcguuuccaagu

SEQ ID NO: 834985 - RNA, 19 nt, Homo sapiens
aagagacuccuugugauga

SEQ ID NO: 834986 - RNA, 19 nt, Homo sapiens
gagcuuugcguugacuuuc

SEQ ID NO: 834987 - RNA, 19 nt, Homo sapiens
gaguugcugccuuugauag

SEQ ID NO: 834988 - RNA, 19 nt, Homo sapiens
cggaugacuuggcgugucu

SEQ ID NO: 834989 - RNA, 19 nt, Homo sapiens
uugcagguauacucugguu

SEQ ID NO: 834990 - RNA, 19 nt, Homo sapiens
cauccagcauggugauuuu

SEQ ID NO: 834991 - RNA, 19 nt, Homo sapiens
ggugcacugacaaaguaua

SEQ ID NO: 834992 - RNA, 19 nt, Homo sapiens
ugaaucuugcugcuaaaug

SEQ ID NO: 834993 - RNA, 19 nt, Homo sapiens
caacgucacucacuacuuu

SEQ ID NO: 834994 - RNA, 19 nt, Homo sapiens
gaacucccauucuucuuuc

SEQ ID NO: 834995 - RNA, 19 nt, Homo sapiens
gaacaucgaugggcuugag

SEQ ID NO: 834996 - RNA, 19 nt, Homo sapiens
ggaguggccuguacagcaa

SEQ ID NO: 834997 - RNA, 19 nt, Homo sapiens
cagaauaugugaacugagu

SEQ ID NO: 834998 - RNA, 19 nt, Homo sapiens
gaccgagucugcuuucugu

SEQ ID NO: 834999 - RNA, 19 nt, Homo sapiens
ggagcugccugccuguuug

SEQ ID NO: 835000 - RNA, 19 nt, Homo sapiens
ccacuggaaugucuucuca

SEQ ID NO: 835001 - RNA, 19 nt, Homo sapiens
acagcaaccuccagcagua

SEQ ID NO: 835002 - RNA, 19 nt, Homo sapiens
guuccgaaguguagucuug

SEQ ID NO: 835003 - RNA, 19 nt, Homo sapiens
gccaugagcugcagugacu

SEQ ID NO: 835004 - RNA, 19 nt, Homo sapiens
ggcagcagcucccaguuuc

SEQ ID NO: 835005 - RNA, 19 nt, Homo sapiens
gcaggugaaaccagaauau

SEQ ID NO: 835006 - RNA, 19 nt, Homo sapiens
gcauguuggucuccuuuag

SEQ ID NO: 835007 - RNA, 19 nt, Homo sapiens
gggcagcagcucccaguuu

SEQ ID NO: 835008 - RNA, 19 nt, Homo sapiens
ugaaucagaccaacuggaa

SEQ ID NO: 835009 - RNA, 19 nt, Homo sapiens
gcuguacccuggaaacuac

SEQ ID NO: 835010 - RNA, 19 nt, Homo sapiens
ggugaaaccagaauaugug

SEQ ID NO: 835011 - RNA, 19 nt, Homo sapiens
gaccagacaaauaggauga

SEQ ID NO: 835012 - RNA, 19 nt, Homo sapiens
ugaacucccauucuucuuu

SEQ ID NO: 835013 - RNA, 19 nt, Homo sapiens
gcucggcaucuguugguua

SEQ ID NO: 835014 - RNA, 19 nt, Homo sapiens
gaaacugggaagcuugaug

SEQ ID NO: 835015 - RNA, 19 nt, Homo sapiens
gaaaccagaauaugugaac

SEQ ID NO: 835016 - RNA, 19 nt, Homo sapiens
gcgggaaacugggaagcuu

SEQ ID NO: 835017 - RNA, 19 nt, Homo sapiens
ucgaugggcuugagagagu

SEQ ID NO: 835018 - RNA, 19 nt, Homo sapiens
ccaguggcauuccagacuu

SEQ ID NO: 835019 - RNA, 19 nt, Homo sapiens
ugaagcucauggaaccuuu

SEQ ID NO: 835020 - RNA, 19 nt, Homo sapiens
aaagcuuucuucugacugu

SEQ ID NO: 835021 - RNA, 19 nt, Homo sapiens
ccagacaaauaggaugaug

SEQ ID NO: 835022 - RNA, 19 nt, Homo sapiens
gaaacuacaagcccaacgu

SEQ ID NO: 835023 - RNA, 19 nt, Homo sapiens
uacauuuagucuccucaaa

SEQ ID NO: 835024 - RNA, 19 nt, Homo sapiens
gcccgacauuguguucuuu

SEQ ID NO: 835025 - RNA, 19 nt, Homo sapiens
cauuuagucuccucaaagg

SEQ ID NO: 835026 - RNA, 19 nt, Homo sapiens
cggcaucuguugguuacaa

SEQ ID NO: 835027 - RNA, 19 nt, Homo sapiens
gggaaacugggaagcuuga

SEQ ID NO: 835028 - RNA, 19 nt, Homo sapiens
cauucgggcugacgugaug

SEQ ID NO: 835029 - RNA, 19 nt, Homo sapiens
gaaguggaggcagcaguga

SEQ ID NO: 835030 - RNA, 19 nt, Homo sapiens
cugaagcuccuaauggaaa

SEQ ID NO: 835031 - RNA, 19 nt, Homo sapiens
agacauccacaucccaauu

SEQ ID NO: 835032 - RNA, 19 nt, Homo sapiens
uugauggaccagacaaaua

SEQ ID NO: 835033 - RNA, 19 nt, Homo sapiens
gacauccacaucccaauuc

SEQ ID NO: 835034 - RNA, 19 nt, Homo sapiens
ugauggaccagacaaauag

SEQ ID NO: 835035 - RNA, 19 nt, Homo sapiens
gggcuggacagaagagaug

SEQ ID NO: 835036 - RNA, 19 nt, Homo sapiens
cagcacacccaguggcauu

SEQ ID NO: 835037 - RNA, 19 nt, Homo sapiens
gugggugcuucaaguguug

SEQ ID NO: 835038 - RNA, 19 nt, Homo sapiens
ccgcacuucuagcauguug

SEQ ID NO: 835039 - RNA, 19 nt, Homo sapiens
ccacaucccaauucugaca

SEQ ID NO: 835040 - RNA, 19 nt, Homo sapiens
cauaggagacauccacauc

SEQ ID NO: 835041 - RNA, 19 nt, Homo sapiens
caauaaaugguaacauagg

SEQ ID NO: 835042 - RNA, 19 nt, Homo sapiens
gcucaucaaccgggacuug

SEQ ID NO: 835043 - RNA, 19 nt, Homo sapiens
gaagcccgacauuguguuc

SEQ ID NO: 835044 - RNA, 19 nt, Homo sapiens
gcacuucuagcauguuggu

SEQ ID NO: 835045 - RNA, 19 nt, Homo sapiens
gugacccucuugaacugaa

SEQ ID NO: 835046 - RNA, 19 nt, Homo sapiens
ugacugugacccucuugaa

SEQ ID NO: 835047 - RNA, 19 nt, Homo sapiens
ugcugaagcuccuaaugga

SEQ ID NO: 835048 - RNA, 19 nt, Homo sapiens
gugaaaccagaauauguga

SEQ ID NO: 835049 - RNA, 19 nt, Homo sapiens
cccuggagguggagccuuu

SEQ ID NO: 835050 - RNA, 19 nt, Homo sapiens
gaaucagaccaacuggaau

SEQ ID NO: 835051 - RNA, 19 nt, Homo sapiens
gcugaagcuccuaauggaa

SEQ ID NO: 835052 - RNA, 19 nt, Homo sapiens
ucuguucuuuccagcauga

SEQ ID NO: 835053 - RNA, 19 nt, Homo sapiens
accagaauaugugaacuga

SEQ ID NO: 835054 - RNA, 19 nt, Homo sapiens
gaagcucauggaaccuuug

SEQ ID NO: 835055 - RNA, 19 nt, Homo sapiens
caagaccucaugccugaag

SEQ ID NO: 835056 - RNA, 19 nt, Homo sapiens
ugugggugcuucaaguguu

SEQ ID NO: 835057 - RNA, 19 nt, Homo sapiens
gcaagcucggcaucuguug

SEQ ID NO: 835058 - RNA, 19 nt, Homo sapiens
gcucccaguuucuucuuuu

SEQ ID NO: 835059 - RNA, 19 nt, Homo sapiens
ggcaagcucggcaucuguu

SEQ ID NO: 835060 - RNA, 19 nt, Homo sapiens
cccacacaauaaaugguaa

SEQ ID NO: 835061 - RNA, 19 nt, Homo sapiens
aaucuguucuuuccagcau

SEQ ID NO: 835062 - RNA, 19 nt, Homo sapiens
cagcagcucccaguuucuu

SEQ ID NO: 835063 - RNA, 19 nt, Homo sapiens
uagcauguuggucuccuuu

SEQ ID NO: 835064 - RNA, 19 nt, Homo sapiens
aaggagcuguacccuggaa

SEQ ID NO: 835065 - RNA, 19 nt, Homo sapiens
aaucagaccaacuggaauc

SEQ ID NO: 835066 - RNA, 19 nt, Homo sapiens
cugcacagucugccaaaga

SEQ ID NO: 835067 - RNA, 19 nt, Homo sapiens
gaacaucacuccuaaauua

SEQ ID NO: 835068 - RNA, 19 nt, Homo sapiens
ccagaaagguguaauauuu

SEQ ID NO: 835069 - RNA, 19 nt, Homo sapiens
gcuaagaauuucaggauua

SEQ ID NO: 835070 - RNA, 19 nt, Homo sapiens
ggaaauauauccuggacaa

SEQ ID NO: 835071 - RNA, 19 nt, Homo sapiens
caaaugacaugcaguguga

SEQ ID NO: 835072 - RNA, 19 nt, Homo sapiens
ugaagugccucagauauua

SEQ ID NO: 835073 - RNA, 19 nt, Homo sapiens
ugaagaugcugugaaauua

SEQ ID NO: 835074 - RNA, 19 nt, Homo sapiens
caucuugccugauuuguaa

SEQ ID NO: 835075 - RNA, 19 nt, Homo sapiens
guacaaacuucuaggaaug

SEQ ID NO: 835076 - RNA, 19 nt, Homo sapiens
gaagauggcuuuuguacuu

SEQ ID NO: 835077 - RNA, 19 nt, Homo sapiens
ggaugaaagugaaauugaa

SEQ ID NO: 835078 - RNA, 19 nt, Homo sapiens
agaaggaagucaacaauau

SEQ ID NO: 835079 - RNA, 19 nt, Homo sapiens
agaauuggcuuauuuguca

SEQ ID NO: 835080 - RNA, 19 nt, Homo sapiens
gcaaaggagcagauuagua

SEQ ID NO: 835081 - RNA, 19 nt, Homo sapiens
gaaguugaccuccucauug

SEQ ID NO: 835082 - RNA, 19 nt, Homo sapiens
cuagugaguuucaacauuu

SEQ ID NO: 835083 - RNA, 19 nt, Homo sapiens
gcacaguaagcauuuauuu

SEQ ID NO: 835084 - RNA, 19 nt, Homo sapiens
gcagaauaguuaaugaaug

SEQ ID NO: 835085 - RNA, 19 nt, Homo sapiens
ggacugcuguuuuccauua

SEQ ID NO: 835086 - RNA, 19 nt, Homo sapiens
ccaucggaauguuaaauua

SEQ ID NO: 835087 - RNA, 19 nt, Homo sapiens
guaggcggcuugaugguaa

SEQ ID NO: 835088 - RNA, 19 nt, Homo sapiens
guauuccucuguugcuuua

SEQ ID NO: 835089 - RNA, 19 nt, Homo sapiens
gcgauuggguaccgagaua

SEQ ID NO: 835090 - RNA, 19 nt, Homo sapiens
gaacuauccaucaaacaaa

SEQ ID NO: 835091 - RNA, 19 nt, Homo sapiens
caaaggagcagauuaguag

SEQ ID NO: 835092 - RNA, 19 nt, Homo sapiens
gauagagccucacaugcaa

SEQ ID NO: 835093 - RNA, 19 nt, Homo sapiens
uguacaaacucaacacuaa

SEQ ID NO: 835094 - RNA, 19 nt, Homo sapiens
uagguuagguggugaauau

SEQ ID NO: 835095 - RNA, 19 nt, Homo sapiens
gaacauagacacgcuggaa

SEQ ID NO: 835096 - RNA, 19 nt, Homo sapiens
gggaggauuugguguuaaa

SEQ ID NO: 835097 - RNA, 19 nt, Homo sapiens
gcacagauccucgaacaau

SEQ ID NO: 835098 - RNA, 19 nt, Homo sapiens
uaacagacaugaacuaucc

SEQ ID NO: 835099 - RNA, 19 nt, Homo sapiens
gaugacgucuuauccucua

SEQ ID NO: 835100 - RNA, 19 nt, Homo sapiens
gauccucgaacaauucuua

SEQ ID NO: 835101 - RNA, 19 nt, Homo sapiens
ggauagguccauauacuuu

SEQ ID NO: 835102 - RNA, 19 nt, Homo sapiens
gacaugaacuauccaucaa

SEQ ID NO: 835103 - RNA, 19 nt, Homo sapiens
gaacuucaccaccagauuc

SEQ ID NO: 835104 - RNA, 19 nt, Homo sapiens
caagcgauguuugauauug

SEQ ID NO: 835105 - RNA, 19 nt, Homo sapiens
gaccauuacugccagagaa

SEQ ID NO: 835106 - RNA, 19 nt, Homo sapiens
ucaaucagcuguuggucaa

SEQ ID NO: 835107 - RNA, 19 nt, Homo sapiens
cuaggaauguugaaaguau

SEQ ID NO: 835108 - RNA, 19 nt, Homo sapiens
uagcuguucuuuaugcaua

SEQ ID NO: 835109 - RNA, 19 nt, Homo sapiens
ggcaauuaaugaagcuaua

SEQ ID NO: 835110 - RNA, 19 nt, Homo sapiens
agaaaaugcuggccuaaua

SEQ ID NO: 835111 - RNA, 19 nt, Homo sapiens
ccacaccucuucauguuuc

SEQ ID NO: 835112 - RNA, 19 nt, Homo sapiens
ugacaaagaugaaguugac

SEQ ID NO: 835113 - RNA, 19 nt, Homo sapiens
gaaggaagucaacaauaug

SEQ ID NO: 835114 - RNA, 19 nt, Homo sapiens
gucaagggaugguauuuau

SEQ ID NO: 835115 - RNA, 19 nt, Homo sapiens
ucagcaacaucuuaugauu

SEQ ID NO: 835116 - RNA, 19 nt, Homo sapiens
gauguaacuuguaauagca

SEQ ID NO: 835117 - RNA, 19 nt, Homo sapiens
ccacggauagguccauaua

SEQ ID NO: 835118 - RNA, 19 nt, Homo sapiens
gaucaagaggcaauuaaug

SEQ ID NO: 835119 - RNA, 19 nt, Homo sapiens
ggauagagccucacaugca

SEQ ID NO: 835120 - RNA, 19 nt, Homo sapiens
ggucaagggaugguauuua

SEQ ID NO: 835121 - RNA, 19 nt, Homo sapiens
uguggcagauuguuauuaa

SEQ ID NO: 835122 - RNA, 19 nt, Homo sapiens
gauaucuuccuucaacuuu

SEQ ID NO: 835123 - RNA, 19 nt, Homo sapiens
aagcuuagccugccuuaaa

SEQ ID NO: 835124 - RNA, 19 nt, Homo sapiens
auacaaaguugacugugaa

SEQ ID NO: 835125 - RNA, 19 nt, Homo sapiens
caacuauacccagaacaua

SEQ ID NO: 835126 - RNA, 19 nt, Homo sapiens
gaauuuauuuggcuacacu

SEQ ID NO: 835127 - RNA, 19 nt, Homo sapiens
cagcuaagaguaaugauga

SEQ ID NO: 835128 - RNA, 19 nt, Homo sapiens
gaagugccucagauauuaa

SEQ ID NO: 835129 - RNA, 19 nt, Homo sapiens
auagagccaugaaguauga

SEQ ID NO: 835130 - RNA, 19 nt, Homo sapiens
caccugaguuggaugauau

SEQ ID NO: 835131 - RNA, 19 nt, Homo sapiens
caaaaucuguuacgcuaaa

SEQ ID NO: 835132 - RNA, 19 nt, Homo sapiens
guugaccuccucauuguua

SEQ ID NO: 835133 - RNA, 19 nt, Homo sapiens
caugaaguaugacaaagau

SEQ ID NO: 835134 - RNA, 19 nt, Homo sapiens
ggccauuucccuacuuaua

SEQ ID NO: 835135 - RNA, 19 nt, Homo sapiens
guaauucagccagaaagua

SEQ ID NO: 835136 - RNA, 19 nt, Homo sapiens
ggagagcacucgguugucu

SEQ ID NO: 835137 - RNA, 19 nt, Homo sapiens
cagcuaaucuagaccaaag

SEQ ID NO: 835138 - RNA, 19 nt, Homo sapiens
ggaaguaacagacaugaac

SEQ ID NO: 835139 - RNA, 19 nt, Homo sapiens
ccauggcgcugagguauau

SEQ ID NO: 835140 - RNA, 19 nt, Homo sapiens
aauacaaaguugacuguga

SEQ ID NO: 835141 - RNA, 19 nt, Homo sapiens
aauugaagaugcugugaaa

SEQ ID NO: 835142 - RNA, 19 nt, Homo sapiens
ucuguucggugaugaaauu

SEQ ID NO: 835143 - RNA, 19 nt, Homo sapiens
gccauuucccuacuuauaa

SEQ ID NO: 835144 - RNA, 19 nt, Homo sapiens
uaaagggacagcuaaucua

SEQ ID NO: 835145 - RNA, 19 nt, Homo sapiens
uacaauggcuuagaagaug

SEQ ID NO: 835146 - RNA, 19 nt, Homo sapiens
cuaauagaguggcaaagga

SEQ ID NO: 835147 - RNA, 19 nt, Homo sapiens
ccagaacaguuucauagag

SEQ ID NO: 835148 - RNA, 19 nt, Homo sapiens
ccaccugaguuggaugaua

SEQ ID NO: 835149 - RNA, 19 nt, Homo sapiens
aaagauuuauugccggaaa

SEQ ID NO: 835150 - RNA, 19 nt, Homo sapiens
gcaugauguuugugugcua

SEQ ID NO: 835151 - RNA, 19 nt, Homo sapiens
cuuauaagaugucucaauc

SEQ ID NO: 835152 - RNA, 19 nt, Homo sapiens
guauuaaacugccaaaaug

SEQ ID NO: 835153 - RNA, 19 nt, Homo sapiens
gaaguaugacaaagaugaa

SEQ ID NO: 835154 - RNA, 19 nt, Homo sapiens
ugaaguaugacaaagauga

SEQ ID NO: 835155 - RNA, 19 nt, Homo sapiens
ucagguaguuccucgaugu

SEQ ID NO: 835156 - RNA, 19 nt, Homo sapiens
gaaaacuacuucgcaacua

SEQ ID NO: 835157 - RNA, 19 nt, Homo sapiens
ugaguuggaugauaugaca

SEQ ID NO: 835158 - RNA, 19 nt, Homo sapiens
gaaauauuugccauuguug

SEQ ID NO: 835159 - RNA, 19 nt, Homo sapiens
caaacucaacacuaacuuu

SEQ ID NO: 835160 - RNA, 19 nt, Homo sapiens
agacucaaguucaccagaa

SEQ ID NO: 835161 - RNA, 19 nt, Homo sapiens
ggucuucccucaaaguaag

SEQ ID NO: 835162 - RNA, 19 nt, Homo sapiens
aauauauccuggacaauuc

SEQ ID NO: 835163 - RNA, 19 nt, Homo sapiens
uagaaggaagucaacaaua

SEQ ID NO: 835164 - RNA, 19 nt, Homo sapiens
ucuagugaguuucaacauu

SEQ ID NO: 835165 - RNA, 19 nt, Homo sapiens
gcagguacaggaauuguuc

SEQ ID NO: 835166 - RNA, 19 nt, Homo sapiens
uguaauaauugugcaggua

SEQ ID NO: 835167 - RNA, 19 nt, Homo sapiens
guacagaccugcauauuug

SEQ ID NO: 835168 - RNA, 19 nt, Homo sapiens
gaaaggaaguagacaguau

SEQ ID NO: 835169 - RNA, 19 nt, Homo sapiens
gcagaucucucccucauau

SEQ ID NO: 835170 - RNA, 19 nt, Homo sapiens
aguaguaacuguccauuua

SEQ ID NO: 835171 - RNA, 19 nt, Homo sapiens
ccaaguauuugaaucguuu

SEQ ID NO: 835172 - RNA, 19 nt, Homo sapiens
cuagaagacuguaaauuug

SEQ ID NO: 835173 - RNA, 19 nt, Homo sapiens
cauccagacuugaaacaua

SEQ ID NO: 835174 - RNA, 19 nt, Homo sapiens
gcagaaaggcuuccagaug

SEQ ID NO: 835175 - RNA, 19 nt, Homo sapiens
ccaaucaacuucauaggau

SEQ ID NO: 835176 - RNA, 19 nt, Homo sapiens
ggaaagauacugcccaagu

SEQ ID NO: 835177 - RNA, 19 nt, Homo sapiens
gauaaagaccaaucaacuu

SEQ ID NO: 835178 - RNA, 19 nt, Homo sapiens
ugacagagagcgaauagaa

SEQ ID NO: 835179 - RNA, 19 nt, Homo sapiens
ggaaguagacaguauuaca

SEQ ID NO: 835180 - RNA, 19 nt, Homo sapiens
ggacgaggccguguuagau

SEQ ID NO: 835181 - RNA, 19 nt, Homo sapiens
ggguuaagagggaaagaua

SEQ ID NO: 835182 - RNA, 19 nt, Homo sapiens
gaccuuaaguguacagaac

SEQ ID NO: 835183 - RNA, 19 nt, Homo sapiens
uaagaauucccuagaaauc

SEQ ID NO: 835184 - RNA, 19 nt, Homo sapiens
acuuaaagaugcuucgaaa

SEQ ID NO: 835185 - RNA, 19 nt, Homo sapiens
gaaagcaccgagcugacaa

SEQ ID NO: 835186 - RNA, 19 nt, Homo sapiens
ggaaagcaccgagcugaca

SEQ ID NO: 835187 - RNA, 19 nt, Homo sapiens
uaacuguccauuuauccua

SEQ ID NO: 835188 - RNA, 19 nt, Homo sapiens
guuagaucauccagacuug

SEQ ID NO: 835189 - RNA, 19 nt, Homo sapiens
cauauuuggugaccuuaag

SEQ ID NO: 835190 - RNA, 19 nt, Homo sapiens
uguacagaccugcauauuu

SEQ ID NO: 835191 - RNA, 19 nt, Homo sapiens
cugaauaaauaagguguug

SEQ ID NO: 835192 - RNA, 19 nt, Homo sapiens
guaguaacuguccauuuau

SEQ ID NO: 835193 - RNA, 19 nt, Homo sapiens
ggauguacagaccugcaua

SEQ ID NO: 835194 - RNA, 19 nt, Homo sapiens
gagagcgaauagaacuguu

SEQ ID NO: 835195 - RNA, 19 nt, Homo sapiens
gaaguagacaguauuacac

SEQ ID NO: 835196 - RNA, 19 nt, Homo sapiens
gaaaggguuaagagggaaa

SEQ ID NO: 835197 - RNA, 19 nt, Homo sapiens
aaggaaguagacaguauua

SEQ ID NO: 835198 - RNA, 19 nt, Homo sapiens
gagauuaguuuuaguugca

SEQ ID NO: 835199 - RNA, 19 nt, Homo sapiens
gcauauuuggugaccuuaa

SEQ ID NO: 835200 - RNA, 19 nt, Homo sapiens
aaaggaaguagacaguauu

SEQ ID NO: 835201 - RNA, 19 nt, Homo sapiens
ugaaaggaaguagacagua

SEQ ID NO: 835202 - RNA, 19 nt, Homo sapiens
guugcagcauggaacaauu

SEQ ID NO: 835203 - RNA, 19 nt, Homo sapiens
uuucuuggcgcuuggaaua

SEQ ID NO: 835204 - RNA, 19 nt, Homo sapiens
ccucauauaacggauguuu

SEQ ID NO: 835205 - RNA, 19 nt, Homo sapiens
agaucucucccucauauaa

SEQ ID NO: 835206 - RNA, 19 nt, Homo sapiens
ggaaguauaggcagaucuc

SEQ ID NO: 835207 - RNA, 19 nt, Homo sapiens
cugcauauuuggugaccuu

SEQ ID NO: 835208 - RNA, 19 nt, Homo sapiens
aaagaccaaucaacuucau

SEQ ID NO: 835209 - RNA, 19 nt, Homo sapiens
auaaagaccaaucaacuuc

SEQ ID NO: 835210 - RNA, 19 nt, Homo sapiens
cagcugaaccaccguuugu

SEQ ID NO: 835211 - RNA, 19 nt, Homo sapiens
gauguacagaccugcauau

SEQ ID NO: 835212 - RNA, 19 nt, Homo sapiens
uaguaacuguccauuuauc

SEQ ID NO: 835213 - RNA, 19 nt, Homo sapiens
cagaaacgccuugccuuca

SEQ ID NO: 835214 - RNA, 19 nt, Homo sapiens
ggaacaauuacaggacuug

SEQ ID NO: 835215 - RNA, 19 nt, Homo sapiens
uaaagaccaaucaacuuca

SEQ ID NO: 835216 - RNA, 19 nt, Homo sapiens
ucauauaacggauguuucu

SEQ ID NO: 835217 - RNA, 19 nt, Homo sapiens
ucaagucuucugaaaggaa

SEQ ID NO: 835218 - RNA, 19 nt, Homo sapiens
uugcagcauggaacaauua

SEQ ID NO: 835219 - RNA, 19 nt, Homo sapiens
cauccuauccagagauuag

SEQ ID NO: 835220 - RNA, 19 nt, Homo sapiens
uagaucauccagacuugaa

SEQ ID NO: 835221 - RNA, 19 nt, Homo sapiens
aggcagaucucucccucau

SEQ ID NO: 835222 - RNA, 19 nt, Homo sapiens
gcugcaacuuacauacuag

SEQ ID NO: 835223 - RNA, 19 nt, Homo sapiens
uuggugaccuuaaguguac

SEQ ID NO: 835224 - RNA, 19 nt, Homo sapiens
auccagacuugaaacauau

SEQ ID NO: 835225 - RNA, 19 nt, Homo sapiens
agaaacgccuugccuucag

SEQ ID NO: 835226 - RNA, 19 nt, Homo sapiens
cccauccuauccagagauu

SEQ ID NO: 835227 - RNA, 19 nt, Homo sapiens
agcugcaacuuacauacua

SEQ ID NO: 835228 - RNA, 19 nt, Homo sapiens
ucagauaaagaccaaucaa

SEQ ID NO: 835229 - RNA, 19 nt, Homo sapiens
gaauucccuagaaauccua

SEQ ID NO: 835230 - RNA, 19 nt, Homo sapiens
acauaucgacccagugguu

SEQ ID NO: 835231 - RNA, 19 nt, Homo sapiens
agauaaagaccaaucaacu

SEQ ID NO: 835232 - RNA, 19 nt, Homo sapiens
gacgaggccguguuagauc

SEQ ID NO: 835233 - RNA, 19 nt, Homo sapiens
gacaguauuacacccugaa

SEQ ID NO: 835234 - RNA, 19 nt, Homo sapiens
cauaucgacccagugguuu

SEQ ID NO: 835235 - RNA, 19 nt, Homo sapiens
cccaaguauuugaaucguu

SEQ ID NO: 835236 - RNA, 19 nt, Homo sapiens
acgaggccguguuagauca

SEQ ID NO: 835237 - RNA, 19 nt, Homo sapiens
cagcauggaacaauuacag

SEQ ID NO: 835238 - RNA, 19 nt, Homo sapiens
uaguaguaacuguccauuu

SEQ ID NO: 835239 - RNA, 19 nt, Homo sapiens
acagagagcgaauagaacu

SEQ ID NO: 835240 - RNA, 19 nt, Homo sapiens
gaagacuguaaauuugaca

SEQ ID NO: 835241 - RNA, 19 nt, Homo sapiens
gaacgaacaugguggcuuu

SEQ ID NO: 835242 - RNA, 19 nt, Homo sapiens
gaacagacguuuuaaaaga

SEQ ID NO: 835243 - RNA, 19 nt, Homo sapiens
uggcuaggaugauuaauua

SEQ ID NO: 835244 - RNA, 19 nt, Homo sapiens
gaaguaaguuagcagaaau

SEQ ID NO: 835245 - RNA, 19 nt, Homo sapiens
gaauugaguucuccgaguu

SEQ ID NO: 835246 - RNA, 19 nt, Homo sapiens
ggaaugagaugcuggacau

SEQ ID NO: 835247 - RNA, 19 nt, Homo sapiens
gagaagaguuccaggcaau

SEQ ID NO: 835248 - RNA, 19 nt, Homo sapiens
caggagagguggucuuuga

SEQ ID NO: 835249 - RNA, 19 nt, Homo sapiens
gagguggucuuugaaguaa

SEQ ID NO: 835250 - RNA, 19 nt, Homo sapiens
cagauacugugcuugauuu

SEQ ID NO: 835251 - RNA, 19 nt, Homo sapiens
gaaggccucugccguagug

SEQ ID NO: 835252 - RNA, 19 nt, Homo sapiens
gaccggaucuuugccauga

SEQ ID NO: 835253 - RNA, 19 nt, Homo sapiens
ccaccaaguuugccacauu

SEQ ID NO: 835254 - RNA, 19 nt, Homo sapiens
ugaaguaaguuagcagaaa

SEQ ID NO: 835255 - RNA, 19 nt, Homo sapiens
acaacuaccuucuguccua

SEQ ID NO: 835256 - RNA, 19 nt, Homo sapiens
cagaagaucuacaagcaau

SEQ ID NO: 835257 - RNA, 19 nt, Homo sapiens
guacaaaggcuucaucaag

SEQ ID NO: 835258 - RNA, 19 nt, Homo sapiens
gaucuaagcaggccacguu

SEQ ID NO: 835259 - RNA, 19 nt, Homo sapiens
gauagcaagugaauuaacu

SEQ ID NO: 835260 - RNA, 19 nt, Homo sapiens
uggaggagcugaccaggaa

SEQ ID NO: 835261 - RNA, 19 nt, Homo sapiens
gcaaucccaucaauauagu

SEQ ID NO: 835262 - RNA, 19 nt, Homo sapiens
cuacagcccucugcauaaa

SEQ ID NO: 835263 - RNA, 19 nt, Homo sapiens
cuggauagcaagugaauua

SEQ ID NO: 835264 - RNA, 19 nt, Homo sapiens
ccgaaugccuccugccaaa

SEQ ID NO: 835265 - RNA, 19 nt, Homo sapiens
uaacuuaagggcacuguga

SEQ ID NO: 835266 - RNA, 19 nt, Homo sapiens
caaugcggcucgcuucaga

SEQ ID NO: 835267 - RNA, 19 nt, Homo sapiens
gugaugcugugguuaaguu

SEQ ID NO: 835268 - RNA, 19 nt, Homo sapiens
caccaaguuugccacauuu

SEQ ID NO: 835269 - RNA, 19 nt, Homo sapiens
caaugggacugacacuguu

SEQ ID NO: 835270 - RNA, 19 nt, Homo sapiens
ggucaaauuacuuuccuuu

SEQ ID NO: 835271 - RNA, 19 nt, Homo sapiens
uaaguuagcagaaaucaag

SEQ ID NO: 835272 - RNA, 19 nt, Homo sapiens
gauggugacuuaggagaau

SEQ ID NO: 835273 - RNA, 19 nt, Homo sapiens
gggaggggauuucaagaua

SEQ ID NO: 835274 - RNA, 19 nt, Homo sapiens
gaaauuccuaaauggcuaa

SEQ ID NO: 835275 - RNA, 19 nt, Homo sapiens
gggaaccacucaccuccuu

SEQ ID NO: 835276 - RNA, 19 nt, Homo sapiens
cuaagcaggccacguuuaa

SEQ ID NO: 835277 - RNA, 19 nt, Homo sapiens
ugucugggcuuaagcaugu

SEQ ID NO: 835278 - RNA, 19 nt, Homo sapiens
uuugaaggguggauucuuu

SEQ ID NO: 835279 - RNA, 19 nt, Homo sapiens
gagagguggucuuugaagu

SEQ ID NO: 835280 - RNA, 19 nt, Homo sapiens
gaagaucuacaagcaauuc

SEQ ID NO: 835281 - RNA, 19 nt, Homo sapiens
gacugacacuguuguacaa

SEQ ID NO: 835282 - RNA, 19 nt, Homo sapiens
ggacugacacuguuguaca

SEQ ID NO: 835283 - RNA, 19 nt, Homo sapiens
cagcgcgguuucagcauuu

SEQ ID NO: 835284 - RNA, 19 nt, Homo sapiens
acaaaggcuucaucaagga

SEQ ID NO: 835285 - RNA, 19 nt, Homo sapiens
gcuacagcccucugcauaa

SEQ ID NO: 835286 - RNA, 19 nt, Homo sapiens
ggaaauccaacagcaaguu

SEQ ID NO: 835287 - RNA, 19 nt, Homo sapiens
ggcccuugcucuuugauug

SEQ ID NO: 835288 - RNA, 19 nt, Homo sapiens
guacgugucacccucugua

SEQ ID NO: 835289 - RNA, 19 nt, Homo sapiens
ggccuucucuuggcucaaa

SEQ ID NO: 835290 - RNA, 19 nt, Homo sapiens
ccaggaccaucaccaggaa

SEQ ID NO: 835291 - RNA, 19 nt, Homo sapiens
uaaacugcaugguguccuu

SEQ ID NO: 835292 - RNA, 19 nt, Homo sapiens
gauaacaguauugugcuuu

SEQ ID NO: 835293 - RNA, 19 nt, Homo sapiens
gcuaggaugauuaauuaug

SEQ ID NO: 835294 - RNA, 19 nt, Homo sapiens
gaagacacagacugacaga

SEQ ID NO: 835295 - RNA, 19 nt, Homo sapiens
caggcaaucccaucaauau

SEQ ID NO: 835296 - RNA, 19 nt, Homo sapiens
uuagguuucucaacucuug

SEQ ID NO: 835297 - RNA, 19 nt, Homo sapiens
cgacaacacgaaauggaaa

SEQ ID NO: 835298 - RNA, 19 nt, Homo sapiens
ccagcgcgguuucagcauu

SEQ ID NO: 835299 - RNA, 19 nt, Homo sapiens
gcuccucacuuuguguuga

SEQ ID NO: 835300 - RNA, 19 nt, Homo sapiens
gcagugaugccgcagaauc

SEQ ID NO: 835301 - RNA, 19 nt, Homo sapiens
agacacagacugacagaug

SEQ ID NO: 835302 - RNA, 19 nt, Homo sapiens
aaacaaggacgggcgaauu

SEQ ID NO: 835303 - RNA, 19 nt, Homo sapiens
ccaaugggacugacacugu

SEQ ID NO: 835304 - RNA, 19 nt, Homo sapiens
gcaccaacggcugaaguuu

SEQ ID NO: 835305 - RNA, 19 nt, Homo sapiens
ggcaaucccaucaauauag

SEQ ID NO: 835306 - RNA, 19 nt, Homo sapiens
gaucuacaagcaauucuuc

SEQ ID NO: 835307 - RNA, 19 nt, Homo sapiens
caaguuugccacauuuguu

SEQ ID NO: 835308 - RNA, 19 nt, Homo sapiens
ggacauuguggaugccauu

SEQ ID NO: 835309 - RNA, 19 nt, Homo sapiens
ucuacgacuuggacaauga

SEQ ID NO: 835310 - RNA, 19 nt, Homo sapiens
ggcaggcugucucuggaaa

SEQ ID NO: 835311 - RNA, 19 nt, Homo sapiens
agaccuacuuuaccgagaa

SEQ ID NO: 835312 - RNA, 19 nt, Homo sapiens
ccaggaagaccuacuuuac

SEQ ID NO: 835313 - RNA, 19 nt, Homo sapiens
ccaggcaaucccaucaaua

SEQ ID NO: 835314 - RNA, 19 nt, Homo sapiens
uuucucaacucuugcuuug

SEQ ID NO: 835315 - RNA, 19 nt, Homo sapiens
uuaggagaauguuccgauu

SEQ ID NO: 835316 - RNA, 19 nt, Homo sapiens
ggucaguuccagcagauga

SEQ ID NO: 835317 - RNA, 19 nt, Homo sapiens
agagguggucuuugaagua

SEQ ID NO: 835318 - RNA, 19 nt, Homo sapiens
ucucaacucuugcuuuggu

SEQ ID NO: 835319 - RNA, 19 nt, Homo sapiens
ccuagaagacacagacuga

SEQ ID NO: 835320 - RNA, 19 nt, Homo sapiens
gaggguggaccggaucuuu

SEQ ID NO: 835321 - RNA, 19 nt, Homo sapiens
gcuggacacuggccauuuu

SEQ ID NO: 835322 - RNA, 19 nt, Homo sapiens
ggccuuagcagaugguaug

SEQ ID NO: 835323 - RNA, 19 nt, Homo sapiens
uccagaagaucuacaagca

SEQ ID NO: 835324 - RNA, 19 nt, Homo sapiens
caaguugaagcccgaaguu

SEQ ID NO: 835325 - RNA, 19 nt, Homo sapiens
gguggucuuugaaguaagu

SEQ ID NO: 835326 - RNA, 19 nt, Homo sapiens
ucagauacugugcuugauu

SEQ ID NO: 835327 - RNA, 19 nt, Homo sapiens
gaccaggaagaccuacuuu

SEQ ID NO: 835328 - RNA, 19 nt, Homo sapiens
gguguggcuucuggccuua

SEQ ID NO: 835329 - RNA, 19 nt, Homo sapiens
gaacaggggacaucuuuag

SEQ ID NO: 835330 - RNA, 19 nt, Homo sapiens
ggaugccauuuaccagaug

SEQ ID NO: 835331 - RNA, 19 nt, Homo sapiens
gcaggccacguuuaaaaua

SEQ ID NO: 835332 - RNA, 19 nt, Homo sapiens
gagggugucugggcuuaag

SEQ ID NO: 835333 - RNA, 19 nt, Homo sapiens
gggaaggcuugaggugaga

SEQ ID NO: 835334 - RNA, 19 nt, Homo sapiens
guggcuaggaugauuaauu

SEQ ID NO: 835335 - RNA, 19 nt, Homo sapiens
ggaaaacgacaacacgaaa

SEQ ID NO: 835336 - RNA, 19 nt, Homo sapiens
ccuucaagcucuacgacuu

SEQ ID NO: 835337 - RNA, 19 nt, Homo sapiens
ggcggaaagucacccuguu

SEQ ID NO: 835338 - RNA, 19 nt, Homo sapiens
ugacagcccguuuccuaga

SEQ ID NO: 835339 - RNA, 19 nt, Homo sapiens
uaggagaauguuccgauuu

SEQ ID NO: 835340 - RNA, 19 nt, Homo sapiens
uuucaggaacuuuguguuu

SEQ ID NO: 835341 - RNA, 19 nt, Homo sapiens
gcaaagauguucuaaauac

SEQ ID NO: 835342 - RNA, 19 nt, Homo sapiens
uaacaaaggugaugaugaa

SEQ ID NO: 835343 - RNA, 19 nt, Homo sapiens
gaaccuguauguuaaauga

SEQ ID NO: 835344 - RNA, 19 nt, Homo sapiens
gcagagauuucuugacgua

SEQ ID NO: 835345 - RNA, 19 nt, Homo sapiens
gcagaaagauguaugagau

SEQ ID NO: 835346 - RNA, 19 nt, Homo sapiens
caacaaccuuucaaacuuu

SEQ ID NO: 835347 - RNA, 19 nt, Homo sapiens
gaagcaguauuguaaguaa

SEQ ID NO: 835348 - RNA, 19 nt, Homo sapiens
gaacaguugucuaguauag

SEQ ID NO: 835349 - RNA, 19 nt, Homo sapiens
gaaagugacccaaauaaga

SEQ ID NO: 835350 - RNA, 19 nt, Homo sapiens
gaggaacaguugucuagua

SEQ ID NO: 835351 - RNA, 19 nt, Homo sapiens
gaacaugucaaaugaacua

SEQ ID NO: 835352 - RNA, 19 nt, Homo sapiens
caaauaagacuaccuguga

SEQ ID NO: 835353 - RNA, 19 nt, Homo sapiens
acacagagcuggacaagug

SEQ ID NO: 835354 - RNA, 19 nt, Homo sapiens
gcacgaagacgaccacaaa

SEQ ID NO: 835355 - RNA, 19 nt, Homo sapiens
gaaagauucucugccauug

SEQ ID NO: 835356 - RNA, 19 nt, Homo sapiens
gcacuuguguaucuugauu

SEQ ID NO: 835357 - RNA, 19 nt, Homo sapiens
ucaaacaucuugcaucaau

SEQ ID NO: 835358 - RNA, 19 nt, Homo sapiens
guauguagcuguauguuuc

SEQ ID NO: 835359 - RNA, 19 nt, Homo sapiens
gcccauagaucucagcaaa

SEQ ID NO: 835360 - RNA, 19 nt, Homo sapiens
gaacgaaacagcccugaug

SEQ ID NO: 835361 - RNA, 19 nt, Homo sapiens
ggaauugucucuaaacacu

SEQ ID NO: 835362 - RNA, 19 nt, Homo sapiens
aaacauacaugguccacaa

SEQ ID NO: 835363 - RNA, 19 nt, Homo sapiens
aaacagacaucaucuccaa

SEQ ID NO: 835364 - RNA, 19 nt, Homo sapiens
uggcugaguugaagacuua

SEQ ID NO: 835365 - RNA, 19 nt, Homo sapiens
ucaacaaccuuucaaacuu

SEQ ID NO: 835366 - RNA, 19 nt, Homo sapiens
cuucagagaucuuagcuaa

SEQ ID NO: 835367 - RNA, 19 nt, Homo sapiens
gugcugcgcugaagaaaga

SEQ ID NO: 835368 - RNA, 19 nt, Homo sapiens
ggaagauggacuugaauaa

SEQ ID NO: 835369 - RNA, 19 nt, Homo sapiens
gcuugaaggucuuuaguga

SEQ ID NO: 835370 - RNA, 19 nt, Homo sapiens
caaaggugaugaugaagga

SEQ ID NO: 835371 - RNA, 19 nt, Homo sapiens
gaaaggcacagucuaaauc

SEQ ID NO: 835372 - RNA, 19 nt, Homo sapiens
ucacuaggcuuugcauuug

SEQ ID NO: 835373 - RNA, 19 nt, Homo sapiens
ggaagaagaauguccauca

SEQ ID NO: 835374 - RNA, 19 nt, Homo sapiens
caagcugccuuccgaugua

SEQ ID NO: 835375 - RNA, 19 nt, Homo sapiens
ucagaugacucucacagaa

SEQ ID NO: 835376 - RNA, 19 nt, Homo sapiens
gcauuuguauguagcugua

SEQ ID NO: 835377 - RNA, 19 nt, Homo sapiens
guugaagacuuaaggugua

SEQ ID NO: 835378 - RNA, 19 nt, Homo sapiens
caggagagcuggagguguu

SEQ ID NO: 835379 - RNA, 19 nt, Homo sapiens
gagguaguauuaaucaguu

SEQ ID NO: 835380 - RNA, 19 nt, Homo sapiens
gaaaaugaaucuccuaaag

SEQ ID NO: 835381 - RNA, 19 nt, Homo sapiens
caagaucaguuucaauaag

SEQ ID NO: 835382 - RNA, 19 nt, Homo sapiens
gcaagaucaguuucaauaa

SEQ ID NO: 835383 - RNA, 19 nt, Homo sapiens
aaacuucucugacgaucaa

SEQ ID NO: 835384 - RNA, 19 nt, Homo sapiens
cagagaaagugacauggaa

SEQ ID NO: 835385 - RNA, 19 nt, Homo sapiens
gcauguauauggauggaau

SEQ ID NO: 835386 - RNA, 19 nt, Homo sapiens
gacuuaagguguaauuuca

SEQ ID NO: 835387 - RNA, 19 nt, Homo sapiens
gaugucagcuacgaaagaa

SEQ ID NO: 835388 - RNA, 19 nt, Homo sapiens
acaaaggccuccacugguu

SEQ ID NO: 835389 - RNA, 19 nt, Homo sapiens
gaagauggacuugaauaau

SEQ ID NO: 835390 - RNA, 19 nt, Homo sapiens
ggacacacagucagagaaa

SEQ ID NO: 835391 - RNA, 19 nt, Homo sapiens
gauaauguucuacuucuga

SEQ ID NO: 835392 - RNA, 19 nt, Homo sapiens
uagcagauacagucucuua

SEQ ID NO: 835393 - RNA, 19 nt, Homo sapiens
gaccagcuuucuccauauu

SEQ ID NO: 835394 - RNA, 19 nt, Homo sapiens
gaggucugcuuccaacaaa

SEQ ID NO: 835395 - RNA, 19 nt, Homo sapiens
caacccagcugcucauucu

SEQ ID NO: 835396 - RNA, 19 nt, Homo sapiens
gaagaagaauguccaucag

SEQ ID NO: 835397 - RNA, 19 nt, Homo sapiens
gcuugaagaugccauugaa

SEQ ID NO: 835398 - RNA, 19 nt, Homo sapiens
ucauuacaguccauuagua

SEQ ID NO: 835399 - RNA, 19 nt, Homo sapiens
gcaaucaggagauaauuca

SEQ ID NO: 835400 - RNA, 19 nt, Homo sapiens
cagcagaacaugucaaaug

SEQ ID NO: 835401 - RNA, 19 nt, Homo sapiens
gagaacauuucccagaauc

SEQ ID NO: 835402 - RNA, 19 nt, Homo sapiens
ccgaccagcuuucuccaua

SEQ ID NO: 835403 - RNA, 19 nt, Homo sapiens
gggaaagugacccaaauaa

SEQ ID NO: 835404 - RNA, 19 nt, Homo sapiens
cagcuuugguguacaacua

SEQ ID NO: 835405 - RNA, 19 nt, Homo sapiens
ccaaaaggcugcuggacua

SEQ ID NO: 835406 - RNA, 19 nt, Homo sapiens
gauacagccuacaacaaau

SEQ ID NO: 835407 - RNA, 19 nt, Homo sapiens
gggaagauggacuugaaua

SEQ ID NO: 835408 - RNA, 19 nt, Homo sapiens
caaaagcacuuguguaucu

SEQ ID NO: 835409 - RNA, 19 nt, Homo sapiens
gaaugucucaccaggaauu

SEQ ID NO: 835410 - RNA, 19 nt, Homo sapiens
uagcuacccucccgucauu

SEQ ID NO: 835411 - RNA, 19 nt, Homo sapiens
ggagacagcagaaucagau

SEQ ID NO: 835412 - RNA, 19 nt, Homo sapiens
ggaagcaguauuguaagua

SEQ ID NO: 835413 - RNA, 19 nt, Homo sapiens
aaacaucagucaccuuugg

SEQ ID NO: 835414 - RNA, 19 nt, Homo sapiens
ugugaagcuugcaacauua

SEQ ID NO: 835415 - RNA, 19 nt, Homo sapiens
caguaacaaugaugacaaa

SEQ ID NO: 835416 - RNA, 19 nt, Homo sapiens
caucuugcaucaauucuuc

SEQ ID NO: 835417 - RNA, 19 nt, Homo sapiens
ggucagcuuugguguacaa

SEQ ID NO: 835418 - RNA, 19 nt, Homo sapiens
gaagaugccauugaagaug

SEQ ID NO: 835419 - RNA, 19 nt, Homo sapiens
gaauguccaucagaggaaa

SEQ ID NO: 835420 - RNA, 19 nt, Homo sapiens
gcggcaaacuucccagaga

SEQ ID NO: 835421 - RNA, 19 nt, Homo sapiens
gauguaaucacugccauuu

SEQ ID NO: 835422 - RNA, 19 nt, Homo sapiens
gcaccugaauucacacagu

SEQ ID NO: 835423 - RNA, 19 nt, Homo sapiens
ggaaucugcaggcccauuu

SEQ ID NO: 835424 - RNA, 19 nt, Homo sapiens
gcaguauuguaaguaauga

SEQ ID NO: 835425 - RNA, 19 nt, Homo sapiens
gaagacuuaagguguaauu

SEQ ID NO: 835426 - RNA, 19 nt, Homo sapiens
aagagaacauuucccagaa

SEQ ID NO: 835427 - RNA, 19 nt, Homo sapiens
cuaaacacuuggaaacuuc

SEQ ID NO: 835428 - RNA, 19 nt, Homo sapiens
cuucaaacaucuugcauca

SEQ ID NO: 835429 - RNA, 19 nt, Homo sapiens
gauggcagcagauggcuaa

SEQ ID NO: 835430 - RNA, 19 nt, Homo sapiens
gaagacagugcccaucaga

SEQ ID NO: 835431 - RNA, 19 nt, Homo sapiens
cuacgaaggccaucucuga

SEQ ID NO: 835432 - RNA, 19 nt, Homo sapiens
ccaagugguugcuggaugu

SEQ ID NO: 835433 - RNA, 19 nt, Homo sapiens
cuaaacaucagucaccuuu

SEQ ID NO: 835434 - RNA, 19 nt, Homo sapiens
aagauucucugccauuguu

SEQ ID NO: 835435 - RNA, 19 nt, Homo sapiens
cuacgaaagaagcauaaua

SEQ ID NO: 835436 - RNA, 19 nt, Homo sapiens
ggaaagugacccaaauaag

SEQ ID NO: 835437 - RNA, 19 nt, Homo sapiens
ggaagggccaugacaagga

SEQ ID NO: 835438 - RNA, 19 nt, Homo sapiens
gaggaaugguaauagugaa

SEQ ID NO: 835439 - RNA, 19 nt, Homo sapiens
ccuuuacccuggagcaaua

SEQ ID NO: 835440 - RNA, 19 nt, Homo sapiens
gcaaaguguuuccgaaucc

SEQ ID NO: 835441 - RNA, 19 nt, Homo sapiens
gcacuguacuucacucuaa

SEQ ID NO: 835442 - RNA, 19 nt, Homo sapiens
gcaugaaggccaauaauaa

SEQ ID NO: 835443 - RNA, 19 nt, Homo sapiens
ggacugcgcuccuggacuu

SEQ ID NO: 835444 - RNA, 19 nt, Homo sapiens
gcaccgaggucaugcagaa

SEQ ID NO: 835445 - RNA, 19 nt, Homo sapiens
gaccagugcugaugugaaa

SEQ ID NO: 835446 - RNA, 19 nt, Homo sapiens
cuugagaccuuccauauug

SEQ ID NO: 835447 - RNA, 19 nt, Homo sapiens
gaagcgugguuaccucuga

SEQ ID NO: 835448 - RNA, 19 nt, Homo sapiens
ugaaggaccucaaggacuu

SEQ ID NO: 835449 - RNA, 19 nt, Homo sapiens
cagaugagauccuacuuuc

SEQ ID NO: 835450 - RNA, 19 nt, Homo sapiens
caggaggugucucagcuua

SEQ ID NO: 835451 - RNA, 19 nt, Homo sapiens
ugaaagcucugaccuacug

SEQ ID NO: 835452 - RNA, 19 nt, Homo sapiens
ggagccaccuggaaauuuc

SEQ ID NO: 835453 - RNA, 19 nt, Homo sapiens
gcagaugagauccuacuuu

SEQ ID NO: 835454 - RNA, 19 nt, Homo sapiens
caucgacgccaacgaguua

SEQ ID NO: 835455 - RNA, 19 nt, Homo sapiens
ggaaaugcucuucauccua

SEQ ID NO: 835456 - RNA, 19 nt, Homo sapiens
gaacccagcaggcaugaga

SEQ ID NO: 835457 - RNA, 19 nt, Homo sapiens
gacccaaacuucgugcuaa

SEQ ID NO: 835458 - RNA, 19 nt, Homo sapiens
gagcugacauugcuaugca

SEQ ID NO: 835459 - RNA, 19 nt, Homo sapiens
ggacuugagaccuuccaua

SEQ ID NO: 835460 - RNA, 19 nt, Homo sapiens
gcccagaauuggccaguga

SEQ ID NO: 835461 - RNA, 19 nt, Homo sapiens
gcugagagcugacauugcu

SEQ ID NO: 835462 - RNA, 19 nt, Homo sapiens
ccaauaauaacguguuuga

SEQ ID NO: 835463 - RNA, 19 nt, Homo sapiens
gauaguggauggcauugag

SEQ ID NO: 835464 - RNA, 19 nt, Homo sapiens
gaacgugacagccaucauc

SEQ ID NO: 835465 - RNA, 19 nt, Homo sapiens
ggcaugaaggccaauaaua

SEQ ID NO: 835466 - RNA, 19 nt, Homo sapiens
gggcugaaaucugcuucua

SEQ ID NO: 835467 - RNA, 19 nt, Homo sapiens
cgacaucgccguggaaaug

SEQ ID NO: 835468 - RNA, 19 nt, Homo sapiens
gaaccgcagugcccauugg

SEQ ID NO: 835469 - RNA, 19 nt, Homo sapiens
ugucuccucuccuuccuua

SEQ ID NO: 835470 - RNA, 19 nt, Homo sapiens
ccacccagccuccaggaua

SEQ ID NO: 835471 - RNA, 19 nt, Homo sapiens
ggaggugcccuaugucaau

SEQ ID NO: 835472 - RNA, 19 nt, Homo sapiens
ggccaauaauaacguguuu

SEQ ID NO: 835473 - RNA, 19 nt, Homo sapiens
caacagcacucccuauccu

SEQ ID NO: 835474 - RNA, 19 nt, Homo sapiens
gaggcucuauccugaguau

SEQ ID NO: 835475 - RNA, 19 nt, Homo sapiens
auacuacgcuugcugaagu

SEQ ID NO: 835476 - RNA, 19 nt, Homo sapiens
gaggcaggcugucucucaa

SEQ ID NO: 835477 - RNA, 19 nt, Homo sapiens
uaagcagccucaccagugu

SEQ ID NO: 835478 - RNA, 19 nt, Homo sapiens
gaacuuccgcaccaccuau

SEQ ID NO: 835479 - RNA, 19 nt, Homo sapiens
ggaggcaggcugucucuca

SEQ ID NO: 835480 - RNA, 19 nt, Homo sapiens
gguuaccucugacgcuauu

SEQ ID NO: 835481 - RNA, 19 nt, Homo sapiens
acaagacgcugccauccau

SEQ ID NO: 835482 - RNA, 19 nt, Homo sapiens
gaugcacgcugugguguuc

SEQ ID NO: 835483 - RNA, 19 nt, Homo sapiens
gcaugaaggaccucaagga

SEQ ID NO: 835484 - RNA, 19 nt, Homo sapiens
gcccuugucuccucuccuu

SEQ ID NO: 835485 - RNA, 19 nt, Homo sapiens
cgacugaccggccacuuug

SEQ ID NO: 835486 - RNA, 19 nt, Homo sapiens
caucagugcccgaguacaa

SEQ ID NO: 835487 - RNA, 19 nt, Homo sapiens
gacuugagaccuuccauau

SEQ ID NO: 835488 - RNA, 19 nt, Homo sapiens
ggaccugauuggagcagau

SEQ ID NO: 835489 - RNA, 19 nt, Homo sapiens
ggacggccuuauccuccuu

SEQ ID NO: 835490 - RNA, 19 nt, Homo sapiens
cacgaaaacucccuuggua

SEQ ID NO: 835491 - RNA, 19 nt, Homo sapiens
gcucuggauuucuggacuu

SEQ ID NO: 835492 - RNA, 19 nt, Homo sapiens
gggagcagacccaaacuuc

SEQ ID NO: 835493 - RNA, 19 nt, Homo sapiens
gaggugcccuaugucaaug

SEQ ID NO: 835494 - RNA, 19 nt, Homo sapiens
gggagccaccuggaaauuu

SEQ ID NO: 835495 - RNA, 19 nt, Homo sapiens
ccaaacuucgugcuaaaga

SEQ ID NO: 835496 - RNA, 19 nt, Homo sapiens
cuuuacaucuucaacauca

SEQ ID NO: 835497 - RNA, 19 nt, Homo sapiens
ccauugggcugggcagaug

SEQ ID NO: 835498 - RNA, 19 nt, Homo sapiens
uugcugcucugcccuuuga

SEQ ID NO: 835499 - RNA, 19 nt, Homo sapiens
uagauaucauccugaacuu

SEQ ID NO: 835500 - RNA, 19 nt, Homo sapiens
aaagaccagugcugaugug

SEQ ID NO: 835501 - RNA, 19 nt, Homo sapiens
gagcagacccaaacuucgu

SEQ ID NO: 835502 - RNA, 19 nt, Homo sapiens
gcaccugaaucgggagauc

SEQ ID NO: 835503 - RNA, 19 nt, Homo sapiens
ccgcugcucugggacauug

SEQ ID NO: 835504 - RNA, 19 nt, Homo sapiens
ugaccugcuuuacaucuuc

SEQ ID NO: 835505 - RNA, 19 nt, Homo sapiens
ccuuugaccugcuuuacau

SEQ ID NO: 835506 - RNA, 19 nt, Homo sapiens
cuaaagaccagugcugaug

SEQ ID NO: 835507 - RNA, 19 nt, Homo sapiens
gccugcaucugguauguca

SEQ ID NO: 835508 - RNA, 19 nt, Homo sapiens
gaggcaugaaggccaauaa

SEQ ID NO: 835509 - RNA, 19 nt, Homo sapiens
cagcugccguuuccucuac

SEQ ID NO: 835510 - RNA, 19 nt, Homo sapiens
ggaggugucucagcuuagc

SEQ ID NO: 835511 - RNA, 19 nt, Homo sapiens
uaaagaccagugcugaugu

SEQ ID NO: 835512 - RNA, 19 nt, Homo sapiens
gcgcaugcucgaauacuuc

SEQ ID NO: 835513 - RNA, 19 nt, Homo sapiens
gucuggaggugcccuaugu

SEQ ID NO: 835514 - RNA, 19 nt, Homo sapiens
gggagauggaggccaauga

SEQ ID NO: 835515 - RNA, 19 nt, Homo sapiens
ccaccugguucuucaucga

SEQ ID NO: 835516 - RNA, 19 nt, Homo sapiens
gggcugggcagaugagauc

SEQ ID NO: 835517 - RNA, 19 nt, Homo sapiens
gguuggcucuggauuucug

SEQ ID NO: 835518 - RNA, 19 nt, Homo sapiens
ucaaucaggaggugucuca

SEQ ID NO: 835519 - RNA, 19 nt, Homo sapiens
ggacaguaaucacgaaaac

SEQ ID NO: 835520 - RNA, 19 nt, Homo sapiens
ggauaggaaauaaacucuu

SEQ ID NO: 835521 - RNA, 19 nt, Homo sapiens
gcagcugccguuuccucua

SEQ ID NO: 835522 - RNA, 19 nt, Homo sapiens
caaacuucgugcuaaagac

SEQ ID NO: 835523 - RNA, 19 nt, Homo sapiens
gaccugauuggagcagaua

SEQ ID NO: 835524 - RNA, 19 nt, Homo sapiens
cccuaucgcugcacaucaa

SEQ ID NO: 835525 - RNA, 19 nt, Homo sapiens
gcaucgacgccaacgaguu

SEQ ID NO: 835526 - RNA, 19 nt, Homo sapiens
agccaucagugcccgagua

SEQ ID NO: 835527 - RNA, 19 nt, Homo sapiens
ccagcaggcaugagaugaa

SEQ ID NO: 835528 - RNA, 19 nt, Homo sapiens
acccaaacuucgugcuaaa

SEQ ID NO: 835529 - RNA, 19 nt, Homo sapiens
gaccugcuuuacaucuuca

SEQ ID NO: 835530 - RNA, 19 nt, Homo sapiens
ggucgugcuguuccucuuu

SEQ ID NO: 835531 - RNA, 19 nt, Homo sapiens
ccaugccucucuccuugug

SEQ ID NO: 835532 - RNA, 19 nt, Homo sapiens
gcuaaagaccagugcugau

SEQ ID NO: 835533 - RNA, 19 nt, Homo sapiens
cccgggaccucaccuucaa

SEQ ID NO: 835534 - RNA, 19 nt, Homo sapiens
guucuucaucgaccuuauu

SEQ ID NO: 835535 - RNA, 19 nt, Homo sapiens
cuagauaucauccugaacu

SEQ ID NO: 835536 - RNA, 19 nt, Homo sapiens
caugaaggccaauaauaac

SEQ ID NO: 835537 - RNA, 19 nt, Homo sapiens
ggaggcaugaaggccaaua

SEQ ID NO: 835538 - RNA, 19 nt, Homo sapiens
acagcacucccuauccuuu

SEQ ID NO: 835539 - RNA, 19 nt, Homo sapiens
gcugaggaggugaaggaaa

SEQ ID NO: 835540 - RNA, 19 nt, Homo sapiens
ccgacugaccggccacuuu

SEQ ID NO: 835541 - RNA, 19 nt, Homo sapiens
ggaaugaacucuuuacaga

SEQ ID NO: 835542 - RNA, 19 nt, Homo sapiens
gugcuacacuucccaguua

SEQ ID NO: 835543 - RNA, 19 nt, Homo sapiens
gaucagggauucagguuca

SEQ ID NO: 835544 - RNA, 19 nt, Homo sapiens
gaacauccuccaucagaaa

SEQ ID NO: 835545 - RNA, 19 nt, Homo sapiens
aagaauagguguuccuuug

SEQ ID NO: 835546 - RNA, 19 nt, Homo sapiens
guaccuacaucuucaggaa

SEQ ID NO: 835547 - RNA, 19 nt, Homo sapiens
guaaaccucuccuaaagca

SEQ ID NO: 835548 - RNA, 19 nt, Homo sapiens
ggcauaaguuggauaauag

SEQ ID NO: 835549 - RNA, 19 nt, Homo sapiens
aggcauaaguuggauaaua

SEQ ID NO: 835550 - RNA, 19 nt, Homo sapiens
ggaacauccuccaucagaa

SEQ ID NO: 835551 - RNA, 19 nt, Homo sapiens
ugaaaggaaugcucucaga

SEQ ID NO: 835552 - RNA, 19 nt, Homo sapiens
ucaaggaguugcagagaga

SEQ ID NO: 835553 - RNA, 19 nt, Homo sapiens
gaaaggaaugcucucagaa

SEQ ID NO: 835554 - RNA, 19 nt, Homo sapiens
caguaaaccucuccuaaag

SEQ ID NO: 835555 - RNA, 19 nt, Homo sapiens
caagguguguguaguaagu

SEQ ID NO: 835556 - RNA, 19 nt, Homo sapiens
aaaguugacuguguucuug

SEQ ID NO: 835557 - RNA, 19 nt, Homo sapiens
gacaguaaaccucuccuaa

SEQ ID NO: 835558 - RNA, 19 nt, Homo sapiens
ggugacaucuccagcaaca

SEQ ID NO: 835559 - RNA, 19 nt, Homo sapiens
acagcaagcucugacagua

SEQ ID NO: 835560 - RNA, 19 nt, Homo sapiens
gaacuucacaguaaagaac

SEQ ID NO: 835561 - RNA, 19 nt, Homo sapiens
ggguggagcugggaacauu

SEQ ID NO: 835562 - RNA, 19 nt, Homo sapiens
ggaaugcucucagaauggu

SEQ ID NO: 835563 - RNA, 19 nt, Homo sapiens
aaacagaagagaagaacaa

SEQ ID NO: 835564 - RNA, 19 nt, Homo sapiens
ucaagucugucaccuauac

SEQ ID NO: 835565 - RNA, 19 nt, Homo sapiens
uaaagcgagucgucaagga

SEQ ID NO: 835566 - RNA, 19 nt, Homo sapiens
ugggaggaaugaacucuuu

SEQ ID NO: 835567 - RNA, 19 nt, Homo sapiens
gcuccaagaucaucaaagc

SEQ ID NO: 835568 - RNA, 19 nt, Homo sapiens
gagagaguuuccucaccuu

SEQ ID NO: 835569 - RNA, 19 nt, Homo sapiens
gaaggagcaugggaggaau

SEQ ID NO: 835570 - RNA, 19 nt, Homo sapiens
aaggaaugcucucagaaug

SEQ ID NO: 835571 - RNA, 19 nt, Homo sapiens
acaguaaaccucuccuaaa

SEQ ID NO: 835572 - RNA, 19 nt, Homo sapiens
ccaguuacauucugaagcu

SEQ ID NO: 835573 - RNA, 19 nt, Homo sapiens
ucaacuggauggcggaugu

SEQ ID NO: 835574 - RNA, 19 nt, Homo sapiens
gaucacagguggccccauu

SEQ ID NO: 835575 - RNA, 19 nt, Homo sapiens
gaaugaacucuuuacagau

SEQ ID NO: 835576 - RNA, 19 nt, Homo sapiens
cuucugaacucgcaaacga

SEQ ID NO: 835577 - RNA, 19 nt, Homo sapiens
uuucaagucugucaccuau

SEQ ID NO: 835578 - RNA, 19 nt, Homo sapiens
caucagaaacagaagagaa

SEQ ID NO: 835579 - RNA, 19 nt, Homo sapiens
augagaagguuugugauuu

SEQ ID NO: 835580 - RNA, 19 nt, Homo sapiens
gaucuggcauccuccuaag

SEQ ID NO: 835581 - RNA, 19 nt, Homo sapiens
aaucacugcugcgaucuuu

SEQ ID NO: 835582 - RNA, 19 nt, Homo sapiens
ugagaagguuugugauuuu

SEQ ID NO: 835583 - RNA, 19 nt, Homo sapiens
caaaguugacuguguucuu

SEQ ID NO: 835584 - RNA, 19 nt, Homo sapiens
cagcaagcucugacaguaa

SEQ ID NO: 835585 - RNA, 19 nt, Homo sapiens
guaccuguauggagagaag

SEQ ID NO: 835586 - RNA, 19 nt, Homo sapiens
gaacggguuaccuggcauu

SEQ ID NO: 835587 - RNA, 19 nt, Homo sapiens
cgaaggagcaugggaggaa

SEQ ID NO: 835588 - RNA, 19 nt, Homo sapiens
ggaguugcagagagaguuu

SEQ ID NO: 835589 - RNA, 19 nt, Homo sapiens
gcgcggacuucgugagcuu

SEQ ID NO: 835590 - RNA, 19 nt, Homo sapiens
gcgcguggcccagauaaga

SEQ ID NO: 835591 - RNA, 19 nt, Homo sapiens
ggauaauaggcuuuaaaug

SEQ ID NO: 835592 - RNA, 19 nt, Homo sapiens
uaugagaagguuugugauu

SEQ ID NO: 835593 - RNA, 19 nt, Homo sapiens
agcaagcucugacaguaaa

SEQ ID NO: 835594 - RNA, 19 nt, Homo sapiens
gggaggaaugaacucuuua

SEQ ID NO: 835595 - RNA, 19 nt, Homo sapiens
ggacguccgggaaaugaau

SEQ ID NO: 835596 - RNA, 19 nt, Homo sapiens
uguaugagaagguuuguga

SEQ ID NO: 835597 - RNA, 19 nt, Homo sapiens
aaagggcugugcuacacuu

SEQ ID NO: 835598 - RNA, 19 nt, Homo sapiens
aaaggaaugcucucagaau

SEQ ID NO: 835599 - RNA, 19 nt, Homo sapiens
ccuacgagcugcgcgagaa

SEQ ID NO: 835600 - RNA, 19 nt, Homo sapiens
gggauucagguucauaaug

SEQ ID NO: 835601 - RNA, 19 nt, Homo sapiens
gcuaagaaaacgaucauuu

SEQ ID NO: 835602 - RNA, 19 nt, Homo sapiens
uaccucggcuccaagauca

SEQ ID NO: 835603 - RNA, 19 nt, Homo sapiens
gaagagaagaacaaaauca

SEQ ID NO: 835604 - RNA, 19 nt, Homo sapiens
ccagcaacauccaggcaau

SEQ ID NO: 835605 - RNA, 19 nt, Homo sapiens
uucugaagcucauaaaugu

SEQ ID NO: 835606 - RNA, 19 nt, Homo sapiens
uaagaauagguguuccuuu

SEQ ID NO: 835607 - RNA, 19 nt, Homo sapiens
ugaggcauaaguuggauaa

SEQ ID NO: 835608 - RNA, 19 nt, Homo sapiens
aagccaaaguugacugugu

SEQ ID NO: 835609 - RNA, 19 nt, Homo sapiens
uccggaagauucugucguu

SEQ ID NO: 835610 - RNA, 19 nt, Homo sapiens
ugacaucuccagcaacauc

SEQ ID NO: 835611 - RNA, 19 nt, Homo sapiens
gacaaagggcugugcuaca

SEQ ID NO: 835612 - RNA, 19 nt, Homo sapiens
cagcaaagccaaaguugac

SEQ ID NO: 835613 - RNA, 19 nt, Homo sapiens
ggcacugacuggugacauc

SEQ ID NO: 835614 - RNA, 19 nt, Homo sapiens
cugaagcucauaaauguau

SEQ ID NO: 835615 - RNA, 19 nt, Homo sapiens
acaaagggcugugcuacac

SEQ ID NO: 835616 - RNA, 19 nt, Homo sapiens
ccagcaaagccaaaguuga

SEQ ID NO: 835617 - RNA, 19 nt, Homo sapiens
gagcaugggaggaaugaac

SEQ ID NO: 835618 - RNA, 19 nt, Homo sapiens
gaaacagaagagaagaaca

SEQ ID NO: 835619 - RNA, 19 nt, Homo sapiens
caguaaagaacacguuugu

SEQ ID NO: 835620 - RNA, 19 nt, Homo sapiens
acacuucccaguuacauuc

SEQ ID NO: 835621 - RNA, 19 nt, Homo sapiens
cagauaagaauagguguuc

SEQ ID NO: 835622 - RNA, 19 nt, Homo sapiens
ugugguaccuacaucuuca

SEQ ID NO: 835623 - RNA, 19 nt, Homo sapiens
agccaaaguugacuguguu

SEQ ID NO: 835624 - RNA, 19 nt, Homo sapiens
ugucaccuauaccugguuu

SEQ ID NO: 835625 - RNA, 19 nt, Homo sapiens
cagaaacagaagagaagaa

SEQ ID NO: 835626 - RNA, 19 nt, Homo sapiens
gagaagguuugugauuuug

SEQ ID NO: 835627 - RNA, 19 nt, Homo sapiens
agguguguguaguaaguua

SEQ ID NO: 835628 - RNA, 19 nt, Homo sapiens
augcggcgaugguugcuuu

SEQ ID NO: 835629 - RNA, 19 nt, Homo sapiens
ccagauaagaauagguguu

SEQ ID NO: 835630 - RNA, 19 nt, Homo sapiens
gaggaaugaacucuuuaca

SEQ ID NO: 835631 - RNA, 19 nt, Homo sapiens
ggaggaaugaacucuuuac

SEQ ID NO: 835632 - RNA, 19 nt, Homo sapiens
cagggauucagguucauaa

SEQ ID NO: 835633 - RNA, 19 nt, Homo sapiens
aaaacuggauggacaugaa

SEQ ID NO: 835634 - RNA, 19 nt, Homo sapiens
caaagccaaaguugacugu

SEQ ID NO: 835635 - RNA, 19 nt, Homo sapiens
cagccuaguggcccaguuu

SEQ ID NO: 835636 - RNA, 19 nt, Homo sapiens
ggccaacuaccgcuacuuc

SEQ ID NO: 835637 - RNA, 19 nt, Homo sapiens
ucacugcugcgaucuuuua

SEQ ID NO: 835638 - RNA, 19 nt, Homo sapiens
cagaagagaagaacaaaau

SEQ ID NO: 835639 - RNA, 19 nt, Homo sapiens
gaggcugugcauccuguaa

SEQ ID NO: 835640 - RNA, 19 nt, Homo sapiens
aaauguaugagaagguuug

SEQ ID NO: 835641 - RNA, 19 nt, Homo sapiens
acaaagcggucaaauauua

SEQ ID NO: 835642 - RNA, 19 nt, Homo sapiens
ggaagggacuguucugaua

SEQ ID NO: 835643 - RNA, 19 nt, Homo sapiens
gcacagaguuccagacuga

SEQ ID NO: 835644 - RNA, 19 nt, Homo sapiens
caacaucgaugaaugcuuu

SEQ ID NO: 835645 - RNA, 19 nt, Homo sapiens
ggacaaagcggucaaauau

SEQ ID NO: 835646 - RNA, 19 nt, Homo sapiens
ccagagaacucaccaauau

SEQ ID NO: 835647 - RNA, 19 nt, Homo sapiens
uaacauagcccucagguuu

SEQ ID NO: 835648 - RNA, 19 nt, Homo sapiens
caucagcaaugucuaaaua

SEQ ID NO: 835649 - RNA, 19 nt, Homo sapiens
gagccugaauuucuuaaua

SEQ ID NO: 835650 - RNA, 19 nt, Homo sapiens
gcaagagacugaacuuaau

SEQ ID NO: 835651 - RNA, 19 nt, Homo sapiens
agacaaaucucacuugcua

SEQ ID NO: 835652 - RNA, 19 nt, Homo sapiens
gcauuuaucucucuuacuu

SEQ ID NO: 835653 - RNA, 19 nt, Homo sapiens
gaagugacccuuuccauga

SEQ ID NO: 835654 - RNA, 19 nt, Homo sapiens
gaacuugccugggaauuau

SEQ ID NO: 835655 - RNA, 19 nt, Homo sapiens
gaacaugcaucccucacuu

SEQ ID NO: 835656 - RNA, 19 nt, Homo sapiens
caaccacacuuucauuuga

SEQ ID NO: 835657 - RNA, 19 nt, Homo sapiens
uccaaacucucccaaauua

SEQ ID NO: 835658 - RNA, 19 nt, Homo sapiens
gaacaagggaugcaaaugu

SEQ ID NO: 835659 - RNA, 19 nt, Homo sapiens
gggcucaguuuguaacaua

SEQ ID NO: 835660 - RNA, 19 nt, Homo sapiens
cauucaagauuccagauua

SEQ ID NO: 835661 - RNA, 19 nt, Homo sapiens
ggaaauguccacuugauau

SEQ ID NO: 835662 - RNA, 19 nt, Homo sapiens
caauucaggucaauaauca

SEQ ID NO: 835663 - RNA, 19 nt, Homo sapiens
caaagacugugacaacaug

SEQ ID NO: 835664 - RNA, 19 nt, Homo sapiens
cuacaugccucaaugaaau

SEQ ID NO: 835665 - RNA, 19 nt, Homo sapiens
gaagagcaauuucucaaaa

SEQ ID NO: 835666 - RNA, 19 nt, Homo sapiens
gaagaagacgucaaugaau

SEQ ID NO: 835667 - RNA, 19 nt, Homo sapiens
gcuggaagauucugugaga

SEQ ID NO: 835668 - RNA, 19 nt, Homo sapiens
gggacaaucugugaaacua

SEQ ID NO: 835669 - RNA, 19 nt, Homo sapiens
ggaaugagaagacaaaucu

SEQ ID NO: 835670 - RNA, 19 nt, Homo sapiens
ggaggaaacugugaagaca

SEQ ID NO: 835671 - RNA, 19 nt, Homo sapiens
gaggauguucucuaaauaa

SEQ ID NO: 835672 - RNA, 19 nt, Homo sapiens
ccacaauuauucuggugua

SEQ ID NO: 835673 - RNA, 19 nt, Homo sapiens
ggacaaagacugugacaac

SEQ ID NO: 835674 - RNA, 19 nt, Homo sapiens
ccaggugccucucaaauuc

SEQ ID NO: 835675 - RNA, 19 nt, Homo sapiens
cugcaagggugucuaagua

SEQ ID NO: 835676 - RNA, 19 nt, Homo sapiens
uauccaagauguaagacua

SEQ ID NO: 835677 - RNA, 19 nt, Homo sapiens
gagaaaggauuggugugaa

SEQ ID NO: 835678 - RNA, 19 nt, Homo sapiens
ggaauuauacuugccauug

SEQ ID NO: 835679 - RNA, 19 nt, Homo sapiens
gugaacaggaagauuauua

SEQ ID NO: 835680 - RNA, 19 nt, Homo sapiens
gaaagccaaccuugucaaa

SEQ ID NO: 835681 - RNA, 19 nt, Homo sapiens
ggacugccuucuucuuuca

SEQ ID NO: 835682 - RNA, 19 nt, Homo sapiens
gcacaugugagccuggaua

SEQ ID NO: 835683 - RNA, 19 nt, Homo sapiens
gaugagagcuauggagaca

SEQ ID NO: 835684 - RNA, 19 nt, Homo sapiens
cgaagaagacgucaaugaa

SEQ ID NO: 835685 - RNA, 19 nt, Homo sapiens
ggacaguguugacaauuac

SEQ ID NO: 835686 - RNA, 19 nt, Homo sapiens
ggaggcaacugcacagagu

SEQ ID NO: 835687 - RNA, 19 nt, Homo sapiens
uaugucaucuuuacucuug

SEQ ID NO: 835688 - RNA, 19 nt, Homo sapiens
gauaaccuuucuagaacuu

SEQ ID NO: 835689 - RNA, 19 nt, Homo sapiens
gggaaacacugugaacuca

SEQ ID NO: 835690 - RNA, 19 nt, Homo sapiens
caaaggugcuucuguucau

SEQ ID NO: 835691 - RNA, 19 nt, Homo sapiens
gaaaucgcaaccacacuuu

SEQ ID NO: 835692 - RNA, 19 nt, Homo sapiens
aagaagacgucaaugaaug

SEQ ID NO: 835693 - RNA, 19 nt, Homo sapiens
gcgaagaagacgucaauga

SEQ ID NO: 835694 - RNA, 19 nt, Homo sapiens
ucacuggacugccuucuuc

SEQ ID NO: 835695 - RNA, 19 nt, Homo sapiens
caucugcccugcuggauau

SEQ ID NO: 835696 - RNA, 19 nt, Homo sapiens
gaacugugaaguggauaua

SEQ ID NO: 835697 - RNA, 19 nt, Homo sapiens
ggaagagcaauuucucaaa

SEQ ID NO: 835698 - RNA, 19 nt, Homo sapiens
gcaagggugucuaaguaca

SEQ ID NO: 835699 - RNA, 19 nt, Homo sapiens
aacaagggaugcaaaugua

SEQ ID NO: 835700 - RNA, 19 nt, Homo sapiens
ggauuugaauguauugcaa

SEQ ID NO: 835701 - RNA, 19 nt, Homo sapiens
ggaagauucugugagauag

SEQ ID NO: 835702 - RNA, 19 nt, Homo sapiens
ggacuuacucaacaaauuc

SEQ ID NO: 835703 - RNA, 19 nt, Homo sapiens
gaaacacugugaacucaac

SEQ ID NO: 835704 - RNA, 19 nt, Homo sapiens
agaaaggauuggugugaaa

SEQ ID NO: 835705 - RNA, 19 nt, Homo sapiens
gaaaacagcacuuaucaau

SEQ ID NO: 835706 - RNA, 19 nt, Homo sapiens
caggaugacuccacugguu

SEQ ID NO: 835707 - RNA, 19 nt, Homo sapiens
ccaacugucugagagagua

SEQ ID NO: 835708 - RNA, 19 nt, Homo sapiens
gcugugacccuuaccuuaa

SEQ ID NO: 835709 - RNA, 19 nt, Homo sapiens
ugagauagaucacgaugag

SEQ ID NO: 835710 - RNA, 19 nt, Homo sapiens
uaacuaccuucucaucuuc

SEQ ID NO: 835711 - RNA, 19 nt, Homo sapiens
agacacagccaauaauuug

SEQ ID NO: 835712 - RNA, 19 nt, Homo sapiens
guucagacacagccaauaa

SEQ ID NO: 835713 - RNA, 19 nt, Homo sapiens
caaaggcuguauccaagau

SEQ ID NO: 835714 - RNA, 19 nt, Homo sapiens
ggagaaaugcaucgcgaaa

SEQ ID NO: 835715 - RNA, 19 nt, Homo sapiens
gaaagccugugaggagguu

SEQ ID NO: 835716 - RNA, 19 nt, Homo sapiens
ggauuuauuucugcuucua

SEQ ID NO: 835717 - RNA, 19 nt, Homo sapiens
ggacuguucugauauucuc

SEQ ID NO: 835718 - RNA, 19 nt, Homo sapiens
ggagccaccugcauuaguc

SEQ ID NO: 835719 - RNA, 19 nt, Homo sapiens
cagaagcaaugggaauauu

SEQ ID NO: 835720 - RNA, 19 nt, Homo sapiens
gggaugacuucuccuguuc

SEQ ID NO: 835721 - RNA, 19 nt, Homo sapiens
gaaagcuccuacuccacuu

SEQ ID NO: 835722 - RNA, 19 nt, Homo sapiens
gcugcuaaguggcuacauu

SEQ ID NO: 835723 - RNA, 19 nt, Homo sapiens
gcaaccacacuuucauuug

SEQ ID NO: 835724 - RNA, 19 nt, Homo sapiens
gaagggacuguucugauau

SEQ ID NO: 835725 - RNA, 19 nt, Homo sapiens
cucaaugaaugcaauagua

SEQ ID NO: 835726 - RNA, 19 nt, Homo sapiens
aggacaguguugacaauua

SEQ ID NO: 835727 - RNA, 19 nt, Homo sapiens
acaauaaugcuacauguga

SEQ ID NO: 835728 - RNA, 19 nt, Homo sapiens
gacaaagacugugacaaca

SEQ ID NO: 835729 - RNA, 19 nt, Homo sapiens
ucacaauaaugcuacaugu

SEQ ID NO: 835730 - RNA, 19 nt, Homo sapiens
gaacucaacaucgaugaau

SEQ ID NO: 835731 - RNA, 19 nt, Homo sapiens
caaaaucucuaccaauuca

SEQ ID NO: 835732 - RNA, 19 nt, Homo sapiens
uaauaaaccucaggaagag

SEQ ID NO: 835733 - RNA, 19 nt, Homo sapiens
uuaauaaaccucaggaaga

SEQ ID NO: 835734 - RNA, 19 nt, Homo sapiens
uuaacuaccuucucaucuu

SEQ ID NO: 835735 - RNA, 19 nt, Homo sapiens
gcaagaacgaggcuacaug

SEQ ID NO: 835736 - RNA, 19 nt, Homo sapiens
ggaaguggacaacgaaaca

SEQ ID NO: 835737 - RNA, 19 nt, Homo sapiens
gaauuauacuugccauugc

SEQ ID NO: 835738 - RNA, 19 nt, Homo sapiens
ggagcuguccucagagaaa

SEQ ID NO: 835739 - RNA, 19 nt, Homo sapiens
guguggagcuguccucaga

SEQ ID NO: 835740 - RNA, 19 nt, Homo sapiens
acugugaacucaacacuga

SEQ ID NO: 835741 - RNA, 19 nt, Homo sapiens
gcacaaggauccuacauug

SEQ ID NO: 835742 - RNA, 19 nt, Homo sapiens
gagcagggcugacguugaa

SEQ ID NO: 835743 - RNA, 19 nt, Homo sapiens
ggucagauaucaaucauuc

SEQ ID NO: 835744 - RNA, 19 nt, Homo sapiens
gaaagucucuugcuugaac

SEQ ID NO: 835745 - RNA, 19 nt, Homo sapiens
ccuaguaucuuuacauuga

SEQ ID NO: 835746 - RNA, 19 nt, Homo sapiens
gaaaugggcgugagaaugu

SEQ ID NO: 835747 - RNA, 19 nt, Homo sapiens
gggaaagucucuugcuuga

SEQ ID NO: 835748 - RNA, 19 nt, Homo sapiens
ggagacagaugcucaugga

SEQ ID NO: 835749 - RNA, 19 nt, Homo sapiens
ggagaugguagaugaguua

SEQ ID NO: 835750 - RNA, 19 nt, Homo sapiens
gagcaccucuacuuugaaa

SEQ ID NO: 835751 - RNA, 19 nt, Homo sapiens
gggagaggauuaccuuuga

SEQ ID NO: 835752 - RNA, 19 nt, Homo sapiens
cagaacgacugcagcauuu

SEQ ID NO: 835753 - RNA, 19 nt, Homo sapiens
ggcguaagcuuugagauaa

SEQ ID NO: 835754 - RNA, 19 nt, Homo sapiens
ggaauaaugacaucgauga

SEQ ID NO: 835755 - RNA, 19 nt, Homo sapiens
ugacaaaggugccuacagu

SEQ ID NO: 835756 - RNA, 19 nt, Homo sapiens
gagcaagcguucuauaucu

SEQ ID NO: 835757 - RNA, 19 nt, Homo sapiens
gaacggacccgaaggagau

SEQ ID NO: 835758 - RNA, 19 nt, Homo sapiens
cgaggaagcugccugaaca

SEQ ID NO: 835759 - RNA, 19 nt, Homo sapiens
gaugguagaugaguuacaa

SEQ ID NO: 835760 - RNA, 19 nt, Homo sapiens
gcaguagucacccugaaua

SEQ ID NO: 835761 - RNA, 19 nt, Homo sapiens
agauaaagcuguacaccaa

SEQ ID NO: 835762 - RNA, 19 nt, Homo sapiens
ugauugagguugggaauaa

SEQ ID NO: 835763 - RNA, 19 nt, Homo sapiens
aaacacaccaccuugauuu

SEQ ID NO: 835764 - RNA, 19 nt, Homo sapiens
ucaaaggagucaaccgauu

SEQ ID NO: 835765 - RNA, 19 nt, Homo sapiens
gcagugggcuaccauaaac

SEQ ID NO: 835766 - RNA, 19 nt, Homo sapiens
gagaagacaccgugacaga

SEQ ID NO: 835767 - RNA, 19 nt, Homo sapiens
gacagaugcucauggauca

SEQ ID NO: 835768 - RNA, 19 nt, Homo sapiens
acgagagucugguguauuu

SEQ ID NO: 835769 - RNA, 19 nt, Homo sapiens
gcacagugucuuccuuaaa

SEQ ID NO: 835770 - RNA, 19 nt, Homo sapiens
gagauugucaucagugaaa

SEQ ID NO: 835771 - RNA, 19 nt, Homo sapiens
gcaaagagacaagccaaga

SEQ ID NO: 835772 - RNA, 19 nt, Homo sapiens
gaggauuggugcuggaaga

SEQ ID NO: 835773 - RNA, 19 nt, Homo sapiens
guggaaaugugaucacuuc

SEQ ID NO: 835774 - RNA, 19 nt, Homo sapiens
cagggaagcugaucgagau

SEQ ID NO: 835775 - RNA, 19 nt, Homo sapiens
gcaacaggguucagugucu

SEQ ID NO: 835776 - RNA, 19 nt, Homo sapiens
gaugacaugucugcaguug

SEQ ID NO: 835777 - RNA, 19 nt, Homo sapiens
cgccaugacuuucaccuuu

SEQ ID NO: 835778 - RNA, 19 nt, Homo sapiens
ggagagaaaaucacuguua

SEQ ID NO: 835779 - RNA, 19 nt, Homo sapiens
cauaguugcuggcuacaau

SEQ ID NO: 835780 - RNA, 19 nt, Homo sapiens
cgagaacuauguugugcuu

SEQ ID NO: 835781 - RNA, 19 nt, Homo sapiens
ugaaggaguuccgguuuga

SEQ ID NO: 835782 - RNA, 19 nt, Homo sapiens
ggaaggcgaagaaagaaug

SEQ ID NO: 835783 - RNA, 19 nt, Homo sapiens
ggaaaugggcgugagaaug

SEQ ID NO: 835784 - RNA, 19 nt, Homo sapiens
cgccaucacucuggaauuu

SEQ ID NO: 835785 - RNA, 19 nt, Homo sapiens
uggaagugcuggaggauga

SEQ ID NO: 835786 - RNA, 19 nt, Homo sapiens
gaagagggcaaguucagau

SEQ ID NO: 835787 - RNA, 19 nt, Homo sapiens
ucaaacccaugaugaagga

SEQ ID NO: 835788 - RNA, 19 nt, Homo sapiens
ccugagcgguggccuguuu

SEQ ID NO: 835789 - RNA, 19 nt, Homo sapiens
aaaggugccuacaguguug

SEQ ID NO: 835790 - RNA, 19 nt, Homo sapiens
caccuaguaucuuuacauu

SEQ ID NO: 835791 - RNA, 19 nt, Homo sapiens
ugacaugucugcaguugag

SEQ ID NO: 835792 - RNA, 19 nt, Homo sapiens
caccauccaugcucagaaa

SEQ ID NO: 835793 - RNA, 19 nt, Homo sapiens
gaugaaggaguuccgguuu

SEQ ID NO: 835794 - RNA, 19 nt, Homo sapiens
cgaaggagaugguguucca

SEQ ID NO: 835795 - RNA, 19 nt, Homo sapiens
aagauccaguccacaguua

SEQ ID NO: 835796 - RNA, 19 nt, Homo sapiens
gaaggcaacgaccacauug

SEQ ID NO: 835797 - RNA, 19 nt, Homo sapiens
ggccagaaccugaagauca

SEQ ID NO: 835798 - RNA, 19 nt, Homo sapiens
gcaugggacuuugaaauac

SEQ ID NO: 835799 - RNA, 19 nt, Homo sapiens
cagcaaccuguauucauua

SEQ ID NO: 835800 - RNA, 19 nt, Homo sapiens
cccagaagaugcaaagaga

SEQ ID NO: 835801 - RNA, 19 nt, Homo sapiens
ggacaacggcauucugaca

SEQ ID NO: 835802 - RNA, 19 nt, Homo sapiens
ugcaggagaugguagauga

SEQ ID NO: 835803 - RNA, 19 nt, Homo sapiens
ugaggaaggcgaagaaaga

SEQ ID NO: 835804 - RNA, 19 nt, Homo sapiens
gcugagauguucccugucu

SEQ ID NO: 835805 - RNA, 19 nt, Homo sapiens
caugauggauguggccuuu

SEQ ID NO: 835806 - RNA, 19 nt, Homo sapiens
caugaaaggcgugaaguuu

SEQ ID NO: 835807 - RNA, 19 nt, Homo sapiens
caaagagacaagccaagaa

SEQ ID NO: 835808 - RNA, 19 nt, Homo sapiens
ucagugacaucugcacaaa

SEQ ID NO: 835809 - RNA, 19 nt, Homo sapiens
guucaccgcugaucacagu

SEQ ID NO: 835810 - RNA, 19 nt, Homo sapiens
gaggcaagcaccacaguga

SEQ ID NO: 835811 - RNA, 19 nt, Homo sapiens
aaagagacaagccaagaaa

SEQ ID NO: 835812 - RNA, 19 nt, Homo sapiens
gcguaagcuuugagauaaa

SEQ ID NO: 835813 - RNA, 19 nt, Homo sapiens
caaaggugccuacaguguu

SEQ ID NO: 835814 - RNA, 19 nt, Homo sapiens
ucucguaugauuucucuua

SEQ ID NO: 835815 - RNA, 19 nt, Homo sapiens
uaugacacgucuucaccua

SEQ ID NO: 835816 - RNA, 19 nt, Homo sapiens
gaucaacuacucucucauc

SEQ ID NO: 835817 - RNA, 19 nt, Homo sapiens
acacugugauuccguucua

SEQ ID NO: 835818 - RNA, 19 nt, Homo sapiens
gaaauccucgcaacucauc

SEQ ID NO: 835819 - RNA, 19 nt, Homo sapiens
caaaggagucaaccgauuc

SEQ ID NO: 835820 - RNA, 19 nt, Homo sapiens
gcucauggaucauuuuguu

SEQ ID NO: 835821 - RNA, 19 nt, Homo sapiens
gaaggagggcuauguucug

SEQ ID NO: 835822 - RNA, 19 nt, Homo sapiens
gaaggagucgagauuguca

SEQ ID NO: 835823 - RNA, 19 nt, Homo sapiens
gccaugacuuucaccuuug

SEQ ID NO: 835824 - RNA, 19 nt, Homo sapiens
ggagaggauuaccuuugau

SEQ ID NO: 835825 - RNA, 19 nt, Homo sapiens
ccaugucccuugucacugu

SEQ ID NO: 835826 - RNA, 19 nt, Homo sapiens
gaacaggacaucgcacaag

SEQ ID NO: 835827 - RNA, 19 nt, Homo sapiens
ccagaucccaguaugacua

SEQ ID NO: 835828 - RNA, 19 nt, Homo sapiens
ccagaacgacugcagcauu

SEQ ID NO: 835829 - RNA, 19 nt, Homo sapiens
ccugagcccuggccaguau

SEQ ID NO: 835830 - RNA, 19 nt, Homo sapiens
gauuggugcuggaagaaca

SEQ ID NO: 835831 - RNA, 19 nt, Homo sapiens
gaucuucagccuucguuug

SEQ ID NO: 835832 - RNA, 19 nt, Homo sapiens
ccaagaaacagaagacaag

SEQ ID NO: 835833 - RNA, 19 nt, Homo sapiens
gaacuauguugugcuucug

SEQ ID NO: 835834 - RNA, 19 nt, Homo sapiens
gagggcaaguucagauuac

SEQ ID NO: 835835 - RNA, 19 nt, Homo sapiens
acaacggcauucugacauu

SEQ ID NO: 835836 - RNA, 19 nt, Homo sapiens
gaacuaucaccaccgacaa

SEQ ID NO: 835837 - RNA, 19 nt, Homo sapiens
gcaagcguucuauaucuau

SEQ ID NO: 835838 - RNA, 19 nt, Homo sapiens
uaaacacaccaccuugauu

SEQ ID NO: 835839 - RNA, 19 nt, Homo sapiens
cauaaacacaccaccuuga

SEQ ID NO: 835840 - RNA, 19 nt, Homo sapiens
caacggcauucugacauuc

SEQ ID NO: 835841 - RNA, 19 nt, Homo sapiens
gaaguuggauggucuguua

SEQ ID NO: 835842 - RNA, 19 nt, Homo sapiens
gaaauggacuaucaaauga

SEQ ID NO: 835843 - RNA, 19 nt, Homo sapiens
gcacagaaauggacuauca

SEQ ID NO: 835844 - RNA, 19 nt, Homo sapiens
ccaaagaacuaaugacaaa

SEQ ID NO: 835845 - RNA, 19 nt, Homo sapiens
agaggaagaucuugacuua

SEQ ID NO: 835846 - RNA, 19 nt, Homo sapiens
uaauuaaucugcccaguaa

SEQ ID NO: 835847 - RNA, 19 nt, Homo sapiens
gaagaaaucauggagauaa

SEQ ID NO: 835848 - RNA, 19 nt, Homo sapiens
gcaggugcaugucuagaua

SEQ ID NO: 835849 - RNA, 19 nt, Homo sapiens
aggaagaucuugacuuaua

SEQ ID NO: 835850 - RNA, 19 nt, Homo sapiens
gcaaagaaucuacaacaaa

SEQ ID NO: 835851 - RNA, 19 nt, Homo sapiens
gaaauugucagaagaaauc

SEQ ID NO: 835852 - RNA, 19 nt, Homo sapiens
ggaagaucuugacuuauau

SEQ ID NO: 835853 - RNA, 19 nt, Homo sapiens
gaucuugacuuauauucug

SEQ ID NO: 835854 - RNA, 19 nt, Homo sapiens
gcaucugccugaucauauu

SEQ ID NO: 835855 - RNA, 19 nt, Homo sapiens
aaagaucacugaaguugga

SEQ ID NO: 835856 - RNA, 19 nt, Homo sapiens
guagagagcuugaaaaucu

SEQ ID NO: 835857 - RNA, 19 nt, Homo sapiens
cagaagaaaucauggagau

SEQ ID NO: 835858 - RNA, 19 nt, Homo sapiens
guaauuaaucugcccagua

SEQ ID NO: 835859 - RNA, 19 nt, Homo sapiens
gagaaauugucagaagaaa

SEQ ID NO: 835860 - RNA, 19 nt, Homo sapiens
cuucuuggcucuuuaaugu

SEQ ID NO: 835861 - RNA, 19 nt, Homo sapiens
gcagcuaauuuaaacuuuc

SEQ ID NO: 835862 - RNA, 19 nt, Homo sapiens
ugacagcuaugaauuccuu

SEQ ID NO: 835863 - RNA, 19 nt, Homo sapiens
agaaauggacuaucaaaug

SEQ ID NO: 835864 - RNA, 19 nt, Homo sapiens
uaaguaguauacaggcuuu

SEQ ID NO: 835865 - RNA, 19 nt, Homo sapiens
gcauuuguggguagacuua

SEQ ID NO: 835866 - RNA, 19 nt, Homo sapiens
ugacuuauauucuguacca

SEQ ID NO: 835867 - RNA, 19 nt, Homo sapiens
gauggucuguuagaagaaa

SEQ ID NO: 835868 - RNA, 19 nt, Homo sapiens
gaaagcaaagaaucuacaa

SEQ ID NO: 835869 - RNA, 19 nt, Homo sapiens
gcagaaaaccaaagaacua

SEQ ID NO: 835870 - RNA, 19 nt, Homo sapiens
gaacuaaugacaaaaguga

SEQ ID NO: 835871 - RNA, 19 nt, Homo sapiens
gugcaucacauuucuuaaa

SEQ ID NO: 835872 - RNA, 19 nt, Homo sapiens
cagaaugccuguuaaaaga

SEQ ID NO: 835873 - RNA, 19 nt, Homo sapiens
guugagaaauugucagaag

SEQ ID NO: 835874 - RNA, 19 nt, Homo sapiens
ucuuggcucuuuaauguaa

SEQ ID NO: 835875 - RNA, 19 nt, Homo sapiens
gcaguuggcaggugcaugu

SEQ ID NO: 835876 - RNA, 19 nt, Homo sapiens
gaagaaaugcacucaccau

SEQ ID NO: 835877 - RNA, 19 nt, Homo sapiens
gaacuugucaaaugagucu

SEQ ID NO: 835878 - RNA, 19 nt, Homo sapiens
uggauggucuguuagaaga

SEQ ID NO: 835879 - RNA, 19 nt, Homo sapiens
aaucucagaaugccuguua

SEQ ID NO: 835880 - RNA, 19 nt, Homo sapiens
agaaaugcacucaccauga

SEQ ID NO: 835881 - RNA, 19 nt, Homo sapiens
gcuaugaauuccuuaaagc

SEQ ID NO: 835882 - RNA, 19 nt, Homo sapiens
acacuucuguggacuuuua

SEQ ID NO: 835883 - RNA, 19 nt, Homo sapiens
caaagcaucacgucaucuu

SEQ ID NO: 835884 - RNA, 19 nt, Homo sapiens
uaacugaaagcaaagaauc

SEQ ID NO: 835885 - RNA, 19 nt, Homo sapiens
caacaaaagacaaugauga

SEQ ID NO: 835886 - RNA, 19 nt, Homo sapiens
ggagggcaguagagagcuu

SEQ ID NO: 835887 - RNA, 19 nt, Homo sapiens
cacaaguucugaagagcaa

SEQ ID NO: 835888 - RNA, 19 nt, Homo sapiens
gagaggaagaucuugacuu

SEQ ID NO: 835889 - RNA, 19 nt, Homo sapiens
ugaauuccuuaaagccauu

SEQ ID NO: 835890 - RNA, 19 nt, Homo sapiens
ugagaaauugucagaagaa

SEQ ID NO: 835891 - RNA, 19 nt, Homo sapiens
gaauucaugauguugcuau

SEQ ID NO: 835892 - RNA, 19 nt, Homo sapiens
guuaaaagaucacugaagu

SEQ ID NO: 835893 - RNA, 19 nt, Homo sapiens
acugaggcauuaagaagaa

SEQ ID NO: 835894 - RNA, 19 nt, Homo sapiens
ucacaaagcaucacgucau

SEQ ID NO: 835895 - RNA, 19 nt, Homo sapiens
aacuggaacuugucaaaug

SEQ ID NO: 835896 - RNA, 19 nt, Homo sapiens
acuggaacuugucaaauga

SEQ ID NO: 835897 - RNA, 19 nt, Homo sapiens
gaaaucauggagauaaugc

SEQ ID NO: 835898 - RNA, 19 nt, Homo sapiens
guuggcaggugcaugucua

SEQ ID NO: 835899 - RNA, 19 nt, Homo sapiens
aaacugaggcauuaagaag

SEQ ID NO: 835900 - RNA, 19 nt, Homo sapiens
cacaaagcaucacgucauc

SEQ ID NO: 835901 - RNA, 19 nt, Homo sapiens
uaaacugaggcauuaagaa

SEQ ID NO: 835902 - RNA, 19 nt, Homo sapiens
uuaaucugcccaguaaaua

SEQ ID NO: 835903 - RNA, 19 nt, Homo sapiens
auacacuucuguggacuuu

SEQ ID NO: 835904 - RNA, 19 nt, Homo sapiens
aagccaacauggagaggaa

SEQ ID NO: 835905 - RNA, 19 nt, Homo sapiens
gaaaaccaaagaacuaaug

SEQ ID NO: 835906 - RNA, 19 nt, Homo sapiens
caacuggaacuugucaaau

SEQ ID NO: 835907 - RNA, 19 nt, Homo sapiens
aagcaaagaaucuacaaca

SEQ ID NO: 835908 - RNA, 19 nt, Homo sapiens
gugcaugucuagauaaaau

SEQ ID NO: 835909 - RNA, 19 nt, Homo sapiens
ggcaguagagagcuugaaa

SEQ ID NO: 835910 - RNA, 19 nt, Homo sapiens
agcaaagaaucuacaacaa

SEQ ID NO: 835911 - RNA, 19 nt, Homo sapiens
acagaaauggacuaucaaa

SEQ ID NO: 835912 - RNA, 19 nt, Homo sapiens
gcaccaacuucugcaucug

SEQ ID NO: 835913 - RNA, 19 nt, Homo sapiens
caucuugacagcuaugaau

SEQ ID NO: 835914 - RNA, 19 nt, Homo sapiens
uaacuuauucuccaacaac

SEQ ID NO: 835915 - RNA, 19 nt, Homo sapiens
uugagaaauugucagaaga

SEQ ID NO: 835916 - RNA, 19 nt, Homo sapiens
uaaaagaucacugaaguug

SEQ ID NO: 835917 - RNA, 19 nt, Homo sapiens
cagcuaugaauuccuuaaa

SEQ ID NO: 835918 - RNA, 19 nt, Homo sapiens
uggaaucuccugugcauca

SEQ ID NO: 835919 - RNA, 19 nt, Homo sapiens
aagcaucacgucaucuuga

SEQ ID NO: 835920 - RNA, 19 nt, Homo sapiens
aaagagaaaugcagaaaac

SEQ ID NO: 835921 - RNA, 19 nt, Homo sapiens
gaaaaucucauuggaaucu

SEQ ID NO: 835922 - RNA, 19 nt, Homo sapiens
gagcaaaagcacagaaaug

SEQ ID NO: 835923 - RNA, 19 nt, Homo sapiens
uauauucuguaccacauac

SEQ ID NO: 835924 - RNA, 19 nt, Homo sapiens
ggaacagagaaauauuugu

SEQ ID NO: 835925 - RNA, 19 nt, Homo sapiens
gaaaagaguacaggacuuc

SEQ ID NO: 835926 - RNA, 19 nt, Homo sapiens
cagaaauggacuaucaaau

SEQ ID NO: 835927 - RNA, 19 nt, Homo sapiens
caguaaauaccagcucgua

SEQ ID NO: 835928 - RNA, 19 nt, Homo sapiens
guuggauggucuguuagaa

SEQ ID NO: 835929 - RNA, 19 nt, Homo sapiens
agaagaaaucauggagaua

SEQ ID NO: 835930 - RNA, 19 nt, Homo sapiens
ucauggagauaaugcaaaa

SEQ ID NO: 835931 - RNA, 19 nt, Homo sapiens
uaaauaccagcucguagca

SEQ ID NO: 835932 - RNA, 19 nt, Homo sapiens
caucugccugaucauauuu

SEQ ID NO: 835933 - RNA, 19 nt, Homo sapiens
ucucagaaugccuguuaaa

SEQ ID NO: 835934 - RNA, 19 nt, Homo sapiens
acacgcaccaguagauaau

SEQ ID NO: 835935 - RNA, 19 nt, Homo sapiens
caacauggagaggaagauc

SEQ ID NO: 835936 - RNA, 19 nt, Homo sapiens
aaccaaagaacuaaugaca

SEQ ID NO: 835937 - RNA, 19 nt, Homo sapiens
caguggugcuuucccgaau

SEQ ID NO: 835938 - RNA, 19 nt, Homo sapiens
ugaaagcaaagaaucuaca

SEQ ID NO: 835939 - RNA, 19 nt, Homo sapiens
cauuucuucuuggcucuuu

SEQ ID NO: 835940 - RNA, 19 nt, Homo sapiens
ucugccugaucauauuuaa

SEQ ID NO: 835941 - RNA, 19 nt, Homo sapiens
gaacgaugcugcuguggua

SEQ ID NO: 835942 - RNA, 19 nt, Homo sapiens
gggaaacuguggcuaauaa

SEQ ID NO: 835943 - RNA, 19 nt, Homo sapiens
caagggcguuuaucaguuu

SEQ ID NO: 835944 - RNA, 19 nt, Homo sapiens
gagaaacgaagaagcagua

SEQ ID NO: 835945 - RNA, 19 nt, Homo sapiens
ggaacaccaucuacagaga

SEQ ID NO: 835946 - RNA, 19 nt, Homo sapiens
gaaggcauccgacugcauu

SEQ ID NO: 835947 - RNA, 19 nt, Homo sapiens
gcagggcaguccacuccua

SEQ ID NO: 835948 - RNA, 19 nt, Homo sapiens
ucacagcucucacccagau

SEQ ID NO: 835949 - RNA, 19 nt, Homo sapiens
guaccgggcugaagucaag

SEQ ID NO: 835950 - RNA, 19 nt, Homo sapiens
gaacaccaucuacagagaa

SEQ ID NO: 835951 - RNA, 19 nt, Homo sapiens
ucaagggcguuuaucaguu

SEQ ID NO: 835952 - RNA, 19 nt, Homo sapiens
gaaaggggcucuaaguucu

SEQ ID NO: 835953 - RNA, 19 nt, Homo sapiens
gcgagacgauugcccuguu

SEQ ID NO: 835954 - RNA, 19 nt, Homo sapiens
gugaaguucucccuggauu

SEQ ID NO: 835955 - RNA, 19 nt, Homo sapiens
gaccgucuacuuugacuuu

SEQ ID NO: 835956 - RNA, 19 nt, Homo sapiens
ucagagaccaguaaucaga

SEQ ID NO: 835957 - RNA, 19 nt, Homo sapiens
gagcggaagaccuuaauag

SEQ ID NO: 835958 - RNA, 19 nt, Homo sapiens
gcgaugagccucccauucu

SEQ ID NO: 835959 - RNA, 19 nt, Homo sapiens
gcaugggucauuugucuug

SEQ ID NO: 835960 - RNA, 19 nt, Homo sapiens
acaacuaggccagggauua

SEQ ID NO: 835961 - RNA, 19 nt, Homo sapiens
ggaaacuguggcuaauaaa

SEQ ID NO: 835962 - RNA, 19 nt, Homo sapiens
uaucccauauggagaagaa

SEQ ID NO: 835963 - RNA, 19 nt, Homo sapiens
uuaauagccgagucucuua

SEQ ID NO: 835964 - RNA, 19 nt, Homo sapiens
uaaguucuggcucuucuuu

SEQ ID NO: 835965 - RNA, 19 nt, Homo sapiens
ggaggccacuacgauguug

SEQ ID NO: 835966 - RNA, 19 nt, Homo sapiens
gcauccgacugcauuaagu

SEQ ID NO: 835967 - RNA, 19 nt, Homo sapiens
guaaugaguuuuccaccuu

SEQ ID NO: 835968 - RNA, 19 nt, Homo sapiens
gaaguucucccuggauuac

SEQ ID NO: 835969 - RNA, 19 nt, Homo sapiens
gaagaaaggggcucuaagu

SEQ ID NO: 835970 - RNA, 19 nt, Homo sapiens
gagcagggcgugaaguucu

SEQ ID NO: 835971 - RNA, 19 nt, Homo sapiens
ugaaguucucccuggauua

SEQ ID NO: 835972 - RNA, 19 nt, Homo sapiens
gcucuaaguucuggcucuu

SEQ ID NO: 835973 - RNA, 19 nt, Homo sapiens
gaaacuguggcuaauaaaa

SEQ ID NO: 835974 - RNA, 19 nt, Homo sapiens
caacuaggccagggauuag

SEQ ID NO: 835975 - RNA, 19 nt, Homo sapiens
cuacgauguugacugcuau

SEQ ID NO: 835976 - RNA, 19 nt, Homo sapiens
cagcuucagucaggugcua

SEQ ID NO: 835977 - RNA, 19 nt, Homo sapiens
acuacgauguugacugcua

SEQ ID NO: 835978 - RNA, 19 nt, Homo sapiens
uugcuucaguaaugaguuu

SEQ ID NO: 835979 - RNA, 19 nt, Homo sapiens
cgagacgauugcccuguuc

SEQ ID NO: 835980 - RNA, 19 nt, Homo sapiens
gugggaaacuguggcuaau

SEQ ID NO: 835981 - RNA, 19 nt, Homo sapiens
uuggugagcuguguauuuc

SEQ ID NO: 835982 - RNA, 19 nt, Homo sapiens
gugguagcccuuugccuuu

SEQ ID NO: 835983 - RNA, 19 nt, Homo sapiens
gucaggugcuacuguugaa

SEQ ID NO: 835984 - RNA, 19 nt, Homo sapiens
gguguccuaucccauaugg

SEQ ID NO: 835985 - RNA, 19 nt, Homo sapiens
gugcagcgcugaaaagaca

SEQ ID NO: 835986 - RNA, 19 nt, Homo sapiens
gguagcccuuugccuuuca

SEQ ID NO: 835987 - RNA, 19 nt, Homo sapiens
acagagaaacgaagaagca

SEQ ID NO: 835988 - RNA, 19 nt, Homo sapiens
uuagggcccugccucuguu

SEQ ID NO: 835989 - RNA, 19 nt, Homo sapiens
aacaccaucuacagagaaa

SEQ ID NO: 835990 - RNA, 19 nt, Homo sapiens
ugaagucaagggcguuuau

SEQ ID NO: 835991 - RNA, 19 nt, Homo sapiens
ucacguaccgggcugaagu

SEQ ID NO: 835992 - RNA, 19 nt, Homo sapiens
caugcaagcaggacagaau

SEQ ID NO: 835993 - RNA, 19 nt, Homo sapiens
ugcccaugcuugauucuug

SEQ ID NO: 835994 - RNA, 19 nt, Homo sapiens
ccuucgagcugccggacaa

SEQ ID NO: 835995 - RNA, 19 nt, Homo sapiens
ggacaggcaaugguucagu

SEQ ID NO: 835996 - RNA, 19 nt, Homo sapiens
cgagcggaagaccuuaaua

SEQ ID NO: 835997 - RNA, 19 nt, Homo sapiens
guagaaaacugugggaaac

SEQ ID NO: 835998 - RNA, 19 nt, Homo sapiens
cagagaccaguaaucagaa

SEQ ID NO: 835999 - RNA, 19 nt, Homo sapiens
gucaagggcguuuaucagu

SEQ ID NO: 836000 - RNA, 19 nt, Homo sapiens
ugugggaaacuguggcuaa

SEQ ID NO: 836001 - RNA, 19 nt, Homo sapiens
cuuggugagcuguguauuu

SEQ ID NO: 836002 - RNA, 19 nt, Homo sapiens
uucuggcucuucuuucuuu

SEQ ID NO: 836003 - RNA, 19 nt, Homo sapiens
ucuaaguucuggcucuucu

SEQ ID NO: 836004 - RNA, 19 nt, Homo sapiens
gaagucaagggcguuuauc

SEQ ID NO: 836005 - RNA, 19 nt, Homo sapiens
gagaagaaaggggcucuaa

SEQ ID NO: 836006 - RNA, 19 nt, Homo sapiens
augcaugggucauuugucu

SEQ ID NO: 836007 - RNA, 19 nt, Homo sapiens
uaagugugcagcgcugaaa

SEQ ID NO: 836008 - RNA, 19 nt, Homo sapiens
cgaugagccucccauucuc

SEQ ID NO: 836009 - RNA, 19 nt, Homo sapiens
cuuaauagccgagucucuu

SEQ ID NO: 836010 - RNA, 19 nt, Homo sapiens
ggugagcuguguauuuccu

SEQ ID NO: 836011 - RNA, 19 nt, Homo sapiens
ggagcagggcgugaaguuc

SEQ ID NO: 836012 - RNA, 19 nt, Homo sapiens
gaagugaacuggauacuga

SEQ ID NO: 836013 - RNA, 19 nt, Homo sapiens
gaaagaaccucacagaugu

SEQ ID NO: 836014 - RNA, 19 nt, Homo sapiens
guacacaaaugucaaagua

SEQ ID NO: 836015 - RNA, 19 nt, Homo sapiens
gaaggugguugaaucuuua

SEQ ID NO: 836016 - RNA, 19 nt, Homo sapiens
gaucgcacauguuuauuua

SEQ ID NO: 836017 - RNA, 19 nt, Homo sapiens
gaaaucauguggagaagaa

SEQ ID NO: 836018 - RNA, 19 nt, Homo sapiens
uaucuaagcuuccacauuu

SEQ ID NO: 836019 - RNA, 19 nt, Homo sapiens
gcaggagacuuuaaagaaa

SEQ ID NO: 836020 - RNA, 19 nt, Homo sapiens
gcugaaaugucuccuuaua

SEQ ID NO: 836021 - RNA, 19 nt, Homo sapiens
gaacugagcaacacaaaug

SEQ ID NO: 836022 - RNA, 19 nt, Homo sapiens
gaguagagaucacaaaugu

SEQ ID NO: 836023 - RNA, 19 nt, Homo sapiens
gaaaggguguccaacaguu

SEQ ID NO: 836024 - RNA, 19 nt, Homo sapiens
aagaugagaugaaggaaua

SEQ ID NO: 836025 - RNA, 19 nt, Homo sapiens
caacacaaaugaagugguu

SEQ ID NO: 836026 - RNA, 19 nt, Homo sapiens
ggagaaagaccaaguguau

SEQ ID NO: 836027 - RNA, 19 nt, Homo sapiens
uggaagagaugauucuaua

SEQ ID NO: 836028 - RNA, 19 nt, Homo sapiens
gaacacuggccucauauuu

SEQ ID NO: 836029 - RNA, 19 nt, Homo sapiens
gcaagcacaugaccucuga

SEQ ID NO: 836030 - RNA, 19 nt, Homo sapiens
ugaaaugucuccuuauaug

SEQ ID NO: 836031 - RNA, 19 nt, Homo sapiens
gaggaaauguacaaaguga

SEQ ID NO: 836032 - RNA, 19 nt, Homo sapiens
ggaaggagaucugguuuca

SEQ ID NO: 836033 - RNA, 19 nt, Homo sapiens
caaguuaauugucagauga

SEQ ID NO: 836034 - RNA, 19 nt, Homo sapiens
ucagugaccuucuacguaa

SEQ ID NO: 836035 - RNA, 19 nt, Homo sapiens
gcaagcacauggugauaau

SEQ ID NO: 836036 - RNA, 19 nt, Homo sapiens
cacagaaacugcaagaauu

SEQ ID NO: 836037 - RNA, 19 nt, Homo sapiens
gcacagaaacugcaagaau

SEQ ID NO: 836038 - RNA, 19 nt, Homo sapiens
ucugaaaccuugacaacua

SEQ ID NO: 836039 - RNA, 19 nt, Homo sapiens
ugacaaagcugacauucca

SEQ ID NO: 836040 - RNA, 19 nt, Homo sapiens
acacaacucuuggaaauga

SEQ ID NO: 836041 - RNA, 19 nt, Homo sapiens
ggaaauacuugacaaagcu

SEQ ID NO: 836042 - RNA, 19 nt, Homo sapiens
aaggagaucugguuucaaa

SEQ ID NO: 836043 - RNA, 19 nt, Homo sapiens
ggaaauguacaaagugaaa

SEQ ID NO: 836044 - RNA, 19 nt, Homo sapiens
gggcaacacuggagagaau

SEQ ID NO: 836045 - RNA, 19 nt, Homo sapiens
ugagugcuuuguuucauua

SEQ ID NO: 836046 - RNA, 19 nt, Homo sapiens
ugaaggugguugaaucuuu

SEQ ID NO: 836047 - RNA, 19 nt, Homo sapiens
gcacauggugauaaugaua

SEQ ID NO: 836048 - RNA, 19 nt, Homo sapiens
ccaauggacugguaucugu

SEQ ID NO: 836049 - RNA, 19 nt, Homo sapiens
ggagauacauaaguuggaa

SEQ ID NO: 836050 - RNA, 19 nt, Homo sapiens
gauuacaaaugcagacuug

SEQ ID NO: 836051 - RNA, 19 nt, Homo sapiens
uagcagaucuuccacaauc

SEQ ID NO: 836052 - RNA, 19 nt, Homo sapiens
cuaaggaaaugagugauaa

SEQ ID NO: 836053 - RNA, 19 nt, Homo sapiens
acacacaacucuuggaaau

SEQ ID NO: 836054 - RNA, 19 nt, Homo sapiens
gaacuucccugacccucau

SEQ ID NO: 836055 - RNA, 19 nt, Homo sapiens
ucaagaaccucuacuaagg

SEQ ID NO: 836056 - RNA, 19 nt, Homo sapiens
gguaugcuauguugacuau

SEQ ID NO: 836057 - RNA, 19 nt, Homo sapiens
uguaugagcuggauuaugg

SEQ ID NO: 836058 - RNA, 19 nt, Homo sapiens
ggcaggagauacauaaguu

SEQ ID NO: 836059 - RNA, 19 nt, Homo sapiens
ggacauaacaguuccucuu

SEQ ID NO: 836060 - RNA, 19 nt, Homo sapiens
gacuguagcauuaagguua

SEQ ID NO: 836061 - RNA, 19 nt, Homo sapiens
guagagaucacaaauguuc

SEQ ID NO: 836062 - RNA, 19 nt, Homo sapiens
gcagguagaagaaagcauu

SEQ ID NO: 836063 - RNA, 19 nt, Homo sapiens
cagaccugcuggugaaaua

SEQ ID NO: 836064 - RNA, 19 nt, Homo sapiens
agaaagaaccucacagaug

SEQ ID NO: 836065 - RNA, 19 nt, Homo sapiens
ccagagggaucgcacaugu

SEQ ID NO: 836066 - RNA, 19 nt, Homo sapiens
gaucuuugcaguggaaaua

SEQ ID NO: 836067 - RNA, 19 nt, Homo sapiens
auaaagguaugcuauguug

SEQ ID NO: 836068 - RNA, 19 nt, Homo sapiens
caaaugaagugguuaucag

SEQ ID NO: 836069 - RNA, 19 nt, Homo sapiens
cauaacaguuccucuuuua

SEQ ID NO: 836070 - RNA, 19 nt, Homo sapiens
gagcuguucugcagucuca

SEQ ID NO: 836071 - RNA, 19 nt, Homo sapiens
gauagagacuaguagaucu

SEQ ID NO: 836072 - RNA, 19 nt, Homo sapiens
uaagauagaggacuacuuc

SEQ ID NO: 836073 - RNA, 19 nt, Homo sapiens
gguugaaucuuuaacuugu

SEQ ID NO: 836074 - RNA, 19 nt, Homo sapiens
uaaacaagcauaacaaugg

SEQ ID NO: 836075 - RNA, 19 nt, Homo sapiens
gccauggccugcacagaaa

SEQ ID NO: 836076 - RNA, 19 nt, Homo sapiens
guuaagagauucuguuuug

SEQ ID NO: 836077 - RNA, 19 nt, Homo sapiens
aaacaaacaccaccguuga

SEQ ID NO: 836078 - RNA, 19 nt, Homo sapiens
ggagaucugguuucaaaga

SEQ ID NO: 836079 - RNA, 19 nt, Homo sapiens
auaccuggauucaugauuu

SEQ ID NO: 836080 - RNA, 19 nt, Homo sapiens
cgaauuagucaacauaaga

SEQ ID NO: 836081 - RNA, 19 nt, Homo sapiens
gacauaacaguuccucuuu

SEQ ID NO: 836082 - RNA, 19 nt, Homo sapiens
ggcaggagacuuuaaagaa

SEQ ID NO: 836083 - RNA, 19 nt, Homo sapiens
uaacagaguugacuuuuca

SEQ ID NO: 836084 - RNA, 19 nt, Homo sapiens
gccauuaagugcuguuuag

SEQ ID NO: 836085 - RNA, 19 nt, Homo sapiens
guucugcagucucauaaga

SEQ ID NO: 836086 - RNA, 19 nt, Homo sapiens
guaagggucugaacaagcu

SEQ ID NO: 836087 - RNA, 19 nt, Homo sapiens
ucaagccuccugccucuua

SEQ ID NO: 836088 - RNA, 19 nt, Homo sapiens
gaaccucuacuaaggaaau

SEQ ID NO: 836089 - RNA, 19 nt, Homo sapiens
caaagacauuccagugcaa

SEQ ID NO: 836090 - RNA, 19 nt, Homo sapiens
caaaggaaacucuguugga

SEQ ID NO: 836091 - RNA, 19 nt, Homo sapiens
ggaucgcacauguuuauuu

SEQ ID NO: 836092 - RNA, 19 nt, Homo sapiens
ugucagagcucagggaaau

SEQ ID NO: 836093 - RNA, 19 nt, Homo sapiens
ugaacuggauacugagaaa

SEQ ID NO: 836094 - RNA, 19 nt, Homo sapiens
uuugaacacuggccucaua

SEQ ID NO: 836095 - RNA, 19 nt, Homo sapiens
caaaggaguucuaaaagga

SEQ ID NO: 836096 - RNA, 19 nt, Homo sapiens
gcuuauguuugaugaaaga

SEQ ID NO: 836097 - RNA, 19 nt, Homo sapiens
ggacugguaucuguguaug

SEQ ID NO: 836098 - RNA, 19 nt, Homo sapiens
gcagugcugugguuaagag

SEQ ID NO: 836099 - RNA, 19 nt, Homo sapiens
cuagaagccuaucugagaa

SEQ ID NO: 836100 - RNA, 19 nt, Homo sapiens
cuggagagauuaccugcua

SEQ ID NO: 836101 - RNA, 19 nt, Homo sapiens
caagcucagugaccuucua

SEQ ID NO: 836102 - RNA, 19 nt, Homo sapiens
gugcugugguuaagagauu

SEQ ID NO: 836103 - RNA, 19 nt, Homo sapiens
augcugaaaugucuccuua

SEQ ID NO: 836104 - RNA, 19 nt, Homo sapiens
gcauuaagguuacaaaagu

SEQ ID NO: 836105 - RNA, 19 nt, Homo sapiens
gggcacaggucaucucaac

SEQ ID NO: 836106 - RNA, 19 nt, Homo sapiens
cgaggaggacgccugguua

SEQ ID NO: 836107 - RNA, 19 nt, Homo sapiens
gaagaugagaugaaggaau

SEQ ID NO: 836108 - RNA, 19 nt, Homo sapiens
cagcauagacuacauuucu

SEQ ID NO: 836109 - RNA, 19 nt, Homo sapiens
cugaaaccuugacaacuaa

SEQ ID NO: 836110 - RNA, 19 nt, Homo sapiens
gcaacacuggagagaauuu

SEQ ID NO: 836111 - RNA, 19 nt, Homo sapiens
ggaaaaugguuacgaguag

SEQ ID NO: 836112 - RNA, 19 nt, Homo sapiens
ggacggaucugauauuaaa

SEQ ID NO: 836113 - RNA, 19 nt, Homo sapiens
ucaaagcucucucccaaua

SEQ ID NO: 836114 - RNA, 19 nt, Homo sapiens
gcuggaacuuucugaauua

SEQ ID NO: 836115 - RNA, 19 nt, Homo sapiens
ggacagaggaggcuaauga

SEQ ID NO: 836116 - RNA, 19 nt, Homo sapiens
gaaaccagaucuagagcaa

SEQ ID NO: 836117 - RNA, 19 nt, Homo sapiens
ggaguuagaaccuuaauga

SEQ ID NO: 836118 - RNA, 19 nt, Homo sapiens
ggauggaguuagaaccuua

SEQ ID NO: 836119 - RNA, 19 nt, Homo sapiens
uaaaggcagucuccuguuu

SEQ ID NO: 836120 - RNA, 19 nt, Homo sapiens
gaagaaagagaucggauug

SEQ ID NO: 836121 - RNA, 19 nt, Homo sapiens
caucggcucuggaaucuuu

SEQ ID NO: 836122 - RNA, 19 nt, Homo sapiens
gaguagcccugaagaaaga

SEQ ID NO: 836123 - RNA, 19 nt, Homo sapiens
gaaaguaccugaggauugc

SEQ ID NO: 836124 - RNA, 19 nt, Homo sapiens
gauaauuucuuucguuugg

SEQ ID NO: 836125 - RNA, 19 nt, Homo sapiens
gggacaggcucaagcaauu

SEQ ID NO: 836126 - RNA, 19 nt, Homo sapiens
ucacaugggucaacuguuc

SEQ ID NO: 836127 - RNA, 19 nt, Homo sapiens
aaagcucucucccaauaua

SEQ ID NO: 836128 - RNA, 19 nt, Homo sapiens
ggaaauccaggcucacuuu

SEQ ID NO: 836129 - RNA, 19 nt, Homo sapiens
caggacggaucugauauua

SEQ ID NO: 836130 - RNA, 19 nt, Homo sapiens
caaagggagugcuggagaa

SEQ ID NO: 836131 - RNA, 19 nt, Homo sapiens
gaagcugguauuucuauuu

SEQ ID NO: 836132 - RNA, 19 nt, Homo sapiens
ucaacuaccucuucuaugg

SEQ ID NO: 836133 - RNA, 19 nt, Homo sapiens
gaagaggacaccugggaaa

SEQ ID NO: 836134 - RNA, 19 nt, Homo sapiens
caggcucacuuucugaaua

SEQ ID NO: 836135 - RNA, 19 nt, Homo sapiens
gcagucuccuguuuuauua

SEQ ID NO: 836136 - RNA, 19 nt, Homo sapiens
ugaggaacauauugagaaa

SEQ ID NO: 836137 - RNA, 19 nt, Homo sapiens
ggaaaaggacguucuaauu

SEQ ID NO: 836138 - RNA, 19 nt, Homo sapiens
agaaugcauuugaggauuu

SEQ ID NO: 836139 - RNA, 19 nt, Homo sapiens
cccaauauauuuacacgaa

SEQ ID NO: 836140 - RNA, 19 nt, Homo sapiens
ggcuggaacuuucugaauu

SEQ ID NO: 836141 - RNA, 19 nt, Homo sapiens
gaauacgcauuuagaaagg

SEQ ID NO: 836142 - RNA, 19 nt, Homo sapiens
gaagacacaucccuuucag

SEQ ID NO: 836143 - RNA, 19 nt, Homo sapiens
cgaauucugucugcuuaaa

SEQ ID NO: 836144 - RNA, 19 nt, Homo sapiens
uaagucaccucccauccaa

SEQ ID NO: 836145 - RNA, 19 nt, Homo sapiens
guuaaugggucucucuuca

SEQ ID NO: 836146 - RNA, 19 nt, Homo sapiens
gaagaaaguaccugaggau

SEQ ID NO: 836147 - RNA, 19 nt, Homo sapiens
gaaaaggacguucuaauuc

SEQ ID NO: 836148 - RNA, 19 nt, Homo sapiens
ccaaagaaccagccucuca

SEQ ID NO: 836149 - RNA, 19 nt, Homo sapiens
gcacgaagaccagcgagaa

SEQ ID NO: 836150 - RNA, 19 nt, Homo sapiens
ggaaggcuauggaguuugc

SEQ ID NO: 836151 - RNA, 19 nt, Homo sapiens
gcuuauugcuccucacaug

SEQ ID NO: 836152 - RNA, 19 nt, Homo sapiens
cacgguugcuggacagaua

SEQ ID NO: 836153 - RNA, 19 nt, Homo sapiens
caaugucgcuuaugucacu

SEQ ID NO: 836154 - RNA, 19 nt, Homo sapiens
ggaggcagcuuuugagguu

SEQ ID NO: 836155 - RNA, 19 nt, Homo sapiens
ugaaugcggaguaggaaua

SEQ ID NO: 836156 - RNA, 19 nt, Homo sapiens
ccaagacccuaucuguuca

SEQ ID NO: 836157 - RNA, 19 nt, Homo sapiens
ggaacuuucugaauuacgu

SEQ ID NO: 836158 - RNA, 19 nt, Homo sapiens
cggagucgcuggcacaguu

SEQ ID NO: 836159 - RNA, 19 nt, Homo sapiens
gggaaaggcggaagcagaa

SEQ ID NO: 836160 - RNA, 19 nt, Homo sapiens
gaaaggcggaagcagaaga

SEQ ID NO: 836161 - RNA, 19 nt, Homo sapiens
ugacauucauacccaaaga

SEQ ID NO: 836162 - RNA, 19 nt, Homo sapiens
uguacacacucaucaacua

SEQ ID NO: 836163 - RNA, 19 nt, Homo sapiens
gaguagcagugguuccuau

SEQ ID NO: 836164 - RNA, 19 nt, Homo sapiens
aaacgcgagugaccagaaa

SEQ ID NO: 836165 - RNA, 19 nt, Homo sapiens
gcugguauuucuauuucuu

SEQ ID NO: 836166 - RNA, 19 nt, Homo sapiens
uuguaaaguugaugccuua

SEQ ID NO: 836167 - RNA, 19 nt, Homo sapiens
gaucaugcccauuucuguu

SEQ ID NO: 836168 - RNA, 19 nt, Homo sapiens
aaaggaaggcuauggaguu

SEQ ID NO: 836169 - RNA, 19 nt, Homo sapiens
uagcagugguuccuauuuc

SEQ ID NO: 836170 - RNA, 19 nt, Homo sapiens
cccgaauucugucugcuua

SEQ ID NO: 836171 - RNA, 19 nt, Homo sapiens
aaggaaggcuauggaguuu

SEQ ID NO: 836172 - RNA, 19 nt, Homo sapiens
aaaggacguucuaauucaa

SEQ ID NO: 836173 - RNA, 19 nt, Homo sapiens
gaacggggaucgaaaagag

SEQ ID NO: 836174 - RNA, 19 nt, Homo sapiens
caucaacuaccucuucuau

SEQ ID NO: 836175 - RNA, 19 nt, Homo sapiens
uauggaggcuggaacuuuc

SEQ ID NO: 836176 - RNA, 19 nt, Homo sapiens
cgaauacgcauuuagaaag

SEQ ID NO: 836177 - RNA, 19 nt, Homo sapiens
uuacacgaauacgcauuua

SEQ ID NO: 836178 - RNA, 19 nt, Homo sapiens
gaaugcauuugaggauuuc

SEQ ID NO: 836179 - RNA, 19 nt, Homo sapiens
gaaacaacaccgaaaagaa

SEQ ID NO: 836180 - RNA, 19 nt, Homo sapiens
gaagaccagcgagaaagaa

SEQ ID NO: 836181 - RNA, 19 nt, Homo sapiens
agaaagagaucggauuggu

SEQ ID NO: 836182 - RNA, 19 nt, Homo sapiens
ggaguagcccugaagaaag

SEQ ID NO: 836183 - RNA, 19 nt, Homo sapiens
aggcucacuuucugaauaa

SEQ ID NO: 836184 - RNA, 19 nt, Homo sapiens
aagcugguauuucuauuuc

SEQ ID NO: 836185 - RNA, 19 nt, Homo sapiens
ugacugaggagcuuguuga

SEQ ID NO: 836186 - RNA, 19 nt, Homo sapiens
gcucucaucgucuggauug

SEQ ID NO: 836187 - RNA, 19 nt, Homo sapiens
agaaaguaccugaggauug

SEQ ID NO: 836188 - RNA, 19 nt, Homo sapiens
ggacuuaggauccuuuuau

SEQ ID NO: 836189 - RNA, 19 nt, Homo sapiens
gaggagagcauuggcugaa

SEQ ID NO: 836190 - RNA, 19 nt, Homo sapiens
gaaccggagcucauuacug

SEQ ID NO: 836191 - RNA, 19 nt, Homo sapiens
ucagcugccucuucaggaa

SEQ ID NO: 836192 - RNA, 19 nt, Homo sapiens
acacgaauacgcauuuaga

SEQ ID NO: 836193 - RNA, 19 nt, Homo sapiens
ucccugggcuucaaaggaa

SEQ ID NO: 836194 - RNA, 19 nt, Homo sapiens
gcugaagcccaguuccuuu

SEQ ID NO: 836195 - RNA, 19 nt, Homo sapiens
uagaggugcccauuccaua

SEQ ID NO: 836196 - RNA, 19 nt, Homo sapiens
ucuauuuccuggguguuua

SEQ ID NO: 836197 - RNA, 19 nt, Homo sapiens
gcuggaagaagccugauau

SEQ ID NO: 836198 - RNA, 19 nt, Homo sapiens
cggaguagcccugaagaaa

SEQ ID NO: 836199 - RNA, 19 nt, Homo sapiens
caacauggugccaaagcuu

SEQ ID NO: 836200 - RNA, 19 nt, Homo sapiens
gcucucucccaauauauuu

SEQ ID NO: 836201 - RNA, 19 nt, Homo sapiens
aaaaggacguucuaauuca

SEQ ID NO: 836202 - RNA, 19 nt, Homo sapiens
aaccagaucuagagcaaca

SEQ ID NO: 836203 - RNA, 19 nt, Homo sapiens
gcaaaggagaguacuucug

SEQ ID NO: 836204 - RNA, 19 nt, Homo sapiens
ugaagaaagagaucggauu

SEQ ID NO: 836205 - RNA, 19 nt, Homo sapiens
aaacaacaccgaaaagaaa

SEQ ID NO: 836206 - RNA, 19 nt, Homo sapiens
guagcagugguuccuauuu

SEQ ID NO: 836207 - RNA, 19 nt, Homo sapiens
ggggagaggugaagggaaa

SEQ ID NO: 836208 - RNA, 19 nt, Homo sapiens
ucagugucaugcugucuug

SEQ ID NO: 836209 - RNA, 19 nt, Homo sapiens
ccagaucagccuuaaguca

SEQ ID NO: 836210 - RNA, 19 nt, Homo sapiens
guguuucagugacuucauu

SEQ ID NO: 836211 - RNA, 19 nt, Homo sapiens
aagaaugcauuugaggauu

SEQ ID NO: 836212 - RNA, 19 nt, Homo sapiens
gaaauuaguccuaguguua

SEQ ID NO: 836213 - RNA, 19 nt, Homo sapiens
gaacuugacucucucaucu

SEQ ID NO: 836214 - RNA, 19 nt, Homo sapiens
uaaaguagcuccagaaugc

SEQ ID NO: 836215 - RNA, 19 nt, Homo sapiens
aaagauagcuugaguaaac

SEQ ID NO: 836216 - RNA, 19 nt, Homo sapiens
aaacagugcugaagccuuu

SEQ ID NO: 836217 - RNA, 19 nt, Homo sapiens
gcacagcaguuggcaguaa

SEQ ID NO: 836218 - RNA, 19 nt, Homo sapiens
gaaagauccuccuagugaa

SEQ ID NO: 836219 - RNA, 19 nt, Homo sapiens
uggaauaacugacaaauca

SEQ ID NO: 836220 - RNA, 19 nt, Homo sapiens
gacagucccuucuaugaaa

SEQ ID NO: 836221 - RNA, 19 nt, Homo sapiens
gggcagggcuuugaucauu

SEQ ID NO: 836222 - RNA, 19 nt, Homo sapiens
ugaaagauccuccuaguga

SEQ ID NO: 836223 - RNA, 19 nt, Homo sapiens
cgauuacucuugacacuuu

SEQ ID NO: 836224 - RNA, 19 nt, Homo sapiens
gagaaagacaaggaaauua

SEQ ID NO: 836225 - RNA, 19 nt, Homo sapiens
ggacaucgaccucuuagug

SEQ ID NO: 836226 - RNA, 19 nt, Homo sapiens
ggaaauuaguccuaguguu

SEQ ID NO: 836227 - RNA, 19 nt, Homo sapiens
ggagggaacuuuuauuuau

SEQ ID NO: 836228 - RNA, 19 nt, Homo sapiens
ggauugaaacagucuauaa

SEQ ID NO: 836229 - RNA, 19 nt, Homo sapiens
ggaagcuagucccuuguuu

SEQ ID NO: 836230 - RNA, 19 nt, Homo sapiens
gcaauggaauaacugacaa

SEQ ID NO: 836231 - RNA, 19 nt, Homo sapiens
gaagugaauacaacauuga

SEQ ID NO: 836232 - RNA, 19 nt, Homo sapiens
ggacauaaagauagcuuga

SEQ ID NO: 836233 - RNA, 19 nt, Homo sapiens
ggugguuucuguaauuaaa

SEQ ID NO: 836234 - RNA, 19 nt, Homo sapiens
aaagaguacuggacgauau

SEQ ID NO: 836235 - RNA, 19 nt, Homo sapiens
gguuacauguuaucauuug

SEQ ID NO: 836236 - RNA, 19 nt, Homo sapiens
cuaugaaagugcugaaauu

SEQ ID NO: 836237 - RNA, 19 nt, Homo sapiens
ccaguuauacuauguacua

SEQ ID NO: 836238 - RNA, 19 nt, Homo sapiens
aaucugcugugcacaauuu

SEQ ID NO: 836239 - RNA, 19 nt, Homo sapiens
gaagaaggagaaaguugaa

SEQ ID NO: 836240 - RNA, 19 nt, Homo sapiens
ggaaagcucguacuuacug

SEQ ID NO: 836241 - RNA, 19 nt, Homo sapiens
ugauaaaccuucacucuac

SEQ ID NO: 836242 - RNA, 19 nt, Homo sapiens
aaucacaagugguuuaguu

SEQ ID NO: 836243 - RNA, 19 nt, Homo sapiens
ugacaaaucacaagugguu

SEQ ID NO: 836244 - RNA, 19 nt, Homo sapiens
ucucucaucugucuaaaga

SEQ ID NO: 836245 - RNA, 19 nt, Homo sapiens
ugaagugaauacaacauug

SEQ ID NO: 836246 - RNA, 19 nt, Homo sapiens
gcaaaugcuacaacaaaga

SEQ ID NO: 836247 - RNA, 19 nt, Homo sapiens
cgagcagcauguaaucuuu

SEQ ID NO: 836248 - RNA, 19 nt, Homo sapiens
cauuugcuguucuuacaua

SEQ ID NO: 836249 - RNA, 19 nt, Homo sapiens
uggcaacgcuggugcuuga

SEQ ID NO: 836250 - RNA, 19 nt, Homo sapiens
aaaggcaccuccaccagaa

SEQ ID NO: 836251 - RNA, 19 nt, Homo sapiens
gcagggcuuugaucauuca

SEQ ID NO: 836252 - RNA, 19 nt, Homo sapiens
gcugaagccuuuaaaugca

SEQ ID NO: 836253 - RNA, 19 nt, Homo sapiens
ugaaucaggguaugaaauu

SEQ ID NO: 836254 - RNA, 19 nt, Homo sapiens
gagaagaaggagaaaguug

SEQ ID NO: 836255 - RNA, 19 nt, Homo sapiens
gcaguggugguuucuguaa

SEQ ID NO: 836256 - RNA, 19 nt, Homo sapiens
acaaaucacaagugguuua

SEQ ID NO: 836257 - RNA, 19 nt, Homo sapiens
ugucagcagucaaugauga

SEQ ID NO: 836258 - RNA, 19 nt, Homo sapiens
gaaagacaaggaaauuagu

SEQ ID NO: 836259 - RNA, 19 nt, Homo sapiens
uaacuugaauuccauccau

SEQ ID NO: 836260 - RNA, 19 nt, Homo sapiens
caaagagaaaccugagaaa

SEQ ID NO: 836261 - RNA, 19 nt, Homo sapiens
gaaguauguuccaauccau

SEQ ID NO: 836262 - RNA, 19 nt, Homo sapiens
gcaacgcuggugcuugaua

SEQ ID NO: 836263 - RNA, 19 nt, Homo sapiens
gaugcugccaggauaauuu

SEQ ID NO: 836264 - RNA, 19 nt, Homo sapiens
caacgucaccgucauuauc

SEQ ID NO: 836265 - RNA, 19 nt, Homo sapiens
aaacaaaucacaccucaag

SEQ ID NO: 836266 - RNA, 19 nt, Homo sapiens
agucugacauucugaaaga

SEQ ID NO: 836267 - RNA, 19 nt, Homo sapiens
aagagaaaccugagaaaga

SEQ ID NO: 836268 - RNA, 19 nt, Homo sapiens
guggugguuucuguaauua

SEQ ID NO: 836269 - RNA, 19 nt, Homo sapiens
uacauaagcacucaugaaa

SEQ ID NO: 836270 - RNA, 19 nt, Homo sapiens
ccagauagccugcauuugc

SEQ ID NO: 836271 - RNA, 19 nt, Homo sapiens
uaucacagacuuuaaggaa

SEQ ID NO: 836272 - RNA, 19 nt, Homo sapiens
caaagaccagcgaaacaaa

SEQ ID NO: 836273 - RNA, 19 nt, Homo sapiens
gaagcaaacagcauacagu

SEQ ID NO: 836274 - RNA, 19 nt, Homo sapiens
aaaccaaaccaaagucuga

SEQ ID NO: 836275 - RNA, 19 nt, Homo sapiens
cauaagcacucaugaaaau

SEQ ID NO: 836276 - RNA, 19 nt, Homo sapiens
gcuccagaaugccaaguau

SEQ ID NO: 836277 - RNA, 19 nt, Homo sapiens
ggguacagcccauccauga

SEQ ID NO: 836278 - RNA, 19 nt, Homo sapiens
guucuuucuuccaguuaua

SEQ ID NO: 836279 - RNA, 19 nt, Homo sapiens
ugagaaagacaaggaaauu

SEQ ID NO: 836280 - RNA, 19 nt, Homo sapiens
gaagcuagucccuuguuuc

SEQ ID NO: 836281 - RNA, 19 nt, Homo sapiens
ccaaguauucguguaaauu

SEQ ID NO: 836282 - RNA, 19 nt, Homo sapiens
caugaaguauguuccaauc

SEQ ID NO: 836283 - RNA, 19 nt, Homo sapiens
ggucagagagcacagacaa

SEQ ID NO: 836284 - RNA, 19 nt, Homo sapiens
ucacagacuuuaaggaaaa

SEQ ID NO: 836285 - RNA, 19 nt, Homo sapiens
uucauucucuucacucuuu

SEQ ID NO: 836286 - RNA, 19 nt, Homo sapiens
gagguaaaucuagaaauug

SEQ ID NO: 836287 - RNA, 19 nt, Homo sapiens
uuaaagacugcuccagaua

SEQ ID NO: 836288 - RNA, 19 nt, Homo sapiens
ugaaguauguuccaaucca

SEQ ID NO: 836289 - RNA, 19 nt, Homo sapiens
cgacaugucagcagucaau

SEQ ID NO: 836290 - RNA, 19 nt, Homo sapiens
aaaccaaagucugacauuc

SEQ ID NO: 836291 - RNA, 19 nt, Homo sapiens
gcagggaaagcucguacuu

SEQ ID NO: 836292 - RNA, 19 nt, Homo sapiens
acgguuacauguuaucauu

SEQ ID NO: 836293 - RNA, 19 nt, Homo sapiens
gugcugaagccuuuaaaug

SEQ ID NO: 836294 - RNA, 19 nt, Homo sapiens
gaauaacugacaaaucaca

SEQ ID NO: 836295 - RNA, 19 nt, Homo sapiens
guccuaguguuaccaagaa

SEQ ID NO: 836296 - RNA, 19 nt, Homo sapiens
acauaaagauagcuugagu

SEQ ID NO: 836297 - RNA, 19 nt, Homo sapiens
acaaguggcacaacaguau

SEQ ID NO: 836298 - RNA, 19 nt, Homo sapiens
uaaagaguacuggacgaua

SEQ ID NO: 836299 - RNA, 19 nt, Homo sapiens
cagcauauccuuuuaaguu

SEQ ID NO: 836300 - RNA, 19 nt, Homo sapiens
gacaucgaccucuuaguga

SEQ ID NO: 836301 - RNA, 19 nt, Homo sapiens
agaagaaggagaaaguuga

SEQ ID NO: 836302 - RNA, 19 nt, Homo sapiens
caacaaagaccagcgaaac

SEQ ID NO: 836303 - RNA, 19 nt, Homo sapiens
ugucugagguaaaucuaga

SEQ ID NO: 836304 - RNA, 19 nt, Homo sapiens
gacgucuacucaugucuga

SEQ ID NO: 836305 - RNA, 19 nt, Homo sapiens
uagugaugcugccaggaua

SEQ ID NO: 836306 - RNA, 19 nt, Homo sapiens
gaaaaccucggaucaauuc

SEQ ID NO: 836307 - RNA, 19 nt, Homo sapiens
cagggaaagcucguacuua

SEQ ID NO: 836308 - RNA, 19 nt, Homo sapiens
caugucccuuugucugaua

SEQ ID NO: 836309 - RNA, 19 nt, Homo sapiens
acaaagagaaaccugagaa

SEQ ID NO: 836310 - RNA, 19 nt, Homo sapiens
ggagaagaaggagaaaguu

SEQ ID NO: 836311 - RNA, 19 nt, Homo sapiens
cugcaaaugcuacaacaaa

SEQ ID NO: 836312 - RNA, 19 nt, Homo sapiens
ggccacagcuuucaaaucg

SEQ ID NO: 836313 - RNA, 19 nt, Homo sapiens
gggagcagcaccucuacua

SEQ ID NO: 836314 - RNA, 19 nt, Homo sapiens
gcagcaaacgggcauuguu

SEQ ID NO: 836315 - RNA, 19 nt, Homo sapiens
cagcaaacgggcauuguug

SEQ ID NO: 836316 - RNA, 19 nt, Homo sapiens
uaucacaccggccuccaua

SEQ ID NO: 836317 - RNA, 19 nt, Homo sapiens
cauacuggaugcacuucug

SEQ ID NO: 836318 - RNA, 19 nt, Homo sapiens
cgccauacccgcugaagga

SEQ ID NO: 836319 - RNA, 19 nt, Homo sapiens
cgacguggacaauaaugug

SEQ ID NO: 836320 - RNA, 19 nt, Homo sapiens
ggggcgacguggacaauaa

SEQ ID NO: 836321 - RNA, 19 nt, Homo sapiens
ggaaguccccguaguggaa

SEQ ID NO: 836322 - RNA, 19 nt, Homo sapiens
ccauacgggccacagcuuu

SEQ ID NO: 836323 - RNA, 19 nt, Homo sapiens
gaggagcccgugaacaucu

SEQ ID NO: 836324 - RNA, 19 nt, Homo sapiens
ggaggagcccgugaacauc

SEQ ID NO: 836325 - RNA, 19 nt, Homo sapiens
uggaggagcccgugaacau

SEQ ID NO: 836326 - RNA, 19 nt, Homo sapiens
caucgugcacccacaguuc

SEQ ID NO: 836327 - RNA, 19 nt, Homo sapiens
aaccggacaucaaggaucu

SEQ ID NO: 836328 - RNA, 19 nt, Homo sapiens
gggccacagcuuucaaauc

SEQ ID NO: 836329 - RNA, 19 nt, Homo sapiens
gaauguagaucaagcuaua

SEQ ID NO: 836330 - RNA, 19 nt, Homo sapiens
gaccuaagcuaauguuaua

SEQ ID NO: 836331 - RNA, 19 nt, Homo sapiens
gaaauaugcuccugauaau

SEQ ID NO: 836332 - RNA, 19 nt, Homo sapiens
cagaagcccugcuaaauuu

SEQ ID NO: 836333 - RNA, 19 nt, Homo sapiens
gaaacaaccaguacucaua

SEQ ID NO: 836334 - RNA, 19 nt, Homo sapiens
ggaagaaacuacugaauac

SEQ ID NO: 836335 - RNA, 19 nt, Homo sapiens
ggugguagaugcuucuuua

SEQ ID NO: 836336 - RNA, 19 nt, Homo sapiens
gaggaaagcucccaguaga

SEQ ID NO: 836337 - RNA, 19 nt, Homo sapiens
gacaaugaaugcuguguuu

SEQ ID NO: 836338 - RNA, 19 nt, Homo sapiens
ccacagagauuucuucaag

SEQ ID NO: 836339 - RNA, 19 nt, Homo sapiens
gaucaaugguuuacauaga

SEQ ID NO: 836340 - RNA, 19 nt, Homo sapiens
uagcagagcuggcugagaa

SEQ ID NO: 836341 - RNA, 19 nt, Homo sapiens
gaacugcccuugguugaga

SEQ ID NO: 836342 - RNA, 19 nt, Homo sapiens
gaauguauggugagacuua

SEQ ID NO: 836343 - RNA, 19 nt, Homo sapiens
ggacugaaagagacaaaua

SEQ ID NO: 836344 - RNA, 19 nt, Homo sapiens
ggaauguaguguaugguuu

SEQ ID NO: 836345 - RNA, 19 nt, Homo sapiens
gaacucaugguacuucuaa

SEQ ID NO: 836346 - RNA, 19 nt, Homo sapiens
gcaaguaguuggaggaaag

SEQ ID NO: 836347 - RNA, 19 nt, Homo sapiens
caaggaaaccucuuagaaa

SEQ ID NO: 836348 - RNA, 19 nt, Homo sapiens
aaggaaaucuuacugguuu

SEQ ID NO: 836349 - RNA, 19 nt, Homo sapiens
ggaagucuguaauaaugaa

SEQ ID NO: 836350 - RNA, 19 nt, Homo sapiens
cagaggaaguuauagcuaa

SEQ ID NO: 836351 - RNA, 19 nt, Homo sapiens
ugucaaauguggcauauga

SEQ ID NO: 836352 - RNA, 19 nt, Homo sapiens
ucaaaggacaagugaauua

SEQ ID NO: 836353 - RNA, 19 nt, Homo sapiens
cuauaucagugucuucuua

SEQ ID NO: 836354 - RNA, 19 nt, Homo sapiens
ggucuaggaucagaaagua

SEQ ID NO: 836355 - RNA, 19 nt, Homo sapiens
gagaauucaucuggauaua

SEQ ID NO: 836356 - RNA, 19 nt, Homo sapiens
caaguuagcccaacaagga

SEQ ID NO: 836357 - RNA, 19 nt, Homo sapiens
gcuggaagguauaaagaaa

SEQ ID NO: 836358 - RNA, 19 nt, Homo sapiens
gagacaacaugcauuugaa

SEQ ID NO: 836359 - RNA, 19 nt, Homo sapiens
aacagaagaucagcaauua

SEQ ID NO: 836360 - RNA, 19 nt, Homo sapiens
gcaccaugguuacaaauuc

SEQ ID NO: 836361 - RNA, 19 nt, Homo sapiens
uuauuuggcuguuuccuua

SEQ ID NO: 836362 - RNA, 19 nt, Homo sapiens
ugaaggcucuuaccuaugu

SEQ ID NO: 836363 - RNA, 19 nt, Homo sapiens
gaaacuaagacuccauauu

SEQ ID NO: 836364 - RNA, 19 nt, Homo sapiens
gcaguucagucuuaucuca

SEQ ID NO: 836365 - RNA, 19 nt, Homo sapiens
agaaauaugcuccugauaa

SEQ ID NO: 836366 - RNA, 19 nt, Homo sapiens
gugaaaugcuuggauauga

SEQ ID NO: 836367 - RNA, 19 nt, Homo sapiens
gaagggagacaugaaauug

SEQ ID NO: 836368 - RNA, 19 nt, Homo sapiens
gaucagcaauuaagacucu

SEQ ID NO: 836369 - RNA, 19 nt, Homo sapiens
caagaucaaugguuuacau

SEQ ID NO: 836370 - RNA, 19 nt, Homo sapiens
gcacuuccuucugcacuaa

SEQ ID NO: 836371 - RNA, 19 nt, Homo sapiens
ggaucaaucucaaguucuu

SEQ ID NO: 836372 - RNA, 19 nt, Homo sapiens
caggcgcacucuucuaaua

SEQ ID NO: 836373 - RNA, 19 nt, Homo sapiens
gaagagcugaguuaaauca

SEQ ID NO: 836374 - RNA, 19 nt, Homo sapiens
gaucaaaggacaagugaau

SEQ ID NO: 836375 - RNA, 19 nt, Homo sapiens
caagugugguuuauauguu

SEQ ID NO: 836376 - RNA, 19 nt, Homo sapiens
ucuaugcaguucagucuua

SEQ ID NO: 836377 - RNA, 19 nt, Homo sapiens
gagcugaguuaaaucacaa

SEQ ID NO: 836378 - RNA, 19 nt, Homo sapiens
ggaacugaguagucugaaa

SEQ ID NO: 836379 - RNA, 19 nt, Homo sapiens
gaaggaauguauggugaga

SEQ ID NO: 836380 - RNA, 19 nt, Homo sapiens
guucuacucuuccugacua

SEQ ID NO: 836381 - RNA, 19 nt, Homo sapiens
gaaacuauaucagugucuu

SEQ ID NO: 836382 - RNA, 19 nt, Homo sapiens
cuaauacaguugagagauu

SEQ ID NO: 836383 - RNA, 19 nt, Homo sapiens
caacaccagaugacaauaa

SEQ ID NO: 836384 - RNA, 19 nt, Homo sapiens
ggacaagugaauuaaugua

SEQ ID NO: 836385 - RNA, 19 nt, Homo sapiens
gaaaagcuguucuggcauu

SEQ ID NO: 836386 - RNA, 19 nt, Homo sapiens
gaucaguguugaacuaagu

SEQ ID NO: 836387 - RNA, 19 nt, Homo sapiens
gcaaaugaugugaaacaaa

SEQ ID NO: 836388 - RNA, 19 nt, Homo sapiens
gaaggaaaucuuacugguu

SEQ ID NO: 836389 - RNA, 19 nt, Homo sapiens
uaagagugguuuggaauug

SEQ ID NO: 836390 - RNA, 19 nt, Homo sapiens
acagagauuucuucaaguu

SEQ ID NO: 836391 - RNA, 19 nt, Homo sapiens
ggaagggagacaugaaauu

SEQ ID NO: 836392 - RNA, 19 nt, Homo sapiens
ucacagaacugcccuuggu

SEQ ID NO: 836393 - RNA, 19 nt, Homo sapiens
caaucaaccugcugggaaa

SEQ ID NO: 836394 - RNA, 19 nt, Homo sapiens
uguaugauguucuugauga

SEQ ID NO: 836395 - RNA, 19 nt, Homo sapiens
uccaaucugugaucuauuu

SEQ ID NO: 836396 - RNA, 19 nt, Homo sapiens
uuagaucaguguugaacua

SEQ ID NO: 836397 - RNA, 19 nt, Homo sapiens
uaauaagagugguuuggaa

SEQ ID NO: 836398 - RNA, 19 nt, Homo sapiens
ucgaauacuuugcacgaua

SEQ ID NO: 836399 - RNA, 19 nt, Homo sapiens
acgaagagcugaguuaaau

SEQ ID NO: 836400 - RNA, 19 nt, Homo sapiens
ggagacaugaaauugauaa

SEQ ID NO: 836401 - RNA, 19 nt, Homo sapiens
guaauaaagccaagucuca

SEQ ID NO: 836402 - RNA, 19 nt, Homo sapiens
uggaagaaacuacugaaua

SEQ ID NO: 836403 - RNA, 19 nt, Homo sapiens
gcacucuucuaauacaguu

SEQ ID NO: 836404 - RNA, 19 nt, Homo sapiens
ucacagcccucaccuccaa

SEQ ID NO: 836405 - RNA, 19 nt, Homo sapiens
aaacagaagaucagcaauu

SEQ ID NO: 836406 - RNA, 19 nt, Homo sapiens
caugguacuucuaaugaaa

SEQ ID NO: 836407 - RNA, 19 nt, Homo sapiens
gcuauggaagucuguaaua

SEQ ID NO: 836408 - RNA, 19 nt, Homo sapiens
gaauacauacacucaaaug

SEQ ID NO: 836409 - RNA, 19 nt, Homo sapiens
aaacaaccaguacucauaa

SEQ ID NO: 836410 - RNA, 19 nt, Homo sapiens
gauacugucucucacaagu

SEQ ID NO: 836411 - RNA, 19 nt, Homo sapiens
caaagaagaguaugucauc

SEQ ID NO: 836412 - RNA, 19 nt, Homo sapiens
gcuaauaacaacauggaaa

SEQ ID NO: 836413 - RNA, 19 nt, Homo sapiens
gaucagaaaguacaaucaa

SEQ ID NO: 836414 - RNA, 19 nt, Homo sapiens
gcauuucucuugguucaga

SEQ ID NO: 836415 - RNA, 19 nt, Homo sapiens
gaauauuccuaccucuuag

SEQ ID NO: 836416 - RNA, 19 nt, Homo sapiens
caaaggacaagugaauuaa

SEQ ID NO: 836417 - RNA, 19 nt, Homo sapiens
aagcuguucuggcauuaua

SEQ ID NO: 836418 - RNA, 19 nt, Homo sapiens
gaacugaguagucugaaag

SEQ ID NO: 836419 - RNA, 19 nt, Homo sapiens
ccaacaaggaaaccucuua

SEQ ID NO: 836420 - RNA, 19 nt, Homo sapiens
guagggaagucaauauuuu

SEQ ID NO: 836421 - RNA, 19 nt, Homo sapiens
uacauacacucaaaugcua

SEQ ID NO: 836422 - RNA, 19 nt, Homo sapiens
caaccaguacucauaauau

SEQ ID NO: 836423 - RNA, 19 nt, Homo sapiens
gcuggcaucaucauuauuu

SEQ ID NO: 836424 - RNA, 19 nt, Homo sapiens
gaauuuaccauaucuuugg

SEQ ID NO: 836425 - RNA, 19 nt, Homo sapiens
gaaugacucugugucuuca

SEQ ID NO: 836426 - RNA, 19 nt, Homo sapiens
uguaaugcauccugauauu

SEQ ID NO: 836427 - RNA, 19 nt, Homo sapiens
gaugaauccuuacgaagag

SEQ ID NO: 836428 - RNA, 19 nt, Homo sapiens
ggaaagcucccaguagaau

SEQ ID NO: 836429 - RNA, 19 nt, Homo sapiens
ggaaggagcugaguaaucu

SEQ ID NO: 836430 - RNA, 19 nt, Homo sapiens
caagacaguucgcaaagaa

SEQ ID NO: 836431 - RNA, 19 nt, Homo sapiens
uaaccugcgugcuuuauaa

SEQ ID NO: 836432 - RNA, 19 nt, Homo sapiens
gcaaagcccucaucaccau

SEQ ID NO: 836433 - RNA, 19 nt, Homo sapiens
gaauggaucuuugguguag

SEQ ID NO: 836434 - RNA, 19 nt, Homo sapiens
ggucauccguggaguuuga

SEQ ID NO: 836435 - RNA, 19 nt, Homo sapiens
gcaggaaggagcugaguaa

SEQ ID NO: 836436 - RNA, 19 nt, Homo sapiens
ccacauggcuguccuuugc

SEQ ID NO: 836437 - RNA, 19 nt, Homo sapiens
gaucuggugugcccucuuc

SEQ ID NO: 836438 - RNA, 19 nt, Homo sapiens
ccucucaccugucgcguuu

SEQ ID NO: 836439 - RNA, 19 nt, Homo sapiens
gguauuaucgggaaccauu

SEQ ID NO: 836440 - RNA, 19 nt, Homo sapiens
ggaauggaucuuuggugua

SEQ ID NO: 836441 - RNA, 19 nt, Homo sapiens
gcaacaaguucgucuucag

SEQ ID NO: 836442 - RNA, 19 nt, Homo sapiens
uauggacucuggaacaaga

SEQ ID NO: 836443 - RNA, 19 nt, Homo sapiens
uccaggcucuucagcauuu

SEQ ID NO: 836444 - RNA, 19 nt, Homo sapiens
gguccucggugccuucaug

SEQ ID NO: 836445 - RNA, 19 nt, Homo sapiens
cuacuaugcuguccuguac

SEQ ID NO: 836446 - RNA, 19 nt, Homo sapiens
gaggugcacugaccaugag

SEQ ID NO: 836447 - RNA, 19 nt, Homo sapiens
guaaccugcgugcuuuaua

SEQ ID NO: 836448 - RNA, 19 nt, Homo sapiens
acaagacaguucgcaaaga

SEQ ID NO: 836449 - RNA, 19 nt, Homo sapiens
gcaggaggaaugccuuuca

SEQ ID NO: 836450 - RNA, 19 nt, Homo sapiens
gcuacuaugcuguccugua

SEQ ID NO: 836451 - RNA, 19 nt, Homo sapiens
ggugugcuauggcuucauc

SEQ ID NO: 836452 - RNA, 19 nt, Homo sapiens
cuacugggcaugugcuuug

SEQ ID NO: 836453 - RNA, 19 nt, Homo sapiens
ugauggcacuugucuacau

SEQ ID NO: 836454 - RNA, 19 nt, Homo sapiens
gggcugugauggcacuugu

SEQ ID NO: 836455 - RNA, 19 nt, Homo sapiens
gcaccuccaccuccucuuc

SEQ ID NO: 836456 - RNA, 19 nt, Homo sapiens
ggaaccauuugugcaacga

SEQ ID NO: 836457 - RNA, 19 nt, Homo sapiens
cagaggaccgggaggaaga

SEQ ID NO: 836458 - RNA, 19 nt, Homo sapiens
gccugacucuguccaacuu

SEQ ID NO: 836459 - RNA, 19 nt, Homo sapiens
ucuauggacucuggaacaa

SEQ ID NO: 836460 - RNA, 19 nt, Homo sapiens
cgaggugcacugaccauga

SEQ ID NO: 836461 - RNA, 19 nt, Homo sapiens
guaguguggugcaacuucu

SEQ ID NO: 836462 - RNA, 19 nt, Homo sapiens
ucaucguggucaccuugua

SEQ ID NO: 836463 - RNA, 19 nt, Homo sapiens
ucaggcagcaggaggaaug

SEQ ID NO: 836464 - RNA, 19 nt, Homo sapiens
ccguggaguuugacgaguu

SEQ ID NO: 836465 - RNA, 19 nt, Homo sapiens
guucaucgccaucauuguc

SEQ ID NO: 836466 - RNA, 19 nt, Homo sapiens
cagcaacaaguucgucuuc

SEQ ID NO: 836467 - RNA, 19 nt, Homo sapiens
gcucccaggacucagguaa

SEQ ID NO: 836468 - RNA, 19 nt, Homo sapiens
ccaguucaucgccaucauu

SEQ ID NO: 836469 - RNA, 19 nt, Homo sapiens
caucaucacccaguucauc

SEQ ID NO: 836470 - RNA, 19 nt, Homo sapiens
ugggaaaccuggucaucgu

SEQ ID NO: 836471 - RNA, 19 nt, Homo sapiens
cgcagggaauggaucuuug

SEQ ID NO: 836472 - RNA, 19 nt, Homo sapiens
acaccucacugcgcucaug

SEQ ID NO: 836473 - RNA, 19 nt, Homo sapiens
gcagggaauggaucuuugg

SEQ ID NO: 836474 - RNA, 19 nt, Homo sapiens
gguguaguguggugcaacu

SEQ ID NO: 836475 - RNA, 19 nt, Homo sapiens
ccgcagggaauggaucuuu

SEQ ID NO: 836476 - RNA, 19 nt, Homo sapiens
guauuaucgggaaccauuu

SEQ ID NO: 836477 - RNA, 19 nt, Homo sapiens
cagcaggaggaaugccuuu

SEQ ID NO: 836478 - RNA, 19 nt, Homo sapiens
gguaaccugcgugcuuuau

SEQ ID NO: 836479 - RNA, 19 nt, Homo sapiens
gugcaacgacagaggacuu

SEQ ID NO: 836480 - RNA, 19 nt, Homo sapiens
ggaccgggaggaagaacuc

SEQ ID NO: 836481 - RNA, 19 nt, Homo sapiens
gugcuauggcuucaucuuc

SEQ ID NO: 836482 - RNA, 19 nt, Homo sapiens
gguacuagguguuucauuu

SEQ ID NO: 836483 - RNA, 19 nt, Homo sapiens
ggaaggagcugaguaaucu

SEQ ID NO: 836484 - RNA, 19 nt, Homo sapiens
caaagaagcugccaagaac

SEQ ID NO: 836485 - RNA, 19 nt, Homo sapiens
caagacaguucgcaaagaa

SEQ ID NO: 836486 - RNA, 19 nt, Homo sapiens
acacagcacuucuuccuaa

SEQ ID NO: 836487 - RNA, 19 nt, Homo sapiens
guccacagcuucagcauuu

SEQ ID NO: 836488 - RNA, 19 nt, Homo sapiens
gacaaguucuuugguauuu

SEQ ID NO: 836489 - RNA, 19 nt, Homo sapiens
caccaagccuggaaacaua

SEQ ID NO: 836490 - RNA, 19 nt, Homo sapiens
gcaaagcccucaucaccau

SEQ ID NO: 836491 - RNA, 19 nt, Homo sapiens
gaauggaucuuugguguag

SEQ ID NO: 836492 - RNA, 19 nt, Homo sapiens
ggagcucggugacauuuga

SEQ ID NO: 836493 - RNA, 19 nt, Homo sapiens
ggacaaggacugaaaauaa

SEQ ID NO: 836494 - RNA, 19 nt, Homo sapiens
ggucauccguggaguuuga

SEQ ID NO: 836495 - RNA, 19 nt, Homo sapiens
gcaggaaggagcugaguaa

SEQ ID NO: 836496 - RNA, 19 nt, Homo sapiens
ccacauggcuguccuuugc

SEQ ID NO: 836497 - RNA, 19 nt, Homo sapiens
cagcacuucuuccuaauga

SEQ ID NO: 836498 - RNA, 19 nt, Homo sapiens
ucaaagaagcugccaagaa

SEQ ID NO: 836499 - RNA, 19 nt, Homo sapiens
gaacucgauucuucaugug

SEQ ID NO: 836500 - RNA, 19 nt, Homo sapiens
gaucuggugugcccucuuc

SEQ ID NO: 836501 - RNA, 19 nt, Homo sapiens
caaguucuuugguauuuca

SEQ ID NO: 836502 - RNA, 19 nt, Homo sapiens
gggagcaugucacugugua

SEQ ID NO: 836503 - RNA, 19 nt, Homo sapiens
ccagaagcaucuaaagcaa

SEQ ID NO: 836504 - RNA, 19 nt, Homo sapiens
gcagcaagcuuggccaaag

SEQ ID NO: 836505 - RNA, 19 nt, Homo sapiens
gaaggagcagcaucuggua

SEQ ID NO: 836506 - RNA, 19 nt, Homo sapiens
cauagagucucacccuguu

SEQ ID NO: 836507 - RNA, 19 nt, Homo sapiens
gguauuaucgggaaccauu

SEQ ID NO: 836508 - RNA, 19 nt, Homo sapiens
ggaauggaucuuuggugua

SEQ ID NO: 836509 - RNA, 19 nt, Homo sapiens
cagauaugaugcugcuuga

SEQ ID NO: 836510 - RNA, 19 nt, Homo sapiens
gcaacaaguucgucuucag

SEQ ID NO: 836511 - RNA, 19 nt, Homo sapiens
cgaagaaggagauguuuua

SEQ ID NO: 836512 - RNA, 19 nt, Homo sapiens
ugaaguggaacaaaucaaa

SEQ ID NO: 836513 - RNA, 19 nt, Homo sapiens
gaaggagcucggugacauu

SEQ ID NO: 836514 - RNA, 19 nt, Homo sapiens
uauggacucuggaacaaga

SEQ ID NO: 836515 - RNA, 19 nt, Homo sapiens
uccaggcucuucagcauuu

SEQ ID NO: 836516 - RNA, 19 nt, Homo sapiens
gacaaggacugaaaauaau

SEQ ID NO: 836517 - RNA, 19 nt, Homo sapiens
gagauguggcuguggcuuu

SEQ ID NO: 836518 - RNA, 19 nt, Homo sapiens
gguccucggugccuucaug

SEQ ID NO: 836519 - RNA, 19 nt, Homo sapiens
cuacuaugcuguccuguac

SEQ ID NO: 836520 - RNA, 19 nt, Homo sapiens
acugacaaguucuuuggua

SEQ ID NO: 836521 - RNA, 19 nt, Homo sapiens
gcagagcaucgaagaagga

SEQ ID NO: 836522 - RNA, 19 nt, Homo sapiens
cgaggcagcagaacucuug

SEQ ID NO: 836523 - RNA, 19 nt, Homo sapiens
gaggugcacugaccaugag

SEQ ID NO: 836524 - RNA, 19 nt, Homo sapiens
aaagggagaaaccacuaua

SEQ ID NO: 836525 - RNA, 19 nt, Homo sapiens
gagcaucgaagaaggagau

SEQ ID NO: 836526 - RNA, 19 nt, Homo sapiens
ugugaaagcugaaguacac

SEQ ID NO: 836527 - RNA, 19 nt, Homo sapiens
gcuccuggguucaagcaau

SEQ ID NO: 836528 - RNA, 19 nt, Homo sapiens
agaaggagcucggugacau

SEQ ID NO: 836529 - RNA, 19 nt, Homo sapiens
ggacucagggacagauaug

SEQ ID NO: 836530 - RNA, 19 nt, Homo sapiens
acaagacaguucgcaaaga

SEQ ID NO: 836531 - RNA, 19 nt, Homo sapiens
gcaggaggaaugccuuuca

SEQ ID NO: 836532 - RNA, 19 nt, Homo sapiens
guacuagguguuucauuuc

SEQ ID NO: 836533 - RNA, 19 nt, Homo sapiens
gggcagguacuagguguuu

SEQ ID NO: 836534 - RNA, 19 nt, Homo sapiens
gcacuucuuccuaaugaca

SEQ ID NO: 836535 - RNA, 19 nt, Homo sapiens
gaaguggaacaaaucaaag

SEQ ID NO: 836536 - RNA, 19 nt, Homo sapiens
ggaugaaguggaacaaauc

SEQ ID NO: 836537 - RNA, 19 nt, Homo sapiens
gcuacuaugcuguccugua

SEQ ID NO: 836538 - RNA, 19 nt, Homo sapiens
ugacaaguucuuugguauu

SEQ ID NO: 836539 - RNA, 19 nt, Homo sapiens
gaccacaugugagcuucuu

SEQ ID NO: 836540 - RNA, 19 nt, Homo sapiens
aggaugaaguggaacaaau

SEQ ID NO: 836541 - RNA, 19 nt, Homo sapiens
cuacacgucugaugacaac

SEQ ID NO: 836542 - RNA, 19 nt, Homo sapiens
gagaaaccacuauaaaaga

SEQ ID NO: 836543 - RNA, 19 nt, Homo sapiens
ggagaaaccacuauaaaag

SEQ ID NO: 836544 - RNA, 19 nt, Homo sapiens
cuacuucccuacugacaag

SEQ ID NO: 836545 - RNA, 19 nt, Homo sapiens
gguguuucauuuccagaau

SEQ ID NO: 836546 - RNA, 19 nt, Homo sapiens
ucagugugcucaauauggu

SEQ ID NO: 836547 - RNA, 19 nt, Homo sapiens
agucucacccuguugcuua

SEQ ID NO: 836548 - RNA, 19 nt, Homo sapiens
gaugaaguggaacaaauca

SEQ ID NO: 836549 - RNA, 19 nt, Homo sapiens
ggugugcuauggcuucauc

SEQ ID NO: 836550 - RNA, 19 nt, Homo sapiens
gcagguacuagguguuuca

SEQ ID NO: 836551 - RNA, 19 nt, Homo sapiens
gggagaaaccacuauaaaa

SEQ ID NO: 836552 - RNA, 19 nt, Homo sapiens
gaugacacagcacuucuuc

SEQ ID NO: 836553 - RNA, 19 nt, Homo sapiens
cuacugggcaugugcuuug

SEQ ID NO: 836554 - RNA, 19 nt, Homo sapiens
ugauggcacuugucuacau

SEQ ID NO: 836555 - RNA, 19 nt, Homo sapiens
gggcugugauggcacuugu

SEQ ID NO: 836556 - RNA, 19 nt, Homo sapiens
cagaagcaucuaaagcaaa

SEQ ID NO: 836557 - RNA, 19 nt, Homo sapiens
ggugacauuugaggaugaa

SEQ ID NO: 836558 - RNA, 19 nt, Homo sapiens
ugaugcugcuugaggacua

SEQ ID NO: 836559 - RNA, 19 nt, Homo sapiens
gcaccuccaccuccucuuc

SEQ ID NO: 836560 - RNA, 19 nt, Homo sapiens
gaaggaugacacagcacuu

SEQ ID NO: 836561 - RNA, 19 nt, Homo sapiens
gaauagccgggauuacagu

SEQ ID NO: 836562 - RNA, 19 nt, Homo sapiens
ggaaccauuugugcaacga

SEQ ID NO: 836563 - RNA, 19 nt, Homo sapiens
cagaggaccgggaggaaga

SEQ ID NO: 836564 - RNA, 19 nt, Homo sapiens
gccugacucuguccaacuu

SEQ ID NO: 836565 - RNA, 19 nt, Homo sapiens
gaaagcugaaguacacaag

SEQ ID NO: 836566 - RNA, 19 nt, Homo sapiens
cgaggugcacugaccauga

SEQ ID NO: 836567 - RNA, 19 nt, Homo sapiens
ucuauggacucuggaacaa

SEQ ID NO: 836568 - RNA, 19 nt, Homo sapiens
guguuucauuuccagaauu

SEQ ID NO: 836569 - RNA, 19 nt, Homo sapiens
cugacaaguucuuugguau

SEQ ID NO: 836570 - RNA, 19 nt, Homo sapiens
agaagcaucuaaagcaaaa

SEQ ID NO: 836571 - RNA, 19 nt, Homo sapiens
ggaccagaagcaucuaaag

SEQ ID NO: 836572 - RNA, 19 nt, Homo sapiens
gaggaugaaguggaacaaa

SEQ ID NO: 836573 - RNA, 19 nt, Homo sapiens
guaguguggugcaacuucu

SEQ ID NO: 836574 - RNA, 19 nt, Homo sapiens
caucauuuccuccucuuca

SEQ ID NO: 836575 - RNA, 19 nt, Homo sapiens
ggacugaaaauaaugucua

SEQ ID NO: 836576 - RNA, 19 nt, Homo sapiens
ggcagcagaacucuuguga

SEQ ID NO: 836577 - RNA, 19 nt, Homo sapiens
aagcugaaguacacaaguc

SEQ ID NO: 836578 - RNA, 19 nt, Homo sapiens
cuggaaacauagagucuca

SEQ ID NO: 836579 - RNA, 19 nt, Homo sapiens
ggaagggcagguacuaggu

SEQ ID NO: 836580 - RNA, 19 nt, Homo sapiens
agggagaaaccacuauaaa

SEQ ID NO: 836581 - RNA, 19 nt, Homo sapiens
ggaugacacagcacuucuu

SEQ ID NO: 836582 - RNA, 19 nt, Homo sapiens
uaccggaacuuaaggaaua

SEQ ID NO: 836583 - RNA, 19 nt, Homo sapiens
agaauaggaucaagaugua

SEQ ID NO: 836584 - RNA, 19 nt, Homo sapiens
caagauguauaaacuguug

SEQ ID NO: 836585 - RNA, 19 nt, Homo sapiens
uagcaagacugaaugauau

SEQ ID NO: 836586 - RNA, 19 nt, Homo sapiens
gaacaaggacagaaacuag

SEQ ID NO: 836587 - RNA, 19 nt, Homo sapiens
caaagaaacacacuguaaa

SEQ ID NO: 836588 - RNA, 19 nt, Homo sapiens
ccaaagaaacacacuguaa

SEQ ID NO: 836589 - RNA, 19 nt, Homo sapiens
ggaucaagauguauaaacu

SEQ ID NO: 836590 - RNA, 19 nt, Homo sapiens
gaaacuagcaaaagagaua

SEQ ID NO: 836591 - RNA, 19 nt, Homo sapiens
uguggaauguucagcuuua

SEQ ID NO: 836592 - RNA, 19 nt, Homo sapiens
ggaacaaggacagaaacua

SEQ ID NO: 836593 - RNA, 19 nt, Homo sapiens
gagaugaccccaaaacuuu

SEQ ID NO: 836594 - RNA, 19 nt, Homo sapiens
gccuuuaucuuacccaaug

SEQ ID NO: 836595 - RNA, 19 nt, Homo sapiens
ugaccgaugucuuccuuau

SEQ ID NO: 836596 - RNA, 19 nt, Homo sapiens
aauccagccucauuucaaa

SEQ ID NO: 836597 - RNA, 19 nt, Homo sapiens
uuagcaagacugaaugaua

SEQ ID NO: 836598 - RNA, 19 nt, Homo sapiens
gcugcuauguggaauguuc

SEQ ID NO: 836599 - RNA, 19 nt, Homo sapiens
gacagaaacuagcaaaaga

SEQ ID NO: 836600 - RNA, 19 nt, Homo sapiens
uaauaggaacucagauuga

SEQ ID NO: 836601 - RNA, 19 nt, Homo sapiens
gucugaggccuuuaucuua

SEQ ID NO: 836602 - RNA, 19 nt, Homo sapiens
accgaugucuuccuuauau

SEQ ID NO: 836603 - RNA, 19 nt, Homo sapiens
gcaagacugaaugauauga

SEQ ID NO: 836604 - RNA, 19 nt, Homo sapiens
gaccgaugucuuccuuaua

SEQ ID NO: 836605 - RNA, 19 nt, Homo sapiens
aagaauaggaucaagaugu

SEQ ID NO: 836606 - RNA, 19 nt, Homo sapiens
aauaggaacucagauugau

SEQ ID NO: 836607 - RNA, 19 nt, Homo sapiens
gaucaagauguauaaacug

SEQ ID NO: 836608 - RNA, 19 nt, Homo sapiens
guucagcuuuaacccagaa

SEQ ID NO: 836609 - RNA, 19 nt, Homo sapiens
guggaauguucagcuuuaa

SEQ ID NO: 836610 - RNA, 19 nt, Homo sapiens
uuaauaggaacucagauug

SEQ ID NO: 836611 - RNA, 19 nt, Homo sapiens
agaagggauugaagacugu

SEQ ID NO: 836612 - RNA, 19 nt, Homo sapiens
guacgugcccaccgucuuc

SEQ ID NO: 836613 - RNA, 19 nt, Homo sapiens
caagacgugccuacucaug

SEQ ID NO: 836614 - RNA, 19 nt, Homo sapiens
caagacugaaugauaugaa

SEQ ID NO: 836615 - RNA, 19 nt, Homo sapiens
gggcaagcaguaccuccua

SEQ ID NO: 836616 - RNA, 19 nt, Homo sapiens
gacugaaugauaugaaaga

SEQ ID NO: 836617 - RNA, 19 nt, Homo sapiens
ccccaaaacuuuagcaaga

SEQ ID NO: 836618 - RNA, 19 nt, Homo sapiens
gcgcgcugaugcucaagug

SEQ ID NO: 836619 - RNA, 19 nt, Homo sapiens
gaguggguaccggaacuua

SEQ ID NO: 836620 - RNA, 19 nt, Homo sapiens
uauguggaauguucagcuu

SEQ ID NO: 836621 - RNA, 19 nt, Homo sapiens
cgucugaggccuuuaucuu

SEQ ID NO: 836622 - RNA, 19 nt, Homo sapiens
gaauaggaucaagauguau

SEQ ID NO: 836623 - RNA, 19 nt, Homo sapiens
ucugaggccuuuaucuuac

SEQ ID NO: 836624 - RNA, 19 nt, Homo sapiens
aaugaccgaugucuuccuu

SEQ ID NO: 836625 - RNA, 19 nt, Homo sapiens
ggacagaaacuagcaaaag

SEQ ID NO: 836626 - RNA, 19 nt, Homo sapiens
caagcaguaccuccuagga

SEQ ID NO: 836627 - RNA, 19 nt, Homo sapiens
cccaaugaccgaugucuuc

SEQ ID NO: 836628 - RNA, 19 nt, Homo sapiens
agacgugccuacucaugag

SEQ ID NO: 836629 - RNA, 19 nt, Homo sapiens
guaccggaacuuaaggaau

SEQ ID NO: 836630 - RNA, 19 nt, Homo sapiens
ggccggacaggaagacuau

SEQ ID NO: 836631 - RNA, 19 nt, Homo sapiens
ccaccgucuucgaccacua

SEQ ID NO: 836632 - RNA, 19 nt, Homo sapiens
gaccgucugaggccuuuau

SEQ ID NO: 836633 - RNA, 19 nt, Homo sapiens
ugguaaauccagccucauu

SEQ ID NO: 836634 - RNA, 19 nt, Homo sapiens
ccggacaggaagacuauga

SEQ ID NO: 836635 - RNA, 19 nt, Homo sapiens
aagacgugccuacucauga

SEQ ID NO: 836636 - RNA, 19 nt, Homo sapiens
gaagucggcucuauggauu

SEQ ID NO: 836637 - RNA, 19 nt, Homo sapiens
caacuuugcuuucagcuau

SEQ ID NO: 836638 - RNA, 19 nt, Homo sapiens
gcagucagcucuauauugg

SEQ ID NO: 836639 - RNA, 19 nt, Homo sapiens
ugacacagauggagucuug

SEQ ID NO: 836640 - RNA, 19 nt, Homo sapiens
ggaaacacaugugcacuug

SEQ ID NO: 836641 - RNA, 19 nt, Homo sapiens
ucagagagguuaugugguu

SEQ ID NO: 836642 - RNA, 19 nt, Homo sapiens
gaaggguucugcugcuaaa

SEQ ID NO: 836643 - RNA, 19 nt, Homo sapiens
gaaccacucucucucucuu

SEQ ID NO: 836644 - RNA, 19 nt, Homo sapiens
uaacugcagccaccauuua

SEQ ID NO: 836645 - RNA, 19 nt, Homo sapiens
gaucuuggcucacugaaac

SEQ ID NO: 836646 - RNA, 19 nt, Homo sapiens
ggaggaaggaugagucuga

SEQ ID NO: 836647 - RNA, 19 nt, Homo sapiens
gcaccauucugcuuucugu

SEQ ID NO: 836648 - RNA, 19 nt, Homo sapiens
gggcaaggcuuuuggauga

SEQ ID NO: 836649 - RNA, 19 nt, Homo sapiens
ugagauauuugcagugguu

SEQ ID NO: 836650 - RNA, 19 nt, Homo sapiens
guaccaggcacuuuaugua

SEQ ID NO: 836651 - RNA, 19 nt, Homo sapiens
gcacgagccugccuagacu

SEQ ID NO: 836652 - RNA, 19 nt, Homo sapiens
cugagacaauggacaauaa

SEQ ID NO: 836653 - RNA, 19 nt, Homo sapiens
cuagcauccucuacucuua

SEQ ID NO: 836654 - RNA, 19 nt, Homo sapiens
ugaaugacaugcucacagu

SEQ ID NO: 836655 - RNA, 19 nt, Homo sapiens
guagugaagucggcucuau

SEQ ID NO: 836656 - RNA, 19 nt, Homo sapiens
ccacgucccugguuaaagg

SEQ ID NO: 836657 - RNA, 19 nt, Homo sapiens
uaaggcagcuauuuuguuu

SEQ ID NO: 836658 - RNA, 19 nt, Homo sapiens
gaugaggacgugucuauca

SEQ ID NO: 836659 - RNA, 19 nt, Homo sapiens
ccucagcucuguuucuuuc

SEQ ID NO: 836660 - RNA, 19 nt, Homo sapiens
cagagaggcugaaugacau

SEQ ID NO: 836661 - RNA, 19 nt, Homo sapiens
acagagagcugccuuucca

SEQ ID NO: 836662 - RNA, 19 nt, Homo sapiens
caacaacuucugucccauu

SEQ ID NO: 836663 - RNA, 19 nt, Homo sapiens
ggaagcgcuccaucagaua

SEQ ID NO: 836664 - RNA, 19 nt, Homo sapiens
uauuagcacugaugaagga

SEQ ID NO: 836665 - RNA, 19 nt, Homo sapiens
uuucagagcuaaagugaca

SEQ ID NO: 836666 - RNA, 19 nt, Homo sapiens
ccagagaggcugaaugaca

SEQ ID NO: 836667 - RNA, 19 nt, Homo sapiens
gauauuagcacugaugaag

SEQ ID NO: 836668 - RNA, 19 nt, Homo sapiens
gaaggaagcgcuccaucag

SEQ ID NO: 836669 - RNA, 19 nt, Homo sapiens
aaacaagcccuucccaaca

SEQ ID NO: 836670 - RNA, 19 nt, Homo sapiens
ccucuacucuuagcacuga

SEQ ID NO: 836671 - RNA, 19 nt, Homo sapiens
ccaggccuccuuacccuua

SEQ ID NO: 836672 - RNA, 19 nt, Homo sapiens
cauuugacauggugagaga

SEQ ID NO: 836673 - RNA, 19 nt, Homo sapiens
ccugaacauucuuccuuaa

SEQ ID NO: 836674 - RNA, 19 nt, Homo sapiens
caagucuggugaagaauac

SEQ ID NO: 836675 - RNA, 19 nt, Homo sapiens
acaagcccuucccaacaua

SEQ ID NO: 836676 - RNA, 19 nt, Homo sapiens
ucccagcucucgaauccua

SEQ ID NO: 836677 - RNA, 19 nt, Homo sapiens
aggaagcgcuccaucagau

SEQ ID NO: 836678 - RNA, 19 nt, Homo sapiens
ccaggcaucuucauuuuga

SEQ ID NO: 836679 - RNA, 19 nt, Homo sapiens
aacaacuucugucccauuu

SEQ ID NO: 836680 - RNA, 19 nt, Homo sapiens
gaggugcagucagcucuau

SEQ ID NO: 836681 - RNA, 19 nt, Homo sapiens
aguaugcccugaaugaaug

SEQ ID NO: 836682 - RNA, 19 nt, Homo sapiens
acaagucuggugaagaaua

SEQ ID NO: 836683 - RNA, 19 nt, Homo sapiens
gcaaggcuuuuggaugaua

SEQ ID NO: 836684 - RNA, 19 nt, Homo sapiens
gaagcgcuccaucagauag

SEQ ID NO: 836685 - RNA, 19 nt, Homo sapiens
acucaggcguuucccauug

SEQ ID NO: 836686 - RNA, 19 nt, Homo sapiens
uccugaacauucuuccuua

SEQ ID NO: 836687 - RNA, 19 nt, Homo sapiens
ccuagcagguuggguauuc

SEQ ID NO: 836688 - RNA, 19 nt, Homo sapiens
ccaggcacuuuauguaucu

SEQ ID NO: 836689 - RNA, 19 nt, Homo sapiens
uuauguaccaggcacuuua

SEQ ID NO: 836690 - RNA, 19 nt, Homo sapiens
ugaaggaagcgcuccauca

SEQ ID NO: 836691 - RNA, 19 nt, Homo sapiens
ggcccaggcaucuucauuu

SEQ ID NO: 836692 - RNA, 19 nt, Homo sapiens
gcauuguucugggcucaug

SEQ ID NO: 836693 - RNA, 19 nt, Homo sapiens
acauggauauuagcacuga

SEQ ID NO: 836694 - RNA, 19 nt, Homo sapiens
ucucaaagccacacagcaa

SEQ ID NO: 836695 - RNA, 19 nt, Homo sapiens
cugaguagcugggauuaca

SEQ ID NO: 836696 - RNA, 19 nt, Homo sapiens
caaggucuuuuaacagaaa

SEQ ID NO: 836697 - RNA, 19 nt, Homo sapiens
gccaugcgcaggcagguuu

SEQ ID NO: 836698 - RNA, 19 nt, Homo sapiens
gcccaggcaucuucauuuu

SEQ ID NO: 836699 - RNA, 19 nt, Homo sapiens
guagcugggauuacagaaa

SEQ ID NO: 836700 - RNA, 19 nt, Homo sapiens
gcggcuugcucaccucuca

SEQ ID NO: 836701 - RNA, 19 nt, Homo sapiens
uggguaaggcuucauuuga

SEQ ID NO: 836702 - RNA, 19 nt, Homo sapiens
ggugagagagagagagaga

SEQ ID NO: 836703 - RNA, 19 nt, Homo sapiens
cagagagguuaugugguuu

SEQ ID NO: 836704 - RNA, 19 nt, Homo sapiens
ugagagagagagagagaga

SEQ ID NO: 836705 - RNA, 19 nt, Homo sapiens
ggaagcuucuaggcauugu

SEQ ID NO: 836706 - RNA, 19 nt, Homo sapiens
gagcagucuucucuguagu

SEQ ID NO: 836707 - RNA, 19 nt, Homo sapiens
aacaagcccuucccaacau

SEQ ID NO: 836708 - RNA, 19 nt, Homo sapiens
gauauuugcagugguuuca

SEQ ID NO: 836709 - RNA, 19 nt, Homo sapiens
ccugaucacaacuuucuaa

SEQ ID NO: 836710 - RNA, 19 nt, Homo sapiens
agacaucaagcuccgguuu

SEQ ID NO: 836711 - RNA, 19 nt, Homo sapiens
uagcugggauuacagaaaa

SEQ ID NO: 836712 - RNA, 19 nt, Homo sapiens
ccauugcccuauucuagca

SEQ ID NO: 836713 - RNA, 19 nt, Homo sapiens
uagauuccaggccuccuua

SEQ ID NO: 836714 - RNA, 19 nt, Homo sapiens
auucagcaccuguuaugua

SEQ ID NO: 836715 - RNA, 19 nt, Homo sapiens
acauccacgucccugguua

SEQ ID NO: 836716 - RNA, 19 nt, Homo sapiens
cagcugcucugagacaagu

SEQ ID NO: 836717 - RNA, 19 nt, Homo sapiens
uaaaugcuuaucuguggaa

SEQ ID NO: 836718 - RNA, 19 nt, Homo sapiens
ccacagagagcugccuuuc

SEQ ID NO: 836719 - RNA, 19 nt, Homo sapiens
ugaagucggcucuauggau

SEQ ID NO: 836720 - RNA, 19 nt, Homo sapiens
caacauaagcgcuuuugug

SEQ ID NO: 836721 - RNA, 19 nt, Homo sapiens
cagcaccuguuauguacca

SEQ ID NO: 836722 - RNA, 19 nt, Homo sapiens
ucaaagccacacagcaaga

SEQ ID NO: 836723 - RNA, 19 nt, Homo sapiens
ucacuaaagccugaucuuc

SEQ ID NO: 836724 - RNA, 19 nt, Homo sapiens
ugaaggguucugcugcuaa

SEQ ID NO: 836725 - RNA, 19 nt, Homo sapiens
guacccacccacuaccauu

SEQ ID NO: 836726 - RNA, 19 nt, Homo sapiens
uuguuucgcuacauggaua

SEQ ID NO: 836727 - RNA, 19 nt, Homo sapiens
ggcaugaucuuggcucacu

SEQ ID NO: 836728 - RNA, 19 nt, Homo sapiens
ugagacaauggacaauaaa

SEQ ID NO: 836729 - RNA, 19 nt, Homo sapiens
ccuuagagacugugacuca

SEQ ID NO: 836730 - RNA, 19 nt, Homo sapiens
gcaguggcaggcaguagug

SEQ ID NO: 836731 - RNA, 19 nt, Homo sapiens
uaccaggcacuuuauguau

SEQ ID NO: 836732 - RNA, 19 nt, Homo sapiens
ggugcagucagcucuauau

SEQ ID NO: 836733 - RNA, 19 nt, Homo sapiens
caguaugcccugaaugaau

SEQ ID NO: 836734 - RNA, 19 nt, Homo sapiens
gagagagagagagagauga

SEQ ID NO: 836735 - RNA, 19 nt, Homo sapiens
auuuggaacugauaggaaa

SEQ ID NO: 836736 - RNA, 19 nt, Homo sapiens
ggagaggacuugaucauua

SEQ ID NO: 836737 - RNA, 19 nt, Homo sapiens
gagcaaugauagcaaauaa

SEQ ID NO: 836738 - RNA, 19 nt, Homo sapiens
agaaagaaguggaagauuu

SEQ ID NO: 836739 - RNA, 19 nt, Homo sapiens
gagaggacuugaucauuaa

SEQ ID NO: 836740 - RNA, 19 nt, Homo sapiens
gaaaguagugcuguaaaua

SEQ ID NO: 836741 - RNA, 19 nt, Homo sapiens
ggaaucagcguucauauau

SEQ ID NO: 836742 - RNA, 19 nt, Homo sapiens
gcucaagcauggauucuaa

SEQ ID NO: 836743 - RNA, 19 nt, Homo sapiens
caauagcaauagacaguua

SEQ ID NO: 836744 - RNA, 19 nt, Homo sapiens
gaaguucuaaugucuguua

SEQ ID NO: 836745 - RNA, 19 nt, Homo sapiens
aaacggaaaccauugauua

SEQ ID NO: 836746 - RNA, 19 nt, Homo sapiens
aaagguuucuccuguaaua

SEQ ID NO: 836747 - RNA, 19 nt, Homo sapiens
gaaagaaguggaagauuug

SEQ ID NO: 836748 - RNA, 19 nt, Homo sapiens
gcaaggcugugauauggaa

SEQ ID NO: 836749 - RNA, 19 nt, Homo sapiens
gcaaacuuccuaauucuaa

SEQ ID NO: 836750 - RNA, 19 nt, Homo sapiens
gcaaugauagcaaauaaug

SEQ ID NO: 836751 - RNA, 19 nt, Homo sapiens
gaaaagagcaguccagaaa

SEQ ID NO: 836752 - RNA, 19 nt, Homo sapiens
gcucaggugucucaaagaa

SEQ ID NO: 836753 - RNA, 19 nt, Homo sapiens
gaacauggacugagcuugu

SEQ ID NO: 836754 - RNA, 19 nt, Homo sapiens
guacagaggacaugacuga

SEQ ID NO: 836755 - RNA, 19 nt, Homo sapiens
uaaauauucugccauagga

SEQ ID NO: 836756 - RNA, 19 nt, Homo sapiens
gcaaauaauguacgaaugu

SEQ ID NO: 836757 - RNA, 19 nt, Homo sapiens
aggaagagcuaaaggaauu

SEQ ID NO: 836758 - RNA, 19 nt, Homo sapiens
gaaacacaagugaaaguaa

SEQ ID NO: 836759 - RNA, 19 nt, Homo sapiens
gugcugcucuccacgguua

SEQ ID NO: 836760 - RNA, 19 nt, Homo sapiens
gaaagugaacugcuguuug

SEQ ID NO: 836761 - RNA, 19 nt, Homo sapiens
gagacuugguggugcauaa

SEQ ID NO: 836762 - RNA, 19 nt, Homo sapiens
gaaaucugguguauguugu

SEQ ID NO: 836763 - RNA, 19 nt, Homo sapiens
ggaaaucugguguauguug

SEQ ID NO: 836764 - RNA, 19 nt, Homo sapiens
caacacacuacaauugaua

SEQ ID NO: 836765 - RNA, 19 nt, Homo sapiens
guugaaauauugagugguu

SEQ ID NO: 836766 - RNA, 19 nt, Homo sapiens
gaaacaaucaagguaguaa

SEQ ID NO: 836767 - RNA, 19 nt, Homo sapiens
caaaggacauccacaucug

SEQ ID NO: 836768 - RNA, 19 nt, Homo sapiens
cggaaaccauugauuagaa

SEQ ID NO: 836769 - RNA, 19 nt, Homo sapiens
caggguggauuugguaaua

SEQ ID NO: 836770 - RNA, 19 nt, Homo sapiens
uggaguauauucagcagua

SEQ ID NO: 836771 - RNA, 19 nt, Homo sapiens
gaauaugaaacacaaguga

SEQ ID NO: 836772 - RNA, 19 nt, Homo sapiens
gagcucaggugucucaaag

SEQ ID NO: 836773 - RNA, 19 nt, Homo sapiens
ugaaaguagugcuguaaau

SEQ ID NO: 836774 - RNA, 19 nt, Homo sapiens
ggacaugacugaggaugag

SEQ ID NO: 836775 - RNA, 19 nt, Homo sapiens
caguucaucucauuucaaa

SEQ ID NO: 836776 - RNA, 19 nt, Homo sapiens
gauagcaaauaauguacga

SEQ ID NO: 836777 - RNA, 19 nt, Homo sapiens
gcaugaaaggcuaguauga

SEQ ID NO: 836778 - RNA, 19 nt, Homo sapiens
caaaagguuucuccuguaa

SEQ ID NO: 836779 - RNA, 19 nt, Homo sapiens
caaucaagguaguaauaug

SEQ ID NO: 836780 - RNA, 19 nt, Homo sapiens
caauagacaguuagaaaga

SEQ ID NO: 836781 - RNA, 19 nt, Homo sapiens
uguguguucucuucuguua

SEQ ID NO: 836782 - RNA, 19 nt, Homo sapiens
agaugaauguguuaaguga

SEQ ID NO: 836783 - RNA, 19 nt, Homo sapiens
gguuucuccuguaauauuu

SEQ ID NO: 836784 - RNA, 19 nt, Homo sapiens
uauaguggcucuaauucug

SEQ ID NO: 836785 - RNA, 19 nt, Homo sapiens
caucagcagugaaagugaa

SEQ ID NO: 836786 - RNA, 19 nt, Homo sapiens
agagagcaaugauagcaaa

SEQ ID NO: 836787 - RNA, 19 nt, Homo sapiens
ggagucguaucaacgcuau

SEQ ID NO: 836788 - RNA, 19 nt, Homo sapiens
gggcuucgcuacaggaauc

SEQ ID NO: 836789 - RNA, 19 nt, Homo sapiens
ucacaguguuugguucuuu

SEQ ID NO: 836790 - RNA, 19 nt, Homo sapiens
aaagugaacugcuguuugc

SEQ ID NO: 836791 - RNA, 19 nt, Homo sapiens
ggaaacaaucaagguagua

SEQ ID NO: 836792 - RNA, 19 nt, Homo sapiens
gcaauagacaguuagaaag

SEQ ID NO: 836793 - RNA, 19 nt, Homo sapiens
uuagauaacccacauuaga

SEQ ID NO: 836794 - RNA, 19 nt, Homo sapiens
ggaaaccauugauuagaac

SEQ ID NO: 836795 - RNA, 19 nt, Homo sapiens
gaacgaugagcccauugaa

SEQ ID NO: 836796 - RNA, 19 nt, Homo sapiens
gaaucagcguucauauauc

SEQ ID NO: 836797 - RNA, 19 nt, Homo sapiens
caagaugagccuuugagaa

SEQ ID NO: 836798 - RNA, 19 nt, Homo sapiens
cuacaugcuuucucauuca

SEQ ID NO: 836799 - RNA, 19 nt, Homo sapiens
ggaauacugucuacaugcu

SEQ ID NO: 836800 - RNA, 19 nt, Homo sapiens
gaacugcuguuugccugau

SEQ ID NO: 836801 - RNA, 19 nt, Homo sapiens
ccagaaaacauccgauuua

SEQ ID NO: 836802 - RNA, 19 nt, Homo sapiens
cuguaaauauucugccaua

SEQ ID NO: 836803 - RNA, 19 nt, Homo sapiens
guucuggaaauaacucuua

SEQ ID NO: 836804 - RNA, 19 nt, Homo sapiens
gggaaacaaucaagguagu

SEQ ID NO: 836805 - RNA, 19 nt, Homo sapiens
ggggaaaucugguguaugu

SEQ ID NO: 836806 - RNA, 19 nt, Homo sapiens
gguggaaguucuaaugucu

SEQ ID NO: 836807 - RNA, 19 nt, Homo sapiens
ccagugagcucaggugucu

SEQ ID NO: 836808 - RNA, 19 nt, Homo sapiens
cgaugagcccauugaaaua

SEQ ID NO: 836809 - RNA, 19 nt, Homo sapiens
gguauagaauggugggaau

SEQ ID NO: 836810 - RNA, 19 nt, Homo sapiens
agaaggcugucugaacuuu

SEQ ID NO: 836811 - RNA, 19 nt, Homo sapiens
gcuguuugccugauuggua

SEQ ID NO: 836812 - RNA, 19 nt, Homo sapiens
ggccuucgguucuggaaau

SEQ ID NO: 836813 - RNA, 19 nt, Homo sapiens
gaaccuaagcacaauagca

SEQ ID NO: 836814 - RNA, 19 nt, Homo sapiens
aaaggaaucagcguucaua

SEQ ID NO: 836815 - RNA, 19 nt, Homo sapiens
gauaacccacauuagauga

SEQ ID NO: 836816 - RNA, 19 nt, Homo sapiens
ugagaacgaugagcccauu

SEQ ID NO: 836817 - RNA, 19 nt, Homo sapiens
uaggaauacugucuacaug

SEQ ID NO: 836818 - RNA, 19 nt, Homo sapiens
gugguugguugguauagaa

SEQ ID NO: 836819 - RNA, 19 nt, Homo sapiens
aagcauggauucuaagucu

SEQ ID NO: 836820 - RNA, 19 nt, Homo sapiens
gaugagccuuugagaagca

SEQ ID NO: 836821 - RNA, 19 nt, Homo sapiens
ucucuucuguuacugauau

SEQ ID NO: 836822 - RNA, 19 nt, Homo sapiens
cuaaacucaugguaaguau

SEQ ID NO: 836823 - RNA, 19 nt, Homo sapiens
gggaguucuucucucagua

SEQ ID NO: 836824 - RNA, 19 nt, Homo sapiens
caaagaaggguggaaguuc

SEQ ID NO: 836825 - RNA, 19 nt, Homo sapiens
ccaacacacuacaauugau

SEQ ID NO: 836826 - RNA, 19 nt, Homo sapiens
aaaggaagagcuaaaggaa

SEQ ID NO: 836827 - RNA, 19 nt, Homo sapiens
ccuaagcacaauagcaaua

SEQ ID NO: 836828 - RNA, 19 nt, Homo sapiens
cagaaaacauccgauuuaa

SEQ ID NO: 836829 - RNA, 19 nt, Homo sapiens
gcagagagcaaugauagca

SEQ ID NO: 836830 - RNA, 19 nt, Homo sapiens
gguggugcauaauggauau

SEQ ID NO: 836831 - RNA, 19 nt, Homo sapiens
gaacgcaaggcugugauau

SEQ ID NO: 836832 - RNA, 19 nt, Homo sapiens
cauuuaaucucugcaguuc

SEQ ID NO: 836833 - RNA, 19 nt, Homo sapiens
acacuugucuccccucaua

SEQ ID NO: 836834 - RNA, 19 nt, Homo sapiens
ucaagugaauucuuugcau

SEQ ID NO: 836835 - RNA, 19 nt, Homo sapiens
cuacaggaauccagugucu

SEQ ID NO: 836836 - RNA, 19 nt, Homo sapiens
gaucccacauccugaauaa

SEQ ID NO: 836837 - RNA, 19 nt, Homo sapiens
gcaggaagcccacgguguu

SEQ ID NO: 836838 - RNA, 19 nt, Homo sapiens
gagacacccugcuacauca

SEQ ID NO: 836839 - RNA, 19 nt, Homo sapiens
gaccauagcaagccacuag

SEQ ID NO: 836840 - RNA, 19 nt, Homo sapiens
ugacaucgcccucaucaag

SEQ ID NO: 836841 - RNA, 19 nt, Homo sapiens
cagcuuuguuucugccuuu

SEQ ID NO: 836842 - RNA, 19 nt, Homo sapiens
gaagaagaccauggugugu

SEQ ID NO: 836843 - RNA, 19 nt, Homo sapiens
guacgaccgugcugugaag

SEQ ID NO: 836844 - RNA, 19 nt, Homo sapiens
ucaguucccuccuccuugu

SEQ ID NO: 836845 - RNA, 19 nt, Homo sapiens
ggcgugaccagcuuuguuu

SEQ ID NO: 836846 - RNA, 19 nt, Homo sapiens
cgagacacccugcuacauc

SEQ ID NO: 836847 - RNA, 19 nt, Homo sapiens
ccaacgagacacccugcua

SEQ ID NO: 836848 - RNA, 19 nt, Homo sapiens
agguuucccugcaguauga

SEQ ID NO: 836849 - RNA, 19 nt, Homo sapiens
ccacauccugaauaaagaa

SEQ ID NO: 836850 - RNA, 19 nt, Homo sapiens
gcucaguucccuccuccuu

SEQ ID NO: 836851 - RNA, 19 nt, Homo sapiens
cccacauccugaauaaaga

SEQ ID NO: 836852 - RNA, 19 nt, Homo sapiens
ugccggugguggacuauga

SEQ ID NO: 836853 - RNA, 19 nt, Homo sapiens
gugaccagcuuuguuucug

SEQ ID NO: 836854 - RNA, 19 nt, Homo sapiens
gugacauccuucccaacga

SEQ ID NO: 836855 - RNA, 19 nt, Homo sapiens
gaguacgaccgugcuguga

SEQ ID NO: 836856 - RNA, 19 nt, Homo sapiens
ucccacauccugaauaaag

SEQ ID NO: 836857 - RNA, 19 nt, Homo sapiens
ugaagaagaugaaacguua

SEQ ID NO: 836858 - RNA, 19 nt, Homo sapiens
caagaacgguugaagcuua

SEQ ID NO: 836859 - RNA, 19 nt, Homo sapiens
gagcgaaucuucuacauug

SEQ ID NO: 836860 - RNA, 19 nt, Homo sapiens
gaaagcacaucaagagaaa

SEQ ID NO: 836861 - RNA, 19 nt, Homo sapiens
gagaggagguggccauuaa

SEQ ID NO: 836862 - RNA, 19 nt, Homo sapiens
gcagauggcuggaugugaa

SEQ ID NO: 836863 - RNA, 19 nt, Homo sapiens
uaacccagcugcacuauug

SEQ ID NO: 836864 - RNA, 19 nt, Homo sapiens
gaucaugugugaaauccua

SEQ ID NO: 836865 - RNA, 19 nt, Homo sapiens
gaacaaccccaaacuauua

SEQ ID NO: 836866 - RNA, 19 nt, Homo sapiens
ugaauaaggugaagaagau

SEQ ID NO: 836867 - RNA, 19 nt, Homo sapiens
gaacuuaauagaugacuug

SEQ ID NO: 836868 - RNA, 19 nt, Homo sapiens
ggaauugagugauggacuu

SEQ ID NO: 836869 - RNA, 19 nt, Homo sapiens
ugagguggcugaucgaauu

SEQ ID NO: 836870 - RNA, 19 nt, Homo sapiens
guagagaucugauauuuug

SEQ ID NO: 836871 - RNA, 19 nt, Homo sapiens
gcagagaugcuauacaaga

SEQ ID NO: 836872 - RNA, 19 nt, Homo sapiens
gaucuuaguccucagcaua

SEQ ID NO: 836873 - RNA, 19 nt, Homo sapiens
gacaugagaugguggugaa

SEQ ID NO: 836874 - RNA, 19 nt, Homo sapiens
gcaguacccauguugauuu

SEQ ID NO: 836875 - RNA, 19 nt, Homo sapiens
ugccgaagcuggcuacuaa

SEQ ID NO: 836876 - RNA, 19 nt, Homo sapiens
gcagaguguuugaagauca

SEQ ID NO: 836877 - RNA, 19 nt, Homo sapiens
ggaacguugucaagaggua

SEQ ID NO: 836878 - RNA, 19 nt, Homo sapiens
auacaggagugaucuauga

SEQ ID NO: 836879 - RNA, 19 nt, Homo sapiens
uacagagacucaaguguuu

SEQ ID NO: 836880 - RNA, 19 nt, Homo sapiens
cugauaagaucuccuuuga

SEQ ID NO: 836881 - RNA, 19 nt, Homo sapiens
gucaagagguagugagauu

SEQ ID NO: 836882 - RNA, 19 nt, Homo sapiens
cgagagagcccaaccauag

SEQ ID NO: 836883 - RNA, 19 nt, Homo sapiens
cagagaugcuauacaagaa

SEQ ID NO: 836884 - RNA, 19 nt, Homo sapiens
guuugaagaucauguguga

SEQ ID NO: 836885 - RNA, 19 nt, Homo sapiens
gaaacguuaucauguugga

SEQ ID NO: 836886 - RNA, 19 nt, Homo sapiens
guuaucagcugcuuuaaac

SEQ ID NO: 836887 - RNA, 19 nt, Homo sapiens
cuuaauagaugacuugaca

SEQ ID NO: 836888 - RNA, 19 nt, Homo sapiens
aggcagagaugcuauacaa

SEQ ID NO: 836889 - RNA, 19 nt, Homo sapiens
guuaacaucccaacugaaa

SEQ ID NO: 836890 - RNA, 19 nt, Homo sapiens
gugcagaacuguagaagac

SEQ ID NO: 836891 - RNA, 19 nt, Homo sapiens
ccaggaagggugacaagua

SEQ ID NO: 836892 - RNA, 19 nt, Homo sapiens
gauuguggaugggauguuu

SEQ ID NO: 836893 - RNA, 19 nt, Homo sapiens
gcuguaugcuugauaaucu

SEQ ID NO: 836894 - RNA, 19 nt, Homo sapiens
ggacagaugcuauccuaag

SEQ ID NO: 836895 - RNA, 19 nt, Homo sapiens
ccagauacuuagccuucua

SEQ ID NO: 836896 - RNA, 19 nt, Homo sapiens
gaucagaaaccagauacuu

SEQ ID NO: 836897 - RNA, 19 nt, Homo sapiens
gaccuaaagcugcuauuug

SEQ ID NO: 836898 - RNA, 19 nt, Homo sapiens
gagaugcuauacaagaaca

SEQ ID NO: 836899 - RNA, 19 nt, Homo sapiens
cuacagagacucaaguguu

SEQ ID NO: 836900 - RNA, 19 nt, Homo sapiens
ccuaguagagcaaauguuu

SEQ ID NO: 836901 - RNA, 19 nt, Homo sapiens
agguagagaucugauauuu

SEQ ID NO: 836902 - RNA, 19 nt, Homo sapiens
cagcugcacuauugugaga

SEQ ID NO: 836903 - RNA, 19 nt, Homo sapiens
accuaaagcugcuauuuga

SEQ ID NO: 836904 - RNA, 19 nt, Homo sapiens
gaagaucaugugugaaauc

SEQ ID NO: 836905 - RNA, 19 nt, Homo sapiens
ugaccuuacuguucccuuu

SEQ ID NO: 836906 - RNA, 19 nt, Homo sapiens
ugaaggaaacccugacuga

SEQ ID NO: 836907 - RNA, 19 nt, Homo sapiens
caagguagagaucugauau

SEQ ID NO: 836908 - RNA, 19 nt, Homo sapiens
gaugcagaguguuugaaga

SEQ ID NO: 836909 - RNA, 19 nt, Homo sapiens
ugaaagcacaucaagagaa

SEQ ID NO: 836910 - RNA, 19 nt, Homo sapiens
auacuuagccuucuacugu

SEQ ID NO: 836911 - RNA, 19 nt, Homo sapiens
cacaacaacuagccaggaa

SEQ ID NO: 836912 - RNA, 19 nt, Homo sapiens
uggaauugcugauaagauc

SEQ ID NO: 836913 - RNA, 19 nt, Homo sapiens
uaagggaacuugggaggau

SEQ ID NO: 836914 - RNA, 19 nt, Homo sapiens
gaacgguugaagcuuauug

SEQ ID NO: 836915 - RNA, 19 nt, Homo sapiens
guguuaacaucccaacuga

SEQ ID NO: 836916 - RNA, 19 nt, Homo sapiens
aggaaacccugacugagaa

SEQ ID NO: 836917 - RNA, 19 nt, Homo sapiens
uugcagagcuuugggauuc

SEQ ID NO: 836918 - RNA, 19 nt, Homo sapiens
cauuugagcugaaggaaac

SEQ ID NO: 836919 - RNA, 19 nt, Homo sapiens
ucacugcucuauuccauac

SEQ ID NO: 836920 - RNA, 19 nt, Homo sapiens
gagcaagaacugaaagaag

SEQ ID NO: 836921 - RNA, 19 nt, Homo sapiens
gaaccauugagaucagaaa

SEQ ID NO: 836922 - RNA, 19 nt, Homo sapiens
caggaagggugacaaguac

SEQ ID NO: 836923 - RNA, 19 nt, Homo sapiens
gaaauucagaagcgacugu

SEQ ID NO: 836924 - RNA, 19 nt, Homo sapiens
uaccugacuuuauuuggaa

SEQ ID NO: 836925 - RNA, 19 nt, Homo sapiens
caacugaaagcacaucaag

SEQ ID NO: 836926 - RNA, 19 nt, Homo sapiens
gacagaugcuauccuaagg

SEQ ID NO: 836927 - RNA, 19 nt, Homo sapiens
gcacaucaagagaaaccaa

SEQ ID NO: 836928 - RNA, 19 nt, Homo sapiens
cuaaagcugcuauuugaau

SEQ ID NO: 836929 - RNA, 19 nt, Homo sapiens
cagaggcaguguuaacauc

SEQ ID NO: 836930 - RNA, 19 nt, Homo sapiens
gcgagagagcccaaccaua

SEQ ID NO: 836931 - RNA, 19 nt, Homo sapiens
gaagugguuggauaacaug

SEQ ID NO: 836932 - RNA, 19 nt, Homo sapiens
agaagugguuggauaacau

SEQ ID NO: 836933 - RNA, 19 nt, Homo sapiens
cauggaggcuguuuuagaa

SEQ ID NO: 836934 - RNA, 19 nt, Homo sapiens
gguugcagaggcaguguua

SEQ ID NO: 836935 - RNA, 19 nt, Homo sapiens
ucagaaaccagauacuuag

SEQ ID NO: 836936 - RNA, 19 nt, Homo sapiens
ccucuggaauugagugaug

SEQ ID NO: 836937 - RNA, 19 nt, Homo sapiens
gcugauaagaucuccuuug

SEQ ID NO: 836938 - RNA, 19 nt, Homo sapiens
gaagaagaugaaacguuau

SEQ ID NO: 836939 - RNA, 19 nt, Homo sapiens
gugaagaagaugaaacguu

SEQ ID NO: 836940 - RNA, 19 nt, Homo sapiens
gcauuugagcugaaggaaa

SEQ ID NO: 836941 - RNA, 19 nt, Homo sapiens
gggcuagugugagcagcua

SEQ ID NO: 836942 - RNA, 19 nt, Homo sapiens
ggucauuauuggugagcaa

SEQ ID NO: 836943 - RNA, 19 nt, Homo sapiens
gaugggauguuugcugucu

SEQ ID NO: 836944 - RNA, 19 nt, Homo sapiens
uugaagaucaugugugaaa

SEQ ID NO: 836945 - RNA, 19 nt, Homo sapiens
caucaagagaaaccaaauu

SEQ ID NO: 836946 - RNA, 19 nt, Homo sapiens
caagagguagugagauugu

SEQ ID NO: 836947 - RNA, 19 nt, Homo sapiens
ccacaccacagaagaacuu

SEQ ID NO: 836948 - RNA, 19 nt, Homo sapiens
auaccugacuuuauuugga

SEQ ID NO: 836949 - RNA, 19 nt, Homo sapiens
aaggaaacccugacugaga

SEQ ID NO: 836950 - RNA, 19 nt, Homo sapiens
gguuaucagcugcuuuaaa

SEQ ID NO: 836951 - RNA, 19 nt, Homo sapiens
caguacccauguugauuug

SEQ ID NO: 836952 - RNA, 19 nt, Homo sapiens
uagaagugguuggauaaca

SEQ ID NO: 836953 - RNA, 19 nt, Homo sapiens
ugagaucagaaaccagaua

SEQ ID NO: 836954 - RNA, 19 nt, Homo sapiens
ccacggaacguugucaaga

SEQ ID NO: 836955 - RNA, 19 nt, Homo sapiens
cugcugcucuuuguagaaa

SEQ ID NO: 836956 - RNA, 19 nt, Homo sapiens
ucaaggcagagaugcuaua

SEQ ID NO: 836957 - RNA, 19 nt, Homo sapiens
ggaacucgcuuaagaaauu

SEQ ID NO: 836958 - RNA, 19 nt, Homo sapiens
gcacccggcuugcaauuua

SEQ ID NO: 836959 - RNA, 19 nt, Homo sapiens
gaucaagacugggaauaua

SEQ ID NO: 836960 - RNA, 19 nt, Homo sapiens
gaaaguagcagaggaaauu

SEQ ID NO: 836961 - RNA, 19 nt, Homo sapiens
caagaaggccugccaauuu

SEQ ID NO: 836962 - RNA, 19 nt, Homo sapiens
ggaaaugaauguagauugu

SEQ ID NO: 836963 - RNA, 19 nt, Homo sapiens
gagaaugacuccaaagguu

SEQ ID NO: 836964 - RNA, 19 nt, Homo sapiens
gguagcaccugaauucuuu

SEQ ID NO: 836965 - RNA, 19 nt, Homo sapiens
ggccugaucuuacucauuu

SEQ ID NO: 836966 - RNA, 19 nt, Homo sapiens
gaucuucuauaguagguua

SEQ ID NO: 836967 - RNA, 19 nt, Homo sapiens
aagaaggccugccaauuua

SEQ ID NO: 836968 - RNA, 19 nt, Homo sapiens
gaccaucagucccuauaua

SEQ ID NO: 836969 - RNA, 19 nt, Homo sapiens
gaacaggccugaucuuacu

SEQ ID NO: 836970 - RNA, 19 nt, Homo sapiens
cuacagcucuggaaauuga

SEQ ID NO: 836971 - RNA, 19 nt, Homo sapiens
ucacucaacugcuucuuaa

SEQ ID NO: 836972 - RNA, 19 nt, Homo sapiens
caaccaggcuaauaaccua

SEQ ID NO: 836973 - RNA, 19 nt, Homo sapiens
ggacaagacuguggaaugg

SEQ ID NO: 836974 - RNA, 19 nt, Homo sapiens
ggagaacacuuagcauaug

SEQ ID NO: 836975 - RNA, 19 nt, Homo sapiens
guggagaaguuauacgaua

SEQ ID NO: 836976 - RNA, 19 nt, Homo sapiens
gcuaauaaccuaacacaug

SEQ ID NO: 836977 - RNA, 19 nt, Homo sapiens
ggaggaguuuggagaauga

SEQ ID NO: 836978 - RNA, 19 nt, Homo sapiens
guggaaagcuaugggaaua

SEQ ID NO: 836979 - RNA, 19 nt, Homo sapiens
gacaugaggcagauucuua

SEQ ID NO: 836980 - RNA, 19 nt, Homo sapiens
ggaaagcuaugggaauaug

SEQ ID NO: 836981 - RNA, 19 nt, Homo sapiens
caagaccgcuauaccuaaa

SEQ ID NO: 836982 - RNA, 19 nt, Homo sapiens
gaaccggauuguaggcuuu

SEQ ID NO: 836983 - RNA, 19 nt, Homo sapiens
ugugggagcuguucgauuu

SEQ ID NO: 836984 - RNA, 19 nt, Homo sapiens
uuacagacguggugaagaa

SEQ ID NO: 836985 - RNA, 19 nt, Homo sapiens
gagacaacauggaagaaga

SEQ ID NO: 836986 - RNA, 19 nt, Homo sapiens
ggauaugauugguguuuga

SEQ ID NO: 836987 - RNA, 19 nt, Homo sapiens
gaauugcuguuccucuuug

SEQ ID NO: 836988 - RNA, 19 nt, Homo sapiens
gaacucgcuuaagaaauuu

SEQ ID NO: 836989 - RNA, 19 nt, Homo sapiens
ccagaacucucacccgauu

SEQ ID NO: 836990 - RNA, 19 nt, Homo sapiens
gggcaaaggcgucauaaau

SEQ ID NO: 836991 - RNA, 19 nt, Homo sapiens
guaagauggugacauuguu

SEQ ID NO: 836992 - RNA, 19 nt, Homo sapiens
gaggaaauuucacaugcaa

SEQ ID NO: 836993 - RNA, 19 nt, Homo sapiens
cuaauaaccuaacacaugu

SEQ ID NO: 836994 - RNA, 19 nt, Homo sapiens
ggcaagagauccagcuaga

SEQ ID NO: 836995 - RNA, 19 nt, Homo sapiens
gaaacugccuccucucaac

SEQ ID NO: 836996 - RNA, 19 nt, Homo sapiens
uaagagagaagcagauuug

SEQ ID NO: 836997 - RNA, 19 nt, Homo sapiens
gaagguuuccugcaaaguu

SEQ ID NO: 836998 - RNA, 19 nt, Homo sapiens
gaaggaaagaugagaacaa

SEQ ID NO: 836999 - RNA, 19 nt, Homo sapiens
uuuaagcgcuccuuccuaa

SEQ ID NO: 837000 - RNA, 19 nt, Homo sapiens
gguuugagcuuggcuagaa

SEQ ID NO: 837001 - RNA, 19 nt, Homo sapiens
guaaucgucuaaaggcaaa

SEQ ID NO: 837002 - RNA, 19 nt, Homo sapiens
gauccugucucugaagaaa

SEQ ID NO: 837003 - RNA, 19 nt, Homo sapiens
caauagccaucaaggagaa

SEQ ID NO: 837004 - RNA, 19 nt, Homo sapiens
ccagcuaacuuuuguauuu

SEQ ID NO: 837005 - RNA, 19 nt, Homo sapiens
caagagauccagcuagaga

SEQ ID NO: 837006 - RNA, 19 nt, Homo sapiens
gaagauucccaccagcuaa

SEQ ID NO: 837007 - RNA, 19 nt, Homo sapiens
gcguaaacauaguaucuga

SEQ ID NO: 837008 - RNA, 19 nt, Homo sapiens
gaagggcaaaggcgucaua

SEQ ID NO: 837009 - RNA, 19 nt, Homo sapiens
gcaaacugacucacguuaa

SEQ ID NO: 837010 - RNA, 19 nt, Homo sapiens
gcaaugaggaugaggacaa

SEQ ID NO: 837011 - RNA, 19 nt, Homo sapiens
ggaagaagaggaggagaaa

SEQ ID NO: 837012 - RNA, 19 nt, Homo sapiens
ccgguaagauggugacauu

SEQ ID NO: 837013 - RNA, 19 nt, Homo sapiens
aaggaaagaugagaacaaa

SEQ ID NO: 837014 - RNA, 19 nt, Homo sapiens
gaaggaggaguuuggagaa

SEQ ID NO: 837015 - RNA, 19 nt, Homo sapiens
gagauggaguuucgcuguu

SEQ ID NO: 837016 - RNA, 19 nt, Homo sapiens
gcccauagccuuaacuuca

SEQ ID NO: 837017 - RNA, 19 nt, Homo sapiens
gaaaagggcucagaggaau

SEQ ID NO: 837018 - RNA, 19 nt, Homo sapiens
acaagcaaguggagaaguu

SEQ ID NO: 837019 - RNA, 19 nt, Homo sapiens
ggaggaagcagaagaagag

SEQ ID NO: 837020 - RNA, 19 nt, Homo sapiens
gcagaaagaauugcuguuc

SEQ ID NO: 837021 - RNA, 19 nt, Homo sapiens
ccucuacaauguuuccuuu

SEQ ID NO: 837022 - RNA, 19 nt, Homo sapiens
cgaauaguauagugucuca

SEQ ID NO: 837023 - RNA, 19 nt, Homo sapiens
uaaucucccuguagcguaa

SEQ ID NO: 837024 - RNA, 19 nt, Homo sapiens
uggcagaaauugcagauca

SEQ ID NO: 837025 - RNA, 19 nt, Homo sapiens
cuaacaaguucuagaagau

SEQ ID NO: 837026 - RNA, 19 nt, Homo sapiens
ggagugcaguggugugauc

SEQ ID NO: 837027 - RNA, 19 nt, Homo sapiens
gcaaagccacagucaugaa

SEQ ID NO: 837028 - RNA, 19 nt, Homo sapiens
caucaggggugguuacaua

SEQ ID NO: 837029 - RNA, 19 nt, Homo sapiens
gagaacacuuagcauaugg

SEQ ID NO: 837030 - RNA, 19 nt, Homo sapiens
gggagaacacuuagcauau

SEQ ID NO: 837031 - RNA, 19 nt, Homo sapiens
gaugacaaacagaguauau

SEQ ID NO: 837032 - RNA, 19 nt, Homo sapiens
ggcaaaggcgucauaaaug

SEQ ID NO: 837033 - RNA, 19 nt, Homo sapiens
caaacugacucacguuaac

SEQ ID NO: 837034 - RNA, 19 nt, Homo sapiens
gacauccgauccaucaguu

SEQ ID NO: 837035 - RNA, 19 nt, Homo sapiens
ggagaaagaagaggaggaa

SEQ ID NO: 837036 - RNA, 19 nt, Homo sapiens
agacaggguuucaccaugu

SEQ ID NO: 837037 - RNA, 19 nt, Homo sapiens
gaacuacuuagcagaugaa

SEQ ID NO: 837038 - RNA, 19 nt, Homo sapiens
gaauacaugacaagacaga

SEQ ID NO: 837039 - RNA, 19 nt, Homo sapiens
caaccacuacuaacaaguu

SEQ ID NO: 837040 - RNA, 19 nt, Homo sapiens
auaccaaucuagucccuaa

SEQ ID NO: 837041 - RNA, 19 nt, Homo sapiens
ugaaucuccucuacaaugu

SEQ ID NO: 837042 - RNA, 19 nt, Homo sapiens
aagcaagcaucagcgaaua

SEQ ID NO: 837043 - RNA, 19 nt, Homo sapiens
ccacugaacagccaugaga

SEQ ID NO: 837044 - RNA, 19 nt, Homo sapiens
aggcaaacauuccugcaaa

SEQ ID NO: 837045 - RNA, 19 nt, Homo sapiens
gaaagaagaggaggaagag

SEQ ID NO: 837046 - RNA, 19 nt, Homo sapiens
cuaaagaccucuauauccu

SEQ ID NO: 837047 - RNA, 19 nt, Homo sapiens
uaacuucaacuucaacguu

SEQ ID NO: 837048 - RNA, 19 nt, Homo sapiens
cauccuuuccuuacaguua

SEQ ID NO: 837049 - RNA, 19 nt, Homo sapiens
ccacagugcugggauuaca

SEQ ID NO: 837050 - RNA, 19 nt, Homo sapiens
ggaaauuucacaugcaaag

SEQ ID NO: 837051 - RNA, 19 nt, Homo sapiens
gcagaggaaauuucacaug

SEQ ID NO: 837052 - RNA, 19 nt, Homo sapiens
uaagaaaguagcagaggaa

SEQ ID NO: 837053 - RNA, 19 nt, Homo sapiens
aaucuccucuacaauguuu

SEQ ID NO: 837054 - RNA, 19 nt, Homo sapiens
ucagagaggugaugaaaau

SEQ ID NO: 837055 - RNA, 19 nt, Homo sapiens
aagaggaaaugaauguaga

SEQ ID NO: 837056 - RNA, 19 nt, Homo sapiens
ggaggccaaccacuacuaa

SEQ ID NO: 837057 - RNA, 19 nt, Homo sapiens
gaggugaucugacccauuu

SEQ ID NO: 837058 - RNA, 19 nt, Homo sapiens
gaaacacaaucagcucuuu

SEQ ID NO: 837059 - RNA, 19 nt, Homo sapiens
gagaggagcuucgccaaga

SEQ ID NO: 837060 - RNA, 19 nt, Homo sapiens
ucuaugagcuucacuuaau

SEQ ID NO: 837061 - RNA, 19 nt, Homo sapiens
gaaauaggauguuuugugu

SEQ ID NO: 837062 - RNA, 19 nt, Homo sapiens
cuacaacccugcaacuuug

SEQ ID NO: 837063 - RNA, 19 nt, Homo sapiens
ucuccaagcuccugucuuu

SEQ ID NO: 837064 - RNA, 19 nt, Homo sapiens
gauaaagcauucuuguuac

SEQ ID NO: 837065 - RNA, 19 nt, Homo sapiens
guacagagaaacacaauca

SEQ ID NO: 837066 - RNA, 19 nt, Homo sapiens
gggcccaacugauaugauu

SEQ ID NO: 837067 - RNA, 19 nt, Homo sapiens
ccgcacagcucaacgaguu

SEQ ID NO: 837068 - RNA, 19 nt, Homo sapiens
ggacaaguuuauaucaagu

SEQ ID NO: 837069 - RNA, 19 nt, Homo sapiens
guuacauacuggucaauuu

SEQ ID NO: 837070 - RNA, 19 nt, Homo sapiens
uaaaggaggacaagcauug

SEQ ID NO: 837071 - RNA, 19 nt, Homo sapiens
gaaaucagacaccaaugga

SEQ ID NO: 837072 - RNA, 19 nt, Homo sapiens
gagcacacagucucuauga

SEQ ID NO: 837073 - RNA, 19 nt, Homo sapiens
ggaauucgguuuucuuaau

SEQ ID NO: 837074 - RNA, 19 nt, Homo sapiens
gcaacuuuguacagagaaa

SEQ ID NO: 837075 - RNA, 19 nt, Homo sapiens
ccaaagacccggacaagca

SEQ ID NO: 837076 - RNA, 19 nt, Homo sapiens
gggaggcggugaaguguag

SEQ ID NO: 837077 - RNA, 19 nt, Homo sapiens
gggaggacaucaccacagu

SEQ ID NO: 837078 - RNA, 19 nt, Homo sapiens
gaucugacccauuuugaua

SEQ ID NO: 837079 - RNA, 19 nt, Homo sapiens
ucugagggcccaacugaua

SEQ ID NO: 837080 - RNA, 19 nt, Homo sapiens
guagauaaagcauucuugu

SEQ ID NO: 837081 - RNA, 19 nt, Homo sapiens
caucugagggcccaacuga

SEQ ID NO: 837082 - RNA, 19 nt, Homo sapiens
ucuacaacccugcaacuuu

SEQ ID NO: 837083 - RNA, 19 nt, Homo sapiens
ccacaucucuuuucuggau

SEQ ID NO: 837084 - RNA, 19 nt, Homo sapiens
caagggacagcacaauguu

SEQ ID NO: 837085 - RNA, 19 nt, Homo sapiens
ccggacaaguuuauaucaa

SEQ ID NO: 837086 - RNA, 19 nt, Homo sapiens
ccaagcuccugucuuucuu

SEQ ID NO: 837087 - RNA, 19 nt, Homo sapiens
ggguuuguuugcuuccuuu

SEQ ID NO: 837088 - RNA, 19 nt, Homo sapiens
uuacauacuggucaauuug

SEQ ID NO: 837089 - RNA, 19 nt, Homo sapiens
gaacgugacaguggauugg

SEQ ID NO: 837090 - RNA, 19 nt, Homo sapiens
ucaagggacagcacaaugu

SEQ ID NO: 837091 - RNA, 19 nt, Homo sapiens
cggacaaguuuauaucaag

SEQ ID NO: 837092 - RNA, 19 nt, Homo sapiens
ggugcgcgaugcugucuca

SEQ ID NO: 837093 - RNA, 19 nt, Homo sapiens
ucugugcccuugguuguuu

SEQ ID NO: 837094 - RNA, 19 nt, Homo sapiens
ggaacgugacaguggauug

SEQ ID NO: 837095 - RNA, 19 nt, Homo sapiens
gcccaacugauaugauuug

SEQ ID NO: 837096 - RNA, 19 nt, Homo sapiens
cgaggaagaggugaucuga

SEQ ID NO: 837097 - RNA, 19 nt, Homo sapiens
ggauuggguggcuggagua

SEQ ID NO: 837098 - RNA, 19 nt, Homo sapiens
gcacaauguuagggauuuu

SEQ ID NO: 837099 - RNA, 19 nt, Homo sapiens
ucucuaugagcuucacuua

SEQ ID NO: 837100 - RNA, 19 nt, Homo sapiens
gcauucuuguuacauacug

SEQ ID NO: 837101 - RNA, 19 nt, Homo sapiens
caaauccaaacccagagaa

SEQ ID NO: 837102 - RNA, 19 nt, Homo sapiens
cugcaacuuuguacagaga

SEQ ID NO: 837103 - RNA, 19 nt, Homo sapiens
cuaugagcuucacuuaaug

SEQ ID NO: 837104 - RNA, 19 nt, Homo sapiens
ugaaaucagacaccaaugg

SEQ ID NO: 837105 - RNA, 19 nt, Homo sapiens
ugcaugugcuggucaaauc

SEQ ID NO: 837106 - RNA, 19 nt, Homo sapiens
gcucugugcccuugguugu

SEQ ID NO: 837107 - RNA, 19 nt, Homo sapiens
acaacugugugagagugua

SEQ ID NO: 837108 - RNA, 19 nt, Homo sapiens
caagcuccugucuuucuuu

SEQ ID NO: 837109 - RNA, 19 nt, Homo sapiens
ugucuguguuuauuuaugg

SEQ ID NO: 837110 - RNA, 19 nt, Homo sapiens
gcagcagggccaacagaag

SEQ ID NO: 837111 - RNA, 19 nt, Homo sapiens
ucacuaccccgacaucuuu

SEQ ID NO: 837112 - RNA, 19 nt, Homo sapiens
ucaaauccaaacccagaga

SEQ ID NO: 837113 - RNA, 19 nt, Homo sapiens
uaaagccgcuaaaauuugg

SEQ ID NO: 837114 - RNA, 19 nt, Homo sapiens
uaccaaccgccucaucuga

SEQ ID NO: 837115 - RNA, 19 nt, Homo sapiens
aagggacagcacaauguua

SEQ ID NO: 837116 - RNA, 19 nt, Homo sapiens
aaagacgaccaacguguuc

SEQ ID NO: 837117 - RNA, 19 nt, Homo sapiens
caggcuagguaugaaagau

SEQ ID NO: 837118 - RNA, 19 nt, Homo sapiens
ggucaauuugugauauguu

SEQ ID NO: 837119 - RNA, 19 nt, Homo sapiens
cauacuggucaauuuguga

SEQ ID NO: 837120 - RNA, 19 nt, Homo sapiens
gcacucggacaucuacaac

SEQ ID NO: 837121 - RNA, 19 nt, Homo sapiens
gcuccugucuuucuuuccu

SEQ ID NO: 837122 - RNA, 19 nt, Homo sapiens
caaaccgaauuuucuuuca

SEQ ID NO: 837123 - RNA, 19 nt, Homo sapiens
gagcuggcacugcguaucg

SEQ ID NO: 837124 - RNA, 19 nt, Homo sapiens
cagcacaauguuagggauu

SEQ ID NO: 837125 - RNA, 19 nt, Homo sapiens
uuguguagauaaagcauuc

SEQ ID NO: 837126 - RNA, 19 nt, Homo sapiens
ugaaauaggauguuuugug

SEQ ID NO: 837127 - RNA, 19 nt, Homo sapiens
aaacacaaucagcucuuuc

SEQ ID NO: 837128 - RNA, 19 nt, Homo sapiens
agcacaauguuagggauuu

SEQ ID NO: 837129 - RNA, 19 nt, Homo sapiens
gggcagaaacacacacacu

SEQ ID NO: 837130 - RNA, 19 nt, Homo sapiens
caacauugaucuccuauuu

SEQ ID NO: 837131 - RNA, 19 nt, Homo sapiens
gaacugguaucaaagaaug

SEQ ID NO: 837132 - RNA, 19 nt, Homo sapiens
gaaggaauauuagaggaaa

SEQ ID NO: 837133 - RNA, 19 nt, Homo sapiens
cuaggaaucucgacauuaa

SEQ ID NO: 837134 - RNA, 19 nt, Homo sapiens
gaugguagccagagaauuu

SEQ ID NO: 837135 - RNA, 19 nt, Homo sapiens
gaggaaacuugaaaucuga

SEQ ID NO: 837136 - RNA, 19 nt, Homo sapiens
ggaggcaaaugaagauaaa

SEQ ID NO: 837137 - RNA, 19 nt, Homo sapiens
gauaagacauguguauaug

SEQ ID NO: 837138 - RNA, 19 nt, Homo sapiens
cgacugaccuggauaguag

SEQ ID NO: 837139 - RNA, 19 nt, Homo sapiens
gacagcaaauguagucuaa

SEQ ID NO: 837140 - RNA, 19 nt, Homo sapiens
agaaggaccucguuaucua

SEQ ID NO: 837141 - RNA, 19 nt, Homo sapiens
gaaaucccacuaaagcaua

SEQ ID NO: 837142 - RNA, 19 nt, Homo sapiens
cagcaaauguagucuaaga

SEQ ID NO: 837143 - RNA, 19 nt, Homo sapiens
gaaauauucagcuugguuu

SEQ ID NO: 837144 - RNA, 19 nt, Homo sapiens
uaauggagguuagcccuua

SEQ ID NO: 837145 - RNA, 19 nt, Homo sapiens
uagcugcuguuauuaagua

SEQ ID NO: 837146 - RNA, 19 nt, Homo sapiens
gaucuauacucuucagaau

SEQ ID NO: 837147 - RNA, 19 nt, Homo sapiens
gcacuuggaggccuuguaa

SEQ ID NO: 837148 - RNA, 19 nt, Homo sapiens
gaaggauugcuaaauguuu

SEQ ID NO: 837149 - RNA, 19 nt, Homo sapiens
ggauaagacauguguauau

SEQ ID NO: 837150 - RNA, 19 nt, Homo sapiens
gaagaaggaccucguuauc

SEQ ID NO: 837151 - RNA, 19 nt, Homo sapiens
caacaaaugucagauacca

SEQ ID NO: 837152 - RNA, 19 nt, Homo sapiens
gagaagauaucaucaugcu

SEQ ID NO: 837153 - RNA, 19 nt, Homo sapiens
gagaacugguaucaaagaa

SEQ ID NO: 837154 - RNA, 19 nt, Homo sapiens
aaugaaggauugcuaaaug

SEQ ID NO: 837155 - RNA, 19 nt, Homo sapiens
auucucagcuugauucuaa

SEQ ID NO: 837156 - RNA, 19 nt, Homo sapiens
gcacacaacaaaugucaga

SEQ ID NO: 837157 - RNA, 19 nt, Homo sapiens
caagagcacacaacaaaug

SEQ ID NO: 837158 - RNA, 19 nt, Homo sapiens
ggauuaggauuagaaggaa

SEQ ID NO: 837159 - RNA, 19 nt, Homo sapiens
ucagggaucuauacucuuc

SEQ ID NO: 837160 - RNA, 19 nt, Homo sapiens
ggagccauccuuguaauaa

SEQ ID NO: 837161 - RNA, 19 nt, Homo sapiens
ggagaacugguaucaaaga

SEQ ID NO: 837162 - RNA, 19 nt, Homo sapiens
caucagggaucuauacucu

SEQ ID NO: 837163 - RNA, 19 nt, Homo sapiens
gauaguaguuguucuucag

SEQ ID NO: 837164 - RNA, 19 nt, Homo sapiens
uaaacuugcuauuccauca

SEQ ID NO: 837165 - RNA, 19 nt, Homo sapiens
gcugaaagcaauccaguug

SEQ ID NO: 837166 - RNA, 19 nt, Homo sapiens
ucaggucacguaucaguua

SEQ ID NO: 837167 - RNA, 19 nt, Homo sapiens
cuacuuaucaggucacgua

SEQ ID NO: 837168 - RNA, 19 nt, Homo sapiens
cuacaaagacagcaaaugu

SEQ ID NO: 837169 - RNA, 19 nt, Homo sapiens
gcacagaggacuucuacag

SEQ ID NO: 837170 - RNA, 19 nt, Homo sapiens
cagcuugguuucuuuggaa

SEQ ID NO: 837171 - RNA, 19 nt, Homo sapiens
acacaacaaaugucagaua

SEQ ID NO: 837172 - RNA, 19 nt, Homo sapiens
caaucaguguggauaagaa

SEQ ID NO: 837173 - RNA, 19 nt, Homo sapiens
guacaguggcccucagauu

SEQ ID NO: 837174 - RNA, 19 nt, Homo sapiens
gaaggaccucguuaucuau

SEQ ID NO: 837175 - RNA, 19 nt, Homo sapiens
agaggaaacuugaaaucug

SEQ ID NO: 837176 - RNA, 19 nt, Homo sapiens
gggauuaggauuagaagga

SEQ ID NO: 837177 - RNA, 19 nt, Homo sapiens
ggaaaucccacuaaagcau

SEQ ID NO: 837178 - RNA, 19 nt, Homo sapiens
auggagaacugguaucaaa

SEQ ID NO: 837179 - RNA, 19 nt, Homo sapiens
ugcaaccucuuuaucgaua

SEQ ID NO: 837180 - RNA, 19 nt, Homo sapiens
ggauaguaguuguucuuca

SEQ ID NO: 837181 - RNA, 19 nt, Homo sapiens
ccaguuugguucuaacaau

SEQ ID NO: 837182 - RNA, 19 nt, Homo sapiens
aaaccuauggaaacacuua

SEQ ID NO: 837183 - RNA, 19 nt, Homo sapiens
acauuucacuuaucagaga

SEQ ID NO: 837184 - RNA, 19 nt, Homo sapiens
ucccaaaccugcaggaaau

SEQ ID NO: 837185 - RNA, 19 nt, Homo sapiens
ggaccucguuaucuaucuu

SEQ ID NO: 837186 - RNA, 19 nt, Homo sapiens
gaaauguccuaugcacucu

SEQ ID NO: 837187 - RNA, 19 nt, Homo sapiens
gaauauuagaggaaacuug

SEQ ID NO: 837188 - RNA, 19 nt, Homo sapiens
caaaacacauugcaucuag

SEQ ID NO: 837189 - RNA, 19 nt, Homo sapiens
gacaggaguugcuuuugua

SEQ ID NO: 837190 - RNA, 19 nt, Homo sapiens
cuuaucaggucacguauca

SEQ ID NO: 837191 - RNA, 19 nt, Homo sapiens
gguuagcccuuaaucucuu

SEQ ID NO: 837192 - RNA, 19 nt, Homo sapiens
gagguuagcccuuaaucuc

SEQ ID NO: 837193 - RNA, 19 nt, Homo sapiens
cuaaaugaaggauugcuaa

SEQ ID NO: 837194 - RNA, 19 nt, Homo sapiens
gagcacacaacaaauguca

SEQ ID NO: 837195 - RNA, 19 nt, Homo sapiens
gauaucaucaugcugaauc

SEQ ID NO: 837196 - RNA, 19 nt, Homo sapiens
aaacaaucaguguggauaa

SEQ ID NO: 837197 - RNA, 19 nt, Homo sapiens
ugaaucgaguacuacauga

SEQ ID NO: 837198 - RNA, 19 nt, Homo sapiens
cugagaagauaucaucaug

SEQ ID NO: 837199 - RNA, 19 nt, Homo sapiens
gggaggcaaaugaagauaa

SEQ ID NO: 837200 - RNA, 19 nt, Homo sapiens
ucaguguggauaagaaaua

SEQ ID NO: 837201 - RNA, 19 nt, Homo sapiens
gcccucagauucucagcuu

SEQ ID NO: 837202 - RNA, 19 nt, Homo sapiens
gcaagagcacacaacaaau

SEQ ID NO: 837203 - RNA, 19 nt, Homo sapiens
ugcaagagcacacaacaaa

SEQ ID NO: 837204 - RNA, 19 nt, Homo sapiens
cacauugcaucuagaaauc

SEQ ID NO: 837205 - RNA, 19 nt, Homo sapiens
gcaggaaaucccacuaaag

SEQ ID NO: 837206 - RNA, 19 nt, Homo sapiens
ggaucuauacucuucagaa

SEQ ID NO: 837207 - RNA, 19 nt, Homo sapiens
cacaacaaaugucagauac

SEQ ID NO: 837208 - RNA, 19 nt, Homo sapiens
uuugauugcugcagaaaug

SEQ ID NO: 837209 - RNA, 19 nt, Homo sapiens
ucagcugguucucaauuug

SEQ ID NO: 837210 - RNA, 19 nt, Homo sapiens
acaaugcguuauuccagaa

SEQ ID NO: 837211 - RNA, 19 nt, Homo sapiens
ggaaacacuuaaacuugcu

SEQ ID NO: 837212 - RNA, 19 nt, Homo sapiens
gccagagaauuuuauagua

SEQ ID NO: 837213 - RNA, 19 nt, Homo sapiens
aaacacauugcaucuagaa

SEQ ID NO: 837214 - RNA, 19 nt, Homo sapiens
caguggcugucccuaguaa

SEQ ID NO: 837215 - RNA, 19 nt, Homo sapiens
cuuaaucucuucauugcau

SEQ ID NO: 837216 - RNA, 19 nt, Homo sapiens
ugaaucugaucauacuguu

SEQ ID NO: 837217 - RNA, 19 nt, Homo sapiens
gguaucaaagaauggauuu

SEQ ID NO: 837218 - RNA, 19 nt, Homo sapiens
caggucacguaucaguuaa

SEQ ID NO: 837219 - RNA, 19 nt, Homo sapiens
acaaagacagcaaauguag

SEQ ID NO: 837220 - RNA, 19 nt, Homo sapiens
caugcugaaucugaucaua

SEQ ID NO: 837221 - RNA, 19 nt, Homo sapiens
cagaggacuucuacagagu

SEQ ID NO: 837222 - RNA, 19 nt, Homo sapiens
guaugguuaugaucccaaa

SEQ ID NO: 837223 - RNA, 19 nt, Homo sapiens
gcugaacuuuugaagauaa

SEQ ID NO: 837224 - RNA, 19 nt, Homo sapiens
acacauugcaucuagaaau

SEQ ID NO: 837225 - RNA, 19 nt, Homo sapiens
guauguggcacuaucaaau

SEQ ID NO: 837226 - RNA, 19 nt, Homo sapiens
gcccuuaaucucuucauug

SEQ ID NO: 837227 - RNA, 19 nt, Homo sapiens
cugcagaaauguccuaugc

SEQ ID NO: 837228 - RNA, 19 nt, Homo sapiens
gaaucugaucauacuguuu

SEQ ID NO: 837229 - RNA, 19 nt, Homo sapiens
cacuaggaaucucgacauu

SEQ ID NO: 837230 - RNA, 19 nt, Homo sapiens
uaaaucgccuuauucguua

SEQ ID NO: 837231 - RNA, 19 nt, Homo sapiens
cgaaugauccuuauguaua

SEQ ID NO: 837232 - RNA, 19 nt, Homo sapiens
guaaaucgccuuauucguu

SEQ ID NO: 837233 - RNA, 19 nt, Homo sapiens
gguaguggauguauuauuc

SEQ ID NO: 837234 - RNA, 19 nt, Homo sapiens
ggauuaugcugcucaacua

SEQ ID NO: 837235 - RNA, 19 nt, Homo sapiens
caaagaaggucucccaaag

SEQ ID NO: 837236 - RNA, 19 nt, Homo sapiens
guacuuguguggaucuuaa

SEQ ID NO: 837237 - RNA, 19 nt, Homo sapiens
gcagagaauucuauaugga

SEQ ID NO: 837238 - RNA, 19 nt, Homo sapiens
gcggaaguauguauucuuu

SEQ ID NO: 837239 - RNA, 19 nt, Homo sapiens
gaugugugcugaaaucuug

SEQ ID NO: 837240 - RNA, 19 nt, Homo sapiens
gaccguagcugcacagaca

SEQ ID NO: 837241 - RNA, 19 nt, Homo sapiens
gcaguccuguucagaauga

SEQ ID NO: 837242 - RNA, 19 nt, Homo sapiens
uaaagccgaugcugaagaa

SEQ ID NO: 837243 - RNA, 19 nt, Homo sapiens
gcucauugcuuccugucua

SEQ ID NO: 837244 - RNA, 19 nt, Homo sapiens
guaaugaccagcaaagaaa

SEQ ID NO: 837245 - RNA, 19 nt, Homo sapiens
gaucaucgucugccucuuu

SEQ ID NO: 837246 - RNA, 19 nt, Homo sapiens
caggagcugugguaacaua

SEQ ID NO: 837247 - RNA, 19 nt, Homo sapiens
gcaaagaaggucucccaaa

SEQ ID NO: 837248 - RNA, 19 nt, Homo sapiens
ucagaaguuugcagagaua

SEQ ID NO: 837249 - RNA, 19 nt, Homo sapiens
ugagugauguucagaaguu

SEQ ID NO: 837250 - RNA, 19 nt, Homo sapiens
aagaaggucucccaaagaa

SEQ ID NO: 837251 - RNA, 19 nt, Homo sapiens
gagcugugguaacauacua

SEQ ID NO: 837252 - RNA, 19 nt, Homo sapiens
acagucagcucaaaggaaa

SEQ ID NO: 837253 - RNA, 19 nt, Homo sapiens
cuaguucuauccaugauuu

SEQ ID NO: 837254 - RNA, 19 nt, Homo sapiens
cgacagcuauggaaauauc

SEQ ID NO: 837255 - RNA, 19 nt, Homo sapiens
cagcaggacuacacaguau

SEQ ID NO: 837256 - RNA, 19 nt, Homo sapiens
gggaugggauuuauuugug

SEQ ID NO: 837257 - RNA, 19 nt, Homo sapiens
gaccagcaaagaaauuaua

SEQ ID NO: 837258 - RNA, 19 nt, Homo sapiens
ccuaaagccuucugaauac

SEQ ID NO: 837259 - RNA, 19 nt, Homo sapiens
caagacuagugucaggaua

SEQ ID NO: 837260 - RNA, 19 nt, Homo sapiens
uaugguggcuguaugcaaa

SEQ ID NO: 837261 - RNA, 19 nt, Homo sapiens
ugauaaaccggaagauuaa

SEQ ID NO: 837262 - RNA, 19 nt, Homo sapiens
uugauaaaccggaagauua

SEQ ID NO: 837263 - RNA, 19 nt, Homo sapiens
auaaagugcugauggaguu

SEQ ID NO: 837264 - RNA, 19 nt, Homo sapiens
uacgacagcuauggaaaua

SEQ ID NO: 837265 - RNA, 19 nt, Homo sapiens
gcauugggaugggauuuau

SEQ ID NO: 837266 - RNA, 19 nt, Homo sapiens
gcagagcuccaaacgagaa

SEQ ID NO: 837267 - RNA, 19 nt, Homo sapiens
ggcaggagcugugguaaca

SEQ ID NO: 837268 - RNA, 19 nt, Homo sapiens
ggacuuugcuuguuaucac

SEQ ID NO: 837269 - RNA, 19 nt, Homo sapiens
guacuaugguggcuguaug

SEQ ID NO: 837270 - RNA, 19 nt, Homo sapiens
guucagaaguuugcagaga

SEQ ID NO: 837271 - RNA, 19 nt, Homo sapiens
auacaaaguuggaagcaau

SEQ ID NO: 837272 - RNA, 19 nt, Homo sapiens
guguggaucuuaacgauuc

SEQ ID NO: 837273 - RNA, 19 nt, Homo sapiens
gaaguuugcagagauaaau

SEQ ID NO: 837274 - RNA, 19 nt, Homo sapiens
aaugguaguggauguauua

SEQ ID NO: 837275 - RNA, 19 nt, Homo sapiens
gaaaugguaguggauguau

SEQ ID NO: 837276 - RNA, 19 nt, Homo sapiens
guaggaaagcaaugaaaga

SEQ ID NO: 837277 - RNA, 19 nt, Homo sapiens
gcaaggucuucauucacuu

SEQ ID NO: 837278 - RNA, 19 nt, Homo sapiens
gaaggucucccaaagaaac

SEQ ID NO: 837279 - RNA, 19 nt, Homo sapiens
gggauuuauuuguggcuuu

SEQ ID NO: 837280 - RNA, 19 nt, Homo sapiens
gcaaggcuuuguggaguuc

SEQ ID NO: 837281 - RNA, 19 nt, Homo sapiens
gcaaugaaagaagcuggua

SEQ ID NO: 837282 - RNA, 19 nt, Homo sapiens
cagaggcccugaucaccuu

SEQ ID NO: 837283 - RNA, 19 nt, Homo sapiens
gagugcaccuauuccauuc

SEQ ID NO: 837284 - RNA, 19 nt, Homo sapiens
ggcagagaauucuauaugg

SEQ ID NO: 837285 - RNA, 19 nt, Homo sapiens
ggacuuucuuugcucuugu

SEQ ID NO: 837286 - RNA, 19 nt, Homo sapiens
ggcaaggucuucauucacu

SEQ ID NO: 837287 - RNA, 19 nt, Homo sapiens
gcgaaugauccuuauguau

SEQ ID NO: 837288 - RNA, 19 nt, Homo sapiens
aaaggaauuugccauuuac

SEQ ID NO: 837289 - RNA, 19 nt, Homo sapiens
aaagaaggucucccaaaga

SEQ ID NO: 837290 - RNA, 19 nt, Homo sapiens
uaacgauucuggucauacu

SEQ ID NO: 837291 - RNA, 19 nt, Homo sapiens
guggauguauuauucuugu

SEQ ID NO: 837292 - RNA, 19 nt, Homo sapiens
uuucuuugcucuugucuug

SEQ ID NO: 837293 - RNA, 19 nt, Homo sapiens
cauuucagcuacaguguuc

SEQ ID NO: 837294 - RNA, 19 nt, Homo sapiens
guucagcccuauguagcua

SEQ ID NO: 837295 - RNA, 19 nt, Homo sapiens
gcgaguggcuaccaucaac

SEQ ID NO: 837296 - RNA, 19 nt, Homo sapiens
ucagguauauaucaagagu

SEQ ID NO: 837297 - RNA, 19 nt, Homo sapiens
uaccauggcugcugcucuu

SEQ ID NO: 837298 - RNA, 19 nt, Homo sapiens
cgagugcaccuauuccauu

SEQ ID NO: 837299 - RNA, 19 nt, Homo sapiens
ccucuuugcuuuccuaguc

SEQ ID NO: 837300 - RNA, 19 nt, Homo sapiens
cauacucgguucacuugga

SEQ ID NO: 837301 - RNA, 19 nt, Homo sapiens
uuacacaggcugauuagug

SEQ ID NO: 837302 - RNA, 19 nt, Homo sapiens
accuaaagccuucugaaua

SEQ ID NO: 837303 - RNA, 19 nt, Homo sapiens
uggauaaagugcugaugga

SEQ ID NO: 837304 - RNA, 19 nt, Homo sapiens
cgcgaaugauccuuaugua

SEQ ID NO: 837305 - RNA, 19 nt, Homo sapiens
cggcaguccuguucagaau

SEQ ID NO: 837306 - RNA, 19 nt, Homo sapiens
ccucauuuaugccauuuca

SEQ ID NO: 837307 - RNA, 19 nt, Homo sapiens
gauacgacagcuauggaaa

SEQ ID NO: 837308 - RNA, 19 nt, Homo sapiens
gaagauuaagucuguagca

SEQ ID NO: 837309 - RNA, 19 nt, Homo sapiens
caugcaaccuggacuugau

SEQ ID NO: 837310 - RNA, 19 nt, Homo sapiens
auugggacuuugcuuguua

SEQ ID NO: 837311 - RNA, 19 nt, Homo sapiens
gugaacauuuccugcuaug

SEQ ID NO: 837312 - RNA, 19 nt, Homo sapiens
gcugauggaguuuguggaa

SEQ ID NO: 837313 - RNA, 19 nt, Homo sapiens
ccagcaggacuacacagua

SEQ ID NO: 837314 - RNA, 19 nt, Homo sapiens
ucaacuaccagcaggacua

SEQ ID NO: 837315 - RNA, 19 nt, Homo sapiens
cagcuacaguguucacagu

SEQ ID NO: 837316 - RNA, 19 nt, Homo sapiens
aggcacagguguacuaugg

SEQ ID NO: 837317 - RNA, 19 nt, Homo sapiens
ggucauacucgguucacuu

SEQ ID NO: 837318 - RNA, 19 nt, Homo sapiens
gagugauguucagaaguuu

SEQ ID NO: 837319 - RNA, 19 nt, Homo sapiens
uggcagagaauucuauaug

SEQ ID NO: 837320 - RNA, 19 nt, Homo sapiens
ggauacgacagcuauggaa

SEQ ID NO: 837321 - RNA, 19 nt, Homo sapiens
gcauacacagccacagcua

SEQ ID NO: 837322 - RNA, 19 nt, Homo sapiens
cacgaugugugcugaaauc

SEQ ID NO: 837323 - RNA, 19 nt, Homo sapiens
ucaguaaaucgccuuauuc

SEQ ID NO: 837324 - RNA, 19 nt, Homo sapiens
ucacuaguucuauccauga

SEQ ID NO: 837325 - RNA, 19 nt, Homo sapiens
ggaguaaugaccagcaaag

SEQ ID NO: 837326 - RNA, 19 nt, Homo sapiens
gugcaccuauuccauucuu

SEQ ID NO: 837327 - RNA, 19 nt, Homo sapiens
ugggagcccuggcagagaa

SEQ ID NO: 837328 - RNA, 19 nt, Homo sapiens
ucaacacaguaggagauuu

SEQ ID NO: 837329 - RNA, 19 nt, Homo sapiens
gcaagacuagugucaggau

SEQ ID NO: 837330 - RNA, 19 nt, Homo sapiens
caggaaugcuuucuaauua

SEQ ID NO: 837331 - RNA, 19 nt, Homo sapiens
uaaaucgccuuauucguua

SEQ ID NO: 837332 - RNA, 19 nt, Homo sapiens
gcaauaagagucuggauuu

SEQ ID NO: 837333 - RNA, 19 nt, Homo sapiens
cgaaugauccuuauguaua

SEQ ID NO: 837334 - RNA, 19 nt, Homo sapiens
acagaaacauggaacauaa

SEQ ID NO: 837335 - RNA, 19 nt, Homo sapiens
gaguuuagccuuuaaguuu

SEQ ID NO: 837336 - RNA, 19 nt, Homo sapiens
gaacagggauuuaauaccu

SEQ ID NO: 837337 - RNA, 19 nt, Homo sapiens
guccugaacuuggaaauua

SEQ ID NO: 837338 - RNA, 19 nt, Homo sapiens
gagcaaaucaugugagaaa

SEQ ID NO: 837339 - RNA, 19 nt, Homo sapiens
guaaaucgccuuauucguu

SEQ ID NO: 837340 - RNA, 19 nt, Homo sapiens
gguaguggauguauuauuc

SEQ ID NO: 837341 - RNA, 19 nt, Homo sapiens
ggauuaugcugcucaacua

SEQ ID NO: 837342 - RNA, 19 nt, Homo sapiens
caaggcaacuuccgucauu

SEQ ID NO: 837343 - RNA, 19 nt, Homo sapiens
caaagaaggucucccaaag

SEQ ID NO: 837344 - RNA, 19 nt, Homo sapiens
guacuuguguggaucuuaa

SEQ ID NO: 837345 - RNA, 19 nt, Homo sapiens
caguaucgcuguucucuuu

SEQ ID NO: 837346 - RNA, 19 nt, Homo sapiens
guaaccaacuccucaggua

SEQ ID NO: 837347 - RNA, 19 nt, Homo sapiens
gcagagaauucuauaugga

SEQ ID NO: 837348 - RNA, 19 nt, Homo sapiens
gcggaaguauguauucuuu

SEQ ID NO: 837349 - RNA, 19 nt, Homo sapiens
ggcauaugcuuucagauaa

SEQ ID NO: 837350 - RNA, 19 nt, Homo sapiens
gaugugugcugaaaucuug

SEQ ID NO: 837351 - RNA, 19 nt, Homo sapiens
uaaaugccuugguuucuuu

SEQ ID NO: 837352 - RNA, 19 nt, Homo sapiens
caaagaagccaugucauuu

SEQ ID NO: 837353 - RNA, 19 nt, Homo sapiens
gaacuguaaucagaaagaa

SEQ ID NO: 837354 - RNA, 19 nt, Homo sapiens
ucacaaacauugggaacua

SEQ ID NO: 837355 - RNA, 19 nt, Homo sapiens
gaccguagcugcacagaca

SEQ ID NO: 837356 - RNA, 19 nt, Homo sapiens
gagaguagcuauuuugaaa

SEQ ID NO: 837357 - RNA, 19 nt, Homo sapiens
ggaaaugcauacaaguaau

SEQ ID NO: 837358 - RNA, 19 nt, Homo sapiens
gcauaugcuuucagauaaa

SEQ ID NO: 837359 - RNA, 19 nt, Homo sapiens
gcaguccuguucagaauga

SEQ ID NO: 837360 - RNA, 19 nt, Homo sapiens
gcucauugcuuccugucua

SEQ ID NO: 837361 - RNA, 19 nt, Homo sapiens
guaaugaccagcaaagaaa

SEQ ID NO: 837362 - RNA, 19 nt, Homo sapiens
gagagcaaaucaugugaga

SEQ ID NO: 837363 - RNA, 19 nt, Homo sapiens
gaauuacuccaaucaguuu

SEQ ID NO: 837364 - RNA, 19 nt, Homo sapiens
ggaaugcuuucuaauuauc

SEQ ID NO: 837365 - RNA, 19 nt, Homo sapiens
gauaaucuuucguaugcaa

SEQ ID NO: 837366 - RNA, 19 nt, Homo sapiens
gaucaucgucugccucuuu

SEQ ID NO: 837367 - RNA, 19 nt, Homo sapiens
caggagcugugguaacaua

SEQ ID NO: 837368 - RNA, 19 nt, Homo sapiens
gcaaagaaggucucccaaa

SEQ ID NO: 837369 - RNA, 19 nt, Homo sapiens
ucagaaguuugcagagaua

SEQ ID NO: 837370 - RNA, 19 nt, Homo sapiens
ugagugauguucagaaguu

SEQ ID NO: 837371 - RNA, 19 nt, Homo sapiens
agaacuagacagugaauua

SEQ ID NO: 837372 - RNA, 19 nt, Homo sapiens
gaagaauuggcuaauguuu

SEQ ID NO: 837373 - RNA, 19 nt, Homo sapiens
aagaaggucucccaaagaa

SEQ ID NO: 837374 - RNA, 19 nt, Homo sapiens
gagcugugguaacauacua

SEQ ID NO: 837375 - RNA, 19 nt, Homo sapiens
ucaaagaagccaugucauu

SEQ ID NO: 837376 - RNA, 19 nt, Homo sapiens
uaccagaacuagacaguga

SEQ ID NO: 837377 - RNA, 19 nt, Homo sapiens
ggaauuacuccaaucaguu

SEQ ID NO: 837378 - RNA, 19 nt, Homo sapiens
acagucagcucaaaggaaa

SEQ ID NO: 837379 - RNA, 19 nt, Homo sapiens
cuaguucuauccaugauuu

SEQ ID NO: 837380 - RNA, 19 nt, Homo sapiens
cgacagcuauggaaauauc

SEQ ID NO: 837381 - RNA, 19 nt, Homo sapiens
gggaugggauuuauuugug

SEQ ID NO: 837382 - RNA, 19 nt, Homo sapiens
cagcaggacuacacaguau

SEQ ID NO: 837383 - RNA, 19 nt, Homo sapiens
ccaggaaugcuuucuaauu

SEQ ID NO: 837384 - RNA, 19 nt, Homo sapiens
uaccaggaaugcuuucuaa

SEQ ID NO: 837385 - RNA, 19 nt, Homo sapiens
aaagugaccugauggaagu

SEQ ID NO: 837386 - RNA, 19 nt, Homo sapiens
gaauaccaucuguuucaua

SEQ ID NO: 837387 - RNA, 19 nt, Homo sapiens
gaaaugcauacaaguaaug

SEQ ID NO: 837388 - RNA, 19 nt, Homo sapiens
gaaggagaaucuuuugaaa

SEQ ID NO: 837389 - RNA, 19 nt, Homo sapiens
ucaaaugcuugcuauacaa

SEQ ID NO: 837390 - RNA, 19 nt, Homo sapiens
caagacuagugucaggaua

SEQ ID NO: 837391 - RNA, 19 nt, Homo sapiens
gaccagcaaagaaauuaua

SEQ ID NO: 837392 - RNA, 19 nt, Homo sapiens
ccuaaagccuucugaauac

SEQ ID NO: 837393 - RNA, 19 nt, Homo sapiens
uaugguggcuguaugcaaa

SEQ ID NO: 837394 - RNA, 19 nt, Homo sapiens
ugauaaaccggaagauuaa

SEQ ID NO: 837395 - RNA, 19 nt, Homo sapiens
uugauaaaccggaagauua

SEQ ID NO: 837396 - RNA, 19 nt, Homo sapiens
auaaagugcugauggaguu

SEQ ID NO: 837397 - RNA, 19 nt, Homo sapiens
uacgacagcuauggaaaua

SEQ ID NO: 837398 - RNA, 19 nt, Homo sapiens
uccugaagcuuaccagaua

SEQ ID NO: 837399 - RNA, 19 nt, Homo sapiens
gacagaaacauggaacaua

SEQ ID NO: 837400 - RNA, 19 nt, Homo sapiens
gaauaaagaagggacagaa

SEQ ID NO: 837401 - RNA, 19 nt, Homo sapiens
uaauuucccugaugucugu

SEQ ID NO: 837402 - RNA, 19 nt, Homo sapiens
gcauugggaugggauuuau

SEQ ID NO: 837403 - RNA, 19 nt, Homo sapiens
gaagauggguaucaaaaca

SEQ ID NO: 837404 - RNA, 19 nt, Homo sapiens
cuaaugugcuuccuuucaa

SEQ ID NO: 837405 - RNA, 19 nt, Homo sapiens
cuagaacuguaaucagaaa

SEQ ID NO: 837406 - RNA, 19 nt, Homo sapiens
gcagagcuccaaacgagaa

SEQ ID NO: 837407 - RNA, 19 nt, Homo sapiens
cauggaacauaaagcauug

SEQ ID NO: 837408 - RNA, 19 nt, Homo sapiens
ccagcgaguuuagccuuua

SEQ ID NO: 837409 - RNA, 19 nt, Homo sapiens
ccucagguauuuguaguuu

SEQ ID NO: 837410 - RNA, 19 nt, Homo sapiens
ggcaggagcugugguaaca

SEQ ID NO: 837411 - RNA, 19 nt, Homo sapiens
ggacuuugcuuguuaucac

SEQ ID NO: 837412 - RNA, 19 nt, Homo sapiens
gaacuagacagugaauuag

SEQ ID NO: 837413 - RNA, 19 nt, Homo sapiens
guucuacgauguuuaacug

SEQ ID NO: 837414 - RNA, 19 nt, Homo sapiens
guacuaugguggcuguaug

SEQ ID NO: 837415 - RNA, 19 nt, Homo sapiens
guucagaaguuugcagaga

SEQ ID NO: 837416 - RNA, 19 nt, Homo sapiens
gcaacuagaacuguaauca

SEQ ID NO: 837417 - RNA, 19 nt, Homo sapiens
auacaaaguuggaagcaau

SEQ ID NO: 837418 - RNA, 19 nt, Homo sapiens
uuucauagccgcacagauu

SEQ ID NO: 837419 - RNA, 19 nt, Homo sapiens
cuaaaugccuugguuucuu

SEQ ID NO: 837420 - RNA, 19 nt, Homo sapiens
aagaaagcauugccuccua

SEQ ID NO: 837421 - RNA, 19 nt, Homo sapiens
gggcuucggcuucagagua

SEQ ID NO: 837422 - RNA, 19 nt, Homo sapiens
aacauguacuccuuucaua

SEQ ID NO: 837423 - RNA, 19 nt, Homo sapiens
ugucaaacauguacuccuu

SEQ ID NO: 837424 - RNA, 19 nt, Homo sapiens
guguggaucuuaacgauuc

SEQ ID NO: 837425 - RNA, 19 nt, Homo sapiens
gaaguuugcagagauaaau

SEQ ID NO: 837426 - RNA, 19 nt, Homo sapiens
uuagaucgguauuauggaa

SEQ ID NO: 837427 - RNA, 19 nt, Homo sapiens
ggugaaugcuuuaagaaaa

SEQ ID NO: 837428 - RNA, 19 nt, Homo sapiens
ccagaguucuacgauguuu

SEQ ID NO: 837429 - RNA, 19 nt, Homo sapiens
guagcauccuccacacauu

SEQ ID NO: 837430 - RNA, 19 nt, Homo sapiens
gaggagagcuggucuauuu

SEQ ID NO: 837431 - RNA, 19 nt, Homo sapiens
gagggugacuggauaauua

SEQ ID NO: 837432 - RNA, 19 nt, Homo sapiens
ggaaauggauuaugaggaa

SEQ ID NO: 837433 - RNA, 19 nt, Homo sapiens
guacugaucugcucugaaa

SEQ ID NO: 837434 - RNA, 19 nt, Homo sapiens
ccaagaaacucgaggauau

SEQ ID NO: 837435 - RNA, 19 nt, Homo sapiens
gaacgucucugaagaacug

SEQ ID NO: 837436 - RNA, 19 nt, Homo sapiens
gagaguaacaaccuuauua

SEQ ID NO: 837437 - RNA, 19 nt, Homo sapiens
ggagacagaugaagauaug

SEQ ID NO: 837438 - RNA, 19 nt, Homo sapiens
uaacaccaaugaugaagua

SEQ ID NO: 837439 - RNA, 19 nt, Homo sapiens
ggacauaggguaauuguau

SEQ ID NO: 837440 - RNA, 19 nt, Homo sapiens
ccaaggaccugauacuaaa

SEQ ID NO: 837441 - RNA, 19 nt, Homo sapiens
gcaggagggugacuggaua

SEQ ID NO: 837442 - RNA, 19 nt, Homo sapiens
caggacagcugaaugagua

SEQ ID NO: 837443 - RNA, 19 nt, Homo sapiens
gauauccgcuguccaauuc

SEQ ID NO: 837444 - RNA, 19 nt, Homo sapiens
gaacacggcaacuuccuua

SEQ ID NO: 837445 - RNA, 19 nt, Homo sapiens
caagaaaccuuuggcaaga

SEQ ID NO: 837446 - RNA, 19 nt, Homo sapiens
uagcugaucuggccaauga

SEQ ID NO: 837447 - RNA, 19 nt, Homo sapiens
cacggcaacuuccuuauua

SEQ ID NO: 837448 - RNA, 19 nt, Homo sapiens
ccaaaucgauguucuucuu

SEQ ID NO: 837449 - RNA, 19 nt, Homo sapiens
gaagauaugguuacugaga

SEQ ID NO: 837450 - RNA, 19 nt, Homo sapiens
cagaaucacuugucuauac

SEQ ID NO: 837451 - RNA, 19 nt, Homo sapiens
ggacugagaagcaggauga

SEQ ID NO: 837452 - RNA, 19 nt, Homo sapiens
uggaguagaugucggauuu

SEQ ID NO: 837453 - RNA, 19 nt, Homo sapiens
gaccguggcuugcucaaug

SEQ ID NO: 837454 - RNA, 19 nt, Homo sapiens
agacaaguuuggcaacaua

SEQ ID NO: 837455 - RNA, 19 nt, Homo sapiens
uggagaaacuguagaagaa

SEQ ID NO: 837456 - RNA, 19 nt, Homo sapiens
gcaugagucuggccaaugu

SEQ ID NO: 837457 - RNA, 19 nt, Homo sapiens
gcagggagauaucuuuaag

SEQ ID NO: 837458 - RNA, 19 nt, Homo sapiens
uaaaucaugugguccgaaa

SEQ ID NO: 837459 - RNA, 19 nt, Homo sapiens
ggaagaaggagacacauuc

SEQ ID NO: 837460 - RNA, 19 nt, Homo sapiens
ccaaagccaucccugcauu

SEQ ID NO: 837461 - RNA, 19 nt, Homo sapiens
gagcagggagauaucuuua

SEQ ID NO: 837462 - RNA, 19 nt, Homo sapiens
gcagacacuuacuuucuau

SEQ ID NO: 837463 - RNA, 19 nt, Homo sapiens
gagcuauucuuaccaaucu

SEQ ID NO: 837464 - RNA, 19 nt, Homo sapiens
uaccagccaucuaagaaua

SEQ ID NO: 837465 - RNA, 19 nt, Homo sapiens
ggaacacacuggaccuugu

SEQ ID NO: 837466 - RNA, 19 nt, Homo sapiens
guacacacccaggaaauuu

SEQ ID NO: 837467 - RNA, 19 nt, Homo sapiens
gaccuuguccugcuccuua

SEQ ID NO: 837468 - RNA, 19 nt, Homo sapiens
ugaagauacuccacaguug

SEQ ID NO: 837469 - RNA, 19 nt, Homo sapiens
gggcgagccguuaugauua

SEQ ID NO: 837470 - RNA, 19 nt, Homo sapiens
gccaaggaccugauacuaa

SEQ ID NO: 837471 - RNA, 19 nt, Homo sapiens
gaagaccccuggaaagaaa

SEQ ID NO: 837472 - RNA, 19 nt, Homo sapiens
gaccuugguuuaaaucaug

SEQ ID NO: 837473 - RNA, 19 nt, Homo sapiens
guagaugucggauuugaaa

SEQ ID NO: 837474 - RNA, 19 nt, Homo sapiens
gaguagaugucggauuuga

SEQ ID NO: 837475 - RNA, 19 nt, Homo sapiens
gaaccaaacaacaagaaau

SEQ ID NO: 837476 - RNA, 19 nt, Homo sapiens
cagaggugaucaugaacua

SEQ ID NO: 837477 - RNA, 19 nt, Homo sapiens
gcaacuuccuuauuacagu

SEQ ID NO: 837478 - RNA, 19 nt, Homo sapiens
gaaaauacagugaaccuuu

SEQ ID NO: 837479 - RNA, 19 nt, Homo sapiens
caacuuaaccuugcagaga

SEQ ID NO: 837480 - RNA, 19 nt, Homo sapiens
gaagaggucccugcugcua

SEQ ID NO: 837481 - RNA, 19 nt, Homo sapiens
caaucucgcuuccaucuca

SEQ ID NO: 837482 - RNA, 19 nt, Homo sapiens
gagaaacuguagaagaagu

SEQ ID NO: 837483 - RNA, 19 nt, Homo sapiens
gagcuagaccuugguuuaa

SEQ ID NO: 837484 - RNA, 19 nt, Homo sapiens
guggaaguauucgguguua

SEQ ID NO: 837485 - RNA, 19 nt, Homo sapiens
ugacucuccugucuacuuu

SEQ ID NO: 837486 - RNA, 19 nt, Homo sapiens
ccacgaaagcucagagaaa

SEQ ID NO: 837487 - RNA, 19 nt, Homo sapiens
gcucggugcugucuucaau

SEQ ID NO: 837488 - RNA, 19 nt, Homo sapiens
gacagugcgucgacacauu

SEQ ID NO: 837489 - RNA, 19 nt, Homo sapiens
gaagauacuccacaguugu

SEQ ID NO: 837490 - RNA, 19 nt, Homo sapiens
gagaagauucaccaagaaa

SEQ ID NO: 837491 - RNA, 19 nt, Homo sapiens
caccuugucuggaggaauu

SEQ ID NO: 837492 - RNA, 19 nt, Homo sapiens
ggagguagcauccguugga

SEQ ID NO: 837493 - RNA, 19 nt, Homo sapiens
ugagaagauucaccaagaa

SEQ ID NO: 837494 - RNA, 19 nt, Homo sapiens
gcacugagauuugcuacac

SEQ ID NO: 837495 - RNA, 19 nt, Homo sapiens
aggcagaggugaucaugaa

SEQ ID NO: 837496 - RNA, 19 nt, Homo sapiens
gcagauggcagaggaaaug

SEQ ID NO: 837497 - RNA, 19 nt, Homo sapiens
uaagaucacuuuggagaca

SEQ ID NO: 837498 - RNA, 19 nt, Homo sapiens
gcuagaccuugguuuaaau

SEQ ID NO: 837499 - RNA, 19 nt, Homo sapiens
agccaucccugcauugaua

SEQ ID NO: 837500 - RNA, 19 nt, Homo sapiens
gacuugaggugucagaaau

SEQ ID NO: 837501 - RNA, 19 nt, Homo sapiens
ggacuugaggugucagaaa

SEQ ID NO: 837502 - RNA, 19 nt, Homo sapiens
ggaaaccauuacuuauauc

SEQ ID NO: 837503 - RNA, 19 nt, Homo sapiens
gaucugcucugaaaacuau

SEQ ID NO: 837504 - RNA, 19 nt, Homo sapiens
ugagcuagaccuugguuua

SEQ ID NO: 837505 - RNA, 19 nt, Homo sapiens
gcauugauaugucuugacu

SEQ ID NO: 837506 - RNA, 19 nt, Homo sapiens
agaagaaguuacuccgaaa

SEQ ID NO: 837507 - RNA, 19 nt, Homo sapiens
gaaaugggugggacugaga

SEQ ID NO: 837508 - RNA, 19 nt, Homo sapiens
agauccggcucaaauauuu

SEQ ID NO: 837509 - RNA, 19 nt, Homo sapiens
gaauaccagccaucuaaga

SEQ ID NO: 837510 - RNA, 19 nt, Homo sapiens
gcagacaaguuuggcaaca

SEQ ID NO: 837511 - RNA, 19 nt, Homo sapiens
gcagauguggugugcauga

SEQ ID NO: 837512 - RNA, 19 nt, Homo sapiens
gagauccggcucaaauauu

SEQ ID NO: 837513 - RNA, 19 nt, Homo sapiens
augaagauaugguuacuga

SEQ ID NO: 837514 - RNA, 19 nt, Homo sapiens
ccugaaagaggaaugauuu

SEQ ID NO: 837515 - RNA, 19 nt, Homo sapiens
ccagauauccgcuguccaa

SEQ ID NO: 837516 - RNA, 19 nt, Homo sapiens
uggaauaccagccaucuaa

SEQ ID NO: 837517 - RNA, 19 nt, Homo sapiens
ucuaugaccugggaaagaa

SEQ ID NO: 837518 - RNA, 19 nt, Homo sapiens
gcagugggccucugugauc

SEQ ID NO: 837519 - RNA, 19 nt, Homo sapiens
ggaaagaaaacaauuguga

SEQ ID NO: 837520 - RNA, 19 nt, Homo sapiens
gcacauacgagcagacaag

SEQ ID NO: 837521 - RNA, 19 nt, Homo sapiens
gugcaggucuauccagaug

SEQ ID NO: 837522 - RNA, 19 nt, Homo sapiens
ggaggaacacggcaacuuc

SEQ ID NO: 837523 - RNA, 19 nt, Homo sapiens
ggaaguauucgguguuauc

SEQ ID NO: 837524 - RNA, 19 nt, Homo sapiens
gaaugccacccuaguguug

SEQ ID NO: 837525 - RNA, 19 nt, Homo sapiens
gggagacggugcuguccuu

SEQ ID NO: 837526 - RNA, 19 nt, Homo sapiens
gacagccucucucccauuc

SEQ ID NO: 837527 - RNA, 19 nt, Homo sapiens
uugagaagauucaccaaga

SEQ ID NO: 837528 - RNA, 19 nt, Homo sapiens
aaagaacgucucugaagaa

SEQ ID NO: 837529 - RNA, 19 nt, Homo sapiens
uaucugauguccaagaaag

SEQ ID NO: 837530 - RNA, 19 nt, Homo sapiens
gaagugauguuaauccuua

SEQ ID NO: 837531 - RNA, 19 nt, Homo sapiens
gcacagaccuccaaagauu

SEQ ID NO: 837532 - RNA, 19 nt, Homo sapiens
guacaaacuugaugacuua

SEQ ID NO: 837533 - RNA, 19 nt, Homo sapiens
gaacaacacuugacuaaag

SEQ ID NO: 837534 - RNA, 19 nt, Homo sapiens
caacugaacuugaagauga

SEQ ID NO: 837535 - RNA, 19 nt, Homo sapiens
ugauaaagcucgugaauuu

SEQ ID NO: 837536 - RNA, 19 nt, Homo sapiens
ggaauuagaugcuauguuc

SEQ ID NO: 837537 - RNA, 19 nt, Homo sapiens
gaaggcagcucuugaugaa

SEQ ID NO: 837538 - RNA, 19 nt, Homo sapiens
gaagaugcuuuaauggaua

SEQ ID NO: 837539 - RNA, 19 nt, Homo sapiens
caacagauagcuauucuua

SEQ ID NO: 837540 - RNA, 19 nt, Homo sapiens
cagcagauauugaucauaa

SEQ ID NO: 837541 - RNA, 19 nt, Homo sapiens
caaaguaggugcagcagaa

SEQ ID NO: 837542 - RNA, 19 nt, Homo sapiens
gcaaacgagucaaaccaua

SEQ ID NO: 837543 - RNA, 19 nt, Homo sapiens
gaacugcuguugucaugaa

SEQ ID NO: 837544 - RNA, 19 nt, Homo sapiens
gaaacauguucacccuuua

SEQ ID NO: 837545 - RNA, 19 nt, Homo sapiens
uaagaugacuccaccaauu

SEQ ID NO: 837546 - RNA, 19 nt, Homo sapiens
gauaagaacaccuauauuc

SEQ ID NO: 837547 - RNA, 19 nt, Homo sapiens
gggcauuccuucuuuauug

SEQ ID NO: 837548 - RNA, 19 nt, Homo sapiens
gaacaccuauauucguuau

SEQ ID NO: 837549 - RNA, 19 nt, Homo sapiens
gaaccgcuauugauugaug

SEQ ID NO: 837550 - RNA, 19 nt, Homo sapiens
gagaacaacacuugacuaa

SEQ ID NO: 837551 - RNA, 19 nt, Homo sapiens
acagauagcuauucuuaug

SEQ ID NO: 837552 - RNA, 19 nt, Homo sapiens
guagaauguugcaauauug

SEQ ID NO: 837553 - RNA, 19 nt, Homo sapiens
gaaagucagagauguauau

SEQ ID NO: 837554 - RNA, 19 nt, Homo sapiens
uagauaacauggaugagua

SEQ ID NO: 837555 - RNA, 19 nt, Homo sapiens
caugagaccugauauagau

SEQ ID NO: 837556 - RNA, 19 nt, Homo sapiens
gagcugguccuuuguuuaa

SEQ ID NO: 837557 - RNA, 19 nt, Homo sapiens
gaacaccaccaaugagaaa

SEQ ID NO: 837558 - RNA, 19 nt, Homo sapiens
gcacugaaggccauuguaa

SEQ ID NO: 837559 - RNA, 19 nt, Homo sapiens
ugacuuaguucguccauau

SEQ ID NO: 837560 - RNA, 19 nt, Homo sapiens
caagagaauuguauugauc

SEQ ID NO: 837561 - RNA, 19 nt, Homo sapiens
gaagaacaacugauugaug

SEQ ID NO: 837562 - RNA, 19 nt, Homo sapiens
gauuguggaugaucugaaa

SEQ ID NO: 837563 - RNA, 19 nt, Homo sapiens
ggaguuggcaaacaaagua

SEQ ID NO: 837564 - RNA, 19 nt, Homo sapiens
cauguagaauguugcaaua

SEQ ID NO: 837565 - RNA, 19 nt, Homo sapiens
agaaacauguucacccuuu

SEQ ID NO: 837566 - RNA, 19 nt, Homo sapiens
caacuacuauacuagagaa

SEQ ID NO: 837567 - RNA, 19 nt, Homo sapiens
gcuauuggguaucuuauuc

SEQ ID NO: 837568 - RNA, 19 nt, Homo sapiens
gauaaacuauugguugaug

SEQ ID NO: 837569 - RNA, 19 nt, Homo sapiens
gagcgucauuuacuuguga

SEQ ID NO: 837570 - RNA, 19 nt, Homo sapiens
gagcacagaccuccaaaga

SEQ ID NO: 837571 - RNA, 19 nt, Homo sapiens
ggaaauuuaugguggaagu

SEQ ID NO: 837572 - RNA, 19 nt, Homo sapiens
gagaguggaugaggauuug

SEQ ID NO: 837573 - RNA, 19 nt, Homo sapiens
agaguacccugaaguauug

SEQ ID NO: 837574 - RNA, 19 nt, Homo sapiens
gaacaacugauugauggua

SEQ ID NO: 837575 - RNA, 19 nt, Homo sapiens
acaggcagcugacuugauu

SEQ ID NO: 837576 - RNA, 19 nt, Homo sapiens
gaauaugccaacuacuaua

SEQ ID NO: 837577 - RNA, 19 nt, Homo sapiens
cagaauaugccaacuacua

SEQ ID NO: 837578 - RNA, 19 nt, Homo sapiens
ggaucaagagcgucauuua

SEQ ID NO: 837579 - RNA, 19 nt, Homo sapiens
ggaaguggaugggcugaga

SEQ ID NO: 837580 - RNA, 19 nt, Homo sapiens
ucaaacagcugaucagacu

SEQ ID NO: 837581 - RNA, 19 nt, Homo sapiens
acuaugaucucuaccauga

SEQ ID NO: 837582 - RNA, 19 nt, Homo sapiens
gcauacuccuuccuuaaga

SEQ ID NO: 837583 - RNA, 19 nt, Homo sapiens
acacuugacuaaagaagaa

SEQ ID NO: 837584 - RNA, 19 nt, Homo sapiens
ggaagugacagcagauuug

SEQ ID NO: 837585 - RNA, 19 nt, Homo sapiens
ucagagauguauauuggaa

SEQ ID NO: 837586 - RNA, 19 nt, Homo sapiens
ugaaucacuuguugaacua

SEQ ID NO: 837587 - RNA, 19 nt, Homo sapiens
cuagagaagugauguuaau

SEQ ID NO: 837588 - RNA, 19 nt, Homo sapiens
ggguuuggcugcuuucuug

SEQ ID NO: 837589 - RNA, 19 nt, Homo sapiens
ccgggaagaugaauacaaa

SEQ ID NO: 837590 - RNA, 19 nt, Homo sapiens
caagaacacagugauuaua

SEQ ID NO: 837591 - RNA, 19 nt, Homo sapiens
guacagcacaugucacuug

SEQ ID NO: 837592 - RNA, 19 nt, Homo sapiens
ggaaaagacuacauuuaug

SEQ ID NO: 837593 - RNA, 19 nt, Homo sapiens
ggaugaggauuugcuuuga

SEQ ID NO: 837594 - RNA, 19 nt, Homo sapiens
gaaauuaccgacaguuagu

SEQ ID NO: 837595 - RNA, 19 nt, Homo sapiens
gaaaggcagaacagaguuu

SEQ ID NO: 837596 - RNA, 19 nt, Homo sapiens
gagccacagucaacacauu

SEQ ID NO: 837597 - RNA, 19 nt, Homo sapiens
gcugaugucuccuacacuu

SEQ ID NO: 837598 - RNA, 19 nt, Homo sapiens
gaugaggaauuagaugcua

SEQ ID NO: 837599 - RNA, 19 nt, Homo sapiens
gaaucuacaacgaugauaa

SEQ ID NO: 837600 - RNA, 19 nt, Homo sapiens
gcacauuacccaagaaucu

SEQ ID NO: 837601 - RNA, 19 nt, Homo sapiens
gcacagauucgagaaauuc

SEQ ID NO: 837602 - RNA, 19 nt, Homo sapiens
ugaagaugcuuuaauggau

SEQ ID NO: 837603 - RNA, 19 nt, Homo sapiens
uaaaaucgcuuuccuucuu

SEQ ID NO: 837604 - RNA, 19 nt, Homo sapiens
ucacgaagauauugaagca

SEQ ID NO: 837605 - RNA, 19 nt, Homo sapiens
gagagaaaucgcccacuuu

SEQ ID NO: 837606 - RNA, 19 nt, Homo sapiens
gguuaaugcucuuggcaaa

SEQ ID NO: 837607 - RNA, 19 nt, Homo sapiens
ggaaaggguuuggcugcuu

SEQ ID NO: 837608 - RNA, 19 nt, Homo sapiens
gaugaagauuacuaugcua

SEQ ID NO: 837609 - RNA, 19 nt, Homo sapiens
agaacaguaugauccauuu

SEQ ID NO: 837610 - RNA, 19 nt, Homo sapiens
ccaggacgcucucauagca

SEQ ID NO: 837611 - RNA, 19 nt, Homo sapiens
gcaacaggcagcugacuug

SEQ ID NO: 837612 - RNA, 19 nt, Homo sapiens
gagacacacugguauuaag

SEQ ID NO: 837613 - RNA, 19 nt, Homo sapiens
ucaagagcgucauuuacuu

SEQ ID NO: 837614 - RNA, 19 nt, Homo sapiens
gaauggaacaccaccaaug

SEQ ID NO: 837615 - RNA, 19 nt, Homo sapiens
cagagcgucuugauccuuu

SEQ ID NO: 837616 - RNA, 19 nt, Homo sapiens
gcuauuggaccauguagaa

SEQ ID NO: 837617 - RNA, 19 nt, Homo sapiens
caucuuagaaguuuaguug

SEQ ID NO: 837618 - RNA, 19 nt, Homo sapiens
gggaauguuuaauugagaa

SEQ ID NO: 837619 - RNA, 19 nt, Homo sapiens
gcuuugauuuggugaugua

SEQ ID NO: 837620 - RNA, 19 nt, Homo sapiens
acaccuauauucguuauga

SEQ ID NO: 837621 - RNA, 19 nt, Homo sapiens
gaugauaagaacaccuaua

SEQ ID NO: 837622 - RNA, 19 nt, Homo sapiens
caggauggcuuuggauaga

SEQ ID NO: 837623 - RNA, 19 nt, Homo sapiens
gcgagacacacugguauua

SEQ ID NO: 837624 - RNA, 19 nt, Homo sapiens
ugagagaaaucgcccacuu

SEQ ID NO: 837625 - RNA, 19 nt, Homo sapiens
aagaacaccuauauucguu

SEQ ID NO: 837626 - RNA, 19 nt, Homo sapiens
cuacaacgaugauaagaac

SEQ ID NO: 837627 - RNA, 19 nt, Homo sapiens
ggauuugguugugaagauu

SEQ ID NO: 837628 - RNA, 19 nt, Homo sapiens
gucaacacauuugguuaua

SEQ ID NO: 837629 - RNA, 19 nt, Homo sapiens
gaauauguaucugcaagag

SEQ ID NO: 837630 - RNA, 19 nt, Homo sapiens
gaacauugauggcgaauac

SEQ ID NO: 837631 - RNA, 19 nt, Homo sapiens
ccaacgagauccagaguga

SEQ ID NO: 837632 - RNA, 19 nt, Homo sapiens
gaaccaaggcaacuacaaa

SEQ ID NO: 837633 - RNA, 19 nt, Homo sapiens
ggauggcucuguuaacuuc

SEQ ID NO: 837634 - RNA, 19 nt, Homo sapiens
acaaggaccuggagcacaa

SEQ ID NO: 837635 - RNA, 19 nt, Homo sapiens
ucaagaaaguggugaugau

SEQ ID NO: 837636 - RNA, 19 nt, Homo sapiens
gcaaggguuugggaacauu

SEQ ID NO: 837637 - RNA, 19 nt, Homo sapiens
caagagaguucauuuaccu

SEQ ID NO: 837638 - RNA, 19 nt, Homo sapiens
aagggaggcuggugguaua

SEQ ID NO: 837639 - RNA, 19 nt, Homo sapiens
gaacaccaaccgccucaug

SEQ ID NO: 837640 - RNA, 19 nt, Homo sapiens
caugaugucuacacaggaa

SEQ ID NO: 837641 - RNA, 19 nt, Homo sapiens
ucacgcagcucuacaugca

SEQ ID NO: 837642 - RNA, 19 nt, Homo sapiens
ccugagagcgaguauuaua

SEQ ID NO: 837643 - RNA, 19 nt, Homo sapiens
caaugcgggugacuccuuu

SEQ ID NO: 837644 - RNA, 19 nt, Homo sapiens
aaggagagccgcaacauga

SEQ ID NO: 837645 - RNA, 19 nt, Homo sapiens
gaagggaggcuggugguau

SEQ ID NO: 837646 - RNA, 19 nt, Homo sapiens
aaccugagagcgaguauua

SEQ ID NO: 837647 - RNA, 19 nt, Homo sapiens
gcaccuacaccuucauugu

SEQ ID NO: 837648 - RNA, 19 nt, Homo sapiens
gaaccagacagccgacaug

SEQ ID NO: 837649 - RNA, 19 nt, Homo sapiens
ucaccacccuggacagaga

SEQ ID NO: 837650 - RNA, 19 nt, Homo sapiens
ucaaccagaucucuaccaa

SEQ ID NO: 837651 - RNA, 19 nt, Homo sapiens
ucaccagccucccaucuuc

SEQ ID NO: 837652 - RNA, 19 nt, Homo sapiens
agaaaguggugaugaugau

SEQ ID NO: 837653 - RNA, 19 nt, Homo sapiens
gcgggugacuccuuuacau

SEQ ID NO: 837654 - RNA, 19 nt, Homo sapiens
gcaaugcgggugacuccuu

SEQ ID NO: 837655 - RNA, 19 nt, Homo sapiens
caaggagccugaggugcuu

SEQ ID NO: 837656 - RNA, 19 nt, Homo sapiens
acagagaucaugaugucua

SEQ ID NO: 837657 - RNA, 19 nt, Homo sapiens
gcacaacggcaagcaguuc

SEQ ID NO: 837658 - RNA, 19 nt, Homo sapiens
ggaacugggagacguacaa

SEQ ID NO: 837659 - RNA, 19 nt, Homo sapiens
caagaaaguggugaugaug

SEQ ID NO: 837660 - RNA, 19 nt, Homo sapiens
gccaagagaguucauuuac

SEQ ID NO: 837661 - RNA, 19 nt, Homo sapiens
cgccaagagaguucauuua

SEQ ID NO: 837662 - RNA, 19 nt, Homo sapiens
gaaacugugcccacuacca

SEQ ID NO: 837663 - RNA, 19 nt, Homo sapiens
gcaaggagagccgcaacau

SEQ ID NO: 837664 - RNA, 19 nt, Homo sapiens
ccgaggaggcucuuacuca

SEQ ID NO: 837665 - RNA, 19 nt, Homo sapiens
agagaguucauuuaccuaa

SEQ ID NO: 837666 - RNA, 19 nt, Homo sapiens
gauccagagugaccagaac

SEQ ID NO: 837667 - RNA, 19 nt, Homo sapiens
gcccacaaccaaucagaga

SEQ ID NO: 837668 - RNA, 19 nt, Homo sapiens
caaggagagccgcaacaug

SEQ ID NO: 837669 - RNA, 19 nt, Homo sapiens
cuuacucacucaagaaagu

SEQ ID NO: 837670 - RNA, 19 nt, Homo sapiens
caaccaaucagagaucauc

SEQ ID NO: 837671 - RNA, 19 nt, Homo sapiens
ccacaaccaaucagagauc

SEQ ID NO: 837672 - RNA, 19 nt, Homo sapiens
uggagaaccgagugcauaa

SEQ ID NO: 837673 - RNA, 19 nt, Homo sapiens
aagaaaguggugaugauga

SEQ ID NO: 837674 - RNA, 19 nt, Homo sapiens
ugacgaaccaaggcaacua

SEQ ID NO: 837675 - RNA, 19 nt, Homo sapiens
aagcaaggguuugggaaca

SEQ ID NO: 837676 - RNA, 19 nt, Homo sapiens
caggacaagugcaccuaca

SEQ ID NO: 837677 - RNA, 19 nt, Homo sapiens
ugaagcugcugcgcaagga

SEQ ID NO: 837678 - RNA, 19 nt, Homo sapiens
cccaacaccuuccacuaag

SEQ ID NO: 837679 - RNA, 19 nt, Homo sapiens
cagagaucaugaugucuac

SEQ ID NO: 837680 - RNA, 19 nt, Homo sapiens
gagagcgaguauuauaagc

SEQ ID NO: 837681 - RNA, 19 nt, Homo sapiens
ggaacauugauggcgaaua

SEQ ID NO: 837682 - RNA, 19 nt, Homo sapiens
ggaccuggagcacaaguac

SEQ ID NO: 837683 - RNA, 19 nt, Homo sapiens
ugagagcgaguauuauaag

SEQ ID NO: 837684 - RNA, 19 nt, Homo sapiens
gaaccugagagcgaguauu

SEQ ID NO: 837685 - RNA, 19 nt, Homo sapiens
ccaagagaguucauuuacc

SEQ ID NO: 837686 - RNA, 19 nt, Homo sapiens
guuaacuucuucaggaacu

SEQ ID NO: 837687 - RNA, 19 nt, Homo sapiens
ggaggcuggugguauaacg

SEQ ID NO: 837688 - RNA, 19 nt, Homo sapiens
cugagagcgaguauuauaa

SEQ ID NO: 837689 - RNA, 19 nt, Homo sapiens
gaucaucgcgcagcuugag

SEQ ID NO: 837690 - RNA, 19 nt, Homo sapiens
gaaaguggugaugaugauc

SEQ ID NO: 837691 - RNA, 19 nt, Homo sapiens
gaacugggagacguacaag

SEQ ID NO: 837692 - RNA, 19 nt, Homo sapiens
ccaaggcaacuacaaacuc

SEQ ID NO: 837693 - RNA, 19 nt, Homo sapiens
gacguacaagcaaggguuu

SEQ ID NO: 837694 - RNA, 19 nt, Homo sapiens
ucaggaacugggagacgua

SEQ ID NO: 837695 - RNA, 19 nt, Homo sapiens
cuggagaaccgagugcaua

SEQ ID NO: 837696 - RNA, 19 nt, Homo sapiens
ggagucuacugggcugagu

SEQ ID NO: 837697 - RNA, 19 nt, Homo sapiens
agagugaccagaaccugaa

SEQ ID NO: 837698 - RNA, 19 nt, Homo sapiens
cacaaccaaucagagauca

SEQ ID NO: 837699 - RNA, 19 nt, Homo sapiens
caggaaacugugcccacua

SEQ ID NO: 837700 - RNA, 19 nt, Homo sapiens
gagaaccgagugcauaagc

SEQ ID NO: 837701 - RNA, 19 nt, Homo sapiens
caccuacaccuucauugug

SEQ ID NO: 837702 - RNA, 19 nt, Homo sapiens
aggaaacugugcccacuac

SEQ ID NO: 837703 - RNA, 19 nt, Homo sapiens
cuggauggcucuguuaacu

SEQ ID NO: 837704 - RNA, 19 nt, Homo sapiens
ggaaagaaaugacugaaau

SEQ ID NO: 837705 - RNA, 19 nt, Homo sapiens
gaacugcuagguauuauua

SEQ ID NO: 837706 - RNA, 19 nt, Homo sapiens
ggaaagaagggaacauuua

SEQ ID NO: 837707 - RNA, 19 nt, Homo sapiens
gaagcaaaccuaacuauuu

SEQ ID NO: 837708 - RNA, 19 nt, Homo sapiens
ugacugaaaucgagaaaua

SEQ ID NO: 837709 - RNA, 19 nt, Homo sapiens
gaagaacgguguuaguuau

SEQ ID NO: 837710 - RNA, 19 nt, Homo sapiens
gaagggaacauuuauauug

SEQ ID NO: 837711 - RNA, 19 nt, Homo sapiens
gcugagaacuucauuauuc

SEQ ID NO: 837712 - RNA, 19 nt, Homo sapiens
ggaagaacgguguuaguua

SEQ ID NO: 837713 - RNA, 19 nt, Homo sapiens
gaagaagaaaccacuauuu

SEQ ID NO: 837714 - RNA, 19 nt, Homo sapiens
caaaugggauauacagaaa

SEQ ID NO: 837715 - RNA, 19 nt, Homo sapiens
caacugggcucuccggaaa

SEQ ID NO: 837716 - RNA, 19 nt, Homo sapiens
gaacguauuggaaauguaa

SEQ ID NO: 837717 - RNA, 19 nt, Homo sapiens
gcaggagguugcuuucuuu

SEQ ID NO: 837718 - RNA, 19 nt, Homo sapiens
gaaagaagggaacauuuau

SEQ ID NO: 837719 - RNA, 19 nt, Homo sapiens
gcaaacaacacaauuacaa

SEQ ID NO: 837720 - RNA, 19 nt, Homo sapiens
uaucagugcuguuaauuug

SEQ ID NO: 837721 - RNA, 19 nt, Homo sapiens
guugagagcugaggaauau

SEQ ID NO: 837722 - RNA, 19 nt, Homo sapiens
caucgucuguccaccauua

SEQ ID NO: 837723 - RNA, 19 nt, Homo sapiens
cgagaaauaugccagcaaa

SEQ ID NO: 837724 - RNA, 19 nt, Homo sapiens
ucaagaagcucuagaucga

SEQ ID NO: 837725 - RNA, 19 nt, Homo sapiens
gcccagaggugcccauauu

SEQ ID NO: 837726 - RNA, 19 nt, Homo sapiens
ggaugaggcuagacccuaa

SEQ ID NO: 837727 - RNA, 19 nt, Homo sapiens
ucacauguuuguaugagua

SEQ ID NO: 837728 - RNA, 19 nt, Homo sapiens
aaacguaccuguuaucaag

SEQ ID NO: 837729 - RNA, 19 nt, Homo sapiens
caagaaaacuucagaaugu

SEQ ID NO: 837730 - RNA, 19 nt, Homo sapiens
caugaaagccugacaaguu

SEQ ID NO: 837731 - RNA, 19 nt, Homo sapiens
gaaagcaaacaacacaauu

SEQ ID NO: 837732 - RNA, 19 nt, Homo sapiens
ggaacuauguuugaauaug

SEQ ID NO: 837733 - RNA, 19 nt, Homo sapiens
acucagagacuaugaaaua

SEQ ID NO: 837734 - RNA, 19 nt, Homo sapiens
caaaguggaccauguaaug

SEQ ID NO: 837735 - RNA, 19 nt, Homo sapiens
gcauuuaaguuguuugaag

SEQ ID NO: 837736 - RNA, 19 nt, Homo sapiens
gauaaucucaugaagcaaa

SEQ ID NO: 837737 - RNA, 19 nt, Homo sapiens
ggcaugaacugcuagguau

SEQ ID NO: 837738 - RNA, 19 nt, Homo sapiens
gaaauaugccagcaaagug

SEQ ID NO: 837739 - RNA, 19 nt, Homo sapiens
aaauaauccuugugccaua

SEQ ID NO: 837740 - RNA, 19 nt, Homo sapiens
cuauagcacugaaguuauu

SEQ ID NO: 837741 - RNA, 19 nt, Homo sapiens
gcacaggagaauugauuaa

SEQ ID NO: 837742 - RNA, 19 nt, Homo sapiens
gaacucucuuccuuccuaa

SEQ ID NO: 837743 - RNA, 19 nt, Homo sapiens
ggaaguccuugcuauucaa

SEQ ID NO: 837744 - RNA, 19 nt, Homo sapiens
ugaauaggcugagaacuuc

SEQ ID NO: 837745 - RNA, 19 nt, Homo sapiens
ggaagaagaaaccacuauu

SEQ ID NO: 837746 - RNA, 19 nt, Homo sapiens
gcuagacccuaagaaguaa

SEQ ID NO: 837747 - RNA, 19 nt, Homo sapiens
ugggaacuauguuugaaua

SEQ ID NO: 837748 - RNA, 19 nt, Homo sapiens
ggucugagcucuuucuacu

SEQ ID NO: 837749 - RNA, 19 nt, Homo sapiens
ugaacucucuuccuuccua

SEQ ID NO: 837750 - RNA, 19 nt, Homo sapiens
ccauagaaguauuuacgaa

SEQ ID NO: 837751 - RNA, 19 nt, Homo sapiens
guacaucugugacaaucau

SEQ ID NO: 837752 - RNA, 19 nt, Homo sapiens
ggaacguauuggaaaugua

SEQ ID NO: 837753 - RNA, 19 nt, Homo sapiens
ggucagcgcauugugaaua

SEQ ID NO: 837754 - RNA, 19 nt, Homo sapiens
ccgauaaucucaugaagca

SEQ ID NO: 837755 - RNA, 19 nt, Homo sapiens
ccauugaauuugccauauu

SEQ ID NO: 837756 - RNA, 19 nt, Homo sapiens
gaaaaugaguaccuuguuc

SEQ ID NO: 837757 - RNA, 19 nt, Homo sapiens
ggcuagacccuaagaagua

SEQ ID NO: 837758 - RNA, 19 nt, Homo sapiens
augaaagccugacaaguuu

SEQ ID NO: 837759 - RNA, 19 nt, Homo sapiens
ccaaaugggauauacagaa

SEQ ID NO: 837760 - RNA, 19 nt, Homo sapiens
gcuaaagaaucccaaaauu

SEQ ID NO: 837761 - RNA, 19 nt, Homo sapiens
ccagggugcuuuggaguuu

SEQ ID NO: 837762 - RNA, 19 nt, Homo sapiens
gugaauaggcugagaacuu

SEQ ID NO: 837763 - RNA, 19 nt, Homo sapiens
gaaagaaaugacugaaauc

SEQ ID NO: 837764 - RNA, 19 nt, Homo sapiens
ggcaggagguugcuuucuu

SEQ ID NO: 837765 - RNA, 19 nt, Homo sapiens
guaaugcaguuagcaagga

SEQ ID NO: 837766 - RNA, 19 nt, Homo sapiens
ugauuagacuggaagaaga

SEQ ID NO: 837767 - RNA, 19 nt, Homo sapiens
caugaacugcuagguauua

SEQ ID NO: 837768 - RNA, 19 nt, Homo sapiens
cagcauaaggaagcaauua

SEQ ID NO: 837769 - RNA, 19 nt, Homo sapiens
gaacgugcauuuugccuau

SEQ ID NO: 837770 - RNA, 19 nt, Homo sapiens
ccuaagaaguaauuaaguc

SEQ ID NO: 837771 - RNA, 19 nt, Homo sapiens
gaaacguaccuguuaucaa

SEQ ID NO: 837772 - RNA, 19 nt, Homo sapiens
uaauaugguugcuguucuu

SEQ ID NO: 837773 - RNA, 19 nt, Homo sapiens
gaaggcauguauuuugaaa

SEQ ID NO: 837774 - RNA, 19 nt, Homo sapiens
gaugacccuuccucuguga

SEQ ID NO: 837775 - RNA, 19 nt, Homo sapiens
gauuucagccuuuccauuc

SEQ ID NO: 837776 - RNA, 19 nt, Homo sapiens
cagcaaaguggaccaugua

SEQ ID NO: 837777 - RNA, 19 nt, Homo sapiens
caccuaaucuggccaccuu

SEQ ID NO: 837778 - RNA, 19 nt, Homo sapiens
ggagguugcuuucuuugac

SEQ ID NO: 837779 - RNA, 19 nt, Homo sapiens
caucuccugugucuucaaa

SEQ ID NO: 837780 - RNA, 19 nt, Homo sapiens
gcaaaucaacagugcuuuc

SEQ ID NO: 837781 - RNA, 19 nt, Homo sapiens
gggaaagaaaugacugaaa

SEQ ID NO: 837782 - RNA, 19 nt, Homo sapiens
gcacaugaaagccugacaa

SEQ ID NO: 837783 - RNA, 19 nt, Homo sapiens
uaacaucagcuggaaagaa

SEQ ID NO: 837784 - RNA, 19 nt, Homo sapiens
cagagacuaugaaauacau

SEQ ID NO: 837785 - RNA, 19 nt, Homo sapiens
gaacgguguuaguuauugc

SEQ ID NO: 837786 - RNA, 19 nt, Homo sapiens
gggcagaaacagcggauug

SEQ ID NO: 837787 - RNA, 19 nt, Homo sapiens
ugaggaacguauuggaaau

SEQ ID NO: 837788 - RNA, 19 nt, Homo sapiens
acaacacaauuacaagguu

SEQ ID NO: 837789 - RNA, 19 nt, Homo sapiens
cuacaaccauugaauuugc

SEQ ID NO: 837790 - RNA, 19 nt, Homo sapiens
guuugaauaugugcaguuu

SEQ ID NO: 837791 - RNA, 19 nt, Homo sapiens
acucggagcugaugaaagg

SEQ ID NO: 837792 - RNA, 19 nt, Homo sapiens
gaccgugggugaacucucu

SEQ ID NO: 837793 - RNA, 19 nt, Homo sapiens
ccagcaaaguggaccaugu

SEQ ID NO: 837794 - RNA, 19 nt, Homo sapiens
cucacgauguccaguguua

SEQ ID NO: 837795 - RNA, 19 nt, Homo sapiens
guaucagugcuguuaauuu

SEQ ID NO: 837796 - RNA, 19 nt, Homo sapiens
ugaagcuauugucaaauga

SEQ ID NO: 837797 - RNA, 19 nt, Homo sapiens
uacggaaacugaccaaagu

SEQ ID NO: 837798 - RNA, 19 nt, Homo sapiens
auuacaagguugaaucuga

SEQ ID NO: 837799 - RNA, 19 nt, Homo sapiens
gcucuacuuguguucuuua

SEQ ID NO: 837800 - RNA, 19 nt, Homo sapiens
caaaauuccuaaagcaaug

SEQ ID NO: 837801 - RNA, 19 nt, Homo sapiens
gucuauagcacugaaguua

SEQ ID NO: 837802 - RNA, 19 nt, Homo sapiens
caaaguguguaaaagauug

SEQ ID NO: 837803 - RNA, 19 nt, Homo sapiens
gcccauauuucaggauuuc

SEQ ID NO: 837804 - RNA, 19 nt, Homo sapiens
gaauggcccuuccuuagua

SEQ ID NO: 837805 - RNA, 19 nt, Homo sapiens
gggaagagcuccuguguca

SEQ ID NO: 837806 - RNA, 19 nt, Homo sapiens
gagacaagcuucuuugaug

SEQ ID NO: 837807 - RNA, 19 nt, Homo sapiens
gagagaacccggucaauaa

SEQ ID NO: 837808 - RNA, 19 nt, Homo sapiens
ccagucaacuccuagauuu

SEQ ID NO: 837809 - RNA, 19 nt, Homo sapiens
uaaaguguacuaccucuua

SEQ ID NO: 837810 - RNA, 19 nt, Homo sapiens
ucaccaagauguucuagaa

SEQ ID NO: 837811 - RNA, 19 nt, Homo sapiens
ccaaagagguccagaaugc

SEQ ID NO: 837812 - RNA, 19 nt, Homo sapiens
ggaccucccuagccuccua

SEQ ID NO: 837813 - RNA, 19 nt, Homo sapiens
agacaagcuucuuugauga

SEQ ID NO: 837814 - RNA, 19 nt, Homo sapiens
uguacaagcugaacaggaa

SEQ ID NO: 837815 - RNA, 19 nt, Homo sapiens
ugagagaacccggucaaua

SEQ ID NO: 837816 - RNA, 19 nt, Homo sapiens
ugcauucucuucugucuuu

SEQ ID NO: 837817 - RNA, 19 nt, Homo sapiens
gaagagcuccugugucaac

SEQ ID NO: 837818 - RNA, 19 nt, Homo sapiens
gaaagacgaccugccaugu

SEQ ID NO: 837819 - RNA, 19 nt, Homo sapiens
gagaagguguucgaguuca

SEQ ID NO: 837820 - RNA, 19 nt, Homo sapiens
cugagaagguguucgaguu

SEQ ID NO: 837821 - RNA, 19 nt, Homo sapiens
gaccaucagugccaugaag

SEQ ID NO: 837822 - RNA, 19 nt, Homo sapiens
ugccagagguugcaacaug

SEQ ID NO: 837823 - RNA, 19 nt, Homo sapiens
ccacguggauguucaugag

SEQ ID NO: 837824 - RNA, 19 nt, Homo sapiens
ggagacaagcuucuuugau

SEQ ID NO: 837825 - RNA, 19 nt, Homo sapiens
ggagcacgcgcaccucauu

SEQ ID NO: 837826 - RNA, 19 nt, Homo sapiens
caacaucuacggcaaguac

SEQ ID NO: 837827 - RNA, 19 nt, Homo sapiens
ucaauaaaguguacuaccu

SEQ ID NO: 837828 - RNA, 19 nt, Homo sapiens
gcacuuucaccaagauguu

SEQ ID NO: 837829 - RNA, 19 nt, Homo sapiens
gagcuccugugucaacauc

SEQ ID NO: 837830 - RNA, 19 nt, Homo sapiens
ucaacauccuggagaacuu

SEQ ID NO: 837831 - RNA, 19 nt, Homo sapiens
ggguggacuuugagaaugu

SEQ ID NO: 837832 - RNA, 19 nt, Homo sapiens
guccggagcuucgccaaug

SEQ ID NO: 837833 - RNA, 19 nt, Homo sapiens
agaccuuccugcccuacua

SEQ ID NO: 837834 - RNA, 19 nt, Homo sapiens
gaggacauccgccacuuca

SEQ ID NO: 837835 - RNA, 19 nt, Homo sapiens
ccacggccaucuaugucuu

SEQ ID NO: 837836 - RNA, 19 nt, Homo sapiens
uggaugggaugguggcaaa

SEQ ID NO: 837837 - RNA, 19 nt, Homo sapiens
gugaauggcccuuccuuag

SEQ ID NO: 837838 - RNA, 19 nt, Homo sapiens
gccgagagcgaguaucuga

SEQ ID NO: 837839 - RNA, 19 nt, Homo sapiens
ucacggauaacaucuccua

SEQ ID NO: 837840 - RNA, 19 nt, Homo sapiens
gcacggcugucgucaucgu

SEQ ID NO: 837841 - RNA, 19 nt, Homo sapiens
gccagagguugcaacaugu

SEQ ID NO: 837842 - RNA, 19 nt, Homo sapiens
ccaagauguucuagaaacu

SEQ ID NO: 837843 - RNA, 19 nt, Homo sapiens
gugguggucuucauguuca

SEQ ID NO: 837844 - RNA, 19 nt, Homo sapiens
ggacauccgccacuucaac

SEQ ID NO: 837845 - RNA, 19 nt, Homo sapiens
agagaacccggucaauaaa

SEQ ID NO: 837846 - RNA, 19 nt, Homo sapiens
gcgccuacgaccacaagua

SEQ ID NO: 837847 - RNA, 19 nt, Homo sapiens
gcaggaugcggcuguggaa

SEQ ID NO: 837848 - RNA, 19 nt, Homo sapiens
ucaaugagcagcgcggaaa

SEQ ID NO: 837849 - RNA, 19 nt, Homo sapiens
gaagcacacgguacucauc

SEQ ID NO: 837850 - RNA, 19 nt, Homo sapiens
gcugucagguggccagaag

SEQ ID NO: 837851 - RNA, 19 nt, Homo sapiens
cauggcagcucuccuuggu

SEQ ID NO: 837852 - RNA, 19 nt, Homo sapiens
gcuacaaccuggccuucag

SEQ ID NO: 837853 - RNA, 19 nt, Homo sapiens
ccaggagacaagcuucuuu

SEQ ID NO: 837854 - RNA, 19 nt, Homo sapiens
gaugcauucucuucugucu

SEQ ID NO: 837855 - RNA, 19 nt, Homo sapiens
cuucacagcuggccacaac

SEQ ID NO: 837856 - RNA, 19 nt, Homo sapiens
ccacugugccuuucgagau

SEQ ID NO: 837857 - RNA, 19 nt, Homo sapiens
cgucuacaguggccugaug

SEQ ID NO: 837858 - RNA, 19 nt, Homo sapiens
agaacccggucaauaaagu

SEQ ID NO: 837859 - RNA, 19 nt, Homo sapiens
gagcguggagggcaucugu

SEQ ID NO: 837860 - RNA, 19 nt, Homo sapiens
aagauguucuagaaacuuc

SEQ ID NO: 837861 - RNA, 19 nt, Homo sapiens
gcgggcacuuucaccaaga

SEQ ID NO: 837862 - RNA, 19 nt, Homo sapiens
gcacacgguacucaucauc

SEQ ID NO: 837863 - RNA, 19 nt, Homo sapiens
guacuugcaccgugugauc

SEQ ID NO: 837864 - RNA, 19 nt, Homo sapiens
gaacccggucaauaaagug

SEQ ID NO: 837865 - RNA, 19 nt, Homo sapiens
gaaccacacgaaaccucaa

SEQ ID NO: 837866 - RNA, 19 nt, Homo sapiens
ugaauggcccuuccuuagu

SEQ ID NO: 837867 - RNA, 19 nt, Homo sapiens
caagauguucuagaaacuu

SEQ ID NO: 837868 - RNA, 19 nt, Homo sapiens
gaggccacguggauguuca

SEQ ID NO: 837869 - RNA, 19 nt, Homo sapiens
gcagucacaaggccugaug

SEQ ID NO: 837870 - RNA, 19 nt, Homo sapiens
ugaccacggccaucuaugu

SEQ ID NO: 837871 - RNA, 19 nt, Homo sapiens
aggcggugguggugacuuu

SEQ ID NO: 837872 - RNA, 19 nt, Homo sapiens
gagaacccggucaauaaag

SEQ ID NO: 837873 - RNA, 19 nt, Homo sapiens
gagcacgcgcaccucauug

SEQ ID NO: 837874 - RNA, 19 nt, Homo sapiens
cgagagcgaguaucugauc

SEQ ID NO: 837875 - RNA, 19 nt, Homo sapiens
gcgugguggucuucauguu

SEQ ID NO: 837876 - RNA, 19 nt, Homo sapiens
caggagacaagcuucuuug

SEQ ID NO: 837877 - RNA, 19 nt, Homo sapiens
agaaaagcauggaucaguu

SEQ ID NO: 837878 - RNA, 19 nt, Homo sapiens
gcacgcgcaccucauugug

SEQ ID NO: 837879 - RNA, 19 nt, Homo sapiens
cacugugccuuucgagaug

SEQ ID NO: 837880 - RNA, 19 nt, Homo sapiens
ucaaggcacgccagucuca

SEQ ID NO: 837881 - RNA, 19 nt, Homo sapiens
ggaggacauccgccacuuc

SEQ ID NO: 837882 - RNA, 19 nt, Homo sapiens
uggugaagcugcugcucuu

SEQ ID NO: 837883 - RNA, 19 nt, Homo sapiens
gugucaacauccuggagaa

SEQ ID NO: 837884 - RNA, 19 nt, Homo sapiens
gcagcugccuacauguacu

SEQ ID NO: 837885 - RNA, 19 nt, Homo sapiens
ugaagacuguccggagcuu

SEQ ID NO: 837886 - RNA, 19 nt, Homo sapiens
gagaccaucagugccauga

SEQ ID NO: 837887 - RNA, 19 nt, Homo sapiens
acaagcuucuuugaugaga

SEQ ID NO: 837888 - RNA, 19 nt, Homo sapiens
cggguggacuuugagaaug

SEQ ID NO: 837889 - RNA, 19 nt, Homo sapiens
gacuuuggccuucaugagu

SEQ ID NO: 837890 - RNA, 19 nt, Homo sapiens
gcucauuugccgcagguau

SEQ ID NO: 837891 - RNA, 19 nt, Homo sapiens
gaaaagcauggaucaguuc

SEQ ID NO: 837892 - RNA, 19 nt, Homo sapiens
ccucuugccagcucuguga

SEQ ID NO: 837893 - RNA, 19 nt, Homo sapiens
gacuaggccucuccccuuu

SEQ ID NO: 837894 - RNA, 19 nt, Homo sapiens
ucccuagccuccuaagcaa

SEQ ID NO: 837895 - RNA, 19 nt, Homo sapiens
accaagauguucuagaaac

SEQ ID NO: 837896 - RNA, 19 nt, Homo sapiens
caacauccuggagaacuuc

SEQ ID NO: 837897 - RNA, 19 nt, Homo sapiens
gaagguguucgaguucauc

SEQ ID NO: 837898 - RNA, 19 nt, Homo sapiens
ugagaagguguucgaguuc

SEQ ID NO: 837899 - RNA, 19 nt, Homo sapiens
ggaggaggcagagguguac

SEQ ID NO: 837900 - RNA, 19 nt, Homo sapiens
aaaguguacuaccucuuac

SEQ ID NO: 837901 - RNA, 19 nt, Homo sapiens
agugaauggcccuuccuua

SEQ ID NO: 837902 - RNA, 19 nt, Homo sapiens
caccaagauguucuagaaa

SEQ ID NO: 837903 - RNA, 19 nt, Homo sapiens
gacauccgccacuucaaca

SEQ ID NO: 837904 - RNA, 19 nt, Homo sapiens
gaauggcccuuccuuagua

SEQ ID NO: 837905 - RNA, 19 nt, Homo sapiens
gggaagagcuccuguguca

SEQ ID NO: 837906 - RNA, 19 nt, Homo sapiens
gagacaagcuucuuugaug

SEQ ID NO: 837907 - RNA, 19 nt, Homo sapiens
gagagaacccggucaauaa

SEQ ID NO: 837908 - RNA, 19 nt, Homo sapiens
ccagucaacuccuagauuu

SEQ ID NO: 837909 - RNA, 19 nt, Homo sapiens
uaaaguguacuaccucuua

SEQ ID NO: 837910 - RNA, 19 nt, Homo sapiens
ucaccaagauguucuagaa

SEQ ID NO: 837911 - RNA, 19 nt, Homo sapiens
ccaaagagguccagaaugc

SEQ ID NO: 837912 - RNA, 19 nt, Homo sapiens
ggaccucccuagccuccua

SEQ ID NO: 837913 - RNA, 19 nt, Homo sapiens
agacaagcuucuuugauga

SEQ ID NO: 837914 - RNA, 19 nt, Homo sapiens
uguacaagcugaacaggaa

SEQ ID NO: 837915 - RNA, 19 nt, Homo sapiens
ugagagaacccggucaaua

SEQ ID NO: 837916 - RNA, 19 nt, Homo sapiens
ugcauucucuucugucuuu

SEQ ID NO: 837917 - RNA, 19 nt, Homo sapiens
gaagagcuccugugucaac

SEQ ID NO: 837918 - RNA, 19 nt, Homo sapiens
gaaagacgaccugccaugu

SEQ ID NO: 837919 - RNA, 19 nt, Homo sapiens
gagaagguguucgaguuca

SEQ ID NO: 837920 - RNA, 19 nt, Homo sapiens
cugagaagguguucgaguu

SEQ ID NO: 837921 - RNA, 19 nt, Homo sapiens
gaccaucagugccaugaag

SEQ ID NO: 837922 - RNA, 19 nt, Homo sapiens
ugccagagguugcaacaug

SEQ ID NO: 837923 - RNA, 19 nt, Homo sapiens
ccacguggauguucaugag

SEQ ID NO: 837924 - RNA, 19 nt, Homo sapiens
ggagacaagcuucuuugau

SEQ ID NO: 837925 - RNA, 19 nt, Homo sapiens
ggagcacgcgcaccucauu

SEQ ID NO: 837926 - RNA, 19 nt, Homo sapiens
caacaucuacggcaaguac

SEQ ID NO: 837927 - RNA, 19 nt, Homo sapiens
ucaauaaaguguacuaccu

SEQ ID NO: 837928 - RNA, 19 nt, Homo sapiens
gcacuuucaccaagauguu

SEQ ID NO: 837929 - RNA, 19 nt, Homo sapiens
gagcuccugugucaacauc

SEQ ID NO: 837930 - RNA, 19 nt, Homo sapiens
ucaacauccuggagaacuu

SEQ ID NO: 837931 - RNA, 19 nt, Homo sapiens
ggguggacuuugagaaugu

SEQ ID NO: 837932 - RNA, 19 nt, Homo sapiens
guccggagcuucgccaaug

SEQ ID NO: 837933 - RNA, 19 nt, Homo sapiens
agaccuuccugcccuacua

SEQ ID NO: 837934 - RNA, 19 nt, Homo sapiens
gaggacauccgccacuuca

SEQ ID NO: 837935 - RNA, 19 nt, Homo sapiens
ccacggccaucuaugucuu

SEQ ID NO: 837936 - RNA, 19 nt, Homo sapiens
uggaugggaugguggcaaa

SEQ ID NO: 837937 - RNA, 19 nt, Homo sapiens
gugaauggcccuuccuuag

SEQ ID NO: 837938 - RNA, 19 nt, Homo sapiens
gccgagagcgaguaucuga

SEQ ID NO: 837939 - RNA, 19 nt, Homo sapiens
ucacggauaacaucuccua

SEQ ID NO: 837940 - RNA, 19 nt, Homo sapiens
gcacggcugucgucaucgu

SEQ ID NO: 837941 - RNA, 19 nt, Homo sapiens
gccagagguugcaacaugu

SEQ ID NO: 837942 - RNA, 19 nt, Homo sapiens
ccaagauguucuagaaacu

SEQ ID NO: 837943 - RNA, 19 nt, Homo sapiens
ccucaucgccuucaucauc

SEQ ID NO: 837944 - RNA, 19 nt, Homo sapiens
gugguggucuucauguuca

SEQ ID NO: 837945 - RNA, 19 nt, Homo sapiens
ggacauccgccacuucaac

SEQ ID NO: 837946 - RNA, 19 nt, Homo sapiens
agagaacccggucaauaaa

SEQ ID NO: 837947 - RNA, 19 nt, Homo sapiens
gcgccuacgaccacaagua

SEQ ID NO: 837948 - RNA, 19 nt, Homo sapiens
gcaggaugcggcuguggaa

SEQ ID NO: 837949 - RNA, 19 nt, Homo sapiens
ucaaugagcagcgcggaaa

SEQ ID NO: 837950 - RNA, 19 nt, Homo sapiens
gaagcacacgguacucauc

SEQ ID NO: 837951 - RNA, 19 nt, Homo sapiens
gcugucagguggccagaag

SEQ ID NO: 837952 - RNA, 19 nt, Homo sapiens
cauggcagcucuccuuggu

SEQ ID NO: 837953 - RNA, 19 nt, Homo sapiens
gcuacaaccuggccuucag

SEQ ID NO: 837954 - RNA, 19 nt, Homo sapiens
ccaggagacaagcuucuuu

SEQ ID NO: 837955 - RNA, 19 nt, Homo sapiens
gaugcauucucuucugucu

SEQ ID NO: 837956 - RNA, 19 nt, Homo sapiens
cuucacagcuggccacaac

SEQ ID NO: 837957 - RNA, 19 nt, Homo sapiens
ccacugugccuuucgagau

SEQ ID NO: 837958 - RNA, 19 nt, Homo sapiens
cgucuacaguggccugaug

SEQ ID NO: 837959 - RNA, 19 nt, Homo sapiens
agaacccggucaauaaagu

SEQ ID NO: 837960 - RNA, 19 nt, Homo sapiens
gagcguggagggcaucugu

SEQ ID NO: 837961 - RNA, 19 nt, Homo sapiens
aagauguucuagaaacuuc

SEQ ID NO: 837962 - RNA, 19 nt, Homo sapiens
gcgggcacuuucaccaaga

SEQ ID NO: 837963 - RNA, 19 nt, Homo sapiens
gcacacgguacucaucauc

SEQ ID NO: 837964 - RNA, 19 nt, Homo sapiens
guacuugcaccgugugauc

SEQ ID NO: 837965 - RNA, 19 nt, Homo sapiens
gaacccggucaauaaagug

SEQ ID NO: 837966 - RNA, 19 nt, Homo sapiens
gaaccacacgaaaccucaa

SEQ ID NO: 837967 - RNA, 19 nt, Homo sapiens
ugaauggcccuuccuuagu

SEQ ID NO: 837968 - RNA, 19 nt, Homo sapiens
caagauguucuagaaacuu

SEQ ID NO: 837969 - RNA, 19 nt, Homo sapiens
gaggccacguggauguuca

SEQ ID NO: 837970 - RNA, 19 nt, Homo sapiens
gcagucacaaggccugaug

SEQ ID NO: 837971 - RNA, 19 nt, Homo sapiens
ugaccacggccaucuaugu

SEQ ID NO: 837972 - RNA, 19 nt, Homo sapiens
aggcggugguggugacuuu

SEQ ID NO: 837973 - RNA, 19 nt, Homo sapiens
gagaacccggucaauaaag

SEQ ID NO: 837974 - RNA, 19 nt, Homo sapiens
gagcacgcgcaccucauug

SEQ ID NO: 837975 - RNA, 19 nt, Homo sapiens
cgagagcgaguaucugauc

SEQ ID NO: 837976 - RNA, 19 nt, Homo sapiens
gcgugguggucuucauguu

SEQ ID NO: 837977 - RNA, 19 nt, Homo sapiens
caggagacaagcuucuuug

SEQ ID NO: 837978 - RNA, 19 nt, Homo sapiens
gaguuuguccugggagauu

SEQ ID NO: 837979 - RNA, 19 nt, Homo sapiens
gggccaccuugucaucuca

SEQ ID NO: 837980 - RNA, 19 nt, Homo sapiens
agaaaagcauggaucaguu

SEQ ID NO: 837981 - RNA, 19 nt, Homo sapiens
gcacgcgcaccucauugug

SEQ ID NO: 837982 - RNA, 19 nt, Homo sapiens
cacugugccuuucgagaug

SEQ ID NO: 837983 - RNA, 19 nt, Homo sapiens
ggaggacauccgccacuuc

SEQ ID NO: 837984 - RNA, 19 nt, Homo sapiens
ucaaggcacgccagucuca

SEQ ID NO: 837985 - RNA, 19 nt, Homo sapiens
cuucaucaucuacgaguuu

SEQ ID NO: 837986 - RNA, 19 nt, Homo sapiens
uggugaagcugcugcucuu

SEQ ID NO: 837987 - RNA, 19 nt, Homo sapiens
gugucaacauccuggagaa

SEQ ID NO: 837988 - RNA, 19 nt, Homo sapiens
gcagcugccuacauguacu

SEQ ID NO: 837989 - RNA, 19 nt, Homo sapiens
ugaagacuguccggagcuu

SEQ ID NO: 837990 - RNA, 19 nt, Homo sapiens
gagaccaucagugccauga

SEQ ID NO: 837991 - RNA, 19 nt, Homo sapiens
acaagcuucuuugaugaga

SEQ ID NO: 837992 - RNA, 19 nt, Homo sapiens
cggguggacuuugagaaug

SEQ ID NO: 837993 - RNA, 19 nt, Homo sapiens
gacuuuggccuucaugagu

SEQ ID NO: 837994 - RNA, 19 nt, Homo sapiens
gcucauuugccgcagguau

SEQ ID NO: 837995 - RNA, 19 nt, Homo sapiens
gaaaagcauggaucaguuc

SEQ ID NO: 837996 - RNA, 19 nt, Homo sapiens
ccucuugccagcucuguga

SEQ ID NO: 837997 - RNA, 19 nt, Homo sapiens
gacuaggccucuccccuuu

SEQ ID NO: 837998 - RNA, 19 nt, Homo sapiens
ucccuagccuccuaagcaa

SEQ ID NO: 837999 - RNA, 19 nt, Homo sapiens
gaccagcggcaaccucauc

SEQ ID NO: 838000 - RNA, 19 nt, Homo sapiens
accaagauguucuagaaac

SEQ ID NO: 838001 - RNA, 19 nt, Homo sapiens
caacauccuggagaacuuc

SEQ ID NO: 838002 - RNA, 19 nt, Homo sapiens
gaagguguucgaguucauc

SEQ ID NO: 838003 - RNA, 19 nt, Homo sapiens
ugagaagguguucgaguuc

SEQ ID NO: 838004 - RNA, 19 nt, Homo sapiens
cgaauaggcuaaaugaaua

SEQ ID NO: 838005 - RNA, 19 nt, Homo sapiens
ucacagaccuuucacaaau

SEQ ID NO: 838006 - RNA, 19 nt, Homo sapiens
gcaaugggcuacuucaaau

SEQ ID NO: 838007 - RNA, 19 nt, Homo sapiens
gacgucagcuucuucauuu

SEQ ID NO: 838008 - RNA, 19 nt, Homo sapiens
caaacuggauuauaacuug

SEQ ID NO: 838009 - RNA, 19 nt, Homo sapiens
ggauggauauggugaguuu

SEQ ID NO: 838010 - RNA, 19 nt, Homo sapiens
gaggaaaucagaaagauaa

SEQ ID NO: 838011 - RNA, 19 nt, Homo sapiens
gaagauuucucagcucauu

SEQ ID NO: 838012 - RNA, 19 nt, Homo sapiens
caugagaaauguccaguuu

SEQ ID NO: 838013 - RNA, 19 nt, Homo sapiens
aaagaucgauugggaauuu

SEQ ID NO: 838014 - RNA, 19 nt, Homo sapiens
uaaaggaaguggaacaaga

SEQ ID NO: 838015 - RNA, 19 nt, Homo sapiens
gaaaggaacaagugucauu

SEQ ID NO: 838016 - RNA, 19 nt, Homo sapiens
ucagaaagccucaaugaaa

SEQ ID NO: 838017 - RNA, 19 nt, Homo sapiens
ggauauaacaguccacuuu

SEQ ID NO: 838018 - RNA, 19 nt, Homo sapiens
aaagauaacuggcgucugu

SEQ ID NO: 838019 - RNA, 19 nt, Homo sapiens
gaaauuaacagcaggaauc

SEQ ID NO: 838020 - RNA, 19 nt, Homo sapiens
gaacaaguggagaugauaa

SEQ ID NO: 838021 - RNA, 19 nt, Homo sapiens
gaacaaauaacauccuuca

SEQ ID NO: 838022 - RNA, 19 nt, Homo sapiens
gagaugagcgccauuauuc

SEQ ID NO: 838023 - RNA, 19 nt, Homo sapiens
gaucaucaauaacacagaa

SEQ ID NO: 838024 - RNA, 19 nt, Homo sapiens
ucagaaauguuaagaagga

SEQ ID NO: 838025 - RNA, 19 nt, Homo sapiens
agagagagcuuauuggaau

SEQ ID NO: 838026 - RNA, 19 nt, Homo sapiens
ggaguaggcacccauuuaa

SEQ ID NO: 838027 - RNA, 19 nt, Homo sapiens
gacauuaccuuucauaacu

SEQ ID NO: 838028 - RNA, 19 nt, Homo sapiens
gaagacauuaccuuucaua

SEQ ID NO: 838029 - RNA, 19 nt, Homo sapiens
gcagugaagcauaacuuua

SEQ ID NO: 838030 - RNA, 19 nt, Homo sapiens
uagaagcagugaagcauaa

SEQ ID NO: 838031 - RNA, 19 nt, Homo sapiens
gaugagaaaccuguuauaa

SEQ ID NO: 838032 - RNA, 19 nt, Homo sapiens
cagaagaacccauagauga

SEQ ID NO: 838033 - RNA, 19 nt, Homo sapiens
cagaaagccucaaugaaau

SEQ ID NO: 838034 - RNA, 19 nt, Homo sapiens
ugaaauauguaacccagaa

SEQ ID NO: 838035 - RNA, 19 nt, Homo sapiens
gaucaguuaccaucuauaa

SEQ ID NO: 838036 - RNA, 19 nt, Homo sapiens
uggcaaaucuucacugcua

SEQ ID NO: 838037 - RNA, 19 nt, Homo sapiens
gcuauuggcauuauacuuu

SEQ ID NO: 838038 - RNA, 19 nt, Homo sapiens
uaagaugcauggaacuaaa

SEQ ID NO: 838039 - RNA, 19 nt, Homo sapiens
ucaagcccauuuccucuua

SEQ ID NO: 838040 - RNA, 19 nt, Homo sapiens
ggaaggguagauaaauuua

SEQ ID NO: 838041 - RNA, 19 nt, Homo sapiens
ggaaacuccucccucauuc

SEQ ID NO: 838042 - RNA, 19 nt, Homo sapiens
gaaggaaacgucucaagug

SEQ ID NO: 838043 - RNA, 19 nt, Homo sapiens
gaagaagcagcaauaaaga

SEQ ID NO: 838044 - RNA, 19 nt, Homo sapiens
ucagugaucuggauaagug

SEQ ID NO: 838045 - RNA, 19 nt, Homo sapiens
gaacaggaaguaggaaauu

SEQ ID NO: 838046 - RNA, 19 nt, Homo sapiens
gaaaauagcagcaagaaau

SEQ ID NO: 838047 - RNA, 19 nt, Homo sapiens
uaacauccuucauuacuca

SEQ ID NO: 838048 - RNA, 19 nt, Homo sapiens
gaacaagagguacaacgaa

SEQ ID NO: 838049 - RNA, 19 nt, Homo sapiens
ggacuaaugcuaagguuau

SEQ ID NO: 838050 - RNA, 19 nt, Homo sapiens
uaugcuggcuucaucuuua

SEQ ID NO: 838051 - RNA, 19 nt, Homo sapiens
gaauacagccuuucucagu

SEQ ID NO: 838052 - RNA, 19 nt, Homo sapiens
acagaccuuucacaaauua

SEQ ID NO: 838053 - RNA, 19 nt, Homo sapiens
ccaagagauugcacuguuu

SEQ ID NO: 838054 - RNA, 19 nt, Homo sapiens
ggucuuggauaucaccuaa

SEQ ID NO: 838055 - RNA, 19 nt, Homo sapiens
ggaaguggaacaagaggua

SEQ ID NO: 838056 - RNA, 19 nt, Homo sapiens
gcgaauaggcuaaaugaau

SEQ ID NO: 838057 - RNA, 19 nt, Homo sapiens
ucugaccacuucaaucuua

SEQ ID NO: 838058 - RNA, 19 nt, Homo sapiens
gguauugguuccuucauau

SEQ ID NO: 838059 - RNA, 19 nt, Homo sapiens
ugagugugcuguuaaagaa

SEQ ID NO: 838060 - RNA, 19 nt, Homo sapiens
ggaaacgucucaagugacu

SEQ ID NO: 838061 - RNA, 19 nt, Homo sapiens
cagcaggaaucacgagaaa

SEQ ID NO: 838062 - RNA, 19 nt, Homo sapiens
ccacugcucugaccacuuc

SEQ ID NO: 838063 - RNA, 19 nt, Homo sapiens
gaacuaaaauguggaaaga

SEQ ID NO: 838064 - RNA, 19 nt, Homo sapiens
aaacagaaaugguacugau

SEQ ID NO: 838065 - RNA, 19 nt, Homo sapiens
aagauaaccuugcuaaaca

SEQ ID NO: 838066 - RNA, 19 nt, Homo sapiens
cauguacauugaccaaaua

SEQ ID NO: 838067 - RNA, 19 nt, Homo sapiens
aaacacacauggacgaaau

SEQ ID NO: 838068 - RNA, 19 nt, Homo sapiens
guacugauggccucucaua

SEQ ID NO: 838069 - RNA, 19 nt, Homo sapiens
gaacaagauuucgaacaag

SEQ ID NO: 838070 - RNA, 19 nt, Homo sapiens
gaaggacagucaacuaucg

SEQ ID NO: 838071 - RNA, 19 nt, Homo sapiens
cuuaagaaauggaggauga

SEQ ID NO: 838072 - RNA, 19 nt, Homo sapiens
ggacgucagcuucuucauu

SEQ ID NO: 838073 - RNA, 19 nt, Homo sapiens
uauguagcauuucuccuua

SEQ ID NO: 838074 - RNA, 19 nt, Homo sapiens
caugucaacucuaaaugaa

SEQ ID NO: 838075 - RNA, 19 nt, Homo sapiens
ggaggaaaucagaaagaua

SEQ ID NO: 838076 - RNA, 19 nt, Homo sapiens
ucaggagacucauauacaa

SEQ ID NO: 838077 - RNA, 19 nt, Homo sapiens
gggaaggguagauaaauuu

SEQ ID NO: 838078 - RNA, 19 nt, Homo sapiens
gaaaagagagagcuuauug

SEQ ID NO: 838079 - RNA, 19 nt, Homo sapiens
uggcaaggauuacauucua

SEQ ID NO: 838080 - RNA, 19 nt, Homo sapiens
ggagaugagcgccauuauu

SEQ ID NO: 838081 - RNA, 19 nt, Homo sapiens
gcuaugggaaucaucuuua

SEQ ID NO: 838082 - RNA, 19 nt, Homo sapiens
uagcaaaccugugauaaag

SEQ ID NO: 838083 - RNA, 19 nt, Homo sapiens
gaauguuccugugcagaaa

SEQ ID NO: 838084 - RNA, 19 nt, Homo sapiens
ucauauaccuugcuuggau

SEQ ID NO: 838085 - RNA, 19 nt, Homo sapiens
guuauugacccuauuauug

SEQ ID NO: 838086 - RNA, 19 nt, Homo sapiens
agagguacaacgaauauua

SEQ ID NO: 838087 - RNA, 19 nt, Homo sapiens
gagaaaccuguuauaauug

SEQ ID NO: 838088 - RNA, 19 nt, Homo sapiens
guagagaugcuaagccaaa

SEQ ID NO: 838089 - RNA, 19 nt, Homo sapiens
gauaagagacucagaaagc

SEQ ID NO: 838090 - RNA, 19 nt, Homo sapiens
uggaauggcuccucagaau

SEQ ID NO: 838091 - RNA, 19 nt, Homo sapiens
acuuuaaccuggaagaaua

SEQ ID NO: 838092 - RNA, 19 nt, Homo sapiens
ugacuuugguccacacuga

SEQ ID NO: 838093 - RNA, 19 nt, Homo sapiens
aaggaaacgucucaaguga

SEQ ID NO: 838094 - RNA, 19 nt, Homo sapiens
ggauuacauucuagagcua

SEQ ID NO: 838095 - RNA, 19 nt, Homo sapiens
ucucuugucuucuucauau

SEQ ID NO: 838096 - RNA, 19 nt, Homo sapiens
gauggccucucauacaaug

SEQ ID NO: 838097 - RNA, 19 nt, Homo sapiens
uaaaaucacugaagcauca

SEQ ID NO: 838098 - RNA, 19 nt, Homo sapiens
ccacuggaaaggacaaaua

SEQ ID NO: 838099 - RNA, 19 nt, Homo sapiens
gaaaagugaucauguccaa

SEQ ID NO: 838100 - RNA, 19 nt, Homo sapiens
ggucucaucuacuugcuau

SEQ ID NO: 838101 - RNA, 19 nt, Homo sapiens
aagcuguccucaccaauuu

SEQ ID NO: 838102 - RNA, 19 nt, Homo sapiens
ggugauagcaaaccuguga

SEQ ID NO: 838103 - RNA, 19 nt, Homo sapiens
ucaagaaggugaaauuuug

SEQ ID NO: 838104 - RNA, 19 nt, Homo sapiens
cgaauaggcuaaaugaaua

SEQ ID NO: 838105 - RNA, 19 nt, Homo sapiens
ucacagaccuuucacaaau

SEQ ID NO: 838106 - RNA, 19 nt, Homo sapiens
gcaaugggcuacuucaaau

SEQ ID NO: 838107 - RNA, 19 nt, Homo sapiens
gacgucagcuucuucauuu

SEQ ID NO: 838108 - RNA, 19 nt, Homo sapiens
caaacuggauuauaacuug

SEQ ID NO: 838109 - RNA, 19 nt, Homo sapiens
ggauggauauggugaguuu

SEQ ID NO: 838110 - RNA, 19 nt, Homo sapiens
gaggaaaucagaaagauaa

SEQ ID NO: 838111 - RNA, 19 nt, Homo sapiens
gaagauuucucagcucauu

SEQ ID NO: 838112 - RNA, 19 nt, Homo sapiens
caugagaaauguccaguuu

SEQ ID NO: 838113 - RNA, 19 nt, Homo sapiens
aaagaucgauugggaauuu

SEQ ID NO: 838114 - RNA, 19 nt, Homo sapiens
uaaaggaaguggaacaaga

SEQ ID NO: 838115 - RNA, 19 nt, Homo sapiens
gaaaggaacaagugucauu

SEQ ID NO: 838116 - RNA, 19 nt, Homo sapiens
ucagaaagccucaaugaaa

SEQ ID NO: 838117 - RNA, 19 nt, Homo sapiens
ggauauaacaguccacuuu

SEQ ID NO: 838118 - RNA, 19 nt, Homo sapiens
aaagauaacuggcgucugu

SEQ ID NO: 838119 - RNA, 19 nt, Homo sapiens
gaaauuaacagcaggaauc

SEQ ID NO: 838120 - RNA, 19 nt, Homo sapiens
gaacaaguggagaugauaa

SEQ ID NO: 838121 - RNA, 19 nt, Homo sapiens
gaacaaauaacauccuuca

SEQ ID NO: 838122 - RNA, 19 nt, Homo sapiens
gagaugagcgccauuauuc

SEQ ID NO: 838123 - RNA, 19 nt, Homo sapiens
gaucaucaauaacacagaa

SEQ ID NO: 838124 - RNA, 19 nt, Homo sapiens
ucagaaauguuaagaagga

SEQ ID NO: 838125 - RNA, 19 nt, Homo sapiens
agagagagcuuauuggaau

SEQ ID NO: 838126 - RNA, 19 nt, Homo sapiens
ggaguaggcacccauuuaa

SEQ ID NO: 838127 - RNA, 19 nt, Homo sapiens
gacauuaccuuucauaacu

SEQ ID NO: 838128 - RNA, 19 nt, Homo sapiens
gaagacauuaccuuucaua

SEQ ID NO: 838129 - RNA, 19 nt, Homo sapiens
gcagugaagcauaacuuua

SEQ ID NO: 838130 - RNA, 19 nt, Homo sapiens
uagaagcagugaagcauaa

SEQ ID NO: 838131 - RNA, 19 nt, Homo sapiens
gaugagaaaccuguuauaa

SEQ ID NO: 838132 - RNA, 19 nt, Homo sapiens
cagaagaacccauagauga

SEQ ID NO: 838133 - RNA, 19 nt, Homo sapiens
cagaaagccucaaugaaau

SEQ ID NO: 838134 - RNA, 19 nt, Homo sapiens
ugaaauauguaacccagaa

SEQ ID NO: 838135 - RNA, 19 nt, Homo sapiens
gaucaguuaccaucuauaa

SEQ ID NO: 838136 - RNA, 19 nt, Homo sapiens
uggcaaaucuucacugcua

SEQ ID NO: 838137 - RNA, 19 nt, Homo sapiens
gcuauuggcauuauacuuu

SEQ ID NO: 838138 - RNA, 19 nt, Homo sapiens
uaagaugcauggaacuaaa

SEQ ID NO: 838139 - RNA, 19 nt, Homo sapiens
ucaagcccauuuccucuua

SEQ ID NO: 838140 - RNA, 19 nt, Homo sapiens
ggaaggguagauaaauuua

SEQ ID NO: 838141 - RNA, 19 nt, Homo sapiens
ggaaacuccucccucauuc

SEQ ID NO: 838142 - RNA, 19 nt, Homo sapiens
gaaggaaacgucucaagug

SEQ ID NO: 838143 - RNA, 19 nt, Homo sapiens
gaagaagcagcaauaaaga

SEQ ID NO: 838144 - RNA, 19 nt, Homo sapiens
ucagugaucuggauaagug

SEQ ID NO: 838145 - RNA, 19 nt, Homo sapiens
gaacaggaaguaggaaauu

SEQ ID NO: 838146 - RNA, 19 nt, Homo sapiens
gaaaauagcagcaagaaau

SEQ ID NO: 838147 - RNA, 19 nt, Homo sapiens
uaacauccuucauuacuca

SEQ ID NO: 838148 - RNA, 19 nt, Homo sapiens
gaacaagagguacaacgaa

SEQ ID NO: 838149 - RNA, 19 nt, Homo sapiens
ggacuaaugcuaagguuau

SEQ ID NO: 838150 - RNA, 19 nt, Homo sapiens
uaugcuggcuucaucuuua

SEQ ID NO: 838151 - RNA, 19 nt, Homo sapiens
gaauacagccuuucucagu

SEQ ID NO: 838152 - RNA, 19 nt, Homo sapiens
acagaccuuucacaaauua

SEQ ID NO: 838153 - RNA, 19 nt, Homo sapiens
ccaagagauugcacuguuu

SEQ ID NO: 838154 - RNA, 19 nt, Homo sapiens
ggucuuggauaucaccuaa

SEQ ID NO: 838155 - RNA, 19 nt, Homo sapiens
ggaaguggaacaagaggua

SEQ ID NO: 838156 - RNA, 19 nt, Homo sapiens
gcgaauaggcuaaaugaau

SEQ ID NO: 838157 - RNA, 19 nt, Homo sapiens
ucugaccacuucaaucuua

SEQ ID NO: 838158 - RNA, 19 nt, Homo sapiens
gguauugguuccuucauau

SEQ ID NO: 838159 - RNA, 19 nt, Homo sapiens
ugagugugcuguuaaagaa

SEQ ID NO: 838160 - RNA, 19 nt, Homo sapiens
ggaaacgucucaagugacu

SEQ ID NO: 838161 - RNA, 19 nt, Homo sapiens
cagcaggaaucacgagaaa

SEQ ID NO: 838162 - RNA, 19 nt, Homo sapiens
ccacugcucugaccacuuc

SEQ ID NO: 838163 - RNA, 19 nt, Homo sapiens
gaacuaaaauguggaaaga

SEQ ID NO: 838164 - RNA, 19 nt, Homo sapiens
aaacagaaaugguacugau

SEQ ID NO: 838165 - RNA, 19 nt, Homo sapiens
aagauaaccuugcuaaaca

SEQ ID NO: 838166 - RNA, 19 nt, Homo sapiens
cauguacauugaccaaaua

SEQ ID NO: 838167 - RNA, 19 nt, Homo sapiens
aaacacacauggacgaaau

SEQ ID NO: 838168 - RNA, 19 nt, Homo sapiens
guacugauggccucucaua

SEQ ID NO: 838169 - RNA, 19 nt, Homo sapiens
gaacaagauuucgaacaag

SEQ ID NO: 838170 - RNA, 19 nt, Homo sapiens
gaaggacagucaacuaucg

SEQ ID NO: 838171 - RNA, 19 nt, Homo sapiens
cuuaagaaauggaggauga

SEQ ID NO: 838172 - RNA, 19 nt, Homo sapiens
ggacgucagcuucuucauu

SEQ ID NO: 838173 - RNA, 19 nt, Homo sapiens
uauguagcauuucuccuua

SEQ ID NO: 838174 - RNA, 19 nt, Homo sapiens
caugucaacucuaaaugaa

SEQ ID NO: 838175 - RNA, 19 nt, Homo sapiens
ggaggaaaucagaaagaua

SEQ ID NO: 838176 - RNA, 19 nt, Homo sapiens
ucaggagacucauauacaa

SEQ ID NO: 838177 - RNA, 19 nt, Homo sapiens
gggaaggguagauaaauuu

SEQ ID NO: 838178 - RNA, 19 nt, Homo sapiens
gaaaagagagagcuuauug

SEQ ID NO: 838179 - RNA, 19 nt, Homo sapiens
uggcaaggauuacauucua

SEQ ID NO: 838180 - RNA, 19 nt, Homo sapiens
ggagaugagcgccauuauu

SEQ ID NO: 838181 - RNA, 19 nt, Homo sapiens
gcuaugggaaucaucuuua

SEQ ID NO: 838182 - RNA, 19 nt, Homo sapiens
uagcaaaccugugauaaag

SEQ ID NO: 838183 - RNA, 19 nt, Homo sapiens
gaauguuccugugcagaaa

SEQ ID NO: 838184 - RNA, 19 nt, Homo sapiens
ucauauaccuugcuuggau

SEQ ID NO: 838185 - RNA, 19 nt, Homo sapiens
guuauugacccuauuauug

SEQ ID NO: 838186 - RNA, 19 nt, Homo sapiens
agagguacaacgaauauua

SEQ ID NO: 838187 - RNA, 19 nt, Homo sapiens
gagaaaccuguuauaauug

SEQ ID NO: 838188 - RNA, 19 nt, Homo sapiens
guagagaugcuaagccaaa

SEQ ID NO: 838189 - RNA, 19 nt, Homo sapiens
gauaagagacucagaaagc

SEQ ID NO: 838190 - RNA, 19 nt, Homo sapiens
uggaauggcuccucagaau

SEQ ID NO: 838191 - RNA, 19 nt, Homo sapiens
acuuuaaccuggaagaaua

SEQ ID NO: 838192 - RNA, 19 nt, Homo sapiens
ugacuuugguccacacuga

SEQ ID NO: 838193 - RNA, 19 nt, Homo sapiens
aaggaaacgucucaaguga

SEQ ID NO: 838194 - RNA, 19 nt, Homo sapiens
ggauuacauucuagagcua

SEQ ID NO: 838195 - RNA, 19 nt, Homo sapiens
ucucuugucuucuucauau

SEQ ID NO: 838196 - RNA, 19 nt, Homo sapiens
gauggccucucauacaaug

SEQ ID NO: 838197 - RNA, 19 nt, Homo sapiens
uaaaaucacugaagcauca

SEQ ID NO: 838198 - RNA, 19 nt, Homo sapiens
ccacuggaaaggacaaaua

SEQ ID NO: 838199 - RNA, 19 nt, Homo sapiens
gaaaagugaucauguccaa

SEQ ID NO: 838200 - RNA, 19 nt, Homo sapiens
ggucucaucuacuugcuau

SEQ ID NO: 838201 - RNA, 19 nt, Homo sapiens
aagcuguccucaccaauuu

SEQ ID NO: 838202 - RNA, 19 nt, Homo sapiens
ggugauagcaaaccuguga

SEQ ID NO: 838203 - RNA, 19 nt, Homo sapiens
ucaagaaggugaaauuuug

SEQ ID NO: 838204 - RNA, 19 nt, Homo sapiens
gaacagagcuuacuuauuc

SEQ ID NO: 838205 - RNA, 19 nt, Homo sapiens
gaaaugagcccuuguucua

SEQ ID NO: 838206 - RNA, 19 nt, Homo sapiens
aaacagugcuucugaauuu

SEQ ID NO: 838207 - RNA, 19 nt, Homo sapiens
gaucaaagcuuauacucaa

SEQ ID NO: 838208 - RNA, 19 nt, Homo sapiens
gcaaagggcacauuuaauu

SEQ ID NO: 838209 - RNA, 19 nt, Homo sapiens
gcauguacauagacaaaua

SEQ ID NO: 838210 - RNA, 19 nt, Homo sapiens
ggagagaucuuaggacuau

SEQ ID NO: 838211 - RNA, 19 nt, Homo sapiens
caacagauguauacaauag

SEQ ID NO: 838212 - RNA, 19 nt, Homo sapiens
gggagaaacugcuguugua

SEQ ID NO: 838213 - RNA, 19 nt, Homo sapiens
gaaacuaccugcaggaauc

SEQ ID NO: 838214 - RNA, 19 nt, Homo sapiens
ggaggcagaucaauaagaa

SEQ ID NO: 838215 - RNA, 19 nt, Homo sapiens
ccagagagcuaguguuuau

SEQ ID NO: 838216 - RNA, 19 nt, Homo sapiens
guaauagucugauucuuug

SEQ ID NO: 838217 - RNA, 19 nt, Homo sapiens
gaggagaaaccauccauua

SEQ ID NO: 838218 - RNA, 19 nt, Homo sapiens
ugucaaagcugaaagacua

SEQ ID NO: 838219 - RNA, 19 nt, Homo sapiens
acaagaagauagaguagua

SEQ ID NO: 838220 - RNA, 19 nt, Homo sapiens
ggaugaagcugacauucuu

SEQ ID NO: 838221 - RNA, 19 nt, Homo sapiens
ggaaggagcuggagucaac

SEQ ID NO: 838222 - RNA, 19 nt, Homo sapiens
ucaaggacauggacaaauu

SEQ ID NO: 838223 - RNA, 19 nt, Homo sapiens
caaaguagcagcauuguga

SEQ ID NO: 838224 - RNA, 19 nt, Homo sapiens
ucagaagacuguaaagaaa

SEQ ID NO: 838225 - RNA, 19 nt, Homo sapiens
cauagaugcugccauuaua

SEQ ID NO: 838226 - RNA, 19 nt, Homo sapiens
gagacaaaccacauaaaua

SEQ ID NO: 838227 - RNA, 19 nt, Homo sapiens
ccaagcagauuauagugua

SEQ ID NO: 838228 - RNA, 19 nt, Homo sapiens
ggaaagaguacauugauga

SEQ ID NO: 838229 - RNA, 19 nt, Homo sapiens
gaaaguaaaucagugagau

SEQ ID NO: 838230 - RNA, 19 nt, Homo sapiens
gaauuuggcuuacggagau

SEQ ID NO: 838231 - RNA, 19 nt, Homo sapiens
ucacaugccuuguuuacuu

SEQ ID NO: 838232 - RNA, 19 nt, Homo sapiens
gaagucauaagucgaauaa

SEQ ID NO: 838233 - RNA, 19 nt, Homo sapiens
caaacuuguuccagacuua

SEQ ID NO: 838234 - RNA, 19 nt, Homo sapiens
acacagagucucagaaaua

SEQ ID NO: 838235 - RNA, 19 nt, Homo sapiens
aaagaaagcugucauuagg

SEQ ID NO: 838236 - RNA, 19 nt, Homo sapiens
ggacugaaacagcugcuua

SEQ ID NO: 838237 - RNA, 19 nt, Homo sapiens
gaacgaacacaagaagaua

SEQ ID NO: 838238 - RNA, 19 nt, Homo sapiens
gaagaagugccuaauauag

SEQ ID NO: 838239 - RNA, 19 nt, Homo sapiens
gguaggagguagagaagaa

SEQ ID NO: 838240 - RNA, 19 nt, Homo sapiens
ggaggaagauaauaguugu

SEQ ID NO: 838241 - RNA, 19 nt, Homo sapiens
gaauauagcuuuucucaag

SEQ ID NO: 838242 - RNA, 19 nt, Homo sapiens
ggaagaagcuaaacaugcu

SEQ ID NO: 838243 - RNA, 19 nt, Homo sapiens
aaacaagucugcuucuuca

SEQ ID NO: 838244 - RNA, 19 nt, Homo sapiens
ggacacagagucucagaaa

SEQ ID NO: 838245 - RNA, 19 nt, Homo sapiens
ugcgacagcuucuuuguua

SEQ ID NO: 838246 - RNA, 19 nt, Homo sapiens
gaaagugucuacugaucau

SEQ ID NO: 838247 - RNA, 19 nt, Homo sapiens
ugaaacagcugcuuauuuu

SEQ ID NO: 838248 - RNA, 19 nt, Homo sapiens
gcaauucgaacugcauuua

SEQ ID NO: 838249 - RNA, 19 nt, Homo sapiens
gcuagaaguugaagcagaa

SEQ ID NO: 838250 - RNA, 19 nt, Homo sapiens
cagaagacauacagaaaga

SEQ ID NO: 838251 - RNA, 19 nt, Homo sapiens
cguaaaagcugaaguguaa

SEQ ID NO: 838252 - RNA, 19 nt, Homo sapiens
gaagcugcauguuuguauu

SEQ ID NO: 838253 - RNA, 19 nt, Homo sapiens
ggagaaaccauccauuaug

SEQ ID NO: 838254 - RNA, 19 nt, Homo sapiens
uaggaaagcugugauauca

SEQ ID NO: 838255 - RNA, 19 nt, Homo sapiens
gcacuaggaaaucucaaua

SEQ ID NO: 838256 - RNA, 19 nt, Homo sapiens
gaaauguguugguucuuca

SEQ ID NO: 838257 - RNA, 19 nt, Homo sapiens
gaaauuauugagccaguuu

SEQ ID NO: 838258 - RNA, 19 nt, Homo sapiens
gaaugacaguuaucuaugg

SEQ ID NO: 838259 - RNA, 19 nt, Homo sapiens
ggcauuucauuauggauua

SEQ ID NO: 838260 - RNA, 19 nt, Homo sapiens
ucagugaucuuauuagcuu

SEQ ID NO: 838261 - RNA, 19 nt, Homo sapiens
ggaaacaacagauguauac

SEQ ID NO: 838262 - RNA, 19 nt, Homo sapiens
gauaccagccaacaauaua

SEQ ID NO: 838263 - RNA, 19 nt, Homo sapiens
caaagggcacauuuaauuu

SEQ ID NO: 838264 - RNA, 19 nt, Homo sapiens
gauacacaauugcaacuau

SEQ ID NO: 838265 - RNA, 19 nt, Homo sapiens
guguauagcuugccuuuca

SEQ ID NO: 838266 - RNA, 19 nt, Homo sapiens
ggucaugcauuuagaagau

SEQ ID NO: 838267 - RNA, 19 nt, Homo sapiens
uuucuuaugucccuucuua

SEQ ID NO: 838268 - RNA, 19 nt, Homo sapiens
gauauacuccagugacuaa

SEQ ID NO: 838269 - RNA, 19 nt, Homo sapiens
gaaacagugcuucugaauu

SEQ ID NO: 838270 - RNA, 19 nt, Homo sapiens
gaagauaauaguuguggaa

SEQ ID NO: 838271 - RNA, 19 nt, Homo sapiens
cacaugcacuugauuuaaa

SEQ ID NO: 838272 - RNA, 19 nt, Homo sapiens
caagugacaugaaagaagu

SEQ ID NO: 838273 - RNA, 19 nt, Homo sapiens
ggcaaaagcacaauuauua

SEQ ID NO: 838274 - RNA, 19 nt, Homo sapiens
caacuauucuucauuaugc

SEQ ID NO: 838275 - RNA, 19 nt, Homo sapiens
gaaauuaugaggaguuauc

SEQ ID NO: 838276 - RNA, 19 nt, Homo sapiens
agaaacugcuguuguagaa

SEQ ID NO: 838277 - RNA, 19 nt, Homo sapiens
ggaugaagaugaagauguc

SEQ ID NO: 838278 - RNA, 19 nt, Homo sapiens
caaugaggaugaagaugaa

SEQ ID NO: 838279 - RNA, 19 nt, Homo sapiens
uagguugccugauuucuuu

SEQ ID NO: 838280 - RNA, 19 nt, Homo sapiens
gcucacacuuaauaguaua

SEQ ID NO: 838281 - RNA, 19 nt, Homo sapiens
gcccauauccucuaauuau

SEQ ID NO: 838282 - RNA, 19 nt, Homo sapiens
ggaaaguuauauccacuag

SEQ ID NO: 838283 - RNA, 19 nt, Homo sapiens
guacaacaucuaaagagua

SEQ ID NO: 838284 - RNA, 19 nt, Homo sapiens
caguuauucuguucacuua

SEQ ID NO: 838285 - RNA, 19 nt, Homo sapiens
ggagacaaaccacauaaau

SEQ ID NO: 838286 - RNA, 19 nt, Homo sapiens
caaagauacugcugcuaga

SEQ ID NO: 838287 - RNA, 19 nt, Homo sapiens
gaugaaauguuugaagcaa

SEQ ID NO: 838288 - RNA, 19 nt, Homo sapiens
ggagucaacuaaagcuguu

SEQ ID NO: 838289 - RNA, 19 nt, Homo sapiens
agaagugccuaauauagaa

SEQ ID NO: 838290 - RNA, 19 nt, Homo sapiens
gcccauuccucaauucaaa

SEQ ID NO: 838291 - RNA, 19 nt, Homo sapiens
cguaauagucugauucuuu

SEQ ID NO: 838292 - RNA, 19 nt, Homo sapiens
uaagugaagcugcauguuu

SEQ ID NO: 838293 - RNA, 19 nt, Homo sapiens
gaauaacacaugcacuuga

SEQ ID NO: 838294 - RNA, 19 nt, Homo sapiens
uuacugcaaugccaccuua

SEQ ID NO: 838295 - RNA, 19 nt, Homo sapiens
aggaagaaauggauucaaa

SEQ ID NO: 838296 - RNA, 19 nt, Homo sapiens
gaaauugaccaagcagauu

SEQ ID NO: 838297 - RNA, 19 nt, Homo sapiens
gaaagaguacauugaugaa

SEQ ID NO: 838298 - RNA, 19 nt, Homo sapiens
uaauugaaaugcugugguu

SEQ ID NO: 838299 - RNA, 19 nt, Homo sapiens
uaacacaugcacuugauuu

SEQ ID NO: 838300 - RNA, 19 nt, Homo sapiens
cuaaauacaucucuuucug

SEQ ID NO: 838301 - RNA, 19 nt, Homo sapiens
caacaguacuaugguuuau

SEQ ID NO: 838302 - RNA, 19 nt, Homo sapiens
uaaugacagugacuaugua

SEQ ID NO: 838303 - RNA, 19 nt, Homo sapiens
agaaagcugucauuaggaa

SEQ ID NO: 838304 - RNA, 19 nt, Homo sapiens
gaacagagcuuacuuauuc

SEQ ID NO: 838305 - RNA, 19 nt, Homo sapiens
gaaaugagcccuuguucua

SEQ ID NO: 838306 - RNA, 19 nt, Homo sapiens
aaacagugcuucugaauuu

SEQ ID NO: 838307 - RNA, 19 nt, Homo sapiens
gaucaaagcuuauacucaa

SEQ ID NO: 838308 - RNA, 19 nt, Homo sapiens
gcaaagggcacauuuaauu

SEQ ID NO: 838309 - RNA, 19 nt, Homo sapiens
gcauguacauagacaaaua

SEQ ID NO: 838310 - RNA, 19 nt, Homo sapiens
ggagagaucuuaggacuau

SEQ ID NO: 838311 - RNA, 19 nt, Homo sapiens
caacagauguauacaauag

SEQ ID NO: 838312 - RNA, 19 nt, Homo sapiens
gggagaaacugcuguugua

SEQ ID NO: 838313 - RNA, 19 nt, Homo sapiens
gaaacuaccugcaggaauc

SEQ ID NO: 838314 - RNA, 19 nt, Homo sapiens
ggaggcagaucaauaagaa

SEQ ID NO: 838315 - RNA, 19 nt, Homo sapiens
guaauagucugauucuuug

SEQ ID NO: 838316 - RNA, 19 nt, Homo sapiens
gaggagaaaccauccauua

SEQ ID NO: 838317 - RNA, 19 nt, Homo sapiens
ugucaaagcugaaagacua

SEQ ID NO: 838318 - RNA, 19 nt, Homo sapiens
acaagaagauagaguagua

SEQ ID NO: 838319 - RNA, 19 nt, Homo sapiens
ggaugaagcugacauucuu

SEQ ID NO: 838320 - RNA, 19 nt, Homo sapiens
ggaaggagcuggagucaac

SEQ ID NO: 838321 - RNA, 19 nt, Homo sapiens
ucaaggacauggacaaauu

SEQ ID NO: 838322 - RNA, 19 nt, Homo sapiens
caaaguagcagcauuguga

SEQ ID NO: 838323 - RNA, 19 nt, Homo sapiens
ucagaagacuguaaagaaa

SEQ ID NO: 838324 - RNA, 19 nt, Homo sapiens
cauagaugcugccauuaua

SEQ ID NO: 838325 - RNA, 19 nt, Homo sapiens
gagacaaaccacauaaaua

SEQ ID NO: 838326 - RNA, 19 nt, Homo sapiens
ccaagcagauuauagugua

SEQ ID NO: 838327 - RNA, 19 nt, Homo sapiens
ggaaagaguacauugauga

SEQ ID NO: 838328 - RNA, 19 nt, Homo sapiens
gaaaguaaaucagugagau

SEQ ID NO: 838329 - RNA, 19 nt, Homo sapiens
gaauuuggcuuacggagau

SEQ ID NO: 838330 - RNA, 19 nt, Homo sapiens
gaagucauaagucgaauaa

SEQ ID NO: 838331 - RNA, 19 nt, Homo sapiens
caaacuuguuccagacuua

SEQ ID NO: 838332 - RNA, 19 nt, Homo sapiens
acacagagucucagaaaua

SEQ ID NO: 838333 - RNA, 19 nt, Homo sapiens
aaagaaagcugucauuagg

SEQ ID NO: 838334 - RNA, 19 nt, Homo sapiens
gaacgaacacaagaagaua

SEQ ID NO: 838335 - RNA, 19 nt, Homo sapiens
gaagaagugccuaauauag

SEQ ID NO: 838336 - RNA, 19 nt, Homo sapiens
ggaggaagauaauaguugu

SEQ ID NO: 838337 - RNA, 19 nt, Homo sapiens
gaauauagcuuuucucaag

SEQ ID NO: 838338 - RNA, 19 nt, Homo sapiens
ggaagaagcuaaacaugcu

SEQ ID NO: 838339 - RNA, 19 nt, Homo sapiens
aaacaagucugcuucuuca

SEQ ID NO: 838340 - RNA, 19 nt, Homo sapiens
ggacacagagucucagaaa

SEQ ID NO: 838341 - RNA, 19 nt, Homo sapiens
ugcgacagcuucuuuguua

SEQ ID NO: 838342 - RNA, 19 nt, Homo sapiens
gaaagugucuacugaucau

SEQ ID NO: 838343 - RNA, 19 nt, Homo sapiens
gcaauucgaacugcauuua

SEQ ID NO: 838344 - RNA, 19 nt, Homo sapiens
gcuagaaguugaagcagaa

SEQ ID NO: 838345 - RNA, 19 nt, Homo sapiens
cagaagacauacagaaaga

SEQ ID NO: 838346 - RNA, 19 nt, Homo sapiens
cguaaaagcugaaguguaa

SEQ ID NO: 838347 - RNA, 19 nt, Homo sapiens
gaagcugcauguuuguauu

SEQ ID NO: 838348 - RNA, 19 nt, Homo sapiens
ggagaaaccauccauuaug

SEQ ID NO: 838349 - RNA, 19 nt, Homo sapiens
uaggaaagcugugauauca

SEQ ID NO: 838350 - RNA, 19 nt, Homo sapiens
gcacuaggaaaucucaaua

SEQ ID NO: 838351 - RNA, 19 nt, Homo sapiens
gaaauguguugguucuuca

SEQ ID NO: 838352 - RNA, 19 nt, Homo sapiens
gaaauuauugagccaguuu

SEQ ID NO: 838353 - RNA, 19 nt, Homo sapiens
gaaugacaguuaucuaugg

SEQ ID NO: 838354 - RNA, 19 nt, Homo sapiens
ggcauuucauuauggauua

SEQ ID NO: 838355 - RNA, 19 nt, Homo sapiens
ucagugaucuuauuagcuu

SEQ ID NO: 838356 - RNA, 19 nt, Homo sapiens
ggaaacaacagauguauac

SEQ ID NO: 838357 - RNA, 19 nt, Homo sapiens
gauaccagccaacaauaua

SEQ ID NO: 838358 - RNA, 19 nt, Homo sapiens
caaagggcacauuuaauuu

SEQ ID NO: 838359 - RNA, 19 nt, Homo sapiens
gauacacaauugcaacuau

SEQ ID NO: 838360 - RNA, 19 nt, Homo sapiens
guguauagcuugccuuuca

SEQ ID NO: 838361 - RNA, 19 nt, Homo sapiens
ggucaugcauuuagaagau

SEQ ID NO: 838362 - RNA, 19 nt, Homo sapiens
uuucuuaugucccuucuua

SEQ ID NO: 838363 - RNA, 19 nt, Homo sapiens
gauauacuccagugacuaa

SEQ ID NO: 838364 - RNA, 19 nt, Homo sapiens
gaaacagugcuucugaauu

SEQ ID NO: 838365 - RNA, 19 nt, Homo sapiens
gaagauaauaguuguggaa

SEQ ID NO: 838366 - RNA, 19 nt, Homo sapiens
cacaugcacuugauuuaaa

SEQ ID NO: 838367 - RNA, 19 nt, Homo sapiens
caagugacaugaaagaagu

SEQ ID NO: 838368 - RNA, 19 nt, Homo sapiens
ggcaaaagcacaauuauua

SEQ ID NO: 838369 - RNA, 19 nt, Homo sapiens
caacuauucuucauuaugc

SEQ ID NO: 838370 - RNA, 19 nt, Homo sapiens
gaaauuaugaggaguuauc

SEQ ID NO: 838371 - RNA, 19 nt, Homo sapiens
agaaacugcuguuguagaa

SEQ ID NO: 838372 - RNA, 19 nt, Homo sapiens
ggaugaagaugaagauguc

SEQ ID NO: 838373 - RNA, 19 nt, Homo sapiens
caaugaggaugaagaugaa

SEQ ID NO: 838374 - RNA, 19 nt, Homo sapiens
uagguugccugauuucuuu

SEQ ID NO: 838375 - RNA, 19 nt, Homo sapiens
gcucacacuuaauaguaua

SEQ ID NO: 838376 - RNA, 19 nt, Homo sapiens
gcccauauccucuaauuau

SEQ ID NO: 838377 - RNA, 19 nt, Homo sapiens
agaagugccuaauauagaa

SEQ ID NO: 838378 - RNA, 19 nt, Homo sapiens
ggaaaguuauauccacuag

SEQ ID NO: 838379 - RNA, 19 nt, Homo sapiens
guacaacaucuaaagagua

SEQ ID NO: 838380 - RNA, 19 nt, Homo sapiens
caguuauucuguucacuua
